United States Patent 8,822,426 (PREVENTION AND TREATMENT OF NOSEMA DISEASE IN BEES) - sequence listing, part 3

SEQ ID NO: 64413 - DNA, 27 bp, Artificial sequence
  SiRNA target sequence
ttataggaaaaaatggaacaggtaaaa

SEQ ID NO: 64414 - DNA, 27 bp, Artificial sequence
  SiRNA target sequence
tataggaaaaaatggaacaggtaaaag

SEQ ID NO: 64415 - DNA, 27 bp, Artificial sequence
  SiRNA target sequence
ataggaaaaaatggaacaggtaaaagt

SEQ ID NO: 64416 - DNA, 27 bp, Artificial sequence
  SiRNA target sequence
taggaaaaaatggaacaggtaaaagta

SEQ ID NO: 64417 - DNA, 27 bp, Artificial sequence
  SiRNA target sequence
aggaaaaaatggaacaggtaaaagtac

SEQ ID NO: 64418 - DNA, 27 bp, Artificial sequence
  SiRNA target sequence
ggaaaaaatggaacaggtaaaagtaca

SEQ ID NO: 64419 - DNA, 27 bp, Artificial sequence
  SiRNA target sequence
gaaaaaatggaacaggtaaaagtacaa

SEQ ID NO: 64420 - DNA, 27 bp, Artificial sequence
  SiRNA target sequence
aaaaaatggaacaggtaaaagtacaat

SEQ ID NO: 64421 - DNA, 27 bp, Artificial sequence
  SiRNA target sequence
aaaaatggaacaggtaaaagtacaata

SEQ ID NO: 64422 - DNA, 27 bp, Artificial sequence
  SiRNA target sequence
aaaatggaacaggtaaaagtacaataa

SEQ ID NO: 64423 - DNA, 27 bp, Artificial sequence
  SiRNA target sequence
aaatggaacaggtaaaagtacaataat

SEQ ID NO: 64424 - DNA, 27 bp, Artificial sequence
  SiRNA target sequence
aatggaacaggtaaaagtacaataata

SEQ ID NO: 64425 - DNA, 27 bp, Artificial sequence
  SiRNA target sequence
atggaacaggtaaaagtacaataataa

SEQ ID NO: 64426 - DNA, 27 bp, Artificial sequence
  SiRNA target sequence
tggaacaggtaaaagtacaataataaa

SEQ ID NO: 64427 - DNA, 27 bp, Artificial sequence
  SiRNA target sequence
ggaacaggtaaaagtacaataataaaa

SEQ ID NO: 64428 - DNA, 27 bp, Artificial sequence
  SiRNA target sequence
gaacaggtaaaagtacaataataaaat

SEQ ID NO: 64429 - DNA, 27 bp, Artificial sequence
  SiRNA target sequence
aacaggtaaaagtacaataataaaatt

SEQ ID NO: 64430 - DNA, 27 bp, Artificial sequence
  SiRNA target sequence
acaggtaaaagtacaataataaaattg

SEQ ID NO: 64431 - DNA, 27 bp, Artificial sequence
  SiRNA target sequence
caggtaaaagtacaataataaaattgt

SEQ ID NO: 64432 - DNA, 27 bp, Artificial sequence
  SiRNA target sequence
aggtaaaagtacaataataaaattgtt

SEQ ID NO: 64433 - DNA, 27 bp, Artificial sequence
  SiRNA target sequence
ggtaaaagtacaataataaaattgtta

SEQ ID NO: 64434 - DNA, 27 bp, Artificial sequence
  SiRNA target sequence
gtaaaagtacaataataaaattgttaa

SEQ ID NO: 64435 - DNA, 27 bp, Artificial sequence
  SiRNA target sequence
taaaagtacaataataaaattgttaat

SEQ ID NO: 64436 - DNA, 27 bp, Artificial sequence
  SiRNA target sequence
aaaagtacaataataaaattgttaatg

SEQ ID NO: 64437 - DNA, 27 bp, Artificial sequence
  SiRNA target sequence
aaagtacaataataaaattgttaatga

SEQ ID NO: 64438 - DNA, 27 bp, Artificial sequence
  SiRNA target sequence
aagtacaataataaaattgttaatgaa

SEQ ID NO: 64439 - DNA, 27 bp, Artificial sequence
  SiRNA target sequence
agtacaataataaaattgttaatgaaa

SEQ ID NO: 64440 - DNA, 27 bp, Artificial sequence
  SiRNA target sequence
gtacaataataaaattgttaatgaaat

SEQ ID NO: 64441 - DNA, 27 bp, Artificial sequence
  SiRNA target sequence
tacaataataaaattgttaatgaaatt

SEQ ID NO: 64442 - DNA, 27 bp, Artificial sequence
  SiRNA target sequence
acaataataaaattgttaatgaaattt

SEQ ID NO: 64443 - DNA, 27 bp, Artificial sequence
  SiRNA target sequence
caataataaaattgttaatgaaatttt

SEQ ID NO: 64444 - DNA, 27 bp, Artificial sequence
  SiRNA target sequence
aataataaaattgttaatgaaatttta

SEQ ID NO: 64445 - DNA, 27 bp, Artificial sequence
  SiRNA target sequence
ataataaaattgttaatgaaattttat

SEQ ID NO: 64446 - DNA, 27 bp, Artificial sequence
  SiRNA target sequence
taataaaattgttaatgaaattttata

SEQ ID NO: 64447 - DNA, 27 bp, Artificial sequence
  SiRNA target sequence
aataaaattgttaatgaaattttataa

SEQ ID NO: 64448 - DNA, 27 bp, Artificial sequence
  SiRNA target sequence
ataaaattgttaatgaaattttataaa

SEQ ID NO: 64449 - DNA, 27 bp, Artificial sequence
  SiRNA target sequence
taaaattgttaatgaaattttataaat

SEQ ID NO: 64450 - DNA, 27 bp, Artificial sequence
  SiRNA target sequence
aaaattgttaatgaaattttataaata

SEQ ID NO: 64451 - DNA, 27 bp, Artificial sequence
  SiRNA target sequence
aaattgttaatgaaattttataaatat

SEQ ID NO: 64452 - DNA, 27 bp, Artificial sequence
  SiRNA target sequence
aattgttaatgaaattttataaatatg

SEQ ID NO: 64453 - DNA, 27 bp, Artificial sequence
  SiRNA target sequence
attgttaatgaaattttataaatatga

SEQ ID NO: 64454 - DNA, 27 bp, Artificial sequence
  SiRNA target sequence
ttgttaatgaaattttataaatatgat

SEQ ID NO: 64455 - DNA, 27 bp, Artificial sequence
  SiRNA target sequence
tgttaatgaaattttataaatatgatg

SEQ ID NO: 64456 - DNA, 27 bp, Artificial sequence
  SiRNA target sequence
gttaatgaaattttataaatatgatgg

SEQ ID NO: 64457 - DNA, 27 bp, Artificial sequence
  SiRNA target sequence
ttaatgaaattttataaatatgatgga

SEQ ID NO: 64458 - DNA, 27 bp, Artificial sequence
  SiRNA target sequence
taatgaaattttataaatatgatggag

SEQ ID NO: 64459 - DNA, 27 bp, Artificial sequence
  SiRNA target sequence
aatgaaattttataaatatgatggaga

SEQ ID NO: 64460 - DNA, 27 bp, Artificial sequence
  SiRNA target sequence
atgaaattttataaatatgatggagat

SEQ ID NO: 64461 - DNA, 27 bp, Artificial sequence
  SiRNA target sequence
tgaaattttataaatatgatggagata

SEQ ID NO: 64462 - DNA, 27 bp, Artificial sequence
  SiRNA target sequence
gaaattttataaatatgatggagatat

SEQ ID NO: 64463 - DNA, 27 bp, Artificial sequence
  SiRNA target sequence
aaattttataaatatgatggagatata

SEQ ID NO: 64464 - DNA, 27 bp, Artificial sequence
  SiRNA target sequence
aattttataaatatgatggagatatat

SEQ ID NO: 64465 - DNA, 27 bp, Artificial sequence
  SiRNA target sequence
attttataaatatgatggagatatatt

SEQ ID NO: 64466 - DNA, 27 bp, Artificial sequence
  SiRNA target sequence
ttttataaatatgatggagatatatta

SEQ ID NO: 64467 - DNA, 27 bp, Artificial sequence
  SiRNA target sequence
tttataaatatgatggagatatattaa

SEQ ID NO: 64468 - DNA, 27 bp, Artificial sequence
  SiRNA target sequence
ttataaatatgatggagatatattaat

SEQ ID NO: 64469 - DNA, 27 bp, Artificial sequence
  SiRNA target sequence
tataaatatgatggagatatattaatt

SEQ ID NO: 64470 - DNA, 27 bp, Artificial sequence
  SiRNA target sequence
ataaatatgatggagatatattaattg

SEQ ID NO: 64471 - DNA, 27 bp, Artificial sequence
  SiRNA target sequence
taaatatgatggagatatattaattga

SEQ ID NO: 64472 - DNA, 27 bp, Artificial sequence
  SiRNA target sequence
aaatatgatggagatatattaattgat

SEQ ID NO: 64473 - DNA, 27 bp, Artificial sequence
  SiRNA target sequence
aatatgatggagatatattaattgatg

SEQ ID NO: 64474 - DNA, 27 bp, Artificial sequence
  SiRNA target sequence
atatgatggagatatattaattgatga

SEQ ID NO: 64475 - DNA, 27 bp, Artificial sequence
  SiRNA target sequence
tatgatggagatatattaattgatgat

SEQ ID NO: 64476 - DNA, 27 bp, Artificial sequence
  SiRNA target sequence
atgatggagatatattaattgatgata

SEQ ID NO: 64477 - DNA, 27 bp, Artificial sequence
  SiRNA target sequence
tgatggagatatattaattgatgatac

SEQ ID NO: 64478 - DNA, 27 bp, Artificial sequence
  SiRNA target sequence
gatggagatatattaattgatgataca

SEQ ID NO: 64479 - DNA, 27 bp, Artificial sequence
  SiRNA target sequence
atggagatatattaattgatgatacag

SEQ ID NO: 64480 - DNA, 27 bp, Artificial sequence
  SiRNA target sequence
tggagatatattaattgatgatacaga

SEQ ID NO: 64481 - DNA, 27 bp, Artificial sequence
  SiRNA target sequence
ggagatatattaattgatgatacagaa

SEQ ID NO: 64482 - DNA, 27 bp, Artificial sequence
  SiRNA target sequence
gagatatattaattgatgatacagaaa

SEQ ID NO: 64483 - DNA, 27 bp, Artificial sequence
  SiRNA target sequence
agatatattaattgatgatacagaaat

SEQ ID NO: 64484 - DNA, 27 bp, Artificial sequence
  SiRNA target sequence
gatatattaattgatgatacagaaata

SEQ ID NO: 64485 - DNA, 27 bp, Artificial sequence
  SiRNA target sequence
atatattaattgatgatacagaaatag

SEQ ID NO: 64486 - DNA, 27 bp, Artificial sequence
  SiRNA target sequence
tatattaattgatgatacagaaataga

SEQ ID NO: 64487 - DNA, 27 bp, Artificial sequence
  SiRNA target sequence
atattaattgatgatacagaaatagat

SEQ ID NO: 64488 - DNA, 27 bp, Artificial sequence
  SiRNA target sequence
tattaattgatgatacagaaatagata

SEQ ID NO: 64489 - DNA, 27 bp, Artificial sequence
  SiRNA target sequence
attaattgatgatacagaaatagataa

SEQ ID NO: 64490 - DNA, 27 bp, Artificial sequence
  SiRNA target sequence
ttaattgatgatacagaaatagataat

SEQ ID NO: 64491 - DNA, 27 bp, Artificial sequence
  SiRNA target sequence
taattgatgatacagaaatagataata

SEQ ID NO: 64492 - DNA, 27 bp, Artificial sequence
  SiRNA target sequence
aattgatgatacagaaatagataatat

SEQ ID NO: 64493 - DNA, 27 bp, Artificial sequence
  SiRNA target sequence
attgatgatacagaaatagataatatt

SEQ ID NO: 64494 - DNA, 27 bp, Artificial sequence
  SiRNA target sequence
ttgatgatacagaaatagataatattt

SEQ ID NO: 64495 - DNA, 27 bp, Artificial sequence
  SiRNA target sequence
tgatgatacagaaatagataatatttc

SEQ ID NO: 64496 - DNA, 27 bp, Artificial sequence
  SiRNA target sequence
gatgatacagaaatagataatatttcg

SEQ ID NO: 64497 - DNA, 27 bp, Artificial sequence
  SiRNA target sequence
atgatacagaaatagataatatttcgg

SEQ ID NO: 64498 - DNA, 27 bp, Artificial sequence
  SiRNA target sequence
tgatacagaaatagataatatttcgga

SEQ ID NO: 64499 - DNA, 27 bp, Artificial sequence
  SiRNA target sequence
gatacagaaatagataatatttcggat

SEQ ID NO: 64500 - DNA, 27 bp, Artificial sequence
  SiRNA target sequence
atacagaaatagataatatttcggata

SEQ ID NO: 64501 - DNA, 27 bp, Artificial sequence
  SiRNA target sequence
tacagaaatagataatatttcggatag

SEQ ID NO: 64502 - DNA, 27 bp, Artificial sequence
  SiRNA target sequence
acagaaatagataatatttcggataga

SEQ ID NO: 64503 - DNA, 27 bp, Artificial sequence
  SiRNA target sequence
cagaaatagataatatttcggatagaa

SEQ ID NO: 64504 - DNA, 27 bp, Artificial sequence
  SiRNA target sequence
agaaatagataatatttcggatagaag

SEQ ID NO: 64505 - DNA, 27 bp, Artificial sequence
  SiRNA target sequence
gaaatagataatatttcggatagaagt

SEQ ID NO: 64506 - DNA, 27 bp, Artificial sequence
  SiRNA target sequence
aaatagataatatttcggatagaagtt

SEQ ID NO: 64507 - DNA, 27 bp, Artificial sequence
  SiRNA target sequence
aatagataatatttcggatagaagtta

SEQ ID NO: 64508 - DNA, 27 bp, Artificial sequence
  SiRNA target sequence
atagataatatttcggatagaagttac

SEQ ID NO: 64509 - DNA, 27 bp, Artificial sequence
  SiRNA target sequence
tagataatatttcggatagaagttaca

SEQ ID NO: 64510 - DNA, 27 bp, Artificial sequence
  SiRNA target sequence
agataatatttcggatagaagttacag

SEQ ID NO: 64511 - DNA, 27 bp, Artificial sequence
  SiRNA target sequence
gataatatttcggatagaagttacaga

SEQ ID NO: 64512 - DNA, 27 bp, Artificial sequence
  SiRNA target sequence
ataatatttcggatagaagttacagaa

SEQ ID NO: 64513 - DNA, 27 bp, Artificial sequence
  SiRNA target sequence
taatatttcggatagaagttacagaag

SEQ ID NO: 64514 - DNA, 27 bp, Artificial sequence
  SiRNA target sequence
aatatttcggatagaagttacagaagt

SEQ ID NO: 64515 - DNA, 27 bp, Artificial sequence
  SiRNA target sequence
atatttcggatagaagttacagaagtt

SEQ ID NO: 64516 - DNA, 27 bp, Artificial sequence
  SiRNA target sequence
tatttcggatagaagttacagaagttt

SEQ ID NO: 64517 - DNA, 27 bp, Artificial sequence
  SiRNA target sequence
atttcggatagaagttacagaagttta

SEQ ID NO: 64518 - DNA, 27 bp, Artificial sequence
  SiRNA target sequence
tttcggatagaagttacagaagtttaa

SEQ ID NO: 64519 - DNA, 27 bp, Artificial sequence
  SiRNA target sequence
ttcggatagaagttacagaagtttaat

SEQ ID NO: 64520 - DNA, 27 bp, Artificial sequence
  SiRNA target sequence
tcggatagaagttacagaagtttaata

SEQ ID NO: 64521 - DNA, 27 bp, Artificial sequence
  SiRNA target sequence
cggatagaagttacagaagtttaatat

SEQ ID NO: 64522 - DNA, 27 bp, Artificial sequence
  SiRNA target sequence
ggatagaagttacagaagtttaatatc

SEQ ID NO: 64523 - DNA, 27 bp, Artificial sequence
  SiRNA target sequence
gatagaagttacagaagtttaatatca

SEQ ID NO: 64524 - DNA, 27 bp, Artificial sequence
  SiRNA target sequence
atagaagttacagaagtttaatatcat

SEQ ID NO: 64525 - DNA, 27 bp, Artificial sequence
  SiRNA target sequence
tagaagttacagaagtttaatatcata

SEQ ID NO: 64526 - DNA, 27 bp, Artificial sequence
  SiRNA target sequence
agaagttacagaagtttaatatcatat

SEQ ID NO: 64527 - DNA, 27 bp, Artificial sequence
  SiRNA target sequence
gaagttacagaagtttaatatcatatg

SEQ ID NO: 64528 - DNA, 27 bp, Artificial sequence
  SiRNA target sequence
aagttacagaagtttaatatcatatgc

SEQ ID NO: 64529 - DNA, 27 bp, Artificial sequence
  SiRNA target sequence
agttacagaagtttaatatcatatgca

SEQ ID NO: 64530 - DNA, 27 bp, Artificial sequence
  SiRNA target sequence
gttacagaagtttaatatcatatgcaa

SEQ ID NO: 64531 - DNA, 27 bp, Artificial sequence
  SiRNA target sequence
ttacagaagtttaatatcatatgcaac

SEQ ID NO: 64532 - DNA, 27 bp, Artificial sequence
  SiRNA target sequence
tacagaagtttaatatcatatgcaaca

SEQ ID NO: 64533 - DNA, 27 bp, Artificial sequence
  SiRNA target sequence
acagaagtttaatatcatatgcaacac

SEQ ID NO: 64534 - DNA, 27 bp, Artificial sequence
  SiRNA target sequence
cagaagtttaatatcatatgcaacaca

SEQ ID NO: 64535 - DNA, 27 bp, Artificial sequence
  SiRNA target sequence
agaagtttaatatcatatgcaacacaa

SEQ ID NO: 64536 - DNA, 27 bp, Artificial sequence
  SiRNA target sequence
gaagtttaatatcatatgcaacacaaa

SEQ ID NO: 64537 - DNA, 27 bp, Artificial sequence
  SiRNA target sequence
aagtttaatatcatatgcaacacaaaa

SEQ ID NO: 64538 - DNA, 27 bp, Artificial sequence
  SiRNA target sequence
agtttaatatcatatgcaacacaaaac

SEQ ID NO: 64539 - DNA, 27 bp, Artificial sequence
  SiRNA target sequence
gtttaatatcatatgcaacacaaaaca

SEQ ID NO: 64540 - DNA, 27 bp, Artificial sequence
  SiRNA target sequence
tttaatatcatatgcaacacaaaacac

SEQ ID NO: 64541 - DNA, 27 bp, Artificial sequence
  SiRNA target sequence
ttaatatcatatgcaacacaaaacacg

SEQ ID NO: 64542 - DNA, 27 bp, Artificial sequence
  SiRNA target sequence
taatatcatatgcaacacaaaacacgt

SEQ ID NO: 64543 - DNA, 27 bp, Artificial sequence
  SiRNA target sequence
aatatcatatgcaacacaaaacacgtt

SEQ ID NO: 64544 - DNA, 27 bp, Artificial sequence
  SiRNA target sequence
atatcatatgcaacacaaaacacgttc

SEQ ID NO: 64545 - DNA, 27 bp, Artificial sequence
  SiRNA target sequence
tatcatatgcaacacaaaacacgttct

SEQ ID NO: 64546 - DNA, 27 bp, Artificial sequence
  SiRNA target sequence
atcatatgcaacacaaaacacgttctt

SEQ ID NO: 64547 - DNA, 27 bp, Artificial sequence
  SiRNA target sequence
tcatatgcaacacaaaacacgttctta

SEQ ID NO: 64548 - DNA, 27 bp, Artificial sequence
  SiRNA target sequence
catatgcaacacaaaacacgttcttat

SEQ ID NO: 64549 - DNA, 27 bp, Artificial sequence
  SiRNA target sequence
atatgcaacacaaaacacgttcttatt

SEQ ID NO: 64550 - DNA, 27 bp, Artificial sequence
  SiRNA target sequence
tatgcaacacaaaacacgttcttattc

SEQ ID NO: 64551 - DNA, 27 bp, Artificial sequence
  SiRNA target sequence
atgcaacacaaaacacgttcttattcg

SEQ ID NO: 64552 - DNA, 27 bp, Artificial sequence
  SiRNA target sequence
tgcaacacaaaacacgttcttattcga

SEQ ID NO: 64553 - DNA, 27 bp, Artificial sequence
  SiRNA target sequence
gcaacacaaaacacgttcttattcgat

SEQ ID NO: 64554 - DNA, 27 bp, Artificial sequence
  SiRNA target sequence
caacacaaaacacgttcttattcgata

SEQ ID NO: 64555 - DNA, 27 bp, Artificial sequence
  SiRNA target sequence
aacacaaaacacgttcttattcgataa

SEQ ID NO: 64556 - DNA, 27 bp, Artificial sequence
  SiRNA target sequence
acacaaaacacgttcttattcgataat

SEQ ID NO: 64557 - DNA, 27 bp, Artificial sequence
  SiRNA target sequence
cacaaaacacgttcttattcgataata

SEQ ID NO: 64558 - DNA, 27 bp, Artificial sequence
  SiRNA target sequence
acaaaacacgttcttattcgataatac

SEQ ID NO: 64559 - DNA, 27 bp, Artificial sequence
  SiRNA target sequence
caaaacacgttcttattcgataatact

SEQ ID NO: 64560 - DNA, 27 bp, Artificial sequence
  SiRNA target sequence
aaaacacgttcttattcgataatactg

SEQ ID NO: 64561 - DNA, 27 bp, Artificial sequence
  SiRNA target sequence
aaacacgttcttattcgataatactgt

SEQ ID NO: 64562 - DNA, 27 bp, Artificial sequence
  SiRNA target sequence
aacacgttcttattcgataatactgtg

SEQ ID NO: 64563 - DNA, 27 bp, Artificial sequence
  SiRNA target sequence
acacgttcttattcgataatactgtga

SEQ ID NO: 64564 - DNA, 27 bp, Artificial sequence
  SiRNA target sequence
cacgttcttattcgataatactgtgac

SEQ ID NO: 64565 - DNA, 27 bp, Artificial sequence
  SiRNA target sequence
acgttcttattcgataatactgtgaca

SEQ ID NO: 64566 - DNA, 27 bp, Artificial sequence
  SiRNA target sequence
cgttcttattcgataatactgtgacat

SEQ ID NO: 64567 - DNA, 27 bp, Artificial sequence
  SiRNA target sequence
gttcttattcgataatactgtgacata

SEQ ID NO: 64568 - DNA, 27 bp, Artificial sequence
  SiRNA target sequence
ttcttattcgataatactgtgacatac

SEQ ID NO: 64569 - DNA, 27 bp, Artificial sequence
  SiRNA target sequence
tcttattcgataatactgtgacataca

SEQ ID NO: 64570 - DNA, 27 bp, Artificial sequence
  SiRNA target sequence
cttattcgataatactgtgacatacaa

SEQ ID NO: 64571 - DNA, 27 bp, Artificial sequence
  SiRNA target sequence
ttattcgataatactgtgacatacaat

SEQ ID NO: 64572 - DNA, 27 bp, Artificial sequence
  SiRNA target sequence
tattcgataatactgtgacatacaata

SEQ ID NO: 64573 - DNA, 27 bp, Artificial sequence
  SiRNA target sequence
attcgataatactgtgacatacaatat

SEQ ID NO: 64574 - DNA, 27 bp, Artificial sequence
  SiRNA target sequence
ttcgataatactgtgacatacaatata

SEQ ID NO: 64575 - DNA, 27 bp, Artificial sequence
  SiRNA target sequence
tcgataatactgtgacatacaatatat

SEQ ID NO: 64576 - DNA, 27 bp, Artificial sequence
  SiRNA target sequence
cgataatactgtgacatacaatatatt

SEQ ID NO: 64577 - DNA, 27 bp, Artificial sequence
  SiRNA target sequence
gataatactgtgacatacaatatattt

SEQ ID NO: 64578 - DNA, 27 bp, Artificial sequence
  SiRNA target sequence
ataatactgtgacatacaatatatttt

SEQ ID NO: 64579 - DNA, 27 bp, Artificial sequence
  SiRNA target sequence
taatactgtgacatacaatatatttta

SEQ ID NO: 64580 - DNA, 27 bp, Artificial sequence
  SiRNA target sequence
aatactgtgacatacaatatattttac

SEQ ID NO: 64581 - DNA, 27 bp, Artificial sequence
  SiRNA target sequence
atactgtgacatacaatatattttacg

SEQ ID NO: 64582 - DNA, 27 bp, Artificial sequence
  SiRNA target sequence
tactgtgacatacaatatattttacgg

SEQ ID NO: 64583 - DNA, 27 bp, Artificial sequence
  SiRNA target sequence
actgtgacatacaatatattttacggg

SEQ ID NO: 64584 - DNA, 27 bp, Artificial sequence
  SiRNA target sequence
ctgtgacatacaatatattttacggga

SEQ ID NO: 64585 - DNA, 27 bp, Artificial sequence
  SiRNA target sequence
tgtgacatacaatatattttacgggac

SEQ ID NO: 64586 - DNA, 27 bp, Artificial sequence
  SiRNA target sequence
gtgacatacaatatattttacgggact

SEQ ID NO: 64587 - DNA, 27 bp, Artificial sequence
  SiRNA target sequence
tgacatacaatatattttacgggacta

SEQ ID NO: 64588 - DNA, 27 bp, Artificial sequence
  SiRNA target sequence
gacatacaatatattttacgggactaa

SEQ ID NO: 64589 - DNA, 27 bp, Artificial sequence
  SiRNA target sequence
acatacaatatattttacgggactaaa

SEQ ID NO: 64590 - DNA, 27 bp, Artificial sequence
  SiRNA target sequence
catacaatatattttacgggactaaaa

SEQ ID NO: 64591 - DNA, 27 bp, Artificial sequence
  SiRNA target sequence
atacaatatattttacgggactaaaaa

SEQ ID NO: 64592 - DNA, 27 bp, Artificial sequence
  SiRNA target sequence
tacaatatattttacgggactaaaaac

SEQ ID NO: 64593 - DNA, 27 bp, Artificial sequence
  SiRNA target sequence
acaatatattttacgggactaaaaacg

SEQ ID NO: 64594 - DNA, 27 bp, Artificial sequence
  SiRNA target sequence
caatatattttacgggactaaaaacgt

SEQ ID NO: 64595 - DNA, 27 bp, Artificial sequence
  SiRNA target sequence
aatatattttacgggactaaaaacgta

SEQ ID NO: 64596 - DNA, 27 bp, Artificial sequence
  SiRNA target sequence
atatattttacgggactaaaaacgtaa

SEQ ID NO: 64597 - DNA, 27 bp, Artificial sequence
  SiRNA target sequence
tatattttacgggactaaaaacgtaac

SEQ ID NO: 64598 - DNA, 27 bp, Artificial sequence
  SiRNA target sequence
atattttacgggactaaaaacgtaaca

SEQ ID NO: 64599 - DNA, 27 bp, Artificial sequence
  SiRNA target sequence
tattttacgggactaaaaacgtaacag

SEQ ID NO: 64600 - DNA, 27 bp, Artificial sequence
  SiRNA target sequence
attttacgggactaaaaacgtaacaga

SEQ ID NO: 64601 - DNA, 27 bp, Artificial sequence
  SiRNA target sequence
ttttacgggactaaaaacgtaacagaa

SEQ ID NO: 64602 - DNA, 27 bp, Artificial sequence
  SiRNA target sequence
tttacgggactaaaaacgtaacagaaa

SEQ ID NO: 64603 - DNA, 27 bp, Artificial sequence
  SiRNA target sequence
ttacgggactaaaaacgtaacagaaaa

SEQ ID NO: 64604 - DNA, 27 bp, Artificial sequence
  SiRNA target sequence
tacgggactaaaaacgtaacagaaaaa

SEQ ID NO: 64605 - DNA, 27 bp, Artificial sequence
  SiRNA target sequence
acgggactaaaaacgtaacagaaaaag

SEQ ID NO: 64606 - DNA, 27 bp, Artificial sequence
  SiRNA target sequence
cgggactaaaaacgtaacagaaaaaga

SEQ ID NO: 64607 - DNA, 27 bp, Artificial sequence
  SiRNA target sequence
gggactaaaaacgtaacagaaaaagaa

SEQ ID NO: 64608 - DNA, 27 bp, Artificial sequence
  SiRNA target sequence
ggactaaaaacgtaacagaaaaagaag

SEQ ID NO: 64609 - DNA, 27 bp, Artificial sequence
  SiRNA target sequence
gactaaaaacgtaacagaaaaagaagt

SEQ ID NO: 64610 - DNA, 27 bp, Artificial sequence
  SiRNA target sequence
actaaaaacgtaacagaaaaagaagtt

SEQ ID NO: 64611 - DNA, 27 bp, Artificial sequence
  SiRNA target sequence
ctaaaaacgtaacagaaaaagaagttt

SEQ ID NO: 64612 - DNA, 27 bp, Artificial sequence
  SiRNA target sequence
taaaaacgtaacagaaaaagaagtttt

SEQ ID NO: 64613 - DNA, 27 bp, Artificial sequence
  SiRNA target sequence
aaaaacgtaacagaaaaagaagtttta

SEQ ID NO: 64614 - DNA, 27 bp, Artificial sequence
  SiRNA target sequence
aaaacgtaacagaaaaagaagttttag

SEQ ID NO: 64615 - DNA, 27 bp, Artificial sequence
  SiRNA target sequence
aaacgtaacagaaaaagaagttttaga

SEQ ID NO: 64616 - DNA, 27 bp, Artificial sequence
  SiRNA target sequence
aacgtaacagaaaaagaagttttagaa

SEQ ID NO: 64617 - DNA, 27 bp, Artificial sequence
  SiRNA target sequence
acgtaacagaaaaagaagttttagaat

SEQ ID NO: 64618 - DNA, 27 bp, Artificial sequence
  SiRNA target sequence
cgtaacagaaaaagaagttttagaatt

SEQ ID NO: 64619 - DNA, 27 bp, Artificial sequence
  SiRNA target sequence
gtaacagaaaaagaagttttagaatta

SEQ ID NO: 64620 - DNA, 27 bp, Artificial sequence
  SiRNA target sequence
taacagaaaaagaagttttagaattag

SEQ ID NO: 64621 - DNA, 27 bp, Artificial sequence
  SiRNA target sequence
aacagaaaaagaagttttagaattagc

SEQ ID NO: 64622 - DNA, 27 bp, Artificial sequence
  SiRNA target sequence
acagaaaaagaagttttagaattagcc

SEQ ID NO: 64623 - DNA, 27 bp, Artificial sequence
  SiRNA target sequence
cagaaaaagaagttttagaattagcca

SEQ ID NO: 64624 - DNA, 27 bp, Artificial sequence
  SiRNA target sequence
agaaaaagaagttttagaattagccaa

SEQ ID NO: 64625 - DNA, 27 bp, Artificial sequence
  SiRNA target sequence
gaaaaagaagttttagaattagccaaa

SEQ ID NO: 64626 - DNA, 27 bp, Artificial sequence
  SiRNA target sequence
aaaaagaagttttagaattagccaaaa

SEQ ID NO: 64627 - DNA, 27 bp, Artificial sequence
  SiRNA target sequence
aaaagaagttttagaattagccaaaaa

SEQ ID NO: 64628 - DNA, 27 bp, Artificial sequence
  SiRNA target sequence
aaagaagttttagaattagccaaaaaa

SEQ ID NO: 64629 - DNA, 27 bp, Artificial sequence
  SiRNA target sequence
aagaagttttagaattagccaaaaaaa

SEQ ID NO: 64630 - DNA, 27 bp, Artificial sequence
  SiRNA target sequence
agaagttttagaattagccaaaaaaat

SEQ ID NO: 64631 - DNA, 27 bp, Artificial sequence
  SiRNA target sequence
gaagttttagaattagccaaaaaaata

SEQ ID NO: 64632 - DNA, 27 bp, Artificial sequence
  SiRNA target sequence
aagttttagaattagccaaaaaaatag

SEQ ID NO: 64633 - DNA, 27 bp, Artificial sequence
  SiRNA target sequence
agttttagaattagccaaaaaaatagg

SEQ ID NO: 64634 - DNA, 27 bp, Artificial sequence
  SiRNA target sequence
gttttagaattagccaaaaaaataggt

SEQ ID NO: 64635 - DNA, 27 bp, Artificial sequence
  SiRNA target sequence
ttttagaattagccaaaaaaataggtg

SEQ ID NO: 64636 - DNA, 27 bp, Artificial sequence
  SiRNA target sequence
tttagaattagccaaaaaaataggtgt

SEQ ID NO: 64637 - DNA, 27 bp, Artificial sequence
  SiRNA target sequence
ttagaattagccaaaaaaataggtgta

SEQ ID NO: 64638 - DNA, 27 bp, Artificial sequence
  SiRNA target sequence
tagaattagccaaaaaaataggtgtat

SEQ ID NO: 64639 - DNA, 27 bp, Artificial sequence
  SiRNA target sequence
agaattagccaaaaaaataggtgtatt

SEQ ID NO: 64640 - DNA, 27 bp, Artificial sequence
  SiRNA target sequence
gaattagccaaaaaaataggtgtatta

SEQ ID NO: 64641 - DNA, 27 bp, Artificial sequence
  SiRNA target sequence
aattagccaaaaaaataggtgtattag

SEQ ID NO: 64642 - DNA, 27 bp, Artificial sequence
  SiRNA target sequence
attagccaaaaaaataggtgtattaga

SEQ ID NO: 64643 - DNA, 27 bp, Artificial sequence
  SiRNA target sequence
ttagccaaaaaaataggtgtattagag

SEQ ID NO: 64644 - DNA, 27 bp, Artificial sequence
  SiRNA target sequence
tagccaaaaaaataggtgtattagagt

SEQ ID NO: 64645 - DNA, 27 bp, Artificial sequence
  SiRNA target sequence
agccaaaaaaataggtgtattagagtc

SEQ ID NO: 64646 - DNA, 27 bp, Artificial sequence
  SiRNA target sequence
gccaaaaaaataggtgtattagagtct

SEQ ID NO: 64647 - DNA, 27 bp, Artificial sequence
  SiRNA target sequence
ccaaaaaaataggtgtattagagtcta

SEQ ID NO: 64648 - DNA, 27 bp, Artificial sequence
  SiRNA target sequence
caaaaaaataggtgtattagagtctat

SEQ ID NO: 64649 - DNA, 27 bp, Artificial sequence
  SiRNA target sequence
aaaaaaataggtgtattagagtctata

SEQ ID NO: 64650 - DNA, 27 bp, Artificial sequence
  SiRNA target sequence
aaaaaataggtgtattagagtctatac

SEQ ID NO: 64651 - DNA, 27 bp, Artificial sequence
  SiRNA target sequence
aaaaataggtgtattagagtctataca

SEQ ID NO: 64652 - DNA, 27 bp, Artificial sequence
  SiRNA target sequence
aaaataggtgtattagagtctatacag

SEQ ID NO: 64653 - DNA, 27 bp, Artificial sequence
  SiRNA target sequence
aaataggtgtattagagtctatacagg

SEQ ID NO: 64654 - DNA, 27 bp, Artificial sequence
  SiRNA target sequence
aataggtgtattagagtctatacagga

SEQ ID NO: 64655 - DNA, 27 bp, Artificial sequence
  SiRNA target sequence
ataggtgtattagagtctatacaggaa

SEQ ID NO: 64656 - DNA, 27 bp, Artificial sequence
  SiRNA target sequence
taggtgtattagagtctatacaggaat

SEQ ID NO: 64657 - DNA, 27 bp, Artificial sequence
  SiRNA target sequence
aggtgtattagagtctatacaggaatt

SEQ ID NO: 64658 - DNA, 27 bp, Artificial sequence
  SiRNA target sequence
ggtgtattagagtctatacaggaattt

SEQ ID NO: 64659 - DNA, 27 bp, Artificial sequence
  SiRNA target sequence
gtgtattagagtctatacaggaattta

SEQ ID NO: 64660 - DNA, 27 bp, Artificial sequence
  SiRNA target sequence
tgtattagagtctatacaggaatttaa

SEQ ID NO: 64661 - DNA, 27 bp, Artificial sequence
  SiRNA target sequence
gtattagagtctatacaggaatttaaa

SEQ ID NO: 64662 - DNA, 27 bp, Artificial sequence
  SiRNA target sequence
tattagagtctatacaggaatttaaag

SEQ ID NO: 64663 - DNA, 27 bp, Artificial sequence
  SiRNA target sequence
attagagtctatacaggaatttaaaga

SEQ ID NO: 64664 - DNA, 27 bp, Artificial sequence
  SiRNA target sequence
ttagagtctatacaggaatttaaagat

SEQ ID NO: 64665 - DNA, 27 bp, Artificial sequence
  SiRNA target sequence
tagagtctatacaggaatttaaagatg

SEQ ID NO: 64666 - DNA, 27 bp, Artificial sequence
  SiRNA target sequence
agagtctatacaggaatttaaagatgg

SEQ ID NO: 64667 - DNA, 27 bp, Artificial sequence
  SiRNA target sequence
gagtctatacaggaatttaaagatggg

SEQ ID NO: 64668 - DNA, 27 bp, Artificial sequence
  SiRNA target sequence
agtctatacaggaatttaaagatgggt

SEQ ID NO: 64669 - DNA, 27 bp, Artificial sequence
  SiRNA target sequence
gtctatacaggaatttaaagatgggtt

SEQ ID NO: 64670 - DNA, 27 bp, Artificial sequence
  SiRNA target sequence
tctatacaggaatttaaagatgggttt

SEQ ID NO: 64671 - DNA, 27 bp, Artificial sequence
  SiRNA target sequence
ctatacaggaatttaaagatgggttta

SEQ ID NO: 64672 - DNA, 27 bp, Artificial sequence
  SiRNA target sequence
tatacaggaatttaaagatgggtttag

SEQ ID NO: 64673 - DNA, 27 bp, Artificial sequence
  SiRNA target sequence
atacaggaatttaaagatgggtttagc

SEQ ID NO: 64674 - DNA, 27 bp, Artificial sequence
  SiRNA target sequence
tacaggaatttaaagatgggtttagca

SEQ ID NO: 64675 - DNA, 27 bp, Artificial sequence
  SiRNA target sequence
acaggaatttaaagatgggtttagcac

SEQ ID NO: 64676 - DNA, 27 bp, Artificial sequence
  SiRNA target sequence
caggaatttaaagatgggtttagcaca

SEQ ID NO: 64677 - DNA, 27 bp, Artificial sequence
  SiRNA target sequence
aggaatttaaagatgggtttagcacat

SEQ ID NO: 64678 - DNA, 27 bp, Artificial sequence
  SiRNA target sequence
ggaatttaaagatgggtttagcacatc

SEQ ID NO: 64679 - DNA, 27 bp, Artificial sequence
  SiRNA target sequence
gaatttaaagatgggtttagcacatcg

SEQ ID NO: 64680 - DNA, 27 bp, Artificial sequence
  SiRNA target sequence
aatttaaagatgggtttagcacatcgg

SEQ ID NO: 64681 - DNA, 27 bp, Artificial sequence
  SiRNA target sequence
atttaaagatgggtttagcacatcggt

SEQ ID NO: 64682 - DNA, 27 bp, Artificial sequence
  SiRNA target sequence
tttaaagatgggtttagcacatcggtc

SEQ ID NO: 64683 - DNA, 27 bp, Artificial sequence
  SiRNA target sequence
ttaaagatgggtttagcacatcggtcg

SEQ ID NO: 64684 - DNA, 27 bp, Artificial sequence
  SiRNA target sequence
taaagatgggtttagcacatcggtcgg

SEQ ID NO: 64685 - DNA, 27 bp, Artificial sequence
  SiRNA target sequence
aaagatgggtttagcacatcggtcggt

SEQ ID NO: 64686 - DNA, 27 bp, Artificial sequence
  SiRNA target sequence
aagatgggtttagcacatcggtcggtg

SEQ ID NO: 64687 - DNA, 27 bp, Artificial sequence
  SiRNA target sequence
agatgggtttagcacatcggtcggtga

SEQ ID NO: 64688 - DNA, 27 bp, Artificial sequence
  SiRNA target sequence
gatgggtttagcacatcggtcggtgaa

SEQ ID NO: 64689 - DNA, 27 bp, Artificial sequence
  SiRNA target sequence
atgggtttagcacatcggtcggtgaac

SEQ ID NO: 64690 - DNA, 27 bp, Artificial sequence
  SiRNA target sequence
tgggtttagcacatcggtcggtgaacg

SEQ ID NO: 64691 - DNA, 27 bp, Artificial sequence
  SiRNA target sequence
gggtttagcacatcggtcggtgaacgc

SEQ ID NO: 64692 - DNA, 27 bp, Artificial sequence
  SiRNA target sequence
ggtttagcacatcggtcggtgaacgcg

SEQ ID NO: 64693 - DNA, 27 bp, Artificial sequence
  SiRNA target sequence
gtttagcacatcggtcggtgaacgcgg

SEQ ID NO: 64694 - DNA, 27 bp, Artificial sequence
  SiRNA target sequence
tttagcacatcggtcggtgaacgcgga

SEQ ID NO: 64695 - DNA, 27 bp, Artificial sequence
  SiRNA target sequence
ttagcacatcggtcggtgaacgcggaa

SEQ ID NO: 64696 - DNA, 27 bp, Artificial sequence
  SiRNA target sequence
tagcacatcggtcggtgaacgcggaag

SEQ ID NO: 64697 - DNA, 27 bp, Artificial sequence
  SiRNA target sequence
agcacatcggtcggtgaacgcggaaga

SEQ ID NO: 64698 - DNA, 27 bp, Artificial sequence
  SiRNA target sequence
gcacatcggtcggtgaacgcggaagat

SEQ ID NO: 64699 - DNA, 27 bp, Artificial sequence
  SiRNA target sequence
cacatcggtcggtgaacgcggaagatt

SEQ ID NO: 64700 - DNA, 27 bp, Artificial sequence
  SiRNA target sequence
acatcggtcggtgaacgcggaagattt

SEQ ID NO: 64701 - DNA, 27 bp, Artificial sequence
  SiRNA target sequence
catcggtcggtgaacgcggaagatttt

SEQ ID NO: 64702 - DNA, 27 bp, Artificial sequence
  SiRNA target sequence
atcggtcggtgaacgcggaagattttt

SEQ ID NO: 64703 - DNA, 27 bp, Artificial sequence
  SiRNA target sequence
tcggtcggtgaacgcggaagattttta

SEQ ID NO: 64704 - DNA, 27 bp, Artificial sequence
  SiRNA target sequence
cggtcggtgaacgcggaagatttttat

SEQ ID NO: 64705 - DNA, 27 bp, Artificial sequence
  SiRNA target sequence
ggtcggtgaacgcggaagatttttatc

SEQ ID NO: 64706 - DNA, 27 bp, Artificial sequence
  SiRNA target sequence
gtcggtgaacgcggaagatttttatct

SEQ ID NO: 64707 - DNA, 27 bp, Artificial sequence
  SiRNA target sequence
tcggtgaacgcggaagatttttatctg

SEQ ID NO: 64708 - DNA, 27 bp, Artificial sequence
  SiRNA target sequence
cggtgaacgcggaagatttttatctgg

SEQ ID NO: 64709 - DNA, 27 bp, Artificial sequence
  SiRNA target sequence
ggtgaacgcggaagatttttatctggt

SEQ ID NO: 64710 - DNA, 27 bp, Artificial sequence
  SiRNA target sequence
gtgaacgcggaagatttttatctggtg

SEQ ID NO: 64711 - DNA, 27 bp, Artificial sequence
  SiRNA target sequence
tgaacgcggaagatttttatctggtgg

SEQ ID NO: 64712 - DNA, 27 bp, Artificial sequence
  SiRNA target sequence
gaacgcggaagatttttatctggtggt

SEQ ID NO: 64713 - DNA, 27 bp, Artificial sequence
  SiRNA target sequence
aacgcggaagatttttatctggtggtg

SEQ ID NO: 64714 - DNA, 27 bp, Artificial sequence
  SiRNA target sequence
acgcggaagatttttatctggtggtga

SEQ ID NO: 64715 - DNA, 27 bp, Artificial sequence
  SiRNA target sequence
cgcggaagatttttatctggtggtgaa

SEQ ID NO: 64716 - DNA, 27 bp, Artificial sequence
  SiRNA target sequence
gcggaagatttttatctggtggtgaaa

SEQ ID NO: 64717 - DNA, 27 bp, Artificial sequence
  SiRNA target sequence
cggaagatttttatctggtggtgaaag

SEQ ID NO: 64718 - DNA, 27 bp, Artificial sequence
  SiRNA target sequence
ggaagatttttatctggtggtgaaagg

SEQ ID NO: 64719 - DNA, 27 bp, Artificial sequence
  SiRNA target sequence
gaagatttttatctggtggtgaaaggc

SEQ ID NO: 64720 - DNA, 27 bp, Artificial sequence
  SiRNA target sequence
aagatttttatctggtggtgaaaggca

SEQ ID NO: 64721 - DNA, 27 bp, Artificial sequence
  SiRNA target sequence
agatttttatctggtggtgaaaggcaa

SEQ ID NO: 64722 - DNA, 27 bp, Artificial sequence
  SiRNA target sequence
gatttttatctggtggtgaaaggcaaa

SEQ ID NO: 64723 - DNA, 27 bp, Artificial sequence
  SiRNA target sequence
atttttatctggtggtgaaaggcaaaa

SEQ ID NO: 64724 - DNA, 27 bp, Artificial sequence
  SiRNA target sequence
tttttatctggtggtgaaaggcaaaaa

SEQ ID NO: 64725 - DNA, 27 bp, Artificial sequence
  SiRNA target sequence
ttttatctggtggtgaaaggcaaaaaa

SEQ ID NO: 64726 - DNA, 27 bp, Artificial sequence
  SiRNA target sequence
tttatctggtggtgaaaggcaaaaaat

SEQ ID NO: 64727 - DNA, 27 bp, Artificial sequence
  SiRNA target sequence
ttatctggtggtgaaaggcaaaaaatt

SEQ ID NO: 64728 - DNA, 27 bp, Artificial sequence
  SiRNA target sequence
tatctggtggtgaaaggcaaaaaatta

SEQ ID NO: 64729 - DNA, 27 bp, Artificial sequence
  SiRNA target sequence
atctggtggtgaaaggcaaaaaattat

SEQ ID NO: 64730 - DNA, 27 bp, Artificial sequence
  SiRNA target sequence
tctggtggtgaaaggcaaaaaattatg

SEQ ID NO: 64731 - DNA, 27 bp, Artificial sequence
  SiRNA target sequence
ctggtggtgaaaggcaaaaaattatgc

SEQ ID NO: 64732 - DNA, 27 bp, Artificial sequence
  SiRNA target sequence
tggtggtgaaaggcaaaaaattatgct

SEQ ID NO: 64733 - DNA, 27 bp, Artificial sequence
  SiRNA target sequence
ggtggtgaaaggcaaaaaattatgctg

SEQ ID NO: 64734 - DNA, 27 bp, Artificial sequence
  SiRNA target sequence
gtggtgaaaggcaaaaaattatgctga

SEQ ID NO: 64735 - DNA, 27 bp, Artificial sequence
  SiRNA target sequence
tggtgaaaggcaaaaaattatgctgat

SEQ ID NO: 64736 - DNA, 27 bp, Artificial sequence
  SiRNA target sequence
ggtgaaaggcaaaaaattatgctgatg

SEQ ID NO: 64737 - DNA, 27 bp, Artificial sequence
  SiRNA target sequence
gtgaaaggcaaaaaattatgctgatgc

SEQ ID NO: 64738 - DNA, 27 bp, Artificial sequence
  SiRNA target sequence
tgaaaggcaaaaaattatgctgatgcg

SEQ ID NO: 64739 - DNA, 27 bp, Artificial sequence
  SiRNA target sequence
gaaaggcaaaaaattatgctgatgcgt

SEQ ID NO: 64740 - DNA, 27 bp, Artificial sequence
  SiRNA target sequence
aaaggcaaaaaattatgctgatgcgtg

SEQ ID NO: 64741 - DNA, 27 bp, Artificial sequence
  SiRNA target sequence
aaggcaaaaaattatgctgatgcgtgc

SEQ ID NO: 64742 - DNA, 27 bp, Artificial sequence
  SiRNA target sequence
aggcaaaaaattatgctgatgcgtgca

SEQ ID NO: 64743 - DNA, 27 bp, Artificial sequence
  SiRNA target sequence
ggcaaaaaattatgctgatgcgtgcat

SEQ ID NO: 64744 - DNA, 27 bp, Artificial sequence
  SiRNA target sequence
gcaaaaaattatgctgatgcgtgcatt

SEQ ID NO: 64745 - DNA, 27 bp, Artificial sequence
  SiRNA target sequence
caaaaaattatgctgatgcgtgcattg

SEQ ID NO: 64746 - DNA, 27 bp, Artificial sequence
  SiRNA target sequence
aaaaaattatgctgatgcgtgcattgc

SEQ ID NO: 64747 - DNA, 27 bp, Artificial sequence
  SiRNA target sequence
aaaaattatgctgatgcgtgcattgct

SEQ ID NO: 64748 - DNA, 27 bp, Artificial sequence
  SiRNA target sequence
aaaattatgctgatgcgtgcattgctt

SEQ ID NO: 64749 - DNA, 27 bp, Artificial sequence
  SiRNA target sequence
aaattatgctgatgcgtgcattgctta

SEQ ID NO: 64750 - DNA, 27 bp, Artificial sequence
  SiRNA target sequence
aattatgctgatgcgtgcattgcttaa

SEQ ID NO: 64751 - DNA, 27 bp, Artificial sequence
  SiRNA target sequence
attatgctgatgcgtgcattgcttaaa

SEQ ID NO: 64752 - DNA, 27 bp, Artificial sequence
  SiRNA target sequence
ttatgctgatgcgtgcattgcttaaaa

SEQ ID NO: 64753 - DNA, 27 bp, Artificial sequence
  SiRNA target sequence
tatgctgatgcgtgcattgcttaaaaa

SEQ ID NO: 64754 - DNA, 27 bp, Artificial sequence
  SiRNA target sequence
atgctgatgcgtgcattgcttaaaaat

SEQ ID NO: 64755 - DNA, 27 bp, Artificial sequence
  SiRNA target sequence
tgctgatgcgtgcattgcttaaaaatt

SEQ ID NO: 64756 - DNA, 27 bp, Artificial sequence
  SiRNA target sequence
gctgatgcgtgcattgcttaaaaattc

SEQ ID NO: 64757 - DNA, 27 bp, Artificial sequence
  SiRNA target sequence
ctgatgcgtgcattgcttaaaaattca

SEQ ID NO: 64758 - DNA, 27 bp, Artificial sequence
  SiRNA target sequence
tgatgcgtgcattgcttaaaaattcag

SEQ ID NO: 64759 - DNA, 27 bp, Artificial sequence
  SiRNA target sequence
gatgcgtgcattgcttaaaaattcaga

SEQ ID NO: 64760 - DNA, 27 bp, Artificial sequence
  SiRNA target sequence
atgcgtgcattgcttaaaaattcagag

SEQ ID NO: 64761 - DNA, 27 bp, Artificial sequence
  SiRNA target sequence
tgcgtgcattgcttaaaaattcagaga

SEQ ID NO: 64762 - DNA, 27 bp, Artificial sequence
  SiRNA target sequence
gcgtgcattgcttaaaaattcagagat

SEQ ID NO: 64763 - DNA, 27 bp, Artificial sequence
  SiRNA target sequence
cgtgcattgcttaaaaattcagagatc

SEQ ID NO: 64764 - DNA, 27 bp, Artificial sequence
  SiRNA target sequence
gtgcattgcttaaaaattcagagatcg

SEQ ID NO: 64765 - DNA, 27 bp, Artificial sequence
  SiRNA target sequence
tgcattgcttaaaaattcagagatcgt

SEQ ID NO: 64766 - DNA, 27 bp, Artificial sequence
  SiRNA target sequence
gcattgcttaaaaattcagagatcgtt

SEQ ID NO: 64767 - DNA, 27 bp, Artificial sequence
  SiRNA target sequence
cattgcttaaaaattcagagatcgttt

SEQ ID NO: 64768 - DNA, 27 bp, Artificial sequence
  SiRNA target sequence
attgcttaaaaattcagagatcgtttt

SEQ ID NO: 64769 - DNA, 27 bp, Artificial sequence
  SiRNA target sequence
ttgcttaaaaattcagagatcgtttta

SEQ ID NO: 64770 - DNA, 27 bp, Artificial sequence
  SiRNA target sequence
tgcttaaaaattcagagatcgttttat

SEQ ID NO: 64771 - DNA, 27 bp, Artificial sequence
  SiRNA target sequence
gcttaaaaattcagagatcgttttatt

SEQ ID NO: 64772 - DNA, 27 bp, Artificial sequence
  SiRNA target sequence
cttaaaaattcagagatcgttttatta

SEQ ID NO: 64773 - DNA, 27 bp, Artificial sequence
  SiRNA target sequence
ttaaaaattcagagatcgttttattag

SEQ ID NO: 64774 - DNA, 27 bp, Artificial sequence
  SiRNA target sequence
taaaaattcagagatcgttttattaga

SEQ ID NO: 64775 - DNA, 27 bp, Artificial sequence
  SiRNA target sequence
aaaaattcagagatcgttttattagac

SEQ ID NO: 64776 - DNA, 27 bp, Artificial sequence
  SiRNA target sequence
aaaattcagagatcgttttattagacg

SEQ ID NO: 64777 - DNA, 27 bp, Artificial sequence
  SiRNA target sequence
aaattcagagatcgttttattagacga

SEQ ID NO: 64778 - DNA, 27 bp, Artificial sequence
  SiRNA target sequence
aattcagagatcgttttattagacgag

SEQ ID NO: 64779 - DNA, 27 bp, Artificial sequence
  SiRNA target sequence
attcagagatcgttttattagacgagc

SEQ ID NO: 64780 - DNA, 27 bp, Artificial sequence
  SiRNA target sequence
ttcagagatcgttttattagacgagcc

SEQ ID NO: 64781 - DNA, 27 bp, Artificial sequence
  SiRNA target sequence
tcagagatcgttttattagacgagcca

SEQ ID NO: 64782 - DNA, 27 bp, Artificial sequence
  SiRNA target sequence
cagagatcgttttattagacgagccaa

SEQ ID NO: 64783 - DNA, 27 bp, Artificial sequence
  SiRNA target sequence
agagatcgttttattagacgagccaac

SEQ ID NO: 64784 - DNA, 27 bp, Artificial sequence
  SiRNA target sequence
gagatcgttttattagacgagccaacc

SEQ ID NO: 64785 - DNA, 27 bp, Artificial sequence
  SiRNA target sequence
agatcgttttattagacgagccaacct

SEQ ID NO: 64786 - DNA, 27 bp, Artificial sequence
  SiRNA target sequence
gatcgttttattagacgagccaacctc

SEQ ID NO: 64787 - DNA, 27 bp, Artificial sequence
  SiRNA target sequence
atcgttttattagacgagccaacctca

SEQ ID NO: 64788 - DNA, 27 bp, Artificial sequence
  SiRNA target sequence
tcgttttattagacgagccaacctcag

SEQ ID NO: 64789 - DNA, 27 bp, Artificial sequence
  SiRNA target sequence
cgttttattagacgagccaacctcagc

SEQ ID NO: 64790 - DNA, 27 bp, Artificial sequence
  SiRNA target sequence
gttttattagacgagccaacctcagca

SEQ ID NO: 64791 - DNA, 27 bp, Artificial sequence
  SiRNA target sequence
ttttattagacgagccaacctcagcac

SEQ ID NO: 64792 - DNA, 27 bp, Artificial sequence
  SiRNA target sequence
tttattagacgagccaacctcagcact

SEQ ID NO: 64793 - DNA, 27 bp, Artificial sequence
  SiRNA target sequence
ttattagacgagccaacctcagcacta

SEQ ID NO: 64794 - DNA, 27 bp, Artificial sequence
  SiRNA target sequence
tattagacgagccaacctcagcactag

SEQ ID NO: 64795 - DNA, 27 bp, Artificial sequence
  SiRNA target sequence
attagacgagccaacctcagcactaga

SEQ ID NO: 64796 - DNA, 27 bp, Artificial sequence
  SiRNA target sequence
ttagacgagccaacctcagcactagat

SEQ ID NO: 64797 - DNA, 27 bp, Artificial sequence
  SiRNA target sequence
tagacgagccaacctcagcactagata

SEQ ID NO: 64798 - DNA, 27 bp, Artificial sequence
  SiRNA target sequence
agacgagccaacctcagcactagataa

SEQ ID NO: 64799 - DNA, 27 bp, Artificial sequence
  SiRNA target sequence
gacgagccaacctcagcactagataaa

SEQ ID NO: 64800 - DNA, 27 bp, Artificial sequence
  SiRNA target sequence
acgagccaacctcagcactagataaaa

SEQ ID NO: 64801 - DNA, 27 bp, Artificial sequence
  SiRNA target sequence
cgagccaacctcagcactagataaaaa

SEQ ID NO: 64802 - DNA, 27 bp, Artificial sequence
  SiRNA target sequence
gagccaacctcagcactagataaaaag

SEQ ID NO: 64803 - DNA, 27 bp, Artificial sequence
  SiRNA target sequence
agccaacctcagcactagataaaaaga

SEQ ID NO: 64804 - DNA, 27 bp, Artificial sequence
  SiRNA target sequence
gccaacctcagcactagataaaaagag

SEQ ID NO: 64805 - DNA, 27 bp, Artificial sequence
  SiRNA target sequence
ccaacctcagcactagataaaaagagt

SEQ ID NO: 64806 - DNA, 27 bp, Artificial sequence
  SiRNA target sequence
caacctcagcactagataaaaagagtg

SEQ ID NO: 64807 - DNA, 27 bp, Artificial sequence
  SiRNA target sequence
aacctcagcactagataaaaagagtga

SEQ ID NO: 64808 - DNA, 27 bp, Artificial sequence
  SiRNA target sequence
acctcagcactagataaaaagagtgaa

SEQ ID NO: 64809 - DNA, 27 bp, Artificial sequence
  SiRNA target sequence
cctcagcactagataaaaagagtgaac

SEQ ID NO: 64810 - DNA, 27 bp, Artificial sequence
  SiRNA target sequence
ctcagcactagataaaaagagtgaact

SEQ ID NO: 64811 - DNA, 27 bp, Artificial sequence
  SiRNA target sequence
tcagcactagataaaaagagtgaacta

SEQ ID NO: 64812 - DNA, 27 bp, Artificial sequence
  SiRNA target sequence
cagcactagataaaaagagtgaactag

SEQ ID NO: 64813 - DNA, 27 bp, Artificial sequence
  SiRNA target sequence
agcactagataaaaagagtgaactaga

SEQ ID NO: 64814 - DNA, 27 bp, Artificial sequence
  SiRNA target sequence
gcactagataaaaagagtgaactagaa

SEQ ID NO: 64815 - DNA, 27 bp, Artificial sequence
  SiRNA target sequence
cactagataaaaagagtgaactagaaa

SEQ ID NO: 64816 - DNA, 27 bp, Artificial sequence
  SiRNA target sequence
actagataaaaagagtgaactagaaac

SEQ ID NO: 64817 - DNA, 27 bp, Artificial sequence
  SiRNA target sequence
ctagataaaaagagtgaactagaaact

SEQ ID NO: 64818 - DNA, 27 bp, Artificial sequence
  SiRNA target sequence
tagataaaaagagtgaactagaaacta

SEQ ID NO: 64819 - DNA, 27 bp, Artificial sequence
  SiRNA target sequence
agataaaaagagtgaactagaaactat

SEQ ID NO: 64820 - DNA, 27 bp, Artificial sequence
  SiRNA target sequence
gataaaaagagtgaactagaaactatg

SEQ ID NO: 64821 - DNA, 27 bp, Artificial sequence
  SiRNA target sequence
ataaaaagagtgaactagaaactatga

SEQ ID NO: 64822 - DNA, 27 bp, Artificial sequence
  SiRNA target sequence
taaaaagagtgaactagaaactatgac

SEQ ID NO: 64823 - DNA, 27 bp, Artificial sequence
  SiRNA target sequence
aaaaagagtgaactagaaactatgaca

SEQ ID NO: 64824 - DNA, 27 bp, Artificial sequence
  SiRNA target sequence
aaaagagtgaactagaaactatgacat

SEQ ID NO: 64825 - DNA, 27 bp, Artificial sequence
  SiRNA target sequence
aaagagtgaactagaaactatgacata

SEQ ID NO: 64826 - DNA, 27 bp, Artificial sequence
  SiRNA target sequence
aagagtgaactagaaactatgacatat

SEQ ID NO: 64827 - DNA, 27 bp, Artificial sequence
  SiRNA target sequence
agagtgaactagaaactatgacatata

SEQ ID NO: 64828 - DNA, 27 bp, Artificial sequence
  SiRNA target sequence
gagtgaactagaaactatgacatatat

SEQ ID NO: 64829 - DNA, 27 bp, Artificial sequence
  SiRNA target sequence
agtgaactagaaactatgacatatatt

SEQ ID NO: 64830 - DNA, 27 bp, Artificial sequence
  SiRNA target sequence
gtgaactagaaactatgacatatattt

SEQ ID NO: 64831 - DNA, 27 bp, Artificial sequence
  SiRNA target sequence
tgaactagaaactatgacatatatttt

SEQ ID NO: 64832 - DNA, 27 bp, Artificial sequence
  SiRNA target sequence
gaactagaaactatgacatatattttt

SEQ ID NO: 64833 - DNA, 27 bp, Artificial sequence
  SiRNA target sequence
aactagaaactatgacatatattttta

SEQ ID NO: 64834 - DNA, 27 bp, Artificial sequence
  SiRNA target sequence
actagaaactatgacatatatttttaa

SEQ ID NO: 64835 - DNA, 27 bp, Artificial sequence
  SiRNA target sequence
ctagaaactatgacatatatttttaat

SEQ ID NO: 64836 - DNA, 27 bp, Artificial sequence
  SiRNA target sequence
tagaaactatgacatatatttttaatg

SEQ ID NO: 64837 - DNA, 27 bp, Artificial sequence
  SiRNA target sequence
agaaactatgacatatatttttaatga

SEQ ID NO: 64838 - DNA, 27 bp, Artificial sequence
  SiRNA target sequence
gaaactatgacatatatttttaatgaa

SEQ ID NO: 64839 - DNA, 27 bp, Artificial sequence
  SiRNA target sequence
aaactatgacatatatttttaatgaat

SEQ ID NO: 64840 - DNA, 27 bp, Artificial sequence
  SiRNA target sequence
aactatgacatatatttttaatgaatt

SEQ ID NO: 64841 - DNA, 27 bp, Artificial sequence
  SiRNA target sequence
actatgacatatatttttaatgaattt

SEQ ID NO: 64842 - DNA, 27 bp, Artificial sequence
  SiRNA target sequence
ctatgacatatatttttaatgaattta

SEQ ID NO: 64843 - DNA, 27 bp, Artificial sequence
  SiRNA target sequence
tatgacatatatttttaatgaatttaa

SEQ ID NO: 64844 - DNA, 27 bp, Artificial sequence
  SiRNA target sequence
atgacatatatttttaatgaatttaag

SEQ ID NO: 64845 - DNA, 27 bp, Artificial sequence
  SiRNA target sequence
tgacatatatttttaatgaatttaagt

SEQ ID NO: 64846 - DNA, 27 bp, Artificial sequence
  SiRNA target sequence
gacatatatttttaatgaatttaagta

SEQ ID NO: 64847 - DNA, 27 bp, Artificial sequence
  SiRNA target sequence
acatatatttttaatgaatttaagtac

SEQ ID NO: 64848 - DNA, 27 bp, Artificial sequence
  SiRNA target sequence
catatatttttaatgaatttaagtacc

SEQ ID NO: 64849 - DNA, 27 bp, Artificial sequence
  SiRNA target sequence
atatatttttaatgaatttaagtacca

SEQ ID NO: 64850 - DNA, 27 bp, Artificial sequence
  SiRNA target sequence
tatatttttaatgaatttaagtaccat

SEQ ID NO: 64851 - DNA, 27 bp, Artificial sequence
  SiRNA target sequence
atatttttaatgaatttaagtaccata

SEQ ID NO: 64852 - DNA, 27 bp, Artificial sequence
  SiRNA target sequence
tatttttaatgaatttaagtaccatac

SEQ ID NO: 64853 - DNA, 27 bp, Artificial sequence
  SiRNA target sequence
atttttaatgaatttaagtaccatact

SEQ ID NO: 64854 - DNA, 27 bp, Artificial sequence
  SiRNA target sequence
tttttaatgaatttaagtaccatactt

SEQ ID NO: 64855 - DNA, 27 bp, Artificial sequence
  SiRNA target sequence
ttttaatgaatttaagtaccatacttt

SEQ ID NO: 64856 - DNA, 27 bp, Artificial sequence
  SiRNA target sequence
tttaatgaatttaagtaccatactttt

SEQ ID NO: 64857 - DNA, 27 bp, Artificial sequence
  SiRNA target sequence
ttaatgaatttaagtaccatacttttg

SEQ ID NO: 64858 - DNA, 27 bp, Artificial sequence
  SiRNA target sequence
taatgaatttaagtaccatacttttgt

SEQ ID NO: 64859 - DNA, 27 bp, Artificial sequence
  SiRNA target sequence
aatgaatttaagtaccatacttttgta

SEQ ID NO: 64860 - DNA, 27 bp, Artificial sequence
  SiRNA target sequence
atgaatttaagtaccatacttttgtaa

SEQ ID NO: 64861 - DNA, 27 bp, Artificial sequence
  SiRNA target sequence
tgaatttaagtaccatacttttgtaat

SEQ ID NO: 64862 - DNA, 27 bp, Artificial sequence
  SiRNA target sequence
gaatttaagtaccatacttttgtaata

SEQ ID NO: 64863 - DNA, 27 bp, Artificial sequence
  SiRNA target sequence
aatttaagtaccatacttttgtaataa

SEQ ID NO: 64864 - DNA, 27 bp, Artificial sequence
  SiRNA target sequence
atttaagtaccatacttttgtaataat

SEQ ID NO: 64865 - DNA, 27 bp, Artificial sequence
  SiRNA target sequence
tttaagtaccatacttttgtaataatt

SEQ ID NO: 64866 - DNA, 27 bp, Artificial sequence
  SiRNA target sequence
ttaagtaccatacttttgtaataattg

SEQ ID NO: 64867 - DNA, 27 bp, Artificial sequence
  SiRNA target sequence
taagtaccatacttttgtaataattgt

SEQ ID NO: 64868 - DNA, 27 bp, Artificial sequence
  SiRNA target sequence
aagtaccatacttttgtaataattgta

SEQ ID NO: 64869 - DNA, 27 bp, Artificial sequence
  SiRNA target sequence
agtaccatacttttgtaataattgtac

SEQ ID NO: 64870 - DNA, 27 bp, Artificial sequence
  SiRNA target sequence
gtaccatacttttgtaataattgtaca

SEQ ID NO: 64871 - DNA, 27 bp, Artificial sequence
  SiRNA target sequence
taccatacttttgtaataattgtacac

SEQ ID NO: 64872 - DNA, 27 bp, Artificial sequence
  SiRNA target sequence
accatacttttgtaataattgtacaca

SEQ ID NO: 64873 - DNA, 27 bp, Artificial sequence
  SiRNA target sequence
ccatacttttgtaataattgtacacaa

SEQ ID NO: 64874 - DNA, 27 bp, Artificial sequence
  SiRNA target sequence
catacttttgtaataattgtacacaat

SEQ ID NO: 64875 - DNA, 27 bp, Artificial sequence
  SiRNA target sequence
atacttttgtaataattgtacacaatc

SEQ ID NO: 64876 - DNA, 27 bp, Artificial sequence
  SiRNA target sequence
tacttttgtaataattgtacacaatct

SEQ ID NO: 64877 - DNA, 27 bp, Artificial sequence
  SiRNA target sequence
acttttgtaataattgtacacaatcta

SEQ ID NO: 64878 - DNA, 27 bp, Artificial sequence
  SiRNA target sequence
cttttgtaataattgtacacaatctag

SEQ ID NO: 64879 - DNA, 27 bp, Artificial sequence
  SiRNA target sequence
ttttgtaataattgtacacaatctaga

SEQ ID NO: 64880 - DNA, 27 bp, Artificial sequence
  SiRNA target sequence
tttgtaataattgtacacaatctagaa

SEQ ID NO: 64881 - DNA, 27 bp, Artificial sequence
  SiRNA target sequence
ttgtaataattgtacacaatctagaat

SEQ ID NO: 64882 - DNA, 27 bp, Artificial sequence
  SiRNA target sequence
tgtaataattgtacacaatctagaatt

SEQ ID NO: 64883 - DNA, 27 bp, Artificial sequence
  SiRNA target sequence
gtaataattgtacacaatctagaatta

SEQ ID NO: 64884 - DNA, 27 bp, Artificial sequence
  SiRNA target sequence
taataattgtacacaatctagaattat

SEQ ID NO: 64885 - DNA, 27 bp, Artificial sequence
  SiRNA target sequence
aataattgtacacaatctagaattatt

SEQ ID NO: 64886 - DNA, 27 bp, Artificial sequence
  SiRNA target sequence
ataattgtacacaatctagaattattg

SEQ ID NO: 64887 - DNA, 27 bp, Artificial sequence
  SiRNA target sequence
taattgtacacaatctagaattattgg

SEQ ID NO: 64888 - DNA, 27 bp, Artificial sequence
  SiRNA target sequence
aattgtacacaatctagaattattggc

SEQ ID NO: 64889 - DNA, 27 bp, Artificial sequence
  SiRNA target sequence
attgtacacaatctagaattattggct

SEQ ID NO: 64890 - DNA, 27 bp, Artificial sequence
  SiRNA target sequence
ttgtacacaatctagaattattggctt

SEQ ID NO: 64891 - DNA, 27 bp, Artificial sequence
  SiRNA target sequence
tgtacacaatctagaattattggcttt

SEQ ID NO: 64892 - DNA, 27 bp, Artificial sequence
  SiRNA target sequence
gtacacaatctagaattattggctttg

SEQ ID NO: 64893 - DNA, 27 bp, Artificial sequence
  SiRNA target sequence
tacacaatctagaattattggctttgt

SEQ ID NO: 64894 - DNA, 27 bp, Artificial sequence
  SiRNA target sequence
acacaatctagaattattggctttgtt

SEQ ID NO: 64895 - DNA, 27 bp, Artificial sequence
  SiRNA target sequence
cacaatctagaattattggctttgttt

SEQ ID NO: 64896 - DNA, 27 bp, Artificial sequence
  SiRNA target sequence
acaatctagaattattggctttgtttg

SEQ ID NO: 64897 - DNA, 27 bp, Artificial sequence
  SiRNA target sequence
caatctagaattattggctttgtttga

SEQ ID NO: 64898 - DNA, 27 bp, Artificial sequence
  SiRNA target sequence
aatctagaattattggctttgtttgat

SEQ ID NO: 64899 - DNA, 27 bp, Artificial sequence
  SiRNA target sequence
atctagaattattggctttgtttgata

SEQ ID NO: 64900 - DNA, 27 bp, Artificial sequence
  SiRNA target sequence
tctagaattattggctttgtttgataa

SEQ ID NO: 64901 - DNA, 27 bp, Artificial sequence
  SiRNA target sequence
ctagaattattggctttgtttgataaa

SEQ ID NO: 64902 - DNA, 27 bp, Artificial sequence
  SiRNA target sequence
tagaattattggctttgtttgataaaa

SEQ ID NO: 64903 - DNA, 27 bp, Artificial sequence
  SiRNA target sequence
agaattattggctttgtttgataaaat

SEQ ID NO: 64904 - DNA, 27 bp, Artificial sequence
  SiRNA target sequence
gaattattggctttgtttgataaaatt

SEQ ID NO: 64905 - DNA, 27 bp, Artificial sequence
  SiRNA target sequence
aattattggctttgtttgataaaattt

SEQ ID NO: 64906 - DNA, 27 bp, Artificial sequence
  SiRNA target sequence
attattggctttgtttgataaaatttt

SEQ ID NO: 64907 - DNA, 27 bp, Artificial sequence
  SiRNA target sequence
ttattggctttgtttgataaaatttta

SEQ ID NO: 64908 - DNA, 27 bp, Artificial sequence
  SiRNA target sequence
tattggctttgtttgataaaattttat

SEQ ID NO: 64909 - DNA, 27 bp, Artificial sequence
  SiRNA target sequence
attggctttgtttgataaaattttatt

SEQ ID NO: 64910 - DNA, 27 bp, Artificial sequence
  SiRNA target sequence
ttggctttgtttgataaaattttattt

SEQ ID NO: 64911 - DNA, 27 bp, Artificial sequence
  SiRNA target sequence
tggctttgtttgataaaattttatttg

SEQ ID NO: 64912 - DNA, 27 bp, Artificial sequence
  SiRNA target sequence
ggctttgtttgataaaattttatttgt

SEQ ID NO: 64913 - DNA, 27 bp, Artificial sequence
  SiRNA target sequence
gctttgtttgataaaattttatttgta

SEQ ID NO: 64914 - DNA, 27 bp, Artificial sequence
  SiRNA target sequence
ctttgtttgataaaattttatttgtaa

SEQ ID NO: 64915 - DNA, 27 bp, Artificial sequence
  SiRNA target sequence
tttgtttgataaaattttatttgtaaa

SEQ ID NO: 64916 - DNA, 27 bp, Artificial sequence
  SiRNA target sequence
ttgtttgataaaattttatttgtaaat

SEQ ID NO: 64917 - DNA, 27 bp, Artificial sequence
  SiRNA target sequence
tgtttgataaaattttatttgtaaatg

SEQ ID NO: 64918 - DNA, 27 bp, Artificial sequence
  SiRNA target sequence
gtttgataaaattttatttgtaaatgg

SEQ ID NO: 64919 - DNA, 27 bp, Artificial sequence
  SiRNA target sequence
tttgataaaattttatttgtaaatggt

SEQ ID NO: 64920 - DNA, 27 bp, Artificial sequence
  SiRNA target sequence
ttgataaaattttatttgtaaatggta

SEQ ID NO: 64921 - DNA, 27 bp, Artificial sequence
  SiRNA target sequence
tgataaaattttatttgtaaatggtaa

SEQ ID NO: 64922 - DNA, 27 bp, Artificial sequence
  SiRNA target sequence
gataaaattttatttgtaaatggtaat

SEQ ID NO: 64923 - DNA, 27 bp, Artificial sequence
  SiRNA target sequence
ataaaattttatttgtaaatggtaatg

SEQ ID NO: 64924 - DNA, 27 bp, Artificial sequence
  SiRNA target sequence
taaaattttatttgtaaatggtaatga

SEQ ID NO: 64925 - DNA, 27 bp, Artificial sequence
  SiRNA target sequence
aaaattttatttgtaaatggtaatgag

SEQ ID NO: 64926 - DNA, 27 bp, Artificial sequence
  SiRNA target sequence
aaattttatttgtaaatggtaatgagg

SEQ ID NO: 64927 - DNA, 27 bp, Artificial sequence
  SiRNA target sequence
aattttatttgtaaatggtaatgaggt

SEQ ID NO: 64928 - DNA, 27 bp, Artificial sequence
  SiRNA target sequence
attttatttgtaaatggtaatgaggta

SEQ ID NO: 64929 - DNA, 27 bp, Artificial sequence
  SiRNA target sequence
ttttatttgtaaatggtaatgaggtaa

SEQ ID NO: 64930 - DNA, 27 bp, Artificial sequence
  SiRNA target sequence
tttatttgtaaatggtaatgaggtaac

SEQ ID NO: 64931 - DNA, 27 bp, Artificial sequence
  SiRNA target sequence
ttatttgtaaatggtaatgaggtaaca

SEQ ID NO: 64932 - DNA, 27 bp, Artificial sequence
  SiRNA target sequence
tatttgtaaatggtaatgaggtaacaa

SEQ ID NO: 64933 - DNA, 27 bp, Artificial sequence
  SiRNA target sequence
atttgtaaatggtaatgaggtaacaat

SEQ ID NO: 64934 - DNA, 27 bp, Artificial sequence
  SiRNA target sequence
tttgtaaatggtaatgaggtaacaatg

SEQ ID NO: 64935 - DNA, 27 bp, Artificial sequence
  SiRNA target sequence
ttgtaaatggtaatgaggtaacaatga

SEQ ID NO: 64936 - DNA, 27 bp, Artificial sequence
  SiRNA target sequence
tgtaaatggtaatgaggtaacaatgat

SEQ ID NO: 64937 - DNA, 27 bp, Artificial sequence
  SiRNA target sequence
gtaaatggtaatgaggtaacaatgata

SEQ ID NO: 64938 - DNA, 27 bp, Artificial sequence
  SiRNA target sequence
taaatggtaatgaggtaacaatgatag

SEQ ID NO: 64939 - DNA, 27 bp, Artificial sequence
  SiRNA target sequence
aaatggtaatgaggtaacaatgataga

SEQ ID NO: 64940 - DNA, 27 bp, Artificial sequence
  SiRNA target sequence
aatggtaatgaggtaacaatgatagaa

SEQ ID NO: 64941 - DNA, 27 bp, Artificial sequence
  SiRNA target sequence
atggtaatgaggtaacaatgatagaag

SEQ ID NO: 64942 - DNA, 27 bp, Artificial sequence
  SiRNA target sequence
tggtaatgaggtaacaatgatagaaga

SEQ ID NO: 64943 - DNA, 27 bp, Artificial sequence
  SiRNA target sequence
ggtaatgaggtaacaatgatagaagac

SEQ ID NO: 64944 - DNA, 27 bp, Artificial sequence
  SiRNA target sequence
gtaatgaggtaacaatgatagaagaca

SEQ ID NO: 64945 - DNA, 27 bp, Artificial sequence
  SiRNA target sequence
taatgaggtaacaatgatagaagacat

SEQ ID NO: 64946 - DNA, 27 bp, Artificial sequence
  SiRNA target sequence
aatgaggtaacaatgatagaagacatt

SEQ ID NO: 64947 - DNA, 27 bp, Artificial sequence
  SiRNA target sequence
atgaggtaacaatgatagaagacatta

SEQ ID NO: 64948 - DNA, 27 bp, Artificial sequence
  SiRNA target sequence
tgaggtaacaatgatagaagacattaa

SEQ ID NO: 64949 - DNA, 27 bp, Artificial sequence
  SiRNA target sequence
gaggtaacaatgatagaagacattaac

SEQ ID NO: 64950 - DNA, 27 bp, Artificial sequence
  SiRNA target sequence
aggtaacaatgatagaagacattaaca

SEQ ID NO: 64951 - DNA, 27 bp, Artificial sequence
  SiRNA target sequence
ggtaacaatgatagaagacattaacaa

SEQ ID NO: 64952 - DNA, 27 bp, Artificial sequence
  SiRNA target sequence
gtaacaatgatagaagacattaacaaa

SEQ ID NO: 64953 - DNA, 27 bp, Artificial sequence
  SiRNA target sequence
taacaatgatagaagacattaacaaaa

SEQ ID NO: 64954 - DNA, 27 bp, Artificial sequence
  SiRNA target sequence
aacaatgatagaagacattaacaaaaa

SEQ ID NO: 64955 - DNA, 27 bp, Artificial sequence
  SiRNA target sequence
acaatgatagaagacattaacaaaaaa

SEQ ID NO: 64956 - DNA, 27 bp, Artificial sequence
  SiRNA target sequence
caatgatagaagacattaacaaaaaac

SEQ ID NO: 64957 - DNA, 27 bp, Artificial sequence
  SiRNA target sequence
aatgatagaagacattaacaaaaaact

SEQ ID NO: 64958 - DNA, 27 bp, Artificial sequence
  SiRNA target sequence
atgatagaagacattaacaaaaaactt

SEQ ID NO: 64959 - DNA, 27 bp, Artificial sequence
  SiRNA target sequence
tgatagaagacattaacaaaaaacttg

SEQ ID NO: 64960 - DNA, 27 bp, Artificial sequence
  SiRNA target sequence
gatagaagacattaacaaaaaacttga

SEQ ID NO: 64961 - DNA, 27 bp, Artificial sequence
  SiRNA target sequence
atagaagacattaacaaaaaacttgaa

SEQ ID NO: 64962 - DNA, 27 bp, Artificial sequence
  SiRNA target sequence
tagaagacattaacaaaaaacttgaag

SEQ ID NO: 64963 - DNA, 27 bp, Artificial sequence
  SiRNA target sequence
agaagacattaacaaaaaacttgaaga

SEQ ID NO: 64964 - DNA, 27 bp, Artificial sequence
  SiRNA target sequence
gaagacattaacaaaaaacttgaagaa

SEQ ID NO: 64965 - DNA, 27 bp, Artificial sequence
  SiRNA target sequence
aagacattaacaaaaaacttgaagaaa

SEQ ID NO: 64966 - DNA, 27 bp, Artificial sequence
  SiRNA target sequence
agacattaacaaaaaacttgaagaaaa

SEQ ID NO: 64967 - DNA, 27 bp, Artificial sequence
  SiRNA target sequence
gacattaacaaaaaacttgaagaaaat

SEQ ID NO: 64968 - DNA, 27 bp, Artificial sequence
  SiRNA target sequence
acattaacaaaaaacttgaagaaaatt

SEQ ID NO: 64969 - DNA, 27 bp, Artificial sequence
  SiRNA target sequence
cattaacaaaaaacttgaagaaaattc

SEQ ID NO: 64970 - DNA, 27 bp, Artificial sequence
  SiRNA target sequence
attaacaaaaaacttgaagaaaattca

SEQ ID NO: 64971 - DNA, 27 bp, Artificial sequence
  SiRNA target sequence
ttaacaaaaaacttgaagaaaattcaa

SEQ ID NO: 64972 - DNA, 27 bp, Artificial sequence
  SiRNA target sequence
taacaaaaaacttgaagaaaattcaaa

SEQ ID NO: 64973 - DNA, 27 bp, Artificial sequence
  SiRNA target sequence
aacaaaaaacttgaagaaaattcaaag

SEQ ID NO: 64974 - DNA, 27 bp, Artificial sequence
  SiRNA target sequence
acaaaaaacttgaagaaaattcaaagt

SEQ ID NO: 64975 - DNA, 27 bp, Artificial sequence
  SiRNA target sequence
caaaaaacttgaagaaaattcaaagta

SEQ ID NO: 64976 - DNA, 27 bp, Artificial sequence
  SiRNA target sequence
aaaaaacttgaagaaaattcaaagtat

SEQ ID NO: 64977 - DNA, 27 bp, Artificial sequence
  SiRNA target sequence
aaaaacttgaagaaaattcaaagtatt

SEQ ID NO: 64978 - DNA, 27 bp, Artificial sequence
  SiRNA target sequence
aaaacttgaagaaaattcaaagtattt

SEQ ID NO: 64979 - DNA, 27 bp, Artificial sequence
  SiRNA target sequence
aaacttgaagaaaattcaaagtatttt

SEQ ID NO: 64980 - DNA, 27 bp, Artificial sequence
  SiRNA target sequence
aacttgaagaaaattcaaagtattttg

SEQ ID NO: 64981 - DNA, 27 bp, Artificial sequence
  SiRNA target sequence
acttgaagaaaattcaaagtattttgc

SEQ ID NO: 64982 - DNA, 27 bp, Artificial sequence
  SiRNA target sequence
cttgaagaaaattcaaagtattttgca

SEQ ID NO: 64983 - DNA, 27 bp, Artificial sequence
  SiRNA target sequence
ttgaagaaaattcaaagtattttgcag

SEQ ID NO: 64984 - DNA, 27 bp, Artificial sequence
  SiRNA target sequence
tgaagaaaattcaaagtattttgcaga

SEQ ID NO: 64985 - DNA, 27 bp, Artificial sequence
  SiRNA target sequence
gaagaaaattcaaagtattttgcagat

SEQ ID NO: 64986 - DNA, 27 bp, Artificial sequence
  SiRNA target sequence
aagaaaattcaaagtattttgcagata

SEQ ID NO: 64987 - DNA, 27 bp, Artificial sequence
  SiRNA target sequence
agaaaattcaaagtattttgcagatat

SEQ ID NO: 64988 - DNA, 27 bp, Artificial sequence
  SiRNA target sequence
gaaaattcaaagtattttgcagatatt

SEQ ID NO: 64989 - DNA, 27 bp, Artificial sequence
  SiRNA target sequence
aaaattcaaagtattttgcagatattt

SEQ ID NO: 64990 - DNA, 27 bp, Artificial sequence
  SiRNA target sequence
aaattcaaagtattttgcagatatttt

SEQ ID NO: 64991 - DNA, 27 bp, Artificial sequence
  SiRNA target sequence
aattcaaagtattttgcagatatttta

SEQ ID NO: 64992 - DNA, 27 bp, Artificial sequence
  SiRNA target sequence
attcaaagtattttgcagatattttaa

SEQ ID NO: 64993 - DNA, 27 bp, Artificial sequence
  SiRNA target sequence
ttcaaagtattttgcagatattttaaa

SEQ ID NO: 64994 - DNA, 27 bp, Artificial sequence
  SiRNA target sequence
tcaaagtattttgcagatattttaaac

SEQ ID NO: 64995 - DNA, 27 bp, Artificial sequence
  SiRNA target sequence
caaagtattttgcagatattttaaaca

SEQ ID NO: 64996 - DNA, 27 bp, Artificial sequence
  SiRNA target sequence
aaagtattttgcagatattttaaacaa

SEQ ID NO: 64997 - DNA, 27 bp, Artificial sequence
  SiRNA target sequence
aagtattttgcagatattttaaacaac

SEQ ID NO: 64998 - DNA, 27 bp, Artificial sequence
  SiRNA target sequence
agtattttgcagatattttaaacaacg

SEQ ID NO: 64999 - DNA, 27 bp, Artificial sequence
  SiRNA target sequence
gtattttgcagatattttaaacaacga

SEQ ID NO: 65000 - DNA, 27 bp, Artificial sequence
  SiRNA target sequence
tattttgcagatattttaaacaacgaa

SEQ ID NO: 65001 - DNA, 27 bp, Artificial sequence
  SiRNA target sequence
attttgcagatattttaaacaacgaat

SEQ ID NO: 65002 - DNA, 27 bp, Artificial sequence
  SiRNA target sequence
ttttgcagatattttaaacaacgaata

SEQ ID NO: 65003 - DNA, 27 bp, Artificial sequence
  SiRNA target sequence
tttgcagatattttaaacaacgaataa

SEQ ID NO: 65004 - DNA, 19 bp, Artificial sequence
  SiRNA target sequence
atgaaaaaaatttcgaata

SEQ ID NO: 65005 - DNA, 19 bp, Artificial sequence
  SiRNA target sequence
tgaaaaaaatttcgaatag

SEQ ID NO: 65006 - DNA, 19 bp, Artificial sequence
  SiRNA target sequence
gaaaaaaatttcgaataga

SEQ ID NO: 65007 - DNA, 19 bp, Artificial sequence
  SiRNA target sequence
aaaaaaatttcgaatagaa

SEQ ID NO: 65008 - DNA, 19 bp, Artificial sequence
  SiRNA target sequence
aaaaaatttcgaatagaaa

SEQ ID NO: 65009 - DNA, 19 bp, Artificial sequence
  SiRNA target sequence
aaaaatttcgaatagaaaa

SEQ ID NO: 65010 - DNA, 19 bp, Artificial sequence
  SiRNA target sequence
aaaatttcgaatagaaaaa

SEQ ID NO: 65011 - DNA, 19 bp, Artificial sequence
  SiRNA target sequence
aaatttcgaatagaaaaat

SEQ ID NO: 65012 - DNA, 19 bp, Artificial sequence
  SiRNA target sequence
aatttcgaatagaaaaatt

SEQ ID NO: 65013 - DNA, 19 bp, Artificial sequence
  SiRNA target sequence
atttcgaatagaaaaatta

SEQ ID NO: 65014 - DNA, 19 bp, Artificial sequence
  SiRNA target sequence
tttcgaatagaaaaattat

SEQ ID NO: 65015 - DNA, 19 bp, Artificial sequence
  SiRNA target sequence
ttcgaatagaaaaattatc

SEQ ID NO: 65016 - DNA, 19 bp, Artificial sequence
  SiRNA target sequence
tcgaatagaaaaattatca

SEQ ID NO: 65017 - DNA, 19 bp, Artificial sequence
  SiRNA target sequence
cgaatagaaaaattatcaa

SEQ ID NO: 65018 - DNA, 19 bp, Artificial sequence
  SiRNA target sequence
gaatagaaaaattatcaaa

SEQ ID NO: 65019 - DNA, 19 bp, Artificial sequence
  SiRNA target sequence
aatagaaaaattatcaaag

SEQ ID NO: 65020 - DNA, 19 bp, Artificial sequence
  SiRNA target sequence
atagaaaaattatcaaaga

SEQ ID NO: 65021 - DNA, 19 bp, Artificial sequence
  SiRNA target sequence
tagaaaaattatcaaagaa

SEQ ID NO: 65022 - DNA, 19 bp, Artificial sequence
  SiRNA target sequence
agaaaaattatcaaagaaa

SEQ ID NO: 65023 - DNA, 19 bp, Artificial sequence
  SiRNA target sequence
gaaaaattatcaaagaaat

SEQ ID NO: 65024 - DNA, 19 bp, Artificial sequence
  SiRNA target sequence
aaaaattatcaaagaaatt

SEQ ID NO: 65025 - DNA, 19 bp, Artificial sequence
  SiRNA target sequence
aaaattatcaaagaaatta

SEQ ID NO: 65026 - DNA, 19 bp, Artificial sequence
  SiRNA target sequence
aaattatcaaagaaattat

SEQ ID NO: 65027 - DNA, 19 bp, Artificial sequence
  SiRNA target sequence
aattatcaaagaaattatt

SEQ ID NO: 65028 - DNA, 19 bp, Artificial sequence
  SiRNA target sequence
attatcaaagaaattattt

SEQ ID NO: 65029 - DNA, 19 bp, Artificial sequence
  SiRNA target sequence
ttatcaaagaaattattta

SEQ ID NO: 65030 - DNA, 19 bp, Artificial sequence
  SiRNA target sequence
tatcaaagaaattatttac

SEQ ID NO: 65031 - DNA, 19 bp, Artificial sequence
  SiRNA target sequence
atcaaagaaattatttaca

SEQ ID NO: 65032 - DNA, 19 bp, Artificial sequence
  SiRNA target sequence
tcaaagaaattatttacaa

SEQ ID NO: 65033 - DNA, 19 bp, Artificial sequence
  SiRNA target sequence
caaagaaattatttacaat

SEQ ID NO: 65034 - DNA, 19 bp, Artificial sequence
  SiRNA target sequence
aaagaaattatttacaatg

SEQ ID NO: 65035 - DNA, 19 bp, Artificial sequence
  SiRNA target sequence
aagaaattatttacaatga

SEQ ID NO: 65036 - DNA, 19 bp, Artificial sequence
  SiRNA target sequence
agaaattatttacaatgat

SEQ ID NO: 65037 - DNA, 19 bp, Artificial sequence
  SiRNA target sequence
gaaattatttacaatgatt

SEQ ID NO: 65038 - DNA, 19 bp, Artificial sequence
  SiRNA target sequence
aaattatttacaatgattt

SEQ ID NO: 65039 - DNA, 19 bp, Artificial sequence
  SiRNA target sequence
aattatttacaatgattta

SEQ ID NO: 65040 - DNA, 19 bp, Artificial sequence
  SiRNA target sequence
attatttacaatgatttat

SEQ ID NO: 65041 - DNA, 19 bp, Artificial sequence
  SiRNA target sequence
ttatttacaatgatttatt

SEQ ID NO: 65042 - DNA, 19 bp, Artificial sequence
  SiRNA target sequence
tatttacaatgatttatta

SEQ ID NO: 65043 - DNA, 19 bp, Artificial sequence
  SiRNA target sequence
atttacaatgatttattaa

SEQ ID NO: 65044 - DNA, 19 bp, Artificial sequence
  SiRNA target sequence
tttacaatgatttattaaa

SEQ ID NO: 65045 - DNA, 19 bp, Artificial sequence
  SiRNA target sequence
ttacaatgatttattaaaa

SEQ ID NO: 65046 - DNA, 19 bp, Artificial sequence
  SiRNA target sequence
tacaatgatttattaaaaa

SEQ ID NO: 65047 - DNA, 19 bp, Artificial sequence
  SiRNA target sequence
acaatgatttattaaaaat

SEQ ID NO: 65048 - DNA, 19 bp, Artificial sequence
  SiRNA target sequence
caatgatttattaaaaata

SEQ ID NO: 65049 - DNA, 19 bp, Artificial sequence
  SiRNA target sequence
aatgatttattaaaaataa

SEQ ID NO: 65050 - DNA, 19 bp, Artificial sequence
  SiRNA target sequence
atgatttattaaaaataag

SEQ ID NO: 65051 - DNA, 19 bp, Artificial sequence
  SiRNA target sequence
tgatttattaaaaataaga

SEQ ID NO: 65052 - DNA, 19 bp, Artificial sequence
  SiRNA target sequence
gatttattaaaaataagaa

SEQ ID NO: 65053 - DNA, 19 bp, Artificial sequence
  SiRNA target sequence
atttattaaaaataagaat

SEQ ID NO: 65054 - DNA, 19 bp, Artificial sequence
  SiRNA target sequence
tttattaaaaataagaatg

SEQ ID NO: 65055 - DNA, 19 bp, Artificial sequence
  SiRNA target sequence
ttattaaaaataagaatgt

SEQ ID NO: 65056 - DNA, 19 bp, Artificial sequence
  SiRNA target sequence
tattaaaaataagaatgtt

SEQ ID NO: 65057 - DNA, 19 bp, Artificial sequence
  SiRNA target sequence
attaaaaataagaatgttg

SEQ ID NO: 65058 - DNA, 19 bp, Artificial sequence
  SiRNA target sequence
ttaaaaataagaatgttgc

SEQ ID NO: 65059 - DNA, 19 bp, Artificial sequence
  SiRNA target sequence
taaaaataagaatgttgcg

SEQ ID NO: 65060 - DNA, 19 bp, Artificial sequence
  SiRNA target sequence
aaaaataagaatgttgcga

SEQ ID NO: 65061 - DNA, 19 bp, Artificial sequence
  SiRNA target sequence
aaaataagaatgttgcgat

SEQ ID NO: 65062 - DNA, 19 bp, Artificial sequence
  SiRNA target sequence
aaataagaatgttgcgata

SEQ ID NO: 65063 - DNA, 19 bp, Artificial sequence
  SiRNA target sequence
aataagaatgttgcgatat

SEQ ID NO: 65064 - DNA, 19 bp, Artificial sequence
  SiRNA target sequence
ataagaatgttgcgatatg

SEQ ID NO: 65065 - DNA, 19 bp, Artificial sequence
  SiRNA target sequence
taagaatgttgcgatatgt

SEQ ID NO: 65066 - DNA, 19 bp, Artificial sequence
  SiRNA target sequence
aagaatgttgcgatatgtt

SEQ ID NO: 65067 - DNA, 19 bp, Artificial sequence
  SiRNA target sequence
agaatgttgcgatatgtta

SEQ ID NO: 65068 - DNA, 19 bp, Artificial sequence
  SiRNA target sequence
gaatgttgcgatatgttat

SEQ ID NO: 65069 - DNA, 19 bp, Artificial sequence
  SiRNA target sequence
aatgttgcgatatgttatt

SEQ ID NO: 65070 - DNA, 19 bp, Artificial sequence
  SiRNA target sequence
atgttgcgatatgttattg

SEQ ID NO: 65071 - DNA, 19 bp, Artificial sequence
  SiRNA target sequence
tgttgcgatatgttattgt

SEQ ID NO: 65072 - DNA, 19 bp, Artificial sequence
  SiRNA target sequence
gttgcgatatgttattgta

SEQ ID NO: 65073 - DNA, 19 bp, Artificial sequence
  SiRNA target sequence
ttgcgatatgttattgtac

SEQ ID NO: 65074 - DNA, 19 bp, Artificial sequence
  SiRNA target sequence
tgcgatatgttattgtacc

SEQ ID NO: 65075 - DNA, 19 bp, Artificial sequence
  SiRNA target sequence
gcgatatgttattgtacca

SEQ ID NO: 65076 - DNA, 19 bp, Artificial sequence
  SiRNA target sequence
cgatatgttattgtaccaa

SEQ ID NO: 65077 - DNA, 19 bp, Artificial sequence
  SiRNA target sequence
gatatgttattgtaccaat

SEQ ID NO: 65078 - DNA, 19 bp, Artificial sequence
  SiRNA target sequence
atatgttattgtaccaata

SEQ ID NO: 65079 - DNA, 19 bp, Artificial sequence
  SiRNA target sequence
tatgttattgtaccaataa

SEQ ID NO: 65080 - DNA, 19 bp, Artificial sequence
  SiRNA target sequence
atgttattgtaccaataat

SEQ ID NO: 65081 - DNA, 19 bp, Artificial sequence
  SiRNA target sequence
tgttattgtaccaataata

SEQ ID NO: 65082 - DNA, 19 bp, Artificial sequence
  SiRNA target sequence
gttattgtaccaataatat

SEQ ID NO: 65083 - DNA, 19 bp, Artificial sequence
  SiRNA target sequence
ttattgtaccaataatatt

SEQ ID NO: 65084 - DNA, 19 bp, Artificial sequence
  SiRNA target sequence
tattgtaccaataatattt

SEQ ID NO: 65085 - DNA, 19 bp, Artificial sequence
  SiRNA target sequence
attgtaccaataatatttt

SEQ ID NO: 65086 - DNA, 19 bp, Artificial sequence
  SiRNA target sequence
ttgtaccaataatattttt

SEQ ID NO: 65087 - DNA, 19 bp, Artificial sequence
  SiRNA target sequence
tgtaccaataatattttta

SEQ ID NO: 65088 - DNA, 19 bp, Artificial sequence
  SiRNA target sequence
gtaccaataatatttttaa

SEQ ID NO: 65089 - DNA, 19 bp, Artificial sequence
  SiRNA target sequence
taccaataatatttttaac

SEQ ID NO: 65090 - DNA, 19 bp, Artificial sequence
  SiRNA target sequence
accaataatatttttaact

SEQ ID NO: 65091 - DNA, 19 bp, Artificial sequence
  SiRNA target sequence
ccaataatatttttaacta

SEQ ID NO: 65092 - DNA, 19 bp, Artificial sequence
  SiRNA target sequence
caataatatttttaactat

SEQ ID NO: 65093 - DNA, 19 bp, Artificial sequence
  SiRNA target sequence
aataatatttttaactata

SEQ ID NO: 65094 - DNA, 19 bp, Artificial sequence
  SiRNA target sequence
ataatatttttaactatat

SEQ ID NO: 65095 - DNA, 19 bp, Artificial sequence
  SiRNA target sequence
taatatttttaactatatt

SEQ ID NO: 65096 - DNA, 19 bp, Artificial sequence
  SiRNA target sequence
aatatttttaactatattt

SEQ ID NO: 65097 - DNA, 19 bp, Artificial sequence
  SiRNA target sequence
atatttttaactatatttt

SEQ ID NO: 65098 - DNA, 19 bp, Artificial sequence
  SiRNA target sequence
tatttttaactatatttta

SEQ ID NO: 65099 - DNA, 19 bp, Artificial sequence
  SiRNA target sequence
atttttaactatattttac

SEQ ID NO: 65100 - DNA, 19 bp, Artificial sequence
  SiRNA target sequence
tttttaactatattttaca

SEQ ID NO: 65101 - DNA, 19 bp, Artificial sequence
  SiRNA target sequence
ttttaactatattttacac

SEQ ID NO: 65102 - DNA, 19 bp, Artificial sequence
  SiRNA target sequence
tttaactatattttacact

SEQ ID NO: 65103 - DNA, 19 bp, Artificial sequence
  SiRNA target sequence
ttaactatattttacactg

SEQ ID NO: 65104 - DNA, 19 bp, Artificial sequence
  SiRNA target sequence
taactatattttacactgt

SEQ ID NO: 65105 - DNA, 19 bp, Artificial sequence
  SiRNA target sequence
aactatattttacactgtt

SEQ ID NO: 65106 - DNA, 19 bp, Artificial sequence
  SiRNA target sequence
actatattttacactgttt

SEQ ID NO: 65107 - DNA, 19 bp, Artificial sequence
  SiRNA target sequence
ctatattttacactgtttt

SEQ ID NO: 65108 - DNA, 19 bp, Artificial sequence
  SiRNA target sequence
tatattttacactgtttta

SEQ ID NO: 65109 - DNA, 19 bp, Artificial sequence
  SiRNA target sequence
atattttacactgttttag

SEQ ID NO: 65110 - DNA, 19 bp, Artificial sequence
  SiRNA target sequence
tattttacactgttttaga

SEQ ID NO: 65111 - DNA, 19 bp, Artificial sequence
  SiRNA target sequence
attttacactgttttagag

SEQ ID NO: 65112 - DNA, 19 bp, Artificial sequence
  SiRNA target sequence
ttttacactgttttagaga

SEQ ID NO: 65113 - DNA, 19 bp, Artificial sequence
  SiRNA target sequence
tttacactgttttagagat

SEQ ID NO: 65114 - DNA, 19 bp, Artificial sequence
  SiRNA target sequence
ttacactgttttagagata

SEQ ID NO: 65115 - DNA, 19 bp, Artificial sequence
  SiRNA target sequence
tacactgttttagagataa

SEQ ID NO: 65116 - DNA, 19 bp, Artificial sequence
  SiRNA target sequence
acactgttttagagataaa

SEQ ID NO: 65117 - DNA, 19 bp, Artificial sequence
  SiRNA target sequence
cactgttttagagataaaa

SEQ ID NO: 65118 - DNA, 19 bp, Artificial sequence
  SiRNA target sequence
actgttttagagataaaaa

SEQ ID NO: 65119 - DNA, 19 bp, Artificial sequence
  SiRNA target sequence
ctgttttagagataaaaat

SEQ ID NO: 65120 - DNA, 19 bp, Artificial sequence
  SiRNA target sequence
tgttttagagataaaaata

SEQ ID NO: 65121 - DNA, 19 bp, Artificial sequence
  SiRNA target sequence
gttttagagataaaaataa

SEQ ID NO: 65122 - DNA, 19 bp, Artificial sequence
  SiRNA target sequence
ttttagagataaaaataag

SEQ ID NO: 65123 - DNA, 19 bp, Artificial sequence
  SiRNA target sequence
tttagagataaaaataagt

SEQ ID NO: 65124 - DNA, 19 bp, Artificial sequence
  SiRNA target sequence
ttagagataaaaataagta

SEQ ID NO: 65125 - DNA, 19 bp, Artificial sequence
  SiRNA target sequence
tagagataaaaataagtac

SEQ ID NO: 65126 - DNA, 19 bp, Artificial sequence
  SiRNA target sequence
agagataaaaataagtaca

SEQ ID NO: 65127 - DNA, 19 bp, Artificial sequence
  SiRNA target sequence
gagataaaaataagtacat

SEQ ID NO: 65128 - DNA, 19 bp, Artificial sequence
  SiRNA target sequence
agataaaaataagtacatt

SEQ ID NO: 65129 - DNA, 19 bp, Artificial sequence
  SiRNA target sequence
gataaaaataagtacatta

SEQ ID NO: 65130 - DNA, 19 bp, Artificial sequence
  SiRNA target sequence
ataaaaataagtacattag

SEQ ID NO: 65131 - DNA, 19 bp, Artificial sequence
  SiRNA target sequence
taaaaataagtacattagt

SEQ ID NO: 65132 - DNA, 19 bp, Artificial sequence
  SiRNA target sequence
aaaaataagtacattagta

SEQ ID NO: 65133 - DNA, 19 bp, Artificial sequence
  SiRNA target sequence
aaaataagtacattagtaa

SEQ ID NO: 65134 - DNA, 19 bp, Artificial sequence
  SiRNA target sequence
aaataagtacattagtaaa

SEQ ID NO: 65135 - DNA, 19 bp, Artificial sequence
  SiRNA target sequence
aataagtacattagtaaag

SEQ ID NO: 65136 - DNA, 19 bp, Artificial sequence
  SiRNA target sequence
ataagtacattagtaaaga

SEQ ID NO: 65137 - DNA, 19 bp, Artificial sequence
  SiRNA target sequence
taagtacattagtaaagaa

SEQ ID NO: 65138 - DNA, 19 bp, Artificial sequence
  SiRNA target sequence
aagtacattagtaaagaat

SEQ ID NO: 65139 - DNA, 19 bp, Artificial sequence
  SiRNA target sequence
agtacattagtaaagaatc

SEQ ID NO: 65140 - DNA, 19 bp, Artificial sequence
  SiRNA target sequence
gtacattagtaaagaatct

SEQ ID NO: 65141 - DNA, 19 bp, Artificial sequence
  SiRNA target sequence
tacattagtaaagaatctt

SEQ ID NO: 65142 - DNA, 19 bp, Artificial sequence
  SiRNA target sequence
acattagtaaagaatctta

SEQ ID NO: 65143 - DNA, 19 bp, Artificial sequence
  SiRNA target sequence
cattagtaaagaatcttaa

SEQ ID NO: 65144 - DNA, 19 bp, Artificial sequence
  SiRNA target sequence
attagtaaagaatcttaat

SEQ ID NO: 65145 - DNA, 19 bp, Artificial sequence
  SiRNA target sequence
ttagtaaagaatcttaatc

SEQ ID NO: 65146 - DNA, 19 bp, Artificial sequence
  SiRNA target sequence
tagtaaagaatcttaatca

SEQ ID NO: 65147 - DNA, 19 bp, Artificial sequence
  SiRNA target sequence
agtaaagaatcttaatcaa

SEQ ID NO: 65148 - DNA, 19 bp, Artificial sequence
  SiRNA target sequence
gtaaagaatcttaatcaat

SEQ ID NO: 65149 - DNA, 19 bp, Artificial sequence
  SiRNA target sequence
taaagaatcttaatcaatc

SEQ ID NO: 65150 - DNA, 19 bp, Artificial sequence
  SiRNA target sequence
aaagaatcttaatcaatct

SEQ ID NO: 65151 - DNA, 19 bp, Artificial sequence
  SiRNA target sequence
aagaatcttaatcaatcta

SEQ ID NO: 65152 - DNA, 19 bp, Artificial sequence
  SiRNA target sequence
agaatcttaatcaatctat

SEQ ID NO: 65153 - DNA, 19 bp, Artificial sequence
  SiRNA target sequence
gaatcttaatcaatctatc

SEQ ID NO: 65154 - DNA, 19 bp, Artificial sequence
  SiRNA target sequence
aatcttaatcaatctatcg

SEQ ID NO: 65155 - DNA, 19 bp, Artificial sequence
  SiRNA target sequence
atcttaatcaatctatcgc

SEQ ID NO: 65156 - DNA, 19 bp, Artificial sequence
  SiRNA target sequence
tcttaatcaatctatcgca

SEQ ID NO: 65157 - DNA, 19 bp, Artificial sequence
  SiRNA target sequence
cttaatcaatctatcgcaa

SEQ ID NO: 65158 - DNA, 19 bp, Artificial sequence
  SiRNA target sequence
ttaatcaatctatcgcaaa

SEQ ID NO: 65159 - DNA, 19 bp, Artificial sequence
  SiRNA target sequence
taatcaatctatcgcaaat

SEQ ID NO: 65160 - DNA, 19 bp, Artificial sequence
  SiRNA target sequence
aatcaatctatcgcaaatc

SEQ ID NO: 65161 - DNA, 19 bp, Artificial sequence
  SiRNA target sequence
atcaatctatcgcaaatcg

SEQ ID NO: 65162 - DNA, 19 bp, Artificial sequence
  SiRNA target sequence
tcaatctatcgcaaatcga

SEQ ID NO: 65163 - DNA, 19 bp, Artificial sequence
  SiRNA target sequence
caatctatcgcaaatcgaa

SEQ ID NO: 65164 - DNA, 19 bp, Artificial sequence
  SiRNA target sequence
aatctatcgcaaatcgaaa

SEQ ID NO: 65165 - DNA, 19 bp, Artificial sequence
  SiRNA target sequence
atctatcgcaaatcgaaaa

SEQ ID NO: 65166 - DNA, 19 bp, Artificial sequence
  SiRNA target sequence
tctatcgcaaatcgaaaag

SEQ ID NO: 65167 - DNA, 19 bp, Artificial sequence
  SiRNA target sequence
ctatcgcaaatcgaaaagg

SEQ ID NO: 65168 - DNA, 19 bp, Artificial sequence
  SiRNA target sequence
tatcgcaaatcgaaaaggt

SEQ ID NO: 65169 - DNA, 19 bp, Artificial sequence
  SiRNA target sequence
atcgcaaatcgaaaaggtg

SEQ ID NO: 65170 - DNA, 19 bp, Artificial sequence
  SiRNA target sequence
tcgcaaatcgaaaaggtga

SEQ ID NO: 65171 - DNA, 19 bp, Artificial sequence
  SiRNA target sequence
cgcaaatcgaaaaggtgaa

SEQ ID NO: 65172 - DNA, 19 bp, Artificial sequence
  SiRNA target sequence
gcaaatcgaaaaggtgaac

SEQ ID NO: 65173 - DNA, 19 bp, Artificial sequence
  SiRNA target sequence
caaatcgaaaaggtgaaca

SEQ ID NO: 65174 - DNA, 19 bp, Artificial sequence
  SiRNA target sequence
aaatcgaaaaggtgaacac

SEQ ID NO: 65175 - DNA, 19 bp, Artificial sequence
  SiRNA target sequence
aatcgaaaaggtgaacaca

SEQ ID NO: 65176 - DNA, 19 bp, Artificial sequence
  SiRNA target sequence
atcgaaaaggtgaacacac

SEQ ID NO: 65177 - DNA, 19 bp, Artificial sequence
  SiRNA target sequence
tcgaaaaggtgaacacaca

SEQ ID NO: 65178 - DNA, 19 bp, Artificial sequence
  SiRNA target sequence
cgaaaaggtgaacacacag

SEQ ID NO: 65179 - DNA, 19 bp, Artificial sequence
  SiRNA target sequence
gaaaaggtgaacacacagc

SEQ ID NO: 65180 - DNA, 19 bp, Artificial sequence
  SiRNA target sequence
aaaaggtgaacacacagca

SEQ ID NO: 65181 - DNA, 19 bp, Artificial sequence
  SiRNA target sequence
aaaggtgaacacacagcac

SEQ ID NO: 65182 - DNA, 19 bp, Artificial sequence
  SiRNA target sequence
aaggtgaacacacagcact

SEQ ID NO: 65183 - DNA, 19 bp, Artificial sequence
  SiRNA target sequence
aggtgaacacacagcactt

SEQ ID NO: 65184 - DNA, 19 bp, Artificial sequence
  SiRNA target sequence
ggtgaacacacagcacttg

SEQ ID NO: 65185 - DNA, 19 bp, Artificial sequence
  SiRNA target sequence
gtgaacacacagcacttga

SEQ ID NO: 65186 - DNA, 19 bp, Artificial sequence
  SiRNA target sequence
tgaacacacagcacttgaa

SEQ ID NO: 65187 - DNA, 19 bp, Artificial sequence
  SiRNA target sequence
gaacacacagcacttgaaa

SEQ ID NO: 65188 - DNA, 19 bp, Artificial sequence
  SiRNA target sequence
aacacacagcacttgaaag

SEQ ID NO: 65189 - DNA, 19 bp, Artificial sequence
  SiRNA target sequence
acacacagcacttgaaaga

SEQ ID NO: 65190 - DNA, 19 bp, Artificial sequence
  SiRNA target sequence
cacacagcacttgaaagat

SEQ ID NO: 65191 - DNA, 19 bp, Artificial sequence
  SiRNA target sequence
acacagcacttgaaagatt

SEQ ID NO: 65192 - DNA, 19 bp, Artificial sequence
  SiRNA target sequence
cacagcacttgaaagattt

SEQ ID NO: 65193 - DNA, 19 bp, Artificial sequence
  SiRNA target sequence
acagcacttgaaagatttg

SEQ ID NO: 65194 - DNA, 19 bp, Artificial sequence
  SiRNA target sequence
cagcacttgaaagatttgt

SEQ ID NO: 65195 - DNA, 19 bp, Artificial sequence
  SiRNA target sequence
agcacttgaaagatttgtg

SEQ ID NO: 65196 - DNA, 19 bp, Artificial sequence
  SiRNA target sequence
gcacttgaaagatttgtgt

SEQ ID NO: 65197 - DNA, 19 bp, Artificial sequence
  SiRNA target sequence
cacttgaaagatttgtgtt

SEQ ID NO: 65198 - DNA, 19 bp, Artificial sequence
  SiRNA target sequence
acttgaaagatttgtgtta

SEQ ID NO: 65199 - DNA, 19 bp, Artificial sequence
  SiRNA target sequence
cttgaaagatttgtgttac

SEQ ID NO: 65200 - DNA, 19 bp, Artificial sequence
  SiRNA target sequence
ttgaaagatttgtgttaca

SEQ ID NO: 65201 - DNA, 19 bp, Artificial sequence
  SiRNA target sequence
tgaaagatttgtgttacag

SEQ ID NO: 65202 - DNA, 19 bp, Artificial sequence
  SiRNA target sequence
gaaagatttgtgttacagt

SEQ ID NO: 65203 - DNA, 19 bp, Artificial sequence
  SiRNA target sequence
aaagatttgtgttacagtc

SEQ ID NO: 65204 - DNA, 19 bp, Artificial sequence
  SiRNA target sequence
aagatttgtgttacagtca

SEQ ID NO: 65205 - DNA, 19 bp, Artificial sequence
  SiRNA target sequence
agatttgtgttacagtcac

SEQ ID NO: 65206 - DNA, 19 bp, Artificial sequence
  SiRNA target sequence
gatttgtgttacagtcact

SEQ ID NO: 65207 - DNA, 19 bp, Artificial sequence
  SiRNA target sequence
atttgtgttacagtcactc

SEQ ID NO: 65208 - DNA, 19 bp, Artificial sequence
  SiRNA target sequence
tttgtgttacagtcactct

SEQ ID NO: 65209 - DNA, 19 bp, Artificial sequence
  SiRNA target sequence
ttgtgttacagtcactctt

SEQ ID NO: 65210 - DNA, 19 bp, Artificial sequence
  SiRNA target sequence
tgtgttacagtcactctta

SEQ ID NO: 65211 - DNA, 19 bp, Artificial sequence
  SiRNA target sequence
gtgttacagtcactcttag

SEQ ID NO: 65212 - DNA, 19 bp, Artificial sequence
  SiRNA target sequence
tgttacagtcactcttagt

SEQ ID NO: 65213 - DNA, 19 bp, Artificial sequence
  SiRNA target sequence
gttacagtcactcttagtg

SEQ ID NO: 65214 - DNA, 19 bp, Artificial sequence
  SiRNA target sequence
ttacagtcactcttagtgg

SEQ ID NO: 65215 - DNA, 19 bp, Artificial sequence
  SiRNA target sequence
tacagtcactcttagtggc

SEQ ID NO: 65216 - DNA, 19 bp, Artificial sequence
  SiRNA target sequence
acagtcactcttagtggct

SEQ ID NO: 65217 - DNA, 19 bp, Artificial sequence
  SiRNA target sequence
cagtcactcttagtggctg

SEQ ID NO: 65218 - DNA, 19 bp, Artificial sequence
  SiRNA target sequence
agtcactcttagtggctgt

SEQ ID NO: 65219 - DNA, 19 bp, Artificial sequence
  SiRNA target sequence
gtcactcttagtggctgta

SEQ ID NO: 65220 - DNA, 19 bp, Artificial sequence
  SiRNA target sequence
tcactcttagtggctgtat

SEQ ID NO: 65221 - DNA, 19 bp, Artificial sequence
  SiRNA target sequence
cactcttagtggctgtatt

SEQ ID NO: 65222 - DNA, 19 bp, Artificial sequence
  SiRNA target sequence
actcttagtggctgtattg

SEQ ID NO: 65223 - DNA, 19 bp, Artificial sequence
  SiRNA target sequence
ctcttagtggctgtattga

SEQ ID NO: 65224 - DNA, 19 bp, Artificial sequence
  SiRNA target sequence
tcttagtggctgtattgac

SEQ ID NO: 65225 - DNA, 19 bp, Artificial sequence
  SiRNA target sequence
cttagtggctgtattgacc

SEQ ID NO: 65226 - DNA, 19 bp, Artificial sequence
  SiRNA target sequence
ttagtggctgtattgaccg

SEQ ID NO: 65227 - DNA, 19 bp, Artificial sequence
  SiRNA target sequence
tagtggctgtattgaccga

SEQ ID NO: 65228 - DNA, 19 bp, Artificial sequence
  SiRNA target sequence
agtggctgtattgaccgaa

SEQ ID NO: 65229 - DNA, 19 bp, Artificial sequence
  SiRNA target sequence
gtggctgtattgaccgaac

SEQ ID NO: 65230 - DNA, 19 bp, Artificial sequence
  SiRNA target sequence
tggctgtattgaccgaact

SEQ ID NO: 65231 - DNA, 19 bp, Artificial sequence
  SiRNA target sequence
ggctgtattgaccgaactt

SEQ ID NO: 65232 - DNA, 19 bp, Artificial sequence
  SiRNA target sequence
gctgtattgaccgaactta

SEQ ID NO: 65233 - DNA, 19 bp, Artificial sequence
  SiRNA target sequence
ctgtattgaccgaacttaa

SEQ ID NO: 65234 - DNA, 19 bp, Artificial sequence
  SiRNA target sequence
tgtattgaccgaacttaat

SEQ ID NO: 65235 - DNA, 19 bp, Artificial sequence
  SiRNA target sequence
gtattgaccgaacttaatg

SEQ ID NO: 65236 - DNA, 19 bp, Artificial sequence
  SiRNA target sequence
tattgaccgaacttaatgg

SEQ ID NO: 65237 - DNA, 19 bp, Artificial sequence
  SiRNA target sequence
attgaccgaacttaatgga

SEQ ID NO: 65238 - DNA, 19 bp, Artificial sequence
  SiRNA target sequence
ttgaccgaacttaatggat

SEQ ID NO: 65239 - DNA, 19 bp, Artificial sequence
  SiRNA target sequence
tgaccgaacttaatggatt

SEQ ID NO: 65240 - DNA, 19 bp, Artificial sequence
  SiRNA target sequence
gaccgaacttaatggattt

SEQ ID NO: 65241 - DNA, 19 bp, Artificial sequence
  SiRNA target sequence
accgaacttaatggattta

SEQ ID NO: 65242 - DNA, 19 bp, Artificial sequence
  SiRNA target sequence
ccgaacttaatggatttat

SEQ ID NO: 65243 - DNA, 19 bp, Artificial sequence
  SiRNA target sequence
cgaacttaatggatttatt

SEQ ID NO: 65244 - DNA, 19 bp, Artificial sequence
  SiRNA target sequence
gaacttaatggatttattt

SEQ ID NO: 65245 - DNA, 19 bp, Artificial sequence
  SiRNA target sequence
aacttaatggatttatttt

SEQ ID NO: 65246 - DNA, 19 bp, Artificial sequence
  SiRNA target sequence
acttaatggatttattttt

SEQ ID NO: 65247 - DNA, 19 bp, Artificial sequence
  SiRNA target sequence
cttaatggatttattttta

SEQ ID NO: 65248 - DNA, 19 bp, Artificial sequence
  SiRNA target sequence
ttaatggatttatttttac

SEQ ID NO: 65249 - DNA, 19 bp, Artificial sequence
  SiRNA target sequence
taatggatttatttttaca

SEQ ID NO: 65250 - DNA, 19 bp, Artificial sequence
  SiRNA target sequence
aatggatttatttttacag

SEQ ID NO: 65251 - DNA, 19 bp, Artificial sequence
  SiRNA target sequence
atggatttatttttacagg

SEQ ID NO: 65252 - DNA, 19 bp, Artificial sequence
  SiRNA target sequence
tggatttatttttacaggt

SEQ ID NO: 65253 - DNA, 19 bp, Artificial sequence
  SiRNA target sequence
ggatttatttttacaggtg

SEQ ID NO: 65254 - DNA, 19 bp, Artificial sequence
  SiRNA target sequence
gatttatttttacaggtgt

SEQ ID NO: 65255 - DNA, 19 bp, Artificial sequence
  SiRNA target sequence
atttatttttacaggtgta

SEQ ID NO: 65256 - DNA, 19 bp, Artificial sequence
  SiRNA target sequence
tttatttttacaggtgtag

SEQ ID NO: 65257 - DNA, 19 bp, Artificial sequence
  SiRNA target sequence
ttatttttacaggtgtagt

SEQ ID NO: 65258 - DNA, 19 bp, Artificial sequence
  SiRNA target sequence
tatttttacaggtgtagtg

SEQ ID NO: 65259 - DNA, 19 bp, Artificial sequence
  SiRNA target sequence
atttttacaggtgtagtgc

SEQ ID NO: 65260 - DNA, 19 bp, Artificial sequence
  SiRNA target sequence
tttttacaggtgtagtgca

SEQ ID NO: 65261 - DNA, 19 bp, Artificial sequence
  SiRNA target sequence
ttttacaggtgtagtgcaa

SEQ ID NO: 65262 - DNA, 19 bp, Artificial sequence
  SiRNA target sequence
tttacaggtgtagtgcaat

SEQ ID NO: 65263 - DNA, 19 bp, Artificial sequence
  SiRNA target sequence
ttacaggtgtagtgcaata

SEQ ID NO: 65264 - DNA, 19 bp, Artificial sequence
  SiRNA target sequence
tacaggtgtagtgcaatat

SEQ ID NO: 65265 - DNA, 19 bp, Artificial sequence
  SiRNA target sequence
acaggtgtagtgcaatata

SEQ ID NO: 65266 - DNA, 19 bp, Artificial sequence
  SiRNA target sequence
caggtgtagtgcaatatat

SEQ ID NO: 65267 - DNA, 19 bp, Artificial sequence
  SiRNA target sequence
aggtgtagtgcaatatatt

SEQ ID NO: 65268 - DNA, 19 bp, Artificial sequence
  SiRNA target sequence
ggtgtagtgcaatatattt

SEQ ID NO: 65269 - DNA, 19 bp, Artificial sequence
  SiRNA target sequence
gtgtagtgcaatatattta

SEQ ID NO: 65270 - DNA, 19 bp, Artificial sequence
  SiRNA target sequence
tgtagtgcaatatatttat

SEQ ID NO: 65271 - DNA, 19 bp, Artificial sequence
  SiRNA target sequence
gtagtgcaatatatttata

SEQ ID NO: 65272 - DNA, 19 bp, Artificial sequence
  SiRNA target sequence
tagtgcaatatatttatag

SEQ ID NO: 65273 - DNA, 19 bp, Artificial sequence
  SiRNA target sequence
agtgcaatatatttataga

SEQ ID NO: 65274 - DNA, 19 bp, Artificial sequence
  SiRNA target sequence
gtgcaatatatttatagaa

SEQ ID NO: 65275 - DNA, 19 bp, Artificial sequence
  SiRNA target sequence
tgcaatatatttatagaaa

SEQ ID NO: 65276 - DNA, 19 bp, Artificial sequence
  SiRNA target sequence
gcaatatatttatagaaat

SEQ ID NO: 65277 - DNA, 19 bp, Artificial sequence
  SiRNA target sequence
caatatatttatagaaata

SEQ ID NO: 65278 - DNA, 19 bp, Artificial sequence
  SiRNA target sequence
aatatatttatagaaatac

SEQ ID NO: 65279 - DNA, 19 bp, Artificial sequence
  SiRNA target sequence
atatatttatagaaatacg

SEQ ID NO: 65280 - DNA, 19 bp, Artificial sequence
  SiRNA target sequence
tatatttatagaaatacgg

SEQ ID NO: 65281 - DNA, 19 bp, Artificial sequence
  SiRNA target sequence
atatttatagaaatacggc

SEQ ID NO: 65282 - DNA, 19 bp, Artificial sequence
  SiRNA target sequence
tatttatagaaatacggca

SEQ ID NO: 65283 - DNA, 19 bp, Artificial sequence
  SiRNA target sequence
atttatagaaatacggcaa

SEQ ID NO: 65284 - DNA, 19 bp, Artificial sequence
  SiRNA target sequence
tttatagaaatacggcaaa

SEQ ID NO: 65285 - DNA, 19 bp, Artificial sequence
  SiRNA target sequence
ttatagaaatacggcaaaa

SEQ ID NO: 65286 - DNA, 19 bp, Artificial sequence
  SiRNA target sequence
tatagaaatacggcaaaat

SEQ ID NO: 65287 - DNA, 19 bp, Artificial sequence
  SiRNA target sequence
atagaaatacggcaaaatc

SEQ ID NO: 65288 - DNA, 19 bp, Artificial sequence
  SiRNA target sequence
tagaaatacggcaaaatct

SEQ ID NO: 65289 - DNA, 19 bp, Artificial sequence
  SiRNA target sequence
agaaatacggcaaaatcta

SEQ ID NO: 65290 - DNA, 19 bp, Artificial sequence
  SiRNA target sequence
gaaatacggcaaaatctac

SEQ ID NO: 65291 - DNA, 19 bp, Artificial sequence
  SiRNA target sequence
aaatacggcaaaatctaca

SEQ ID NO: 65292 - DNA, 19 bp, Artificial sequence
  SiRNA target sequence
aatacggcaaaatctacat

SEQ ID NO: 65293 - DNA, 19 bp, Artificial sequence
  SiRNA target sequence
atacggcaaaatctacatt

SEQ ID NO: 65294 - DNA, 19 bp, Artificial sequence
  SiRNA target sequence
tacggcaaaatctacattc

SEQ ID NO: 65295 - DNA, 19 bp, Artificial sequence
  SiRNA target sequence
acggcaaaatctacattca

SEQ ID NO: 65296 - DNA, 19 bp, Artificial sequence
  SiRNA target sequence
cggcaaaatctacattcaa

SEQ ID NO: 65297 - DNA, 19 bp, Artificial sequence
  SiRNA target sequence
ggcaaaatctacattcaaa

SEQ ID NO: 65298 - DNA, 19 bp, Artificial sequence
  SiRNA target sequence
gcaaaatctacattcaaag

SEQ ID NO: 65299 - DNA, 19 bp, Artificial sequence
  SiRNA target sequence
caaaatctacattcaaagg

SEQ ID NO: 65300 - DNA, 19 bp, Artificial sequence
  SiRNA target sequence
aaaatctacattcaaaggc

SEQ ID NO: 65301 - DNA, 19 bp, Artificial sequence
  SiRNA target sequence
aaatctacattcaaaggct

SEQ ID NO: 65302 - DNA, 19 bp, Artificial sequence
  SiRNA target sequence
aatctacattcaaaggctt

SEQ ID NO: 65303 - DNA, 19 bp, Artificial sequence
  SiRNA target sequence
atctacattcaaaggcttc

SEQ ID NO: 65304 - DNA, 19 bp, Artificial sequence
  SiRNA target sequence
tctacattcaaaggcttca

SEQ ID NO: 65305 - DNA, 19 bp, Artificial sequence
  SiRNA target sequence
ctacattcaaaggcttcat

SEQ ID NO: 65306 - DNA, 19 bp, Artificial sequence
  SiRNA target sequence
tacattcaaaggcttcatt

SEQ ID NO: 65307 - DNA, 19 bp, Artificial sequence
  SiRNA target sequence
acattcaaaggcttcattt

SEQ ID NO: 65308 - DNA, 19 bp, Artificial sequence
  SiRNA target sequence
cattcaaaggcttcatttc

SEQ ID NO: 65309 - DNA, 19 bp, Artificial sequence
  SiRNA target sequence
attcaaaggcttcatttct

SEQ ID NO: 65310 - DNA, 19 bp, Artificial sequence
  SiRNA target sequence
ttcaaaggcttcatttctc

SEQ ID NO: 65311 - DNA, 19 bp, Artificial sequence
  SiRNA target sequence
tcaaaggcttcatttctct

SEQ ID NO: 65312 - DNA, 19 bp, Artificial sequence
  SiRNA target sequence
caaaggcttcatttctctt

SEQ ID NO: 65313 - DNA, 19 bp, Artificial sequence
  SiRNA target sequence
aaaggcttcatttctcttt

SEQ ID NO: 65314 - DNA, 19 bp, Artificial sequence
  SiRNA target sequence
aaggcttcatttctctttc

SEQ ID NO: 65315 - DNA, 19 bp, Artificial sequence
  SiRNA target sequence
aggcttcatttctctttca

SEQ ID NO: 65316 - DNA, 19 bp, Artificial sequence
  SiRNA target sequence
ggcttcatttctctttcac

SEQ ID NO: 65317 - DNA, 19 bp, Artificial sequence
  SiRNA target sequence
gcttcatttctctttcacc

SEQ ID NO: 65318 - DNA, 19 bp, Artificial sequence
  SiRNA target sequence
cttcatttctctttcacct

SEQ ID NO: 65319 - DNA, 19 bp, Artificial sequence
  SiRNA target sequence
ttcatttctctttcaccta

SEQ ID NO: 65320 - DNA, 19 bp, Artificial sequence
  SiRNA target sequence
tcatttctctttcacctaa

SEQ ID NO: 65321 - DNA, 19 bp, Artificial sequence
  SiRNA target sequence
catttctctttcacctaaa

SEQ ID NO: 65322 - DNA, 19 bp, Artificial sequence
  SiRNA target sequence
atttctctttcacctaaaa

SEQ ID NO: 65323 - DNA, 19 bp, Artificial sequence
  SiRNA target sequence
tttctctttcacctaaaaa

SEQ ID NO: 65324 - DNA, 19 bp, Artificial sequence
  SiRNA target sequence
ttctctttcacctaaaaat

SEQ ID NO: 65325 - DNA, 19 bp, Artificial sequence
  SiRNA target sequence
tctctttcacctaaaaatt

SEQ ID NO: 65326 - DNA, 19 bp, Artificial sequence
  SiRNA target sequence
ctctttcacctaaaaattt

SEQ ID NO: 65327 - DNA, 19 bp, Artificial sequence
  SiRNA target sequence
tctttcacctaaaaatttt

SEQ ID NO: 65328 - DNA, 19 bp, Artificial sequence
  SiRNA target sequence
ctttcacctaaaaatttta

SEQ ID NO: 65329 - DNA, 19 bp, Artificial sequence
  SiRNA target sequence
tttcacctaaaaattttag

SEQ ID NO: 65330 - DNA, 19 bp, Artificial sequence
  SiRNA target sequence
ttcacctaaaaattttagt

SEQ ID NO: 65331 - DNA, 19 bp, Artificial sequence
  SiRNA target sequence
tcacctaaaaattttagta

SEQ ID NO: 65332 - DNA, 19 bp, Artificial sequence
  SiRNA target sequence
cacctaaaaattttagtac

SEQ ID NO: 65333 - DNA, 19 bp, Artificial sequence
  SiRNA target sequence
acctaaaaattttagtacc

SEQ ID NO: 65334 - DNA, 19 bp, Artificial sequence
  SiRNA target sequence
cctaaaaattttagtacca

SEQ ID NO: 65335 - DNA, 19 bp, Artificial sequence
  SiRNA target sequence
ctaaaaattttagtaccat

SEQ ID NO: 65336 - DNA, 19 bp, Artificial sequence
  SiRNA target sequence
taaaaattttagtaccata

SEQ ID NO: 65337 - DNA, 19 bp, Artificial sequence
  SiRNA target sequence
aaaaattttagtaccatag

SEQ ID NO: 65338 - DNA, 19 bp, Artificial sequence
  SiRNA target sequence
aaaattttagtaccatagg

SEQ ID NO: 65339 - DNA, 19 bp, Artificial sequence
  SiRNA target sequence
aaattttagtaccataggt

SEQ ID NO: 65340 - DNA, 19 bp, Artificial sequence
  SiRNA target sequence
aattttagtaccataggtg

SEQ ID NO: 65341 - DNA, 19 bp, Artificial sequence
  SiRNA target sequence
attttagtaccataggtgg

SEQ ID NO: 65342 - DNA, 19 bp, Artificial sequence
  SiRNA target sequence
ttttagtaccataggtggc

SEQ ID NO: 65343 - DNA, 19 bp, Artificial sequence
  SiRNA target sequence
tttagtaccataggtggcg

SEQ ID NO: 65344 - DNA, 19 bp, Artificial sequence
  SiRNA target sequence
ttagtaccataggtggcgg

SEQ ID NO: 65345 - DNA, 19 bp, Artificial sequence
  SiRNA target sequence
tagtaccataggtggcgga

SEQ ID NO: 65346 - DNA, 19 bp, Artificial sequence
  SiRNA target sequence
agtaccataggtggcggag

SEQ ID NO: 65347 - DNA, 19 bp, Artificial sequence
  SiRNA target sequence
gtaccataggtggcggaga

SEQ ID NO: 65348 - DNA, 19 bp, Artificial sequence
  SiRNA target sequence
taccataggtggcggagaa

SEQ ID NO: 65349 - DNA, 19 bp, Artificial sequence
  SiRNA target sequence
accataggtggcggagaaa

SEQ ID NO: 65350 - DNA, 19 bp, Artificial sequence
  SiRNA target sequence
ccataggtggcggagaaat

SEQ ID NO: 65351 - DNA, 19 bp, Artificial sequence
  SiRNA target sequence
cataggtggcggagaaatt

SEQ ID NO: 65352 - DNA, 19 bp, Artificial sequence
  SiRNA target sequence
ataggtggcggagaaattc

SEQ ID NO: 65353 - DNA, 19 bp, Artificial sequence
  SiRNA target sequence
taggtggcggagaaattca

SEQ ID NO: 65354 - DNA, 19 bp, Artificial sequence
  SiRNA target sequence
aggtggcggagaaattcaa

SEQ ID NO: 65355 - DNA, 19 bp, Artificial sequence
  SiRNA target sequence
ggtggcggagaaattcaaa

SEQ ID NO: 65356 - DNA, 19 bp, Artificial sequence
  SiRNA target sequence
gtggcggagaaattcaaac

SEQ ID NO: 65357 - DNA, 19 bp, Artificial sequence
  SiRNA target sequence
tggcggagaaattcaaaca

SEQ ID NO: 65358 - DNA, 19 bp, Artificial sequence
  SiRNA target sequence
ggcggagaaattcaaacaa

SEQ ID NO: 65359 - DNA, 19 bp, Artificial sequence
  SiRNA target sequence
gcggagaaattcaaacaat

SEQ ID NO: 65360 - DNA, 19 bp, Artificial sequence
  SiRNA target sequence
cggagaaattcaaacaata

SEQ ID NO: 65361 - DNA, 19 bp, Artificial sequence
  SiRNA target sequence
ggagaaattcaaacaataa

SEQ ID NO: 65362 - DNA, 19 bp, Artificial sequence
  SiRNA target sequence
gagaaattcaaacaataat

SEQ ID NO: 65363 - DNA, 19 bp, Artificial sequence
  SiRNA target sequence
agaaattcaaacaataata

SEQ ID NO: 65364 - DNA, 19 bp, Artificial sequence
  SiRNA target sequence
gaaattcaaacaataatag

SEQ ID NO: 65365 - DNA, 19 bp, Artificial sequence
  SiRNA target sequence
aaattcaaacaataataga

SEQ ID NO: 65366 - DNA, 19 bp, Artificial sequence
  SiRNA target sequence
aattcaaacaataatagat

SEQ ID NO: 65367 - DNA, 19 bp, Artificial sequence
  SiRNA target sequence
attcaaacaataatagata

SEQ ID NO: 65368 - DNA, 19 bp, Artificial sequence
  SiRNA target sequence
ttcaaacaataatagatag

SEQ ID NO: 65369 - DNA, 19 bp, Artificial sequence
  SiRNA target sequence
tcaaacaataatagataga

SEQ ID NO: 65370 - DNA, 19 bp, Artificial sequence
  SiRNA target sequence
caaacaataatagatagaa

SEQ ID NO: 65371 - DNA, 19 bp, Artificial sequence
  SiRNA target sequence
aaacaataatagatagaaa

SEQ ID NO: 65372 - DNA, 19 bp, Artificial sequence
  SiRNA target sequence
aacaataatagatagaaaa

SEQ ID NO: 65373 - DNA, 19 bp, Artificial sequence
  SiRNA target sequence
acaataatagatagaaaat

SEQ ID NO: 65374 - DNA, 19 bp, Artificial sequence
  SiRNA target sequence
caataatagatagaaaatc

SEQ ID NO: 65375 - DNA, 19 bp, Artificial sequence
  SiRNA target sequence
aataatagatagaaaatca

SEQ ID NO: 65376 - DNA, 19 bp, Artificial sequence
  SiRNA target sequence
ataatagatagaaaatcaa

SEQ ID NO: 65377 - DNA, 19 bp, Artificial sequence
  SiRNA target sequence
taatagatagaaaatcaaa

SEQ ID NO: 65378 - DNA, 19 bp, Artificial sequence
  SiRNA target sequence
aatagatagaaaatcaaaa

SEQ ID NO: 65379 - DNA, 19 bp, Artificial sequence
  SiRNA target sequence
atagatagaaaatcaaaat

SEQ ID NO: 65380 - DNA, 19 bp, Artificial sequence
  SiRNA target sequence
tagatagaaaatcaaaatc

SEQ ID NO: 65381 - DNA, 19 bp, Artificial sequence
  SiRNA target sequence
agatagaaaatcaaaatct

SEQ ID NO: 65382 - DNA, 19 bp, Artificial sequence
  SiRNA target sequence
gatagaaaatcaaaatctg

SEQ ID NO: 65383 - DNA, 19 bp, Artificial sequence
  SiRNA target sequence
atagaaaatcaaaatctgc

SEQ ID NO: 65384 - DNA, 19 bp, Artificial sequence
  SiRNA target sequence
tagaaaatcaaaatctgca

SEQ ID NO: 65385 - DNA, 19 bp, Artificial sequence
  SiRNA target sequence
agaaaatcaaaatctgcaa

SEQ ID NO: 65386 - DNA, 19 bp, Artificial sequence
  SiRNA target sequence
gaaaatcaaaatctgcaag

SEQ ID NO: 65387 - DNA, 19 bp, Artificial sequence
  SiRNA target sequence
aaaatcaaaatctgcaagt

SEQ ID NO: 65388 - DNA, 19 bp, Artificial sequence
  SiRNA target sequence
aaatcaaaatctgcaagtg

SEQ ID NO: 65389 - DNA, 19 bp, Artificial sequence
  SiRNA target sequence
aatcaaaatctgcaagtga

SEQ ID NO: 65390 - DNA, 19 bp, Artificial sequence
  SiRNA target sequence
atcaaaatctgcaagtgaa

SEQ ID NO: 65391 - DNA, 19 bp, Artificial sequence
  SiRNA target sequence
tcaaaatctgcaagtgaac

SEQ ID NO: 65392 - DNA, 19 bp, Artificial sequence
  SiRNA target sequence
caaaatctgcaagtgaact

SEQ ID NO: 65393 - DNA, 19 bp, Artificial sequence
  SiRNA target sequence
aaaatctgcaagtgaactt

SEQ ID NO: 65394 - DNA, 19 bp, Artificial sequence
  SiRNA target sequence
aaatctgcaagtgaactta

SEQ ID NO: 65395 - DNA, 19 bp, Artificial sequence
  SiRNA target sequence
aatctgcaagtgaacttat

SEQ ID NO: 65396 - DNA, 19 bp, Artificial sequence
  SiRNA target sequence
atctgcaagtgaacttatt

SEQ ID NO: 65397 - DNA, 19 bp, Artificial sequence
  SiRNA target sequence
tctgcaagtgaacttattg

SEQ ID NO: 65398 - DNA, 19 bp, Artificial sequence
  SiRNA target sequence
ctgcaagtgaacttattga

SEQ ID NO: 65399 - DNA, 19 bp, Artificial sequence
  SiRNA target sequence
tgcaagtgaacttattgaa

SEQ ID NO: 65400 - DNA, 19 bp, Artificial sequence
  SiRNA target sequence
gcaagtgaacttattgaag

SEQ ID NO: 65401 - DNA, 19 bp, Artificial sequence
  SiRNA target sequence
caagtgaacttattgaagt

SEQ ID NO: 65402 - DNA, 19 bp, Artificial sequence
  SiRNA target sequence
aagtgaacttattgaagtg

SEQ ID NO: 65403 - DNA, 19 bp, Artificial sequence
  SiRNA target sequence
agtgaacttattgaagtgt

SEQ ID NO: 65404 - DNA, 19 bp, Artificial sequence
  SiRNA target sequence
gtgaacttattgaagtgtt

SEQ ID NO: 65405 - DNA, 19 bp, Artificial sequence
  SiRNA target sequence
tgaacttattgaagtgttt

SEQ ID NO: 65406 - DNA, 19 bp, Artificial sequence
  SiRNA target sequence
gaacttattgaagtgtttc

SEQ ID NO: 65407 - DNA, 19 bp, Artificial sequence
  SiRNA target sequence
aacttattgaagtgtttct

SEQ ID NO: 65408 - DNA, 19 bp, Artificial sequence
  SiRNA target sequence
acttattgaagtgtttctt

SEQ ID NO: 65409 - DNA, 19 bp, Artificial sequence
  SiRNA target sequence
cttattgaagtgtttctta

SEQ ID NO: 65410 - DNA, 19 bp, Artificial sequence
  SiRNA target sequence
ttattgaagtgtttcttac

SEQ ID NO: 65411 - DNA, 19 bp, Artificial sequence
  SiRNA target sequence
tattgaagtgtttcttaca

SEQ ID NO: 65412 - DNA, 19 bp, Artificial sequence
  SiRNA target sequence
attgaagtgtttcttacaa

SEQ ID NO: 65413 - DNA, 19 bp, Artificial sequence
  SiRNA target sequence
ttgaagtgtttcttacaag

SEQ ID NO: 65414 - DNA, 19 bp, Artificial sequence
  SiRNA target sequence
tgaagtgtttcttacaagc

SEQ ID NO: 65415 - DNA, 19 bp, Artificial sequence
  SiRNA target sequence
gaagtgtttcttacaagct

SEQ ID NO: 65416 - DNA, 19 bp, Artificial sequence
  SiRNA target sequence
aagtgtttcttacaagctt

SEQ ID NO: 65417 - DNA, 19 bp, Artificial sequence
  SiRNA target sequence
agtgtttcttacaagcttg

SEQ ID NO: 65418 - DNA, 19 bp, Artificial sequence
  SiRNA target sequence
gtgtttcttacaagcttgc

SEQ ID NO: 65419 - DNA, 19 bp, Artificial sequence
  SiRNA target sequence
tgtttcttacaagcttgct

SEQ ID NO: 65420 - DNA, 19 bp, Artificial sequence
  SiRNA target sequence
gtttcttacaagcttgctt

SEQ ID NO: 65421 - DNA, 19 bp, Artificial sequence
  SiRNA target sequence
tttcttacaagcttgcttc

SEQ ID NO: 65422 - DNA, 19 bp, Artificial sequence
  SiRNA target sequence
ttcttacaagcttgcttcc

SEQ ID NO: 65423 - DNA, 19 bp, Artificial sequence
  SiRNA target sequence
tcttacaagcttgcttcca

SEQ ID NO: 65424 - DNA, 19 bp, Artificial sequence
  SiRNA target sequence
cttacaagcttgcttccaa

SEQ ID NO: 65425 - DNA, 19 bp, Artificial sequence
  SiRNA target sequence
ttacaagcttgcttccaat

SEQ ID NO: 65426 - DNA, 19 bp, Artificial sequence
  SiRNA target sequence
tacaagcttgcttccaata

SEQ ID NO: 65427 - DNA, 19 bp, Artificial sequence
  SiRNA target sequence
acaagcttgcttccaatat

SEQ ID NO: 65428 - DNA, 19 bp, Artificial sequence
  SiRNA target sequence
caagcttgcttccaatatg

SEQ ID NO: 65429 - DNA, 19 bp, Artificial sequence
  SiRNA target sequence
aagcttgcttccaatatgc

SEQ ID NO: 65430 - DNA, 19 bp, Artificial sequence
  SiRNA target sequence
agcttgcttccaatatgcc

SEQ ID NO: 65431 - DNA, 19 bp, Artificial sequence
  SiRNA target sequence
gcttgcttccaatatgcct

SEQ ID NO: 65432 - DNA, 19 bp, Artificial sequence
  SiRNA target sequence
cttgcttccaatatgcctt

SEQ ID NO: 65433 - DNA, 19 bp, Artificial sequence
  SiRNA target sequence
ttgcttccaatatgcctta

SEQ ID NO: 65434 - DNA, 19 bp, Artificial sequence
  SiRNA target sequence
tgcttccaatatgccttaa

SEQ ID NO: 65435 - DNA, 19 bp, Artificial sequence
  SiRNA target sequence
gcttccaatatgccttaaa

SEQ ID NO: 65436 - DNA, 19 bp, Artificial sequence
  SiRNA target sequence
cttccaatatgccttaaac

SEQ ID NO: 65437 - DNA, 19 bp, Artificial sequence
  SiRNA target sequence
ttccaatatgccttaaact

SEQ ID NO: 65438 - DNA, 19 bp, Artificial sequence
  SiRNA target sequence
tccaatatgccttaaactt

SEQ ID NO: 65439 - DNA, 19 bp, Artificial sequence
  SiRNA target sequence
ccaatatgccttaaacttt

SEQ ID NO: 65440 - DNA, 19 bp, Artificial sequence
  SiRNA target sequence
caatatgccttaaactttt

SEQ ID NO: 65441 - DNA, 19 bp, Artificial sequence
  SiRNA target sequence
aatatgccttaaactttta

SEQ ID NO: 65442 - DNA, 19 bp, Artificial sequence
  SiRNA target sequence
atatgccttaaacttttat

SEQ ID NO: 65443 - DNA, 19 bp, Artificial sequence
  SiRNA target sequence
tatgccttaaacttttatt

SEQ ID NO: 65444 - DNA, 19 bp, Artificial sequence
  SiRNA target sequence
atgccttaaacttttattt

SEQ ID NO: 65445 - DNA, 19 bp, Artificial sequence
  SiRNA target sequence
tgccttaaacttttatttg

SEQ ID NO: 65446 - DNA, 19 bp, Artificial sequence
  SiRNA target sequence
gccttaaacttttatttgc

SEQ ID NO: 65447 - DNA, 19 bp, Artificial sequence
  SiRNA target sequence
ccttaaacttttatttgcc

SEQ ID NO: 65448 - DNA, 19 bp, Artificial sequence
  SiRNA target sequence
cttaaacttttatttgccc

SEQ ID NO: 65449 - DNA, 19 bp, Artificial sequence
  SiRNA target sequence
ttaaacttttatttgccct

SEQ ID NO: 65450 - DNA, 19 bp, Artificial sequence
  SiRNA target sequence
taaacttttatttgccctt

SEQ ID NO: 65451 - DNA, 19 bp, Artificial sequence
  SiRNA target sequence
aaacttttatttgccctta

SEQ ID NO: 65452 - DNA, 19 bp, Artificial sequence
  SiRNA target sequence
aacttttatttgcccttat

SEQ ID NO: 65453 - DNA, 19 bp, Artificial sequence
  SiRNA target sequence
acttttatttgcccttatt

SEQ ID NO: 65454 - DNA, 19 bp, Artificial sequence
  SiRNA target sequence
cttttatttgcccttattg

SEQ ID NO: 65455 - DNA, 19 bp, Artificial sequence
  SiRNA target sequence
ttttatttgcccttattgc

SEQ ID NO: 65456 - DNA, 19 bp, Artificial sequence
  SiRNA target sequence
tttatttgcccttattgca

SEQ ID NO: 65457 - DNA, 19 bp, Artificial sequence
  SiRNA target sequence
ttatttgcccttattgcag

SEQ ID NO: 65458 - DNA, 19 bp, Artificial sequence
  SiRNA target sequence
tatttgcccttattgcagt

SEQ ID NO: 65459 - DNA, 19 bp, Artificial sequence
  SiRNA target sequence
atttgcccttattgcagtt

SEQ ID NO: 65460 - DNA, 19 bp, Artificial sequence
  SiRNA target sequence
tttgcccttattgcagtta

SEQ ID NO: 65461 - DNA, 19 bp, Artificial sequence
  SiRNA target sequence
ttgcccttattgcagttat

SEQ ID NO: 65462 - DNA, 19 bp, Artificial sequence
  SiRNA target sequence
tgcccttattgcagttata

SEQ ID NO: 65463 - DNA, 19 bp, Artificial sequence
  SiRNA target sequence
gcccttattgcagttataa

SEQ ID NO: 65464 - DNA, 19 bp, Artificial sequence
  SiRNA target sequence
cccttattgcagttataaa

SEQ ID NO: 65465 - DNA, 19 bp, Artificial sequence
  SiRNA target sequence
ccttattgcagttataaaa

SEQ ID NO: 65466 - DNA, 19 bp, Artificial sequence
  SiRNA target sequence
cttattgcagttataaaaa

SEQ ID NO: 65467 - DNA, 19 bp, Artificial sequence
  SiRNA target sequence
ttattgcagttataaaaaa

SEQ ID NO: 65468 - DNA, 19 bp, Artificial sequence
  SiRNA target sequence
tattgcagttataaaaaat

SEQ ID NO: 65469 - DNA, 19 bp, Artificial sequence
  SiRNA target sequence
attgcagttataaaaaata

SEQ ID NO: 65470 - DNA, 19 bp, Artificial sequence
  SiRNA target sequence
ttgcagttataaaaaatat

SEQ ID NO: 65471 - DNA, 19 bp, Artificial sequence
  SiRNA target sequence
tgcagttataaaaaatatg

SEQ ID NO: 65472 - DNA, 19 bp, Artificial sequence
  SiRNA target sequence
gcagttataaaaaatatgg

SEQ ID NO: 65473 - DNA, 19 bp, Artificial sequence
  SiRNA target sequence
cagttataaaaaatatggg

SEQ ID NO: 65474 - DNA, 19 bp, Artificial sequence
  SiRNA target sequence
agttataaaaaatatggga

SEQ ID NO: 65475 - DNA, 19 bp, Artificial sequence
  SiRNA target sequence
gttataaaaaatatgggag

SEQ ID NO: 65476 - DNA, 19 bp, Artificial sequence
  SiRNA target sequence
ttataaaaaatatgggagg

SEQ ID NO: 65477 - DNA, 19 bp, Artificial sequence
  SiRNA target sequence
tataaaaaatatgggaggt

SEQ ID NO: 65478 - DNA, 19 bp, Artificial sequence
  SiRNA target sequence
ataaaaaatatgggaggtc

SEQ ID NO: 65479 - DNA, 19 bp, Artificial sequence
  SiRNA target sequence
taaaaaatatgggaggtct

SEQ ID NO: 65480 - DNA, 19 bp, Artificial sequence
  SiRNA target sequence
aaaaaatatgggaggtctt

SEQ ID NO: 65481 - DNA, 19 bp, Artificial sequence
  SiRNA target sequence
aaaaatatgggaggtcttg

SEQ ID NO: 65482 - DNA, 19 bp, Artificial sequence
  SiRNA target sequence
aaaatatgggaggtcttgc

SEQ ID NO: 65483 - DNA, 19 bp, Artificial sequence
  SiRNA target sequence
aaatatgggaggtcttgcg

SEQ ID NO: 65484 - DNA, 19 bp, Artificial sequence
  SiRNA target sequence
aatatgggaggtcttgcgg

SEQ ID NO: 65485 - DNA, 19 bp, Artificial sequence
  SiRNA target sequence
atatgggaggtcttgcggg

SEQ ID NO: 65486 - DNA, 19 bp, Artificial sequence
  SiRNA target sequence
tatgggaggtcttgcgggc

SEQ ID NO: 65487 - DNA, 19 bp, Artificial sequence
  SiRNA target sequence
atgggaggtcttgcgggct

SEQ ID NO: 65488 - DNA, 19 bp, Artificial sequence
  SiRNA target sequence
tgggaggtcttgcgggctt

SEQ ID NO: 65489 - DNA, 19 bp, Artificial sequence
  SiRNA target sequence
gggaggtcttgcgggcttc

SEQ ID NO: 65490 - DNA, 19 bp, Artificial sequence
  SiRNA target sequence
ggaggtcttgcgggcttca

SEQ ID NO: 65491 - DNA, 19 bp, Artificial sequence
  SiRNA target sequence
gaggtcttgcgggcttcat

SEQ ID NO: 65492 - DNA, 19 bp, Artificial sequence
  SiRNA target sequence
aggtcttgcgggcttcata

SEQ ID NO: 65493 - DNA, 19 bp, Artificial sequence
  SiRNA target sequence
ggtcttgcgggcttcataa

SEQ ID NO: 65494 - DNA, 19 bp, Artificial sequence
  SiRNA target sequence
gtcttgcgggcttcataat

SEQ ID NO: 65495 - DNA, 19 bp, Artificial sequence
  SiRNA target sequence
tcttgcgggcttcataatg

SEQ ID NO: 65496 - DNA, 19 bp, Artificial sequence
  SiRNA target sequence
cttgcgggcttcataatgt

SEQ ID NO: 65497 - DNA, 19 bp, Artificial sequence
  SiRNA target sequence
ttgcgggcttcataatgtt

SEQ ID NO: 65498 - DNA, 19 bp, Artificial sequence
  SiRNA target sequence
tgcgggcttcataatgttt

SEQ ID NO: 65499 - DNA, 19 bp, Artificial sequence
  SiRNA target sequence
gcgggcttcataatgtttg

SEQ ID NO: 65500 - DNA, 19 bp, Artificial sequence
  SiRNA target sequence
cgggcttcataatgtttgt

SEQ ID NO: 65501 - DNA, 19 bp, Artificial sequence
  SiRNA target sequence
gggcttcataatgtttgtt

SEQ ID NO: 65502 - DNA, 19 bp, Artificial sequence
  SiRNA target sequence
ggcttcataatgtttgttt

SEQ ID NO: 65503 - DNA, 19 bp, Artificial sequence
  SiRNA target sequence
gcttcataatgtttgtttg

SEQ ID NO: 65504 - DNA, 19 bp, Artificial sequence
  SiRNA target sequence
cttcataatgtttgtttgt

SEQ ID NO: 65505 - DNA, 19 bp, Artificial sequence
  SiRNA target sequence
ttcataatgtttgtttgtg

SEQ ID NO: 65506 - DNA, 19 bp, Artificial sequence
  SiRNA target sequence
tcataatgtttgtttgtgt

SEQ ID NO: 65507 - DNA, 19 bp, Artificial sequence
  SiRNA target sequence
cataatgtttgtttgtgtt

SEQ ID NO: 65508 - DNA, 19 bp, Artificial sequence
  SiRNA target sequence
ataatgtttgtttgtgttt

SEQ ID NO: 65509 - DNA, 19 bp, Artificial sequence
  SiRNA target sequence
taatgtttgtttgtgtttc

SEQ ID NO: 65510 - DNA, 19 bp, Artificial sequence
  SiRNA target sequence
aatgtttgtttgtgtttct

SEQ ID NO: 65511 - DNA, 19 bp, Artificial sequence
  SiRNA target sequence
atgtttgtttgtgtttctt

SEQ ID NO: 65512 - DNA, 19 bp, Artificial sequence
  SiRNA target sequence
tgtttgtttgtgtttcttg

SEQ ID NO: 65513 - DNA, 19 bp, Artificial sequence
  SiRNA target sequence
gtttgtttgtgtttcttgc

SEQ ID NO: 65514 - DNA, 19 bp, Artificial sequence
  SiRNA target sequence
tttgtttgtgtttcttgct

SEQ ID NO: 65515 - DNA, 19 bp, Artificial sequence
  SiRNA target sequence
ttgtttgtgtttcttgcta

SEQ ID NO: 65516 - DNA, 19 bp, Artificial sequence
  SiRNA target sequence
tgtttgtgtttcttgctat

SEQ ID NO: 65517 - DNA, 19 bp, Artificial sequence
  SiRNA target sequence
gtttgtgtttcttgctatg

SEQ ID NO: 65518 - DNA, 19 bp, Artificial sequence
  SiRNA target sequence
tttgtgtttcttgctatgc

SEQ ID NO: 65519 - DNA, 19 bp, Artificial sequence
  SiRNA target sequence
ttgtgtttcttgctatgcg

SEQ ID NO: 65520 - DNA, 19 bp, Artificial sequence
  SiRNA target sequence
tgtgtttcttgctatgcga

SEQ ID NO: 65521 - DNA, 19 bp, Artificial sequence
  SiRNA target sequence
gtgtttcttgctatgcgac

SEQ ID NO: 65522 - DNA, 19 bp, Artificial sequence
  SiRNA target sequence
tgtttcttgctatgcgact

SEQ ID NO: 65523 - DNA, 19 bp, Artificial sequence
  SiRNA target sequence
gtttcttgctatgcgactg

SEQ ID NO: 65524 - DNA, 19 bp, Artificial sequence
  SiRNA target sequence
tttcttgctatgcgactgt

SEQ ID NO: 65525 - DNA, 19 bp, Artificial sequence
  SiRNA target sequence
ttcttgctatgcgactgtg

SEQ ID NO: 65526 - DNA, 19 bp, Artificial sequence
  SiRNA target sequence
tcttgctatgcgactgtga

SEQ ID NO: 65527 - DNA, 19 bp, Artificial sequence
  SiRNA target sequence
cttgctatgcgactgtgac

SEQ ID NO: 65528 - DNA, 19 bp, Artificial sequence
  SiRNA target sequence
ttgctatgcgactgtgact

SEQ ID NO: 65529 - DNA, 19 bp, Artificial sequence
  SiRNA target sequence
tgctatgcgactgtgacta

SEQ ID NO: 65530 - DNA, 19 bp, Artificial sequence
  SiRNA target sequence
gctatgcgactgtgactat

SEQ ID NO: 65531 - DNA, 19 bp, Artificial sequence
  SiRNA target sequence
ctatgcgactgtgactata

SEQ ID NO: 65532 - DNA, 19 bp, Artificial sequence
  SiRNA target sequence
tatgcgactgtgactatat

SEQ ID NO: 65533 - DNA, 19 bp, Artificial sequence
  SiRNA target sequence
atgcgactgtgactatatt

SEQ ID NO: 65534 - DNA, 19 bp, Artificial sequence
  SiRNA target sequence
tgcgactgtgactatattg

SEQ ID NO: 65535 - DNA, 19 bp, Artificial sequence
  SiRNA target sequence
gcgactgtgactatattga

SEQ ID NO: 65536 - DNA, 19 bp, Artificial sequence
  SiRNA target sequence
cgactgtgactatattgat

SEQ ID NO: 65537 - DNA, 19 bp, Artificial sequence
  SiRNA target sequence
gactgtgactatattgata

SEQ ID NO: 65538 - DNA, 19 bp, Artificial sequence
  SiRNA target sequence
actgtgactatattgatag

SEQ ID NO: 65539 - DNA, 19 bp, Artificial sequence
  SiRNA target sequence
ctgtgactatattgatagc

SEQ ID NO: 65540 - DNA, 19 bp, Artificial sequence
  SiRNA target sequence
tgtgactatattgatagca

SEQ ID NO: 65541 - DNA, 19 bp, Artificial sequence
  SiRNA target sequence
gtgactatattgatagcac

SEQ ID NO: 65542 - DNA, 19 bp, Artificial sequence
  SiRNA target sequence
tgactatattgatagcaca

SEQ ID NO: 65543 - DNA, 19 bp, Artificial sequence
  SiRNA target sequence
gactatattgatagcacaa

SEQ ID NO: 65544 - DNA, 19 bp, Artificial sequence
  SiRNA target sequence
actatattgatagcacaat

SEQ ID NO: 65545 - DNA, 19 bp, Artificial sequence
  SiRNA target sequence
ctatattgatagcacaatg

SEQ ID NO: 65546 - DNA, 19 bp, Artificial sequence
  SiRNA target sequence
tatattgatagcacaatgg

SEQ ID NO: 65547 - DNA, 19 bp, Artificial sequence
  SiRNA target sequence
atattgatagcacaatgga

SEQ ID NO: 65548 - DNA, 19 bp, Artificial sequence
  SiRNA target sequence
tattgatagcacaatggag

SEQ ID NO: 65549 - DNA, 19 bp, Artificial sequence
  SiRNA target sequence
attgatagcacaatggaga

SEQ ID NO: 65550 - DNA, 19 bp, Artificial sequence
  SiRNA target sequence
ttgatagcacaatggagat

SEQ ID NO: 65551 - DNA, 19 bp, Artificial sequence
  SiRNA target sequence
tgatagcacaatggagatc

SEQ ID NO: 65552 - DNA, 19 bp, Artificial sequence
  SiRNA target sequence
gatagcacaatggagatct

SEQ ID NO: 65553 - DNA, 19 bp, Artificial sequence
  SiRNA target sequence
atagcacaatggagatcta

SEQ ID NO: 65554 - DNA, 19 bp, Artificial sequence
  SiRNA target sequence
tagcacaatggagatctaa

SEQ ID NO: 65555 - DNA, 19 bp, Artificial sequence
  SiRNA target sequence
agcacaatggagatctaat

SEQ ID NO: 65556 - DNA, 19 bp, Artificial sequence
  SiRNA target sequence
gcacaatggagatctaata

SEQ ID NO: 65557 - DNA, 19 bp, Artificial sequence
  SiRNA target sequence
cacaatggagatctaatat

SEQ ID NO: 65558 - DNA, 19 bp, Artificial sequence
  SiRNA target sequence
acaatggagatctaatatt

SEQ ID NO: 65559 - DNA, 19 bp, Artificial sequence
  SiRNA target sequence
caatggagatctaatatta

SEQ ID NO: 65560 - DNA, 19 bp, Artificial sequence
  SiRNA target sequence
aatggagatctaatattag

SEQ ID NO: 65561 - DNA, 19 bp, Artificial sequence
  SiRNA target sequence
atggagatctaatattaga

SEQ ID NO: 65562 - DNA, 19 bp, Artificial sequence
  SiRNA target sequence
tggagatctaatattagaa

SEQ ID NO: 65563 - DNA, 19 bp, Artificial sequence
  SiRNA target sequence
ggagatctaatattagaag

SEQ ID NO: 65564 - DNA, 19 bp, Artificial sequence
  SiRNA target sequence
gagatctaatattagaaga

SEQ ID NO: 65565 - DNA, 19 bp, Artificial sequence
  SiRNA target sequence
agatctaatattagaagag

SEQ ID NO: 65566 - DNA, 19 bp, Artificial sequence
  SiRNA target sequence
gatctaatattagaagaga

SEQ ID NO: 65567 - DNA, 19 bp, Artificial sequence
  SiRNA target sequence
atctaatattagaagagaa

SEQ ID NO: 65568 - DNA, 19 bp, Artificial sequence
  SiRNA target sequence
tctaatattagaagagaac

SEQ ID NO: 65569 - DNA, 19 bp, Artificial sequence
  SiRNA target sequence
ctaatattagaagagaact

SEQ ID NO: 65570 - DNA, 19 bp, Artificial sequence
  SiRNA target sequence
taatattagaagagaactt

SEQ ID NO: 65571 - DNA, 19 bp, Artificial sequence
  SiRNA target sequence
aatattagaagagaactta

SEQ ID NO: 65572 - DNA, 19 bp, Artificial sequence
  SiRNA target sequence
atattagaagagaacttaa

SEQ ID NO: 65573 - DNA, 19 bp, Artificial sequence
  SiRNA target sequence
tattagaagagaacttaat

SEQ ID NO: 65574 - DNA, 19 bp, Artificial sequence
  SiRNA target sequence
attagaagagaacttaata

SEQ ID NO: 65575 - DNA, 19 bp, Artificial sequence
  SiRNA target sequence
ttagaagagaacttaataa

SEQ ID NO: 65576 - DNA, 19 bp, Artificial sequence
  SiRNA target sequence
tagaagagaacttaataac

SEQ ID NO: 65577 - DNA, 19 bp, Artificial sequence
  SiRNA target sequence
agaagagaacttaataact

SEQ ID NO: 65578 - DNA, 19 bp, Artificial sequence
  SiRNA target sequence
gaagagaacttaataactc

SEQ ID NO: 65579 - DNA, 19 bp, Artificial sequence
  SiRNA target sequence
aagagaacttaataactct

SEQ ID NO: 65580 - DNA, 19 bp, Artificial sequence
  SiRNA target sequence
agagaacttaataactctg

SEQ ID NO: 65581 - DNA, 19 bp, Artificial sequence
  SiRNA target sequence
gagaacttaataactctga

SEQ ID NO: 65582 - DNA, 19 bp, Artificial sequence
  SiRNA target sequence
agaacttaataactctgaa

SEQ ID NO: 65583 - DNA, 19 bp, Artificial sequence
  SiRNA target sequence
gaacttaataactctgaaa

SEQ ID NO: 65584 - DNA, 19 bp, Artificial sequence
  SiRNA target sequence
aacttaataactctgaaaa

SEQ ID NO: 65585 - DNA, 19 bp, Artificial sequence
  SiRNA target sequence
acttaataactctgaaaat

SEQ ID NO: 65586 - DNA, 19 bp, Artificial sequence
  SiRNA target sequence
cttaataactctgaaaata

SEQ ID NO: 65587 - DNA, 19 bp, Artificial sequence
  SiRNA target sequence
ttaataactctgaaaatag

SEQ ID NO: 65588 - DNA, 19 bp, Artificial sequence
  SiRNA target sequence
taataactctgaaaataga

SEQ ID NO: 65589 - DNA, 19 bp, Artificial sequence
  SiRNA target sequence
aataactctgaaaatagat

SEQ ID NO: 65590 - DNA, 19 bp, Artificial sequence
  SiRNA target sequence
ataactctgaaaatagatc

SEQ ID NO: 65591 - DNA, 19 bp, Artificial sequence
  SiRNA target sequence
taactctgaaaatagatct

SEQ ID NO: 65592 - DNA, 19 bp, Artificial sequence
  SiRNA target sequence
aactctgaaaatagatcta

SEQ ID NO: 65593 - DNA, 19 bp, Artificial sequence
  SiRNA target sequence
actctgaaaatagatctag

SEQ ID NO: 65594 - DNA, 19 bp, Artificial sequence
  SiRNA target sequence
ctctgaaaatagatctagt

SEQ ID NO: 65595 - DNA, 19 bp, Artificial sequence
  SiRNA target sequence
tctgaaaatagatctagta

SEQ ID NO: 65596 - DNA, 19 bp, Artificial sequence
  SiRNA target sequence
ctgaaaatagatctagtaa

SEQ ID NO: 65597 - DNA, 19 bp, Artificial sequence
  SiRNA target sequence
tgaaaatagatctagtaat

SEQ ID NO: 65598 - DNA, 19 bp, Artificial sequence
  SiRNA target sequence
gaaaatagatctagtaata

SEQ ID NO: 65599 - DNA, 19 bp, Artificial sequence
  SiRNA target sequence
aaaatagatctagtaataa

SEQ ID NO: 65600 - DNA, 19 bp, Artificial sequence
  SiRNA target sequence
aaatagatctagtaataaa

SEQ ID NO: 65601 - DNA, 19 bp, Artificial sequence
  SiRNA target sequence
aatagatctagtaataaac

SEQ ID NO: 65602 - DNA, 19 bp, Artificial sequence
  SiRNA target sequence
atagatctagtaataaact

SEQ ID NO: 65603 - DNA, 19 bp, Artificial sequence
  SiRNA target sequence
tagatctagtaataaacta

SEQ ID NO: 65604 - DNA, 19 bp, Artificial sequence
  SiRNA target sequence
agatctagtaataaactac

SEQ ID NO: 65605 - DNA, 19 bp, Artificial sequence
  SiRNA target sequence
gatctagtaataaactaca

SEQ ID NO: 65606 - DNA, 19 bp, Artificial sequence
  SiRNA target sequence
atctagtaataaactacaa

SEQ ID NO: 65607 - DNA, 19 bp, Artificial sequence
  SiRNA target sequence
tctagtaataaactacaag

SEQ ID NO: 65608 - DNA, 19 bp, Artificial sequence
  SiRNA target sequence
ctagtaataaactacaaga

SEQ ID NO: 65609 - DNA, 19 bp, Artificial sequence
  SiRNA target sequence
tagtaataaactacaagat

SEQ ID NO: 65610 - DNA, 19 bp, Artificial sequence
  SiRNA target sequence
agtaataaactacaagatg

SEQ ID NO: 65611 - DNA, 19 bp, Artificial sequence
  SiRNA target sequence
gtaataaactacaagatgg

SEQ ID NO: 65612 - DNA, 19 bp, Artificial sequence
  SiRNA target sequence
taataaactacaagatgga

SEQ ID NO: 65613 - DNA, 19 bp, Artificial sequence
  SiRNA target sequence
aataaactacaagatggat

SEQ ID NO: 65614 - DNA, 19 bp, Artificial sequence
  SiRNA target sequence
ataaactacaagatggatt

SEQ ID NO: 65615 - DNA, 19 bp, Artificial sequence
  SiRNA target sequence
taaactacaagatggatta

SEQ ID NO: 65616 - DNA, 19 bp, Artificial sequence
  SiRNA target sequence
aaactacaagatggattaa

SEQ ID NO: 65617 - DNA, 19 bp, Artificial sequence
  SiRNA target sequence
aactacaagatggattaaa

SEQ ID NO: 65618 - DNA, 19 bp, Artificial sequence
  SiRNA target sequence
actacaagatggattaaat

SEQ ID NO: 65619 - DNA, 19 bp, Artificial sequence
  SiRNA target sequence
ctacaagatggattaaata

SEQ ID NO: 65620 - DNA, 19 bp, Artificial sequence
  SiRNA target sequence
tacaagatggattaaataa

SEQ ID NO: 65621 - DNA, 19 bp, Artificial sequence
  SiRNA target sequence
acaagatggattaaataat

SEQ ID NO: 65622 - DNA, 19 bp, Artificial sequence
  SiRNA target sequence
caagatggattaaataatc

SEQ ID NO: 65623 - DNA, 19 bp, Artificial sequence
  SiRNA target sequence
aagatggattaaataatca

SEQ ID NO: 65624 - DNA, 19 bp, Artificial sequence
  SiRNA target sequence
agatggattaaataatcat

SEQ ID NO: 65625 - DNA, 19 bp, Artificial sequence
  SiRNA target sequence
gatggattaaataatcatg

SEQ ID NO: 65626 - DNA, 19 bp, Artificial sequence
  SiRNA target sequence
atggattaaataatcatga

SEQ ID NO: 65627 - DNA, 19 bp, Artificial sequence
  SiRNA target sequence
tggattaaataatcatgaa

SEQ ID NO: 65628 - DNA, 19 bp, Artificial sequence
  SiRNA target sequence
ggattaaataatcatgaaa

SEQ ID NO: 65629 - DNA, 19 bp, Artificial sequence
  SiRNA target sequence
gattaaataatcatgaaac

SEQ ID NO: 65630 - DNA, 19 bp, Artificial sequence
  SiRNA target sequence
attaaataatcatgaaaca

SEQ ID NO: 65631 - DNA, 19 bp, Artificial sequence
  SiRNA target sequence
ttaaataatcatgaaacaa

SEQ ID NO: 65632 - DNA, 19 bp, Artificial sequence
  SiRNA target sequence
taaataatcatgaaacaat

SEQ ID NO: 65633 - DNA, 19 bp, Artificial sequence
  SiRNA target sequence
aaataatcatgaaacaatc

SEQ ID NO: 65634 - DNA, 19 bp, Artificial sequence
  SiRNA target sequence
aataatcatgaaacaatcg

SEQ ID NO: 65635 - DNA, 19 bp, Artificial sequence
  SiRNA target sequence
ataatcatgaaacaatcgt

SEQ ID NO: 65636 - DNA, 19 bp, Artificial sequence
  SiRNA target sequence
taatcatgaaacaatcgtc

SEQ ID NO: 65637 - DNA, 19 bp, Artificial sequence
  SiRNA target sequence
aatcatgaaacaatcgtct

SEQ ID NO: 65638 - DNA, 19 bp, Artificial sequence
  SiRNA target sequence
atcatgaaacaatcgtctc

SEQ ID NO: 65639 - DNA, 19 bp, Artificial sequence
  SiRNA target sequence
tcatgaaacaatcgtctcc

SEQ ID NO: 65640 - DNA, 19 bp, Artificial sequence
  SiRNA target sequence
catgaaacaatcgtctcct

SEQ ID NO: 65641 - DNA, 19 bp, Artificial sequence
  SiRNA target sequence
atgaaacaatcgtctcctt

SEQ ID NO: 65642 - DNA, 19 bp, Artificial sequence
  SiRNA target sequence
tgaaacaatcgtctccttt

SEQ ID NO: 65643 - DNA, 19 bp, Artificial sequence
  SiRNA target sequence
gaaacaatcgtctcctttg

SEQ ID NO: 65644 - DNA, 19 bp, Artificial sequence
  SiRNA target sequence
aaacaatcgtctcctttgg

SEQ ID NO: 65645 - DNA, 19 bp, Artificial sequence
  SiRNA target sequence
aacaatcgtctcctttggg

SEQ ID NO: 65646 - DNA, 19 bp, Artificial sequence
  SiRNA target sequence
acaatcgtctcctttggga

SEQ ID NO: 65647 - DNA, 19 bp, Artificial sequence
  SiRNA target sequence
caatcgtctcctttgggac

SEQ ID NO: 65648 - DNA, 19 bp, Artificial sequence
  SiRNA target sequence
aatcgtctcctttgggact

SEQ ID NO: 65649 - DNA, 19 bp, Artificial sequence
  SiRNA target sequence
atcgtctcctttgggacta

SEQ ID NO: 65650 - DNA, 19 bp, Artificial sequence
  SiRNA target sequence
tcgtctcctttgggactac

SEQ ID NO: 65651 - DNA, 19 bp, Artificial sequence
  SiRNA target sequence
cgtctcctttgggactaca

SEQ ID NO: 65652 - DNA, 19 bp, Artificial sequence
  SiRNA target sequence
gtctcctttgggactacag

SEQ ID NO: 65653 - DNA, 19 bp, Artificial sequence
  SiRNA target sequence
tctcctttgggactacaga

SEQ ID NO: 65654 - DNA, 19 bp, Artificial sequence
  SiRNA target sequence
ctcctttgggactacagat

SEQ ID NO: 65655 - DNA, 19 bp, Artificial sequence
  SiRNA target sequence
tcctttgggactacagatc

SEQ ID NO: 65656 - DNA, 19 bp, Artificial sequence
  SiRNA target sequence
cctttgggactacagatct

SEQ ID NO: 65657 - DNA, 19 bp, Artificial sequence
  SiRNA target sequence
ctttgggactacagatctt

SEQ ID NO: 65658 - DNA, 19 bp, Artificial sequence
  SiRNA target sequence
tttgggactacagatcttg

SEQ ID NO: 65659 - DNA, 19 bp, Artificial sequence
  SiRNA target sequence
ttgggactacagatcttga

SEQ ID NO: 65660 - DNA, 19 bp, Artificial sequence
  SiRNA target sequence
tgggactacagatcttgaa

SEQ ID NO: 65661 - DNA, 19 bp, Artificial sequence
  SiRNA target sequence
gggactacagatcttgaag

SEQ ID NO: 65662 - DNA, 19 bp, Artificial sequence
  SiRNA target sequence
ggactacagatcttgaagt

SEQ ID NO: 65663 - DNA, 19 bp, Artificial sequence
  SiRNA target sequence
gactacagatcttgaagta

SEQ ID NO: 65664 - DNA, 19 bp, Artificial sequence
  SiRNA target sequence
actacagatcttgaagtag

SEQ ID NO: 65665 - DNA, 19 bp, Artificial sequence
  SiRNA target sequence
ctacagatcttgaagtaga

SEQ ID NO: 65666 - DNA, 19 bp, Artificial sequence
  SiRNA target sequence
tacagatcttgaagtagat

SEQ ID NO: 65667 - DNA, 19 bp, Artificial sequence
  SiRNA target sequence
acagatcttgaagtagatg

SEQ ID NO: 65668 - DNA, 19 bp, Artificial sequence
  SiRNA target sequence
cagatcttgaagtagatga

SEQ ID NO: 65669 - DNA, 19 bp, Artificial sequence
  SiRNA target sequence
agatcttgaagtagatgaa

SEQ ID NO: 65670 - DNA, 19 bp, Artificial sequence
  SiRNA target sequence
gatcttgaagtagatgaat

SEQ ID NO: 65671 - DNA, 19 bp, Artificial sequence
  SiRNA target sequence
atcttgaagtagatgaata

SEQ ID NO: 65672 - DNA, 19 bp, Artificial sequence
  SiRNA target sequence
tcttgaagtagatgaatat

SEQ ID NO: 65673 - DNA, 19 bp, Artificial sequence
  SiRNA target sequence
cttgaagtagatgaatatg

SEQ ID NO: 65674 - DNA, 19 bp, Artificial sequence
  SiRNA target sequence
ttgaagtagatgaatatga

SEQ ID NO: 65675 - DNA, 19 bp, Artificial sequence
  SiRNA target sequence
tgaagtagatgaatatgat

SEQ ID NO: 65676 - DNA, 19 bp, Artificial sequence
  SiRNA target sequence
gaagtagatgaatatgatc

SEQ ID NO: 65677 - DNA, 19 bp, Artificial sequence
  SiRNA target sequence
aagtagatgaatatgatca

SEQ ID NO: 65678 - DNA, 19 bp, Artificial sequence
  SiRNA target sequence
agtagatgaatatgatcag

SEQ ID NO: 65679 - DNA, 19 bp, Artificial sequence
  SiRNA target sequence
gtagatgaatatgatcagt

SEQ ID NO: 65680 - DNA, 19 bp, Artificial sequence
  SiRNA target sequence
tagatgaatatgatcagtt

SEQ ID NO: 65681 - DNA, 19 bp, Artificial sequence
  SiRNA target sequence
agatgaatatgatcagttt

SEQ ID NO: 65682 - DNA, 19 bp, Artificial sequence
  SiRNA target sequence
gatgaatatgatcagtttc

SEQ ID NO: 65683 - DNA, 19 bp, Artificial sequence
  SiRNA target sequence
atgaatatgatcagtttct

SEQ ID NO: 65684 - DNA, 19 bp, Artificial sequence
  SiRNA target sequence
tgaatatgatcagtttctt

SEQ ID NO: 65685 - DNA, 19 bp, Artificial sequence
  SiRNA target sequence
gaatatgatcagtttctta

SEQ ID NO: 65686 - DNA, 19 bp, Artificial sequence
  SiRNA target sequence
aatatgatcagtttcttaa

SEQ ID NO: 65687 - DNA, 19 bp, Artificial sequence
  SiRNA target sequence
atatgatcagtttcttaaa

SEQ ID NO: 65688 - DNA, 19 bp, Artificial sequence
  SiRNA target sequence
tatgatcagtttcttaaaa

SEQ ID NO: 65689 - DNA, 19 bp, Artificial sequence
  SiRNA target sequence
atgatcagtttcttaaaat

SEQ ID NO: 65690 - DNA, 19 bp, Artificial sequence
  SiRNA target sequence
tgatcagtttcttaaaatt

SEQ ID NO: 65691 - DNA, 19 bp, Artificial sequence
  SiRNA target sequence
gatcagtttcttaaaatta

SEQ ID NO: 65692 - DNA, 19 bp, Artificial sequence
  SiRNA target sequence
atcagtttcttaaaattaa

SEQ ID NO: 65693 - DNA, 19 bp, Artificial sequence
  SiRNA target sequence
tcagtttcttaaaattaat

SEQ ID NO: 65694 - DNA, 19 bp, Artificial sequence
  SiRNA target sequence
cagtttcttaaaattaatg

SEQ ID NO: 65695 - DNA, 19 bp, Artificial sequence
  SiRNA target sequence
agtttcttaaaattaatgc

SEQ ID NO: 65696 - DNA, 19 bp, Artificial sequence
  SiRNA target sequence
gtttcttaaaattaatgca

SEQ ID NO: 65697 - DNA, 19 bp, Artificial sequence
  SiRNA target sequence
tttcttaaaattaatgcat

SEQ ID NO: 65698 - DNA, 19 bp, Artificial sequence
  SiRNA target sequence
ttcttaaaattaatgcatc

SEQ ID NO: 65699 - DNA, 19 bp, Artificial sequence
  SiRNA target sequence
tcttaaaattaatgcatct

SEQ ID NO: 65700 - DNA, 19 bp, Artificial sequence
  SiRNA target sequence
cttaaaattaatgcatcta

SEQ ID NO: 65701 - DNA, 19 bp, Artificial sequence
  SiRNA target sequence
ttaaaattaatgcatctaa

SEQ ID NO: 65702 - DNA, 19 bp, Artificial sequence
  SiRNA target sequence
taaaattaatgcatctaat

SEQ ID NO: 65703 - DNA, 19 bp, Artificial sequence
  SiRNA target sequence
aaaattaatgcatctaata

SEQ ID NO: 65704 - DNA, 19 bp, Artificial sequence
  SiRNA target sequence
aaattaatgcatctaatag

SEQ ID NO: 65705 - DNA, 19 bp, Artificial sequence
  SiRNA target sequence
aattaatgcatctaatagt

SEQ ID NO: 65706 - DNA, 19 bp, Artificial sequence
  SiRNA target sequence
attaatgcatctaatagta

SEQ ID NO: 65707 - DNA, 19 bp, Artificial sequence
  SiRNA target sequence
ttaatgcatctaatagtaa

SEQ ID NO: 65708 - DNA, 19 bp, Artificial sequence
  SiRNA target sequence
taatgcatctaatagtaac

SEQ ID NO: 65709 - DNA, 19 bp, Artificial sequence
  SiRNA target sequence
aatgcatctaatagtaaca

SEQ ID NO: 65710 - DNA, 19 bp, Artificial sequence
  SiRNA target sequence
atgcatctaatagtaacag

SEQ ID NO: 65711 - DNA, 19 bp, Artificial sequence
  SiRNA target sequence
tgcatctaatagtaacaga

SEQ ID NO: 65712 - DNA, 19 bp, Artificial sequence
  SiRNA target sequence
gcatctaatagtaacagat

SEQ ID NO: 65713 - DNA, 19 bp, Artificial sequence
  SiRNA target sequence
catctaatagtaacagatt

SEQ ID NO: 65714 - DNA, 19 bp, Artificial sequence
  SiRNA target sequence
atctaatagtaacagatta

SEQ ID NO: 65715 - DNA, 19 bp, Artificial sequence
  SiRNA target sequence
tctaatagtaacagattat

SEQ ID NO: 65716 - DNA, 19 bp, Artificial sequence
  SiRNA target sequence
ctaatagtaacagattatg

SEQ ID NO: 65717 - DNA, 19 bp, Artificial sequence
  SiRNA target sequence
taatagtaacagattatgg

SEQ ID NO: 65718 - DNA, 19 bp, Artificial sequence
  SiRNA target sequence
aatagtaacagattatgga

SEQ ID NO: 65719 - DNA, 19 bp, Artificial sequence
  SiRNA target sequence
atagtaacagattatggag

SEQ ID NO: 65720 - DNA, 19 bp, Artificial sequence
  SiRNA target sequence
tagtaacagattatggaga

SEQ ID NO: 65721 - DNA, 19 bp, Artificial sequence
  SiRNA target sequence
agtaacagattatggagag

SEQ ID NO: 65722 - DNA, 19 bp, Artificial sequence
  SiRNA target sequence
gtaacagattatggagagc

SEQ ID NO: 65723 - DNA, 19 bp, Artificial sequence
  SiRNA target sequence
taacagattatggagagca

SEQ ID NO: 65724 - DNA, 19 bp, Artificial sequence
  SiRNA target sequence
aacagattatggagagcac

SEQ ID NO: 65725 - DNA, 19 bp, Artificial sequence
  SiRNA target sequence
acagattatggagagcact

SEQ ID NO: 65726 - DNA, 19 bp, Artificial sequence
  SiRNA target sequence
cagattatggagagcactg

SEQ ID NO: 65727 - DNA, 19 bp, Artificial sequence
  SiRNA target sequence
agattatggagagcactgt

SEQ ID NO: 65728 - DNA, 19 bp, Artificial sequence
  SiRNA target sequence
gattatggagagcactgta

SEQ ID NO: 65729 - DNA, 19 bp, Artificial sequence
  SiRNA target sequence
attatggagagcactgtac

SEQ ID NO: 65730 - DNA, 19 bp, Artificial sequence
  SiRNA target sequence
ttatggagagcactgtaca

SEQ ID NO: 65731 - DNA, 19 bp, Artificial sequence
  SiRNA target sequence
tatggagagcactgtacat

SEQ ID NO: 65732 - DNA, 19 bp, Artificial sequence
  SiRNA target sequence
atggagagcactgtacatt

SEQ ID NO: 65733 - DNA, 19 bp, Artificial sequence
  SiRNA target sequence
tggagagcactgtacattt

SEQ ID NO: 65734 - DNA, 19 bp, Artificial sequence
  SiRNA target sequence
ggagagcactgtacatttt

SEQ ID NO: 65735 - DNA, 19 bp, Artificial sequence
  SiRNA target sequence
gagagcactgtacatttta

SEQ ID NO: 65736 - DNA, 19 bp, Artificial sequence
  SiRNA target sequence
agagcactgtacattttaa

SEQ ID NO: 65737 - DNA, 19 bp, Artificial sequence
  SiRNA target sequence
gagcactgtacattttaaa

SEQ ID NO: 65738 - DNA, 19 bp, Artificial sequence
  SiRNA target sequence
agcactgtacattttaaat

SEQ ID NO: 65739 - DNA, 19 bp, Artificial sequence
  SiRNA target sequence
gcactgtacattttaaatt

SEQ ID NO: 65740 - DNA, 19 bp, Artificial sequence
  SiRNA target sequence
cactgtacattttaaattt

SEQ ID NO: 65741 - DNA, 19 bp, Artificial sequence
  SiRNA target sequence
actgtacattttaaattta

SEQ ID NO: 65742 - DNA, 19 bp, Artificial sequence
  SiRNA target sequence
ctgtacattttaaatttat

SEQ ID NO: 65743 - DNA, 19 bp, Artificial sequence
  SiRNA target sequence
tgtacattttaaatttatc

SEQ ID NO: 65744 - DNA, 19 bp, Artificial sequence
  SiRNA target sequence
gtacattttaaatttatct

SEQ ID NO: 65745 - DNA, 19 bp, Artificial sequence
  SiRNA target sequence
tacattttaaatttatctc

SEQ ID NO: 65746 - DNA, 19 bp, Artificial sequence
  SiRNA target sequence
acattttaaatttatctca

SEQ ID NO: 65747 - DNA, 19 bp, Artificial sequence
  SiRNA target sequence
cattttaaatttatctcag

SEQ ID NO: 65748 - DNA, 19 bp, Artificial sequence
  SiRNA target sequence
attttaaatttatctcaga

SEQ ID NO: 65749 - DNA, 19 bp, Artificial sequence
  SiRNA target sequence
ttttaaatttatctcagag

SEQ ID NO: 65750 - DNA, 19 bp, Artificial sequence
  SiRNA target sequence
tttaaatttatctcagaga

SEQ ID NO: 65751 - DNA, 19 bp, Artificial sequence
  SiRNA target sequence
ttaaatttatctcagagag

SEQ ID NO: 65752 - DNA, 19 bp, Artificial sequence
  SiRNA target sequence
taaatttatctcagagagc

SEQ ID NO: 65753 - DNA, 19 bp, Artificial sequence
  SiRNA target sequence
aaatttatctcagagagca

SEQ ID NO: 65754 - DNA, 19 bp, Artificial sequence
  SiRNA target sequence
aatttatctcagagagcaa

SEQ ID NO: 65755 - DNA, 19 bp, Artificial sequence
  SiRNA target sequence
atttatctcagagagcaat

SEQ ID NO: 65756 - DNA, 19 bp, Artificial sequence
  SiRNA target sequence
tttatctcagagagcaatt

SEQ ID NO: 65757 - DNA, 19 bp, Artificial sequence
  SiRNA target sequence
ttatctcagagagcaattt

SEQ ID NO: 65758 - DNA, 19 bp, Artificial sequence
  SiRNA target sequence
tatctcagagagcaatttt

SEQ ID NO: 65759 - DNA, 19 bp, Artificial sequence
  SiRNA target sequence
atctcagagagcaattttt

SEQ ID NO: 65760 - DNA, 19 bp, Artificial sequence
  SiRNA target sequence
tctcagagagcaatttttc

SEQ ID NO: 65761 - DNA, 19 bp, Artificial sequence
  SiRNA target sequence
ctcagagagcaatttttct

SEQ ID NO: 65762 - DNA, 19 bp, Artificial sequence
  SiRNA target sequence
tcagagagcaatttttctc

SEQ ID NO: 65763 - DNA, 19 bp, Artificial sequence
  SiRNA target sequence
cagagagcaatttttctct

SEQ ID NO: 65764 - DNA, 19 bp, Artificial sequence
  SiRNA target sequence
agagagcaatttttctctt

SEQ ID NO: 65765 - DNA, 19 bp, Artificial sequence
  SiRNA target sequence
gagagcaatttttctctta

SEQ ID NO: 65766 - DNA, 19 bp, Artificial sequence
  SiRNA target sequence
agagcaatttttctcttac

SEQ ID NO: 65767 - DNA, 19 bp, Artificial sequence
  SiRNA target sequence
gagcaatttttctcttaca

SEQ ID NO: 65768 - DNA, 19 bp, Artificial sequence
  SiRNA target sequence
agcaatttttctcttacaa

SEQ ID NO: 65769 - DNA, 19 bp, Artificial sequence
  SiRNA target sequence
gcaatttttctcttacaaa

SEQ ID NO: 65770 - DNA, 19 bp, Artificial sequence
  SiRNA target sequence
caatttttctcttacaaag

SEQ ID NO: 65771 - DNA, 19 bp, Artificial sequence
  SiRNA target sequence
aatttttctcttacaaagt

SEQ ID NO: 65772 - DNA, 19 bp, Artificial sequence
  SiRNA target sequence
atttttctcttacaaagtt

SEQ ID NO: 65773 - DNA, 19 bp, Artificial sequence
  SiRNA target sequence
tttttctcttacaaagttt

SEQ ID NO: 65774 - DNA, 19 bp, Artificial sequence
  SiRNA target sequence
ttttctcttacaaagtttt

SEQ ID NO: 65775 - DNA, 19 bp, Artificial sequence
  SiRNA target sequence
tttctcttacaaagttttt

SEQ ID NO: 65776 - DNA, 19 bp, Artificial sequence
  SiRNA target sequence
ttctcttacaaagtttttt

SEQ ID NO: 65777 - DNA, 19 bp, Artificial sequence
  SiRNA target sequence
tctcttacaaagttttttt

SEQ ID NO: 65778 - DNA, 19 bp, Artificial sequence
  SiRNA target sequence
ctcttacaaagttttttta

SEQ ID NO: 65779 - DNA, 19 bp, Artificial sequence
  SiRNA target sequence
tcttacaaagtttttttat

SEQ ID NO: 65780 - DNA, 19 bp, Artificial sequence
  SiRNA target sequence
cttacaaagtttttttatt

SEQ ID NO: 65781 - DNA, 19 bp, Artificial sequence
  SiRNA target sequence
ttacaaagtttttttatta

SEQ ID NO: 65782 - DNA, 19 bp, Artificial sequence
  SiRNA target sequence
tacaaagtttttttattat

SEQ ID NO: 65783 - DNA, 19 bp, Artificial sequence
  SiRNA target sequence
acaaagtttttttattatt

SEQ ID NO: 65784 - DNA, 19 bp, Artificial sequence
  SiRNA target sequence
caaagtttttttattattt

SEQ ID NO: 65785 - DNA, 19 bp, Artificial sequence
  SiRNA target sequence
aaagtttttttattattta

SEQ ID NO: 65786 - DNA, 19 bp, Artificial sequence
  SiRNA target sequence
aagtttttttattatttat

SEQ ID NO: 65787 - DNA, 19 bp, Artificial sequence
  SiRNA target sequence
agtttttttattatttatg

SEQ ID NO: 65788 - DNA, 19 bp, Artificial sequence
  SiRNA target sequence
gtttttttattatttatgc

SEQ ID NO: 65789 - DNA, 19 bp, Artificial sequence
  SiRNA target sequence
tttttttattatttatgca

SEQ ID NO: 65790 - DNA, 19 bp, Artificial sequence
  SiRNA target sequence
ttttttattatttatgcag

SEQ ID NO: 65791 - DNA, 19 bp, Artificial sequence
  SiRNA target sequence
tttttattatttatgcagg

SEQ ID NO: 65792 - DNA, 19 bp, Artificial sequence
  SiRNA target sequence
ttttattatttatgcagga

SEQ ID NO: 65793 - DNA, 19 bp, Artificial sequence
  SiRNA target sequence
tttattatttatgcaggaa

SEQ ID NO: 65794 - DNA, 19 bp, Artificial sequence
  SiRNA target sequence
ttattatttatgcaggaat

SEQ ID NO: 65795 - DNA, 19 bp, Artificial sequence
  SiRNA target sequence
tattatttatgcaggaata

SEQ ID NO: 65796 - DNA, 19 bp, Artificial sequence
  SiRNA target sequence
attatttatgcaggaatat

SEQ ID NO: 65797 - DNA, 19 bp, Artificial sequence
  SiRNA target sequence
ttatttatgcaggaatatc

SEQ ID NO: 65798 - DNA, 19 bp, Artificial sequence
  SiRNA target sequence
tatttatgcaggaatatca

SEQ ID NO: 65799 - DNA, 19 bp, Artificial sequence
  SiRNA target sequence
atttatgcaggaatatcag

SEQ ID NO: 65800 - DNA, 19 bp, Artificial sequence
  SiRNA target sequence
tttatgcaggaatatcagg

SEQ ID NO: 65801 - DNA, 19 bp, Artificial sequence
  SiRNA target sequence
ttatgcaggaatatcagga

SEQ ID NO: 65802 - DNA, 19 bp, Artificial sequence
  SiRNA target sequence
tatgcaggaatatcaggaa

SEQ ID NO: 65803 - DNA, 19 bp, Artificial sequence
  SiRNA target sequence
atgcaggaatatcaggaat

SEQ ID NO: 65804 - DNA, 19 bp, Artificial sequence
  SiRNA target sequence
tgcaggaatatcaggaata

SEQ ID NO: 65805 - DNA, 19 bp, Artificial sequence
  SiRNA target sequence
gcaggaatatcaggaatat

SEQ ID NO: 65806 - DNA, 19 bp, Artificial sequence
  SiRNA target sequence
caggaatatcaggaatatt

SEQ ID NO: 65807 - DNA, 19 bp, Artificial sequence
  SiRNA target sequence
aggaatatcaggaatatta

SEQ ID NO: 65808 - DNA, 19 bp, Artificial sequence
  SiRNA target sequence
ggaatatcaggaatattat

SEQ ID NO: 65809 - DNA, 19 bp, Artificial sequence
  SiRNA target sequence
gaatatcaggaatattatc

SEQ ID NO: 65810 - DNA, 19 bp, Artificial sequence
  SiRNA target sequence
aatatcaggaatattatct

SEQ ID NO: 65811 - DNA, 19 bp, Artificial sequence
  SiRNA target sequence
atatcaggaatattatctc

SEQ ID NO: 65812 - DNA, 19 bp, Artificial sequence
  SiRNA target sequence
tatcaggaatattatctca

SEQ ID NO: 65813 - DNA, 19 bp, Artificial sequence
  SiRNA target sequence
atcaggaatattatctcaa

SEQ ID NO: 65814 - DNA, 19 bp, Artificial sequence
  SiRNA target sequence
tcaggaatattatctcaaa

SEQ ID NO: 65815 - DNA, 19 bp, Artificial sequence
  SiRNA target sequence
caggaatattatctcaaaa

SEQ ID NO: 65816 - DNA, 19 bp, Artificial sequence
  SiRNA target sequence
aggaatattatctcaaaat

SEQ ID NO: 65817 - DNA, 19 bp, Artificial sequence
  SiRNA target sequence
ggaatattatctcaaaata

SEQ ID NO: 65818 - DNA, 19 bp, Artificial sequence
  SiRNA target sequence
gaatattatctcaaaatat

SEQ ID NO: 65819 - DNA, 19 bp, Artificial sequence
  SiRNA target sequence
aatattatctcaaaatatg

SEQ ID NO: 65820 - DNA, 19 bp, Artificial sequence
  SiRNA target sequence
atattatctcaaaatatgt

SEQ ID NO: 65821 - DNA, 19 bp, Artificial sequence
  SiRNA target sequence
tattatctcaaaatatgtc

SEQ ID NO: 65822 - DNA, 19 bp, Artificial sequence
  SiRNA target sequence
attatctcaaaatatgtca

SEQ ID NO: 65823 - DNA, 19 bp, Artificial sequence
  SiRNA target sequence
ttatctcaaaatatgtcat

SEQ ID NO: 65824 - DNA, 19 bp, Artificial sequence
  SiRNA target sequence
tatctcaaaatatgtcatc

SEQ ID NO: 65825 - DNA, 19 bp, Artificial sequence
  SiRNA target sequence
atctcaaaatatgtcatct

SEQ ID NO: 65826 - DNA, 19 bp, Artificial sequence
  SiRNA target sequence
tctcaaaatatgtcatcta

SEQ ID NO: 65827 - DNA, 19 bp, Artificial sequence
  SiRNA target sequence
ctcaaaatatgtcatctaa

SEQ ID NO: 65828 - DNA, 19 bp, Artificial sequence
  SiRNA target sequence
tcaaaatatgtcatctaac

SEQ ID NO: 65829 - DNA, 19 bp, Artificial sequence
  SiRNA target sequence
caaaatatgtcatctaacc

SEQ ID NO: 65830 - DNA, 19 bp, Artificial sequence
  SiRNA target sequence
aaaatatgtcatctaacca

SEQ ID NO: 65831 - DNA, 19 bp, Artificial sequence
  SiRNA target sequence
aaatatgtcatctaaccaa

SEQ ID NO: 65832 - DNA, 19 bp, Artificial sequence
  SiRNA target sequence
aatatgtcatctaaccaac

SEQ ID NO: 65833 - DNA, 19 bp, Artificial sequence
  SiRNA target sequence
atatgtcatctaaccaact

SEQ ID NO: 65834 - DNA, 19 bp, Artificial sequence
  SiRNA target sequence
tatgtcatctaaccaactc

SEQ ID NO: 65835 - DNA, 19 bp, Artificial sequence
  SiRNA target sequence
atgtcatctaaccaactca

SEQ ID NO: 65836 - DNA, 19 bp, Artificial sequence
  SiRNA target sequence
tgtcatctaaccaactcat

SEQ ID NO: 65837 - DNA, 19 bp, Artificial sequence
  SiRNA target sequence
gtcatctaaccaactcatt

SEQ ID NO: 65838 - DNA, 19 bp, Artificial sequence
  SiRNA target sequence
tcatctaaccaactcattt

SEQ ID NO: 65839 - DNA, 19 bp, Artificial sequence
  SiRNA target sequence
catctaaccaactcattta

SEQ ID NO: 65840 - DNA, 19 bp, Artificial sequence
  SiRNA target sequence
atctaaccaactcatttat

SEQ ID NO: 65841 - DNA, 19 bp, Artificial sequence
  SiRNA target sequence
tctaaccaactcatttatt

SEQ ID NO: 65842 - DNA, 19 bp, Artificial sequence
  SiRNA target sequence
ctaaccaactcatttattt

SEQ ID NO: 65843 - DNA, 19 bp, Artificial sequence
  SiRNA target sequence
taaccaactcatttattta

SEQ ID NO: 65844 - DNA, 19 bp, Artificial sequence
  SiRNA target sequence
aaccaactcatttatttaa

SEQ ID NO: 65845 - DNA, 19 bp, Artificial sequence
  SiRNA target sequence
accaactcatttatttaat

SEQ ID NO: 65846 - DNA, 19 bp, Artificial sequence
  SiRNA target sequence
ccaactcatttatttaatg

SEQ ID NO: 65847 - DNA, 19 bp, Artificial sequence
  SiRNA target sequence
caactcatttatttaatgt

SEQ ID NO: 65848 - DNA, 19 bp, Artificial sequence
  SiRNA target sequence
aactcatttatttaatgtc

SEQ ID NO: 65849 - DNA, 19 bp, Artificial sequence
  SiRNA target sequence
actcatttatttaatgtcc

SEQ ID NO: 65850 - DNA, 19 bp, Artificial sequence
  SiRNA target sequence
ctcatttatttaatgtcca

SEQ ID NO: 65851 - DNA, 19 bp, Artificial sequence
  SiRNA target sequence
tcatttatttaatgtccat

SEQ ID NO: 65852 - DNA, 19 bp, Artificial sequence
  SiRNA target sequence
catttatttaatgtccatt

SEQ ID NO: 65853 - DNA, 19 bp, Artificial sequence
  SiRNA target sequence
atttatttaatgtccatta

SEQ ID NO: 65854 - DNA, 19 bp, Artificial sequence
  SiRNA target sequence
tttatttaatgtccattac

SEQ ID NO: 65855 - DNA, 19 bp, Artificial sequence
  SiRNA target sequence
ttatttaatgtccattaca

SEQ ID NO: 65856 - DNA, 19 bp, Artificial sequence
  SiRNA target sequence
tatttaatgtccattacat

SEQ ID NO: 65857 - DNA, 19 bp, Artificial sequence
  SiRNA target sequence
atttaatgtccattacatc

SEQ ID NO: 65858 - DNA, 19 bp, Artificial sequence
  SiRNA target sequence
tttaatgtccattacatct

SEQ ID NO: 65859 - DNA, 19 bp, Artificial sequence
  SiRNA target sequence
ttaatgtccattacatcta

SEQ ID NO: 65860 - DNA, 19 bp, Artificial sequence
  SiRNA target sequence
taatgtccattacatctac

SEQ ID NO: 65861 - DNA, 19 bp, Artificial sequence
  SiRNA target sequence
aatgtccattacatctacg

SEQ ID NO: 65862 - DNA, 19 bp, Artificial sequence
  SiRNA target sequence
atgtccattacatctacgg

SEQ ID NO: 65863 - DNA, 19 bp, Artificial sequence
  SiRNA target sequence
tgtccattacatctacggt

SEQ ID NO: 65864 - DNA, 19 bp, Artificial sequence
  SiRNA target sequence
gtccattacatctacggtt

SEQ ID NO: 65865 - DNA, 19 bp, Artificial sequence
  SiRNA target sequence
tccattacatctacggtta

SEQ ID NO: 65866 - DNA, 19 bp, Artificial sequence
  SiRNA target sequence
ccattacatctacggttac

SEQ ID NO: 65867 - DNA, 19 bp, Artificial sequence
  SiRNA target sequence
cattacatctacggttact

SEQ ID NO: 65868 - DNA, 19 bp, Artificial sequence
  SiRNA target sequence
attacatctacggttacta

SEQ ID NO: 65869 - DNA, 19 bp, Artificial sequence
  SiRNA target sequence
ttacatctacggttactat

SEQ ID NO: 65870 - DNA, 19 bp, Artificial sequence
  SiRNA target sequence
tacatctacggttactatt

SEQ ID NO: 65871 - DNA, 19 bp, Artificial sequence
  SiRNA target sequence
acatctacggttactatta

SEQ ID NO: 65872 - DNA, 19 bp, Artificial sequence
  SiRNA target sequence
catctacggttactattaa

SEQ ID NO: 65873 - DNA, 19 bp, Artificial sequence
  SiRNA target sequence
atctacggttactattaat

SEQ ID NO: 65874 - DNA, 19 bp, Artificial sequence
  SiRNA target sequence
tctacggttactattaatt

SEQ ID NO: 65875 - DNA, 19 bp, Artificial sequence
  SiRNA target sequence
ctacggttactattaattt

SEQ ID NO: 65876 - DNA, 19 bp, Artificial sequence
  SiRNA target sequence
tacggttactattaattta

SEQ ID NO: 65877 - DNA, 19 bp, Artificial sequence
  SiRNA target sequence
acggttactattaatttaa

SEQ ID NO: 65878 - DNA, 19 bp, Artificial sequence
  SiRNA target sequence
cggttactattaatttaag

SEQ ID NO: 65879 - DNA, 19 bp, Artificial sequence
  SiRNA target sequence
ggttactattaatttaagt

SEQ ID NO: 65880 - DNA, 19 bp, Artificial sequence
  SiRNA target sequence
gttactattaatttaagta

SEQ ID NO: 65881 - DNA, 19 bp, Artificial sequence
  SiRNA target sequence
ttactattaatttaagtaa

SEQ ID NO: 65882 - DNA, 19 bp, Artificial sequence
  SiRNA target sequence
tactattaatttaagtaac

SEQ ID NO: 65883 - DNA, 19 bp, Artificial sequence
  SiRNA target sequence
actattaatttaagtaact

SEQ ID NO: 65884 - DNA, 19 bp, Artificial sequence
  SiRNA target sequence
ctattaatttaagtaactt

SEQ ID NO: 65885 - DNA, 19 bp, Artificial sequence
  SiRNA target sequence
tattaatttaagtaacttg

SEQ ID NO: 65886 - DNA, 19 bp, Artificial sequence
  SiRNA target sequence
attaatttaagtaacttgg

SEQ ID NO: 65887 - DNA, 19 bp, Artificial sequence
  SiRNA target sequence
ttaatttaagtaacttggg

SEQ ID NO: 65888 - DNA, 19 bp, Artificial sequence
  SiRNA target sequence
taatttaagtaacttgggt

SEQ ID NO: 65889 - DNA, 19 bp, Artificial sequence
  SiRNA target sequence
aatttaagtaacttgggtt

SEQ ID NO: 65890 - DNA, 19 bp, Artificial sequence
  SiRNA target sequence
atttaagtaacttgggtta

SEQ ID NO: 65891 - DNA, 19 bp, Artificial sequence
  SiRNA target sequence
tttaagtaacttgggttac

SEQ ID NO: 65892 - DNA, 19 bp, Artificial sequence
  SiRNA target sequence
ttaagtaacttgggttact

SEQ ID NO: 65893 - DNA, 19 bp, Artificial sequence
  SiRNA target sequence
taagtaacttgggttactt

SEQ ID NO: 65894 - DNA, 19 bp, Artificial sequence
  SiRNA target sequence
aagtaacttgggttactta

SEQ ID NO: 65895 - DNA, 19 bp, Artificial sequence
  SiRNA target sequence
agtaacttgggttacttat

SEQ ID NO: 65896 - DNA, 19 bp, Artificial sequence
  SiRNA target sequence
gtaacttgggttacttata

SEQ ID NO: 65897 - DNA, 19 bp, Artificial sequence
  SiRNA target sequence
taacttgggttacttatac

SEQ ID NO: 65898 - DNA, 19 bp, Artificial sequence
  SiRNA target sequence
aacttgggttacttataca

SEQ ID NO: 65899 - DNA, 19 bp, Artificial sequence
  SiRNA target sequence
acttgggttacttatacac

SEQ ID NO: 65900 - DNA, 19 bp, Artificial sequence
  SiRNA target sequence
cttgggttacttatacact

SEQ ID NO: 65901 - DNA, 19 bp, Artificial sequence
  SiRNA target sequence
ttgggttacttatacacta

SEQ ID NO: 65902 - DNA, 19 bp, Artificial sequence
  SiRNA target sequence
tgggttacttatacactag

SEQ ID NO: 65903 - DNA, 19 bp, Artificial sequence
  SiRNA target sequence
gggttacttatacactaga

SEQ ID NO: 65904 - DNA, 19 bp, Artificial sequence
  SiRNA target sequence
ggttacttatacactagat

SEQ ID NO: 65905 - DNA, 19 bp, Artificial sequence
  SiRNA target sequence
gttacttatacactagata

SEQ ID NO: 65906 - DNA, 19 bp, Artificial sequence
  SiRNA target sequence
ttacttatacactagatat

SEQ ID NO: 65907 - DNA, 19 bp, Artificial sequence
  SiRNA target sequence
tacttatacactagatata

SEQ ID NO: 65908 - DNA, 19 bp, Artificial sequence
  SiRNA target sequence
acttatacactagatatac

SEQ ID NO: 65909 - DNA, 19 bp, Artificial sequence
  SiRNA target sequence
cttatacactagatataca

SEQ ID NO: 65910 - DNA, 19 bp, Artificial sequence
  SiRNA target sequence
ttatacactagatatacac

SEQ ID NO: 65911 - DNA, 19 bp, Artificial sequence
  SiRNA target sequence
tatacactagatatacaca

SEQ ID NO: 65912 - DNA, 19 bp, Artificial sequence
  SiRNA target sequence
atacactagatatacacaa

SEQ ID NO: 65913 - DNA, 19 bp, Artificial sequence
  SiRNA target sequence
tacactagatatacacaag

SEQ ID NO: 65914 - DNA, 19 bp, Artificial sequence
  SiRNA target sequence
acactagatatacacaagc

SEQ ID NO: 65915 - DNA, 19 bp, Artificial sequence
  SiRNA target sequence
cactagatatacacaagca

SEQ ID NO: 65916 - DNA, 19 bp, Artificial sequence
  SiRNA target sequence
actagatatacacaagcaa

SEQ ID NO: 65917 - DNA, 19 bp, Artificial sequence
  SiRNA target sequence
ctagatatacacaagcaat

SEQ ID NO: 65918 - DNA, 19 bp, Artificial sequence
  SiRNA target sequence
tagatatacacaagcaata

SEQ ID NO: 65919 - DNA, 19 bp, Artificial sequence
  SiRNA target sequence
agatatacacaagcaataa

SEQ ID NO: 65920 - DNA, 19 bp, Artificial sequence
  SiRNA target sequence
gatatacacaagcaataat

SEQ ID NO: 65921 - DNA, 19 bp, Artificial sequence
  SiRNA target sequence
atatacacaagcaataatt

SEQ ID NO: 65922 - DNA, 19 bp, Artificial sequence
  SiRNA target sequence
tatacacaagcaataatta

SEQ ID NO: 65923 - DNA, 19 bp, Artificial sequence
  SiRNA target sequence
atacacaagcaataattaa

SEQ ID NO: 65924 - DNA, 19 bp, Artificial sequence
  SiRNA target sequence
tacacaagcaataattaat

SEQ ID NO: 65925 - DNA, 19 bp, Artificial sequence
  SiRNA target sequence
acacaagcaataattaatg

SEQ ID NO: 65926 - DNA, 19 bp, Artificial sequence
  SiRNA target sequence
cacaagcaataattaatgc

SEQ ID NO: 65927 - DNA, 19 bp, Artificial sequence
  SiRNA target sequence
acaagcaataattaatgca

SEQ ID NO: 65928 - DNA, 19 bp, Artificial sequence
  SiRNA target sequence
caagcaataattaatgcaa

SEQ ID NO: 65929 - DNA, 19 bp, Artificial sequence
  SiRNA target sequence
aagcaataattaatgcaag

SEQ ID NO: 65930 - DNA, 19 bp, Artificial sequence
  SiRNA target sequence
agcaataattaatgcaaga

SEQ ID NO: 65931 - DNA, 19 bp, Artificial sequence
  SiRNA target sequence
gcaataattaatgcaagat

SEQ ID NO: 65932 - DNA, 19 bp, Artificial sequence
  SiRNA target sequence
caataattaatgcaagatc

SEQ ID NO: 65933 - DNA, 19 bp, Artificial sequence
  SiRNA target sequence
aataattaatgcaagatct

SEQ ID NO: 65934 - DNA, 19 bp, Artificial sequence
  SiRNA target sequence
ataattaatgcaagatcta

SEQ ID NO: 65935 - DNA, 19 bp, Artificial sequence
  SiRNA target sequence
taattaatgcaagatctac

SEQ ID NO: 65936 - DNA, 19 bp, Artificial sequence
  SiRNA target sequence
aattaatgcaagatctact

SEQ ID NO: 65937 - DNA, 19 bp, Artificial sequence
  SiRNA target sequence
attaatgcaagatctactt

SEQ ID NO: 65938 - DNA, 19 bp, Artificial sequence
  SiRNA target sequence
ttaatgcaagatctactta

SEQ ID NO: 65939 - DNA, 19 bp, Artificial sequence
  SiRNA target sequence
taatgcaagatctacttat

SEQ ID NO: 65940 - DNA, 19 bp, Artificial sequence
  SiRNA target sequence
aatgcaagatctacttatg

SEQ ID NO: 65941 - DNA, 19 bp, Artificial sequence
  SiRNA target sequence
atgcaagatctacttatga

SEQ ID NO: 65942 - DNA, 19 bp, Artificial sequence
  SiRNA target sequence
tgcaagatctacttatgat

SEQ ID NO: 65943 - DNA, 19 bp, Artificial sequence
  SiRNA target sequence
gcaagatctacttatgata

SEQ ID NO: 65944 - DNA, 19 bp, Artificial sequence
  SiRNA target sequence
caagatctacttatgatac

SEQ ID NO: 65945 - DNA, 19 bp, Artificial sequence
  SiRNA target sequence
aagatctacttatgataca

SEQ ID NO: 65946 - DNA, 19 bp, Artificial sequence
  SiRNA target sequence
agatctacttatgatacaa

SEQ ID NO: 65947 - DNA, 19 bp, Artificial sequence
  SiRNA target sequence
gatctacttatgatacaat

SEQ ID NO: 65948 - DNA, 19 bp, Artificial sequence
  SiRNA target sequence
atctacttatgatacaatg

SEQ ID NO: 65949 - DNA, 19 bp, Artificial sequence
  SiRNA target sequence
tctacttatgatacaatgt

SEQ ID NO: 65950 - DNA, 19 bp, Artificial sequence
  SiRNA target sequence
ctacttatgatacaatgtt

SEQ ID NO: 65951 - DNA, 19 bp, Artificial sequence
  SiRNA target sequence
tacttatgatacaatgtta

SEQ ID NO: 65952 - DNA, 19 bp, Artificial sequence
  SiRNA target sequence
acttatgatacaatgttag

SEQ ID NO: 65953 - DNA, 19 bp, Artificial sequence
  SiRNA target sequence
cttatgatacaatgttaga

SEQ ID NO: 65954 - DNA, 19 bp, Artificial sequence
  SiRNA target sequence
ttatgatacaatgttagat

SEQ ID NO: 65955 - DNA, 19 bp, Artificial sequence
  SiRNA target sequence
tatgatacaatgttagata

SEQ ID NO: 65956 - DNA, 19 bp, Artificial sequence
  SiRNA target sequence
atgatacaatgttagatat

SEQ ID NO: 65957 - DNA, 19 bp, Artificial sequence
  SiRNA target sequence
tgatacaatgttagatata

SEQ ID NO: 65958 - DNA, 19 bp, Artificial sequence
  SiRNA target sequence
gatacaatgttagatataa

SEQ ID NO: 65959 - DNA, 19 bp, Artificial sequence
  SiRNA target sequence
atacaatgttagatataaa

SEQ ID NO: 65960 - DNA, 19 bp, Artificial sequence
  SiRNA target sequence
tacaatgttagatataaaa

SEQ ID NO: 65961 - DNA, 19 bp, Artificial sequence
  SiRNA target sequence
acaatgttagatataaaaa

SEQ ID NO: 65962 - DNA, 19 bp, Artificial sequence
  SiRNA target sequence
caatgttagatataaaaaa

SEQ ID NO: 65963 - DNA, 19 bp, Artificial sequence
  SiRNA target sequence
aatgttagatataaaaaaa

SEQ ID NO: 65964 - DNA, 19 bp, Artificial sequence
  SiRNA target sequence
atgttagatataaaaaaag

SEQ ID NO: 65965 - DNA, 19 bp, Artificial sequence
  SiRNA target sequence
tgttagatataaaaaaaga

SEQ ID NO: 65966 - DNA, 19 bp, Artificial sequence
  SiRNA target sequence
gttagatataaaaaaagag

SEQ ID NO: 65967 - DNA, 19 bp, Artificial sequence
  SiRNA target sequence
ttagatataaaaaaagaga

SEQ ID NO: 65968 - DNA, 19 bp, Artificial sequence
  SiRNA target sequence
tagatataaaaaaagagaa

SEQ ID NO: 65969 - DNA, 19 bp, Artificial sequence
  SiRNA target sequence
agatataaaaaaagagaat

SEQ ID NO: 65970 - DNA, 19 bp, Artificial sequence
  SiRNA target sequence
gatataaaaaaagagaata

SEQ ID NO: 65971 - DNA, 19 bp, Artificial sequence
  SiRNA target sequence
atataaaaaaagagaataa

SEQ ID NO: 65972 - DNA, 19 bp, Artificial sequence
  SiRNA target sequence
tataaaaaaagagaataat

SEQ ID NO: 65973 - DNA, 19 bp, Artificial sequence
  SiRNA target sequence
ataaaaaaagagaataata

SEQ ID NO: 65974 - DNA, 19 bp, Artificial sequence
  SiRNA target sequence
taaaaaaagagaataataa

SEQ ID NO: 65975 - DNA, 19 bp, Artificial sequence
  SiRNA target sequence
aaaaaaagagaataataag

SEQ ID NO: 65976 - DNA, 19 bp, Artificial sequence
  SiRNA target sequence
aaaaaagagaataataagt

SEQ ID NO: 65977 - DNA, 19 bp, Artificial sequence
  SiRNA target sequence
aaaaagagaataataagtt

SEQ ID NO: 65978 - DNA, 19 bp, Artificial sequence
  SiRNA target sequence
aaaagagaataataagttt

SEQ ID NO: 65979 - DNA, 19 bp, Artificial sequence
  SiRNA target sequence
aaagagaataataagttta

SEQ ID NO: 65980 - DNA, 19 bp, Artificial sequence
  SiRNA target sequence
aagagaataataagtttaa

SEQ ID NO: 65981 - DNA, 19 bp, Artificial sequence
  SiRNA target sequence
agagaataataagtttaag

SEQ ID NO: 65982 - DNA, 19 bp, Artificial sequence
  SiRNA target sequence
gagaataataagtttaaga

SEQ ID NO: 65983 - DNA, 19 bp, Artificial sequence
  SiRNA target sequence
agaataataagtttaagat

SEQ ID NO: 65984 - DNA, 19 bp, Artificial sequence
  SiRNA target sequence
gaataataagtttaagatt

SEQ ID NO: 65985 - DNA, 19 bp, Artificial sequence
  SiRNA target sequence
aataataagtttaagatta

SEQ ID NO: 65986 - DNA, 19 bp, Artificial sequence
  SiRNA target sequence
ataataagtttaagattac

SEQ ID NO: 65987 - DNA, 19 bp, Artificial sequence
  SiRNA target sequence
taataagtttaagattaca

SEQ ID NO: 65988 - DNA, 19 bp, Artificial sequence
  SiRNA target sequence
aataagtttaagattacag

SEQ ID NO: 65989 - DNA, 19 bp, Artificial sequence
  SiRNA target sequence
ataagtttaagattacaga

SEQ ID NO: 65990 - DNA, 19 bp, Artificial sequence
  SiRNA target sequence
taagtttaagattacagaa

SEQ ID NO: 65991 - DNA, 19 bp, Artificial sequence
  SiRNA target sequence
aagtttaagattacagaat

SEQ ID NO: 65992 - DNA, 19 bp, Artificial sequence
  SiRNA target sequence
agtttaagattacagaatt

SEQ ID NO: 65993 - DNA, 19 bp, Artificial sequence
  SiRNA target sequence
gtttaagattacagaattt

SEQ ID NO: 65994 - DNA, 19 bp, Artificial sequence
  SiRNA target sequence
tttaagattacagaattta

SEQ ID NO: 65995 - DNA, 19 bp, Artificial sequence
  SiRNA target sequence
ttaagattacagaatttaa

SEQ ID NO: 65996 - DNA, 19 bp, Artificial sequence
  SiRNA target sequence
taagattacagaatttaaa

SEQ ID NO: 65997 - DNA, 19 bp, Artificial sequence
  SiRNA target sequence
aagattacagaatttaaag

SEQ ID NO: 65998 - DNA, 19 bp, Artificial sequence
  SiRNA target sequence
agattacagaatttaaaga

SEQ ID NO: 65999 - DNA, 19 bp, Artificial sequence
  SiRNA target sequence
gattacagaatttaaagaa

SEQ ID NO: 66000 - DNA, 19 bp, Artificial sequence
  SiRNA target sequence
attacagaatttaaagaaa

SEQ ID NO: 66001 - DNA, 19 bp, Artificial sequence
  SiRNA target sequence
ttacagaatttaaagaaag

SEQ ID NO: 66002 - DNA, 19 bp, Artificial sequence
  SiRNA target sequence
tacagaatttaaagaaagt

SEQ ID NO: 66003 - DNA, 19 bp, Artificial sequence
  SiRNA target sequence
acagaatttaaagaaagta

SEQ ID NO: 66004 - DNA, 19 bp, Artificial sequence
  SiRNA target sequence
cagaatttaaagaaagtat

SEQ ID NO: 66005 - DNA, 19 bp, Artificial sequence
  SiRNA target sequence
agaatttaaagaaagtatt

SEQ ID NO: 66006 - DNA, 19 bp, Artificial sequence
  SiRNA target sequence
gaatttaaagaaagtatta

SEQ ID NO: 66007 - DNA, 19 bp, Artificial sequence
  SiRNA target sequence
aatttaaagaaagtattaa

SEQ ID NO: 66008 - DNA, 19 bp, Artificial sequence
  SiRNA target sequence
atttaaagaaagtattaag

SEQ ID NO: 66009 - DNA, 19 bp, Artificial sequence
  SiRNA target sequence
tttaaagaaagtattaagt

SEQ ID NO: 66010 - DNA, 19 bp, Artificial sequence
  SiRNA target sequence
ttaaagaaagtattaagtt

SEQ ID NO: 66011 - DNA, 19 bp, Artificial sequence
  SiRNA target sequence
taaagaaagtattaagttt

SEQ ID NO: 66012 - DNA, 19 bp, Artificial sequence
  SiRNA target sequence
aaagaaagtattaagttta

SEQ ID NO: 66013 - DNA, 19 bp, Artificial sequence
  SiRNA target sequence
aagaaagtattaagtttaa

SEQ ID NO: 66014 - DNA, 19 bp, Artificial sequence
  SiRNA target sequence
agaaagtattaagtttaat

SEQ ID NO: 66015 - DNA, 19 bp, Artificial sequence
  SiRNA target sequence
gaaagtattaagtttaata

SEQ ID NO: 66016 - DNA, 19 bp, Artificial sequence
  SiRNA target sequence
aaagtattaagtttaataa

SEQ ID NO: 66017 - DNA, 19 bp, Artificial sequence
  SiRNA target sequence
aagtattaagtttaataat

SEQ ID NO: 66018 - DNA, 19 bp, Artificial sequence
  SiRNA target sequence
agtattaagtttaataatt

SEQ ID NO: 66019 - DNA, 19 bp, Artificial sequence
  SiRNA target sequence
gtattaagtttaataattt

SEQ ID NO: 66020 - DNA, 19 bp, Artificial sequence
  SiRNA target sequence
tattaagtttaataatttg

SEQ ID NO: 66021 - DNA, 19 bp, Artificial sequence
  SiRNA target sequence
attaagtttaataatttgt

SEQ ID NO: 66022 - DNA, 19 bp, Artificial sequence
  SiRNA target sequence
ttaagtttaataatttgtc

SEQ ID NO: 66023 - DNA, 19 bp, Artificial sequence
  SiRNA target sequence
taagtttaataatttgtca

SEQ ID NO: 66024 - DNA, 19 bp, Artificial sequence
  SiRNA target sequence
aagtttaataatttgtcat

SEQ ID NO: 66025 - DNA, 19 bp, Artificial sequence
  SiRNA target sequence
agtttaataatttgtcatt

SEQ ID NO: 66026 - DNA, 19 bp, Artificial sequence
  SiRNA target sequence
gtttaataatttgtcattt

SEQ ID NO: 66027 - DNA, 19 bp, Artificial sequence
  SiRNA target sequence
tttaataatttgtcatttg

SEQ ID NO: 66028 - DNA, 19 bp, Artificial sequence
  SiRNA target sequence
ttaataatttgtcatttgg

SEQ ID NO: 66029 - DNA, 19 bp, Artificial sequence
  SiRNA target sequence
taataatttgtcatttggt

SEQ ID NO: 66030 - DNA, 19 bp, Artificial sequence
  SiRNA target sequence
aataatttgtcatttggtt

SEQ ID NO: 66031 - DNA, 19 bp, Artificial sequence
  SiRNA target sequence
ataatttgtcatttggtta

SEQ ID NO: 66032 - DNA, 19 bp, Artificial sequence
  SiRNA target sequence
taatttgtcatttggttat

SEQ ID NO: 66033 - DNA, 19 bp, Artificial sequence
  SiRNA target sequence
aatttgtcatttggttatg

SEQ ID NO: 66034 - DNA, 19 bp, Artificial sequence
  SiRNA target sequence
atttgtcatttggttatga

SEQ ID NO: 66035 - DNA, 19 bp, Artificial sequence
  SiRNA target sequence
tttgtcatttggttatgaa

SEQ ID NO: 66036 - DNA, 19 bp, Artificial sequence
  SiRNA target sequence
ttgtcatttggttatgaaa

SEQ ID NO: 66037 - DNA, 19 bp, Artificial sequence
  SiRNA target sequence
tgtcatttggttatgaaag

SEQ ID NO: 66038 - DNA, 19 bp, Artificial sequence
  SiRNA target sequence
gtcatttggttatgaaagt

SEQ ID NO: 66039 - DNA, 19 bp, Artificial sequence
  SiRNA target sequence
tcatttggttatgaaagta

SEQ ID NO: 66040 - DNA, 19 bp, Artificial sequence
  SiRNA target sequence
catttggttatgaaagtag

SEQ ID NO: 66041 - DNA, 19 bp, Artificial sequence
  SiRNA target sequence
atttggttatgaaagtaga

SEQ ID NO: 66042 - DNA, 19 bp, Artificial sequence
  SiRNA target sequence
tttggttatgaaagtagac

SEQ ID NO: 66043 - DNA, 19 bp, Artificial sequence
  SiRNA target sequence
ttggttatgaaagtagaca

SEQ ID NO: 66044 - DNA, 19 bp, Artificial sequence
  SiRNA target sequence
tggttatgaaagtagacaa

SEQ ID NO: 66045 - DNA, 19 bp, Artificial sequence
  SiRNA target sequence
ggttatgaaagtagacaaa

SEQ ID NO: 66046 - DNA, 19 bp, Artificial sequence
  SiRNA target sequence
gttatgaaagtagacaaat

SEQ ID NO: 66047 - DNA, 19 bp, Artificial sequence
  SiRNA target sequence
ttatgaaagtagacaaatt

SEQ ID NO: 66048 - DNA, 19 bp, Artificial sequence
  SiRNA target sequence
tatgaaagtagacaaattt

SEQ ID NO: 66049 - DNA, 19 bp, Artificial sequence
  SiRNA target sequence
atgaaagtagacaaatttt

SEQ ID NO: 66050 - DNA, 19 bp, Artificial sequence
  SiRNA target sequence
tgaaagtagacaaattttt

SEQ ID NO: 66051 - DNA, 19 bp, Artificial sequence
  SiRNA target sequence
gaaagtagacaaattttta

SEQ ID NO: 66052 - DNA, 19 bp, Artificial sequence
  SiRNA target sequence
aaagtagacaaatttttaa

SEQ ID NO: 66053 - DNA, 19 bp, Artificial sequence
  SiRNA target sequence
aagtagacaaatttttaat

SEQ ID NO: 66054 - DNA, 19 bp, Artificial sequence
  SiRNA target sequence
agtagacaaatttttaata

SEQ ID NO: 66055 - DNA, 19 bp, Artificial sequence
  SiRNA target sequence
gtagacaaatttttaataa

SEQ ID NO: 66056 - DNA, 19 bp, Artificial sequence
  SiRNA target sequence
tagacaaatttttaataaa

SEQ ID NO: 66057 - DNA, 19 bp, Artificial sequence
  SiRNA target sequence
agacaaatttttaataaaa

SEQ ID NO: 66058 - DNA, 19 bp, Artificial sequence
  SiRNA target sequence
gacaaatttttaataaaat

SEQ ID NO: 66059 - DNA, 19 bp, Artificial sequence
  SiRNA target sequence
acaaatttttaataaaata

SEQ ID NO: 66060 - DNA, 19 bp, Artificial sequence
  SiRNA target sequence
caaatttttaataaaataa

SEQ ID NO: 66061 - DNA, 19 bp, Artificial sequence
  SiRNA target sequence
aaatttttaataaaataaa

SEQ ID NO: 66062 - DNA, 19 bp, Artificial sequence
  SiRNA target sequence
aatttttaataaaataaat

SEQ ID NO: 66063 - DNA, 19 bp, Artificial sequence
  SiRNA target sequence
atttttaataaaataaatc

SEQ ID NO: 66064 - DNA, 19 bp, Artificial sequence
  SiRNA target sequence
tttttaataaaataaatct

SEQ ID NO: 66065 - DNA, 19 bp, Artificial sequence
  SiRNA target sequence
ttttaataaaataaatcta

SEQ ID NO: 66066 - DNA, 19 bp, Artificial sequence
  SiRNA target sequence
tttaataaaataaatctag

SEQ ID NO: 66067 - DNA, 19 bp, Artificial sequence
  SiRNA target sequence
ttaataaaataaatctaga

SEQ ID NO: 66068 - DNA, 19 bp, Artificial sequence
  SiRNA target sequence
taataaaataaatctagaa

SEQ ID NO: 66069 - DNA, 19 bp, Artificial sequence
  SiRNA target sequence
aataaaataaatctagaaa

SEQ ID NO: 66070 - DNA, 19 bp, Artificial sequence
  SiRNA target sequence
ataaaataaatctagaaat

SEQ ID NO: 66071 - DNA, 19 bp, Artificial sequence
  SiRNA target sequence
taaaataaatctagaaata

SEQ ID NO: 66072 - DNA, 19 bp, Artificial sequence
  SiRNA target sequence
aaaataaatctagaaatat

SEQ ID NO: 66073 - DNA, 19 bp, Artificial sequence
  SiRNA target sequence
aaataaatctagaaatata

SEQ ID NO: 66074 - DNA, 19 bp, Artificial sequence
  SiRNA target sequence
aataaatctagaaatatac

SEQ ID NO: 66075 - DNA, 19 bp, Artificial sequence
  SiRNA target sequence
ataaatctagaaatataca

SEQ ID NO: 66076 - DNA, 19 bp, Artificial sequence
  SiRNA target sequence
taaatctagaaatatacaa

SEQ ID NO: 66077 - DNA, 19 bp, Artificial sequence
  SiRNA target sequence
aaatctagaaatatacaaa

SEQ ID NO: 66078 - DNA, 19 bp, Artificial sequence
  SiRNA target sequence
aatctagaaatatacaaag

SEQ ID NO: 66079 - DNA, 19 bp, Artificial sequence
  SiRNA target sequence
atctagaaatatacaaagg

SEQ ID NO: 66080 - DNA, 19 bp, Artificial sequence
  SiRNA target sequence
tctagaaatatacaaagga

SEQ ID NO: 66081 - DNA, 19 bp, Artificial sequence
  SiRNA target sequence
ctagaaatatacaaaggag

SEQ ID NO: 66082 - DNA, 19 bp, Artificial sequence
  SiRNA target sequence
tagaaatatacaaaggaga

SEQ ID NO: 66083 - DNA, 19 bp, Artificial sequence
  SiRNA target sequence
agaaatatacaaaggagaa

SEQ ID NO: 66084 - DNA, 19 bp, Artificial sequence
  SiRNA target sequence
gaaatatacaaaggagaaa

SEQ ID NO: 66085 - DNA, 19 bp, Artificial sequence
  SiRNA target sequence
aaatatacaaaggagaaaa

SEQ ID NO: 66086 - DNA, 19 bp, Artificial sequence
  SiRNA target sequence
aatatacaaaggagaaaaa

SEQ ID NO: 66087 - DNA, 19 bp, Artificial sequence
  SiRNA target sequence
atatacaaaggagaaaaag

SEQ ID NO: 66088 - DNA, 19 bp, Artificial sequence
  SiRNA target sequence
tatacaaaggagaaaaagt

SEQ ID NO: 66089 - DNA, 19 bp, Artificial sequence
  SiRNA target sequence
atacaaaggagaaaaagta

SEQ ID NO: 66090 - DNA, 19 bp, Artificial sequence
  SiRNA target sequence
tacaaaggagaaaaagtag

SEQ ID NO: 66091 - DNA, 19 bp, Artificial sequence
  SiRNA target sequence
acaaaggagaaaaagtagc

SEQ ID NO: 66092 - DNA, 19 bp, Artificial sequence
  SiRNA target sequence
caaaggagaaaaagtagca

SEQ ID NO: 66093 - DNA, 19 bp, Artificial sequence
  SiRNA target sequence
aaaggagaaaaagtagcaa

SEQ ID NO: 66094 - DNA, 19 bp, Artificial sequence
  SiRNA target sequence
aaggagaaaaagtagcaat

SEQ ID NO: 66095 - DNA, 19 bp, Artificial sequence
  SiRNA target sequence
aggagaaaaagtagcaatt

SEQ ID NO: 66096 - DNA, 19 bp, Artificial sequence
  SiRNA target sequence
ggagaaaaagtagcaatta

SEQ ID NO: 66097 - DNA, 19 bp, Artificial sequence
  SiRNA target sequence
gagaaaaagtagcaattat

SEQ ID NO: 66098 - DNA, 19 bp, Artificial sequence
  SiRNA target sequence
agaaaaagtagcaattata

SEQ ID NO: 66099 - DNA, 19 bp, Artificial sequence
  SiRNA target sequence
gaaaaagtagcaattatag

SEQ ID NO: 66100 - DNA, 19 bp, Artificial sequence
  SiRNA target sequence
aaaaagtagcaattatagg

SEQ ID NO: 66101 - DNA, 19 bp, Artificial sequence
  SiRNA target sequence
aaaagtagcaattataggt

SEQ ID NO: 66102 - DNA, 19 bp, Artificial sequence
  SiRNA target sequence
aaagtagcaattataggta

SEQ ID NO: 66103 - DNA, 19 bp, Artificial sequence
  SiRNA target sequence
aagtagcaattataggtaa

SEQ ID NO: 66104 - DNA, 19 bp, Artificial sequence
  SiRNA target sequence
agtagcaattataggtaaa

SEQ ID NO: 66105 - DNA, 19 bp, Artificial sequence
  SiRNA target sequence
gtagcaattataggtaaaa

SEQ ID NO: 66106 - DNA, 19 bp, Artificial sequence
  SiRNA target sequence
tagcaattataggtaaaaa

SEQ ID NO: 66107 - DNA, 19 bp, Artificial sequence
  SiRNA target sequence
agcaattataggtaaaaat

SEQ ID NO: 66108 - DNA, 19 bp, Artificial sequence
  SiRNA target sequence
gcaattataggtaaaaatg

SEQ ID NO: 66109 - DNA, 19 bp, Artificial sequence
  SiRNA target sequence
caattataggtaaaaatgg

SEQ ID NO: 66110 - DNA, 19 bp, Artificial sequence
  SiRNA target sequence
aattataggtaaaaatggt

SEQ ID NO: 66111 - DNA, 19 bp, Artificial sequence
  SiRNA target sequence
attataggtaaaaatggta

SEQ ID NO: 66112 - DNA, 19 bp, Artificial sequence
  SiRNA target sequence
ttataggtaaaaatggtag

SEQ ID NO: 66113 - DNA, 19 bp, Artificial sequence
  SiRNA target sequence
tataggtaaaaatggtagt

SEQ ID NO: 66114 - DNA, 19 bp, Artificial sequence
  SiRNA target sequence
ataggtaaaaatggtagtg

SEQ ID NO: 66115 - DNA, 19 bp, Artificial sequence
  SiRNA target sequence
taggtaaaaatggtagtgg

SEQ ID NO: 66116 - DNA, 19 bp, Artificial sequence
  SiRNA target sequence
aggtaaaaatggtagtggt

SEQ ID NO: 66117 - DNA, 19 bp, Artificial sequence
  SiRNA target sequence
ggtaaaaatggtagtggta

SEQ ID NO: 66118 - DNA, 19 bp, Artificial sequence
  SiRNA target sequence
gtaaaaatggtagtggtaa

SEQ ID NO: 66119 - DNA, 19 bp, Artificial sequence
  SiRNA target sequence
taaaaatggtagtggtaaa

SEQ ID NO: 66120 - DNA, 19 bp, Artificial sequence
  SiRNA target sequence
aaaaatggtagtggtaaat

SEQ ID NO: 66121 - DNA, 19 bp, Artificial sequence
  SiRNA target sequence
aaaatggtagtggtaaatc

SEQ ID NO: 66122 - DNA, 19 bp, Artificial sequence
  SiRNA target sequence
aaatggtagtggtaaatca

SEQ ID NO: 66123 - DNA, 19 bp, Artificial sequence
  SiRNA target sequence
aatggtagtggtaaatcaa

SEQ ID NO: 66124 - DNA, 19 bp, Artificial sequence
  SiRNA target sequence
atggtagtggtaaatcaac

SEQ ID NO: 66125 - DNA, 19 bp, Artificial sequence
  SiRNA target sequence
tggtagtggtaaatcaaca

SEQ ID NO: 66126 - DNA, 19 bp, Artificial sequence
  SiRNA target sequence
ggtagtggtaaatcaacat

SEQ ID NO: 66127 - DNA, 19 bp, Artificial sequence
  SiRNA target sequence
gtagtggtaaatcaacatt

SEQ ID NO: 66128 - DNA, 19 bp, Artificial sequence
  SiRNA target sequence
tagtggtaaatcaacatta

SEQ ID NO: 66129 - DNA, 19 bp, Artificial sequence
  SiRNA target sequence
agtggtaaatcaacattac

SEQ ID NO: 66130 - DNA, 19 bp, Artificial sequence
  SiRNA target sequence
gtggtaaatcaacattact

SEQ ID NO: 66131 - DNA, 19 bp, Artificial sequence
  SiRNA target sequence
tggtaaatcaacattacta

SEQ ID NO: 66132 - DNA, 19 bp, Artificial sequence
  SiRNA target sequence
ggtaaatcaacattactaa

SEQ ID NO: 66133 - DNA, 19 bp, Artificial sequence
  SiRNA target sequence
gtaaatcaacattactaaa

SEQ ID NO: 66134 - DNA, 19 bp, Artificial sequence
  SiRNA target sequence
taaatcaacattactaaaa

SEQ ID NO: 66135 - DNA, 19 bp, Artificial sequence
  SiRNA target sequence
aaatcaacattactaaaac

SEQ ID NO: 66136 - DNA, 19 bp, Artificial sequence
  SiRNA target sequence
aatcaacattactaaaact

SEQ ID NO: 66137 - DNA, 19 bp, Artificial sequence
  SiRNA target sequence
atcaacattactaaaacta

SEQ ID NO: 66138 - DNA, 19 bp, Artificial sequence
  SiRNA target sequence
tcaacattactaaaactac

SEQ ID NO: 66139 - DNA, 19 bp, Artificial sequence
  SiRNA target sequence
caacattactaaaactact

SEQ ID NO: 66140 - DNA, 19 bp, Artificial sequence
  SiRNA target sequence
aacattactaaaactactg

SEQ ID NO: 66141 - DNA, 19 bp, Artificial sequence
  SiRNA target sequence
acattactaaaactactgc

SEQ ID NO: 66142 - DNA, 19 bp, Artificial sequence
  SiRNA target sequence
cattactaaaactactgct

SEQ ID NO: 66143 - DNA, 19 bp, Artificial sequence
  SiRNA target sequence
attactaaaactactgctt

SEQ ID NO: 66144 - DNA, 19 bp, Artificial sequence
  SiRNA target sequence
ttactaaaactactgctta

SEQ ID NO: 66145 - DNA, 19 bp, Artificial sequence
  SiRNA target sequence
tactaaaactactgcttaa

SEQ ID NO: 66146 - DNA, 19 bp, Artificial sequence
  SiRNA target sequence
actaaaactactgcttaaa

SEQ ID NO: 66147 - DNA, 19 bp, Artificial sequence
  SiRNA target sequence
ctaaaactactgcttaaat

SEQ ID NO: 66148 - DNA, 19 bp, Artificial sequence
  SiRNA target sequence
taaaactactgcttaaatt

SEQ ID NO: 66149 - DNA, 19 bp, Artificial sequence
  SiRNA target sequence
aaaactactgcttaaattt

SEQ ID NO: 66150 - DNA, 19 bp, Artificial sequence
  SiRNA target sequence
aaactactgcttaaatttg

SEQ ID NO: 66151 - DNA, 19 bp, Artificial sequence
  SiRNA target sequence
aactactgcttaaatttga

SEQ ID NO: 66152 - DNA, 19 bp, Artificial sequence
  SiRNA target sequence
actactgcttaaatttgat

SEQ ID NO: 66153 - DNA, 19 bp, Artificial sequence
  SiRNA target sequence
ctactgcttaaatttgatg

SEQ ID NO: 66154 - DNA, 19 bp, Artificial sequence
  SiRNA target sequence
tactgcttaaatttgatga

SEQ ID NO: 66155 - DNA, 19 bp, Artificial sequence
  SiRNA target sequence
actgcttaaatttgatgaa

SEQ ID NO: 66156 - DNA, 19 bp, Artificial sequence
  SiRNA target sequence
ctgcttaaatttgatgaag

SEQ ID NO: 66157 - DNA, 19 bp, Artificial sequence
  SiRNA target sequence
tgcttaaatttgatgaaga

SEQ ID NO: 66158 - DNA, 19 bp, Artificial sequence
  SiRNA target sequence
gcttaaatttgatgaagat

SEQ ID NO: 66159 - DNA, 19 bp, Artificial sequence
  SiRNA target sequence
cttaaatttgatgaagatt

SEQ ID NO: 66160 - DNA, 19 bp, Artificial sequence
  SiRNA target sequence
ttaaatttgatgaagatta

SEQ ID NO: 66161 - DNA, 19 bp, Artificial sequence
  SiRNA target sequence
taaatttgatgaagattac

SEQ ID NO: 66162 - DNA, 19 bp, Artificial sequence
  SiRNA target sequence
aaatttgatgaagattaca

SEQ ID NO: 66163 - DNA, 19 bp, Artificial sequence
  SiRNA target sequence
aatttgatgaagattacaa

SEQ ID NO: 66164 - DNA, 19 bp, Artificial sequence
  SiRNA target sequence
atttgatgaagattacaaa

SEQ ID NO: 66165 - DNA, 19 bp, Artificial sequence
  SiRNA target sequence
tttgatgaagattacaaag

SEQ ID NO: 66166 - DNA, 19 bp, Artificial sequence
  SiRNA target sequence
ttgatgaagattacaaagg

SEQ ID NO: 66167 - DNA, 19 bp, Artificial sequence
  SiRNA target sequence
tgatgaagattacaaaggt

SEQ ID NO: 66168 - DNA, 19 bp, Artificial sequence
  SiRNA target sequence
gatgaagattacaaaggta

SEQ ID NO: 66169 - DNA, 19 bp, Artificial sequence
  SiRNA target sequence
atgaagattacaaaggtag

SEQ ID NO: 66170 - DNA, 19 bp, Artificial sequence
  SiRNA target sequence
tgaagattacaaaggtagc

SEQ ID NO: 66171 - DNA, 19 bp, Artificial sequence
  SiRNA target sequence
gaagattacaaaggtagca

SEQ ID NO: 66172 - DNA, 19 bp, Artificial sequence
  SiRNA target sequence
aagattacaaaggtagcat

SEQ ID NO: 66173 - DNA, 19 bp, Artificial sequence
  SiRNA target sequence
agattacaaaggtagcatt

SEQ ID NO: 66174 - DNA, 19 bp, Artificial sequence
  SiRNA target sequence
gattacaaaggtagcattt

SEQ ID NO: 66175 - DNA, 19 bp, Artificial sequence
  SiRNA target sequence
attacaaaggtagcatttt

SEQ ID NO: 66176 - DNA, 19 bp, Artificial sequence
  SiRNA target sequence
ttacaaaggtagcatttta

SEQ ID NO: 66177 - DNA, 19 bp, Artificial sequence
  SiRNA target sequence
tacaaaggtagcattttaa

SEQ ID NO: 66178 - DNA, 19 bp, Artificial sequence
  SiRNA target sequence
acaaaggtagcattttaat

SEQ ID NO: 66179 - DNA, 19 bp, Artificial sequence
  SiRNA target sequence
caaaggtagcattttaata

SEQ ID NO: 66180 - DNA, 19 bp, Artificial sequence
  SiRNA target sequence
aaaggtagcattttaatag

SEQ ID NO: 66181 - DNA, 19 bp, Artificial sequence
  SiRNA target sequence
aaggtagcattttaataga

SEQ ID NO: 66182 - DNA, 19 bp, Artificial sequence
  SiRNA target sequence
aggtagcattttaatagat

SEQ ID NO: 66183 - DNA, 19 bp, Artificial sequence
  SiRNA target sequence
ggtagcattttaatagatg

SEQ ID NO: 66184 - DNA, 19 bp, Artificial sequence
  SiRNA target sequence
gtagcattttaatagatga

SEQ ID NO: 66185 - DNA, 19 bp, Artificial sequence
  SiRNA target sequence
tagcattttaatagatgac

SEQ ID NO: 66186 - DNA, 19 bp, Artificial sequence
  SiRNA target sequence
agcattttaatagatgaca

SEQ ID NO: 66187 - DNA, 19 bp, Artificial sequence
  SiRNA target sequence
gcattttaatagatgacat

SEQ ID NO: 66188 - DNA, 19 bp, Artificial sequence
  SiRNA target sequence
cattttaatagatgacatt

SEQ ID NO: 66189 - DNA, 19 bp, Artificial sequence
  SiRNA target sequence
attttaatagatgacattg

SEQ ID NO: 66190 - DNA, 19 bp, Artificial sequence
  SiRNA target sequence
ttttaatagatgacattga

SEQ ID NO: 66191 - DNA, 19 bp, Artificial sequence
  SiRNA target sequence
tttaatagatgacattgat

SEQ ID NO: 66192 - DNA, 19 bp, Artificial sequence
  SiRNA target sequence
ttaatagatgacattgata

SEQ ID NO: 66193 - DNA, 19 bp, Artificial sequence
  SiRNA target sequence
taatagatgacattgatat

SEQ ID NO: 66194 - DNA, 19 bp, Artificial sequence
  SiRNA target sequence
aatagatgacattgatatt

SEQ ID NO: 66195 - DNA, 19 bp, Artificial sequence
  SiRNA target sequence
atagatgacattgatatta

SEQ ID NO: 66196 - DNA, 19 bp, Artificial sequence
  SiRNA target sequence
tagatgacattgatattaa

SEQ ID NO: 66197 - DNA, 19 bp, Artificial sequence
  SiRNA target sequence
agatgacattgatattaaa

SEQ ID NO: 66198 - DNA, 19 bp, Artificial sequence
  SiRNA target sequence
gatgacattgatattaaaa

SEQ ID NO: 66199 - DNA, 19 bp, Artificial sequence
  SiRNA target sequence
atgacattgatattaaaaa

SEQ ID NO: 66200 - DNA, 19 bp, Artificial sequence
  SiRNA target sequence
tgacattgatattaaaaaa

SEQ ID NO: 66201 - DNA, 19 bp, Artificial sequence
  SiRNA target sequence
gacattgatattaaaaaaa

SEQ ID NO: 66202 - DNA, 19 bp, Artificial sequence
  SiRNA target sequence
acattgatattaaaaaaat

SEQ ID NO: 66203 - DNA, 19 bp, Artificial sequence
  SiRNA target sequence
cattgatattaaaaaaatc

SEQ ID NO: 66204 - DNA, 19 bp, Artificial sequence
  SiRNA target sequence
attgatattaaaaaaatca

SEQ ID NO: 66205 - DNA, 19 bp, Artificial sequence
  SiRNA target sequence
ttgatattaaaaaaatcaa

SEQ ID NO: 66206 - DNA, 19 bp, Artificial sequence
  SiRNA target sequence
tgatattaaaaaaatcaaa

SEQ ID NO: 66207 - DNA, 19 bp, Artificial sequence
  SiRNA target sequence
gatattaaaaaaatcaaag

SEQ ID NO: 66208 - DNA, 19 bp, Artificial sequence
  SiRNA target sequence
atattaaaaaaatcaaaga

SEQ ID NO: 66209 - DNA, 19 bp, Artificial sequence
  SiRNA target sequence
tattaaaaaaatcaaagac

SEQ ID NO: 66210 - DNA, 19 bp, Artificial sequence
  SiRNA target sequence
attaaaaaaatcaaagacg

SEQ ID NO: 66211 - DNA, 19 bp, Artificial sequence
  SiRNA target sequence
ttaaaaaaatcaaagacga

SEQ ID NO: 66212 - DNA, 19 bp, Artificial sequence
  SiRNA target sequence
taaaaaaatcaaagacgaa

SEQ ID NO: 66213 - DNA, 19 bp, Artificial sequence
  SiRNA target sequence
aaaaaaatcaaagacgaat

SEQ ID NO: 66214 - DNA, 19 bp, Artificial sequence
  SiRNA target sequence
aaaaaatcaaagacgaatt

SEQ ID NO: 66215 - DNA, 19 bp, Artificial sequence
  SiRNA target sequence
aaaaatcaaagacgaattt

SEQ ID NO: 66216 - DNA, 19 bp, Artificial sequence
  SiRNA target sequence
aaaatcaaagacgaatttt

SEQ ID NO: 66217 - DNA, 19 bp, Artificial sequence
  SiRNA target sequence
aaatcaaagacgaatttta

SEQ ID NO: 66218 - DNA, 19 bp, Artificial sequence
  SiRNA target sequence
aatcaaagacgaattttat

SEQ ID NO: 66219 - DNA, 19 bp, Artificial sequence
  SiRNA target sequence
atcaaagacgaattttata

SEQ ID NO: 66220 - DNA, 19 bp, Artificial sequence
  SiRNA target sequence
tcaaagacgaattttatag

SEQ ID NO: 66221 - DNA, 19 bp, Artificial sequence
  SiRNA target sequence
caaagacgaattttatagg

SEQ ID NO: 66222 - DNA, 19 bp, Artificial sequence
  SiRNA target sequence
aaagacgaattttatagga

SEQ ID NO: 66223 - DNA, 19 bp, Artificial sequence
  SiRNA target sequence
aagacgaattttataggaa

SEQ ID NO: 66224 - DNA, 19 bp, Artificial sequence
  SiRNA target sequence
agacgaattttataggaat

SEQ ID NO: 66225 - DNA, 19 bp, Artificial sequence
  SiRNA target sequence
gacgaattttataggaatt

SEQ ID NO: 66226 - DNA, 19 bp, Artificial sequence
  SiRNA target sequence
acgaattttataggaattt

SEQ ID NO: 66227 - DNA, 19 bp, Artificial sequence
  SiRNA target sequence
cgaattttataggaattta

SEQ ID NO: 66228 - DNA, 19 bp, Artificial sequence
  SiRNA target sequence
gaattttataggaatttat

SEQ ID NO: 66229 - DNA, 19 bp, Artificial sequence
  SiRNA target sequence
aattttataggaatttatt

SEQ ID NO: 66230 - DNA, 19 bp, Artificial sequence
  SiRNA target sequence
attttataggaatttatta

SEQ ID NO: 66231 - DNA, 19 bp, Artificial sequence
  SiRNA target sequence
ttttataggaatttattag

SEQ ID NO: 66232 - DNA, 19 bp, Artificial sequence
  SiRNA target sequence
tttataggaatttattagg

SEQ ID NO: 66233 - DNA, 19 bp, Artificial sequence
  SiRNA target sequence
ttataggaatttattaggt

SEQ ID NO: 66234 - DNA, 19 bp, Artificial sequence
  SiRNA target sequence
tataggaatttattaggtt

SEQ ID NO: 66235 - DNA, 19 bp, Artificial sequence
  SiRNA target sequence
ataggaatttattaggtta

SEQ ID NO: 66236 - DNA, 19 bp, Artificial sequence
  SiRNA target sequence
taggaatttattaggttac

SEQ ID NO: 66237 - DNA, 19 bp, Artificial sequence
  SiRNA target sequence
aggaatttattaggttaca

SEQ ID NO: 66238 - DNA, 19 bp, Artificial sequence
  SiRNA target sequence
ggaatttattaggttacat

SEQ ID NO: 66239 - DNA, 19 bp, Artificial sequence
  SiRNA target sequence
gaatttattaggttacata

SEQ ID NO: 66240 - DNA, 19 bp, Artificial sequence
  SiRNA target sequence
aatttattaggttacatac

SEQ ID NO: 66241 - DNA, 19 bp, Artificial sequence
  SiRNA target sequence
atttattaggttacatacc

SEQ ID NO: 66242 - DNA, 19 bp, Artificial sequence
  SiRNA target sequence
tttattaggttacatacca

SEQ ID NO: 66243 - DNA, 19 bp, Artificial sequence
  SiRNA target sequence
ttattaggttacataccac

SEQ ID NO: 66244 - DNA, 19 bp, Artificial sequence
  SiRNA target sequence
tattaggttacataccaca

SEQ ID NO: 66245 - DNA, 19 bp, Artificial sequence
  SiRNA target sequence
attaggttacataccacag

SEQ ID NO: 66246 - DNA, 19 bp, Artificial sequence
  SiRNA target sequence
ttaggttacataccacaga

SEQ ID NO: 66247 - DNA, 19 bp, Artificial sequence
  SiRNA target sequence
taggttacataccacagaa

SEQ ID NO: 66248 - DNA, 19 bp, Artificial sequence
  SiRNA target sequence
aggttacataccacagaat

SEQ ID NO: 66249 - DNA, 19 bp, Artificial sequence
  SiRNA target sequence
ggttacataccacagaata

SEQ ID NO: 66250 - DNA, 19 bp, Artificial sequence
  SiRNA target sequence
gttacataccacagaatac

SEQ ID NO: 66251 - DNA, 19 bp, Artificial sequence
  SiRNA target sequence
ttacataccacagaataca

SEQ ID NO: 66252 - DNA, 19 bp, Artificial sequence
  SiRNA target sequence
tacataccacagaatacat

SEQ ID NO: 66253 - DNA, 19 bp, Artificial sequence
  SiRNA target sequence
acataccacagaatacatt

SEQ ID NO: 66254 - DNA, 19 bp, Artificial sequence
  SiRNA target sequence
cataccacagaatacattt

SEQ ID NO: 66255 - DNA, 19 bp, Artificial sequence
  SiRNA target sequence
ataccacagaatacatttt

SEQ ID NO: 66256 - DNA, 19 bp, Artificial sequence
  SiRNA target sequence
taccacagaatacattttt

SEQ ID NO: 66257 - DNA, 19 bp, Artificial sequence
  SiRNA target sequence
accacagaatacatttttg

SEQ ID NO: 66258 - DNA, 19 bp, Artificial sequence
  SiRNA target sequence
ccacagaatacatttttgt

SEQ ID NO: 66259 - DNA, 19 bp, Artificial sequence
  SiRNA target sequence
cacagaatacatttttgtt

SEQ ID NO: 66260 - DNA, 19 bp, Artificial sequence
  SiRNA target sequence
acagaatacatttttgttt

SEQ ID NO: 66261 - DNA, 19 bp, Artificial sequence
  SiRNA target sequence
cagaatacatttttgttta

SEQ ID NO: 66262 - DNA, 19 bp, Artificial sequence
  SiRNA target sequence
agaatacatttttgtttaa

SEQ ID NO: 66263 - DNA, 19 bp, Artificial sequence
  SiRNA target sequence
gaatacatttttgtttaat

SEQ ID NO: 66264 - DNA, 19 bp, Artificial sequence
  SiRNA target sequence
aatacatttttgtttaatg

SEQ ID NO: 66265 - DNA, 19 bp, Artificial sequence
  SiRNA target sequence
atacatttttgtttaatga

SEQ ID NO: 66266 - DNA, 19 bp, Artificial sequence
  SiRNA target sequence
tacatttttgtttaatgaa

SEQ ID NO: 66267 - DNA, 19 bp, Artificial sequence
  SiRNA target sequence
acatttttgtttaatgaat

SEQ ID NO: 66268 - DNA, 19 bp, Artificial sequence
  SiRNA target sequence
catttttgtttaatgaatc

SEQ ID NO: 66269 - DNA, 19 bp, Artificial sequence
  SiRNA target sequence
atttttgtttaatgaatct

SEQ ID NO: 66270 - DNA, 19 bp, Artificial sequence
  SiRNA target sequence
tttttgtttaatgaatctg

SEQ ID NO: 66271 - DNA, 19 bp, Artificial sequence
  SiRNA target sequence
ttttgtttaatgaatctgt

SEQ ID NO: 66272 - DNA, 19 bp, Artificial sequence
  SiRNA target sequence
tttgtttaatgaatctgta

SEQ ID NO: 66273 - DNA, 19 bp, Artificial sequence
  SiRNA target sequence
ttgtttaatgaatctgtaa

SEQ ID NO: 66274 - DNA, 19 bp, Artificial sequence
  SiRNA target sequence
tgtttaatgaatctgtaaa

SEQ ID NO: 66275 - DNA, 19 bp, Artificial sequence
  SiRNA target sequence
gtttaatgaatctgtaaaa

SEQ ID NO: 66276 - DNA, 19 bp, Artificial sequence
  SiRNA target sequence
tttaatgaatctgtaaaat

SEQ ID NO: 66277 - DNA, 19 bp, Artificial sequence
  SiRNA target sequence
ttaatgaatctgtaaaata

SEQ ID NO: 66278 - DNA, 19 bp, Artificial sequence
  SiRNA target sequence
taatgaatctgtaaaatat

SEQ ID NO: 66279 - DNA, 19 bp, Artificial sequence
  SiRNA target sequence
aatgaatctgtaaaatata

SEQ ID NO: 66280 - DNA, 19 bp, Artificial sequence
  SiRNA target sequence
atgaatctgtaaaatataa

SEQ ID NO: 66281 - DNA, 19 bp, Artificial sequence
  SiRNA target sequence
tgaatctgtaaaatataat

SEQ ID NO: 66282 - DNA, 19 bp, Artificial sequence
  SiRNA target sequence
gaatctgtaaaatataata

SEQ ID NO: 66283 - DNA, 19 bp, Artificial sequence
  SiRNA target sequence
aatctgtaaaatataatat

SEQ ID NO: 66284 - DNA, 19 bp, Artificial sequence
  SiRNA target sequence
atctgtaaaatataatatt

SEQ ID NO: 66285 - DNA, 19 bp, Artificial sequence
  SiRNA target sequence
tctgtaaaatataatatta

SEQ ID NO: 66286 - DNA, 19 bp, Artificial sequence
  SiRNA target sequence
ctgtaaaatataatattaa

SEQ ID NO: 66287 - DNA, 19 bp, Artificial sequence
  SiRNA target sequence
tgtaaaatataatattaaa

SEQ ID NO: 66288 - DNA, 19 bp, Artificial sequence
  SiRNA target sequence
gtaaaatataatattaaat

SEQ ID NO: 66289 - DNA, 19 bp, Artificial sequence
  SiRNA target sequence
taaaatataatattaaata

SEQ ID NO: 66290 - DNA, 19 bp, Artificial sequence
  SiRNA target sequence
aaaatataatattaaatac

SEQ ID NO: 66291 - DNA, 19 bp, Artificial sequence
  SiRNA target sequence
aaatataatattaaatacg

SEQ ID NO: 66292 - DNA, 19 bp, Artificial sequence
  SiRNA target sequence
aatataatattaaatacgg

SEQ ID NO: 66293 - DNA, 19 bp, Artificial sequence
  SiRNA target sequence
atataatattaaatacgga

SEQ ID NO: 66294 - DNA, 19 bp, Artificial sequence
  SiRNA target sequence
tataatattaaatacggat

SEQ ID NO: 66295 - DNA, 19 bp, Artificial sequence
  SiRNA target sequence
ataatattaaatacggatc

SEQ ID NO: 66296 - DNA, 19 bp, Artificial sequence
  SiRNA target sequence
taatattaaatacggatct

SEQ ID NO: 66297 - DNA, 19 bp, Artificial sequence
  SiRNA target sequence
aatattaaatacggatctt

SEQ ID NO: 66298 - DNA, 19 bp, Artificial sequence
  SiRNA target sequence
atattaaatacggatcttt

SEQ ID NO: 66299 - DNA, 19 bp, Artificial sequence
  SiRNA target sequence
tattaaatacggatctttt

SEQ ID NO: 66300 - DNA, 19 bp, Artificial sequence
  SiRNA target sequence
attaaatacggatcttttg

SEQ ID NO: 66301 - DNA, 19 bp, Artificial sequence
  SiRNA target sequence
ttaaatacggatcttttgg

SEQ ID NO: 66302 - DNA, 19 bp, Artificial sequence
  SiRNA target sequence
taaatacggatcttttggt

SEQ ID NO: 66303 - DNA, 19 bp, Artificial sequence
  SiRNA target sequence
aaatacggatcttttggta

SEQ ID NO: 66304 - DNA, 19 bp, Artificial sequence
  SiRNA target sequence
aatacggatcttttggtat

SEQ ID NO: 66305 - DNA, 19 bp, Artificial sequence
  SiRNA target sequence
atacggatcttttggtatt

SEQ ID NO: 66306 - DNA, 19 bp, Artificial sequence
  SiRNA target sequence
tacggatcttttggtattt

SEQ ID NO: 66307 - DNA, 19 bp, Artificial sequence
  SiRNA target sequence
acggatcttttggtatttc

SEQ ID NO: 66308 - DNA, 19 bp, Artificial sequence
  SiRNA target sequence
cggatcttttggtatttca

SEQ ID NO: 66309 - DNA, 19 bp, Artificial sequence
  SiRNA target sequence
ggatcttttggtatttcag

SEQ ID NO: 66310 - DNA, 19 bp, Artificial sequence
  SiRNA target sequence
gatcttttggtatttcaga

SEQ ID NO: 66311 - DNA, 19 bp, Artificial sequence
  SiRNA target sequence
atcttttggtatttcagac

SEQ ID NO: 66312 - DNA, 19 bp, Artificial sequence
  SiRNA target sequence
tcttttggtatttcagacg

SEQ ID NO: 66313 - DNA, 19 bp, Artificial sequence
  SiRNA target sequence
cttttggtatttcagacga

SEQ ID NO: 66314 - DNA, 19 bp, Artificial sequence
  SiRNA target sequence
ttttggtatttcagacgag

SEQ ID NO: 66315 - DNA, 19 bp, Artificial sequence
  SiRNA target sequence
tttggtatttcagacgagg

SEQ ID NO: 66316 - DNA, 19 bp, Artificial sequence
  SiRNA target sequence
ttggtatttcagacgagga

SEQ ID NO: 66317 - DNA, 19 bp, Artificial sequence
  SiRNA target sequence
tggtatttcagacgaggat

SEQ ID NO: 66318 - DNA, 19 bp, Artificial sequence
  SiRNA target sequence
ggtatttcagacgaggata

SEQ ID NO: 66319 - DNA, 19 bp, Artificial sequence
  SiRNA target sequence
gtatttcagacgaggatat

SEQ ID NO: 66320 - DNA, 19 bp, Artificial sequence
  SiRNA target sequence
tatttcagacgaggatatt

SEQ ID NO: 66321 - DNA, 19 bp, Artificial sequence
  SiRNA target sequence
atttcagacgaggatattt

SEQ ID NO: 66322 - DNA, 19 bp, Artificial sequence
  SiRNA target sequence
tttcagacgaggatatttt

SEQ ID NO: 66323 - DNA, 19 bp, Artificial sequence
  SiRNA target sequence
ttcagacgaggatattttt

SEQ ID NO: 66324 - DNA, 19 bp, Artificial sequence
  SiRNA target sequence
tcagacgaggatatttttg

SEQ ID NO: 66325 - DNA, 19 bp, Artificial sequence
  SiRNA target sequence
cagacgaggatatttttgc

SEQ ID NO: 66326 - DNA, 19 bp, Artificial sequence
  SiRNA target sequence
agacgaggatatttttgca

SEQ ID NO: 66327 - DNA, 19 bp, Artificial sequence
  SiRNA target sequence
gacgaggatatttttgcat

SEQ ID NO: 66328 - DNA, 19 bp, Artificial sequence
  SiRNA target sequence
acgaggatatttttgcatt

SEQ ID NO: 66329 - DNA, 19 bp, Artificial sequence
  SiRNA target sequence
cgaggatatttttgcattg

SEQ ID NO: 66330 - DNA, 19 bp, Artificial sequence
  SiRNA target sequence
gaggatatttttgcattgt

SEQ ID NO: 66331 - DNA, 19 bp, Artificial sequence
  SiRNA target sequence
aggatatttttgcattgtg

SEQ ID NO: 66332 - DNA, 19 bp, Artificial sequence
  SiRNA target sequence
ggatatttttgcattgtgt

SEQ ID NO: 66333 - DNA, 19 bp, Artificial sequence
  SiRNA target sequence
gatatttttgcattgtgta

SEQ ID NO: 66334 - DNA, 19 bp, Artificial sequence
  SiRNA target sequence
atatttttgcattgtgtaa

SEQ ID NO: 66335 - DNA, 19 bp, Artificial sequence
  SiRNA target sequence
tatttttgcattgtgtaaa

SEQ ID NO: 66336 - DNA, 19 bp, Artificial sequence
  SiRNA target sequence
atttttgcattgtgtaaag

SEQ ID NO: 66337 - DNA, 19 bp, Artificial sequence
  SiRNA target sequence
tttttgcattgtgtaaaga

SEQ ID NO: 66338 - DNA, 19 bp, Artificial sequence
  SiRNA target sequence
ttttgcattgtgtaaagag

SEQ ID NO: 66339 - DNA, 19 bp, Artificial sequence
  SiRNA target sequence
tttgcattgtgtaaagagt

SEQ ID NO: 66340 - DNA, 19 bp, Artificial sequence
  SiRNA target sequence
ttgcattgtgtaaagagtt

SEQ ID NO: 66341 - DNA, 19 bp, Artificial sequence
  SiRNA target sequence
tgcattgtgtaaagagttt

SEQ ID NO: 66342 - DNA, 19 bp, Artificial sequence
  SiRNA target sequence
gcattgtgtaaagagtttg

SEQ ID NO: 66343 - DNA, 19 bp, Artificial sequence
  SiRNA target sequence
cattgtgtaaagagtttgg

SEQ ID NO: 66344 - DNA, 19 bp, Artificial sequence
  SiRNA target sequence
attgtgtaaagagtttgga

SEQ ID NO: 66345 - DNA, 19 bp, Artificial sequence
  SiRNA target sequence
ttgtgtaaagagtttggat

SEQ ID NO: 66346 - DNA, 19 bp, Artificial sequence
  SiRNA target sequence
tgtgtaaagagtttggatt

SEQ ID NO: 66347 - DNA, 19 bp, Artificial sequence
  SiRNA target sequence
gtgtaaagagtttggatta

SEQ ID NO: 66348 - DNA, 19 bp, Artificial sequence
  SiRNA target sequence
tgtaaagagtttggattat

SEQ ID NO: 66349 - DNA, 19 bp, Artificial sequence
  SiRNA target sequence
gtaaagagtttggattata

SEQ ID NO: 66350 - DNA, 19 bp, Artificial sequence
  SiRNA target sequence
taaagagtttggattatat

SEQ ID NO: 66351 - DNA, 19 bp, Artificial sequence
  SiRNA target sequence
aaagagtttggattatatg

SEQ ID NO: 66352 - DNA, 19 bp, Artificial sequence
  SiRNA target sequence
aagagtttggattatatga

SEQ ID NO: 66353 - DNA, 19 bp, Artificial sequence
  SiRNA target sequence
agagtttggattatatgac

SEQ ID NO: 66354 - DNA, 19 bp, Artificial sequence
  SiRNA target sequence
gagtttggattatatgacg

SEQ ID NO: 66355 - DNA, 19 bp, Artificial sequence
  SiRNA target sequence
agtttggattatatgacgt

SEQ ID NO: 66356 - DNA, 19 bp, Artificial sequence
  SiRNA target sequence
gtttggattatatgacgtt

SEQ ID NO: 66357 - DNA, 19 bp, Artificial sequence
  SiRNA target sequence
tttggattatatgacgttt

SEQ ID NO: 66358 - DNA, 19 bp, Artificial sequence
  SiRNA target sequence
ttggattatatgacgtttt

SEQ ID NO: 66359 - DNA, 19 bp, Artificial sequence
  SiRNA target sequence
tggattatatgacgttttc

SEQ ID NO: 66360 - DNA, 19 bp, Artificial sequence
  SiRNA target sequence
ggattatatgacgttttca

SEQ ID NO: 66361 - DNA, 19 bp, Artificial sequence
  SiRNA target sequence
gattatatgacgttttcat

SEQ ID NO: 66362 - DNA, 19 bp, Artificial sequence
  SiRNA target sequence
attatatgacgttttcatg

SEQ ID NO: 66363 - DNA, 19 bp, Artificial sequence
  SiRNA target sequence
ttatatgacgttttcatga

SEQ ID NO: 66364 - DNA, 19 bp, Artificial sequence
  SiRNA target sequence
tatatgacgttttcatgaa

SEQ ID NO: 66365 - DNA, 19 bp, Artificial sequence
  SiRNA target sequence
atatgacgttttcatgaac

SEQ ID NO: 66366 - DNA, 19 bp, Artificial sequence
  SiRNA target sequence
tatgacgttttcatgaacc

SEQ ID NO: 66367 - DNA, 19 bp, Artificial sequence
  SiRNA target sequence
atgacgttttcatgaacct

SEQ ID NO: 66368 - DNA, 19 bp, Artificial sequence
  SiRNA target sequence
tgacgttttcatgaacctc

SEQ ID NO: 66369 - DNA, 19 bp, Artificial sequence
  SiRNA target sequence
gacgttttcatgaacctcg

SEQ ID NO: 66370 - DNA, 19 bp, Artificial sequence
  SiRNA target sequence
acgttttcatgaacctcga

SEQ ID NO: 66371 - DNA, 19 bp, Artificial sequence
  SiRNA target sequence
cgttttcatgaacctcgaa

SEQ ID NO: 66372 - DNA, 19 bp, Artificial sequence
  SiRNA target sequence
gttttcatgaacctcgaaa

SEQ ID NO: 66373 - DNA, 19 bp, Artificial sequence
  SiRNA target sequence
ttttcatgaacctcgaaaa

SEQ ID NO: 66374 - DNA, 19 bp, Artificial sequence
  SiRNA target sequence
tttcatgaacctcgaaaat

SEQ ID NO: 66375 - DNA, 19 bp, Artificial sequence
  SiRNA target sequence
ttcatgaacctcgaaaatg

SEQ ID NO: 66376 - DNA, 19 bp, Artificial sequence
  SiRNA target sequence
tcatgaacctcgaaaatgg

SEQ ID NO: 66377 - DNA, 19 bp, Artificial sequence
  SiRNA target sequence
catgaacctcgaaaatggt

SEQ ID NO: 66378 - DNA, 19 bp, Artificial sequence
  SiRNA target sequence
atgaacctcgaaaatggtt

SEQ ID NO: 66379 - DNA, 19 bp, Artificial sequence
  SiRNA target sequence
tgaacctcgaaaatggttt

SEQ ID NO: 66380 - DNA, 19 bp, Artificial sequence
  SiRNA target sequence
gaacctcgaaaatggtttt

SEQ ID NO: 66381 - DNA, 19 bp, Artificial sequence
  SiRNA target sequence
aacctcgaaaatggttttg

SEQ ID NO: 66382 - DNA, 19 bp, Artificial sequence
  SiRNA target sequence
acctcgaaaatggttttga

SEQ ID NO: 66383 - DNA, 19 bp, Artificial sequence
  SiRNA target sequence
cctcgaaaatggttttgat

SEQ ID NO: 66384 - DNA, 19 bp, Artificial sequence
  SiRNA target sequence
ctcgaaaatggttttgata

SEQ ID NO: 66385 - DNA, 19 bp, Artificial sequence
  SiRNA target sequence
tcgaaaatggttttgatac

SEQ ID NO: 66386 - DNA, 19 bp, Artificial sequence
  SiRNA target sequence
cgaaaatggttttgatacg

SEQ ID NO: 66387 - DNA, 19 bp, Artificial sequence
  SiRNA target sequence
gaaaatggttttgatacga

SEQ ID NO: 66388 - DNA, 19 bp, Artificial sequence
  SiRNA target sequence
aaaatggttttgatacgaa

SEQ ID NO: 66389 - DNA, 19 bp, Artificial sequence
  SiRNA target sequence
aaatggttttgatacgaat

SEQ ID NO: 66390 - DNA, 19 bp, Artificial sequence
  SiRNA target sequence
aatggttttgatacgaatg

SEQ ID NO: 66391 - DNA, 19 bp, Artificial sequence
  SiRNA target sequence
atggttttgatacgaatgt

SEQ ID NO: 66392 - DNA, 19 bp, Artificial sequence
  SiRNA target sequence
tggttttgatacgaatgta

SEQ ID NO: 66393 - DNA, 19 bp, Artificial sequence
  SiRNA target sequence
ggttttgatacgaatgtag

SEQ ID NO: 66394 - DNA, 19 bp, Artificial sequence
  SiRNA target sequence
gttttgatacgaatgtagg

SEQ ID NO: 66395 - DNA, 19 bp, Artificial sequence
  SiRNA target sequence
ttttgatacgaatgtagga

SEQ ID NO: 66396 - DNA, 19 bp, Artificial sequence
  SiRNA target sequence
tttgatacgaatgtaggag

SEQ ID NO: 66397 - DNA, 19 bp, Artificial sequence
  SiRNA target sequence
ttgatacgaatgtaggaga

SEQ ID NO: 66398 - DNA, 19 bp, Artificial sequence
  SiRNA target sequence
tgatacgaatgtaggagaa

SEQ ID NO: 66399 - DNA, 19 bp, Artificial sequence
  SiRNA target sequence
gatacgaatgtaggagaaa

SEQ ID NO: 66400 - DNA, 19 bp, Artificial sequence
  SiRNA target sequence
atacgaatgtaggagaaag

SEQ ID NO: 66401 - DNA, 19 bp, Artificial sequence
  SiRNA target sequence
tacgaatgtaggagaaaga

SEQ ID NO: 66402 - DNA, 19 bp, Artificial sequence
  SiRNA target sequence
acgaatgtaggagaaagag

SEQ ID NO: 66403 - DNA, 19 bp, Artificial sequence
  SiRNA target sequence
cgaatgtaggagaaagagg

SEQ ID NO: 66404 - DNA, 19 bp, Artificial sequence
  SiRNA target sequence
gaatgtaggagaaagagga

SEQ ID NO: 66405 - DNA, 19 bp, Artificial sequence
  SiRNA target sequence
aatgtaggagaaagaggaa

SEQ ID NO: 66406 - DNA, 19 bp, Artificial sequence
  SiRNA target sequence
atgtaggagaaagaggaag

SEQ ID NO: 66407 - DNA, 19 bp, Artificial sequence
  SiRNA target sequence
tgtaggagaaagaggaagg

SEQ ID NO: 66408 - DNA, 19 bp, Artificial sequence
  SiRNA target sequence
gtaggagaaagaggaaggt

SEQ ID NO: 66409 - DNA, 19 bp, Artificial sequence
  SiRNA target sequence
taggagaaagaggaaggtt

SEQ ID NO: 66410 - DNA, 19 bp, Artificial sequence
  SiRNA target sequence
aggagaaagaggaaggtta

SEQ ID NO: 66411 - DNA, 19 bp, Artificial sequence
  SiRNA target sequence
ggagaaagaggaaggttat

SEQ ID NO: 66412 - DNA, 19 bp, Artificial sequence
  SiRNA target sequence
gagaaagaggaaggttatt

SEQ ID NO: 66413 - DNA, 19 bp, Artificial sequence
  SiRNA target sequence
agaaagaggaaggttatta

SEQ ID NO: 66414 - DNA, 19 bp, Artificial sequence
  SiRNA target sequence
gaaagaggaaggttattaa

SEQ ID NO: 66415 - DNA, 19 bp, Artificial sequence
  SiRNA target sequence
aaagaggaaggttattaag

SEQ ID NO: 66416 - DNA, 19 bp, Artificial sequence
  SiRNA target sequence
aagaggaaggttattaagt

SEQ ID NO: 66417 - DNA, 19 bp, Artificial sequence
  SiRNA target sequence
agaggaaggttattaagtg

SEQ ID NO: 66418 - DNA, 19 bp, Artificial sequence
  SiRNA target sequence
gaggaaggttattaagtgg

SEQ ID NO: 66419 - DNA, 19 bp, Artificial sequence
  SiRNA target sequence
aggaaggttattaagtggt

SEQ ID NO: 66420 - DNA, 19 bp, Artificial sequence
  SiRNA target sequence
ggaaggttattaagtggtg

SEQ ID NO: 66421 - DNA, 19 bp, Artificial sequence
  SiRNA target sequence
gaaggttattaagtggtgg

SEQ ID NO: 66422 - DNA, 19 bp, Artificial sequence
  SiRNA target sequence
aaggttattaagtggtgga

SEQ ID NO: 66423 - DNA, 19 bp, Artificial sequence
  SiRNA target sequence
aggttattaagtggtggag

SEQ ID NO: 66424 - DNA, 19 bp, Artificial sequence
  SiRNA target sequence
ggttattaagtggtggaga

SEQ ID NO: 66425 - DNA, 19 bp, Artificial sequence
  SiRNA target sequence
gttattaagtggtggagaa

SEQ ID NO: 66426 - DNA, 19 bp, Artificial sequence
  SiRNA target sequence
ttattaagtggtggagaaa

SEQ ID NO: 66427 - DNA, 19 bp, Artificial sequence
  SiRNA target sequence
tattaagtggtggagaaaa

SEQ ID NO: 66428 - DNA, 19 bp, Artificial sequence
  SiRNA target sequence
attaagtggtggagaaaag

SEQ ID NO: 66429 - DNA, 19 bp, Artificial sequence
  SiRNA target sequence
ttaagtggtggagaaaagc

SEQ ID NO: 66430 - DNA, 19 bp, Artificial sequence
  SiRNA target sequence
taagtggtggagaaaagca

SEQ ID NO: 66431 - DNA, 19 bp, Artificial sequence
  SiRNA target sequence
aagtggtggagaaaagcaa

SEQ ID NO: 66432 - DNA, 19 bp, Artificial sequence
  SiRNA target sequence
agtggtggagaaaagcaaa

SEQ ID NO: 66433 - DNA, 19 bp, Artificial sequence
  SiRNA target sequence
gtggtggagaaaagcaaaa

SEQ ID NO: 66434 - DNA, 19 bp, Artificial sequence
  SiRNA target sequence
tggtggagaaaagcaaaag

SEQ ID NO: 66435 - DNA, 19 bp, Artificial sequence
  SiRNA target sequence
ggtggagaaaagcaaaaga

SEQ ID NO: 66436 - DNA, 19 bp, Artificial sequence
  SiRNA target sequence
gtggagaaaagcaaaagat

SEQ ID NO: 66437 - DNA, 19 bp, Artificial sequence
  SiRNA target sequence
tggagaaaagcaaaagatt

SEQ ID NO: 66438 - DNA, 19 bp, Artificial sequence
  SiRNA target sequence
ggagaaaagcaaaagattt

SEQ ID NO: 66439 - DNA, 19 bp, Artificial sequence
  SiRNA target sequence
gagaaaagcaaaagatttt

SEQ ID NO: 66440 - DNA, 19 bp, Artificial sequence
  SiRNA target sequence
agaaaagcaaaagatttta

SEQ ID NO: 66441 - DNA, 19 bp, Artificial sequence
  SiRNA target sequence
gaaaagcaaaagattttat

SEQ ID NO: 66442 - DNA, 19 bp, Artificial sequence
  SiRNA target sequence
aaaagcaaaagattttatt

SEQ ID NO: 66443 - DNA, 19 bp, Artificial sequence
  SiRNA target sequence
aaagcaaaagattttatta

SEQ ID NO: 66444 - DNA, 19 bp, Artificial sequence
  SiRNA target sequence
aagcaaaagattttattaa

SEQ ID NO: 66445 - DNA, 19 bp, Artificial sequence
  SiRNA target sequence
agcaaaagattttattaat

SEQ ID NO: 66446 - DNA, 19 bp, Artificial sequence
  SiRNA target sequence
gcaaaagattttattaatg

SEQ ID NO: 66447 - DNA, 19 bp, Artificial sequence
  SiRNA target sequence
caaaagattttattaatgc

SEQ ID NO: 66448 - DNA, 19 bp, Artificial sequence
  SiRNA target sequence
aaaagattttattaatgcg

SEQ ID NO: 66449 - DNA, 19 bp, Artificial sequence
  SiRNA target sequence
aaagattttattaatgcgt

SEQ ID NO: 66450 - DNA, 19 bp, Artificial sequence
  SiRNA target sequence
aagattttattaatgcgta

SEQ ID NO: 66451 - DNA, 19 bp, Artificial sequence
  SiRNA target sequence
agattttattaatgcgtac

SEQ ID NO: 66452 - DNA, 19 bp, Artificial sequence
  SiRNA target sequence
gattttattaatgcgtact

SEQ ID NO: 66453 - DNA, 19 bp, Artificial sequence
  SiRNA target sequence
attttattaatgcgtacta

SEQ ID NO: 66454 - DNA, 19 bp, Artificial sequence
  SiRNA target sequence
ttttattaatgcgtactat

SEQ ID NO: 66455 - DNA, 19 bp, Artificial sequence
  SiRNA target sequence
tttattaatgcgtactatg

SEQ ID NO: 66456 - DNA, 19 bp, Artificial sequence
  SiRNA target sequence
ttattaatgcgtactatgt

SEQ ID NO: 66457 - DNA, 19 bp, Artificial sequence
  SiRNA target sequence
tattaatgcgtactatgtt

SEQ ID NO: 66458 - DNA, 19 bp, Artificial sequence
  SiRNA target sequence
attaatgcgtactatgtta

SEQ ID NO: 66459 - DNA, 19 bp, Artificial sequence
  SiRNA target sequence
ttaatgcgtactatgttaa

SEQ ID NO: 66460 - DNA, 19 bp, Artificial sequence
  SiRNA target sequence
taatgcgtactatgttaag

SEQ ID NO: 66461 - DNA, 19 bp, Artificial sequence
  SiRNA target sequence
aatgcgtactatgttaaga

SEQ ID NO: 66462 - DNA, 19 bp, Artificial sequence
  SiRNA target sequence
atgcgtactatgttaagaa

SEQ ID NO: 66463 - DNA, 19 bp, Artificial sequence
  SiRNA target sequence
tgcgtactatgttaagaaa

SEQ ID NO: 66464 - DNA, 19 bp, Artificial sequence
  SiRNA target sequence
gcgtactatgttaagaaac

SEQ ID NO: 66465 - DNA, 19 bp, Artificial sequence
  SiRNA target sequence
cgtactatgttaagaaaca

SEQ ID NO: 66466 - DNA, 19 bp, Artificial sequence
  SiRNA target sequence
gtactatgttaagaaacaa

SEQ ID NO: 66467 - DNA, 19 bp, Artificial sequence
  SiRNA target sequence
tactatgttaagaaacaag

SEQ ID NO: 66468 - DNA, 19 bp, Artificial sequence
  SiRNA target sequence
actatgttaagaaacaagg

SEQ ID NO: 66469 - DNA, 19 bp, Artificial sequence
  SiRNA target sequence
ctatgttaagaaacaagga

SEQ ID NO: 66470 - DNA, 19 bp, Artificial sequence
  SiRNA target sequence
tatgttaagaaacaaggag

SEQ ID NO: 66471 - DNA, 19 bp, Artificial sequence
  SiRNA target sequence
atgttaagaaacaaggaga

SEQ ID NO: 66472 - DNA, 19 bp, Artificial sequence
  SiRNA target sequence
tgttaagaaacaaggagat

SEQ ID NO: 66473 - DNA, 19 bp, Artificial sequence
  SiRNA target sequence
gttaagaaacaaggagata

SEQ ID NO: 66474 - DNA, 19 bp, Artificial sequence
  SiRNA target sequence
ttaagaaacaaggagataa

SEQ ID NO: 66475 - DNA, 19 bp, Artificial sequence
  SiRNA target sequence
taagaaacaaggagataat

SEQ ID NO: 66476 - DNA, 19 bp, Artificial sequence
  SiRNA target sequence
aagaaacaaggagataatg

SEQ ID NO: 66477 - DNA, 19 bp, Artificial sequence
  SiRNA target sequence
agaaacaaggagataatgg

SEQ ID NO: 66478 - DNA, 19 bp, Artificial sequence
  SiRNA target sequence
gaaacaaggagataatggc

SEQ ID NO: 66479 - DNA, 19 bp, Artificial sequence
  SiRNA target sequence
aaacaaggagataatggca

SEQ ID NO: 66480 - DNA, 19 bp, Artificial sequence
  SiRNA target sequence
aacaaggagataatggcat

SEQ ID NO: 66481 - DNA, 19 bp, Artificial sequence
  SiRNA target sequence
acaaggagataatggcatt

SEQ ID NO: 66482 - DNA, 19 bp, Artificial sequence
  SiRNA target sequence
caaggagataatggcatta

SEQ ID NO: 66483 - DNA, 19 bp, Artificial sequence
  SiRNA target sequence
aaggagataatggcattag

SEQ ID NO: 66484 - DNA, 19 bp, Artificial sequence
  SiRNA target sequence
aggagataatggcattaga

SEQ ID NO: 66485 - DNA, 19 bp, Artificial sequence
  SiRNA target sequence
ggagataatggcattagat

SEQ ID NO: 66486 - DNA, 19 bp, Artificial sequence
  SiRNA target sequence
gagataatggcattagatg

SEQ ID NO: 66487 - DNA, 19 bp, Artificial sequence
  SiRNA target sequence
agataatggcattagatga

SEQ ID NO: 66488 - DNA, 19 bp, Artificial sequence
  SiRNA target sequence
gataatggcattagatgaa

SEQ ID NO: 66489 - DNA, 19 bp, Artificial sequence
  SiRNA target sequence
ataatggcattagatgaac

SEQ ID NO: 66490 - DNA, 19 bp, Artificial sequence
  SiRNA target sequence
taatggcattagatgaacc

SEQ ID NO: 66491 - DNA, 19 bp, Artificial sequence
  SiRNA target sequence
aatggcattagatgaaccc

SEQ ID NO: 66492 - DNA, 19 bp, Artificial sequence
  SiRNA target sequence
atggcattagatgaaccca

SEQ ID NO: 66493 - DNA, 19 bp, Artificial sequence
  SiRNA target sequence
tggcattagatgaacccac

SEQ ID NO: 66494 - DNA, 19 bp, Artificial sequence
  SiRNA target sequence
ggcattagatgaacccact

SEQ ID NO: 66495 - DNA, 19 bp, Artificial sequence
  SiRNA target sequence
gcattagatgaacccactg

SEQ ID NO: 66496 - DNA, 19 bp, Artificial sequence
  SiRNA target sequence
cattagatgaacccactgc

SEQ ID NO: 66497 - DNA, 19 bp, Artificial sequence
  SiRNA target sequence
attagatgaacccactgca

SEQ ID NO: 66498 - DNA, 19 bp, Artificial sequence
  SiRNA target sequence
ttagatgaacccactgcag

SEQ ID NO: 66499 - DNA, 19 bp, Artificial sequence
  SiRNA target sequence
tagatgaacccactgcagc

SEQ ID NO: 66500 - DNA, 19 bp, Artificial sequence
  SiRNA target sequence
agatgaacccactgcagca

SEQ ID NO: 66501 - DNA, 19 bp, Artificial sequence
  SiRNA target sequence
gatgaacccactgcagcac

SEQ ID NO: 66502 - DNA, 19 bp, Artificial sequence
  SiRNA target sequence
atgaacccactgcagcact

SEQ ID NO: 66503 - DNA, 19 bp, Artificial sequence
  SiRNA target sequence
tgaacccactgcagcactt

SEQ ID NO: 66504 - DNA, 19 bp, Artificial sequence
  SiRNA target sequence
gaacccactgcagcacttg

SEQ ID NO: 66505 - DNA, 19 bp, Artificial sequence
  SiRNA target sequence
aacccactgcagcacttga

SEQ ID NO: 66506 - DNA, 19 bp, Artificial sequence
  SiRNA target sequence
acccactgcagcacttgat

SEQ ID NO: 66507 - DNA, 19 bp, Artificial sequence
  SiRNA target sequence
cccactgcagcacttgata

SEQ ID NO: 66508 - DNA, 19 bp, Artificial sequence
  SiRNA target sequence
ccactgcagcacttgataa

SEQ ID NO: 66509 - DNA, 19 bp, Artificial sequence
  SiRNA target sequence
cactgcagcacttgataag

SEQ ID NO: 66510 - DNA, 19 bp, Artificial sequence
  SiRNA target sequence
actgcagcacttgataagg

SEQ ID NO: 66511 - DNA, 19 bp, Artificial sequence
  SiRNA target sequence
ctgcagcacttgataagga

SEQ ID NO: 66512 - DNA, 19 bp, Artificial sequence
  SiRNA target sequence
tgcagcacttgataaggag

SEQ ID NO: 66513 - DNA, 19 bp, Artificial sequence
  SiRNA target sequence
gcagcacttgataaggagt

SEQ ID NO: 66514 - DNA, 19 bp, Artificial sequence
  SiRNA target sequence
cagcacttgataaggagtc

SEQ ID NO: 66515 - DNA, 19 bp, Artificial sequence
  SiRNA target sequence
agcacttgataaggagtct

SEQ ID NO: 66516 - DNA, 19 bp, Artificial sequence
  SiRNA target sequence
gcacttgataaggagtctg

SEQ ID NO: 66517 - DNA, 19 bp, Artificial sequence
  SiRNA target sequence
cacttgataaggagtctga

SEQ ID NO: 66518 - DNA, 19 bp, Artificial sequence
  SiRNA target sequence
acttgataaggagtctgaa

SEQ ID NO: 66519 - DNA, 19 bp, Artificial sequence
  SiRNA target sequence
cttgataaggagtctgaaa

SEQ ID NO: 66520 - DNA, 19 bp, Artificial sequence
  SiRNA target sequence
ttgataaggagtctgaaaa

SEQ ID NO: 66521 - DNA, 19 bp, Artificial sequence
  SiRNA target sequence
tgataaggagtctgaaaaa

SEQ ID NO: 66522 - DNA, 19 bp, Artificial sequence
  SiRNA target sequence
gataaggagtctgaaaaaa

SEQ ID NO: 66523 - DNA, 19 bp, Artificial sequence
  SiRNA target sequence
ataaggagtctgaaaaaaa

SEQ ID NO: 66524 - DNA, 19 bp, Artificial sequence
  SiRNA target sequence
taaggagtctgaaaaaaag

SEQ ID NO: 66525 - DNA, 19 bp, Artificial sequence
  SiRNA target sequence
aaggagtctgaaaaaaaga

SEQ ID NO: 66526 - DNA, 19 bp, Artificial sequence
  SiRNA target sequence
aggagtctgaaaaaaagat

SEQ ID NO: 66527 - DNA, 19 bp, Artificial sequence
  SiRNA target sequence
ggagtctgaaaaaaagatt

SEQ ID NO: 66528 - DNA, 19 bp, Artificial sequence
  SiRNA target sequence
gagtctgaaaaaaagattt

SEQ ID NO: 66529 - DNA, 19 bp, Artificial sequence
  SiRNA target sequence
agtctgaaaaaaagatttt

SEQ ID NO: 66530 - DNA, 19 bp, Artificial sequence
  SiRNA target sequence
gtctgaaaaaaagatttta

SEQ ID NO: 66531 - DNA, 19 bp, Artificial sequence
  SiRNA target sequence
tctgaaaaaaagattttag

SEQ ID NO: 66532 - DNA, 19 bp, Artificial sequence
  SiRNA target sequence
ctgaaaaaaagattttaga

SEQ ID NO: 66533 - DNA, 19 bp, Artificial sequence
  SiRNA target sequence
tgaaaaaaagattttagag

SEQ ID NO: 66534 - DNA, 19 bp, Artificial sequence
  SiRNA target sequence
gaaaaaaagattttagaga

SEQ ID NO: 66535 - DNA, 19 bp, Artificial sequence
  SiRNA target sequence
aaaaaaagattttagagat

SEQ ID NO: 66536 - DNA, 19 bp, Artificial sequence
  SiRNA target sequence
aaaaaagattttagagata

SEQ ID NO: 66537 - DNA, 19 bp, Artificial sequence
  SiRNA target sequence
aaaaagattttagagataa

SEQ ID NO: 66538 - DNA, 19 bp, Artificial sequence
  SiRNA target sequence
aaaagattttagagataat

SEQ ID NO: 66539 - DNA, 19 bp, Artificial sequence
  SiRNA target sequence
aaagattttagagataatt

SEQ ID NO: 66540 - DNA, 19 bp, Artificial sequence
  SiRNA target sequence
aagattttagagataattt

SEQ ID NO: 66541 - DNA, 19 bp, Artificial sequence
  SiRNA target sequence
agattttagagataatttt

SEQ ID NO: 66542 - DNA, 19 bp, Artificial sequence
  SiRNA target sequence
gattttagagataatttta

SEQ ID NO: 66543 - DNA, 19 bp, Artificial sequence
  SiRNA target sequence
attttagagataattttac

SEQ ID NO: 66544 - DNA, 19 bp, Artificial sequence
  SiRNA target sequence
ttttagagataattttaca

SEQ ID NO: 66545 - DNA, 19 bp, Artificial sequence
  SiRNA target sequence
tttagagataattttacaa

SEQ ID NO: 66546 - DNA, 19 bp, Artificial sequence
  SiRNA target sequence
ttagagataattttacaac

SEQ ID NO: 66547 - DNA, 19 bp, Artificial sequence
  SiRNA target sequence
tagagataattttacaaca

SEQ ID NO: 66548 - DNA, 19 bp, Artificial sequence
  SiRNA target sequence
agagataattttacaacag

SEQ ID NO: 66549 - DNA, 19 bp, Artificial sequence
  SiRNA target sequence
gagataattttacaacagg

SEQ ID NO: 66550 - DNA, 19 bp, Artificial sequence
  SiRNA target sequence
agataattttacaacagga

SEQ ID NO: 66551 - DNA, 19 bp, Artificial sequence
  SiRNA target sequence
gataattttacaacaggaa

SEQ ID NO: 66552 - DNA, 19 bp, Artificial sequence
  SiRNA target sequence
ataattttacaacaggaag

SEQ ID NO: 66553 - DNA, 19 bp, Artificial sequence
  SiRNA target sequence
taattttacaacaggaaga

SEQ ID NO: 66554 - DNA, 19 bp, Artificial sequence
  SiRNA target sequence
aattttacaacaggaagat

SEQ ID NO: 66555 - DNA, 19 bp, Artificial sequence
  SiRNA target sequence
attttacaacaggaagatc

SEQ ID NO: 66556 - DNA, 19 bp, Artificial sequence
  SiRNA target sequence
ttttacaacaggaagatcg

SEQ ID NO: 66557 - DNA, 19 bp, Artificial sequence
  SiRNA target sequence
tttacaacaggaagatcga

SEQ ID NO: 66558 - DNA, 19 bp, Artificial sequence
  SiRNA target sequence
ttacaacaggaagatcgaa

SEQ ID NO: 66559 - DNA, 19 bp, Artificial sequence
  SiRNA target sequence
tacaacaggaagatcgaac

SEQ ID NO: 66560 - DNA, 19 bp, Artificial sequence
  SiRNA target sequence
acaacaggaagatcgaaca

SEQ ID NO: 66561 - DNA, 19 bp, Artificial sequence
  SiRNA target sequence
caacaggaagatcgaacag

SEQ ID NO: 66562 - DNA, 19 bp, Artificial sequence
  SiRNA target sequence
aacaggaagatcgaacagt

SEQ ID NO: 66563 - DNA, 19 bp, Artificial sequence
  SiRNA target sequence
acaggaagatcgaacagtt

SEQ ID NO: 66564 - DNA, 19 bp, Artificial sequence
  SiRNA target sequence
caggaagatcgaacagttt

SEQ ID NO: 66565 - DNA, 19 bp, Artificial sequence
  SiRNA target sequence
aggaagatcgaacagtttt

SEQ ID NO: 66566 - DNA, 19 bp, Artificial sequence
  SiRNA target sequence
ggaagatcgaacagttttg

SEQ ID NO: 66567 - DNA, 19 bp, Artificial sequence
  SiRNA target sequence
gaagatcgaacagttttga

SEQ ID NO: 66568 - DNA, 19 bp, Artificial sequence
  SiRNA target sequence
aagatcgaacagttttgat

SEQ ID NO: 66569 - DNA, 19 bp, Artificial sequence
  SiRNA target sequence
agatcgaacagttttgatg

SEQ ID NO: 66570 - DNA, 19 bp, Artificial sequence
  SiRNA target sequence
gatcgaacagttttgatga

SEQ ID NO: 66571 - DNA, 19 bp, Artificial sequence
  SiRNA target sequence
atcgaacagttttgatgat

SEQ ID NO: 66572 - DNA, 19 bp, Artificial sequence
  SiRNA target sequence
tcgaacagttttgatgata

SEQ ID NO: 66573 - DNA, 19 bp, Artificial sequence
  SiRNA target sequence
cgaacagttttgatgataa

SEQ ID NO: 66574 - DNA, 19 bp, Artificial sequence
  SiRNA target sequence
gaacagttttgatgataat

SEQ ID NO: 66575 - DNA, 19 bp, Artificial sequence
  SiRNA target sequence
aacagttttgatgataatt

SEQ ID NO: 66576 - DNA, 19 bp, Artificial sequence
  SiRNA target sequence
acagttttgatgataattc

SEQ ID NO: 66577 - DNA, 19 bp, Artificial sequence
  SiRNA target sequence
cagttttgatgataattca

SEQ ID NO: 66578 - DNA, 19 bp, Artificial sequence
  SiRNA target sequence
agttttgatgataattcat

SEQ ID NO: 66579 - DNA, 19 bp, Artificial sequence
  SiRNA target sequence
gttttgatgataattcata

SEQ ID NO: 66580 - DNA, 19 bp, Artificial sequence
  SiRNA target sequence
ttttgatgataattcataa

SEQ ID NO: 66581 - DNA, 19 bp, Artificial sequence
  SiRNA target sequence
tttgatgataattcataat

SEQ ID NO: 66582 - DNA, 19 bp, Artificial sequence
  SiRNA target sequence
ttgatgataattcataatc

SEQ ID NO: 66583 - DNA, 19 bp, Artificial sequence
  SiRNA target sequence
tgatgataattcataatct

SEQ ID NO: 66584 - DNA, 19 bp, Artificial sequence
  SiRNA target sequence
gatgataattcataatcta

SEQ ID NO: 66585 - DNA, 19 bp, Artificial sequence
  SiRNA target sequence
atgataattcataatctag

SEQ ID NO: 66586 - DNA, 19 bp, Artificial sequence
  SiRNA target sequence
tgataattcataatctaga

SEQ ID NO: 66587 - DNA, 19 bp, Artificial sequence
  SiRNA target sequence
gataattcataatctagaa

SEQ ID NO: 66588 - DNA, 19 bp, Artificial sequence
  SiRNA target sequence
ataattcataatctagaac

SEQ ID NO: 66589 - DNA, 19 bp, Artificial sequence
  SiRNA target sequence
taattcataatctagaact

SEQ ID NO: 66590 - DNA, 19 bp, Artificial sequence
  SiRNA target sequence
aattcataatctagaactt

SEQ ID NO: 66591 - DNA, 19 bp, Artificial sequence
  SiRNA target sequence
attcataatctagaactta

SEQ ID NO: 66592 - DNA, 19 bp, Artificial sequence
  SiRNA target sequence
ttcataatctagaacttat

SEQ ID NO: 66593 - DNA, 19 bp, Artificial sequence
  SiRNA target sequence
tcataatctagaacttatt

SEQ ID NO: 66594 - DNA, 19 bp, Artificial sequence
  SiRNA target sequence
cataatctagaacttatta

SEQ ID NO: 66595 - DNA, 19 bp, Artificial sequence
  SiRNA target sequence
ataatctagaacttattaa

SEQ ID NO: 66596 - DNA, 19 bp, Artificial sequence
  SiRNA target sequence
taatctagaacttattaat

SEQ ID NO: 66597 - DNA, 19 bp, Artificial sequence
  SiRNA target sequence
aatctagaacttattaata

SEQ ID NO: 66598 - DNA, 19 bp, Artificial sequence
  SiRNA target sequence
atctagaacttattaataa

SEQ ID NO: 66599 - DNA, 19 bp, Artificial sequence
  SiRNA target sequence
tctagaacttattaataaa

SEQ ID NO: 66600 - DNA, 19 bp, Artificial sequence
  SiRNA target sequence
ctagaacttattaataaat

SEQ ID NO: 66601 - DNA, 19 bp, Artificial sequence
  SiRNA target sequence
tagaacttattaataaatt

SEQ ID NO: 66602 - DNA, 19 bp, Artificial sequence
  SiRNA target sequence
agaacttattaataaattt

SEQ ID NO: 66603 - DNA, 19 bp, Artificial sequence
  SiRNA target sequence
gaacttattaataaatttg

SEQ ID NO: 66604 - DNA, 19 bp, Artificial sequence
  SiRNA target sequence
aacttattaataaatttga

SEQ ID NO: 66605 - DNA, 19 bp, Artificial sequence
  SiRNA target sequence
acttattaataaatttgat

SEQ ID NO: 66606 - DNA, 19 bp, Artificial sequence
  SiRNA target sequence
cttattaataaatttgata

SEQ ID NO: 66607 - DNA, 19 bp, Artificial sequence
  SiRNA target sequence
ttattaataaatttgataa

SEQ ID NO: 66608 - DNA, 19 bp, Artificial sequence
  SiRNA target sequence
tattaataaatttgataaa

SEQ ID NO: 66609 - DNA, 19 bp, Artificial sequence
  SiRNA target sequence
attaataaatttgataaaa

SEQ ID NO: 66610 - DNA, 19 bp, Artificial sequence
  SiRNA target sequence
ttaataaatttgataaaat

SEQ ID NO: 66611 - DNA, 19 bp, Artificial sequence
  SiRNA target sequence
taataaatttgataaaata

SEQ ID NO: 66612 - DNA, 19 bp, Artificial sequence
  SiRNA target sequence
aataaatttgataaaataa

SEQ ID NO: 66613 - DNA, 19 bp, Artificial sequence
  SiRNA target sequence
ataaatttgataaaataat

SEQ ID NO: 66614 - DNA, 19 bp, Artificial sequence
  SiRNA target sequence
taaatttgataaaataatt

SEQ ID NO: 66615 - DNA, 19 bp, Artificial sequence
  SiRNA target sequence
aaatttgataaaataattt

SEQ ID NO: 66616 - DNA, 19 bp, Artificial sequence
  SiRNA target sequence
aatttgataaaataattta

SEQ ID NO: 66617 - DNA, 19 bp, Artificial sequence
  SiRNA target sequence
atttgataaaataatttac

SEQ ID NO: 66618 - DNA, 19 bp, Artificial sequence
  SiRNA target sequence
tttgataaaataatttaca

SEQ ID NO: 66619 - DNA, 19 bp, Artificial sequence
  SiRNA target sequence
ttgataaaataatttacat

SEQ ID NO: 66620 - DNA, 19 bp, Artificial sequence
  SiRNA target sequence
tgataaaataatttacatt

SEQ ID NO: 66621 - DNA, 19 bp, Artificial sequence
  SiRNA target sequence
gataaaataatttacattg

SEQ ID NO: 66622 - DNA, 19 bp, Artificial sequence
  SiRNA target sequence
ataaaataatttacattga

SEQ ID NO: 66623 - DNA, 19 bp, Artificial sequence
  SiRNA target sequence
taaaataatttacattgat

SEQ ID NO: 66624 - DNA, 19 bp, Artificial sequence
  SiRNA target sequence
aaaataatttacattgatg

SEQ ID NO: 66625 - DNA, 19 bp, Artificial sequence
  SiRNA target sequence
aaataatttacattgatga

SEQ ID NO: 66626 - DNA, 19 bp, Artificial sequence
  SiRNA target sequence
aataatttacattgatgaa

SEQ ID NO: 66627 - DNA, 19 bp, Artificial sequence
  SiRNA target sequence
ataatttacattgatgaaa

SEQ ID NO: 66628 - DNA, 19 bp, Artificial sequence
  SiRNA target sequence
taatttacattgatgaaaa

SEQ ID NO: 66629 - DNA, 19 bp, Artificial sequence
  SiRNA target sequence
aatttacattgatgaaaat

SEQ ID NO: 66630 - DNA, 19 bp, Artificial sequence
  SiRNA target sequence
atttacattgatgaaaata

SEQ ID NO: 66631 - DNA, 19 bp, Artificial sequence
  SiRNA target sequence
tttacattgatgaaaataa

SEQ ID NO: 66632 - DNA, 19 bp, Artificial sequence
  SiRNA target sequence
ttacattgatgaaaataat

SEQ ID NO: 66633 - DNA, 19 bp, Artificial sequence
  SiRNA target sequence
tacattgatgaaaataata

SEQ ID NO: 66634 - DNA, 19 bp, Artificial sequence
  SiRNA target sequence
acattgatgaaaataatat

SEQ ID NO: 66635 - DNA, 19 bp, Artificial sequence
  SiRNA target sequence
cattgatgaaaataatata

SEQ ID NO: 66636 - DNA, 19 bp, Artificial sequence
  SiRNA target sequence
attgatgaaaataatatag

SEQ ID NO: 66637 - DNA, 19 bp, Artificial sequence
  SiRNA target sequence
ttgatgaaaataatataga

SEQ ID NO: 66638 - DNA, 19 bp, Artificial sequence
  SiRNA target sequence
tgatgaaaataatatagaa

SEQ ID NO: 66639 - DNA, 19 bp, Artificial sequence
  SiRNA target sequence
gatgaaaataatatagaag

SEQ ID NO: 66640 - DNA, 19 bp, Artificial sequence
  SiRNA target sequence
atgaaaataatatagaagt

SEQ ID NO: 66641 - DNA, 19 bp, Artificial sequence
  SiRNA target sequence
tgaaaataatatagaagtc

SEQ ID NO: 66642 - DNA, 19 bp, Artificial sequence
  SiRNA target sequence
gaaaataatatagaagtct

SEQ ID NO: 66643 - DNA, 19 bp, Artificial sequence
  SiRNA target sequence
aaaataatatagaagtcta

SEQ ID NO: 66644 - DNA, 19 bp, Artificial sequence
  SiRNA target sequence
aaataatatagaagtctat

SEQ ID NO: 66645 - DNA, 19 bp, Artificial sequence
  SiRNA target sequence
aataatatagaagtctata

SEQ ID NO: 66646 - DNA, 19 bp, Artificial sequence
  SiRNA target sequence
ataatatagaagtctataa

SEQ ID NO: 66647 - DNA, 19 bp, Artificial sequence
  SiRNA target sequence
taatatagaagtctataaa

SEQ ID NO: 66648 - DNA, 19 bp, Artificial sequence
  SiRNA target sequence
aatatagaagtctataaaa

SEQ ID NO: 66649 - DNA, 19 bp, Artificial sequence
  SiRNA target sequence
atatagaagtctataaaaa

SEQ ID NO: 66650 - DNA, 19 bp, Artificial sequence
  SiRNA target sequence
tatagaagtctataaaaat

SEQ ID NO: 66651 - DNA, 19 bp, Artificial sequence
  SiRNA target sequence
atagaagtctataaaaatg

SEQ ID NO: 66652 - DNA, 19 bp, Artificial sequence
  SiRNA target sequence
tagaagtctataaaaatga

SEQ ID NO: 66653 - DNA, 19 bp, Artificial sequence
  SiRNA target sequence
agaagtctataaaaatgat

SEQ ID NO: 66654 - DNA, 19 bp, Artificial sequence
  SiRNA target sequence
gaagtctataaaaatgata

SEQ ID NO: 66655 - DNA, 19 bp, Artificial sequence
  SiRNA target sequence
aagtctataaaaatgatat

SEQ ID NO: 66656 - DNA, 19 bp, Artificial sequence
  SiRNA target sequence
agtctataaaaatgatatt

SEQ ID NO: 66657 - DNA, 19 bp, Artificial sequence
  SiRNA target sequence
gtctataaaaatgatattg

SEQ ID NO: 66658 - DNA, 19 bp, Artificial sequence
  SiRNA target sequence
tctataaaaatgatattga

SEQ ID NO: 66659 - DNA, 19 bp, Artificial sequence
  SiRNA target sequence
ctataaaaatgatattgaa

SEQ ID NO: 66660 - DNA, 19 bp, Artificial sequence
  SiRNA target sequence
tataaaaatgatattgaag

SEQ ID NO: 66661 - DNA, 19 bp, Artificial sequence
  SiRNA target sequence
ataaaaatgatattgaagg

SEQ ID NO: 66662 - DNA, 19 bp, Artificial sequence
  SiRNA target sequence
taaaaatgatattgaagga

SEQ ID NO: 66663 - DNA, 19 bp, Artificial sequence
  SiRNA target sequence
aaaaatgatattgaaggac

SEQ ID NO: 66664 - DNA, 19 bp, Artificial sequence
  SiRNA target sequence
aaaatgatattgaaggaca

SEQ ID NO: 66665 - DNA, 19 bp, Artificial sequence
  SiRNA target sequence
aaatgatattgaaggacaa

SEQ ID NO: 66666 - DNA, 19 bp, Artificial sequence
  SiRNA target sequence
aatgatattgaaggacaaa

SEQ ID NO: 66667 - DNA, 19 bp, Artificial sequence
  SiRNA target sequence
atgatattgaaggacaaaa

SEQ ID NO: 66668 - DNA, 19 bp, Artificial sequence
  SiRNA target sequence
tgatattgaaggacaaaaa

SEQ ID NO: 66669 - DNA, 19 bp, Artificial sequence
  SiRNA target sequence
gatattgaaggacaaaaaa

SEQ ID NO: 66670 - DNA, 19 bp, Artificial sequence
  SiRNA target sequence
atattgaaggacaaaaaaa

SEQ ID NO: 66671 - DNA, 19 bp, Artificial sequence
  SiRNA target sequence
tattgaaggacaaaaaaag

SEQ ID NO: 66672 - DNA, 19 bp, Artificial sequence
  SiRNA target sequence
attgaaggacaaaaaaagt

SEQ ID NO: 66673 - DNA, 19 bp, Artificial sequence
  SiRNA target sequence
ttgaaggacaaaaaaagtt

SEQ ID NO: 66674 - DNA, 19 bp, Artificial sequence
  SiRNA target sequence
tgaaggacaaaaaaagttt

SEQ ID NO: 66675 - DNA, 19 bp, Artificial sequence
  SiRNA target sequence
gaaggacaaaaaaagtttt

SEQ ID NO: 66676 - DNA, 19 bp, Artificial sequence
  SiRNA target sequence
aaggacaaaaaaagttttc

SEQ ID NO: 66677 - DNA, 19 bp, Artificial sequence
  SiRNA target sequence
aggacaaaaaaagttttct

SEQ ID NO: 66678 - DNA, 19 bp, Artificial sequence
  SiRNA target sequence
ggacaaaaaaagttttcta

SEQ ID NO: 66679 - DNA, 19 bp, Artificial sequence
  SiRNA target sequence
gacaaaaaaagttttctac

SEQ ID NO: 66680 - DNA, 19 bp, Artificial sequence
  SiRNA target sequence
acaaaaaaagttttctaca

SEQ ID NO: 66681 - DNA, 19 bp, Artificial sequence
  SiRNA target sequence
caaaaaaagttttctacaa

SEQ ID NO: 66682 - DNA, 19 bp, Artificial sequence
  SiRNA target sequence
aaaaaaagttttctacaaa

SEQ ID NO: 66683 - DNA, 19 bp, Artificial sequence
  SiRNA target sequence
aaaaaagttttctacaaat

SEQ ID NO: 66684 - DNA, 19 bp, Artificial sequence
  SiRNA target sequence
aaaaagttttctacaaatt

SEQ ID NO: 66685 - DNA, 19 bp, Artificial sequence
  SiRNA target sequence
aaaagttttctacaaattt

SEQ ID NO: 66686 - DNA, 19 bp, Artificial sequence
  SiRNA target sequence
aaagttttctacaaattta

SEQ ID NO: 66687 - DNA, 19 bp, Artificial sequence
  SiRNA target sequence
aagttttctacaaatttac

SEQ ID NO: 66688 - DNA, 19 bp, Artificial sequence
  SiRNA target sequence
agttttctacaaatttaca

SEQ ID NO: 66689 - DNA, 19 bp, Artificial sequence
  SiRNA target sequence
gttttctacaaatttacaa

SEQ ID NO: 66690 - DNA, 19 bp, Artificial sequence
  SiRNA target sequence
ttttctacaaatttacaat

SEQ ID NO: 66691 - DNA, 19 bp, Artificial sequence
  SiRNA target sequence
tttctacaaatttacaata

SEQ ID NO: 66692 - DNA, 19 bp, Artificial sequence
  SiRNA target sequence
ttctacaaatttacaatat

SEQ ID NO: 66693 - DNA, 19 bp, Artificial sequence
  SiRNA target sequence
tctacaaatttacaatatt

SEQ ID NO: 66694 - DNA, 19 bp, Artificial sequence
  SiRNA target sequence
ctacaaatttacaatattt

SEQ ID NO: 66695 - DNA, 19 bp, Artificial sequence
  SiRNA target sequence
tacaaatttacaatatttt

SEQ ID NO: 66696 - DNA, 19 bp, Artificial sequence
  SiRNA target sequence
acaaatttacaatattttt

SEQ ID NO: 66697 - DNA, 19 bp, Artificial sequence
  SiRNA target sequence
caaatttacaatatttttt

SEQ ID NO: 66698 - DNA, 19 bp, Artificial sequence
  SiRNA target sequence
aaatttacaatatttttta

SEQ ID NO: 66699 - DNA, 19 bp, Artificial sequence
  SiRNA target sequence
aatttacaatattttttat

SEQ ID NO: 66700 - DNA, 19 bp, Artificial sequence
  SiRNA target sequence
atttacaatattttttatc

SEQ ID NO: 66701 - DNA, 19 bp, Artificial sequence
  SiRNA target sequence
tttacaatattttttatca

SEQ ID NO: 66702 - DNA, 19 bp, Artificial sequence
  SiRNA target sequence
ttacaatattttttatcat

SEQ ID NO: 66703 - DNA, 19 bp, Artificial sequence
  SiRNA target sequence
tacaatattttttatcata

SEQ ID NO: 66704 - DNA, 19 bp, Artificial sequence
  SiRNA target sequence
acaatattttttatcatac

SEQ ID NO: 66705 - DNA, 19 bp, Artificial sequence
  SiRNA target sequence
caatattttttatcataca

SEQ ID NO: 66706 - DNA, 19 bp, Artificial sequence
  SiRNA target sequence
aatattttttatcatacaa

SEQ ID NO: 66707 - DNA, 19 bp, Artificial sequence
  SiRNA target sequence
atattttttatcatacaaa

SEQ ID NO: 66708 - DNA, 19 bp, Artificial sequence
  SiRNA target sequence
tattttttatcatacaaat

SEQ ID NO: 66709 - DNA, 19 bp, Artificial sequence
  SiRNA target sequence
attttttatcatacaaatt

SEQ ID NO: 66710 - DNA, 19 bp, Artificial sequence
  SiRNA target sequence
ttttttatcatacaaatta

SEQ ID NO: 66711 - DNA, 19 bp, Artificial sequence
  SiRNA target sequence
tttttatcatacaaattag

SEQ ID NO: 66712 - DNA, 19 bp, Artificial sequence
  SiRNA target sequence
ttttatcatacaaattagg

SEQ ID NO: 66713 - DNA, 19 bp, Artificial sequence
  SiRNA target sequence
tttatcatacaaattaggt

SEQ ID NO: 66714 - DNA, 19 bp, Artificial sequence
  SiRNA target sequence
ttatcatacaaattaggta

SEQ ID NO: 66715 - DNA, 19 bp, Artificial sequence
  SiRNA target sequence
tatcatacaaattaggtaa

SEQ ID NO: 66716 - DNA, 19 bp, Artificial sequence
  SiRNA target sequence
atcatacaaattaggtaaa

SEQ ID NO: 66717 - DNA, 19 bp, Artificial sequence
  SiRNA target sequence
tcatacaaattaggtaaat

SEQ ID NO: 66718 - DNA, 19 bp, Artificial sequence
  SiRNA target sequence
catacaaattaggtaaata

SEQ ID NO: 66719 - DNA, 19 bp, Artificial sequence
  SiRNA target sequence
atacaaattaggtaaataa

SEQ ID NO: 66720 - DNA, 20 bp, Artificial sequence
  SiRNA target sequence
atgaaaaaaatttcgaatag

SEQ ID NO: 66721 - DNA, 20 bp, Artificial sequence
  SiRNA target sequence
tgaaaaaaatttcgaataga

SEQ ID NO: 66722 - DNA, 20 bp, Artificial sequence
  SiRNA target sequence
gaaaaaaatttcgaatagaa

SEQ ID NO: 66723 - DNA, 20 bp, Artificial sequence
  SiRNA target sequence
aaaaaaatttcgaatagaaa

SEQ ID NO: 66724 - DNA, 20 bp, Artificial sequence
  SiRNA target sequence
aaaaaatttcgaatagaaaa

SEQ ID NO: 66725 - DNA, 20 bp, Artificial sequence
  SiRNA target sequence
aaaaatttcgaatagaaaaa

SEQ ID NO: 66726 - DNA, 20 bp, Artificial sequence
  SiRNA target sequence
aaaatttcgaatagaaaaat

SEQ ID NO: 66727 - DNA, 20 bp, Artificial sequence
  SiRNA target sequence
aaatttcgaatagaaaaatt

SEQ ID NO: 66728 - DNA, 20 bp, Artificial sequence
  SiRNA target sequence
aatttcgaatagaaaaatta

SEQ ID NO: 66729 - DNA, 20 bp, Artificial sequence
  SiRNA target sequence
atttcgaatagaaaaattat

SEQ ID NO: 66730 - DNA, 20 bp, Artificial sequence
  SiRNA target sequence
tttcgaatagaaaaattatc

SEQ ID NO: 66731 - DNA, 20 bp, Artificial sequence
  SiRNA target sequence
ttcgaatagaaaaattatca

SEQ ID NO: 66732 - DNA, 20 bp, Artificial sequence
  SiRNA target sequence
tcgaatagaaaaattatcaa

SEQ ID NO: 66733 - DNA, 20 bp, Artificial sequence
  SiRNA target sequence
cgaatagaaaaattatcaaa

SEQ ID NO: 66734 - DNA, 20 bp, Artificial sequence
  SiRNA target sequence
gaatagaaaaattatcaaag

SEQ ID NO: 66735 - DNA, 20 bp, Artificial sequence
  SiRNA target sequence
aatagaaaaattatcaaaga

SEQ ID NO: 66736 - DNA, 20 bp, Artificial sequence
  SiRNA target sequence
atagaaaaattatcaaagaa

SEQ ID NO: 66737 - DNA, 20 bp, Artificial sequence
  SiRNA target sequence
tagaaaaattatcaaagaaa

SEQ ID NO: 66738 - DNA, 20 bp, Artificial sequence
  SiRNA target sequence
agaaaaattatcaaagaaat

SEQ ID NO: 66739 - DNA, 20 bp, Artificial sequence
  SiRNA target sequence
gaaaaattatcaaagaaatt

SEQ ID NO: 66740 - DNA, 20 bp, Artificial sequence
  SiRNA target sequence
aaaaattatcaaagaaatta

SEQ ID NO: 66741 - DNA, 20 bp, Artificial sequence
  SiRNA target sequence
aaaattatcaaagaaattat

SEQ ID NO: 66742 - DNA, 20 bp, Artificial sequence
  SiRNA target sequence
aaattatcaaagaaattatt

SEQ ID NO: 66743 - DNA, 20 bp, Artificial sequence
  SiRNA target sequence
aattatcaaagaaattattt

SEQ ID NO: 66744 - DNA, 20 bp, Artificial sequence
  SiRNA target sequence
attatcaaagaaattattta

SEQ ID NO: 66745 - DNA, 20 bp, Artificial sequence
  SiRNA target sequence
ttatcaaagaaattatttac

SEQ ID NO: 66746 - DNA, 20 bp, Artificial sequence
  SiRNA target sequence
tatcaaagaaattatttaca

SEQ ID NO: 66747 - DNA, 20 bp, Artificial sequence
  SiRNA target sequence
atcaaagaaattatttacaa

SEQ ID NO: 66748 - DNA, 20 bp, Artificial sequence
  SiRNA target sequence
tcaaagaaattatttacaat

SEQ ID NO: 66749 - DNA, 20 bp, Artificial sequence
  SiRNA target sequence
caaagaaattatttacaatg

SEQ ID NO: 66750 - DNA, 20 bp, Artificial sequence
  SiRNA target sequence
aaagaaattatttacaatga

SEQ ID NO: 66751 - DNA, 20 bp, Artificial sequence
  SiRNA target sequence
aagaaattatttacaatgat

SEQ ID NO: 66752 - DNA, 20 bp, Artificial sequence
  SiRNA target sequence
agaaattatttacaatgatt

SEQ ID NO: 66753 - DNA, 20 bp, Artificial sequence
  SiRNA target sequence
gaaattatttacaatgattt

SEQ ID NO: 66754 - DNA, 20 bp, Artificial sequence
  SiRNA target sequence
aaattatttacaatgattta

SEQ ID NO: 66755 - DNA, 20 bp, Artificial sequence
  SiRNA target sequence
aattatttacaatgatttat

SEQ ID NO: 66756 - DNA, 20 bp, Artificial sequence
  SiRNA target sequence
attatttacaatgatttatt

SEQ ID NO: 66757 - DNA, 20 bp, Artificial sequence
  SiRNA target sequence
ttatttacaatgatttatta

SEQ ID NO: 66758 - DNA, 20 bp, Artificial sequence
  SiRNA target sequence
tatttacaatgatttattaa

SEQ ID NO: 66759 - DNA, 20 bp, Artificial sequence
  SiRNA target sequence
atttacaatgatttattaaa

SEQ ID NO: 66760 - DNA, 20 bp, Artificial sequence
  SiRNA target sequence
tttacaatgatttattaaaa

SEQ ID NO: 66761 - DNA, 20 bp, Artificial sequence
  SiRNA target sequence
ttacaatgatttattaaaaa

SEQ ID NO: 66762 - DNA, 20 bp, Artificial sequence
  SiRNA target sequence
tacaatgatttattaaaaat

SEQ ID NO: 66763 - DNA, 20 bp, Artificial sequence
  SiRNA target sequence
acaatgatttattaaaaata

SEQ ID NO: 66764 - DNA, 20 bp, Artificial sequence
  SiRNA target sequence
caatgatttattaaaaataa

SEQ ID NO: 66765 - DNA, 20 bp, Artificial sequence
  SiRNA target sequence
aatgatttattaaaaataag

SEQ ID NO: 66766 - DNA, 20 bp, Artificial sequence
  SiRNA target sequence
atgatttattaaaaataaga

SEQ ID NO: 66767 - DNA, 20 bp, Artificial sequence
  SiRNA target sequence
tgatttattaaaaataagaa

SEQ ID NO: 66768 - DNA, 20 bp, Artificial sequence
  SiRNA target sequence
gatttattaaaaataagaat

SEQ ID NO: 66769 - DNA, 20 bp, Artificial sequence
  SiRNA target sequence
atttattaaaaataagaatg

SEQ ID NO: 66770 - DNA, 20 bp, Artificial sequence
  SiRNA target sequence
tttattaaaaataagaatgt

SEQ ID NO: 66771 - DNA, 20 bp, Artificial sequence
  SiRNA target sequence
ttattaaaaataagaatgtt

SEQ ID NO: 66772 - DNA, 20 bp, Artificial sequence
  SiRNA target sequence
tattaaaaataagaatgttg

SEQ ID NO: 66773 - DNA, 20 bp, Artificial sequence
  SiRNA target sequence
attaaaaataagaatgttgc

SEQ ID NO: 66774 - DNA, 20 bp, Artificial sequence
  SiRNA target sequence
ttaaaaataagaatgttgcg

SEQ ID NO: 66775 - DNA, 20 bp, Artificial sequence
  SiRNA target sequence
taaaaataagaatgttgcga

SEQ ID NO: 66776 - DNA, 20 bp, Artificial sequence
  SiRNA target sequence
aaaaataagaatgttgcgat

SEQ ID NO: 66777 - DNA, 20 bp, Artificial sequence
  SiRNA target sequence
aaaataagaatgttgcgata

SEQ ID NO: 66778 - DNA, 20 bp, Artificial sequence
  SiRNA target sequence
aaataagaatgttgcgatat

SEQ ID NO: 66779 - DNA, 20 bp, Artificial sequence
  SiRNA target sequence
aataagaatgttgcgatatg

SEQ ID NO: 66780 - DNA, 20 bp, Artificial sequence
  SiRNA target sequence
ataagaatgttgcgatatgt

SEQ ID NO: 66781 - DNA, 20 bp, Artificial sequence
  SiRNA target sequence
taagaatgttgcgatatgtt

SEQ ID NO: 66782 - DNA, 20 bp, Artificial sequence
  SiRNA target sequence
aagaatgttgcgatatgtta

SEQ ID NO: 66783 - DNA, 20 bp, Artificial sequence
  SiRNA target sequence
agaatgttgcgatatgttat

SEQ ID NO: 66784 - DNA, 20 bp, Artificial sequence
  SiRNA target sequence
gaatgttgcgatatgttatt

SEQ ID NO: 66785 - DNA, 20 bp, Artificial sequence
  SiRNA target sequence
aatgttgcgatatgttattg

SEQ ID NO: 66786 - DNA, 20 bp, Artificial sequence
  SiRNA target sequence
atgttgcgatatgttattgt

SEQ ID NO: 66787 - DNA, 20 bp, Artificial sequence
  SiRNA target sequence
tgttgcgatatgttattgta

SEQ ID NO: 66788 - DNA, 20 bp, Artificial sequence
  SiRNA target sequence
gttgcgatatgttattgtac

SEQ ID NO: 66789 - DNA, 20 bp, Artificial sequence
  SiRNA target sequence
ttgcgatatgttattgtacc

SEQ ID NO: 66790 - DNA, 20 bp, Artificial sequence
  SiRNA target sequence
tgcgatatgttattgtacca

SEQ ID NO: 66791 - DNA, 20 bp, Artificial sequence
  SiRNA target sequence
gcgatatgttattgtaccaa

SEQ ID NO: 66792 - DNA, 20 bp, Artificial sequence
  SiRNA target sequence
cgatatgttattgtaccaat

SEQ ID NO: 66793 - DNA, 20 bp, Artificial sequence
  SiRNA target sequence
gatatgttattgtaccaata

SEQ ID NO: 66794 - DNA, 20 bp, Artificial sequence
  SiRNA target sequence
atatgttattgtaccaataa

SEQ ID NO: 66795 - DNA, 20 bp, Artificial sequence
  SiRNA target sequence
tatgttattgtaccaataat

SEQ ID NO: 66796 - DNA, 20 bp, Artificial sequence
  SiRNA target sequence
atgttattgtaccaataata

SEQ ID NO: 66797 - DNA, 20 bp, Artificial sequence
  SiRNA target sequence
tgttattgtaccaataatat

SEQ ID NO: 66798 - DNA, 20 bp, Artificial sequence
  SiRNA target sequence
gttattgtaccaataatatt

SEQ ID NO: 66799 - DNA, 20 bp, Artificial sequence
  SiRNA target sequence
ttattgtaccaataatattt

SEQ ID NO: 66800 - DNA, 20 bp, Artificial sequence
  SiRNA target sequence
tattgtaccaataatatttt

SEQ ID NO: 66801 - DNA, 20 bp, Artificial sequence
  SiRNA target sequence
attgtaccaataatattttt

SEQ ID NO: 66802 - DNA, 20 bp, Artificial sequence
  SiRNA target sequence
ttgtaccaataatattttta

SEQ ID NO: 66803 - DNA, 20 bp, Artificial sequence
  SiRNA target sequence
tgtaccaataatatttttaa

SEQ ID NO: 66804 - DNA, 20 bp, Artificial sequence
  SiRNA target sequence
gtaccaataatatttttaac

SEQ ID NO: 66805 - DNA, 20 bp, Artificial sequence
  SiRNA target sequence
taccaataatatttttaact

SEQ ID NO: 66806 - DNA, 20 bp, Artificial sequence
  SiRNA target sequence
accaataatatttttaacta

SEQ ID NO: 66807 - DNA, 20 bp, Artificial sequence
  SiRNA target sequence
ccaataatatttttaactat

SEQ ID NO: 66808 - DNA, 20 bp, Artificial sequence
  SiRNA target sequence
caataatatttttaactata

SEQ ID NO: 66809 - DNA, 20 bp, Artificial sequence
  SiRNA target sequence
aataatatttttaactatat

SEQ ID NO: 66810 - DNA, 20 bp, Artificial sequence
  SiRNA target sequence
ataatatttttaactatatt

SEQ ID NO: 66811 - DNA, 20 bp, Artificial sequence
  SiRNA target sequence
taatatttttaactatattt

SEQ ID NO: 66812 - DNA, 20 bp, Artificial sequence
  SiRNA target sequence
aatatttttaactatatttt

SEQ ID NO: 66813 - DNA, 20 bp, Artificial sequence
  SiRNA target sequence
atatttttaactatatttta

SEQ ID NO: 66814 - DNA, 20 bp, Artificial sequence
  SiRNA target sequence
tatttttaactatattttac

SEQ ID NO: 66815 - DNA, 20 bp, Artificial sequence
  SiRNA target sequence
atttttaactatattttaca

SEQ ID NO: 66816 - DNA, 20 bp, Artificial sequence
  SiRNA target sequence
tttttaactatattttacac

SEQ ID NO: 66817 - DNA, 20 bp, Artificial sequence
  SiRNA target sequence
ttttaactatattttacact

SEQ ID NO: 66818 - DNA, 20 bp, Artificial sequence
  SiRNA target sequence
tttaactatattttacactg

SEQ ID NO: 66819 - DNA, 20 bp, Artificial sequence
  SiRNA target sequence
ttaactatattttacactgt

SEQ ID NO: 66820 - DNA, 20 bp, Artificial sequence
  SiRNA target sequence
taactatattttacactgtt

SEQ ID NO: 66821 - DNA, 20 bp, Artificial sequence
  SiRNA target sequence
aactatattttacactgttt

SEQ ID NO: 66822 - DNA, 20 bp, Artificial sequence
  SiRNA target sequence
actatattttacactgtttt

SEQ ID NO: 66823 - DNA, 20 bp, Artificial sequence
  SiRNA target sequence
ctatattttacactgtttta

SEQ ID NO: 66824 - DNA, 20 bp, Artificial sequence
  SiRNA target sequence
tatattttacactgttttag

SEQ ID NO: 66825 - DNA, 20 bp, Artificial sequence
  SiRNA target sequence
atattttacactgttttaga

SEQ ID NO: 66826 - DNA, 20 bp, Artificial sequence
  SiRNA target sequence
tattttacactgttttagag

SEQ ID NO: 66827 - DNA, 20 bp, Artificial sequence
  SiRNA target sequence
attttacactgttttagaga

SEQ ID NO: 66828 - DNA, 20 bp, Artificial sequence
  SiRNA target sequence
ttttacactgttttagagat

SEQ ID NO: 66829 - DNA, 20 bp, Artificial sequence
  SiRNA target sequence
tttacactgttttagagata

SEQ ID NO: 66830 - DNA, 20 bp, Artificial sequence
  SiRNA target sequence
ttacactgttttagagataa

SEQ ID NO: 66831 - DNA, 20 bp, Artificial sequence
  SiRNA target sequence
tacactgttttagagataaa

SEQ ID NO: 66832 - DNA, 20 bp, Artificial sequence
  SiRNA target sequence
acactgttttagagataaaa

SEQ ID NO: 66833 - DNA, 20 bp, Artificial sequence
  SiRNA target sequence
cactgttttagagataaaaa

SEQ ID NO: 66834 - DNA, 20 bp, Artificial sequence
  SiRNA target sequence
actgttttagagataaaaat

SEQ ID NO: 66835 - DNA, 20 bp, Artificial sequence
  SiRNA target sequence
ctgttttagagataaaaata

SEQ ID NO: 66836 - DNA, 20 bp, Artificial sequence
  SiRNA target sequence
tgttttagagataaaaataa

SEQ ID NO: 66837 - DNA, 20 bp, Artificial sequence
  SiRNA target sequence
gttttagagataaaaataag

SEQ ID NO: 66838 - DNA, 20 bp, Artificial sequence
  SiRNA target sequence
ttttagagataaaaataagt

SEQ ID NO: 66839 - DNA, 20 bp, Artificial sequence
  SiRNA target sequence
tttagagataaaaataagta

SEQ ID NO: 66840 - DNA, 20 bp, Artificial sequence
  SiRNA target sequence
ttagagataaaaataagtac

SEQ ID NO: 66841 - DNA, 20 bp, Artificial sequence
  SiRNA target sequence
tagagataaaaataagtaca

SEQ ID NO: 66842 - DNA, 20 bp, Artificial sequence
  SiRNA target sequence
agagataaaaataagtacat

SEQ ID NO: 66843 - DNA, 20 bp, Artificial sequence
  SiRNA target sequence
gagataaaaataagtacatt

SEQ ID NO: 66844 - DNA, 20 bp, Artificial sequence
  SiRNA target sequence
agataaaaataagtacatta

SEQ ID NO: 66845 - DNA, 20 bp, Artificial sequence
  SiRNA target sequence
gataaaaataagtacattag

SEQ ID NO: 66846 - DNA, 20 bp, Artificial sequence
  SiRNA target sequence
ataaaaataagtacattagt

SEQ ID NO: 66847 - DNA, 20 bp, Artificial sequence
  SiRNA target sequence
taaaaataagtacattagta

SEQ ID NO: 66848 - DNA, 20 bp, Artificial sequence
  SiRNA target sequence
aaaaataagtacattagtaa

SEQ ID NO: 66849 - DNA, 20 bp, Artificial sequence
  SiRNA target sequence
aaaataagtacattagtaaa

SEQ ID NO: 66850 - DNA, 20 bp, Artificial sequence
  SiRNA target sequence
aaataagtacattagtaaag

SEQ ID NO: 66851 - DNA, 20 bp, Artificial sequence
  SiRNA target sequence
aataagtacattagtaaaga

SEQ ID NO: 66852 - DNA, 20 bp, Artificial sequence
  SiRNA target sequence
ataagtacattagtaaagaa

SEQ ID NO: 66853 - DNA, 20 bp, Artificial sequence
  SiRNA target sequence
taagtacattagtaaagaat

SEQ ID NO: 66854 - DNA, 20 bp, Artificial sequence
  SiRNA target sequence
aagtacattagtaaagaatc

SEQ ID NO: 66855 - DNA, 20 bp, Artificial sequence
  SiRNA target sequence
agtacattagtaaagaatct

SEQ ID NO: 66856 - DNA, 20 bp, Artificial sequence
  SiRNA target sequence
gtacattagtaaagaatctt

SEQ ID NO: 66857 - DNA, 20 bp, Artificial sequence
  SiRNA target sequence
tacattagtaaagaatctta

SEQ ID NO: 66858 - DNA, 20 bp, Artificial sequence
  SiRNA target sequence
acattagtaaagaatcttaa

SEQ ID NO: 66859 - DNA, 20 bp, Artificial sequence
  SiRNA target sequence
cattagtaaagaatcttaat

SEQ ID NO: 66860 - DNA, 20 bp, Artificial sequence
  SiRNA target sequence
attagtaaagaatcttaatc

SEQ ID NO: 66861 - DNA, 20 bp, Artificial sequence
  SiRNA target sequence
ttagtaaagaatcttaatca

SEQ ID NO: 66862 - DNA, 20 bp, Artificial sequence
  SiRNA target sequence
tagtaaagaatcttaatcaa

SEQ ID NO: 66863 - DNA, 20 bp, Artificial sequence
  SiRNA target sequence
agtaaagaatcttaatcaat

SEQ ID NO: 66864 - DNA, 20 bp, Artificial sequence
  SiRNA target sequence
gtaaagaatcttaatcaatc

SEQ ID NO: 66865 - DNA, 20 bp, Artificial sequence
  SiRNA target sequence
taaagaatcttaatcaatct

SEQ ID NO: 66866 - DNA, 20 bp, Artificial sequence
  SiRNA target sequence
aaagaatcttaatcaatcta

SEQ ID NO: 66867 - DNA, 20 bp, Artificial sequence
  SiRNA target sequence
aagaatcttaatcaatctat

SEQ ID NO: 66868 - DNA, 20 bp, Artificial sequence
  SiRNA target sequence
agaatcttaatcaatctatc

SEQ ID NO: 66869 - DNA, 20 bp, Artificial sequence
  SiRNA target sequence
gaatcttaatcaatctatcg

SEQ ID NO: 66870 - DNA, 20 bp, Artificial sequence
  SiRNA target sequence
aatcttaatcaatctatcgc

SEQ ID NO: 66871 - DNA, 20 bp, Artificial sequence
  SiRNA target sequence
atcttaatcaatctatcgca

SEQ ID NO: 66872 - DNA, 20 bp, Artificial sequence
  SiRNA target sequence
tcttaatcaatctatcgcaa

SEQ ID NO: 66873 - DNA, 20 bp, Artificial sequence
  SiRNA target sequence
cttaatcaatctatcgcaaa

SEQ ID NO: 66874 - DNA, 20 bp, Artificial sequence
  SiRNA target sequence
ttaatcaatctatcgcaaat

SEQ ID NO: 66875 - DNA, 20 bp, Artificial sequence
  SiRNA target sequence
taatcaatctatcgcaaatc

SEQ ID NO: 66876 - DNA, 20 bp, Artificial sequence
  SiRNA target sequence
aatcaatctatcgcaaatcg

SEQ ID NO: 66877 - DNA, 20 bp, Artificial sequence
  SiRNA target sequence
atcaatctatcgcaaatcga

SEQ ID NO: 66878 - DNA, 20 bp, Artificial sequence
  SiRNA target sequence
tcaatctatcgcaaatcgaa

SEQ ID NO: 66879 - DNA, 20 bp, Artificial sequence
  SiRNA target sequence
caatctatcgcaaatcgaaa

SEQ ID NO: 66880 - DNA, 20 bp, Artificial sequence
  SiRNA target sequence
aatctatcgcaaatcgaaaa

SEQ ID NO: 66881 - DNA, 20 bp, Artificial sequence
  SiRNA target sequence
atctatcgcaaatcgaaaag

SEQ ID NO: 66882 - DNA, 20 bp, Artificial sequence
  SiRNA target sequence
tctatcgcaaatcgaaaagg

SEQ ID NO: 66883 - DNA, 20 bp, Artificial sequence
  SiRNA target sequence
ctatcgcaaatcgaaaaggt

SEQ ID NO: 66884 - DNA, 20 bp, Artificial sequence
  SiRNA target sequence
tatcgcaaatcgaaaaggtg

SEQ ID NO: 66885 - DNA, 20 bp, Artificial sequence
  SiRNA target sequence
atcgcaaatcgaaaaggtga

SEQ ID NO: 66886 - DNA, 20 bp, Artificial sequence
  SiRNA target sequence
tcgcaaatcgaaaaggtgaa

SEQ ID NO: 66887 - DNA, 20 bp, Artificial sequence
  SiRNA target sequence
cgcaaatcgaaaaggtgaac

SEQ ID NO: 66888 - DNA, 20 bp, Artificial sequence
  SiRNA target sequence
gcaaatcgaaaaggtgaaca

SEQ ID NO: 66889 - DNA, 20 bp, Artificial sequence
  SiRNA target sequence
caaatcgaaaaggtgaacac

SEQ ID NO: 66890 - DNA, 20 bp, Artificial sequence
  SiRNA target sequence
aaatcgaaaaggtgaacaca

SEQ ID NO: 66891 - DNA, 20 bp, Artificial sequence
  SiRNA target sequence
aatcgaaaaggtgaacacac

SEQ ID NO: 66892 - DNA, 20 bp, Artificial sequence
  SiRNA target sequence
atcgaaaaggtgaacacaca

SEQ ID NO: 66893 - DNA, 20 bp, Artificial sequence
  SiRNA target sequence
tcgaaaaggtgaacacacag

SEQ ID NO: 66894 - DNA, 20 bp, Artificial sequence
  SiRNA target sequence
cgaaaaggtgaacacacagc

SEQ ID NO: 66895 - DNA, 20 bp, Artificial sequence
  SiRNA target sequence
gaaaaggtgaacacacagca

SEQ ID NO: 66896 - DNA, 20 bp, Artificial sequence
  SiRNA target sequence
aaaaggtgaacacacagcac

SEQ ID NO: 66897 - DNA, 20 bp, Artificial sequence
  SiRNA target sequence
aaaggtgaacacacagcact

SEQ ID NO: 66898 - DNA, 20 bp, Artificial sequence
  SiRNA target sequence
aaggtgaacacacagcactt

SEQ ID NO: 66899 - DNA, 20 bp, Artificial sequence
  SiRNA target sequence
aggtgaacacacagcacttg

SEQ ID NO: 66900 - DNA, 20 bp, Artificial sequence
  SiRNA target sequence
ggtgaacacacagcacttga

SEQ ID NO: 66901 - DNA, 20 bp, Artificial sequence
  SiRNA target sequence
gtgaacacacagcacttgaa

SEQ ID NO: 66902 - DNA, 20 bp, Artificial sequence
  SiRNA target sequence
tgaacacacagcacttgaaa

SEQ ID NO: 66903 - DNA, 20 bp, Artificial sequence
  SiRNA target sequence
gaacacacagcacttgaaag

SEQ ID NO: 66904 - DNA, 20 bp, Artificial sequence
  SiRNA target sequence
aacacacagcacttgaaaga

SEQ ID NO: 66905 - DNA, 20 bp, Artificial sequence
  SiRNA target sequence
acacacagcacttgaaagat

SEQ ID NO: 66906 - DNA, 20 bp, Artificial sequence
  SiRNA target sequence
cacacagcacttgaaagatt

SEQ ID NO: 66907 - DNA, 20 bp, Artificial sequence
  SiRNA target sequence
acacagcacttgaaagattt

SEQ ID NO: 66908 - DNA, 20 bp, Artificial sequence
  SiRNA target sequence
cacagcacttgaaagatttg

SEQ ID NO: 66909 - DNA, 20 bp, Artificial sequence
  SiRNA target sequence
acagcacttgaaagatttgt

SEQ ID NO: 66910 - DNA, 20 bp, Artificial sequence
  SiRNA target sequence
cagcacttgaaagatttgtg

SEQ ID NO: 66911 - DNA, 20 bp, Artificial sequence
  SiRNA target sequence
agcacttgaaagatttgtgt

SEQ ID NO: 66912 - DNA, 20 bp, Artificial sequence
  SiRNA target sequence
gcacttgaaagatttgtgtt

SEQ ID NO: 66913 - DNA, 20 bp, Artificial sequence
  SiRNA target sequence
cacttgaaagatttgtgtta

SEQ ID NO: 66914 - DNA, 20 bp, Artificial sequence
  SiRNA target sequence
acttgaaagatttgtgttac

SEQ ID NO: 66915 - DNA, 20 bp, Artificial sequence
  SiRNA target sequence
cttgaaagatttgtgttaca

SEQ ID NO: 66916 - DNA, 20 bp, Artificial sequence
  SiRNA target sequence
ttgaaagatttgtgttacag

SEQ ID NO: 66917 - DNA, 20 bp, Artificial sequence
  SiRNA target sequence
tgaaagatttgtgttacagt

SEQ ID NO: 66918 - DNA, 20 bp, Artificial sequence
  SiRNA target sequence
gaaagatttgtgttacagtc

SEQ ID NO: 66919 - DNA, 20 bp, Artificial sequence
  SiRNA target sequence
aaagatttgtgttacagtca

SEQ ID NO: 66920 - DNA, 20 bp, Artificial sequence
  SiRNA target sequence
aagatttgtgttacagtcac

SEQ ID NO: 66921 - DNA, 20 bp, Artificial sequence
  SiRNA target sequence
agatttgtgttacagtcact

SEQ ID NO: 66922 - DNA, 20 bp, Artificial sequence
  SiRNA target sequence
gatttgtgttacagtcactc

SEQ ID NO: 66923 - DNA, 20 bp, Artificial sequence
  SiRNA target sequence
atttgtgttacagtcactct

SEQ ID NO: 66924 - DNA, 20 bp, Artificial sequence
  SiRNA target sequence
tttgtgttacagtcactctt

SEQ ID NO: 66925 - DNA, 20 bp, Artificial sequence
  SiRNA target sequence
ttgtgttacagtcactctta

SEQ ID NO: 66926 - DNA, 20 bp, Artificial sequence
  SiRNA target sequence
tgtgttacagtcactcttag

SEQ ID NO: 66927 - DNA, 20 bp, Artificial sequence
  SiRNA target sequence
gtgttacagtcactcttagt

SEQ ID NO: 66928 - DNA, 20 bp, Artificial sequence
  SiRNA target sequence
tgttacagtcactcttagtg

SEQ ID NO: 66929 - DNA, 20 bp, Artificial sequence
  SiRNA target sequence
gttacagtcactcttagtgg

SEQ ID NO: 66930 - DNA, 20 bp, Artificial sequence
  SiRNA target sequence
ttacagtcactcttagtggc

SEQ ID NO: 66931 - DNA, 20 bp, Artificial sequence
  SiRNA target sequence
tacagtcactcttagtggct

SEQ ID NO: 66932 - DNA, 20 bp, Artificial sequence
  SiRNA target sequence
acagtcactcttagtggctg

SEQ ID NO: 66933 - DNA, 20 bp, Artificial sequence
  SiRNA target sequence
cagtcactcttagtggctgt

SEQ ID NO: 66934 - DNA, 20 bp, Artificial sequence
  SiRNA target sequence
agtcactcttagtggctgta

SEQ ID NO: 66935 - DNA, 20 bp, Artificial sequence
  SiRNA target sequence
gtcactcttagtggctgtat

SEQ ID NO: 66936 - DNA, 20 bp, Artificial sequence
  SiRNA target sequence
tcactcttagtggctgtatt

SEQ ID NO: 66937 - DNA, 20 bp, Artificial sequence
  SiRNA target sequence
cactcttagtggctgtattg

SEQ ID NO: 66938 - DNA, 20 bp, Artificial sequence
  SiRNA target sequence
actcttagtggctgtattga

SEQ ID NO: 66939 - DNA, 20 bp, Artificial sequence
  SiRNA target sequence
ctcttagtggctgtattgac

SEQ ID NO: 66940 - DNA, 20 bp, Artificial sequence
  SiRNA target sequence
tcttagtggctgtattgacc

SEQ ID NO: 66941 - DNA, 20 bp, Artificial sequence
  SiRNA target sequence
cttagtggctgtattgaccg

SEQ ID NO: 66942 - DNA, 20 bp, Artificial sequence
  SiRNA target sequence
ttagtggctgtattgaccga

SEQ ID NO: 66943 - DNA, 20 bp, Artificial sequence
  SiRNA target sequence
tagtggctgtattgaccgaa

SEQ ID NO: 66944 - DNA, 20 bp, Artificial sequence
  SiRNA target sequence
agtggctgtattgaccgaac

SEQ ID NO: 66945 - DNA, 20 bp, Artificial sequence
  SiRNA target sequence
gtggctgtattgaccgaact

SEQ ID NO: 66946 - DNA, 20 bp, Artificial sequence
  SiRNA target sequence
tggctgtattgaccgaactt

SEQ ID NO: 66947 - DNA, 20 bp, Artificial sequence
  SiRNA target sequence
ggctgtattgaccgaactta

SEQ ID NO: 66948 - DNA, 20 bp, Artificial sequence
  SiRNA target sequence
gctgtattgaccgaacttaa

SEQ ID NO: 66949 - DNA, 20 bp, Artificial sequence
  SiRNA target sequence
ctgtattgaccgaacttaat

SEQ ID NO: 66950 - DNA, 20 bp, Artificial sequence
  SiRNA target sequence
tgtattgaccgaacttaatg

SEQ ID NO: 66951 - DNA, 20 bp, Artificial sequence
  SiRNA target sequence
gtattgaccgaacttaatgg

SEQ ID NO: 66952 - DNA, 20 bp, Artificial sequence
  SiRNA target sequence
tattgaccgaacttaatgga

SEQ ID NO: 66953 - DNA, 20 bp, Artificial sequence
  SiRNA target sequence
attgaccgaacttaatggat

SEQ ID NO: 66954 - DNA, 20 bp, Artificial sequence
  SiRNA target sequence
ttgaccgaacttaatggatt

SEQ ID NO: 66955 - DNA, 20 bp, Artificial sequence
  SiRNA target sequence
tgaccgaacttaatggattt

SEQ ID NO: 66956 - DNA, 20 bp, Artificial sequence
  SiRNA target sequence
gaccgaacttaatggattta

SEQ ID NO: 66957 - DNA, 20 bp, Artificial sequence
  SiRNA target sequence
accgaacttaatggatttat

SEQ ID NO: 66958 - DNA, 20 bp, Artificial sequence
  SiRNA target sequence
ccgaacttaatggatttatt

SEQ ID NO: 66959 - DNA, 20 bp, Artificial sequence
  SiRNA target sequence
cgaacttaatggatttattt

SEQ ID NO: 66960 - DNA, 20 bp, Artificial sequence
  SiRNA target sequence
gaacttaatggatttatttt

SEQ ID NO: 66961 - DNA, 20 bp, Artificial sequence
  SiRNA target sequence
aacttaatggatttattttt

SEQ ID NO: 66962 - DNA, 20 bp, Artificial sequence
  SiRNA target sequence
acttaatggatttattttta

SEQ ID NO: 66963 - DNA, 20 bp, Artificial sequence
  SiRNA target sequence
cttaatggatttatttttac

SEQ ID NO: 66964 - DNA, 20 bp, Artificial sequence
  SiRNA target sequence
ttaatggatttatttttaca

SEQ ID NO: 66965 - DNA, 20 bp, Artificial sequence
  SiRNA target sequence
taatggatttatttttacag

SEQ ID NO: 66966 - DNA, 20 bp, Artificial sequence
  SiRNA target sequence
aatggatttatttttacagg

SEQ ID NO: 66967 - DNA, 20 bp, Artificial sequence
  SiRNA target sequence
atggatttatttttacaggt

SEQ ID NO: 66968 - DNA, 20 bp, Artificial sequence
  SiRNA target sequence
tggatttatttttacaggtg

SEQ ID NO: 66969 - DNA, 20 bp, Artificial sequence
  SiRNA target sequence
ggatttatttttacaggtgt

SEQ ID NO: 66970 - DNA, 20 bp, Artificial sequence
  SiRNA target sequence
gatttatttttacaggtgta

SEQ ID NO: 66971 - DNA, 20 bp, Artificial sequence
  SiRNA target sequence
atttatttttacaggtgtag

SEQ ID NO: 66972 - DNA, 20 bp, Artificial sequence
  SiRNA target sequence
tttatttttacaggtgtagt

SEQ ID NO: 66973 - DNA, 20 bp, Artificial sequence
  SiRNA target sequence
ttatttttacaggtgtagtg

SEQ ID NO: 66974 - DNA, 20 bp, Artificial sequence
  SiRNA target sequence
tatttttacaggtgtagtgc

SEQ ID NO: 66975 - DNA, 20 bp, Artificial sequence
  SiRNA target sequence
atttttacaggtgtagtgca

SEQ ID NO: 66976 - DNA, 20 bp, Artificial sequence
  SiRNA target sequence
tttttacaggtgtagtgcaa

SEQ ID NO: 66977 - DNA, 20 bp, Artificial sequence
  SiRNA target sequence
ttttacaggtgtagtgcaat

SEQ ID NO: 66978 - DNA, 20 bp, Artificial sequence
  SiRNA target sequence
tttacaggtgtagtgcaata

SEQ ID NO: 66979 - DNA, 20 bp, Artificial sequence
  SiRNA target sequence
ttacaggtgtagtgcaatat

SEQ ID NO: 66980 - DNA, 20 bp, Artificial sequence
  SiRNA target sequence
tacaggtgtagtgcaatata

SEQ ID NO: 66981 - DNA, 20 bp, Artificial sequence
  SiRNA target sequence
acaggtgtagtgcaatatat

SEQ ID NO: 66982 - DNA, 20 bp, Artificial sequence
  SiRNA target sequence
caggtgtagtgcaatatatt

SEQ ID NO: 66983 - DNA, 20 bp, Artificial sequence
  SiRNA target sequence
aggtgtagtgcaatatattt

SEQ ID NO: 66984 - DNA, 20 bp, Artificial sequence
  SiRNA target sequence
ggtgtagtgcaatatattta

SEQ ID NO: 66985 - DNA, 20 bp, Artificial sequence
  SiRNA target sequence
gtgtagtgcaatatatttat

SEQ ID NO: 66986 - DNA, 20 bp, Artificial sequence
  SiRNA target sequence
tgtagtgcaatatatttata

SEQ ID NO: 66987 - DNA, 20 bp, Artificial sequence
  SiRNA target sequence
gtagtgcaatatatttatag

SEQ ID NO: 66988 - DNA, 20 bp, Artificial sequence
  SiRNA target sequence
tagtgcaatatatttataga

SEQ ID NO: 66989 - DNA, 20 bp, Artificial sequence
  SiRNA target sequence
agtgcaatatatttatagaa

SEQ ID NO: 66990 - DNA, 20 bp, Artificial sequence
  SiRNA target sequence
gtgcaatatatttatagaaa

SEQ ID NO: 66991 - DNA, 20 bp, Artificial sequence
  SiRNA target sequence
tgcaatatatttatagaaat

SEQ ID NO: 66992 - DNA, 20 bp, Artificial sequence
  SiRNA target sequence
gcaatatatttatagaaata

SEQ ID NO: 66993 - DNA, 20 bp, Artificial sequence
  SiRNA target sequence
caatatatttatagaaatac

SEQ ID NO: 66994 - DNA, 20 bp, Artificial sequence
  SiRNA target sequence
aatatatttatagaaatacg

SEQ ID NO: 66995 - DNA, 20 bp, Artificial sequence
  SiRNA target sequence
atatatttatagaaatacgg

SEQ ID NO: 66996 - DNA, 20 bp, Artificial sequence
  SiRNA target sequence
tatatttatagaaatacggc

SEQ ID NO: 66997 - DNA, 20 bp, Artificial sequence
  SiRNA target sequence
atatttatagaaatacggca

SEQ ID NO: 66998 - DNA, 20 bp, Artificial sequence
  SiRNA target sequence
tatttatagaaatacggcaa

SEQ ID NO: 66999 - DNA, 20 bp, Artificial sequence
  SiRNA target sequence
atttatagaaatacggcaaa

SEQ ID NO: 67000 - DNA, 20 bp, Artificial sequence
  SiRNA target sequence
tttatagaaatacggcaaaa

SEQ ID NO: 67001 - DNA, 20 bp, Artificial sequence
  SiRNA target sequence
ttatagaaatacggcaaaat

SEQ ID NO: 67002 - DNA, 20 bp, Artificial sequence
  SiRNA target sequence
tatagaaatacggcaaaatc

SEQ ID NO: 67003 - DNA, 20 bp, Artificial sequence
  SiRNA target sequence
atagaaatacggcaaaatct

SEQ ID NO: 67004 - DNA, 20 bp, Artificial sequence
  SiRNA target sequence
tagaaatacggcaaaatcta

SEQ ID NO: 67005 - DNA, 20 bp, Artificial sequence
  SiRNA target sequence
agaaatacggcaaaatctac

SEQ ID NO: 67006 - DNA, 20 bp, Artificial sequence
  SiRNA target sequence
gaaatacggcaaaatctaca

SEQ ID NO: 67007 - DNA, 20 bp, Artificial sequence
  SiRNA target sequence
aaatacggcaaaatctacat

SEQ ID NO: 67008 - DNA, 20 bp, Artificial sequence
  SiRNA target sequence
aatacggcaaaatctacatt

SEQ ID NO: 67009 - DNA, 20 bp, Artificial sequence
  SiRNA target sequence
atacggcaaaatctacattc

SEQ ID NO: 67010 - DNA, 20 bp, Artificial sequence
  SiRNA target sequence
tacggcaaaatctacattca

SEQ ID NO: 67011 - DNA, 20 bp, Artificial sequence
  SiRNA target sequence
acggcaaaatctacattcaa

SEQ ID NO: 67012 - DNA, 20 bp, Artificial sequence
  SiRNA target sequence
cggcaaaatctacattcaaa

SEQ ID NO: 67013 - DNA, 20 bp, Artificial sequence
  SiRNA target sequence
ggcaaaatctacattcaaag

SEQ ID NO: 67014 - DNA, 20 bp, Artificial sequence
  SiRNA target sequence
gcaaaatctacattcaaagg

SEQ ID NO: 67015 - DNA, 20 bp, Artificial sequence
  SiRNA target sequence
caaaatctacattcaaaggc

SEQ ID NO: 67016 - DNA, 20 bp, Artificial sequence
  SiRNA target sequence
aaaatctacattcaaaggct

SEQ ID NO: 67017 - DNA, 20 bp, Artificial sequence
  SiRNA target sequence
aaatctacattcaaaggctt

SEQ ID NO: 67018 - DNA, 20 bp, Artificial sequence
  SiRNA target sequence
aatctacattcaaaggcttc

SEQ ID NO: 67019 - DNA, 20 bp, Artificial sequence
  SiRNA target sequence
atctacattcaaaggcttca

SEQ ID NO: 67020 - DNA, 20 bp, Artificial sequence
  SiRNA target sequence
tctacattcaaaggcttcat

SEQ ID NO: 67021 - DNA, 20 bp, Artificial sequence
  SiRNA target sequence
ctacattcaaaggcttcatt

SEQ ID NO: 67022 - DNA, 20 bp, Artificial sequence
  SiRNA target sequence
tacattcaaaggcttcattt

SEQ ID NO: 67023 - DNA, 20 bp, Artificial sequence
  SiRNA target sequence
acattcaaaggcttcatttc

SEQ ID NO: 67024 - DNA, 20 bp, Artificial sequence
  SiRNA target sequence
cattcaaaggcttcatttct

SEQ ID NO: 67025 - DNA, 20 bp, Artificial sequence
  SiRNA target sequence
attcaaaggcttcatttctc

SEQ ID NO: 67026 - DNA, 20 bp, Artificial sequence
  SiRNA target sequence
ttcaaaggcttcatttctct

SEQ ID NO: 67027 - DNA, 20 bp, Artificial sequence
  SiRNA target sequence
tcaaaggcttcatttctctt

SEQ ID NO: 67028 - DNA, 20 bp, Artificial sequence
  SiRNA target sequence
caaaggcttcatttctcttt

SEQ ID NO: 67029 - DNA, 20 bp, Artificial sequence
  SiRNA target sequence
aaaggcttcatttctctttc

SEQ ID NO: 67030 - DNA, 20 bp, Artificial sequence
  SiRNA target sequence
aaggcttcatttctctttca

SEQ ID NO: 67031 - DNA, 20 bp, Artificial sequence
  SiRNA target sequence
aggcttcatttctctttcac

SEQ ID NO: 67032 - DNA, 20 bp, Artificial sequence
  SiRNA target sequence
ggcttcatttctctttcacc

SEQ ID NO: 67033 - DNA, 20 bp, Artificial sequence
  SiRNA target sequence
gcttcatttctctttcacct

SEQ ID NO: 67034 - DNA, 20 bp, Artificial sequence
  SiRNA target sequence
cttcatttctctttcaccta

SEQ ID NO: 67035 - DNA, 20 bp, Artificial sequence
  SiRNA target sequence
ttcatttctctttcacctaa

SEQ ID NO: 67036 - DNA, 20 bp, Artificial sequence
  SiRNA target sequence
tcatttctctttcacctaaa

SEQ ID NO: 67037 - DNA, 20 bp, Artificial sequence
  SiRNA target sequence
catttctctttcacctaaaa

SEQ ID NO: 67038 - DNA, 20 bp, Artificial sequence
  SiRNA target sequence
atttctctttcacctaaaaa

SEQ ID NO: 67039 - DNA, 20 bp, Artificial sequence
  SiRNA target sequence
tttctctttcacctaaaaat

SEQ ID NO: 67040 - DNA, 20 bp, Artificial sequence
  SiRNA target sequence
ttctctttcacctaaaaatt

SEQ ID NO: 67041 - DNA, 20 bp, Artificial sequence
  SiRNA target sequence
tctctttcacctaaaaattt

SEQ ID NO: 67042 - DNA, 20 bp, Artificial sequence
  SiRNA target sequence
ctctttcacctaaaaatttt

SEQ ID NO: 67043 - DNA, 20 bp, Artificial sequence
  SiRNA target sequence
tctttcacctaaaaatttta

SEQ ID NO: 67044 - DNA, 20 bp, Artificial sequence
  SiRNA target sequence
ctttcacctaaaaattttag

SEQ ID NO: 67045 - DNA, 20 bp, Artificial sequence
  SiRNA target sequence
tttcacctaaaaattttagt

SEQ ID NO: 67046 - DNA, 20 bp, Artificial sequence
  SiRNA target sequence
ttcacctaaaaattttagta

SEQ ID NO: 67047 - DNA, 20 bp, Artificial sequence
  SiRNA target sequence
tcacctaaaaattttagtac

SEQ ID NO: 67048 - DNA, 20 bp, Artificial sequence
  SiRNA target sequence
cacctaaaaattttagtacc

SEQ ID NO: 67049 - DNA, 20 bp, Artificial sequence
  SiRNA target sequence
acctaaaaattttagtacca

SEQ ID NO: 67050 - DNA, 20 bp, Artificial sequence
  SiRNA target sequence
cctaaaaattttagtaccat

SEQ ID NO: 67051 - DNA, 20 bp, Artificial sequence
  SiRNA target sequence
ctaaaaattttagtaccata

SEQ ID NO: 67052 - DNA, 20 bp, Artificial sequence
  SiRNA target sequence
taaaaattttagtaccatag

SEQ ID NO: 67053 - DNA, 20 bp, Artificial sequence
  SiRNA target sequence
aaaaattttagtaccatagg

SEQ ID NO: 67054 - DNA, 20 bp, Artificial sequence
  SiRNA target sequence
aaaattttagtaccataggt

SEQ ID NO: 67055 - DNA, 20 bp, Artificial sequence
  SiRNA target sequence
aaattttagtaccataggtg

SEQ ID NO: 67056 - DNA, 20 bp, Artificial sequence
  SiRNA target sequence
aattttagtaccataggtgg

SEQ ID NO: 67057 - DNA, 20 bp, Artificial sequence
  SiRNA target sequence
attttagtaccataggtggc

SEQ ID NO: 67058 - DNA, 20 bp, Artificial sequence
  SiRNA target sequence
ttttagtaccataggtggcg

SEQ ID NO: 67059 - DNA, 20 bp, Artificial sequence
  SiRNA target sequence
tttagtaccataggtggcgg

SEQ ID NO: 67060 - DNA, 20 bp, Artificial sequence
  SiRNA target sequence
ttagtaccataggtggcgga

SEQ ID NO: 67061 - DNA, 20 bp, Artificial sequence
  SiRNA target sequence
tagtaccataggtggcggag

SEQ ID NO: 67062 - DNA, 20 bp, Artificial sequence
  SiRNA target sequence
agtaccataggtggcggaga

SEQ ID NO: 67063 - DNA, 20 bp, Artificial sequence
  SiRNA target sequence
gtaccataggtggcggagaa

SEQ ID NO: 67064 - DNA, 20 bp, Artificial sequence
  SiRNA target sequence
taccataggtggcggagaaa

SEQ ID NO: 67065 - DNA, 20 bp, Artificial sequence
  SiRNA target sequence
accataggtggcggagaaat

SEQ ID NO: 67066 - DNA, 20 bp, Artificial sequence
  SiRNA target sequence
ccataggtggcggagaaatt

SEQ ID NO: 67067 - DNA, 20 bp, Artificial sequence
  SiRNA target sequence
cataggtggcggagaaattc

SEQ ID NO: 67068 - DNA, 20 bp, Artificial sequence
  SiRNA target sequence
ataggtggcggagaaattca

SEQ ID NO: 67069 - DNA, 20 bp, Artificial sequence
  SiRNA target sequence
taggtggcggagaaattcaa

SEQ ID NO: 67070 - DNA, 20 bp, Artificial sequence
  SiRNA target sequence
aggtggcggagaaattcaaa

SEQ ID NO: 67071 - DNA, 20 bp, Artificial sequence
  SiRNA target sequence
ggtggcggagaaattcaaac

SEQ ID NO: 67072 - DNA, 20 bp, Artificial sequence
  SiRNA target sequence
gtggcggagaaattcaaaca

SEQ ID NO: 67073 - DNA, 20 bp, Artificial sequence
  SiRNA target sequence
tggcggagaaattcaaacaa

SEQ ID NO: 67074 - DNA, 20 bp, Artificial sequence
  SiRNA target sequence
ggcggagaaattcaaacaat

SEQ ID NO: 67075 - DNA, 20 bp, Artificial sequence
  SiRNA target sequence
gcggagaaattcaaacaata

SEQ ID NO: 67076 - DNA, 20 bp, Artificial sequence
  SiRNA target sequence
cggagaaattcaaacaataa

SEQ ID NO: 67077 - DNA, 20 bp, Artificial sequence
  SiRNA target sequence
ggagaaattcaaacaataat

SEQ ID NO: 67078 - DNA, 20 bp, Artificial sequence
  SiRNA target sequence
gagaaattcaaacaataata

SEQ ID NO: 67079 - DNA, 20 bp, Artificial sequence
  SiRNA target sequence
agaaattcaaacaataatag

SEQ ID NO: 67080 - DNA, 20 bp, Artificial sequence
  SiRNA target sequence
gaaattcaaacaataataga

SEQ ID NO: 67081 - DNA, 20 bp, Artificial sequence
  SiRNA target sequence
aaattcaaacaataatagat

SEQ ID NO: 67082 - DNA, 20 bp, Artificial sequence
  SiRNA target sequence
aattcaaacaataatagata

SEQ ID NO: 67083 - DNA, 20 bp, Artificial sequence
  SiRNA target sequence
attcaaacaataatagatag

SEQ ID NO: 67084 - DNA, 20 bp, Artificial sequence
  SiRNA target sequence
ttcaaacaataatagataga

SEQ ID NO: 67085 - DNA, 20 bp, Artificial sequence
  SiRNA target sequence
tcaaacaataatagatagaa

SEQ ID NO: 67086 - DNA, 20 bp, Artificial sequence
  SiRNA target sequence
caaacaataatagatagaaa

SEQ ID NO: 67087 - DNA, 20 bp, Artificial sequence
  SiRNA target sequence
aaacaataatagatagaaaa

SEQ ID NO: 67088 - DNA, 20 bp, Artificial sequence
  SiRNA target sequence
aacaataatagatagaaaat

SEQ ID NO: 67089 - DNA, 20 bp, Artificial sequence
  SiRNA target sequence
acaataatagatagaaaatc

SEQ ID NO: 67090 - DNA, 20 bp, Artificial sequence
  SiRNA target sequence
caataatagatagaaaatca

SEQ ID NO: 67091 - DNA, 20 bp, Artificial sequence
  SiRNA target sequence
aataatagatagaaaatcaa

SEQ ID NO: 67092 - DNA, 20 bp, Artificial sequence
  SiRNA target sequence
ataatagatagaaaatcaaa

SEQ ID NO: 67093 - DNA, 20 bp, Artificial sequence
  SiRNA target sequence
taatagatagaaaatcaaaa

SEQ ID NO: 67094 - DNA, 20 bp, Artificial sequence
  SiRNA target sequence
aatagatagaaaatcaaaat

SEQ ID NO: 67095 - DNA, 20 bp, Artificial sequence
  SiRNA target sequence
atagatagaaaatcaaaatc

SEQ ID NO: 67096 - DNA, 20 bp, Artificial sequence
  SiRNA target sequence
tagatagaaaatcaaaatct

SEQ ID NO: 67097 - DNA, 20 bp, Artificial sequence
  SiRNA target sequence
agatagaaaatcaaaatctg

SEQ ID NO: 67098 - DNA, 20 bp, Artificial sequence
  SiRNA target sequence
gatagaaaatcaaaatctgc

SEQ ID NO: 67099 - DNA, 20 bp, Artificial sequence
  SiRNA target sequence
atagaaaatcaaaatctgca

SEQ ID NO: 67100 - DNA, 20 bp, Artificial sequence
  SiRNA target sequence
tagaaaatcaaaatctgcaa

SEQ ID NO: 67101 - DNA, 20 bp, Artificial sequence
  SiRNA target sequence
agaaaatcaaaatctgcaag

SEQ ID NO: 67102 - DNA, 20 bp, Artificial sequence
  SiRNA target sequence
gaaaatcaaaatctgcaagt

SEQ ID NO: 67103 - DNA, 20 bp, Artificial sequence
  SiRNA target sequence
aaaatcaaaatctgcaagtg

SEQ ID NO: 67104 - DNA, 20 bp, Artificial sequence
  SiRNA target sequence
aaatcaaaatctgcaagtga

SEQ ID NO: 67105 - DNA, 20 bp, Artificial sequence
  SiRNA target sequence
aatcaaaatctgcaagtgaa

SEQ ID NO: 67106 - DNA, 20 bp, Artificial sequence
  SiRNA target sequence
atcaaaatctgcaagtgaac

SEQ ID NO: 67107 - DNA, 20 bp, Artificial sequence
  SiRNA target sequence
tcaaaatctgcaagtgaact

SEQ ID NO: 67108 - DNA, 20 bp, Artificial sequence
  SiRNA target sequence
caaaatctgcaagtgaactt

SEQ ID NO: 67109 - DNA, 20 bp, Artificial sequence
  SiRNA target sequence
aaaatctgcaagtgaactta

SEQ ID NO: 67110 - DNA, 20 bp, Artificial sequence
  SiRNA target sequence
aaatctgcaagtgaacttat

SEQ ID NO: 67111 - DNA, 20 bp, Artificial sequence
  SiRNA target sequence
aatctgcaagtgaacttatt

SEQ ID NO: 67112 - DNA, 20 bp, Artificial sequence
  SiRNA target sequence
atctgcaagtgaacttattg

SEQ ID NO: 67113 - DNA, 20 bp, Artificial sequence
  SiRNA target sequence
tctgcaagtgaacttattga

SEQ ID NO: 67114 - DNA, 20 bp, Artificial sequence
  SiRNA target sequence
ctgcaagtgaacttattgaa

SEQ ID NO: 67115 - DNA, 20 bp, Artificial sequence
  SiRNA target sequence
tgcaagtgaacttattgaag

SEQ ID NO: 67116 - DNA, 20 bp, Artificial sequence
  SiRNA target sequence
gcaagtgaacttattgaagt

SEQ ID NO: 67117 - DNA, 20 bp, Artificial sequence
  SiRNA target sequence
caagtgaacttattgaagtg

SEQ ID NO: 67118 - DNA, 20 bp, Artificial sequence
  SiRNA target sequence
aagtgaacttattgaagtgt

SEQ ID NO: 67119 - DNA, 20 bp, Artificial sequence
  SiRNA target sequence
agtgaacttattgaagtgtt

SEQ ID NO: 67120 - DNA, 20 bp, Artificial sequence
  SiRNA target sequence
gtgaacttattgaagtgttt

SEQ ID NO: 67121 - DNA, 20 bp, Artificial sequence
  SiRNA target sequence
tgaacttattgaagtgtttc

SEQ ID NO: 67122 - DNA, 20 bp, Artificial sequence
  SiRNA target sequence
gaacttattgaagtgtttct

SEQ ID NO: 67123 - DNA, 20 bp, Artificial sequence
  SiRNA target sequence
aacttattgaagtgtttctt

SEQ ID NO: 67124 - DNA, 20 bp, Artificial sequence
  SiRNA target sequence
acttattgaagtgtttctta

SEQ ID NO: 67125 - DNA, 20 bp, Artificial sequence
  SiRNA target sequence
cttattgaagtgtttcttac

SEQ ID NO: 67126 - DNA, 20 bp, Artificial sequence
  SiRNA target sequence
ttattgaagtgtttcttaca

SEQ ID NO: 67127 - DNA, 20 bp, Artificial sequence
  SiRNA target sequence
tattgaagtgtttcttacaa

SEQ ID NO: 67128 - DNA, 20 bp, Artificial sequence
  SiRNA target sequence
attgaagtgtttcttacaag

SEQ ID NO: 67129 - DNA, 20 bp, Artificial sequence
  SiRNA target sequence
ttgaagtgtttcttacaagc

SEQ ID NO: 67130 - DNA, 20 bp, Artificial sequence
  SiRNA target sequence
tgaagtgtttcttacaagct

SEQ ID NO: 67131 - DNA, 20 bp, Artificial sequence
  SiRNA target sequence
gaagtgtttcttacaagctt

SEQ ID NO: 67132 - DNA, 20 bp, Artificial sequence
  SiRNA target sequence
aagtgtttcttacaagcttg

SEQ ID NO: 67133 - DNA, 20 bp, Artificial sequence
  SiRNA target sequence
agtgtttcttacaagcttgc

SEQ ID NO: 67134 - DNA, 20 bp, Artificial sequence
  SiRNA target sequence
gtgtttcttacaagcttgct

SEQ ID NO: 67135 - DNA, 20 bp, Artificial sequence
  SiRNA target sequence
tgtttcttacaagcttgctt

SEQ ID NO: 67136 - DNA, 20 bp, Artificial sequence
  SiRNA target sequence
gtttcttacaagcttgcttc

SEQ ID NO: 67137 - DNA, 20 bp, Artificial sequence
  SiRNA target sequence
tttcttacaagcttgcttcc

SEQ ID NO: 67138 - DNA, 20 bp, Artificial sequence
  SiRNA target sequence
ttcttacaagcttgcttcca

SEQ ID NO: 67139 - DNA, 20 bp, Artificial sequence
  SiRNA target sequence
tcttacaagcttgcttccaa

SEQ ID NO: 67140 - DNA, 20 bp, Artificial sequence
  SiRNA target sequence
cttacaagcttgcttccaat

SEQ ID NO: 67141 - DNA, 20 bp, Artificial sequence
  SiRNA target sequence
ttacaagcttgcttccaata

SEQ ID NO: 67142 - DNA, 20 bp, Artificial sequence
  SiRNA target sequence
tacaagcttgcttccaatat

SEQ ID NO: 67143 - DNA, 20 bp, Artificial sequence
  SiRNA target sequence
acaagcttgcttccaatatg

SEQ ID NO: 67144 - DNA, 20 bp, Artificial sequence
  SiRNA target sequence
caagcttgcttccaatatgc

SEQ ID NO: 67145 - DNA, 20 bp, Artificial sequence
  SiRNA target sequence
aagcttgcttccaatatgcc

SEQ ID NO: 67146 - DNA, 20 bp, Artificial sequence
  SiRNA target sequence
agcttgcttccaatatgcct

SEQ ID NO: 67147 - DNA, 20 bp, Artificial sequence
  SiRNA target sequence
gcttgcttccaatatgcctt

SEQ ID NO: 67148 - DNA, 20 bp, Artificial sequence
  SiRNA target sequence
cttgcttccaatatgcctta

SEQ ID NO: 67149 - DNA, 20 bp, Artificial sequence
  SiRNA target sequence
ttgcttccaatatgccttaa

SEQ ID NO: 67150 - DNA, 20 bp, Artificial sequence
  SiRNA target sequence
tgcttccaatatgccttaaa

SEQ ID NO: 67151 - DNA, 20 bp, Artificial sequence
  SiRNA target sequence
gcttccaatatgccttaaac

SEQ ID NO: 67152 - DNA, 20 bp, Artificial sequence
  SiRNA target sequence
cttccaatatgccttaaact

SEQ ID NO: 67153 - DNA, 20 bp, Artificial sequence
  SiRNA target sequence
ttccaatatgccttaaactt

SEQ ID NO: 67154 - DNA, 20 bp, Artificial sequence
  SiRNA target sequence
tccaatatgccttaaacttt

SEQ ID NO: 67155 - DNA, 20 bp, Artificial sequence
  SiRNA target sequence
ccaatatgccttaaactttt

SEQ ID NO: 67156 - DNA, 20 bp, Artificial sequence
  SiRNA target sequence
caatatgccttaaactttta

SEQ ID NO: 67157 - DNA, 20 bp, Artificial sequence
  SiRNA target sequence
aatatgccttaaacttttat

SEQ ID NO: 67158 - DNA, 20 bp, Artificial sequence
  SiRNA target sequence
atatgccttaaacttttatt

SEQ ID NO: 67159 - DNA, 20 bp, Artificial sequence
  SiRNA target sequence
tatgccttaaacttttattt

SEQ ID NO: 67160 - DNA, 20 bp, Artificial sequence
  SiRNA target sequence
atgccttaaacttttatttg

SEQ ID NO: 67161 - DNA, 20 bp, Artificial sequence
  SiRNA target sequence
tgccttaaacttttatttgc

SEQ ID NO: 67162 - DNA, 20 bp, Artificial sequence
  SiRNA target sequence
gccttaaacttttatttgcc

SEQ ID NO: 67163 - DNA, 20 bp, Artificial sequence
  SiRNA target sequence
ccttaaacttttatttgccc

SEQ ID NO: 67164 - DNA, 20 bp, Artificial sequence
  SiRNA target sequence
cttaaacttttatttgccct

SEQ ID NO: 67165 - DNA, 20 bp, Artificial sequence
  SiRNA target sequence
ttaaacttttatttgccctt

SEQ ID NO: 67166 - DNA, 20 bp, Artificial sequence
  SiRNA target sequence
taaacttttatttgccctta

SEQ ID NO: 67167 - DNA, 20 bp, Artificial sequence
  SiRNA target sequence
aaacttttatttgcccttat

SEQ ID NO: 67168 - DNA, 20 bp, Artificial sequence
  SiRNA target sequence
aacttttatttgcccttatt

SEQ ID NO: 67169 - DNA, 20 bp, Artificial sequence
  SiRNA target sequence
acttttatttgcccttattg

SEQ ID NO: 67170 - DNA, 20 bp, Artificial sequence
  SiRNA target sequence
cttttatttgcccttattgc

SEQ ID NO: 67171 - DNA, 20 bp, Artificial sequence
  SiRNA target sequence
ttttatttgcccttattgca

SEQ ID NO: 67172 - DNA, 20 bp, Artificial sequence
  SiRNA target sequence
tttatttgcccttattgcag

SEQ ID NO: 67173 - DNA, 20 bp, Artificial sequence
  SiRNA target sequence
ttatttgcccttattgcagt

SEQ ID NO: 67174 - DNA, 20 bp, Artificial sequence
  SiRNA target sequence
tatttgcccttattgcagtt

SEQ ID NO: 67175 - DNA, 20 bp, Artificial sequence
  SiRNA target sequence
atttgcccttattgcagtta

SEQ ID NO: 67176 - DNA, 20 bp, Artificial sequence
  SiRNA target sequence
tttgcccttattgcagttat

SEQ ID NO: 67177 - DNA, 20 bp, Artificial sequence
  SiRNA target sequence
ttgcccttattgcagttata

SEQ ID NO: 67178 - DNA, 20 bp, Artificial sequence
  SiRNA target sequence
tgcccttattgcagttataa

SEQ ID NO: 67179 - DNA, 20 bp, Artificial sequence
  SiRNA target sequence
gcccttattgcagttataaa

SEQ ID NO: 67180 - DNA, 20 bp, Artificial sequence
  SiRNA target sequence
cccttattgcagttataaaa

SEQ ID NO: 67181 - DNA, 20 bp, Artificial sequence
  SiRNA target sequence
ccttattgcagttataaaaa

SEQ ID NO: 67182 - DNA, 20 bp, Artificial sequence
  SiRNA target sequence
cttattgcagttataaaaaa

SEQ ID NO: 67183 - DNA, 20 bp, Artificial sequence
  SiRNA target sequence
ttattgcagttataaaaaat

SEQ ID NO: 67184 - DNA, 20 bp, Artificial sequence
  SiRNA target sequence
tattgcagttataaaaaata

SEQ ID NO: 67185 - DNA, 20 bp, Artificial sequence
  SiRNA target sequence
attgcagttataaaaaatat

SEQ ID NO: 67186 - DNA, 20 bp, Artificial sequence
  SiRNA target sequence
ttgcagttataaaaaatatg

SEQ ID NO: 67187 - DNA, 20 bp, Artificial sequence
  SiRNA target sequence
tgcagttataaaaaatatgg

SEQ ID NO: 67188 - DNA, 20 bp, Artificial sequence
  SiRNA target sequence
gcagttataaaaaatatggg

SEQ ID NO: 67189 - DNA, 20 bp, Artificial sequence
  SiRNA target sequence
cagttataaaaaatatggga

SEQ ID NO: 67190 - DNA, 20 bp, Artificial sequence
  SiRNA target sequence
agttataaaaaatatgggag

SEQ ID NO: 67191 - DNA, 20 bp, Artificial sequence
  SiRNA target sequence
gttataaaaaatatgggagg

SEQ ID NO: 67192 - DNA, 20 bp, Artificial sequence
  SiRNA target sequence
ttataaaaaatatgggaggt

SEQ ID NO: 67193 - DNA, 20 bp, Artificial sequence
  SiRNA target sequence
tataaaaaatatgggaggtc

SEQ ID NO: 67194 - DNA, 20 bp, Artificial sequence
  SiRNA target sequence
ataaaaaatatgggaggtct

SEQ ID NO: 67195 - DNA, 20 bp, Artificial sequence
  SiRNA target sequence
taaaaaatatgggaggtctt

SEQ ID NO: 67196 - DNA, 20 bp, Artificial sequence
  SiRNA target sequence
aaaaaatatgggaggtcttg

SEQ ID NO: 67197 - DNA, 20 bp, Artificial sequence
  SiRNA target sequence
aaaaatatgggaggtcttgc

SEQ ID NO: 67198 - DNA, 20 bp, Artificial sequence
  SiRNA target sequence
aaaatatgggaggtcttgcg

SEQ ID NO: 67199 - DNA, 20 bp, Artificial sequence
  SiRNA target sequence
aaatatgggaggtcttgcgg

SEQ ID NO: 67200 - DNA, 20 bp, Artificial sequence
  SiRNA target sequence
aatatgggaggtcttgcggg

SEQ ID NO: 67201 - DNA, 20 bp, Artificial sequence
  SiRNA target sequence
atatgggaggtcttgcgggc

SEQ ID NO: 67202 - DNA, 20 bp, Artificial sequence
  SiRNA target sequence
tatgggaggtcttgcgggct

SEQ ID NO: 67203 - DNA, 20 bp, Artificial sequence
  SiRNA target sequence
atgggaggtcttgcgggctt

SEQ ID NO: 67204 - DNA, 20 bp, Artificial sequence
  SiRNA target sequence
tgggaggtcttgcgggcttc

SEQ ID NO: 67205 - DNA, 20 bp, Artificial sequence
  SiRNA target sequence
gggaggtcttgcgggcttca

SEQ ID NO: 67206 - DNA, 20 bp, Artificial sequence
  SiRNA target sequence
ggaggtcttgcgggcttcat

SEQ ID NO: 67207 - DNA, 20 bp, Artificial sequence
  SiRNA target sequence
gaggtcttgcgggcttcata

SEQ ID NO: 67208 - DNA, 20 bp, Artificial sequence
  SiRNA target sequence
aggtcttgcgggcttcataa

SEQ ID NO: 67209 - DNA, 20 bp, Artificial sequence
  SiRNA target sequence
ggtcttgcgggcttcataat

SEQ ID NO: 67210 - DNA, 20 bp, Artificial sequence
  SiRNA target sequence
gtcttgcgggcttcataatg

SEQ ID NO: 67211 - DNA, 20 bp, Artificial sequence
  SiRNA target sequence
tcttgcgggcttcataatgt

SEQ ID NO: 67212 - DNA, 20 bp, Artificial sequence
  SiRNA target sequence
cttgcgggcttcataatgtt

SEQ ID NO: 67213 - DNA, 20 bp, Artificial sequence
  SiRNA target sequence
ttgcgggcttcataatgttt

SEQ ID NO: 67214 - DNA, 20 bp, Artificial sequence
  SiRNA target sequence
tgcgggcttcataatgtttg

SEQ ID NO: 67215 - DNA, 20 bp, Artificial sequence
  SiRNA target sequence
gcgggcttcataatgtttgt

SEQ ID NO: 67216 - DNA, 20 bp, Artificial sequence
  SiRNA target sequence
cgggcttcataatgtttgtt

SEQ ID NO: 67217 - DNA, 20 bp, Artificial sequence
  SiRNA target sequence
gggcttcataatgtttgttt

SEQ ID NO: 67218 - DNA, 20 bp, Artificial sequence
  SiRNA target sequence
ggcttcataatgtttgtttg

SEQ ID NO: 67219 - DNA, 20 bp, Artificial sequence
  SiRNA target sequence
gcttcataatgtttgtttgt

SEQ ID NO: 67220 - DNA, 20 bp, Artificial sequence
  SiRNA target sequence
cttcataatgtttgtttgtg

SEQ ID NO: 67221 - DNA, 20 bp, Artificial sequence
  SiRNA target sequence
ttcataatgtttgtttgtgt

SEQ ID NO: 67222 - DNA, 20 bp, Artificial sequence
  SiRNA target sequence
tcataatgtttgtttgtgtt

SEQ ID NO: 67223 - DNA, 20 bp, Artificial sequence
  SiRNA target sequence
cataatgtttgtttgtgttt

SEQ ID NO: 67224 - DNA, 20 bp, Artificial sequence
  SiRNA target sequence
ataatgtttgtttgtgtttc

SEQ ID NO: 67225 - DNA, 20 bp, Artificial sequence
  SiRNA target sequence
taatgtttgtttgtgtttct

SEQ ID NO: 67226 - DNA, 20 bp, Artificial sequence
  SiRNA target sequence
aatgtttgtttgtgtttctt

SEQ ID NO: 67227 - DNA, 20 bp, Artificial sequence
  SiRNA target sequence
atgtttgtttgtgtttcttg

SEQ ID NO: 67228 - DNA, 20 bp, Artificial sequence
  SiRNA target sequence
tgtttgtttgtgtttcttgc

SEQ ID NO: 67229 - DNA, 20 bp, Artificial sequence
  SiRNA target sequence
gtttgtttgtgtttcttgct

SEQ ID NO: 67230 - DNA, 20 bp, Artificial sequence
  SiRNA target sequence
tttgtttgtgtttcttgcta

SEQ ID NO: 67231 - DNA, 20 bp, Artificial sequence
  SiRNA target sequence
ttgtttgtgtttcttgctat

SEQ ID NO: 67232 - DNA, 20 bp, Artificial sequence
  SiRNA target sequence
tgtttgtgtttcttgctatg

SEQ ID NO: 67233 - DNA, 20 bp, Artificial sequence
  SiRNA target sequence
gtttgtgtttcttgctatgc

SEQ ID NO: 67234 - DNA, 20 bp, Artificial sequence
  SiRNA target sequence
tttgtgtttcttgctatgcg

SEQ ID NO: 67235 - DNA, 20 bp, Artificial sequence
  SiRNA target sequence
ttgtgtttcttgctatgcga

SEQ ID NO: 67236 - DNA, 20 bp, Artificial sequence
  SiRNA target sequence
tgtgtttcttgctatgcgac

SEQ ID NO: 67237 - DNA, 20 bp, Artificial sequence
  SiRNA target sequence
gtgtttcttgctatgcgact

SEQ ID NO: 67238 - DNA, 20 bp, Artificial sequence
  SiRNA target sequence
tgtttcttgctatgcgactg

SEQ ID NO: 67239 - DNA, 20 bp, Artificial sequence
  SiRNA target sequence
gtttcttgctatgcgactgt

SEQ ID NO: 67240 - DNA, 20 bp, Artificial sequence
  SiRNA target sequence
tttcttgctatgcgactgtg

SEQ ID NO: 67241 - DNA, 20 bp, Artificial sequence
  SiRNA target sequence
ttcttgctatgcgactgtga

SEQ ID NO: 67242 - DNA, 20 bp, Artificial sequence
  SiRNA target sequence
tcttgctatgcgactgtgac

SEQ ID NO: 67243 - DNA, 20 bp, Artificial sequence
  SiRNA target sequence
cttgctatgcgactgtgact

SEQ ID NO: 67244 - DNA, 20 bp, Artificial sequence
  SiRNA target sequence
ttgctatgcgactgtgacta

SEQ ID NO: 67245 - DNA, 20 bp, Artificial sequence
  SiRNA target sequence
tgctatgcgactgtgactat

SEQ ID NO: 67246 - DNA, 20 bp, Artificial sequence
  SiRNA target sequence
gctatgcgactgtgactata

SEQ ID NO: 67247 - DNA, 20 bp, Artificial sequence
  SiRNA target sequence
ctatgcgactgtgactatat

SEQ ID NO: 67248 - DNA, 20 bp, Artificial sequence
  SiRNA target sequence
tatgcgactgtgactatatt

SEQ ID NO: 67249 - DNA, 20 bp, Artificial sequence
  SiRNA target sequence
atgcgactgtgactatattg

SEQ ID NO: 67250 - DNA, 20 bp, Artificial sequence
  SiRNA target sequence
tgcgactgtgactatattga

SEQ ID NO: 67251 - DNA, 20 bp, Artificial sequence
  SiRNA target sequence
gcgactgtgactatattgat

SEQ ID NO: 67252 - DNA, 20 bp, Artificial sequence
  SiRNA target sequence
cgactgtgactatattgata

SEQ ID NO: 67253 - DNA, 20 bp, Artificial sequence
  SiRNA target sequence
gactgtgactatattgatag

SEQ ID NO: 67254 - DNA, 20 bp, Artificial sequence
  SiRNA target sequence
actgtgactatattgatagc

SEQ ID NO: 67255 - DNA, 20 bp, Artificial sequence
  SiRNA target sequence
ctgtgactatattgatagca

SEQ ID NO: 67256 - DNA, 20 bp, Artificial sequence
  SiRNA target sequence
tgtgactatattgatagcac

SEQ ID NO: 67257 - DNA, 20 bp, Artificial sequence
  SiRNA target sequence
gtgactatattgatagcaca

SEQ ID NO: 67258 - DNA, 20 bp, Artificial sequence
  SiRNA target sequence
tgactatattgatagcacaa

SEQ ID NO: 67259 - DNA, 20 bp, Artificial sequence
  SiRNA target sequence
gactatattgatagcacaat

SEQ ID NO: 67260 - DNA, 20 bp, Artificial sequence
  SiRNA target sequence
actatattgatagcacaatg

SEQ ID NO: 67261 - DNA, 20 bp, Artificial sequence
  SiRNA target sequence
ctatattgatagcacaatgg

SEQ ID NO: 67262 - DNA, 20 bp, Artificial sequence
  SiRNA target sequence
tatattgatagcacaatgga

SEQ ID NO: 67263 - DNA, 20 bp, Artificial sequence
  SiRNA target sequence
atattgatagcacaatggag

SEQ ID NO: 67264 - DNA, 20 bp, Artificial sequence
  SiRNA target sequence
tattgatagcacaatggaga

SEQ ID NO: 67265 - DNA, 20 bp, Artificial sequence
  SiRNA target sequence
attgatagcacaatggagat

SEQ ID NO: 67266 - DNA, 20 bp, Artificial sequence
  SiRNA target sequence
ttgatagcacaatggagatc

SEQ ID NO: 67267 - DNA, 20 bp, Artificial sequence
  SiRNA target sequence
tgatagcacaatggagatct

SEQ ID NO: 67268 - DNA, 20 bp, Artificial sequence
  SiRNA target sequence
gatagcacaatggagatcta

SEQ ID NO: 67269 - DNA, 20 bp, Artificial sequence
  SiRNA target sequence
atagcacaatggagatctaa

SEQ ID NO: 67270 - DNA, 20 bp, Artificial sequence
  SiRNA target sequence
tagcacaatggagatctaat

SEQ ID NO: 67271 - DNA, 20 bp, Artificial sequence
  SiRNA target sequence
agcacaatggagatctaata

SEQ ID NO: 67272 - DNA, 20 bp, Artificial sequence
  SiRNA target sequence
gcacaatggagatctaatat

SEQ ID NO: 67273 - DNA, 20 bp, Artificial sequence
  SiRNA target sequence
cacaatggagatctaatatt

SEQ ID NO: 67274 - DNA, 20 bp, Artificial sequence
  SiRNA target sequence
acaatggagatctaatatta

SEQ ID NO: 67275 - DNA, 20 bp, Artificial sequence
  SiRNA target sequence
caatggagatctaatattag

SEQ ID NO: 67276 - DNA, 20 bp, Artificial sequence
  SiRNA target sequence
aatggagatctaatattaga

SEQ ID NO: 67277 - DNA, 20 bp, Artificial sequence
  SiRNA target sequence
atggagatctaatattagaa

SEQ ID NO: 67278 - DNA, 20 bp, Artificial sequence
  SiRNA target sequence
tggagatctaatattagaag

SEQ ID NO: 67279 - DNA, 20 bp, Artificial sequence
  SiRNA target sequence
ggagatctaatattagaaga

SEQ ID NO: 67280 - DNA, 20 bp, Artificial sequence
  SiRNA target sequence
gagatctaatattagaagag

SEQ ID NO: 67281 - DNA, 20 bp, Artificial sequence
  SiRNA target sequence
agatctaatattagaagaga

SEQ ID NO: 67282 - DNA, 20 bp, Artificial sequence
  SiRNA target sequence
gatctaatattagaagagaa

SEQ ID NO: 67283 - DNA, 20 bp, Artificial sequence
  SiRNA target sequence
atctaatattagaagagaac

SEQ ID NO: 67284 - DNA, 20 bp, Artificial sequence
  SiRNA target sequence
tctaatattagaagagaact

SEQ ID NO: 67285 - DNA, 20 bp, Artificial sequence
  SiRNA target sequence
ctaatattagaagagaactt

SEQ ID NO: 67286 - DNA, 20 bp, Artificial sequence
  SiRNA target sequence
taatattagaagagaactta

SEQ ID NO: 67287 - DNA, 20 bp, Artificial sequence
  SiRNA target sequence
aatattagaagagaacttaa

SEQ ID NO: 67288 - DNA, 20 bp, Artificial sequence
  SiRNA target sequence
atattagaagagaacttaat

SEQ ID NO: 67289 - DNA, 20 bp, Artificial sequence
  SiRNA target sequence
tattagaagagaacttaata

SEQ ID NO: 67290 - DNA, 20 bp, Artificial sequence
  SiRNA target sequence
attagaagagaacttaataa

SEQ ID NO: 67291 - DNA, 20 bp, Artificial sequence
  SiRNA target sequence
ttagaagagaacttaataac

SEQ ID NO: 67292 - DNA, 20 bp, Artificial sequence
  SiRNA target sequence
tagaagagaacttaataact

SEQ ID NO: 67293 - DNA, 20 bp, Artificial sequence
  SiRNA target sequence
agaagagaacttaataactc

SEQ ID NO: 67294 - DNA, 20 bp, Artificial sequence
  SiRNA target sequence
gaagagaacttaataactct

SEQ ID NO: 67295 - DNA, 20 bp, Artificial sequence
  SiRNA target sequence
aagagaacttaataactctg

SEQ ID NO: 67296 - DNA, 20 bp, Artificial sequence
  SiRNA target sequence
agagaacttaataactctga

SEQ ID NO: 67297 - DNA, 20 bp, Artificial sequence
  SiRNA target sequence
gagaacttaataactctgaa

SEQ ID NO: 67298 - DNA, 20 bp, Artificial sequence
  SiRNA target sequence
agaacttaataactctgaaa

SEQ ID NO: 67299 - DNA, 20 bp, Artificial sequence
  SiRNA target sequence
gaacttaataactctgaaaa

SEQ ID NO: 67300 - DNA, 20 bp, Artificial sequence
  SiRNA target sequence
aacttaataactctgaaaat

SEQ ID NO: 67301 - DNA, 20 bp, Artificial sequence
  SiRNA target sequence
acttaataactctgaaaata

SEQ ID NO: 67302 - DNA, 20 bp, Artificial sequence
  SiRNA target sequence
cttaataactctgaaaatag

SEQ ID NO: 67303 - DNA, 20 bp, Artificial sequence
  SiRNA target sequence
ttaataactctgaaaataga

SEQ ID NO: 67304 - DNA, 20 bp, Artificial sequence
  SiRNA target sequence
taataactctgaaaatagat

SEQ ID NO: 67305 - DNA, 20 bp, Artificial sequence
  SiRNA target sequence
aataactctgaaaatagatc

SEQ ID NO: 67306 - DNA, 20 bp, Artificial sequence
  SiRNA target sequence
ataactctgaaaatagatct

SEQ ID NO: 67307 - DNA, 20 bp, Artificial sequence
  SiRNA target sequence
taactctgaaaatagatcta

SEQ ID NO: 67308 - DNA, 20 bp, Artificial sequence
  SiRNA target sequence
aactctgaaaatagatctag

SEQ ID NO: 67309 - DNA, 20 bp, Artificial sequence
  SiRNA target sequence
actctgaaaatagatctagt

SEQ ID NO: 67310 - DNA, 20 bp, Artificial sequence
  SiRNA target sequence
ctctgaaaatagatctagta

SEQ ID NO: 67311 - DNA, 20 bp, Artificial sequence
  SiRNA target sequence
tctgaaaatagatctagtaa

SEQ ID NO: 67312 - DNA, 20 bp, Artificial sequence
  SiRNA target sequence
ctgaaaatagatctagtaat

SEQ ID NO: 67313 - DNA, 20 bp, Artificial sequence
  SiRNA target sequence
tgaaaatagatctagtaata

SEQ ID NO: 67314 - DNA, 20 bp, Artificial sequence
  SiRNA target sequence
gaaaatagatctagtaataa

SEQ ID NO: 67315 - DNA, 20 bp, Artificial sequence
  SiRNA target sequence
aaaatagatctagtaataaa

SEQ ID NO: 67316 - DNA, 20 bp, Artificial sequence
  SiRNA target sequence
aaatagatctagtaataaac

SEQ ID NO: 67317 - DNA, 20 bp, Artificial sequence
  SiRNA target sequence
aatagatctagtaataaact

SEQ ID NO: 67318 - DNA, 20 bp, Artificial sequence
  SiRNA target sequence
atagatctagtaataaacta

SEQ ID NO: 67319 - DNA, 20 bp, Artificial sequence
  SiRNA target sequence
tagatctagtaataaactac

SEQ ID NO: 67320 - DNA, 20 bp, Artificial sequence
  SiRNA target sequence
agatctagtaataaactaca

SEQ ID NO: 67321 - DNA, 20 bp, Artificial sequence
  SiRNA target sequence
gatctagtaataaactacaa

SEQ ID NO: 67322 - DNA, 20 bp, Artificial sequence
  SiRNA target sequence
atctagtaataaactacaag

SEQ ID NO: 67323 - DNA, 20 bp, Artificial sequence
  SiRNA target sequence
tctagtaataaactacaaga

SEQ ID NO: 67324 - DNA, 20 bp, Artificial sequence
  SiRNA target sequence
ctagtaataaactacaagat

SEQ ID NO: 67325 - DNA, 20 bp, Artificial sequence
  SiRNA target sequence
tagtaataaactacaagatg

SEQ ID NO: 67326 - DNA, 20 bp, Artificial sequence
  SiRNA target sequence
agtaataaactacaagatgg

SEQ ID NO: 67327 - DNA, 20 bp, Artificial sequence
  SiRNA target sequence
gtaataaactacaagatgga

SEQ ID NO: 67328 - DNA, 20 bp, Artificial sequence
  SiRNA target sequence
taataaactacaagatggat

SEQ ID NO: 67329 - DNA, 20 bp, Artificial sequence
  SiRNA target sequence
aataaactacaagatggatt

SEQ ID NO: 67330 - DNA, 20 bp, Artificial sequence
  SiRNA target sequence
ataaactacaagatggatta

SEQ ID NO: 67331 - DNA, 20 bp, Artificial sequence
  SiRNA target sequence
taaactacaagatggattaa

SEQ ID NO: 67332 - DNA, 20 bp, Artificial sequence
  SiRNA target sequence
aaactacaagatggattaaa

SEQ ID NO: 67333 - DNA, 20 bp, Artificial sequence
  SiRNA target sequence
aactacaagatggattaaat

SEQ ID NO: 67334 - DNA, 20 bp, Artificial sequence
  SiRNA target sequence
actacaagatggattaaata

SEQ ID NO: 67335 - DNA, 20 bp, Artificial sequence
  SiRNA target sequence
ctacaagatggattaaataa

SEQ ID NO: 67336 - DNA, 20 bp, Artificial sequence
  SiRNA target sequence
tacaagatggattaaataat

SEQ ID NO: 67337 - DNA, 20 bp, Artificial sequence
  SiRNA target sequence
acaagatggattaaataatc

SEQ ID NO: 67338 - DNA, 20 bp, Artificial sequence
  SiRNA target sequence
caagatggattaaataatca

SEQ ID NO: 67339 - DNA, 20 bp, Artificial sequence
  SiRNA target sequence
aagatggattaaataatcat

SEQ ID NO: 67340 - DNA, 20 bp, Artificial sequence
  SiRNA target sequence
agatggattaaataatcatg

SEQ ID NO: 67341 - DNA, 20 bp, Artificial sequence
  SiRNA target sequence
gatggattaaataatcatga

SEQ ID NO: 67342 - DNA, 20 bp, Artificial sequence
  SiRNA target sequence
atggattaaataatcatgaa

SEQ ID NO: 67343 - DNA, 20 bp, Artificial sequence
  SiRNA target sequence
tggattaaataatcatgaaa

SEQ ID NO: 67344 - DNA, 20 bp, Artificial sequence
  SiRNA target sequence
ggattaaataatcatgaaac

SEQ ID NO: 67345 - DNA, 20 bp, Artificial sequence
  SiRNA target sequence
gattaaataatcatgaaaca

SEQ ID NO: 67346 - DNA, 20 bp, Artificial sequence
  SiRNA target sequence
attaaataatcatgaaacaa

SEQ ID NO: 67347 - DNA, 20 bp, Artificial sequence
  SiRNA target sequence
ttaaataatcatgaaacaat

SEQ ID NO: 67348 - DNA, 20 bp, Artificial sequence
  SiRNA target sequence
taaataatcatgaaacaatc

SEQ ID NO: 67349 - DNA, 20 bp, Artificial sequence
  SiRNA target sequence
aaataatcatgaaacaatcg

SEQ ID NO: 67350 - DNA, 20 bp, Artificial sequence
  SiRNA target sequence
aataatcatgaaacaatcgt

SEQ ID NO: 67351 - DNA, 20 bp, Artificial sequence
  SiRNA target sequence
ataatcatgaaacaatcgtc

SEQ ID NO: 67352 - DNA, 20 bp, Artificial sequence
  SiRNA target sequence
taatcatgaaacaatcgtct

SEQ ID NO: 67353 - DNA, 20 bp, Artificial sequence
  SiRNA target sequence
aatcatgaaacaatcgtctc

SEQ ID NO: 67354 - DNA, 20 bp, Artificial sequence
  SiRNA target sequence
atcatgaaacaatcgtctcc

SEQ ID NO: 67355 - DNA, 20 bp, Artificial sequence
  SiRNA target sequence
tcatgaaacaatcgtctcct

SEQ ID NO: 67356 - DNA, 20 bp, Artificial sequence
  SiRNA target sequence
catgaaacaatcgtctcctt

SEQ ID NO: 67357 - DNA, 20 bp, Artificial sequence
  SiRNA target sequence
atgaaacaatcgtctccttt

SEQ ID NO: 67358 - DNA, 20 bp, Artificial sequence
  SiRNA target sequence
tgaaacaatcgtctcctttg

SEQ ID NO: 67359 - DNA, 20 bp, Artificial sequence
  SiRNA target sequence
gaaacaatcgtctcctttgg

SEQ ID NO: 67360 - DNA, 20 bp, Artificial sequence
  SiRNA target sequence
aaacaatcgtctcctttggg

SEQ ID NO: 67361 - DNA, 20 bp, Artificial sequence
  SiRNA target sequence
aacaatcgtctcctttggga

SEQ ID NO: 67362 - DNA, 20 bp, Artificial sequence
  SiRNA target sequence
acaatcgtctcctttgggac

SEQ ID NO: 67363 - DNA, 20 bp, Artificial sequence
  SiRNA target sequence
caatcgtctcctttgggact

SEQ ID NO: 67364 - DNA, 20 bp, Artificial sequence
  SiRNA target sequence
aatcgtctcctttgggacta

SEQ ID NO: 67365 - DNA, 20 bp, Artificial sequence
  SiRNA target sequence
atcgtctcctttgggactac

SEQ ID NO: 67366 - DNA, 20 bp, Artificial sequence
  SiRNA target sequence
tcgtctcctttgggactaca

SEQ ID NO: 67367 - DNA, 20 bp, Artificial sequence
  SiRNA target sequence
cgtctcctttgggactacag

SEQ ID NO: 67368 - DNA, 20 bp, Artificial sequence
  SiRNA target sequence
gtctcctttgggactacaga

SEQ ID NO: 67369 - DNA, 20 bp, Artificial sequence
  SiRNA target sequence
tctcctttgggactacagat

SEQ ID NO: 67370 - DNA, 20 bp, Artificial sequence
  SiRNA target sequence
ctcctttgggactacagatc

SEQ ID NO: 67371 - DNA, 20 bp, Artificial sequence
  SiRNA target sequence
tcctttgggactacagatct

SEQ ID NO: 67372 - DNA, 20 bp, Artificial sequence
  SiRNA target sequence
cctttgggactacagatctt

SEQ ID NO: 67373 - DNA, 20 bp, Artificial sequence
  SiRNA target sequence
ctttgggactacagatcttg

SEQ ID NO: 67374 - DNA, 20 bp, Artificial sequence
  SiRNA target sequence
tttgggactacagatcttga

SEQ ID NO: 67375 - DNA, 20 bp, Artificial sequence
  SiRNA target sequence
ttgggactacagatcttgaa

SEQ ID NO: 67376 - DNA, 20 bp, Artificial sequence
  SiRNA target sequence
tgggactacagatcttgaag

SEQ ID NO: 67377 - DNA, 20 bp, Artificial sequence
  SiRNA target sequence
gggactacagatcttgaagt

SEQ ID NO: 67378 - DNA, 20 bp, Artificial sequence
  SiRNA target sequence
ggactacagatcttgaagta

SEQ ID NO: 67379 - DNA, 20 bp, Artificial sequence
  SiRNA target sequence
gactacagatcttgaagtag

SEQ ID NO: 67380 - DNA, 20 bp, Artificial sequence
  SiRNA target sequence
actacagatcttgaagtaga

SEQ ID NO: 67381 - DNA, 20 bp, Artificial sequence
  SiRNA target sequence
ctacagatcttgaagtagat

SEQ ID NO: 67382 - DNA, 20 bp, Artificial sequence
  SiRNA target sequence
tacagatcttgaagtagatg

SEQ ID NO: 67383 - DNA, 20 bp, Artificial sequence
  SiRNA target sequence
acagatcttgaagtagatga

SEQ ID NO: 67384 - DNA, 20 bp, Artificial sequence
  SiRNA target sequence
cagatcttgaagtagatgaa

SEQ ID NO: 67385 - DNA, 20 bp, Artificial sequence
  SiRNA target sequence
agatcttgaagtagatgaat

SEQ ID NO: 67386 - DNA, 20 bp, Artificial sequence
  SiRNA target sequence
gatcttgaagtagatgaata

SEQ ID NO: 67387 - DNA, 20 bp, Artificial sequence
  SiRNA target sequence
atcttgaagtagatgaatat

SEQ ID NO: 67388 - DNA, 20 bp, Artificial sequence
  SiRNA target sequence
tcttgaagtagatgaatatg

SEQ ID NO: 67389 - DNA, 20 bp, Artificial sequence
  SiRNA target sequence
cttgaagtagatgaatatga

SEQ ID NO: 67390 - DNA, 20 bp, Artificial sequence
  SiRNA target sequence
ttgaagtagatgaatatgat

SEQ ID NO: 67391 - DNA, 20 bp, Artificial sequence
  SiRNA target sequence
tgaagtagatgaatatgatc

SEQ ID NO: 67392 - DNA, 20 bp, Artificial sequence
  SiRNA target sequence
gaagtagatgaatatgatca

SEQ ID NO: 67393 - DNA, 20 bp, Artificial sequence
  SiRNA target sequence
aagtagatgaatatgatcag

SEQ ID NO: 67394 - DNA, 20 bp, Artificial sequence
  SiRNA target sequence
agtagatgaatatgatcagt

SEQ ID NO: 67395 - DNA, 20 bp, Artificial sequence
  SiRNA target sequence
gtagatgaatatgatcagtt

SEQ ID NO: 67396 - DNA, 20 bp, Artificial sequence
  SiRNA target sequence
tagatgaatatgatcagttt

SEQ ID NO: 67397 - DNA, 20 bp, Artificial sequence
  SiRNA target sequence
agatgaatatgatcagtttc

SEQ ID NO: 67398 - DNA, 20 bp, Artificial sequence
  SiRNA target sequence
gatgaatatgatcagtttct

SEQ ID NO: 67399 - DNA, 20 bp, Artificial sequence
  SiRNA target sequence
atgaatatgatcagtttctt

SEQ ID NO: 67400 - DNA, 20 bp, Artificial sequence
  SiRNA target sequence
tgaatatgatcagtttctta

SEQ ID NO: 67401 - DNA, 20 bp, Artificial sequence
  SiRNA target sequence
gaatatgatcagtttcttaa

SEQ ID NO: 67402 - DNA, 20 bp, Artificial sequence
  SiRNA target sequence
aatatgatcagtttcttaaa

SEQ ID NO: 67403 - DNA, 20 bp, Artificial sequence
  SiRNA target sequence
atatgatcagtttcttaaaa

SEQ ID NO: 67404 - DNA, 20 bp, Artificial sequence
  SiRNA target sequence
tatgatcagtttcttaaaat

SEQ ID NO: 67405 - DNA, 20 bp, Artificial sequence
  SiRNA target sequence
atgatcagtttcttaaaatt

SEQ ID NO: 67406 - DNA, 20 bp, Artificial sequence
  SiRNA target sequence
tgatcagtttcttaaaatta

SEQ ID NO: 67407 - DNA, 20 bp, Artificial sequence
  SiRNA target sequence
gatcagtttcttaaaattaa

SEQ ID NO: 67408 - DNA, 20 bp, Artificial sequence
  SiRNA target sequence
atcagtttcttaaaattaat

SEQ ID NO: 67409 - DNA, 20 bp, Artificial sequence
  SiRNA target sequence
tcagtttcttaaaattaatg

SEQ ID NO: 67410 - DNA, 20 bp, Artificial sequence
  SiRNA target sequence
cagtttcttaaaattaatgc

SEQ ID NO: 67411 - DNA, 20 bp, Artificial sequence
  SiRNA target sequence
agtttcttaaaattaatgca

SEQ ID NO: 67412 - DNA, 20 bp, Artificial sequence
  SiRNA target sequence
gtttcttaaaattaatgcat

SEQ ID NO: 67413 - DNA, 20 bp, Artificial sequence
  SiRNA target sequence
tttcttaaaattaatgcatc

SEQ ID NO: 67414 - DNA, 20 bp, Artificial sequence
  SiRNA target sequence
ttcttaaaattaatgcatct

SEQ ID NO: 67415 - DNA, 20 bp, Artificial sequence
  SiRNA target sequence
tcttaaaattaatgcatcta

SEQ ID NO: 67416 - DNA, 20 bp, Artificial sequence
  SiRNA target sequence
cttaaaattaatgcatctaa

SEQ ID NO: 67417 - DNA, 20 bp, Artificial sequence
  SiRNA target sequence
ttaaaattaatgcatctaat

SEQ ID NO: 67418 - DNA, 20 bp, Artificial sequence
  SiRNA target sequence
taaaattaatgcatctaata

SEQ ID NO: 67419 - DNA, 20 bp, Artificial sequence
  SiRNA target sequence
aaaattaatgcatctaatag

SEQ ID NO: 67420 - DNA, 20 bp, Artificial sequence
  SiRNA target sequence
aaattaatgcatctaatagt

SEQ ID NO: 67421 - DNA, 20 bp, Artificial sequence
  SiRNA target sequence
aattaatgcatctaatagta

SEQ ID NO: 67422 - DNA, 20 bp, Artificial sequence
  SiRNA target sequence
attaatgcatctaatagtaa

SEQ ID NO: 67423 - DNA, 20 bp, Artificial sequence
  SiRNA target sequence
ttaatgcatctaatagtaac

SEQ ID NO: 67424 - DNA, 20 bp, Artificial sequence
  SiRNA target sequence
taatgcatctaatagtaaca

SEQ ID NO: 67425 - DNA, 20 bp, Artificial sequence
  SiRNA target sequence
aatgcatctaatagtaacag

SEQ ID NO: 67426 - DNA, 20 bp, Artificial sequence
  SiRNA target sequence
atgcatctaatagtaacaga

SEQ ID NO: 67427 - DNA, 20 bp, Artificial sequence
  SiRNA target sequence
tgcatctaatagtaacagat

SEQ ID NO: 67428 - DNA, 20 bp, Artificial sequence
  SiRNA target sequence
gcatctaatagtaacagatt

SEQ ID NO: 67429 - DNA, 20 bp, Artificial sequence
  SiRNA target sequence
catctaatagtaacagatta

SEQ ID NO: 67430 - DNA, 20 bp, Artificial sequence
  SiRNA target sequence
atctaatagtaacagattat

SEQ ID NO: 67431 - DNA, 20 bp, Artificial sequence
  SiRNA target sequence
tctaatagtaacagattatg

SEQ ID NO: 67432 - DNA, 20 bp, Artificial sequence
  SiRNA target sequence
ctaatagtaacagattatgg

SEQ ID NO: 67433 - DNA, 20 bp, Artificial sequence
  SiRNA target sequence
taatagtaacagattatgga

SEQ ID NO: 67434 - DNA, 20 bp, Artificial sequence
  SiRNA target sequence
aatagtaacagattatggag

SEQ ID NO: 67435 - DNA, 20 bp, Artificial sequence
  SiRNA target sequence
atagtaacagattatggaga

SEQ ID NO: 67436 - DNA, 20 bp, Artificial sequence
  SiRNA target sequence
tagtaacagattatggagag

SEQ ID NO: 67437 - DNA, 20 bp, Artificial sequence
  SiRNA target sequence
agtaacagattatggagagc

SEQ ID NO: 67438 - DNA, 20 bp, Artificial sequence
  SiRNA target sequence
gtaacagattatggagagca

SEQ ID NO: 67439 - DNA, 20 bp, Artificial sequence
  SiRNA target sequence
taacagattatggagagcac

SEQ ID NO: 67440 - DNA, 20 bp, Artificial sequence
  SiRNA target sequence
aacagattatggagagcact

SEQ ID NO: 67441 - DNA, 20 bp, Artificial sequence
  SiRNA target sequence
acagattatggagagcactg

SEQ ID NO: 67442 - DNA, 20 bp, Artificial sequence
  SiRNA target sequence
cagattatggagagcactgt

SEQ ID NO: 67443 - DNA, 20 bp, Artificial sequence
  SiRNA target sequence
agattatggagagcactgta

SEQ ID NO: 67444 - DNA, 20 bp, Artificial sequence
  SiRNA target sequence
gattatggagagcactgtac

SEQ ID NO: 67445 - DNA, 20 bp, Artificial sequence
  SiRNA target sequence
attatggagagcactgtaca

SEQ ID NO: 67446 - DNA, 20 bp, Artificial sequence
  SiRNA target sequence
ttatggagagcactgtacat

SEQ ID NO: 67447 - DNA, 20 bp, Artificial sequence
  SiRNA target sequence
tatggagagcactgtacatt

SEQ ID NO: 67448 - DNA, 20 bp, Artificial sequence
  SiRNA target sequence
atggagagcactgtacattt

SEQ ID NO: 67449 - DNA, 20 bp, Artificial sequence
  SiRNA target sequence
tggagagcactgtacatttt

SEQ ID NO: 67450 - DNA, 20 bp, Artificial sequence
  SiRNA target sequence
ggagagcactgtacatttta

SEQ ID NO: 67451 - DNA, 20 bp, Artificial sequence
  SiRNA target sequence
gagagcactgtacattttaa

SEQ ID NO: 67452 - DNA, 20 bp, Artificial sequence
  SiRNA target sequence
agagcactgtacattttaaa

SEQ ID NO: 67453 - DNA, 20 bp, Artificial sequence
  SiRNA target sequence
gagcactgtacattttaaat

SEQ ID NO: 67454 - DNA, 20 bp, Artificial sequence
  SiRNA target sequence
agcactgtacattttaaatt

SEQ ID NO: 67455 - DNA, 20 bp, Artificial sequence
  SiRNA target sequence
gcactgtacattttaaattt

SEQ ID NO: 67456 - DNA, 20 bp, Artificial sequence
  SiRNA target sequence
cactgtacattttaaattta

SEQ ID NO: 67457 - DNA, 20 bp, Artificial sequence
  SiRNA target sequence
actgtacattttaaatttat

SEQ ID NO: 67458 - DNA, 20 bp, Artificial sequence
  SiRNA target sequence
ctgtacattttaaatttatc

SEQ ID NO: 67459 - DNA, 20 bp, Artificial sequence
  SiRNA target sequence
tgtacattttaaatttatct

SEQ ID NO: 67460 - DNA, 20 bp, Artificial sequence
  SiRNA target sequence
gtacattttaaatttatctc

SEQ ID NO: 67461 - DNA, 20 bp, Artificial sequence
  SiRNA target sequence
tacattttaaatttatctca

SEQ ID NO: 67462 - DNA, 20 bp, Artificial sequence
  SiRNA target sequence
acattttaaatttatctcag

SEQ ID NO: 67463 - DNA, 20 bp, Artificial sequence
  SiRNA target sequence
cattttaaatttatctcaga

SEQ ID NO: 67464 - DNA, 20 bp, Artificial sequence
  SiRNA target sequence
attttaaatttatctcagag

SEQ ID NO: 67465 - DNA, 20 bp, Artificial sequence
  SiRNA target sequence
ttttaaatttatctcagaga

SEQ ID NO: 67466 - DNA, 20 bp, Artificial sequence
  SiRNA target sequence
tttaaatttatctcagagag

SEQ ID NO: 67467 - DNA, 20 bp, Artificial sequence
  SiRNA target sequence
ttaaatttatctcagagagc

SEQ ID NO: 67468 - DNA, 20 bp, Artificial sequence
  SiRNA target sequence
taaatttatctcagagagca

SEQ ID NO: 67469 - DNA, 20 bp, Artificial sequence
  SiRNA target sequence
aaatttatctcagagagcaa

SEQ ID NO: 67470 - DNA, 20 bp, Artificial sequence
  SiRNA target sequence
aatttatctcagagagcaat

SEQ ID NO: 67471 - DNA, 20 bp, Artificial sequence
  SiRNA target sequence
atttatctcagagagcaatt

SEQ ID NO: 67472 - DNA, 20 bp, Artificial sequence
  SiRNA target sequence
tttatctcagagagcaattt

SEQ ID NO: 67473 - DNA, 20 bp, Artificial sequence
  SiRNA target sequence
ttatctcagagagcaatttt

SEQ ID NO: 67474 - DNA, 20 bp, Artificial sequence
  SiRNA target sequence
tatctcagagagcaattttt

SEQ ID NO: 67475 - DNA, 20 bp, Artificial sequence
  SiRNA target sequence
atctcagagagcaatttttc

SEQ ID NO: 67476 - DNA, 20 bp, Artificial sequence
  SiRNA target sequence
tctcagagagcaatttttct

SEQ ID NO: 67477 - DNA, 20 bp, Artificial sequence
  SiRNA target sequence
ctcagagagcaatttttctc

SEQ ID NO: 67478 - DNA, 20 bp, Artificial sequence
  SiRNA target sequence
tcagagagcaatttttctct

SEQ ID NO: 67479 - DNA, 20 bp, Artificial sequence
  SiRNA target sequence
cagagagcaatttttctctt

SEQ ID NO: 67480 - DNA, 20 bp, Artificial sequence
  SiRNA target sequence
agagagcaatttttctctta

SEQ ID NO: 67481 - DNA, 20 bp, Artificial sequence
  SiRNA target sequence
gagagcaatttttctcttac

SEQ ID NO: 67482 - DNA, 20 bp, Artificial sequence
  SiRNA target sequence
agagcaatttttctcttaca

SEQ ID NO: 67483 - DNA, 20 bp, Artificial sequence
  SiRNA target sequence
gagcaatttttctcttacaa

SEQ ID NO: 67484 - DNA, 20 bp, Artificial sequence
  SiRNA target sequence
agcaatttttctcttacaaa

SEQ ID NO: 67485 - DNA, 20 bp, Artificial sequence
  SiRNA target sequence
gcaatttttctcttacaaag

SEQ ID NO: 67486 - DNA, 20 bp, Artificial sequence
  SiRNA target sequence
caatttttctcttacaaagt

SEQ ID NO: 67487 - DNA, 20 bp, Artificial sequence
  SiRNA target sequence
aatttttctcttacaaagtt

SEQ ID NO: 67488 - DNA, 20 bp, Artificial sequence
  SiRNA target sequence
atttttctcttacaaagttt

SEQ ID NO: 67489 - DNA, 20 bp, Artificial sequence
  SiRNA target sequence
tttttctcttacaaagtttt

SEQ ID NO: 67490 - DNA, 20 bp, Artificial sequence
  SiRNA target sequence
ttttctcttacaaagttttt

SEQ ID NO: 67491 - DNA, 20 bp, Artificial sequence
  SiRNA target sequence
tttctcttacaaagtttttt

SEQ ID NO: 67492 - DNA, 20 bp, Artificial sequence
  SiRNA target sequence
ttctcttacaaagttttttt

SEQ ID NO: 67493 - DNA, 20 bp, Artificial sequence
  SiRNA target sequence
tctcttacaaagttttttta

SEQ ID NO: 67494 - DNA, 20 bp, Artificial sequence
  SiRNA target sequence
ctcttacaaagtttttttat

SEQ ID NO: 67495 - DNA, 20 bp, Artificial sequence
  SiRNA target sequence
tcttacaaagtttttttatt

SEQ ID NO: 67496 - DNA, 20 bp, Artificial sequence
  SiRNA target sequence
cttacaaagtttttttatta

SEQ ID NO: 67497 - DNA, 20 bp, Artificial sequence
  SiRNA target sequence
ttacaaagtttttttattat

SEQ ID NO: 67498 - DNA, 20 bp, Artificial sequence
  SiRNA target sequence
tacaaagtttttttattatt

SEQ ID NO: 67499 - DNA, 20 bp, Artificial sequence
  SiRNA target sequence
acaaagtttttttattattt

SEQ ID NO: 67500 - DNA, 20 bp, Artificial sequence
  SiRNA target sequence
caaagtttttttattattta

SEQ ID NO: 67501 - DNA, 20 bp, Artificial sequence
  SiRNA target sequence
aaagtttttttattatttat

SEQ ID NO: 67502 - DNA, 20 bp, Artificial sequence
  SiRNA target sequence
aagtttttttattatttatg

SEQ ID NO: 67503 - DNA, 20 bp, Artificial sequence
  SiRNA target sequence
agtttttttattatttatgc

SEQ ID NO: 67504 - DNA, 20 bp, Artificial sequence
  SiRNA target sequence
gtttttttattatttatgca

SEQ ID NO: 67505 - DNA, 20 bp, Artificial sequence
  SiRNA target sequence
tttttttattatttatgcag

SEQ ID NO: 67506 - DNA, 20 bp, Artificial sequence
  SiRNA target sequence
ttttttattatttatgcagg

SEQ ID NO: 67507 - DNA, 20 bp, Artificial sequence
  SiRNA target sequence
tttttattatttatgcagga

SEQ ID NO: 67508 - DNA, 20 bp, Artificial sequence
  SiRNA target sequence
ttttattatttatgcaggaa

SEQ ID NO: 67509 - DNA, 20 bp, Artificial sequence
  SiRNA target sequence
tttattatttatgcaggaat

SEQ ID NO: 67510 - DNA, 20 bp, Artificial sequence
  SiRNA target sequence
ttattatttatgcaggaata

SEQ ID NO: 67511 - DNA, 20 bp, Artificial sequence
  SiRNA target sequence
tattatttatgcaggaatat

SEQ ID NO: 67512 - DNA, 20 bp, Artificial sequence
  SiRNA target sequence
attatttatgcaggaatatc

SEQ ID NO: 67513 - DNA, 20 bp, Artificial sequence
  SiRNA target sequence
ttatttatgcaggaatatca

SEQ ID NO: 67514 - DNA, 20 bp, Artificial sequence
  SiRNA target sequence
tatttatgcaggaatatcag

SEQ ID NO: 67515 - DNA, 20 bp, Artificial sequence
  SiRNA target sequence
atttatgcaggaatatcagg

SEQ ID NO: 67516 - DNA, 20 bp, Artificial sequence
  SiRNA target sequence
tttatgcaggaatatcagga

SEQ ID NO: 67517 - DNA, 20 bp, Artificial sequence
  SiRNA target sequence
ttatgcaggaatatcaggaa

SEQ ID NO: 67518 - DNA, 20 bp, Artificial sequence
  SiRNA target sequence
tatgcaggaatatcaggaat

SEQ ID NO: 67519 - DNA, 20 bp, Artificial sequence
  SiRNA target sequence
atgcaggaatatcaggaata

SEQ ID NO: 67520 - DNA, 20 bp, Artificial sequence
  SiRNA target sequence
tgcaggaatatcaggaatat

SEQ ID NO: 67521 - DNA, 20 bp, Artificial sequence
  SiRNA target sequence
gcaggaatatcaggaatatt

SEQ ID NO: 67522 - DNA, 20 bp, Artificial sequence
  SiRNA target sequence
caggaatatcaggaatatta

SEQ ID NO: 67523 - DNA, 20 bp, Artificial sequence
  SiRNA target sequence
aggaatatcaggaatattat

SEQ ID NO: 67524 - DNA, 20 bp, Artificial sequence
  SiRNA target sequence
ggaatatcaggaatattatc

SEQ ID NO: 67525 - DNA, 20 bp, Artificial sequence
  SiRNA target sequence
gaatatcaggaatattatct

SEQ ID NO: 67526 - DNA, 20 bp, Artificial sequence
  SiRNA target sequence
aatatcaggaatattatctc

SEQ ID NO: 67527 - DNA, 20 bp, Artificial sequence
  SiRNA target sequence
atatcaggaatattatctca

SEQ ID NO: 67528 - DNA, 20 bp, Artificial sequence
  SiRNA target sequence
tatcaggaatattatctcaa

SEQ ID NO: 67529 - DNA, 20 bp, Artificial sequence
  SiRNA target sequence
atcaggaatattatctcaaa

SEQ ID NO: 67530 - DNA, 20 bp, Artificial sequence
  SiRNA target sequence
tcaggaatattatctcaaaa

SEQ ID NO: 67531 - DNA, 20 bp, Artificial sequence
  SiRNA target sequence
caggaatattatctcaaaat

SEQ ID NO: 67532 - DNA, 20 bp, Artificial sequence
  SiRNA target sequence
aggaatattatctcaaaata

SEQ ID NO: 67533 - DNA, 20 bp, Artificial sequence
  SiRNA target sequence
ggaatattatctcaaaatat

SEQ ID NO: 67534 - DNA, 20 bp, Artificial sequence
  SiRNA target sequence
gaatattatctcaaaatatg

SEQ ID NO: 67535 - DNA, 20 bp, Artificial sequence
  SiRNA target sequence
aatattatctcaaaatatgt

SEQ ID NO: 67536 - DNA, 20 bp, Artificial sequence
  SiRNA target sequence
atattatctcaaaatatgtc

SEQ ID NO: 67537 - DNA, 20 bp, Artificial sequence
  SiRNA target sequence
tattatctcaaaatatgtca

SEQ ID NO: 67538 - DNA, 20 bp, Artificial sequence
  SiRNA target sequence
attatctcaaaatatgtcat

SEQ ID NO: 67539 - DNA, 20 bp, Artificial sequence
  SiRNA target sequence
ttatctcaaaatatgtcatc

SEQ ID NO: 67540 - DNA, 20 bp, Artificial sequence
  SiRNA target sequence
tatctcaaaatatgtcatct

SEQ ID NO: 67541 - DNA, 20 bp, Artificial sequence
  SiRNA target sequence
atctcaaaatatgtcatcta

SEQ ID NO: 67542 - DNA, 20 bp, Artificial sequence
  SiRNA target sequence
tctcaaaatatgtcatctaa

SEQ ID NO: 67543 - DNA, 20 bp, Artificial sequence
  SiRNA target sequence
ctcaaaatatgtcatctaac

SEQ ID NO: 67544 - DNA, 20 bp, Artificial sequence
  SiRNA target sequence
tcaaaatatgtcatctaacc

SEQ ID NO: 67545 - DNA, 20 bp, Artificial sequence
  SiRNA target sequence
caaaatatgtcatctaacca

SEQ ID NO: 67546 - DNA, 20 bp, Artificial sequence
  SiRNA target sequence
aaaatatgtcatctaaccaa

SEQ ID NO: 67547 - DNA, 20 bp, Artificial sequence
  SiRNA target sequence
aaatatgtcatctaaccaac

SEQ ID NO: 67548 - DNA, 20 bp, Artificial sequence
  SiRNA target sequence
aatatgtcatctaaccaact

SEQ ID NO: 67549 - DNA, 20 bp, Artificial sequence
  SiRNA target sequence
atatgtcatctaaccaactc

SEQ ID NO: 67550 - DNA, 20 bp, Artificial sequence
  SiRNA target sequence
tatgtcatctaaccaactca

SEQ ID NO: 67551 - DNA, 20 bp, Artificial sequence
  SiRNA target sequence
atgtcatctaaccaactcat

SEQ ID NO: 67552 - DNA, 20 bp, Artificial sequence
  SiRNA target sequence
tgtcatctaaccaactcatt

SEQ ID NO: 67553 - DNA, 20 bp, Artificial sequence
  SiRNA target sequence
gtcatctaaccaactcattt

SEQ ID NO: 67554 - DNA, 20 bp, Artificial sequence
  SiRNA target sequence
tcatctaaccaactcattta

SEQ ID NO: 67555 - DNA, 20 bp, Artificial sequence
  SiRNA target sequence
catctaaccaactcatttat

SEQ ID NO: 67556 - DNA, 20 bp, Artificial sequence
  SiRNA target sequence
atctaaccaactcatttatt

SEQ ID NO: 67557 - DNA, 20 bp, Artificial sequence
  SiRNA target sequence
tctaaccaactcatttattt

SEQ ID NO: 67558 - DNA, 20 bp, Artificial sequence
  SiRNA target sequence
ctaaccaactcatttattta

SEQ ID NO: 67559 - DNA, 20 bp, Artificial sequence
  SiRNA target sequence
taaccaactcatttatttaa

SEQ ID NO: 67560 - DNA, 20 bp, Artificial sequence
  SiRNA target sequence
aaccaactcatttatttaat

SEQ ID NO: 67561 - DNA, 20 bp, Artificial sequence
  SiRNA target sequence
accaactcatttatttaatg

SEQ ID NO: 67562 - DNA, 20 bp, Artificial sequence
  SiRNA target sequence
ccaactcatttatttaatgt

SEQ ID NO: 67563 - DNA, 20 bp, Artificial sequence
  SiRNA target sequence
caactcatttatttaatgtc

SEQ ID NO: 67564 - DNA, 20 bp, Artificial sequence
  SiRNA target sequence
aactcatttatttaatgtcc

SEQ ID NO: 67565 - DNA, 20 bp, Artificial sequence
  SiRNA target sequence
actcatttatttaatgtcca

SEQ ID NO: 67566 - DNA, 20 bp, Artificial sequence
  SiRNA target sequence
ctcatttatttaatgtccat

SEQ ID NO: 67567 - DNA, 20 bp, Artificial sequence
  SiRNA target sequence
tcatttatttaatgtccatt

SEQ ID NO: 67568 - DNA, 20 bp, Artificial sequence
  SiRNA target sequence
catttatttaatgtccatta

SEQ ID NO: 67569 - DNA, 20 bp, Artificial sequence
  SiRNA target sequence
atttatttaatgtccattac

SEQ ID NO: 67570 - DNA, 20 bp, Artificial sequence
  SiRNA target sequence
tttatttaatgtccattaca

SEQ ID NO: 67571 - DNA, 20 bp, Artificial sequence
  SiRNA target sequence
ttatttaatgtccattacat

SEQ ID NO: 67572 - DNA, 20 bp, Artificial sequence
  SiRNA target sequence
tatttaatgtccattacatc

SEQ ID NO: 67573 - DNA, 20 bp, Artificial sequence
  SiRNA target sequence
atttaatgtccattacatct

SEQ ID NO: 67574 - DNA, 20 bp, Artificial sequence
  SiRNA target sequence
tttaatgtccattacatcta

SEQ ID NO: 67575 - DNA, 20 bp, Artificial sequence
  SiRNA target sequence
ttaatgtccattacatctac

SEQ ID NO: 67576 - DNA, 20 bp, Artificial sequence
  SiRNA target sequence
taatgtccattacatctacg

SEQ ID NO: 67577 - DNA, 20 bp, Artificial sequence
  SiRNA target sequence
aatgtccattacatctacgg

SEQ ID NO: 67578 - DNA, 20 bp, Artificial sequence
  SiRNA target sequence
atgtccattacatctacggt

SEQ ID NO: 67579 - DNA, 20 bp, Artificial sequence
  SiRNA target sequence
tgtccattacatctacggtt

SEQ ID NO: 67580 - DNA, 20 bp, Artificial sequence
  SiRNA target sequence
gtccattacatctacggtta

SEQ ID NO: 67581 - DNA, 20 bp, Artificial sequence
  SiRNA target sequence
tccattacatctacggttac

SEQ ID NO: 67582 - DNA, 20 bp, Artificial sequence
  SiRNA target sequence
ccattacatctacggttact

SEQ ID NO: 67583 - DNA, 20 bp, Artificial sequence
  SiRNA target sequence
cattacatctacggttacta

SEQ ID NO: 67584 - DNA, 20 bp, Artificial sequence
  SiRNA target sequence
attacatctacggttactat

SEQ ID NO: 67585 - DNA, 20 bp, Artificial sequence
  SiRNA target sequence
ttacatctacggttactatt

SEQ ID NO: 67586 - DNA, 20 bp, Artificial sequence
  SiRNA target sequence
tacatctacggttactatta

SEQ ID NO: 67587 - DNA, 20 bp, Artificial sequence
  SiRNA target sequence
acatctacggttactattaa

SEQ ID NO: 67588 - DNA, 20 bp, Artificial sequence
  SiRNA target sequence
catctacggttactattaat

SEQ ID NO: 67589 - DNA, 20 bp, Artificial sequence
  SiRNA target sequence
atctacggttactattaatt

SEQ ID NO: 67590 - DNA, 20 bp, Artificial sequence
  SiRNA target sequence
tctacggttactattaattt

SEQ ID NO: 67591 - DNA, 20 bp, Artificial sequence
  SiRNA target sequence
ctacggttactattaattta

SEQ ID NO: 67592 - DNA, 20 bp, Artificial sequence
  SiRNA target sequence
tacggttactattaatttaa

SEQ ID NO: 67593 - DNA, 20 bp, Artificial sequence
  SiRNA target sequence
acggttactattaatttaag

SEQ ID NO: 67594 - DNA, 20 bp, Artificial sequence
  SiRNA target sequence
cggttactattaatttaagt

SEQ ID NO: 67595 - DNA, 20 bp, Artificial sequence
  SiRNA target sequence
ggttactattaatttaagta

SEQ ID NO: 67596 - DNA, 20 bp, Artificial sequence
  SiRNA target sequence
gttactattaatttaagtaa

SEQ ID NO: 67597 - DNA, 20 bp, Artificial sequence
  SiRNA target sequence
ttactattaatttaagtaac

SEQ ID NO: 67598 - DNA, 20 bp, Artificial sequence
  SiRNA target sequence
tactattaatttaagtaact

SEQ ID NO: 67599 - DNA, 20 bp, Artificial sequence
  SiRNA target sequence
actattaatttaagtaactt

SEQ ID NO: 67600 - DNA, 20 bp, Artificial sequence
  SiRNA target sequence
ctattaatttaagtaacttg

SEQ ID NO: 67601 - DNA, 20 bp, Artificial sequence
  SiRNA target sequence
tattaatttaagtaacttgg

SEQ ID NO: 67602 - DNA, 20 bp, Artificial sequence
  SiRNA target sequence
attaatttaagtaacttggg

SEQ ID NO: 67603 - DNA, 20 bp, Artificial sequence
  SiRNA target sequence
ttaatttaagtaacttgggt

SEQ ID NO: 67604 - DNA, 20 bp, Artificial sequence
  SiRNA target sequence
taatttaagtaacttgggtt

SEQ ID NO: 67605 - DNA, 20 bp, Artificial sequence
  SiRNA target sequence
aatttaagtaacttgggtta

SEQ ID NO: 67606 - DNA, 20 bp, Artificial sequence
  SiRNA target sequence
atttaagtaacttgggttac

SEQ ID NO: 67607 - DNA, 20 bp, Artificial sequence
  SiRNA target sequence
tttaagtaacttgggttact

SEQ ID NO: 67608 - DNA, 20 bp, Artificial sequence
  SiRNA target sequence
ttaagtaacttgggttactt

SEQ ID NO: 67609 - DNA, 20 bp, Artificial sequence
  SiRNA target sequence
taagtaacttgggttactta

SEQ ID NO: 67610 - DNA, 20 bp, Artificial sequence
  SiRNA target sequence
aagtaacttgggttacttat

SEQ ID NO: 67611 - DNA, 20 bp, Artificial sequence
  SiRNA target sequence
agtaacttgggttacttata

SEQ ID NO: 67612 - DNA, 20 bp, Artificial sequence
  SiRNA target sequence
gtaacttgggttacttatac

SEQ ID NO: 67613 - DNA, 20 bp, Artificial sequence
  SiRNA target sequence
taacttgggttacttataca

SEQ ID NO: 67614 - DNA, 20 bp, Artificial sequence
  SiRNA target sequence
aacttgggttacttatacac

SEQ ID NO: 67615 - DNA, 20 bp, Artificial sequence
  SiRNA target sequence
acttgggttacttatacact

SEQ ID NO: 67616 - DNA, 20 bp, Artificial sequence
  SiRNA target sequence
cttgggttacttatacacta

SEQ ID NO: 67617 - DNA, 20 bp, Artificial sequence
  SiRNA target sequence
ttgggttacttatacactag

SEQ ID NO: 67618 - DNA, 20 bp, Artificial sequence
  SiRNA target sequence
tgggttacttatacactaga

SEQ ID NO: 67619 - DNA, 20 bp, Artificial sequence
  SiRNA target sequence
gggttacttatacactagat

SEQ ID NO: 67620 - DNA, 20 bp, Artificial sequence
  SiRNA target sequence
ggttacttatacactagata

SEQ ID NO: 67621 - DNA, 20 bp, Artificial sequence
  SiRNA target sequence
gttacttatacactagatat

SEQ ID NO: 67622 - DNA, 20 bp, Artificial sequence
  SiRNA target sequence
ttacttatacactagatata

SEQ ID NO: 67623 - DNA, 20 bp, Artificial sequence
  SiRNA target sequence
tacttatacactagatatac

SEQ ID NO: 67624 - DNA, 20 bp, Artificial sequence
  SiRNA target sequence
acttatacactagatataca

SEQ ID NO: 67625 - DNA, 20 bp, Artificial sequence
  SiRNA target sequence
cttatacactagatatacac

SEQ ID NO: 67626 - DNA, 20 bp, Artificial sequence
  SiRNA target sequence
ttatacactagatatacaca

SEQ ID NO: 67627 - DNA, 20 bp, Artificial sequence
  SiRNA target sequence
tatacactagatatacacaa

SEQ ID NO: 67628 - DNA, 20 bp, Artificial sequence
  SiRNA target sequence
atacactagatatacacaag

SEQ ID NO: 67629 - DNA, 20 bp, Artificial sequence
  SiRNA target sequence
tacactagatatacacaagc

SEQ ID NO: 67630 - DNA, 20 bp, Artificial sequence
  SiRNA target sequence
acactagatatacacaagca

SEQ ID NO: 67631 - DNA, 20 bp, Artificial sequence
  SiRNA target sequence
cactagatatacacaagcaa

SEQ ID NO: 67632 - DNA, 20 bp, Artificial sequence
  SiRNA target sequence
actagatatacacaagcaat

SEQ ID NO: 67633 - DNA, 20 bp, Artificial sequence
  SiRNA target sequence
ctagatatacacaagcaata

SEQ ID NO: 67634 - DNA, 20 bp, Artificial sequence
  SiRNA target sequence
tagatatacacaagcaataa

SEQ ID NO: 67635 - DNA, 20 bp, Artificial sequence
  SiRNA target sequence
agatatacacaagcaataat

SEQ ID NO: 67636 - DNA, 20 bp, Artificial sequence
  SiRNA target sequence
gatatacacaagcaataatt

SEQ ID NO: 67637 - DNA, 20 bp, Artificial sequence
  SiRNA target sequence
atatacacaagcaataatta

SEQ ID NO: 67638 - DNA, 20 bp, Artificial sequence
  SiRNA target sequence
tatacacaagcaataattaa

SEQ ID NO: 67639 - DNA, 20 bp, Artificial sequence
  SiRNA target sequence
atacacaagcaataattaat

SEQ ID NO: 67640 - DNA, 20 bp, Artificial sequence
  SiRNA target sequence
tacacaagcaataattaatg

SEQ ID NO: 67641 - DNA, 20 bp, Artificial sequence
  SiRNA target sequence
acacaagcaataattaatgc

SEQ ID NO: 67642 - DNA, 20 bp, Artificial sequence
  SiRNA target sequence
cacaagcaataattaatgca

SEQ ID NO: 67643 - DNA, 20 bp, Artificial sequence
  SiRNA target sequence
acaagcaataattaatgcaa

SEQ ID NO: 67644 - DNA, 20 bp, Artificial sequence
  SiRNA target sequence
caagcaataattaatgcaag

SEQ ID NO: 67645 - DNA, 20 bp, Artificial sequence
  SiRNA target sequence
aagcaataattaatgcaaga

SEQ ID NO: 67646 - DNA, 20 bp, Artificial sequence
  SiRNA target sequence
agcaataattaatgcaagat

SEQ ID NO: 67647 - DNA, 20 bp, Artificial sequence
  SiRNA target sequence
gcaataattaatgcaagatc

SEQ ID NO: 67648 - DNA, 20 bp, Artificial sequence
  SiRNA target sequence
caataattaatgcaagatct

SEQ ID NO: 67649 - DNA, 20 bp, Artificial sequence
  SiRNA target sequence
aataattaatgcaagatcta

SEQ ID NO: 67650 - DNA, 20 bp, Artificial sequence
  SiRNA target sequence
ataattaatgcaagatctac

SEQ ID NO: 67651 - DNA, 20 bp, Artificial sequence
  SiRNA target sequence
taattaatgcaagatctact

SEQ ID NO: 67652 - DNA, 20 bp, Artificial sequence
  SiRNA target sequence
aattaatgcaagatctactt

SEQ ID NO: 67653 - DNA, 20 bp, Artificial sequence
  SiRNA target sequence
attaatgcaagatctactta

SEQ ID NO: 67654 - DNA, 20 bp, Artificial sequence
  SiRNA target sequence
ttaatgcaagatctacttat

SEQ ID NO: 67655 - DNA, 20 bp, Artificial sequence
  SiRNA target sequence
taatgcaagatctacttatg

SEQ ID NO: 67656 - DNA, 20 bp, Artificial sequence
  SiRNA target sequence
aatgcaagatctacttatga

SEQ ID NO: 67657 - DNA, 20 bp, Artificial sequence
  SiRNA target sequence
atgcaagatctacttatgat

SEQ ID NO: 67658 - DNA, 20 bp, Artificial sequence
  SiRNA target sequence
tgcaagatctacttatgata

SEQ ID NO: 67659 - DNA, 20 bp, Artificial sequence
  SiRNA target sequence
gcaagatctacttatgatac

SEQ ID NO: 67660 - DNA, 20 bp, Artificial sequence
  SiRNA target sequence
caagatctacttatgataca

SEQ ID NO: 67661 - DNA, 20 bp, Artificial sequence
  SiRNA target sequence
aagatctacttatgatacaa

SEQ ID NO: 67662 - DNA, 20 bp, Artificial sequence
  SiRNA target sequence
agatctacttatgatacaat

SEQ ID NO: 67663 - DNA, 20 bp, Artificial sequence
  SiRNA target sequence
gatctacttatgatacaatg

SEQ ID NO: 67664 - DNA, 20 bp, Artificial sequence
  SiRNA target sequence
atctacttatgatacaatgt

SEQ ID NO: 67665 - DNA, 20 bp, Artificial sequence
  SiRNA target sequence
tctacttatgatacaatgtt

SEQ ID NO: 67666 - DNA, 20 bp, Artificial sequence
  SiRNA target sequence
ctacttatgatacaatgtta

SEQ ID NO: 67667 - DNA, 20 bp, Artificial sequence
  SiRNA target sequence
tacttatgatacaatgttag

SEQ ID NO: 67668 - DNA, 20 bp, Artificial sequence
  SiRNA target sequence
acttatgatacaatgttaga

SEQ ID NO: 67669 - DNA, 20 bp, Artificial sequence
  SiRNA target sequence
cttatgatacaatgttagat

SEQ ID NO: 67670 - DNA, 20 bp, Artificial sequence
  SiRNA target sequence
ttatgatacaatgttagata

SEQ ID NO: 67671 - DNA, 20 bp, Artificial sequence
  SiRNA target sequence
tatgatacaatgttagatat

SEQ ID NO: 67672 - DNA, 20 bp, Artificial sequence
  SiRNA target sequence
atgatacaatgttagatata

SEQ ID NO: 67673 - DNA, 20 bp, Artificial sequence
  SiRNA target sequence
tgatacaatgttagatataa

SEQ ID NO: 67674 - DNA, 20 bp, Artificial sequence
  SiRNA target sequence
gatacaatgttagatataaa

SEQ ID NO: 67675 - DNA, 20 bp, Artificial sequence
  SiRNA target sequence
atacaatgttagatataaaa

SEQ ID NO: 67676 - DNA, 20 bp, Artificial sequence
  SiRNA target sequence
tacaatgttagatataaaaa

SEQ ID NO: 67677 - DNA, 20 bp, Artificial sequence
  SiRNA target sequence
acaatgttagatataaaaaa

SEQ ID NO: 67678 - DNA, 20 bp, Artificial sequence
  SiRNA target sequence
caatgttagatataaaaaaa

SEQ ID NO: 67679 - DNA, 20 bp, Artificial sequence
  SiRNA target sequence
aatgttagatataaaaaaag

SEQ ID NO: 67680 - DNA, 20 bp, Artificial sequence
  SiRNA target sequence
atgttagatataaaaaaaga

SEQ ID NO: 67681 - DNA, 20 bp, Artificial sequence
  SiRNA target sequence
tgttagatataaaaaaagag

SEQ ID NO: 67682 - DNA, 20 bp, Artificial sequence
  SiRNA target sequence
gttagatataaaaaaagaga

SEQ ID NO: 67683 - DNA, 20 bp, Artificial sequence
  SiRNA target sequence
ttagatataaaaaaagagaa

SEQ ID NO: 67684 - DNA, 20 bp, Artificial sequence
  SiRNA target sequence
tagatataaaaaaagagaat

SEQ ID NO: 67685 - DNA, 20 bp, Artificial sequence
  SiRNA target sequence
agatataaaaaaagagaata

SEQ ID NO: 67686 - DNA, 20 bp, Artificial sequence
  SiRNA target sequence
gatataaaaaaagagaataa

SEQ ID NO: 67687 - DNA, 20 bp, Artificial sequence
  SiRNA target sequence
atataaaaaaagagaataat

SEQ ID NO: 67688 - DNA, 20 bp, Artificial sequence
  SiRNA target sequence
tataaaaaaagagaataata

SEQ ID NO: 67689 - DNA, 20 bp, Artificial sequence
  SiRNA target sequence
ataaaaaaagagaataataa

SEQ ID NO: 67690 - DNA, 20 bp, Artificial sequence
  SiRNA target sequence
taaaaaaagagaataataag

SEQ ID NO: 67691 - DNA, 20 bp, Artificial sequence
  SiRNA target sequence
aaaaaaagagaataataagt

SEQ ID NO: 67692 - DNA, 20 bp, Artificial sequence
  SiRNA target sequence
aaaaaagagaataataagtt

SEQ ID NO: 67693 - DNA, 20 bp, Artificial sequence
  SiRNA target sequence
aaaaagagaataataagttt

SEQ ID NO: 67694 - DNA, 20 bp, Artificial sequence
  SiRNA target sequence
aaaagagaataataagttta

SEQ ID NO: 67695 - DNA, 20 bp, Artificial sequence
  SiRNA target sequence
aaagagaataataagtttaa

SEQ ID NO: 67696 - DNA, 20 bp, Artificial sequence
  SiRNA target sequence
aagagaataataagtttaag

SEQ ID NO: 67697 - DNA, 20 bp, Artificial sequence
  SiRNA target sequence
agagaataataagtttaaga

SEQ ID NO: 67698 - DNA, 20 bp, Artificial sequence
  SiRNA target sequence
gagaataataagtttaagat

SEQ ID NO: 67699 - DNA, 20 bp, Artificial sequence
  SiRNA target sequence
agaataataagtttaagatt

SEQ ID NO: 67700 - DNA, 20 bp, Artificial sequence
  SiRNA target sequence
gaataataagtttaagatta

SEQ ID NO: 67701 - DNA, 20 bp, Artificial sequence
  SiRNA target sequence
aataataagtttaagattac

SEQ ID NO: 67702 - DNA, 20 bp, Artificial sequence
  SiRNA target sequence
ataataagtttaagattaca

SEQ ID NO: 67703 - DNA, 20 bp, Artificial sequence
  SiRNA target sequence
taataagtttaagattacag

SEQ ID NO: 67704 - DNA, 20 bp, Artificial sequence
  SiRNA target sequence
aataagtttaagattacaga

SEQ ID NO: 67705 - DNA, 20 bp, Artificial sequence
  SiRNA target sequence
ataagtttaagattacagaa

SEQ ID NO: 67706 - DNA, 20 bp, Artificial sequence
  SiRNA target sequence
taagtttaagattacagaat

SEQ ID NO: 67707 - DNA, 20 bp, Artificial sequence
  SiRNA target sequence
aagtttaagattacagaatt

SEQ ID NO: 67708 - DNA, 20 bp, Artificial sequence
  SiRNA target sequence
agtttaagattacagaattt

SEQ ID NO: 67709 - DNA, 20 bp, Artificial sequence
  SiRNA target sequence
gtttaagattacagaattta

SEQ ID NO: 67710 - DNA, 20 bp, Artificial sequence
  SiRNA target sequence
tttaagattacagaatttaa

SEQ ID NO: 67711 - DNA, 20 bp, Artificial sequence
  SiRNA target sequence
ttaagattacagaatttaaa

SEQ ID NO: 67712 - DNA, 20 bp, Artificial sequence
  SiRNA target sequence
taagattacagaatttaaag

SEQ ID NO: 67713 - DNA, 20 bp, Artificial sequence
  SiRNA target sequence
aagattacagaatttaaaga

SEQ ID NO: 67714 - DNA, 20 bp, Artificial sequence
  SiRNA target sequence
agattacagaatttaaagaa

SEQ ID NO: 67715 - DNA, 20 bp, Artificial sequence
  SiRNA target sequence
gattacagaatttaaagaaa

SEQ ID NO: 67716 - DNA, 20 bp, Artificial sequence
  SiRNA target sequence
attacagaatttaaagaaag

SEQ ID NO: 67717 - DNA, 20 bp, Artificial sequence
  SiRNA target sequence
ttacagaatttaaagaaagt

SEQ ID NO: 67718 - DNA, 20 bp, Artificial sequence
  SiRNA target sequence
tacagaatttaaagaaagta

SEQ ID NO: 67719 - DNA, 20 bp, Artificial sequence
  SiRNA target sequence
acagaatttaaagaaagtat

SEQ ID NO: 67720 - DNA, 20 bp, Artificial sequence
  SiRNA target sequence
cagaatttaaagaaagtatt

SEQ ID NO: 67721 - DNA, 20 bp, Artificial sequence
  SiRNA target sequence
agaatttaaagaaagtatta

SEQ ID NO: 67722 - DNA, 20 bp, Artificial sequence
  SiRNA target sequence
gaatttaaagaaagtattaa

SEQ ID NO: 67723 - DNA, 20 bp, Artificial sequence
  SiRNA target sequence
aatttaaagaaagtattaag

SEQ ID NO: 67724 - DNA, 20 bp, Artificial sequence
  SiRNA target sequence
atttaaagaaagtattaagt

SEQ ID NO: 67725 - DNA, 20 bp, Artificial sequence
  SiRNA target sequence
tttaaagaaagtattaagtt

SEQ ID NO: 67726 - DNA, 20 bp, Artificial sequence
  SiRNA target sequence
ttaaagaaagtattaagttt

SEQ ID NO: 67727 - DNA, 20 bp, Artificial sequence
  SiRNA target sequence
taaagaaagtattaagttta

SEQ ID NO: 67728 - DNA, 20 bp, Artificial sequence
  SiRNA target sequence
aaagaaagtattaagtttaa

SEQ ID NO: 67729 - DNA, 20 bp, Artificial sequence
  SiRNA target sequence
aagaaagtattaagtttaat

SEQ ID NO: 67730 - DNA, 20 bp, Artificial sequence
  SiRNA target sequence
agaaagtattaagtttaata

SEQ ID NO: 67731 - DNA, 20 bp, Artificial sequence
  SiRNA target sequence
gaaagtattaagtttaataa

SEQ ID NO: 67732 - DNA, 20 bp, Artificial sequence
  SiRNA target sequence
aaagtattaagtttaataat

SEQ ID NO: 67733 - DNA, 20 bp, Artificial sequence
  SiRNA target sequence
aagtattaagtttaataatt

SEQ ID NO: 67734 - DNA, 20 bp, Artificial sequence
  SiRNA target sequence
agtattaagtttaataattt

SEQ ID NO: 67735 - DNA, 20 bp, Artificial sequence
  SiRNA target sequence
gtattaagtttaataatttg

SEQ ID NO: 67736 - DNA, 20 bp, Artificial sequence
  SiRNA target sequence
tattaagtttaataatttgt

SEQ ID NO: 67737 - DNA, 20 bp, Artificial sequence
  SiRNA target sequence
attaagtttaataatttgtc

SEQ ID NO: 67738 - DNA, 20 bp, Artificial sequence
  SiRNA target sequence
ttaagtttaataatttgtca

SEQ ID NO: 67739 - DNA, 20 bp, Artificial sequence
  SiRNA target sequence
taagtttaataatttgtcat

SEQ ID NO: 67740 - DNA, 20 bp, Artificial sequence
  SiRNA target sequence
aagtttaataatttgtcatt

SEQ ID NO: 67741 - DNA, 20 bp, Artificial sequence
  SiRNA target sequence
agtttaataatttgtcattt

SEQ ID NO: 67742 - DNA, 20 bp, Artificial sequence
  SiRNA target sequence
gtttaataatttgtcatttg

SEQ ID NO: 67743 - DNA, 20 bp, Artificial sequence
  SiRNA target sequence
tttaataatttgtcatttgg

SEQ ID NO: 67744 - DNA, 20 bp, Artificial sequence
  SiRNA target sequence
ttaataatttgtcatttggt

SEQ ID NO: 67745 - DNA, 20 bp, Artificial sequence
  SiRNA target sequence
taataatttgtcatttggtt

SEQ ID NO: 67746 - DNA, 20 bp, Artificial sequence
  SiRNA target sequence
aataatttgtcatttggtta

SEQ ID NO: 67747 - DNA, 20 bp, Artificial sequence
  SiRNA target sequence
ataatttgtcatttggttat

SEQ ID NO: 67748 - DNA, 20 bp, Artificial sequence
  SiRNA target sequence
taatttgtcatttggttatg

SEQ ID NO: 67749 - DNA, 20 bp, Artificial sequence
  SiRNA target sequence
aatttgtcatttggttatga

SEQ ID NO: 67750 - DNA, 20 bp, Artificial sequence
  SiRNA target sequence
atttgtcatttggttatgaa

SEQ ID NO: 67751 - DNA, 20 bp, Artificial sequence
  SiRNA target sequence
tttgtcatttggttatgaaa

SEQ ID NO: 67752 - DNA, 20 bp, Artificial sequence
  SiRNA target sequence
ttgtcatttggttatgaaag

SEQ ID NO: 67753 - DNA, 20 bp, Artificial sequence
  SiRNA target sequence
tgtcatttggttatgaaagt

SEQ ID NO: 67754 - DNA, 20 bp, Artificial sequence
  SiRNA target sequence
gtcatttggttatgaaagta

SEQ ID NO: 67755 - DNA, 20 bp, Artificial sequence
  SiRNA target sequence
tcatttggttatgaaagtag

SEQ ID NO: 67756 - DNA, 20 bp, Artificial sequence
  SiRNA target sequence
catttggttatgaaagtaga

SEQ ID NO: 67757 - DNA, 20 bp, Artificial sequence
  SiRNA target sequence
atttggttatgaaagtagac

SEQ ID NO: 67758 - DNA, 20 bp, Artificial sequence
  SiRNA target sequence
tttggttatgaaagtagaca

SEQ ID NO: 67759 - DNA, 20 bp, Artificial sequence
  SiRNA target sequence
ttggttatgaaagtagacaa

SEQ ID NO: 67760 - DNA, 20 bp, Artificial sequence
  SiRNA target sequence
tggttatgaaagtagacaaa

SEQ ID NO: 67761 - DNA, 20 bp, Artificial sequence
  SiRNA target sequence
ggttatgaaagtagacaaat

SEQ ID NO: 67762 - DNA, 20 bp, Artificial sequence
  SiRNA target sequence
gttatgaaagtagacaaatt

SEQ ID NO: 67763 - DNA, 20 bp, Artificial sequence
  SiRNA target sequence
ttatgaaagtagacaaattt

SEQ ID NO: 67764 - DNA, 20 bp, Artificial sequence
  SiRNA target sequence
tatgaaagtagacaaatttt

SEQ ID NO: 67765 - DNA, 20 bp, Artificial sequence
  SiRNA target sequence
atgaaagtagacaaattttt

SEQ ID NO: 67766 - DNA, 20 bp, Artificial sequence
  SiRNA target sequence
tgaaagtagacaaattttta

SEQ ID NO: 67767 - DNA, 20 bp, Artificial sequence
  SiRNA target sequence
gaaagtagacaaatttttaa

SEQ ID NO: 67768 - DNA, 20 bp, Artificial sequence
  SiRNA target sequence
aaagtagacaaatttttaat

SEQ ID NO: 67769 - DNA, 20 bp, Artificial sequence
  SiRNA target sequence
aagtagacaaatttttaata

SEQ ID NO: 67770 - DNA, 20 bp, Artificial sequence
  SiRNA target sequence
agtagacaaatttttaataa

SEQ ID NO: 67771 - DNA, 20 bp, Artificial sequence
  SiRNA target sequence
gtagacaaatttttaataaa

SEQ ID NO: 67772 - DNA, 20 bp, Artificial sequence
  SiRNA target sequence
tagacaaatttttaataaaa

SEQ ID NO: 67773 - DNA, 20 bp, Artificial sequence
  SiRNA target sequence
agacaaatttttaataaaat

SEQ ID NO: 67774 - DNA, 20 bp, Artificial sequence
  SiRNA target sequence
gacaaatttttaataaaata

SEQ ID NO: 67775 - DNA, 20 bp, Artificial sequence
  SiRNA target sequence
acaaatttttaataaaataa

SEQ ID NO: 67776 - DNA, 20 bp, Artificial sequence
  SiRNA target sequence
caaatttttaataaaataaa

SEQ ID NO: 67777 - DNA, 20 bp, Artificial sequence
  SiRNA target sequence
aaatttttaataaaataaat

SEQ ID NO: 67778 - DNA, 20 bp, Artificial sequence
  SiRNA target sequence
aatttttaataaaataaatc

SEQ ID NO: 67779 - DNA, 20 bp, Artificial sequence
  SiRNA target sequence
atttttaataaaataaatct

SEQ ID NO: 67780 - DNA, 20 bp, Artificial sequence
  SiRNA target sequence
tttttaataaaataaatcta

SEQ ID NO: 67781 - DNA, 20 bp, Artificial sequence
  SiRNA target sequence
ttttaataaaataaatctag

SEQ ID NO: 67782 - DNA, 20 bp, Artificial sequence
  SiRNA target sequence
tttaataaaataaatctaga

SEQ ID NO: 67783 - DNA, 20 bp, Artificial sequence
  SiRNA target sequence
ttaataaaataaatctagaa

SEQ ID NO: 67784 - DNA, 20 bp, Artificial sequence
  SiRNA target sequence
taataaaataaatctagaaa

SEQ ID NO: 67785 - DNA, 20 bp, Artificial sequence
  SiRNA target sequence
aataaaataaatctagaaat

SEQ ID NO: 67786 - DNA, 20 bp, Artificial sequence
  SiRNA target sequence
ataaaataaatctagaaata

SEQ ID NO: 67787 - DNA, 20 bp, Artificial sequence
  SiRNA target sequence
taaaataaatctagaaatat

SEQ ID NO: 67788 - DNA, 20 bp, Artificial sequence
  SiRNA target sequence
aaaataaatctagaaatata

SEQ ID NO: 67789 - DNA, 20 bp, Artificial sequence
  SiRNA target sequence
aaataaatctagaaatatac

SEQ ID NO: 67790 - DNA, 20 bp, Artificial sequence
  SiRNA target sequence
aataaatctagaaatataca

SEQ ID NO: 67791 - DNA, 20 bp, Artificial sequence
  SiRNA target sequence
ataaatctagaaatatacaa

SEQ ID NO: 67792 - DNA, 20 bp, Artificial sequence
  SiRNA target sequence
taaatctagaaatatacaaa

SEQ ID NO: 67793 - DNA, 20 bp, Artificial sequence
  SiRNA target sequence
aaatctagaaatatacaaag

SEQ ID NO: 67794 - DNA, 20 bp, Artificial sequence
  SiRNA target sequence
aatctagaaatatacaaagg

SEQ ID NO: 67795 - DNA, 20 bp, Artificial sequence
  SiRNA target sequence
atctagaaatatacaaagga

SEQ ID NO: 67796 - DNA, 20 bp, Artificial sequence
  SiRNA target sequence
tctagaaatatacaaaggag

SEQ ID NO: 67797 - DNA, 20 bp, Artificial sequence
  SiRNA target sequence
ctagaaatatacaaaggaga

SEQ ID NO: 67798 - DNA, 20 bp, Artificial sequence
  SiRNA target sequence
tagaaatatacaaaggagaa

SEQ ID NO: 67799 - DNA, 20 bp, Artificial sequence
  SiRNA target sequence
agaaatatacaaaggagaaa

SEQ ID NO: 67800 - DNA, 20 bp, Artificial sequence
  SiRNA target sequence
gaaatatacaaaggagaaaa

SEQ ID NO: 67801 - DNA, 20 bp, Artificial sequence
  SiRNA target sequence
aaatatacaaaggagaaaaa

SEQ ID NO: 67802 - DNA, 20 bp, Artificial sequence
  SiRNA target sequence
aatatacaaaggagaaaaag

SEQ ID NO: 67803 - DNA, 20 bp, Artificial sequence
  SiRNA target sequence
atatacaaaggagaaaaagt

SEQ ID NO: 67804 - DNA, 20 bp, Artificial sequence
  SiRNA target sequence
tatacaaaggagaaaaagta

SEQ ID NO: 67805 - DNA, 20 bp, Artificial sequence
  SiRNA target sequence
atacaaaggagaaaaagtag

SEQ ID NO: 67806 - DNA, 20 bp, Artificial sequence
  SiRNA target sequence
tacaaaggagaaaaagtagc

SEQ ID NO: 67807 - DNA, 20 bp, Artificial sequence
  SiRNA target sequence
acaaaggagaaaaagtagca

SEQ ID NO: 67808 - DNA, 20 bp, Artificial sequence
  SiRNA target sequence
caaaggagaaaaagtagcaa

SEQ ID NO: 67809 - DNA, 20 bp, Artificial sequence
  SiRNA target sequence
aaaggagaaaaagtagcaat

SEQ ID NO: 67810 - DNA, 20 bp, Artificial sequence
  SiRNA target sequence
aaggagaaaaagtagcaatt

SEQ ID NO: 67811 - DNA, 20 bp, Artificial sequence
  SiRNA target sequence
aggagaaaaagtagcaatta

SEQ ID NO: 67812 - DNA, 20 bp, Artificial sequence
  SiRNA target sequence
ggagaaaaagtagcaattat

SEQ ID NO: 67813 - DNA, 20 bp, Artificial sequence
  SiRNA target sequence
gagaaaaagtagcaattata

SEQ ID NO: 67814 - DNA, 20 bp, Artificial sequence
  SiRNA target sequence
agaaaaagtagcaattatag

SEQ ID NO: 67815 - DNA, 20 bp, Artificial sequence
  SiRNA target sequence
gaaaaagtagcaattatagg

SEQ ID NO: 67816 - DNA, 20 bp, Artificial sequence
  SiRNA target sequence
aaaaagtagcaattataggt

SEQ ID NO: 67817 - DNA, 20 bp, Artificial sequence
  SiRNA target sequence
aaaagtagcaattataggta

SEQ ID NO: 67818 - DNA, 20 bp, Artificial sequence
  SiRNA target sequence
aaagtagcaattataggtaa

SEQ ID NO: 67819 - DNA, 20 bp, Artificial sequence
  SiRNA target sequence
aagtagcaattataggtaaa

SEQ ID NO: 67820 - DNA, 20 bp, Artificial sequence
  SiRNA target sequence
agtagcaattataggtaaaa

SEQ ID NO: 67821 - DNA, 20 bp, Artificial sequence
  SiRNA target sequence
gtagcaattataggtaaaaa

SEQ ID NO: 67822 - DNA, 20 bp, Artificial sequence
  SiRNA target sequence
tagcaattataggtaaaaat

SEQ ID NO: 67823 - DNA, 20 bp, Artificial sequence
  SiRNA target sequence
agcaattataggtaaaaatg

SEQ ID NO: 67824 - DNA, 20 bp, Artificial sequence
  SiRNA target sequence
gcaattataggtaaaaatgg

SEQ ID NO: 67825 - DNA, 20 bp, Artificial sequence
  SiRNA target sequence
caattataggtaaaaatggt

SEQ ID NO: 67826 - DNA, 20 bp, Artificial sequence
  SiRNA target sequence
aattataggtaaaaatggta

SEQ ID NO: 67827 - DNA, 20 bp, Artificial sequence
  SiRNA target sequence
attataggtaaaaatggtag

SEQ ID NO: 67828 - DNA, 20 bp, Artificial sequence
  SiRNA target sequence
ttataggtaaaaatggtagt

SEQ ID NO: 67829 - DNA, 20 bp, Artificial sequence
  SiRNA target sequence
tataggtaaaaatggtagtg

SEQ ID NO: 67830 - DNA, 20 bp, Artificial sequence
  SiRNA target sequence
ataggtaaaaatggtagtgg

SEQ ID NO: 67831 - DNA, 20 bp, Artificial sequence
  SiRNA target sequence
taggtaaaaatggtagtggt

SEQ ID NO: 67832 - DNA, 20 bp, Artificial sequence
  SiRNA target sequence
aggtaaaaatggtagtggta

SEQ ID NO: 67833 - DNA, 20 bp, Artificial sequence
  SiRNA target sequence
ggtaaaaatggtagtggtaa

SEQ ID NO: 67834 - DNA, 20 bp, Artificial sequence
  SiRNA target sequence
gtaaaaatggtagtggtaaa

SEQ ID NO: 67835 - DNA, 20 bp, Artificial sequence
  SiRNA target sequence
taaaaatggtagtggtaaat

SEQ ID NO: 67836 - DNA, 20 bp, Artificial sequence
  SiRNA target sequence
aaaaatggtagtggtaaatc

SEQ ID NO: 67837 - DNA, 20 bp, Artificial sequence
  SiRNA target sequence
aaaatggtagtggtaaatca

SEQ ID NO: 67838 - DNA, 20 bp, Artificial sequence
  SiRNA target sequence
aaatggtagtggtaaatcaa

SEQ ID NO: 67839 - DNA, 20 bp, Artificial sequence
  SiRNA target sequence
aatggtagtggtaaatcaac

SEQ ID NO: 67840 - DNA, 20 bp, Artificial sequence
  SiRNA target sequence
atggtagtggtaaatcaaca

SEQ ID NO: 67841 - DNA, 20 bp, Artificial sequence
  SiRNA target sequence
tggtagtggtaaatcaacat

SEQ ID NO: 67842 - DNA, 20 bp, Artificial sequence
  SiRNA target sequence
ggtagtggtaaatcaacatt

SEQ ID NO: 67843 - DNA, 20 bp, Artificial sequence
  SiRNA target sequence
gtagtggtaaatcaacatta

SEQ ID NO: 67844 - DNA, 20 bp, Artificial sequence
  SiRNA target sequence
tagtggtaaatcaacattac

SEQ ID NO: 67845 - DNA, 20 bp, Artificial sequence
  SiRNA target sequence
agtggtaaatcaacattact

SEQ ID NO: 67846 - DNA, 20 bp, Artificial sequence
  SiRNA target sequence
gtggtaaatcaacattacta

SEQ ID NO: 67847 - DNA, 20 bp, Artificial sequence
  SiRNA target sequence
tggtaaatcaacattactaa

SEQ ID NO: 67848 - DNA, 20 bp, Artificial sequence
  SiRNA target sequence
ggtaaatcaacattactaaa

SEQ ID NO: 67849 - DNA, 20 bp, Artificial sequence
  SiRNA target sequence
gtaaatcaacattactaaaa

SEQ ID NO: 67850 - DNA, 20 bp, Artificial sequence
  SiRNA target sequence
taaatcaacattactaaaac

SEQ ID NO: 67851 - DNA, 20 bp, Artificial sequence
  SiRNA target sequence
aaatcaacattactaaaact

SEQ ID NO: 67852 - DNA, 20 bp, Artificial sequence
  SiRNA target sequence
aatcaacattactaaaacta

SEQ ID NO: 67853 - DNA, 20 bp, Artificial sequence
  SiRNA target sequence
atcaacattactaaaactac

SEQ ID NO: 67854 - DNA, 20 bp, Artificial sequence
  SiRNA target sequence
tcaacattactaaaactact

SEQ ID NO: 67855 - DNA, 20 bp, Artificial sequence
  SiRNA target sequence
caacattactaaaactactg

SEQ ID NO: 67856 - DNA, 20 bp, Artificial sequence
  SiRNA target sequence
aacattactaaaactactgc

SEQ ID NO: 67857 - DNA, 20 bp, Artificial sequence
  SiRNA target sequence
acattactaaaactactgct

SEQ ID NO: 67858 - DNA, 20 bp, Artificial sequence
  SiRNA target sequence
cattactaaaactactgctt

SEQ ID NO: 67859 - DNA, 20 bp, Artificial sequence
  SiRNA target sequence
attactaaaactactgctta

SEQ ID NO: 67860 - DNA, 20 bp, Artificial sequence
  SiRNA target sequence
ttactaaaactactgcttaa

SEQ ID NO: 67861 - DNA, 20 bp, Artificial sequence
  SiRNA target sequence
tactaaaactactgcttaaa

SEQ ID NO: 67862 - DNA, 20 bp, Artificial sequence
  SiRNA target sequence
actaaaactactgcttaaat

SEQ ID NO: 67863 - DNA, 20 bp, Artificial sequence
  SiRNA target sequence
ctaaaactactgcttaaatt

SEQ ID NO: 67864 - DNA, 20 bp, Artificial sequence
  SiRNA target sequence
taaaactactgcttaaattt

SEQ ID NO: 67865 - DNA, 20 bp, Artificial sequence
  SiRNA target sequence
aaaactactgcttaaatttg

SEQ ID NO: 67866 - DNA, 20 bp, Artificial sequence
  SiRNA target sequence
aaactactgcttaaatttga

SEQ ID NO: 67867 - DNA, 20 bp, Artificial sequence
  SiRNA target sequence
aactactgcttaaatttgat

SEQ ID NO: 67868 - DNA, 20 bp, Artificial sequence
  SiRNA target sequence
actactgcttaaatttgatg

SEQ ID NO: 67869 - DNA, 20 bp, Artificial sequence
  SiRNA target sequence
ctactgcttaaatttgatga

SEQ ID NO: 67870 - DNA, 20 bp, Artificial sequence
  SiRNA target sequence
tactgcttaaatttgatgaa

SEQ ID NO: 67871 - DNA, 20 bp, Artificial sequence
  SiRNA target sequence
actgcttaaatttgatgaag

SEQ ID NO: 67872 - DNA, 20 bp, Artificial sequence
  SiRNA target sequence
ctgcttaaatttgatgaaga

SEQ ID NO: 67873 - DNA, 20 bp, Artificial sequence
  SiRNA target sequence
tgcttaaatttgatgaagat

SEQ ID NO: 67874 - DNA, 20 bp, Artificial sequence
  SiRNA target sequence
gcttaaatttgatgaagatt

SEQ ID NO: 67875 - DNA, 20 bp, Artificial sequence
  SiRNA target sequence
cttaaatttgatgaagatta

SEQ ID NO: 67876 - DNA, 20 bp, Artificial sequence
  SiRNA target sequence
ttaaatttgatgaagattac

SEQ ID NO: 67877 - DNA, 20 bp, Artificial sequence
  SiRNA target sequence
taaatttgatgaagattaca

SEQ ID NO: 67878 - DNA, 20 bp, Artificial sequence
  SiRNA target sequence
aaatttgatgaagattacaa

SEQ ID NO: 67879 - DNA, 20 bp, Artificial sequence
  SiRNA target sequence
aatttgatgaagattacaaa

SEQ ID NO: 67880 - DNA, 20 bp, Artificial sequence
  SiRNA target sequence
atttgatgaagattacaaag

SEQ ID NO: 67881 - DNA, 20 bp, Artificial sequence
  SiRNA target sequence
tttgatgaagattacaaagg

SEQ ID NO: 67882 - DNA, 20 bp, Artificial sequence
  SiRNA target sequence
ttgatgaagattacaaaggt

SEQ ID NO: 67883 - DNA, 20 bp, Artificial sequence
  SiRNA target sequence
tgatgaagattacaaaggta

SEQ ID NO: 67884 - DNA, 20 bp, Artificial sequence
  SiRNA target sequence
gatgaagattacaaaggtag

SEQ ID NO: 67885 - DNA, 20 bp, Artificial sequence
  SiRNA target sequence
atgaagattacaaaggtagc

SEQ ID NO: 67886 - DNA, 20 bp, Artificial sequence
  SiRNA target sequence
tgaagattacaaaggtagca

SEQ ID NO: 67887 - DNA, 20 bp, Artificial sequence
  SiRNA target sequence
gaagattacaaaggtagcat

SEQ ID NO: 67888 - DNA, 20 bp, Artificial sequence
  SiRNA target sequence
aagattacaaaggtagcatt

SEQ ID NO: 67889 - DNA, 20 bp, Artificial sequence
  SiRNA target sequence
agattacaaaggtagcattt

SEQ ID NO: 67890 - DNA, 20 bp, Artificial sequence
  SiRNA target sequence
gattacaaaggtagcatttt

SEQ ID NO: 67891 - DNA, 20 bp, Artificial sequence
  SiRNA target sequence
attacaaaggtagcatttta

SEQ ID NO: 67892 - DNA, 20 bp, Artificial sequence
  SiRNA target sequence
ttacaaaggtagcattttaa

SEQ ID NO: 67893 - DNA, 20 bp, Artificial sequence
  SiRNA target sequence
tacaaaggtagcattttaat

SEQ ID NO: 67894 - DNA, 20 bp, Artificial sequence
  SiRNA target sequence
acaaaggtagcattttaata

SEQ ID NO: 67895 - DNA, 20 bp, Artificial sequence
  SiRNA target sequence
caaaggtagcattttaatag

SEQ ID NO: 67896 - DNA, 20 bp, Artificial sequence
  SiRNA target sequence
aaaggtagcattttaataga

SEQ ID NO: 67897 - DNA, 20 bp, Artificial sequence
  SiRNA target sequence
aaggtagcattttaatagat

SEQ ID NO: 67898 - DNA, 20 bp, Artificial sequence
  SiRNA target sequence
aggtagcattttaatagatg

SEQ ID NO: 67899 - DNA, 20 bp, Artificial sequence
  SiRNA target sequence
ggtagcattttaatagatga

SEQ ID NO: 67900 - DNA, 20 bp, Artificial sequence
  SiRNA target sequence
gtagcattttaatagatgac

SEQ ID NO: 67901 - DNA, 20 bp, Artificial sequence
  SiRNA target sequence
tagcattttaatagatgaca

SEQ ID NO: 67902 - DNA, 20 bp, Artificial sequence
  SiRNA target sequence
agcattttaatagatgacat

SEQ ID NO: 67903 - DNA, 20 bp, Artificial sequence
  SiRNA target sequence
gcattttaatagatgacatt

SEQ ID NO: 67904 - DNA, 20 bp, Artificial sequence
  SiRNA target sequence
cattttaatagatgacattg

SEQ ID NO: 67905 - DNA, 20 bp, Artificial sequence
  SiRNA target sequence
attttaatagatgacattga

SEQ ID NO: 67906 - DNA, 20 bp, Artificial sequence
  SiRNA target sequence
ttttaatagatgacattgat

SEQ ID NO: 67907 - DNA, 20 bp, Artificial sequence
  SiRNA target sequence
tttaatagatgacattgata

SEQ ID NO: 67908 - DNA, 20 bp, Artificial sequence
  SiRNA target sequence
ttaatagatgacattgatat

SEQ ID NO: 67909 - DNA, 20 bp, Artificial sequence
  SiRNA target sequence
taatagatgacattgatatt

SEQ ID NO: 67910 - DNA, 20 bp, Artificial sequence
  SiRNA target sequence
aatagatgacattgatatta

SEQ ID NO: 67911 - DNA, 20 bp, Artificial sequence
  SiRNA target sequence
atagatgacattgatattaa

SEQ ID NO: 67912 - DNA, 20 bp, Artificial sequence
  SiRNA target sequence
tagatgacattgatattaaa

SEQ ID NO: 67913 - DNA, 20 bp, Artificial sequence
  SiRNA target sequence
agatgacattgatattaaaa

SEQ ID NO: 67914 - DNA, 20 bp, Artificial sequence
  SiRNA target sequence
gatgacattgatattaaaaa

SEQ ID NO: 67915 - DNA, 20 bp, Artificial sequence
  SiRNA target sequence
atgacattgatattaaaaaa

SEQ ID NO: 67916 - DNA, 20 bp, Artificial sequence
  SiRNA target sequence
tgacattgatattaaaaaaa

SEQ ID NO: 67917 - DNA, 20 bp, Artificial sequence
  SiRNA target sequence
gacattgatattaaaaaaat

SEQ ID NO: 67918 - DNA, 20 bp, Artificial sequence
  SiRNA target sequence
acattgatattaaaaaaatc

SEQ ID NO: 67919 - DNA, 20 bp, Artificial sequence
  SiRNA target sequence
cattgatattaaaaaaatca

SEQ ID NO: 67920 - DNA, 20 bp, Artificial sequence
  SiRNA target sequence
attgatattaaaaaaatcaa

SEQ ID NO: 67921 - DNA, 20 bp, Artificial sequence
  SiRNA target sequence
ttgatattaaaaaaatcaaa

SEQ ID NO: 67922 - DNA, 20 bp, Artificial sequence
  SiRNA target sequence
tgatattaaaaaaatcaaag

SEQ ID NO: 67923 - DNA, 20 bp, Artificial sequence
  SiRNA target sequence
gatattaaaaaaatcaaaga

SEQ ID NO: 67924 - DNA, 20 bp, Artificial sequence
  SiRNA target sequence
atattaaaaaaatcaaagac

SEQ ID NO: 67925 - DNA, 20 bp, Artificial sequence
  SiRNA target sequence
tattaaaaaaatcaaagacg

SEQ ID NO: 67926 - DNA, 20 bp, Artificial sequence
  SiRNA target sequence
attaaaaaaatcaaagacga

SEQ ID NO: 67927 - DNA, 20 bp, Artificial sequence
  SiRNA target sequence
ttaaaaaaatcaaagacgaa

SEQ ID NO: 67928 - DNA, 20 bp, Artificial sequence
  SiRNA target sequence
taaaaaaatcaaagacgaat

SEQ ID NO: 67929 - DNA, 20 bp, Artificial sequence
  SiRNA target sequence
aaaaaaatcaaagacgaatt

SEQ ID NO: 67930 - DNA, 20 bp, Artificial sequence
  SiRNA target sequence
aaaaaatcaaagacgaattt

SEQ ID NO: 67931 - DNA, 20 bp, Artificial sequence
  SiRNA target sequence
aaaaatcaaagacgaatttt

SEQ ID NO: 67932 - DNA, 20 bp, Artificial sequence
  SiRNA target sequence
aaaatcaaagacgaatttta

SEQ ID NO: 67933 - DNA, 20 bp, Artificial sequence
  SiRNA target sequence
aaatcaaagacgaattttat

SEQ ID NO: 67934 - DNA, 20 bp, Artificial sequence
  SiRNA target sequence
aatcaaagacgaattttata

SEQ ID NO: 67935 - DNA, 20 bp, Artificial sequence
  SiRNA target sequence
atcaaagacgaattttatag

SEQ ID NO: 67936 - DNA, 20 bp, Artificial sequence
  SiRNA target sequence
tcaaagacgaattttatagg

SEQ ID NO: 67937 - DNA, 20 bp, Artificial sequence
  SiRNA target sequence
caaagacgaattttatagga

SEQ ID NO: 67938 - DNA, 20 bp, Artificial sequence
  SiRNA target sequence
aaagacgaattttataggaa

SEQ ID NO: 67939 - DNA, 20 bp, Artificial sequence
  SiRNA target sequence
aagacgaattttataggaat

SEQ ID NO: 67940 - DNA, 20 bp, Artificial sequence
  SiRNA target sequence
agacgaattttataggaatt

SEQ ID NO: 67941 - DNA, 20 bp, Artificial sequence
  SiRNA target sequence
gacgaattttataggaattt

SEQ ID NO: 67942 - DNA, 20 bp, Artificial sequence
  SiRNA target sequence
acgaattttataggaattta

SEQ ID NO: 67943 - DNA, 20 bp, Artificial sequence
  SiRNA target sequence
cgaattttataggaatttat

SEQ ID NO: 67944 - DNA, 20 bp, Artificial sequence
  SiRNA target sequence
gaattttataggaatttatt

SEQ ID NO: 67945 - DNA, 20 bp, Artificial sequence
  SiRNA target sequence
aattttataggaatttatta

SEQ ID NO: 67946 - DNA, 20 bp, Artificial sequence
  SiRNA target sequence
attttataggaatttattag

SEQ ID NO: 67947 - DNA, 20 bp, Artificial sequence
  SiRNA target sequence
ttttataggaatttattagg

SEQ ID NO: 67948 - DNA, 20 bp, Artificial sequence
  SiRNA target sequence
tttataggaatttattaggt

SEQ ID NO: 67949 - DNA, 20 bp, Artificial sequence
  SiRNA target sequence
ttataggaatttattaggtt

SEQ ID NO: 67950 - DNA, 20 bp, Artificial sequence
  SiRNA target sequence
tataggaatttattaggtta

SEQ ID NO: 67951 - DNA, 20 bp, Artificial sequence
  SiRNA target sequence
ataggaatttattaggttac

SEQ ID NO: 67952 - DNA, 20 bp, Artificial sequence
  SiRNA target sequence
taggaatttattaggttaca

SEQ ID NO: 67953 - DNA, 20 bp, Artificial sequence
  SiRNA target sequence
aggaatttattaggttacat

SEQ ID NO: 67954 - DNA, 20 bp, Artificial sequence
  SiRNA target sequence
ggaatttattaggttacata

SEQ ID NO: 67955 - DNA, 20 bp, Artificial sequence
  SiRNA target sequence
gaatttattaggttacatac

SEQ ID NO: 67956 - DNA, 20 bp, Artificial sequence
  SiRNA target sequence
aatttattaggttacatacc

SEQ ID NO: 67957 - DNA, 20 bp, Artificial sequence
  SiRNA target sequence
atttattaggttacatacca

SEQ ID NO: 67958 - DNA, 20 bp, Artificial sequence
  SiRNA target sequence
tttattaggttacataccac

SEQ ID NO: 67959 - DNA, 20 bp, Artificial sequence
  SiRNA target sequence
ttattaggttacataccaca

SEQ ID NO: 67960 - DNA, 20 bp, Artificial sequence
  SiRNA target sequence
tattaggttacataccacag

SEQ ID NO: 67961 - DNA, 20 bp, Artificial sequence
  SiRNA target sequence
attaggttacataccacaga

SEQ ID NO: 67962 - DNA, 20 bp, Artificial sequence
  SiRNA target sequence
ttaggttacataccacagaa

SEQ ID NO: 67963 - DNA, 20 bp, Artificial sequence
  SiRNA target sequence
taggttacataccacagaat

SEQ ID NO: 67964 - DNA, 20 bp, Artificial sequence
  SiRNA target sequence
aggttacataccacagaata

SEQ ID NO: 67965 - DNA, 20 bp, Artificial sequence
  SiRNA target sequence
ggttacataccacagaatac

SEQ ID NO: 67966 - DNA, 20 bp, Artificial sequence
  SiRNA target sequence
gttacataccacagaataca

SEQ ID NO: 67967 - DNA, 20 bp, Artificial sequence
  SiRNA target sequence
ttacataccacagaatacat

SEQ ID NO: 67968 - DNA, 20 bp, Artificial sequence
  SiRNA target sequence
tacataccacagaatacatt

SEQ ID NO: 67969 - DNA, 20 bp, Artificial sequence
  SiRNA target sequence
acataccacagaatacattt

SEQ ID NO: 67970 - DNA, 20 bp, Artificial sequence
  SiRNA target sequence
cataccacagaatacatttt

SEQ ID NO: 67971 - DNA, 20 bp, Artificial sequence
  SiRNA target sequence
ataccacagaatacattttt

SEQ ID NO: 67972 - DNA, 20 bp, Artificial sequence
  SiRNA target sequence
taccacagaatacatttttg

SEQ ID NO: 67973 - DNA, 20 bp, Artificial sequence
  SiRNA target sequence
accacagaatacatttttgt

SEQ ID NO: 67974 - DNA, 20 bp, Artificial sequence
  SiRNA target sequence
ccacagaatacatttttgtt

SEQ ID NO: 67975 - DNA, 20 bp, Artificial sequence
  SiRNA target sequence
cacagaatacatttttgttt

SEQ ID NO: 67976 - DNA, 20 bp, Artificial sequence
  SiRNA target sequence
acagaatacatttttgttta

SEQ ID NO: 67977 - DNA, 20 bp, Artificial sequence
  SiRNA target sequence
cagaatacatttttgtttaa

SEQ ID NO: 67978 - DNA, 20 bp, Artificial sequence
  SiRNA target sequence
agaatacatttttgtttaat

SEQ ID NO: 67979 - DNA, 20 bp, Artificial sequence
  SiRNA target sequence
gaatacatttttgtttaatg

SEQ ID NO: 67980 - DNA, 20 bp, Artificial sequence
  SiRNA target sequence
aatacatttttgtttaatga

SEQ ID NO: 67981 - DNA, 20 bp, Artificial sequence
  SiRNA target sequence
atacatttttgtttaatgaa

SEQ ID NO: 67982 - DNA, 20 bp, Artificial sequence
  SiRNA target sequence
tacatttttgtttaatgaat

SEQ ID NO: 67983 - DNA, 20 bp, Artificial sequence
  SiRNA target sequence
acatttttgtttaatgaatc

SEQ ID NO: 67984 - DNA, 20 bp, Artificial sequence
  SiRNA target sequence
catttttgtttaatgaatct

SEQ ID NO: 67985 - DNA, 20 bp, Artificial sequence
  SiRNA target sequence
atttttgtttaatgaatctg

SEQ ID NO: 67986 - DNA, 20 bp, Artificial sequence
  SiRNA target sequence
tttttgtttaatgaatctgt

SEQ ID NO: 67987 - DNA, 20 bp, Artificial sequence
  SiRNA target sequence
ttttgtttaatgaatctgta

SEQ ID NO: 67988 - DNA, 20 bp, Artificial sequence
  SiRNA target sequence
tttgtttaatgaatctgtaa

SEQ ID NO: 67989 - DNA, 20 bp, Artificial sequence
  SiRNA target sequence
ttgtttaatgaatctgtaaa

SEQ ID NO: 67990 - DNA, 20 bp, Artificial sequence
  SiRNA target sequence
tgtttaatgaatctgtaaaa

SEQ ID NO: 67991 - DNA, 20 bp, Artificial sequence
  SiRNA target sequence
gtttaatgaatctgtaaaat

SEQ ID NO: 67992 - DNA, 20 bp, Artificial sequence
  SiRNA target sequence
tttaatgaatctgtaaaata

SEQ ID NO: 67993 - DNA, 20 bp, Artificial sequence
  SiRNA target sequence
ttaatgaatctgtaaaatat

SEQ ID NO: 67994 - DNA, 20 bp, Artificial sequence
  SiRNA target sequence
taatgaatctgtaaaatata

SEQ ID NO: 67995 - DNA, 20 bp, Artificial sequence
  SiRNA target sequence
aatgaatctgtaaaatataa

SEQ ID NO: 67996 - DNA, 20 bp, Artificial sequence
  SiRNA target sequence
atgaatctgtaaaatataat

SEQ ID NO: 67997 - DNA, 20 bp, Artificial sequence
  SiRNA target sequence
tgaatctgtaaaatataata

SEQ ID NO: 67998 - DNA, 20 bp, Artificial sequence
  SiRNA target sequence
gaatctgtaaaatataatat

SEQ ID NO: 67999 - DNA, 20 bp, Artificial sequence
  SiRNA target sequence
aatctgtaaaatataatatt

SEQ ID NO: 68000 - DNA, 20 bp, Artificial sequence
  SiRNA target sequence
atctgtaaaatataatatta

SEQ ID NO: 68001 - DNA, 20 bp, Artificial sequence
  SiRNA target sequence
tctgtaaaatataatattaa

SEQ ID NO: 68002 - DNA, 20 bp, Artificial sequence
  SiRNA target sequence
ctgtaaaatataatattaaa

SEQ ID NO: 68003 - DNA, 20 bp, Artificial sequence
  SiRNA target sequence
tgtaaaatataatattaaat

SEQ ID NO: 68004 - DNA, 20 bp, Artificial sequence
  SiRNA target sequence
gtaaaatataatattaaata

SEQ ID NO: 68005 - DNA, 20 bp, Artificial sequence
  SiRNA target sequence
taaaatataatattaaatac

SEQ ID NO: 68006 - DNA, 20 bp, Artificial sequence
  SiRNA target sequence
aaaatataatattaaatacg

SEQ ID NO: 68007 - DNA, 20 bp, Artificial sequence
  SiRNA target sequence
aaatataatattaaatacgg

SEQ ID NO: 68008 - DNA, 20 bp, Artificial sequence
  SiRNA target sequence
aatataatattaaatacgga

SEQ ID NO: 68009 - DNA, 20 bp, Artificial sequence
  SiRNA target sequence
atataatattaaatacggat

SEQ ID NO: 68010 - DNA, 20 bp, Artificial sequence
  SiRNA target sequence
tataatattaaatacggatc

SEQ ID NO: 68011 - DNA, 20 bp, Artificial sequence
  SiRNA target sequence
ataatattaaatacggatct

SEQ ID NO: 68012 - DNA, 20 bp, Artificial sequence
  SiRNA target sequence
taatattaaatacggatctt

SEQ ID NO: 68013 - DNA, 20 bp, Artificial sequence
  SiRNA target sequence
aatattaaatacggatcttt

SEQ ID NO: 68014 - DNA, 20 bp, Artificial sequence
  SiRNA target sequence
atattaaatacggatctttt

SEQ ID NO: 68015 - DNA, 20 bp, Artificial sequence
  SiRNA target sequence
tattaaatacggatcttttg

SEQ ID NO: 68016 - DNA, 20 bp, Artificial sequence
  SiRNA target sequence
attaaatacggatcttttgg

SEQ ID NO: 68017 - DNA, 20 bp, Artificial sequence
  SiRNA target sequence
ttaaatacggatcttttggt

SEQ ID NO: 68018 - DNA, 20 bp, Artificial sequence
  SiRNA target sequence
taaatacggatcttttggta

SEQ ID NO: 68019 - DNA, 20 bp, Artificial sequence
  SiRNA target sequence
aaatacggatcttttggtat

SEQ ID NO: 68020 - DNA, 20 bp, Artificial sequence
  SiRNA target sequence
aatacggatcttttggtatt

SEQ ID NO: 68021 - DNA, 20 bp, Artificial sequence
  SiRNA target sequence
atacggatcttttggtattt

SEQ ID NO: 68022 - DNA, 20 bp, Artificial sequence
  SiRNA target sequence
tacggatcttttggtatttc

SEQ ID NO: 68023 - DNA, 20 bp, Artificial sequence
  SiRNA target sequence
acggatcttttggtatttca

SEQ ID NO: 68024 - DNA, 20 bp, Artificial sequence
  SiRNA target sequence
cggatcttttggtatttcag

SEQ ID NO: 68025 - DNA, 20 bp, Artificial sequence
  SiRNA target sequence
ggatcttttggtatttcaga

SEQ ID NO: 68026 - DNA, 20 bp, Artificial sequence
  SiRNA target sequence
gatcttttggtatttcagac

SEQ ID NO: 68027 - DNA, 20 bp, Artificial sequence
  SiRNA target sequence
atcttttggtatttcagacg

SEQ ID NO: 68028 - DNA, 20 bp, Artificial sequence
  SiRNA target sequence
tcttttggtatttcagacga

SEQ ID NO: 68029 - DNA, 20 bp, Artificial sequence
  SiRNA target sequence
cttttggtatttcagacgag

SEQ ID NO: 68030 - DNA, 20 bp, Artificial sequence
  SiRNA target sequence
ttttggtatttcagacgagg

SEQ ID NO: 68031 - DNA, 20 bp, Artificial sequence
  SiRNA target sequence
tttggtatttcagacgagga

SEQ ID NO: 68032 - DNA, 20 bp, Artificial sequence
  SiRNA target sequence
ttggtatttcagacgaggat

SEQ ID NO: 68033 - DNA, 20 bp, Artificial sequence
  SiRNA target sequence
tggtatttcagacgaggata

SEQ ID NO: 68034 - DNA, 20 bp, Artificial sequence
  SiRNA target sequence
ggtatttcagacgaggatat

SEQ ID NO: 68035 - DNA, 20 bp, Artificial sequence
  SiRNA target sequence
gtatttcagacgaggatatt

SEQ ID NO: 68036 - DNA, 20 bp, Artificial sequence
  SiRNA target sequence
tatttcagacgaggatattt

SEQ ID NO: 68037 - DNA, 20 bp, Artificial sequence
  SiRNA target sequence
atttcagacgaggatatttt

SEQ ID NO: 68038 - DNA, 20 bp, Artificial sequence
  SiRNA target sequence
tttcagacgaggatattttt

SEQ ID NO: 68039 - DNA, 20 bp, Artificial sequence
  SiRNA target sequence
ttcagacgaggatatttttg

SEQ ID NO: 68040 - DNA, 20 bp, Artificial sequence
  SiRNA target sequence
tcagacgaggatatttttgc

SEQ ID NO: 68041 - DNA, 20 bp, Artificial sequence
  SiRNA target sequence
cagacgaggatatttttgca

SEQ ID NO: 68042 - DNA, 20 bp, Artificial sequence
  SiRNA target sequence
agacgaggatatttttgcat

SEQ ID NO: 68043 - DNA, 20 bp, Artificial sequence
  SiRNA target sequence
gacgaggatatttttgcatt

SEQ ID NO: 68044 - DNA, 20 bp, Artificial sequence
  SiRNA target sequence
acgaggatatttttgcattg

SEQ ID NO: 68045 - DNA, 20 bp, Artificial sequence
  SiRNA target sequence
cgaggatatttttgcattgt

SEQ ID NO: 68046 - DNA, 20 bp, Artificial sequence
  SiRNA target sequence
gaggatatttttgcattgtg

SEQ ID NO: 68047 - DNA, 20 bp, Artificial sequence
  SiRNA target sequence
aggatatttttgcattgtgt

SEQ ID NO: 68048 - DNA, 20 bp, Artificial sequence
  SiRNA target sequence
ggatatttttgcattgtgta

SEQ ID NO: 68049 - DNA, 20 bp, Artificial sequence
  SiRNA target sequence
gatatttttgcattgtgtaa

SEQ ID NO: 68050 - DNA, 20 bp, Artificial sequence
  SiRNA target sequence
atatttttgcattgtgtaaa

SEQ ID NO: 68051 - DNA, 20 bp, Artificial sequence
  SiRNA target sequence
tatttttgcattgtgtaaag

SEQ ID NO: 68052 - DNA, 20 bp, Artificial sequence
  SiRNA target sequence
atttttgcattgtgtaaaga

SEQ ID NO: 68053 - DNA, 20 bp, Artificial sequence
  SiRNA target sequence
tttttgcattgtgtaaagag

SEQ ID NO: 68054 - DNA, 20 bp, Artificial sequence
  SiRNA target sequence
ttttgcattgtgtaaagagt

SEQ ID NO: 68055 - DNA, 20 bp, Artificial sequence
  SiRNA target sequence
tttgcattgtgtaaagagtt

SEQ ID NO: 68056 - DNA, 20 bp, Artificial sequence
  SiRNA target sequence
ttgcattgtgtaaagagttt

SEQ ID NO: 68057 - DNA, 20 bp, Artificial sequence
  SiRNA target sequence
tgcattgtgtaaagagtttg

SEQ ID NO: 68058 - DNA, 20 bp, Artificial sequence
  SiRNA target sequence
gcattgtgtaaagagtttgg

SEQ ID NO: 68059 - DNA, 20 bp, Artificial sequence
  SiRNA target sequence
cattgtgtaaagagtttgga

SEQ ID NO: 68060 - DNA, 20 bp, Artificial sequence
  SiRNA target sequence
attgtgtaaagagtttggat

SEQ ID NO: 68061 - DNA, 20 bp, Artificial sequence
  SiRNA target sequence
ttgtgtaaagagtttggatt

SEQ ID NO: 68062 - DNA, 20 bp, Artificial sequence
  SiRNA target sequence
tgtgtaaagagtttggatta

SEQ ID NO: 68063 - DNA, 20 bp, Artificial sequence
  SiRNA target sequence
gtgtaaagagtttggattat

SEQ ID NO: 68064 - DNA, 20 bp, Artificial sequence
  SiRNA target sequence
tgtaaagagtttggattata

SEQ ID NO: 68065 - DNA, 20 bp, Artificial sequence
  SiRNA target sequence
gtaaagagtttggattatat

SEQ ID NO: 68066 - DNA, 20 bp, Artificial sequence
  SiRNA target sequence
taaagagtttggattatatg

SEQ ID NO: 68067 - DNA, 20 bp, Artificial sequence
  SiRNA target sequence
aaagagtttggattatatga

SEQ ID NO: 68068 - DNA, 20 bp, Artificial sequence
  SiRNA target sequence
aagagtttggattatatgac

SEQ ID NO: 68069 - DNA, 20 bp, Artificial sequence
  SiRNA target sequence
agagtttggattatatgacg

SEQ ID NO: 68070 - DNA, 20 bp, Artificial sequence
  SiRNA target sequence
gagtttggattatatgacgt

SEQ ID NO: 68071 - DNA, 20 bp, Artificial sequence
  SiRNA target sequence
agtttggattatatgacgtt

SEQ ID NO: 68072 - DNA, 20 bp, Artificial sequence
  SiRNA target sequence
gtttggattatatgacgttt

SEQ ID NO: 68073 - DNA, 20 bp, Artificial sequence
  SiRNA target sequence
tttggattatatgacgtttt

SEQ ID NO: 68074 - DNA, 20 bp, Artificial sequence
  SiRNA target sequence
ttggattatatgacgttttc

SEQ ID NO: 68075 - DNA, 20 bp, Artificial sequence
  SiRNA target sequence
tggattatatgacgttttca

SEQ ID NO: 68076 - DNA, 20 bp, Artificial sequence
  SiRNA target sequence
ggattatatgacgttttcat

SEQ ID NO: 68077 - DNA, 20 bp, Artificial sequence
  SiRNA target sequence
gattatatgacgttttcatg

SEQ ID NO: 68078 - DNA, 20 bp, Artificial sequence
  SiRNA target sequence
attatatgacgttttcatga

SEQ ID NO: 68079 - DNA, 20 bp, Artificial sequence
  SiRNA target sequence
ttatatgacgttttcatgaa

SEQ ID NO: 68080 - DNA, 20 bp, Artificial sequence
  SiRNA target sequence
tatatgacgttttcatgaac

SEQ ID NO: 68081 - DNA, 20 bp, Artificial sequence
  SiRNA target sequence
atatgacgttttcatgaacc

SEQ ID NO: 68082 - DNA, 20 bp, Artificial sequence
  SiRNA target sequence
tatgacgttttcatgaacct

SEQ ID NO: 68083 - DNA, 20 bp, Artificial sequence
  SiRNA target sequence
atgacgttttcatgaacctc

SEQ ID NO: 68084 - DNA, 20 bp, Artificial sequence
  SiRNA target sequence
tgacgttttcatgaacctcg

SEQ ID NO: 68085 - DNA, 20 bp, Artificial sequence
  SiRNA target sequence
gacgttttcatgaacctcga

SEQ ID NO: 68086 - DNA, 20 bp, Artificial sequence
  SiRNA target sequence
acgttttcatgaacctcgaa

SEQ ID NO: 68087 - DNA, 20 bp, Artificial sequence
  SiRNA target sequence
cgttttcatgaacctcgaaa

SEQ ID NO: 68088 - DNA, 20 bp, Artificial sequence
  SiRNA target sequence
gttttcatgaacctcgaaaa

SEQ ID NO: 68089 - DNA, 20 bp, Artificial sequence
  SiRNA target sequence
ttttcatgaacctcgaaaat

SEQ ID NO: 68090 - DNA, 20 bp, Artificial sequence
  SiRNA target sequence
tttcatgaacctcgaaaatg

SEQ ID NO: 68091 - DNA, 20 bp, Artificial sequence
  SiRNA target sequence
ttcatgaacctcgaaaatgg

SEQ ID NO: 68092 - DNA, 20 bp, Artificial sequence
  SiRNA target sequence
tcatgaacctcgaaaatggt

SEQ ID NO: 68093 - DNA, 20 bp, Artificial sequence
  SiRNA target sequence
catgaacctcgaaaatggtt

SEQ ID NO: 68094 - DNA, 20 bp, Artificial sequence
  SiRNA target sequence
atgaacctcgaaaatggttt

SEQ ID NO: 68095 - DNA, 20 bp, Artificial sequence
  SiRNA target sequence
tgaacctcgaaaatggtttt

SEQ ID NO: 68096 - DNA, 20 bp, Artificial sequence
  SiRNA target sequence
gaacctcgaaaatggttttg

SEQ ID NO: 68097 - DNA, 20 bp, Artificial sequence
  SiRNA target sequence
aacctcgaaaatggttttga

SEQ ID NO: 68098 - DNA, 20 bp, Artificial sequence
  SiRNA target sequence
acctcgaaaatggttttgat

SEQ ID NO: 68099 - DNA, 20 bp, Artificial sequence
  SiRNA target sequence
cctcgaaaatggttttgata

SEQ ID NO: 68100 - DNA, 20 bp, Artificial sequence
  SiRNA target sequence
ctcgaaaatggttttgatac

SEQ ID NO: 68101 - DNA, 20 bp, Artificial sequence
  SiRNA target sequence
tcgaaaatggttttgatacg

SEQ ID NO: 68102 - DNA, 20 bp, Artificial sequence
  SiRNA target sequence
cgaaaatggttttgatacga

SEQ ID NO: 68103 - DNA, 20 bp, Artificial sequence
  SiRNA target sequence
gaaaatggttttgatacgaa

SEQ ID NO: 68104 - DNA, 20 bp, Artificial sequence
  SiRNA target sequence
aaaatggttttgatacgaat

SEQ ID NO: 68105 - DNA, 20 bp, Artificial sequence
  SiRNA target sequence
aaatggttttgatacgaatg

SEQ ID NO: 68106 - DNA, 20 bp, Artificial sequence
  SiRNA target sequence
aatggttttgatacgaatgt

SEQ ID NO: 68107 - DNA, 20 bp, Artificial sequence
  SiRNA target sequence
atggttttgatacgaatgta

SEQ ID NO: 68108 - DNA, 20 bp, Artificial sequence
  SiRNA target sequence
tggttttgatacgaatgtag

SEQ ID NO: 68109 - DNA, 20 bp, Artificial sequence
  SiRNA target sequence
ggttttgatacgaatgtagg

SEQ ID NO: 68110 - DNA, 20 bp, Artificial sequence
  SiRNA target sequence
gttttgatacgaatgtagga

SEQ ID NO: 68111 - DNA, 20 bp, Artificial sequence
  SiRNA target sequence
ttttgatacgaatgtaggag

SEQ ID NO: 68112 - DNA, 20 bp, Artificial sequence
  SiRNA target sequence
tttgatacgaatgtaggaga

SEQ ID NO: 68113 - DNA, 20 bp, Artificial sequence
  SiRNA target sequence
ttgatacgaatgtaggagaa

SEQ ID NO: 68114 - DNA, 20 bp, Artificial sequence
  SiRNA target sequence
tgatacgaatgtaggagaaa

SEQ ID NO: 68115 - DNA, 20 bp, Artificial sequence
  SiRNA target sequence
gatacgaatgtaggagaaag

SEQ ID NO: 68116 - DNA, 20 bp, Artificial sequence
  SiRNA target sequence
atacgaatgtaggagaaaga

SEQ ID NO: 68117 - DNA, 20 bp, Artificial sequence
  SiRNA target sequence
tacgaatgtaggagaaagag

SEQ ID NO: 68118 - DNA, 20 bp, Artificial sequence
  SiRNA target sequence
acgaatgtaggagaaagagg

SEQ ID NO: 68119 - DNA, 20 bp, Artificial sequence
  SiRNA target sequence
cgaatgtaggagaaagagga

SEQ ID NO: 68120 - DNA, 20 bp, Artificial sequence
  SiRNA target sequence
gaatgtaggagaaagaggaa

SEQ ID NO: 68121 - DNA, 20 bp, Artificial sequence
  SiRNA target sequence
aatgtaggagaaagaggaag

SEQ ID NO: 68122 - DNA, 20 bp, Artificial sequence
  SiRNA target sequence
atgtaggagaaagaggaagg

SEQ ID NO: 68123 - DNA, 20 bp, Artificial sequence
  SiRNA target sequence
tgtaggagaaagaggaaggt

SEQ ID NO: 68124 - DNA, 20 bp, Artificial sequence
  SiRNA target sequence
gtaggagaaagaggaaggtt

SEQ ID NO: 68125 - DNA, 20 bp, Artificial sequence
  SiRNA target sequence
taggagaaagaggaaggtta

SEQ ID NO: 68126 - DNA, 20 bp, Artificial sequence
  SiRNA target sequence
aggagaaagaggaaggttat

SEQ ID NO: 68127 - DNA, 20 bp, Artificial sequence
  SiRNA target sequence
ggagaaagaggaaggttatt

SEQ ID NO: 68128 - DNA, 20 bp, Artificial sequence
  SiRNA target sequence
gagaaagaggaaggttatta

SEQ ID NO: 68129 - DNA, 20 bp, Artificial sequence
  SiRNA target sequence
agaaagaggaaggttattaa

SEQ ID NO: 68130 - DNA, 20 bp, Artificial sequence
  SiRNA target sequence
gaaagaggaaggttattaag

SEQ ID NO: 68131 - DNA, 20 bp, Artificial sequence
  SiRNA target sequence
aaagaggaaggttattaagt

SEQ ID NO: 68132 - DNA, 20 bp, Artificial sequence
  SiRNA target sequence
aagaggaaggttattaagtg

SEQ ID NO: 68133 - DNA, 20 bp, Artificial sequence
  SiRNA target sequence
agaggaaggttattaagtgg

SEQ ID NO: 68134 - DNA, 20 bp, Artificial sequence
  SiRNA target sequence
gaggaaggttattaagtggt

SEQ ID NO: 68135 - DNA, 20 bp, Artificial sequence
  SiRNA target sequence
aggaaggttattaagtggtg

SEQ ID NO: 68136 - DNA, 20 bp, Artificial sequence
  SiRNA target sequence
ggaaggttattaagtggtgg

SEQ ID NO: 68137 - DNA, 20 bp, Artificial sequence
  SiRNA target sequence
gaaggttattaagtggtgga

SEQ ID NO: 68138 - DNA, 20 bp, Artificial sequence
  SiRNA target sequence
aaggttattaagtggtggag

SEQ ID NO: 68139 - DNA, 20 bp, Artificial sequence
  SiRNA target sequence
aggttattaagtggtggaga

SEQ ID NO: 68140 - DNA, 20 bp, Artificial sequence
  SiRNA target sequence
ggttattaagtggtggagaa

SEQ ID NO: 68141 - DNA, 20 bp, Artificial sequence
  SiRNA target sequence
gttattaagtggtggagaaa

SEQ ID NO: 68142 - DNA, 20 bp, Artificial sequence
  SiRNA target sequence
ttattaagtggtggagaaaa

SEQ ID NO: 68143 - DNA, 20 bp, Artificial sequence
  SiRNA target sequence
tattaagtggtggagaaaag

SEQ ID NO: 68144 - DNA, 20 bp, Artificial sequence
  SiRNA target sequence
attaagtggtggagaaaagc

SEQ ID NO: 68145 - DNA, 20 bp, Artificial sequence
  SiRNA target sequence
ttaagtggtggagaaaagca

SEQ ID NO: 68146 - DNA, 20 bp, Artificial sequence
  SiRNA target sequence
taagtggtggagaaaagcaa

SEQ ID NO: 68147 - DNA, 20 bp, Artificial sequence
  SiRNA target sequence
aagtggtggagaaaagcaaa

SEQ ID NO: 68148 - DNA, 20 bp, Artificial sequence
  SiRNA target sequence
agtggtggagaaaagcaaaa

SEQ ID NO: 68149 - DNA, 20 bp, Artificial sequence
  SiRNA target sequence
gtggtggagaaaagcaaaag

SEQ ID NO: 68150 - DNA, 20 bp, Artificial sequence
  SiRNA target sequence
tggtggagaaaagcaaaaga

SEQ ID NO: 68151 - DNA, 20 bp, Artificial sequence
  SiRNA target sequence
ggtggagaaaagcaaaagat

SEQ ID NO: 68152 - DNA, 20 bp, Artificial sequence
  SiRNA target sequence
gtggagaaaagcaaaagatt

SEQ ID NO: 68153 - DNA, 20 bp, Artificial sequence
  SiRNA target sequence
tggagaaaagcaaaagattt

SEQ ID NO: 68154 - DNA, 20 bp, Artificial sequence
  SiRNA target sequence
ggagaaaagcaaaagatttt

SEQ ID NO: 68155 - DNA, 20 bp, Artificial sequence
  SiRNA target sequence
gagaaaagcaaaagatttta

SEQ ID NO: 68156 - DNA, 20 bp, Artificial sequence
  SiRNA target sequence
agaaaagcaaaagattttat

SEQ ID NO: 68157 - DNA, 20 bp, Artificial sequence
  SiRNA target sequence
gaaaagcaaaagattttatt

SEQ ID NO: 68158 - DNA, 20 bp, Artificial sequence
  SiRNA target sequence
aaaagcaaaagattttatta

SEQ ID NO: 68159 - DNA, 20 bp, Artificial sequence
  SiRNA target sequence
aaagcaaaagattttattaa

SEQ ID NO: 68160 - DNA, 20 bp, Artificial sequence
  SiRNA target sequence
aagcaaaagattttattaat

SEQ ID NO: 68161 - DNA, 20 bp, Artificial sequence
  SiRNA target sequence
agcaaaagattttattaatg

SEQ ID NO: 68162 - DNA, 20 bp, Artificial sequence
  SiRNA target sequence
gcaaaagattttattaatgc

SEQ ID NO: 68163 - DNA, 20 bp, Artificial sequence
  SiRNA target sequence
caaaagattttattaatgcg

SEQ ID NO: 68164 - DNA, 20 bp, Artificial sequence
  SiRNA target sequence
aaaagattttattaatgcgt

SEQ ID NO: 68165 - DNA, 20 bp, Artificial sequence
  SiRNA target sequence
aaagattttattaatgcgta

SEQ ID NO: 68166 - DNA, 20 bp, Artificial sequence
  SiRNA target sequence
aagattttattaatgcgtac

SEQ ID NO: 68167 - DNA, 20 bp, Artificial sequence
  SiRNA target sequence
agattttattaatgcgtact

SEQ ID NO: 68168 - DNA, 20 bp, Artificial sequence
  SiRNA target sequence
gattttattaatgcgtacta

SEQ ID NO: 68169 - DNA, 20 bp, Artificial sequence
  SiRNA target sequence
attttattaatgcgtactat

SEQ ID NO: 68170 - DNA, 20 bp, Artificial sequence
  SiRNA target sequence
ttttattaatgcgtactatg

SEQ ID NO: 68171 - DNA, 20 bp, Artificial sequence
  SiRNA target sequence
tttattaatgcgtactatgt

SEQ ID NO: 68172 - DNA, 20 bp, Artificial sequence
  SiRNA target sequence
ttattaatgcgtactatgtt

SEQ ID NO: 68173 - DNA, 20 bp, Artificial sequence
  SiRNA target sequence
tattaatgcgtactatgtta

SEQ ID NO: 68174 - DNA, 20 bp, Artificial sequence
  SiRNA target sequence
attaatgcgtactatgttaa

SEQ ID NO: 68175 - DNA, 20 bp, Artificial sequence
  SiRNA target sequence
ttaatgcgtactatgttaag

SEQ ID NO: 68176 - DNA, 20 bp, Artificial sequence
  SiRNA target sequence
taatgcgtactatgttaaga

SEQ ID NO: 68177 - DNA, 20 bp, Artificial sequence
  SiRNA target sequence
aatgcgtactatgttaagaa

SEQ ID NO: 68178 - DNA, 20 bp, Artificial sequence
  SiRNA target sequence
atgcgtactatgttaagaaa

SEQ ID NO: 68179 - DNA, 20 bp, Artificial sequence
  SiRNA target sequence
tgcgtactatgttaagaaac

SEQ ID NO: 68180 - DNA, 20 bp, Artificial sequence
  SiRNA target sequence
gcgtactatgttaagaaaca

SEQ ID NO: 68181 - DNA, 20 bp, Artificial sequence
  SiRNA target sequence
cgtactatgttaagaaacaa

SEQ ID NO: 68182 - DNA, 20 bp, Artificial sequence
  SiRNA target sequence
gtactatgttaagaaacaag

SEQ ID NO: 68183 - DNA, 20 bp, Artificial sequence
  SiRNA target sequence
tactatgttaagaaacaagg

SEQ ID NO: 68184 - DNA, 20 bp, Artificial sequence
  SiRNA target sequence
actatgttaagaaacaagga

SEQ ID NO: 68185 - DNA, 20 bp, Artificial sequence
  SiRNA target sequence
ctatgttaagaaacaaggag

SEQ ID NO: 68186 - DNA, 20 bp, Artificial sequence
  SiRNA target sequence
tatgttaagaaacaaggaga

SEQ ID NO: 68187 - DNA, 20 bp, Artificial sequence
  SiRNA target sequence
atgttaagaaacaaggagat

SEQ ID NO: 68188 - DNA, 20 bp, Artificial sequence
  SiRNA target sequence
tgttaagaaacaaggagata

SEQ ID NO: 68189 - DNA, 20 bp, Artificial sequence
  SiRNA target sequence
gttaagaaacaaggagataa

SEQ ID NO: 68190 - DNA, 20 bp, Artificial sequence
  SiRNA target sequence
ttaagaaacaaggagataat

SEQ ID NO: 68191 - DNA, 20 bp, Artificial sequence
  SiRNA target sequence
taagaaacaaggagataatg

SEQ ID NO: 68192 - DNA, 20 bp, Artificial sequence
  SiRNA target sequence
aagaaacaaggagataatgg

SEQ ID NO: 68193 - DNA, 20 bp, Artificial sequence
  SiRNA target sequence
agaaacaaggagataatggc

SEQ ID NO: 68194 - DNA, 20 bp, Artificial sequence
  SiRNA target sequence
gaaacaaggagataatggca

SEQ ID NO: 68195 - DNA, 20 bp, Artificial sequence
  SiRNA target sequence
aaacaaggagataatggcat

SEQ ID NO: 68196 - DNA, 20 bp, Artificial sequence
  SiRNA target sequence
aacaaggagataatggcatt

SEQ ID NO: 68197 - DNA, 20 bp, Artificial sequence
  SiRNA target sequence
acaaggagataatggcatta

SEQ ID NO: 68198 - DNA, 20 bp, Artificial sequence
  SiRNA target sequence
caaggagataatggcattag

SEQ ID NO: 68199 - DNA, 20 bp, Artificial sequence
  SiRNA target sequence
aaggagataatggcattaga

SEQ ID NO: 68200 - DNA, 20 bp, Artificial sequence
  SiRNA target sequence
aggagataatggcattagat

SEQ ID NO: 68201 - DNA, 20 bp, Artificial sequence
  SiRNA target sequence
ggagataatggcattagatg

SEQ ID NO: 68202 - DNA, 20 bp, Artificial sequence
  SiRNA target sequence
gagataatggcattagatga

SEQ ID NO: 68203 - DNA, 20 bp, Artificial sequence
  SiRNA target sequence
agataatggcattagatgaa

SEQ ID NO: 68204 - DNA, 20 bp, Artificial sequence
  SiRNA target sequence
gataatggcattagatgaac

SEQ ID NO: 68205 - DNA, 20 bp, Artificial sequence
  SiRNA target sequence
ataatggcattagatgaacc

SEQ ID NO: 68206 - DNA, 20 bp, Artificial sequence
  SiRNA target sequence
taatggcattagatgaaccc

SEQ ID NO: 68207 - DNA, 20 bp, Artificial sequence
  SiRNA target sequence
aatggcattagatgaaccca

SEQ ID NO: 68208 - DNA, 20 bp, Artificial sequence
  SiRNA target sequence
atggcattagatgaacccac

SEQ ID NO: 68209 - DNA, 20 bp, Artificial sequence
  SiRNA target sequence
tggcattagatgaacccact

SEQ ID NO: 68210 - DNA, 20 bp, Artificial sequence
  SiRNA target sequence
ggcattagatgaacccactg

SEQ ID NO: 68211 - DNA, 20 bp, Artificial sequence
  SiRNA target sequence
gcattagatgaacccactgc

SEQ ID NO: 68212 - DNA, 20 bp, Artificial sequence
  SiRNA target sequence
cattagatgaacccactgca

SEQ ID NO: 68213 - DNA, 20 bp, Artificial sequence
  SiRNA target sequence
attagatgaacccactgcag

SEQ ID NO: 68214 - DNA, 20 bp, Artificial sequence
  SiRNA target sequence
ttagatgaacccactgcagc

SEQ ID NO: 68215 - DNA, 20 bp, Artificial sequence
  SiRNA target sequence
tagatgaacccactgcagca

SEQ ID NO: 68216 - DNA, 20 bp, Artificial sequence
  SiRNA target sequence
agatgaacccactgcagcac

SEQ ID NO: 68217 - DNA, 20 bp, Artificial sequence
  SiRNA target sequence
gatgaacccactgcagcact

SEQ ID NO: 68218 - DNA, 20 bp, Artificial sequence
  SiRNA target sequence
atgaacccactgcagcactt

SEQ ID NO: 68219 - DNA, 20 bp, Artificial sequence
  SiRNA target sequence
tgaacccactgcagcacttg

SEQ ID NO: 68220 - DNA, 20 bp, Artificial sequence
  SiRNA target sequence
gaacccactgcagcacttga

SEQ ID NO: 68221 - DNA, 20 bp, Artificial sequence
  SiRNA target sequence
aacccactgcagcacttgat

SEQ ID NO: 68222 - DNA, 20 bp, Artificial sequence
  SiRNA target sequence
acccactgcagcacttgata

SEQ ID NO: 68223 - DNA, 20 bp, Artificial sequence
  SiRNA target sequence
cccactgcagcacttgataa

SEQ ID NO: 68224 - DNA, 20 bp, Artificial sequence
  SiRNA target sequence
ccactgcagcacttgataag

SEQ ID NO: 68225 - DNA, 20 bp, Artificial sequence
  SiRNA target sequence
cactgcagcacttgataagg

SEQ ID NO: 68226 - DNA, 20 bp, Artificial sequence
  SiRNA target sequence
actgcagcacttgataagga

SEQ ID NO: 68227 - DNA, 20 bp, Artificial sequence
  SiRNA target sequence
ctgcagcacttgataaggag

SEQ ID NO: 68228 - DNA, 20 bp, Artificial sequence
  SiRNA target sequence
tgcagcacttgataaggagt

SEQ ID NO: 68229 - DNA, 20 bp, Artificial sequence
  SiRNA target sequence
gcagcacttgataaggagtc

SEQ ID NO: 68230 - DNA, 20 bp, Artificial sequence
  SiRNA target sequence
cagcacttgataaggagtct

SEQ ID NO: 68231 - DNA, 20 bp, Artificial sequence
  SiRNA target sequence
agcacttgataaggagtctg

SEQ ID NO: 68232 - DNA, 20 bp, Artificial sequence
  SiRNA target sequence
gcacttgataaggagtctga

SEQ ID NO: 68233 - DNA, 20 bp, Artificial sequence
  SiRNA target sequence
cacttgataaggagtctgaa

SEQ ID NO: 68234 - DNA, 20 bp, Artificial sequence
  SiRNA target sequence
acttgataaggagtctgaaa

SEQ ID NO: 68235 - DNA, 20 bp, Artificial sequence
  SiRNA target sequence
cttgataaggagtctgaaaa

SEQ ID NO: 68236 - DNA, 20 bp, Artificial sequence
  SiRNA target sequence
ttgataaggagtctgaaaaa

SEQ ID NO: 68237 - DNA, 20 bp, Artificial sequence
  SiRNA target sequence
tgataaggagtctgaaaaaa

SEQ ID NO: 68238 - DNA, 20 bp, Artificial sequence
  SiRNA target sequence
gataaggagtctgaaaaaaa

SEQ ID NO: 68239 - DNA, 20 bp, Artificial sequence
  SiRNA target sequence
ataaggagtctgaaaaaaag

SEQ ID NO: 68240 - DNA, 20 bp, Artificial sequence
  SiRNA target sequence
taaggagtctgaaaaaaaga

SEQ ID NO: 68241 - DNA, 20 bp, Artificial sequence
  SiRNA target sequence
aaggagtctgaaaaaaagat

SEQ ID NO: 68242 - DNA, 20 bp, Artificial sequence
  SiRNA target sequence
aggagtctgaaaaaaagatt

SEQ ID NO: 68243 - DNA, 20 bp, Artificial sequence
  SiRNA target sequence
ggagtctgaaaaaaagattt

SEQ ID NO: 68244 - DNA, 20 bp, Artificial sequence
  SiRNA target sequence
gagtctgaaaaaaagatttt

SEQ ID NO: 68245 - DNA, 20 bp, Artificial sequence
  SiRNA target sequence
agtctgaaaaaaagatttta

SEQ ID NO: 68246 - DNA, 20 bp, Artificial sequence
  SiRNA target sequence
gtctgaaaaaaagattttag

SEQ ID NO: 68247 - DNA, 20 bp, Artificial sequence
  SiRNA target sequence
tctgaaaaaaagattttaga

SEQ ID NO: 68248 - DNA, 20 bp, Artificial sequence
  SiRNA target sequence
ctgaaaaaaagattttagag

SEQ ID NO: 68249 - DNA, 20 bp, Artificial sequence
  SiRNA target sequence
tgaaaaaaagattttagaga

SEQ ID NO: 68250 - DNA, 20 bp, Artificial sequence
  SiRNA target sequence
gaaaaaaagattttagagat

SEQ ID NO: 68251 - DNA, 20 bp, Artificial sequence
  SiRNA target sequence
aaaaaaagattttagagata

SEQ ID NO: 68252 - DNA, 20 bp, Artificial sequence
  SiRNA target sequence
aaaaaagattttagagataa

SEQ ID NO: 68253 - DNA, 20 bp, Artificial sequence
  SiRNA target sequence
aaaaagattttagagataat

SEQ ID NO: 68254 - DNA, 20 bp, Artificial sequence
  SiRNA target sequence
aaaagattttagagataatt

SEQ ID NO: 68255 - DNA, 20 bp, Artificial sequence
  SiRNA target sequence
aaagattttagagataattt

SEQ ID NO: 68256 - DNA, 20 bp, Artificial sequence
  SiRNA target sequence
aagattttagagataatttt

SEQ ID NO: 68257 - DNA, 20 bp, Artificial sequence
  SiRNA target sequence
agattttagagataatttta

SEQ ID NO: 68258 - DNA, 20 bp, Artificial sequence
  SiRNA target sequence
gattttagagataattttac

SEQ ID NO: 68259 - DNA, 20 bp, Artificial sequence
  SiRNA target sequence
attttagagataattttaca

SEQ ID NO: 68260 - DNA, 20 bp, Artificial sequence
  SiRNA target sequence
ttttagagataattttacaa

SEQ ID NO: 68261 - DNA, 20 bp, Artificial sequence
  SiRNA target sequence
tttagagataattttacaac

SEQ ID NO: 68262 - DNA, 20 bp, Artificial sequence
  SiRNA target sequence
ttagagataattttacaaca

SEQ ID NO: 68263 - DNA, 20 bp, Artificial sequence
  SiRNA target sequence
tagagataattttacaacag

SEQ ID NO: 68264 - DNA, 20 bp, Artificial sequence
  SiRNA target sequence
agagataattttacaacagg

SEQ ID NO: 68265 - DNA, 20 bp, Artificial sequence
  SiRNA target sequence
gagataattttacaacagga

SEQ ID NO: 68266 - DNA, 20 bp, Artificial sequence
  SiRNA target sequence
agataattttacaacaggaa

SEQ ID NO: 68267 - DNA, 20 bp, Artificial sequence
  SiRNA target sequence
gataattttacaacaggaag

SEQ ID NO: 68268 - DNA, 20 bp, Artificial sequence
  SiRNA target sequence
ataattttacaacaggaaga

SEQ ID NO: 68269 - DNA, 20 bp, Artificial sequence
  SiRNA target sequence
taattttacaacaggaagat

SEQ ID NO: 68270 - DNA, 20 bp, Artificial sequence
  SiRNA target sequence
aattttacaacaggaagatc

SEQ ID NO: 68271 - DNA, 20 bp, Artificial sequence
  SiRNA target sequence
attttacaacaggaagatcg

SEQ ID NO: 68272 - DNA, 20 bp, Artificial sequence
  SiRNA target sequence
ttttacaacaggaagatcga

SEQ ID NO: 68273 - DNA, 20 bp, Artificial sequence
  SiRNA target sequence
tttacaacaggaagatcgaa

SEQ ID NO: 68274 - DNA, 20 bp, Artificial sequence
  SiRNA target sequence
ttacaacaggaagatcgaac

SEQ ID NO: 68275 - DNA, 20 bp, Artificial sequence
  SiRNA target sequence
tacaacaggaagatcgaaca

SEQ ID NO: 68276 - DNA, 20 bp, Artificial sequence
  SiRNA target sequence
acaacaggaagatcgaacag

SEQ ID NO: 68277 - DNA, 20 bp, Artificial sequence
  SiRNA target sequence
caacaggaagatcgaacagt

SEQ ID NO: 68278 - DNA, 20 bp, Artificial sequence
  SiRNA target sequence
aacaggaagatcgaacagtt

SEQ ID NO: 68279 - DNA, 20 bp, Artificial sequence
  SiRNA target sequence
acaggaagatcgaacagttt

SEQ ID NO: 68280 - DNA, 20 bp, Artificial sequence
  SiRNA target sequence
caggaagatcgaacagtttt

SEQ ID NO: 68281 - DNA, 20 bp, Artificial sequence
  SiRNA target sequence
aggaagatcgaacagttttg

SEQ ID NO: 68282 - DNA, 20 bp, Artificial sequence
  SiRNA target sequence
ggaagatcgaacagttttga

SEQ ID NO: 68283 - DNA, 20 bp, Artificial sequence
  SiRNA target sequence
gaagatcgaacagttttgat

SEQ ID NO: 68284 - DNA, 20 bp, Artificial sequence
  SiRNA target sequence
aagatcgaacagttttgatg

SEQ ID NO: 68285 - DNA, 20 bp, Artificial sequence
  SiRNA target sequence
agatcgaacagttttgatga

SEQ ID NO: 68286 - DNA, 20 bp, Artificial sequence
  SiRNA target sequence
gatcgaacagttttgatgat

SEQ ID NO: 68287 - DNA, 20 bp, Artificial sequence
  SiRNA target sequence
atcgaacagttttgatgata

SEQ ID NO: 68288 - DNA, 20 bp, Artificial sequence
  SiRNA target sequence
tcgaacagttttgatgataa

SEQ ID NO: 68289 - DNA, 20 bp, Artificial sequence
  SiRNA target sequence
cgaacagttttgatgataat

SEQ ID NO: 68290 - DNA, 20 bp, Artificial sequence
  SiRNA target sequence
gaacagttttgatgataatt

SEQ ID NO: 68291 - DNA, 20 bp, Artificial sequence
  SiRNA target sequence
aacagttttgatgataattc

SEQ ID NO: 68292 - DNA, 20 bp, Artificial sequence
  SiRNA target sequence
acagttttgatgataattca

SEQ ID NO: 68293 - DNA, 20 bp, Artificial sequence
  SiRNA target sequence
cagttttgatgataattcat

SEQ ID NO: 68294 - DNA, 20 bp, Artificial sequence
  SiRNA target sequence
agttttgatgataattcata

SEQ ID NO: 68295 - DNA, 20 bp, Artificial sequence
  SiRNA target sequence
gttttgatgataattcataa

SEQ ID NO: 68296 - DNA, 20 bp, Artificial sequence
  SiRNA target sequence
ttttgatgataattcataat

SEQ ID NO: 68297 - DNA, 20 bp, Artificial sequence
  SiRNA target sequence
tttgatgataattcataatc

SEQ ID NO: 68298 - DNA, 20 bp, Artificial sequence
  SiRNA target sequence
ttgatgataattcataatct

SEQ ID NO: 68299 - DNA, 20 bp, Artificial sequence
  SiRNA target sequence
tgatgataattcataatcta

SEQ ID NO: 68300 - DNA, 20 bp, Artificial sequence
  SiRNA target sequence
gatgataattcataatctag

SEQ ID NO: 68301 - DNA, 20 bp, Artificial sequence
  SiRNA target sequence
atgataattcataatctaga

SEQ ID NO: 68302 - DNA, 20 bp, Artificial sequence
  SiRNA target sequence
tgataattcataatctagaa

SEQ ID NO: 68303 - DNA, 20 bp, Artificial sequence
  SiRNA target sequence
gataattcataatctagaac

SEQ ID NO: 68304 - DNA, 20 bp, Artificial sequence
  SiRNA target sequence
ataattcataatctagaact

SEQ ID NO: 68305 - DNA, 20 bp, Artificial sequence
  SiRNA target sequence
taattcataatctagaactt

SEQ ID NO: 68306 - DNA, 20 bp, Artificial sequence
  SiRNA target sequence
aattcataatctagaactta

SEQ ID NO: 68307 - DNA, 20 bp, Artificial sequence
  SiRNA target sequence
attcataatctagaacttat

SEQ ID NO: 68308 - DNA, 20 bp, Artificial sequence
  SiRNA target sequence
ttcataatctagaacttatt

SEQ ID NO: 68309 - DNA, 20 bp, Artificial sequence
  SiRNA target sequence
tcataatctagaacttatta

SEQ ID NO: 68310 - DNA, 20 bp, Artificial sequence
  SiRNA target sequence
cataatctagaacttattaa

SEQ ID NO: 68311 - DNA, 20 bp, Artificial sequence
  SiRNA target sequence
ataatctagaacttattaat

SEQ ID NO: 68312 - DNA, 20 bp, Artificial sequence
  SiRNA target sequence
taatctagaacttattaata

SEQ ID NO: 68313 - DNA, 20 bp, Artificial sequence
  SiRNA target sequence
aatctagaacttattaataa

SEQ ID NO: 68314 - DNA, 20 bp, Artificial sequence
  SiRNA target sequence
atctagaacttattaataaa

SEQ ID NO: 68315 - DNA, 20 bp, Artificial sequence
  SiRNA target sequence
tctagaacttattaataaat

SEQ ID NO: 68316 - DNA, 20 bp, Artificial sequence
  SiRNA target sequence
ctagaacttattaataaatt

SEQ ID NO: 68317 - DNA, 20 bp, Artificial sequence
  SiRNA target sequence
tagaacttattaataaattt

SEQ ID NO: 68318 - DNA, 20 bp, Artificial sequence
  SiRNA target sequence
agaacttattaataaatttg

SEQ ID NO: 68319 - DNA, 20 bp, Artificial sequence
  SiRNA target sequence
gaacttattaataaatttga

SEQ ID NO: 68320 - DNA, 20 bp, Artificial sequence
  SiRNA target sequence
aacttattaataaatttgat

SEQ ID NO: 68321 - DNA, 20 bp, Artificial sequence
  SiRNA target sequence
acttattaataaatttgata

SEQ ID NO: 68322 - DNA, 20 bp, Artificial sequence
  SiRNA target sequence
cttattaataaatttgataa

SEQ ID NO: 68323 - DNA, 20 bp, Artificial sequence
  SiRNA target sequence
ttattaataaatttgataaa

SEQ ID NO: 68324 - DNA, 20 bp, Artificial sequence
  SiRNA target sequence
tattaataaatttgataaaa

SEQ ID NO: 68325 - DNA, 20 bp, Artificial sequence
  SiRNA target sequence
attaataaatttgataaaat

SEQ ID NO: 68326 - DNA, 20 bp, Artificial sequence
  SiRNA target sequence
ttaataaatttgataaaata

SEQ ID NO: 68327 - DNA, 20 bp, Artificial sequence
  SiRNA target sequence
taataaatttgataaaataa

SEQ ID NO: 68328 - DNA, 20 bp, Artificial sequence
  SiRNA target sequence
aataaatttgataaaataat

SEQ ID NO: 68329 - DNA, 20 bp, Artificial sequence
  SiRNA target sequence
ataaatttgataaaataatt

SEQ ID NO: 68330 - DNA, 20 bp, Artificial sequence
  SiRNA target sequence
taaatttgataaaataattt

SEQ ID NO: 68331 - DNA, 20 bp, Artificial sequence
  SiRNA target sequence
aaatttgataaaataattta

SEQ ID NO: 68332 - DNA, 20 bp, Artificial sequence
  SiRNA target sequence
aatttgataaaataatttac

SEQ ID NO: 68333 - DNA, 20 bp, Artificial sequence
  SiRNA target sequence
atttgataaaataatttaca

SEQ ID NO: 68334 - DNA, 20 bp, Artificial sequence
  SiRNA target sequence
tttgataaaataatttacat

SEQ ID NO: 68335 - DNA, 20 bp, Artificial sequence
  SiRNA target sequence
ttgataaaataatttacatt

SEQ ID NO: 68336 - DNA, 20 bp, Artificial sequence
  SiRNA target sequence
tgataaaataatttacattg

SEQ ID NO: 68337 - DNA, 20 bp, Artificial sequence
  SiRNA target sequence
gataaaataatttacattga

SEQ ID NO: 68338 - DNA, 20 bp, Artificial sequence
  SiRNA target sequence
ataaaataatttacattgat

SEQ ID NO: 68339 - DNA, 20 bp, Artificial sequence
  SiRNA target sequence
taaaataatttacattgatg

SEQ ID NO: 68340 - DNA, 20 bp, Artificial sequence
  SiRNA target sequence
aaaataatttacattgatga

SEQ ID NO: 68341 - DNA, 20 bp, Artificial sequence
  SiRNA target sequence
aaataatttacattgatgaa

SEQ ID NO: 68342 - DNA, 20 bp, Artificial sequence
  SiRNA target sequence
aataatttacattgatgaaa

SEQ ID NO: 68343 - DNA, 20 bp, Artificial sequence
  SiRNA target sequence
ataatttacattgatgaaaa

SEQ ID NO: 68344 - DNA, 20 bp, Artificial sequence
  SiRNA target sequence
taatttacattgatgaaaat

SEQ ID NO: 68345 - DNA, 20 bp, Artificial sequence
  SiRNA target sequence
aatttacattgatgaaaata

SEQ ID NO: 68346 - DNA, 20 bp, Artificial sequence
  SiRNA target sequence
atttacattgatgaaaataa

SEQ ID NO: 68347 - DNA, 20 bp, Artificial sequence
  SiRNA target sequence
tttacattgatgaaaataat

SEQ ID NO: 68348 - DNA, 20 bp, Artificial sequence
  SiRNA target sequence
ttacattgatgaaaataata

SEQ ID NO: 68349 - DNA, 20 bp, Artificial sequence
  SiRNA target sequence
tacattgatgaaaataatat

SEQ ID NO: 68350 - DNA, 20 bp, Artificial sequence
  SiRNA target sequence
acattgatgaaaataatata

SEQ ID NO: 68351 - DNA, 20 bp, Artificial sequence
  SiRNA target sequence
cattgatgaaaataatatag

SEQ ID NO: 68352 - DNA, 20 bp, Artificial sequence
  SiRNA target sequence
attgatgaaaataatataga

SEQ ID NO: 68353 - DNA, 20 bp, Artificial sequence
  SiRNA target sequence
ttgatgaaaataatatagaa

SEQ ID NO: 68354 - DNA, 20 bp, Artificial sequence
  SiRNA target sequence
tgatgaaaataatatagaag

SEQ ID NO: 68355 - DNA, 20 bp, Artificial sequence
  SiRNA target sequence
gatgaaaataatatagaagt

SEQ ID NO: 68356 - DNA, 20 bp, Artificial sequence
  SiRNA target sequence
atgaaaataatatagaagtc

SEQ ID NO: 68357 - DNA, 20 bp, Artificial sequence
  SiRNA target sequence
tgaaaataatatagaagtct

SEQ ID NO: 68358 - DNA, 20 bp, Artificial sequence
  SiRNA target sequence
gaaaataatatagaagtcta

SEQ ID NO: 68359 - DNA, 20 bp, Artificial sequence
  SiRNA target sequence
aaaataatatagaagtctat

SEQ ID NO: 68360 - DNA, 20 bp, Artificial sequence
  SiRNA target sequence
aaataatatagaagtctata

SEQ ID NO: 68361 - DNA, 20 bp, Artificial sequence
  SiRNA target sequence
aataatatagaagtctataa

SEQ ID NO: 68362 - DNA, 20 bp, Artificial sequence
  SiRNA target sequence
ataatatagaagtctataaa

SEQ ID NO: 68363 - DNA, 20 bp, Artificial sequence
  SiRNA target sequence
taatatagaagtctataaaa

SEQ ID NO: 68364 - DNA, 20 bp, Artificial sequence
  SiRNA target sequence
aatatagaagtctataaaaa

SEQ ID NO: 68365 - DNA, 20 bp, Artificial sequence
  SiRNA target sequence
atatagaagtctataaaaat

SEQ ID NO: 68366 - DNA, 20 bp, Artificial sequence
  SiRNA target sequence
tatagaagtctataaaaatg

SEQ ID NO: 68367 - DNA, 20 bp, Artificial sequence
  SiRNA target sequence
atagaagtctataaaaatga

SEQ ID NO: 68368 - DNA, 20 bp, Artificial sequence
  SiRNA target sequence
tagaagtctataaaaatgat

SEQ ID NO: 68369 - DNA, 20 bp, Artificial sequence
  SiRNA target sequence
agaagtctataaaaatgata

SEQ ID NO: 68370 - DNA, 20 bp, Artificial sequence
  SiRNA target sequence
gaagtctataaaaatgatat

SEQ ID NO: 68371 - DNA, 20 bp, Artificial sequence
  SiRNA target sequence
aagtctataaaaatgatatt

SEQ ID NO: 68372 - DNA, 20 bp, Artificial sequence
  SiRNA target sequence
agtctataaaaatgatattg

SEQ ID NO: 68373 - DNA, 20 bp, Artificial sequence
  SiRNA target sequence
gtctataaaaatgatattga

SEQ ID NO: 68374 - DNA, 20 bp, Artificial sequence
  SiRNA target sequence
tctataaaaatgatattgaa

SEQ ID NO: 68375 - DNA, 20 bp, Artificial sequence
  SiRNA target sequence
ctataaaaatgatattgaag

SEQ ID NO: 68376 - DNA, 20 bp, Artificial sequence
  SiRNA target sequence
tataaaaatgatattgaagg

SEQ ID NO: 68377 - DNA, 20 bp, Artificial sequence
  SiRNA target sequence
ataaaaatgatattgaagga

SEQ ID NO: 68378 - DNA, 20 bp, Artificial sequence
  SiRNA target sequence
taaaaatgatattgaaggac

SEQ ID NO: 68379 - DNA, 20 bp, Artificial sequence
  SiRNA target sequence
aaaaatgatattgaaggaca

SEQ ID NO: 68380 - DNA, 20 bp, Artificial sequence
  SiRNA target sequence
aaaatgatattgaaggacaa

SEQ ID NO: 68381 - DNA, 20 bp, Artificial sequence
  SiRNA target sequence
aaatgatattgaaggacaaa

SEQ ID NO: 68382 - DNA, 20 bp, Artificial sequence
  SiRNA target sequence
aatgatattgaaggacaaaa

SEQ ID NO: 68383 - DNA, 20 bp, Artificial sequence
  SiRNA target sequence
atgatattgaaggacaaaaa

SEQ ID NO: 68384 - DNA, 20 bp, Artificial sequence
  SiRNA target sequence
tgatattgaaggacaaaaaa

SEQ ID NO: 68385 - DNA, 20 bp, Artificial sequence
  SiRNA target sequence
gatattgaaggacaaaaaaa

SEQ ID NO: 68386 - DNA, 20 bp, Artificial sequence
  SiRNA target sequence
atattgaaggacaaaaaaag

SEQ ID NO: 68387 - DNA, 20 bp, Artificial sequence
  SiRNA target sequence
tattgaaggacaaaaaaagt

SEQ ID NO: 68388 - DNA, 20 bp, Artificial sequence
  SiRNA target sequence
attgaaggacaaaaaaagtt

SEQ ID NO: 68389 - DNA, 20 bp, Artificial sequence
  SiRNA target sequence
ttgaaggacaaaaaaagttt

SEQ ID NO: 68390 - DNA, 20 bp, Artificial sequence
  SiRNA target sequence
tgaaggacaaaaaaagtttt

SEQ ID NO: 68391 - DNA, 20 bp, Artificial sequence
  SiRNA target sequence
gaaggacaaaaaaagttttc

SEQ ID NO: 68392 - DNA, 20 bp, Artificial sequence
  SiRNA target sequence
aaggacaaaaaaagttttct

SEQ ID NO: 68393 - DNA, 20 bp, Artificial sequence
  SiRNA target sequence
aggacaaaaaaagttttcta

SEQ ID NO: 68394 - DNA, 20 bp, Artificial sequence
  SiRNA target sequence
ggacaaaaaaagttttctac

SEQ ID NO: 68395 - DNA, 20 bp, Artificial sequence
  SiRNA target sequence
gacaaaaaaagttttctaca

SEQ ID NO: 68396 - DNA, 20 bp, Artificial sequence
  SiRNA target sequence
acaaaaaaagttttctacaa

SEQ ID NO: 68397 - DNA, 20 bp, Artificial sequence
  SiRNA target sequence
caaaaaaagttttctacaaa

SEQ ID NO: 68398 - DNA, 20 bp, Artificial sequence
  SiRNA target sequence
aaaaaaagttttctacaaat

SEQ ID NO: 68399 - DNA, 20 bp, Artificial sequence
  SiRNA target sequence
aaaaaagttttctacaaatt

SEQ ID NO: 68400 - DNA, 20 bp, Artificial sequence
  SiRNA target sequence
aaaaagttttctacaaattt

SEQ ID NO: 68401 - DNA, 20 bp, Artificial sequence
  SiRNA target sequence
aaaagttttctacaaattta

SEQ ID NO: 68402 - DNA, 20 bp, Artificial sequence
  SiRNA target sequence
aaagttttctacaaatttac

SEQ ID NO: 68403 - DNA, 20 bp, Artificial sequence
  SiRNA target sequence
aagttttctacaaatttaca

SEQ ID NO: 68404 - DNA, 20 bp, Artificial sequence
  SiRNA target sequence
agttttctacaaatttacaa

SEQ ID NO: 68405 - DNA, 20 bp, Artificial sequence
  SiRNA target sequence
gttttctacaaatttacaat

SEQ ID NO: 68406 - DNA, 20 bp, Artificial sequence
  SiRNA target sequence
ttttctacaaatttacaata

SEQ ID NO: 68407 - DNA, 20 bp, Artificial sequence
  SiRNA target sequence
tttctacaaatttacaatat

SEQ ID NO: 68408 - DNA, 20 bp, Artificial sequence
  SiRNA target sequence
ttctacaaatttacaatatt

SEQ ID NO: 68409 - DNA, 20 bp, Artificial sequence
  SiRNA target sequence
tctacaaatttacaatattt

SEQ ID NO: 68410 - DNA, 20 bp, Artificial sequence
  SiRNA target sequence
ctacaaatttacaatatttt

SEQ ID NO: 68411 - DNA, 20 bp, Artificial sequence
  SiRNA target sequence
tacaaatttacaatattttt

SEQ ID NO: 68412 - DNA, 20 bp, Artificial sequence
  SiRNA target sequence
acaaatttacaatatttttt

SEQ ID NO: 68413 - DNA, 20 bp, Artificial sequence
  SiRNA target sequence
caaatttacaatatttttta

SEQ ID NO: 68414 - DNA, 20 bp, Artificial sequence
  SiRNA target sequence
aaatttacaatattttttat

SEQ ID NO: 68415 - DNA, 20 bp, Artificial sequence
  SiRNA target sequence
aatttacaatattttttatc

SEQ ID NO: 68416 - DNA, 20 bp, Artificial sequence
  SiRNA target sequence
atttacaatattttttatca

SEQ ID NO: 68417 - DNA, 20 bp, Artificial sequence
  SiRNA target sequence
tttacaatattttttatcat

SEQ ID NO: 68418 - DNA, 20 bp, Artificial sequence
  SiRNA target sequence
ttacaatattttttatcata

SEQ ID NO: 68419 - DNA, 20 bp, Artificial sequence
  SiRNA target sequence
tacaatattttttatcatac

SEQ ID NO: 68420 - DNA, 20 bp, Artificial sequence
  SiRNA target sequence
acaatattttttatcataca

SEQ ID NO: 68421 - DNA, 20 bp, Artificial sequence
  SiRNA target sequence
caatattttttatcatacaa

SEQ ID NO: 68422 - DNA, 20 bp, Artificial sequence
  SiRNA target sequence
aatattttttatcatacaaa

SEQ ID NO: 68423 - DNA, 20 bp, Artificial sequence
  SiRNA target sequence
atattttttatcatacaaat

SEQ ID NO: 68424 - DNA, 20 bp, Artificial sequence
  SiRNA target sequence
tattttttatcatacaaatt

SEQ ID NO: 68425 - DNA, 20 bp, Artificial sequence
  SiRNA target sequence
attttttatcatacaaatta

SEQ ID NO: 68426 - DNA, 20 bp, Artificial sequence
  SiRNA target sequence
ttttttatcatacaaattag

SEQ ID NO: 68427 - DNA, 20 bp, Artificial sequence
  SiRNA target sequence
tttttatcatacaaattagg

SEQ ID NO: 68428 - DNA, 20 bp, Artificial sequence
  SiRNA target sequence
ttttatcatacaaattaggt

SEQ ID NO: 68429 - DNA, 20 bp, Artificial sequence
  SiRNA target sequence
tttatcatacaaattaggta

SEQ ID NO: 68430 - DNA, 20 bp, Artificial sequence
  SiRNA target sequence
ttatcatacaaattaggtaa

SEQ ID NO: 68431 - DNA, 20 bp, Artificial sequence
  SiRNA target sequence
tatcatacaaattaggtaaa

SEQ ID NO: 68432 - DNA, 20 bp, Artificial sequence
  SiRNA target sequence
atcatacaaattaggtaaat

SEQ ID NO: 68433 - DNA, 20 bp, Artificial sequence
  SiRNA target sequence
tcatacaaattaggtaaata

SEQ ID NO: 68434 - DNA, 20 bp, Artificial sequence
  SiRNA target sequence
catacaaattaggtaaataa

SEQ ID NO: 68435 - DNA, 21 bp, Artificial sequence
  SiRNA target sequence
atgaaaaaaatttcgaataga

SEQ ID NO: 68436 - DNA, 21 bp, Artificial sequence
  SiRNA target sequence
tgaaaaaaatttcgaatagaa

SEQ ID NO: 68437 - DNA, 21 bp, Artificial sequence
  SiRNA target sequence
gaaaaaaatttcgaatagaaa

SEQ ID NO: 68438 - DNA, 21 bp, Artificial sequence
  SiRNA target sequence
aaaaaaatttcgaatagaaaa

SEQ ID NO: 68439 - DNA, 21 bp, Artificial sequence
  SiRNA target sequence
aaaaaatttcgaatagaaaaa

SEQ ID NO: 68440 - DNA, 21 bp, Artificial sequence
  SiRNA target sequence
aaaaatttcgaatagaaaaat

SEQ ID NO: 68441 - DNA, 21 bp, Artificial sequence
  SiRNA target sequence
aaaatttcgaatagaaaaatt

SEQ ID NO: 68442 - DNA, 21 bp, Artificial sequence
  SiRNA target sequence
aaatttcgaatagaaaaatta

SEQ ID NO: 68443 - DNA, 21 bp, Artificial sequence
  SiRNA target sequence
aatttcgaatagaaaaattat

SEQ ID NO: 68444 - DNA, 21 bp, Artificial sequence
  SiRNA target sequence
atttcgaatagaaaaattatc

SEQ ID NO: 68445 - DNA, 21 bp, Artificial sequence
  SiRNA target sequence
tttcgaatagaaaaattatca

SEQ ID NO: 68446 - DNA, 21 bp, Artificial sequence
  SiRNA target sequence
ttcgaatagaaaaattatcaa

SEQ ID NO: 68447 - DNA, 21 bp, Artificial sequence
  SiRNA target sequence
tcgaatagaaaaattatcaaa

SEQ ID NO: 68448 - DNA, 21 bp, Artificial sequence
  SiRNA target sequence
cgaatagaaaaattatcaaag

SEQ ID NO: 68449 - DNA, 21 bp, Artificial sequence
  SiRNA target sequence
gaatagaaaaattatcaaaga

SEQ ID NO: 68450 - DNA, 21 bp, Artificial sequence
  SiRNA target sequence
aatagaaaaattatcaaagaa

SEQ ID NO: 68451 - DNA, 21 bp, Artificial sequence
  SiRNA target sequence
atagaaaaattatcaaagaaa

SEQ ID NO: 68452 - DNA, 21 bp, Artificial sequence
  SiRNA target sequence
tagaaaaattatcaaagaaat

SEQ ID NO: 68453 - DNA, 21 bp, Artificial sequence
  SiRNA target sequence
agaaaaattatcaaagaaatt

SEQ ID NO: 68454 - DNA, 21 bp, Artificial sequence
  SiRNA target sequence
gaaaaattatcaaagaaatta

SEQ ID NO: 68455 - DNA, 21 bp, Artificial sequence
  SiRNA target sequence
aaaaattatcaaagaaattat

SEQ ID NO: 68456 - DNA, 21 bp, Artificial sequence
  SiRNA target sequence
aaaattatcaaagaaattatt

SEQ ID NO: 68457 - DNA, 21 bp, Artificial sequence
  SiRNA target sequence
aaattatcaaagaaattattt

SEQ ID NO: 68458 - DNA, 21 bp, Artificial sequence
  SiRNA target sequence
aattatcaaagaaattattta

SEQ ID NO: 68459 - DNA, 21 bp, Artificial sequence
  SiRNA target sequence
attatcaaagaaattatttac

SEQ ID NO: 68460 - DNA, 21 bp, Artificial sequence
  SiRNA target sequence
ttatcaaagaaattatttaca

SEQ ID NO: 68461 - DNA, 21 bp, Artificial sequence
  SiRNA target sequence
tatcaaagaaattatttacaa

SEQ ID NO: 68462 - DNA, 21 bp, Artificial sequence
  SiRNA target sequence
atcaaagaaattatttacaat

SEQ ID NO: 68463 - DNA, 21 bp, Artificial sequence
  SiRNA target sequence
tcaaagaaattatttacaatg

SEQ ID NO: 68464 - DNA, 21 bp, Artificial sequence
  SiRNA target sequence
caaagaaattatttacaatga

SEQ ID NO: 68465 - DNA, 21 bp, Artificial sequence
  SiRNA target sequence
aaagaaattatttacaatgat

SEQ ID NO: 68466 - DNA, 21 bp, Artificial sequence
  SiRNA target sequence
aagaaattatttacaatgatt

SEQ ID NO: 68467 - DNA, 21 bp, Artificial sequence
  SiRNA target sequence
agaaattatttacaatgattt

SEQ ID NO: 68468 - DNA, 21 bp, Artificial sequence
  SiRNA target sequence
gaaattatttacaatgattta

SEQ ID NO: 68469 - DNA, 21 bp, Artificial sequence
  SiRNA target sequence
aaattatttacaatgatttat

SEQ ID NO: 68470 - DNA, 21 bp, Artificial sequence
  SiRNA target sequence
aattatttacaatgatttatt

SEQ ID NO: 68471 - DNA, 21 bp, Artificial sequence
  SiRNA target sequence
attatttacaatgatttatta

SEQ ID NO: 68472 - DNA, 21 bp, Artificial sequence
  SiRNA target sequence
ttatttacaatgatttattaa

SEQ ID NO: 68473 - DNA, 21 bp, Artificial sequence
  SiRNA target sequence
tatttacaatgatttattaaa

SEQ ID NO: 68474 - DNA, 21 bp, Artificial sequence
  SiRNA target sequence
atttacaatgatttattaaaa

SEQ ID NO: 68475 - DNA, 21 bp, Artificial sequence
  SiRNA target sequence
tttacaatgatttattaaaaa

SEQ ID NO: 68476 - DNA, 21 bp, Artificial sequence
  SiRNA target sequence
ttacaatgatttattaaaaat

SEQ ID NO: 68477 - DNA, 21 bp, Artificial sequence
  SiRNA target sequence
tacaatgatttattaaaaata

SEQ ID NO: 68478 - DNA, 21 bp, Artificial sequence
  SiRNA target sequence
acaatgatttattaaaaataa

SEQ ID NO: 68479 - DNA, 21 bp, Artificial sequence
  SiRNA target sequence
caatgatttattaaaaataag

SEQ ID NO: 68480 - DNA, 21 bp, Artificial sequence
  SiRNA target sequence
aatgatttattaaaaataaga

SEQ ID NO: 68481 - DNA, 21 bp, Artificial sequence
  SiRNA target sequence
atgatttattaaaaataagaa

SEQ ID NO: 68482 - DNA, 21 bp, Artificial sequence
  SiRNA target sequence
tgatttattaaaaataagaat

SEQ ID NO: 68483 - DNA, 21 bp, Artificial sequence
  SiRNA target sequence
gatttattaaaaataagaatg

SEQ ID NO: 68484 - DNA, 21 bp, Artificial sequence
  SiRNA target sequence
atttattaaaaataagaatgt

SEQ ID NO: 68485 - DNA, 21 bp, Artificial sequence
  SiRNA target sequence
tttattaaaaataagaatgtt

SEQ ID NO: 68486 - DNA, 21 bp, Artificial sequence
  SiRNA target sequence
ttattaaaaataagaatgttg

SEQ ID NO: 68487 - DNA, 21 bp, Artificial sequence
  SiRNA target sequence
tattaaaaataagaatgttgc

SEQ ID NO: 68488 - DNA, 21 bp, Artificial sequence
  SiRNA target sequence
attaaaaataagaatgttgcg

SEQ ID NO: 68489 - DNA, 21 bp, Artificial sequence
  SiRNA target sequence
ttaaaaataagaatgttgcga

SEQ ID NO: 68490 - DNA, 21 bp, Artificial sequence
  SiRNA target sequence
taaaaataagaatgttgcgat

SEQ ID NO: 68491 - DNA, 21 bp, Artificial sequence
  SiRNA target sequence
aaaaataagaatgttgcgata

SEQ ID NO: 68492 - DNA, 21 bp, Artificial sequence
  SiRNA target sequence
aaaataagaatgttgcgatat

SEQ ID NO: 68493 - DNA, 21 bp, Artificial sequence
  SiRNA target sequence
aaataagaatgttgcgatatg

SEQ ID NO: 68494 - DNA, 21 bp, Artificial sequence
  SiRNA target sequence
aataagaatgttgcgatatgt

SEQ ID NO: 68495 - DNA, 21 bp, Artificial sequence
  SiRNA target sequence
ataagaatgttgcgatatgtt

SEQ ID NO: 68496 - DNA, 21 bp, Artificial sequence
  SiRNA target sequence
taagaatgttgcgatatgtta

SEQ ID NO: 68497 - DNA, 21 bp, Artificial sequence
  SiRNA target sequence
aagaatgttgcgatatgttat

SEQ ID NO: 68498 - DNA, 21 bp, Artificial sequence
  SiRNA target sequence
agaatgttgcgatatgttatt

SEQ ID NO: 68499 - DNA, 21 bp, Artificial sequence
  SiRNA target sequence
gaatgttgcgatatgttattg

SEQ ID NO: 68500 - DNA, 21 bp, Artificial sequence
  SiRNA target sequence
aatgttgcgatatgttattgt

SEQ ID NO: 68501 - DNA, 21 bp, Artificial sequence
  SiRNA target sequence
atgttgcgatatgttattgta

SEQ ID NO: 68502 - DNA, 21 bp, Artificial sequence
  SiRNA target sequence
tgttgcgatatgttattgtac

SEQ ID NO: 68503 - DNA, 21 bp, Artificial sequence
  SiRNA target sequence
gttgcgatatgttattgtacc

SEQ ID NO: 68504 - DNA, 21 bp, Artificial sequence
  SiRNA target sequence
ttgcgatatgttattgtacca

SEQ ID NO: 68505 - DNA, 21 bp, Artificial sequence
  SiRNA target sequence
tgcgatatgttattgtaccaa

SEQ ID NO: 68506 - DNA, 21 bp, Artificial sequence
  SiRNA target sequence
gcgatatgttattgtaccaat

SEQ ID NO: 68507 - DNA, 21 bp, Artificial sequence
  SiRNA target sequence
cgatatgttattgtaccaata

SEQ ID NO: 68508 - DNA, 21 bp, Artificial sequence
  SiRNA target sequence
gatatgttattgtaccaataa

SEQ ID NO: 68509 - DNA, 21 bp, Artificial sequence
  SiRNA target sequence
atatgttattgtaccaataat

SEQ ID NO: 68510 - DNA, 21 bp, Artificial sequence
  SiRNA target sequence
tatgttattgtaccaataata

SEQ ID NO: 68511 - DNA, 21 bp, Artificial sequence
  SiRNA target sequence
atgttattgtaccaataatat

SEQ ID NO: 68512 - DNA, 21 bp, Artificial sequence
  SiRNA target sequence
tgttattgtaccaataatatt

SEQ ID NO: 68513 - DNA, 21 bp, Artificial sequence
  SiRNA target sequence
gttattgtaccaataatattt

SEQ ID NO: 68514 - DNA, 21 bp, Artificial sequence
  SiRNA target sequence
ttattgtaccaataatatttt

SEQ ID NO: 68515 - DNA, 21 bp, Artificial sequence
  SiRNA target sequence
tattgtaccaataatattttt

SEQ ID NO: 68516 - DNA, 21 bp, Artificial sequence
  SiRNA target sequence
attgtaccaataatattttta

SEQ ID NO: 68517 - DNA, 21 bp, Artificial sequence
  SiRNA target sequence
ttgtaccaataatatttttaa

SEQ ID NO: 68518 - DNA, 21 bp, Artificial sequence
  SiRNA target sequence
tgtaccaataatatttttaac

SEQ ID NO: 68519 - DNA, 21 bp, Artificial sequence
  SiRNA target sequence
gtaccaataatatttttaact

SEQ ID NO: 68520 - DNA, 21 bp, Artificial sequence
  SiRNA target sequence
taccaataatatttttaacta

SEQ ID NO: 68521 - DNA, 21 bp, Artificial sequence
  SiRNA target sequence
accaataatatttttaactat

SEQ ID NO: 68522 - DNA, 21 bp, Artificial sequence
  SiRNA target sequence
ccaataatatttttaactata

SEQ ID NO: 68523 - DNA, 21 bp, Artificial sequence
  SiRNA target sequence
caataatatttttaactatat

SEQ ID NO: 68524 - DNA, 21 bp, Artificial sequence
  SiRNA target sequence
aataatatttttaactatatt

SEQ ID NO: 68525 - DNA, 21 bp, Artificial sequence
  SiRNA target sequence
ataatatttttaactatattt

SEQ ID NO: 68526 - DNA, 21 bp, Artificial sequence
  SiRNA target sequence
taatatttttaactatatttt

SEQ ID NO: 68527 - DNA, 21 bp, Artificial sequence
  SiRNA target sequence
aatatttttaactatatttta

SEQ ID NO: 68528 - DNA, 21 bp, Artificial sequence
  SiRNA target sequence
atatttttaactatattttac

SEQ ID NO: 68529 - DNA, 21 bp, Artificial sequence
  SiRNA target sequence
tatttttaactatattttaca

SEQ ID NO: 68530 - DNA, 21 bp, Artificial sequence
  SiRNA target sequence
atttttaactatattttacac

SEQ ID NO: 68531 - DNA, 21 bp, Artificial sequence
  SiRNA target sequence
tttttaactatattttacact

SEQ ID NO: 68532 - DNA, 21 bp, Artificial sequence
  SiRNA target sequence
ttttaactatattttacactg

SEQ ID NO: 68533 - DNA, 21 bp, Artificial sequence
  SiRNA target sequence
tttaactatattttacactgt

SEQ ID NO: 68534 - DNA, 21 bp, Artificial sequence
  SiRNA target sequence
ttaactatattttacactgtt

SEQ ID NO: 68535 - DNA, 21 bp, Artificial sequence
  SiRNA target sequence
taactatattttacactgttt

SEQ ID NO: 68536 - DNA, 21 bp, Artificial sequence
  SiRNA target sequence
aactatattttacactgtttt

SEQ ID NO: 68537 - DNA, 21 bp, Artificial sequence
  SiRNA target sequence
actatattttacactgtttta

SEQ ID NO: 68538 - DNA, 21 bp, Artificial sequence
  SiRNA target sequence
ctatattttacactgttttag

SEQ ID NO: 68539 - DNA, 21 bp, Artificial sequence
  SiRNA target sequence
tatattttacactgttttaga

SEQ ID NO: 68540 - DNA, 21 bp, Artificial sequence
  SiRNA target sequence
atattttacactgttttagag

SEQ ID NO: 68541 - DNA, 21 bp, Artificial sequence
  SiRNA target sequence
tattttacactgttttagaga

SEQ ID NO: 68542 - DNA, 21 bp, Artificial sequence
  SiRNA target sequence
attttacactgttttagagat

SEQ ID NO: 68543 - DNA, 21 bp, Artificial sequence
  SiRNA target sequence
ttttacactgttttagagata

SEQ ID NO: 68544 - DNA, 21 bp, Artificial sequence
  SiRNA target sequence
tttacactgttttagagataa

SEQ ID NO: 68545 - DNA, 21 bp, Artificial sequence
  SiRNA target sequence
ttacactgttttagagataaa

SEQ ID NO: 68546 - DNA, 21 bp, Artificial sequence
  SiRNA target sequence
tacactgttttagagataaaa

SEQ ID NO: 68547 - DNA, 21 bp, Artificial sequence
  SiRNA target sequence
acactgttttagagataaaaa

SEQ ID NO: 68548 - DNA, 21 bp, Artificial sequence
  SiRNA target sequence
cactgttttagagataaaaat

SEQ ID NO: 68549 - DNA, 21 bp, Artificial sequence
  SiRNA target sequence
actgttttagagataaaaata

SEQ ID NO: 68550 - DNA, 21 bp, Artificial sequence
  SiRNA target sequence
ctgttttagagataaaaataa

SEQ ID NO: 68551 - DNA, 21 bp, Artificial sequence
  SiRNA target sequence
tgttttagagataaaaataag

SEQ ID NO: 68552 - DNA, 21 bp, Artificial sequence
  SiRNA target sequence
gttttagagataaaaataagt

SEQ ID NO: 68553 - DNA, 21 bp, Artificial sequence
  SiRNA target sequence
ttttagagataaaaataagta

SEQ ID NO: 68554 - DNA, 21 bp, Artificial sequence
  SiRNA target sequence
tttagagataaaaataagtac

SEQ ID NO: 68555 - DNA, 21 bp, Artificial sequence
  SiRNA target sequence
ttagagataaaaataagtaca

SEQ ID NO: 68556 - DNA, 21 bp, Artificial sequence
  SiRNA target sequence
tagagataaaaataagtacat

SEQ ID NO: 68557 - DNA, 21 bp, Artificial sequence
  SiRNA target sequence
agagataaaaataagtacatt

SEQ ID NO: 68558 - DNA, 21 bp, Artificial sequence
  SiRNA target sequence
gagataaaaataagtacatta

SEQ ID NO: 68559 - DNA, 21 bp, Artificial sequence
  SiRNA target sequence
agataaaaataagtacattag

SEQ ID NO: 68560 - DNA, 21 bp, Artificial sequence
  SiRNA target sequence
gataaaaataagtacattagt

SEQ ID NO: 68561 - DNA, 21 bp, Artificial sequence
  SiRNA target sequence
ataaaaataagtacattagta

SEQ ID NO: 68562 - DNA, 21 bp, Artificial sequence
  SiRNA target sequence
taaaaataagtacattagtaa

SEQ ID NO: 68563 - DNA, 21 bp, Artificial sequence
  SiRNA target sequence
aaaaataagtacattagtaaa

SEQ ID NO: 68564 - DNA, 21 bp, Artificial sequence
  SiRNA target sequence
aaaataagtacattagtaaag

SEQ ID NO: 68565 - DNA, 21 bp, Artificial sequence
  SiRNA target sequence
aaataagtacattagtaaaga

SEQ ID NO: 68566 - DNA, 21 bp, Artificial sequence
  SiRNA target sequence
aataagtacattagtaaagaa

SEQ ID NO: 68567 - DNA, 21 bp, Artificial sequence
  SiRNA target sequence
ataagtacattagtaaagaat

SEQ ID NO: 68568 - DNA, 21 bp, Artificial sequence
  SiRNA target sequence
taagtacattagtaaagaatc

SEQ ID NO: 68569 - DNA, 21 bp, Artificial sequence
  SiRNA target sequence
aagtacattagtaaagaatct

SEQ ID NO: 68570 - DNA, 21 bp, Artificial sequence
  SiRNA target sequence
agtacattagtaaagaatctt

SEQ ID NO: 68571 - DNA, 21 bp, Artificial sequence
  SiRNA target sequence
gtacattagtaaagaatctta

SEQ ID NO: 68572 - DNA, 21 bp, Artificial sequence
  SiRNA target sequence
tacattagtaaagaatcttaa

SEQ ID NO: 68573 - DNA, 21 bp, Artificial sequence
  SiRNA target sequence
acattagtaaagaatcttaat

SEQ ID NO: 68574 - DNA, 21 bp, Artificial sequence
  SiRNA target sequence
cattagtaaagaatcttaatc

SEQ ID NO: 68575 - DNA, 21 bp, Artificial sequence
  SiRNA target sequence
attagtaaagaatcttaatca

SEQ ID NO: 68576 - DNA, 21 bp, Artificial sequence
  SiRNA target sequence
ttagtaaagaatcttaatcaa

SEQ ID NO: 68577 - DNA, 21 bp, Artificial sequence
  SiRNA target sequence
tagtaaagaatcttaatcaat

SEQ ID NO: 68578 - DNA, 21 bp, Artificial sequence
  SiRNA target sequence
agtaaagaatcttaatcaatc

SEQ ID NO: 68579 - DNA, 21 bp, Artificial sequence
  SiRNA target sequence
gtaaagaatcttaatcaatct

SEQ ID NO: 68580 - DNA, 21 bp, Artificial sequence
  SiRNA target sequence
taaagaatcttaatcaatcta

SEQ ID NO: 68581 - DNA, 21 bp, Artificial sequence
  SiRNA target sequence
aaagaatcttaatcaatctat

SEQ ID NO: 68582 - DNA, 21 bp, Artificial sequence
  SiRNA target sequence
aagaatcttaatcaatctatc

SEQ ID NO: 68583 - DNA, 21 bp, Artificial sequence
  SiRNA target sequence
agaatcttaatcaatctatcg

SEQ ID NO: 68584 - DNA, 21 bp, Artificial sequence
  SiRNA target sequence
gaatcttaatcaatctatcgc

SEQ ID NO: 68585 - DNA, 21 bp, Artificial sequence
  SiRNA target sequence
aatcttaatcaatctatcgca

SEQ ID NO: 68586 - DNA, 21 bp, Artificial sequence
  SiRNA target sequence
atcttaatcaatctatcgcaa

SEQ ID NO: 68587 - DNA, 21 bp, Artificial sequence
  SiRNA target sequence
tcttaatcaatctatcgcaaa

SEQ ID NO: 68588 - DNA, 21 bp, Artificial sequence
  SiRNA target sequence
cttaatcaatctatcgcaaat

SEQ ID NO: 68589 - DNA, 21 bp, Artificial sequence
  SiRNA target sequence
ttaatcaatctatcgcaaatc

SEQ ID NO: 68590 - DNA, 21 bp, Artificial sequence
  SiRNA target sequence
taatcaatctatcgcaaatcg

SEQ ID NO: 68591 - DNA, 21 bp, Artificial sequence
  SiRNA target sequence
aatcaatctatcgcaaatcga

SEQ ID NO: 68592 - DNA, 21 bp, Artificial sequence
  SiRNA target sequence
atcaatctatcgcaaatcgaa

SEQ ID NO: 68593 - DNA, 21 bp, Artificial sequence
  SiRNA target sequence
tcaatctatcgcaaatcgaaa

SEQ ID NO: 68594 - DNA, 21 bp, Artificial sequence
  SiRNA target sequence
caatctatcgcaaatcgaaaa

SEQ ID NO: 68595 - DNA, 21 bp, Artificial sequence
  SiRNA target sequence
aatctatcgcaaatcgaaaag

SEQ ID NO: 68596 - DNA, 21 bp, Artificial sequence
  SiRNA target sequence
atctatcgcaaatcgaaaagg

SEQ ID NO: 68597 - DNA, 21 bp, Artificial sequence
  SiRNA target sequence
tctatcgcaaatcgaaaaggt

SEQ ID NO: 68598 - DNA, 21 bp, Artificial sequence
  SiRNA target sequence
ctatcgcaaatcgaaaaggtg

SEQ ID NO: 68599 - DNA, 21 bp, Artificial sequence
  SiRNA target sequence
tatcgcaaatcgaaaaggtga

SEQ ID NO: 68600 - DNA, 21 bp, Artificial sequence
  SiRNA target sequence
atcgcaaatcgaaaaggtgaa

SEQ ID NO: 68601 - DNA, 21 bp, Artificial sequence
  SiRNA target sequence
tcgcaaatcgaaaaggtgaac

SEQ ID NO: 68602 - DNA, 21 bp, Artificial sequence
  SiRNA target sequence
cgcaaatcgaaaaggtgaaca

SEQ ID NO: 68603 - DNA, 21 bp, Artificial sequence
  SiRNA target sequence
gcaaatcgaaaaggtgaacac

SEQ ID NO: 68604 - DNA, 21 bp, Artificial sequence
  SiRNA target sequence
caaatcgaaaaggtgaacaca

SEQ ID NO: 68605 - DNA, 21 bp, Artificial sequence
  SiRNA target sequence
aaatcgaaaaggtgaacacac

SEQ ID NO: 68606 - DNA, 21 bp, Artificial sequence
  SiRNA target sequence
aatcgaaaaggtgaacacaca

SEQ ID NO: 68607 - DNA, 21 bp, Artificial sequence
  SiRNA target sequence
atcgaaaaggtgaacacacag

SEQ ID NO: 68608 - DNA, 21 bp, Artificial sequence
  SiRNA target sequence
tcgaaaaggtgaacacacagc

SEQ ID NO: 68609 - DNA, 21 bp, Artificial sequence
  SiRNA target sequence
cgaaaaggtgaacacacagca

SEQ ID NO: 68610 - DNA, 21 bp, Artificial sequence
  SiRNA target sequence
gaaaaggtgaacacacagcac

SEQ ID NO: 68611 - DNA, 21 bp, Artificial sequence
  SiRNA target sequence
aaaaggtgaacacacagcact

SEQ ID NO: 68612 - DNA, 21 bp, Artificial sequence
  SiRNA target sequence
aaaggtgaacacacagcactt

SEQ ID NO: 68613 - DNA, 21 bp, Artificial sequence
  SiRNA target sequence
aaggtgaacacacagcacttg

SEQ ID NO: 68614 - DNA, 21 bp, Artificial sequence
  SiRNA target sequence
aggtgaacacacagcacttga

SEQ ID NO: 68615 - DNA, 21 bp, Artificial sequence
  SiRNA target sequence
ggtgaacacacagcacttgaa

SEQ ID NO: 68616 - DNA, 21 bp, Artificial sequence
  SiRNA target sequence
gtgaacacacagcacttgaaa

SEQ ID NO: 68617 - DNA, 21 bp, Artificial sequence
  SiRNA target sequence
tgaacacacagcacttgaaag

SEQ ID NO: 68618 - DNA, 21 bp, Artificial sequence
  SiRNA target sequence
gaacacacagcacttgaaaga

SEQ ID NO: 68619 - DNA, 21 bp, Artificial sequence
  SiRNA target sequence
aacacacagcacttgaaagat

SEQ ID NO: 68620 - DNA, 21 bp, Artificial sequence
  SiRNA target sequence
acacacagcacttgaaagatt

SEQ ID NO: 68621 - DNA, 21 bp, Artificial sequence
  SiRNA target sequence
cacacagcacttgaaagattt

SEQ ID NO: 68622 - DNA, 21 bp, Artificial sequence
  SiRNA target sequence
acacagcacttgaaagatttg

SEQ ID NO: 68623 - DNA, 21 bp, Artificial sequence
  SiRNA target sequence
cacagcacttgaaagatttgt

SEQ ID NO: 68624 - DNA, 21 bp, Artificial sequence
  SiRNA target sequence
acagcacttgaaagatttgtg

SEQ ID NO: 68625 - DNA, 21 bp, Artificial sequence
  SiRNA target sequence
cagcacttgaaagatttgtgt

SEQ ID NO: 68626 - DNA, 21 bp, Artificial sequence
  SiRNA target sequence
agcacttgaaagatttgtgtt

SEQ ID NO: 68627 - DNA, 21 bp, Artificial sequence
  SiRNA target sequence
gcacttgaaagatttgtgtta

SEQ ID NO: 68628 - DNA, 21 bp, Artificial sequence
  SiRNA target sequence
cacttgaaagatttgtgttac

SEQ ID NO: 68629 - DNA, 21 bp, Artificial sequence
  SiRNA target sequence
acttgaaagatttgtgttaca

SEQ ID NO: 68630 - DNA, 21 bp, Artificial sequence
  SiRNA target sequence
cttgaaagatttgtgttacag

SEQ ID NO: 68631 - DNA, 21 bp, Artificial sequence
  SiRNA target sequence
ttgaaagatttgtgttacagt

SEQ ID NO: 68632 - DNA, 21 bp, Artificial sequence
  SiRNA target sequence
tgaaagatttgtgttacagtc

SEQ ID NO: 68633 - DNA, 21 bp, Artificial sequence
  SiRNA target sequence
gaaagatttgtgttacagtca

SEQ ID NO: 68634 - DNA, 21 bp, Artificial sequence
  SiRNA target sequence
aaagatttgtgttacagtcac

SEQ ID NO: 68635 - DNA, 21 bp, Artificial sequence
  SiRNA target sequence
aagatttgtgttacagtcact

SEQ ID NO: 68636 - DNA, 21 bp, Artificial sequence
  SiRNA target sequence
agatttgtgttacagtcactc

SEQ ID NO: 68637 - DNA, 21 bp, Artificial sequence
  SiRNA target sequence
gatttgtgttacagtcactct

SEQ ID NO: 68638 - DNA, 21 bp, Artificial sequence
  SiRNA target sequence
atttgtgttacagtcactctt

SEQ ID NO: 68639 - DNA, 21 bp, Artificial sequence
  SiRNA target sequence
tttgtgttacagtcactctta

SEQ ID NO: 68640 - DNA, 21 bp, Artificial sequence
  SiRNA target sequence
ttgtgttacagtcactcttag

SEQ ID NO: 68641 - DNA, 21 bp, Artificial sequence
  SiRNA target sequence
tgtgttacagtcactcttagt

SEQ ID NO: 68642 - DNA, 21 bp, Artificial sequence
  SiRNA target sequence
gtgttacagtcactcttagtg

SEQ ID NO: 68643 - DNA, 21 bp, Artificial sequence
  SiRNA target sequence
tgttacagtcactcttagtgg

SEQ ID NO: 68644 - DNA, 21 bp, Artificial sequence
  SiRNA target sequence
gttacagtcactcttagtggc

SEQ ID NO: 68645 - DNA, 21 bp, Artificial sequence
  SiRNA target sequence
ttacagtcactcttagtggct

SEQ ID NO: 68646 - DNA, 21 bp, Artificial sequence
  SiRNA target sequence
tacagtcactcttagtggctg

SEQ ID NO: 68647 - DNA, 21 bp, Artificial sequence
  SiRNA target sequence
acagtcactcttagtggctgt

SEQ ID NO: 68648 - DNA, 21 bp, Artificial sequence
  SiRNA target sequence
cagtcactcttagtggctgta

SEQ ID NO: 68649 - DNA, 21 bp, Artificial sequence
  SiRNA target sequence
agtcactcttagtggctgtat

SEQ ID NO: 68650 - DNA, 21 bp, Artificial sequence
  SiRNA target sequence
gtcactcttagtggctgtatt

SEQ ID NO: 68651 - DNA, 21 bp, Artificial sequence
  SiRNA target sequence
tcactcttagtggctgtattg

SEQ ID NO: 68652 - DNA, 21 bp, Artificial sequence
  SiRNA target sequence
cactcttagtggctgtattga

SEQ ID NO: 68653 - DNA, 21 bp, Artificial sequence
  SiRNA target sequence
actcttagtggctgtattgac

SEQ ID NO: 68654 - DNA, 21 bp, Artificial sequence
  SiRNA target sequence
ctcttagtggctgtattgacc

SEQ ID NO: 68655 - DNA, 21 bp, Artificial sequence
  SiRNA target sequence
tcttagtggctgtattgaccg

SEQ ID NO: 68656 - DNA, 21 bp, Artificial sequence
  SiRNA target sequence
cttagtggctgtattgaccga

SEQ ID NO: 68657 - DNA, 21 bp, Artificial sequence
  SiRNA target sequence
ttagtggctgtattgaccgaa

SEQ ID NO: 68658 - DNA, 21 bp, Artificial sequence
  SiRNA target sequence
tagtggctgtattgaccgaac

SEQ ID NO: 68659 - DNA, 21 bp, Artificial sequence
  SiRNA target sequence
agtggctgtattgaccgaact

SEQ ID NO: 68660 - DNA, 21 bp, Artificial sequence
  SiRNA target sequence
gtggctgtattgaccgaactt

SEQ ID NO: 68661 - DNA, 21 bp, Artificial sequence
  SiRNA target sequence
tggctgtattgaccgaactta

SEQ ID NO: 68662 - DNA, 21 bp, Artificial sequence
  SiRNA target sequence
ggctgtattgaccgaacttaa

SEQ ID NO: 68663 - DNA, 21 bp, Artificial sequence
  SiRNA target sequence
gctgtattgaccgaacttaat

SEQ ID NO: 68664 - DNA, 21 bp, Artificial sequence
  SiRNA target sequence
ctgtattgaccgaacttaatg

SEQ ID NO: 68665 - DNA, 21 bp, Artificial sequence
  SiRNA target sequence
tgtattgaccgaacttaatgg

SEQ ID NO: 68666 - DNA, 21 bp, Artificial sequence
  SiRNA target sequence
gtattgaccgaacttaatgga

SEQ ID NO: 68667 - DNA, 21 bp, Artificial sequence
  SiRNA target sequence
tattgaccgaacttaatggat

SEQ ID NO: 68668 - DNA, 21 bp, Artificial sequence
  SiRNA target sequence
attgaccgaacttaatggatt

SEQ ID NO: 68669 - DNA, 21 bp, Artificial sequence
  SiRNA target sequence
ttgaccgaacttaatggattt

SEQ ID NO: 68670 - DNA, 21 bp, Artificial sequence
  SiRNA target sequence
tgaccgaacttaatggattta

SEQ ID NO: 68671 - DNA, 21 bp, Artificial sequence
  SiRNA target sequence
gaccgaacttaatggatttat

SEQ ID NO: 68672 - DNA, 21 bp, Artificial sequence
  SiRNA target sequence
accgaacttaatggatttatt

SEQ ID NO: 68673 - DNA, 21 bp, Artificial sequence
  SiRNA target sequence
ccgaacttaatggatttattt

SEQ ID NO: 68674 - DNA, 21 bp, Artificial sequence
  SiRNA target sequence
cgaacttaatggatttatttt

SEQ ID NO: 68675 - DNA, 21 bp, Artificial sequence
  SiRNA target sequence
gaacttaatggatttattttt

SEQ ID NO: 68676 - DNA, 21 bp, Artificial sequence
  SiRNA target sequence
aacttaatggatttattttta

SEQ ID NO: 68677 - DNA, 21 bp, Artificial sequence
  SiRNA target sequence
acttaatggatttatttttac

SEQ ID NO: 68678 - DNA, 21 bp, Artificial sequence
  SiRNA target sequence
cttaatggatttatttttaca

SEQ ID NO: 68679 - DNA, 21 bp, Artificial sequence
  SiRNA target sequence
ttaatggatttatttttacag

SEQ ID NO: 68680 - DNA, 21 bp, Artificial sequence
  SiRNA target sequence
taatggatttatttttacagg

SEQ ID NO: 68681 - DNA, 21 bp, Artificial sequence
  SiRNA target sequence
aatggatttatttttacaggt

SEQ ID NO: 68682 - DNA, 21 bp, Artificial sequence
  SiRNA target sequence
atggatttatttttacaggtg

SEQ ID NO: 68683 - DNA, 21 bp, Artificial sequence
  SiRNA target sequence
tggatttatttttacaggtgt

SEQ ID NO: 68684 - DNA, 21 bp, Artificial sequence
  SiRNA target sequence
ggatttatttttacaggtgta

SEQ ID NO: 68685 - DNA, 21 bp, Artificial sequence
  SiRNA target sequence
gatttatttttacaggtgtag

SEQ ID NO: 68686 - DNA, 21 bp, Artificial sequence
  SiRNA target sequence
atttatttttacaggtgtagt

SEQ ID NO: 68687 - DNA, 21 bp, Artificial sequence
  SiRNA target sequence
tttatttttacaggtgtagtg

SEQ ID NO: 68688 - DNA, 21 bp, Artificial sequence
  SiRNA target sequence
ttatttttacaggtgtagtgc

SEQ ID NO: 68689 - DNA, 21 bp, Artificial sequence
  SiRNA target sequence
tatttttacaggtgtagtgca

SEQ ID NO: 68690 - DNA, 21 bp, Artificial sequence
  SiRNA target sequence
atttttacaggtgtagtgcaa

SEQ ID NO: 68691 - DNA, 21 bp, Artificial sequence
  SiRNA target sequence
tttttacaggtgtagtgcaat

SEQ ID NO: 68692 - DNA, 21 bp, Artificial sequence
  SiRNA target sequence
ttttacaggtgtagtgcaata

SEQ ID NO: 68693 - DNA, 21 bp, Artificial sequence
  SiRNA target sequence
tttacaggtgtagtgcaatat

SEQ ID NO: 68694 - DNA, 21 bp, Artificial sequence
  SiRNA target sequence
ttacaggtgtagtgcaatata

SEQ ID NO: 68695 - DNA, 21 bp, Artificial sequence
  SiRNA target sequence
tacaggtgtagtgcaatatat

SEQ ID NO: 68696 - DNA, 21 bp, Artificial sequence
  SiRNA target sequence
acaggtgtagtgcaatatatt

SEQ ID NO: 68697 - DNA, 21 bp, Artificial sequence
  SiRNA target sequence
caggtgtagtgcaatatattt

SEQ ID NO: 68698 - DNA, 21 bp, Artificial sequence
  SiRNA target sequence
aggtgtagtgcaatatattta

SEQ ID NO: 68699 - DNA, 21 bp, Artificial sequence
  SiRNA target sequence
ggtgtagtgcaatatatttat

SEQ ID NO: 68700 - DNA, 21 bp, Artificial sequence
  SiRNA target sequence
gtgtagtgcaatatatttata

SEQ ID NO: 68701 - DNA, 21 bp, Artificial sequence
  SiRNA target sequence
tgtagtgcaatatatttatag

SEQ ID NO: 68702 - DNA, 21 bp, Artificial sequence
  SiRNA target sequence
gtagtgcaatatatttataga

SEQ ID NO: 68703 - DNA, 21 bp, Artificial sequence
  SiRNA target sequence
tagtgcaatatatttatagaa

SEQ ID NO: 68704 - DNA, 21 bp, Artificial sequence
  SiRNA target sequence
agtgcaatatatttatagaaa

SEQ ID NO: 68705 - DNA, 21 bp, Artificial sequence
  SiRNA target sequence
gtgcaatatatttatagaaat

SEQ ID NO: 68706 - DNA, 21 bp, Artificial sequence
  SiRNA target sequence
tgcaatatatttatagaaata

SEQ ID NO: 68707 - DNA, 21 bp, Artificial sequence
  SiRNA target sequence
gcaatatatttatagaaatac

SEQ ID NO: 68708 - DNA, 21 bp, Artificial sequence
  SiRNA target sequence
caatatatttatagaaatacg

SEQ ID NO: 68709 - DNA, 21 bp, Artificial sequence
  SiRNA target sequence
aatatatttatagaaatacgg

SEQ ID NO: 68710 - DNA, 21 bp, Artificial sequence
  SiRNA target sequence
atatatttatagaaatacggc

SEQ ID NO: 68711 - DNA, 21 bp, Artificial sequence
  SiRNA target sequence
tatatttatagaaatacggca

SEQ ID NO: 68712 - DNA, 21 bp, Artificial sequence
  SiRNA target sequence
atatttatagaaatacggcaa

SEQ ID NO: 68713 - DNA, 21 bp, Artificial sequence
  SiRNA target sequence
tatttatagaaatacggcaaa

SEQ ID NO: 68714 - DNA, 21 bp, Artificial sequence
  SiRNA target sequence
atttatagaaatacggcaaaa

SEQ ID NO: 68715 - DNA, 21 bp, Artificial sequence
  SiRNA target sequence
tttatagaaatacggcaaaat

SEQ ID NO: 68716 - DNA, 21 bp, Artificial sequence
  SiRNA target sequence
ttatagaaatacggcaaaatc

SEQ ID NO: 68717 - DNA, 21 bp, Artificial sequence
  SiRNA target sequence
tatagaaatacggcaaaatct

SEQ ID NO: 68718 - DNA, 21 bp, Artificial sequence
  SiRNA target sequence
atagaaatacggcaaaatcta

SEQ ID NO: 68719 - DNA, 21 bp, Artificial sequence
  SiRNA target sequence
tagaaatacggcaaaatctac

SEQ ID NO: 68720 - DNA, 21 bp, Artificial sequence
  SiRNA target sequence
agaaatacggcaaaatctaca

SEQ ID NO: 68721 - DNA, 21 bp, Artificial sequence
  SiRNA target sequence
gaaatacggcaaaatctacat

SEQ ID NO: 68722 - DNA, 21 bp, Artificial sequence
  SiRNA target sequence
aaatacggcaaaatctacatt

SEQ ID NO: 68723 - DNA, 21 bp, Artificial sequence
  SiRNA target sequence
aatacggcaaaatctacattc

SEQ ID NO: 68724 - DNA, 21 bp, Artificial sequence
  SiRNA target sequence
atacggcaaaatctacattca

SEQ ID NO: 68725 - DNA, 21 bp, Artificial sequence
  SiRNA target sequence
tacggcaaaatctacattcaa

SEQ ID NO: 68726 - DNA, 21 bp, Artificial sequence
  SiRNA target sequence
acggcaaaatctacattcaaa

SEQ ID NO: 68727 - DNA, 21 bp, Artificial sequence
  SiRNA target sequence
cggcaaaatctacattcaaag

SEQ ID NO: 68728 - DNA, 21 bp, Artificial sequence
  SiRNA target sequence
ggcaaaatctacattcaaagg

SEQ ID NO: 68729 - DNA, 21 bp, Artificial sequence
  SiRNA target sequence
gcaaaatctacattcaaaggc

SEQ ID NO: 68730 - DNA, 21 bp, Artificial sequence
  SiRNA target sequence
caaaatctacattcaaaggct

SEQ ID NO: 68731 - DNA, 21 bp, Artificial sequence
  SiRNA target sequence
aaaatctacattcaaaggctt

SEQ ID NO: 68732 - DNA, 21 bp, Artificial sequence
  SiRNA target sequence
aaatctacattcaaaggcttc

SEQ ID NO: 68733 - DNA, 21 bp, Artificial sequence
  SiRNA target sequence
aatctacattcaaaggcttca

SEQ ID NO: 68734 - DNA, 21 bp, Artificial sequence
  SiRNA target sequence
atctacattcaaaggcttcat

SEQ ID NO: 68735 - DNA, 21 bp, Artificial sequence
  SiRNA target sequence
tctacattcaaaggcttcatt

SEQ ID NO: 68736 - DNA, 21 bp, Artificial sequence
  SiRNA target sequence
ctacattcaaaggcttcattt

SEQ ID NO: 68737 - DNA, 21 bp, Artificial sequence
  SiRNA target sequence
tacattcaaaggcttcatttc

SEQ ID NO: 68738 - DNA, 21 bp, Artificial sequence
  SiRNA target sequence
acattcaaaggcttcatttct

SEQ ID NO: 68739 - DNA, 21 bp, Artificial sequence
  SiRNA target sequence
cattcaaaggcttcatttctc

SEQ ID NO: 68740 - DNA, 21 bp, Artificial sequence
  SiRNA target sequence
attcaaaggcttcatttctct

SEQ ID NO: 68741 - DNA, 21 bp, Artificial sequence
  SiRNA target sequence
ttcaaaggcttcatttctctt

SEQ ID NO: 68742 - DNA, 21 bp, Artificial sequence
  SiRNA target sequence
tcaaaggcttcatttctcttt

SEQ ID NO: 68743 - DNA, 21 bp, Artificial sequence
  SiRNA target sequence
caaaggcttcatttctctttc

SEQ ID NO: 68744 - DNA, 21 bp, Artificial sequence
  SiRNA target sequence
aaaggcttcatttctctttca

SEQ ID NO: 68745 - DNA, 21 bp, Artificial sequence
  SiRNA target sequence
aaggcttcatttctctttcac

SEQ ID NO: 68746 - DNA, 21 bp, Artificial sequence
  SiRNA target sequence
aggcttcatttctctttcacc

SEQ ID NO: 68747 - DNA, 21 bp, Artificial sequence
  SiRNA target sequence
ggcttcatttctctttcacct

SEQ ID NO: 68748 - DNA, 21 bp, Artificial sequence
  SiRNA target sequence
gcttcatttctctttcaccta

SEQ ID NO: 68749 - DNA, 21 bp, Artificial sequence
  SiRNA target sequence
cttcatttctctttcacctaa

SEQ ID NO: 68750 - DNA, 21 bp, Artificial sequence
  SiRNA target sequence
ttcatttctctttcacctaaa

SEQ ID NO: 68751 - DNA, 21 bp, Artificial sequence
  SiRNA target sequence
tcatttctctttcacctaaaa

SEQ ID NO: 68752 - DNA, 21 bp, Artificial sequence
  SiRNA target sequence
catttctctttcacctaaaaa

SEQ ID NO: 68753 - DNA, 21 bp, Artificial sequence
  SiRNA target sequence
atttctctttcacctaaaaat

SEQ ID NO: 68754 - DNA, 21 bp, Artificial sequence
  SiRNA target sequence
tttctctttcacctaaaaatt

SEQ ID NO: 68755 - DNA, 21 bp, Artificial sequence
  SiRNA target sequence
ttctctttcacctaaaaattt

SEQ ID NO: 68756 - DNA, 21 bp, Artificial sequence
  SiRNA target sequence
tctctttcacctaaaaatttt

SEQ ID NO: 68757 - DNA, 21 bp, Artificial sequence
  SiRNA target sequence
ctctttcacctaaaaatttta

SEQ ID NO: 68758 - DNA, 21 bp, Artificial sequence
  SiRNA target sequence
tctttcacctaaaaattttag

SEQ ID NO: 68759 - DNA, 21 bp, Artificial sequence
  SiRNA target sequence
ctttcacctaaaaattttagt

SEQ ID NO: 68760 - DNA, 21 bp, Artificial sequence
  SiRNA target sequence
tttcacctaaaaattttagta

SEQ ID NO: 68761 - DNA, 21 bp, Artificial sequence
  SiRNA target sequence
ttcacctaaaaattttagtac

SEQ ID NO: 68762 - DNA, 21 bp, Artificial sequence
  SiRNA target sequence
tcacctaaaaattttagtacc

SEQ ID NO: 68763 - DNA, 21 bp, Artificial sequence
  SiRNA target sequence
cacctaaaaattttagtacca

SEQ ID NO: 68764 - DNA, 21 bp, Artificial sequence
  SiRNA target sequence
acctaaaaattttagtaccat

SEQ ID NO: 68765 - DNA, 21 bp, Artificial sequence
  SiRNA target sequence
cctaaaaattttagtaccata

SEQ ID NO: 68766 - DNA, 21 bp, Artificial sequence
  SiRNA target sequence
ctaaaaattttagtaccatag

SEQ ID NO: 68767 - DNA, 21 bp, Artificial sequence
  SiRNA target sequence
taaaaattttagtaccatagg

SEQ ID NO: 68768 - DNA, 21 bp, Artificial sequence
  SiRNA target sequence
aaaaattttagtaccataggt

SEQ ID NO: 68769 - DNA, 21 bp, Artificial sequence
  SiRNA target sequence
aaaattttagtaccataggtg

SEQ ID NO: 68770 - DNA, 21 bp, Artificial sequence
  SiRNA target sequence
aaattttagtaccataggtgg

SEQ ID NO: 68771 - DNA, 21 bp, Artificial sequence
  SiRNA target sequence
aattttagtaccataggtggc

SEQ ID NO: 68772 - DNA, 21 bp, Artificial sequence
  SiRNA target sequence
attttagtaccataggtggcg

SEQ ID NO: 68773 - DNA, 21 bp, Artificial sequence
  SiRNA target sequence
ttttagtaccataggtggcgg

SEQ ID NO: 68774 - DNA, 21 bp, Artificial sequence
  SiRNA target sequence
tttagtaccataggtggcgga

SEQ ID NO: 68775 - DNA, 21 bp, Artificial sequence
  SiRNA target sequence
ttagtaccataggtggcggag

SEQ ID NO: 68776 - DNA, 21 bp, Artificial sequence
  SiRNA target sequence
tagtaccataggtggcggaga

SEQ ID NO: 68777 - DNA, 21 bp, Artificial sequence
  SiRNA target sequence
agtaccataggtggcggagaa

SEQ ID NO: 68778 - DNA, 21 bp, Artificial sequence
  SiRNA target sequence
gtaccataggtggcggagaaa

SEQ ID NO: 68779 - DNA, 21 bp, Artificial sequence
  SiRNA target sequence
taccataggtggcggagaaat

SEQ ID NO: 68780 - DNA, 21 bp, Artificial sequence
  SiRNA target sequence
accataggtggcggagaaatt

SEQ ID NO: 68781 - DNA, 21 bp, Artificial sequence
  SiRNA target sequence
ccataggtggcggagaaattc

SEQ ID NO: 68782 - DNA, 21 bp, Artificial sequence
  SiRNA target sequence
cataggtggcggagaaattca

SEQ ID NO: 68783 - DNA, 21 bp, Artificial sequence
  SiRNA target sequence
ataggtggcggagaaattcaa

SEQ ID NO: 68784 - DNA, 21 bp, Artificial sequence
  SiRNA target sequence
taggtggcggagaaattcaaa

SEQ ID NO: 68785 - DNA, 21 bp, Artificial sequence
  SiRNA target sequence
aggtggcggagaaattcaaac

SEQ ID NO: 68786 - DNA, 21 bp, Artificial sequence
  SiRNA target sequence
ggtggcggagaaattcaaaca

SEQ ID NO: 68787 - DNA, 21 bp, Artificial sequence
  SiRNA target sequence
gtggcggagaaattcaaacaa

SEQ ID NO: 68788 - DNA, 21 bp, Artificial sequence
  SiRNA target sequence
tggcggagaaattcaaacaat

SEQ ID NO: 68789 - DNA, 21 bp, Artificial sequence
  SiRNA target sequence
ggcggagaaattcaaacaata

SEQ ID NO: 68790 - DNA, 21 bp, Artificial sequence
  SiRNA target sequence
gcggagaaattcaaacaataa

SEQ ID NO: 68791 - DNA, 21 bp, Artificial sequence
  SiRNA target sequence
cggagaaattcaaacaataat

SEQ ID NO: 68792 - DNA, 21 bp, Artificial sequence
  SiRNA target sequence
ggagaaattcaaacaataata

SEQ ID NO: 68793 - DNA, 21 bp, Artificial sequence
  SiRNA target sequence
gagaaattcaaacaataatag

SEQ ID NO: 68794 - DNA, 21 bp, Artificial sequence
  SiRNA target sequence
agaaattcaaacaataataga

SEQ ID NO: 68795 - DNA, 21 bp, Artificial sequence
  SiRNA target sequence
gaaattcaaacaataatagat

SEQ ID NO: 68796 - DNA, 21 bp, Artificial sequence
  SiRNA target sequence
aaattcaaacaataatagata

SEQ ID NO: 68797 - DNA, 21 bp, Artificial sequence
  SiRNA target sequence
aattcaaacaataatagatag

SEQ ID NO: 68798 - DNA, 21 bp, Artificial sequence
  SiRNA target sequence
attcaaacaataatagataga

SEQ ID NO: 68799 - DNA, 21 bp, Artificial sequence
  SiRNA target sequence
ttcaaacaataatagatagaa

SEQ ID NO: 68800 - DNA, 21 bp, Artificial sequence
  SiRNA target sequence
tcaaacaataatagatagaaa

SEQ ID NO: 68801 - DNA, 21 bp, Artificial sequence
  SiRNA target sequence
caaacaataatagatagaaaa

SEQ ID NO: 68802 - DNA, 21 bp, Artificial sequence
  SiRNA target sequence
aaacaataatagatagaaaat

SEQ ID NO: 68803 - DNA, 21 bp, Artificial sequence
  SiRNA target sequence
aacaataatagatagaaaatc

SEQ ID NO: 68804 - DNA, 21 bp, Artificial sequence
  SiRNA target sequence
acaataatagatagaaaatca

SEQ ID NO: 68805 - DNA, 21 bp, Artificial sequence
  SiRNA target sequence
caataatagatagaaaatcaa

SEQ ID NO: 68806 - DNA, 21 bp, Artificial sequence
  SiRNA target sequence
aataatagatagaaaatcaaa

SEQ ID NO: 68807 - DNA, 21 bp, Artificial sequence
  SiRNA target sequence
ataatagatagaaaatcaaaa

SEQ ID NO: 68808 - DNA, 21 bp, Artificial sequence
  SiRNA target sequence
taatagatagaaaatcaaaat

SEQ ID NO: 68809 - DNA, 21 bp, Artificial sequence
  SiRNA target sequence
aatagatagaaaatcaaaatc

SEQ ID NO: 68810 - DNA, 21 bp, Artificial sequence
  SiRNA target sequence
atagatagaaaatcaaaatct

SEQ ID NO: 68811 - DNA, 21 bp, Artificial sequence
  SiRNA target sequence
tagatagaaaatcaaaatctg

SEQ ID NO: 68812 - DNA, 21 bp, Artificial sequence
  SiRNA target sequence
agatagaaaatcaaaatctgc

SEQ ID NO: 68813 - DNA, 21 bp, Artificial sequence
  SiRNA target sequence
gatagaaaatcaaaatctgca

SEQ ID NO: 68814 - DNA, 21 bp, Artificial sequence
  SiRNA target sequence
atagaaaatcaaaatctgcaa

SEQ ID NO: 68815 - DNA, 21 bp, Artificial sequence
  SiRNA target sequence
tagaaaatcaaaatctgcaag

SEQ ID NO: 68816 - DNA, 21 bp, Artificial sequence
  SiRNA target sequence
agaaaatcaaaatctgcaagt

SEQ ID NO: 68817 - DNA, 21 bp, Artificial sequence
  SiRNA target sequence
gaaaatcaaaatctgcaagtg

SEQ ID NO: 68818 - DNA, 21 bp, Artificial sequence
  SiRNA target sequence
aaaatcaaaatctgcaagtga

SEQ ID NO: 68819 - DNA, 21 bp, Artificial sequence
  SiRNA target sequence
aaatcaaaatctgcaagtgaa

SEQ ID NO: 68820 - DNA, 21 bp, Artificial sequence
  SiRNA target sequence
aatcaaaatctgcaagtgaac

SEQ ID NO: 68821 - DNA, 21 bp, Artificial sequence
  SiRNA target sequence
atcaaaatctgcaagtgaact

SEQ ID NO: 68822 - DNA, 21 bp, Artificial sequence
  SiRNA target sequence
tcaaaatctgcaagtgaactt

SEQ ID NO: 68823 - DNA, 21 bp, Artificial sequence
  SiRNA target sequence
caaaatctgcaagtgaactta

SEQ ID NO: 68824 - DNA, 21 bp, Artificial sequence
  SiRNA target sequence
aaaatctgcaagtgaacttat

SEQ ID NO: 68825 - DNA, 21 bp, Artificial sequence
  SiRNA target sequence
aaatctgcaagtgaacttatt

SEQ ID NO: 68826 - DNA, 21 bp, Artificial sequence
  SiRNA target sequence
aatctgcaagtgaacttattg

SEQ ID NO: 68827 - DNA, 21 bp, Artificial sequence
  SiRNA target sequence
atctgcaagtgaacttattga

SEQ ID NO: 68828 - DNA, 21 bp, Artificial sequence
  SiRNA target sequence
tctgcaagtgaacttattgaa

SEQ ID NO: 68829 - DNA, 21 bp, Artificial sequence
  SiRNA target sequence
ctgcaagtgaacttattgaag

SEQ ID NO: 68830 - DNA, 21 bp, Artificial sequence
  SiRNA target sequence
tgcaagtgaacttattgaagt

SEQ ID NO: 68831 - DNA, 21 bp, Artificial sequence
  SiRNA target sequence
gcaagtgaacttattgaagtg

SEQ ID NO: 68832 - DNA, 21 bp, Artificial sequence
  SiRNA target sequence
caagtgaacttattgaagtgt

SEQ ID NO: 68833 - DNA, 21 bp, Artificial sequence
  SiRNA target sequence
aagtgaacttattgaagtgtt

SEQ ID NO: 68834 - DNA, 21 bp, Artificial sequence
  SiRNA target sequence
agtgaacttattgaagtgttt

SEQ ID NO: 68835 - DNA, 21 bp, Artificial sequence
  SiRNA target sequence
gtgaacttattgaagtgtttc

SEQ ID NO: 68836 - DNA, 21 bp, Artificial sequence
  SiRNA target sequence
tgaacttattgaagtgtttct

SEQ ID NO: 68837 - DNA, 21 bp, Artificial sequence
  SiRNA target sequence
gaacttattgaagtgtttctt

SEQ ID NO: 68838 - DNA, 21 bp, Artificial sequence
  SiRNA target sequence
aacttattgaagtgtttctta

SEQ ID NO: 68839 - DNA, 21 bp, Artificial sequence
  SiRNA target sequence
acttattgaagtgtttcttac

SEQ ID NO: 68840 - DNA, 21 bp, Artificial sequence
  SiRNA target sequence
cttattgaagtgtttcttaca

SEQ ID NO: 68841 - DNA, 21 bp, Artificial sequence
  SiRNA target sequence
ttattgaagtgtttcttacaa

SEQ ID NO: 68842 - DNA, 21 bp, Artificial sequence
  SiRNA target sequence
tattgaagtgtttcttacaag

SEQ ID NO: 68843 - DNA, 21 bp, Artificial sequence
  SiRNA target sequence
attgaagtgtttcttacaagc

SEQ ID NO: 68844 - DNA, 21 bp, Artificial sequence
  SiRNA target sequence
ttgaagtgtttcttacaagct

SEQ ID NO: 68845 - DNA, 21 bp, Artificial sequence
  SiRNA target sequence
tgaagtgtttcttacaagctt

SEQ ID NO: 68846 - DNA, 21 bp, Artificial sequence
  SiRNA target sequence
gaagtgtttcttacaagcttg

SEQ ID NO: 68847 - DNA, 21 bp, Artificial sequence
  SiRNA target sequence
aagtgtttcttacaagcttgc

SEQ ID NO: 68848 - DNA, 21 bp, Artificial sequence
  SiRNA target sequence
agtgtttcttacaagcttgct

SEQ ID NO: 68849 - DNA, 21 bp, Artificial sequence
  SiRNA target sequence
gtgtttcttacaagcttgctt

SEQ ID NO: 68850 - DNA, 21 bp, Artificial sequence
  SiRNA target sequence
tgtttcttacaagcttgcttc

SEQ ID NO: 68851 - DNA, 21 bp, Artificial sequence
  SiRNA target sequence
gtttcttacaagcttgcttcc

SEQ ID NO: 68852 - DNA, 21 bp, Artificial sequence
  SiRNA target sequence
tttcttacaagcttgcttcca

SEQ ID NO: 68853 - DNA, 21 bp, Artificial sequence
  SiRNA target sequence
ttcttacaagcttgcttccaa

SEQ ID NO: 68854 - DNA, 21 bp, Artificial sequence
  SiRNA target sequence
tcttacaagcttgcttccaat

SEQ ID NO: 68855 - DNA, 21 bp, Artificial sequence
  SiRNA target sequence
cttacaagcttgcttccaata

SEQ ID NO: 68856 - DNA, 21 bp, Artificial sequence
  SiRNA target sequence
ttacaagcttgcttccaatat

SEQ ID NO: 68857 - DNA, 21 bp, Artificial sequence
  SiRNA target sequence
tacaagcttgcttccaatatg

SEQ ID NO: 68858 - DNA, 21 bp, Artificial sequence
  SiRNA target sequence
acaagcttgcttccaatatgc

SEQ ID NO: 68859 - DNA, 21 bp, Artificial sequence
  SiRNA target sequence
caagcttgcttccaatatgcc

SEQ ID NO: 68860 - DNA, 21 bp, Artificial sequence
  SiRNA target sequence
aagcttgcttccaatatgcct

SEQ ID NO: 68861 - DNA, 21 bp, Artificial sequence
  SiRNA target sequence
agcttgcttccaatatgcctt

SEQ ID NO: 68862 - DNA, 21 bp, Artificial sequence
  SiRNA target sequence
gcttgcttccaatatgcctta

SEQ ID NO: 68863 - DNA, 21 bp, Artificial sequence
  SiRNA target sequence
cttgcttccaatatgccttaa

SEQ ID NO: 68864 - DNA, 21 bp, Artificial sequence
  SiRNA target sequence
ttgcttccaatatgccttaaa

SEQ ID NO: 68865 - DNA, 21 bp, Artificial sequence
  SiRNA target sequence
tgcttccaatatgccttaaac

SEQ ID NO: 68866 - DNA, 21 bp, Artificial sequence
  SiRNA target sequence
gcttccaatatgccttaaact

SEQ ID NO: 68867 - DNA, 21 bp, Artificial sequence
  SiRNA target sequence
cttccaatatgccttaaactt

SEQ ID NO: 68868 - DNA, 21 bp, Artificial sequence
  SiRNA target sequence
ttccaatatgccttaaacttt

SEQ ID NO: 68869 - DNA, 21 bp, Artificial sequence
  SiRNA target sequence
tccaatatgccttaaactttt

SEQ ID NO: 68870 - DNA, 21 bp, Artificial sequence
  SiRNA target sequence
ccaatatgccttaaactttta

SEQ ID NO: 68871 - DNA, 21 bp, Artificial sequence
  SiRNA target sequence
caatatgccttaaacttttat

SEQ ID NO: 68872 - DNA, 21 bp, Artificial sequence
  SiRNA target sequence
aatatgccttaaacttttatt

SEQ ID NO: 68873 - DNA, 21 bp, Artificial sequence
  SiRNA target sequence
atatgccttaaacttttattt

SEQ ID NO: 68874 - DNA, 21 bp, Artificial sequence
  SiRNA target sequence
tatgccttaaacttttatttg

SEQ ID NO: 68875 - DNA, 21 bp, Artificial sequence
  SiRNA target sequence
atgccttaaacttttatttgc

SEQ ID NO: 68876 - DNA, 21 bp, Artificial sequence
  SiRNA target sequence
tgccttaaacttttatttgcc

SEQ ID NO: 68877 - DNA, 21 bp, Artificial sequence
  SiRNA target sequence
gccttaaacttttatttgccc

SEQ ID NO: 68878 - DNA, 21 bp, Artificial sequence
  SiRNA target sequence
ccttaaacttttatttgccct

SEQ ID NO: 68879 - DNA, 21 bp, Artificial sequence
  SiRNA target sequence
cttaaacttttatttgccctt

SEQ ID NO: 68880 - DNA, 21 bp, Artificial sequence
  SiRNA target sequence
ttaaacttttatttgccctta

SEQ ID NO: 68881 - DNA, 21 bp, Artificial sequence
  SiRNA target sequence
taaacttttatttgcccttat

SEQ ID NO: 68882 - DNA, 21 bp, Artificial sequence
  SiRNA target sequence
aaacttttatttgcccttatt

SEQ ID NO: 68883 - DNA, 21 bp, Artificial sequence
  SiRNA target sequence
aacttttatttgcccttattg

SEQ ID NO: 68884 - DNA, 21 bp, Artificial sequence
  SiRNA target sequence
acttttatttgcccttattgc

SEQ ID NO: 68885 - DNA, 21 bp, Artificial sequence
  SiRNA target sequence
cttttatttgcccttattgca

SEQ ID NO: 68886 - DNA, 21 bp, Artificial sequence
  SiRNA target sequence
ttttatttgcccttattgcag

SEQ ID NO: 68887 - DNA, 21 bp, Artificial sequence
  SiRNA target sequence
tttatttgcccttattgcagt

SEQ ID NO: 68888 - DNA, 21 bp, Artificial sequence
  SiRNA target sequence
ttatttgcccttattgcagtt

SEQ ID NO: 68889 - DNA, 21 bp, Artificial sequence
  SiRNA target sequence
tatttgcccttattgcagtta

SEQ ID NO: 68890 - DNA, 21 bp, Artificial sequence
  SiRNA target sequence
atttgcccttattgcagttat

SEQ ID NO: 68891 - DNA, 21 bp, Artificial sequence
  SiRNA target sequence
tttgcccttattgcagttata

SEQ ID NO: 68892 - DNA, 21 bp, Artificial sequence
  SiRNA target sequence
ttgcccttattgcagttataa

SEQ ID NO: 68893 - DNA, 21 bp, Artificial sequence
  SiRNA target sequence
tgcccttattgcagttataaa

SEQ ID NO: 68894 - DNA, 21 bp, Artificial sequence
  SiRNA target sequence
gcccttattgcagttataaaa

SEQ ID NO: 68895 - DNA, 21 bp, Artificial sequence
  SiRNA target sequence
cccttattgcagttataaaaa

SEQ ID NO: 68896 - DNA, 21 bp, Artificial sequence
  SiRNA target sequence
ccttattgcagttataaaaaa

SEQ ID NO: 68897 - DNA, 21 bp, Artificial sequence
  SiRNA target sequence
cttattgcagttataaaaaat

SEQ ID NO: 68898 - DNA, 21 bp, Artificial sequence
  SiRNA target sequence
ttattgcagttataaaaaata

SEQ ID NO: 68899 - DNA, 21 bp, Artificial sequence
  SiRNA target sequence
tattgcagttataaaaaatat

SEQ ID NO: 68900 - DNA, 21 bp, Artificial sequence
  SiRNA target sequence
attgcagttataaaaaatatg

SEQ ID NO: 68901 - DNA, 21 bp, Artificial sequence
  SiRNA target sequence
ttgcagttataaaaaatatgg

SEQ ID NO: 68902 - DNA, 21 bp, Artificial sequence
  SiRNA target sequence
tgcagttataaaaaatatggg

SEQ ID NO: 68903 - DNA, 21 bp, Artificial sequence
  SiRNA target sequence
gcagttataaaaaatatggga

SEQ ID NO: 68904 - DNA, 21 bp, Artificial sequence
  SiRNA target sequence
cagttataaaaaatatgggag

SEQ ID NO: 68905 - DNA, 21 bp, Artificial sequence
  SiRNA target sequence
agttataaaaaatatgggagg

SEQ ID NO: 68906 - DNA, 21 bp, Artificial sequence
  SiRNA target sequence
gttataaaaaatatgggaggt

SEQ ID NO: 68907 - DNA, 21 bp, Artificial sequence
  SiRNA target sequence
ttataaaaaatatgggaggtc

SEQ ID NO: 68908 - DNA, 21 bp, Artificial sequence
  SiRNA target sequence
tataaaaaatatgggaggtct

SEQ ID NO: 68909 - DNA, 21 bp, Artificial sequence
  SiRNA target sequence
ataaaaaatatgggaggtctt

SEQ ID NO: 68910 - DNA, 21 bp, Artificial sequence
  SiRNA target sequence
taaaaaatatgggaggtcttg

SEQ ID NO: 68911 - DNA, 21 bp, Artificial sequence
  SiRNA target sequence
aaaaaatatgggaggtcttgc

SEQ ID NO: 68912 - DNA, 21 bp, Artificial sequence
  SiRNA target sequence
aaaaatatgggaggtcttgcg

SEQ ID NO: 68913 - DNA, 21 bp, Artificial sequence
  SiRNA target sequence
aaaatatgggaggtcttgcgg

SEQ ID NO: 68914 - DNA, 21 bp, Artificial sequence
  SiRNA target sequence
aaatatgggaggtcttgcggg

SEQ ID NO: 68915 - DNA, 21 bp, Artificial sequence
  SiRNA target sequence
aatatgggaggtcttgcgggc

SEQ ID NO: 68916 - DNA, 21 bp, Artificial sequence
  SiRNA target sequence
atatgggaggtcttgcgggct

SEQ ID NO: 68917 - DNA, 21 bp, Artificial sequence
  SiRNA target sequence
tatgggaggtcttgcgggctt

SEQ ID NO: 68918 - DNA, 21 bp, Artificial sequence
  SiRNA target sequence
atgggaggtcttgcgggcttc

SEQ ID NO: 68919 - DNA, 21 bp, Artificial sequence
  SiRNA target sequence
tgggaggtcttgcgggcttca

SEQ ID NO: 68920 - DNA, 21 bp, Artificial sequence
  SiRNA target sequence
gggaggtcttgcgggcttcat

SEQ ID NO: 68921 - DNA, 21 bp, Artificial sequence
  SiRNA target sequence
ggaggtcttgcgggcttcata

SEQ ID NO: 68922 - DNA, 21 bp, Artificial sequence
  SiRNA target sequence
gaggtcttgcgggcttcataa

SEQ ID NO: 68923 - DNA, 21 bp, Artificial sequence
  SiRNA target sequence
aggtcttgcgggcttcataat

SEQ ID NO: 68924 - DNA, 21 bp, Artificial sequence
  SiRNA target sequence
ggtcttgcgggcttcataatg

SEQ ID NO: 68925 - DNA, 21 bp, Artificial sequence
  SiRNA target sequence
gtcttgcgggcttcataatgt

SEQ ID NO: 68926 - DNA, 21 bp, Artificial sequence
  SiRNA target sequence
tcttgcgggcttcataatgtt

SEQ ID NO: 68927 - DNA, 21 bp, Artificial sequence
  SiRNA target sequence
cttgcgggcttcataatgttt

SEQ ID NO: 68928 - DNA, 21 bp, Artificial sequence
  SiRNA target sequence
ttgcgggcttcataatgtttg

SEQ ID NO: 68929 - DNA, 21 bp, Artificial sequence
  SiRNA target sequence
tgcgggcttcataatgtttgt

SEQ ID NO: 68930 - DNA, 21 bp, Artificial sequence
  SiRNA target sequence
gcgggcttcataatgtttgtt

SEQ ID NO: 68931 - DNA, 21 bp, Artificial sequence
  SiRNA target sequence
cgggcttcataatgtttgttt

SEQ ID NO: 68932 - DNA, 21 bp, Artificial sequence
  SiRNA target sequence
gggcttcataatgtttgtttg

SEQ ID NO: 68933 - DNA, 21 bp, Artificial sequence
  SiRNA target sequence
ggcttcataatgtttgtttgt

SEQ ID NO: 68934 - DNA, 21 bp, Artificial sequence
  SiRNA target sequence
gcttcataatgtttgtttgtg

SEQ ID NO: 68935 - DNA, 21 bp, Artificial sequence
  SiRNA target sequence
cttcataatgtttgtttgtgt

SEQ ID NO: 68936 - DNA, 21 bp, Artificial sequence
  SiRNA target sequence
ttcataatgtttgtttgtgtt

SEQ ID NO: 68937 - DNA, 21 bp, Artificial sequence
  SiRNA target sequence
tcataatgtttgtttgtgttt

SEQ ID NO: 68938 - DNA, 21 bp, Artificial sequence
  SiRNA target sequence
cataatgtttgtttgtgtttc

SEQ ID NO: 68939 - DNA, 21 bp, Artificial sequence
  SiRNA target sequence
ataatgtttgtttgtgtttct

SEQ ID NO: 68940 - DNA, 21 bp, Artificial sequence
  SiRNA target sequence
taatgtttgtttgtgtttctt

SEQ ID NO: 68941 - DNA, 21 bp, Artificial sequence
  SiRNA target sequence
aatgtttgtttgtgtttcttg

SEQ ID NO: 68942 - DNA, 21 bp, Artificial sequence
  SiRNA target sequence
atgtttgtttgtgtttcttgc

SEQ ID NO: 68943 - DNA, 21 bp, Artificial sequence
  SiRNA target sequence
tgtttgtttgtgtttcttgct

SEQ ID NO: 68944 - DNA, 21 bp, Artificial sequence
  SiRNA target sequence
gtttgtttgtgtttcttgcta

SEQ ID NO: 68945 - DNA, 21 bp, Artificial sequence
  SiRNA target sequence
tttgtttgtgtttcttgctat

SEQ ID NO: 68946 - DNA, 21 bp, Artificial sequence
  SiRNA target sequence
ttgtttgtgtttcttgctatg

SEQ ID NO: 68947 - DNA, 21 bp, Artificial sequence
  SiRNA target sequence
tgtttgtgtttcttgctatgc

SEQ ID NO: 68948 - DNA, 21 bp, Artificial sequence
  SiRNA target sequence
gtttgtgtttcttgctatgcg

SEQ ID NO: 68949 - DNA, 21 bp, Artificial sequence
  SiRNA target sequence
tttgtgtttcttgctatgcga

SEQ ID NO: 68950 - DNA, 21 bp, Artificial sequence
  SiRNA target sequence
ttgtgtttcttgctatgcgac

SEQ ID NO: 68951 - DNA, 21 bp, Artificial sequence
  SiRNA target sequence
tgtgtttcttgctatgcgact

SEQ ID NO: 68952 - DNA, 21 bp, Artificial sequence
  SiRNA target sequence
gtgtttcttgctatgcgactg

SEQ ID NO: 68953 - DNA, 21 bp, Artificial sequence
  SiRNA target sequence
tgtttcttgctatgcgactgt

SEQ ID NO: 68954 - DNA, 21 bp, Artificial sequence
  SiRNA target sequence
gtttcttgctatgcgactgtg

SEQ ID NO: 68955 - DNA, 21 bp, Artificial sequence
  SiRNA target sequence
tttcttgctatgcgactgtga

SEQ ID NO: 68956 - DNA, 21 bp, Artificial sequence
  SiRNA target sequence
ttcttgctatgcgactgtgac

SEQ ID NO: 68957 - DNA, 21 bp, Artificial sequence
  SiRNA target sequence
tcttgctatgcgactgtgact

SEQ ID NO: 68958 - DNA, 21 bp, Artificial sequence
  SiRNA target sequence
cttgctatgcgactgtgacta

SEQ ID NO: 68959 - DNA, 21 bp, Artificial sequence
  SiRNA target sequence
ttgctatgcgactgtgactat

SEQ ID NO: 68960 - DNA, 21 bp, Artificial sequence
  SiRNA target sequence
tgctatgcgactgtgactata

SEQ ID NO: 68961 - DNA, 21 bp, Artificial sequence
  SiRNA target sequence
gctatgcgactgtgactatat

SEQ ID NO: 68962 - DNA, 21 bp, Artificial sequence
  SiRNA target sequence
ctatgcgactgtgactatatt

SEQ ID NO: 68963 - DNA, 21 bp, Artificial sequence
  SiRNA target sequence
tatgcgactgtgactatattg

SEQ ID NO: 68964 - DNA, 21 bp, Artificial sequence
  SiRNA target sequence
atgcgactgtgactatattga

SEQ ID NO: 68965 - DNA, 21 bp, Artificial sequence
  SiRNA target sequence
tgcgactgtgactatattgat

SEQ ID NO: 68966 - DNA, 21 bp, Artificial sequence
  SiRNA target sequence
gcgactgtgactatattgata

SEQ ID NO: 68967 - DNA, 21 bp, Artificial sequence
  SiRNA target sequence
cgactgtgactatattgatag

SEQ ID NO: 68968 - DNA, 21 bp, Artificial sequence
  SiRNA target sequence
gactgtgactatattgatagc

SEQ ID NO: 68969 - DNA, 21 bp, Artificial sequence
  SiRNA target sequence
actgtgactatattgatagca

SEQ ID NO: 68970 - DNA, 21 bp, Artificial sequence
  SiRNA target sequence
ctgtgactatattgatagcac

SEQ ID NO: 68971 - DNA, 21 bp, Artificial sequence
  SiRNA target sequence
tgtgactatattgatagcaca

SEQ ID NO: 68972 - DNA, 21 bp, Artificial sequence
  SiRNA target sequence
gtgactatattgatagcacaa

SEQ ID NO: 68973 - DNA, 21 bp, Artificial sequence
  SiRNA target sequence
tgactatattgatagcacaat

SEQ ID NO: 68974 - DNA, 21 bp, Artificial sequence
  SiRNA target sequence
gactatattgatagcacaatg

SEQ ID NO: 68975 - DNA, 21 bp, Artificial sequence
  SiRNA target sequence
actatattgatagcacaatgg

SEQ ID NO: 68976 - DNA, 21 bp, Artificial sequence
  SiRNA target sequence
ctatattgatagcacaatgga

SEQ ID NO: 68977 - DNA, 21 bp, Artificial sequence
  SiRNA target sequence
tatattgatagcacaatggag

SEQ ID NO: 68978 - DNA, 21 bp, Artificial sequence
  SiRNA target sequence
atattgatagcacaatggaga

SEQ ID NO: 68979 - DNA, 21 bp, Artificial sequence
  SiRNA target sequence
tattgatagcacaatggagat

SEQ ID NO: 68980 - DNA, 21 bp, Artificial sequence
  SiRNA target sequence
attgatagcacaatggagatc

SEQ ID NO: 68981 - DNA, 21 bp, Artificial sequence
  SiRNA target sequence
ttgatagcacaatggagatct

SEQ ID NO: 68982 - DNA, 21 bp, Artificial sequence
  SiRNA target sequence
tgatagcacaatggagatcta

SEQ ID NO: 68983 - DNA, 21 bp, Artificial sequence
  SiRNA target sequence
gatagcacaatggagatctaa

SEQ ID NO: 68984 - DNA, 21 bp, Artificial sequence
  SiRNA target sequence
atagcacaatggagatctaat

SEQ ID NO: 68985 - DNA, 21 bp, Artificial sequence
  SiRNA target sequence
tagcacaatggagatctaata

SEQ ID NO: 68986 - DNA, 21 bp, Artificial sequence
  SiRNA target sequence
agcacaatggagatctaatat

SEQ ID NO: 68987 - DNA, 21 bp, Artificial sequence
  SiRNA target sequence
gcacaatggagatctaatatt

SEQ ID NO: 68988 - DNA, 21 bp, Artificial sequence
  SiRNA target sequence
cacaatggagatctaatatta

SEQ ID NO: 68989 - DNA, 21 bp, Artificial sequence
  SiRNA target sequence
acaatggagatctaatattag

SEQ ID NO: 68990 - DNA, 21 bp, Artificial sequence
  SiRNA target sequence
caatggagatctaatattaga

SEQ ID NO: 68991 - DNA, 21 bp, Artificial sequence
  SiRNA target sequence
aatggagatctaatattagaa

SEQ ID NO: 68992 - DNA, 21 bp, Artificial sequence
  SiRNA target sequence
atggagatctaatattagaag

SEQ ID NO: 68993 - DNA, 21 bp, Artificial sequence
  SiRNA target sequence
tggagatctaatattagaaga

SEQ ID NO: 68994 - DNA, 21 bp, Artificial sequence
  SiRNA target sequence
ggagatctaatattagaagag

SEQ ID NO: 68995 - DNA, 21 bp, Artificial sequence
  SiRNA target sequence
gagatctaatattagaagaga

SEQ ID NO: 68996 - DNA, 21 bp, Artificial sequence
  SiRNA target sequence
agatctaatattagaagagaa

SEQ ID NO: 68997 - DNA, 21 bp, Artificial sequence
  SiRNA target sequence
gatctaatattagaagagaac

SEQ ID NO: 68998 - DNA, 21 bp, Artificial sequence
  SiRNA target sequence
atctaatattagaagagaact

SEQ ID NO: 68999 - DNA, 21 bp, Artificial sequence
  SiRNA target sequence
tctaatattagaagagaactt

SEQ ID NO: 69000 - DNA, 21 bp, Artificial sequence
  SiRNA target sequence
ctaatattagaagagaactta

SEQ ID NO: 69001 - DNA, 21 bp, Artificial sequence
  SiRNA target sequence
taatattagaagagaacttaa

SEQ ID NO: 69002 - DNA, 21 bp, Artificial sequence
  SiRNA target sequence
aatattagaagagaacttaat

SEQ ID NO: 69003 - DNA, 21 bp, Artificial sequence
  SiRNA target sequence
atattagaagagaacttaata

SEQ ID NO: 69004 - DNA, 21 bp, Artificial sequence
  SiRNA target sequence
tattagaagagaacttaataa

SEQ ID NO: 69005 - DNA, 21 bp, Artificial sequence
  SiRNA target sequence
attagaagagaacttaataac

SEQ ID NO: 69006 - DNA, 21 bp, Artificial sequence
  SiRNA target sequence
ttagaagagaacttaataact

SEQ ID NO: 69007 - DNA, 21 bp, Artificial sequence
  SiRNA target sequence
tagaagagaacttaataactc

SEQ ID NO: 69008 - DNA, 21 bp, Artificial sequence
  SiRNA target sequence
agaagagaacttaataactct

SEQ ID NO: 69009 - DNA, 21 bp, Artificial sequence
  SiRNA target sequence
gaagagaacttaataactctg

SEQ ID NO: 69010 - DNA, 21 bp, Artificial sequence
  SiRNA target sequence
aagagaacttaataactctga

SEQ ID NO: 69011 - DNA, 21 bp, Artificial sequence
  SiRNA target sequence
agagaacttaataactctgaa

SEQ ID NO: 69012 - DNA, 21 bp, Artificial sequence
  SiRNA target sequence
gagaacttaataactctgaaa

SEQ ID NO: 69013 - DNA, 21 bp, Artificial sequence
  SiRNA target sequence
agaacttaataactctgaaaa

SEQ ID NO: 69014 - DNA, 21 bp, Artificial sequence
  SiRNA target sequence
gaacttaataactctgaaaat

SEQ ID NO: 69015 - DNA, 21 bp, Artificial sequence
  SiRNA target sequence
aacttaataactctgaaaata

SEQ ID NO: 69016 - DNA, 21 bp, Artificial sequence
  SiRNA target sequence
acttaataactctgaaaatag

SEQ ID NO: 69017 - DNA, 21 bp, Artificial sequence
  SiRNA target sequence
cttaataactctgaaaataga

SEQ ID NO: 69018 - DNA, 21 bp, Artificial sequence
  SiRNA target sequence
ttaataactctgaaaatagat

SEQ ID NO: 69019 - DNA, 21 bp, Artificial sequence
  SiRNA target sequence
taataactctgaaaatagatc

SEQ ID NO: 69020 - DNA, 21 bp, Artificial sequence
  SiRNA target sequence
aataactctgaaaatagatct

SEQ ID NO: 69021 - DNA, 21 bp, Artificial sequence
  SiRNA target sequence
ataactctgaaaatagatcta

SEQ ID NO: 69022 - DNA, 21 bp, Artificial sequence
  SiRNA target sequence
taactctgaaaatagatctag

SEQ ID NO: 69023 - DNA, 21 bp, Artificial sequence
  SiRNA target sequence
aactctgaaaatagatctagt

SEQ ID NO: 69024 - DNA, 21 bp, Artificial sequence
  SiRNA target sequence
actctgaaaatagatctagta

SEQ ID NO: 69025 - DNA, 21 bp, Artificial sequence
  SiRNA target sequence
ctctgaaaatagatctagtaa

SEQ ID NO: 69026 - DNA, 21 bp, Artificial sequence
  SiRNA target sequence
tctgaaaatagatctagtaat

SEQ ID NO: 69027 - DNA, 21 bp, Artificial sequence
  SiRNA target sequence
ctgaaaatagatctagtaata

SEQ ID NO: 69028 - DNA, 21 bp, Artificial sequence
  SiRNA target sequence
tgaaaatagatctagtaataa

SEQ ID NO: 69029 - DNA, 21 bp, Artificial sequence
  SiRNA target sequence
gaaaatagatctagtaataaa

SEQ ID NO: 69030 - DNA, 21 bp, Artificial sequence
  SiRNA target sequence
aaaatagatctagtaataaac

SEQ ID NO: 69031 - DNA, 21 bp, Artificial sequence
  SiRNA target sequence
aaatagatctagtaataaact

SEQ ID NO: 69032 - DNA, 21 bp, Artificial sequence
  SiRNA target sequence
aatagatctagtaataaacta

SEQ ID NO: 69033 - DNA, 21 bp, Artificial sequence
  SiRNA target sequence
atagatctagtaataaactac

SEQ ID NO: 69034 - DNA, 21 bp, Artificial sequence
  SiRNA target sequence
tagatctagtaataaactaca

SEQ ID NO: 69035 - DNA, 21 bp, Artificial sequence
  SiRNA target sequence
agatctagtaataaactacaa

SEQ ID NO: 69036 - DNA, 21 bp, Artificial sequence
  SiRNA target sequence
gatctagtaataaactacaag

SEQ ID NO: 69037 - DNA, 21 bp, Artificial sequence
  SiRNA target sequence
atctagtaataaactacaaga

SEQ ID NO: 69038 - DNA, 21 bp, Artificial sequence
  SiRNA target sequence
tctagtaataaactacaagat

SEQ ID NO: 69039 - DNA, 21 bp, Artificial sequence
  SiRNA target sequence
ctagtaataaactacaagatg

SEQ ID NO: 69040 - DNA, 21 bp, Artificial sequence
  SiRNA target sequence
tagtaataaactacaagatgg

SEQ ID NO: 69041 - DNA, 21 bp, Artificial sequence
  SiRNA target sequence
agtaataaactacaagatgga

SEQ ID NO: 69042 - DNA, 21 bp, Artificial sequence
  SiRNA target sequence
gtaataaactacaagatggat

SEQ ID NO: 69043 - DNA, 21 bp, Artificial sequence
  SiRNA target sequence
taataaactacaagatggatt

SEQ ID NO: 69044 - DNA, 21 bp, Artificial sequence
  SiRNA target sequence
aataaactacaagatggatta

SEQ ID NO: 69045 - DNA, 21 bp, Artificial sequence
  SiRNA target sequence
ataaactacaagatggattaa

SEQ ID NO: 69046 - DNA, 21 bp, Artificial sequence
  SiRNA target sequence
taaactacaagatggattaaa

SEQ ID NO: 69047 - DNA, 21 bp, Artificial sequence
  SiRNA target sequence
aaactacaagatggattaaat

SEQ ID NO: 69048 - DNA, 21 bp, Artificial sequence
  SiRNA target sequence
aactacaagatggattaaata

SEQ ID NO: 69049 - DNA, 21 bp, Artificial sequence
  SiRNA target sequence
actacaagatggattaaataa

SEQ ID NO: 69050 - DNA, 21 bp, Artificial sequence
  SiRNA target sequence
ctacaagatggattaaataat

SEQ ID NO: 69051 - DNA, 21 bp, Artificial sequence
  SiRNA target sequence
tacaagatggattaaataatc

SEQ ID NO: 69052 - DNA, 21 bp, Artificial sequence
  SiRNA target sequence
acaagatggattaaataatca

SEQ ID NO: 69053 - DNA, 21 bp, Artificial sequence
  SiRNA target sequence
caagatggattaaataatcat

SEQ ID NO: 69054 - DNA, 21 bp, Artificial sequence
  SiRNA target sequence
aagatggattaaataatcatg

SEQ ID NO: 69055 - DNA, 21 bp, Artificial sequence
  SiRNA target sequence
agatggattaaataatcatga

SEQ ID NO: 69056 - DNA, 21 bp, Artificial sequence
  SiRNA target sequence
gatggattaaataatcatgaa

SEQ ID NO: 69057 - DNA, 21 bp, Artificial sequence
  SiRNA target sequence
atggattaaataatcatgaaa

SEQ ID NO: 69058 - DNA, 21 bp, Artificial sequence
  SiRNA target sequence
tggattaaataatcatgaaac

SEQ ID NO: 69059 - DNA, 21 bp, Artificial sequence
  SiRNA target sequence
ggattaaataatcatgaaaca

SEQ ID NO: 69060 - DNA, 21 bp, Artificial sequence
  SiRNA target sequence
gattaaataatcatgaaacaa

SEQ ID NO: 69061 - DNA, 21 bp, Artificial sequence
  SiRNA target sequence
attaaataatcatgaaacaat

SEQ ID NO: 69062 - DNA, 21 bp, Artificial sequence
  SiRNA target sequence
ttaaataatcatgaaacaatc

SEQ ID NO: 69063 - DNA, 21 bp, Artificial sequence
  SiRNA target sequence
taaataatcatgaaacaatcg

SEQ ID NO: 69064 - DNA, 21 bp, Artificial sequence
  SiRNA target sequence
aaataatcatgaaacaatcgt

SEQ ID NO: 69065 - DNA, 21 bp, Artificial sequence
  SiRNA target sequence
aataatcatgaaacaatcgtc

SEQ ID NO: 69066 - DNA, 21 bp, Artificial sequence
  SiRNA target sequence
ataatcatgaaacaatcgtct

SEQ ID NO: 69067 - DNA, 21 bp, Artificial sequence
  SiRNA target sequence
taatcatgaaacaatcgtctc

SEQ ID NO: 69068 - DNA, 21 bp, Artificial sequence
  SiRNA target sequence
aatcatgaaacaatcgtctcc

SEQ ID NO: 69069 - DNA, 21 bp, Artificial sequence
  SiRNA target sequence
atcatgaaacaatcgtctcct

SEQ ID NO: 69070 - DNA, 21 bp, Artificial sequence
  SiRNA target sequence
tcatgaaacaatcgtctcctt

SEQ ID NO: 69071 - DNA, 21 bp, Artificial sequence
  SiRNA target sequence
catgaaacaatcgtctccttt

SEQ ID NO: 69072 - DNA, 21 bp, Artificial sequence
  SiRNA target sequence
atgaaacaatcgtctcctttg

SEQ ID NO: 69073 - DNA, 21 bp, Artificial sequence
  SiRNA target sequence
tgaaacaatcgtctcctttgg

SEQ ID NO: 69074 - DNA, 21 bp, Artificial sequence
  SiRNA target sequence
gaaacaatcgtctcctttggg

SEQ ID NO: 69075 - DNA, 21 bp, Artificial sequence
  SiRNA target sequence
aaacaatcgtctcctttggga

SEQ ID NO: 69076 - DNA, 21 bp, Artificial sequence
  SiRNA target sequence
aacaatcgtctcctttgggac

SEQ ID NO: 69077 - DNA, 21 bp, Artificial sequence
  SiRNA target sequence
acaatcgtctcctttgggact

SEQ ID NO: 69078 - DNA, 21 bp, Artificial sequence
  SiRNA target sequence
caatcgtctcctttgggacta

SEQ ID NO: 69079 - DNA, 21 bp, Artificial sequence
  SiRNA target sequence
aatcgtctcctttgggactac

SEQ ID NO: 69080 - DNA, 21 bp, Artificial sequence
  SiRNA target sequence
atcgtctcctttgggactaca

SEQ ID NO: 69081 - DNA, 21 bp, Artificial sequence
  SiRNA target sequence
tcgtctcctttgggactacag

SEQ ID NO: 69082 - DNA, 21 bp, Artificial sequence
  SiRNA target sequence
cgtctcctttgggactacaga

SEQ ID NO: 69083 - DNA, 21 bp, Artificial sequence
  SiRNA target sequence
gtctcctttgggactacagat

SEQ ID NO: 69084 - DNA, 21 bp, Artificial sequence
  SiRNA target sequence
tctcctttgggactacagatc

SEQ ID NO: 69085 - DNA, 21 bp, Artificial sequence
  SiRNA target sequence
ctcctttgggactacagatct

SEQ ID NO: 69086 - DNA, 21 bp, Artificial sequence
  SiRNA target sequence
tcctttgggactacagatctt

SEQ ID NO: 69087 - DNA, 21 bp, Artificial sequence
  SiRNA target sequence
cctttgggactacagatcttg

SEQ ID NO: 69088 - DNA, 21 bp, Artificial sequence
  SiRNA target sequence
ctttgggactacagatcttga

SEQ ID NO: 69089 - DNA, 21 bp, Artificial sequence
  SiRNA target sequence
tttgggactacagatcttgaa

SEQ ID NO: 69090 - DNA, 21 bp, Artificial sequence
  SiRNA target sequence
ttgggactacagatcttgaag

SEQ ID NO: 69091 - DNA, 21 bp, Artificial sequence
  SiRNA target sequence
tgggactacagatcttgaagt

SEQ ID NO: 69092 - DNA, 21 bp, Artificial sequence
  SiRNA target sequence
gggactacagatcttgaagta

SEQ ID NO: 69093 - DNA, 21 bp, Artificial sequence
  SiRNA target sequence
ggactacagatcttgaagtag

SEQ ID NO: 69094 - DNA, 21 bp, Artificial sequence
  SiRNA target sequence
gactacagatcttgaagtaga

SEQ ID NO: 69095 - DNA, 21 bp, Artificial sequence
  SiRNA target sequence
actacagatcttgaagtagat

SEQ ID NO: 69096 - DNA, 21 bp, Artificial sequence
  SiRNA target sequence
ctacagatcttgaagtagatg

SEQ ID NO: 69097 - DNA, 21 bp, Artificial sequence
  SiRNA target sequence
tacagatcttgaagtagatga

SEQ ID NO: 69098 - DNA, 21 bp, Artificial sequence
  SiRNA target sequence
acagatcttgaagtagatgaa

SEQ ID NO: 69099 - DNA, 21 bp, Artificial sequence
  SiRNA target sequence
cagatcttgaagtagatgaat

SEQ ID NO: 69100 - DNA, 21 bp, Artificial sequence
  SiRNA target sequence
agatcttgaagtagatgaata

SEQ ID NO: 69101 - DNA, 21 bp, Artificial sequence
  SiRNA target sequence
gatcttgaagtagatgaatat

SEQ ID NO: 69102 - DNA, 21 bp, Artificial sequence
  SiRNA target sequence
atcttgaagtagatgaatatg

SEQ ID NO: 69103 - DNA, 21 bp, Artificial sequence
  SiRNA target sequence
tcttgaagtagatgaatatga

SEQ ID NO: 69104 - DNA, 21 bp, Artificial sequence
  SiRNA target sequence
cttgaagtagatgaatatgat

SEQ ID NO: 69105 - DNA, 21 bp, Artificial sequence
  SiRNA target sequence
ttgaagtagatgaatatgatc

SEQ ID NO: 69106 - DNA, 21 bp, Artificial sequence
  SiRNA target sequence
tgaagtagatgaatatgatca

SEQ ID NO: 69107 - DNA, 21 bp, Artificial sequence
  SiRNA target sequence
gaagtagatgaatatgatcag

SEQ ID NO: 69108 - DNA, 21 bp, Artificial sequence
  SiRNA target sequence
aagtagatgaatatgatcagt

SEQ ID NO: 69109 - DNA, 21 bp, Artificial sequence
  SiRNA target sequence
agtagatgaatatgatcagtt

SEQ ID NO: 69110 - DNA, 21 bp, Artificial sequence
  SiRNA target sequence
gtagatgaatatgatcagttt

SEQ ID NO: 69111 - DNA, 21 bp, Artificial sequence
  SiRNA target sequence
tagatgaatatgatcagtttc

SEQ ID NO: 69112 - DNA, 21 bp, Artificial sequence
  SiRNA target sequence
agatgaatatgatcagtttct

SEQ ID NO: 69113 - DNA, 21 bp, Artificial sequence
  SiRNA target sequence
gatgaatatgatcagtttctt

SEQ ID NO: 69114 - DNA, 21 bp, Artificial sequence
  SiRNA target sequence
atgaatatgatcagtttctta

SEQ ID NO: 69115 - DNA, 21 bp, Artificial sequence
  SiRNA target sequence
tgaatatgatcagtttcttaa

SEQ ID NO: 69116 - DNA, 21 bp, Artificial sequence
  SiRNA target sequence
gaatatgatcagtttcttaaa

SEQ ID NO: 69117 - DNA, 21 bp, Artificial sequence
  SiRNA target sequence
aatatgatcagtttcttaaaa

SEQ ID NO: 69118 - DNA, 21 bp, Artificial sequence
  SiRNA target sequence
atatgatcagtttcttaaaat

SEQ ID NO: 69119 - DNA, 21 bp, Artificial sequence
  SiRNA target sequence
tatgatcagtttcttaaaatt

SEQ ID NO: 69120 - DNA, 21 bp, Artificial sequence
  SiRNA target sequence
atgatcagtttcttaaaatta

SEQ ID NO: 69121 - DNA, 21 bp, Artificial sequence
  SiRNA target sequence
tgatcagtttcttaaaattaa

SEQ ID NO: 69122 - DNA, 21 bp, Artificial sequence
  SiRNA target sequence
gatcagtttcttaaaattaat

SEQ ID NO: 69123 - DNA, 21 bp, Artificial sequence
  SiRNA target sequence
atcagtttcttaaaattaatg

SEQ ID NO: 69124 - DNA, 21 bp, Artificial sequence
  SiRNA target sequence
tcagtttcttaaaattaatgc

SEQ ID NO: 69125 - DNA, 21 bp, Artificial sequence
  SiRNA target sequence
cagtttcttaaaattaatgca

SEQ ID NO: 69126 - DNA, 21 bp, Artificial sequence
  SiRNA target sequence
agtttcttaaaattaatgcat

SEQ ID NO: 69127 - DNA, 21 bp, Artificial sequence
  SiRNA target sequence
gtttcttaaaattaatgcatc

SEQ ID NO: 69128 - DNA, 21 bp, Artificial sequence
  SiRNA target sequence
tttcttaaaattaatgcatct

SEQ ID NO: 69129 - DNA, 21 bp, Artificial sequence
  SiRNA target sequence
ttcttaaaattaatgcatcta

SEQ ID NO: 69130 - DNA, 21 bp, Artificial sequence
  SiRNA target sequence
tcttaaaattaatgcatctaa

SEQ ID NO: 69131 - DNA, 21 bp, Artificial sequence
  SiRNA target sequence
cttaaaattaatgcatctaat

SEQ ID NO: 69132 - DNA, 21 bp, Artificial sequence
  SiRNA target sequence
ttaaaattaatgcatctaata

SEQ ID NO: 69133 - DNA, 21 bp, Artificial sequence
  SiRNA target sequence
taaaattaatgcatctaatag

SEQ ID NO: 69134 - DNA, 21 bp, Artificial sequence
  SiRNA target sequence
aaaattaatgcatctaatagt

SEQ ID NO: 69135 - DNA, 21 bp, Artificial sequence
  SiRNA target sequence
aaattaatgcatctaatagta

SEQ ID NO: 69136 - DNA, 21 bp, Artificial sequence
  SiRNA target sequence
aattaatgcatctaatagtaa

SEQ ID NO: 69137 - DNA, 21 bp, Artificial sequence
  SiRNA target sequence
attaatgcatctaatagtaac

SEQ ID NO: 69138 - DNA, 21 bp, Artificial sequence
  SiRNA target sequence
ttaatgcatctaatagtaaca

SEQ ID NO: 69139 - DNA, 21 bp, Artificial sequence
  SiRNA target sequence
taatgcatctaatagtaacag

SEQ ID NO: 69140 - DNA, 21 bp, Artificial sequence
  SiRNA target sequence
aatgcatctaatagtaacaga

SEQ ID NO: 69141 - DNA, 21 bp, Artificial sequence
  SiRNA target sequence
atgcatctaatagtaacagat

SEQ ID NO: 69142 - DNA, 21 bp, Artificial sequence
  SiRNA target sequence
tgcatctaatagtaacagatt

SEQ ID NO: 69143 - DNA, 21 bp, Artificial sequence
  SiRNA target sequence
gcatctaatagtaacagatta

SEQ ID NO: 69144 - DNA, 21 bp, Artificial sequence
  SiRNA target sequence
catctaatagtaacagattat

SEQ ID NO: 69145 - DNA, 21 bp, Artificial sequence
  SiRNA target sequence
atctaatagtaacagattatg

SEQ ID NO: 69146 - DNA, 21 bp, Artificial sequence
  SiRNA target sequence
tctaatagtaacagattatgg

SEQ ID NO: 69147 - DNA, 21 bp, Artificial sequence
  SiRNA target sequence
ctaatagtaacagattatgga

SEQ ID NO: 69148 - DNA, 21 bp, Artificial sequence
  SiRNA target sequence
taatagtaacagattatggag

SEQ ID NO: 69149 - DNA, 21 bp, Artificial sequence
  SiRNA target sequence
aatagtaacagattatggaga

SEQ ID NO: 69150 - DNA, 21 bp, Artificial sequence
  SiRNA target sequence
atagtaacagattatggagag

SEQ ID NO: 69151 - DNA, 21 bp, Artificial sequence
  SiRNA target sequence
tagtaacagattatggagagc

SEQ ID NO: 69152 - DNA, 21 bp, Artificial sequence
  SiRNA target sequence
agtaacagattatggagagca

SEQ ID NO: 69153 - DNA, 21 bp, Artificial sequence
  SiRNA target sequence
gtaacagattatggagagcac

SEQ ID NO: 69154 - DNA, 21 bp, Artificial sequence
  SiRNA target sequence
taacagattatggagagcact

SEQ ID NO: 69155 - DNA, 21 bp, Artificial sequence
  SiRNA target sequence
aacagattatggagagcactg

SEQ ID NO: 69156 - DNA, 21 bp, Artificial sequence
  SiRNA target sequence
acagattatggagagcactgt

SEQ ID NO: 69157 - DNA, 21 bp, Artificial sequence
  SiRNA target sequence
cagattatggagagcactgta

SEQ ID NO: 69158 - DNA, 21 bp, Artificial sequence
  SiRNA target sequence
agattatggagagcactgtac

SEQ ID NO: 69159 - DNA, 21 bp, Artificial sequence
  SiRNA target sequence
gattatggagagcactgtaca

SEQ ID NO: 69160 - DNA, 21 bp, Artificial sequence
  SiRNA target sequence
attatggagagcactgtacat

SEQ ID NO: 69161 - DNA, 21 bp, Artificial sequence
  SiRNA target sequence
ttatggagagcactgtacatt

SEQ ID NO: 69162 - DNA, 21 bp, Artificial sequence
  SiRNA target sequence
tatggagagcactgtacattt

SEQ ID NO: 69163 - DNA, 21 bp, Artificial sequence
  SiRNA target sequence
atggagagcactgtacatttt

SEQ ID NO: 69164 - DNA, 21 bp, Artificial sequence
  SiRNA target sequence
tggagagcactgtacatttta

SEQ ID NO: 69165 - DNA, 21 bp, Artificial sequence
  SiRNA target sequence
ggagagcactgtacattttaa

SEQ ID NO: 69166 - DNA, 21 bp, Artificial sequence
  SiRNA target sequence
gagagcactgtacattttaaa

SEQ ID NO: 69167 - DNA, 21 bp, Artificial sequence
  SiRNA target sequence
agagcactgtacattttaaat

SEQ ID NO: 69168 - DNA, 21 bp, Artificial sequence
  SiRNA target sequence
gagcactgtacattttaaatt

SEQ ID NO: 69169 - DNA, 21 bp, Artificial sequence
  SiRNA target sequence
agcactgtacattttaaattt

SEQ ID NO: 69170 - DNA, 21 bp, Artificial sequence
  SiRNA target sequence
gcactgtacattttaaattta

SEQ ID NO: 69171 - DNA, 21 bp, Artificial sequence
  SiRNA target sequence
cactgtacattttaaatttat

SEQ ID NO: 69172 - DNA, 21 bp, Artificial sequence
  SiRNA target sequence
actgtacattttaaatttatc

SEQ ID NO: 69173 - DNA, 21 bp, Artificial sequence
  SiRNA target sequence
ctgtacattttaaatttatct

SEQ ID NO: 69174 - DNA, 21 bp, Artificial sequence
  SiRNA target sequence
tgtacattttaaatttatctc

SEQ ID NO: 69175 - DNA, 21 bp, Artificial sequence
  SiRNA target sequence
gtacattttaaatttatctca

SEQ ID NO: 69176 - DNA, 21 bp, Artificial sequence
  SiRNA target sequence
tacattttaaatttatctcag

SEQ ID NO: 69177 - DNA, 21 bp, Artificial sequence
  SiRNA target sequence
acattttaaatttatctcaga

SEQ ID NO: 69178 - DNA, 21 bp, Artificial sequence
  SiRNA target sequence
cattttaaatttatctcagag

SEQ ID NO: 69179 - DNA, 21 bp, Artificial sequence
  SiRNA target sequence
attttaaatttatctcagaga

SEQ ID NO: 69180 - DNA, 21 bp, Artificial sequence
  SiRNA target sequence
ttttaaatttatctcagagag

SEQ ID NO: 69181 - DNA, 21 bp, Artificial sequence
  SiRNA target sequence
tttaaatttatctcagagagc

SEQ ID NO: 69182 - DNA, 21 bp, Artificial sequence
  SiRNA target sequence
ttaaatttatctcagagagca

SEQ ID NO: 69183 - DNA, 21 bp, Artificial sequence
  SiRNA target sequence
taaatttatctcagagagcaa

SEQ ID NO: 69184 - DNA, 21 bp, Artificial sequence
  SiRNA target sequence
aaatttatctcagagagcaat

SEQ ID NO: 69185 - DNA, 21 bp, Artificial sequence
  SiRNA target sequence
aatttatctcagagagcaatt

SEQ ID NO: 69186 - DNA, 21 bp, Artificial sequence
  SiRNA target sequence
atttatctcagagagcaattt

SEQ ID NO: 69187 - DNA, 21 bp, Artificial sequence
  SiRNA target sequence
tttatctcagagagcaatttt

SEQ ID NO: 69188 - DNA, 21 bp, Artificial sequence
  SiRNA target sequence
ttatctcagagagcaattttt

SEQ ID NO: 69189 - DNA, 21 bp, Artificial sequence
  SiRNA target sequence
tatctcagagagcaatttttc

SEQ ID NO: 69190 - DNA, 21 bp, Artificial sequence
  SiRNA target sequence
atctcagagagcaatttttct

SEQ ID NO: 69191 - DNA, 21 bp, Artificial sequence
  SiRNA target sequence
tctcagagagcaatttttctc

SEQ ID NO: 69192 - DNA, 21 bp, Artificial sequence
  SiRNA target sequence
ctcagagagcaatttttctct

SEQ ID NO: 69193 - DNA, 21 bp, Artificial sequence
  SiRNA target sequence
tcagagagcaatttttctctt

SEQ ID NO: 69194 - DNA, 21 bp, Artificial sequence
  SiRNA target sequence
cagagagcaatttttctctta

SEQ ID NO: 69195 - DNA, 21 bp, Artificial sequence
  SiRNA target sequence
agagagcaatttttctcttac

SEQ ID NO: 69196 - DNA, 21 bp, Artificial sequence
  SiRNA target sequence
gagagcaatttttctcttaca

SEQ ID NO: 69197 - DNA, 21 bp, Artificial sequence
  SiRNA target sequence
agagcaatttttctcttacaa

SEQ ID NO: 69198 - DNA, 21 bp, Artificial sequence
  SiRNA target sequence
gagcaatttttctcttacaaa

SEQ ID NO: 69199 - DNA, 21 bp, Artificial sequence
  SiRNA target sequence
agcaatttttctcttacaaag

SEQ ID NO: 69200 - DNA, 21 bp, Artificial sequence
  SiRNA target sequence
gcaatttttctcttacaaagt

SEQ ID NO: 69201 - DNA, 21 bp, Artificial sequence
  SiRNA target sequence
caatttttctcttacaaagtt

SEQ ID NO: 69202 - DNA, 21 bp, Artificial sequence
  SiRNA target sequence
aatttttctcttacaaagttt

SEQ ID NO: 69203 - DNA, 21 bp, Artificial sequence
  SiRNA target sequence
atttttctcttacaaagtttt

SEQ ID NO: 69204 - DNA, 21 bp, Artificial sequence
  SiRNA target sequence
tttttctcttacaaagttttt

SEQ ID NO: 69205 - DNA, 21 bp, Artificial sequence
  SiRNA target sequence
ttttctcttacaaagtttttt

SEQ ID NO: 69206 - DNA, 21 bp, Artificial sequence
  SiRNA target sequence
tttctcttacaaagttttttt

SEQ ID NO: 69207 - DNA, 21 bp, Artificial sequence
  SiRNA target sequence
ttctcttacaaagttttttta

SEQ ID NO: 69208 - DNA, 21 bp, Artificial sequence
  SiRNA target sequence
tctcttacaaagtttttttat

SEQ ID NO: 69209 - DNA, 21 bp, Artificial sequence
  SiRNA target sequence
ctcttacaaagtttttttatt

SEQ ID NO: 69210 - DNA, 21 bp, Artificial sequence
  SiRNA target sequence
tcttacaaagtttttttatta

SEQ ID NO: 69211 - DNA, 21 bp, Artificial sequence
  SiRNA target sequence
cttacaaagtttttttattat

SEQ ID NO: 69212 - DNA, 21 bp, Artificial sequence
  SiRNA target sequence
ttacaaagtttttttattatt

SEQ ID NO: 69213 - DNA, 21 bp, Artificial sequence
  SiRNA target sequence
tacaaagtttttttattattt

SEQ ID NO: 69214 - DNA, 21 bp, Artificial sequence
  SiRNA target sequence
acaaagtttttttattattta

SEQ ID NO: 69215 - DNA, 21 bp, Artificial sequence
  SiRNA target sequence
caaagtttttttattatttat

SEQ ID NO: 69216 - DNA, 21 bp, Artificial sequence
  SiRNA target sequence
aaagtttttttattatttatg

SEQ ID NO: 69217 - DNA, 21 bp, Artificial sequence
  SiRNA target sequence
aagtttttttattatttatgc

SEQ ID NO: 69218 - DNA, 21 bp, Artificial sequence
  SiRNA target sequence
agtttttttattatttatgca

SEQ ID NO: 69219 - DNA, 21 bp, Artificial sequence
  SiRNA target sequence
gtttttttattatttatgcag

SEQ ID NO: 69220 - DNA, 21 bp, Artificial sequence
  SiRNA target sequence
tttttttattatttatgcagg

SEQ ID NO: 69221 - DNA, 21 bp, Artificial sequence
  SiRNA target sequence
ttttttattatttatgcagga

SEQ ID NO: 69222 - DNA, 21 bp, Artificial sequence
  SiRNA target sequence
tttttattatttatgcaggaa

SEQ ID NO: 69223 - DNA, 21 bp, Artificial sequence
  SiRNA target sequence
ttttattatttatgcaggaat

SEQ ID NO: 69224 - DNA, 21 bp, Artificial sequence
  SiRNA target sequence
tttattatttatgcaggaata

SEQ ID NO: 69225 - DNA, 21 bp, Artificial sequence
  SiRNA target sequence
ttattatttatgcaggaatat

SEQ ID NO: 69226 - DNA, 21 bp, Artificial sequence
  SiRNA target sequence
tattatttatgcaggaatatc

SEQ ID NO: 69227 - DNA, 21 bp, Artificial sequence
  SiRNA target sequence
attatttatgcaggaatatca

SEQ ID NO: 69228 - DNA, 21 bp, Artificial sequence
  SiRNA target sequence
ttatttatgcaggaatatcag

SEQ ID NO: 69229 - DNA, 21 bp, Artificial sequence
  SiRNA target sequence
tatttatgcaggaatatcagg

SEQ ID NO: 69230 - DNA, 21 bp, Artificial sequence
  SiRNA target sequence
atttatgcaggaatatcagga

SEQ ID NO: 69231 - DNA, 21 bp, Artificial sequence
  SiRNA target sequence
tttatgcaggaatatcaggaa

SEQ ID NO: 69232 - DNA, 21 bp, Artificial sequence
  SiRNA target sequence
ttatgcaggaatatcaggaat

SEQ ID NO: 69233 - DNA, 21 bp, Artificial sequence
  SiRNA target sequence
tatgcaggaatatcaggaata

SEQ ID NO: 69234 - DNA, 21 bp, Artificial sequence
  SiRNA target sequence
atgcaggaatatcaggaatat

SEQ ID NO: 69235 - DNA, 21 bp, Artificial sequence
  SiRNA target sequence
tgcaggaatatcaggaatatt

SEQ ID NO: 69236 - DNA, 21 bp, Artificial sequence
  SiRNA target sequence
gcaggaatatcaggaatatta

SEQ ID NO: 69237 - DNA, 21 bp, Artificial sequence
  SiRNA target sequence
caggaatatcaggaatattat

SEQ ID NO: 69238 - DNA, 21 bp, Artificial sequence
  SiRNA target sequence
aggaatatcaggaatattatc

SEQ ID NO: 69239 - DNA, 21 bp, Artificial sequence
  SiRNA target sequence
ggaatatcaggaatattatct

SEQ ID NO: 69240 - DNA, 21 bp, Artificial sequence
  SiRNA target sequence
gaatatcaggaatattatctc

SEQ ID NO: 69241 - DNA, 21 bp, Artificial sequence
  SiRNA target sequence
aatatcaggaatattatctca

SEQ ID NO: 69242 - DNA, 21 bp, Artificial sequence
  SiRNA target sequence
atatcaggaatattatctcaa

SEQ ID NO: 69243 - DNA, 21 bp, Artificial sequence
  SiRNA target sequence
tatcaggaatattatctcaaa

SEQ ID NO: 69244 - DNA, 21 bp, Artificial sequence
  SiRNA target sequence
atcaggaatattatctcaaaa

SEQ ID NO: 69245 - DNA, 21 bp, Artificial sequence
  SiRNA target sequence
tcaggaatattatctcaaaat

SEQ ID NO: 69246 - DNA, 21 bp, Artificial sequence
  SiRNA target sequence
caggaatattatctcaaaata

SEQ ID NO: 69247 - DNA, 21 bp, Artificial sequence
  SiRNA target sequence
aggaatattatctcaaaatat

SEQ ID NO: 69248 - DNA, 21 bp, Artificial sequence
  SiRNA target sequence
ggaatattatctcaaaatatg

SEQ ID NO: 69249 - DNA, 21 bp, Artificial sequence
  SiRNA target sequence
gaatattatctcaaaatatgt

SEQ ID NO: 69250 - DNA, 21 bp, Artificial sequence
  SiRNA target sequence
aatattatctcaaaatatgtc

SEQ ID NO: 69251 - DNA, 21 bp, Artificial sequence
  SiRNA target sequence
atattatctcaaaatatgtca

SEQ ID NO: 69252 - DNA, 21 bp, Artificial sequence
  SiRNA target sequence
tattatctcaaaatatgtcat

SEQ ID NO: 69253 - DNA, 21 bp, Artificial sequence
  SiRNA target sequence
attatctcaaaatatgtcatc

SEQ ID NO: 69254 - DNA, 21 bp, Artificial sequence
  SiRNA target sequence
ttatctcaaaatatgtcatct

SEQ ID NO: 69255 - DNA, 21 bp, Artificial sequence
  SiRNA target sequence
tatctcaaaatatgtcatcta

SEQ ID NO: 69256 - DNA, 21 bp, Artificial sequence
  SiRNA target sequence
atctcaaaatatgtcatctaa

SEQ ID NO: 69257 - DNA, 21 bp, Artificial sequence
  SiRNA target sequence
tctcaaaatatgtcatctaac

SEQ ID NO: 69258 - DNA, 21 bp, Artificial sequence
  SiRNA target sequence
ctcaaaatatgtcatctaacc

SEQ ID NO: 69259 - DNA, 21 bp, Artificial sequence
  SiRNA target sequence
tcaaaatatgtcatctaacca

SEQ ID NO: 69260 - DNA, 21 bp, Artificial sequence
  SiRNA target sequence
caaaatatgtcatctaaccaa

SEQ ID NO: 69261 - DNA, 21 bp, Artificial sequence
  SiRNA target sequence
aaaatatgtcatctaaccaac

SEQ ID NO: 69262 - DNA, 21 bp, Artificial sequence
  SiRNA target sequence
aaatatgtcatctaaccaact

SEQ ID NO: 69263 - DNA, 21 bp, Artificial sequence
  SiRNA target sequence
aatatgtcatctaaccaactc

SEQ ID NO: 69264 - DNA, 21 bp, Artificial sequence
  SiRNA target sequence
atatgtcatctaaccaactca

SEQ ID NO: 69265 - DNA, 21 bp, Artificial sequence
  SiRNA target sequence
tatgtcatctaaccaactcat

SEQ ID NO: 69266 - DNA, 21 bp, Artificial sequence
  SiRNA target sequence
atgtcatctaaccaactcatt

SEQ ID NO: 69267 - DNA, 21 bp, Artificial sequence
  SiRNA target sequence
tgtcatctaaccaactcattt

SEQ ID NO: 69268 - DNA, 21 bp, Artificial sequence
  SiRNA target sequence
gtcatctaaccaactcattta

SEQ ID NO: 69269 - DNA, 21 bp, Artificial sequence
  SiRNA target sequence
tcatctaaccaactcatttat

SEQ ID NO: 69270 - DNA, 21 bp, Artificial sequence
  SiRNA target sequence
catctaaccaactcatttatt

SEQ ID NO: 69271 - DNA, 21 bp, Artificial sequence
  SiRNA target sequence
atctaaccaactcatttattt

SEQ ID NO: 69272 - DNA, 21 bp, Artificial sequence
  SiRNA target sequence
tctaaccaactcatttattta

SEQ ID NO: 69273 - DNA, 21 bp, Artificial sequence
  SiRNA target sequence
ctaaccaactcatttatttaa

SEQ ID NO: 69274 - DNA, 21 bp, Artificial sequence
  SiRNA target sequence
taaccaactcatttatttaat

SEQ ID NO: 69275 - DNA, 21 bp, Artificial sequence
  SiRNA target sequence
aaccaactcatttatttaatg

SEQ ID NO: 69276 - DNA, 21 bp, Artificial sequence
  SiRNA target sequence
accaactcatttatttaatgt

SEQ ID NO: 69277 - DNA, 21 bp, Artificial sequence
  SiRNA target sequence
ccaactcatttatttaatgtc

SEQ ID NO: 69278 - DNA, 21 bp, Artificial sequence
  SiRNA target sequence
caactcatttatttaatgtcc

SEQ ID NO: 69279 - DNA, 21 bp, Artificial sequence
  SiRNA target sequence
aactcatttatttaatgtcca

SEQ ID NO: 69280 - DNA, 21 bp, Artificial sequence
  SiRNA target sequence
actcatttatttaatgtccat

SEQ ID NO: 69281 - DNA, 21 bp, Artificial sequence
  SiRNA target sequence
ctcatttatttaatgtccatt

SEQ ID NO: 69282 - DNA, 21 bp, Artificial sequence
  SiRNA target sequence
tcatttatttaatgtccatta

SEQ ID NO: 69283 - DNA, 21 bp, Artificial sequence
  SiRNA target sequence
catttatttaatgtccattac

SEQ ID NO: 69284 - DNA, 21 bp, Artificial sequence
  SiRNA target sequence
atttatttaatgtccattaca

SEQ ID NO: 69285 - DNA, 21 bp, Artificial sequence
  SiRNA target sequence
tttatttaatgtccattacat

SEQ ID NO: 69286 - DNA, 21 bp, Artificial sequence
  SiRNA target sequence
ttatttaatgtccattacatc

SEQ ID NO: 69287 - DNA, 21 bp, Artificial sequence
  SiRNA target sequence
tatttaatgtccattacatct

SEQ ID NO: 69288 - DNA, 21 bp, Artificial sequence
  SiRNA target sequence
atttaatgtccattacatcta

SEQ ID NO: 69289 - DNA, 21 bp, Artificial sequence
  SiRNA target sequence
tttaatgtccattacatctac

SEQ ID NO: 69290 - DNA, 21 bp, Artificial sequence
  SiRNA target sequence
ttaatgtccattacatctacg

SEQ ID NO: 69291 - DNA, 21 bp, Artificial sequence
  SiRNA target sequence
taatgtccattacatctacgg

SEQ ID NO: 69292 - DNA, 21 bp, Artificial sequence
  SiRNA target sequence
aatgtccattacatctacggt

SEQ ID NO: 69293 - DNA, 21 bp, Artificial sequence
  SiRNA target sequence
atgtccattacatctacggtt

SEQ ID NO: 69294 - DNA, 21 bp, Artificial sequence
  SiRNA target sequence
tgtccattacatctacggtta

SEQ ID NO: 69295 - DNA, 21 bp, Artificial sequence
  SiRNA target sequence
gtccattacatctacggttac

SEQ ID NO: 69296 - DNA, 21 bp, Artificial sequence
  SiRNA target sequence
tccattacatctacggttact

SEQ ID NO: 69297 - DNA, 21 bp, Artificial sequence
  SiRNA target sequence
ccattacatctacggttacta

SEQ ID NO: 69298 - DNA, 21 bp, Artificial sequence
  SiRNA target sequence
cattacatctacggttactat

SEQ ID NO: 69299 - DNA, 21 bp, Artificial sequence
  SiRNA target sequence
attacatctacggttactatt

SEQ ID NO: 69300 - DNA, 21 bp, Artificial sequence
  SiRNA target sequence
ttacatctacggttactatta

SEQ ID NO: 69301 - DNA, 21 bp, Artificial sequence
  SiRNA target sequence
tacatctacggttactattaa

SEQ ID NO: 69302 - DNA, 21 bp, Artificial sequence
  SiRNA target sequence
acatctacggttactattaat

SEQ ID NO: 69303 - DNA, 21 bp, Artificial sequence
  SiRNA target sequence
catctacggttactattaatt

SEQ ID NO: 69304 - DNA, 21 bp, Artificial sequence
  SiRNA target sequence
atctacggttactattaattt

SEQ ID NO: 69305 - DNA, 21 bp, Artificial sequence
  SiRNA target sequence
tctacggttactattaattta

SEQ ID NO: 69306 - DNA, 21 bp, Artificial sequence
  SiRNA target sequence
ctacggttactattaatttaa

SEQ ID NO: 69307 - DNA, 21 bp, Artificial sequence
  SiRNA target sequence
tacggttactattaatttaag

SEQ ID NO: 69308 - DNA, 21 bp, Artificial sequence
  SiRNA target sequence
acggttactattaatttaagt

SEQ ID NO: 69309 - DNA, 21 bp, Artificial sequence
  SiRNA target sequence
cggttactattaatttaagta

SEQ ID NO: 69310 - DNA, 21 bp, Artificial sequence
  SiRNA target sequence
ggttactattaatttaagtaa

SEQ ID NO: 69311 - DNA, 21 bp, Artificial sequence
  SiRNA target sequence
gttactattaatttaagtaac

SEQ ID NO: 69312 - DNA, 21 bp, Artificial sequence
  SiRNA target sequence
ttactattaatttaagtaact

SEQ ID NO: 69313 - DNA, 21 bp, Artificial sequence
  SiRNA target sequence
tactattaatttaagtaactt

SEQ ID NO: 69314 - DNA, 21 bp, Artificial sequence
  SiRNA target sequence
actattaatttaagtaacttg

SEQ ID NO: 69315 - DNA, 21 bp, Artificial sequence
  SiRNA target sequence
ctattaatttaagtaacttgg

SEQ ID NO: 69316 - DNA, 21 bp, Artificial sequence
  SiRNA target sequence
tattaatttaagtaacttggg

SEQ ID NO: 69317 - DNA, 21 bp, Artificial sequence
  SiRNA target sequence
attaatttaagtaacttgggt

SEQ ID NO: 69318 - DNA, 21 bp, Artificial sequence
  SiRNA target sequence
ttaatttaagtaacttgggtt

SEQ ID NO: 69319 - DNA, 21 bp, Artificial sequence
  SiRNA target sequence
taatttaagtaacttgggtta

SEQ ID NO: 69320 - DNA, 21 bp, Artificial sequence
  SiRNA target sequence
aatttaagtaacttgggttac

SEQ ID NO: 69321 - DNA, 21 bp, Artificial sequence
  SiRNA target sequence
atttaagtaacttgggttact

SEQ ID NO: 69322 - DNA, 21 bp, Artificial sequence
  SiRNA target sequence
tttaagtaacttgggttactt

SEQ ID NO: 69323 - DNA, 21 bp, Artificial sequence
  SiRNA target sequence
ttaagtaacttgggttactta

SEQ ID NO: 69324 - DNA, 21 bp, Artificial sequence
  SiRNA target sequence
taagtaacttgggttacttat

SEQ ID NO: 69325 - DNA, 21 bp, Artificial sequence
  SiRNA target sequence
aagtaacttgggttacttata

SEQ ID NO: 69326 - DNA, 21 bp, Artificial sequence
  SiRNA target sequence
agtaacttgggttacttatac

SEQ ID NO: 69327 - DNA, 21 bp, Artificial sequence
  SiRNA target sequence
gtaacttgggttacttataca

SEQ ID NO: 69328 - DNA, 21 bp, Artificial sequence
  SiRNA target sequence
taacttgggttacttatacac

SEQ ID NO: 69329 - DNA, 21 bp, Artificial sequence
  SiRNA target sequence
aacttgggttacttatacact

SEQ ID NO: 69330 - DNA, 21 bp, Artificial sequence
  SiRNA target sequence
acttgggttacttatacacta

SEQ ID NO: 69331 - DNA, 21 bp, Artificial sequence
  SiRNA target sequence
cttgggttacttatacactag

SEQ ID NO: 69332 - DNA, 21 bp, Artificial sequence
  SiRNA target sequence
ttgggttacttatacactaga

SEQ ID NO: 69333 - DNA, 21 bp, Artificial sequence
  SiRNA target sequence
tgggttacttatacactagat

SEQ ID NO: 69334 - DNA, 21 bp, Artificial sequence
  SiRNA target sequence
gggttacttatacactagata

SEQ ID NO: 69335 - DNA, 21 bp, Artificial sequence
  SiRNA target sequence
ggttacttatacactagatat

SEQ ID NO: 69336 - DNA, 21 bp, Artificial sequence
  SiRNA target sequence
gttacttatacactagatata

SEQ ID NO: 69337 - DNA, 21 bp, Artificial sequence
  SiRNA target sequence
ttacttatacactagatatac

SEQ ID NO: 69338 - DNA, 21 bp, Artificial sequence
  SiRNA target sequence
tacttatacactagatataca

SEQ ID NO: 69339 - DNA, 21 bp, Artificial sequence
  SiRNA target sequence
acttatacactagatatacac

SEQ ID NO: 69340 - DNA, 21 bp, Artificial sequence
  SiRNA target sequence
cttatacactagatatacaca

SEQ ID NO: 69341 - DNA, 21 bp, Artificial sequence
  SiRNA target sequence
ttatacactagatatacacaa

SEQ ID NO: 69342 - DNA, 21 bp, Artificial sequence
  SiRNA target sequence
tatacactagatatacacaag

SEQ ID NO: 69343 - DNA, 21 bp, Artificial sequence
  SiRNA target sequence
atacactagatatacacaagc

SEQ ID NO: 69344 - DNA, 21 bp, Artificial sequence
  SiRNA target sequence
tacactagatatacacaagca

SEQ ID NO: 69345 - DNA, 21 bp, Artificial sequence
  SiRNA target sequence
acactagatatacacaagcaa

SEQ ID NO: 69346 - DNA, 21 bp, Artificial sequence
  SiRNA target sequence
cactagatatacacaagcaat

SEQ ID NO: 69347 - DNA, 21 bp, Artificial sequence
  SiRNA target sequence
actagatatacacaagcaata

SEQ ID NO: 69348 - DNA, 21 bp, Artificial sequence
  SiRNA target sequence
ctagatatacacaagcaataa

SEQ ID NO: 69349 - DNA, 21 bp, Artificial sequence
  SiRNA target sequence
tagatatacacaagcaataat

SEQ ID NO: 69350 - DNA, 21 bp, Artificial sequence
  SiRNA target sequence
agatatacacaagcaataatt

SEQ ID NO: 69351 - DNA, 21 bp, Artificial sequence
  SiRNA target sequence
gatatacacaagcaataatta

SEQ ID NO: 69352 - DNA, 21 bp, Artificial sequence
  SiRNA target sequence
atatacacaagcaataattaa

SEQ ID NO: 69353 - DNA, 21 bp, Artificial sequence
  SiRNA target sequence
tatacacaagcaataattaat

SEQ ID NO: 69354 - DNA, 21 bp, Artificial sequence
  SiRNA target sequence
atacacaagcaataattaatg

SEQ ID NO: 69355 - DNA, 21 bp, Artificial sequence
  SiRNA target sequence
tacacaagcaataattaatgc

SEQ ID NO: 69356 - DNA, 21 bp, Artificial sequence
  SiRNA target sequence
acacaagcaataattaatgca

SEQ ID NO: 69357 - DNA, 21 bp, Artificial sequence
  SiRNA target sequence
cacaagcaataattaatgcaa

SEQ ID NO: 69358 - DNA, 21 bp, Artificial sequence
  SiRNA target sequence
acaagcaataattaatgcaag

SEQ ID NO: 69359 - DNA, 21 bp, Artificial sequence
  SiRNA target sequence
caagcaataattaatgcaaga

SEQ ID NO: 69360 - DNA, 21 bp, Artificial sequence
  SiRNA target sequence
aagcaataattaatgcaagat

SEQ ID NO: 69361 - DNA, 21 bp, Artificial sequence
  SiRNA target sequence
agcaataattaatgcaagatc

SEQ ID NO: 69362 - DNA, 21 bp, Artificial sequence
  SiRNA target sequence
gcaataattaatgcaagatct

SEQ ID NO: 69363 - DNA, 21 bp, Artificial sequence
  SiRNA target sequence
caataattaatgcaagatcta

SEQ ID NO: 69364 - DNA, 21 bp, Artificial sequence
  SiRNA target sequence
aataattaatgcaagatctac

SEQ ID NO: 69365 - DNA, 21 bp, Artificial sequence
  SiRNA target sequence
ataattaatgcaagatctact

SEQ ID NO: 69366 - DNA, 21 bp, Artificial sequence
  SiRNA target sequence
taattaatgcaagatctactt

SEQ ID NO: 69367 - DNA, 21 bp, Artificial sequence
  SiRNA target sequence
aattaatgcaagatctactta

SEQ ID NO: 69368 - DNA, 21 bp, Artificial sequence
  SiRNA target sequence
attaatgcaagatctacttat

SEQ ID NO: 69369 - DNA, 21 bp, Artificial sequence
  SiRNA target sequence
ttaatgcaagatctacttatg

SEQ ID NO: 69370 - DNA, 21 bp, Artificial sequence
  SiRNA target sequence
taatgcaagatctacttatga

SEQ ID NO: 69371 - DNA, 21 bp, Artificial sequence
  SiRNA target sequence
aatgcaagatctacttatgat

SEQ ID NO: 69372 - DNA, 21 bp, Artificial sequence
  SiRNA target sequence
atgcaagatctacttatgata

SEQ ID NO: 69373 - DNA, 21 bp, Artificial sequence
  SiRNA target sequence
tgcaagatctacttatgatac

SEQ ID NO: 69374 - DNA, 21 bp, Artificial sequence
  SiRNA target sequence
gcaagatctacttatgataca

SEQ ID NO: 69375 - DNA, 21 bp, Artificial sequence
  SiRNA target sequence
caagatctacttatgatacaa

SEQ ID NO: 69376 - DNA, 21 bp, Artificial sequence
  SiRNA target sequence
aagatctacttatgatacaat

SEQ ID NO: 69377 - DNA, 21 bp, Artificial sequence
  SiRNA target sequence
agatctacttatgatacaatg

SEQ ID NO: 69378 - DNA, 21 bp, Artificial sequence
  SiRNA target sequence
gatctacttatgatacaatgt

SEQ ID NO: 69379 - DNA, 21 bp, Artificial sequence
  SiRNA target sequence
atctacttatgatacaatgtt

SEQ ID NO: 69380 - DNA, 21 bp, Artificial sequence
  SiRNA target sequence
tctacttatgatacaatgtta

SEQ ID NO: 69381 - DNA, 21 bp, Artificial sequence
  SiRNA target sequence
ctacttatgatacaatgttag

SEQ ID NO: 69382 - DNA, 21 bp, Artificial sequence
  SiRNA target sequence
tacttatgatacaatgttaga

SEQ ID NO: 69383 - DNA, 21 bp, Artificial sequence
  SiRNA target sequence
acttatgatacaatgttagat

SEQ ID NO: 69384 - DNA, 21 bp, Artificial sequence
  SiRNA target sequence
cttatgatacaatgttagata

SEQ ID NO: 69385 - DNA, 21 bp, Artificial sequence
  SiRNA target sequence
ttatgatacaatgttagatat

SEQ ID NO: 69386 - DNA, 21 bp, Artificial sequence
  SiRNA target sequence
tatgatacaatgttagatata

SEQ ID NO: 69387 - DNA, 21 bp, Artificial sequence
  SiRNA target sequence
atgatacaatgttagatataa

SEQ ID NO: 69388 - DNA, 21 bp, Artificial sequence
  SiRNA target sequence
tgatacaatgttagatataaa

SEQ ID NO: 69389 - DNA, 21 bp, Artificial sequence
  SiRNA target sequence
gatacaatgttagatataaaa

SEQ ID NO: 69390 - DNA, 21 bp, Artificial sequence
  SiRNA target sequence
atacaatgttagatataaaaa

SEQ ID NO: 69391 - DNA, 21 bp, Artificial sequence
  SiRNA target sequence
tacaatgttagatataaaaaa

SEQ ID NO: 69392 - DNA, 21 bp, Artificial sequence
  SiRNA target sequence
acaatgttagatataaaaaaa

SEQ ID NO: 69393 - DNA, 21 bp, Artificial sequence
  SiRNA target sequence
caatgttagatataaaaaaag

SEQ ID NO: 69394 - DNA, 21 bp, Artificial sequence
  SiRNA target sequence
aatgttagatataaaaaaaga

SEQ ID NO: 69395 - DNA, 21 bp, Artificial sequence
  SiRNA target sequence
atgttagatataaaaaaagag

SEQ ID NO: 69396 - DNA, 21 bp, Artificial sequence
  SiRNA target sequence
tgttagatataaaaaaagaga

SEQ ID NO: 69397 - DNA, 21 bp, Artificial sequence
  SiRNA target sequence
gttagatataaaaaaagagaa

SEQ ID NO: 69398 - DNA, 21 bp, Artificial sequence
  SiRNA target sequence
ttagatataaaaaaagagaat

SEQ ID NO: 69399 - DNA, 21 bp, Artificial sequence
  SiRNA target sequence
tagatataaaaaaagagaata

SEQ ID NO: 69400 - DNA, 21 bp, Artificial sequence
  SiRNA target sequence
agatataaaaaaagagaataa

SEQ ID NO: 69401 - DNA, 21 bp, Artificial sequence
  SiRNA target sequence
gatataaaaaaagagaataat

SEQ ID NO: 69402 - DNA, 21 bp, Artificial sequence
  SiRNA target sequence
atataaaaaaagagaataata

SEQ ID NO: 69403 - DNA, 21 bp, Artificial sequence
  SiRNA target sequence
tataaaaaaagagaataataa

SEQ ID NO: 69404 - DNA, 21 bp, Artificial sequence
  SiRNA target sequence
ataaaaaaagagaataataag

SEQ ID NO: 69405 - DNA, 21 bp, Artificial sequence
  SiRNA target sequence
taaaaaaagagaataataagt

SEQ ID NO: 69406 - DNA, 21 bp, Artificial sequence
  SiRNA target sequence
aaaaaaagagaataataagtt

SEQ ID NO: 69407 - DNA, 21 bp, Artificial sequence
  SiRNA target sequence
aaaaaagagaataataagttt

SEQ ID NO: 69408 - DNA, 21 bp, Artificial sequence
  SiRNA target sequence
aaaaagagaataataagttta

SEQ ID NO: 69409 - DNA, 21 bp, Artificial sequence
  SiRNA target sequence
aaaagagaataataagtttaa

SEQ ID NO: 69410 - DNA, 21 bp, Artificial sequence
  SiRNA target sequence
aaagagaataataagtttaag

SEQ ID NO: 69411 - DNA, 21 bp, Artificial sequence
  SiRNA target sequence
aagagaataataagtttaaga

SEQ ID NO: 69412 - DNA, 21 bp, Artificial sequence
  SiRNA target sequence
agagaataataagtttaagat

SEQ ID NO: 69413 - DNA, 21 bp, Artificial sequence
  SiRNA target sequence
gagaataataagtttaagatt

SEQ ID NO: 69414 - DNA, 21 bp, Artificial sequence
  SiRNA target sequence
agaataataagtttaagatta

SEQ ID NO: 69415 - DNA, 21 bp, Artificial sequence
  SiRNA target sequence
gaataataagtttaagattac

SEQ ID NO: 69416 - DNA, 21 bp, Artificial sequence
  SiRNA target sequence
aataataagtttaagattaca

SEQ ID NO: 69417 - DNA, 21 bp, Artificial sequence
  SiRNA target sequence
ataataagtttaagattacag

SEQ ID NO: 69418 - DNA, 21 bp, Artificial sequence
  SiRNA target sequence
taataagtttaagattacaga

SEQ ID NO: 69419 - DNA, 21 bp, Artificial sequence
  SiRNA target sequence
aataagtttaagattacagaa

SEQ ID NO: 69420 - DNA, 21 bp, Artificial sequence
  SiRNA target sequence
ataagtttaagattacagaat

SEQ ID NO: 69421 - DNA, 21 bp, Artificial sequence
  SiRNA target sequence
taagtttaagattacagaatt

SEQ ID NO: 69422 - DNA, 21 bp, Artificial sequence
  SiRNA target sequence
aagtttaagattacagaattt

SEQ ID NO: 69423 - DNA, 21 bp, Artificial sequence
  SiRNA target sequence
agtttaagattacagaattta

SEQ ID NO: 69424 - DNA, 21 bp, Artificial sequence
  SiRNA target sequence
gtttaagattacagaatttaa

SEQ ID NO: 69425 - DNA, 21 bp, Artificial sequence
  SiRNA target sequence
tttaagattacagaatttaaa

SEQ ID NO: 69426 - DNA, 21 bp, Artificial sequence
  SiRNA target sequence
ttaagattacagaatttaaag

SEQ ID NO: 69427 - DNA, 21 bp, Artificial sequence
  SiRNA target sequence
taagattacagaatttaaaga

SEQ ID NO: 69428 - DNA, 21 bp, Artificial sequence
  SiRNA target sequence
aagattacagaatttaaagaa

SEQ ID NO: 69429 - DNA, 21 bp, Artificial sequence
  SiRNA target sequence
agattacagaatttaaagaaa

SEQ ID NO: 69430 - DNA, 21 bp, Artificial sequence
  SiRNA target sequence
gattacagaatttaaagaaag

SEQ ID NO: 69431 - DNA, 21 bp, Artificial sequence
  SiRNA target sequence
attacagaatttaaagaaagt

SEQ ID NO: 69432 - DNA, 21 bp, Artificial sequence
  SiRNA target sequence
ttacagaatttaaagaaagta

SEQ ID NO: 69433 - DNA, 21 bp, Artificial sequence
  SiRNA target sequence
tacagaatttaaagaaagtat

SEQ ID NO: 69434 - DNA, 21 bp, Artificial sequence
  SiRNA target sequence
acagaatttaaagaaagtatt

SEQ ID NO: 69435 - DNA, 21 bp, Artificial sequence
  SiRNA target sequence
cagaatttaaagaaagtatta

SEQ ID NO: 69436 - DNA, 21 bp, Artificial sequence
  SiRNA target sequence
agaatttaaagaaagtattaa

SEQ ID NO: 69437 - DNA, 21 bp, Artificial sequence
  SiRNA target sequence
gaatttaaagaaagtattaag

SEQ ID NO: 69438 - DNA, 21 bp, Artificial sequence
  SiRNA target sequence
aatttaaagaaagtattaagt

SEQ ID NO: 69439 - DNA, 21 bp, Artificial sequence
  SiRNA target sequence
atttaaagaaagtattaagtt

SEQ ID NO: 69440 - DNA, 21 bp, Artificial sequence
  SiRNA target sequence
tttaaagaaagtattaagttt

SEQ ID NO: 69441 - DNA, 21 bp, Artificial sequence
  SiRNA target sequence
ttaaagaaagtattaagttta

SEQ ID NO: 69442 - DNA, 21 bp, Artificial sequence
  SiRNA target sequence
taaagaaagtattaagtttaa

SEQ ID NO: 69443 - DNA, 21 bp, Artificial sequence
  SiRNA target sequence
aaagaaagtattaagtttaat

SEQ ID NO: 69444 - DNA, 21 bp, Artificial sequence
  SiRNA target sequence
aagaaagtattaagtttaata

SEQ ID NO: 69445 - DNA, 21 bp, Artificial sequence
  SiRNA target sequence
agaaagtattaagtttaataa

SEQ ID NO: 69446 - DNA, 21 bp, Artificial sequence
  SiRNA target sequence
gaaagtattaagtttaataat

SEQ ID NO: 69447 - DNA, 21 bp, Artificial sequence
  SiRNA target sequence
aaagtattaagtttaataatt

SEQ ID NO: 69448 - DNA, 21 bp, Artificial sequence
  SiRNA target sequence
aagtattaagtttaataattt

SEQ ID NO: 69449 - DNA, 21 bp, Artificial sequence
  SiRNA target sequence
agtattaagtttaataatttg

SEQ ID NO: 69450 - DNA, 21 bp, Artificial sequence
  SiRNA target sequence
gtattaagtttaataatttgt

SEQ ID NO: 69451 - DNA, 21 bp, Artificial sequence
  SiRNA target sequence
tattaagtttaataatttgtc

SEQ ID NO: 69452 - DNA, 21 bp, Artificial sequence
  SiRNA target sequence
attaagtttaataatttgtca

SEQ ID NO: 69453 - DNA, 21 bp, Artificial sequence
  SiRNA target sequence
ttaagtttaataatttgtcat

SEQ ID NO: 69454 - DNA, 21 bp, Artificial sequence
  SiRNA target sequence
taagtttaataatttgtcatt

SEQ ID NO: 69455 - DNA, 21 bp, Artificial sequence
  SiRNA target sequence
aagtttaataatttgtcattt

SEQ ID NO: 69456 - DNA, 21 bp, Artificial sequence
  SiRNA target sequence
agtttaataatttgtcatttg

SEQ ID NO: 69457 - DNA, 21 bp, Artificial sequence
  SiRNA target sequence
gtttaataatttgtcatttgg

SEQ ID NO: 69458 - DNA, 21 bp, Artificial sequence
  SiRNA target sequence
tttaataatttgtcatttggt

SEQ ID NO: 69459 - DNA, 21 bp, Artificial sequence
  SiRNA target sequence
ttaataatttgtcatttggtt

SEQ ID NO: 69460 - DNA, 21 bp, Artificial sequence
  SiRNA target sequence
taataatttgtcatttggtta

SEQ ID NO: 69461 - DNA, 21 bp, Artificial sequence
  SiRNA target sequence
aataatttgtcatttggttat

SEQ ID NO: 69462 - DNA, 21 bp, Artificial sequence
  SiRNA target sequence
ataatttgtcatttggttatg

SEQ ID NO: 69463 - DNA, 21 bp, Artificial sequence
  SiRNA target sequence
taatttgtcatttggttatga

SEQ ID NO: 69464 - DNA, 21 bp, Artificial sequence
  SiRNA target sequence
aatttgtcatttggttatgaa

SEQ ID NO: 69465 - DNA, 21 bp, Artificial sequence
  SiRNA target sequence
atttgtcatttggttatgaaa

SEQ ID NO: 69466 - DNA, 21 bp, Artificial sequence
  SiRNA target sequence
tttgtcatttggttatgaaag

SEQ ID NO: 69467 - DNA, 21 bp, Artificial sequence
  SiRNA target sequence
ttgtcatttggttatgaaagt

SEQ ID NO: 69468 - DNA, 21 bp, Artificial sequence
  SiRNA target sequence
tgtcatttggttatgaaagta

SEQ ID NO: 69469 - DNA, 21 bp, Artificial sequence
  SiRNA target sequence
gtcatttggttatgaaagtag

SEQ ID NO: 69470 - DNA, 21 bp, Artificial sequence
  SiRNA target sequence
tcatttggttatgaaagtaga

SEQ ID NO: 69471 - DNA, 21 bp, Artificial sequence
  SiRNA target sequence
catttggttatgaaagtagac

SEQ ID NO: 69472 - DNA, 21 bp, Artificial sequence
  SiRNA target sequence
atttggttatgaaagtagaca

SEQ ID NO: 69473 - DNA, 21 bp, Artificial sequence
  SiRNA target sequence
tttggttatgaaagtagacaa

SEQ ID NO: 69474 - DNA, 21 bp, Artificial sequence
  SiRNA target sequence
ttggttatgaaagtagacaaa

SEQ ID NO: 69475 - DNA, 21 bp, Artificial sequence
  SiRNA target sequence
tggttatgaaagtagacaaat

SEQ ID NO: 69476 - DNA, 21 bp, Artificial sequence
  SiRNA target sequence
ggttatgaaagtagacaaatt

SEQ ID NO: 69477 - DNA, 21 bp, Artificial sequence
  SiRNA target sequence
gttatgaaagtagacaaattt

SEQ ID NO: 69478 - DNA, 21 bp, Artificial sequence
  SiRNA target sequence
ttatgaaagtagacaaatttt

SEQ ID NO: 69479 - DNA, 21 bp, Artificial sequence
  SiRNA target sequence
tatgaaagtagacaaattttt

SEQ ID NO: 69480 - DNA, 21 bp, Artificial sequence
  SiRNA target sequence
atgaaagtagacaaattttta

SEQ ID NO: 69481 - DNA, 21 bp, Artificial sequence
  SiRNA target sequence
tgaaagtagacaaatttttaa

SEQ ID NO: 69482 - DNA, 21 bp, Artificial sequence
  SiRNA target sequence
gaaagtagacaaatttttaat

SEQ ID NO: 69483 - DNA, 21 bp, Artificial sequence
  SiRNA target sequence
aaagtagacaaatttttaata

SEQ ID NO: 69484 - DNA, 21 bp, Artificial sequence
  SiRNA target sequence
aagtagacaaatttttaataa

SEQ ID NO: 69485 - DNA, 21 bp, Artificial sequence
  SiRNA target sequence
agtagacaaatttttaataaa

SEQ ID NO: 69486 - DNA, 21 bp, Artificial sequence
  SiRNA target sequence
gtagacaaatttttaataaaa

SEQ ID NO: 69487 - DNA, 21 bp, Artificial sequence
  SiRNA target sequence
tagacaaatttttaataaaat

SEQ ID NO: 69488 - DNA, 21 bp, Artificial sequence
  SiRNA target sequence
agacaaatttttaataaaata

SEQ ID NO: 69489 - DNA, 21 bp, Artificial sequence
  SiRNA target sequence
gacaaatttttaataaaataa

SEQ ID NO: 69490 - DNA, 21 bp, Artificial sequence
  SiRNA target sequence
acaaatttttaataaaataaa

SEQ ID NO: 69491 - DNA, 21 bp, Artificial sequence
  SiRNA target sequence
caaatttttaataaaataaat

SEQ ID NO: 69492 - DNA, 21 bp, Artificial sequence
  SiRNA target sequence
aaatttttaataaaataaatc

SEQ ID NO: 69493 - DNA, 21 bp, Artificial sequence
  SiRNA target sequence
aatttttaataaaataaatct

SEQ ID NO: 69494 - DNA, 21 bp, Artificial sequence
  SiRNA target sequence
atttttaataaaataaatcta

SEQ ID NO: 69495 - DNA, 21 bp, Artificial sequence
  SiRNA target sequence
tttttaataaaataaatctag

SEQ ID NO: 69496 - DNA, 21 bp, Artificial sequence
  SiRNA target sequence
ttttaataaaataaatctaga

SEQ ID NO: 69497 - DNA, 21 bp, Artificial sequence
  SiRNA target sequence
tttaataaaataaatctagaa

SEQ ID NO: 69498 - DNA, 21 bp, Artificial sequence
  SiRNA target sequence
ttaataaaataaatctagaaa

SEQ ID NO: 69499 - DNA, 21 bp, Artificial sequence
  SiRNA target sequence
taataaaataaatctagaaat

SEQ ID NO: 69500 - DNA, 21 bp, Artificial sequence
  SiRNA target sequence
aataaaataaatctagaaata

SEQ ID NO: 69501 - DNA, 21 bp, Artificial sequence
  SiRNA target sequence
ataaaataaatctagaaatat

SEQ ID NO: 69502 - DNA, 21 bp, Artificial sequence
  SiRNA target sequence
taaaataaatctagaaatata

SEQ ID NO: 69503 - DNA, 21 bp, Artificial sequence
  SiRNA target sequence
aaaataaatctagaaatatac

SEQ ID NO: 69504 - DNA, 21 bp, Artificial sequence
  SiRNA target sequence
aaataaatctagaaatataca

SEQ ID NO: 69505 - DNA, 21 bp, Artificial sequence
  SiRNA target sequence
aataaatctagaaatatacaa

SEQ ID NO: 69506 - DNA, 21 bp, Artificial sequence
  SiRNA target sequence
ataaatctagaaatatacaaa

SEQ ID NO: 69507 - DNA, 21 bp, Artificial sequence
  SiRNA target sequence
taaatctagaaatatacaaag

SEQ ID NO: 69508 - DNA, 21 bp, Artificial sequence
  SiRNA target sequence
aaatctagaaatatacaaagg

SEQ ID NO: 69509 - DNA, 21 bp, Artificial sequence
  SiRNA target sequence
aatctagaaatatacaaagga

SEQ ID NO: 69510 - DNA, 21 bp, Artificial sequence
  SiRNA target sequence
atctagaaatatacaaaggag

SEQ ID NO: 69511 - DNA, 21 bp, Artificial sequence
  SiRNA target sequence
tctagaaatatacaaaggaga

SEQ ID NO: 69512 - DNA, 21 bp, Artificial sequence
  SiRNA target sequence
ctagaaatatacaaaggagaa

SEQ ID NO: 69513 - DNA, 21 bp, Artificial sequence
  SiRNA target sequence
tagaaatatacaaaggagaaa

SEQ ID NO: 69514 - DNA, 21 bp, Artificial sequence
  SiRNA target sequence
agaaatatacaaaggagaaaa

SEQ ID NO: 69515 - DNA, 21 bp, Artificial sequence
  SiRNA target sequence
gaaatatacaaaggagaaaaa

SEQ ID NO: 69516 - DNA, 21 bp, Artificial sequence
  SiRNA target sequence
aaatatacaaaggagaaaaag

SEQ ID NO: 69517 - DNA, 21 bp, Artificial sequence
  SiRNA target sequence
aatatacaaaggagaaaaagt

SEQ ID NO: 69518 - DNA, 21 bp, Artificial sequence
  SiRNA target sequence
atatacaaaggagaaaaagta

SEQ ID NO: 69519 - DNA, 21 bp, Artificial sequence
  SiRNA target sequence
tatacaaaggagaaaaagtag

SEQ ID NO: 69520 - DNA, 21 bp, Artificial sequence
  SiRNA target sequence
atacaaaggagaaaaagtagc

SEQ ID NO: 69521 - DNA, 21 bp, Artificial sequence
  SiRNA target sequence
tacaaaggagaaaaagtagca

SEQ ID NO: 69522 - DNA, 21 bp, Artificial sequence
  SiRNA target sequence
acaaaggagaaaaagtagcaa

SEQ ID NO: 69523 - DNA, 21 bp, Artificial sequence
  SiRNA target sequence
caaaggagaaaaagtagcaat

SEQ ID NO: 69524 - DNA, 21 bp, Artificial sequence
  SiRNA target sequence
aaaggagaaaaagtagcaatt

SEQ ID NO: 69525 - DNA, 21 bp, Artificial sequence
  SiRNA target sequence
aaggagaaaaagtagcaatta

SEQ ID NO: 69526 - DNA, 21 bp, Artificial sequence
  SiRNA target sequence
aggagaaaaagtagcaattat

SEQ ID NO: 69527 - DNA, 21 bp, Artificial sequence
  SiRNA target sequence
ggagaaaaagtagcaattata

SEQ ID NO: 69528 - DNA, 21 bp, Artificial sequence
  SiRNA target sequence
gagaaaaagtagcaattatag

SEQ ID NO: 69529 - DNA, 21 bp, Artificial sequence
  SiRNA target sequence
agaaaaagtagcaattatagg

SEQ ID NO: 69530 - DNA, 21 bp, Artificial sequence
  SiRNA target sequence
gaaaaagtagcaattataggt

SEQ ID NO: 69531 - DNA, 21 bp, Artificial sequence
  SiRNA target sequence
aaaaagtagcaattataggta

SEQ ID NO: 69532 - DNA, 21 bp, Artificial sequence
  SiRNA target sequence
aaaagtagcaattataggtaa

SEQ ID NO: 69533 - DNA, 21 bp, Artificial sequence
  SiRNA target sequence
aaagtagcaattataggtaaa

SEQ ID NO: 69534 - DNA, 21 bp, Artificial sequence
  SiRNA target sequence
aagtagcaattataggtaaaa

SEQ ID NO: 69535 - DNA, 21 bp, Artificial sequence
  SiRNA target sequence
agtagcaattataggtaaaaa

SEQ ID NO: 69536 - DNA, 21 bp, Artificial sequence
  SiRNA target sequence
gtagcaattataggtaaaaat

SEQ ID NO: 69537 - DNA, 21 bp, Artificial sequence
  SiRNA target sequence
tagcaattataggtaaaaatg

SEQ ID NO: 69538 - DNA, 21 bp, Artificial sequence
  SiRNA target sequence
agcaattataggtaaaaatgg

SEQ ID NO: 69539 - DNA, 21 bp, Artificial sequence
  SiRNA target sequence
gcaattataggtaaaaatggt

SEQ ID NO: 69540 - DNA, 21 bp, Artificial sequence
  SiRNA target sequence
caattataggtaaaaatggta

SEQ ID NO: 69541 - DNA, 21 bp, Artificial sequence
  SiRNA target sequence
aattataggtaaaaatggtag

SEQ ID NO: 69542 - DNA, 21 bp, Artificial sequence
  SiRNA target sequence
attataggtaaaaatggtagt

SEQ ID NO: 69543 - DNA, 21 bp, Artificial sequence
  SiRNA target sequence
ttataggtaaaaatggtagtg

SEQ ID NO: 69544 - DNA, 21 bp, Artificial sequence
  SiRNA target sequence
tataggtaaaaatggtagtgg

SEQ ID NO: 69545 - DNA, 21 bp, Artificial sequence
  SiRNA target sequence
ataggtaaaaatggtagtggt

SEQ ID NO: 69546 - DNA, 21 bp, Artificial sequence
  SiRNA target sequence
taggtaaaaatggtagtggta

SEQ ID NO: 69547 - DNA, 21 bp, Artificial sequence
  SiRNA target sequence
aggtaaaaatggtagtggtaa

SEQ ID NO: 69548 - DNA, 21 bp, Artificial sequence
  SiRNA target sequence
ggtaaaaatggtagtggtaaa

SEQ ID NO: 69549 - DNA, 21 bp, Artificial sequence
  SiRNA target sequence
gtaaaaatggtagtggtaaat

SEQ ID NO: 69550 - DNA, 21 bp, Artificial sequence
  SiRNA target sequence
taaaaatggtagtggtaaatc

SEQ ID NO: 69551 - DNA, 21 bp, Artificial sequence
  SiRNA target sequence
aaaaatggtagtggtaaatca

SEQ ID NO: 69552 - DNA, 21 bp, Artificial sequence
  SiRNA target sequence
aaaatggtagtggtaaatcaa

SEQ ID NO: 69553 - DNA, 21 bp, Artificial sequence
  SiRNA target sequence
aaatggtagtggtaaatcaac

SEQ ID NO: 69554 - DNA, 21 bp, Artificial sequence
  SiRNA target sequence
aatggtagtggtaaatcaaca

SEQ ID NO: 69555 - DNA, 21 bp, Artificial sequence
  SiRNA target sequence
atggtagtggtaaatcaacat

SEQ ID NO: 69556 - DNA, 21 bp, Artificial sequence
  SiRNA target sequence
tggtagtggtaaatcaacatt

SEQ ID NO: 69557 - DNA, 21 bp, Artificial sequence
  SiRNA target sequence
ggtagtggtaaatcaacatta

SEQ ID NO: 69558 - DNA, 21 bp, Artificial sequence
  SiRNA target sequence
gtagtggtaaatcaacattac

SEQ ID NO: 69559 - DNA, 21 bp, Artificial sequence
  SiRNA target sequence
tagtggtaaatcaacattact

SEQ ID NO: 69560 - DNA, 21 bp, Artificial sequence
  SiRNA target sequence
agtggtaaatcaacattacta

SEQ ID NO: 69561 - DNA, 21 bp, Artificial sequence
  SiRNA target sequence
gtggtaaatcaacattactaa

SEQ ID NO: 69562 - DNA, 21 bp, Artificial sequence
  SiRNA target sequence
tggtaaatcaacattactaaa

SEQ ID NO: 69563 - DNA, 21 bp, Artificial sequence
  SiRNA target sequence
ggtaaatcaacattactaaaa

SEQ ID NO: 69564 - DNA, 21 bp, Artificial sequence
  SiRNA target sequence
gtaaatcaacattactaaaac

SEQ ID NO: 69565 - DNA, 21 bp, Artificial sequence
  SiRNA target sequence
taaatcaacattactaaaact

SEQ ID NO: 69566 - DNA, 21 bp, Artificial sequence
  SiRNA target sequence
aaatcaacattactaaaacta

SEQ ID NO: 69567 - DNA, 21 bp, Artificial sequence
  SiRNA target sequence
aatcaacattactaaaactac

SEQ ID NO: 69568 - DNA, 21 bp, Artificial sequence
  SiRNA target sequence
atcaacattactaaaactact

SEQ ID NO: 69569 - DNA, 21 bp, Artificial sequence
  SiRNA target sequence
tcaacattactaaaactactg

SEQ ID NO: 69570 - DNA, 21 bp, Artificial sequence
  SiRNA target sequence
caacattactaaaactactgc

SEQ ID NO: 69571 - DNA, 21 bp, Artificial sequence
  SiRNA target sequence
aacattactaaaactactgct

SEQ ID NO: 69572 - DNA, 21 bp, Artificial sequence
  SiRNA target sequence
acattactaaaactactgctt

SEQ ID NO: 69573 - DNA, 21 bp, Artificial sequence
  SiRNA target sequence
cattactaaaactactgctta

SEQ ID NO: 69574 - DNA, 21 bp, Artificial sequence
  SiRNA target sequence
attactaaaactactgcttaa

SEQ ID NO: 69575 - DNA, 21 bp, Artificial sequence
  SiRNA target sequence
ttactaaaactactgcttaaa

SEQ ID NO: 69576 - DNA, 21 bp, Artificial sequence
  SiRNA target sequence
tactaaaactactgcttaaat

SEQ ID NO: 69577 - DNA, 21 bp, Artificial sequence
  SiRNA target sequence
actaaaactactgcttaaatt

SEQ ID NO: 69578 - DNA, 21 bp, Artificial sequence
  SiRNA target sequence
ctaaaactactgcttaaattt

SEQ ID NO: 69579 - DNA, 21 bp, Artificial sequence
  SiRNA target sequence
taaaactactgcttaaatttg

SEQ ID NO: 69580 - DNA, 21 bp, Artificial sequence
  SiRNA target sequence
aaaactactgcttaaatttga

SEQ ID NO: 69581 - DNA, 21 bp, Artificial sequence
  SiRNA target sequence
aaactactgcttaaatttgat

SEQ ID NO: 69582 - DNA, 21 bp, Artificial sequence
  SiRNA target sequence
aactactgcttaaatttgatg

SEQ ID NO: 69583 - DNA, 21 bp, Artificial sequence
  SiRNA target sequence
actactgcttaaatttgatga

SEQ ID NO: 69584 - DNA, 21 bp, Artificial sequence
  SiRNA target sequence
ctactgcttaaatttgatgaa

SEQ ID NO: 69585 - DNA, 21 bp, Artificial sequence
  SiRNA target sequence
tactgcttaaatttgatgaag

SEQ ID NO: 69586 - DNA, 21 bp, Artificial sequence
  SiRNA target sequence
actgcttaaatttgatgaaga

SEQ ID NO: 69587 - DNA, 21 bp, Artificial sequence
  SiRNA target sequence
ctgcttaaatttgatgaagat

SEQ ID NO: 69588 - DNA, 21 bp, Artificial sequence
  SiRNA target sequence
tgcttaaatttgatgaagatt

SEQ ID NO: 69589 - DNA, 21 bp, Artificial sequence
  SiRNA target sequence
gcttaaatttgatgaagatta

SEQ ID NO: 69590 - DNA, 21 bp, Artificial sequence
  SiRNA target sequence
cttaaatttgatgaagattac

SEQ ID NO: 69591 - DNA, 21 bp, Artificial sequence
  SiRNA target sequence
ttaaatttgatgaagattaca

SEQ ID NO: 69592 - DNA, 21 bp, Artificial sequence
  SiRNA target sequence
taaatttgatgaagattacaa

SEQ ID NO: 69593 - DNA, 21 bp, Artificial sequence
  SiRNA target sequence
aaatttgatgaagattacaaa

SEQ ID NO: 69594 - DNA, 21 bp, Artificial sequence
  SiRNA target sequence
aatttgatgaagattacaaag

SEQ ID NO: 69595 - DNA, 21 bp, Artificial sequence
  SiRNA target sequence
atttgatgaagattacaaagg

SEQ ID NO: 69596 - DNA, 21 bp, Artificial sequence
  SiRNA target sequence
tttgatgaagattacaaaggt

SEQ ID NO: 69597 - DNA, 21 bp, Artificial sequence
  SiRNA target sequence
ttgatgaagattacaaaggta

SEQ ID NO: 69598 - DNA, 21 bp, Artificial sequence
  SiRNA target sequence
tgatgaagattacaaaggtag

SEQ ID NO: 69599 - DNA, 21 bp, Artificial sequence
  SiRNA target sequence
gatgaagattacaaaggtagc

SEQ ID NO: 69600 - DNA, 21 bp, Artificial sequence
  SiRNA target sequence
atgaagattacaaaggtagca

SEQ ID NO: 69601 - DNA, 21 bp, Artificial sequence
  SiRNA target sequence
tgaagattacaaaggtagcat

SEQ ID NO: 69602 - DNA, 21 bp, Artificial sequence
  SiRNA target sequence
gaagattacaaaggtagcatt

SEQ ID NO: 69603 - DNA, 21 bp, Artificial sequence
  SiRNA target sequence
aagattacaaaggtagcattt

SEQ ID NO: 69604 - DNA, 21 bp, Artificial sequence
  SiRNA target sequence
agattacaaaggtagcatttt

SEQ ID NO: 69605 - DNA, 21 bp, Artificial sequence
  SiRNA target sequence
gattacaaaggtagcatttta

SEQ ID NO: 69606 - DNA, 21 bp, Artificial sequence
  SiRNA target sequence
attacaaaggtagcattttaa

SEQ ID NO: 69607 - DNA, 21 bp, Artificial sequence
  SiRNA target sequence
ttacaaaggtagcattttaat

SEQ ID NO: 69608 - DNA, 21 bp, Artificial sequence
  SiRNA target sequence
tacaaaggtagcattttaata

SEQ ID NO: 69609 - DNA, 21 bp, Artificial sequence
  SiRNA target sequence
acaaaggtagcattttaatag

SEQ ID NO: 69610 - DNA, 21 bp, Artificial sequence
  SiRNA target sequence
caaaggtagcattttaataga

SEQ ID NO: 69611 - DNA, 21 bp, Artificial sequence
  SiRNA target sequence
aaaggtagcattttaatagat

SEQ ID NO: 69612 - DNA, 21 bp, Artificial sequence
  SiRNA target sequence
aaggtagcattttaatagatg

SEQ ID NO: 69613 - DNA, 21 bp, Artificial sequence
  SiRNA target sequence
aggtagcattttaatagatga

SEQ ID NO: 69614 - DNA, 21 bp, Artificial sequence
  SiRNA target sequence
ggtagcattttaatagatgac

SEQ ID NO: 69615 - DNA, 21 bp, Artificial sequence
  SiRNA target sequence
gtagcattttaatagatgaca

SEQ ID NO: 69616 - DNA, 21 bp, Artificial sequence
  SiRNA target sequence
tagcattttaatagatgacat

SEQ ID NO: 69617 - DNA, 21 bp, Artificial sequence
  SiRNA target sequence
agcattttaatagatgacatt

SEQ ID NO: 69618 - DNA, 21 bp, Artificial sequence
  SiRNA target sequence
gcattttaatagatgacattg

SEQ ID NO: 69619 - DNA, 21 bp, Artificial sequence
  SiRNA target sequence
cattttaatagatgacattga

SEQ ID NO: 69620 - DNA, 21 bp, Artificial sequence
  SiRNA target sequence
attttaatagatgacattgat

SEQ ID NO: 69621 - DNA, 21 bp, Artificial sequence
  SiRNA target sequence
ttttaatagatgacattgata

SEQ ID NO: 69622 - DNA, 21 bp, Artificial sequence
  SiRNA target sequence
tttaatagatgacattgatat

SEQ ID NO: 69623 - DNA, 21 bp, Artificial sequence
  SiRNA target sequence
ttaatagatgacattgatatt

SEQ ID NO: 69624 - DNA, 21 bp, Artificial sequence
  SiRNA target sequence
taatagatgacattgatatta

SEQ ID NO: 69625 - DNA, 21 bp, Artificial sequence
  SiRNA target sequence
aatagatgacattgatattaa

SEQ ID NO: 69626 - DNA, 21 bp, Artificial sequence
  SiRNA target sequence
atagatgacattgatattaaa

SEQ ID NO: 69627 - DNA, 21 bp, Artificial sequence
  SiRNA target sequence
tagatgacattgatattaaaa

SEQ ID NO: 69628 - DNA, 21 bp, Artificial sequence
  SiRNA target sequence
agatgacattgatattaaaaa

SEQ ID NO: 69629 - DNA, 21 bp, Artificial sequence
  SiRNA target sequence
gatgacattgatattaaaaaa

SEQ ID NO: 69630 - DNA, 21 bp, Artificial sequence
  SiRNA target sequence
atgacattgatattaaaaaaa

SEQ ID NO: 69631 - DNA, 21 bp, Artificial sequence
  SiRNA target sequence
tgacattgatattaaaaaaat

SEQ ID NO: 69632 - DNA, 21 bp, Artificial sequence
  SiRNA target sequence
gacattgatattaaaaaaatc

SEQ ID NO: 69633 - DNA, 21 bp, Artificial sequence
  SiRNA target sequence
acattgatattaaaaaaatca

SEQ ID NO: 69634 - DNA, 21 bp, Artificial sequence
  SiRNA target sequence
cattgatattaaaaaaatcaa

SEQ ID NO: 69635 - DNA, 21 bp, Artificial sequence
  SiRNA target sequence
attgatattaaaaaaatcaaa

SEQ ID NO: 69636 - DNA, 21 bp, Artificial sequence
  SiRNA target sequence
ttgatattaaaaaaatcaaag

SEQ ID NO: 69637 - DNA, 21 bp, Artificial sequence
  SiRNA target sequence
tgatattaaaaaaatcaaaga

SEQ ID NO: 69638 - DNA, 21 bp, Artificial sequence
  SiRNA target sequence
gatattaaaaaaatcaaagac

SEQ ID NO: 69639 - DNA, 21 bp, Artificial sequence
  SiRNA target sequence
atattaaaaaaatcaaagacg

SEQ ID NO: 69640 - DNA, 21 bp, Artificial sequence
  SiRNA target sequence
tattaaaaaaatcaaagacga

SEQ ID NO: 69641 - DNA, 21 bp, Artificial sequence
  SiRNA target sequence
attaaaaaaatcaaagacgaa

SEQ ID NO: 69642 - DNA, 21 bp, Artificial sequence
  SiRNA target sequence
ttaaaaaaatcaaagacgaat

SEQ ID NO: 69643 - DNA, 21 bp, Artificial sequence
  SiRNA target sequence
taaaaaaatcaaagacgaatt

SEQ ID NO: 69644 - DNA, 21 bp, Artificial sequence
  SiRNA target sequence
aaaaaaatcaaagacgaattt

SEQ ID NO: 69645 - DNA, 21 bp, Artificial sequence
  SiRNA target sequence
aaaaaatcaaagacgaatttt

SEQ ID NO: 69646 - DNA, 21 bp, Artificial sequence
  SiRNA target sequence
aaaaatcaaagacgaatttta

SEQ ID NO: 69647 - DNA, 21 bp, Artificial sequence
  SiRNA target sequence
aaaatcaaagacgaattttat

SEQ ID NO: 69648 - DNA, 21 bp, Artificial sequence
  SiRNA target sequence
aaatcaaagacgaattttata

SEQ ID NO: 69649 - DNA, 21 bp, Artificial sequence
  SiRNA target sequence
aatcaaagacgaattttatag

SEQ ID NO: 69650 - DNA, 21 bp, Artificial sequence
  SiRNA target sequence
atcaaagacgaattttatagg

SEQ ID NO: 69651 - DNA, 21 bp, Artificial sequence
  SiRNA target sequence
tcaaagacgaattttatagga

SEQ ID NO: 69652 - DNA, 21 bp, Artificial sequence
  SiRNA target sequence
caaagacgaattttataggaa

SEQ ID NO: 69653 - DNA, 21 bp, Artificial sequence
  SiRNA target sequence
aaagacgaattttataggaat

SEQ ID NO: 69654 - DNA, 21 bp, Artificial sequence
  SiRNA target sequence
aagacgaattttataggaatt

SEQ ID NO: 69655 - DNA, 21 bp, Artificial sequence
  SiRNA target sequence
agacgaattttataggaattt

SEQ ID NO: 69656 - DNA, 21 bp, Artificial sequence
  SiRNA target sequence
gacgaattttataggaattta

SEQ ID NO: 69657 - DNA, 21 bp, Artificial sequence
  SiRNA target sequence
acgaattttataggaatttat

SEQ ID NO: 69658 - DNA, 21 bp, Artificial sequence
  SiRNA target sequence
cgaattttataggaatttatt

SEQ ID NO: 69659 - DNA, 21 bp, Artificial sequence
  SiRNA target sequence
gaattttataggaatttatta

SEQ ID NO: 69660 - DNA, 21 bp, Artificial sequence
  SiRNA target sequence
aattttataggaatttattag

SEQ ID NO: 69661 - DNA, 21 bp, Artificial sequence
  SiRNA target sequence
attttataggaatttattagg

SEQ ID NO: 69662 - DNA, 21 bp, Artificial sequence
  SiRNA target sequence
ttttataggaatttattaggt

SEQ ID NO: 69663 - DNA, 21 bp, Artificial sequence
  SiRNA target sequence
tttataggaatttattaggtt

SEQ ID NO: 69664 - DNA, 21 bp, Artificial sequence
  SiRNA target sequence
ttataggaatttattaggtta

SEQ ID NO: 69665 - DNA, 21 bp, Artificial sequence
  SiRNA target sequence
tataggaatttattaggttac

SEQ ID NO: 69666 - DNA, 21 bp, Artificial sequence
  SiRNA target sequence
ataggaatttattaggttaca

SEQ ID NO: 69667 - DNA, 21 bp, Artificial sequence
  SiRNA target sequence
taggaatttattaggttacat

SEQ ID NO: 69668 - DNA, 21 bp, Artificial sequence
  SiRNA target sequence
aggaatttattaggttacata

SEQ ID NO: 69669 - DNA, 21 bp, Artificial sequence
  SiRNA target sequence
ggaatttattaggttacatac

SEQ ID NO: 69670 - DNA, 21 bp, Artificial sequence
  SiRNA target sequence
gaatttattaggttacatacc

SEQ ID NO: 69671 - DNA, 21 bp, Artificial sequence
  SiRNA target sequence
aatttattaggttacatacca

SEQ ID NO: 69672 - DNA, 21 bp, Artificial sequence
  SiRNA target sequence
atttattaggttacataccac

SEQ ID NO: 69673 - DNA, 21 bp, Artificial sequence
  SiRNA target sequence
tttattaggttacataccaca

SEQ ID NO: 69674 - DNA, 21 bp, Artificial sequence
  SiRNA target sequence
ttattaggttacataccacag

SEQ ID NO: 69675 - DNA, 21 bp, Artificial sequence
  SiRNA target sequence
tattaggttacataccacaga

SEQ ID NO: 69676 - DNA, 21 bp, Artificial sequence
  SiRNA target sequence
attaggttacataccacagaa

SEQ ID NO: 69677 - DNA, 21 bp, Artificial sequence
  SiRNA target sequence
ttaggttacataccacagaat

SEQ ID NO: 69678 - DNA, 21 bp, Artificial sequence
  SiRNA target sequence
taggttacataccacagaata

SEQ ID NO: 69679 - DNA, 21 bp, Artificial sequence
  SiRNA target sequence
aggttacataccacagaatac

SEQ ID NO: 69680 - DNA, 21 bp, Artificial sequence
  SiRNA target sequence
ggttacataccacagaataca

SEQ ID NO: 69681 - DNA, 21 bp, Artificial sequence
  SiRNA target sequence
gttacataccacagaatacat

SEQ ID NO: 69682 - DNA, 21 bp, Artificial sequence
  SiRNA target sequence
ttacataccacagaatacatt

SEQ ID NO: 69683 - DNA, 21 bp, Artificial sequence
  SiRNA target sequence
tacataccacagaatacattt

SEQ ID NO: 69684 - DNA, 21 bp, Artificial sequence
  SiRNA target sequence
acataccacagaatacatttt

SEQ ID NO: 69685 - DNA, 21 bp, Artificial sequence
  SiRNA target sequence
cataccacagaatacattttt

SEQ ID NO: 69686 - DNA, 21 bp, Artificial sequence
  SiRNA target sequence
ataccacagaatacatttttg

SEQ ID NO: 69687 - DNA, 21 bp, Artificial sequence
  SiRNA target sequence
taccacagaatacatttttgt

SEQ ID NO: 69688 - DNA, 21 bp, Artificial sequence
  SiRNA target sequence
accacagaatacatttttgtt

SEQ ID NO: 69689 - DNA, 21 bp, Artificial sequence
  SiRNA target sequence
ccacagaatacatttttgttt

SEQ ID NO: 69690 - DNA, 21 bp, Artificial sequence
  SiRNA target sequence
cacagaatacatttttgttta

SEQ ID NO: 69691 - DNA, 21 bp, Artificial sequence
  SiRNA target sequence
acagaatacatttttgtttaa

SEQ ID NO: 69692 - DNA, 21 bp, Artificial sequence
  SiRNA target sequence
cagaatacatttttgtttaat

SEQ ID NO: 69693 - DNA, 21 bp, Artificial sequence
  SiRNA target sequence
agaatacatttttgtttaatg

SEQ ID NO: 69694 - DNA, 21 bp, Artificial sequence
  SiRNA target sequence
gaatacatttttgtttaatga

SEQ ID NO: 69695 - DNA, 21 bp, Artificial sequence
  SiRNA target sequence
aatacatttttgtttaatgaa

SEQ ID NO: 69696 - DNA, 21 bp, Artificial sequence
  SiRNA target sequence
atacatttttgtttaatgaat

SEQ ID NO: 69697 - DNA, 21 bp, Artificial sequence
  SiRNA target sequence
tacatttttgtttaatgaatc

SEQ ID NO: 69698 - DNA, 21 bp, Artificial sequence
  SiRNA target sequence
acatttttgtttaatgaatct

SEQ ID NO: 69699 - DNA, 21 bp, Artificial sequence
  SiRNA target sequence
catttttgtttaatgaatctg

SEQ ID NO: 69700 - DNA, 21 bp, Artificial sequence
  SiRNA target sequence
atttttgtttaatgaatctgt

SEQ ID NO: 69701 - DNA, 21 bp, Artificial sequence
  SiRNA target sequence
tttttgtttaatgaatctgta

SEQ ID NO: 69702 - DNA, 21 bp, Artificial sequence
  SiRNA target sequence
ttttgtttaatgaatctgtaa

SEQ ID NO: 69703 - DNA, 21 bp, Artificial sequence
  SiRNA target sequence
tttgtttaatgaatctgtaaa

SEQ ID NO: 69704 - DNA, 21 bp, Artificial sequence
  SiRNA target sequence
ttgtttaatgaatctgtaaaa

SEQ ID NO: 69705 - DNA, 21 bp, Artificial sequence
  SiRNA target sequence
tgtttaatgaatctgtaaaat

SEQ ID NO: 69706 - DNA, 21 bp, Artificial sequence
  SiRNA target sequence
gtttaatgaatctgtaaaata

SEQ ID NO: 69707 - DNA, 21 bp, Artificial sequence
  SiRNA target sequence
tttaatgaatctgtaaaatat

SEQ ID NO: 69708 - DNA, 21 bp, Artificial sequence
  SiRNA target sequence
ttaatgaatctgtaaaatata

SEQ ID NO: 69709 - DNA, 21 bp, Artificial sequence
  SiRNA target sequence
taatgaatctgtaaaatataa

SEQ ID NO: 69710 - DNA, 21 bp, Artificial sequence
  SiRNA target sequence
aatgaatctgtaaaatataat

SEQ ID NO: 69711 - DNA, 21 bp, Artificial sequence
  SiRNA target sequence
atgaatctgtaaaatataata

SEQ ID NO: 69712 - DNA, 21 bp, Artificial sequence
  SiRNA target sequence
tgaatctgtaaaatataatat

SEQ ID NO: 69713 - DNA, 21 bp, Artificial sequence
  SiRNA target sequence
gaatctgtaaaatataatatt

SEQ ID NO: 69714 - DNA, 21 bp, Artificial sequence
  SiRNA target sequence
aatctgtaaaatataatatta

SEQ ID NO: 69715 - DNA, 21 bp, Artificial sequence
  SiRNA target sequence
atctgtaaaatataatattaa

SEQ ID NO: 69716 - DNA, 21 bp, Artificial sequence
  SiRNA target sequence
tctgtaaaatataatattaaa

SEQ ID NO: 69717 - DNA, 21 bp, Artificial sequence
  SiRNA target sequence
ctgtaaaatataatattaaat

SEQ ID NO: 69718 - DNA, 21 bp, Artificial sequence
  SiRNA target sequence
tgtaaaatataatattaaata

SEQ ID NO: 69719 - DNA, 21 bp, Artificial sequence
  SiRNA target sequence
gtaaaatataatattaaatac

SEQ ID NO: 69720 - DNA, 21 bp, Artificial sequence
  SiRNA target sequence
taaaatataatattaaatacg

SEQ ID NO: 69721 - DNA, 21 bp, Artificial sequence
  SiRNA target sequence
aaaatataatattaaatacgg

SEQ ID NO: 69722 - DNA, 21 bp, Artificial sequence
  SiRNA target sequence
aaatataatattaaatacgga

SEQ ID NO: 69723 - DNA, 21 bp, Artificial sequence
  SiRNA target sequence
aatataatattaaatacggat

SEQ ID NO: 69724 - DNA, 21 bp, Artificial sequence
  SiRNA target sequence
atataatattaaatacggatc

SEQ ID NO: 69725 - DNA, 21 bp, Artificial sequence
  SiRNA target sequence
tataatattaaatacggatct

SEQ ID NO: 69726 - DNA, 21 bp, Artificial sequence
  SiRNA target sequence
ataatattaaatacggatctt

SEQ ID NO: 69727 - DNA, 21 bp, Artificial sequence
  SiRNA target sequence
taatattaaatacggatcttt

SEQ ID NO: 69728 - DNA, 21 bp, Artificial sequence
  SiRNA target sequence
aatattaaatacggatctttt

SEQ ID NO: 69729 - DNA, 21 bp, Artificial sequence
  SiRNA target sequence
atattaaatacggatcttttg

SEQ ID NO: 69730 - DNA, 21 bp, Artificial sequence
  SiRNA target sequence
tattaaatacggatcttttgg

SEQ ID NO: 69731 - DNA, 21 bp, Artificial sequence
  SiRNA target sequence
attaaatacggatcttttggt

SEQ ID NO: 69732 - DNA, 21 bp, Artificial sequence
  SiRNA target sequence
ttaaatacggatcttttggta

SEQ ID NO: 69733 - DNA, 21 bp, Artificial sequence
  SiRNA target sequence
taaatacggatcttttggtat

SEQ ID NO: 69734 - DNA, 21 bp, Artificial sequence
  SiRNA target sequence
aaatacggatcttttggtatt

SEQ ID NO: 69735 - DNA, 21 bp, Artificial sequence
  SiRNA target sequence
aatacggatcttttggtattt

SEQ ID NO: 69736 - DNA, 21 bp, Artificial sequence
  SiRNA target sequence
atacggatcttttggtatttc

SEQ ID NO: 69737 - DNA, 21 bp, Artificial sequence
  SiRNA target sequence
tacggatcttttggtatttca

SEQ ID NO: 69738 - DNA, 21 bp, Artificial sequence
  SiRNA target sequence
acggatcttttggtatttcag

SEQ ID NO: 69739 - DNA, 21 bp, Artificial sequence
  SiRNA target sequence
cggatcttttggtatttcaga

SEQ ID NO: 69740 - DNA, 21 bp, Artificial sequence
  SiRNA target sequence
ggatcttttggtatttcagac

SEQ ID NO: 69741 - DNA, 21 bp, Artificial sequence
  SiRNA target sequence
gatcttttggtatttcagacg

SEQ ID NO: 69742 - DNA, 21 bp, Artificial sequence
  SiRNA target sequence
atcttttggtatttcagacga

SEQ ID NO: 69743 - DNA, 21 bp, Artificial sequence
  SiRNA target sequence
tcttttggtatttcagacgag

SEQ ID NO: 69744 - DNA, 21 bp, Artificial sequence
  SiRNA target sequence
cttttggtatttcagacgagg

SEQ ID NO: 69745 - DNA, 21 bp, Artificial sequence
  SiRNA target sequence
ttttggtatttcagacgagga

SEQ ID NO: 69746 - DNA, 21 bp, Artificial sequence
  SiRNA target sequence
tttggtatttcagacgaggat

SEQ ID NO: 69747 - DNA, 21 bp, Artificial sequence
  SiRNA target sequence
ttggtatttcagacgaggata

SEQ ID NO: 69748 - DNA, 21 bp, Artificial sequence
  SiRNA target sequence
tggtatttcagacgaggatat

SEQ ID NO: 69749 - DNA, 21 bp, Artificial sequence
  SiRNA target sequence
ggtatttcagacgaggatatt

SEQ ID NO: 69750 - DNA, 21 bp, Artificial sequence
  SiRNA target sequence
gtatttcagacgaggatattt

SEQ ID NO: 69751 - DNA, 21 bp, Artificial sequence
  SiRNA target sequence
tatttcagacgaggatatttt

SEQ ID NO: 69752 - DNA, 21 bp, Artificial sequence
  SiRNA target sequence
atttcagacgaggatattttt

SEQ ID NO: 69753 - DNA, 21 bp, Artificial sequence
  SiRNA target sequence
tttcagacgaggatatttttg

SEQ ID NO: 69754 - DNA, 21 bp, Artificial sequence
  SiRNA target sequence
ttcagacgaggatatttttgc

SEQ ID NO: 69755 - DNA, 21 bp, Artificial sequence
  SiRNA target sequence
tcagacgaggatatttttgca

SEQ ID NO: 69756 - DNA, 21 bp, Artificial sequence
  SiRNA target sequence
cagacgaggatatttttgcat

SEQ ID NO: 69757 - DNA, 21 bp, Artificial sequence
  SiRNA target sequence
agacgaggatatttttgcatt

SEQ ID NO: 69758 - DNA, 21 bp, Artificial sequence
  SiRNA target sequence
gacgaggatatttttgcattg

SEQ ID NO: 69759 - DNA, 21 bp, Artificial sequence
  SiRNA target sequence
acgaggatatttttgcattgt

SEQ ID NO: 69760 - DNA, 21 bp, Artificial sequence
  SiRNA target sequence
cgaggatatttttgcattgtg

SEQ ID NO: 69761 - DNA, 21 bp, Artificial sequence
  SiRNA target sequence
gaggatatttttgcattgtgt

SEQ ID NO: 69762 - DNA, 21 bp, Artificial sequence
  SiRNA target sequence
aggatatttttgcattgtgta

SEQ ID NO: 69763 - DNA, 21 bp, Artificial sequence
  SiRNA target sequence
ggatatttttgcattgtgtaa

SEQ ID NO: 69764 - DNA, 21 bp, Artificial sequence
  SiRNA target sequence
gatatttttgcattgtgtaaa

SEQ ID NO: 69765 - DNA, 21 bp, Artificial sequence
  SiRNA target sequence
atatttttgcattgtgtaaag

SEQ ID NO: 69766 - DNA, 21 bp, Artificial sequence
  SiRNA target sequence
tatttttgcattgtgtaaaga

SEQ ID NO: 69767 - DNA, 21 bp, Artificial sequence
  SiRNA target sequence
atttttgcattgtgtaaagag

SEQ ID NO: 69768 - DNA, 21 bp, Artificial sequence
  SiRNA target sequence
tttttgcattgtgtaaagagt

SEQ ID NO: 69769 - DNA, 21 bp, Artificial sequence
  SiRNA target sequence
ttttgcattgtgtaaagagtt

SEQ ID NO: 69770 - DNA, 21 bp, Artificial sequence
  SiRNA target sequence
tttgcattgtgtaaagagttt

SEQ ID NO: 69771 - DNA, 21 bp, Artificial sequence
  SiRNA target sequence
ttgcattgtgtaaagagtttg

SEQ ID NO: 69772 - DNA, 21 bp, Artificial sequence
  SiRNA target sequence
tgcattgtgtaaagagtttgg

SEQ ID NO: 69773 - DNA, 21 bp, Artificial sequence
  SiRNA target sequence
gcattgtgtaaagagtttgga

SEQ ID NO: 69774 - DNA, 21 bp, Artificial sequence
  SiRNA target sequence
cattgtgtaaagagtttggat

SEQ ID NO: 69775 - DNA, 21 bp, Artificial sequence
  SiRNA target sequence
attgtgtaaagagtttggatt

SEQ ID NO: 69776 - DNA, 21 bp, Artificial sequence
  SiRNA target sequence
ttgtgtaaagagtttggatta

SEQ ID NO: 69777 - DNA, 21 bp, Artificial sequence
  SiRNA target sequence
tgtgtaaagagtttggattat

SEQ ID NO: 69778 - DNA, 21 bp, Artificial sequence
  SiRNA target sequence
gtgtaaagagtttggattata

SEQ ID NO: 69779 - DNA, 21 bp, Artificial sequence
  SiRNA target sequence
tgtaaagagtttggattatat

SEQ ID NO: 69780 - DNA, 21 bp, Artificial sequence
  SiRNA target sequence
gtaaagagtttggattatatg

SEQ ID NO: 69781 - DNA, 21 bp, Artificial sequence
  SiRNA target sequence
taaagagtttggattatatga

SEQ ID NO: 69782 - DNA, 21 bp, Artificial sequence
  SiRNA target sequence
aaagagtttggattatatgac

SEQ ID NO: 69783 - DNA, 21 bp, Artificial sequence
  SiRNA target sequence
aagagtttggattatatgacg

SEQ ID NO: 69784 - DNA, 21 bp, Artificial sequence
  SiRNA target sequence
agagtttggattatatgacgt

SEQ ID NO: 69785 - DNA, 21 bp, Artificial sequence
  SiRNA target sequence
gagtttggattatatgacgtt

SEQ ID NO: 69786 - DNA, 21 bp, Artificial sequence
  SiRNA target sequence
agtttggattatatgacgttt

SEQ ID NO: 69787 - DNA, 21 bp, Artificial sequence
  SiRNA target sequence
gtttggattatatgacgtttt

SEQ ID NO: 69788 - DNA, 21 bp, Artificial sequence
  SiRNA target sequence
tttggattatatgacgttttc

SEQ ID NO: 69789 - DNA, 21 bp, Artificial sequence
  SiRNA target sequence
ttggattatatgacgttttca

SEQ ID NO: 69790 - DNA, 21 bp, Artificial sequence
  SiRNA target sequence
tggattatatgacgttttcat

SEQ ID NO: 69791 - DNA, 21 bp, Artificial sequence
  SiRNA target sequence
ggattatatgacgttttcatg

SEQ ID NO: 69792 - DNA, 21 bp, Artificial sequence
  SiRNA target sequence
gattatatgacgttttcatga

SEQ ID NO: 69793 - DNA, 21 bp, Artificial sequence
  SiRNA target sequence
attatatgacgttttcatgaa

SEQ ID NO: 69794 - DNA, 21 bp, Artificial sequence
  SiRNA target sequence
ttatatgacgttttcatgaac

SEQ ID NO: 69795 - DNA, 21 bp, Artificial sequence
  SiRNA target sequence
tatatgacgttttcatgaacc

SEQ ID NO: 69796 - DNA, 21 bp, Artificial sequence
  SiRNA target sequence
atatgacgttttcatgaacct

SEQ ID NO: 69797 - DNA, 21 bp, Artificial sequence
  SiRNA target sequence
tatgacgttttcatgaacctc

SEQ ID NO: 69798 - DNA, 21 bp, Artificial sequence
  SiRNA target sequence
atgacgttttcatgaacctcg

SEQ ID NO: 69799 - DNA, 21 bp, Artificial sequence
  SiRNA target sequence
tgacgttttcatgaacctcga

SEQ ID NO: 69800 - DNA, 21 bp, Artificial sequence
  SiRNA target sequence
gacgttttcatgaacctcgaa

SEQ ID NO: 69801 - DNA, 21 bp, Artificial sequence
  SiRNA target sequence
acgttttcatgaacctcgaaa

SEQ ID NO: 69802 - DNA, 21 bp, Artificial sequence
  SiRNA target sequence
cgttttcatgaacctcgaaaa

SEQ ID NO: 69803 - DNA, 21 bp, Artificial sequence
  SiRNA target sequence
gttttcatgaacctcgaaaat

SEQ ID NO: 69804 - DNA, 21 bp, Artificial sequence
  SiRNA target sequence
ttttcatgaacctcgaaaatg

SEQ ID NO: 69805 - DNA, 21 bp, Artificial sequence
  SiRNA target sequence
tttcatgaacctcgaaaatgg

SEQ ID NO: 69806 - DNA, 21 bp, Artificial sequence
  SiRNA target sequence
ttcatgaacctcgaaaatggt

SEQ ID NO: 69807 - DNA, 21 bp, Artificial sequence
  SiRNA target sequence
tcatgaacctcgaaaatggtt

SEQ ID NO: 69808 - DNA, 21 bp, Artificial sequence
  SiRNA target sequence
catgaacctcgaaaatggttt

SEQ ID NO: 69809 - DNA, 21 bp, Artificial sequence
  SiRNA target sequence
atgaacctcgaaaatggtttt

SEQ ID NO: 69810 - DNA, 21 bp, Artificial sequence
  SiRNA target sequence
tgaacctcgaaaatggttttg

SEQ ID NO: 69811 - DNA, 21 bp, Artificial sequence
  SiRNA target sequence
gaacctcgaaaatggttttga

SEQ ID NO: 69812 - DNA, 21 bp, Artificial sequence
  SiRNA target sequence
aacctcgaaaatggttttgat

SEQ ID NO: 69813 - DNA, 21 bp, Artificial sequence
  SiRNA target sequence
acctcgaaaatggttttgata

SEQ ID NO: 69814 - DNA, 21 bp, Artificial sequence
  SiRNA target sequence
cctcgaaaatggttttgatac

SEQ ID NO: 69815 - DNA, 21 bp, Artificial sequence
  SiRNA target sequence
ctcgaaaatggttttgatacg

SEQ ID NO: 69816 - DNA, 21 bp, Artificial sequence
  SiRNA target sequence
tcgaaaatggttttgatacga

SEQ ID NO: 69817 - DNA, 21 bp, Artificial sequence
  SiRNA target sequence
cgaaaatggttttgatacgaa

SEQ ID NO: 69818 - DNA, 21 bp, Artificial sequence
  SiRNA target sequence
gaaaatggttttgatacgaat

SEQ ID NO: 69819 - DNA, 21 bp, Artificial sequence
  SiRNA target sequence
aaaatggttttgatacgaatg

SEQ ID NO: 69820 - DNA, 21 bp, Artificial sequence
  SiRNA target sequence
aaatggttttgatacgaatgt

SEQ ID NO: 69821 - DNA, 21 bp, Artificial sequence
  SiRNA target sequence
aatggttttgatacgaatgta

SEQ ID NO: 69822 - DNA, 21 bp, Artificial sequence
  SiRNA target sequence
atggttttgatacgaatgtag

SEQ ID NO: 69823 - DNA, 21 bp, Artificial sequence
  SiRNA target sequence
tggttttgatacgaatgtagg

SEQ ID NO: 69824 - DNA, 21 bp, Artificial sequence
  SiRNA target sequence
ggttttgatacgaatgtagga

SEQ ID NO: 69825 - DNA, 21 bp, Artificial sequence
  SiRNA target sequence
gttttgatacgaatgtaggag

SEQ ID NO: 69826 - DNA, 21 bp, Artificial sequence
  SiRNA target sequence
ttttgatacgaatgtaggaga

SEQ ID NO: 69827 - DNA, 21 bp, Artificial sequence
  SiRNA target sequence
tttgatacgaatgtaggagaa

SEQ ID NO: 69828 - DNA, 21 bp, Artificial sequence
  SiRNA target sequence
ttgatacgaatgtaggagaaa

SEQ ID NO: 69829 - DNA, 21 bp, Artificial sequence
  SiRNA target sequence
tgatacgaatgtaggagaaag

SEQ ID NO: 69830 - DNA, 21 bp, Artificial sequence
  SiRNA target sequence
gatacgaatgtaggagaaaga

SEQ ID NO: 69831 - DNA, 21 bp, Artificial sequence
  SiRNA target sequence
atacgaatgtaggagaaagag

SEQ ID NO: 69832 - DNA, 21 bp, Artificial sequence
  SiRNA target sequence
tacgaatgtaggagaaagagg

SEQ ID NO: 69833 - DNA, 21 bp, Artificial sequence
  SiRNA target sequence
acgaatgtaggagaaagagga

SEQ ID NO: 69834 - DNA, 21 bp, Artificial sequence
  SiRNA target sequence
cgaatgtaggagaaagaggaa

SEQ ID NO: 69835 - DNA, 21 bp, Artificial sequence
  SiRNA target sequence
gaatgtaggagaaagaggaag

SEQ ID NO: 69836 - DNA, 21 bp, Artificial sequence
  SiRNA target sequence
aatgtaggagaaagaggaagg

SEQ ID NO: 69837 - DNA, 21 bp, Artificial sequence
  SiRNA target sequence
atgtaggagaaagaggaaggt

SEQ ID NO: 69838 - DNA, 21 bp, Artificial sequence
  SiRNA target sequence
tgtaggagaaagaggaaggtt

SEQ ID NO: 69839 - DNA, 21 bp, Artificial sequence
  SiRNA target sequence
gtaggagaaagaggaaggtta

SEQ ID NO: 69840 - DNA, 21 bp, Artificial sequence
  SiRNA target sequence
taggagaaagaggaaggttat

SEQ ID NO: 69841 - DNA, 21 bp, Artificial sequence
  SiRNA target sequence
aggagaaagaggaaggttatt

SEQ ID NO: 69842 - DNA, 21 bp, Artificial sequence
  SiRNA target sequence
ggagaaagaggaaggttatta

SEQ ID NO: 69843 - DNA, 21 bp, Artificial sequence
  SiRNA target sequence
gagaaagaggaaggttattaa

SEQ ID NO: 69844 - DNA, 21 bp, Artificial sequence
  SiRNA target sequence
agaaagaggaaggttattaag

SEQ ID NO: 69845 - DNA, 21 bp, Artificial sequence
  SiRNA target sequence
gaaagaggaaggttattaagt

SEQ ID NO: 69846 - DNA, 21 bp, Artificial sequence
  SiRNA target sequence
aaagaggaaggttattaagtg

SEQ ID NO: 69847 - DNA, 21 bp, Artificial sequence
  SiRNA target sequence
aagaggaaggttattaagtgg

SEQ ID NO: 69848 - DNA, 21 bp, Artificial sequence
  SiRNA target sequence
agaggaaggttattaagtggt

SEQ ID NO: 69849 - DNA, 21 bp, Artificial sequence
  SiRNA target sequence
gaggaaggttattaagtggtg

SEQ ID NO: 69850 - DNA, 21 bp, Artificial sequence
  SiRNA target sequence
aggaaggttattaagtggtgg

SEQ ID NO: 69851 - DNA, 21 bp, Artificial sequence
  SiRNA target sequence
ggaaggttattaagtggtgga

SEQ ID NO: 69852 - DNA, 21 bp, Artificial sequence
  SiRNA target sequence
gaaggttattaagtggtggag

SEQ ID NO: 69853 - DNA, 21 bp, Artificial sequence
  SiRNA target sequence
aaggttattaagtggtggaga

SEQ ID NO: 69854 - DNA, 21 bp, Artificial sequence
  SiRNA target sequence
aggttattaagtggtggagaa

SEQ ID NO: 69855 - DNA, 21 bp, Artificial sequence
  SiRNA target sequence
ggttattaagtggtggagaaa

SEQ ID NO: 69856 - DNA, 21 bp, Artificial sequence
  SiRNA target sequence
gttattaagtggtggagaaaa

SEQ ID NO: 69857 - DNA, 21 bp, Artificial sequence
  SiRNA target sequence
ttattaagtggtggagaaaag

SEQ ID NO: 69858 - DNA, 21 bp, Artificial sequence
  SiRNA target sequence
tattaagtggtggagaaaagc

SEQ ID NO: 69859 - DNA, 21 bp, Artificial sequence
  SiRNA target sequence
attaagtggtggagaaaagca

SEQ ID NO: 69860 - DNA, 21 bp, Artificial sequence
  SiRNA target sequence
ttaagtggtggagaaaagcaa

SEQ ID NO: 69861 - DNA, 21 bp, Artificial sequence
  SiRNA target sequence
taagtggtggagaaaagcaaa

SEQ ID NO: 69862 - DNA, 21 bp, Artificial sequence
  SiRNA target sequence
aagtggtggagaaaagcaaaa

SEQ ID NO: 69863 - DNA, 21 bp, Artificial sequence
  SiRNA target sequence
agtggtggagaaaagcaaaag

SEQ ID NO: 69864 - DNA, 21 bp, Artificial sequence
  SiRNA target sequence
gtggtggagaaaagcaaaaga

SEQ ID NO: 69865 - DNA, 21 bp, Artificial sequence
  SiRNA target sequence
tggtggagaaaagcaaaagat

SEQ ID NO: 69866 - DNA, 21 bp, Artificial sequence
  SiRNA target sequence
ggtggagaaaagcaaaagatt

SEQ ID NO: 69867 - DNA, 21 bp, Artificial sequence
  SiRNA target sequence
gtggagaaaagcaaaagattt

SEQ ID NO: 69868 - DNA, 21 bp, Artificial sequence
  SiRNA target sequence
tggagaaaagcaaaagatttt

SEQ ID NO: 69869 - DNA, 21 bp, Artificial sequence
  SiRNA target sequence
ggagaaaagcaaaagatttta

SEQ ID NO: 69870 - DNA, 21 bp, Artificial sequence
  SiRNA target sequence
gagaaaagcaaaagattttat

SEQ ID NO: 69871 - DNA, 21 bp, Artificial sequence
  SiRNA target sequence
agaaaagcaaaagattttatt

SEQ ID NO: 69872 - DNA, 21 bp, Artificial sequence
  SiRNA target sequence
gaaaagcaaaagattttatta

SEQ ID NO: 69873 - DNA, 21 bp, Artificial sequence
  SiRNA target sequence
aaaagcaaaagattttattaa

SEQ ID NO: 69874 - DNA, 21 bp, Artificial sequence
  SiRNA target sequence
aaagcaaaagattttattaat

SEQ ID NO: 69875 - DNA, 21 bp, Artificial sequence
  SiRNA target sequence
aagcaaaagattttattaatg

SEQ ID NO: 69876 - DNA, 21 bp, Artificial sequence
  SiRNA target sequence
agcaaaagattttattaatgc

SEQ ID NO: 69877 - DNA, 21 bp, Artificial sequence
  SiRNA target sequence
gcaaaagattttattaatgcg

SEQ ID NO: 69878 - DNA, 21 bp, Artificial sequence
  SiRNA target sequence
caaaagattttattaatgcgt

SEQ ID NO: 69879 - DNA, 21 bp, Artificial sequence
  SiRNA target sequence
aaaagattttattaatgcgta

SEQ ID NO: 69880 - DNA, 21 bp, Artificial sequence
  SiRNA target sequence
aaagattttattaatgcgtac

SEQ ID NO: 69881 - DNA, 21 bp, Artificial sequence
  SiRNA target sequence
aagattttattaatgcgtact

SEQ ID NO: 69882 - DNA, 21 bp, Artificial sequence
  SiRNA target sequence
agattttattaatgcgtacta

SEQ ID NO: 69883 - DNA, 21 bp, Artificial sequence
  SiRNA target sequence
gattttattaatgcgtactat

SEQ ID NO: 69884 - DNA, 21 bp, Artificial sequence
  SiRNA target sequence
attttattaatgcgtactatg

SEQ ID NO: 69885 - DNA, 21 bp, Artificial sequence
  SiRNA target sequence
ttttattaatgcgtactatgt

SEQ ID NO: 69886 - DNA, 21 bp, Artificial sequence
  SiRNA target sequence
tttattaatgcgtactatgtt

SEQ ID NO: 69887 - DNA, 21 bp, Artificial sequence
  SiRNA target sequence
ttattaatgcgtactatgtta

SEQ ID NO: 69888 - DNA, 21 bp, Artificial sequence
  SiRNA target sequence
tattaatgcgtactatgttaa

SEQ ID NO: 69889 - DNA, 21 bp, Artificial sequence
  SiRNA target sequence
attaatgcgtactatgttaag

SEQ ID NO: 69890 - DNA, 21 bp, Artificial sequence
  SiRNA target sequence
ttaatgcgtactatgttaaga

SEQ ID NO: 69891 - DNA, 21 bp, Artificial sequence
  SiRNA target sequence
taatgcgtactatgttaagaa

SEQ ID NO: 69892 - DNA, 21 bp, Artificial sequence
  SiRNA target sequence
aatgcgtactatgttaagaaa

SEQ ID NO: 69893 - DNA, 21 bp, Artificial sequence
  SiRNA target sequence
atgcgtactatgttaagaaac

SEQ ID NO: 69894 - DNA, 21 bp, Artificial sequence
  SiRNA target sequence
tgcgtactatgttaagaaaca

SEQ ID NO: 69895 - DNA, 21 bp, Artificial sequence
  SiRNA target sequence
gcgtactatgttaagaaacaa

SEQ ID NO: 69896 - DNA, 21 bp, Artificial sequence
  SiRNA target sequence
cgtactatgttaagaaacaag

SEQ ID NO: 69897 - DNA, 21 bp, Artificial sequence
  SiRNA target sequence
gtactatgttaagaaacaagg

SEQ ID NO: 69898 - DNA, 21 bp, Artificial sequence
  SiRNA target sequence
tactatgttaagaaacaagga

SEQ ID NO: 69899 - DNA, 21 bp, Artificial sequence
  SiRNA target sequence
actatgttaagaaacaaggag

SEQ ID NO: 69900 - DNA, 21 bp, Artificial sequence
  SiRNA target sequence
ctatgttaagaaacaaggaga

SEQ ID NO: 69901 - DNA, 21 bp, Artificial sequence
  SiRNA target sequence
tatgttaagaaacaaggagat

SEQ ID NO: 69902 - DNA, 21 bp, Artificial sequence
  SiRNA target sequence
atgttaagaaacaaggagata

SEQ ID NO: 69903 - DNA, 21 bp, Artificial sequence
  SiRNA target sequence
tgttaagaaacaaggagataa

SEQ ID NO: 69904 - DNA, 21 bp, Artificial sequence
  SiRNA target sequence
gttaagaaacaaggagataat

SEQ ID NO: 69905 - DNA, 21 bp, Artificial sequence
  SiRNA target sequence
ttaagaaacaaggagataatg

SEQ ID NO: 69906 - DNA, 21 bp, Artificial sequence
  SiRNA target sequence
taagaaacaaggagataatgg

SEQ ID NO: 69907 - DNA, 21 bp, Artificial sequence
  SiRNA target sequence
aagaaacaaggagataatggc

SEQ ID NO: 69908 - DNA, 21 bp, Artificial sequence
  SiRNA target sequence
agaaacaaggagataatggca

SEQ ID NO: 69909 - DNA, 21 bp, Artificial sequence
  SiRNA target sequence
gaaacaaggagataatggcat

SEQ ID NO: 69910 - DNA, 21 bp, Artificial sequence
  SiRNA target sequence
aaacaaggagataatggcatt

SEQ ID NO: 69911 - DNA, 21 bp, Artificial sequence
  SiRNA target sequence
aacaaggagataatggcatta

SEQ ID NO: 69912 - DNA, 21 bp, Artificial sequence
  SiRNA target sequence
acaaggagataatggcattag

SEQ ID NO: 69913 - DNA, 21 bp, Artificial sequence
  SiRNA target sequence
caaggagataatggcattaga

SEQ ID NO: 69914 - DNA, 21 bp, Artificial sequence
  SiRNA target sequence
aaggagataatggcattagat

SEQ ID NO: 69915 - DNA, 21 bp, Artificial sequence
  SiRNA target sequence
aggagataatggcattagatg

SEQ ID NO: 69916 - DNA, 21 bp, Artificial sequence
  SiRNA target sequence
ggagataatggcattagatga

SEQ ID NO: 69917 - DNA, 21 bp, Artificial sequence
  SiRNA target sequence
gagataatggcattagatgaa

SEQ ID NO: 69918 - DNA, 21 bp, Artificial sequence
  SiRNA target sequence
agataatggcattagatgaac

SEQ ID NO: 69919 - DNA, 21 bp, Artificial sequence
  SiRNA target sequence
gataatggcattagatgaacc

SEQ ID NO: 69920 - DNA, 21 bp, Artificial sequence
  SiRNA target sequence
ataatggcattagatgaaccc

SEQ ID NO: 69921 - DNA, 21 bp, Artificial sequence
  SiRNA target sequence
taatggcattagatgaaccca

SEQ ID NO: 69922 - DNA, 21 bp, Artificial sequence
  SiRNA target sequence
aatggcattagatgaacccac

SEQ ID NO: 69923 - DNA, 21 bp, Artificial sequence
  SiRNA target sequence
atggcattagatgaacccact

SEQ ID NO: 69924 - DNA, 21 bp, Artificial sequence
  SiRNA target sequence
tggcattagatgaacccactg

SEQ ID NO: 69925 - DNA, 21 bp, Artificial sequence
  SiRNA target sequence
ggcattagatgaacccactgc

SEQ ID NO: 69926 - DNA, 21 bp, Artificial sequence
  SiRNA target sequence
gcattagatgaacccactgca

SEQ ID NO: 69927 - DNA, 21 bp, Artificial sequence
  SiRNA target sequence
cattagatgaacccactgcag

SEQ ID NO: 69928 - DNA, 21 bp, Artificial sequence
  SiRNA target sequence
attagatgaacccactgcagc

SEQ ID NO: 69929 - DNA, 21 bp, Artificial sequence
  SiRNA target sequence
ttagatgaacccactgcagca

SEQ ID NO: 69930 - DNA, 21 bp, Artificial sequence
  SiRNA target sequence
tagatgaacccactgcagcac

SEQ ID NO: 69931 - DNA, 21 bp, Artificial sequence
  SiRNA target sequence
agatgaacccactgcagcact

SEQ ID NO: 69932 - DNA, 21 bp, Artificial sequence
  SiRNA target sequence
gatgaacccactgcagcactt

SEQ ID NO: 69933 - DNA, 21 bp, Artificial sequence
  SiRNA target sequence
atgaacccactgcagcacttg

SEQ ID NO: 69934 - DNA, 21 bp, Artificial sequence
  SiRNA target sequence
tgaacccactgcagcacttga

SEQ ID NO: 69935 - DNA, 21 bp, Artificial sequence
  SiRNA target sequence
gaacccactgcagcacttgat

SEQ ID NO: 69936 - DNA, 21 bp, Artificial sequence
  SiRNA target sequence
aacccactgcagcacttgata

SEQ ID NO: 69937 - DNA, 21 bp, Artificial sequence
  SiRNA target sequence
acccactgcagcacttgataa

SEQ ID NO: 69938 - DNA, 21 bp, Artificial sequence
  SiRNA target sequence
cccactgcagcacttgataag

SEQ ID NO: 69939 - DNA, 21 bp, Artificial sequence
  SiRNA target sequence
ccactgcagcacttgataagg

SEQ ID NO: 69940 - DNA, 21 bp, Artificial sequence
  SiRNA target sequence
cactgcagcacttgataagga

SEQ ID NO: 69941 - DNA, 21 bp, Artificial sequence
  SiRNA target sequence
actgcagcacttgataaggag

SEQ ID NO: 69942 - DNA, 21 bp, Artificial sequence
  SiRNA target sequence
ctgcagcacttgataaggagt

SEQ ID NO: 69943 - DNA, 21 bp, Artificial sequence
  SiRNA target sequence
tgcagcacttgataaggagtc

SEQ ID NO: 69944 - DNA, 21 bp, Artificial sequence
  SiRNA target sequence
gcagcacttgataaggagtct

SEQ ID NO: 69945 - DNA, 21 bp, Artificial sequence
  SiRNA target sequence
cagcacttgataaggagtctg

SEQ ID NO: 69946 - DNA, 21 bp, Artificial sequence
  SiRNA target sequence
agcacttgataaggagtctga

SEQ ID NO: 69947 - DNA, 21 bp, Artificial sequence
  SiRNA target sequence
gcacttgataaggagtctgaa

SEQ ID NO: 69948 - DNA, 21 bp, Artificial sequence
  SiRNA target sequence
cacttgataaggagtctgaaa

SEQ ID NO: 69949 - DNA, 21 bp, Artificial sequence
  SiRNA target sequence
acttgataaggagtctgaaaa

SEQ ID NO: 69950 - DNA, 21 bp, Artificial sequence
  SiRNA target sequence
cttgataaggagtctgaaaaa

SEQ ID NO: 69951 - DNA, 21 bp, Artificial sequence
  SiRNA target sequence
ttgataaggagtctgaaaaaa

SEQ ID NO: 69952 - DNA, 21 bp, Artificial sequence
  SiRNA target sequence
tgataaggagtctgaaaaaaa

SEQ ID NO: 69953 - DNA, 21 bp, Artificial sequence
  SiRNA target sequence
gataaggagtctgaaaaaaag

SEQ ID NO: 69954 - DNA, 21 bp, Artificial sequence
  SiRNA target sequence
ataaggagtctgaaaaaaaga

SEQ ID NO: 69955 - DNA, 21 bp, Artificial sequence
  SiRNA target sequence
taaggagtctgaaaaaaagat

SEQ ID NO: 69956 - DNA, 21 bp, Artificial sequence
  SiRNA target sequence
aaggagtctgaaaaaaagatt

SEQ ID NO: 69957 - DNA, 21 bp, Artificial sequence
  SiRNA target sequence
aggagtctgaaaaaaagattt

SEQ ID NO: 69958 - DNA, 21 bp, Artificial sequence
  SiRNA target sequence
ggagtctgaaaaaaagatttt

SEQ ID NO: 69959 - DNA, 21 bp, Artificial sequence
  SiRNA target sequence
gagtctgaaaaaaagatttta

SEQ ID NO: 69960 - DNA, 21 bp, Artificial sequence
  SiRNA target sequence
agtctgaaaaaaagattttag

SEQ ID NO: 69961 - DNA, 21 bp, Artificial sequence
  SiRNA target sequence
gtctgaaaaaaagattttaga

SEQ ID NO: 69962 - DNA, 21 bp, Artificial sequence
  SiRNA target sequence
tctgaaaaaaagattttagag

SEQ ID NO: 69963 - DNA, 21 bp, Artificial sequence
  SiRNA target sequence
ctgaaaaaaagattttagaga

SEQ ID NO: 69964 - DNA, 21 bp, Artificial sequence
  SiRNA target sequence
tgaaaaaaagattttagagat

SEQ ID NO: 69965 - DNA, 21 bp, Artificial sequence
  SiRNA target sequence
gaaaaaaagattttagagata

SEQ ID NO: 69966 - DNA, 21 bp, Artificial sequence
  SiRNA target sequence
aaaaaaagattttagagataa

SEQ ID NO: 69967 - DNA, 21 bp, Artificial sequence
  SiRNA target sequence
aaaaaagattttagagataat

SEQ ID NO: 69968 - DNA, 21 bp, Artificial sequence
  SiRNA target sequence
aaaaagattttagagataatt

SEQ ID NO: 69969 - DNA, 21 bp, Artificial sequence
  SiRNA target sequence
aaaagattttagagataattt

SEQ ID NO: 69970 - DNA, 21 bp, Artificial sequence
  SiRNA target sequence
aaagattttagagataatttt

SEQ ID NO: 69971 - DNA, 21 bp, Artificial sequence
  SiRNA target sequence
aagattttagagataatttta

SEQ ID NO: 69972 - DNA, 21 bp, Artificial sequence
  SiRNA target sequence
agattttagagataattttac

SEQ ID NO: 69973 - DNA, 21 bp, Artificial sequence
  SiRNA target sequence
gattttagagataattttaca

SEQ ID NO: 69974 - DNA, 21 bp, Artificial sequence
  SiRNA target sequence
attttagagataattttacaa

SEQ ID NO: 69975 - DNA, 21 bp, Artificial sequence
  SiRNA target sequence
ttttagagataattttacaac

SEQ ID NO: 69976 - DNA, 21 bp, Artificial sequence
  SiRNA target sequence
tttagagataattttacaaca

SEQ ID NO: 69977 - DNA, 21 bp, Artificial sequence
  SiRNA target sequence
ttagagataattttacaacag

SEQ ID NO: 69978 - DNA, 21 bp, Artificial sequence
  SiRNA target sequence
tagagataattttacaacagg

SEQ ID NO: 69979 - DNA, 21 bp, Artificial sequence
  SiRNA target sequence
agagataattttacaacagga

SEQ ID NO: 69980 - DNA, 21 bp, Artificial sequence
  SiRNA target sequence
gagataattttacaacaggaa

SEQ ID NO: 69981 - DNA, 21 bp, Artificial sequence
  SiRNA target sequence
agataattttacaacaggaag

SEQ ID NO: 69982 - DNA, 21 bp, Artificial sequence
  SiRNA target sequence
gataattttacaacaggaaga

SEQ ID NO: 69983 - DNA, 21 bp, Artificial sequence
  SiRNA target sequence
ataattttacaacaggaagat

SEQ ID NO: 69984 - DNA, 21 bp, Artificial sequence
  SiRNA target sequence
taattttacaacaggaagatc

SEQ ID NO: 69985 - DNA, 21 bp, Artificial sequence
  SiRNA target sequence
aattttacaacaggaagatcg

SEQ ID NO: 69986 - DNA, 21 bp, Artificial sequence
  SiRNA target sequence
attttacaacaggaagatcga

SEQ ID NO: 69987 - DNA, 21 bp, Artificial sequence
  SiRNA target sequence
ttttacaacaggaagatcgaa

SEQ ID NO: 69988 - DNA, 21 bp, Artificial sequence
  SiRNA target sequence
tttacaacaggaagatcgaac

SEQ ID NO: 69989 - DNA, 21 bp, Artificial sequence
  SiRNA target sequence
ttacaacaggaagatcgaaca

SEQ ID NO: 69990 - DNA, 21 bp, Artificial sequence
  SiRNA target sequence
tacaacaggaagatcgaacag

SEQ ID NO: 69991 - DNA, 21 bp, Artificial sequence
  SiRNA target sequence
acaacaggaagatcgaacagt

SEQ ID NO: 69992 - DNA, 21 bp, Artificial sequence
  SiRNA target sequence
caacaggaagatcgaacagtt

SEQ ID NO: 69993 - DNA, 21 bp, Artificial sequence
  SiRNA target sequence
aacaggaagatcgaacagttt

SEQ ID NO: 69994 - DNA, 21 bp, Artificial sequence
  SiRNA target sequence
acaggaagatcgaacagtttt

SEQ ID NO: 69995 - DNA, 21 bp, Artificial sequence
  SiRNA target sequence
caggaagatcgaacagttttg

SEQ ID NO: 69996 - DNA, 21 bp, Artificial sequence
  SiRNA target sequence
aggaagatcgaacagttttga

SEQ ID NO: 69997 - DNA, 21 bp, Artificial sequence
  SiRNA target sequence
ggaagatcgaacagttttgat

SEQ ID NO: 69998 - DNA, 21 bp, Artificial sequence
  SiRNA target sequence
gaagatcgaacagttttgatg

SEQ ID NO: 69999 - DNA, 21 bp, Artificial sequence
  SiRNA target sequence
aagatcgaacagttttgatga

SEQ ID NO: 70000 - DNA, 21 bp, Artificial sequence
  SiRNA target sequence
agatcgaacagttttgatgat

SEQ ID NO: 70001 - DNA, 21 bp, Artificial sequence
  SiRNA target sequence
gatcgaacagttttgatgata

SEQ ID NO: 70002 - DNA, 21 bp, Artificial sequence
  SiRNA target sequence
atcgaacagttttgatgataa

SEQ ID NO: 70003 - DNA, 21 bp, Artificial sequence
  SiRNA target sequence
tcgaacagttttgatgataat

SEQ ID NO: 70004 - DNA, 21 bp, Artificial sequence
  SiRNA target sequence
cgaacagttttgatgataatt

SEQ ID NO: 70005 - DNA, 21 bp, Artificial sequence
  SiRNA target sequence
gaacagttttgatgataattc

SEQ ID NO: 70006 - DNA, 21 bp, Artificial sequence
  SiRNA target sequence
aacagttttgatgataattca

SEQ ID NO: 70007 - DNA, 21 bp, Artificial sequence
  SiRNA target sequence
acagttttgatgataattcat

SEQ ID NO: 70008 - DNA, 21 bp, Artificial sequence
  SiRNA target sequence
cagttttgatgataattcata

SEQ ID NO: 70009 - DNA, 21 bp, Artificial sequence
  SiRNA target sequence
agttttgatgataattcataa

SEQ ID NO: 70010 - DNA, 21 bp, Artificial sequence
  SiRNA target sequence
gttttgatgataattcataat

SEQ ID NO: 70011 - DNA, 21 bp, Artificial sequence
  SiRNA target sequence
ttttgatgataattcataatc

SEQ ID NO: 70012 - DNA, 21 bp, Artificial sequence
  SiRNA target sequence
tttgatgataattcataatct

SEQ ID NO: 70013 - DNA, 21 bp, Artificial sequence
  SiRNA target sequence
ttgatgataattcataatcta

SEQ ID NO: 70014 - DNA, 21 bp, Artificial sequence
  SiRNA target sequence
tgatgataattcataatctag

SEQ ID NO: 70015 - DNA, 21 bp, Artificial sequence
  SiRNA target sequence
gatgataattcataatctaga

SEQ ID NO: 70016 - DNA, 21 bp, Artificial sequence
  SiRNA target sequence
atgataattcataatctagaa

SEQ ID NO: 70017 - DNA, 21 bp, Artificial sequence
  SiRNA target sequence
tgataattcataatctagaac

SEQ ID NO: 70018 - DNA, 21 bp, Artificial sequence
  SiRNA target sequence
gataattcataatctagaact

SEQ ID NO: 70019 - DNA, 21 bp, Artificial sequence
  SiRNA target sequence
ataattcataatctagaactt

SEQ ID NO: 70020 - DNA, 21 bp, Artificial sequence
  SiRNA target sequence
taattcataatctagaactta

SEQ ID NO: 70021 - DNA, 21 bp, Artificial sequence
  SiRNA target sequence
aattcataatctagaacttat

SEQ ID NO: 70022 - DNA, 21 bp, Artificial sequence
  SiRNA target sequence
attcataatctagaacttatt

SEQ ID NO: 70023 - DNA, 21 bp, Artificial sequence
  SiRNA target sequence
ttcataatctagaacttatta

SEQ ID NO: 70024 - DNA, 21 bp, Artificial sequence
  SiRNA target sequence
tcataatctagaacttattaa

SEQ ID NO: 70025 - DNA, 21 bp, Artificial sequence
  SiRNA target sequence
cataatctagaacttattaat

SEQ ID NO: 70026 - DNA, 21 bp, Artificial sequence
  SiRNA target sequence
ataatctagaacttattaata

SEQ ID NO: 70027 - DNA, 21 bp, Artificial sequence
  SiRNA target sequence
taatctagaacttattaataa

SEQ ID NO: 70028 - DNA, 21 bp, Artificial sequence
  SiRNA target sequence
aatctagaacttattaataaa

SEQ ID NO: 70029 - DNA, 21 bp, Artificial sequence
  SiRNA target sequence
atctagaacttattaataaat

SEQ ID NO: 70030 - DNA, 21 bp, Artificial sequence
  SiRNA target sequence
tctagaacttattaataaatt

SEQ ID NO: 70031 - DNA, 21 bp, Artificial sequence
  SiRNA target sequence
ctagaacttattaataaattt

SEQ ID NO: 70032 - DNA, 21 bp, Artificial sequence
  SiRNA target sequence
tagaacttattaataaatttg

SEQ ID NO: 70033 - DNA, 21 bp, Artificial sequence
  SiRNA target sequence
agaacttattaataaatttga

SEQ ID NO: 70034 - DNA, 21 bp, Artificial sequence
  SiRNA target sequence
gaacttattaataaatttgat

SEQ ID NO: 70035 - DNA, 21 bp, Artificial sequence
  SiRNA target sequence
aacttattaataaatttgata

SEQ ID NO: 70036 - DNA, 21 bp, Artificial sequence
  SiRNA target sequence
acttattaataaatttgataa

SEQ ID NO: 70037 - DNA, 21 bp, Artificial sequence
  SiRNA target sequence
cttattaataaatttgataaa

SEQ ID NO: 70038 - DNA, 21 bp, Artificial sequence
  SiRNA target sequence
ttattaataaatttgataaaa

SEQ ID NO: 70039 - DNA, 21 bp, Artificial sequence
  SiRNA target sequence
tattaataaatttgataaaat

SEQ ID NO: 70040 - DNA, 21 bp, Artificial sequence
  SiRNA target sequence
attaataaatttgataaaata

SEQ ID NO: 70041 - DNA, 21 bp, Artificial sequence
  SiRNA target sequence
ttaataaatttgataaaataa

SEQ ID NO: 70042 - DNA, 21 bp, Artificial sequence
  SiRNA target sequence
taataaatttgataaaataat

SEQ ID NO: 70043 - DNA, 21 bp, Artificial sequence
  SiRNA target sequence
aataaatttgataaaataatt

SEQ ID NO: 70044 - DNA, 21 bp, Artificial sequence
  SiRNA target sequence
ataaatttgataaaataattt

SEQ ID NO: 70045 - DNA, 21 bp, Artificial sequence
  SiRNA target sequence
taaatttgataaaataattta

SEQ ID NO: 70046 - DNA, 21 bp, Artificial sequence
  SiRNA target sequence
aaatttgataaaataatttac

SEQ ID NO: 70047 - DNA, 21 bp, Artificial sequence
  SiRNA target sequence
aatttgataaaataatttaca

SEQ ID NO: 70048 - DNA, 21 bp, Artificial sequence
  SiRNA target sequence
atttgataaaataatttacat

SEQ ID NO: 70049 - DNA, 21 bp, Artificial sequence
  SiRNA target sequence
tttgataaaataatttacatt

SEQ ID NO: 70050 - DNA, 21 bp, Artificial sequence
  SiRNA target sequence
ttgataaaataatttacattg

SEQ ID NO: 70051 - DNA, 21 bp, Artificial sequence
  SiRNA target sequence
tgataaaataatttacattga

SEQ ID NO: 70052 - DNA, 21 bp, Artificial sequence
  SiRNA target sequence
gataaaataatttacattgat

SEQ ID NO: 70053 - DNA, 21 bp, Artificial sequence
  SiRNA target sequence
ataaaataatttacattgatg

SEQ ID NO: 70054 - DNA, 21 bp, Artificial sequence
  SiRNA target sequence
taaaataatttacattgatga

SEQ ID NO: 70055 - DNA, 21 bp, Artificial sequence
  SiRNA target sequence
aaaataatttacattgatgaa

SEQ ID NO: 70056 - DNA, 21 bp, Artificial sequence
  SiRNA target sequence
aaataatttacattgatgaaa

SEQ ID NO: 70057 - DNA, 21 bp, Artificial sequence
  SiRNA target sequence
aataatttacattgatgaaaa

SEQ ID NO: 70058 - DNA, 21 bp, Artificial sequence
  SiRNA target sequence
ataatttacattgatgaaaat

SEQ ID NO: 70059 - DNA, 21 bp, Artificial sequence
  SiRNA target sequence
taatttacattgatgaaaata

SEQ ID NO: 70060 - DNA, 21 bp, Artificial sequence
  SiRNA target sequence
aatttacattgatgaaaataa

SEQ ID NO: 70061 - DNA, 21 bp, Artificial sequence
  SiRNA target sequence
atttacattgatgaaaataat

SEQ ID NO: 70062 - DNA, 21 bp, Artificial sequence
  SiRNA target sequence
tttacattgatgaaaataata

SEQ ID NO: 70063 - DNA, 21 bp, Artificial sequence
  SiRNA target sequence
ttacattgatgaaaataatat

SEQ ID NO: 70064 - DNA, 21 bp, Artificial sequence
  SiRNA target sequence
tacattgatgaaaataatata

SEQ ID NO: 70065 - DNA, 21 bp, Artificial sequence
  SiRNA target sequence
acattgatgaaaataatatag

SEQ ID NO: 70066 - DNA, 21 bp, Artificial sequence
  SiRNA target sequence
cattgatgaaaataatataga

SEQ ID NO: 70067 - DNA, 21 bp, Artificial sequence
  SiRNA target sequence
attgatgaaaataatatagaa

SEQ ID NO: 70068 - DNA, 21 bp, Artificial sequence
  SiRNA target sequence
ttgatgaaaataatatagaag

SEQ ID NO: 70069 - DNA, 21 bp, Artificial sequence
  SiRNA target sequence
tgatgaaaataatatagaagt

SEQ ID NO: 70070 - DNA, 21 bp, Artificial sequence
  SiRNA target sequence
gatgaaaataatatagaagtc

SEQ ID NO: 70071 - DNA, 21 bp, Artificial sequence
  SiRNA target sequence
atgaaaataatatagaagtct

SEQ ID NO: 70072 - DNA, 21 bp, Artificial sequence
  SiRNA target sequence
tgaaaataatatagaagtcta

SEQ ID NO: 70073 - DNA, 21 bp, Artificial sequence
  SiRNA target sequence
gaaaataatatagaagtctat

SEQ ID NO: 70074 - DNA, 21 bp, Artificial sequence
  SiRNA target sequence
aaaataatatagaagtctata

SEQ ID NO: 70075 - DNA, 21 bp, Artificial sequence
  SiRNA target sequence
aaataatatagaagtctataa

SEQ ID NO: 70076 - DNA, 21 bp, Artificial sequence
  SiRNA target sequence
aataatatagaagtctataaa

SEQ ID NO: 70077 - DNA, 21 bp, Artificial sequence
  SiRNA target sequence
ataatatagaagtctataaaa

SEQ ID NO: 70078 - DNA, 21 bp, Artificial sequence
  SiRNA target sequence
taatatagaagtctataaaaa

SEQ ID NO: 70079 - DNA, 21 bp, Artificial sequence
  SiRNA target sequence
aatatagaagtctataaaaat

SEQ ID NO: 70080 - DNA, 21 bp, Artificial sequence
  SiRNA target sequence
atatagaagtctataaaaatg

SEQ ID NO: 70081 - DNA, 21 bp, Artificial sequence
  SiRNA target sequence
tatagaagtctataaaaatga

SEQ ID NO: 70082 - DNA, 21 bp, Artificial sequence
  SiRNA target sequence
atagaagtctataaaaatgat

SEQ ID NO: 70083 - DNA, 21 bp, Artificial sequence
  SiRNA target sequence
tagaagtctataaaaatgata

SEQ ID NO: 70084 - DNA, 21 bp, Artificial sequence
  SiRNA target sequence
agaagtctataaaaatgatat

SEQ ID NO: 70085 - DNA, 21 bp, Artificial sequence
  SiRNA target sequence
gaagtctataaaaatgatatt

SEQ ID NO: 70086 - DNA, 21 bp, Artificial sequence
  SiRNA target sequence
aagtctataaaaatgatattg

SEQ ID NO: 70087 - DNA, 21 bp, Artificial sequence
  SiRNA target sequence
agtctataaaaatgatattga

SEQ ID NO: 70088 - DNA, 21 bp, Artificial sequence
  SiRNA target sequence
gtctataaaaatgatattgaa

SEQ ID NO: 70089 - DNA, 21 bp, Artificial sequence
  SiRNA target sequence
tctataaaaatgatattgaag

SEQ ID NO: 70090 - DNA, 21 bp, Artificial sequence
  SiRNA target sequence
ctataaaaatgatattgaagg

SEQ ID NO: 70091 - DNA, 21 bp, Artificial sequence
  SiRNA target sequence
tataaaaatgatattgaagga

SEQ ID NO: 70092 - DNA, 21 bp, Artificial sequence
  SiRNA target sequence
ataaaaatgatattgaaggac

SEQ ID NO: 70093 - DNA, 21 bp, Artificial sequence
  SiRNA target sequence
taaaaatgatattgaaggaca

SEQ ID NO: 70094 - DNA, 21 bp, Artificial sequence
  SiRNA target sequence
aaaaatgatattgaaggacaa

SEQ ID NO: 70095 - DNA, 21 bp, Artificial sequence
  SiRNA target sequence
aaaatgatattgaaggacaaa

SEQ ID NO: 70096 - DNA, 21 bp, Artificial sequence
  SiRNA target sequence
aaatgatattgaaggacaaaa

SEQ ID NO: 70097 - DNA, 21 bp, Artificial sequence
  SiRNA target sequence
aatgatattgaaggacaaaaa

SEQ ID NO: 70098 - DNA, 21 bp, Artificial sequence
  SiRNA target sequence
atgatattgaaggacaaaaaa

SEQ ID NO: 70099 - DNA, 21 bp, Artificial sequence
  SiRNA target sequence
tgatattgaaggacaaaaaaa

SEQ ID NO: 70100 - DNA, 21 bp, Artificial sequence
  SiRNA target sequence
gatattgaaggacaaaaaaag

SEQ ID NO: 70101 - DNA, 21 bp, Artificial sequence
  SiRNA target sequence
atattgaaggacaaaaaaagt

SEQ ID NO: 70102 - DNA, 21 bp, Artificial sequence
  SiRNA target sequence
tattgaaggacaaaaaaagtt

SEQ ID NO: 70103 - DNA, 21 bp, Artificial sequence
  SiRNA target sequence
attgaaggacaaaaaaagttt

SEQ ID NO: 70104 - DNA, 21 bp, Artificial sequence
  SiRNA target sequence
ttgaaggacaaaaaaagtttt

SEQ ID NO: 70105 - DNA, 21 bp, Artificial sequence
  SiRNA target sequence
tgaaggacaaaaaaagttttc

SEQ ID NO: 70106 - DNA, 21 bp, Artificial sequence
  SiRNA target sequence
gaaggacaaaaaaagttttct

SEQ ID NO: 70107 - DNA, 21 bp, Artificial sequence
  SiRNA target sequence
aaggacaaaaaaagttttcta

SEQ ID NO: 70108 - DNA, 21 bp, Artificial sequence
  SiRNA target sequence
aggacaaaaaaagttttctac

SEQ ID NO: 70109 - DNA, 21 bp, Artificial sequence
  SiRNA target sequence
ggacaaaaaaagttttctaca

SEQ ID NO: 70110 - DNA, 21 bp, Artificial sequence
  SiRNA target sequence
gacaaaaaaagttttctacaa

SEQ ID NO: 70111 - DNA, 21 bp, Artificial sequence
  SiRNA target sequence
acaaaaaaagttttctacaaa

SEQ ID NO: 70112 - DNA, 21 bp, Artificial sequence
  SiRNA target sequence
caaaaaaagttttctacaaat

SEQ ID NO: 70113 - DNA, 21 bp, Artificial sequence
  SiRNA target sequence
aaaaaaagttttctacaaatt

SEQ ID NO: 70114 - DNA, 21 bp, Artificial sequence
  SiRNA target sequence
aaaaaagttttctacaaattt

SEQ ID NO: 70115 - DNA, 21 bp, Artificial sequence
  SiRNA target sequence
aaaaagttttctacaaattta

SEQ ID NO: 70116 - DNA, 21 bp, Artificial sequence
  SiRNA target sequence
aaaagttttctacaaatttac

SEQ ID NO: 70117 - DNA, 21 bp, Artificial sequence
  SiRNA target sequence
aaagttttctacaaatttaca

SEQ ID NO: 70118 - DNA, 21 bp, Artificial sequence
  SiRNA target sequence
aagttttctacaaatttacaa

SEQ ID NO: 70119 - DNA, 21 bp, Artificial sequence
  SiRNA target sequence
agttttctacaaatttacaat

SEQ ID NO: 70120 - DNA, 21 bp, Artificial sequence
  SiRNA target sequence
gttttctacaaatttacaata

SEQ ID NO: 70121 - DNA, 21 bp, Artificial sequence
  SiRNA target sequence
ttttctacaaatttacaatat

SEQ ID NO: 70122 - DNA, 21 bp, Artificial sequence
  SiRNA target sequence
tttctacaaatttacaatatt

SEQ ID NO: 70123 - DNA, 21 bp, Artificial sequence
  SiRNA target sequence
ttctacaaatttacaatattt

SEQ ID NO: 70124 - DNA, 21 bp, Artificial sequence
  SiRNA target sequence
tctacaaatttacaatatttt

SEQ ID NO: 70125 - DNA, 21 bp, Artificial sequence
  SiRNA target sequence
ctacaaatttacaatattttt

SEQ ID NO: 70126 - DNA, 21 bp, Artificial sequence
  SiRNA target sequence
tacaaatttacaatatttttt

SEQ ID NO: 70127 - DNA, 21 bp, Artificial sequence
  SiRNA target sequence
acaaatttacaatatttttta

SEQ ID NO: 70128 - DNA, 21 bp, Artificial sequence
  SiRNA target sequence
caaatttacaatattttttat

SEQ ID NO: 70129 - DNA, 21 bp, Artificial sequence
  SiRNA target sequence
aaatttacaatattttttatc

SEQ ID NO: 70130 - DNA, 21 bp, Artificial sequence
  SiRNA target sequence
aatttacaatattttttatca

SEQ ID NO: 70131 - DNA, 21 bp, Artificial sequence
  SiRNA target sequence
atttacaatattttttatcat

SEQ ID NO: 70132 - DNA, 21 bp, Artificial sequence
  SiRNA target sequence
tttacaatattttttatcata

SEQ ID NO: 70133 - DNA, 21 bp, Artificial sequence
  SiRNA target sequence
ttacaatattttttatcatac

SEQ ID NO: 70134 - DNA, 21 bp, Artificial sequence
  SiRNA target sequence
tacaatattttttatcataca

SEQ ID NO: 70135 - DNA, 21 bp, Artificial sequence
  SiRNA target sequence
acaatattttttatcatacaa

SEQ ID NO: 70136 - DNA, 21 bp, Artificial sequence
  SiRNA target sequence
caatattttttatcatacaaa

SEQ ID NO: 70137 - DNA, 21 bp, Artificial sequence
  SiRNA target sequence
aatattttttatcatacaaat

SEQ ID NO: 70138 - DNA, 21 bp, Artificial sequence
  SiRNA target sequence
atattttttatcatacaaatt

SEQ ID NO: 70139 - DNA, 21 bp, Artificial sequence
  SiRNA target sequence
tattttttatcatacaaatta

SEQ ID NO: 70140 - DNA, 21 bp, Artificial sequence
  SiRNA target sequence
attttttatcatacaaattag

SEQ ID NO: 70141 - DNA, 21 bp, Artificial sequence
  SiRNA target sequence
ttttttatcatacaaattagg

SEQ ID NO: 70142 - DNA, 21 bp, Artificial sequence
  SiRNA target sequence
tttttatcatacaaattaggt

SEQ ID NO: 70143 - DNA, 21 bp, Artificial sequence
  SiRNA target sequence
ttttatcatacaaattaggta

SEQ ID NO: 70144 - DNA, 21 bp, Artificial sequence
  SiRNA target sequence
tttatcatacaaattaggtaa

SEQ ID NO: 70145 - DNA, 21 bp, Artificial sequence
  SiRNA target sequence
ttatcatacaaattaggtaaa

SEQ ID NO: 70146 - DNA, 21 bp, Artificial sequence
  SiRNA target sequence
tatcatacaaattaggtaaat

SEQ ID NO: 70147 - DNA, 21 bp, Artificial sequence
  SiRNA target sequence
atcatacaaattaggtaaata

SEQ ID NO: 70148 - DNA, 21 bp, Artificial sequence
  SiRNA target sequence
tcatacaaattaggtaaataa

SEQ ID NO: 70149 - DNA, 22 bp, Artificial sequence
  SiRNA target sequence
atgaaaaaaatttcgaatagaa

SEQ ID NO: 70150 - DNA, 22 bp, Artificial sequence
  SiRNA target sequence
tgaaaaaaatttcgaatagaaa

SEQ ID NO: 70151 - DNA, 22 bp, Artificial sequence
  SiRNA target sequence
gaaaaaaatttcgaatagaaaa

SEQ ID NO: 70152 - DNA, 22 bp, Artificial sequence
  SiRNA target sequence
aaaaaaatttcgaatagaaaaa

SEQ ID NO: 70153 - DNA, 22 bp, Artificial sequence
  SiRNA target sequence
aaaaaatttcgaatagaaaaat

SEQ ID NO: 70154 - DNA, 22 bp, Artificial sequence
  SiRNA target sequence
aaaaatttcgaatagaaaaatt

SEQ ID NO: 70155 - DNA, 22 bp, Artificial sequence
  SiRNA target sequence
aaaatttcgaatagaaaaatta

SEQ ID NO: 70156 - DNA, 22 bp, Artificial sequence
  SiRNA target sequence
aaatttcgaatagaaaaattat

SEQ ID NO: 70157 - DNA, 22 bp, Artificial sequence
  SiRNA target sequence
aatttcgaatagaaaaattatc

SEQ ID NO: 70158 - DNA, 22 bp, Artificial sequence
  SiRNA target sequence
atttcgaatagaaaaattatca

SEQ ID NO: 70159 - DNA, 22 bp, Artificial sequence
  SiRNA target sequence
tttcgaatagaaaaattatcaa

SEQ ID NO: 70160 - DNA, 22 bp, Artificial sequence
  SiRNA target sequence
ttcgaatagaaaaattatcaaa

SEQ ID NO: 70161 - DNA, 22 bp, Artificial sequence
  SiRNA target sequence
tcgaatagaaaaattatcaaag

SEQ ID NO: 70162 - DNA, 22 bp, Artificial sequence
  SiRNA target sequence
cgaatagaaaaattatcaaaga

SEQ ID NO: 70163 - DNA, 22 bp, Artificial sequence
  SiRNA target sequence
gaatagaaaaattatcaaagaa

SEQ ID NO: 70164 - DNA, 22 bp, Artificial sequence
  SiRNA target sequence
aatagaaaaattatcaaagaaa

SEQ ID NO: 70165 - DNA, 22 bp, Artificial sequence
  SiRNA target sequence
atagaaaaattatcaaagaaat

SEQ ID NO: 70166 - DNA, 22 bp, Artificial sequence
  SiRNA target sequence
tagaaaaattatcaaagaaatt

SEQ ID NO: 70167 - DNA, 22 bp, Artificial sequence
  SiRNA target sequence
agaaaaattatcaaagaaatta

SEQ ID NO: 70168 - DNA, 22 bp, Artificial sequence
  SiRNA target sequence
gaaaaattatcaaagaaattat

SEQ ID NO: 70169 - DNA, 22 bp, Artificial sequence
  SiRNA target sequence
aaaaattatcaaagaaattatt

SEQ ID NO: 70170 - DNA, 22 bp, Artificial sequence
  SiRNA target sequence
aaaattatcaaagaaattattt

SEQ ID NO: 70171 - DNA, 22 bp, Artificial sequence
  SiRNA target sequence
aaattatcaaagaaattattta

SEQ ID NO: 70172 - DNA, 22 bp, Artificial sequence
  SiRNA target sequence
aattatcaaagaaattatttac

SEQ ID NO: 70173 - DNA, 22 bp, Artificial sequence
  SiRNA target sequence
attatcaaagaaattatttaca

SEQ ID NO: 70174 - DNA, 22 bp, Artificial sequence
  SiRNA target sequence
ttatcaaagaaattatttacaa

SEQ ID NO: 70175 - DNA, 22 bp, Artificial sequence
  SiRNA target sequence
tatcaaagaaattatttacaat

SEQ ID NO: 70176 - DNA, 22 bp, Artificial sequence
  SiRNA target sequence
atcaaagaaattatttacaatg

SEQ ID NO: 70177 - DNA, 22 bp, Artificial sequence
  SiRNA target sequence
tcaaagaaattatttacaatga

SEQ ID NO: 70178 - DNA, 22 bp, Artificial sequence
  SiRNA target sequence
caaagaaattatttacaatgat

SEQ ID NO: 70179 - DNA, 22 bp, Artificial sequence
  SiRNA target sequence
aaagaaattatttacaatgatt

SEQ ID NO: 70180 - DNA, 22 bp, Artificial sequence
  SiRNA target sequence
aagaaattatttacaatgattt

SEQ ID NO: 70181 - DNA, 22 bp, Artificial sequence
  SiRNA target sequence
agaaattatttacaatgattta

SEQ ID NO: 70182 - DNA, 22 bp, Artificial sequence
  SiRNA target sequence
gaaattatttacaatgatttat

SEQ ID NO: 70183 - DNA, 22 bp, Artificial sequence
  SiRNA target sequence
aaattatttacaatgatttatt

SEQ ID NO: 70184 - DNA, 22 bp, Artificial sequence
  SiRNA target sequence
aattatttacaatgatttatta

SEQ ID NO: 70185 - DNA, 22 bp, Artificial sequence
  SiRNA target sequence
attatttacaatgatttattaa

SEQ ID NO: 70186 - DNA, 22 bp, Artificial sequence
  SiRNA target sequence
ttatttacaatgatttattaaa

SEQ ID NO: 70187 - DNA, 22 bp, Artificial sequence
  SiRNA target sequence
tatttacaatgatttattaaaa

SEQ ID NO: 70188 - DNA, 22 bp, Artificial sequence
  SiRNA target sequence
atttacaatgatttattaaaaa

SEQ ID NO: 70189 - DNA, 22 bp, Artificial sequence
  SiRNA target sequence
tttacaatgatttattaaaaat

SEQ ID NO: 70190 - DNA, 22 bp, Artificial sequence
  SiRNA target sequence
ttacaatgatttattaaaaata

SEQ ID NO: 70191 - DNA, 22 bp, Artificial sequence
  SiRNA target sequence
tacaatgatttattaaaaataa

SEQ ID NO: 70192 - DNA, 22 bp, Artificial sequence
  SiRNA target sequence
acaatgatttattaaaaataag

SEQ ID NO: 70193 - DNA, 22 bp, Artificial sequence
  SiRNA target sequence
caatgatttattaaaaataaga

SEQ ID NO: 70194 - DNA, 22 bp, Artificial sequence
  SiRNA target sequence
aatgatttattaaaaataagaa

SEQ ID NO: 70195 - DNA, 22 bp, Artificial sequence
  SiRNA target sequence
atgatttattaaaaataagaat

SEQ ID NO: 70196 - DNA, 22 bp, Artificial sequence
  SiRNA target sequence
tgatttattaaaaataagaatg

SEQ ID NO: 70197 - DNA, 22 bp, Artificial sequence
  SiRNA target sequence
gatttattaaaaataagaatgt

SEQ ID NO: 70198 - DNA, 22 bp, Artificial sequence
  SiRNA target sequence
atttattaaaaataagaatgtt

SEQ ID NO: 70199 - DNA, 22 bp, Artificial sequence
  SiRNA target sequence
tttattaaaaataagaatgttg

SEQ ID NO: 70200 - DNA, 22 bp, Artificial sequence
  SiRNA target sequence
ttattaaaaataagaatgttgc

SEQ ID NO: 70201 - DNA, 22 bp, Artificial sequence
  SiRNA target sequence
tattaaaaataagaatgttgcg

SEQ ID NO: 70202 - DNA, 22 bp, Artificial sequence
  SiRNA target sequence
attaaaaataagaatgttgcga

SEQ ID NO: 70203 - DNA, 22 bp, Artificial sequence
  SiRNA target sequence
ttaaaaataagaatgttgcgat

SEQ ID NO: 70204 - DNA, 22 bp, Artificial sequence
  SiRNA target sequence
taaaaataagaatgttgcgata

SEQ ID NO: 70205 - DNA, 22 bp, Artificial sequence
  SiRNA target sequence
aaaaataagaatgttgcgatat

SEQ ID NO: 70206 - DNA, 22 bp, Artificial sequence
  SiRNA target sequence
aaaataagaatgttgcgatatg

SEQ ID NO: 70207 - DNA, 22 bp, Artificial sequence
  SiRNA target sequence
aaataagaatgttgcgatatgt

SEQ ID NO: 70208 - DNA, 22 bp, Artificial sequence
  SiRNA target sequence
aataagaatgttgcgatatgtt

SEQ ID NO: 70209 - DNA, 22 bp, Artificial sequence
  SiRNA target sequence
ataagaatgttgcgatatgtta

SEQ ID NO: 70210 - DNA, 22 bp, Artificial sequence
  SiRNA target sequence
taagaatgttgcgatatgttat

SEQ ID NO: 70211 - DNA, 22 bp, Artificial sequence
  SiRNA target sequence
aagaatgttgcgatatgttatt

SEQ ID NO: 70212 - DNA, 22 bp, Artificial sequence
  SiRNA target sequence
agaatgttgcgatatgttattg

SEQ ID NO: 70213 - DNA, 22 bp, Artificial sequence
  SiRNA target sequence
gaatgttgcgatatgttattgt

SEQ ID NO: 70214 - DNA, 22 bp, Artificial sequence
  SiRNA target sequence
aatgttgcgatatgttattgta

SEQ ID NO: 70215 - DNA, 22 bp, Artificial sequence
  SiRNA target sequence
atgttgcgatatgttattgtac

SEQ ID NO: 70216 - DNA, 22 bp, Artificial sequence
  SiRNA target sequence
tgttgcgatatgttattgtacc

SEQ ID NO: 70217 - DNA, 22 bp, Artificial sequence
  SiRNA target sequence
gttgcgatatgttattgtacca

SEQ ID NO: 70218 - DNA, 22 bp, Artificial sequence
  SiRNA target sequence
ttgcgatatgttattgtaccaa

SEQ ID NO: 70219 - DNA, 22 bp, Artificial sequence
  SiRNA target sequence
tgcgatatgttattgtaccaat

SEQ ID NO: 70220 - DNA, 22 bp, Artificial sequence
  SiRNA target sequence
gcgatatgttattgtaccaata

SEQ ID NO: 70221 - DNA, 22 bp, Artificial sequence
  SiRNA target sequence
cgatatgttattgtaccaataa

SEQ ID NO: 70222 - DNA, 22 bp, Artificial sequence
  SiRNA target sequence
gatatgttattgtaccaataat

SEQ ID NO: 70223 - DNA, 22 bp, Artificial sequence
  SiRNA target sequence
atatgttattgtaccaataata

SEQ ID NO: 70224 - DNA, 22 bp, Artificial sequence
  SiRNA target sequence
tatgttattgtaccaataatat

SEQ ID NO: 70225 - DNA, 22 bp, Artificial sequence
  SiRNA target sequence
atgttattgtaccaataatatt

SEQ ID NO: 70226 - DNA, 22 bp, Artificial sequence
  SiRNA target sequence
tgttattgtaccaataatattt

SEQ ID NO: 70227 - DNA, 22 bp, Artificial sequence
  SiRNA target sequence
gttattgtaccaataatatttt

SEQ ID NO: 70228 - DNA, 22 bp, Artificial sequence
  SiRNA target sequence
ttattgtaccaataatattttt

SEQ ID NO: 70229 - DNA, 22 bp, Artificial sequence
  SiRNA target sequence
tattgtaccaataatattttta

SEQ ID NO: 70230 - DNA, 22 bp, Artificial sequence
  SiRNA target sequence
attgtaccaataatatttttaa

SEQ ID NO: 70231 - DNA, 22 bp, Artificial sequence
  SiRNA target sequence
ttgtaccaataatatttttaac

SEQ ID NO: 70232 - DNA, 22 bp, Artificial sequence
  SiRNA target sequence
tgtaccaataatatttttaact

SEQ ID NO: 70233 - DNA, 22 bp, Artificial sequence
  SiRNA target sequence
gtaccaataatatttttaacta

SEQ ID NO: 70234 - DNA, 22 bp, Artificial sequence
  SiRNA target sequence
taccaataatatttttaactat

SEQ ID NO: 70235 - DNA, 22 bp, Artificial sequence
  SiRNA target sequence
accaataatatttttaactata

SEQ ID NO: 70236 - DNA, 22 bp, Artificial sequence
  SiRNA target sequence
ccaataatatttttaactatat

SEQ ID NO: 70237 - DNA, 22 bp, Artificial sequence
  SiRNA target sequence
caataatatttttaactatatt

SEQ ID NO: 70238 - DNA, 22 bp, Artificial sequence
  SiRNA target sequence
aataatatttttaactatattt

SEQ ID NO: 70239 - DNA, 22 bp, Artificial sequence
  SiRNA target sequence
ataatatttttaactatatttt

SEQ ID NO: 70240 - DNA, 22 bp, Artificial sequence
  SiRNA target sequence
taatatttttaactatatttta

SEQ ID NO: 70241 - DNA, 22 bp, Artificial sequence
  SiRNA target sequence
aatatttttaactatattttac

SEQ ID NO: 70242 - DNA, 22 bp, Artificial sequence
  SiRNA target sequence
atatttttaactatattttaca

SEQ ID NO: 70243 - DNA, 22 bp, Artificial sequence
  SiRNA target sequence
tatttttaactatattttacac

SEQ ID NO: 70244 - DNA, 22 bp, Artificial sequence
  SiRNA target sequence
atttttaactatattttacact

SEQ ID NO: 70245 - DNA, 22 bp, Artificial sequence
  SiRNA target sequence
tttttaactatattttacactg

SEQ ID NO: 70246 - DNA, 22 bp, Artificial sequence
  SiRNA target sequence
ttttaactatattttacactgt

SEQ ID NO: 70247 - DNA, 22 bp, Artificial sequence
  SiRNA target sequence
tttaactatattttacactgtt

SEQ ID NO: 70248 - DNA, 22 bp, Artificial sequence
  SiRNA target sequence
ttaactatattttacactgttt

SEQ ID NO: 70249 - DNA, 22 bp, Artificial sequence
  SiRNA target sequence
taactatattttacactgtttt

SEQ ID NO: 70250 - DNA, 22 bp, Artificial sequence
  SiRNA target sequence
aactatattttacactgtttta

SEQ ID NO: 70251 - DNA, 22 bp, Artificial sequence
  SiRNA target sequence
actatattttacactgttttag

SEQ ID NO: 70252 - DNA, 22 bp, Artificial sequence
  SiRNA target sequence
ctatattttacactgttttaga

SEQ ID NO: 70253 - DNA, 22 bp, Artificial sequence
  SiRNA target sequence
tatattttacactgttttagag

SEQ ID NO: 70254 - DNA, 22 bp, Artificial sequence
  SiRNA target sequence
atattttacactgttttagaga

SEQ ID NO: 70255 - DNA, 22 bp, Artificial sequence
  SiRNA target sequence
tattttacactgttttagagat

SEQ ID NO: 70256 - DNA, 22 bp, Artificial sequence
  SiRNA target sequence
attttacactgttttagagata

SEQ ID NO: 70257 - DNA, 22 bp, Artificial sequence
  SiRNA target sequence
ttttacactgttttagagataa

SEQ ID NO: 70258 - DNA, 22 bp, Artificial sequence
  SiRNA target sequence
tttacactgttttagagataaa

SEQ ID NO: 70259 - DNA, 22 bp, Artificial sequence
  SiRNA target sequence
ttacactgttttagagataaaa

SEQ ID NO: 70260 - DNA, 22 bp, Artificial sequence
  SiRNA target sequence
tacactgttttagagataaaaa

SEQ ID NO: 70261 - DNA, 22 bp, Artificial sequence
  SiRNA target sequence
acactgttttagagataaaaat

SEQ ID NO: 70262 - DNA, 22 bp, Artificial sequence
  SiRNA target sequence
cactgttttagagataaaaata

SEQ ID NO: 70263 - DNA, 22 bp, Artificial sequence
  SiRNA target sequence
actgttttagagataaaaataa

SEQ ID NO: 70264 - DNA, 22 bp, Artificial sequence
  SiRNA target sequence
ctgttttagagataaaaataag

SEQ ID NO: 70265 - DNA, 22 bp, Artificial sequence
  SiRNA target sequence
tgttttagagataaaaataagt

SEQ ID NO: 70266 - DNA, 22 bp, Artificial sequence
  SiRNA target sequence
gttttagagataaaaataagta

SEQ ID NO: 70267 - DNA, 22 bp, Artificial sequence
  SiRNA target sequence
ttttagagataaaaataagtac

SEQ ID NO: 70268 - DNA, 22 bp, Artificial sequence
  SiRNA target sequence
tttagagataaaaataagtaca

SEQ ID NO: 70269 - DNA, 22 bp, Artificial sequence
  SiRNA target sequence
ttagagataaaaataagtacat

SEQ ID NO: 70270 - DNA, 22 bp, Artificial sequence
  SiRNA target sequence
tagagataaaaataagtacatt

SEQ ID NO: 70271 - DNA, 22 bp, Artificial sequence
  SiRNA target sequence
agagataaaaataagtacatta

SEQ ID NO: 70272 - DNA, 22 bp, Artificial sequence
  SiRNA target sequence
gagataaaaataagtacattag

SEQ ID NO: 70273 - DNA, 22 bp, Artificial sequence
  SiRNA target sequence
agataaaaataagtacattagt

SEQ ID NO: 70274 - DNA, 22 bp, Artificial sequence
  SiRNA target sequence
gataaaaataagtacattagta

SEQ ID NO: 70275 - DNA, 22 bp, Artificial sequence
  SiRNA target sequence
ataaaaataagtacattagtaa

SEQ ID NO: 70276 - DNA, 22 bp, Artificial sequence
  SiRNA target sequence
taaaaataagtacattagtaaa

SEQ ID NO: 70277 - DNA, 22 bp, Artificial sequence
  SiRNA target sequence
aaaaataagtacattagtaaag

SEQ ID NO: 70278 - DNA, 22 bp, Artificial sequence
  SiRNA target sequence
aaaataagtacattagtaaaga

SEQ ID NO: 70279 - DNA, 22 bp, Artificial sequence
  SiRNA target sequence
aaataagtacattagtaaagaa

SEQ ID NO: 70280 - DNA, 22 bp, Artificial sequence
  SiRNA target sequence
aataagtacattagtaaagaat

SEQ ID NO: 70281 - DNA, 22 bp, Artificial sequence
  SiRNA target sequence
ataagtacattagtaaagaatc

SEQ ID NO: 70282 - DNA, 22 bp, Artificial sequence
  SiRNA target sequence
taagtacattagtaaagaatct

SEQ ID NO: 70283 - DNA, 22 bp, Artificial sequence
  SiRNA target sequence
aagtacattagtaaagaatctt

SEQ ID NO: 70284 - DNA, 22 bp, Artificial sequence
  SiRNA target sequence
agtacattagtaaagaatctta

SEQ ID NO: 70285 - DNA, 22 bp, Artificial sequence
  SiRNA target sequence
gtacattagtaaagaatcttaa

SEQ ID NO: 70286 - DNA, 22 bp, Artificial sequence
  SiRNA target sequence
tacattagtaaagaatcttaat

SEQ ID NO: 70287 - DNA, 22 bp, Artificial sequence
  SiRNA target sequence
acattagtaaagaatcttaatc

SEQ ID NO: 70288 - DNA, 22 bp, Artificial sequence
  SiRNA target sequence
cattagtaaagaatcttaatca

SEQ ID NO: 70289 - DNA, 22 bp, Artificial sequence
  SiRNA target sequence
attagtaaagaatcttaatcaa

SEQ ID NO: 70290 - DNA, 22 bp, Artificial sequence
  SiRNA target sequence
ttagtaaagaatcttaatcaat

SEQ ID NO: 70291 - DNA, 22 bp, Artificial sequence
  SiRNA target sequence
tagtaaagaatcttaatcaatc

SEQ ID NO: 70292 - DNA, 22 bp, Artificial sequence
  SiRNA target sequence
agtaaagaatcttaatcaatct

SEQ ID NO: 70293 - DNA, 22 bp, Artificial sequence
  SiRNA target sequence
gtaaagaatcttaatcaatcta

SEQ ID NO: 70294 - DNA, 22 bp, Artificial sequence
  SiRNA target sequence
taaagaatcttaatcaatctat

SEQ ID NO: 70295 - DNA, 22 bp, Artificial sequence
  SiRNA target sequence
aaagaatcttaatcaatctatc

SEQ ID NO: 70296 - DNA, 22 bp, Artificial sequence
  SiRNA target sequence
aagaatcttaatcaatctatcg

SEQ ID NO: 70297 - DNA, 22 bp, Artificial sequence
  SiRNA target sequence
agaatcttaatcaatctatcgc

SEQ ID NO: 70298 - DNA, 22 bp, Artificial sequence
  SiRNA target sequence
gaatcttaatcaatctatcgca

SEQ ID NO: 70299 - DNA, 22 bp, Artificial sequence
  SiRNA target sequence
aatcttaatcaatctatcgcaa

SEQ ID NO: 70300 - DNA, 22 bp, Artificial sequence
  SiRNA target sequence
atcttaatcaatctatcgcaaa

SEQ ID NO: 70301 - DNA, 22 bp, Artificial sequence
  SiRNA target sequence
tcttaatcaatctatcgcaaat

SEQ ID NO: 70302 - DNA, 22 bp, Artificial sequence
  SiRNA target sequence
cttaatcaatctatcgcaaatc

SEQ ID NO: 70303 - DNA, 22 bp, Artificial sequence
  SiRNA target sequence
ttaatcaatctatcgcaaatcg

SEQ ID NO: 70304 - DNA, 22 bp, Artificial sequence
  SiRNA target sequence
taatcaatctatcgcaaatcga

SEQ ID NO: 70305 - DNA, 22 bp, Artificial sequence
  SiRNA target sequence
aatcaatctatcgcaaatcgaa

SEQ ID NO: 70306 - DNA, 22 bp, Artificial sequence
  SiRNA target sequence
atcaatctatcgcaaatcgaaa

SEQ ID NO: 70307 - DNA, 22 bp, Artificial sequence
  SiRNA target sequence
tcaatctatcgcaaatcgaaaa

SEQ ID NO: 70308 - DNA, 22 bp, Artificial sequence
  SiRNA target sequence
caatctatcgcaaatcgaaaag

SEQ ID NO: 70309 - DNA, 22 bp, Artificial sequence
  SiRNA target sequence
aatctatcgcaaatcgaaaagg

SEQ ID NO: 70310 - DNA, 22 bp, Artificial sequence
  SiRNA target sequence
atctatcgcaaatcgaaaaggt

SEQ ID NO: 70311 - DNA, 22 bp, Artificial sequence
  SiRNA target sequence
tctatcgcaaatcgaaaaggtg

SEQ ID NO: 70312 - DNA, 22 bp, Artificial sequence
  SiRNA target sequence
ctatcgcaaatcgaaaaggtga

SEQ ID NO: 70313 - DNA, 22 bp, Artificial sequence
  SiRNA target sequence
tatcgcaaatcgaaaaggtgaa

SEQ ID NO: 70314 - DNA, 22 bp, Artificial sequence
  SiRNA target sequence
atcgcaaatcgaaaaggtgaac

SEQ ID NO: 70315 - DNA, 22 bp, Artificial sequence
  SiRNA target sequence
tcgcaaatcgaaaaggtgaaca

SEQ ID NO: 70316 - DNA, 22 bp, Artificial sequence
  SiRNA target sequence
cgcaaatcgaaaaggtgaacac

SEQ ID NO: 70317 - DNA, 22 bp, Artificial sequence
  SiRNA target sequence
gcaaatcgaaaaggtgaacaca

SEQ ID NO: 70318 - DNA, 22 bp, Artificial sequence
  SiRNA target sequence
caaatcgaaaaggtgaacacac

SEQ ID NO: 70319 - DNA, 22 bp, Artificial sequence
  SiRNA target sequence
aaatcgaaaaggtgaacacaca

SEQ ID NO: 70320 - DNA, 22 bp, Artificial sequence
  SiRNA target sequence
aatcgaaaaggtgaacacacag

SEQ ID NO: 70321 - DNA, 22 bp, Artificial sequence
  SiRNA target sequence
atcgaaaaggtgaacacacagc

SEQ ID NO: 70322 - DNA, 22 bp, Artificial sequence
  SiRNA target sequence
tcgaaaaggtgaacacacagca

SEQ ID NO: 70323 - DNA, 22 bp, Artificial sequence
  SiRNA target sequence
cgaaaaggtgaacacacagcac

SEQ ID NO: 70324 - DNA, 22 bp, Artificial sequence
  SiRNA target sequence
gaaaaggtgaacacacagcact

SEQ ID NO: 70325 - DNA, 22 bp, Artificial sequence
  SiRNA target sequence
aaaaggtgaacacacagcactt

SEQ ID NO: 70326 - DNA, 22 bp, Artificial sequence
  SiRNA target sequence
aaaggtgaacacacagcacttg

SEQ ID NO: 70327 - DNA, 22 bp, Artificial sequence
  SiRNA target sequence
aaggtgaacacacagcacttga

SEQ ID NO: 70328 - DNA, 22 bp, Artificial sequence
  SiRNA target sequence
aggtgaacacacagcacttgaa

SEQ ID NO: 70329 - DNA, 22 bp, Artificial sequence
  SiRNA target sequence
ggtgaacacacagcacttgaaa

SEQ ID NO: 70330 - DNA, 22 bp, Artificial sequence
  SiRNA target sequence
gtgaacacacagcacttgaaag

SEQ ID NO: 70331 - DNA, 22 bp, Artificial sequence
  SiRNA target sequence
tgaacacacagcacttgaaaga

SEQ ID NO: 70332 - DNA, 22 bp, Artificial sequence
  SiRNA target sequence
gaacacacagcacttgaaagat

SEQ ID NO: 70333 - DNA, 22 bp, Artificial sequence
  SiRNA target sequence
aacacacagcacttgaaagatt

SEQ ID NO: 70334 - DNA, 22 bp, Artificial sequence
  SiRNA target sequence
acacacagcacttgaaagattt

SEQ ID NO: 70335 - DNA, 22 bp, Artificial sequence
  SiRNA target sequence
cacacagcacttgaaagatttg

SEQ ID NO: 70336 - DNA, 22 bp, Artificial sequence
  SiRNA target sequence
acacagcacttgaaagatttgt

SEQ ID NO: 70337 - DNA, 22 bp, Artificial sequence
  SiRNA target sequence
cacagcacttgaaagatttgtg

SEQ ID NO: 70338 - DNA, 22 bp, Artificial sequence
  SiRNA target sequence
acagcacttgaaagatttgtgt

SEQ ID NO: 70339 - DNA, 22 bp, Artificial sequence
  SiRNA target sequence
cagcacttgaaagatttgtgtt

SEQ ID NO: 70340 - DNA, 22 bp, Artificial sequence
  SiRNA target sequence
agcacttgaaagatttgtgtta

SEQ ID NO: 70341 - DNA, 22 bp, Artificial sequence
  SiRNA target sequence
gcacttgaaagatttgtgttac

SEQ ID NO: 70342 - DNA, 22 bp, Artificial sequence
  SiRNA target sequence
cacttgaaagatttgtgttaca

SEQ ID NO: 70343 - DNA, 22 bp, Artificial sequence
  SiRNA target sequence
acttgaaagatttgtgttacag

SEQ ID NO: 70344 - DNA, 22 bp, Artificial sequence
  SiRNA target sequence
cttgaaagatttgtgttacagt

SEQ ID NO: 70345 - DNA, 22 bp, Artificial sequence
  SiRNA target sequence
ttgaaagatttgtgttacagtc

SEQ ID NO: 70346 - DNA, 22 bp, Artificial sequence
  SiRNA target sequence
tgaaagatttgtgttacagtca

SEQ ID NO: 70347 - DNA, 22 bp, Artificial sequence
  SiRNA target sequence
gaaagatttgtgttacagtcac

SEQ ID NO: 70348 - DNA, 22 bp, Artificial sequence
  SiRNA target sequence
aaagatttgtgttacagtcact

SEQ ID NO: 70349 - DNA, 22 bp, Artificial sequence
  SiRNA target sequence
aagatttgtgttacagtcactc

SEQ ID NO: 70350 - DNA, 22 bp, Artificial sequence
  SiRNA target sequence
agatttgtgttacagtcactct

SEQ ID NO: 70351 - DNA, 22 bp, Artificial sequence
  SiRNA target sequence
gatttgtgttacagtcactctt

SEQ ID NO: 70352 - DNA, 22 bp, Artificial sequence
  SiRNA target sequence
atttgtgttacagtcactctta

SEQ ID NO: 70353 - DNA, 22 bp, Artificial sequence
  SiRNA target sequence
tttgtgttacagtcactcttag

SEQ ID NO: 70354 - DNA, 22 bp, Artificial sequence
  SiRNA target sequence
ttgtgttacagtcactcttagt

SEQ ID NO: 70355 - DNA, 22 bp, Artificial sequence
  SiRNA target sequence
tgtgttacagtcactcttagtg

SEQ ID NO: 70356 - DNA, 22 bp, Artificial sequence
  SiRNA target sequence
gtgttacagtcactcttagtgg

SEQ ID NO: 70357 - DNA, 22 bp, Artificial sequence
  SiRNA target sequence
tgttacagtcactcttagtggc

SEQ ID NO: 70358 - DNA, 22 bp, Artificial sequence
  SiRNA target sequence
gttacagtcactcttagtggct

SEQ ID NO: 70359 - DNA, 22 bp, Artificial sequence
  SiRNA target sequence
ttacagtcactcttagtggctg

SEQ ID NO: 70360 - DNA, 22 bp, Artificial sequence
  SiRNA target sequence
tacagtcactcttagtggctgt

SEQ ID NO: 70361 - DNA, 22 bp, Artificial sequence
  SiRNA target sequence
acagtcactcttagtggctgta

SEQ ID NO: 70362 - DNA, 22 bp, Artificial sequence
  SiRNA target sequence
cagtcactcttagtggctgtat

SEQ ID NO: 70363 - DNA, 22 bp, Artificial sequence
  SiRNA target sequence
agtcactcttagtggctgtatt

SEQ ID NO: 70364 - DNA, 22 bp, Artificial sequence
  SiRNA target sequence
gtcactcttagtggctgtattg

SEQ ID NO: 70365 - DNA, 22 bp, Artificial sequence
  SiRNA target sequence
tcactcttagtggctgtattga

SEQ ID NO: 70366 - DNA, 22 bp, Artificial sequence
  SiRNA target sequence
cactcttagtggctgtattgac

SEQ ID NO: 70367 - DNA, 22 bp, Artificial sequence
  SiRNA target sequence
actcttagtggctgtattgacc

SEQ ID NO: 70368 - DNA, 22 bp, Artificial sequence
  SiRNA target sequence
ctcttagtggctgtattgaccg

SEQ ID NO: 70369 - DNA, 22 bp, Artificial sequence
  SiRNA target sequence
tcttagtggctgtattgaccga

SEQ ID NO: 70370 - DNA, 22 bp, Artificial sequence
  SiRNA target sequence
cttagtggctgtattgaccgaa

SEQ ID NO: 70371 - DNA, 22 bp, Artificial sequence
  SiRNA target sequence
ttagtggctgtattgaccgaac

SEQ ID NO: 70372 - DNA, 22 bp, Artificial sequence
  SiRNA target sequence
tagtggctgtattgaccgaact

SEQ ID NO: 70373 - DNA, 22 bp, Artificial sequence
  SiRNA target sequence
agtggctgtattgaccgaactt

SEQ ID NO: 70374 - DNA, 22 bp, Artificial sequence
  SiRNA target sequence
gtggctgtattgaccgaactta

SEQ ID NO: 70375 - DNA, 22 bp, Artificial sequence
  SiRNA target sequence
tggctgtattgaccgaacttaa

SEQ ID NO: 70376 - DNA, 22 bp, Artificial sequence
  SiRNA target sequence
ggctgtattgaccgaacttaat

SEQ ID NO: 70377 - DNA, 22 bp, Artificial sequence
  SiRNA target sequence
gctgtattgaccgaacttaatg

SEQ ID NO: 70378 - DNA, 22 bp, Artificial sequence
  SiRNA target sequence
ctgtattgaccgaacttaatgg

SEQ ID NO: 70379 - DNA, 22 bp, Artificial sequence
  SiRNA target sequence
tgtattgaccgaacttaatgga

SEQ ID NO: 70380 - DNA, 22 bp, Artificial sequence
  SiRNA target sequence
gtattgaccgaacttaatggat

SEQ ID NO: 70381 - DNA, 22 bp, Artificial sequence
  SiRNA target sequence
tattgaccgaacttaatggatt

SEQ ID NO: 70382 - DNA, 22 bp, Artificial sequence
  SiRNA target sequence
attgaccgaacttaatggattt

SEQ ID NO: 70383 - DNA, 22 bp, Artificial sequence
  SiRNA target sequence
ttgaccgaacttaatggattta

SEQ ID NO: 70384 - DNA, 22 bp, Artificial sequence
  SiRNA target sequence
tgaccgaacttaatggatttat

SEQ ID NO: 70385 - DNA, 22 bp, Artificial sequence
  SiRNA target sequence
gaccgaacttaatggatttatt

SEQ ID NO: 70386 - DNA, 22 bp, Artificial sequence
  SiRNA target sequence
accgaacttaatggatttattt

SEQ ID NO: 70387 - DNA, 22 bp, Artificial sequence
  SiRNA target sequence
ccgaacttaatggatttatttt

SEQ ID NO: 70388 - DNA, 22 bp, Artificial sequence
  SiRNA target sequence
cgaacttaatggatttattttt

SEQ ID NO: 70389 - DNA, 22 bp, Artificial sequence
  SiRNA target sequence
gaacttaatggatttattttta

SEQ ID NO: 70390 - DNA, 22 bp, Artificial sequence
  SiRNA target sequence
aacttaatggatttatttttac

SEQ ID NO: 70391 - DNA, 22 bp, Artificial sequence
  SiRNA target sequence
acttaatggatttatttttaca

SEQ ID NO: 70392 - DNA, 22 bp, Artificial sequence
  SiRNA target sequence
cttaatggatttatttttacag

SEQ ID NO: 70393 - DNA, 22 bp, Artificial sequence
  SiRNA target sequence
ttaatggatttatttttacagg

SEQ ID NO: 70394 - DNA, 22 bp, Artificial sequence
  SiRNA target sequence
taatggatttatttttacaggt

SEQ ID NO: 70395 - DNA, 22 bp, Artificial sequence
  SiRNA target sequence
aatggatttatttttacaggtg

SEQ ID NO: 70396 - DNA, 22 bp, Artificial sequence
  SiRNA target sequence
atggatttatttttacaggtgt

SEQ ID NO: 70397 - DNA, 22 bp, Artificial sequence
  SiRNA target sequence
tggatttatttttacaggtgta

SEQ ID NO: 70398 - DNA, 22 bp, Artificial sequence
  SiRNA target sequence
ggatttatttttacaggtgtag

SEQ ID NO: 70399 - DNA, 22 bp, Artificial sequence
  SiRNA target sequence
gatttatttttacaggtgtagt

SEQ ID NO: 70400 - DNA, 22 bp, Artificial sequence
  SiRNA target sequence
atttatttttacaggtgtagtg

SEQ ID NO: 70401 - DNA, 22 bp, Artificial sequence
  SiRNA target sequence
tttatttttacaggtgtagtgc

SEQ ID NO: 70402 - DNA, 22 bp, Artificial sequence
  SiRNA target sequence
ttatttttacaggtgtagtgca

SEQ ID NO: 70403 - DNA, 22 bp, Artificial sequence
  SiRNA target sequence
tatttttacaggtgtagtgcaa

SEQ ID NO: 70404 - DNA, 22 bp, Artificial sequence
  SiRNA target sequence
atttttacaggtgtagtgcaat

SEQ ID NO: 70405 - DNA, 22 bp, Artificial sequence
  SiRNA target sequence
tttttacaggtgtagtgcaata

SEQ ID NO: 70406 - DNA, 22 bp, Artificial sequence
  SiRNA target sequence
ttttacaggtgtagtgcaatat

SEQ ID NO: 70407 - DNA, 22 bp, Artificial sequence
  SiRNA target sequence
tttacaggtgtagtgcaatata

SEQ ID NO: 70408 - DNA, 22 bp, Artificial sequence
  SiRNA target sequence
ttacaggtgtagtgcaatatat

SEQ ID NO: 70409 - DNA, 22 bp, Artificial sequence
  SiRNA target sequence
tacaggtgtagtgcaatatatt

SEQ ID NO: 70410 - DNA, 22 bp, Artificial sequence
  SiRNA target sequence
acaggtgtagtgcaatatattt

SEQ ID NO: 70411 - DNA, 22 bp, Artificial sequence
  SiRNA target sequence
caggtgtagtgcaatatattta

SEQ ID NO: 70412 - DNA, 22 bp, Artificial sequence
  SiRNA target sequence
aggtgtagtgcaatatatttat

SEQ ID NO: 70413 - DNA, 22 bp, Artificial sequence
  SiRNA target sequence
ggtgtagtgcaatatatttata

SEQ ID NO: 70414 - DNA, 22 bp, Artificial sequence
  SiRNA target sequence
gtgtagtgcaatatatttatag

SEQ ID NO: 70415 - DNA, 22 bp, Artificial sequence
  SiRNA target sequence
tgtagtgcaatatatttataga

SEQ ID NO: 70416 - DNA, 22 bp, Artificial sequence
  SiRNA target sequence
gtagtgcaatatatttatagaa

SEQ ID NO: 70417 - DNA, 22 bp, Artificial sequence
  SiRNA target sequence
tagtgcaatatatttatagaaa

SEQ ID NO: 70418 - DNA, 22 bp, Artificial sequence
  SiRNA target sequence
agtgcaatatatttatagaaat

SEQ ID NO: 70419 - DNA, 22 bp, Artificial sequence
  SiRNA target sequence
gtgcaatatatttatagaaata

SEQ ID NO: 70420 - DNA, 22 bp, Artificial sequence
  SiRNA target sequence
tgcaatatatttatagaaatac

SEQ ID NO: 70421 - DNA, 22 bp, Artificial sequence
  SiRNA target sequence
gcaatatatttatagaaatacg

SEQ ID NO: 70422 - DNA, 22 bp, Artificial sequence
  SiRNA target sequence
caatatatttatagaaatacgg

SEQ ID NO: 70423 - DNA, 22 bp, Artificial sequence
  SiRNA target sequence
aatatatttatagaaatacggc

SEQ ID NO: 70424 - DNA, 22 bp, Artificial sequence
  SiRNA target sequence
atatatttatagaaatacggca

SEQ ID NO: 70425 - DNA, 22 bp, Artificial sequence
  SiRNA target sequence
tatatttatagaaatacggcaa

SEQ ID NO: 70426 - DNA, 22 bp, Artificial sequence
  SiRNA target sequence
atatttatagaaatacggcaaa

SEQ ID NO: 70427 - DNA, 22 bp, Artificial sequence
  SiRNA target sequence
tatttatagaaatacggcaaaa

SEQ ID NO: 70428 - DNA, 22 bp, Artificial sequence
  SiRNA target sequence
atttatagaaatacggcaaaat

SEQ ID NO: 70429 - DNA, 22 bp, Artificial sequence
  SiRNA target sequence
tttatagaaatacggcaaaatc

SEQ ID NO: 70430 - DNA, 22 bp, Artificial sequence
  SiRNA target sequence
ttatagaaatacggcaaaatct

SEQ ID NO: 70431 - DNA, 22 bp, Artificial sequence
  SiRNA target sequence
tatagaaatacggcaaaatcta

SEQ ID NO: 70432 - DNA, 22 bp, Artificial sequence
  SiRNA target sequence
atagaaatacggcaaaatctac

SEQ ID NO: 70433 - DNA, 22 bp, Artificial sequence
  SiRNA target sequence
tagaaatacggcaaaatctaca

SEQ ID NO: 70434 - DNA, 22 bp, Artificial sequence
  SiRNA target sequence
agaaatacggcaaaatctacat

SEQ ID NO: 70435 - DNA, 22 bp, Artificial sequence
  SiRNA target sequence
gaaatacggcaaaatctacatt

SEQ ID NO: 70436 - DNA, 22 bp, Artificial sequence
  SiRNA target sequence
aaatacggcaaaatctacattc

SEQ ID NO: 70437 - DNA, 22 bp, Artificial sequence
  SiRNA target sequence
aatacggcaaaatctacattca

SEQ ID NO: 70438 - DNA, 22 bp, Artificial sequence
  SiRNA target sequence
atacggcaaaatctacattcaa

SEQ ID NO: 70439 - DNA, 22 bp, Artificial sequence
  SiRNA target sequence
tacggcaaaatctacattcaaa

SEQ ID NO: 70440 - DNA, 22 bp, Artificial sequence
  SiRNA target sequence
acggcaaaatctacattcaaag

SEQ ID NO: 70441 - DNA, 22 bp, Artificial sequence
  SiRNA target sequence
cggcaaaatctacattcaaagg

SEQ ID NO: 70442 - DNA, 22 bp, Artificial sequence
  SiRNA target sequence
ggcaaaatctacattcaaaggc

SEQ ID NO: 70443 - DNA, 22 bp, Artificial sequence
  SiRNA target sequence
gcaaaatctacattcaaaggct

SEQ ID NO: 70444 - DNA, 22 bp, Artificial sequence
  SiRNA target sequence
caaaatctacattcaaaggctt

SEQ ID NO: 70445 - DNA, 22 bp, Artificial sequence
  SiRNA target sequence
aaaatctacattcaaaggcttc

SEQ ID NO: 70446 - DNA, 22 bp, Artificial sequence
  SiRNA target sequence
aaatctacattcaaaggcttca

SEQ ID NO: 70447 - DNA, 22 bp, Artificial sequence
  SiRNA target sequence
aatctacattcaaaggcttcat

SEQ ID NO: 70448 - DNA, 22 bp, Artificial sequence
  SiRNA target sequence
atctacattcaaaggcttcatt

SEQ ID NO: 70449 - DNA, 22 bp, Artificial sequence
  SiRNA target sequence
tctacattcaaaggcttcattt

SEQ ID NO: 70450 - DNA, 22 bp, Artificial sequence
  SiRNA target sequence
ctacattcaaaggcttcatttc

SEQ ID NO: 70451 - DNA, 22 bp, Artificial sequence
  SiRNA target sequence
tacattcaaaggcttcatttct

SEQ ID NO: 70452 - DNA, 22 bp, Artificial sequence
  SiRNA target sequence
acattcaaaggcttcatttctc

SEQ ID NO: 70453 - DNA, 22 bp, Artificial sequence
  SiRNA target sequence
cattcaaaggcttcatttctct

SEQ ID NO: 70454 - DNA, 22 bp, Artificial sequence
  SiRNA target sequence
attcaaaggcttcatttctctt

SEQ ID NO: 70455 - DNA, 22 bp, Artificial sequence
  SiRNA target sequence
ttcaaaggcttcatttctcttt

SEQ ID NO: 70456 - DNA, 22 bp, Artificial sequence
  SiRNA target sequence
tcaaaggcttcatttctctttc

SEQ ID NO: 70457 - DNA, 22 bp, Artificial sequence
  SiRNA target sequence
caaaggcttcatttctctttca

SEQ ID NO: 70458 - DNA, 22 bp, Artificial sequence
  SiRNA target sequence
aaaggcttcatttctctttcac

SEQ ID NO: 70459 - DNA, 22 bp, Artificial sequence
  SiRNA target sequence
aaggcttcatttctctttcacc

SEQ ID NO: 70460 - DNA, 22 bp, Artificial sequence
  SiRNA target sequence
aggcttcatttctctttcacct

SEQ ID NO: 70461 - DNA, 22 bp, Artificial sequence
  SiRNA target sequence
ggcttcatttctctttcaccta

SEQ ID NO: 70462 - DNA, 22 bp, Artificial sequence
  SiRNA target sequence
gcttcatttctctttcacctaa

SEQ ID NO: 70463 - DNA, 22 bp, Artificial sequence
  SiRNA target sequence
cttcatttctctttcacctaaa

SEQ ID NO: 70464 - DNA, 22 bp, Artificial sequence
  SiRNA target sequence
ttcatttctctttcacctaaaa

SEQ ID NO: 70465 - DNA, 22 bp, Artificial sequence
  SiRNA target sequence
tcatttctctttcacctaaaaa

SEQ ID NO: 70466 - DNA, 22 bp, Artificial sequence
  SiRNA target sequence
catttctctttcacctaaaaat

SEQ ID NO: 70467 - DNA, 22 bp, Artificial sequence
  SiRNA target sequence
atttctctttcacctaaaaatt

SEQ ID NO: 70468 - DNA, 22 bp, Artificial sequence
  SiRNA target sequence
tttctctttcacctaaaaattt

SEQ ID NO: 70469 - DNA, 22 bp, Artificial sequence
  SiRNA target sequence
ttctctttcacctaaaaatttt

SEQ ID NO: 70470 - DNA, 22 bp, Artificial sequence
  SiRNA target sequence
tctctttcacctaaaaatttta

SEQ ID NO: 70471 - DNA, 22 bp, Artificial sequence
  SiRNA target sequence
ctctttcacctaaaaattttag

SEQ ID NO: 70472 - DNA, 22 bp, Artificial sequence
  SiRNA target sequence
tctttcacctaaaaattttagt

SEQ ID NO: 70473 - DNA, 22 bp, Artificial sequence
  SiRNA target sequence
ctttcacctaaaaattttagta

SEQ ID NO: 70474 - DNA, 22 bp, Artificial sequence
  SiRNA target sequence
tttcacctaaaaattttagtac

SEQ ID NO: 70475 - DNA, 22 bp, Artificial sequence
  SiRNA target sequence
ttcacctaaaaattttagtacc

SEQ ID NO: 70476 - DNA, 22 bp, Artificial sequence
  SiRNA target sequence
tcacctaaaaattttagtacca

SEQ ID NO: 70477 - DNA, 22 bp, Artificial sequence
  SiRNA target sequence
cacctaaaaattttagtaccat

SEQ ID NO: 70478 - DNA, 22 bp, Artificial sequence
  SiRNA target sequence
acctaaaaattttagtaccata

SEQ ID NO: 70479 - DNA, 22 bp, Artificial sequence
  SiRNA target sequence
cctaaaaattttagtaccatag

SEQ ID NO: 70480 - DNA, 22 bp, Artificial sequence
  SiRNA target sequence
ctaaaaattttagtaccatagg

SEQ ID NO: 70481 - DNA, 22 bp, Artificial sequence
  SiRNA target sequence
taaaaattttagtaccataggt

SEQ ID NO: 70482 - DNA, 22 bp, Artificial sequence
  SiRNA target sequence
aaaaattttagtaccataggtg

SEQ ID NO: 70483 - DNA, 22 bp, Artificial sequence
  SiRNA target sequence
aaaattttagtaccataggtgg

SEQ ID NO: 70484 - DNA, 22 bp, Artificial sequence
  SiRNA target sequence
aaattttagtaccataggtggc

SEQ ID NO: 70485 - DNA, 22 bp, Artificial sequence
  SiRNA target sequence
aattttagtaccataggtggcg

SEQ ID NO: 70486 - DNA, 22 bp, Artificial sequence
  SiRNA target sequence
attttagtaccataggtggcgg

SEQ ID NO: 70487 - DNA, 22 bp, Artificial sequence
  SiRNA target sequence
ttttagtaccataggtggcgga

SEQ ID NO: 70488 - DNA, 22 bp, Artificial sequence
  SiRNA target sequence
tttagtaccataggtggcggag

SEQ ID NO: 70489 - DNA, 22 bp, Artificial sequence
  SiRNA target sequence
ttagtaccataggtggcggaga

SEQ ID NO: 70490 - DNA, 22 bp, Artificial sequence
  SiRNA target sequence
tagtaccataggtggcggagaa

SEQ ID NO: 70491 - DNA, 22 bp, Artificial sequence
  SiRNA target sequence
agtaccataggtggcggagaaa

SEQ ID NO: 70492 - DNA, 22 bp, Artificial sequence
  SiRNA target sequence
gtaccataggtggcggagaaat

SEQ ID NO: 70493 - DNA, 22 bp, Artificial sequence
  SiRNA target sequence
taccataggtggcggagaaatt

SEQ ID NO: 70494 - DNA, 22 bp, Artificial sequence
  SiRNA target sequence
accataggtggcggagaaattc

SEQ ID NO: 70495 - DNA, 22 bp, Artificial sequence
  SiRNA target sequence
ccataggtggcggagaaattca

SEQ ID NO: 70496 - DNA, 22 bp, Artificial sequence
  SiRNA target sequence
cataggtggcggagaaattcaa

SEQ ID NO: 70497 - DNA, 22 bp, Artificial sequence
  SiRNA target sequence
ataggtggcggagaaattcaaa

SEQ ID NO: 70498 - DNA, 22 bp, Artificial sequence
  SiRNA target sequence
taggtggcggagaaattcaaac

SEQ ID NO: 70499 - DNA, 22 bp, Artificial sequence
  SiRNA target sequence
aggtggcggagaaattcaaaca

SEQ ID NO: 70500 - DNA, 22 bp, Artificial sequence
  SiRNA target sequence
ggtggcggagaaattcaaacaa

SEQ ID NO: 70501 - DNA, 22 bp, Artificial sequence
  SiRNA target sequence
gtggcggagaaattcaaacaat

SEQ ID NO: 70502 - DNA, 22 bp, Artificial sequence
  SiRNA target sequence
tggcggagaaattcaaacaata

SEQ ID NO: 70503 - DNA, 22 bp, Artificial sequence
  SiRNA target sequence
ggcggagaaattcaaacaataa

SEQ ID NO: 70504 - DNA, 22 bp, Artificial sequence
  SiRNA target sequence
gcggagaaattcaaacaataat

SEQ ID NO: 70505 - DNA, 22 bp, Artificial sequence
  SiRNA target sequence
cggagaaattcaaacaataata

SEQ ID NO: 70506 - DNA, 22 bp, Artificial sequence
  SiRNA target sequence
ggagaaattcaaacaataatag

SEQ ID NO: 70507 - DNA, 22 bp, Artificial sequence
  SiRNA target sequence
gagaaattcaaacaataataga

SEQ ID NO: 70508 - DNA, 22 bp, Artificial sequence
  SiRNA target sequence
agaaattcaaacaataatagat

SEQ ID NO: 70509 - DNA, 22 bp, Artificial sequence
  SiRNA target sequence
gaaattcaaacaataatagata

SEQ ID NO: 70510 - DNA, 22 bp, Artificial sequence
  SiRNA target sequence
aaattcaaacaataatagatag

SEQ ID NO: 70511 - DNA, 22 bp, Artificial sequence
  SiRNA target sequence
aattcaaacaataatagataga

SEQ ID NO: 70512 - DNA, 22 bp, Artificial sequence
  SiRNA target sequence
attcaaacaataatagatagaa

SEQ ID NO: 70513 - DNA, 22 bp, Artificial sequence
  SiRNA target sequence
ttcaaacaataatagatagaaa

SEQ ID NO: 70514 - DNA, 22 bp, Artificial sequence
  SiRNA target sequence
tcaaacaataatagatagaaaa

SEQ ID NO: 70515 - DNA, 22 bp, Artificial sequence
  SiRNA target sequence
caaacaataatagatagaaaat

SEQ ID NO: 70516 - DNA, 22 bp, Artificial sequence
  SiRNA target sequence
aaacaataatagatagaaaatc

SEQ ID NO: 70517 - DNA, 22 bp, Artificial sequence
  SiRNA target sequence
aacaataatagatagaaaatca

SEQ ID NO: 70518 - DNA, 22 bp, Artificial sequence
  SiRNA target sequence
acaataatagatagaaaatcaa

SEQ ID NO: 70519 - DNA, 22 bp, Artificial sequence
  SiRNA target sequence
caataatagatagaaaatcaaa

SEQ ID NO: 70520 - DNA, 22 bp, Artificial sequence
  SiRNA target sequence
aataatagatagaaaatcaaaa

SEQ ID NO: 70521 - DNA, 22 bp, Artificial sequence
  SiRNA target sequence
ataatagatagaaaatcaaaat

SEQ ID NO: 70522 - DNA, 22 bp, Artificial sequence
  SiRNA target sequence
taatagatagaaaatcaaaatc

SEQ ID NO: 70523 - DNA, 22 bp, Artificial sequence
  SiRNA target sequence
aatagatagaaaatcaaaatct

SEQ ID NO: 70524 - DNA, 22 bp, Artificial sequence
  SiRNA target sequence
atagatagaaaatcaaaatctg

SEQ ID NO: 70525 - DNA, 22 bp, Artificial sequence
  SiRNA target sequence
tagatagaaaatcaaaatctgc

SEQ ID NO: 70526 - DNA, 22 bp, Artificial sequence
  SiRNA target sequence
agatagaaaatcaaaatctgca

SEQ ID NO: 70527 - DNA, 22 bp, Artificial sequence
  SiRNA target sequence
gatagaaaatcaaaatctgcaa

SEQ ID NO: 70528 - DNA, 22 bp, Artificial sequence
  SiRNA target sequence
atagaaaatcaaaatctgcaag

SEQ ID NO: 70529 - DNA, 22 bp, Artificial sequence
  SiRNA target sequence
tagaaaatcaaaatctgcaagt

SEQ ID NO: 70530 - DNA, 22 bp, Artificial sequence
  SiRNA target sequence
agaaaatcaaaatctgcaagtg

SEQ ID NO: 70531 - DNA, 22 bp, Artificial sequence
  SiRNA target sequence
gaaaatcaaaatctgcaagtga

SEQ ID NO: 70532 - DNA, 22 bp, Artificial sequence
  SiRNA target sequence
aaaatcaaaatctgcaagtgaa

SEQ ID NO: 70533 - DNA, 22 bp, Artificial sequence
  SiRNA target sequence
aaatcaaaatctgcaagtgaac

SEQ ID NO: 70534 - DNA, 22 bp, Artificial sequence
  SiRNA target sequence
aatcaaaatctgcaagtgaact

SEQ ID NO: 70535 - DNA, 22 bp, Artificial sequence
  SiRNA target sequence
atcaaaatctgcaagtgaactt

SEQ ID NO: 70536 - DNA, 22 bp, Artificial sequence
  SiRNA target sequence
tcaaaatctgcaagtgaactta

SEQ ID NO: 70537 - DNA, 22 bp, Artificial sequence
  SiRNA target sequence
caaaatctgcaagtgaacttat

SEQ ID NO: 70538 - DNA, 22 bp, Artificial sequence
  SiRNA target sequence
aaaatctgcaagtgaacttatt

SEQ ID NO: 70539 - DNA, 22 bp, Artificial sequence
  SiRNA target sequence
aaatctgcaagtgaacttattg

SEQ ID NO: 70540 - DNA, 22 bp, Artificial sequence
  SiRNA target sequence
aatctgcaagtgaacttattga

SEQ ID NO: 70541 - DNA, 22 bp, Artificial sequence
  SiRNA target sequence
atctgcaagtgaacttattgaa

SEQ ID NO: 70542 - DNA, 22 bp, Artificial sequence
  SiRNA target sequence
tctgcaagtgaacttattgaag

SEQ ID NO: 70543 - DNA, 22 bp, Artificial sequence
  SiRNA target sequence
ctgcaagtgaacttattgaagt

SEQ ID NO: 70544 - DNA, 22 bp, Artificial sequence
  SiRNA target sequence
tgcaagtgaacttattgaagtg

SEQ ID NO: 70545 - DNA, 22 bp, Artificial sequence
  SiRNA target sequence
gcaagtgaacttattgaagtgt

SEQ ID NO: 70546 - DNA, 22 bp, Artificial sequence
  SiRNA target sequence
caagtgaacttattgaagtgtt

SEQ ID NO: 70547 - DNA, 22 bp, Artificial sequence
  SiRNA target sequence
aagtgaacttattgaagtgttt

SEQ ID NO: 70548 - DNA, 22 bp, Artificial sequence
  SiRNA target sequence
agtgaacttattgaagtgtttc

SEQ ID NO: 70549 - DNA, 22 bp, Artificial sequence
  SiRNA target sequence
gtgaacttattgaagtgtttct

SEQ ID NO: 70550 - DNA, 22 bp, Artificial sequence
  SiRNA target sequence
tgaacttattgaagtgtttctt

SEQ ID NO: 70551 - DNA, 22 bp, Artificial sequence
  SiRNA target sequence
gaacttattgaagtgtttctta

SEQ ID NO: 70552 - DNA, 22 bp, Artificial sequence
  SiRNA target sequence
aacttattgaagtgtttcttac

SEQ ID NO: 70553 - DNA, 22 bp, Artificial sequence
  SiRNA target sequence
acttattgaagtgtttcttaca

SEQ ID NO: 70554 - DNA, 22 bp, Artificial sequence
  SiRNA target sequence
cttattgaagtgtttcttacaa

SEQ ID NO: 70555 - DNA, 22 bp, Artificial sequence
  SiRNA target sequence
ttattgaagtgtttcttacaag

SEQ ID NO: 70556 - DNA, 22 bp, Artificial sequence
  SiRNA target sequence
tattgaagtgtttcttacaagc

SEQ ID NO: 70557 - DNA, 22 bp, Artificial sequence
  SiRNA target sequence
attgaagtgtttcttacaagct

SEQ ID NO: 70558 - DNA, 22 bp, Artificial sequence
  SiRNA target sequence
ttgaagtgtttcttacaagctt

SEQ ID NO: 70559 - DNA, 22 bp, Artificial sequence
  SiRNA target sequence
tgaagtgtttcttacaagcttg

SEQ ID NO: 70560 - DNA, 22 bp, Artificial sequence
  SiRNA target sequence
gaagtgtttcttacaagcttgc

SEQ ID NO: 70561 - DNA, 22 bp, Artificial sequence
  SiRNA target sequence
aagtgtttcttacaagcttgct

SEQ ID NO: 70562 - DNA, 22 bp, Artificial sequence
  SiRNA target sequence
agtgtttcttacaagcttgctt

SEQ ID NO: 70563 - DNA, 22 bp, Artificial sequence
  SiRNA target sequence
gtgtttcttacaagcttgcttc

SEQ ID NO: 70564 - DNA, 22 bp, Artificial sequence
  SiRNA target sequence
tgtttcttacaagcttgcttcc

SEQ ID NO: 70565 - DNA, 22 bp, Artificial sequence
  SiRNA target sequence
gtttcttacaagcttgcttcca

SEQ ID NO: 70566 - DNA, 22 bp, Artificial sequence
  SiRNA target sequence
tttcttacaagcttgcttccaa

SEQ ID NO: 70567 - DNA, 22 bp, Artificial sequence
  SiRNA target sequence
ttcttacaagcttgcttccaat

SEQ ID NO: 70568 - DNA, 22 bp, Artificial sequence
  SiRNA target sequence
tcttacaagcttgcttccaata

SEQ ID NO: 70569 - DNA, 22 bp, Artificial sequence
  SiRNA target sequence
cttacaagcttgcttccaatat

SEQ ID NO: 70570 - DNA, 22 bp, Artificial sequence
  SiRNA target sequence
ttacaagcttgcttccaatatg

SEQ ID NO: 70571 - DNA, 22 bp, Artificial sequence
  SiRNA target sequence
tacaagcttgcttccaatatgc

SEQ ID NO: 70572 - DNA, 22 bp, Artificial sequence
  SiRNA target sequence
acaagcttgcttccaatatgcc

SEQ ID NO: 70573 - DNA, 22 bp, Artificial sequence
  SiRNA target sequence
caagcttgcttccaatatgcct

SEQ ID NO: 70574 - DNA, 22 bp, Artificial sequence
  SiRNA target sequence
aagcttgcttccaatatgcctt

SEQ ID NO: 70575 - DNA, 22 bp, Artificial sequence
  SiRNA target sequence
agcttgcttccaatatgcctta

SEQ ID NO: 70576 - DNA, 22 bp, Artificial sequence
  SiRNA target sequence
gcttgcttccaatatgccttaa

SEQ ID NO: 70577 - DNA, 22 bp, Artificial sequence
  SiRNA target sequence
cttgcttccaatatgccttaaa

SEQ ID NO: 70578 - DNA, 22 bp, Artificial sequence
  SiRNA target sequence
ttgcttccaatatgccttaaac

SEQ ID NO: 70579 - DNA, 22 bp, Artificial sequence
  SiRNA target sequence
tgcttccaatatgccttaaact

SEQ ID NO: 70580 - DNA, 22 bp, Artificial sequence
  SiRNA target sequence
gcttccaatatgccttaaactt

SEQ ID NO: 70581 - DNA, 22 bp, Artificial sequence
  SiRNA target sequence
cttccaatatgccttaaacttt

SEQ ID NO: 70582 - DNA, 22 bp, Artificial sequence
  SiRNA target sequence
ttccaatatgccttaaactttt

SEQ ID NO: 70583 - DNA, 22 bp, Artificial sequence
  SiRNA target sequence
tccaatatgccttaaactttta

SEQ ID NO: 70584 - DNA, 22 bp, Artificial sequence
  SiRNA target sequence
ccaatatgccttaaacttttat

SEQ ID NO: 70585 - DNA, 22 bp, Artificial sequence
  SiRNA target sequence
caatatgccttaaacttttatt

SEQ ID NO: 70586 - DNA, 22 bp, Artificial sequence
  SiRNA target sequence
aatatgccttaaacttttattt

SEQ ID NO: 70587 - DNA, 22 bp, Artificial sequence
  SiRNA target sequence
atatgccttaaacttttatttg

SEQ ID NO: 70588 - DNA, 22 bp, Artificial sequence
  SiRNA target sequence
tatgccttaaacttttatttgc

SEQ ID NO: 70589 - DNA, 22 bp, Artificial sequence
  SiRNA target sequence
atgccttaaacttttatttgcc

SEQ ID NO: 70590 - DNA, 22 bp, Artificial sequence
  SiRNA target sequence
tgccttaaacttttatttgccc

SEQ ID NO: 70591 - DNA, 22 bp, Artificial sequence
  SiRNA target sequence
gccttaaacttttatttgccct

SEQ ID NO: 70592 - DNA, 22 bp, Artificial sequence
  SiRNA target sequence
ccttaaacttttatttgccctt

SEQ ID NO: 70593 - DNA, 22 bp, Artificial sequence
  SiRNA target sequence
cttaaacttttatttgccctta

SEQ ID NO: 70594 - DNA, 22 bp, Artificial sequence
  SiRNA target sequence
ttaaacttttatttgcccttat

SEQ ID NO: 70595 - DNA, 22 bp, Artificial sequence
  SiRNA target sequence
taaacttttatttgcccttatt

SEQ ID NO: 70596 - DNA, 22 bp, Artificial sequence
  SiRNA target sequence
aaacttttatttgcccttattg

SEQ ID NO: 70597 - DNA, 22 bp, Artificial sequence
  SiRNA target sequence
aacttttatttgcccttattgc

SEQ ID NO: 70598 - DNA, 22 bp, Artificial sequence
  SiRNA target sequence
acttttatttgcccttattgca

SEQ ID NO: 70599 - DNA, 22 bp, Artificial sequence
  SiRNA target sequence
cttttatttgcccttattgcag

SEQ ID NO: 70600 - DNA, 22 bp, Artificial sequence
  SiRNA target sequence
ttttatttgcccttattgcagt

SEQ ID NO: 70601 - DNA, 22 bp, Artificial sequence
  SiRNA target sequence
tttatttgcccttattgcagtt

SEQ ID NO: 70602 - DNA, 22 bp, Artificial sequence
  SiRNA target sequence
ttatttgcccttattgcagtta

SEQ ID NO: 70603 - DNA, 22 bp, Artificial sequence
  SiRNA target sequence
tatttgcccttattgcagttat

SEQ ID NO: 70604 - DNA, 22 bp, Artificial sequence
  SiRNA target sequence
atttgcccttattgcagttata

SEQ ID NO: 70605 - DNA, 22 bp, Artificial sequence
  SiRNA target sequence
tttgcccttattgcagttataa

SEQ ID NO: 70606 - DNA, 22 bp, Artificial sequence
  SiRNA target sequence
ttgcccttattgcagttataaa

SEQ ID NO: 70607 - DNA, 22 bp, Artificial sequence
  SiRNA target sequence
tgcccttattgcagttataaaa

SEQ ID NO: 70608 - DNA, 22 bp, Artificial sequence
  SiRNA target sequence
gcccttattgcagttataaaaa

SEQ ID NO: 70609 - DNA, 22 bp, Artificial sequence
  SiRNA target sequence
cccttattgcagttataaaaaa

SEQ ID NO: 70610 - DNA, 22 bp, Artificial sequence
  SiRNA target sequence
ccttattgcagttataaaaaat

SEQ ID NO: 70611 - DNA, 22 bp, Artificial sequence
  SiRNA target sequence
cttattgcagttataaaaaata

SEQ ID NO: 70612 - DNA, 22 bp, Artificial sequence
  SiRNA target sequence
ttattgcagttataaaaaatat

SEQ ID NO: 70613 - DNA, 22 bp, Artificial sequence
  SiRNA target sequence
tattgcagttataaaaaatatg

SEQ ID NO: 70614 - DNA, 22 bp, Artificial sequence
  SiRNA target sequence
attgcagttataaaaaatatgg

SEQ ID NO: 70615 - DNA, 22 bp, Artificial sequence
  SiRNA target sequence
ttgcagttataaaaaatatggg

SEQ ID NO: 70616 - DNA, 22 bp, Artificial sequence
  SiRNA target sequence
tgcagttataaaaaatatggga

SEQ ID NO: 70617 - DNA, 22 bp, Artificial sequence
  SiRNA target sequence
gcagttataaaaaatatgggag

SEQ ID NO: 70618 - DNA, 22 bp, Artificial sequence
  SiRNA target sequence
cagttataaaaaatatgggagg

SEQ ID NO: 70619 - DNA, 22 bp, Artificial sequence
  SiRNA target sequence
agttataaaaaatatgggaggt

SEQ ID NO: 70620 - DNA, 22 bp, Artificial sequence
  SiRNA target sequence
gttataaaaaatatgggaggtc

SEQ ID NO: 70621 - DNA, 22 bp, Artificial sequence
  SiRNA target sequence
ttataaaaaatatgggaggtct

SEQ ID NO: 70622 - DNA, 22 bp, Artificial sequence
  SiRNA target sequence
tataaaaaatatgggaggtctt

SEQ ID NO: 70623 - DNA, 22 bp, Artificial sequence
  SiRNA target sequence
ataaaaaatatgggaggtcttg

SEQ ID NO: 70624 - DNA, 22 bp, Artificial sequence
  SiRNA target sequence
taaaaaatatgggaggtcttgc

SEQ ID NO: 70625 - DNA, 22 bp, Artificial sequence
  SiRNA target sequence
aaaaaatatgggaggtcttgcg

SEQ ID NO: 70626 - DNA, 22 bp, Artificial sequence
  SiRNA target sequence
aaaaatatgggaggtcttgcgg

SEQ ID NO: 70627 - DNA, 22 bp, Artificial sequence
  SiRNA target sequence
aaaatatgggaggtcttgcggg

SEQ ID NO: 70628 - DNA, 22 bp, Artificial sequence
  SiRNA target sequence
aaatatgggaggtcttgcgggc

SEQ ID NO: 70629 - DNA, 22 bp, Artificial sequence
  SiRNA target sequence
aatatgggaggtcttgcgggct

SEQ ID NO: 70630 - DNA, 22 bp, Artificial sequence
  SiRNA target sequence
atatgggaggtcttgcgggctt

SEQ ID NO: 70631 - DNA, 22 bp, Artificial sequence
  SiRNA target sequence
tatgggaggtcttgcgggcttc

SEQ ID NO: 70632 - DNA, 22 bp, Artificial sequence
  SiRNA target sequence
atgggaggtcttgcgggcttca

SEQ ID NO: 70633 - DNA, 22 bp, Artificial sequence
  SiRNA target sequence
tgggaggtcttgcgggcttcat

SEQ ID NO: 70634 - DNA, 22 bp, Artificial sequence
  SiRNA target sequence
gggaggtcttgcgggcttcata

SEQ ID NO: 70635 - DNA, 22 bp, Artificial sequence
  SiRNA target sequence
ggaggtcttgcgggcttcataa

SEQ ID NO: 70636 - DNA, 22 bp, Artificial sequence
  SiRNA target sequence
gaggtcttgcgggcttcataat

SEQ ID NO: 70637 - DNA, 22 bp, Artificial sequence
  SiRNA target sequence
aggtcttgcgggcttcataatg

SEQ ID NO: 70638 - DNA, 22 bp, Artificial sequence
  SiRNA target sequence
ggtcttgcgggcttcataatgt

SEQ ID NO: 70639 - DNA, 22 bp, Artificial sequence
  SiRNA target sequence
gtcttgcgggcttcataatgtt

SEQ ID NO: 70640 - DNA, 22 bp, Artificial sequence
  SiRNA target sequence
tcttgcgggcttcataatgttt

SEQ ID NO: 70641 - DNA, 22 bp, Artificial sequence
  SiRNA target sequence
cttgcgggcttcataatgtttg

SEQ ID NO: 70642 - DNA, 22 bp, Artificial sequence
  SiRNA target sequence
ttgcgggcttcataatgtttgt

SEQ ID NO: 70643 - DNA, 22 bp, Artificial sequence
  SiRNA target sequence
tgcgggcttcataatgtttgtt

SEQ ID NO: 70644 - DNA, 22 bp, Artificial sequence
  SiRNA target sequence
gcgggcttcataatgtttgttt

SEQ ID NO: 70645 - DNA, 22 bp, Artificial sequence
  SiRNA target sequence
cgggcttcataatgtttgtttg

SEQ ID NO: 70646 - DNA, 22 bp, Artificial sequence
  SiRNA target sequence
gggcttcataatgtttgtttgt

SEQ ID NO: 70647 - DNA, 22 bp, Artificial sequence
  SiRNA target sequence
ggcttcataatgtttgtttgtg

SEQ ID NO: 70648 - DNA, 22 bp, Artificial sequence
  SiRNA target sequence
gcttcataatgtttgtttgtgt

SEQ ID NO: 70649 - DNA, 22 bp, Artificial sequence
  SiRNA target sequence
cttcataatgtttgtttgtgtt

SEQ ID NO: 70650 - DNA, 22 bp, Artificial sequence
  SiRNA target sequence
ttcataatgtttgtttgtgttt

SEQ ID NO: 70651 - DNA, 22 bp, Artificial sequence
  SiRNA target sequence
tcataatgtttgtttgtgtttc

SEQ ID NO: 70652 - DNA, 22 bp, Artificial sequence
  SiRNA target sequence
cataatgtttgtttgtgtttct

SEQ ID NO: 70653 - DNA, 22 bp, Artificial sequence
  SiRNA target sequence
ataatgtttgtttgtgtttctt

SEQ ID NO: 70654 - DNA, 22 bp, Artificial sequence
  SiRNA target sequence
taatgtttgtttgtgtttcttg

SEQ ID NO: 70655 - DNA, 22 bp, Artificial sequence
  SiRNA target sequence
aatgtttgtttgtgtttcttgc

SEQ ID NO: 70656 - DNA, 22 bp, Artificial sequence
  SiRNA target sequence
atgtttgtttgtgtttcttgct

SEQ ID NO: 70657 - DNA, 22 bp, Artificial sequence
  SiRNA target sequence
tgtttgtttgtgtttcttgcta

SEQ ID NO: 70658 - DNA, 22 bp, Artificial sequence
  SiRNA target sequence
gtttgtttgtgtttcttgctat

SEQ ID NO: 70659 - DNA, 22 bp, Artificial sequence
  SiRNA target sequence
tttgtttgtgtttcttgctatg

SEQ ID NO: 70660 - DNA, 22 bp, Artificial sequence
  SiRNA target sequence
ttgtttgtgtttcttgctatgc

SEQ ID NO: 70661 - DNA, 22 bp, Artificial sequence
  SiRNA target sequence
tgtttgtgtttcttgctatgcg

SEQ ID NO: 70662 - DNA, 22 bp, Artificial sequence
  SiRNA target sequence
gtttgtgtttcttgctatgcga

SEQ ID NO: 70663 - DNA, 22 bp, Artificial sequence
  SiRNA target sequence
tttgtgtttcttgctatgcgac

SEQ ID NO: 70664 - DNA, 22 bp, Artificial sequence
  SiRNA target sequence
ttgtgtttcttgctatgcgact

SEQ ID NO: 70665 - DNA, 22 bp, Artificial sequence
  SiRNA target sequence
tgtgtttcttgctatgcgactg

SEQ ID NO: 70666 - DNA, 22 bp, Artificial sequence
  SiRNA target sequence
gtgtttcttgctatgcgactgt

SEQ ID NO: 70667 - DNA, 22 bp, Artificial sequence
  SiRNA target sequence
tgtttcttgctatgcgactgtg

SEQ ID NO: 70668 - DNA, 22 bp, Artificial sequence
  SiRNA target sequence
gtttcttgctatgcgactgtga

SEQ ID NO: 70669 - DNA, 22 bp, Artificial sequence
  SiRNA target sequence
tttcttgctatgcgactgtgac

SEQ ID NO: 70670 - DNA, 22 bp, Artificial sequence
  SiRNA target sequence
ttcttgctatgcgactgtgact

SEQ ID NO: 70671 - DNA, 22 bp, Artificial sequence
  SiRNA target sequence
tcttgctatgcgactgtgacta

SEQ ID NO: 70672 - DNA, 22 bp, Artificial sequence
  SiRNA target sequence
cttgctatgcgactgtgactat

SEQ ID NO: 70673 - DNA, 22 bp, Artificial sequence
  SiRNA target sequence
ttgctatgcgactgtgactata

SEQ ID NO: 70674 - DNA, 22 bp, Artificial sequence
  SiRNA target sequence
tgctatgcgactgtgactatat

SEQ ID NO: 70675 - DNA, 22 bp, Artificial sequence
  SiRNA target sequence
gctatgcgactgtgactatatt

SEQ ID NO: 70676 - DNA, 22 bp, Artificial sequence
  SiRNA target sequence
ctatgcgactgtgactatattg

SEQ ID NO: 70677 - DNA, 22 bp, Artificial sequence
  SiRNA target sequence
tatgcgactgtgactatattga

SEQ ID NO: 70678 - DNA, 22 bp, Artificial sequence
  SiRNA target sequence
atgcgactgtgactatattgat

SEQ ID NO: 70679 - DNA, 22 bp, Artificial sequence
  SiRNA target sequence
tgcgactgtgactatattgata

SEQ ID NO: 70680 - DNA, 22 bp, Artificial sequence
  SiRNA target sequence
gcgactgtgactatattgatag

SEQ ID NO: 70681 - DNA, 22 bp, Artificial sequence
  SiRNA target sequence
cgactgtgactatattgatagc

SEQ ID NO: 70682 - DNA, 22 bp, Artificial sequence
  SiRNA target sequence
gactgtgactatattgatagca

SEQ ID NO: 70683 - DNA, 22 bp, Artificial sequence
  SiRNA target sequence
actgtgactatattgatagcac

SEQ ID NO: 70684 - DNA, 22 bp, Artificial sequence
  SiRNA target sequence
ctgtgactatattgatagcaca

SEQ ID NO: 70685 - DNA, 22 bp, Artificial sequence
  SiRNA target sequence
tgtgactatattgatagcacaa

SEQ ID NO: 70686 - DNA, 22 bp, Artificial sequence
  SiRNA target sequence
gtgactatattgatagcacaat

SEQ ID NO: 70687 - DNA, 22 bp, Artificial sequence
  SiRNA target sequence
tgactatattgatagcacaatg

SEQ ID NO: 70688 - DNA, 22 bp, Artificial sequence
  SiRNA target sequence
gactatattgatagcacaatgg

SEQ ID NO: 70689 - DNA, 22 bp, Artificial sequence
  SiRNA target sequence
actatattgatagcacaatgga

SEQ ID NO: 70690 - DNA, 22 bp, Artificial sequence
  SiRNA target sequence
ctatattgatagcacaatggag

SEQ ID NO: 70691 - DNA, 22 bp, Artificial sequence
  SiRNA target sequence
tatattgatagcacaatggaga

SEQ ID NO: 70692 - DNA, 22 bp, Artificial sequence
  SiRNA target sequence
atattgatagcacaatggagat

SEQ ID NO: 70693 - DNA, 22 bp, Artificial sequence
  SiRNA target sequence
tattgatagcacaatggagatc

SEQ ID NO: 70694 - DNA, 22 bp, Artificial sequence
  SiRNA target sequence
attgatagcacaatggagatct

SEQ ID NO: 70695 - DNA, 22 bp, Artificial sequence
  SiRNA target sequence
ttgatagcacaatggagatcta

SEQ ID NO: 70696 - DNA, 22 bp, Artificial sequence
  SiRNA target sequence
tgatagcacaatggagatctaa

SEQ ID NO: 70697 - DNA, 22 bp, Artificial sequence
  SiRNA target sequence
gatagcacaatggagatctaat

SEQ ID NO: 70698 - DNA, 22 bp, Artificial sequence
  SiRNA target sequence
atagcacaatggagatctaata

SEQ ID NO: 70699 - DNA, 22 bp, Artificial sequence
  SiRNA target sequence
tagcacaatggagatctaatat

SEQ ID NO: 70700 - DNA, 22 bp, Artificial sequence
  SiRNA target sequence
agcacaatggagatctaatatt

SEQ ID NO: 70701 - DNA, 22 bp, Artificial sequence
  SiRNA target sequence
gcacaatggagatctaatatta

SEQ ID NO: 70702 - DNA, 22 bp, Artificial sequence
  SiRNA target sequence
cacaatggagatctaatattag

SEQ ID NO: 70703 - DNA, 22 bp, Artificial sequence
  SiRNA target sequence
acaatggagatctaatattaga

SEQ ID NO: 70704 - DNA, 22 bp, Artificial sequence
  SiRNA target sequence
caatggagatctaatattagaa

SEQ ID NO: 70705 - DNA, 22 bp, Artificial sequence
  SiRNA target sequence
aatggagatctaatattagaag

SEQ ID NO: 70706 - DNA, 22 bp, Artificial sequence
  SiRNA target sequence
atggagatctaatattagaaga

SEQ ID NO: 70707 - DNA, 22 bp, Artificial sequence
  SiRNA target sequence
tggagatctaatattagaagag

SEQ ID NO: 70708 - DNA, 22 bp, Artificial sequence
  SiRNA target sequence
ggagatctaatattagaagaga

SEQ ID NO: 70709 - DNA, 22 bp, Artificial sequence
  SiRNA target sequence
gagatctaatattagaagagaa

SEQ ID NO: 70710 - DNA, 22 bp, Artificial sequence
  SiRNA target sequence
agatctaatattagaagagaac

SEQ ID NO: 70711 - DNA, 22 bp, Artificial sequence
  SiRNA target sequence
gatctaatattagaagagaact

SEQ ID NO: 70712 - DNA, 22 bp, Artificial sequence
  SiRNA target sequence
atctaatattagaagagaactt

SEQ ID NO: 70713 - DNA, 22 bp, Artificial sequence
  SiRNA target sequence
tctaatattagaagagaactta

SEQ ID NO: 70714 - DNA, 22 bp, Artificial sequence
  SiRNA target sequence
ctaatattagaagagaacttaa

SEQ ID NO: 70715 - DNA, 22 bp, Artificial sequence
  SiRNA target sequence
taatattagaagagaacttaat

SEQ ID NO: 70716 - DNA, 22 bp, Artificial sequence
  SiRNA target sequence
aatattagaagagaacttaata

SEQ ID NO: 70717 - DNA, 22 bp, Artificial sequence
  SiRNA target sequence
atattagaagagaacttaataa

SEQ ID NO: 70718 - DNA, 22 bp, Artificial sequence
  SiRNA target sequence
tattagaagagaacttaataac

SEQ ID NO: 70719 - DNA, 22 bp, Artificial sequence
  SiRNA target sequence
attagaagagaacttaataact

SEQ ID NO: 70720 - DNA, 22 bp, Artificial sequence
  SiRNA target sequence
ttagaagagaacttaataactc

SEQ ID NO: 70721 - DNA, 22 bp, Artificial sequence
  SiRNA target sequence
tagaagagaacttaataactct

SEQ ID NO: 70722 - DNA, 22 bp, Artificial sequence
  SiRNA target sequence
agaagagaacttaataactctg

SEQ ID NO: 70723 - DNA, 22 bp, Artificial sequence
  SiRNA target sequence
gaagagaacttaataactctga

SEQ ID NO: 70724 - DNA, 22 bp, Artificial sequence
  SiRNA target sequence
aagagaacttaataactctgaa

SEQ ID NO: 70725 - DNA, 22 bp, Artificial sequence
  SiRNA target sequence
agagaacttaataactctgaaa

SEQ ID NO: 70726 - DNA, 22 bp, Artificial sequence
  SiRNA target sequence
gagaacttaataactctgaaaa

SEQ ID NO: 70727 - DNA, 22 bp, Artificial sequence
  SiRNA target sequence
agaacttaataactctgaaaat

SEQ ID NO: 70728 - DNA, 22 bp, Artificial sequence
  SiRNA target sequence
gaacttaataactctgaaaata

SEQ ID NO: 70729 - DNA, 22 bp, Artificial sequence
  SiRNA target sequence
aacttaataactctgaaaatag

SEQ ID NO: 70730 - DNA, 22 bp, Artificial sequence
  SiRNA target sequence
acttaataactctgaaaataga

SEQ ID NO: 70731 - DNA, 22 bp, Artificial sequence
  SiRNA target sequence
cttaataactctgaaaatagat

SEQ ID NO: 70732 - DNA, 22 bp, Artificial sequence
  SiRNA target sequence
ttaataactctgaaaatagatc

SEQ ID NO: 70733 - DNA, 22 bp, Artificial sequence
  SiRNA target sequence
taataactctgaaaatagatct

SEQ ID NO: 70734 - DNA, 22 bp, Artificial sequence
  SiRNA target sequence
aataactctgaaaatagatcta

SEQ ID NO: 70735 - DNA, 22 bp, Artificial sequence
  SiRNA target sequence
ataactctgaaaatagatctag

SEQ ID NO: 70736 - DNA, 22 bp, Artificial sequence
  SiRNA target sequence
taactctgaaaatagatctagt

SEQ ID NO: 70737 - DNA, 22 bp, Artificial sequence
  SiRNA target sequence
aactctgaaaatagatctagta

SEQ ID NO: 70738 - DNA, 22 bp, Artificial sequence
  SiRNA target sequence
actctgaaaatagatctagtaa

SEQ ID NO: 70739 - DNA, 22 bp, Artificial sequence
  SiRNA target sequence
ctctgaaaatagatctagtaat

SEQ ID NO: 70740 - DNA, 22 bp, Artificial sequence
  SiRNA target sequence
tctgaaaatagatctagtaata

SEQ ID NO: 70741 - DNA, 22 bp, Artificial sequence
  SiRNA target sequence
ctgaaaatagatctagtaataa

SEQ ID NO: 70742 - DNA, 22 bp, Artificial sequence
  SiRNA target sequence
tgaaaatagatctagtaataaa

SEQ ID NO: 70743 - DNA, 22 bp, Artificial sequence
  SiRNA target sequence
gaaaatagatctagtaataaac

SEQ ID NO: 70744 - DNA, 22 bp, Artificial sequence
  SiRNA target sequence
aaaatagatctagtaataaact

SEQ ID NO: 70745 - DNA, 22 bp, Artificial sequence
  SiRNA target sequence
aaatagatctagtaataaacta

SEQ ID NO: 70746 - DNA, 22 bp, Artificial sequence
  SiRNA target sequence
aatagatctagtaataaactac

SEQ ID NO: 70747 - DNA, 22 bp, Artificial sequence
  SiRNA target sequence
atagatctagtaataaactaca

SEQ ID NO: 70748 - DNA, 22 bp, Artificial sequence
  SiRNA target sequence
tagatctagtaataaactacaa

SEQ ID NO: 70749 - DNA, 22 bp, Artificial sequence
  SiRNA target sequence
agatctagtaataaactacaag

SEQ ID NO: 70750 - DNA, 22 bp, Artificial sequence
  SiRNA target sequence
gatctagtaataaactacaaga

SEQ ID NO: 70751 - DNA, 22 bp, Artificial sequence
  SiRNA target sequence
atctagtaataaactacaagat

SEQ ID NO: 70752 - DNA, 22 bp, Artificial sequence
  SiRNA target sequence
tctagtaataaactacaagatg

SEQ ID NO: 70753 - DNA, 22 bp, Artificial sequence
  SiRNA target sequence
ctagtaataaactacaagatgg

SEQ ID NO: 70754 - DNA, 22 bp, Artificial sequence
  SiRNA target sequence
tagtaataaactacaagatgga

SEQ ID NO: 70755 - DNA, 22 bp, Artificial sequence
  SiRNA target sequence
agtaataaactacaagatggat

SEQ ID NO: 70756 - DNA, 22 bp, Artificial sequence
  SiRNA target sequence
gtaataaactacaagatggatt

SEQ ID NO: 70757 - DNA, 22 bp, Artificial sequence
  SiRNA target sequence
taataaactacaagatggatta

SEQ ID NO: 70758 - DNA, 22 bp, Artificial sequence
  SiRNA target sequence
aataaactacaagatggattaa

SEQ ID NO: 70759 - DNA, 22 bp, Artificial sequence
  SiRNA target sequence
ataaactacaagatggattaaa

SEQ ID NO: 70760 - DNA, 22 bp, Artificial sequence
  SiRNA target sequence
taaactacaagatggattaaat

SEQ ID NO: 70761 - DNA, 22 bp, Artificial sequence
  SiRNA target sequence
aaactacaagatggattaaata

SEQ ID NO: 70762 - DNA, 22 bp, Artificial sequence
  SiRNA target sequence
aactacaagatggattaaataa

SEQ ID NO: 70763 - DNA, 22 bp, Artificial sequence
  SiRNA target sequence
actacaagatggattaaataat

SEQ ID NO: 70764 - DNA, 22 bp, Artificial sequence
  SiRNA target sequence
ctacaagatggattaaataatc

SEQ ID NO: 70765 - DNA, 22 bp, Artificial sequence
  SiRNA target sequence
tacaagatggattaaataatca

SEQ ID NO: 70766 - DNA, 22 bp, Artificial sequence
  SiRNA target sequence
acaagatggattaaataatcat

SEQ ID NO: 70767 - DNA, 22 bp, Artificial sequence
  SiRNA target sequence
caagatggattaaataatcatg

SEQ ID NO: 70768 - DNA, 22 bp, Artificial sequence
  SiRNA target sequence
aagatggattaaataatcatga

SEQ ID NO: 70769 - DNA, 22 bp, Artificial sequence
  SiRNA target sequence
agatggattaaataatcatgaa

SEQ ID NO: 70770 - DNA, 22 bp, Artificial sequence
  SiRNA target sequence
gatggattaaataatcatgaaa

SEQ ID NO: 70771 - DNA, 22 bp, Artificial sequence
  SiRNA target sequence
atggattaaataatcatgaaac

SEQ ID NO: 70772 - DNA, 22 bp, Artificial sequence
  SiRNA target sequence
tggattaaataatcatgaaaca

SEQ ID NO: 70773 - DNA, 22 bp, Artificial sequence
  SiRNA target sequence
ggattaaataatcatgaaacaa

SEQ ID NO: 70774 - DNA, 22 bp, Artificial sequence
  SiRNA target sequence
gattaaataatcatgaaacaat

SEQ ID NO: 70775 - DNA, 22 bp, Artificial sequence
  SiRNA target sequence
attaaataatcatgaaacaatc

SEQ ID NO: 70776 - DNA, 22 bp, Artificial sequence
  SiRNA target sequence
ttaaataatcatgaaacaatcg

SEQ ID NO: 70777 - DNA, 22 bp, Artificial sequence
  SiRNA target sequence
taaataatcatgaaacaatcgt

SEQ ID NO: 70778 - DNA, 22 bp, Artificial sequence
  SiRNA target sequence
aaataatcatgaaacaatcgtc

SEQ ID NO: 70779 - DNA, 22 bp, Artificial sequence
  SiRNA target sequence
aataatcatgaaacaatcgtct

SEQ ID NO: 70780 - DNA, 22 bp, Artificial sequence
  SiRNA target sequence
ataatcatgaaacaatcgtctc

SEQ ID NO: 70781 - DNA, 22 bp, Artificial sequence
  SiRNA target sequence
taatcatgaaacaatcgtctcc

SEQ ID NO: 70782 - DNA, 22 bp, Artificial sequence
  SiRNA target sequence
aatcatgaaacaatcgtctcct

SEQ ID NO: 70783 - DNA, 22 bp, Artificial sequence
  SiRNA target sequence
atcatgaaacaatcgtctcctt

SEQ ID NO: 70784 - DNA, 22 bp, Artificial sequence
  SiRNA target sequence
tcatgaaacaatcgtctccttt

SEQ ID NO: 70785 - DNA, 22 bp, Artificial sequence
  SiRNA target sequence
catgaaacaatcgtctcctttg

SEQ ID NO: 70786 - DNA, 22 bp, Artificial sequence
  SiRNA target sequence
atgaaacaatcgtctcctttgg

SEQ ID NO: 70787 - DNA, 22 bp, Artificial sequence
  SiRNA target sequence
tgaaacaatcgtctcctttggg

SEQ ID NO: 70788 - DNA, 22 bp, Artificial sequence
  SiRNA target sequence
gaaacaatcgtctcctttggga

SEQ ID NO: 70789 - DNA, 22 bp, Artificial sequence
  SiRNA target sequence
aaacaatcgtctcctttgggac

SEQ ID NO: 70790 - DNA, 22 bp, Artificial sequence
  SiRNA target sequence
aacaatcgtctcctttgggact

SEQ ID NO: 70791 - DNA, 22 bp, Artificial sequence
  SiRNA target sequence
acaatcgtctcctttgggacta

SEQ ID NO: 70792 - DNA, 22 bp, Artificial sequence
  SiRNA target sequence
caatcgtctcctttgggactac

SEQ ID NO: 70793 - DNA, 22 bp, Artificial sequence
  SiRNA target sequence
aatcgtctcctttgggactaca

SEQ ID NO: 70794 - DNA, 22 bp, Artificial sequence
  SiRNA target sequence
atcgtctcctttgggactacag

SEQ ID NO: 70795 - DNA, 22 bp, Artificial sequence
  SiRNA target sequence
tcgtctcctttgggactacaga

SEQ ID NO: 70796 - DNA, 22 bp, Artificial sequence
  SiRNA target sequence
cgtctcctttgggactacagat

SEQ ID NO: 70797 - DNA, 22 bp, Artificial sequence
  SiRNA target sequence
gtctcctttgggactacagatc

SEQ ID NO: 70798 - DNA, 22 bp, Artificial sequence
  SiRNA target sequence
tctcctttgggactacagatct

SEQ ID NO: 70799 - DNA, 22 bp, Artificial sequence
  SiRNA target sequence
ctcctttgggactacagatctt

SEQ ID NO: 70800 - DNA, 22 bp, Artificial sequence
  SiRNA target sequence
tcctttgggactacagatcttg

SEQ ID NO: 70801 - DNA, 22 bp, Artificial sequence
  SiRNA target sequence
cctttgggactacagatcttga

SEQ ID NO: 70802 - DNA, 22 bp, Artificial sequence
  SiRNA target sequence
ctttgggactacagatcttgaa

SEQ ID NO: 70803 - DNA, 22 bp, Artificial sequence
  SiRNA target sequence
tttgggactacagatcttgaag

SEQ ID NO: 70804 - DNA, 22 bp, Artificial sequence
  SiRNA target sequence
ttgggactacagatcttgaagt

SEQ ID NO: 70805 - DNA, 22 bp, Artificial sequence
  SiRNA target sequence
tgggactacagatcttgaagta

SEQ ID NO: 70806 - DNA, 22 bp, Artificial sequence
  SiRNA target sequence
gggactacagatcttgaagtag

SEQ ID NO: 70807 - DNA, 22 bp, Artificial sequence
  SiRNA target sequence
ggactacagatcttgaagtaga

SEQ ID NO: 70808 - DNA, 22 bp, Artificial sequence
  SiRNA target sequence
gactacagatcttgaagtagat

SEQ ID NO: 70809 - DNA, 22 bp, Artificial sequence
  SiRNA target sequence
actacagatcttgaagtagatg

SEQ ID NO: 70810 - DNA, 22 bp, Artificial sequence
  SiRNA target sequence
ctacagatcttgaagtagatga

SEQ ID NO: 70811 - DNA, 22 bp, Artificial sequence
  SiRNA target sequence
tacagatcttgaagtagatgaa

SEQ ID NO: 70812 - DNA, 22 bp, Artificial sequence
  SiRNA target sequence
acagatcttgaagtagatgaat

SEQ ID NO: 70813 - DNA, 22 bp, Artificial sequence
  SiRNA target sequence
cagatcttgaagtagatgaata

SEQ ID NO: 70814 - DNA, 22 bp, Artificial sequence
  SiRNA target sequence
agatcttgaagtagatgaatat

SEQ ID NO: 70815 - DNA, 22 bp, Artificial sequence
  SiRNA target sequence
gatcttgaagtagatgaatatg

SEQ ID NO: 70816 - DNA, 22 bp, Artificial sequence
  SiRNA target sequence
atcttgaagtagatgaatatga

SEQ ID NO: 70817 - DNA, 22 bp, Artificial sequence
  SiRNA target sequence
tcttgaagtagatgaatatgat

SEQ ID NO: 70818 - DNA, 22 bp, Artificial sequence
  SiRNA target sequence
cttgaagtagatgaatatgatc

SEQ ID NO: 70819 - DNA, 22 bp, Artificial sequence
  SiRNA target sequence
ttgaagtagatgaatatgatca

SEQ ID NO: 70820 - DNA, 22 bp, Artificial sequence
  SiRNA target sequence
tgaagtagatgaatatgatcag

SEQ ID NO: 70821 - DNA, 22 bp, Artificial sequence
  SiRNA target sequence
gaagtagatgaatatgatcagt

SEQ ID NO: 70822 - DNA, 22 bp, Artificial sequence
  SiRNA target sequence
aagtagatgaatatgatcagtt

SEQ ID NO: 70823 - DNA, 22 bp, Artificial sequence
  SiRNA target sequence
agtagatgaatatgatcagttt

SEQ ID NO: 70824 - DNA, 22 bp, Artificial sequence
  SiRNA target sequence
gtagatgaatatgatcagtttc

SEQ ID NO: 70825 - DNA, 22 bp, Artificial sequence
  SiRNA target sequence
tagatgaatatgatcagtttct

SEQ ID NO: 70826 - DNA, 22 bp, Artificial sequence
  SiRNA target sequence
agatgaatatgatcagtttctt

SEQ ID NO: 70827 - DNA, 22 bp, Artificial sequence
  SiRNA target sequence
gatgaatatgatcagtttctta

SEQ ID NO: 70828 - DNA, 22 bp, Artificial sequence
  SiRNA target sequence
atgaatatgatcagtttcttaa

SEQ ID NO: 70829 - DNA, 22 bp, Artificial sequence
  SiRNA target sequence
tgaatatgatcagtttcttaaa

SEQ ID NO: 70830 - DNA, 22 bp, Artificial sequence
  SiRNA target sequence
gaatatgatcagtttcttaaaa

SEQ ID NO: 70831 - DNA, 22 bp, Artificial sequence
  SiRNA target sequence
aatatgatcagtttcttaaaat

SEQ ID NO: 70832 - DNA, 22 bp, Artificial sequence
  SiRNA target sequence
atatgatcagtttcttaaaatt

SEQ ID NO: 70833 - DNA, 22 bp, Artificial sequence
  SiRNA target sequence
tatgatcagtttcttaaaatta

SEQ ID NO: 70834 - DNA, 22 bp, Artificial sequence
  SiRNA target sequence
atgatcagtttcttaaaattaa

SEQ ID NO: 70835 - DNA, 22 bp, Artificial sequence
  SiRNA target sequence
tgatcagtttcttaaaattaat

SEQ ID NO: 70836 - DNA, 22 bp, Artificial sequence
  SiRNA target sequence
gatcagtttcttaaaattaatg

SEQ ID NO: 70837 - DNA, 22 bp, Artificial sequence
  SiRNA target sequence
atcagtttcttaaaattaatgc

SEQ ID NO: 70838 - DNA, 22 bp, Artificial sequence
  SiRNA target sequence
tcagtttcttaaaattaatgca

SEQ ID NO: 70839 - DNA, 22 bp, Artificial sequence
  SiRNA target sequence
cagtttcttaaaattaatgcat

SEQ ID NO: 70840 - DNA, 22 bp, Artificial sequence
  SiRNA target sequence
agtttcttaaaattaatgcatc

SEQ ID NO: 70841 - DNA, 22 bp, Artificial sequence
  SiRNA target sequence
gtttcttaaaattaatgcatct

SEQ ID NO: 70842 - DNA, 22 bp, Artificial sequence
  SiRNA target sequence
tttcttaaaattaatgcatcta

SEQ ID NO: 70843 - DNA, 22 bp, Artificial sequence
  SiRNA target sequence
ttcttaaaattaatgcatctaa

SEQ ID NO: 70844 - DNA, 22 bp, Artificial sequence
  SiRNA target sequence
tcttaaaattaatgcatctaat

SEQ ID NO: 70845 - DNA, 22 bp, Artificial sequence
  SiRNA target sequence
cttaaaattaatgcatctaata

SEQ ID NO: 70846 - DNA, 22 bp, Artificial sequence
  SiRNA target sequence
ttaaaattaatgcatctaatag

SEQ ID NO: 70847 - DNA, 22 bp, Artificial sequence
  SiRNA target sequence
taaaattaatgcatctaatagt

SEQ ID NO: 70848 - DNA, 22 bp, Artificial sequence
  SiRNA target sequence
aaaattaatgcatctaatagta

SEQ ID NO: 70849 - DNA, 22 bp, Artificial sequence
  SiRNA target sequence
aaattaatgcatctaatagtaa

SEQ ID NO: 70850 - DNA, 22 bp, Artificial sequence
  SiRNA target sequence
aattaatgcatctaatagtaac

SEQ ID NO: 70851 - DNA, 22 bp, Artificial sequence
  SiRNA target sequence
attaatgcatctaatagtaaca

SEQ ID NO: 70852 - DNA, 22 bp, Artificial sequence
  SiRNA target sequence
ttaatgcatctaatagtaacag

SEQ ID NO: 70853 - DNA, 22 bp, Artificial sequence
  SiRNA target sequence
taatgcatctaatagtaacaga

SEQ ID NO: 70854 - DNA, 22 bp, Artificial sequence
  SiRNA target sequence
aatgcatctaatagtaacagat

SEQ ID NO: 70855 - DNA, 22 bp, Artificial sequence
  SiRNA target sequence
atgcatctaatagtaacagatt

SEQ ID NO: 70856 - DNA, 22 bp, Artificial sequence
  SiRNA target sequence
tgcatctaatagtaacagatta

SEQ ID NO: 70857 - DNA, 22 bp, Artificial sequence
  SiRNA target sequence
gcatctaatagtaacagattat

SEQ ID NO: 70858 - DNA, 22 bp, Artificial sequence
  SiRNA target sequence
catctaatagtaacagattatg

SEQ ID NO: 70859 - DNA, 22 bp, Artificial sequence
  SiRNA target sequence
atctaatagtaacagattatgg

SEQ ID NO: 70860 - DNA, 22 bp, Artificial sequence
  SiRNA target sequence
tctaatagtaacagattatgga

SEQ ID NO: 70861 - DNA, 22 bp, Artificial sequence
  SiRNA target sequence
ctaatagtaacagattatggag

SEQ ID NO: 70862 - DNA, 22 bp, Artificial sequence
  SiRNA target sequence
taatagtaacagattatggaga

SEQ ID NO: 70863 - DNA, 22 bp, Artificial sequence
  SiRNA target sequence
aatagtaacagattatggagag

SEQ ID NO: 70864 - DNA, 22 bp, Artificial sequence
  SiRNA target sequence
atagtaacagattatggagagc

SEQ ID NO: 70865 - DNA, 22 bp, Artificial sequence
  SiRNA target sequence
tagtaacagattatggagagca

SEQ ID NO: 70866 - DNA, 22 bp, Artificial sequence
  SiRNA target sequence
agtaacagattatggagagcac

SEQ ID NO: 70867 - DNA, 22 bp, Artificial sequence
  SiRNA target sequence
gtaacagattatggagagcact

SEQ ID NO: 70868 - DNA, 22 bp, Artificial sequence
  SiRNA target sequence
taacagattatggagagcactg

SEQ ID NO: 70869 - DNA, 22 bp, Artificial sequence
  SiRNA target sequence
aacagattatggagagcactgt

SEQ ID NO: 70870 - DNA, 22 bp, Artificial sequence
  SiRNA target sequence
acagattatggagagcactgta

SEQ ID NO: 70871 - DNA, 22 bp, Artificial sequence
  SiRNA target sequence
cagattatggagagcactgtac

SEQ ID NO: 70872 - DNA, 22 bp, Artificial sequence
  SiRNA target sequence
agattatggagagcactgtaca

SEQ ID NO: 70873 - DNA, 22 bp, Artificial sequence
  SiRNA target sequence
gattatggagagcactgtacat

SEQ ID NO: 70874 - DNA, 22 bp, Artificial sequence
  SiRNA target sequence
attatggagagcactgtacatt

SEQ ID NO: 70875 - DNA, 22 bp, Artificial sequence
  SiRNA target sequence
ttatggagagcactgtacattt

SEQ ID NO: 70876 - DNA, 22 bp, Artificial sequence
  SiRNA target sequence
tatggagagcactgtacatttt

SEQ ID NO: 70877 - DNA, 22 bp, Artificial sequence
  SiRNA target sequence
atggagagcactgtacatttta

SEQ ID NO: 70878 - DNA, 22 bp, Artificial sequence
  SiRNA target sequence
tggagagcactgtacattttaa

SEQ ID NO: 70879 - DNA, 22 bp, Artificial sequence
  SiRNA target sequence
ggagagcactgtacattttaaa

SEQ ID NO: 70880 - DNA, 22 bp, Artificial sequence
  SiRNA target sequence
gagagcactgtacattttaaat

SEQ ID NO: 70881 - DNA, 22 bp, Artificial sequence
  SiRNA target sequence
agagcactgtacattttaaatt

SEQ ID NO: 70882 - DNA, 22 bp, Artificial sequence
  SiRNA target sequence
gagcactgtacattttaaattt

SEQ ID NO: 70883 - DNA, 22 bp, Artificial sequence
  SiRNA target sequence
agcactgtacattttaaattta

SEQ ID NO: 70884 - DNA, 22 bp, Artificial sequence
  SiRNA target sequence
gcactgtacattttaaatttat

SEQ ID NO: 70885 - DNA, 22 bp, Artificial sequence
  SiRNA target sequence
cactgtacattttaaatttatc

SEQ ID NO: 70886 - DNA, 22 bp, Artificial sequence
  SiRNA target sequence
actgtacattttaaatttatct

SEQ ID NO: 70887 - DNA, 22 bp, Artificial sequence
  SiRNA target sequence
ctgtacattttaaatttatctc

SEQ ID NO: 70888 - DNA, 22 bp, Artificial sequence
  SiRNA target sequence
tgtacattttaaatttatctca

SEQ ID NO: 70889 - DNA, 22 bp, Artificial sequence
  SiRNA target sequence
gtacattttaaatttatctcag

SEQ ID NO: 70890 - DNA, 22 bp, Artificial sequence
  SiRNA target sequence
tacattttaaatttatctcaga

SEQ ID NO: 70891 - DNA, 22 bp, Artificial sequence
  SiRNA target sequence
acattttaaatttatctcagag

SEQ ID NO: 70892 - DNA, 22 bp, Artificial sequence
  SiRNA target sequence
cattttaaatttatctcagaga

SEQ ID NO: 70893 - DNA, 22 bp, Artificial sequence
  SiRNA target sequence
attttaaatttatctcagagag

SEQ ID NO: 70894 - DNA, 22 bp, Artificial sequence
  SiRNA target sequence
ttttaaatttatctcagagagc

SEQ ID NO: 70895 - DNA, 22 bp, Artificial sequence
  SiRNA target sequence
tttaaatttatctcagagagca

SEQ ID NO: 70896 - DNA, 22 bp, Artificial sequence
  SiRNA target sequence
ttaaatttatctcagagagcaa

SEQ ID NO: 70897 - DNA, 22 bp, Artificial sequence
  SiRNA target sequence
taaatttatctcagagagcaat

SEQ ID NO: 70898 - DNA, 22 bp, Artificial sequence
  SiRNA target sequence
aaatttatctcagagagcaatt

SEQ ID NO: 70899 - DNA, 22 bp, Artificial sequence
  SiRNA target sequence
aatttatctcagagagcaattt

SEQ ID NO: 70900 - DNA, 22 bp, Artificial sequence
  SiRNA target sequence
atttatctcagagagcaatttt

SEQ ID NO: 70901 - DNA, 22 bp, Artificial sequence
  SiRNA target sequence
tttatctcagagagcaattttt

SEQ ID NO: 70902 - DNA, 22 bp, Artificial sequence
  SiRNA target sequence
ttatctcagagagcaatttttc

SEQ ID NO: 70903 - DNA, 22 bp, Artificial sequence
  SiRNA target sequence
tatctcagagagcaatttttct

SEQ ID NO: 70904 - DNA, 22 bp, Artificial sequence
  SiRNA target sequence
atctcagagagcaatttttctc

SEQ ID NO: 70905 - DNA, 22 bp, Artificial sequence
  SiRNA target sequence
tctcagagagcaatttttctct

SEQ ID NO: 70906 - DNA, 22 bp, Artificial sequence
  SiRNA target sequence
ctcagagagcaatttttctctt

SEQ ID NO: 70907 - DNA, 22 bp, Artificial sequence
  SiRNA target sequence
tcagagagcaatttttctctta

SEQ ID NO: 70908 - DNA, 22 bp, Artificial sequence
  SiRNA target sequence
cagagagcaatttttctcttac

SEQ ID NO: 70909 - DNA, 22 bp, Artificial sequence
  SiRNA target sequence
agagagcaatttttctcttaca

SEQ ID NO: 70910 - DNA, 22 bp, Artificial sequence
  SiRNA target sequence
gagagcaatttttctcttacaa

SEQ ID NO: 70911 - DNA, 22 bp, Artificial sequence
  SiRNA target sequence
agagcaatttttctcttacaaa

SEQ ID NO: 70912 - DNA, 22 bp, Artificial sequence
  SiRNA target sequence
gagcaatttttctcttacaaag

SEQ ID NO: 70913 - DNA, 22 bp, Artificial sequence
  SiRNA target sequence
agcaatttttctcttacaaagt

SEQ ID NO: 70914 - DNA, 22 bp, Artificial sequence
  SiRNA target sequence
gcaatttttctcttacaaagtt

SEQ ID NO: 70915 - DNA, 22 bp, Artificial sequence
  SiRNA target sequence
caatttttctcttacaaagttt

SEQ ID NO: 70916 - DNA, 22 bp, Artificial sequence
  SiRNA target sequence
aatttttctcttacaaagtttt

SEQ ID NO: 70917 - DNA, 22 bp, Artificial sequence
  SiRNA target sequence
atttttctcttacaaagttttt

SEQ ID NO: 70918 - DNA, 22 bp, Artificial sequence
  SiRNA target sequence
tttttctcttacaaagtttttt

SEQ ID NO: 70919 - DNA, 22 bp, Artificial sequence
  SiRNA target sequence
ttttctcttacaaagttttttt

SEQ ID NO: 70920 - DNA, 22 bp, Artificial sequence
  SiRNA target sequence
tttctcttacaaagttttttta

SEQ ID NO: 70921 - DNA, 22 bp, Artificial sequence
  SiRNA target sequence
ttctcttacaaagtttttttat

SEQ ID NO: 70922 - DNA, 22 bp, Artificial sequence
  SiRNA target sequence
tctcttacaaagtttttttatt

SEQ ID NO: 70923 - DNA, 22 bp, Artificial sequence
  SiRNA target sequence
ctcttacaaagtttttttatta

SEQ ID NO: 70924 - DNA, 22 bp, Artificial sequence
  SiRNA target sequence
tcttacaaagtttttttattat

SEQ ID NO: 70925 - DNA, 22 bp, Artificial sequence
  SiRNA target sequence
cttacaaagtttttttattatt

SEQ ID NO: 70926 - DNA, 22 bp, Artificial sequence
  SiRNA target sequence
ttacaaagtttttttattattt

SEQ ID NO: 70927 - DNA, 22 bp, Artificial sequence
  SiRNA target sequence
tacaaagtttttttattattta

SEQ ID NO: 70928 - DNA, 22 bp, Artificial sequence
  SiRNA target sequence
acaaagtttttttattatttat

SEQ ID NO: 70929 - DNA, 22 bp, Artificial sequence
  SiRNA target sequence
caaagtttttttattatttatg

SEQ ID NO: 70930 - DNA, 22 bp, Artificial sequence
  SiRNA target sequence
aaagtttttttattatttatgc

SEQ ID NO: 70931 - DNA, 22 bp, Artificial sequence
  SiRNA target sequence
aagtttttttattatttatgca

SEQ ID NO: 70932 - DNA, 22 bp, Artificial sequence
  SiRNA target sequence
agtttttttattatttatgcag

SEQ ID NO: 70933 - DNA, 22 bp, Artificial sequence
  SiRNA target sequence
gtttttttattatttatgcagg

SEQ ID NO: 70934 - DNA, 22 bp, Artificial sequence
  SiRNA target sequence
tttttttattatttatgcagga

SEQ ID NO: 70935 - DNA, 22 bp, Artificial sequence
  SiRNA target sequence
ttttttattatttatgcaggaa

SEQ ID NO: 70936 - DNA, 22 bp, Artificial sequence
  SiRNA target sequence
tttttattatttatgcaggaat

SEQ ID NO: 70937 - DNA, 22 bp, Artificial sequence
  SiRNA target sequence
ttttattatttatgcaggaata

SEQ ID NO: 70938 - DNA, 22 bp, Artificial sequence
  SiRNA target sequence
tttattatttatgcaggaatat

SEQ ID NO: 70939 - DNA, 22 bp, Artificial sequence
  SiRNA target sequence
ttattatttatgcaggaatatc

SEQ ID NO: 70940 - DNA, 22 bp, Artificial sequence
  SiRNA target sequence
tattatttatgcaggaatatca

SEQ ID NO: 70941 - DNA, 22 bp, Artificial sequence
  SiRNA target sequence
attatttatgcaggaatatcag

SEQ ID NO: 70942 - DNA, 22 bp, Artificial sequence
  SiRNA target sequence
ttatttatgcaggaatatcagg

SEQ ID NO: 70943 - DNA, 22 bp, Artificial sequence
  SiRNA target sequence
tatttatgcaggaatatcagga

SEQ ID NO: 70944 - DNA, 22 bp, Artificial sequence
  SiRNA target sequence
atttatgcaggaatatcaggaa

SEQ ID NO: 70945 - DNA, 22 bp, Artificial sequence
  SiRNA target sequence
tttatgcaggaatatcaggaat

SEQ ID NO: 70946 - DNA, 22 bp, Artificial sequence
  SiRNA target sequence
ttatgcaggaatatcaggaata

SEQ ID NO: 70947 - DNA, 22 bp, Artificial sequence
  SiRNA target sequence
tatgcaggaatatcaggaatat

SEQ ID NO: 70948 - DNA, 22 bp, Artificial sequence
  SiRNA target sequence
atgcaggaatatcaggaatatt

SEQ ID NO: 70949 - DNA, 22 bp, Artificial sequence
  SiRNA target sequence
tgcaggaatatcaggaatatta

SEQ ID NO: 70950 - DNA, 22 bp, Artificial sequence
  SiRNA target sequence
gcaggaatatcaggaatattat

SEQ ID NO: 70951 - DNA, 22 bp, Artificial sequence
  SiRNA target sequence
caggaatatcaggaatattatc

SEQ ID NO: 70952 - DNA, 22 bp, Artificial sequence
  SiRNA target sequence
aggaatatcaggaatattatct

SEQ ID NO: 70953 - DNA, 22 bp, Artificial sequence
  SiRNA target sequence
ggaatatcaggaatattatctc

SEQ ID NO: 70954 - DNA, 22 bp, Artificial sequence
  SiRNA target sequence
gaatatcaggaatattatctca

SEQ ID NO: 70955 - DNA, 22 bp, Artificial sequence
  SiRNA target sequence
aatatcaggaatattatctcaa

SEQ ID NO: 70956 - DNA, 22 bp, Artificial sequence
  SiRNA target sequence
atatcaggaatattatctcaaa

SEQ ID NO: 70957 - DNA, 22 bp, Artificial sequence
  SiRNA target sequence
tatcaggaatattatctcaaaa

SEQ ID NO: 70958 - DNA, 22 bp, Artificial sequence
  SiRNA target sequence
atcaggaatattatctcaaaat

SEQ ID NO: 70959 - DNA, 22 bp, Artificial sequence
  SiRNA target sequence
tcaggaatattatctcaaaata

SEQ ID NO: 70960 - DNA, 22 bp, Artificial sequence
  SiRNA target sequence
caggaatattatctcaaaatat

SEQ ID NO: 70961 - DNA, 22 bp, Artificial sequence
  SiRNA target sequence
aggaatattatctcaaaatatg

SEQ ID NO: 70962 - DNA, 22 bp, Artificial sequence
  SiRNA target sequence
ggaatattatctcaaaatatgt

SEQ ID NO: 70963 - DNA, 22 bp, Artificial sequence
  SiRNA target sequence
gaatattatctcaaaatatgtc

SEQ ID NO: 70964 - DNA, 22 bp, Artificial sequence
  SiRNA target sequence
aatattatctcaaaatatgtca

SEQ ID NO: 70965 - DNA, 22 bp, Artificial sequence
  SiRNA target sequence
atattatctcaaaatatgtcat

SEQ ID NO: 70966 - DNA, 22 bp, Artificial sequence
  SiRNA target sequence
tattatctcaaaatatgtcatc

SEQ ID NO: 70967 - DNA, 22 bp, Artificial sequence
  SiRNA target sequence
attatctcaaaatatgtcatct

SEQ ID NO: 70968 - DNA, 22 bp, Artificial sequence
  SiRNA target sequence
ttatctcaaaatatgtcatcta

SEQ ID NO: 70969 - DNA, 22 bp, Artificial sequence
  SiRNA target sequence
tatctcaaaatatgtcatctaa

SEQ ID NO: 70970 - DNA, 22 bp, Artificial sequence
  SiRNA target sequence
atctcaaaatatgtcatctaac

SEQ ID NO: 70971 - DNA, 22 bp, Artificial sequence
  SiRNA target sequence
tctcaaaatatgtcatctaacc

SEQ ID NO: 70972 - DNA, 22 bp, Artificial sequence
  SiRNA target sequence
ctcaaaatatgtcatctaacca

SEQ ID NO: 70973 - DNA, 22 bp, Artificial sequence
  SiRNA target sequence
tcaaaatatgtcatctaaccaa

SEQ ID NO: 70974 - DNA, 22 bp, Artificial sequence
  SiRNA target sequence
caaaatatgtcatctaaccaac

SEQ ID NO: 70975 - DNA, 22 bp, Artificial sequence
  SiRNA target sequence
aaaatatgtcatctaaccaact

SEQ ID NO: 70976 - DNA, 22 bp, Artificial sequence
  SiRNA target sequence
aaatatgtcatctaaccaactc

SEQ ID NO: 70977 - DNA, 22 bp, Artificial sequence
  SiRNA target sequence
aatatgtcatctaaccaactca

SEQ ID NO: 70978 - DNA, 22 bp, Artificial sequence
  SiRNA target sequence
atatgtcatctaaccaactcat

SEQ ID NO: 70979 - DNA, 22 bp, Artificial sequence
  SiRNA target sequence
tatgtcatctaaccaactcatt

SEQ ID NO: 70980 - DNA, 22 bp, Artificial sequence
  SiRNA target sequence
atgtcatctaaccaactcattt

SEQ ID NO: 70981 - DNA, 22 bp, Artificial sequence
  SiRNA target sequence
tgtcatctaaccaactcattta

SEQ ID NO: 70982 - DNA, 22 bp, Artificial sequence
  SiRNA target sequence
gtcatctaaccaactcatttat

SEQ ID NO: 70983 - DNA, 22 bp, Artificial sequence
  SiRNA target sequence
tcatctaaccaactcatttatt

SEQ ID NO: 70984 - DNA, 22 bp, Artificial sequence
  SiRNA target sequence
catctaaccaactcatttattt

SEQ ID NO: 70985 - DNA, 22 bp, Artificial sequence
  SiRNA target sequence
atctaaccaactcatttattta

SEQ ID NO: 70986 - DNA, 22 bp, Artificial sequence
  SiRNA target sequence
tctaaccaactcatttatttaa

SEQ ID NO: 70987 - DNA, 22 bp, Artificial sequence
  SiRNA target sequence
ctaaccaactcatttatttaat

SEQ ID NO: 70988 - DNA, 22 bp, Artificial sequence
  SiRNA target sequence
taaccaactcatttatttaatg

SEQ ID NO: 70989 - DNA, 22 bp, Artificial sequence
  SiRNA target sequence
aaccaactcatttatttaatgt

SEQ ID NO: 70990 - DNA, 22 bp, Artificial sequence
  SiRNA target sequence
accaactcatttatttaatgtc

SEQ ID NO: 70991 - DNA, 22 bp, Artificial sequence
  SiRNA target sequence
ccaactcatttatttaatgtcc

SEQ ID NO: 70992 - DNA, 22 bp, Artificial sequence
  SiRNA target sequence
caactcatttatttaatgtcca

SEQ ID NO: 70993 - DNA, 22 bp, Artificial sequence
  SiRNA target sequence
aactcatttatttaatgtccat

SEQ ID NO: 70994 - DNA, 22 bp, Artificial sequence
  SiRNA target sequence
actcatttatttaatgtccatt

SEQ ID NO: 70995 - DNA, 22 bp, Artificial sequence
  SiRNA target sequence
ctcatttatttaatgtccatta

SEQ ID NO: 70996 - DNA, 22 bp, Artificial sequence
  SiRNA target sequence
tcatttatttaatgtccattac

SEQ ID NO: 70997 - DNA, 22 bp, Artificial sequence
  SiRNA target sequence
catttatttaatgtccattaca

SEQ ID NO: 70998 - DNA, 22 bp, Artificial sequence
  SiRNA target sequence
atttatttaatgtccattacat

SEQ ID NO: 70999 - DNA, 22 bp, Artificial sequence
  SiRNA target sequence
tttatttaatgtccattacatc

SEQ ID NO: 71000 - DNA, 22 bp, Artificial sequence
  SiRNA target sequence
ttatttaatgtccattacatct

SEQ ID NO: 71001 - DNA, 22 bp, Artificial sequence
  SiRNA target sequence
tatttaatgtccattacatcta

SEQ ID NO: 71002 - DNA, 22 bp, Artificial sequence
  SiRNA target sequence
atttaatgtccattacatctac

SEQ ID NO: 71003 - DNA, 22 bp, Artificial sequence
  SiRNA target sequence
tttaatgtccattacatctacg

SEQ ID NO: 71004 - DNA, 22 bp, Artificial sequence
  SiRNA target sequence
ttaatgtccattacatctacgg

SEQ ID NO: 71005 - DNA, 22 bp, Artificial sequence
  SiRNA target sequence
taatgtccattacatctacggt

SEQ ID NO: 71006 - DNA, 22 bp, Artificial sequence
  SiRNA target sequence
aatgtccattacatctacggtt

SEQ ID NO: 71007 - DNA, 22 bp, Artificial sequence
  SiRNA target sequence
atgtccattacatctacggtta

SEQ ID NO: 71008 - DNA, 22 bp, Artificial sequence
  SiRNA target sequence
tgtccattacatctacggttac

SEQ ID NO: 71009 - DNA, 22 bp, Artificial sequence
  SiRNA target sequence
gtccattacatctacggttact

SEQ ID NO: 71010 - DNA, 22 bp, Artificial sequence
  SiRNA target sequence
tccattacatctacggttacta

SEQ ID NO: 71011 - DNA, 22 bp, Artificial sequence
  SiRNA target sequence
ccattacatctacggttactat

SEQ ID NO: 71012 - DNA, 22 bp, Artificial sequence
  SiRNA target sequence
cattacatctacggttactatt

SEQ ID NO: 71013 - DNA, 22 bp, Artificial sequence
  SiRNA target sequence
attacatctacggttactatta

SEQ ID NO: 71014 - DNA, 22 bp, Artificial sequence
  SiRNA target sequence
ttacatctacggttactattaa

SEQ ID NO: 71015 - DNA, 22 bp, Artificial sequence
  SiRNA target sequence
tacatctacggttactattaat

SEQ ID NO: 71016 - DNA, 22 bp, Artificial sequence
  SiRNA target sequence
acatctacggttactattaatt

SEQ ID NO: 71017 - DNA, 22 bp, Artificial sequence
  SiRNA target sequence
catctacggttactattaattt

SEQ ID NO: 71018 - DNA, 22 bp, Artificial sequence
  SiRNA target sequence
atctacggttactattaattta

SEQ ID NO: 71019 - DNA, 22 bp, Artificial sequence
  SiRNA target sequence
tctacggttactattaatttaa

SEQ ID NO: 71020 - DNA, 22 bp, Artificial sequence
  SiRNA target sequence
ctacggttactattaatttaag

SEQ ID NO: 71021 - DNA, 22 bp, Artificial sequence
  SiRNA target sequence
tacggttactattaatttaagt

SEQ ID NO: 71022 - DNA, 22 bp, Artificial sequence
  SiRNA target sequence
acggttactattaatttaagta

SEQ ID NO: 71023 - DNA, 22 bp, Artificial sequence
  SiRNA target sequence
cggttactattaatttaagtaa

SEQ ID NO: 71024 - DNA, 22 bp, Artificial sequence
  SiRNA target sequence
ggttactattaatttaagtaac

SEQ ID NO: 71025 - DNA, 22 bp, Artificial sequence
  SiRNA target sequence
gttactattaatttaagtaact

SEQ ID NO: 71026 - DNA, 22 bp, Artificial sequence
  SiRNA target sequence
ttactattaatttaagtaactt

SEQ ID NO: 71027 - DNA, 22 bp, Artificial sequence
  SiRNA target sequence
tactattaatttaagtaacttg

SEQ ID NO: 71028 - DNA, 22 bp, Artificial sequence
  SiRNA target sequence
actattaatttaagtaacttgg

SEQ ID NO: 71029 - DNA, 22 bp, Artificial sequence
  SiRNA target sequence
ctattaatttaagtaacttggg

SEQ ID NO: 71030 - DNA, 22 bp, Artificial sequence
  SiRNA target sequence
tattaatttaagtaacttgggt

SEQ ID NO: 71031 - DNA, 22 bp, Artificial sequence
  SiRNA target sequence
attaatttaagtaacttgggtt

SEQ ID NO: 71032 - DNA, 22 bp, Artificial sequence
  SiRNA target sequence
ttaatttaagtaacttgggtta

SEQ ID NO: 71033 - DNA, 22 bp, Artificial sequence
  SiRNA target sequence
taatttaagtaacttgggttac

SEQ ID NO: 71034 - DNA, 22 bp, Artificial sequence
  SiRNA target sequence
aatttaagtaacttgggttact

SEQ ID NO: 71035 - DNA, 22 bp, Artificial sequence
  SiRNA target sequence
atttaagtaacttgggttactt

SEQ ID NO: 71036 - DNA, 22 bp, Artificial sequence
  SiRNA target sequence
tttaagtaacttgggttactta

SEQ ID NO: 71037 - DNA, 22 bp, Artificial sequence
  SiRNA target sequence
ttaagtaacttgggttacttat

SEQ ID NO: 71038 - DNA, 22 bp, Artificial sequence
  SiRNA target sequence
taagtaacttgggttacttata

SEQ ID NO: 71039 - DNA, 22 bp, Artificial sequence
  SiRNA target sequence
aagtaacttgggttacttatac

SEQ ID NO: 71040 - DNA, 22 bp, Artificial sequence
  SiRNA target sequence
agtaacttgggttacttataca

SEQ ID NO: 71041 - DNA, 22 bp, Artificial sequence
  SiRNA target sequence
gtaacttgggttacttatacac

SEQ ID NO: 71042 - DNA, 22 bp, Artificial sequence
  SiRNA target sequence
taacttgggttacttatacact

SEQ ID NO: 71043 - DNA, 22 bp, Artificial sequence
  SiRNA target sequence
aacttgggttacttatacacta

SEQ ID NO: 71044 - DNA, 22 bp, Artificial sequence
  SiRNA target sequence
acttgggttacttatacactag

SEQ ID NO: 71045 - DNA, 22 bp, Artificial sequence
  SiRNA target sequence
cttgggttacttatacactaga

SEQ ID NO: 71046 - DNA, 22 bp, Artificial sequence
  SiRNA target sequence
ttgggttacttatacactagat

SEQ ID NO: 71047 - DNA, 22 bp, Artificial sequence
  SiRNA target sequence
tgggttacttatacactagata

SEQ ID NO: 71048 - DNA, 22 bp, Artificial sequence
  SiRNA target sequence
gggttacttatacactagatat

SEQ ID NO: 71049 - DNA, 22 bp, Artificial sequence
  SiRNA target sequence
ggttacttatacactagatata

SEQ ID NO: 71050 - DNA, 22 bp, Artificial sequence
  SiRNA target sequence
gttacttatacactagatatac

SEQ ID NO: 71051 - DNA, 22 bp, Artificial sequence
  SiRNA target sequence
ttacttatacactagatataca

SEQ ID NO: 71052 - DNA, 22 bp, Artificial sequence
  SiRNA target sequence
tacttatacactagatatacac

SEQ ID NO: 71053 - DNA, 22 bp, Artificial sequence
  SiRNA target sequence
acttatacactagatatacaca

SEQ ID NO: 71054 - DNA, 22 bp, Artificial sequence
  SiRNA target sequence
cttatacactagatatacacaa

SEQ ID NO: 71055 - DNA, 22 bp, Artificial sequence
  SiRNA target sequence
ttatacactagatatacacaag

SEQ ID NO: 71056 - DNA, 22 bp, Artificial sequence
  SiRNA target sequence
tatacactagatatacacaagc

SEQ ID NO: 71057 - DNA, 22 bp, Artificial sequence
  SiRNA target sequence
atacactagatatacacaagca

SEQ ID NO: 71058 - DNA, 22 bp, Artificial sequence
  SiRNA target sequence
tacactagatatacacaagcaa

SEQ ID NO: 71059 - DNA, 22 bp, Artificial sequence
  SiRNA target sequence
acactagatatacacaagcaat

SEQ ID NO: 71060 - DNA, 22 bp, Artificial sequence
  SiRNA target sequence
cactagatatacacaagcaata

SEQ ID NO: 71061 - DNA, 22 bp, Artificial sequence
  SiRNA target sequence
actagatatacacaagcaataa

SEQ ID NO: 71062 - DNA, 22 bp, Artificial sequence
  SiRNA target sequence
ctagatatacacaagcaataat

SEQ ID NO: 71063 - DNA, 22 bp, Artificial sequence
  SiRNA target sequence
tagatatacacaagcaataatt

SEQ ID NO: 71064 - DNA, 22 bp, Artificial sequence
  SiRNA target sequence
agatatacacaagcaataatta

SEQ ID NO: 71065 - DNA, 22 bp, Artificial sequence
  SiRNA target sequence
gatatacacaagcaataattaa

SEQ ID NO: 71066 - DNA, 22 bp, Artificial sequence
  SiRNA target sequence
atatacacaagcaataattaat

SEQ ID NO: 71067 - DNA, 22 bp, Artificial sequence
  SiRNA target sequence
tatacacaagcaataattaatg

SEQ ID NO: 71068 - DNA, 22 bp, Artificial sequence
  SiRNA target sequence
atacacaagcaataattaatgc

SEQ ID NO: 71069 - DNA, 22 bp, Artificial sequence
  SiRNA target sequence
tacacaagcaataattaatgca

SEQ ID NO: 71070 - DNA, 22 bp, Artificial sequence
  SiRNA target sequence
acacaagcaataattaatgcaa

SEQ ID NO: 71071 - DNA, 22 bp, Artificial sequence
  SiRNA target sequence
cacaagcaataattaatgcaag

SEQ ID NO: 71072 - DNA, 22 bp, Artificial sequence
  SiRNA target sequence
acaagcaataattaatgcaaga

SEQ ID NO: 71073 - DNA, 22 bp, Artificial sequence
  SiRNA target sequence
caagcaataattaatgcaagat

SEQ ID NO: 71074 - DNA, 22 bp, Artificial sequence
  SiRNA target sequence
aagcaataattaatgcaagatc

SEQ ID NO: 71075 - DNA, 22 bp, Artificial sequence
  SiRNA target sequence
agcaataattaatgcaagatct

SEQ ID NO: 71076 - DNA, 22 bp, Artificial sequence
  SiRNA target sequence
gcaataattaatgcaagatcta

SEQ ID NO: 71077 - DNA, 22 bp, Artificial sequence
  SiRNA target sequence
caataattaatgcaagatctac

SEQ ID NO: 71078 - DNA, 22 bp, Artificial sequence
  SiRNA target sequence
aataattaatgcaagatctact

SEQ ID NO: 71079 - DNA, 22 bp, Artificial sequence
  SiRNA target sequence
ataattaatgcaagatctactt

SEQ ID NO: 71080 - DNA, 22 bp, Artificial sequence
  SiRNA target sequence
taattaatgcaagatctactta

SEQ ID NO: 71081 - DNA, 22 bp, Artificial sequence
  SiRNA target sequence
aattaatgcaagatctacttat

SEQ ID NO: 71082 - DNA, 22 bp, Artificial sequence
  SiRNA target sequence
attaatgcaagatctacttatg

SEQ ID NO: 71083 - DNA, 22 bp, Artificial sequence
  SiRNA target sequence
ttaatgcaagatctacttatga

SEQ ID NO: 71084 - DNA, 22 bp, Artificial sequence
  SiRNA target sequence
taatgcaagatctacttatgat

SEQ ID NO: 71085 - DNA, 22 bp, Artificial sequence
  SiRNA target sequence
aatgcaagatctacttatgata

SEQ ID NO: 71086 - DNA, 22 bp, Artificial sequence
  SiRNA target sequence
atgcaagatctacttatgatac

SEQ ID NO: 71087 - DNA, 22 bp, Artificial sequence
  SiRNA target sequence
tgcaagatctacttatgataca

SEQ ID NO: 71088 - DNA, 22 bp, Artificial sequence
  SiRNA target sequence
gcaagatctacttatgatacaa

SEQ ID NO: 71089 - DNA, 22 bp, Artificial sequence
  SiRNA target sequence
caagatctacttatgatacaat

SEQ ID NO: 71090 - DNA, 22 bp, Artificial sequence
  SiRNA target sequence
aagatctacttatgatacaatg

SEQ ID NO: 71091 - DNA, 22 bp, Artificial sequence
  SiRNA target sequence
agatctacttatgatacaatgt

SEQ ID NO: 71092 - DNA, 22 bp, Artificial sequence
  SiRNA target sequence
gatctacttatgatacaatgtt

SEQ ID NO: 71093 - DNA, 22 bp, Artificial sequence
  SiRNA target sequence
atctacttatgatacaatgtta

SEQ ID NO: 71094 - DNA, 22 bp, Artificial sequence
  SiRNA target sequence
tctacttatgatacaatgttag

SEQ ID NO: 71095 - DNA, 22 bp, Artificial sequence
  SiRNA target sequence
ctacttatgatacaatgttaga

SEQ ID NO: 71096 - DNA, 22 bp, Artificial sequence
  SiRNA target sequence
tacttatgatacaatgttagat

SEQ ID NO: 71097 - DNA, 22 bp, Artificial sequence
  SiRNA target sequence
acttatgatacaatgttagata

SEQ ID NO: 71098 - DNA, 22 bp, Artificial sequence
  SiRNA target sequence
cttatgatacaatgttagatat

SEQ ID NO: 71099 - DNA, 22 bp, Artificial sequence
  SiRNA target sequence
ttatgatacaatgttagatata

SEQ ID NO: 71100 - DNA, 22 bp, Artificial sequence
  SiRNA target sequence
tatgatacaatgttagatataa

SEQ ID NO: 71101 - DNA, 22 bp, Artificial sequence
  SiRNA target sequence
atgatacaatgttagatataaa

SEQ ID NO: 71102 - DNA, 22 bp, Artificial sequence
  SiRNA target sequence
tgatacaatgttagatataaaa

SEQ ID NO: 71103 - DNA, 22 bp, Artificial sequence
  SiRNA target sequence
gatacaatgttagatataaaaa

SEQ ID NO: 71104 - DNA, 22 bp, Artificial sequence
  SiRNA target sequence
atacaatgttagatataaaaaa

SEQ ID NO: 71105 - DNA, 22 bp, Artificial sequence
  SiRNA target sequence
tacaatgttagatataaaaaaa

SEQ ID NO: 71106 - DNA, 22 bp, Artificial sequence
  SiRNA target sequence
acaatgttagatataaaaaaag

SEQ ID NO: 71107 - DNA, 22 bp, Artificial sequence
  SiRNA target sequence
caatgttagatataaaaaaaga

SEQ ID NO: 71108 - DNA, 22 bp, Artificial sequence
  SiRNA target sequence
aatgttagatataaaaaaagag

SEQ ID NO: 71109 - DNA, 22 bp, Artificial sequence
  SiRNA target sequence
atgttagatataaaaaaagaga

SEQ ID NO: 71110 - DNA, 22 bp, Artificial sequence
  SiRNA target sequence
tgttagatataaaaaaagagaa

SEQ ID NO: 71111 - DNA, 22 bp, Artificial sequence
  SiRNA target sequence
gttagatataaaaaaagagaat

SEQ ID NO: 71112 - DNA, 22 bp, Artificial sequence
  SiRNA target sequence
ttagatataaaaaaagagaata

SEQ ID NO: 71113 - DNA, 22 bp, Artificial sequence
  SiRNA target sequence
tagatataaaaaaagagaataa

SEQ ID NO: 71114 - DNA, 22 bp, Artificial sequence
  SiRNA target sequence
agatataaaaaaagagaataat

SEQ ID NO: 71115 - DNA, 22 bp, Artificial sequence
  SiRNA target sequence
gatataaaaaaagagaataata

SEQ ID NO: 71116 - DNA, 22 bp, Artificial sequence
  SiRNA target sequence
atataaaaaaagagaataataa

SEQ ID NO: 71117 - DNA, 22 bp, Artificial sequence
  SiRNA target sequence
tataaaaaaagagaataataag

SEQ ID NO: 71118 - DNA, 22 bp, Artificial sequence
  SiRNA target sequence
ataaaaaaagagaataataagt

SEQ ID NO: 71119 - DNA, 22 bp, Artificial sequence
  SiRNA target sequence
taaaaaaagagaataataagtt

SEQ ID NO: 71120 - DNA, 22 bp, Artificial sequence
  SiRNA target sequence
aaaaaaagagaataataagttt

SEQ ID NO: 71121 - DNA, 22 bp, Artificial sequence
  SiRNA target sequence
aaaaaagagaataataagttta

SEQ ID NO: 71122 - DNA, 22 bp, Artificial sequence
  SiRNA target sequence
aaaaagagaataataagtttaa

SEQ ID NO: 71123 - DNA, 22 bp, Artificial sequence
  SiRNA target sequence
aaaagagaataataagtttaag

SEQ ID NO: 71124 - DNA, 22 bp, Artificial sequence
  SiRNA target sequence
aaagagaataataagtttaaga

SEQ ID NO: 71125 - DNA, 22 bp, Artificial sequence
  SiRNA target sequence
aagagaataataagtttaagat

SEQ ID NO: 71126 - DNA, 22 bp, Artificial sequence
  SiRNA target sequence
agagaataataagtttaagatt

SEQ ID NO: 71127 - DNA, 22 bp, Artificial sequence
  SiRNA target sequence
gagaataataagtttaagatta

SEQ ID NO: 71128 - DNA, 22 bp, Artificial sequence
  SiRNA target sequence
agaataataagtttaagattac

SEQ ID NO: 71129 - DNA, 22 bp, Artificial sequence
  SiRNA target sequence
gaataataagtttaagattaca

SEQ ID NO: 71130 - DNA, 22 bp, Artificial sequence
  SiRNA target sequence
aataataagtttaagattacag

SEQ ID NO: 71131 - DNA, 22 bp, Artificial sequence
  SiRNA target sequence
ataataagtttaagattacaga

SEQ ID NO: 71132 - DNA, 22 bp, Artificial sequence
  SiRNA target sequence
taataagtttaagattacagaa

SEQ ID NO: 71133 - DNA, 22 bp, Artificial sequence
  SiRNA target sequence
aataagtttaagattacagaat

SEQ ID NO: 71134 - DNA, 22 bp, Artificial sequence
  SiRNA target sequence
ataagtttaagattacagaatt

SEQ ID NO: 71135 - DNA, 22 bp, Artificial sequence
  SiRNA target sequence
taagtttaagattacagaattt

SEQ ID NO: 71136 - DNA, 22 bp, Artificial sequence
  SiRNA target sequence
aagtttaagattacagaattta

SEQ ID NO: 71137 - DNA, 22 bp, Artificial sequence
  SiRNA target sequence
agtttaagattacagaatttaa

SEQ ID NO: 71138 - DNA, 22 bp, Artificial sequence
  SiRNA target sequence
gtttaagattacagaatttaaa

SEQ ID NO: 71139 - DNA, 22 bp, Artificial sequence
  SiRNA target sequence
tttaagattacagaatttaaag

SEQ ID NO: 71140 - DNA, 22 bp, Artificial sequence
  SiRNA target sequence
ttaagattacagaatttaaaga

SEQ ID NO: 71141 - DNA, 22 bp, Artificial sequence
  SiRNA target sequence
taagattacagaatttaaagaa

SEQ ID NO: 71142 - DNA, 22 bp, Artificial sequence
  SiRNA target sequence
aagattacagaatttaaagaaa

SEQ ID NO: 71143 - DNA, 22 bp, Artificial sequence
  SiRNA target sequence
agattacagaatttaaagaaag

SEQ ID NO: 71144 - DNA, 22 bp, Artificial sequence
  SiRNA target sequence
gattacagaatttaaagaaagt

SEQ ID NO: 71145 - DNA, 22 bp, Artificial sequence
  SiRNA target sequence
attacagaatttaaagaaagta

SEQ ID NO: 71146 - DNA, 22 bp, Artificial sequence
  SiRNA target sequence
ttacagaatttaaagaaagtat

SEQ ID NO: 71147 - DNA, 22 bp, Artificial sequence
  SiRNA target sequence
tacagaatttaaagaaagtatt

SEQ ID NO: 71148 - DNA, 22 bp, Artificial sequence
  SiRNA target sequence
acagaatttaaagaaagtatta

SEQ ID NO: 71149 - DNA, 22 bp, Artificial sequence
  SiRNA target sequence
cagaatttaaagaaagtattaa

SEQ ID NO: 71150 - DNA, 22 bp, Artificial sequence
  SiRNA target sequence
agaatttaaagaaagtattaag

SEQ ID NO: 71151 - DNA, 22 bp, Artificial sequence
  SiRNA target sequence
gaatttaaagaaagtattaagt

SEQ ID NO: 71152 - DNA, 22 bp, Artificial sequence
  SiRNA target sequence
aatttaaagaaagtattaagtt

SEQ ID NO: 71153 - DNA, 22 bp, Artificial sequence
  SiRNA target sequence
atttaaagaaagtattaagttt

SEQ ID NO: 71154 - DNA, 22 bp, Artificial sequence
  SiRNA target sequence
tttaaagaaagtattaagttta

SEQ ID NO: 71155 - DNA, 22 bp, Artificial sequence
  SiRNA target sequence
ttaaagaaagtattaagtttaa

SEQ ID NO: 71156 - DNA, 22 bp, Artificial sequence
  SiRNA target sequence
taaagaaagtattaagtttaat

SEQ ID NO: 71157 - DNA, 22 bp, Artificial sequence
  SiRNA target sequence
aaagaaagtattaagtttaata

SEQ ID NO: 71158 - DNA, 22 bp, Artificial sequence
  SiRNA target sequence
aagaaagtattaagtttaataa

SEQ ID NO: 71159 - DNA, 22 bp, Artificial sequence
  SiRNA target sequence
agaaagtattaagtttaataat

SEQ ID NO: 71160 - DNA, 22 bp, Artificial sequence
  SiRNA target sequence
gaaagtattaagtttaataatt

SEQ ID NO: 71161 - DNA, 22 bp, Artificial sequence
  SiRNA target sequence
aaagtattaagtttaataattt

SEQ ID NO: 71162 - DNA, 22 bp, Artificial sequence
  SiRNA target sequence
aagtattaagtttaataatttg

SEQ ID NO: 71163 - DNA, 22 bp, Artificial sequence
  SiRNA target sequence
agtattaagtttaataatttgt

SEQ ID NO: 71164 - DNA, 22 bp, Artificial sequence
  SiRNA target sequence
gtattaagtttaataatttgtc

SEQ ID NO: 71165 - DNA, 22 bp, Artificial sequence
  SiRNA target sequence
tattaagtttaataatttgtca

SEQ ID NO: 71166 - DNA, 22 bp, Artificial sequence
  SiRNA target sequence
attaagtttaataatttgtcat

SEQ ID NO: 71167 - DNA, 22 bp, Artificial sequence
  SiRNA target sequence
ttaagtttaataatttgtcatt

SEQ ID NO: 71168 - DNA, 22 bp, Artificial sequence
  SiRNA target sequence
taagtttaataatttgtcattt

SEQ ID NO: 71169 - DNA, 22 bp, Artificial sequence
  SiRNA target sequence
aagtttaataatttgtcatttg

SEQ ID NO: 71170 - DNA, 22 bp, Artificial sequence
  SiRNA target sequence
agtttaataatttgtcatttgg

SEQ ID NO: 71171 - DNA, 22 bp, Artificial sequence
  SiRNA target sequence
gtttaataatttgtcatttggt

SEQ ID NO: 71172 - DNA, 22 bp, Artificial sequence
  SiRNA target sequence
tttaataatttgtcatttggtt

SEQ ID NO: 71173 - DNA, 22 bp, Artificial sequence
  SiRNA target sequence
ttaataatttgtcatttggtta

SEQ ID NO: 71174 - DNA, 22 bp, Artificial sequence
  SiRNA target sequence
taataatttgtcatttggttat

SEQ ID NO: 71175 - DNA, 22 bp, Artificial sequence
  SiRNA target sequence
aataatttgtcatttggttatg

SEQ ID NO: 71176 - DNA, 22 bp, Artificial sequence
  SiRNA target sequence
ataatttgtcatttggttatga

SEQ ID NO: 71177 - DNA, 22 bp, Artificial sequence
  SiRNA target sequence
taatttgtcatttggttatgaa

SEQ ID NO: 71178 - DNA, 22 bp, Artificial sequence
  SiRNA target sequence
aatttgtcatttggttatgaaa

SEQ ID NO: 71179 - DNA, 22 bp, Artificial sequence
  SiRNA target sequence
atttgtcatttggttatgaaag

SEQ ID NO: 71180 - DNA, 22 bp, Artificial sequence
  SiRNA target sequence
tttgtcatttggttatgaaagt

SEQ ID NO: 71181 - DNA, 22 bp, Artificial sequence
  SiRNA target sequence
ttgtcatttggttatgaaagta

SEQ ID NO: 71182 - DNA, 22 bp, Artificial sequence
  SiRNA target sequence
tgtcatttggttatgaaagtag

SEQ ID NO: 71183 - DNA, 22 bp, Artificial sequence
  SiRNA target sequence
gtcatttggttatgaaagtaga

SEQ ID NO: 71184 - DNA, 22 bp, Artificial sequence
  SiRNA target sequence
tcatttggttatgaaagtagac

SEQ ID NO: 71185 - DNA, 22 bp, Artificial sequence
  SiRNA target sequence
catttggttatgaaagtagaca

SEQ ID NO: 71186 - DNA, 22 bp, Artificial sequence
  SiRNA target sequence
atttggttatgaaagtagacaa

SEQ ID NO: 71187 - DNA, 22 bp, Artificial sequence
  SiRNA target sequence
tttggttatgaaagtagacaaa

SEQ ID NO: 71188 - DNA, 22 bp, Artificial sequence
  SiRNA target sequence
ttggttatgaaagtagacaaat

SEQ ID NO: 71189 - DNA, 22 bp, Artificial sequence
  SiRNA target sequence
tggttatgaaagtagacaaatt

SEQ ID NO: 71190 - DNA, 22 bp, Artificial sequence
  SiRNA target sequence
ggttatgaaagtagacaaattt

SEQ ID NO: 71191 - DNA, 22 bp, Artificial sequence
  SiRNA target sequence
gttatgaaagtagacaaatttt

SEQ ID NO: 71192 - DNA, 22 bp, Artificial sequence
  SiRNA target sequence
ttatgaaagtagacaaattttt

SEQ ID NO: 71193 - DNA, 22 bp, Artificial sequence
  SiRNA target sequence
tatgaaagtagacaaattttta

SEQ ID NO: 71194 - DNA, 22 bp, Artificial sequence
  SiRNA target sequence
atgaaagtagacaaatttttaa

SEQ ID NO: 71195 - DNA, 22 bp, Artificial sequence
  SiRNA target sequence
tgaaagtagacaaatttttaat

SEQ ID NO: 71196 - DNA, 22 bp, Artificial sequence
  SiRNA target sequence
gaaagtagacaaatttttaata

SEQ ID NO: 71197 - DNA, 22 bp, Artificial sequence
  SiRNA target sequence
aaagtagacaaatttttaataa

SEQ ID NO: 71198 - DNA, 22 bp, Artificial sequence
  SiRNA target sequence
aagtagacaaatttttaataaa

SEQ ID NO: 71199 - DNA, 22 bp, Artificial sequence
  SiRNA target sequence
agtagacaaatttttaataaaa

SEQ ID NO: 71200 - DNA, 22 bp, Artificial sequence
  SiRNA target sequence
gtagacaaatttttaataaaat

SEQ ID NO: 71201 - DNA, 22 bp, Artificial sequence
  SiRNA target sequence
tagacaaatttttaataaaata

SEQ ID NO: 71202 - DNA, 22 bp, Artificial sequence
  SiRNA target sequence
agacaaatttttaataaaataa

SEQ ID NO: 71203 - DNA, 22 bp, Artificial sequence
  SiRNA target sequence
gacaaatttttaataaaataaa

SEQ ID NO: 71204 - DNA, 22 bp, Artificial sequence
  SiRNA target sequence
acaaatttttaataaaataaat

SEQ ID NO: 71205 - DNA, 22 bp, Artificial sequence
  SiRNA target sequence
caaatttttaataaaataaatc

SEQ ID NO: 71206 - DNA, 22 bp, Artificial sequence
  SiRNA target sequence
aaatttttaataaaataaatct

SEQ ID NO: 71207 - DNA, 22 bp, Artificial sequence
  SiRNA target sequence
aatttttaataaaataaatcta

SEQ ID NO: 71208 - DNA, 22 bp, Artificial sequence
  SiRNA target sequence
atttttaataaaataaatctag

SEQ ID NO: 71209 - DNA, 22 bp, Artificial sequence
  SiRNA target sequence
tttttaataaaataaatctaga

SEQ ID NO: 71210 - DNA, 22 bp, Artificial sequence
  SiRNA target sequence
ttttaataaaataaatctagaa

SEQ ID NO: 71211 - DNA, 22 bp, Artificial sequence
  SiRNA target sequence
tttaataaaataaatctagaaa

SEQ ID NO: 71212 - DNA, 22 bp, Artificial sequence
  SiRNA target sequence
ttaataaaataaatctagaaat

SEQ ID NO: 71213 - DNA, 22 bp, Artificial sequence
  SiRNA target sequence
taataaaataaatctagaaata

SEQ ID NO: 71214 - DNA, 22 bp, Artificial sequence
  SiRNA target sequence
aataaaataaatctagaaatat

SEQ ID NO: 71215 - DNA, 22 bp, Artificial sequence
  SiRNA target sequence
ataaaataaatctagaaatata

SEQ ID NO: 71216 - DNA, 22 bp, Artificial sequence
  SiRNA target sequence
taaaataaatctagaaatatac

SEQ ID NO: 71217 - DNA, 22 bp, Artificial sequence
  SiRNA target sequence
aaaataaatctagaaatataca

SEQ ID NO: 71218 - DNA, 22 bp, Artificial sequence
  SiRNA target sequence
aaataaatctagaaatatacaa

SEQ ID NO: 71219 - DNA, 22 bp, Artificial sequence
  SiRNA target sequence
aataaatctagaaatatacaaa

SEQ ID NO: 71220 - DNA, 22 bp, Artificial sequence
  SiRNA target sequence
ataaatctagaaatatacaaag

SEQ ID NO: 71221 - DNA, 22 bp, Artificial sequence
  SiRNA target sequence
taaatctagaaatatacaaagg

SEQ ID NO: 71222 - DNA, 22 bp, Artificial sequence
  SiRNA target sequence
aaatctagaaatatacaaagga

SEQ ID NO: 71223 - DNA, 22 bp, Artificial sequence
  SiRNA target sequence
aatctagaaatatacaaaggag

SEQ ID NO: 71224 - DNA, 22 bp, Artificial sequence
  SiRNA target sequence
atctagaaatatacaaaggaga

SEQ ID NO: 71225 - DNA, 22 bp, Artificial sequence
  SiRNA target sequence
tctagaaatatacaaaggagaa

SEQ ID NO: 71226 - DNA, 22 bp, Artificial sequence
  SiRNA target sequence
ctagaaatatacaaaggagaaa

SEQ ID NO: 71227 - DNA, 22 bp, Artificial sequence
  SiRNA target sequence
tagaaatatacaaaggagaaaa

SEQ ID NO: 71228 - DNA, 22 bp, Artificial sequence
  SiRNA target sequence
agaaatatacaaaggagaaaaa

SEQ ID NO: 71229 - DNA, 22 bp, Artificial sequence
  SiRNA target sequence
gaaatatacaaaggagaaaaag

SEQ ID NO: 71230 - DNA, 22 bp, Artificial sequence
  SiRNA target sequence
aaatatacaaaggagaaaaagt

SEQ ID NO: 71231 - DNA, 22 bp, Artificial sequence
  SiRNA target sequence
aatatacaaaggagaaaaagta

SEQ ID NO: 71232 - DNA, 22 bp, Artificial sequence
  SiRNA target sequence
atatacaaaggagaaaaagtag

SEQ ID NO: 71233 - DNA, 22 bp, Artificial sequence
  SiRNA target sequence
tatacaaaggagaaaaagtagc

SEQ ID NO: 71234 - DNA, 22 bp, Artificial sequence
  SiRNA target sequence
atacaaaggagaaaaagtagca

SEQ ID NO: 71235 - DNA, 22 bp, Artificial sequence
  SiRNA target sequence
tacaaaggagaaaaagtagcaa

SEQ ID NO: 71236 - DNA, 22 bp, Artificial sequence
  SiRNA target sequence
acaaaggagaaaaagtagcaat

SEQ ID NO: 71237 - DNA, 22 bp, Artificial sequence
  SiRNA target sequence
caaaggagaaaaagtagcaatt

SEQ ID NO: 71238 - DNA, 22 bp, Artificial sequence
  SiRNA target sequence
aaaggagaaaaagtagcaatta

SEQ ID NO: 71239 - DNA, 22 bp, Artificial sequence
  SiRNA target sequence
aaggagaaaaagtagcaattat

SEQ ID NO: 71240 - DNA, 22 bp, Artificial sequence
  SiRNA target sequence
aggagaaaaagtagcaattata

SEQ ID NO: 71241 - DNA, 22 bp, Artificial sequence
  SiRNA target sequence
ggagaaaaagtagcaattatag

SEQ ID NO: 71242 - DNA, 22 bp, Artificial sequence
  SiRNA target sequence
gagaaaaagtagcaattatagg

SEQ ID NO: 71243 - DNA, 22 bp, Artificial sequence
  SiRNA target sequence
agaaaaagtagcaattataggt

SEQ ID NO: 71244 - DNA, 22 bp, Artificial sequence
  SiRNA target sequence
gaaaaagtagcaattataggta

SEQ ID NO: 71245 - DNA, 22 bp, Artificial sequence
  SiRNA target sequence
aaaaagtagcaattataggtaa

SEQ ID NO: 71246 - DNA, 22 bp, Artificial sequence
  SiRNA target sequence
aaaagtagcaattataggtaaa

SEQ ID NO: 71247 - DNA, 22 bp, Artificial sequence
  SiRNA target sequence
aaagtagcaattataggtaaaa

SEQ ID NO: 71248 - DNA, 22 bp, Artificial sequence
  SiRNA target sequence
aagtagcaattataggtaaaaa

SEQ ID NO: 71249 - DNA, 22 bp, Artificial sequence
  SiRNA target sequence
agtagcaattataggtaaaaat

SEQ ID NO: 71250 - DNA, 22 bp, Artificial sequence
  SiRNA target sequence
gtagcaattataggtaaaaatg

SEQ ID NO: 71251 - DNA, 22 bp, Artificial sequence
  SiRNA target sequence
tagcaattataggtaaaaatgg

SEQ ID NO: 71252 - DNA, 22 bp, Artificial sequence
  SiRNA target sequence
agcaattataggtaaaaatggt

SEQ ID NO: 71253 - DNA, 22 bp, Artificial sequence
  SiRNA target sequence
gcaattataggtaaaaatggta

SEQ ID NO: 71254 - DNA, 22 bp, Artificial sequence
  SiRNA target sequence
caattataggtaaaaatggtag

SEQ ID NO: 71255 - DNA, 22 bp, Artificial sequence
  SiRNA target sequence
aattataggtaaaaatggtagt

SEQ ID NO: 71256 - DNA, 22 bp, Artificial sequence
  SiRNA target sequence
attataggtaaaaatggtagtg

SEQ ID NO: 71257 - DNA, 22 bp, Artificial sequence
  SiRNA target sequence
ttataggtaaaaatggtagtgg

SEQ ID NO: 71258 - DNA, 22 bp, Artificial sequence
  SiRNA target sequence
tataggtaaaaatggtagtggt

SEQ ID NO: 71259 - DNA, 22 bp, Artificial sequence
  SiRNA target sequence
ataggtaaaaatggtagtggta

SEQ ID NO: 71260 - DNA, 22 bp, Artificial sequence
  SiRNA target sequence
taggtaaaaatggtagtggtaa

SEQ ID NO: 71261 - DNA, 22 bp, Artificial sequence
  SiRNA target sequence
aggtaaaaatggtagtggtaaa

SEQ ID NO: 71262 - DNA, 22 bp, Artificial sequence
  SiRNA target sequence
ggtaaaaatggtagtggtaaat

SEQ ID NO: 71263 - DNA, 22 bp, Artificial sequence
  SiRNA target sequence
gtaaaaatggtagtggtaaatc

SEQ ID NO: 71264 - DNA, 22 bp, Artificial sequence
  SiRNA target sequence
taaaaatggtagtggtaaatca

SEQ ID NO: 71265 - DNA, 22 bp, Artificial sequence
  SiRNA target sequence
aaaaatggtagtggtaaatcaa

SEQ ID NO: 71266 - DNA, 22 bp, Artificial sequence
  SiRNA target sequence
aaaatggtagtggtaaatcaac

SEQ ID NO: 71267 - DNA, 22 bp, Artificial sequence
  SiRNA target sequence
aaatggtagtggtaaatcaaca

SEQ ID NO: 71268 - DNA, 22 bp, Artificial sequence
  SiRNA target sequence
aatggtagtggtaaatcaacat

SEQ ID NO: 71269 - DNA, 22 bp, Artificial sequence
  SiRNA target sequence
atggtagtggtaaatcaacatt

SEQ ID NO: 71270 - DNA, 22 bp, Artificial sequence
  SiRNA target sequence
tggtagtggtaaatcaacatta

SEQ ID NO: 71271 - DNA, 22 bp, Artificial sequence
  SiRNA target sequence
ggtagtggtaaatcaacattac

SEQ ID NO: 71272 - DNA, 22 bp, Artificial sequence
  SiRNA target sequence
gtagtggtaaatcaacattact

SEQ ID NO: 71273 - DNA, 22 bp, Artificial sequence
  SiRNA target sequence
tagtggtaaatcaacattacta

SEQ ID NO: 71274 - DNA, 22 bp, Artificial sequence
  SiRNA target sequence
agtggtaaatcaacattactaa

SEQ ID NO: 71275 - DNA, 22 bp, Artificial sequence
  SiRNA target sequence
gtggtaaatcaacattactaaa

SEQ ID NO: 71276 - DNA, 22 bp, Artificial sequence
  SiRNA target sequence
tggtaaatcaacattactaaaa

SEQ ID NO: 71277 - DNA, 22 bp, Artificial sequence
  SiRNA target sequence
ggtaaatcaacattactaaaac

SEQ ID NO: 71278 - DNA, 22 bp, Artificial sequence
  SiRNA target sequence
gtaaatcaacattactaaaact

SEQ ID NO: 71279 - DNA, 22 bp, Artificial sequence
  SiRNA target sequence
taaatcaacattactaaaacta

SEQ ID NO: 71280 - DNA, 22 bp, Artificial sequence
  SiRNA target sequence
aaatcaacattactaaaactac

SEQ ID NO: 71281 - DNA, 22 bp, Artificial sequence
  SiRNA target sequence
aatcaacattactaaaactact

SEQ ID NO: 71282 - DNA, 22 bp, Artificial sequence
  SiRNA target sequence
atcaacattactaaaactactg

SEQ ID NO: 71283 - DNA, 22 bp, Artificial sequence
  SiRNA target sequence
tcaacattactaaaactactgc

SEQ ID NO: 71284 - DNA, 22 bp, Artificial sequence
  SiRNA target sequence
caacattactaaaactactgct

SEQ ID NO: 71285 - DNA, 22 bp, Artificial sequence
  SiRNA target sequence
aacattactaaaactactgctt

SEQ ID NO: 71286 - DNA, 22 bp, Artificial sequence
  SiRNA target sequence
acattactaaaactactgctta

SEQ ID NO: 71287 - DNA, 22 bp, Artificial sequence
  SiRNA target sequence
cattactaaaactactgcttaa

SEQ ID NO: 71288 - DNA, 22 bp, Artificial sequence
  SiRNA target sequence
attactaaaactactgcttaaa

SEQ ID NO: 71289 - DNA, 22 bp, Artificial sequence
  SiRNA target sequence
ttactaaaactactgcttaaat

SEQ ID NO: 71290 - DNA, 22 bp, Artificial sequence
  SiRNA target sequence
tactaaaactactgcttaaatt

SEQ ID NO: 71291 - DNA, 22 bp, Artificial sequence
  SiRNA target sequence
actaaaactactgcttaaattt

SEQ ID NO: 71292 - DNA, 22 bp, Artificial sequence
  SiRNA target sequence
ctaaaactactgcttaaatttg

SEQ ID NO: 71293 - DNA, 22 bp, Artificial sequence
  SiRNA target sequence
taaaactactgcttaaatttga

SEQ ID NO: 71294 - DNA, 22 bp, Artificial sequence
  SiRNA target sequence
aaaactactgcttaaatttgat

SEQ ID NO: 71295 - DNA, 22 bp, Artificial sequence
  SiRNA target sequence
aaactactgcttaaatttgatg

SEQ ID NO: 71296 - DNA, 22 bp, Artificial sequence
  SiRNA target sequence
aactactgcttaaatttgatga

SEQ ID NO: 71297 - DNA, 22 bp, Artificial sequence
  SiRNA target sequence
actactgcttaaatttgatgaa

SEQ ID NO: 71298 - DNA, 22 bp, Artificial sequence
  SiRNA target sequence
ctactgcttaaatttgatgaag

SEQ ID NO: 71299 - DNA, 22 bp, Artificial sequence
  SiRNA target sequence
tactgcttaaatttgatgaaga

SEQ ID NO: 71300 - DNA, 22 bp, Artificial sequence
  SiRNA target sequence
actgcttaaatttgatgaagat

SEQ ID NO: 71301 - DNA, 22 bp, Artificial sequence
  SiRNA target sequence
ctgcttaaatttgatgaagatt

SEQ ID NO: 71302 - DNA, 22 bp, Artificial sequence
  SiRNA target sequence
tgcttaaatttgatgaagatta

SEQ ID NO: 71303 - DNA, 22 bp, Artificial sequence
  SiRNA target sequence
gcttaaatttgatgaagattac

SEQ ID NO: 71304 - DNA, 22 bp, Artificial sequence
  SiRNA target sequence
cttaaatttgatgaagattaca

SEQ ID NO: 71305 - DNA, 22 bp, Artificial sequence
  SiRNA target sequence
ttaaatttgatgaagattacaa

SEQ ID NO: 71306 - DNA, 22 bp, Artificial sequence
  SiRNA target sequence
taaatttgatgaagattacaaa

SEQ ID NO: 71307 - DNA, 22 bp, Artificial sequence
  SiRNA target sequence
aaatttgatgaagattacaaag

SEQ ID NO: 71308 - DNA, 22 bp, Artificial sequence
  SiRNA target sequence
aatttgatgaagattacaaagg

SEQ ID NO: 71309 - DNA, 22 bp, Artificial sequence
  SiRNA target sequence
atttgatgaagattacaaaggt

SEQ ID NO: 71310 - DNA, 22 bp, Artificial sequence
  SiRNA target sequence
tttgatgaagattacaaaggta

SEQ ID NO: 71311 - DNA, 22 bp, Artificial sequence
  SiRNA target sequence
ttgatgaagattacaaaggtag

SEQ ID NO: 71312 - DNA, 22 bp, Artificial sequence
  SiRNA target sequence
tgatgaagattacaaaggtagc

SEQ ID NO: 71313 - DNA, 22 bp, Artificial sequence
  SiRNA target sequence
gatgaagattacaaaggtagca

SEQ ID NO: 71314 - DNA, 22 bp, Artificial sequence
  SiRNA target sequence
atgaagattacaaaggtagcat

SEQ ID NO: 71315 - DNA, 22 bp, Artificial sequence
  SiRNA target sequence
tgaagattacaaaggtagcatt

SEQ ID NO: 71316 - DNA, 22 bp, Artificial sequence
  SiRNA target sequence
gaagattacaaaggtagcattt

SEQ ID NO: 71317 - DNA, 22 bp, Artificial sequence
  SiRNA target sequence
aagattacaaaggtagcatttt

SEQ ID NO: 71318 - DNA, 22 bp, Artificial sequence
  SiRNA target sequence
agattacaaaggtagcatttta

SEQ ID NO: 71319 - DNA, 22 bp, Artificial sequence
  SiRNA target sequence
gattacaaaggtagcattttaa

SEQ ID NO: 71320 - DNA, 22 bp, Artificial sequence
  SiRNA target sequence
attacaaaggtagcattttaat

SEQ ID NO: 71321 - DNA, 22 bp, Artificial sequence
  SiRNA target sequence
ttacaaaggtagcattttaata

SEQ ID NO: 71322 - DNA, 22 bp, Artificial sequence
  SiRNA target sequence
tacaaaggtagcattttaatag

SEQ ID NO: 71323 - DNA, 22 bp, Artificial sequence
  SiRNA target sequence
acaaaggtagcattttaataga

SEQ ID NO: 71324 - DNA, 22 bp, Artificial sequence
  SiRNA target sequence
caaaggtagcattttaatagat

SEQ ID NO: 71325 - DNA, 22 bp, Artificial sequence
  SiRNA target sequence
aaaggtagcattttaatagatg

SEQ ID NO: 71326 - DNA, 22 bp, Artificial sequence
  SiRNA target sequence
aaggtagcattttaatagatga

SEQ ID NO: 71327 - DNA, 22 bp, Artificial sequence
  SiRNA target sequence
aggtagcattttaatagatgac

SEQ ID NO: 71328 - DNA, 22 bp, Artificial sequence
  SiRNA target sequence
ggtagcattttaatagatgaca

SEQ ID NO: 71329 - DNA, 22 bp, Artificial sequence
  SiRNA target sequence
gtagcattttaatagatgacat

SEQ ID NO: 71330 - DNA, 22 bp, Artificial sequence
  SiRNA target sequence
tagcattttaatagatgacatt

SEQ ID NO: 71331 - DNA, 22 bp, Artificial sequence
  SiRNA target sequence
agcattttaatagatgacattg

SEQ ID NO: 71332 - DNA, 22 bp, Artificial sequence
  SiRNA target sequence
gcattttaatagatgacattga

SEQ ID NO: 71333 - DNA, 22 bp, Artificial sequence
  SiRNA target sequence
cattttaatagatgacattgat

SEQ ID NO: 71334 - DNA, 22 bp, Artificial sequence
  SiRNA target sequence
attttaatagatgacattgata

SEQ ID NO: 71335 - DNA, 22 bp, Artificial sequence
  SiRNA target sequence
ttttaatagatgacattgatat

SEQ ID NO: 71336 - DNA, 22 bp, Artificial sequence
  SiRNA target sequence
tttaatagatgacattgatatt

SEQ ID NO: 71337 - DNA, 22 bp, Artificial sequence
  SiRNA target sequence
ttaatagatgacattgatatta

SEQ ID NO: 71338 - DNA, 22 bp, Artificial sequence
  SiRNA target sequence
taatagatgacattgatattaa

SEQ ID NO: 71339 - DNA, 22 bp, Artificial sequence
  SiRNA target sequence
aatagatgacattgatattaaa

SEQ ID NO: 71340 - DNA, 22 bp, Artificial sequence
  SiRNA target sequence
atagatgacattgatattaaaa

SEQ ID NO: 71341 - DNA, 22 bp, Artificial sequence
  SiRNA target sequence
tagatgacattgatattaaaaa

SEQ ID NO: 71342 - DNA, 22 bp, Artificial sequence
  SiRNA target sequence
agatgacattgatattaaaaaa

SEQ ID NO: 71343 - DNA, 22 bp, Artificial sequence
  SiRNA target sequence
gatgacattgatattaaaaaaa

SEQ ID NO: 71344 - DNA, 22 bp, Artificial sequence
  SiRNA target sequence
atgacattgatattaaaaaaat

SEQ ID NO: 71345 - DNA, 22 bp, Artificial sequence
  SiRNA target sequence
tgacattgatattaaaaaaatc

SEQ ID NO: 71346 - DNA, 22 bp, Artificial sequence
  SiRNA target sequence
gacattgatattaaaaaaatca

SEQ ID NO: 71347 - DNA, 22 bp, Artificial sequence
  SiRNA target sequence
acattgatattaaaaaaatcaa

SEQ ID NO: 71348 - DNA, 22 bp, Artificial sequence
  SiRNA target sequence
cattgatattaaaaaaatcaaa

SEQ ID NO: 71349 - DNA, 22 bp, Artificial sequence
  SiRNA target sequence
attgatattaaaaaaatcaaag

SEQ ID NO: 71350 - DNA, 22 bp, Artificial sequence
  SiRNA target sequence
ttgatattaaaaaaatcaaaga

SEQ ID NO: 71351 - DNA, 22 bp, Artificial sequence
  SiRNA target sequence
tgatattaaaaaaatcaaagac

SEQ ID NO: 71352 - DNA, 22 bp, Artificial sequence
  SiRNA target sequence
gatattaaaaaaatcaaagacg

SEQ ID NO: 71353 - DNA, 22 bp, Artificial sequence
  SiRNA target sequence
atattaaaaaaatcaaagacga

SEQ ID NO: 71354 - DNA, 22 bp, Artificial sequence
  SiRNA target sequence
tattaaaaaaatcaaagacgaa

SEQ ID NO: 71355 - DNA, 22 bp, Artificial sequence
  SiRNA target sequence
attaaaaaaatcaaagacgaat

SEQ ID NO: 71356 - DNA, 22 bp, Artificial sequence
  SiRNA target sequence
ttaaaaaaatcaaagacgaatt

SEQ ID NO: 71357 - DNA, 22 bp, Artificial sequence
  SiRNA target sequence
taaaaaaatcaaagacgaattt

SEQ ID NO: 71358 - DNA, 22 bp, Artificial sequence
  SiRNA target sequence
aaaaaaatcaaagacgaatttt

SEQ ID NO: 71359 - DNA, 22 bp, Artificial sequence
  SiRNA target sequence
aaaaaatcaaagacgaatttta

SEQ ID NO: 71360 - DNA, 22 bp, Artificial sequence
  SiRNA target sequence
aaaaatcaaagacgaattttat

SEQ ID NO: 71361 - DNA, 22 bp, Artificial sequence
  SiRNA target sequence
aaaatcaaagacgaattttata

SEQ ID NO: 71362 - DNA, 22 bp, Artificial sequence
  SiRNA target sequence
aaatcaaagacgaattttatag

SEQ ID NO: 71363 - DNA, 22 bp, Artificial sequence
  SiRNA target sequence
aatcaaagacgaattttatagg

SEQ ID NO: 71364 - DNA, 22 bp, Artificial sequence
  SiRNA target sequence
atcaaagacgaattttatagga

SEQ ID NO: 71365 - DNA, 22 bp, Artificial sequence
  SiRNA target sequence
tcaaagacgaattttataggaa

SEQ ID NO: 71366 - DNA, 22 bp, Artificial sequence
  SiRNA target sequence
caaagacgaattttataggaat

SEQ ID NO: 71367 - DNA, 22 bp, Artificial sequence
  SiRNA target sequence
aaagacgaattttataggaatt

SEQ ID NO: 71368 - DNA, 22 bp, Artificial sequence
  SiRNA target sequence
aagacgaattttataggaattt

SEQ ID NO: 71369 - DNA, 22 bp, Artificial sequence
  SiRNA target sequence
agacgaattttataggaattta

SEQ ID NO: 71370 - DNA, 22 bp, Artificial sequence
  SiRNA target sequence
gacgaattttataggaatttat

SEQ ID NO: 71371 - DNA, 22 bp, Artificial sequence
  SiRNA target sequence
acgaattttataggaatttatt

SEQ ID NO: 71372 - DNA, 22 bp, Artificial sequence
  SiRNA target sequence
cgaattttataggaatttatta

SEQ ID NO: 71373 - DNA, 22 bp, Artificial sequence
  SiRNA target sequence
gaattttataggaatttattag

SEQ ID NO: 71374 - DNA, 22 bp, Artificial sequence
  SiRNA target sequence
aattttataggaatttattagg

SEQ ID NO: 71375 - DNA, 22 bp, Artificial sequence
  SiRNA target sequence
attttataggaatttattaggt

SEQ ID NO: 71376 - DNA, 22 bp, Artificial sequence
  SiRNA target sequence
ttttataggaatttattaggtt

SEQ ID NO: 71377 - DNA, 22 bp, Artificial sequence
  SiRNA target sequence
tttataggaatttattaggtta

SEQ ID NO: 71378 - DNA, 22 bp, Artificial sequence
  SiRNA target sequence
ttataggaatttattaggttac

SEQ ID NO: 71379 - DNA, 22 bp, Artificial sequence
  SiRNA target sequence
tataggaatttattaggttaca

SEQ ID NO: 71380 - DNA, 22 bp, Artificial sequence
  SiRNA target sequence
ataggaatttattaggttacat

SEQ ID NO: 71381 - DNA, 22 bp, Artificial sequence
  SiRNA target sequence
taggaatttattaggttacata

SEQ ID NO: 71382 - DNA, 22 bp, Artificial sequence
  SiRNA target sequence
aggaatttattaggttacatac

SEQ ID NO: 71383 - DNA, 22 bp, Artificial sequence
  SiRNA target sequence
ggaatttattaggttacatacc

SEQ ID NO: 71384 - DNA, 22 bp, Artificial sequence
  SiRNA target sequence
gaatttattaggttacatacca

SEQ ID NO: 71385 - DNA, 22 bp, Artificial sequence
  SiRNA target sequence
aatttattaggttacataccac

SEQ ID NO: 71386 - DNA, 22 bp, Artificial sequence
  SiRNA target sequence
atttattaggttacataccaca

SEQ ID NO: 71387 - DNA, 22 bp, Artificial sequence
  SiRNA target sequence
tttattaggttacataccacag

SEQ ID NO: 71388 - DNA, 22 bp, Artificial sequence
  SiRNA target sequence
ttattaggttacataccacaga

SEQ ID NO: 71389 - DNA, 22 bp, Artificial sequence
  SiRNA target sequence
tattaggttacataccacagaa

SEQ ID NO: 71390 - DNA, 22 bp, Artificial sequence
  SiRNA target sequence
attaggttacataccacagaat

SEQ ID NO: 71391 - DNA, 22 bp, Artificial sequence
  SiRNA target sequence
ttaggttacataccacagaata

SEQ ID NO: 71392 - DNA, 22 bp, Artificial sequence
  SiRNA target sequence
taggttacataccacagaatac

SEQ ID NO: 71393 - DNA, 22 bp, Artificial sequence
  SiRNA target sequence
aggttacataccacagaataca

SEQ ID NO: 71394 - DNA, 22 bp, Artificial sequence
  SiRNA target sequence
ggttacataccacagaatacat

SEQ ID NO: 71395 - DNA, 22 bp, Artificial sequence
  SiRNA target sequence
gttacataccacagaatacatt

SEQ ID NO: 71396 - DNA, 22 bp, Artificial sequence
  SiRNA target sequence
ttacataccacagaatacattt

SEQ ID NO: 71397 - DNA, 22 bp, Artificial sequence
  SiRNA target sequence
tacataccacagaatacatttt

SEQ ID NO: 71398 - DNA, 22 bp, Artificial sequence
  SiRNA target sequence
acataccacagaatacattttt

SEQ ID NO: 71399 - DNA, 22 bp, Artificial sequence
  SiRNA target sequence
cataccacagaatacatttttg

SEQ ID NO: 71400 - DNA, 22 bp, Artificial sequence
  SiRNA target sequence
ataccacagaatacatttttgt

SEQ ID NO: 71401 - DNA, 22 bp, Artificial sequence
  SiRNA target sequence
taccacagaatacatttttgtt

SEQ ID NO: 71402 - DNA, 22 bp, Artificial sequence
  SiRNA target sequence
accacagaatacatttttgttt

SEQ ID NO: 71403 - DNA, 22 bp, Artificial sequence
  SiRNA target sequence
ccacagaatacatttttgttta

SEQ ID NO: 71404 - DNA, 22 bp, Artificial sequence
  SiRNA target sequence
cacagaatacatttttgtttaa

SEQ ID NO: 71405 - DNA, 22 bp, Artificial sequence
  SiRNA target sequence
acagaatacatttttgtttaat

SEQ ID NO: 71406 - DNA, 22 bp, Artificial sequence
  SiRNA target sequence
cagaatacatttttgtttaatg

SEQ ID NO: 71407 - DNA, 22 bp, Artificial sequence
  SiRNA target sequence
agaatacatttttgtttaatga

SEQ ID NO: 71408 - DNA, 22 bp, Artificial sequence
  SiRNA target sequence
gaatacatttttgtttaatgaa

SEQ ID NO: 71409 - DNA, 22 bp, Artificial sequence
  SiRNA target sequence
aatacatttttgtttaatgaat

SEQ ID NO: 71410 - DNA, 22 bp, Artificial sequence
  SiRNA target sequence
atacatttttgtttaatgaatc

SEQ ID NO: 71411 - DNA, 22 bp, Artificial sequence
  SiRNA target sequence
tacatttttgtttaatgaatct

SEQ ID NO: 71412 - DNA, 22 bp, Artificial sequence
  SiRNA target sequence
acatttttgtttaatgaatctg

SEQ ID NO: 71413 - DNA, 22 bp, Artificial sequence
  SiRNA target sequence
catttttgtttaatgaatctgt

SEQ ID NO: 71414 - DNA, 22 bp, Artificial sequence
  SiRNA target sequence
atttttgtttaatgaatctgta

SEQ ID NO: 71415 - DNA, 22 bp, Artificial sequence
  SiRNA target sequence
tttttgtttaatgaatctgtaa

SEQ ID NO: 71416 - DNA, 22 bp, Artificial sequence
  SiRNA target sequence
ttttgtttaatgaatctgtaaa

SEQ ID NO: 71417 - DNA, 22 bp, Artificial sequence
  SiRNA target sequence
tttgtttaatgaatctgtaaaa

SEQ ID NO: 71418 - DNA, 22 bp, Artificial sequence
  SiRNA target sequence
ttgtttaatgaatctgtaaaat

SEQ ID NO: 71419 - DNA, 22 bp, Artificial sequence
  SiRNA target sequence
tgtttaatgaatctgtaaaata

SEQ ID NO: 71420 - DNA, 22 bp, Artificial sequence
  SiRNA target sequence
gtttaatgaatctgtaaaatat

SEQ ID NO: 71421 - DNA, 22 bp, Artificial sequence
  SiRNA target sequence
tttaatgaatctgtaaaatata

SEQ ID NO: 71422 - DNA, 22 bp, Artificial sequence
  SiRNA target sequence
ttaatgaatctgtaaaatataa

SEQ ID NO: 71423 - DNA, 22 bp, Artificial sequence
  SiRNA target sequence
taatgaatctgtaaaatataat

SEQ ID NO: 71424 - DNA, 22 bp, Artificial sequence
  SiRNA target sequence
aatgaatctgtaaaatataata

SEQ ID NO: 71425 - DNA, 22 bp, Artificial sequence
  SiRNA target sequence
atgaatctgtaaaatataatat

SEQ ID NO: 71426 - DNA, 22 bp, Artificial sequence
  SiRNA target sequence
tgaatctgtaaaatataatatt

SEQ ID NO: 71427 - DNA, 22 bp, Artificial sequence
  SiRNA target sequence
gaatctgtaaaatataatatta

SEQ ID NO: 71428 - DNA, 22 bp, Artificial sequence
  SiRNA target sequence
aatctgtaaaatataatattaa

SEQ ID NO: 71429 - DNA, 22 bp, Artificial sequence
  SiRNA target sequence
atctgtaaaatataatattaaa

SEQ ID NO: 71430 - DNA, 22 bp, Artificial sequence
  SiRNA target sequence
tctgtaaaatataatattaaat

SEQ ID NO: 71431 - DNA, 22 bp, Artificial sequence
  SiRNA target sequence
ctgtaaaatataatattaaata

SEQ ID NO: 71432 - DNA, 22 bp, Artificial sequence
  SiRNA target sequence
tgtaaaatataatattaaatac

SEQ ID NO: 71433 - DNA, 22 bp, Artificial sequence
  SiRNA target sequence
gtaaaatataatattaaatacg

SEQ ID NO: 71434 - DNA, 22 bp, Artificial sequence
  SiRNA target sequence
taaaatataatattaaatacgg

SEQ ID NO: 71435 - DNA, 22 bp, Artificial sequence
  SiRNA target sequence
aaaatataatattaaatacgga

SEQ ID NO: 71436 - DNA, 22 bp, Artificial sequence
  SiRNA target sequence
aaatataatattaaatacggat

SEQ ID NO: 71437 - DNA, 22 bp, Artificial sequence
  SiRNA target sequence
aatataatattaaatacggatc

SEQ ID NO: 71438 - DNA, 22 bp, Artificial sequence
  SiRNA target sequence
atataatattaaatacggatct

SEQ ID NO: 71439 - DNA, 22 bp, Artificial sequence
  SiRNA target sequence
tataatattaaatacggatctt

SEQ ID NO: 71440 - DNA, 22 bp, Artificial sequence
  SiRNA target sequence
ataatattaaatacggatcttt

SEQ ID NO: 71441 - DNA, 22 bp, Artificial sequence
  SiRNA target sequence
taatattaaatacggatctttt

SEQ ID NO: 71442 - DNA, 22 bp, Artificial sequence
  SiRNA target sequence
aatattaaatacggatcttttg

SEQ ID NO: 71443 - DNA, 22 bp, Artificial sequence
  SiRNA target sequence
atattaaatacggatcttttgg

SEQ ID NO: 71444 - DNA, 22 bp, Artificial sequence
  SiRNA target sequence
tattaaatacggatcttttggt

SEQ ID NO: 71445 - DNA, 22 bp, Artificial sequence
  SiRNA target sequence
attaaatacggatcttttggta

SEQ ID NO: 71446 - DNA, 22 bp, Artificial sequence
  SiRNA target sequence
ttaaatacggatcttttggtat

SEQ ID NO: 71447 - DNA, 22 bp, Artificial sequence
  SiRNA target sequence
taaatacggatcttttggtatt

SEQ ID NO: 71448 - DNA, 22 bp, Artificial sequence
  SiRNA target sequence
aaatacggatcttttggtattt

SEQ ID NO: 71449 - DNA, 22 bp, Artificial sequence
  SiRNA target sequence
aatacggatcttttggtatttc

SEQ ID NO: 71450 - DNA, 22 bp, Artificial sequence
  SiRNA target sequence
atacggatcttttggtatttca

SEQ ID NO: 71451 - DNA, 22 bp, Artificial sequence
  SiRNA target sequence
tacggatcttttggtatttcag

SEQ ID NO: 71452 - DNA, 22 bp, Artificial sequence
  SiRNA target sequence
acggatcttttggtatttcaga

SEQ ID NO: 71453 - DNA, 22 bp, Artificial sequence
  SiRNA target sequence
cggatcttttggtatttcagac

SEQ ID NO: 71454 - DNA, 22 bp, Artificial sequence
  SiRNA target sequence
ggatcttttggtatttcagacg

SEQ ID NO: 71455 - DNA, 22 bp, Artificial sequence
  SiRNA target sequence
gatcttttggtatttcagacga

SEQ ID NO: 71456 - DNA, 22 bp, Artificial sequence
  SiRNA target sequence
atcttttggtatttcagacgag

SEQ ID NO: 71457 - DNA, 22 bp, Artificial sequence
  SiRNA target sequence
tcttttggtatttcagacgagg

SEQ ID NO: 71458 - DNA, 22 bp, Artificial sequence
  SiRNA target sequence
cttttggtatttcagacgagga

SEQ ID NO: 71459 - DNA, 22 bp, Artificial sequence
  SiRNA target sequence
ttttggtatttcagacgaggat

SEQ ID NO: 71460 - DNA, 22 bp, Artificial sequence
  SiRNA target sequence
tttggtatttcagacgaggata

SEQ ID NO: 71461 - DNA, 22 bp, Artificial sequence
  SiRNA target sequence
ttggtatttcagacgaggatat

SEQ ID NO: 71462 - DNA, 22 bp, Artificial sequence
  SiRNA target sequence
tggtatttcagacgaggatatt

SEQ ID NO: 71463 - DNA, 22 bp, Artificial sequence
  SiRNA target sequence
ggtatttcagacgaggatattt

SEQ ID NO: 71464 - DNA, 22 bp, Artificial sequence
  SiRNA target sequence
gtatttcagacgaggatatttt

SEQ ID NO: 71465 - DNA, 22 bp, Artificial sequence
  SiRNA target sequence
tatttcagacgaggatattttt

SEQ ID NO: 71466 - DNA, 22 bp, Artificial sequence
  SiRNA target sequence
atttcagacgaggatatttttg

SEQ ID NO: 71467 - DNA, 22 bp, Artificial sequence
  SiRNA target sequence
tttcagacgaggatatttttgc

SEQ ID NO: 71468 - DNA, 22 bp, Artificial sequence
  SiRNA target sequence
ttcagacgaggatatttttgca

SEQ ID NO: 71469 - DNA, 22 bp, Artificial sequence
  SiRNA target sequence
tcagacgaggatatttttgcat

SEQ ID NO: 71470 - DNA, 22 bp, Artificial sequence
  SiRNA target sequence
cagacgaggatatttttgcatt

SEQ ID NO: 71471 - DNA, 22 bp, Artificial sequence
  SiRNA target sequence
agacgaggatatttttgcattg

SEQ ID NO: 71472 - DNA, 22 bp, Artificial sequence
  SiRNA target sequence
gacgaggatatttttgcattgt

SEQ ID NO: 71473 - DNA, 22 bp, Artificial sequence
  SiRNA target sequence
acgaggatatttttgcattgtg

SEQ ID NO: 71474 - DNA, 22 bp, Artificial sequence
  SiRNA target sequence
cgaggatatttttgcattgtgt

SEQ ID NO: 71475 - DNA, 22 bp, Artificial sequence
  SiRNA target sequence
gaggatatttttgcattgtgta

SEQ ID NO: 71476 - DNA, 22 bp, Artificial sequence
  SiRNA target sequence
aggatatttttgcattgtgtaa

SEQ ID NO: 71477 - DNA, 22 bp, Artificial sequence
  SiRNA target sequence
ggatatttttgcattgtgtaaa

SEQ ID NO: 71478 - DNA, 22 bp, Artificial sequence
  SiRNA target sequence
gatatttttgcattgtgtaaag

SEQ ID NO: 71479 - DNA, 22 bp, Artificial sequence
  SiRNA target sequence
atatttttgcattgtgtaaaga

SEQ ID NO: 71480 - DNA, 22 bp, Artificial sequence
  SiRNA target sequence
tatttttgcattgtgtaaagag

SEQ ID NO: 71481 - DNA, 22 bp, Artificial sequence
  SiRNA target sequence
atttttgcattgtgtaaagagt

SEQ ID NO: 71482 - DNA, 22 bp, Artificial sequence
  SiRNA target sequence
tttttgcattgtgtaaagagtt

SEQ ID NO: 71483 - DNA, 22 bp, Artificial sequence
  SiRNA target sequence
ttttgcattgtgtaaagagttt

SEQ ID NO: 71484 - DNA, 22 bp, Artificial sequence
  SiRNA target sequence
tttgcattgtgtaaagagtttg

SEQ ID NO: 71485 - DNA, 22 bp, Artificial sequence
  SiRNA target sequence
ttgcattgtgtaaagagtttgg

SEQ ID NO: 71486 - DNA, 22 bp, Artificial sequence
  SiRNA target sequence
tgcattgtgtaaagagtttgga

SEQ ID NO: 71487 - DNA, 22 bp, Artificial sequence
  SiRNA target sequence
gcattgtgtaaagagtttggat

SEQ ID NO: 71488 - DNA, 22 bp, Artificial sequence
  SiRNA target sequence
cattgtgtaaagagtttggatt

SEQ ID NO: 71489 - DNA, 22 bp, Artificial sequence
  SiRNA target sequence
attgtgtaaagagtttggatta

SEQ ID NO: 71490 - DNA, 22 bp, Artificial sequence
  SiRNA target sequence
ttgtgtaaagagtttggattat

SEQ ID NO: 71491 - DNA, 22 bp, Artificial sequence
  SiRNA target sequence
tgtgtaaagagtttggattata

SEQ ID NO: 71492 - DNA, 22 bp, Artificial sequence
  SiRNA target sequence
gtgtaaagagtttggattatat

SEQ ID NO: 71493 - DNA, 22 bp, Artificial sequence
  SiRNA target sequence
tgtaaagagtttggattatatg

SEQ ID NO: 71494 - DNA, 22 bp, Artificial sequence
  SiRNA target sequence
gtaaagagtttggattatatga

SEQ ID NO: 71495 - DNA, 22 bp, Artificial sequence
  SiRNA target sequence
taaagagtttggattatatgac

SEQ ID NO: 71496 - DNA, 22 bp, Artificial sequence
  SiRNA target sequence
aaagagtttggattatatgacg

SEQ ID NO: 71497 - DNA, 22 bp, Artificial sequence
  SiRNA target sequence
aagagtttggattatatgacgt

SEQ ID NO: 71498 - DNA, 22 bp, Artificial sequence
  SiRNA target sequence
agagtttggattatatgacgtt

SEQ ID NO: 71499 - DNA, 22 bp, Artificial sequence
  SiRNA target sequence
gagtttggattatatgacgttt

SEQ ID NO: 71500 - DNA, 22 bp, Artificial sequence
  SiRNA target sequence
agtttggattatatgacgtttt

SEQ ID NO: 71501 - DNA, 22 bp, Artificial sequence
  SiRNA target sequence
gtttggattatatgacgttttc

SEQ ID NO: 71502 - DNA, 22 bp, Artificial sequence
  SiRNA target sequence
tttggattatatgacgttttca

SEQ ID NO: 71503 - DNA, 22 bp, Artificial sequence
  SiRNA target sequence
ttggattatatgacgttttcat

SEQ ID NO: 71504 - DNA, 22 bp, Artificial sequence
  SiRNA target sequence
tggattatatgacgttttcatg

SEQ ID NO: 71505 - DNA, 22 bp, Artificial sequence
  SiRNA target sequence
ggattatatgacgttttcatga

SEQ ID NO: 71506 - DNA, 22 bp, Artificial sequence
  SiRNA target sequence
gattatatgacgttttcatgaa

SEQ ID NO: 71507 - DNA, 22 bp, Artificial sequence
  SiRNA target sequence
attatatgacgttttcatgaac

SEQ ID NO: 71508 - DNA, 22 bp, Artificial sequence
  SiRNA target sequence
ttatatgacgttttcatgaacc

SEQ ID NO: 71509 - DNA, 22 bp, Artificial sequence
  SiRNA target sequence
tatatgacgttttcatgaacct

SEQ ID NO: 71510 - DNA, 22 bp, Artificial sequence
  SiRNA target sequence
atatgacgttttcatgaacctc

SEQ ID NO: 71511 - DNA, 22 bp, Artificial sequence
  SiRNA target sequence
tatgacgttttcatgaacctcg

SEQ ID NO: 71512 - DNA, 22 bp, Artificial sequence
  SiRNA target sequence
atgacgttttcatgaacctcga

SEQ ID NO: 71513 - DNA, 22 bp, Artificial sequence
  SiRNA target sequence
tgacgttttcatgaacctcgaa

SEQ ID NO: 71514 - DNA, 22 bp, Artificial sequence
  SiRNA target sequence
gacgttttcatgaacctcgaaa

SEQ ID NO: 71515 - DNA, 22 bp, Artificial sequence
  SiRNA target sequence
acgttttcatgaacctcgaaaa

SEQ ID NO: 71516 - DNA, 22 bp, Artificial sequence
  SiRNA target sequence
cgttttcatgaacctcgaaaat

SEQ ID NO: 71517 - DNA, 22 bp, Artificial sequence
  SiRNA target sequence
gttttcatgaacctcgaaaatg

SEQ ID NO: 71518 - DNA, 22 bp, Artificial sequence
  SiRNA target sequence
ttttcatgaacctcgaaaatgg

SEQ ID NO: 71519 - DNA, 22 bp, Artificial sequence
  SiRNA target sequence
tttcatgaacctcgaaaatggt

SEQ ID NO: 71520 - DNA, 22 bp, Artificial sequence
  SiRNA target sequence
ttcatgaacctcgaaaatggtt

SEQ ID NO: 71521 - DNA, 22 bp, Artificial sequence
  SiRNA target sequence
tcatgaacctcgaaaatggttt

SEQ ID NO: 71522 - DNA, 22 bp, Artificial sequence
  SiRNA target sequence
catgaacctcgaaaatggtttt

SEQ ID NO: 71523 - DNA, 22 bp, Artificial sequence
  SiRNA target sequence
atgaacctcgaaaatggttttg

SEQ ID NO: 71524 - DNA, 22 bp, Artificial sequence
  SiRNA target sequence
tgaacctcgaaaatggttttga

SEQ ID NO: 71525 - DNA, 22 bp, Artificial sequence
  SiRNA target sequence
gaacctcgaaaatggttttgat

SEQ ID NO: 71526 - DNA, 22 bp, Artificial sequence
  SiRNA target sequence
aacctcgaaaatggttttgata

SEQ ID NO: 71527 - DNA, 22 bp, Artificial sequence
  SiRNA target sequence
acctcgaaaatggttttgatac

SEQ ID NO: 71528 - DNA, 22 bp, Artificial sequence
  SiRNA target sequence
cctcgaaaatggttttgatacg

SEQ ID NO: 71529 - DNA, 22 bp, Artificial sequence
  SiRNA target sequence
ctcgaaaatggttttgatacga

SEQ ID NO: 71530 - DNA, 22 bp, Artificial sequence
  SiRNA target sequence
tcgaaaatggttttgatacgaa

SEQ ID NO: 71531 - DNA, 22 bp, Artificial sequence
  SiRNA target sequence
cgaaaatggttttgatacgaat

SEQ ID NO: 71532 - DNA, 22 bp, Artificial sequence
  SiRNA target sequence
gaaaatggttttgatacgaatg

SEQ ID NO: 71533 - DNA, 22 bp, Artificial sequence
  SiRNA target sequence
aaaatggttttgatacgaatgt

SEQ ID NO: 71534 - DNA, 22 bp, Artificial sequence
  SiRNA target sequence
aaatggttttgatacgaatgta

SEQ ID NO: 71535 - DNA, 22 bp, Artificial sequence
  SiRNA target sequence
aatggttttgatacgaatgtag

SEQ ID NO: 71536 - DNA, 22 bp, Artificial sequence
  SiRNA target sequence
atggttttgatacgaatgtagg

SEQ ID NO: 71537 - DNA, 22 bp, Artificial sequence
  SiRNA target sequence
tggttttgatacgaatgtagga

SEQ ID NO: 71538 - DNA, 22 bp, Artificial sequence
  SiRNA target sequence
ggttttgatacgaatgtaggag

SEQ ID NO: 71539 - DNA, 22 bp, Artificial sequence
  SiRNA target sequence
gttttgatacgaatgtaggaga

SEQ ID NO: 71540 - DNA, 22 bp, Artificial sequence
  SiRNA target sequence
ttttgatacgaatgtaggagaa

SEQ ID NO: 71541 - DNA, 22 bp, Artificial sequence
  SiRNA target sequence
tttgatacgaatgtaggagaaa

SEQ ID NO: 71542 - DNA, 22 bp, Artificial sequence
  SiRNA target sequence
ttgatacgaatgtaggagaaag

SEQ ID NO: 71543 - DNA, 22 bp, Artificial sequence
  SiRNA target sequence
tgatacgaatgtaggagaaaga

SEQ ID NO: 71544 - DNA, 22 bp, Artificial sequence
  SiRNA target sequence
gatacgaatgtaggagaaagag

SEQ ID NO: 71545 - DNA, 22 bp, Artificial sequence
  SiRNA target sequence
atacgaatgtaggagaaagagg

SEQ ID NO: 71546 - DNA, 22 bp, Artificial sequence
  SiRNA target sequence
tacgaatgtaggagaaagagga

SEQ ID NO: 71547 - DNA, 22 bp, Artificial sequence
  SiRNA target sequence
acgaatgtaggagaaagaggaa

SEQ ID NO: 71548 - DNA, 22 bp, Artificial sequence
  SiRNA target sequence
cgaatgtaggagaaagaggaag

SEQ ID NO: 71549 - DNA, 22 bp, Artificial sequence
  SiRNA target sequence
gaatgtaggagaaagaggaagg

SEQ ID NO: 71550 - DNA, 22 bp, Artificial sequence
  SiRNA target sequence
aatgtaggagaaagaggaaggt

SEQ ID NO: 71551 - DNA, 22 bp, Artificial sequence
  SiRNA target sequence
atgtaggagaaagaggaaggtt

SEQ ID NO: 71552 - DNA, 22 bp, Artificial sequence
  SiRNA target sequence
tgtaggagaaagaggaaggtta

SEQ ID NO: 71553 - DNA, 22 bp, Artificial sequence
  SiRNA target sequence
gtaggagaaagaggaaggttat

SEQ ID NO: 71554 - DNA, 22 bp, Artificial sequence
  SiRNA target sequence
taggagaaagaggaaggttatt

SEQ ID NO: 71555 - DNA, 22 bp, Artificial sequence
  SiRNA target sequence
aggagaaagaggaaggttatta

SEQ ID NO: 71556 - DNA, 22 bp, Artificial sequence
  SiRNA target sequence
ggagaaagaggaaggttattaa

SEQ ID NO: 71557 - DNA, 22 bp, Artificial sequence
  SiRNA target sequence
gagaaagaggaaggttattaag

SEQ ID NO: 71558 - DNA, 22 bp, Artificial sequence
  SiRNA target sequence
agaaagaggaaggttattaagt

SEQ ID NO: 71559 - DNA, 22 bp, Artificial sequence
  SiRNA target sequence
gaaagaggaaggttattaagtg

SEQ ID NO: 71560 - DNA, 22 bp, Artificial sequence
  SiRNA target sequence
aaagaggaaggttattaagtgg

SEQ ID NO: 71561 - DNA, 22 bp, Artificial sequence
  SiRNA target sequence
aagaggaaggttattaagtggt

SEQ ID NO: 71562 - DNA, 22 bp, Artificial sequence
  SiRNA target sequence
agaggaaggttattaagtggtg

SEQ ID NO: 71563 - DNA, 22 bp, Artificial sequence
  SiRNA target sequence
gaggaaggttattaagtggtgg

SEQ ID NO: 71564 - DNA, 22 bp, Artificial sequence
  SiRNA target sequence
aggaaggttattaagtggtgga

SEQ ID NO: 71565 - DNA, 22 bp, Artificial sequence
  SiRNA target sequence
ggaaggttattaagtggtggag

SEQ ID NO: 71566 - DNA, 22 bp, Artificial sequence
  SiRNA target sequence
gaaggttattaagtggtggaga

SEQ ID NO: 71567 - DNA, 22 bp, Artificial sequence
  SiRNA target sequence
aaggttattaagtggtggagaa

SEQ ID NO: 71568 - DNA, 22 bp, Artificial sequence
  SiRNA target sequence
aggttattaagtggtggagaaa

SEQ ID NO: 71569 - DNA, 22 bp, Artificial sequence
  SiRNA target sequence
ggttattaagtggtggagaaaa

SEQ ID NO: 71570 - DNA, 22 bp, Artificial sequence
  SiRNA target sequence
gttattaagtggtggagaaaag

SEQ ID NO: 71571 - DNA, 22 bp, Artificial sequence
  SiRNA target sequence
ttattaagtggtggagaaaagc

SEQ ID NO: 71572 - DNA, 22 bp, Artificial sequence
  SiRNA target sequence
tattaagtggtggagaaaagca

SEQ ID NO: 71573 - DNA, 22 bp, Artificial sequence
  SiRNA target sequence
attaagtggtggagaaaagcaa

SEQ ID NO: 71574 - DNA, 22 bp, Artificial sequence
  SiRNA target sequence
ttaagtggtggagaaaagcaaa

SEQ ID NO: 71575 - DNA, 22 bp, Artificial sequence
  SiRNA target sequence
taagtggtggagaaaagcaaaa

SEQ ID NO: 71576 - DNA, 22 bp, Artificial sequence
  SiRNA target sequence
aagtggtggagaaaagcaaaag

SEQ ID NO: 71577 - DNA, 22 bp, Artificial sequence
  SiRNA target sequence
agtggtggagaaaagcaaaaga

SEQ ID NO: 71578 - DNA, 22 bp, Artificial sequence
  SiRNA target sequence
gtggtggagaaaagcaaaagat

SEQ ID NO: 71579 - DNA, 22 bp, Artificial sequence
  SiRNA target sequence
tggtggagaaaagcaaaagatt

SEQ ID NO: 71580 - DNA, 22 bp, Artificial sequence
  SiRNA target sequence
ggtggagaaaagcaaaagattt

SEQ ID NO: 71581 - DNA, 22 bp, Artificial sequence
  SiRNA target sequence
gtggagaaaagcaaaagatttt

SEQ ID NO: 71582 - DNA, 22 bp, Artificial sequence
  SiRNA target sequence
tggagaaaagcaaaagatttta

SEQ ID NO: 71583 - DNA, 22 bp, Artificial sequence
  SiRNA target sequence
ggagaaaagcaaaagattttat

SEQ ID NO: 71584 - DNA, 22 bp, Artificial sequence
  SiRNA target sequence
gagaaaagcaaaagattttatt

SEQ ID NO: 71585 - DNA, 22 bp, Artificial sequence
  SiRNA target sequence
agaaaagcaaaagattttatta

SEQ ID NO: 71586 - DNA, 22 bp, Artificial sequence
  SiRNA target sequence
gaaaagcaaaagattttattaa

SEQ ID NO: 71587 - DNA, 22 bp, Artificial sequence
  SiRNA target sequence
aaaagcaaaagattttattaat

SEQ ID NO: 71588 - DNA, 22 bp, Artificial sequence
  SiRNA target sequence
aaagcaaaagattttattaatg

SEQ ID NO: 71589 - DNA, 22 bp, Artificial sequence
  SiRNA target sequence
aagcaaaagattttattaatgc

SEQ ID NO: 71590 - DNA, 22 bp, Artificial sequence
  SiRNA target sequence
agcaaaagattttattaatgcg

SEQ ID NO: 71591 - DNA, 22 bp, Artificial sequence
  SiRNA target sequence
gcaaaagattttattaatgcgt

SEQ ID NO: 71592 - DNA, 22 bp, Artificial sequence
  SiRNA target sequence
caaaagattttattaatgcgta

SEQ ID NO: 71593 - DNA, 22 bp, Artificial sequence
  SiRNA target sequence
aaaagattttattaatgcgtac

SEQ ID NO: 71594 - DNA, 22 bp, Artificial sequence
  SiRNA target sequence
aaagattttattaatgcgtact

SEQ ID NO: 71595 - DNA, 22 bp, Artificial sequence
  SiRNA target sequence
aagattttattaatgcgtacta

SEQ ID NO: 71596 - DNA, 22 bp, Artificial sequence
  SiRNA target sequence
agattttattaatgcgtactat

SEQ ID NO: 71597 - DNA, 22 bp, Artificial sequence
  SiRNA target sequence
gattttattaatgcgtactatg

SEQ ID NO: 71598 - DNA, 22 bp, Artificial sequence
  SiRNA target sequence
attttattaatgcgtactatgt

SEQ ID NO: 71599 - DNA, 22 bp, Artificial sequence
  SiRNA target sequence
ttttattaatgcgtactatgtt

SEQ ID NO: 71600 - DNA, 22 bp, Artificial sequence
  SiRNA target sequence
tttattaatgcgtactatgtta

SEQ ID NO: 71601 - DNA, 22 bp, Artificial sequence
  SiRNA target sequence
ttattaatgcgtactatgttaa

SEQ ID NO: 71602 - DNA, 22 bp, Artificial sequence
  SiRNA target sequence
tattaatgcgtactatgttaag

SEQ ID NO: 71603 - DNA, 22 bp, Artificial sequence
  SiRNA target sequence
attaatgcgtactatgttaaga

SEQ ID NO: 71604 - DNA, 22 bp, Artificial sequence
  SiRNA target sequence
ttaatgcgtactatgttaagaa

SEQ ID NO: 71605 - DNA, 22 bp, Artificial sequence
  SiRNA target sequence
taatgcgtactatgttaagaaa

SEQ ID NO: 71606 - DNA, 22 bp, Artificial sequence
  SiRNA target sequence
aatgcgtactatgttaagaaac

SEQ ID NO: 71607 - DNA, 22 bp, Artificial sequence
  SiRNA target sequence
atgcgtactatgttaagaaaca

SEQ ID NO: 71608 - DNA, 22 bp, Artificial sequence
  SiRNA target sequence
tgcgtactatgttaagaaacaa

SEQ ID NO: 71609 - DNA, 22 bp, Artificial sequence
  SiRNA target sequence
gcgtactatgttaagaaacaag

SEQ ID NO: 71610 - DNA, 22 bp, Artificial sequence
  SiRNA target sequence
cgtactatgttaagaaacaagg

SEQ ID NO: 71611 - DNA, 22 bp, Artificial sequence
  SiRNA target sequence
gtactatgttaagaaacaagga

SEQ ID NO: 71612 - DNA, 22 bp, Artificial sequence
  SiRNA target sequence
tactatgttaagaaacaaggag

SEQ ID NO: 71613 - DNA, 22 bp, Artificial sequence
  SiRNA target sequence
actatgttaagaaacaaggaga

SEQ ID NO: 71614 - DNA, 22 bp, Artificial sequence
  SiRNA target sequence
ctatgttaagaaacaaggagat

SEQ ID NO: 71615 - DNA, 22 bp, Artificial sequence
  SiRNA target sequence
tatgttaagaaacaaggagata

SEQ ID NO: 71616 - DNA, 22 bp, Artificial sequence
  SiRNA target sequence
atgttaagaaacaaggagataa

SEQ ID NO: 71617 - DNA, 22 bp, Artificial sequence
  SiRNA target sequence
tgttaagaaacaaggagataat

SEQ ID NO: 71618 - DNA, 22 bp, Artificial sequence
  SiRNA target sequence
gttaagaaacaaggagataatg

SEQ ID NO: 71619 - DNA, 22 bp, Artificial sequence
  SiRNA target sequence
ttaagaaacaaggagataatgg

SEQ ID NO: 71620 - DNA, 22 bp, Artificial sequence
  SiRNA target sequence
taagaaacaaggagataatggc

SEQ ID NO: 71621 - DNA, 22 bp, Artificial sequence
  SiRNA target sequence
aagaaacaaggagataatggca

SEQ ID NO: 71622 - DNA, 22 bp, Artificial sequence
  SiRNA target sequence
agaaacaaggagataatggcat

SEQ ID NO: 71623 - DNA, 22 bp, Artificial sequence
  SiRNA target sequence
gaaacaaggagataatggcatt

SEQ ID NO: 71624 - DNA, 22 bp, Artificial sequence
  SiRNA target sequence
aaacaaggagataatggcatta

SEQ ID NO: 71625 - DNA, 22 bp, Artificial sequence
  SiRNA target sequence
aacaaggagataatggcattag

SEQ ID NO: 71626 - DNA, 22 bp, Artificial sequence
  SiRNA target sequence
acaaggagataatggcattaga

SEQ ID NO: 71627 - DNA, 22 bp, Artificial sequence
  SiRNA target sequence
caaggagataatggcattagat

SEQ ID NO: 71628 - DNA, 22 bp, Artificial sequence
  SiRNA target sequence
aaggagataatggcattagatg

SEQ ID NO: 71629 - DNA, 22 bp, Artificial sequence
  SiRNA target sequence
aggagataatggcattagatga

SEQ ID NO: 71630 - DNA, 22 bp, Artificial sequence
  SiRNA target sequence
ggagataatggcattagatgaa

SEQ ID NO: 71631 - DNA, 22 bp, Artificial sequence
  SiRNA target sequence
gagataatggcattagatgaac

SEQ ID NO: 71632 - DNA, 22 bp, Artificial sequence
  SiRNA target sequence
agataatggcattagatgaacc

SEQ ID NO: 71633 - DNA, 22 bp, Artificial sequence
  SiRNA target sequence
gataatggcattagatgaaccc

SEQ ID NO: 71634 - DNA, 22 bp, Artificial sequence
  SiRNA target sequence
ataatggcattagatgaaccca

SEQ ID NO: 71635 - DNA, 22 bp, Artificial sequence
  SiRNA target sequence
taatggcattagatgaacccac

SEQ ID NO: 71636 - DNA, 22 bp, Artificial sequence
  SiRNA target sequence
aatggcattagatgaacccact

SEQ ID NO: 71637 - DNA, 22 bp, Artificial sequence
  SiRNA target sequence
atggcattagatgaacccactg

SEQ ID NO: 71638 - DNA, 22 bp, Artificial sequence
  SiRNA target sequence
tggcattagatgaacccactgc

SEQ ID NO: 71639 - DNA, 22 bp, Artificial sequence
  SiRNA target sequence
ggcattagatgaacccactgca

SEQ ID NO: 71640 - DNA, 22 bp, Artificial sequence
  SiRNA target sequence
gcattagatgaacccactgcag

SEQ ID NO: 71641 - DNA, 22 bp, Artificial sequence
  SiRNA target sequence
cattagatgaacccactgcagc

SEQ ID NO: 71642 - DNA, 22 bp, Artificial sequence
  SiRNA target sequence
attagatgaacccactgcagca

SEQ ID NO: 71643 - DNA, 22 bp, Artificial sequence
  SiRNA target sequence
ttagatgaacccactgcagcac

SEQ ID NO: 71644 - DNA, 22 bp, Artificial sequence
  SiRNA target sequence
tagatgaacccactgcagcact

SEQ ID NO: 71645 - DNA, 22 bp, Artificial sequence
  SiRNA target sequence
agatgaacccactgcagcactt

SEQ ID NO: 71646 - DNA, 22 bp, Artificial sequence
  SiRNA target sequence
gatgaacccactgcagcacttg

SEQ ID NO: 71647 - DNA, 22 bp, Artificial sequence
  SiRNA target sequence
atgaacccactgcagcacttga

SEQ ID NO: 71648 - DNA, 22 bp, Artificial sequence
  SiRNA target sequence
tgaacccactgcagcacttgat

SEQ ID NO: 71649 - DNA, 22 bp, Artificial sequence
  SiRNA target sequence
gaacccactgcagcacttgata

SEQ ID NO: 71650 - DNA, 22 bp, Artificial sequence
  SiRNA target sequence
aacccactgcagcacttgataa

SEQ ID NO: 71651 - DNA, 22 bp, Artificial sequence
  SiRNA target sequence
acccactgcagcacttgataag

SEQ ID NO: 71652 - DNA, 22 bp, Artificial sequence
  SiRNA target sequence
cccactgcagcacttgataagg

SEQ ID NO: 71653 - DNA, 22 bp, Artificial sequence
  SiRNA target sequence
ccactgcagcacttgataagga

SEQ ID NO: 71654 - DNA, 22 bp, Artificial sequence
  SiRNA target sequence
cactgcagcacttgataaggag

SEQ ID NO: 71655 - DNA, 22 bp, Artificial sequence
  SiRNA target sequence
actgcagcacttgataaggagt

SEQ ID NO: 71656 - DNA, 22 bp, Artificial sequence
  SiRNA target sequence
ctgcagcacttgataaggagtc

SEQ ID NO: 71657 - DNA, 22 bp, Artificial sequence
  SiRNA target sequence
tgcagcacttgataaggagtct

SEQ ID NO: 71658 - DNA, 22 bp, Artificial sequence
  SiRNA target sequence
gcagcacttgataaggagtctg

SEQ ID NO: 71659 - DNA, 22 bp, Artificial sequence
  SiRNA target sequence
cagcacttgataaggagtctga

SEQ ID NO: 71660 - DNA, 22 bp, Artificial sequence
  SiRNA target sequence
agcacttgataaggagtctgaa

SEQ ID NO: 71661 - DNA, 22 bp, Artificial sequence
  SiRNA target sequence
gcacttgataaggagtctgaaa

SEQ ID NO: 71662 - DNA, 22 bp, Artificial sequence
  SiRNA target sequence
cacttgataaggagtctgaaaa

SEQ ID NO: 71663 - DNA, 22 bp, Artificial sequence
  SiRNA target sequence
acttgataaggagtctgaaaaa

SEQ ID NO: 71664 - DNA, 22 bp, Artificial sequence
  SiRNA target sequence
cttgataaggagtctgaaaaaa

SEQ ID NO: 71665 - DNA, 22 bp, Artificial sequence
  SiRNA target sequence
ttgataaggagtctgaaaaaaa

SEQ ID NO: 71666 - DNA, 22 bp, Artificial sequence
  SiRNA target sequence
tgataaggagtctgaaaaaaag

SEQ ID NO: 71667 - DNA, 22 bp, Artificial sequence
  SiRNA target sequence
gataaggagtctgaaaaaaaga

SEQ ID NO: 71668 - DNA, 22 bp, Artificial sequence
  SiRNA target sequence
ataaggagtctgaaaaaaagat

SEQ ID NO: 71669 - DNA, 22 bp, Artificial sequence
  SiRNA target sequence
taaggagtctgaaaaaaagatt

SEQ ID NO: 71670 - DNA, 22 bp, Artificial sequence
  SiRNA target sequence
aaggagtctgaaaaaaagattt

SEQ ID NO: 71671 - DNA, 22 bp, Artificial sequence
  SiRNA target sequence
aggagtctgaaaaaaagatttt

SEQ ID NO: 71672 - DNA, 22 bp, Artificial sequence
  SiRNA target sequence
ggagtctgaaaaaaagatttta

SEQ ID NO: 71673 - DNA, 22 bp, Artificial sequence
  SiRNA target sequence
gagtctgaaaaaaagattttag

SEQ ID NO: 71674 - DNA, 22 bp, Artificial sequence
  SiRNA target sequence
agtctgaaaaaaagattttaga

SEQ ID NO: 71675 - DNA, 22 bp, Artificial sequence
  SiRNA target sequence
gtctgaaaaaaagattttagag

SEQ ID NO: 71676 - DNA, 22 bp, Artificial sequence
  SiRNA target sequence
tctgaaaaaaagattttagaga

SEQ ID NO: 71677 - DNA, 22 bp, Artificial sequence
  SiRNA target sequence
ctgaaaaaaagattttagagat

SEQ ID NO: 71678 - DNA, 22 bp, Artificial sequence
  SiRNA target sequence
tgaaaaaaagattttagagata

SEQ ID NO: 71679 - DNA, 22 bp, Artificial sequence
  SiRNA target sequence
gaaaaaaagattttagagataa

SEQ ID NO: 71680 - DNA, 22 bp, Artificial sequence
  SiRNA target sequence
aaaaaaagattttagagataat

SEQ ID NO: 71681 - DNA, 22 bp, Artificial sequence
  SiRNA target sequence
aaaaaagattttagagataatt

SEQ ID NO: 71682 - DNA, 22 bp, Artificial sequence
  SiRNA target sequence
aaaaagattttagagataattt

SEQ ID NO: 71683 - DNA, 22 bp, Artificial sequence
  SiRNA target sequence
aaaagattttagagataatttt

SEQ ID NO: 71684 - DNA, 22 bp, Artificial sequence
  SiRNA target sequence
aaagattttagagataatttta

SEQ ID NO: 71685 - DNA, 22 bp, Artificial sequence
  SiRNA target sequence
aagattttagagataattttac

SEQ ID NO: 71686 - DNA, 22 bp, Artificial sequence
  SiRNA target sequence
agattttagagataattttaca

SEQ ID NO: 71687 - DNA, 22 bp, Artificial sequence
  SiRNA target sequence
gattttagagataattttacaa

SEQ ID NO: 71688 - DNA, 22 bp, Artificial sequence
  SiRNA target sequence
attttagagataattttacaac

SEQ ID NO: 71689 - DNA, 22 bp, Artificial sequence
  SiRNA target sequence
ttttagagataattttacaaca

SEQ ID NO: 71690 - DNA, 22 bp, Artificial sequence
  SiRNA target sequence
tttagagataattttacaacag

SEQ ID NO: 71691 - DNA, 22 bp, Artificial sequence
  SiRNA target sequence
ttagagataattttacaacagg

SEQ ID NO: 71692 - DNA, 22 bp, Artificial sequence
  SiRNA target sequence
tagagataattttacaacagga

SEQ ID NO: 71693 - DNA, 22 bp, Artificial sequence
  SiRNA target sequence
agagataattttacaacaggaa

SEQ ID NO: 71694 - DNA, 22 bp, Artificial sequence
  SiRNA target sequence
gagataattttacaacaggaag

SEQ ID NO: 71695 - DNA, 22 bp, Artificial sequence
  SiRNA target sequence
agataattttacaacaggaaga

SEQ ID NO: 71696 - DNA, 22 bp, Artificial sequence
  SiRNA target sequence
gataattttacaacaggaagat

SEQ ID NO: 71697 - DNA, 22 bp, Artificial sequence
  SiRNA target sequence
ataattttacaacaggaagatc

SEQ ID NO: 71698 - DNA, 22 bp, Artificial sequence
  SiRNA target sequence
taattttacaacaggaagatcg

SEQ ID NO: 71699 - DNA, 22 bp, Artificial sequence
  SiRNA target sequence
aattttacaacaggaagatcga

SEQ ID NO: 71700 - DNA, 22 bp, Artificial sequence
  SiRNA target sequence
attttacaacaggaagatcgaa

SEQ ID NO: 71701 - DNA, 22 bp, Artificial sequence
  SiRNA target sequence
ttttacaacaggaagatcgaac

SEQ ID NO: 71702 - DNA, 22 bp, Artificial sequence
  SiRNA target sequence
tttacaacaggaagatcgaaca

SEQ ID NO: 71703 - DNA, 22 bp, Artificial sequence
  SiRNA target sequence
ttacaacaggaagatcgaacag

SEQ ID NO: 71704 - DNA, 22 bp, Artificial sequence
  SiRNA target sequence
tacaacaggaagatcgaacagt

SEQ ID NO: 71705 - DNA, 22 bp, Artificial sequence
  SiRNA target sequence
acaacaggaagatcgaacagtt

SEQ ID NO: 71706 - DNA, 22 bp, Artificial sequence
  SiRNA target sequence
caacaggaagatcgaacagttt

SEQ ID NO: 71707 - DNA, 22 bp, Artificial sequence
  SiRNA target sequence
aacaggaagatcgaacagtttt

SEQ ID NO: 71708 - DNA, 22 bp, Artificial sequence
  SiRNA target sequence
acaggaagatcgaacagttttg

SEQ ID NO: 71709 - DNA, 22 bp, Artificial sequence
  SiRNA target sequence
caggaagatcgaacagttttga

SEQ ID NO: 71710 - DNA, 22 bp, Artificial sequence
  SiRNA target sequence
aggaagatcgaacagttttgat

SEQ ID NO: 71711 - DNA, 22 bp, Artificial sequence
  SiRNA target sequence
ggaagatcgaacagttttgatg

SEQ ID NO: 71712 - DNA, 22 bp, Artificial sequence
  SiRNA target sequence
gaagatcgaacagttttgatga

SEQ ID NO: 71713 - DNA, 22 bp, Artificial sequence
  SiRNA target sequence
aagatcgaacagttttgatgat

SEQ ID NO: 71714 - DNA, 22 bp, Artificial sequence
  SiRNA target sequence
agatcgaacagttttgatgata

SEQ ID NO: 71715 - DNA, 22 bp, Artificial sequence
  SiRNA target sequence
gatcgaacagttttgatgataa

SEQ ID NO: 71716 - DNA, 22 bp, Artificial sequence
  SiRNA target sequence
atcgaacagttttgatgataat

SEQ ID NO: 71717 - DNA, 22 bp, Artificial sequence
  SiRNA target sequence
tcgaacagttttgatgataatt

SEQ ID NO: 71718 - DNA, 22 bp, Artificial sequence
  SiRNA target sequence
cgaacagttttgatgataattc

SEQ ID NO: 71719 - DNA, 22 bp, Artificial sequence
  SiRNA target sequence
gaacagttttgatgataattca

SEQ ID NO: 71720 - DNA, 22 bp, Artificial sequence
  SiRNA target sequence
aacagttttgatgataattcat

SEQ ID NO: 71721 - DNA, 22 bp, Artificial sequence
  SiRNA target sequence
acagttttgatgataattcata

SEQ ID NO: 71722 - DNA, 22 bp, Artificial sequence
  SiRNA target sequence
cagttttgatgataattcataa

SEQ ID NO: 71723 - DNA, 22 bp, Artificial sequence
  SiRNA target sequence
agttttgatgataattcataat

SEQ ID NO: 71724 - DNA, 22 bp, Artificial sequence
  SiRNA target sequence
gttttgatgataattcataatc

SEQ ID NO: 71725 - DNA, 22 bp, Artificial sequence
  SiRNA target sequence
ttttgatgataattcataatct

SEQ ID NO: 71726 - DNA, 22 bp, Artificial sequence
  SiRNA target sequence
tttgatgataattcataatcta

SEQ ID NO: 71727 - DNA, 22 bp, Artificial sequence
  SiRNA target sequence
ttgatgataattcataatctag

SEQ ID NO: 71728 - DNA, 22 bp, Artificial sequence
  SiRNA target sequence
tgatgataattcataatctaga

SEQ ID NO: 71729 - DNA, 22 bp, Artificial sequence
  SiRNA target sequence
gatgataattcataatctagaa

SEQ ID NO: 71730 - DNA, 22 bp, Artificial sequence
  SiRNA target sequence
atgataattcataatctagaac

SEQ ID NO: 71731 - DNA, 22 bp, Artificial sequence
  SiRNA target sequence
tgataattcataatctagaact

SEQ ID NO: 71732 - DNA, 22 bp, Artificial sequence
  SiRNA target sequence
gataattcataatctagaactt

SEQ ID NO: 71733 - DNA, 22 bp, Artificial sequence
  SiRNA target sequence
ataattcataatctagaactta

SEQ ID NO: 71734 - DNA, 22 bp, Artificial sequence
  SiRNA target sequence
taattcataatctagaacttat

SEQ ID NO: 71735 - DNA, 22 bp, Artificial sequence
  SiRNA target sequence
aattcataatctagaacttatt

SEQ ID NO: 71736 - DNA, 22 bp, Artificial sequence
  SiRNA target sequence
attcataatctagaacttatta

SEQ ID NO: 71737 - DNA, 22 bp, Artificial sequence
  SiRNA target sequence
ttcataatctagaacttattaa

SEQ ID NO: 71738 - DNA, 22 bp, Artificial sequence
  SiRNA target sequence
tcataatctagaacttattaat

SEQ ID NO: 71739 - DNA, 22 bp, Artificial sequence
  SiRNA target sequence
cataatctagaacttattaata

SEQ ID NO: 71740 - DNA, 22 bp, Artificial sequence
  SiRNA target sequence
ataatctagaacttattaataa

SEQ ID NO: 71741 - DNA, 22 bp, Artificial sequence
  SiRNA target sequence
taatctagaacttattaataaa

SEQ ID NO: 71742 - DNA, 22 bp, Artificial sequence
  SiRNA target sequence
aatctagaacttattaataaat

SEQ ID NO: 71743 - DNA, 22 bp, Artificial sequence
  SiRNA target sequence
atctagaacttattaataaatt

SEQ ID NO: 71744 - DNA, 22 bp, Artificial sequence
  SiRNA target sequence
tctagaacttattaataaattt

SEQ ID NO: 71745 - DNA, 22 bp, Artificial sequence
  SiRNA target sequence
ctagaacttattaataaatttg

SEQ ID NO: 71746 - DNA, 22 bp, Artificial sequence
  SiRNA target sequence
tagaacttattaataaatttga

SEQ ID NO: 71747 - DNA, 22 bp, Artificial sequence
  SiRNA target sequence
agaacttattaataaatttgat

SEQ ID NO: 71748 - DNA, 22 bp, Artificial sequence
  SiRNA target sequence
gaacttattaataaatttgata

SEQ ID NO: 71749 - DNA, 22 bp, Artificial sequence
  SiRNA target sequence
aacttattaataaatttgataa

SEQ ID NO: 71750 - DNA, 22 bp, Artificial sequence
  SiRNA target sequence
acttattaataaatttgataaa

SEQ ID NO: 71751 - DNA, 22 bp, Artificial sequence
  SiRNA target sequence
cttattaataaatttgataaaa

SEQ ID NO: 71752 - DNA, 22 bp, Artificial sequence
  SiRNA target sequence
ttattaataaatttgataaaat

SEQ ID NO: 71753 - DNA, 22 bp, Artificial sequence
  SiRNA target sequence
tattaataaatttgataaaata

SEQ ID NO: 71754 - DNA, 22 bp, Artificial sequence
  SiRNA target sequence
attaataaatttgataaaataa

SEQ ID NO: 71755 - DNA, 22 bp, Artificial sequence
  SiRNA target sequence
ttaataaatttgataaaataat

SEQ ID NO: 71756 - DNA, 22 bp, Artificial sequence
  SiRNA target sequence
taataaatttgataaaataatt

SEQ ID NO: 71757 - DNA, 22 bp, Artificial sequence
  SiRNA target sequence
aataaatttgataaaataattt

SEQ ID NO: 71758 - DNA, 22 bp, Artificial sequence
  SiRNA target sequence
ataaatttgataaaataattta

SEQ ID NO: 71759 - DNA, 22 bp, Artificial sequence
  SiRNA target sequence
taaatttgataaaataatttac

SEQ ID NO: 71760 - DNA, 22 bp, Artificial sequence
  SiRNA target sequence
aaatttgataaaataatttaca

SEQ ID NO: 71761 - DNA, 22 bp, Artificial sequence
  SiRNA target sequence
aatttgataaaataatttacat

SEQ ID NO: 71762 - DNA, 22 bp, Artificial sequence
  SiRNA target sequence
atttgataaaataatttacatt

SEQ ID NO: 71763 - DNA, 22 bp, Artificial sequence
  SiRNA target sequence
tttgataaaataatttacattg

SEQ ID NO: 71764 - DNA, 22 bp, Artificial sequence
  SiRNA target sequence
ttgataaaataatttacattga

SEQ ID NO: 71765 - DNA, 22 bp, Artificial sequence
  SiRNA target sequence
tgataaaataatttacattgat

SEQ ID NO: 71766 - DNA, 22 bp, Artificial sequence
  SiRNA target sequence
gataaaataatttacattgatg

SEQ ID NO: 71767 - DNA, 22 bp, Artificial sequence
  SiRNA target sequence
ataaaataatttacattgatga

SEQ ID NO: 71768 - DNA, 22 bp, Artificial sequence
  SiRNA target sequence
taaaataatttacattgatgaa

SEQ ID NO: 71769 - DNA, 22 bp, Artificial sequence
  SiRNA target sequence
aaaataatttacattgatgaaa

SEQ ID NO: 71770 - DNA, 22 bp, Artificial sequence
  SiRNA target sequence
aaataatttacattgatgaaaa

SEQ ID NO: 71771 - DNA, 22 bp, Artificial sequence
  SiRNA target sequence
aataatttacattgatgaaaat

SEQ ID NO: 71772 - DNA, 22 bp, Artificial sequence
  SiRNA target sequence
ataatttacattgatgaaaata

SEQ ID NO: 71773 - DNA, 22 bp, Artificial sequence
  SiRNA target sequence
taatttacattgatgaaaataa

SEQ ID NO: 71774 - DNA, 22 bp, Artificial sequence
  SiRNA target sequence
aatttacattgatgaaaataat

SEQ ID NO: 71775 - DNA, 22 bp, Artificial sequence
  SiRNA target sequence
atttacattgatgaaaataata

SEQ ID NO: 71776 - DNA, 22 bp, Artificial sequence
  SiRNA target sequence
tttacattgatgaaaataatat

SEQ ID NO: 71777 - DNA, 22 bp, Artificial sequence
  SiRNA target sequence
ttacattgatgaaaataatata

SEQ ID NO: 71778 - DNA, 22 bp, Artificial sequence
  SiRNA target sequence
tacattgatgaaaataatatag

SEQ ID NO: 71779 - DNA, 22 bp, Artificial sequence
  SiRNA target sequence
acattgatgaaaataatataga

SEQ ID NO: 71780 - DNA, 22 bp, Artificial sequence
  SiRNA target sequence
cattgatgaaaataatatagaa

SEQ ID NO: 71781 - DNA, 22 bp, Artificial sequence
  SiRNA target sequence
attgatgaaaataatatagaag

SEQ ID NO: 71782 - DNA, 22 bp, Artificial sequence
  SiRNA target sequence
ttgatgaaaataatatagaagt

SEQ ID NO: 71783 - DNA, 22 bp, Artificial sequence
  SiRNA target sequence
tgatgaaaataatatagaagtc

SEQ ID NO: 71784 - DNA, 22 bp, Artificial sequence
  SiRNA target sequence
gatgaaaataatatagaagtct

SEQ ID NO: 71785 - DNA, 22 bp, Artificial sequence
  SiRNA target sequence
atgaaaataatatagaagtcta

SEQ ID NO: 71786 - DNA, 22 bp, Artificial sequence
  SiRNA target sequence
tgaaaataatatagaagtctat

SEQ ID NO: 71787 - DNA, 22 bp, Artificial sequence
  SiRNA target sequence
gaaaataatatagaagtctata

SEQ ID NO: 71788 - DNA, 22 bp, Artificial sequence
  SiRNA target sequence
aaaataatatagaagtctataa

SEQ ID NO: 71789 - DNA, 22 bp, Artificial sequence
  SiRNA target sequence
aaataatatagaagtctataaa

SEQ ID NO: 71790 - DNA, 22 bp, Artificial sequence
  SiRNA target sequence
aataatatagaagtctataaaa

SEQ ID NO: 71791 - DNA, 22 bp, Artificial sequence
  SiRNA target sequence
ataatatagaagtctataaaaa

SEQ ID NO: 71792 - DNA, 22 bp, Artificial sequence
  SiRNA target sequence
taatatagaagtctataaaaat

SEQ ID NO: 71793 - DNA, 22 bp, Artificial sequence
  SiRNA target sequence
aatatagaagtctataaaaatg

SEQ ID NO: 71794 - DNA, 22 bp, Artificial sequence
  SiRNA target sequence
atatagaagtctataaaaatga

SEQ ID NO: 71795 - DNA, 22 bp, Artificial sequence
  SiRNA target sequence
tatagaagtctataaaaatgat

SEQ ID NO: 71796 - DNA, 22 bp, Artificial sequence
  SiRNA target sequence
atagaagtctataaaaatgata

SEQ ID NO: 71797 - DNA, 22 bp, Artificial sequence
  SiRNA target sequence
tagaagtctataaaaatgatat

SEQ ID NO: 71798 - DNA, 22 bp, Artificial sequence
  SiRNA target sequence
agaagtctataaaaatgatatt

SEQ ID NO: 71799 - DNA, 22 bp, Artificial sequence
  SiRNA target sequence
gaagtctataaaaatgatattg

SEQ ID NO: 71800 - DNA, 22 bp, Artificial sequence
  SiRNA target sequence
aagtctataaaaatgatattga

SEQ ID NO: 71801 - DNA, 22 bp, Artificial sequence
  SiRNA target sequence
agtctataaaaatgatattgaa

SEQ ID NO: 71802 - DNA, 22 bp, Artificial sequence
  SiRNA target sequence
gtctataaaaatgatattgaag

SEQ ID NO: 71803 - DNA, 22 bp, Artificial sequence
  SiRNA target sequence
tctataaaaatgatattgaagg

SEQ ID NO: 71804 - DNA, 22 bp, Artificial sequence
  SiRNA target sequence
ctataaaaatgatattgaagga

SEQ ID NO: 71805 - DNA, 22 bp, Artificial sequence
  SiRNA target sequence
tataaaaatgatattgaaggac

SEQ ID NO: 71806 - DNA, 22 bp, Artificial sequence
  SiRNA target sequence
ataaaaatgatattgaaggaca

SEQ ID NO: 71807 - DNA, 22 bp, Artificial sequence
  SiRNA target sequence
taaaaatgatattgaaggacaa

SEQ ID NO: 71808 - DNA, 22 bp, Artificial sequence
  SiRNA target sequence
aaaaatgatattgaaggacaaa

SEQ ID NO: 71809 - DNA, 22 bp, Artificial sequence
  SiRNA target sequence
aaaatgatattgaaggacaaaa

SEQ ID NO: 71810 - DNA, 22 bp, Artificial sequence
  SiRNA target sequence
aaatgatattgaaggacaaaaa

SEQ ID NO: 71811 - DNA, 22 bp, Artificial sequence
  SiRNA target sequence
aatgatattgaaggacaaaaaa

SEQ ID NO: 71812 - DNA, 22 bp, Artificial sequence
  SiRNA target sequence
atgatattgaaggacaaaaaaa

SEQ ID NO: 71813 - DNA, 22 bp, Artificial sequence
  SiRNA target sequence
tgatattgaaggacaaaaaaag

SEQ ID NO: 71814 - DNA, 22 bp, Artificial sequence
  SiRNA target sequence
gatattgaaggacaaaaaaagt

SEQ ID NO: 71815 - DNA, 22 bp, Artificial sequence
  SiRNA target sequence
atattgaaggacaaaaaaagtt

SEQ ID NO: 71816 - DNA, 22 bp, Artificial sequence
  SiRNA target sequence
tattgaaggacaaaaaaagttt

SEQ ID NO: 71817 - DNA, 22 bp, Artificial sequence
  SiRNA target sequence
attgaaggacaaaaaaagtttt

SEQ ID NO: 71818 - DNA, 22 bp, Artificial sequence
  SiRNA target sequence
ttgaaggacaaaaaaagttttc

SEQ ID NO: 71819 - DNA, 22 bp, Artificial sequence
  SiRNA target sequence
tgaaggacaaaaaaagttttct

SEQ ID NO: 71820 - DNA, 22 bp, Artificial sequence
  SiRNA target sequence
gaaggacaaaaaaagttttcta

SEQ ID NO: 71821 - DNA, 22 bp, Artificial sequence
  SiRNA target sequence
aaggacaaaaaaagttttctac

SEQ ID NO: 71822 - DNA, 22 bp, Artificial sequence
  SiRNA target sequence
aggacaaaaaaagttttctaca

SEQ ID NO: 71823 - DNA, 22 bp, Artificial sequence
  SiRNA target sequence
ggacaaaaaaagttttctacaa

SEQ ID NO: 71824 - DNA, 22 bp, Artificial sequence
  SiRNA target sequence
gacaaaaaaagttttctacaaa

SEQ ID NO: 71825 - DNA, 22 bp, Artificial sequence
  SiRNA target sequence
acaaaaaaagttttctacaaat

SEQ ID NO: 71826 - DNA, 22 bp, Artificial sequence
  SiRNA target sequence
caaaaaaagttttctacaaatt

SEQ ID NO: 71827 - DNA, 22 bp, Artificial sequence
  SiRNA target sequence
aaaaaaagttttctacaaattt

SEQ ID NO: 71828 - DNA, 22 bp, Artificial sequence
  SiRNA target sequence
aaaaaagttttctacaaattta

SEQ ID NO: 71829 - DNA, 22 bp, Artificial sequence
  SiRNA target sequence
aaaaagttttctacaaatttac

SEQ ID NO: 71830 - DNA, 22 bp, Artificial sequence
  SiRNA target sequence
aaaagttttctacaaatttaca

SEQ ID NO: 71831 - DNA, 22 bp, Artificial sequence
  SiRNA target sequence
aaagttttctacaaatttacaa

SEQ ID NO: 71832 - DNA, 22 bp, Artificial sequence
  SiRNA target sequence
aagttttctacaaatttacaat

SEQ ID NO: 71833 - DNA, 22 bp, Artificial sequence
  SiRNA target sequence
agttttctacaaatttacaata

SEQ ID NO: 71834 - DNA, 22 bp, Artificial sequence
  SiRNA target sequence
gttttctacaaatttacaatat

SEQ ID NO: 71835 - DNA, 22 bp, Artificial sequence
  SiRNA target sequence
ttttctacaaatttacaatatt

SEQ ID NO: 71836 - DNA, 22 bp, Artificial sequence
  SiRNA target sequence
tttctacaaatttacaatattt

SEQ ID NO: 71837 - DNA, 22 bp, Artificial sequence
  SiRNA target sequence
ttctacaaatttacaatatttt

SEQ ID NO: 71838 - DNA, 22 bp, Artificial sequence
  SiRNA target sequence
tctacaaatttacaatattttt

SEQ ID NO: 71839 - DNA, 22 bp, Artificial sequence
  SiRNA target sequence
ctacaaatttacaatatttttt

SEQ ID NO: 71840 - DNA, 22 bp, Artificial sequence
  SiRNA target sequence
tacaaatttacaatatttttta

SEQ ID NO: 71841 - DNA, 22 bp, Artificial sequence
  SiRNA target sequence
acaaatttacaatattttttat

SEQ ID NO: 71842 - DNA, 22 bp, Artificial sequence
  SiRNA target sequence
caaatttacaatattttttatc

SEQ ID NO: 71843 - DNA, 22 bp, Artificial sequence
  SiRNA target sequence
aaatttacaatattttttatca

SEQ ID NO: 71844 - DNA, 22 bp, Artificial sequence
  SiRNA target sequence
aatttacaatattttttatcat

SEQ ID NO: 71845 - DNA, 22 bp, Artificial sequence
  SiRNA target sequence
atttacaatattttttatcata

SEQ ID NO: 71846 - DNA, 22 bp, Artificial sequence
  SiRNA target sequence
tttacaatattttttatcatac

SEQ ID NO: 71847 - DNA, 22 bp, Artificial sequence
  SiRNA target sequence
ttacaatattttttatcataca

SEQ ID NO: 71848 - DNA, 22 bp, Artificial sequence
  SiRNA target sequence
tacaatattttttatcatacaa

SEQ ID NO: 71849 - DNA, 22 bp, Artificial sequence
  SiRNA target sequence
acaatattttttatcatacaaa

SEQ ID NO: 71850 - DNA, 22 bp, Artificial sequence
  SiRNA target sequence
caatattttttatcatacaaat

SEQ ID NO: 71851 - DNA, 22 bp, Artificial sequence
  SiRNA target sequence
aatattttttatcatacaaatt

SEQ ID NO: 71852 - DNA, 22 bp, Artificial sequence
  SiRNA target sequence
atattttttatcatacaaatta

SEQ ID NO: 71853 - DNA, 22 bp, Artificial sequence
  SiRNA target sequence
tattttttatcatacaaattag

SEQ ID NO: 71854 - DNA, 22 bp, Artificial sequence
  SiRNA target sequence
attttttatcatacaaattagg

SEQ ID NO: 71855 - DNA, 22 bp, Artificial sequence
  SiRNA target sequence
ttttttatcatacaaattaggt

SEQ ID NO: 71856 - DNA, 22 bp, Artificial sequence
  SiRNA target sequence
tttttatcatacaaattaggta

SEQ ID NO: 71857 - DNA, 22 bp, Artificial sequence
  SiRNA target sequence
ttttatcatacaaattaggtaa

SEQ ID NO: 71858 - DNA, 22 bp, Artificial sequence
  SiRNA target sequence
tttatcatacaaattaggtaaa

SEQ ID NO: 71859 - DNA, 22 bp, Artificial sequence
  SiRNA target sequence
ttatcatacaaattaggtaaat

SEQ ID NO: 71860 - DNA, 22 bp, Artificial sequence
  SiRNA target sequence
tatcatacaaattaggtaaata

SEQ ID NO: 71861 - DNA, 22 bp, Artificial sequence
  SiRNA target sequence
atcatacaaattaggtaaataa

SEQ ID NO: 71862 - DNA, 23 bp, Artificial sequence
  SiRNA target sequence
atgaaaaaaatttcgaatagaaa

SEQ ID NO: 71863 - DNA, 23 bp, Artificial sequence
  SiRNA target sequence
tgaaaaaaatttcgaatagaaaa

SEQ ID NO: 71864 - DNA, 23 bp, Artificial sequence
  SiRNA target sequence
gaaaaaaatttcgaatagaaaaa

SEQ ID NO: 71865 - DNA, 23 bp, Artificial sequence
  SiRNA target sequence
aaaaaaatttcgaatagaaaaat

SEQ ID NO: 71866 - DNA, 23 bp, Artificial sequence
  SiRNA target sequence
aaaaaatttcgaatagaaaaatt

SEQ ID NO: 71867 - DNA, 23 bp, Artificial sequence
  SiRNA target sequence
aaaaatttcgaatagaaaaatta

SEQ ID NO: 71868 - DNA, 23 bp, Artificial sequence
  SiRNA target sequence
aaaatttcgaatagaaaaattat

SEQ ID NO: 71869 - DNA, 23 bp, Artificial sequence
  SiRNA target sequence
aaatttcgaatagaaaaattatc

SEQ ID NO: 71870 - DNA, 23 bp, Artificial sequence
  SiRNA target sequence
aatttcgaatagaaaaattatca

SEQ ID NO: 71871 - DNA, 23 bp, Artificial sequence
  SiRNA target sequence
atttcgaatagaaaaattatcaa

SEQ ID NO: 71872 - DNA, 23 bp, Artificial sequence
  SiRNA target sequence
tttcgaatagaaaaattatcaaa

SEQ ID NO: 71873 - DNA, 23 bp, Artificial sequence
  SiRNA target sequence
ttcgaatagaaaaattatcaaag

SEQ ID NO: 71874 - DNA, 23 bp, Artificial sequence
  SiRNA target sequence
tcgaatagaaaaattatcaaaga

SEQ ID NO: 71875 - DNA, 23 bp, Artificial sequence
  SiRNA target sequence
cgaatagaaaaattatcaaagaa

SEQ ID NO: 71876 - DNA, 23 bp, Artificial sequence
  SiRNA target sequence
gaatagaaaaattatcaaagaaa

SEQ ID NO: 71877 - DNA, 23 bp, Artificial sequence
  SiRNA target sequence
aatagaaaaattatcaaagaaat

SEQ ID NO: 71878 - DNA, 23 bp, Artificial sequence
  SiRNA target sequence
atagaaaaattatcaaagaaatt

SEQ ID NO: 71879 - DNA, 23 bp, Artificial sequence
  SiRNA target sequence
tagaaaaattatcaaagaaatta

SEQ ID NO: 71880 - DNA, 23 bp, Artificial sequence
  SiRNA target sequence
agaaaaattatcaaagaaattat

SEQ ID NO: 71881 - DNA, 23 bp, Artificial sequence
  SiRNA target sequence
gaaaaattatcaaagaaattatt

SEQ ID NO: 71882 - DNA, 23 bp, Artificial sequence
  SiRNA target sequence
aaaaattatcaaagaaattattt

SEQ ID NO: 71883 - DNA, 23 bp, Artificial sequence
  SiRNA target sequence
aaaattatcaaagaaattattta

SEQ ID NO: 71884 - DNA, 23 bp, Artificial sequence
  SiRNA target sequence
aaattatcaaagaaattatttac

SEQ ID NO: 71885 - DNA, 23 bp, Artificial sequence
  SiRNA target sequence
aattatcaaagaaattatttaca

SEQ ID NO: 71886 - DNA, 23 bp, Artificial sequence
  SiRNA target sequence
attatcaaagaaattatttacaa

SEQ ID NO: 71887 - DNA, 23 bp, Artificial sequence
  SiRNA target sequence
ttatcaaagaaattatttacaat

SEQ ID NO: 71888 - DNA, 23 bp, Artificial sequence
  SiRNA target sequence
tatcaaagaaattatttacaatg

SEQ ID NO: 71889 - DNA, 23 bp, Artificial sequence
  SiRNA target sequence
atcaaagaaattatttacaatga

SEQ ID NO: 71890 - DNA, 23 bp, Artificial sequence
  SiRNA target sequence
tcaaagaaattatttacaatgat

SEQ ID NO: 71891 - DNA, 23 bp, Artificial sequence
  SiRNA target sequence
caaagaaattatttacaatgatt

SEQ ID NO: 71892 - DNA, 23 bp, Artificial sequence
  SiRNA target sequence
aaagaaattatttacaatgattt

SEQ ID NO: 71893 - DNA, 23 bp, Artificial sequence
  SiRNA target sequence
aagaaattatttacaatgattta

SEQ ID NO: 71894 - DNA, 23 bp, Artificial sequence
  SiRNA target sequence
agaaattatttacaatgatttat

SEQ ID NO: 71895 - DNA, 23 bp, Artificial sequence
  SiRNA target sequence
gaaattatttacaatgatttatt

SEQ ID NO: 71896 - DNA, 23 bp, Artificial sequence
  SiRNA target sequence
aaattatttacaatgatttatta

SEQ ID NO: 71897 - DNA, 23 bp, Artificial sequence
  SiRNA target sequence
aattatttacaatgatttattaa

SEQ ID NO: 71898 - DNA, 23 bp, Artificial sequence
  SiRNA target sequence
attatttacaatgatttattaaa

SEQ ID NO: 71899 - DNA, 23 bp, Artificial sequence
  SiRNA target sequence
ttatttacaatgatttattaaaa

SEQ ID NO: 71900 - DNA, 23 bp, Artificial sequence
  SiRNA target sequence
tatttacaatgatttattaaaaa

SEQ ID NO: 71901 - DNA, 23 bp, Artificial sequence
  SiRNA target sequence
atttacaatgatttattaaaaat

SEQ ID NO: 71902 - DNA, 23 bp, Artificial sequence
  SiRNA target sequence
tttacaatgatttattaaaaata

SEQ ID NO: 71903 - DNA, 23 bp, Artificial sequence
  SiRNA target sequence
ttacaatgatttattaaaaataa

SEQ ID NO: 71904 - DNA, 23 bp, Artificial sequence
  SiRNA target sequence
tacaatgatttattaaaaataag

SEQ ID NO: 71905 - DNA, 23 bp, Artificial sequence
  SiRNA target sequence
acaatgatttattaaaaataaga

SEQ ID NO: 71906 - DNA, 23 bp, Artificial sequence
  SiRNA target sequence
caatgatttattaaaaataagaa

SEQ ID NO: 71907 - DNA, 23 bp, Artificial sequence
  SiRNA target sequence
aatgatttattaaaaataagaat

SEQ ID NO: 71908 - DNA, 23 bp, Artificial sequence
  SiRNA target sequence
atgatttattaaaaataagaatg

SEQ ID NO: 71909 - DNA, 23 bp, Artificial sequence
  SiRNA target sequence
tgatttattaaaaataagaatgt

SEQ ID NO: 71910 - DNA, 23 bp, Artificial sequence
  SiRNA target sequence
gatttattaaaaataagaatgtt

SEQ ID NO: 71911 - DNA, 23 bp, Artificial sequence
  SiRNA target sequence
atttattaaaaataagaatgttg

SEQ ID NO: 71912 - DNA, 23 bp, Artificial sequence
  SiRNA target sequence
tttattaaaaataagaatgttgc

SEQ ID NO: 71913 - DNA, 23 bp, Artificial sequence
  SiRNA target sequence
ttattaaaaataagaatgttgcg

SEQ ID NO: 71914 - DNA, 23 bp, Artificial sequence
  SiRNA target sequence
tattaaaaataagaatgttgcga

SEQ ID NO: 71915 - DNA, 23 bp, Artificial sequence
  SiRNA target sequence
attaaaaataagaatgttgcgat

SEQ ID NO: 71916 - DNA, 23 bp, Artificial sequence
  SiRNA target sequence
ttaaaaataagaatgttgcgata

SEQ ID NO: 71917 - DNA, 23 bp, Artificial sequence
  SiRNA target sequence
taaaaataagaatgttgcgatat

SEQ ID NO: 71918 - DNA, 23 bp, Artificial sequence
  SiRNA target sequence
aaaaataagaatgttgcgatatg

SEQ ID NO: 71919 - DNA, 23 bp, Artificial sequence
  SiRNA target sequence
aaaataagaatgttgcgatatgt

SEQ ID NO: 71920 - DNA, 23 bp, Artificial sequence
  SiRNA target sequence
aaataagaatgttgcgatatgtt

SEQ ID NO: 71921 - DNA, 23 bp, Artificial sequence
  SiRNA target sequence
aataagaatgttgcgatatgtta

SEQ ID NO: 71922 - DNA, 23 bp, Artificial sequence
  SiRNA target sequence
ataagaatgttgcgatatgttat

SEQ ID NO: 71923 - DNA, 23 bp, Artificial sequence
  SiRNA target sequence
taagaatgttgcgatatgttatt

SEQ ID NO: 71924 - DNA, 23 bp, Artificial sequence
  SiRNA target sequence
aagaatgttgcgatatgttattg

SEQ ID NO: 71925 - DNA, 23 bp, Artificial sequence
  SiRNA target sequence
agaatgttgcgatatgttattgt

SEQ ID NO: 71926 - DNA, 23 bp, Artificial sequence
  SiRNA target sequence
gaatgttgcgatatgttattgta

SEQ ID NO: 71927 - DNA, 23 bp, Artificial sequence
  SiRNA target sequence
aatgttgcgatatgttattgtac

SEQ ID NO: 71928 - DNA, 23 bp, Artificial sequence
  SiRNA target sequence
atgttgcgatatgttattgtacc

SEQ ID NO: 71929 - DNA, 23 bp, Artificial sequence
  SiRNA target sequence
tgttgcgatatgttattgtacca

SEQ ID NO: 71930 - DNA, 23 bp, Artificial sequence
  SiRNA target sequence
gttgcgatatgttattgtaccaa

SEQ ID NO: 71931 - DNA, 23 bp, Artificial sequence
  SiRNA target sequence
ttgcgatatgttattgtaccaat

SEQ ID NO: 71932 - DNA, 23 bp, Artificial sequence
  SiRNA target sequence
tgcgatatgttattgtaccaata

SEQ ID NO: 71933 - DNA, 23 bp, Artificial sequence
  SiRNA target sequence
gcgatatgttattgtaccaataa

SEQ ID NO: 71934 - DNA, 23 bp, Artificial sequence
  SiRNA target sequence
cgatatgttattgtaccaataat

SEQ ID NO: 71935 - DNA, 23 bp, Artificial sequence
  SiRNA target sequence
gatatgttattgtaccaataata

SEQ ID NO: 71936 - DNA, 23 bp, Artificial sequence
  SiRNA target sequence
atatgttattgtaccaataatat

SEQ ID NO: 71937 - DNA, 23 bp, Artificial sequence
  SiRNA target sequence
tatgttattgtaccaataatatt

SEQ ID NO: 71938 - DNA, 23 bp, Artificial sequence
  SiRNA target sequence
atgttattgtaccaataatattt

SEQ ID NO: 71939 - DNA, 23 bp, Artificial sequence
  SiRNA target sequence
tgttattgtaccaataatatttt

SEQ ID NO: 71940 - DNA, 23 bp, Artificial sequence
  SiRNA target sequence
gttattgtaccaataatattttt

SEQ ID NO: 71941 - DNA, 23 bp, Artificial sequence
  SiRNA target sequence
ttattgtaccaataatattttta

SEQ ID NO: 71942 - DNA, 23 bp, Artificial sequence
  SiRNA target sequence
tattgtaccaataatatttttaa

SEQ ID NO: 71943 - DNA, 23 bp, Artificial sequence
  SiRNA target sequence
attgtaccaataatatttttaac

SEQ ID NO: 71944 - DNA, 23 bp, Artificial sequence
  SiRNA target sequence
ttgtaccaataatatttttaact

SEQ ID NO: 71945 - DNA, 23 bp, Artificial sequence
  SiRNA target sequence
tgtaccaataatatttttaacta

SEQ ID NO: 71946 - DNA, 23 bp, Artificial sequence
  SiRNA target sequence
gtaccaataatatttttaactat

SEQ ID NO: 71947 - DNA, 23 bp, Artificial sequence
  SiRNA target sequence
taccaataatatttttaactata

SEQ ID NO: 71948 - DNA, 23 bp, Artificial sequence
  SiRNA target sequence
accaataatatttttaactatat

SEQ ID NO: 71949 - DNA, 23 bp, Artificial sequence
  SiRNA target sequence
ccaataatatttttaactatatt

SEQ ID NO: 71950 - DNA, 23 bp, Artificial sequence
  SiRNA target sequence
caataatatttttaactatattt

SEQ ID NO: 71951 - DNA, 23 bp, Artificial sequence
  SiRNA target sequence
aataatatttttaactatatttt

SEQ ID NO: 71952 - DNA, 23 bp, Artificial sequence
  SiRNA target sequence
ataatatttttaactatatttta

SEQ ID NO: 71953 - DNA, 23 bp, Artificial sequence
  SiRNA target sequence
taatatttttaactatattttac

SEQ ID NO: 71954 - DNA, 23 bp, Artificial sequence
  SiRNA target sequence
aatatttttaactatattttaca

SEQ ID NO: 71955 - DNA, 23 bp, Artificial sequence
  SiRNA target sequence
atatttttaactatattttacac

SEQ ID NO: 71956 - DNA, 23 bp, Artificial sequence
  SiRNA target sequence
tatttttaactatattttacact

SEQ ID NO: 71957 - DNA, 23 bp, Artificial sequence
  SiRNA target sequence
atttttaactatattttacactg

SEQ ID NO: 71958 - DNA, 23 bp, Artificial sequence
  SiRNA target sequence
tttttaactatattttacactgt

SEQ ID NO: 71959 - DNA, 23 bp, Artificial sequence
  SiRNA target sequence
ttttaactatattttacactgtt

SEQ ID NO: 71960 - DNA, 23 bp, Artificial sequence
  SiRNA target sequence
tttaactatattttacactgttt

SEQ ID NO: 71961 - DNA, 23 bp, Artificial sequence
  SiRNA target sequence
ttaactatattttacactgtttt

SEQ ID NO: 71962 - DNA, 23 bp, Artificial sequence
  SiRNA target sequence
taactatattttacactgtttta

SEQ ID NO: 71963 - DNA, 23 bp, Artificial sequence
  SiRNA target sequence
aactatattttacactgttttag

SEQ ID NO: 71964 - DNA, 23 bp, Artificial sequence
  SiRNA target sequence
actatattttacactgttttaga

SEQ ID NO: 71965 - DNA, 23 bp, Artificial sequence
  SiRNA target sequence
ctatattttacactgttttagag

SEQ ID NO: 71966 - DNA, 23 bp, Artificial sequence
  SiRNA target sequence
tatattttacactgttttagaga

SEQ ID NO: 71967 - DNA, 23 bp, Artificial sequence
  SiRNA target sequence
atattttacactgttttagagat

SEQ ID NO: 71968 - DNA, 23 bp, Artificial sequence
  SiRNA target sequence
tattttacactgttttagagata

SEQ ID NO: 71969 - DNA, 23 bp, Artificial sequence
  SiRNA target sequence
attttacactgttttagagataa

SEQ ID NO: 71970 - DNA, 23 bp, Artificial sequence
  SiRNA target sequence
ttttacactgttttagagataaa

SEQ ID NO: 71971 - DNA, 23 bp, Artificial sequence
  SiRNA target sequence
tttacactgttttagagataaaa

SEQ ID NO: 71972 - DNA, 23 bp, Artificial sequence
  SiRNA target sequence
ttacactgttttagagataaaaa

SEQ ID NO: 71973 - DNA, 23 bp, Artificial sequence
  SiRNA target sequence
tacactgttttagagataaaaat

SEQ ID NO: 71974 - DNA, 23 bp, Artificial sequence
  SiRNA target sequence
acactgttttagagataaaaata

SEQ ID NO: 71975 - DNA, 23 bp, Artificial sequence
  SiRNA target sequence
cactgttttagagataaaaataa

SEQ ID NO: 71976 - DNA, 23 bp, Artificial sequence
  SiRNA target sequence
actgttttagagataaaaataag

SEQ ID NO: 71977 - DNA, 23 bp, Artificial sequence
  SiRNA target sequence
ctgttttagagataaaaataagt

SEQ ID NO: 71978 - DNA, 23 bp, Artificial sequence
  SiRNA target sequence
tgttttagagataaaaataagta

SEQ ID NO: 71979 - DNA, 23 bp, Artificial sequence
  SiRNA target sequence
gttttagagataaaaataagtac

SEQ ID NO: 71980 - DNA, 23 bp, Artificial sequence
  SiRNA target sequence
ttttagagataaaaataagtaca

SEQ ID NO: 71981 - DNA, 23 bp, Artificial sequence
  SiRNA target sequence
tttagagataaaaataagtacat

SEQ ID NO: 71982 - DNA, 23 bp, Artificial sequence
  SiRNA target sequence
ttagagataaaaataagtacatt

SEQ ID NO: 71983 - DNA, 23 bp, Artificial sequence
  SiRNA target sequence
tagagataaaaataagtacatta

SEQ ID NO: 71984 - DNA, 23 bp, Artificial sequence
  SiRNA target sequence
agagataaaaataagtacattag

SEQ ID NO: 71985 - DNA, 23 bp, Artificial sequence
  SiRNA target sequence
gagataaaaataagtacattagt

SEQ ID NO: 71986 - DNA, 23 bp, Artificial sequence
  SiRNA target sequence
agataaaaataagtacattagta

SEQ ID NO: 71987 - DNA, 23 bp, Artificial sequence
  SiRNA target sequence
gataaaaataagtacattagtaa

SEQ ID NO: 71988 - DNA, 23 bp, Artificial sequence
  SiRNA target sequence
ataaaaataagtacattagtaaa

SEQ ID NO: 71989 - DNA, 23 bp, Artificial sequence
  SiRNA target sequence
taaaaataagtacattagtaaag

SEQ ID NO: 71990 - DNA, 23 bp, Artificial sequence
  SiRNA target sequence
aaaaataagtacattagtaaaga

SEQ ID NO: 71991 - DNA, 23 bp, Artificial sequence
  SiRNA target sequence
aaaataagtacattagtaaagaa

SEQ ID NO: 71992 - DNA, 23 bp, Artificial sequence
  SiRNA target sequence
aaataagtacattagtaaagaat

SEQ ID NO: 71993 - DNA, 23 bp, Artificial sequence
  SiRNA target sequence
aataagtacattagtaaagaatc

SEQ ID NO: 71994 - DNA, 23 bp, Artificial sequence
  SiRNA target sequence
ataagtacattagtaaagaatct

SEQ ID NO: 71995 - DNA, 23 bp, Artificial sequence
  SiRNA target sequence
taagtacattagtaaagaatctt

SEQ ID NO: 71996 - DNA, 23 bp, Artificial sequence
  SiRNA target sequence
aagtacattagtaaagaatctta

SEQ ID NO: 71997 - DNA, 23 bp, Artificial sequence
  SiRNA target sequence
agtacattagtaaagaatcttaa

SEQ ID NO: 71998 - DNA, 23 bp, Artificial sequence
  SiRNA target sequence
gtacattagtaaagaatcttaat

SEQ ID NO: 71999 - DNA, 23 bp, Artificial sequence
  SiRNA target sequence
tacattagtaaagaatcttaatc

SEQ ID NO: 72000 - DNA, 23 bp, Artificial sequence
  SiRNA target sequence
acattagtaaagaatcttaatca

SEQ ID NO: 72001 - DNA, 23 bp, Artificial sequence
  SiRNA target sequence
cattagtaaagaatcttaatcaa

SEQ ID NO: 72002 - DNA, 23 bp, Artificial sequence
  SiRNA target sequence
attagtaaagaatcttaatcaat

SEQ ID NO: 72003 - DNA, 23 bp, Artificial sequence
  SiRNA target sequence
ttagtaaagaatcttaatcaatc

SEQ ID NO: 72004 - DNA, 23 bp, Artificial sequence
  SiRNA target sequence
tagtaaagaatcttaatcaatct

SEQ ID NO: 72005 - DNA, 23 bp, Artificial sequence
  SiRNA target sequence
agtaaagaatcttaatcaatcta

SEQ ID NO: 72006 - DNA, 23 bp, Artificial sequence
  SiRNA target sequence
gtaaagaatcttaatcaatctat

SEQ ID NO: 72007 - DNA, 23 bp, Artificial sequence
  SiRNA target sequence
taaagaatcttaatcaatctatc

SEQ ID NO: 72008 - DNA, 23 bp, Artificial sequence
  SiRNA target sequence
aaagaatcttaatcaatctatcg

SEQ ID NO: 72009 - DNA, 23 bp, Artificial sequence
  SiRNA target sequence
aagaatcttaatcaatctatcgc

SEQ ID NO: 72010 - DNA, 23 bp, Artificial sequence
  SiRNA target sequence
agaatcttaatcaatctatcgca

SEQ ID NO: 72011 - DNA, 23 bp, Artificial sequence
  SiRNA target sequence
gaatcttaatcaatctatcgcaa

SEQ ID NO: 72012 - DNA, 23 bp, Artificial sequence
  SiRNA target sequence
aatcttaatcaatctatcgcaaa

SEQ ID NO: 72013 - DNA, 23 bp, Artificial sequence
  SiRNA target sequence
atcttaatcaatctatcgcaaat

SEQ ID NO: 72014 - DNA, 23 bp, Artificial sequence
  SiRNA target sequence
tcttaatcaatctatcgcaaatc

SEQ ID NO: 72015 - DNA, 23 bp, Artificial sequence
  SiRNA target sequence
cttaatcaatctatcgcaaatcg

SEQ ID NO: 72016 - DNA, 23 bp, Artificial sequence
  SiRNA target sequence
ttaatcaatctatcgcaaatcga

SEQ ID NO: 72017 - DNA, 23 bp, Artificial sequence
  SiRNA target sequence
taatcaatctatcgcaaatcgaa

SEQ ID NO: 72018 - DNA, 23 bp, Artificial sequence
  SiRNA target sequence
aatcaatctatcgcaaatcgaaa

SEQ ID NO: 72019 - DNA, 23 bp, Artificial sequence
  SiRNA target sequence
atcaatctatcgcaaatcgaaaa

SEQ ID NO: 72020 - DNA, 23 bp, Artificial sequence
  SiRNA target sequence
tcaatctatcgcaaatcgaaaag

SEQ ID NO: 72021 - DNA, 23 bp, Artificial sequence
  SiRNA target sequence
caatctatcgcaaatcgaaaagg

SEQ ID NO: 72022 - DNA, 23 bp, Artificial sequence
  SiRNA target sequence
aatctatcgcaaatcgaaaaggt

SEQ ID NO: 72023 - DNA, 23 bp, Artificial sequence
  SiRNA target sequence
atctatcgcaaatcgaaaaggtg

SEQ ID NO: 72024 - DNA, 23 bp, Artificial sequence
  SiRNA target sequence
tctatcgcaaatcgaaaaggtga

SEQ ID NO: 72025 - DNA, 23 bp, Artificial sequence
  SiRNA target sequence
ctatcgcaaatcgaaaaggtgaa

SEQ ID NO: 72026 - DNA, 23 bp, Artificial sequence
  SiRNA target sequence
tatcgcaaatcgaaaaggtgaac

SEQ ID NO: 72027 - DNA, 23 bp, Artificial sequence
  SiRNA target sequence
atcgcaaatcgaaaaggtgaaca

SEQ ID NO: 72028 - DNA, 23 bp, Artificial sequence
  SiRNA target sequence
tcgcaaatcgaaaaggtgaacac

SEQ ID NO: 72029 - DNA, 23 bp, Artificial sequence
  SiRNA target sequence
cgcaaatcgaaaaggtgaacaca

SEQ ID NO: 72030 - DNA, 23 bp, Artificial sequence
  SiRNA target sequence
gcaaatcgaaaaggtgaacacac

SEQ ID NO: 72031 - DNA, 23 bp, Artificial sequence
  SiRNA target sequence
caaatcgaaaaggtgaacacaca

SEQ ID NO: 72032 - DNA, 23 bp, Artificial sequence
  SiRNA target sequence
aaatcgaaaaggtgaacacacag

SEQ ID NO: 72033 - DNA, 23 bp, Artificial sequence
  SiRNA target sequence
aatcgaaaaggtgaacacacagc

SEQ ID NO: 72034 - DNA, 23 bp, Artificial sequence
  SiRNA target sequence
atcgaaaaggtgaacacacagca

SEQ ID NO: 72035 - DNA, 23 bp, Artificial sequence
  SiRNA target sequence
tcgaaaaggtgaacacacagcac

SEQ ID NO: 72036 - DNA, 23 bp, Artificial sequence
  SiRNA target sequence
cgaaaaggtgaacacacagcact

SEQ ID NO: 72037 - DNA, 23 bp, Artificial sequence
  SiRNA target sequence
gaaaaggtgaacacacagcactt

SEQ ID NO: 72038 - DNA, 23 bp, Artificial sequence
  SiRNA target sequence
aaaaggtgaacacacagcacttg

SEQ ID NO: 72039 - DNA, 23 bp, Artificial sequence
  SiRNA target sequence
aaaggtgaacacacagcacttga

SEQ ID NO: 72040 - DNA, 23 bp, Artificial sequence
  SiRNA target sequence
aaggtgaacacacagcacttgaa

SEQ ID NO: 72041 - DNA, 23 bp, Artificial sequence
  SiRNA target sequence
aggtgaacacacagcacttgaaa

SEQ ID NO: 72042 - DNA, 23 bp, Artificial sequence
  SiRNA target sequence
ggtgaacacacagcacttgaaag

SEQ ID NO: 72043 - DNA, 23 bp, Artificial sequence
  SiRNA target sequence
gtgaacacacagcacttgaaaga

SEQ ID NO: 72044 - DNA, 23 bp, Artificial sequence
  SiRNA target sequence
tgaacacacagcacttgaaagat

SEQ ID NO: 72045 - DNA, 23 bp, Artificial sequence
  SiRNA target sequence
gaacacacagcacttgaaagatt

SEQ ID NO: 72046 - DNA, 23 bp, Artificial sequence
  SiRNA target sequence
aacacacagcacttgaaagattt

SEQ ID NO: 72047 - DNA, 23 bp, Artificial sequence
  SiRNA target sequence
acacacagcacttgaaagatttg

SEQ ID NO: 72048 - DNA, 23 bp, Artificial sequence
  SiRNA target sequence
cacacagcacttgaaagatttgt

SEQ ID NO: 72049 - DNA, 23 bp, Artificial sequence
  SiRNA target sequence
acacagcacttgaaagatttgtg

SEQ ID NO: 72050 - DNA, 23 bp, Artificial sequence
  SiRNA target sequence
cacagcacttgaaagatttgtgt

SEQ ID NO: 72051 - DNA, 23 bp, Artificial sequence
  SiRNA target sequence
acagcacttgaaagatttgtgtt

SEQ ID NO: 72052 - DNA, 23 bp, Artificial sequence
  SiRNA target sequence
cagcacttgaaagatttgtgtta

SEQ ID NO: 72053 - DNA, 23 bp, Artificial sequence
  SiRNA target sequence
agcacttgaaagatttgtgttac

SEQ ID NO: 72054 - DNA, 23 bp, Artificial sequence
  SiRNA target sequence
gcacttgaaagatttgtgttaca

SEQ ID NO: 72055 - DNA, 23 bp, Artificial sequence
  SiRNA target sequence
cacttgaaagatttgtgttacag

SEQ ID NO: 72056 - DNA, 23 bp, Artificial sequence
  SiRNA target sequence
acttgaaagatttgtgttacagt

SEQ ID NO: 72057 - DNA, 23 bp, Artificial sequence
  SiRNA target sequence
cttgaaagatttgtgttacagtc

SEQ ID NO: 72058 - DNA, 23 bp, Artificial sequence
  SiRNA target sequence
ttgaaagatttgtgttacagtca

SEQ ID NO: 72059 - DNA, 23 bp, Artificial sequence
  SiRNA target sequence
tgaaagatttgtgttacagtcac

SEQ ID NO: 72060 - DNA, 23 bp, Artificial sequence
  SiRNA target sequence
gaaagatttgtgttacagtcact

SEQ ID NO: 72061 - DNA, 23 bp, Artificial sequence
  SiRNA target sequence
aaagatttgtgttacagtcactc

SEQ ID NO: 72062 - DNA, 23 bp, Artificial sequence
  SiRNA target sequence
aagatttgtgttacagtcactct

SEQ ID NO: 72063 - DNA, 23 bp, Artificial sequence
  SiRNA target sequence
agatttgtgttacagtcactctt

SEQ ID NO: 72064 - DNA, 23 bp, Artificial sequence
  SiRNA target sequence
gatttgtgttacagtcactctta

SEQ ID NO: 72065 - DNA, 23 bp, Artificial sequence
  SiRNA target sequence
atttgtgttacagtcactcttag

SEQ ID NO: 72066 - DNA, 23 bp, Artificial sequence
  SiRNA target sequence
tttgtgttacagtcactcttagt

SEQ ID NO: 72067 - DNA, 23 bp, Artificial sequence
  SiRNA target sequence
ttgtgttacagtcactcttagtg

SEQ ID NO: 72068 - DNA, 23 bp, Artificial sequence
  SiRNA target sequence
tgtgttacagtcactcttagtgg

SEQ ID NO: 72069 - DNA, 23 bp, Artificial sequence
  SiRNA target sequence
gtgttacagtcactcttagtggc

SEQ ID NO: 72070 - DNA, 23 bp, Artificial sequence
  SiRNA target sequence
tgttacagtcactcttagtggct

SEQ ID NO: 72071 - DNA, 23 bp, Artificial sequence
  SiRNA target sequence
gttacagtcactcttagtggctg

SEQ ID NO: 72072 - DNA, 23 bp, Artificial sequence
  SiRNA target sequence
ttacagtcactcttagtggctgt

SEQ ID NO: 72073 - DNA, 23 bp, Artificial sequence
  SiRNA target sequence
tacagtcactcttagtggctgta

SEQ ID NO: 72074 - DNA, 23 bp, Artificial sequence
  SiRNA target sequence
acagtcactcttagtggctgtat

SEQ ID NO: 72075 - DNA, 23 bp, Artificial sequence
  SiRNA target sequence
cagtcactcttagtggctgtatt

SEQ ID NO: 72076 - DNA, 23 bp, Artificial sequence
  SiRNA target sequence
agtcactcttagtggctgtattg

SEQ ID NO: 72077 - DNA, 23 bp, Artificial sequence
  SiRNA target sequence
gtcactcttagtggctgtattga

SEQ ID NO: 72078 - DNA, 23 bp, Artificial sequence
  SiRNA target sequence
tcactcttagtggctgtattgac

SEQ ID NO: 72079 - DNA, 23 bp, Artificial sequence
  SiRNA target sequence
cactcttagtggctgtattgacc

SEQ ID NO: 72080 - DNA, 23 bp, Artificial sequence
  SiRNA target sequence
actcttagtggctgtattgaccg

SEQ ID NO: 72081 - DNA, 23 bp, Artificial sequence
  SiRNA target sequence
ctcttagtggctgtattgaccga

SEQ ID NO: 72082 - DNA, 23 bp, Artificial sequence
  SiRNA target sequence
tcttagtggctgtattgaccgaa

SEQ ID NO: 72083 - DNA, 23 bp, Artificial sequence
  SiRNA target sequence
cttagtggctgtattgaccgaac

SEQ ID NO: 72084 - DNA, 23 bp, Artificial sequence
  SiRNA target sequence
ttagtggctgtattgaccgaact

SEQ ID NO: 72085 - DNA, 23 bp, Artificial sequence
  SiRNA target sequence
tagtggctgtattgaccgaactt

SEQ ID NO: 72086 - DNA, 23 bp, Artificial sequence
  SiRNA target sequence
agtggctgtattgaccgaactta

SEQ ID NO: 72087 - DNA, 23 bp, Artificial sequence
  SiRNA target sequence
gtggctgtattgaccgaacttaa

SEQ ID NO: 72088 - DNA, 23 bp, Artificial sequence
  SiRNA target sequence
tggctgtattgaccgaacttaat

SEQ ID NO: 72089 - DNA, 23 bp, Artificial sequence
  SiRNA target sequence
ggctgtattgaccgaacttaatg

SEQ ID NO: 72090 - DNA, 23 bp, Artificial sequence
  SiRNA target sequence
gctgtattgaccgaacttaatgg

SEQ ID NO: 72091 - DNA, 23 bp, Artificial sequence
  SiRNA target sequence
ctgtattgaccgaacttaatgga

SEQ ID NO: 72092 - DNA, 23 bp, Artificial sequence
  SiRNA target sequence
tgtattgaccgaacttaatggat

SEQ ID NO: 72093 - DNA, 23 bp, Artificial sequence
  SiRNA target sequence
gtattgaccgaacttaatggatt

SEQ ID NO: 72094 - DNA, 23 bp, Artificial sequence
  SiRNA target sequence
tattgaccgaacttaatggattt

SEQ ID NO: 72095 - DNA, 23 bp, Artificial sequence
  SiRNA target sequence
attgaccgaacttaatggattta

SEQ ID NO: 72096 - DNA, 23 bp, Artificial sequence
  SiRNA target sequence
ttgaccgaacttaatggatttat

SEQ ID NO: 72097 - DNA, 23 bp, Artificial sequence
  SiRNA target sequence
tgaccgaacttaatggatttatt

SEQ ID NO: 72098 - DNA, 23 bp, Artificial sequence
  SiRNA target sequence
gaccgaacttaatggatttattt

SEQ ID NO: 72099 - DNA, 23 bp, Artificial sequence
  SiRNA target sequence
accgaacttaatggatttatttt

SEQ ID NO: 72100 - DNA, 23 bp, Artificial sequence
  SiRNA target sequence
ccgaacttaatggatttattttt

SEQ ID NO: 72101 - DNA, 23 bp, Artificial sequence
  SiRNA target sequence
cgaacttaatggatttattttta

SEQ ID NO: 72102 - DNA, 23 bp, Artificial sequence
  SiRNA target sequence
gaacttaatggatttatttttac

SEQ ID NO: 72103 - DNA, 23 bp, Artificial sequence
  SiRNA target sequence
aacttaatggatttatttttaca

SEQ ID NO: 72104 - DNA, 23 bp, Artificial sequence
  SiRNA target sequence
acttaatggatttatttttacag

SEQ ID NO: 72105 - DNA, 23 bp, Artificial sequence
  SiRNA target sequence
cttaatggatttatttttacagg

SEQ ID NO: 72106 - DNA, 23 bp, Artificial sequence
  SiRNA target sequence
ttaatggatttatttttacaggt

SEQ ID NO: 72107 - DNA, 23 bp, Artificial sequence
  SiRNA target sequence
taatggatttatttttacaggtg

SEQ ID NO: 72108 - DNA, 23 bp, Artificial sequence
  SiRNA target sequence
aatggatttatttttacaggtgt

SEQ ID NO: 72109 - DNA, 23 bp, Artificial sequence
  SiRNA target sequence
atggatttatttttacaggtgta

SEQ ID NO: 72110 - DNA, 23 bp, Artificial sequence
  SiRNA target sequence
tggatttatttttacaggtgtag

SEQ ID NO: 72111 - DNA, 23 bp, Artificial sequence
  SiRNA target sequence
ggatttatttttacaggtgtagt

SEQ ID NO: 72112 - DNA, 23 bp, Artificial sequence
  SiRNA target sequence
gatttatttttacaggtgtagtg

SEQ ID NO: 72113 - DNA, 23 bp, Artificial sequence
  SiRNA target sequence
atttatttttacaggtgtagtgc

SEQ ID NO: 72114 - DNA, 23 bp, Artificial sequence
  SiRNA target sequence
tttatttttacaggtgtagtgca

SEQ ID NO: 72115 - DNA, 23 bp, Artificial sequence
  SiRNA target sequence
ttatttttacaggtgtagtgcaa

SEQ ID NO: 72116 - DNA, 23 bp, Artificial sequence
  SiRNA target sequence
tatttttacaggtgtagtgcaat

SEQ ID NO: 72117 - DNA, 23 bp, Artificial sequence
  SiRNA target sequence
atttttacaggtgtagtgcaata

SEQ ID NO: 72118 - DNA, 23 bp, Artificial sequence
  SiRNA target sequence
tttttacaggtgtagtgcaatat

SEQ ID NO: 72119 - DNA, 23 bp, Artificial sequence
  SiRNA target sequence
ttttacaggtgtagtgcaatata

SEQ ID NO: 72120 - DNA, 23 bp, Artificial sequence
  SiRNA target sequence
tttacaggtgtagtgcaatatat

SEQ ID NO: 72121 - DNA, 23 bp, Artificial sequence
  SiRNA target sequence
ttacaggtgtagtgcaatatatt

SEQ ID NO: 72122 - DNA, 23 bp, Artificial sequence
  SiRNA target sequence
tacaggtgtagtgcaatatattt

SEQ ID NO: 72123 - DNA, 23 bp, Artificial sequence
  SiRNA target sequence
acaggtgtagtgcaatatattta

SEQ ID NO: 72124 - DNA, 23 bp, Artificial sequence
  SiRNA target sequence
caggtgtagtgcaatatatttat

SEQ ID NO: 72125 - DNA, 23 bp, Artificial sequence
  SiRNA target sequence
aggtgtagtgcaatatatttata

SEQ ID NO: 72126 - DNA, 23 bp, Artificial sequence
  SiRNA target sequence
ggtgtagtgcaatatatttatag

SEQ ID NO: 72127 - DNA, 23 bp, Artificial sequence
  SiRNA target sequence
gtgtagtgcaatatatttataga

SEQ ID NO: 72128 - DNA, 23 bp, Artificial sequence
  SiRNA target sequence
tgtagtgcaatatatttatagaa

SEQ ID NO: 72129 - DNA, 23 bp, Artificial sequence
  SiRNA target sequence
gtagtgcaatatatttatagaaa

SEQ ID NO: 72130 - DNA, 23 bp, Artificial sequence
  SiRNA target sequence
tagtgcaatatatttatagaaat

SEQ ID NO: 72131 - DNA, 23 bp, Artificial sequence
  SiRNA target sequence
agtgcaatatatttatagaaata

SEQ ID NO: 72132 - DNA, 23 bp, Artificial sequence
  SiRNA target sequence
gtgcaatatatttatagaaatac

SEQ ID NO: 72133 - DNA, 23 bp, Artificial sequence
  SiRNA target sequence
tgcaatatatttatagaaatacg

SEQ ID NO: 72134 - DNA, 23 bp, Artificial sequence
  SiRNA target sequence
gcaatatatttatagaaatacgg

SEQ ID NO: 72135 - DNA, 23 bp, Artificial sequence
  SiRNA target sequence
caatatatttatagaaatacggc

SEQ ID NO: 72136 - DNA, 23 bp, Artificial sequence
  SiRNA target sequence
aatatatttatagaaatacggca

SEQ ID NO: 72137 - DNA, 23 bp, Artificial sequence
  SiRNA target sequence
atatatttatagaaatacggcaa

SEQ ID NO: 72138 - DNA, 23 bp, Artificial sequence
  SiRNA target sequence
tatatttatagaaatacggcaaa

SEQ ID NO: 72139 - DNA, 23 bp, Artificial sequence
  SiRNA target sequence
atatttatagaaatacggcaaaa

SEQ ID NO: 72140 - DNA, 23 bp, Artificial sequence
  SiRNA target sequence
tatttatagaaatacggcaaaat

SEQ ID NO: 72141 - DNA, 23 bp, Artificial sequence
  SiRNA target sequence
atttatagaaatacggcaaaatc

SEQ ID NO: 72142 - DNA, 23 bp, Artificial sequence
  SiRNA target sequence
tttatagaaatacggcaaaatct

SEQ ID NO: 72143 - DNA, 23 bp, Artificial sequence
  SiRNA target sequence
ttatagaaatacggcaaaatcta

SEQ ID NO: 72144 - DNA, 23 bp, Artificial sequence
  SiRNA target sequence
tatagaaatacggcaaaatctac

SEQ ID NO: 72145 - DNA, 23 bp, Artificial sequence
  SiRNA target sequence
atagaaatacggcaaaatctaca

SEQ ID NO: 72146 - DNA, 23 bp, Artificial sequence
  SiRNA target sequence
tagaaatacggcaaaatctacat

SEQ ID NO: 72147 - DNA, 23 bp, Artificial sequence
  SiRNA target sequence
agaaatacggcaaaatctacatt

SEQ ID NO: 72148 - DNA, 23 bp, Artificial sequence
  SiRNA target sequence
gaaatacggcaaaatctacattc

SEQ ID NO: 72149 - DNA, 23 bp, Artificial sequence
  SiRNA target sequence
aaatacggcaaaatctacattca

SEQ ID NO: 72150 - DNA, 23 bp, Artificial sequence
  SiRNA target sequence
aatacggcaaaatctacattcaa

SEQ ID NO: 72151 - DNA, 23 bp, Artificial sequence
  SiRNA target sequence
atacggcaaaatctacattcaaa

SEQ ID NO: 72152 - DNA, 23 bp, Artificial sequence
  SiRNA target sequence
tacggcaaaatctacattcaaag

SEQ ID NO: 72153 - DNA, 23 bp, Artificial sequence
  SiRNA target sequence
acggcaaaatctacattcaaagg

SEQ ID NO: 72154 - DNA, 23 bp, Artificial sequence
  SiRNA target sequence
cggcaaaatctacattcaaaggc

SEQ ID NO: 72155 - DNA, 23 bp, Artificial sequence
  SiRNA target sequence
ggcaaaatctacattcaaaggct

SEQ ID NO: 72156 - DNA, 23 bp, Artificial sequence
  SiRNA target sequence
gcaaaatctacattcaaaggctt

SEQ ID NO: 72157 - DNA, 23 bp, Artificial sequence
  SiRNA target sequence
caaaatctacattcaaaggcttc

SEQ ID NO: 72158 - DNA, 23 bp, Artificial sequence
  SiRNA target sequence
aaaatctacattcaaaggcttca

SEQ ID NO: 72159 - DNA, 23 bp, Artificial sequence
  SiRNA target sequence
aaatctacattcaaaggcttcat

SEQ ID NO: 72160 - DNA, 23 bp, Artificial sequence
  SiRNA target sequence
aatctacattcaaaggcttcatt

SEQ ID NO: 72161 - DNA, 23 bp, Artificial sequence
  SiRNA target sequence
atctacattcaaaggcttcattt

SEQ ID NO: 72162 - DNA, 23 bp, Artificial sequence
  SiRNA target sequence
tctacattcaaaggcttcatttc

SEQ ID NO: 72163 - DNA, 23 bp, Artificial sequence
  SiRNA target sequence
ctacattcaaaggcttcatttct

SEQ ID NO: 72164 - DNA, 23 bp, Artificial sequence
  SiRNA target sequence
tacattcaaaggcttcatttctc

SEQ ID NO: 72165 - DNA, 23 bp, Artificial sequence
  SiRNA target sequence
acattcaaaggcttcatttctct

SEQ ID NO: 72166 - DNA, 23 bp, Artificial sequence
  SiRNA target sequence
cattcaaaggcttcatttctctt

SEQ ID NO: 72167 - DNA, 23 bp, Artificial sequence
  SiRNA target sequence
attcaaaggcttcatttctcttt

SEQ ID NO: 72168 - DNA, 23 bp, Artificial sequence
  SiRNA target sequence
ttcaaaggcttcatttctctttc

SEQ ID NO: 72169 - DNA, 23 bp, Artificial sequence
  SiRNA target sequence
tcaaaggcttcatttctctttca

SEQ ID NO: 72170 - DNA, 23 bp, Artificial sequence
  SiRNA target sequence
caaaggcttcatttctctttcac

SEQ ID NO: 72171 - DNA, 23 bp, Artificial sequence
  SiRNA target sequence
aaaggcttcatttctctttcacc

SEQ ID NO: 72172 - DNA, 23 bp, Artificial sequence
  SiRNA target sequence
aaggcttcatttctctttcacct

SEQ ID NO: 72173 - DNA, 23 bp, Artificial sequence
  SiRNA target sequence
aggcttcatttctctttcaccta

SEQ ID NO: 72174 - DNA, 23 bp, Artificial sequence
  SiRNA target sequence
ggcttcatttctctttcacctaa

SEQ ID NO: 72175 - DNA, 23 bp, Artificial sequence
  SiRNA target sequence
gcttcatttctctttcacctaaa

SEQ ID NO: 72176 - DNA, 23 bp, Artificial sequence
  SiRNA target sequence
cttcatttctctttcacctaaaa

SEQ ID NO: 72177 - DNA, 23 bp, Artificial sequence
  SiRNA target sequence
ttcatttctctttcacctaaaaa

SEQ ID NO: 72178 - DNA, 23 bp, Artificial sequence
  SiRNA target sequence
tcatttctctttcacctaaaaat

SEQ ID NO: 72179 - DNA, 23 bp, Artificial sequence
  SiRNA target sequence
catttctctttcacctaaaaatt

SEQ ID NO: 72180 - DNA, 23 bp, Artificial sequence
  SiRNA target sequence
atttctctttcacctaaaaattt

SEQ ID NO: 72181 - DNA, 23 bp, Artificial sequence
  SiRNA target sequence
tttctctttcacctaaaaatttt

SEQ ID NO: 72182 - DNA, 23 bp, Artificial sequence
  SiRNA target sequence
ttctctttcacctaaaaatttta

SEQ ID NO: 72183 - DNA, 23 bp, Artificial sequence
  SiRNA target sequence
tctctttcacctaaaaattttag

SEQ ID NO: 72184 - DNA, 23 bp, Artificial sequence
  SiRNA target sequence
ctctttcacctaaaaattttagt

SEQ ID NO: 72185 - DNA, 23 bp, Artificial sequence
  SiRNA target sequence
tctttcacctaaaaattttagta

SEQ ID NO: 72186 - DNA, 23 bp, Artificial sequence
  SiRNA target sequence
ctttcacctaaaaattttagtac

SEQ ID NO: 72187 - DNA, 23 bp, Artificial sequence
  SiRNA target sequence
tttcacctaaaaattttagtacc

SEQ ID NO: 72188 - DNA, 23 bp, Artificial sequence
  SiRNA target sequence
ttcacctaaaaattttagtacca

SEQ ID NO: 72189 - DNA, 23 bp, Artificial sequence
  SiRNA target sequence
tcacctaaaaattttagtaccat

SEQ ID NO: 72190 - DNA, 23 bp, Artificial sequence
  SiRNA target sequence
cacctaaaaattttagtaccata

SEQ ID NO: 72191 - DNA, 23 bp, Artificial sequence
  SiRNA target sequence
acctaaaaattttagtaccatag

SEQ ID NO: 72192 - DNA, 23 bp, Artificial sequence
  SiRNA target sequence
cctaaaaattttagtaccatagg

SEQ ID NO: 72193 - DNA, 23 bp, Artificial sequence
  SiRNA target sequence
ctaaaaattttagtaccataggt

SEQ ID NO: 72194 - DNA, 23 bp, Artificial sequence
  SiRNA target sequence
taaaaattttagtaccataggtg

SEQ ID NO: 72195 - DNA, 23 bp, Artificial sequence
  SiRNA target sequence
aaaaattttagtaccataggtgg

SEQ ID NO: 72196 - DNA, 23 bp, Artificial sequence
  SiRNA target sequence
aaaattttagtaccataggtggc

SEQ ID NO: 72197 - DNA, 23 bp, Artificial sequence
  SiRNA target sequence
aaattttagtaccataggtggcg

SEQ ID NO: 72198 - DNA, 23 bp, Artificial sequence
  SiRNA target sequence
aattttagtaccataggtggcgg

SEQ ID NO: 72199 - DNA, 23 bp, Artificial sequence
  SiRNA target sequence
attttagtaccataggtggcgga

SEQ ID NO: 72200 - DNA, 23 bp, Artificial sequence
  SiRNA target sequence
ttttagtaccataggtggcggag

SEQ ID NO: 72201 - DNA, 23 bp, Artificial sequence
  SiRNA target sequence
tttagtaccataggtggcggaga

SEQ ID NO: 72202 - DNA, 23 bp, Artificial sequence
  SiRNA target sequence
ttagtaccataggtggcggagaa

SEQ ID NO: 72203 - DNA, 23 bp, Artificial sequence
  SiRNA target sequence
tagtaccataggtggcggagaaa

SEQ ID NO: 72204 - DNA, 23 bp, Artificial sequence
  SiRNA target sequence
agtaccataggtggcggagaaat

SEQ ID NO: 72205 - DNA, 23 bp, Artificial sequence
  SiRNA target sequence
gtaccataggtggcggagaaatt

SEQ ID NO: 72206 - DNA, 23 bp, Artificial sequence
  SiRNA target sequence
taccataggtggcggagaaattc

SEQ ID NO: 72207 - DNA, 23 bp, Artificial sequence
  SiRNA target sequence
accataggtggcggagaaattca

SEQ ID NO: 72208 - DNA, 23 bp, Artificial sequence
  SiRNA target sequence
ccataggtggcggagaaattcaa

SEQ ID NO: 72209 - DNA, 23 bp, Artificial sequence
  SiRNA target sequence
cataggtggcggagaaattcaaa

SEQ ID NO: 72210 - DNA, 23 bp, Artificial sequence
  SiRNA target sequence
ataggtggcggagaaattcaaac

SEQ ID NO: 72211 - DNA, 23 bp, Artificial sequence
  SiRNA target sequence
taggtggcggagaaattcaaaca

SEQ ID NO: 72212 - DNA, 23 bp, Artificial sequence
  SiRNA target sequence
aggtggcggagaaattcaaacaa

SEQ ID NO: 72213 - DNA, 23 bp, Artificial sequence
  SiRNA target sequence
ggtggcggagaaattcaaacaat

SEQ ID NO: 72214 - DNA, 23 bp, Artificial sequence
  SiRNA target sequence
gtggcggagaaattcaaacaata

SEQ ID NO: 72215 - DNA, 23 bp, Artificial sequence
  SiRNA target sequence
tggcggagaaattcaaacaataa

SEQ ID NO: 72216 - DNA, 23 bp, Artificial sequence
  SiRNA target sequence
ggcggagaaattcaaacaataat

SEQ ID NO: 72217 - DNA, 23 bp, Artificial sequence
  SiRNA target sequence
gcggagaaattcaaacaataata

SEQ ID NO: 72218 - DNA, 23 bp, Artificial sequence
  SiRNA target sequence
cggagaaattcaaacaataatag

SEQ ID NO: 72219 - DNA, 23 bp, Artificial sequence
  SiRNA target sequence
ggagaaattcaaacaataataga

SEQ ID NO: 72220 - DNA, 23 bp, Artificial sequence
  SiRNA target sequence
gagaaattcaaacaataatagat

SEQ ID NO: 72221 - DNA, 23 bp, Artificial sequence
  SiRNA target sequence
agaaattcaaacaataatagata

SEQ ID NO: 72222 - DNA, 23 bp, Artificial sequence
  SiRNA target sequence
gaaattcaaacaataatagatag

SEQ ID NO: 72223 - DNA, 23 bp, Artificial sequence
  SiRNA target sequence
aaattcaaacaataatagataga

SEQ ID NO: 72224 - DNA, 23 bp, Artificial sequence
  SiRNA target sequence
aattcaaacaataatagatagaa

SEQ ID NO: 72225 - DNA, 23 bp, Artificial sequence
  SiRNA target sequence
attcaaacaataatagatagaaa

SEQ ID NO: 72226 - DNA, 23 bp, Artificial sequence
  SiRNA target sequence
ttcaaacaataatagatagaaaa

SEQ ID NO: 72227 - DNA, 23 bp, Artificial sequence
  SiRNA target sequence
tcaaacaataatagatagaaaat

SEQ ID NO: 72228 - DNA, 23 bp, Artificial sequence
  SiRNA target sequence
caaacaataatagatagaaaatc

SEQ ID NO: 72229 - DNA, 23 bp, Artificial sequence
  SiRNA target sequence
aaacaataatagatagaaaatca

SEQ ID NO: 72230 - DNA, 23 bp, Artificial sequence
  SiRNA target sequence
aacaataatagatagaaaatcaa

SEQ ID NO: 72231 - DNA, 23 bp, Artificial sequence
  SiRNA target sequence
acaataatagatagaaaatcaaa

SEQ ID NO: 72232 - DNA, 23 bp, Artificial sequence
  SiRNA target sequence
caataatagatagaaaatcaaaa

SEQ ID NO: 72233 - DNA, 23 bp, Artificial sequence
  SiRNA target sequence
aataatagatagaaaatcaaaat

SEQ ID NO: 72234 - DNA, 23 bp, Artificial sequence
  SiRNA target sequence
ataatagatagaaaatcaaaatc

SEQ ID NO: 72235 - DNA, 23 bp, Artificial sequence
  SiRNA target sequence
taatagatagaaaatcaaaatct

SEQ ID NO: 72236 - DNA, 23 bp, Artificial sequence
  SiRNA target sequence
aatagatagaaaatcaaaatctg

SEQ ID NO: 72237 - DNA, 23 bp, Artificial sequence
  SiRNA target sequence
atagatagaaaatcaaaatctgc

SEQ ID NO: 72238 - DNA, 23 bp, Artificial sequence
  SiRNA target sequence
tagatagaaaatcaaaatctgca

SEQ ID NO: 72239 - DNA, 23 bp, Artificial sequence
  SiRNA target sequence
agatagaaaatcaaaatctgcaa

SEQ ID NO: 72240 - DNA, 23 bp, Artificial sequence
  SiRNA target sequence
gatagaaaatcaaaatctgcaag

SEQ ID NO: 72241 - DNA, 23 bp, Artificial sequence
  SiRNA target sequence
atagaaaatcaaaatctgcaagt

SEQ ID NO: 72242 - DNA, 23 bp, Artificial sequence
  SiRNA target sequence
tagaaaatcaaaatctgcaagtg

SEQ ID NO: 72243 - DNA, 23 bp, Artificial sequence
  SiRNA target sequence
agaaaatcaaaatctgcaagtga

SEQ ID NO: 72244 - DNA, 23 bp, Artificial sequence
  SiRNA target sequence
gaaaatcaaaatctgcaagtgaa

SEQ ID NO: 72245 - DNA, 23 bp, Artificial sequence
  SiRNA target sequence
aaaatcaaaatctgcaagtgaac

SEQ ID NO: 72246 - DNA, 23 bp, Artificial sequence
  SiRNA target sequence
aaatcaaaatctgcaagtgaact

SEQ ID NO: 72247 - DNA, 23 bp, Artificial sequence
  SiRNA target sequence
aatcaaaatctgcaagtgaactt

SEQ ID NO: 72248 - DNA, 23 bp, Artificial sequence
  SiRNA target sequence
atcaaaatctgcaagtgaactta

SEQ ID NO: 72249 - DNA, 23 bp, Artificial sequence
  SiRNA target sequence
tcaaaatctgcaagtgaacttat

SEQ ID NO: 72250 - DNA, 23 bp, Artificial sequence
  SiRNA target sequence
caaaatctgcaagtgaacttatt

SEQ ID NO: 72251 - DNA, 23 bp, Artificial sequence
  SiRNA target sequence
aaaatctgcaagtgaacttattg

SEQ ID NO: 72252 - DNA, 23 bp, Artificial sequence
  SiRNA target sequence
aaatctgcaagtgaacttattga

SEQ ID NO: 72253 - DNA, 23 bp, Artificial sequence
  SiRNA target sequence
aatctgcaagtgaacttattgaa

SEQ ID NO: 72254 - DNA, 23 bp, Artificial sequence
  SiRNA target sequence
atctgcaagtgaacttattgaag

SEQ ID NO: 72255 - DNA, 23 bp, Artificial sequence
  SiRNA target sequence
tctgcaagtgaacttattgaagt

SEQ ID NO: 72256 - DNA, 23 bp, Artificial sequence
  SiRNA target sequence
ctgcaagtgaacttattgaagtg

SEQ ID NO: 72257 - DNA, 23 bp, Artificial sequence
  SiRNA target sequence
tgcaagtgaacttattgaagtgt

SEQ ID NO: 72258 - DNA, 23 bp, Artificial sequence
  SiRNA target sequence
gcaagtgaacttattgaagtgtt

SEQ ID NO: 72259 - DNA, 23 bp, Artificial sequence
  SiRNA target sequence
caagtgaacttattgaagtgttt

SEQ ID NO: 72260 - DNA, 23 bp, Artificial sequence
  SiRNA target sequence
aagtgaacttattgaagtgtttc

SEQ ID NO: 72261 - DNA, 23 bp, Artificial sequence
  SiRNA target sequence
agtgaacttattgaagtgtttct

SEQ ID NO: 72262 - DNA, 23 bp, Artificial sequence
  SiRNA target sequence
gtgaacttattgaagtgtttctt

SEQ ID NO: 72263 - DNA, 23 bp, Artificial sequence
  SiRNA target sequence
tgaacttattgaagtgtttctta

SEQ ID NO: 72264 - DNA, 23 bp, Artificial sequence
  SiRNA target sequence
gaacttattgaagtgtttcttac

SEQ ID NO: 72265 - DNA, 23 bp, Artificial sequence
  SiRNA target sequence
aacttattgaagtgtttcttaca

SEQ ID NO: 72266 - DNA, 23 bp, Artificial sequence
  SiRNA target sequence
acttattgaagtgtttcttacaa

SEQ ID NO: 72267 - DNA, 23 bp, Artificial sequence
  SiRNA target sequence
cttattgaagtgtttcttacaag

SEQ ID NO: 72268 - DNA, 23 bp, Artificial sequence
  SiRNA target sequence
ttattgaagtgtttcttacaagc

SEQ ID NO: 72269 - DNA, 23 bp, Artificial sequence
  SiRNA target sequence
tattgaagtgtttcttacaagct

SEQ ID NO: 72270 - DNA, 23 bp, Artificial sequence
  SiRNA target sequence
attgaagtgtttcttacaagctt

SEQ ID NO: 72271 - DNA, 23 bp, Artificial sequence
  SiRNA target sequence
ttgaagtgtttcttacaagcttg

SEQ ID NO: 72272 - DNA, 23 bp, Artificial sequence
  SiRNA target sequence
tgaagtgtttcttacaagcttgc

SEQ ID NO: 72273 - DNA, 23 bp, Artificial sequence
  SiRNA target sequence
gaagtgtttcttacaagcttgct

SEQ ID NO: 72274 - DNA, 23 bp, Artificial sequence
  SiRNA target sequence
aagtgtttcttacaagcttgctt

SEQ ID NO: 72275 - DNA, 23 bp, Artificial sequence
  SiRNA target sequence
agtgtttcttacaagcttgcttc

SEQ ID NO: 72276 - DNA, 23 bp, Artificial sequence
  SiRNA target sequence
gtgtttcttacaagcttgcttcc

SEQ ID NO: 72277 - DNA, 23 bp, Artificial sequence
  SiRNA target sequence
tgtttcttacaagcttgcttcca

SEQ ID NO: 72278 - DNA, 23 bp, Artificial sequence
  SiRNA target sequence
gtttcttacaagcttgcttccaa

SEQ ID NO: 72279 - DNA, 23 bp, Artificial sequence
  SiRNA target sequence
tttcttacaagcttgcttccaat

SEQ ID NO: 72280 - DNA, 23 bp, Artificial sequence
  SiRNA target sequence
ttcttacaagcttgcttccaata

SEQ ID NO: 72281 - DNA, 23 bp, Artificial sequence
  SiRNA target sequence
tcttacaagcttgcttccaatat

SEQ ID NO: 72282 - DNA, 23 bp, Artificial sequence
  SiRNA target sequence
cttacaagcttgcttccaatatg

SEQ ID NO: 72283 - DNA, 23 bp, Artificial sequence
  SiRNA target sequence
ttacaagcttgcttccaatatgc

SEQ ID NO: 72284 - DNA, 23 bp, Artificial sequence
  SiRNA target sequence
tacaagcttgcttccaatatgcc

SEQ ID NO: 72285 - DNA, 23 bp, Artificial sequence
  SiRNA target sequence
acaagcttgcttccaatatgcct

SEQ ID NO: 72286 - DNA, 23 bp, Artificial sequence
  SiRNA target sequence
caagcttgcttccaatatgcctt

SEQ ID NO: 72287 - DNA, 23 bp, Artificial sequence
  SiRNA target sequence
aagcttgcttccaatatgcctta

SEQ ID NO: 72288 - DNA, 23 bp, Artificial sequence
  SiRNA target sequence
agcttgcttccaatatgccttaa

SEQ ID NO: 72289 - DNA, 23 bp, Artificial sequence
  SiRNA target sequence
gcttgcttccaatatgccttaaa

SEQ ID NO: 72290 - DNA, 23 bp, Artificial sequence
  SiRNA target sequence
cttgcttccaatatgccttaaac

SEQ ID NO: 72291 - DNA, 23 bp, Artificial sequence
  SiRNA target sequence
ttgcttccaatatgccttaaact

SEQ ID NO: 72292 - DNA, 23 bp, Artificial sequence
  SiRNA target sequence
tgcttccaatatgccttaaactt

SEQ ID NO: 72293 - DNA, 23 bp, Artificial sequence
  SiRNA target sequence
gcttccaatatgccttaaacttt

SEQ ID NO: 72294 - DNA, 23 bp, Artificial sequence
  SiRNA target sequence
cttccaatatgccttaaactttt

SEQ ID NO: 72295 - DNA, 23 bp, Artificial sequence
  SiRNA target sequence
ttccaatatgccttaaactttta

SEQ ID NO: 72296 - DNA, 23 bp, Artificial sequence
  SiRNA target sequence
tccaatatgccttaaacttttat

SEQ ID NO: 72297 - DNA, 23 bp, Artificial sequence
  SiRNA target sequence
ccaatatgccttaaacttttatt

SEQ ID NO: 72298 - DNA, 23 bp, Artificial sequence
  SiRNA target sequence
caatatgccttaaacttttattt

SEQ ID NO: 72299 - DNA, 23 bp, Artificial sequence
  SiRNA target sequence
aatatgccttaaacttttatttg

SEQ ID NO: 72300 - DNA, 23 bp, Artificial sequence
  SiRNA target sequence
atatgccttaaacttttatttgc

SEQ ID NO: 72301 - DNA, 23 bp, Artificial sequence
  SiRNA target sequence
tatgccttaaacttttatttgcc

SEQ ID NO: 72302 - DNA, 23 bp, Artificial sequence
  SiRNA target sequence
atgccttaaacttttatttgccc

SEQ ID NO: 72303 - DNA, 23 bp, Artificial sequence
  SiRNA target sequence
tgccttaaacttttatttgccct

SEQ ID NO: 72304 - DNA, 23 bp, Artificial sequence
  SiRNA target sequence
gccttaaacttttatttgccctt

SEQ ID NO: 72305 - DNA, 23 bp, Artificial sequence
  SiRNA target sequence
ccttaaacttttatttgccctta

SEQ ID NO: 72306 - DNA, 23 bp, Artificial sequence
  SiRNA target sequence
cttaaacttttatttgcccttat

SEQ ID NO: 72307 - DNA, 23 bp, Artificial sequence
  SiRNA target sequence
ttaaacttttatttgcccttatt

SEQ ID NO: 72308 - DNA, 23 bp, Artificial sequence
  SiRNA target sequence
taaacttttatttgcccttattg

SEQ ID NO: 72309 - DNA, 23 bp, Artificial sequence
  SiRNA target sequence
aaacttttatttgcccttattgc

SEQ ID NO: 72310 - DNA, 23 bp, Artificial sequence
  SiRNA target sequence
aacttttatttgcccttattgca

SEQ ID NO: 72311 - DNA, 23 bp, Artificial sequence
  SiRNA target sequence
acttttatttgcccttattgcag

SEQ ID NO: 72312 - DNA, 23 bp, Artificial sequence
  SiRNA target sequence
cttttatttgcccttattgcagt

SEQ ID NO: 72313 - DNA, 23 bp, Artificial sequence
  SiRNA target sequence
ttttatttgcccttattgcagtt

SEQ ID NO: 72314 - DNA, 23 bp, Artificial sequence
  SiRNA target sequence
tttatttgcccttattgcagtta

SEQ ID NO: 72315 - DNA, 23 bp, Artificial sequence
  SiRNA target sequence
ttatttgcccttattgcagttat

SEQ ID NO: 72316 - DNA, 23 bp, Artificial sequence
  SiRNA target sequence
tatttgcccttattgcagttata

SEQ ID NO: 72317 - DNA, 23 bp, Artificial sequence
  SiRNA target sequence
atttgcccttattgcagttataa

SEQ ID NO: 72318 - DNA, 23 bp, Artificial sequence
  SiRNA target sequence
tttgcccttattgcagttataaa

SEQ ID NO: 72319 - DNA, 23 bp, Artificial sequence
  SiRNA target sequence
ttgcccttattgcagttataaaa

SEQ ID NO: 72320 - DNA, 23 bp, Artificial sequence
  SiRNA target sequence
tgcccttattgcagttataaaaa

SEQ ID NO: 72321 - DNA, 23 bp, Artificial sequence
  SiRNA target sequence
gcccttattgcagttataaaaaa

SEQ ID NO: 72322 - DNA, 23 bp, Artificial sequence
  SiRNA target sequence
cccttattgcagttataaaaaat

SEQ ID NO: 72323 - DNA, 23 bp, Artificial sequence
  SiRNA target sequence
ccttattgcagttataaaaaata

SEQ ID NO: 72324 - DNA, 23 bp, Artificial sequence
  SiRNA target sequence
cttattgcagttataaaaaatat

SEQ ID NO: 72325 - DNA, 23 bp, Artificial sequence
  SiRNA target sequence
ttattgcagttataaaaaatatg

SEQ ID NO: 72326 - DNA, 23 bp, Artificial sequence
  SiRNA target sequence
tattgcagttataaaaaatatgg

SEQ ID NO: 72327 - DNA, 23 bp, Artificial sequence
  SiRNA target sequence
attgcagttataaaaaatatggg

SEQ ID NO: 72328 - DNA, 23 bp, Artificial sequence
  SiRNA target sequence
ttgcagttataaaaaatatggga

SEQ ID NO: 72329 - DNA, 23 bp, Artificial sequence
  SiRNA target sequence
tgcagttataaaaaatatgggag

SEQ ID NO: 72330 - DNA, 23 bp, Artificial sequence
  SiRNA target sequence
gcagttataaaaaatatgggagg

SEQ ID NO: 72331 - DNA, 23 bp, Artificial sequence
  SiRNA target sequence
cagttataaaaaatatgggaggt

SEQ ID NO: 72332 - DNA, 23 bp, Artificial sequence
  SiRNA target sequence
agttataaaaaatatgggaggtc

SEQ ID NO: 72333 - DNA, 23 bp, Artificial sequence
  SiRNA target sequence
gttataaaaaatatgggaggtct

SEQ ID NO: 72334 - DNA, 23 bp, Artificial sequence
  SiRNA target sequence
ttataaaaaatatgggaggtctt

SEQ ID NO: 72335 - DNA, 23 bp, Artificial sequence
  SiRNA target sequence
tataaaaaatatgggaggtcttg

SEQ ID NO: 72336 - DNA, 23 bp, Artificial sequence
  SiRNA target sequence
ataaaaaatatgggaggtcttgc

SEQ ID NO: 72337 - DNA, 23 bp, Artificial sequence
  SiRNA target sequence
taaaaaatatgggaggtcttgcg

SEQ ID NO: 72338 - DNA, 23 bp, Artificial sequence
  SiRNA target sequence
aaaaaatatgggaggtcttgcgg

SEQ ID NO: 72339 - DNA, 23 bp, Artificial sequence
  SiRNA target sequence
aaaaatatgggaggtcttgcggg

SEQ ID NO: 72340 - DNA, 23 bp, Artificial sequence
  SiRNA target sequence
aaaatatgggaggtcttgcgggc

SEQ ID NO: 72341 - DNA, 23 bp, Artificial sequence
  SiRNA target sequence
aaatatgggaggtcttgcgggct

SEQ ID NO: 72342 - DNA, 23 bp, Artificial sequence
  SiRNA target sequence
aatatgggaggtcttgcgggctt

SEQ ID NO: 72343 - DNA, 23 bp, Artificial sequence
  SiRNA target sequence
atatgggaggtcttgcgggcttc

SEQ ID NO: 72344 - DNA, 23 bp, Artificial sequence
  SiRNA target sequence
tatgggaggtcttgcgggcttca

SEQ ID NO: 72345 - DNA, 23 bp, Artificial sequence
  SiRNA target sequence
atgggaggtcttgcgggcttcat

SEQ ID NO: 72346 - DNA, 23 bp, Artificial sequence
  SiRNA target sequence
tgggaggtcttgcgggcttcata

SEQ ID NO: 72347 - DNA, 23 bp, Artificial sequence
  SiRNA target sequence
gggaggtcttgcgggcttcataa

SEQ ID NO: 72348 - DNA, 23 bp, Artificial sequence
  SiRNA target sequence
ggaggtcttgcgggcttcataat

SEQ ID NO: 72349 - DNA, 23 bp, Artificial sequence
  SiRNA target sequence
gaggtcttgcgggcttcataatg

SEQ ID NO: 72350 - DNA, 23 bp, Artificial sequence
  SiRNA target sequence
aggtcttgcgggcttcataatgt

SEQ ID NO: 72351 - DNA, 23 bp, Artificial sequence
  SiRNA target sequence
ggtcttgcgggcttcataatgtt

SEQ ID NO: 72352 - DNA, 23 bp, Artificial sequence
  SiRNA target sequence
gtcttgcgggcttcataatgttt

SEQ ID NO: 72353 - DNA, 23 bp, Artificial sequence
  SiRNA target sequence
tcttgcgggcttcataatgtttg

SEQ ID NO: 72354 - DNA, 23 bp, Artificial sequence
  SiRNA target sequence
cttgcgggcttcataatgtttgt

SEQ ID NO: 72355 - DNA, 23 bp, Artificial sequence
  SiRNA target sequence
ttgcgggcttcataatgtttgtt

SEQ ID NO: 72356 - DNA, 23 bp, Artificial sequence
  SiRNA target sequence
tgcgggcttcataatgtttgttt

SEQ ID NO: 72357 - DNA, 23 bp, Artificial sequence
  SiRNA target sequence
gcgggcttcataatgtttgtttg

SEQ ID NO: 72358 - DNA, 23 bp, Artificial sequence
  SiRNA target sequence
cgggcttcataatgtttgtttgt

SEQ ID NO: 72359 - DNA, 23 bp, Artificial sequence
  SiRNA target sequence
gggcttcataatgtttgtttgtg

SEQ ID NO: 72360 - DNA, 23 bp, Artificial sequence
  SiRNA target sequence
ggcttcataatgtttgtttgtgt

SEQ ID NO: 72361 - DNA, 23 bp, Artificial sequence
  SiRNA target sequence
gcttcataatgtttgtttgtgtt

SEQ ID NO: 72362 - DNA, 23 bp, Artificial sequence
  SiRNA target sequence
cttcataatgtttgtttgtgttt

SEQ ID NO: 72363 - DNA, 23 bp, Artificial sequence
  SiRNA target sequence
ttcataatgtttgtttgtgtttc

SEQ ID NO: 72364 - DNA, 23 bp, Artificial sequence
  SiRNA target sequence
tcataatgtttgtttgtgtttct

SEQ ID NO: 72365 - DNA, 23 bp, Artificial sequence
  SiRNA target sequence
cataatgtttgtttgtgtttctt

SEQ ID NO: 72366 - DNA, 23 bp, Artificial sequence
  SiRNA target sequence
ataatgtttgtttgtgtttcttg

SEQ ID NO: 72367 - DNA, 23 bp, Artificial sequence
  SiRNA target sequence
taatgtttgtttgtgtttcttgc

SEQ ID NO: 72368 - DNA, 23 bp, Artificial sequence
  SiRNA target sequence
aatgtttgtttgtgtttcttgct

SEQ ID NO: 72369 - DNA, 23 bp, Artificial sequence
  SiRNA target sequence
atgtttgtttgtgtttcttgcta

SEQ ID NO: 72370 - DNA, 23 bp, Artificial sequence
  SiRNA target sequence
tgtttgtttgtgtttcttgctat

SEQ ID NO: 72371 - DNA, 23 bp, Artificial sequence
  SiRNA target sequence
gtttgtttgtgtttcttgctatg

SEQ ID NO: 72372 - DNA, 23 bp, Artificial sequence
  SiRNA target sequence
tttgtttgtgtttcttgctatgc

SEQ ID NO: 72373 - DNA, 23 bp, Artificial sequence
  SiRNA target sequence
ttgtttgtgtttcttgctatgcg

SEQ ID NO: 72374 - DNA, 23 bp, Artificial sequence
  SiRNA target sequence
tgtttgtgtttcttgctatgcga

SEQ ID NO: 72375 - DNA, 23 bp, Artificial sequence
  SiRNA target sequence
gtttgtgtttcttgctatgcgac

SEQ ID NO: 72376 - DNA, 23 bp, Artificial sequence
  SiRNA target sequence
tttgtgtttcttgctatgcgact

SEQ ID NO: 72377 - DNA, 23 bp, Artificial sequence
  SiRNA target sequence
ttgtgtttcttgctatgcgactg

SEQ ID NO: 72378 - DNA, 23 bp, Artificial sequence
  SiRNA target sequence
tgtgtttcttgctatgcgactgt

SEQ ID NO: 72379 - DNA, 23 bp, Artificial sequence
  SiRNA target sequence
gtgtttcttgctatgcgactgtg

SEQ ID NO: 72380 - DNA, 23 bp, Artificial sequence
  SiRNA target sequence
tgtttcttgctatgcgactgtga

SEQ ID NO: 72381 - DNA, 23 bp, Artificial sequence
  SiRNA target sequence
gtttcttgctatgcgactgtgac

SEQ ID NO: 72382 - DNA, 23 bp, Artificial sequence
  SiRNA target sequence
tttcttgctatgcgactgtgact

SEQ ID NO: 72383 - DNA, 23 bp, Artificial sequence
  SiRNA target sequence
ttcttgctatgcgactgtgacta

SEQ ID NO: 72384 - DNA, 23 bp, Artificial sequence
  SiRNA target sequence
tcttgctatgcgactgtgactat

SEQ ID NO: 72385 - DNA, 23 bp, Artificial sequence
  SiRNA target sequence
cttgctatgcgactgtgactata

SEQ ID NO: 72386 - DNA, 23 bp, Artificial sequence
  SiRNA target sequence
ttgctatgcgactgtgactatat

SEQ ID NO: 72387 - DNA, 23 bp, Artificial sequence
  SiRNA target sequence
tgctatgcgactgtgactatatt

SEQ ID NO: 72388 - DNA, 23 bp, Artificial sequence
  SiRNA target sequence
gctatgcgactgtgactatattg

SEQ ID NO: 72389 - DNA, 23 bp, Artificial sequence
  SiRNA target sequence
ctatgcgactgtgactatattga

SEQ ID NO: 72390 - DNA, 23 bp, Artificial sequence
  SiRNA target sequence
tatgcgactgtgactatattgat

SEQ ID NO: 72391 - DNA, 23 bp, Artificial sequence
  SiRNA target sequence
atgcgactgtgactatattgata

SEQ ID NO: 72392 - DNA, 23 bp, Artificial sequence
  SiRNA target sequence
tgcgactgtgactatattgatag

SEQ ID NO: 72393 - DNA, 23 bp, Artificial sequence
  SiRNA target sequence
gcgactgtgactatattgatagc

SEQ ID NO: 72394 - DNA, 23 bp, Artificial sequence
  SiRNA target sequence
cgactgtgactatattgatagca

SEQ ID NO: 72395 - DNA, 23 bp, Artificial sequence
  SiRNA target sequence
gactgtgactatattgatagcac

SEQ ID NO: 72396 - DNA, 23 bp, Artificial sequence
  SiRNA target sequence
actgtgactatattgatagcaca

SEQ ID NO: 72397 - DNA, 23 bp, Artificial sequence
  SiRNA target sequence
ctgtgactatattgatagcacaa

SEQ ID NO: 72398 - DNA, 23 bp, Artificial sequence
  SiRNA target sequence
tgtgactatattgatagcacaat

SEQ ID NO: 72399 - DNA, 23 bp, Artificial sequence
  SiRNA target sequence
gtgactatattgatagcacaatg

SEQ ID NO: 72400 - DNA, 23 bp, Artificial sequence
  SiRNA target sequence
tgactatattgatagcacaatgg

SEQ ID NO: 72401 - DNA, 23 bp, Artificial sequence
  SiRNA target sequence
gactatattgatagcacaatgga

SEQ ID NO: 72402 - DNA, 23 bp, Artificial sequence
  SiRNA target sequence
actatattgatagcacaatggag

SEQ ID NO: 72403 - DNA, 23 bp, Artificial sequence
  SiRNA target sequence
ctatattgatagcacaatggaga

SEQ ID NO: 72404 - DNA, 23 bp, Artificial sequence
  SiRNA target sequence
tatattgatagcacaatggagat

SEQ ID NO: 72405 - DNA, 23 bp, Artificial sequence
  SiRNA target sequence
atattgatagcacaatggagatc

SEQ ID NO: 72406 - DNA, 23 bp, Artificial sequence
  SiRNA target sequence
tattgatagcacaatggagatct

SEQ ID NO: 72407 - DNA, 23 bp, Artificial sequence
  SiRNA target sequence
attgatagcacaatggagatcta

SEQ ID NO: 72408 - DNA, 23 bp, Artificial sequence
  SiRNA target sequence
ttgatagcacaatggagatctaa

SEQ ID NO: 72409 - DNA, 23 bp, Artificial sequence
  SiRNA target sequence
tgatagcacaatggagatctaat

SEQ ID NO: 72410 - DNA, 23 bp, Artificial sequence
  SiRNA target sequence
gatagcacaatggagatctaata

SEQ ID NO: 72411 - DNA, 23 bp, Artificial sequence
  SiRNA target sequence
atagcacaatggagatctaatat

SEQ ID NO: 72412 - DNA, 23 bp, Artificial sequence
  SiRNA target sequence
tagcacaatggagatctaatatt

SEQ ID NO: 72413 - DNA, 23 bp, Artificial sequence
  SiRNA target sequence
agcacaatggagatctaatatta

SEQ ID NO: 72414 - DNA, 23 bp, Artificial sequence
  SiRNA target sequence
gcacaatggagatctaatattag

SEQ ID NO: 72415 - DNA, 23 bp, Artificial sequence
  SiRNA target sequence
cacaatggagatctaatattaga

SEQ ID NO: 72416 - DNA, 23 bp, Artificial sequence
  SiRNA target sequence
acaatggagatctaatattagaa

SEQ ID NO: 72417 - DNA, 23 bp, Artificial sequence
  SiRNA target sequence
caatggagatctaatattagaag

SEQ ID NO: 72418 - DNA, 23 bp, Artificial sequence
  SiRNA target sequence
aatggagatctaatattagaaga

SEQ ID NO: 72419 - DNA, 23 bp, Artificial sequence
  SiRNA target sequence
atggagatctaatattagaagag

SEQ ID NO: 72420 - DNA, 23 bp, Artificial sequence
  SiRNA target sequence
tggagatctaatattagaagaga

SEQ ID NO: 72421 - DNA, 23 bp, Artificial sequence
  SiRNA target sequence
ggagatctaatattagaagagaa

SEQ ID NO: 72422 - DNA, 23 bp, Artificial sequence
  SiRNA target sequence
gagatctaatattagaagagaac

SEQ ID NO: 72423 - DNA, 23 bp, Artificial sequence
  SiRNA target sequence
agatctaatattagaagagaact

SEQ ID NO: 72424 - DNA, 23 bp, Artificial sequence
  SiRNA target sequence
gatctaatattagaagagaactt

SEQ ID NO: 72425 - DNA, 23 bp, Artificial sequence
  SiRNA target sequence
atctaatattagaagagaactta

SEQ ID NO: 72426 - DNA, 23 bp, Artificial sequence
  SiRNA target sequence
tctaatattagaagagaacttaa

SEQ ID NO: 72427 - DNA, 23 bp, Artificial sequence
  SiRNA target sequence
ctaatattagaagagaacttaat

SEQ ID NO: 72428 - DNA, 23 bp, Artificial sequence
  SiRNA target sequence
taatattagaagagaacttaata

SEQ ID NO: 72429 - DNA, 23 bp, Artificial sequence
  SiRNA target sequence
aatattagaagagaacttaataa

SEQ ID NO: 72430 - DNA, 23 bp, Artificial sequence
  SiRNA target sequence
atattagaagagaacttaataac

SEQ ID NO: 72431 - DNA, 23 bp, Artificial sequence
  SiRNA target sequence
tattagaagagaacttaataact

SEQ ID NO: 72432 - DNA, 23 bp, Artificial sequence
  SiRNA target sequence
attagaagagaacttaataactc

SEQ ID NO: 72433 - DNA, 23 bp, Artificial sequence
  SiRNA target sequence
ttagaagagaacttaataactct

SEQ ID NO: 72434 - DNA, 23 bp, Artificial sequence
  SiRNA target sequence
tagaagagaacttaataactctg

SEQ ID NO: 72435 - DNA, 23 bp, Artificial sequence
  SiRNA target sequence
agaagagaacttaataactctga

SEQ ID NO: 72436 - DNA, 23 bp, Artificial sequence
  SiRNA target sequence
gaagagaacttaataactctgaa

SEQ ID NO: 72437 - DNA, 23 bp, Artificial sequence
  SiRNA target sequence
aagagaacttaataactctgaaa

SEQ ID NO: 72438 - DNA, 23 bp, Artificial sequence
  SiRNA target sequence
agagaacttaataactctgaaaa

SEQ ID NO: 72439 - DNA, 23 bp, Artificial sequence
  SiRNA target sequence
gagaacttaataactctgaaaat

SEQ ID NO: 72440 - DNA, 23 bp, Artificial sequence
  SiRNA target sequence
agaacttaataactctgaaaata

SEQ ID NO: 72441 - DNA, 23 bp, Artificial sequence
  SiRNA target sequence
gaacttaataactctgaaaatag

SEQ ID NO: 72442 - DNA, 23 bp, Artificial sequence
  SiRNA target sequence
aacttaataactctgaaaataga

SEQ ID NO: 72443 - DNA, 23 bp, Artificial sequence
  SiRNA target sequence
acttaataactctgaaaatagat

SEQ ID NO: 72444 - DNA, 23 bp, Artificial sequence
  SiRNA target sequence
cttaataactctgaaaatagatc

SEQ ID NO: 72445 - DNA, 23 bp, Artificial sequence
  SiRNA target sequence
ttaataactctgaaaatagatct

SEQ ID NO: 72446 - DNA, 23 bp, Artificial sequence
  SiRNA target sequence
taataactctgaaaatagatcta

SEQ ID NO: 72447 - DNA, 23 bp, Artificial sequence
  SiRNA target sequence
aataactctgaaaatagatctag

SEQ ID NO: 72448 - DNA, 23 bp, Artificial sequence
  SiRNA target sequence
ataactctgaaaatagatctagt

SEQ ID NO: 72449 - DNA, 23 bp, Artificial sequence
  SiRNA target sequence
taactctgaaaatagatctagta

SEQ ID NO: 72450 - DNA, 23 bp, Artificial sequence
  SiRNA target sequence
aactctgaaaatagatctagtaa

SEQ ID NO: 72451 - DNA, 23 bp, Artificial sequence
  SiRNA target sequence
actctgaaaatagatctagtaat

SEQ ID NO: 72452 - DNA, 23 bp, Artificial sequence
  SiRNA target sequence
ctctgaaaatagatctagtaata

SEQ ID NO: 72453 - DNA, 23 bp, Artificial sequence
  SiRNA target sequence
tctgaaaatagatctagtaataa

SEQ ID NO: 72454 - DNA, 23 bp, Artificial sequence
  SiRNA target sequence
ctgaaaatagatctagtaataaa

SEQ ID NO: 72455 - DNA, 23 bp, Artificial sequence
  SiRNA target sequence
tgaaaatagatctagtaataaac

SEQ ID NO: 72456 - DNA, 23 bp, Artificial sequence
  SiRNA target sequence
gaaaatagatctagtaataaact

SEQ ID NO: 72457 - DNA, 23 bp, Artificial sequence
  SiRNA target sequence
aaaatagatctagtaataaacta

SEQ ID NO: 72458 - DNA, 23 bp, Artificial sequence
  SiRNA target sequence
aaatagatctagtaataaactac

SEQ ID NO: 72459 - DNA, 23 bp, Artificial sequence
  SiRNA target sequence
aatagatctagtaataaactaca

SEQ ID NO: 72460 - DNA, 23 bp, Artificial sequence
  SiRNA target sequence
atagatctagtaataaactacaa

SEQ ID NO: 72461 - DNA, 23 bp, Artificial sequence
  SiRNA target sequence
tagatctagtaataaactacaag

SEQ ID NO: 72462 - DNA, 23 bp, Artificial sequence
  SiRNA target sequence
agatctagtaataaactacaaga

SEQ ID NO: 72463 - DNA, 23 bp, Artificial sequence
  SiRNA target sequence
gatctagtaataaactacaagat

SEQ ID NO: 72464 - DNA, 23 bp, Artificial sequence
  SiRNA target sequence
atctagtaataaactacaagatg

SEQ ID NO: 72465 - DNA, 23 bp, Artificial sequence
  SiRNA target sequence
tctagtaataaactacaagatgg

SEQ ID NO: 72466 - DNA, 23 bp, Artificial sequence
  SiRNA target sequence
ctagtaataaactacaagatgga

SEQ ID NO: 72467 - DNA, 23 bp, Artificial sequence
  SiRNA target sequence
tagtaataaactacaagatggat

SEQ ID NO: 72468 - DNA, 23 bp, Artificial sequence
  SiRNA target sequence
agtaataaactacaagatggatt

SEQ ID NO: 72469 - DNA, 23 bp, Artificial sequence
  SiRNA target sequence
gtaataaactacaagatggatta

SEQ ID NO: 72470 - DNA, 23 bp, Artificial sequence
  SiRNA target sequence
taataaactacaagatggattaa

SEQ ID NO: 72471 - DNA, 23 bp, Artificial sequence
  SiRNA target sequence
aataaactacaagatggattaaa

SEQ ID NO: 72472 - DNA, 23 bp, Artificial sequence
  SiRNA target sequence
ataaactacaagatggattaaat

SEQ ID NO: 72473 - DNA, 23 bp, Artificial sequence
  SiRNA target sequence
taaactacaagatggattaaata

SEQ ID NO: 72474 - DNA, 23 bp, Artificial sequence
  SiRNA target sequence
aaactacaagatggattaaataa

SEQ ID NO: 72475 - DNA, 23 bp, Artificial sequence
  SiRNA target sequence
aactacaagatggattaaataat

SEQ ID NO: 72476 - DNA, 23 bp, Artificial sequence
  SiRNA target sequence
actacaagatggattaaataatc

SEQ ID NO: 72477 - DNA, 23 bp, Artificial sequence
  SiRNA target sequence
ctacaagatggattaaataatca

SEQ ID NO: 72478 - DNA, 23 bp, Artificial sequence
  SiRNA target sequence
tacaagatggattaaataatcat

SEQ ID NO: 72479 - DNA, 23 bp, Artificial sequence
  SiRNA target sequence
acaagatggattaaataatcatg

SEQ ID NO: 72480 - DNA, 23 bp, Artificial sequence
  SiRNA target sequence
caagatggattaaataatcatga

SEQ ID NO: 72481 - DNA, 23 bp, Artificial sequence
  SiRNA target sequence
aagatggattaaataatcatgaa

SEQ ID NO: 72482 - DNA, 23 bp, Artificial sequence
  SiRNA target sequence
agatggattaaataatcatgaaa

SEQ ID NO: 72483 - DNA, 23 bp, Artificial sequence
  SiRNA target sequence
gatggattaaataatcatgaaac

SEQ ID NO: 72484 - DNA, 23 bp, Artificial sequence
  SiRNA target sequence
atggattaaataatcatgaaaca

SEQ ID NO: 72485 - DNA, 23 bp, Artificial sequence
  SiRNA target sequence
tggattaaataatcatgaaacaa

SEQ ID NO: 72486 - DNA, 23 bp, Artificial sequence
  SiRNA target sequence
ggattaaataatcatgaaacaat

SEQ ID NO: 72487 - DNA, 23 bp, Artificial sequence
  SiRNA target sequence
gattaaataatcatgaaacaatc

SEQ ID NO: 72488 - DNA, 23 bp, Artificial sequence
  SiRNA target sequence
attaaataatcatgaaacaatcg

SEQ ID NO: 72489 - DNA, 23 bp, Artificial sequence
  SiRNA target sequence
ttaaataatcatgaaacaatcgt

SEQ ID NO: 72490 - DNA, 23 bp, Artificial sequence
  SiRNA target sequence
taaataatcatgaaacaatcgtc

SEQ ID NO: 72491 - DNA, 23 bp, Artificial sequence
  SiRNA target sequence
aaataatcatgaaacaatcgtct

SEQ ID NO: 72492 - DNA, 23 bp, Artificial sequence
  SiRNA target sequence
aataatcatgaaacaatcgtctc

SEQ ID NO: 72493 - DNA, 23 bp, Artificial sequence
  SiRNA target sequence
ataatcatgaaacaatcgtctcc

SEQ ID NO: 72494 - DNA, 23 bp, Artificial sequence
  SiRNA target sequence
taatcatgaaacaatcgtctcct

SEQ ID NO: 72495 - DNA, 23 bp, Artificial sequence
  SiRNA target sequence
aatcatgaaacaatcgtctcctt

SEQ ID NO: 72496 - DNA, 23 bp, Artificial sequence
  SiRNA target sequence
atcatgaaacaatcgtctccttt

SEQ ID NO: 72497 - DNA, 23 bp, Artificial sequence
  SiRNA target sequence
tcatgaaacaatcgtctcctttg

SEQ ID NO: 72498 - DNA, 23 bp, Artificial sequence
  SiRNA target sequence
catgaaacaatcgtctcctttgg

SEQ ID NO: 72499 - DNA, 23 bp, Artificial sequence
  SiRNA target sequence
atgaaacaatcgtctcctttggg

SEQ ID NO: 72500 - DNA, 23 bp, Artificial sequence
  SiRNA target sequence
tgaaacaatcgtctcctttggga

SEQ ID NO: 72501 - DNA, 23 bp, Artificial sequence
  SiRNA target sequence
gaaacaatcgtctcctttgggac

SEQ ID NO: 72502 - DNA, 23 bp, Artificial sequence
  SiRNA target sequence
aaacaatcgtctcctttgggact

SEQ ID NO: 72503 - DNA, 23 bp, Artificial sequence
  SiRNA target sequence
aacaatcgtctcctttgggacta

SEQ ID NO: 72504 - DNA, 23 bp, Artificial sequence
  SiRNA target sequence
acaatcgtctcctttgggactac

SEQ ID NO: 72505 - DNA, 23 bp, Artificial sequence
  SiRNA target sequence
caatcgtctcctttgggactaca

SEQ ID NO: 72506 - DNA, 23 bp, Artificial sequence
  SiRNA target sequence
aatcgtctcctttgggactacag

SEQ ID NO: 72507 - DNA, 23 bp, Artificial sequence
  SiRNA target sequence
atcgtctcctttgggactacaga

SEQ ID NO: 72508 - DNA, 23 bp, Artificial sequence
  SiRNA target sequence
tcgtctcctttgggactacagat

SEQ ID NO: 72509 - DNA, 23 bp, Artificial sequence
  SiRNA target sequence
cgtctcctttgggactacagatc

SEQ ID NO: 72510 - DNA, 23 bp, Artificial sequence
  SiRNA target sequence
gtctcctttgggactacagatct

SEQ ID NO: 72511 - DNA, 23 bp, Artificial sequence
  SiRNA target sequence
tctcctttgggactacagatctt

SEQ ID NO: 72512 - DNA, 23 bp, Artificial sequence
  SiRNA target sequence
ctcctttgggactacagatcttg

SEQ ID NO: 72513 - DNA, 23 bp, Artificial sequence
  SiRNA target sequence
tcctttgggactacagatcttga

SEQ ID NO: 72514 - DNA, 23 bp, Artificial sequence
  SiRNA target sequence
cctttgggactacagatcttgaa

SEQ ID NO: 72515 - DNA, 23 bp, Artificial sequence
  SiRNA target sequence
ctttgggactacagatcttgaag

SEQ ID NO: 72516 - DNA, 23 bp, Artificial sequence
  SiRNA target sequence
tttgggactacagatcttgaagt

SEQ ID NO: 72517 - DNA, 23 bp, Artificial sequence
  SiRNA target sequence
ttgggactacagatcttgaagta

SEQ ID NO: 72518 - DNA, 23 bp, Artificial sequence
  SiRNA target sequence
tgggactacagatcttgaagtag

SEQ ID NO: 72519 - DNA, 23 bp, Artificial sequence
  SiRNA target sequence
gggactacagatcttgaagtaga

SEQ ID NO: 72520 - DNA, 23 bp, Artificial sequence
  SiRNA target sequence
ggactacagatcttgaagtagat

SEQ ID NO: 72521 - DNA, 23 bp, Artificial sequence
  SiRNA target sequence
gactacagatcttgaagtagatg

SEQ ID NO: 72522 - DNA, 23 bp, Artificial sequence
  SiRNA target sequence
actacagatcttgaagtagatga

SEQ ID NO: 72523 - DNA, 23 bp, Artificial sequence
  SiRNA target sequence
ctacagatcttgaagtagatgaa

SEQ ID NO: 72524 - DNA, 23 bp, Artificial sequence
  SiRNA target sequence
tacagatcttgaagtagatgaat

SEQ ID NO: 72525 - DNA, 23 bp, Artificial sequence
  SiRNA target sequence
acagatcttgaagtagatgaata

SEQ ID NO: 72526 - DNA, 23 bp, Artificial sequence
  SiRNA target sequence
cagatcttgaagtagatgaatat

SEQ ID NO: 72527 - DNA, 23 bp, Artificial sequence
  SiRNA target sequence
agatcttgaagtagatgaatatg

SEQ ID NO: 72528 - DNA, 23 bp, Artificial sequence
  SiRNA target sequence
gatcttgaagtagatgaatatga

SEQ ID NO: 72529 - DNA, 23 bp, Artificial sequence
  SiRNA target sequence
atcttgaagtagatgaatatgat

SEQ ID NO: 72530 - DNA, 23 bp, Artificial sequence
  SiRNA target sequence
tcttgaagtagatgaatatgatc

SEQ ID NO: 72531 - DNA, 23 bp, Artificial sequence
  SiRNA target sequence
cttgaagtagatgaatatgatca

SEQ ID NO: 72532 - DNA, 23 bp, Artificial sequence
  SiRNA target sequence
ttgaagtagatgaatatgatcag

SEQ ID NO: 72533 - DNA, 23 bp, Artificial sequence
  SiRNA target sequence
tgaagtagatgaatatgatcagt

SEQ ID NO: 72534 - DNA, 23 bp, Artificial sequence
  SiRNA target sequence
gaagtagatgaatatgatcagtt

SEQ ID NO: 72535 - DNA, 23 bp, Artificial sequence
  SiRNA target sequence
aagtagatgaatatgatcagttt

SEQ ID NO: 72536 - DNA, 23 bp, Artificial sequence
  SiRNA target sequence
agtagatgaatatgatcagtttc

SEQ ID NO: 72537 - DNA, 23 bp, Artificial sequence
  SiRNA target sequence
gtagatgaatatgatcagtttct

SEQ ID NO: 72538 - DNA, 23 bp, Artificial sequence
  SiRNA target sequence
tagatgaatatgatcagtttctt

SEQ ID NO: 72539 - DNA, 23 bp, Artificial sequence
  SiRNA target sequence
agatgaatatgatcagtttctta

SEQ ID NO: 72540 - DNA, 23 bp, Artificial sequence
  SiRNA target sequence
gatgaatatgatcagtttcttaa

SEQ ID NO: 72541 - DNA, 23 bp, Artificial sequence
  SiRNA target sequence
atgaatatgatcagtttcttaaa

SEQ ID NO: 72542 - DNA, 23 bp, Artificial sequence
  SiRNA target sequence
tgaatatgatcagtttcttaaaa

SEQ ID NO: 72543 - DNA, 23 bp, Artificial sequence
  SiRNA target sequence
gaatatgatcagtttcttaaaat

SEQ ID NO: 72544 - DNA, 23 bp, Artificial sequence
  SiRNA target sequence
aatatgatcagtttcttaaaatt

SEQ ID NO: 72545 - DNA, 23 bp, Artificial sequence
  SiRNA target sequence
atatgatcagtttcttaaaatta

SEQ ID NO: 72546 - DNA, 23 bp, Artificial sequence
  SiRNA target sequence
tatgatcagtttcttaaaattaa

SEQ ID NO: 72547 - DNA, 23 bp, Artificial sequence
  SiRNA target sequence
atgatcagtttcttaaaattaat

SEQ ID NO: 72548 - DNA, 23 bp, Artificial sequence
  SiRNA target sequence
tgatcagtttcttaaaattaatg

SEQ ID NO: 72549 - DNA, 23 bp, Artificial sequence
  SiRNA target sequence
gatcagtttcttaaaattaatgc

SEQ ID NO: 72550 - DNA, 23 bp, Artificial sequence
  SiRNA target sequence
atcagtttcttaaaattaatgca

SEQ ID NO: 72551 - DNA, 23 bp, Artificial sequence
  SiRNA target sequence
tcagtttcttaaaattaatgcat

SEQ ID NO: 72552 - DNA, 23 bp, Artificial sequence
  SiRNA target sequence
cagtttcttaaaattaatgcatc

SEQ ID NO: 72553 - DNA, 23 bp, Artificial sequence
  SiRNA target sequence
agtttcttaaaattaatgcatct

SEQ ID NO: 72554 - DNA, 23 bp, Artificial sequence
  SiRNA target sequence
gtttcttaaaattaatgcatcta

SEQ ID NO: 72555 - DNA, 23 bp, Artificial sequence
  SiRNA target sequence
tttcttaaaattaatgcatctaa

SEQ ID NO: 72556 - DNA, 23 bp, Artificial sequence
  SiRNA target sequence
ttcttaaaattaatgcatctaat

SEQ ID NO: 72557 - DNA, 23 bp, Artificial sequence
  SiRNA target sequence
tcttaaaattaatgcatctaata

SEQ ID NO: 72558 - DNA, 23 bp, Artificial sequence
  SiRNA target sequence
cttaaaattaatgcatctaatag

SEQ ID NO: 72559 - DNA, 23 bp, Artificial sequence
  SiRNA target sequence
ttaaaattaatgcatctaatagt

SEQ ID NO: 72560 - DNA, 23 bp, Artificial sequence
  SiRNA target sequence
taaaattaatgcatctaatagta

SEQ ID NO: 72561 - DNA, 23 bp, Artificial sequence
  SiRNA target sequence
aaaattaatgcatctaatagtaa

SEQ ID NO: 72562 - DNA, 23 bp, Artificial sequence
  SiRNA target sequence
aaattaatgcatctaatagtaac

SEQ ID NO: 72563 - DNA, 23 bp, Artificial sequence
  SiRNA target sequence
aattaatgcatctaatagtaaca

SEQ ID NO: 72564 - DNA, 23 bp, Artificial sequence
  SiRNA target sequence
attaatgcatctaatagtaacag

SEQ ID NO: 72565 - DNA, 23 bp, Artificial sequence
  SiRNA target sequence
ttaatgcatctaatagtaacaga

SEQ ID NO: 72566 - DNA, 23 bp, Artificial sequence
  SiRNA target sequence
taatgcatctaatagtaacagat

SEQ ID NO: 72567 - DNA, 23 bp, Artificial sequence
  SiRNA target sequence
aatgcatctaatagtaacagatt

SEQ ID NO: 72568 - DNA, 23 bp, Artificial sequence
  SiRNA target sequence
atgcatctaatagtaacagatta

SEQ ID NO: 72569 - DNA, 23 bp, Artificial sequence
  SiRNA target sequence
tgcatctaatagtaacagattat

SEQ ID NO: 72570 - DNA, 23 bp, Artificial sequence
  SiRNA target sequence
gcatctaatagtaacagattatg

SEQ ID NO: 72571 - DNA, 23 bp, Artificial sequence
  SiRNA target sequence
catctaatagtaacagattatgg

SEQ ID NO: 72572 - DNA, 23 bp, Artificial sequence
  SiRNA target sequence
atctaatagtaacagattatgga

SEQ ID NO: 72573 - DNA, 23 bp, Artificial sequence
  SiRNA target sequence
tctaatagtaacagattatggag

SEQ ID NO: 72574 - DNA, 23 bp, Artificial sequence
  SiRNA target sequence
ctaatagtaacagattatggaga

SEQ ID NO: 72575 - DNA, 23 bp, Artificial sequence
  SiRNA target sequence
taatagtaacagattatggagag

SEQ ID NO: 72576 - DNA, 23 bp, Artificial sequence
  SiRNA target sequence
aatagtaacagattatggagagc

SEQ ID NO: 72577 - DNA, 23 bp, Artificial sequence
  SiRNA target sequence
atagtaacagattatggagagca

SEQ ID NO: 72578 - DNA, 23 bp, Artificial sequence
  SiRNA target sequence
tagtaacagattatggagagcac

SEQ ID NO: 72579 - DNA, 23 bp, Artificial sequence
  SiRNA target sequence
agtaacagattatggagagcact

SEQ ID NO: 72580 - DNA, 23 bp, Artificial sequence
  SiRNA target sequence
gtaacagattatggagagcactg

SEQ ID NO: 72581 - DNA, 23 bp, Artificial sequence
  SiRNA target sequence
taacagattatggagagcactgt

SEQ ID NO: 72582 - DNA, 23 bp, Artificial sequence
  SiRNA target sequence
aacagattatggagagcactgta

SEQ ID NO: 72583 - DNA, 23 bp, Artificial sequence
  SiRNA target sequence
acagattatggagagcactgtac

SEQ ID NO: 72584 - DNA, 23 bp, Artificial sequence
  SiRNA target sequence
cagattatggagagcactgtaca

SEQ ID NO: 72585 - DNA, 23 bp, Artificial sequence
  SiRNA target sequence
agattatggagagcactgtacat

SEQ ID NO: 72586 - DNA, 23 bp, Artificial sequence
  SiRNA target sequence
gattatggagagcactgtacatt

SEQ ID NO: 72587 - DNA, 23 bp, Artificial sequence
  SiRNA target sequence
attatggagagcactgtacattt

SEQ ID NO: 72588 - DNA, 23 bp, Artificial sequence
  SiRNA target sequence
ttatggagagcactgtacatttt

SEQ ID NO: 72589 - DNA, 23 bp, Artificial sequence
  SiRNA target sequence
tatggagagcactgtacatttta

SEQ ID NO: 72590 - DNA, 23 bp, Artificial sequence
  SiRNA target sequence
atggagagcactgtacattttaa

SEQ ID NO: 72591 - DNA, 23 bp, Artificial sequence
  SiRNA target sequence
tggagagcactgtacattttaaa

SEQ ID NO: 72592 - DNA, 23 bp, Artificial sequence
  SiRNA target sequence
ggagagcactgtacattttaaat

SEQ ID NO: 72593 - DNA, 23 bp, Artificial sequence
  SiRNA target sequence
gagagcactgtacattttaaatt

SEQ ID NO: 72594 - DNA, 23 bp, Artificial sequence
  SiRNA target sequence
agagcactgtacattttaaattt

SEQ ID NO: 72595 - DNA, 23 bp, Artificial sequence
  SiRNA target sequence
gagcactgtacattttaaattta

SEQ ID NO: 72596 - DNA, 23 bp, Artificial sequence
  SiRNA target sequence
agcactgtacattttaaatttat

SEQ ID NO: 72597 - DNA, 23 bp, Artificial sequence
  SiRNA target sequence
gcactgtacattttaaatttatc

SEQ ID NO: 72598 - DNA, 23 bp, Artificial sequence
  SiRNA target sequence
cactgtacattttaaatttatct

SEQ ID NO: 72599 - DNA, 23 bp, Artificial sequence
  SiRNA target sequence
actgtacattttaaatttatctc

SEQ ID NO: 72600 - DNA, 23 bp, Artificial sequence
  SiRNA target sequence
ctgtacattttaaatttatctca

SEQ ID NO: 72601 - DNA, 23 bp, Artificial sequence
  SiRNA target sequence
tgtacattttaaatttatctcag

SEQ ID NO: 72602 - DNA, 23 bp, Artificial sequence
  SiRNA target sequence
gtacattttaaatttatctcaga

SEQ ID NO: 72603 - DNA, 23 bp, Artificial sequence
  SiRNA target sequence
tacattttaaatttatctcagag

SEQ ID NO: 72604 - DNA, 23 bp, Artificial sequence
  SiRNA target sequence
acattttaaatttatctcagaga

SEQ ID NO: 72605 - DNA, 23 bp, Artificial sequence
  SiRNA target sequence
cattttaaatttatctcagagag

SEQ ID NO: 72606 - DNA, 23 bp, Artificial sequence
  SiRNA target sequence
attttaaatttatctcagagagc

SEQ ID NO: 72607 - DNA, 23 bp, Artificial sequence
  SiRNA target sequence
ttttaaatttatctcagagagca

SEQ ID NO: 72608 - DNA, 23 bp, Artificial sequence
  SiRNA target sequence
tttaaatttatctcagagagcaa

SEQ ID NO: 72609 - DNA, 23 bp, Artificial sequence
  SiRNA target sequence
ttaaatttatctcagagagcaat

SEQ ID NO: 72610 - DNA, 23 bp, Artificial sequence
  SiRNA target sequence
taaatttatctcagagagcaatt

SEQ ID NO: 72611 - DNA, 23 bp, Artificial sequence
  SiRNA target sequence
aaatttatctcagagagcaattt

SEQ ID NO: 72612 - DNA, 23 bp, Artificial sequence
  SiRNA target sequence
aatttatctcagagagcaatttt

SEQ ID NO: 72613 - DNA, 23 bp, Artificial sequence
  SiRNA target sequence
atttatctcagagagcaattttt

SEQ ID NO: 72614 - DNA, 23 bp, Artificial sequence
  SiRNA target sequence
tttatctcagagagcaatttttc

SEQ ID NO: 72615 - DNA, 23 bp, Artificial sequence
  SiRNA target sequence
ttatctcagagagcaatttttct

SEQ ID NO: 72616 - DNA, 23 bp, Artificial sequence
  SiRNA target sequence
tatctcagagagcaatttttctc

SEQ ID NO: 72617 - DNA, 23 bp, Artificial sequence
  SiRNA target sequence
atctcagagagcaatttttctct

SEQ ID NO: 72618 - DNA, 23 bp, Artificial sequence
  SiRNA target sequence
tctcagagagcaatttttctctt

SEQ ID NO: 72619 - DNA, 23 bp, Artificial sequence
  SiRNA target sequence
ctcagagagcaatttttctctta

SEQ ID NO: 72620 - DNA, 23 bp, Artificial sequence
  SiRNA target sequence
tcagagagcaatttttctcttac

SEQ ID NO: 72621 - DNA, 23 bp, Artificial sequence
  SiRNA target sequence
cagagagcaatttttctcttaca

SEQ ID NO: 72622 - DNA, 23 bp, Artificial sequence
  SiRNA target sequence
agagagcaatttttctcttacaa

SEQ ID NO: 72623 - DNA, 23 bp, Artificial sequence
  SiRNA target sequence
gagagcaatttttctcttacaaa

SEQ ID NO: 72624 - DNA, 23 bp, Artificial sequence
  SiRNA target sequence
agagcaatttttctcttacaaag

SEQ ID NO: 72625 - DNA, 23 bp, Artificial sequence
  SiRNA target sequence
gagcaatttttctcttacaaagt

SEQ ID NO: 72626 - DNA, 23 bp, Artificial sequence
  SiRNA target sequence
agcaatttttctcttacaaagtt

SEQ ID NO: 72627 - DNA, 23 bp, Artificial sequence
  SiRNA target sequence
gcaatttttctcttacaaagttt

SEQ ID NO: 72628 - DNA, 23 bp, Artificial sequence
  SiRNA target sequence
caatttttctcttacaaagtttt

SEQ ID NO: 72629 - DNA, 23 bp, Artificial sequence
  SiRNA target sequence
aatttttctcttacaaagttttt

SEQ ID NO: 72630 - DNA, 23 bp, Artificial sequence
  SiRNA target sequence
atttttctcttacaaagtttttt

SEQ ID NO: 72631 - DNA, 23 bp, Artificial sequence
  SiRNA target sequence
tttttctcttacaaagttttttt

SEQ ID NO: 72632 - DNA, 23 bp, Artificial sequence
  SiRNA target sequence
ttttctcttacaaagttttttta

SEQ ID NO: 72633 - DNA, 23 bp, Artificial sequence
  SiRNA target sequence
tttctcttacaaagtttttttat

SEQ ID NO: 72634 - DNA, 23 bp, Artificial sequence
  SiRNA target sequence
ttctcttacaaagtttttttatt

SEQ ID NO: 72635 - DNA, 23 bp, Artificial sequence
  SiRNA target sequence
tctcttacaaagtttttttatta

SEQ ID NO: 72636 - DNA, 23 bp, Artificial sequence
  SiRNA target sequence
ctcttacaaagtttttttattat

SEQ ID NO: 72637 - DNA, 23 bp, Artificial sequence
  SiRNA target sequence
tcttacaaagtttttttattatt

SEQ ID NO: 72638 - DNA, 23 bp, Artificial sequence
  SiRNA target sequence
cttacaaagtttttttattattt

SEQ ID NO: 72639 - DNA, 23 bp, Artificial sequence
  SiRNA target sequence
ttacaaagtttttttattattta

SEQ ID NO: 72640 - DNA, 23 bp, Artificial sequence
  SiRNA target sequence
tacaaagtttttttattatttat

SEQ ID NO: 72641 - DNA, 23 bp, Artificial sequence
  SiRNA target sequence
acaaagtttttttattatttatg

SEQ ID NO: 72642 - DNA, 23 bp, Artificial sequence
  SiRNA target sequence
caaagtttttttattatttatgc

SEQ ID NO: 72643 - DNA, 23 bp, Artificial sequence
  SiRNA target sequence
aaagtttttttattatttatgca

SEQ ID NO: 72644 - DNA, 23 bp, Artificial sequence
  SiRNA target sequence
aagtttttttattatttatgcag

SEQ ID NO: 72645 - DNA, 23 bp, Artificial sequence
  SiRNA target sequence
agtttttttattatttatgcagg

SEQ ID NO: 72646 - DNA, 23 bp, Artificial sequence
  SiRNA target sequence
gtttttttattatttatgcagga

SEQ ID NO: 72647 - DNA, 23 bp, Artificial sequence
  SiRNA target sequence
tttttttattatttatgcaggaa

SEQ ID NO: 72648 - DNA, 23 bp, Artificial sequence
  SiRNA target sequence
ttttttattatttatgcaggaat

SEQ ID NO: 72649 - DNA, 23 bp, Artificial sequence
  SiRNA target sequence
tttttattatttatgcaggaata

SEQ ID NO: 72650 - DNA, 23 bp, Artificial sequence
  SiRNA target sequence
ttttattatttatgcaggaatat

SEQ ID NO: 72651 - DNA, 23 bp, Artificial sequence
  SiRNA target sequence
tttattatttatgcaggaatatc

SEQ ID NO: 72652 - DNA, 23 bp, Artificial sequence
  SiRNA target sequence
ttattatttatgcaggaatatca

SEQ ID NO: 72653 - DNA, 23 bp, Artificial sequence
  SiRNA target sequence
tattatttatgcaggaatatcag

SEQ ID NO: 72654 - DNA, 23 bp, Artificial sequence
  SiRNA target sequence
attatttatgcaggaatatcagg

SEQ ID NO: 72655 - DNA, 23 bp, Artificial sequence
  SiRNA target sequence
ttatttatgcaggaatatcagga

SEQ ID NO: 72656 - DNA, 23 bp, Artificial sequence
  SiRNA target sequence
tatttatgcaggaatatcaggaa

SEQ ID NO: 72657 - DNA, 23 bp, Artificial sequence
  SiRNA target sequence
atttatgcaggaatatcaggaat

SEQ ID NO: 72658 - DNA, 23 bp, Artificial sequence
  SiRNA target sequence
tttatgcaggaatatcaggaata

SEQ ID NO: 72659 - DNA, 23 bp, Artificial sequence
  SiRNA target sequence
ttatgcaggaatatcaggaatat

SEQ ID NO: 72660 - DNA, 23 bp, Artificial sequence
  SiRNA target sequence
tatgcaggaatatcaggaatatt

SEQ ID NO: 72661 - DNA, 23 bp, Artificial sequence
  SiRNA target sequence
atgcaggaatatcaggaatatta

SEQ ID NO: 72662 - DNA, 23 bp, Artificial sequence
  SiRNA target sequence
tgcaggaatatcaggaatattat

SEQ ID NO: 72663 - DNA, 23 bp, Artificial sequence
  SiRNA target sequence
gcaggaatatcaggaatattatc

SEQ ID NO: 72664 - DNA, 23 bp, Artificial sequence
  SiRNA target sequence
caggaatatcaggaatattatct

SEQ ID NO: 72665 - DNA, 23 bp, Artificial sequence
  SiRNA target sequence
aggaatatcaggaatattatctc

SEQ ID NO: 72666 - DNA, 23 bp, Artificial sequence
  SiRNA target sequence
ggaatatcaggaatattatctca

SEQ ID NO: 72667 - DNA, 23 bp, Artificial sequence
  SiRNA target sequence
gaatatcaggaatattatctcaa

SEQ ID NO: 72668 - DNA, 23 bp, Artificial sequence
  SiRNA target sequence
aatatcaggaatattatctcaaa

SEQ ID NO: 72669 - DNA, 23 bp, Artificial sequence
  SiRNA target sequence
atatcaggaatattatctcaaaa

SEQ ID NO: 72670 - DNA, 23 bp, Artificial sequence
  SiRNA target sequence
tatcaggaatattatctcaaaat

SEQ ID NO: 72671 - DNA, 23 bp, Artificial sequence
  SiRNA target sequence
atcaggaatattatctcaaaata

SEQ ID NO: 72672 - DNA, 23 bp, Artificial sequence
  SiRNA target sequence
tcaggaatattatctcaaaatat

SEQ ID NO: 72673 - DNA, 23 bp, Artificial sequence
  SiRNA target sequence
caggaatattatctcaaaatatg

SEQ ID NO: 72674 - DNA, 23 bp, Artificial sequence
  SiRNA target sequence
aggaatattatctcaaaatatgt

SEQ ID NO: 72675 - DNA, 23 bp, Artificial sequence
  SiRNA target sequence
ggaatattatctcaaaatatgtc

SEQ ID NO: 72676 - DNA, 23 bp, Artificial sequence
  SiRNA target sequence
gaatattatctcaaaatatgtca

SEQ ID NO: 72677 - DNA, 23 bp, Artificial sequence
  SiRNA target sequence
aatattatctcaaaatatgtcat

SEQ ID NO: 72678 - DNA, 23 bp, Artificial sequence
  SiRNA target sequence
atattatctcaaaatatgtcatc

SEQ ID NO: 72679 - DNA, 23 bp, Artificial sequence
  SiRNA target sequence
tattatctcaaaatatgtcatct

SEQ ID NO: 72680 - DNA, 23 bp, Artificial sequence
  SiRNA target sequence
attatctcaaaatatgtcatcta

SEQ ID NO: 72681 - DNA, 23 bp, Artificial sequence
  SiRNA target sequence
ttatctcaaaatatgtcatctaa

SEQ ID NO: 72682 - DNA, 23 bp, Artificial sequence
  SiRNA target sequence
tatctcaaaatatgtcatctaac

SEQ ID NO: 72683 - DNA, 23 bp, Artificial sequence
  SiRNA target sequence
atctcaaaatatgtcatctaacc

SEQ ID NO: 72684 - DNA, 23 bp, Artificial sequence
  SiRNA target sequence
tctcaaaatatgtcatctaacca

SEQ ID NO: 72685 - DNA, 23 bp, Artificial sequence
  SiRNA target sequence
ctcaaaatatgtcatctaaccaa

SEQ ID NO: 72686 - DNA, 23 bp, Artificial sequence
  SiRNA target sequence
tcaaaatatgtcatctaaccaac

SEQ ID NO: 72687 - DNA, 23 bp, Artificial sequence
  SiRNA target sequence
caaaatatgtcatctaaccaact

SEQ ID NO: 72688 - DNA, 23 bp, Artificial sequence
  SiRNA target sequence
aaaatatgtcatctaaccaactc

SEQ ID NO: 72689 - DNA, 23 bp, Artificial sequence
  SiRNA target sequence
aaatatgtcatctaaccaactca

SEQ ID NO: 72690 - DNA, 23 bp, Artificial sequence
  SiRNA target sequence
aatatgtcatctaaccaactcat

SEQ ID NO: 72691 - DNA, 23 bp, Artificial sequence
  SiRNA target sequence
atatgtcatctaaccaactcatt

SEQ ID NO: 72692 - DNA, 23 bp, Artificial sequence
  SiRNA target sequence
tatgtcatctaaccaactcattt

SEQ ID NO: 72693 - DNA, 23 bp, Artificial sequence
  SiRNA target sequence
atgtcatctaaccaactcattta

SEQ ID NO: 72694 - DNA, 23 bp, Artificial sequence
  SiRNA target sequence
tgtcatctaaccaactcatttat

SEQ ID NO: 72695 - DNA, 23 bp, Artificial sequence
  SiRNA target sequence
gtcatctaaccaactcatttatt

SEQ ID NO: 72696 - DNA, 23 bp, Artificial sequence
  SiRNA target sequence
tcatctaaccaactcatttattt

SEQ ID NO: 72697 - DNA, 23 bp, Artificial sequence
  SiRNA target sequence
catctaaccaactcatttattta

SEQ ID NO: 72698 - DNA, 23 bp, Artificial sequence
  SiRNA target sequence
atctaaccaactcatttatttaa

SEQ ID NO: 72699 - DNA, 23 bp, Artificial sequence
  SiRNA target sequence
tctaaccaactcatttatttaat

SEQ ID NO: 72700 - DNA, 23 bp, Artificial sequence
  SiRNA target sequence
ctaaccaactcatttatttaatg

SEQ ID NO: 72701 - DNA, 23 bp, Artificial sequence
  SiRNA target sequence
taaccaactcatttatttaatgt

SEQ ID NO: 72702 - DNA, 23 bp, Artificial sequence
  SiRNA target sequence
aaccaactcatttatttaatgtc

SEQ ID NO: 72703 - DNA, 23 bp, Artificial sequence
  SiRNA target sequence
accaactcatttatttaatgtcc

SEQ ID NO: 72704 - DNA, 23 bp, Artificial sequence
  SiRNA target sequence
ccaactcatttatttaatgtcca

SEQ ID NO: 72705 - DNA, 23 bp, Artificial sequence
  SiRNA target sequence
caactcatttatttaatgtccat

SEQ ID NO: 72706 - DNA, 23 bp, Artificial sequence
  SiRNA target sequence
aactcatttatttaatgtccatt

SEQ ID NO: 72707 - DNA, 23 bp, Artificial sequence
  SiRNA target sequence
actcatttatttaatgtccatta

SEQ ID NO: 72708 - DNA, 23 bp, Artificial sequence
  SiRNA target sequence
ctcatttatttaatgtccattac

SEQ ID NO: 72709 - DNA, 23 bp, Artificial sequence
  SiRNA target sequence
tcatttatttaatgtccattaca

SEQ ID NO: 72710 - DNA, 23 bp, Artificial sequence
  SiRNA target sequence
catttatttaatgtccattacat

SEQ ID NO: 72711 - DNA, 23 bp, Artificial sequence
  SiRNA target sequence
atttatttaatgtccattacatc

SEQ ID NO: 72712 - DNA, 23 bp, Artificial sequence
  SiRNA target sequence
tttatttaatgtccattacatct

SEQ ID NO: 72713 - DNA, 23 bp, Artificial sequence
  SiRNA target sequence
ttatttaatgtccattacatcta

SEQ ID NO: 72714 - DNA, 23 bp, Artificial sequence
  SiRNA target sequence
tatttaatgtccattacatctac

SEQ ID NO: 72715 - DNA, 23 bp, Artificial sequence
  SiRNA target sequence
atttaatgtccattacatctacg

SEQ ID NO: 72716 - DNA, 23 bp, Artificial sequence
  SiRNA target sequence
tttaatgtccattacatctacgg

SEQ ID NO: 72717 - DNA, 23 bp, Artificial sequence
  SiRNA target sequence
ttaatgtccattacatctacggt

SEQ ID NO: 72718 - DNA, 23 bp, Artificial sequence
  SiRNA target sequence
taatgtccattacatctacggtt

SEQ ID NO: 72719 - DNA, 23 bp, Artificial sequence
  SiRNA target sequence
aatgtccattacatctacggtta

SEQ ID NO: 72720 - DNA, 23 bp, Artificial sequence
  SiRNA target sequence
atgtccattacatctacggttac

SEQ ID NO: 72721 - DNA, 23 bp, Artificial sequence
  SiRNA target sequence
tgtccattacatctacggttact

SEQ ID NO: 72722 - DNA, 23 bp, Artificial sequence
  SiRNA target sequence
gtccattacatctacggttacta

SEQ ID NO: 72723 - DNA, 23 bp, Artificial sequence
  SiRNA target sequence
tccattacatctacggttactat

SEQ ID NO: 72724 - DNA, 23 bp, Artificial sequence
  SiRNA target sequence
ccattacatctacggttactatt

SEQ ID NO: 72725 - DNA, 23 bp, Artificial sequence
  SiRNA target sequence
cattacatctacggttactatta

SEQ ID NO: 72726 - DNA, 23 bp, Artificial sequence
  SiRNA target sequence
attacatctacggttactattaa

SEQ ID NO: 72727 - DNA, 23 bp, Artificial sequence
  SiRNA target sequence
ttacatctacggttactattaat

SEQ ID NO: 72728 - DNA, 23 bp, Artificial sequence
  SiRNA target sequence
tacatctacggttactattaatt

SEQ ID NO: 72729 - DNA, 23 bp, Artificial sequence
  SiRNA target sequence
acatctacggttactattaattt

SEQ ID NO: 72730 - DNA, 23 bp, Artificial sequence
  SiRNA target sequence
catctacggttactattaattta

SEQ ID NO: 72731 - DNA, 23 bp, Artificial sequence
  SiRNA target sequence
atctacggttactattaatttaa

SEQ ID NO: 72732 - DNA, 23 bp, Artificial sequence
  SiRNA target sequence
tctacggttactattaatttaag

SEQ ID NO: 72733 - DNA, 23 bp, Artificial sequence
  SiRNA target sequence
ctacggttactattaatttaagt

SEQ ID NO: 72734 - DNA, 23 bp, Artificial sequence
  SiRNA target sequence
tacggttactattaatttaagta

SEQ ID NO: 72735 - DNA, 23 bp, Artificial sequence
  SiRNA target sequence
acggttactattaatttaagtaa

SEQ ID NO: 72736 - DNA, 23 bp, Artificial sequence
  SiRNA target sequence
cggttactattaatttaagtaac

SEQ ID NO: 72737 - DNA, 23 bp, Artificial sequence
  SiRNA target sequence
ggttactattaatttaagtaact

SEQ ID NO: 72738 - DNA, 23 bp, Artificial sequence
  SiRNA target sequence
gttactattaatttaagtaactt

SEQ ID NO: 72739 - DNA, 23 bp, Artificial sequence
  SiRNA target sequence
ttactattaatttaagtaacttg

SEQ ID NO: 72740 - DNA, 23 bp, Artificial sequence
  SiRNA target sequence
tactattaatttaagtaacttgg

SEQ ID NO: 72741 - DNA, 23 bp, Artificial sequence
  SiRNA target sequence
actattaatttaagtaacttggg

SEQ ID NO: 72742 - DNA, 23 bp, Artificial sequence
  SiRNA target sequence
ctattaatttaagtaacttgggt

SEQ ID NO: 72743 - DNA, 23 bp, Artificial sequence
  SiRNA target sequence
tattaatttaagtaacttgggtt

SEQ ID NO: 72744 - DNA, 23 bp, Artificial sequence
  SiRNA target sequence
attaatttaagtaacttgggtta

SEQ ID NO: 72745 - DNA, 23 bp, Artificial sequence
  SiRNA target sequence
ttaatttaagtaacttgggttac

SEQ ID NO: 72746 - DNA, 23 bp, Artificial sequence
  SiRNA target sequence
taatttaagtaacttgggttact

SEQ ID NO: 72747 - DNA, 23 bp, Artificial sequence
  SiRNA target sequence
aatttaagtaacttgggttactt

SEQ ID NO: 72748 - DNA, 23 bp, Artificial sequence
  SiRNA target sequence
atttaagtaacttgggttactta

SEQ ID NO: 72749 - DNA, 23 bp, Artificial sequence
  SiRNA target sequence
tttaagtaacttgggttacttat

SEQ ID NO: 72750 - DNA, 23 bp, Artificial sequence
  SiRNA target sequence
ttaagtaacttgggttacttata

SEQ ID NO: 72751 - DNA, 23 bp, Artificial sequence
  SiRNA target sequence
taagtaacttgggttacttatac

SEQ ID NO: 72752 - DNA, 23 bp, Artificial sequence
  SiRNA target sequence
aagtaacttgggttacttataca

SEQ ID NO: 72753 - DNA, 23 bp, Artificial sequence
  SiRNA target sequence
agtaacttgggttacttatacac

SEQ ID NO: 72754 - DNA, 23 bp, Artificial sequence
  SiRNA target sequence
gtaacttgggttacttatacact

SEQ ID NO: 72755 - DNA, 23 bp, Artificial sequence
  SiRNA target sequence
taacttgggttacttatacacta

SEQ ID NO: 72756 - DNA, 23 bp, Artificial sequence
  SiRNA target sequence
aacttgggttacttatacactag

SEQ ID NO: 72757 - DNA, 23 bp, Artificial sequence
  SiRNA target sequence
acttgggttacttatacactaga

SEQ ID NO: 72758 - DNA, 23 bp, Artificial sequence
  SiRNA target sequence
cttgggttacttatacactagat

SEQ ID NO: 72759 - DNA, 23 bp, Artificial sequence
  SiRNA target sequence
ttgggttacttatacactagata

SEQ ID NO: 72760 - DNA, 23 bp, Artificial sequence
  SiRNA target sequence
tgggttacttatacactagatat

SEQ ID NO: 72761 - DNA, 23 bp, Artificial sequence
  SiRNA target sequence
gggttacttatacactagatata

SEQ ID NO: 72762 - DNA, 23 bp, Artificial sequence
  SiRNA target sequence
ggttacttatacactagatatac

SEQ ID NO: 72763 - DNA, 23 bp, Artificial sequence
  SiRNA target sequence
gttacttatacactagatataca

SEQ ID NO: 72764 - DNA, 23 bp, Artificial sequence
  SiRNA target sequence
ttacttatacactagatatacac

SEQ ID NO: 72765 - DNA, 23 bp, Artificial sequence
  SiRNA target sequence
tacttatacactagatatacaca

SEQ ID NO: 72766 - DNA, 23 bp, Artificial sequence
  SiRNA target sequence
acttatacactagatatacacaa

SEQ ID NO: 72767 - DNA, 23 bp, Artificial sequence
  SiRNA target sequence
cttatacactagatatacacaag

SEQ ID NO: 72768 - DNA, 23 bp, Artificial sequence
  SiRNA target sequence
ttatacactagatatacacaagc

SEQ ID NO: 72769 - DNA, 23 bp, Artificial sequence
  SiRNA target sequence
tatacactagatatacacaagca

SEQ ID NO: 72770 - DNA, 23 bp, Artificial sequence
  SiRNA target sequence
atacactagatatacacaagcaa

SEQ ID NO: 72771 - DNA, 23 bp, Artificial sequence
  SiRNA target sequence
tacactagatatacacaagcaat

SEQ ID NO: 72772 - DNA, 23 bp, Artificial sequence
  SiRNA target sequence
acactagatatacacaagcaata

SEQ ID NO: 72773 - DNA, 23 bp, Artificial sequence
  SiRNA target sequence
cactagatatacacaagcaataa

SEQ ID NO: 72774 - DNA, 23 bp, Artificial sequence
  SiRNA target sequence
actagatatacacaagcaataat

SEQ ID NO: 72775 - DNA, 23 bp, Artificial sequence
  SiRNA target sequence
ctagatatacacaagcaataatt

SEQ ID NO: 72776 - DNA, 23 bp, Artificial sequence
  SiRNA target sequence
tagatatacacaagcaataatta

SEQ ID NO: 72777 - DNA, 23 bp, Artificial sequence
  SiRNA target sequence
agatatacacaagcaataattaa

SEQ ID NO: 72778 - DNA, 23 bp, Artificial sequence
  SiRNA target sequence
gatatacacaagcaataattaat

SEQ ID NO: 72779 - DNA, 23 bp, Artificial sequence
  SiRNA target sequence
atatacacaagcaataattaatg

SEQ ID NO: 72780 - DNA, 23 bp, Artificial sequence
  SiRNA target sequence
tatacacaagcaataattaatgc

SEQ ID NO: 72781 - DNA, 23 bp, Artificial sequence
  SiRNA target sequence
atacacaagcaataattaatgca

SEQ ID NO: 72782 - DNA, 23 bp, Artificial sequence
  SiRNA target sequence
tacacaagcaataattaatgcaa

SEQ ID NO: 72783 - DNA, 23 bp, Artificial sequence
  SiRNA target sequence
acacaagcaataattaatgcaag

SEQ ID NO: 72784 - DNA, 23 bp, Artificial sequence
  SiRNA target sequence
cacaagcaataattaatgcaaga

SEQ ID NO: 72785 - DNA, 23 bp, Artificial sequence
  SiRNA target sequence
acaagcaataattaatgcaagat

SEQ ID NO: 72786 - DNA, 23 bp, Artificial sequence
  SiRNA target sequence
caagcaataattaatgcaagatc

SEQ ID NO: 72787 - DNA, 23 bp, Artificial sequence
  SiRNA target sequence
aagcaataattaatgcaagatct

SEQ ID NO: 72788 - DNA, 23 bp, Artificial sequence
  SiRNA target sequence
agcaataattaatgcaagatcta

SEQ ID NO: 72789 - DNA, 23 bp, Artificial sequence
  SiRNA target sequence
gcaataattaatgcaagatctac

SEQ ID NO: 72790 - DNA, 23 bp, Artificial sequence
  SiRNA target sequence
caataattaatgcaagatctact

SEQ ID NO: 72791 - DNA, 23 bp, Artificial sequence
  SiRNA target sequence
aataattaatgcaagatctactt

SEQ ID NO: 72792 - DNA, 23 bp, Artificial sequence
  SiRNA target sequence
ataattaatgcaagatctactta

SEQ ID NO: 72793 - DNA, 23 bp, Artificial sequence
  SiRNA target sequence
taattaatgcaagatctacttat

SEQ ID NO: 72794 - DNA, 23 bp, Artificial sequence
  SiRNA target sequence
aattaatgcaagatctacttatg

SEQ ID NO: 72795 - DNA, 23 bp, Artificial sequence
  SiRNA target sequence
attaatgcaagatctacttatga

SEQ ID NO: 72796 - DNA, 23 bp, Artificial sequence
  SiRNA target sequence
ttaatgcaagatctacttatgat

SEQ ID NO: 72797 - DNA, 23 bp, Artificial sequence
  SiRNA target sequence
taatgcaagatctacttatgata

SEQ ID NO: 72798 - DNA, 23 bp, Artificial sequence
  SiRNA target sequence
aatgcaagatctacttatgatac

SEQ ID NO: 72799 - DNA, 23 bp, Artificial sequence
  SiRNA target sequence
atgcaagatctacttatgataca

SEQ ID NO: 72800 - DNA, 23 bp, Artificial sequence
  SiRNA target sequence
tgcaagatctacttatgatacaa

SEQ ID NO: 72801 - DNA, 23 bp, Artificial sequence
  SiRNA target sequence
gcaagatctacttatgatacaat

SEQ ID NO: 72802 - DNA, 23 bp, Artificial sequence
  SiRNA target sequence
caagatctacttatgatacaatg

SEQ ID NO: 72803 - DNA, 23 bp, Artificial sequence
  SiRNA target sequence
aagatctacttatgatacaatgt

SEQ ID NO: 72804 - DNA, 23 bp, Artificial sequence
  SiRNA target sequence
agatctacttatgatacaatgtt

SEQ ID NO: 72805 - DNA, 23 bp, Artificial sequence
  SiRNA target sequence
gatctacttatgatacaatgtta

SEQ ID NO: 72806 - DNA, 23 bp, Artificial sequence
  SiRNA target sequence
atctacttatgatacaatgttag

SEQ ID NO: 72807 - DNA, 23 bp, Artificial sequence
  SiRNA target sequence
tctacttatgatacaatgttaga

SEQ ID NO: 72808 - DNA, 23 bp, Artificial sequence
  SiRNA target sequence
ctacttatgatacaatgttagat

SEQ ID NO: 72809 - DNA, 23 bp, Artificial sequence
  SiRNA target sequence
tacttatgatacaatgttagata

SEQ ID NO: 72810 - DNA, 23 bp, Artificial sequence
  SiRNA target sequence
acttatgatacaatgttagatat

SEQ ID NO: 72811 - DNA, 23 bp, Artificial sequence
  SiRNA target sequence
cttatgatacaatgttagatata

SEQ ID NO: 72812 - DNA, 23 bp, Artificial sequence
  SiRNA target sequence
ttatgatacaatgttagatataa

SEQ ID NO: 72813 - DNA, 23 bp, Artificial sequence
  SiRNA target sequence
tatgatacaatgttagatataaa

SEQ ID NO: 72814 - DNA, 23 bp, Artificial sequence
  SiRNA target sequence
atgatacaatgttagatataaaa

SEQ ID NO: 72815 - DNA, 23 bp, Artificial sequence
  SiRNA target sequence
tgatacaatgttagatataaaaa

SEQ ID NO: 72816 - DNA, 23 bp, Artificial sequence
  SiRNA target sequence
gatacaatgttagatataaaaaa

SEQ ID NO: 72817 - DNA, 23 bp, Artificial sequence
  SiRNA target sequence
atacaatgttagatataaaaaaa

SEQ ID NO: 72818 - DNA, 23 bp, Artificial sequence
  SiRNA target sequence
tacaatgttagatataaaaaaag

SEQ ID NO: 72819 - DNA, 23 bp, Artificial sequence
  SiRNA target sequence
acaatgttagatataaaaaaaga

SEQ ID NO: 72820 - DNA, 23 bp, Artificial sequence
  SiRNA target sequence
caatgttagatataaaaaaagag

SEQ ID NO: 72821 - DNA, 23 bp, Artificial sequence
  SiRNA target sequence
aatgttagatataaaaaaagaga

SEQ ID NO: 72822 - DNA, 23 bp, Artificial sequence
  SiRNA target sequence
atgttagatataaaaaaagagaa

SEQ ID NO: 72823 - DNA, 23 bp, Artificial sequence
  SiRNA target sequence
tgttagatataaaaaaagagaat

SEQ ID NO: 72824 - DNA, 23 bp, Artificial sequence
  SiRNA target sequence
gttagatataaaaaaagagaata

SEQ ID NO: 72825 - DNA, 23 bp, Artificial sequence
  SiRNA target sequence
ttagatataaaaaaagagaataa

SEQ ID NO: 72826 - DNA, 23 bp, Artificial sequence
  SiRNA target sequence
tagatataaaaaaagagaataat

SEQ ID NO: 72827 - DNA, 23 bp, Artificial sequence
  SiRNA target sequence
agatataaaaaaagagaataata

SEQ ID NO: 72828 - DNA, 23 bp, Artificial sequence
  SiRNA target sequence
gatataaaaaaagagaataataa

SEQ ID NO: 72829 - DNA, 23 bp, Artificial sequence
  SiRNA target sequence
atataaaaaaagagaataataag

SEQ ID NO: 72830 - DNA, 23 bp, Artificial sequence
  SiRNA target sequence
tataaaaaaagagaataataagt

SEQ ID NO: 72831 - DNA, 23 bp, Artificial sequence
  SiRNA target sequence
ataaaaaaagagaataataagtt

SEQ ID NO: 72832 - DNA, 23 bp, Artificial sequence
  SiRNA target sequence
taaaaaaagagaataataagttt

SEQ ID NO: 72833 - DNA, 23 bp, Artificial sequence
  SiRNA target sequence
aaaaaaagagaataataagttta

SEQ ID NO: 72834 - DNA, 23 bp, Artificial sequence
  SiRNA target sequence
aaaaaagagaataataagtttaa

SEQ ID NO: 72835 - DNA, 23 bp, Artificial sequence
  SiRNA target sequence
aaaaagagaataataagtttaag

SEQ ID NO: 72836 - DNA, 23 bp, Artificial sequence
  SiRNA target sequence
aaaagagaataataagtttaaga

SEQ ID NO: 72837 - DNA, 23 bp, Artificial sequence
  SiRNA target sequence
aaagagaataataagtttaagat

SEQ ID NO: 72838 - DNA, 23 bp, Artificial sequence
  SiRNA target sequence
aagagaataataagtttaagatt

SEQ ID NO: 72839 - DNA, 23 bp, Artificial sequence
  SiRNA target sequence
agagaataataagtttaagatta

SEQ ID NO: 72840 - DNA, 23 bp, Artificial sequence
  SiRNA target sequence
gagaataataagtttaagattac

SEQ ID NO: 72841 - DNA, 23 bp, Artificial sequence
  SiRNA target sequence
agaataataagtttaagattaca

SEQ ID NO: 72842 - DNA, 23 bp, Artificial sequence
  SiRNA target sequence
gaataataagtttaagattacag

SEQ ID NO: 72843 - DNA, 23 bp, Artificial sequence
  SiRNA target sequence
aataataagtttaagattacaga

SEQ ID NO: 72844 - DNA, 23 bp, Artificial sequence
  SiRNA target sequence
ataataagtttaagattacagaa

SEQ ID NO: 72845 - DNA, 23 bp, Artificial sequence
  SiRNA target sequence
taataagtttaagattacagaat

SEQ ID NO: 72846 - DNA, 23 bp, Artificial sequence
  SiRNA target sequence
aataagtttaagattacagaatt

SEQ ID NO: 72847 - DNA, 23 bp, Artificial sequence
  SiRNA target sequence
ataagtttaagattacagaattt

SEQ ID NO: 72848 - DNA, 23 bp, Artificial sequence
  SiRNA target sequence
taagtttaagattacagaattta

SEQ ID NO: 72849 - DNA, 23 bp, Artificial sequence
  SiRNA target sequence
aagtttaagattacagaatttaa

SEQ ID NO: 72850 - DNA, 23 bp, Artificial sequence
  SiRNA target sequence
agtttaagattacagaatttaaa

SEQ ID NO: 72851 - DNA, 23 bp, Artificial sequence
  SiRNA target sequence
gtttaagattacagaatttaaag

SEQ ID NO: 72852 - DNA, 23 bp, Artificial sequence
  SiRNA target sequence
tttaagattacagaatttaaaga

SEQ ID NO: 72853 - DNA, 23 bp, Artificial sequence
  SiRNA target sequence
ttaagattacagaatttaaagaa

SEQ ID NO: 72854 - DNA, 23 bp, Artificial sequence
  SiRNA target sequence
taagattacagaatttaaagaaa

SEQ ID NO: 72855 - DNA, 23 bp, Artificial sequence
  SiRNA target sequence
aagattacagaatttaaagaaag

SEQ ID NO: 72856 - DNA, 23 bp, Artificial sequence
  SiRNA target sequence
agattacagaatttaaagaaagt

SEQ ID NO: 72857 - DNA, 23 bp, Artificial sequence
  SiRNA target sequence
gattacagaatttaaagaaagta

SEQ ID NO: 72858 - DNA, 23 bp, Artificial sequence
  SiRNA target sequence
attacagaatttaaagaaagtat

SEQ ID NO: 72859 - DNA, 23 bp, Artificial sequence
  SiRNA target sequence
ttacagaatttaaagaaagtatt

SEQ ID NO: 72860 - DNA, 23 bp, Artificial sequence
  SiRNA target sequence
tacagaatttaaagaaagtatta

SEQ ID NO: 72861 - DNA, 23 bp, Artificial sequence
  SiRNA target sequence
acagaatttaaagaaagtattaa

SEQ ID NO: 72862 - DNA, 23 bp, Artificial sequence
  SiRNA target sequence
cagaatttaaagaaagtattaag

SEQ ID NO: 72863 - DNA, 23 bp, Artificial sequence
  SiRNA target sequence
agaatttaaagaaagtattaagt

SEQ ID NO: 72864 - DNA, 23 bp, Artificial sequence
  SiRNA target sequence
gaatttaaagaaagtattaagtt

SEQ ID NO: 72865 - DNA, 23 bp, Artificial sequence
  SiRNA target sequence
aatttaaagaaagtattaagttt

SEQ ID NO: 72866 - DNA, 23 bp, Artificial sequence
  SiRNA target sequence
atttaaagaaagtattaagttta

SEQ ID NO: 72867 - DNA, 23 bp, Artificial sequence
  SiRNA target sequence
tttaaagaaagtattaagtttaa

SEQ ID NO: 72868 - DNA, 23 bp, Artificial sequence
  SiRNA target sequence
ttaaagaaagtattaagtttaat

SEQ ID NO: 72869 - DNA, 23 bp, Artificial sequence
  SiRNA target sequence
taaagaaagtattaagtttaata

SEQ ID NO: 72870 - DNA, 23 bp, Artificial sequence
  SiRNA target sequence
aaagaaagtattaagtttaataa

SEQ ID NO: 72871 - DNA, 23 bp, Artificial sequence
  SiRNA target sequence
aagaaagtattaagtttaataat

SEQ ID NO: 72872 - DNA, 23 bp, Artificial sequence
  SiRNA target sequence
agaaagtattaagtttaataatt

SEQ ID NO: 72873 - DNA, 23 bp, Artificial sequence
  SiRNA target sequence
gaaagtattaagtttaataattt

SEQ ID NO: 72874 - DNA, 23 bp, Artificial sequence
  SiRNA target sequence
aaagtattaagtttaataatttg

SEQ ID NO: 72875 - DNA, 23 bp, Artificial sequence
  SiRNA target sequence
aagtattaagtttaataatttgt

SEQ ID NO: 72876 - DNA, 23 bp, Artificial sequence
  SiRNA target sequence
agtattaagtttaataatttgtc

SEQ ID NO: 72877 - DNA, 23 bp, Artificial sequence
  SiRNA target sequence
gtattaagtttaataatttgtca

SEQ ID NO: 72878 - DNA, 23 bp, Artificial sequence
  SiRNA target sequence
tattaagtttaataatttgtcat

SEQ ID NO: 72879 - DNA, 23 bp, Artificial sequence
  SiRNA target sequence
attaagtttaataatttgtcatt

SEQ ID NO: 72880 - DNA, 23 bp, Artificial sequence
  SiRNA target sequence
ttaagtttaataatttgtcattt

SEQ ID NO: 72881 - DNA, 23 bp, Artificial sequence
  SiRNA target sequence
taagtttaataatttgtcatttg

SEQ ID NO: 72882 - DNA, 23 bp, Artificial sequence
  SiRNA target sequence
aagtttaataatttgtcatttgg

SEQ ID NO: 72883 - DNA, 23 bp, Artificial sequence
  SiRNA target sequence
agtttaataatttgtcatttggt

SEQ ID NO: 72884 - DNA, 23 bp, Artificial sequence
  SiRNA target sequence
gtttaataatttgtcatttggtt

SEQ ID NO: 72885 - DNA, 23 bp, Artificial sequence
  SiRNA target sequence
tttaataatttgtcatttggtta

SEQ ID NO: 72886 - DNA, 23 bp, Artificial sequence
  SiRNA target sequence
ttaataatttgtcatttggttat

SEQ ID NO: 72887 - DNA, 23 bp, Artificial sequence
  SiRNA target sequence
taataatttgtcatttggttatg

SEQ ID NO: 72888 - DNA, 23 bp, Artificial sequence
  SiRNA target sequence
aataatttgtcatttggttatga

SEQ ID NO: 72889 - DNA, 23 bp, Artificial sequence
  SiRNA target sequence
ataatttgtcatttggttatgaa

SEQ ID NO: 72890 - DNA, 23 bp, Artificial sequence
  SiRNA target sequence
taatttgtcatttggttatgaaa

SEQ ID NO: 72891 - DNA, 23 bp, Artificial sequence
  SiRNA target sequence
aatttgtcatttggttatgaaag

SEQ ID NO: 72892 - DNA, 23 bp, Artificial sequence
  SiRNA target sequence
atttgtcatttggttatgaaagt

SEQ ID NO: 72893 - DNA, 23 bp, Artificial sequence
  SiRNA target sequence
tttgtcatttggttatgaaagta

SEQ ID NO: 72894 - DNA, 23 bp, Artificial sequence
  SiRNA target sequence
ttgtcatttggttatgaaagtag

SEQ ID NO: 72895 - DNA, 23 bp, Artificial sequence
  SiRNA target sequence
tgtcatttggttatgaaagtaga

SEQ ID NO: 72896 - DNA, 23 bp, Artificial sequence
  SiRNA target sequence
gtcatttggttatgaaagtagac

SEQ ID NO: 72897 - DNA, 23 bp, Artificial sequence
  SiRNA target sequence
tcatttggttatgaaagtagaca

SEQ ID NO: 72898 - DNA, 23 bp, Artificial sequence
  SiRNA target sequence
catttggttatgaaagtagacaa

SEQ ID NO: 72899 - DNA, 23 bp, Artificial sequence
  SiRNA target sequence
atttggttatgaaagtagacaaa

SEQ ID NO: 72900 - DNA, 23 bp, Artificial sequence
  SiRNA target sequence
tttggttatgaaagtagacaaat

SEQ ID NO: 72901 - DNA, 23 bp, Artificial sequence
  SiRNA target sequence
ttggttatgaaagtagacaaatt

SEQ ID NO: 72902 - DNA, 23 bp, Artificial sequence
  SiRNA target sequence
tggttatgaaagtagacaaattt

SEQ ID NO: 72903 - DNA, 23 bp, Artificial sequence
  SiRNA target sequence
ggttatgaaagtagacaaatttt

SEQ ID NO: 72904 - DNA, 23 bp, Artificial sequence
  SiRNA target sequence
gttatgaaagtagacaaattttt

SEQ ID NO: 72905 - DNA, 23 bp, Artificial sequence
  SiRNA target sequence
ttatgaaagtagacaaattttta

SEQ ID NO: 72906 - DNA, 23 bp, Artificial sequence
  SiRNA target sequence
tatgaaagtagacaaatttttaa

SEQ ID NO: 72907 - DNA, 23 bp, Artificial sequence
  SiRNA target sequence
atgaaagtagacaaatttttaat

SEQ ID NO: 72908 - DNA, 23 bp, Artificial sequence
  SiRNA target sequence
tgaaagtagacaaatttttaata

SEQ ID NO: 72909 - DNA, 23 bp, Artificial sequence
  SiRNA target sequence
gaaagtagacaaatttttaataa

SEQ ID NO: 72910 - DNA, 23 bp, Artificial sequence
  SiRNA target sequence
aaagtagacaaatttttaataaa

SEQ ID NO: 72911 - DNA, 23 bp, Artificial sequence
  SiRNA target sequence
aagtagacaaatttttaataaaa

SEQ ID NO: 72912 - DNA, 23 bp, Artificial sequence
  SiRNA target sequence
agtagacaaatttttaataaaat

SEQ ID NO: 72913 - DNA, 23 bp, Artificial sequence
  SiRNA target sequence
gtagacaaatttttaataaaata

SEQ ID NO: 72914 - DNA, 23 bp, Artificial sequence
  SiRNA target sequence
tagacaaatttttaataaaataa

SEQ ID NO: 72915 - DNA, 23 bp, Artificial sequence
  SiRNA target sequence
agacaaatttttaataaaataaa

SEQ ID NO: 72916 - DNA, 23 bp, Artificial sequence
  SiRNA target sequence
gacaaatttttaataaaataaat

SEQ ID NO: 72917 - DNA, 23 bp, Artificial sequence
  SiRNA target sequence
acaaatttttaataaaataaatc

SEQ ID NO: 72918 - DNA, 23 bp, Artificial sequence
  SiRNA target sequence
caaatttttaataaaataaatct

SEQ ID NO: 72919 - DNA, 23 bp, Artificial sequence
  SiRNA target sequence
aaatttttaataaaataaatcta

SEQ ID NO: 72920 - DNA, 23 bp, Artificial sequence
  SiRNA target sequence
aatttttaataaaataaatctag

SEQ ID NO: 72921 - DNA, 23 bp, Artificial sequence
  SiRNA target sequence
atttttaataaaataaatctaga

SEQ ID NO: 72922 - DNA, 23 bp, Artificial sequence
  SiRNA target sequence
tttttaataaaataaatctagaa

SEQ ID NO: 72923 - DNA, 23 bp, Artificial sequence
  SiRNA target sequence
ttttaataaaataaatctagaaa

SEQ ID NO: 72924 - DNA, 23 bp, Artificial sequence
  SiRNA target sequence
tttaataaaataaatctagaaat

SEQ ID NO: 72925 - DNA, 23 bp, Artificial sequence
  SiRNA target sequence
ttaataaaataaatctagaaata

SEQ ID NO: 72926 - DNA, 23 bp, Artificial sequence
  SiRNA target sequence
taataaaataaatctagaaatat

SEQ ID NO: 72927 - DNA, 23 bp, Artificial sequence
  SiRNA target sequence
aataaaataaatctagaaatata

SEQ ID NO: 72928 - DNA, 23 bp, Artificial sequence
  SiRNA target sequence
ataaaataaatctagaaatatac

SEQ ID NO: 72929 - DNA, 23 bp, Artificial sequence
  SiRNA target sequence
taaaataaatctagaaatataca

SEQ ID NO: 72930 - DNA, 23 bp, Artificial sequence
  SiRNA target sequence
aaaataaatctagaaatatacaa

SEQ ID NO: 72931 - DNA, 23 bp, Artificial sequence
  SiRNA target sequence
aaataaatctagaaatatacaaa

SEQ ID NO: 72932 - DNA, 23 bp, Artificial sequence
  SiRNA target sequence
aataaatctagaaatatacaaag

SEQ ID NO: 72933 - DNA, 23 bp, Artificial sequence
  SiRNA target sequence
ataaatctagaaatatacaaagg

SEQ ID NO: 72934 - DNA, 23 bp, Artificial sequence
  SiRNA target sequence
taaatctagaaatatacaaagga

SEQ ID NO: 72935 - DNA, 23 bp, Artificial sequence
  SiRNA target sequence
aaatctagaaatatacaaaggag

SEQ ID NO: 72936 - DNA, 23 bp, Artificial sequence
  SiRNA target sequence
aatctagaaatatacaaaggaga

SEQ ID NO: 72937 - DNA, 23 bp, Artificial sequence
  SiRNA target sequence
atctagaaatatacaaaggagaa

SEQ ID NO: 72938 - DNA, 23 bp, Artificial sequence
  SiRNA target sequence
tctagaaatatacaaaggagaaa

SEQ ID NO: 72939 - DNA, 23 bp, Artificial sequence
  SiRNA target sequence
ctagaaatatacaaaggagaaaa

SEQ ID NO: 72940 - DNA, 23 bp, Artificial sequence
  SiRNA target sequence
tagaaatatacaaaggagaaaaa

SEQ ID NO: 72941 - DNA, 23 bp, Artificial sequence
  SiRNA target sequence
agaaatatacaaaggagaaaaag

SEQ ID NO: 72942 - DNA, 23 bp, Artificial sequence
  SiRNA target sequence
gaaatatacaaaggagaaaaagt

SEQ ID NO: 72943 - DNA, 23 bp, Artificial sequence
  SiRNA target sequence
aaatatacaaaggagaaaaagta

SEQ ID NO: 72944 - DNA, 23 bp, Artificial sequence
  SiRNA target sequence
aatatacaaaggagaaaaagtag

SEQ ID NO: 72945 - DNA, 23 bp, Artificial sequence
  SiRNA target sequence
atatacaaaggagaaaaagtagc

SEQ ID NO: 72946 - DNA, 23 bp, Artificial sequence
  SiRNA target sequence
tatacaaaggagaaaaagtagca

SEQ ID NO: 72947 - DNA, 23 bp, Artificial sequence
  SiRNA target sequence
atacaaaggagaaaaagtagcaa

SEQ ID NO: 72948 - DNA, 23 bp, Artificial sequence
  SiRNA target sequence
tacaaaggagaaaaagtagcaat

SEQ ID NO: 72949 - DNA, 23 bp, Artificial sequence
  SiRNA target sequence
acaaaggagaaaaagtagcaatt

SEQ ID NO: 72950 - DNA, 23 bp, Artificial sequence
  SiRNA target sequence
caaaggagaaaaagtagcaatta

SEQ ID NO: 72951 - DNA, 23 bp, Artificial sequence
  SiRNA target sequence
aaaggagaaaaagtagcaattat

SEQ ID NO: 72952 - DNA, 23 bp, Artificial sequence
  SiRNA target sequence
aaggagaaaaagtagcaattata

SEQ ID NO: 72953 - DNA, 23 bp, Artificial sequence
  SiRNA target sequence
aggagaaaaagtagcaattatag

SEQ ID NO: 72954 - DNA, 23 bp, Artificial sequence
  SiRNA target sequence
ggagaaaaagtagcaattatagg

SEQ ID NO: 72955 - DNA, 23 bp, Artificial sequence
  SiRNA target sequence
gagaaaaagtagcaattataggt

SEQ ID NO: 72956 - DNA, 23 bp, Artificial sequence
  SiRNA target sequence
agaaaaagtagcaattataggta

SEQ ID NO: 72957 - DNA, 23 bp, Artificial sequence
  SiRNA target sequence
gaaaaagtagcaattataggtaa

SEQ ID NO: 72958 - DNA, 23 bp, Artificial sequence
  SiRNA target sequence
aaaaagtagcaattataggtaaa

SEQ ID NO: 72959 - DNA, 23 bp, Artificial sequence
  SiRNA target sequence
aaaagtagcaattataggtaaaa

SEQ ID NO: 72960 - DNA, 23 bp, Artificial sequence
  SiRNA target sequence
aaagtagcaattataggtaaaaa

SEQ ID NO: 72961 - DNA, 23 bp, Artificial sequence
  SiRNA target sequence
aagtagcaattataggtaaaaat

SEQ ID NO: 72962 - DNA, 23 bp, Artificial sequence
  SiRNA target sequence
agtagcaattataggtaaaaatg

SEQ ID NO: 72963 - DNA, 23 bp, Artificial sequence
  SiRNA target sequence
gtagcaattataggtaaaaatgg

SEQ ID NO: 72964 - DNA, 23 bp, Artificial sequence
  SiRNA target sequence
tagcaattataggtaaaaatggt

SEQ ID NO: 72965 - DNA, 23 bp, Artificial sequence
  SiRNA target sequence
agcaattataggtaaaaatggta

SEQ ID NO: 72966 - DNA, 23 bp, Artificial sequence
  SiRNA target sequence
gcaattataggtaaaaatggtag

SEQ ID NO: 72967 - DNA, 23 bp, Artificial sequence
  SiRNA target sequence
caattataggtaaaaatggtagt

SEQ ID NO: 72968 - DNA, 23 bp, Artificial sequence
  SiRNA target sequence
aattataggtaaaaatggtagtg

SEQ ID NO: 72969 - DNA, 23 bp, Artificial sequence
  SiRNA target sequence
attataggtaaaaatggtagtgg

SEQ ID NO: 72970 - DNA, 23 bp, Artificial sequence
  SiRNA target sequence
ttataggtaaaaatggtagtggt

SEQ ID NO: 72971 - DNA, 23 bp, Artificial sequence
  SiRNA target sequence
tataggtaaaaatggtagtggta

SEQ ID NO: 72972 - DNA, 23 bp, Artificial sequence
  SiRNA target sequence
ataggtaaaaatggtagtggtaa

SEQ ID NO: 72973 - DNA, 23 bp, Artificial sequence
  SiRNA target sequence
taggtaaaaatggtagtggtaaa

SEQ ID NO: 72974 - DNA, 23 bp, Artificial sequence
  SiRNA target sequence
aggtaaaaatggtagtggtaaat

SEQ ID NO: 72975 - DNA, 23 bp, Artificial sequence
  SiRNA target sequence
ggtaaaaatggtagtggtaaatc

SEQ ID NO: 72976 - DNA, 23 bp, Artificial sequence
  SiRNA target sequence
gtaaaaatggtagtggtaaatca

SEQ ID NO: 72977 - DNA, 23 bp, Artificial sequence
  SiRNA target sequence
taaaaatggtagtggtaaatcaa

SEQ ID NO: 72978 - DNA, 23 bp, Artificial sequence
  SiRNA target sequence
aaaaatggtagtggtaaatcaac

SEQ ID NO: 72979 - DNA, 23 bp, Artificial sequence
  SiRNA target sequence
aaaatggtagtggtaaatcaaca

SEQ ID NO: 72980 - DNA, 23 bp, Artificial sequence
  SiRNA target sequence
aaatggtagtggtaaatcaacat

SEQ ID NO: 72981 - DNA, 23 bp, Artificial sequence
  SiRNA target sequence
aatggtagtggtaaatcaacatt

SEQ ID NO: 72982 - DNA, 23 bp, Artificial sequence
  SiRNA target sequence
atggtagtggtaaatcaacatta

SEQ ID NO: 72983 - DNA, 23 bp, Artificial sequence
  SiRNA target sequence
tggtagtggtaaatcaacattac

SEQ ID NO: 72984 - DNA, 23 bp, Artificial sequence
  SiRNA target sequence
ggtagtggtaaatcaacattact

SEQ ID NO: 72985 - DNA, 23 bp, Artificial sequence
  SiRNA target sequence
gtagtggtaaatcaacattacta

SEQ ID NO: 72986 - DNA, 23 bp, Artificial sequence
  SiRNA target sequence
tagtggtaaatcaacattactaa

SEQ ID NO: 72987 - DNA, 23 bp, Artificial sequence
  SiRNA target sequence
agtggtaaatcaacattactaaa

SEQ ID NO: 72988 - DNA, 23 bp, Artificial sequence
  SiRNA target sequence
gtggtaaatcaacattactaaaa

SEQ ID NO: 72989 - DNA, 23 bp, Artificial sequence
  SiRNA target sequence
tggtaaatcaacattactaaaac

SEQ ID NO: 72990 - DNA, 23 bp, Artificial sequence
  SiRNA target sequence
ggtaaatcaacattactaaaact

SEQ ID NO: 72991 - DNA, 23 bp, Artificial sequence
  SiRNA target sequence
gtaaatcaacattactaaaacta

SEQ ID NO: 72992 - DNA, 23 bp, Artificial sequence
  SiRNA target sequence
taaatcaacattactaaaactac

SEQ ID NO: 72993 - DNA, 23 bp, Artificial sequence
  SiRNA target sequence
aaatcaacattactaaaactact

SEQ ID NO: 72994 - DNA, 23 bp, Artificial sequence
  SiRNA target sequence
aatcaacattactaaaactactg

SEQ ID NO: 72995 - DNA, 23 bp, Artificial sequence
  SiRNA target sequence
atcaacattactaaaactactgc

SEQ ID NO: 72996 - DNA, 23 bp, Artificial sequence
  SiRNA target sequence
tcaacattactaaaactactgct

SEQ ID NO: 72997 - DNA, 23 bp, Artificial sequence
  SiRNA target sequence
caacattactaaaactactgctt

SEQ ID NO: 72998 - DNA, 23 bp, Artificial sequence
  SiRNA target sequence
aacattactaaaactactgctta

SEQ ID NO: 72999 - DNA, 23 bp, Artificial sequence
  SiRNA target sequence
acattactaaaactactgcttaa

SEQ ID NO: 73000 - DNA, 23 bp, Artificial sequence
  SiRNA target sequence
cattactaaaactactgcttaaa

SEQ ID NO: 73001 - DNA, 23 bp, Artificial sequence
  SiRNA target sequence
attactaaaactactgcttaaat

SEQ ID NO: 73002 - DNA, 23 bp, Artificial sequence
  SiRNA target sequence
ttactaaaactactgcttaaatt

SEQ ID NO: 73003 - DNA, 23 bp, Artificial sequence
  SiRNA target sequence
tactaaaactactgcttaaattt

SEQ ID NO: 73004 - DNA, 23 bp, Artificial sequence
  SiRNA target sequence
actaaaactactgcttaaatttg

SEQ ID NO: 73005 - DNA, 23 bp, Artificial sequence
  SiRNA target sequence
ctaaaactactgcttaaatttga

SEQ ID NO: 73006 - DNA, 23 bp, Artificial sequence
  SiRNA target sequence
taaaactactgcttaaatttgat

SEQ ID NO: 73007 - DNA, 23 bp, Artificial sequence
  SiRNA target sequence
aaaactactgcttaaatttgatg

SEQ ID NO: 73008 - DNA, 23 bp, Artificial sequence
  SiRNA target sequence
aaactactgcttaaatttgatga

SEQ ID NO: 73009 - DNA, 23 bp, Artificial sequence
  SiRNA target sequence
aactactgcttaaatttgatgaa

SEQ ID NO: 73010 - DNA, 23 bp, Artificial sequence
  SiRNA target sequence
actactgcttaaatttgatgaag

SEQ ID NO: 73011 - DNA, 23 bp, Artificial sequence
  SiRNA target sequence
ctactgcttaaatttgatgaaga

SEQ ID NO: 73012 - DNA, 23 bp, Artificial sequence
  SiRNA target sequence
tactgcttaaatttgatgaagat

SEQ ID NO: 73013 - DNA, 23 bp, Artificial sequence
  SiRNA target sequence
actgcttaaatttgatgaagatt

SEQ ID NO: 73014 - DNA, 23 bp, Artificial sequence
  SiRNA target sequence
ctgcttaaatttgatgaagatta

SEQ ID NO: 73015 - DNA, 23 bp, Artificial sequence
  SiRNA target sequence
tgcttaaatttgatgaagattac

SEQ ID NO: 73016 - DNA, 23 bp, Artificial sequence
  SiRNA target sequence
gcttaaatttgatgaagattaca

SEQ ID NO: 73017 - DNA, 23 bp, Artificial sequence
  SiRNA target sequence
cttaaatttgatgaagattacaa

SEQ ID NO: 73018 - DNA, 23 bp, Artificial sequence
  SiRNA target sequence
ttaaatttgatgaagattacaaa

SEQ ID NO: 73019 - DNA, 23 bp, Artificial sequence
  SiRNA target sequence
taaatttgatgaagattacaaag

SEQ ID NO: 73020 - DNA, 23 bp, Artificial sequence
  SiRNA target sequence
aaatttgatgaagattacaaagg

SEQ ID NO: 73021 - DNA, 23 bp, Artificial sequence
  SiRNA target sequence
aatttgatgaagattacaaaggt

SEQ ID NO: 73022 - DNA, 23 bp, Artificial sequence
  SiRNA target sequence
atttgatgaagattacaaaggta

SEQ ID NO: 73023 - DNA, 23 bp, Artificial sequence
  SiRNA target sequence
tttgatgaagattacaaaggtag

SEQ ID NO: 73024 - DNA, 23 bp, Artificial sequence
  SiRNA target sequence
ttgatgaagattacaaaggtagc

SEQ ID NO: 73025 - DNA, 23 bp, Artificial sequence
  SiRNA target sequence
tgatgaagattacaaaggtagca

SEQ ID NO: 73026 - DNA, 23 bp, Artificial sequence
  SiRNA target sequence
gatgaagattacaaaggtagcat

SEQ ID NO: 73027 - DNA, 23 bp, Artificial sequence
  SiRNA target sequence
atgaagattacaaaggtagcatt

SEQ ID NO: 73028 - DNA, 23 bp, Artificial sequence
  SiRNA target sequence
tgaagattacaaaggtagcattt

SEQ ID NO: 73029 - DNA, 23 bp, Artificial sequence
  SiRNA target sequence
gaagattacaaaggtagcatttt

SEQ ID NO: 73030 - DNA, 23 bp, Artificial sequence
  SiRNA target sequence
aagattacaaaggtagcatttta

SEQ ID NO: 73031 - DNA, 23 bp, Artificial sequence
  SiRNA target sequence
agattacaaaggtagcattttaa

SEQ ID NO: 73032 - DNA, 23 bp, Artificial sequence
  SiRNA target sequence
gattacaaaggtagcattttaat

SEQ ID NO: 73033 - DNA, 23 bp, Artificial sequence
  SiRNA target sequence
attacaaaggtagcattttaata

SEQ ID NO: 73034 - DNA, 23 bp, Artificial sequence
  SiRNA target sequence
ttacaaaggtagcattttaatag

SEQ ID NO: 73035 - DNA, 23 bp, Artificial sequence
  SiRNA target sequence
tacaaaggtagcattttaataga

SEQ ID NO: 73036 - DNA, 23 bp, Artificial sequence
  SiRNA target sequence
acaaaggtagcattttaatagat

SEQ ID NO: 73037 - DNA, 23 bp, Artificial sequence
  SiRNA target sequence
caaaggtagcattttaatagatg

SEQ ID NO: 73038 - DNA, 23 bp, Artificial sequence
  SiRNA target sequence
aaaggtagcattttaatagatga

SEQ ID NO: 73039 - DNA, 23 bp, Artificial sequence
  SiRNA target sequence
aaggtagcattttaatagatgac

SEQ ID NO: 73040 - DNA, 23 bp, Artificial sequence
  SiRNA target sequence
aggtagcattttaatagatgaca

SEQ ID NO: 73041 - DNA, 23 bp, Artificial sequence
  SiRNA target sequence
ggtagcattttaatagatgacat

SEQ ID NO: 73042 - DNA, 23 bp, Artificial sequence
  SiRNA target sequence
gtagcattttaatagatgacatt

SEQ ID NO: 73043 - DNA, 23 bp, Artificial sequence
  SiRNA target sequence
tagcattttaatagatgacattg

SEQ ID NO: 73044 - DNA, 23 bp, Artificial sequence
  SiRNA target sequence
agcattttaatagatgacattga

SEQ ID NO: 73045 - DNA, 23 bp, Artificial sequence
  SiRNA target sequence
gcattttaatagatgacattgat

SEQ ID NO: 73046 - DNA, 23 bp, Artificial sequence
  SiRNA target sequence
cattttaatagatgacattgata

SEQ ID NO: 73047 - DNA, 23 bp, Artificial sequence
  SiRNA target sequence
attttaatagatgacattgatat

SEQ ID NO: 73048 - DNA, 23 bp, Artificial sequence
  SiRNA target sequence
ttttaatagatgacattgatatt

SEQ ID NO: 73049 - DNA, 23 bp, Artificial sequence
  SiRNA target sequence
tttaatagatgacattgatatta

SEQ ID NO: 73050 - DNA, 23 bp, Artificial sequence
  SiRNA target sequence
ttaatagatgacattgatattaa

SEQ ID NO: 73051 - DNA, 23 bp, Artificial sequence
  SiRNA target sequence
taatagatgacattgatattaaa

SEQ ID NO: 73052 - DNA, 23 bp, Artificial sequence
  SiRNA target sequence
aatagatgacattgatattaaaa

SEQ ID NO: 73053 - DNA, 23 bp, Artificial sequence
  SiRNA target sequence
atagatgacattgatattaaaaa

SEQ ID NO: 73054 - DNA, 23 bp, Artificial sequence
  SiRNA target sequence
tagatgacattgatattaaaaaa

SEQ ID NO: 73055 - DNA, 23 bp, Artificial sequence
  SiRNA target sequence
agatgacattgatattaaaaaaa

SEQ ID NO: 73056 - DNA, 23 bp, Artificial sequence
  SiRNA target sequence
gatgacattgatattaaaaaaat

SEQ ID NO: 73057 - DNA, 23 bp, Artificial sequence
  SiRNA target sequence
atgacattgatattaaaaaaatc

SEQ ID NO: 73058 - DNA, 23 bp, Artificial sequence
  SiRNA target sequence
tgacattgatattaaaaaaatca

SEQ ID NO: 73059 - DNA, 23 bp, Artificial sequence
  SiRNA target sequence
gacattgatattaaaaaaatcaa

SEQ ID NO: 73060 - DNA, 23 bp, Artificial sequence
  SiRNA target sequence
acattgatattaaaaaaatcaaa

SEQ ID NO: 73061 - DNA, 23 bp, Artificial sequence
  SiRNA target sequence
cattgatattaaaaaaatcaaag

SEQ ID NO: 73062 - DNA, 23 bp, Artificial sequence
  SiRNA target sequence
attgatattaaaaaaatcaaaga

SEQ ID NO: 73063 - DNA, 23 bp, Artificial sequence
  SiRNA target sequence
ttgatattaaaaaaatcaaagac

SEQ ID NO: 73064 - DNA, 23 bp, Artificial sequence
  SiRNA target sequence
tgatattaaaaaaatcaaagacg

SEQ ID NO: 73065 - DNA, 23 bp, Artificial sequence
  SiRNA target sequence
gatattaaaaaaatcaaagacga

SEQ ID NO: 73066 - DNA, 23 bp, Artificial sequence
  SiRNA target sequence
atattaaaaaaatcaaagacgaa

SEQ ID NO: 73067 - DNA, 23 bp, Artificial sequence
  SiRNA target sequence
tattaaaaaaatcaaagacgaat

SEQ ID NO: 73068 - DNA, 23 bp, Artificial sequence
  SiRNA target sequence
attaaaaaaatcaaagacgaatt

SEQ ID NO: 73069 - DNA, 23 bp, Artificial sequence
  SiRNA target sequence
ttaaaaaaatcaaagacgaattt

SEQ ID NO: 73070 - DNA, 23 bp, Artificial sequence
  SiRNA target sequence
taaaaaaatcaaagacgaatttt

SEQ ID NO: 73071 - DNA, 23 bp, Artificial sequence
  SiRNA target sequence
aaaaaaatcaaagacgaatttta

SEQ ID NO: 73072 - DNA, 23 bp, Artificial sequence
  SiRNA target sequence
aaaaaatcaaagacgaattttat

SEQ ID NO: 73073 - DNA, 23 bp, Artificial sequence
  SiRNA target sequence
aaaaatcaaagacgaattttata

SEQ ID NO: 73074 - DNA, 23 bp, Artificial sequence
  SiRNA target sequence
aaaatcaaagacgaattttatag

SEQ ID NO: 73075 - DNA, 23 bp, Artificial sequence
  SiRNA target sequence
aaatcaaagacgaattttatagg

SEQ ID NO: 73076 - DNA, 23 bp, Artificial sequence
  SiRNA target sequence
aatcaaagacgaattttatagga

SEQ ID NO: 73077 - DNA, 23 bp, Artificial sequence
  SiRNA target sequence
atcaaagacgaattttataggaa

SEQ ID NO: 73078 - DNA, 23 bp, Artificial sequence
  SiRNA target sequence
tcaaagacgaattttataggaat

SEQ ID NO: 73079 - DNA, 23 bp, Artificial sequence
  SiRNA target sequence
caaagacgaattttataggaatt

SEQ ID NO: 73080 - DNA, 23 bp, Artificial sequence
  SiRNA target sequence
aaagacgaattttataggaattt

SEQ ID NO: 73081 - DNA, 23 bp, Artificial sequence
  SiRNA target sequence
aagacgaattttataggaattta

SEQ ID NO: 73082 - DNA, 23 bp, Artificial sequence
  SiRNA target sequence
agacgaattttataggaatttat

SEQ ID NO: 73083 - DNA, 23 bp, Artificial sequence
  SiRNA target sequence
gacgaattttataggaatttatt

SEQ ID NO: 73084 - DNA, 23 bp, Artificial sequence
  SiRNA target sequence
acgaattttataggaatttatta

SEQ ID NO: 73085 - DNA, 23 bp, Artificial sequence
  SiRNA target sequence
cgaattttataggaatttattag

SEQ ID NO: 73086 - DNA, 23 bp, Artificial sequence
  SiRNA target sequence
gaattttataggaatttattagg

SEQ ID NO: 73087 - DNA, 23 bp, Artificial sequence
  SiRNA target sequence
aattttataggaatttattaggt

SEQ ID NO: 73088 - DNA, 23 bp, Artificial sequence
  SiRNA target sequence
attttataggaatttattaggtt

SEQ ID NO: 73089 - DNA, 23 bp, Artificial sequence
  SiRNA target sequence
ttttataggaatttattaggtta

SEQ ID NO: 73090 - DNA, 23 bp, Artificial sequence
  SiRNA target sequence
tttataggaatttattaggttac

SEQ ID NO: 73091 - DNA, 23 bp, Artificial sequence
  SiRNA target sequence
ttataggaatttattaggttaca

SEQ ID NO: 73092 - DNA, 23 bp, Artificial sequence
  SiRNA target sequence
tataggaatttattaggttacat

SEQ ID NO: 73093 - DNA, 23 bp, Artificial sequence
  SiRNA target sequence
ataggaatttattaggttacata

SEQ ID NO: 73094 - DNA, 23 bp, Artificial sequence
  SiRNA target sequence
taggaatttattaggttacatac

SEQ ID NO: 73095 - DNA, 23 bp, Artificial sequence
  SiRNA target sequence
aggaatttattaggttacatacc

SEQ ID NO: 73096 - DNA, 23 bp, Artificial sequence
  SiRNA target sequence
ggaatttattaggttacatacca

SEQ ID NO: 73097 - DNA, 23 bp, Artificial sequence
  SiRNA target sequence
gaatttattaggttacataccac

SEQ ID NO: 73098 - DNA, 23 bp, Artificial sequence
  SiRNA target sequence
aatttattaggttacataccaca

SEQ ID NO: 73099 - DNA, 23 bp, Artificial sequence
  SiRNA target sequence
atttattaggttacataccacag

SEQ ID NO: 73100 - DNA, 23 bp, Artificial sequence
  SiRNA target sequence
tttattaggttacataccacaga

SEQ ID NO: 73101 - DNA, 23 bp, Artificial sequence
  SiRNA target sequence
ttattaggttacataccacagaa

SEQ ID NO: 73102 - DNA, 23 bp, Artificial sequence
  SiRNA target sequence
tattaggttacataccacagaat

SEQ ID NO: 73103 - DNA, 23 bp, Artificial sequence
  SiRNA target sequence
attaggttacataccacagaata

SEQ ID NO: 73104 - DNA, 23 bp, Artificial sequence
  SiRNA target sequence
ttaggttacataccacagaatac

SEQ ID NO: 73105 - DNA, 23 bp, Artificial sequence
  SiRNA target sequence
taggttacataccacagaataca

SEQ ID NO: 73106 - DNA, 23 bp, Artificial sequence
  SiRNA target sequence
aggttacataccacagaatacat

SEQ ID NO: 73107 - DNA, 23 bp, Artificial sequence
  SiRNA target sequence
ggttacataccacagaatacatt

SEQ ID NO: 73108 - DNA, 23 bp, Artificial sequence
  SiRNA target sequence
gttacataccacagaatacattt

SEQ ID NO: 73109 - DNA, 23 bp, Artificial sequence
  SiRNA target sequence
ttacataccacagaatacatttt

SEQ ID NO: 73110 - DNA, 23 bp, Artificial sequence
  SiRNA target sequence
tacataccacagaatacattttt

SEQ ID NO: 73111 - DNA, 23 bp, Artificial sequence
  SiRNA target sequence
acataccacagaatacatttttg

SEQ ID NO: 73112 - DNA, 23 bp, Artificial sequence
  SiRNA target sequence
cataccacagaatacatttttgt

SEQ ID NO: 73113 - DNA, 23 bp, Artificial sequence
  SiRNA target sequence
ataccacagaatacatttttgtt

SEQ ID NO: 73114 - DNA, 23 bp, Artificial sequence
  SiRNA target sequence
taccacagaatacatttttgttt

SEQ ID NO: 73115 - DNA, 23 bp, Artificial sequence
  SiRNA target sequence
accacagaatacatttttgttta

SEQ ID NO: 73116 - DNA, 23 bp, Artificial sequence
  SiRNA target sequence
ccacagaatacatttttgtttaa

SEQ ID NO: 73117 - DNA, 23 bp, Artificial sequence
  SiRNA target sequence
cacagaatacatttttgtttaat

SEQ ID NO: 73118 - DNA, 23 bp, Artificial sequence
  SiRNA target sequence
acagaatacatttttgtttaatg

SEQ ID NO: 73119 - DNA, 23 bp, Artificial sequence
  SiRNA target sequence
cagaatacatttttgtttaatga

SEQ ID NO: 73120 - DNA, 23 bp, Artificial sequence
  SiRNA target sequence
agaatacatttttgtttaatgaa

SEQ ID NO: 73121 - DNA, 23 bp, Artificial sequence
  SiRNA target sequence
gaatacatttttgtttaatgaat

SEQ ID NO: 73122 - DNA, 23 bp, Artificial sequence
  SiRNA target sequence
aatacatttttgtttaatgaatc

SEQ ID NO: 73123 - DNA, 23 bp, Artificial sequence
  SiRNA target sequence
atacatttttgtttaatgaatct

SEQ ID NO: 73124 - DNA, 23 bp, Artificial sequence
  SiRNA target sequence
tacatttttgtttaatgaatctg

SEQ ID NO: 73125 - DNA, 23 bp, Artificial sequence
  SiRNA target sequence
acatttttgtttaatgaatctgt

SEQ ID NO: 73126 - DNA, 23 bp, Artificial sequence
  SiRNA target sequence
catttttgtttaatgaatctgta

SEQ ID NO: 73127 - DNA, 23 bp, Artificial sequence
  SiRNA target sequence
atttttgtttaatgaatctgtaa

SEQ ID NO: 73128 - DNA, 23 bp, Artificial sequence
  SiRNA target sequence
tttttgtttaatgaatctgtaaa

SEQ ID NO: 73129 - DNA, 23 bp, Artificial sequence
  SiRNA target sequence
ttttgtttaatgaatctgtaaaa

SEQ ID NO: 73130 - DNA, 23 bp, Artificial sequence
  SiRNA target sequence
tttgtttaatgaatctgtaaaat

SEQ ID NO: 73131 - DNA, 23 bp, Artificial sequence
  SiRNA target sequence
ttgtttaatgaatctgtaaaata

SEQ ID NO: 73132 - DNA, 23 bp, Artificial sequence
  SiRNA target sequence
tgtttaatgaatctgtaaaatat

SEQ ID NO: 73133 - DNA, 23 bp, Artificial sequence
  SiRNA target sequence
gtttaatgaatctgtaaaatata

SEQ ID NO: 73134 - DNA, 23 bp, Artificial sequence
  SiRNA target sequence
tttaatgaatctgtaaaatataa

SEQ ID NO: 73135 - DNA, 23 bp, Artificial sequence
  SiRNA target sequence
ttaatgaatctgtaaaatataat

SEQ ID NO: 73136 - DNA, 23 bp, Artificial sequence
  SiRNA target sequence
taatgaatctgtaaaatataata

SEQ ID NO: 73137 - DNA, 23 bp, Artificial sequence
  SiRNA target sequence
aatgaatctgtaaaatataatat

SEQ ID NO: 73138 - DNA, 23 bp, Artificial sequence
  SiRNA target sequence
atgaatctgtaaaatataatatt

SEQ ID NO: 73139 - DNA, 23 bp, Artificial sequence
  SiRNA target sequence
tgaatctgtaaaatataatatta

SEQ ID NO: 73140 - DNA, 23 bp, Artificial sequence
  SiRNA target sequence
gaatctgtaaaatataatattaa

SEQ ID NO: 73141 - DNA, 23 bp, Artificial sequence
  SiRNA target sequence
aatctgtaaaatataatattaaa

SEQ ID NO: 73142 - DNA, 23 bp, Artificial sequence
  SiRNA target sequence
atctgtaaaatataatattaaat

SEQ ID NO: 73143 - DNA, 23 bp, Artificial sequence
  SiRNA target sequence
tctgtaaaatataatattaaata

SEQ ID NO: 73144 - DNA, 23 bp, Artificial sequence
  SiRNA target sequence
ctgtaaaatataatattaaatac

SEQ ID NO: 73145 - DNA, 23 bp, Artificial sequence
  SiRNA target sequence
tgtaaaatataatattaaatacg

SEQ ID NO: 73146 - DNA, 23 bp, Artificial sequence
  SiRNA target sequence
gtaaaatataatattaaatacgg

SEQ ID NO: 73147 - DNA, 23 bp, Artificial sequence
  SiRNA target sequence
taaaatataatattaaatacgga

SEQ ID NO: 73148 - DNA, 23 bp, Artificial sequence
  SiRNA target sequence
aaaatataatattaaatacggat

SEQ ID NO: 73149 - DNA, 23 bp, Artificial sequence
  SiRNA target sequence
aaatataatattaaatacggatc

SEQ ID NO: 73150 - DNA, 23 bp, Artificial sequence
  SiRNA target sequence
aatataatattaaatacggatct

SEQ ID NO: 73151 - DNA, 23 bp, Artificial sequence
  SiRNA target sequence
atataatattaaatacggatctt

SEQ ID NO: 73152 - DNA, 23 bp, Artificial sequence
  SiRNA target sequence
tataatattaaatacggatcttt

SEQ ID NO: 73153 - DNA, 23 bp, Artificial sequence
  SiRNA target sequence
ataatattaaatacggatctttt

SEQ ID NO: 73154 - DNA, 23 bp, Artificial sequence
  SiRNA target sequence
taatattaaatacggatcttttg

SEQ ID NO: 73155 - DNA, 23 bp, Artificial sequence
  SiRNA target sequence
aatattaaatacggatcttttgg

SEQ ID NO: 73156 - DNA, 23 bp, Artificial sequence
  SiRNA target sequence
atattaaatacggatcttttggt

SEQ ID NO: 73157 - DNA, 23 bp, Artificial sequence
  SiRNA target sequence
tattaaatacggatcttttggta

SEQ ID NO: 73158 - DNA, 23 bp, Artificial sequence
  SiRNA target sequence
attaaatacggatcttttggtat

SEQ ID NO: 73159 - DNA, 23 bp, Artificial sequence
  SiRNA target sequence
ttaaatacggatcttttggtatt

SEQ ID NO: 73160 - DNA, 23 bp, Artificial sequence
  SiRNA target sequence
taaatacggatcttttggtattt

SEQ ID NO: 73161 - DNA, 23 bp, Artificial sequence
  SiRNA target sequence
aaatacggatcttttggtatttc

SEQ ID NO: 73162 - DNA, 23 bp, Artificial sequence
  SiRNA target sequence
aatacggatcttttggtatttca

SEQ ID NO: 73163 - DNA, 23 bp, Artificial sequence
  SiRNA target sequence
atacggatcttttggtatttcag

SEQ ID NO: 73164 - DNA, 23 bp, Artificial sequence
  SiRNA target sequence
tacggatcttttggtatttcaga

SEQ ID NO: 73165 - DNA, 23 bp, Artificial sequence
  SiRNA target sequence
acggatcttttggtatttcagac

SEQ ID NO: 73166 - DNA, 23 bp, Artificial sequence
  SiRNA target sequence
cggatcttttggtatttcagacg

SEQ ID NO: 73167 - DNA, 23 bp, Artificial sequence
  SiRNA target sequence
ggatcttttggtatttcagacga

SEQ ID NO: 73168 - DNA, 23 bp, Artificial sequence
  SiRNA target sequence
gatcttttggtatttcagacgag

SEQ ID NO: 73169 - DNA, 23 bp, Artificial sequence
  SiRNA target sequence
atcttttggtatttcagacgagg

SEQ ID NO: 73170 - DNA, 23 bp, Artificial sequence
  SiRNA target sequence
tcttttggtatttcagacgagga

SEQ ID NO: 73171 - DNA, 23 bp, Artificial sequence
  SiRNA target sequence
cttttggtatttcagacgaggat

SEQ ID NO: 73172 - DNA, 23 bp, Artificial sequence
  SiRNA target sequence
ttttggtatttcagacgaggata

SEQ ID NO: 73173 - DNA, 23 bp, Artificial sequence
  SiRNA target sequence
tttggtatttcagacgaggatat

SEQ ID NO: 73174 - DNA, 23 bp, Artificial sequence
  SiRNA target sequence
ttggtatttcagacgaggatatt

SEQ ID NO: 73175 - DNA, 23 bp, Artificial sequence
  SiRNA target sequence
tggtatttcagacgaggatattt

SEQ ID NO: 73176 - DNA, 23 bp, Artificial sequence
  SiRNA target sequence
ggtatttcagacgaggatatttt

SEQ ID NO: 73177 - DNA, 23 bp, Artificial sequence
  SiRNA target sequence
gtatttcagacgaggatattttt

SEQ ID NO: 73178 - DNA, 23 bp, Artificial sequence
  SiRNA target sequence
tatttcagacgaggatatttttg

SEQ ID NO: 73179 - DNA, 23 bp, Artificial sequence
  SiRNA target sequence
atttcagacgaggatatttttgc

SEQ ID NO: 73180 - DNA, 23 bp, Artificial sequence
  SiRNA target sequence
tttcagacgaggatatttttgca

SEQ ID NO: 73181 - DNA, 23 bp, Artificial sequence
  SiRNA target sequence
ttcagacgaggatatttttgcat

SEQ ID NO: 73182 - DNA, 23 bp, Artificial sequence
  SiRNA target sequence
tcagacgaggatatttttgcatt

SEQ ID NO: 73183 - DNA, 23 bp, Artificial sequence
  SiRNA target sequence
cagacgaggatatttttgcattg

SEQ ID NO: 73184 - DNA, 23 bp, Artificial sequence
  SiRNA target sequence
agacgaggatatttttgcattgt

SEQ ID NO: 73185 - DNA, 23 bp, Artificial sequence
  SiRNA target sequence
gacgaggatatttttgcattgtg

SEQ ID NO: 73186 - DNA, 23 bp, Artificial sequence
  SiRNA target sequence
acgaggatatttttgcattgtgt

SEQ ID NO: 73187 - DNA, 23 bp, Artificial sequence
  SiRNA target sequence
cgaggatatttttgcattgtgta

SEQ ID NO: 73188 - DNA, 23 bp, Artificial sequence
  SiRNA target sequence
gaggatatttttgcattgtgtaa

SEQ ID NO: 73189 - DNA, 23 bp, Artificial sequence
  SiRNA target sequence
aggatatttttgcattgtgtaaa

SEQ ID NO: 73190 - DNA, 23 bp, Artificial sequence
  SiRNA target sequence
ggatatttttgcattgtgtaaag

SEQ ID NO: 73191 - DNA, 23 bp, Artificial sequence
  SiRNA target sequence
gatatttttgcattgtgtaaaga

SEQ ID NO: 73192 - DNA, 23 bp, Artificial sequence
  SiRNA target sequence
atatttttgcattgtgtaaagag

SEQ ID NO: 73193 - DNA, 23 bp, Artificial sequence
  SiRNA target sequence
tatttttgcattgtgtaaagagt

SEQ ID NO: 73194 - DNA, 23 bp, Artificial sequence
  SiRNA target sequence
atttttgcattgtgtaaagagtt

SEQ ID NO: 73195 - DNA, 23 bp, Artificial sequence
  SiRNA target sequence
tttttgcattgtgtaaagagttt

SEQ ID NO: 73196 - DNA, 23 bp, Artificial sequence
  SiRNA target sequence
ttttgcattgtgtaaagagtttg

SEQ ID NO: 73197 - DNA, 23 bp, Artificial sequence
  SiRNA target sequence
tttgcattgtgtaaagagtttgg

SEQ ID NO: 73198 - DNA, 23 bp, Artificial sequence
  SiRNA target sequence
ttgcattgtgtaaagagtttgga

SEQ ID NO: 73199 - DNA, 23 bp, Artificial sequence
  SiRNA target sequence
tgcattgtgtaaagagtttggat

SEQ ID NO: 73200 - DNA, 23 bp, Artificial sequence
  SiRNA target sequence
gcattgtgtaaagagtttggatt

SEQ ID NO: 73201 - DNA, 23 bp, Artificial sequence
  SiRNA target sequence
cattgtgtaaagagtttggatta

SEQ ID NO: 73202 - DNA, 23 bp, Artificial sequence
  SiRNA target sequence
attgtgtaaagagtttggattat

SEQ ID NO: 73203 - DNA, 23 bp, Artificial sequence
  SiRNA target sequence
ttgtgtaaagagtttggattata

SEQ ID NO: 73204 - DNA, 23 bp, Artificial sequence
  SiRNA target sequence
tgtgtaaagagtttggattatat

SEQ ID NO: 73205 - DNA, 23 bp, Artificial sequence
  SiRNA target sequence
gtgtaaagagtttggattatatg

SEQ ID NO: 73206 - DNA, 23 bp, Artificial sequence
  SiRNA target sequence
tgtaaagagtttggattatatga

SEQ ID NO: 73207 - DNA, 23 bp, Artificial sequence
  SiRNA target sequence
gtaaagagtttggattatatgac

SEQ ID NO: 73208 - DNA, 23 bp, Artificial sequence
  SiRNA target sequence
taaagagtttggattatatgacg

SEQ ID NO: 73209 - DNA, 23 bp, Artificial sequence
  SiRNA target sequence
aaagagtttggattatatgacgt

SEQ ID NO: 73210 - DNA, 23 bp, Artificial sequence
  SiRNA target sequence
aagagtttggattatatgacgtt

SEQ ID NO: 73211 - DNA, 23 bp, Artificial sequence
  SiRNA target sequence
agagtttggattatatgacgttt

SEQ ID NO: 73212 - DNA, 23 bp, Artificial sequence
  SiRNA target sequence
gagtttggattatatgacgtttt

SEQ ID NO: 73213 - DNA, 23 bp, Artificial sequence
  SiRNA target sequence
agtttggattatatgacgttttc

SEQ ID NO: 73214 - DNA, 23 bp, Artificial sequence
  SiRNA target sequence
gtttggattatatgacgttttca

SEQ ID NO: 73215 - DNA, 23 bp, Artificial sequence
  SiRNA target sequence
tttggattatatgacgttttcat

SEQ ID NO: 73216 - DNA, 23 bp, Artificial sequence
  SiRNA target sequence
ttggattatatgacgttttcatg

SEQ ID NO: 73217 - DNA, 23 bp, Artificial sequence
  SiRNA target sequence
tggattatatgacgttttcatga

SEQ ID NO: 73218 - DNA, 23 bp, Artificial sequence
  SiRNA target sequence
ggattatatgacgttttcatgaa

SEQ ID NO: 73219 - DNA, 23 bp, Artificial sequence
  SiRNA target sequence
gattatatgacgttttcatgaac

SEQ ID NO: 73220 - DNA, 23 bp, Artificial sequence
  SiRNA target sequence
attatatgacgttttcatgaacc

SEQ ID NO: 73221 - DNA, 23 bp, Artificial sequence
  SiRNA target sequence
ttatatgacgttttcatgaacct

SEQ ID NO: 73222 - DNA, 23 bp, Artificial sequence
  SiRNA target sequence
tatatgacgttttcatgaacctc

SEQ ID NO: 73223 - DNA, 23 bp, Artificial sequence
  SiRNA target sequence
atatgacgttttcatgaacctcg

SEQ ID NO: 73224 - DNA, 23 bp, Artificial sequence
  SiRNA target sequence
tatgacgttttcatgaacctcga

SEQ ID NO: 73225 - DNA, 23 bp, Artificial sequence
  SiRNA target sequence
atgacgttttcatgaacctcgaa

SEQ ID NO: 73226 - DNA, 23 bp, Artificial sequence
  SiRNA target sequence
tgacgttttcatgaacctcgaaa

SEQ ID NO: 73227 - DNA, 23 bp, Artificial sequence
  SiRNA target sequence
gacgttttcatgaacctcgaaaa

SEQ ID NO: 73228 - DNA, 23 bp, Artificial sequence
  SiRNA target sequence
acgttttcatgaacctcgaaaat

SEQ ID NO: 73229 - DNA, 23 bp, Artificial sequence
  SiRNA target sequence
cgttttcatgaacctcgaaaatg

SEQ ID NO: 73230 - DNA, 23 bp, Artificial sequence
  SiRNA target sequence
gttttcatgaacctcgaaaatgg

SEQ ID NO: 73231 - DNA, 23 bp, Artificial sequence
  SiRNA target sequence
ttttcatgaacctcgaaaatggt

SEQ ID NO: 73232 - DNA, 23 bp, Artificial sequence
  SiRNA target sequence
tttcatgaacctcgaaaatggtt

SEQ ID NO: 73233 - DNA, 23 bp, Artificial sequence
  SiRNA target sequence
ttcatgaacctcgaaaatggttt

SEQ ID NO: 73234 - DNA, 23 bp, Artificial sequence
  SiRNA target sequence
tcatgaacctcgaaaatggtttt

SEQ ID NO: 73235 - DNA, 23 bp, Artificial sequence
  SiRNA target sequence
catgaacctcgaaaatggttttg

SEQ ID NO: 73236 - DNA, 23 bp, Artificial sequence
  SiRNA target sequence
atgaacctcgaaaatggttttga

SEQ ID NO: 73237 - DNA, 23 bp, Artificial sequence
  SiRNA target sequence
tgaacctcgaaaatggttttgat

SEQ ID NO: 73238 - DNA, 23 bp, Artificial sequence
  SiRNA target sequence
gaacctcgaaaatggttttgata

SEQ ID NO: 73239 - DNA, 23 bp, Artificial sequence
  SiRNA target sequence
aacctcgaaaatggttttgatac

SEQ ID NO: 73240 - DNA, 23 bp, Artificial sequence
  SiRNA target sequence
acctcgaaaatggttttgatacg

SEQ ID NO: 73241 - DNA, 23 bp, Artificial sequence
  SiRNA target sequence
cctcgaaaatggttttgatacga

SEQ ID NO: 73242 - DNA, 23 bp, Artificial sequence
  SiRNA target sequence
ctcgaaaatggttttgatacgaa

SEQ ID NO: 73243 - DNA, 23 bp, Artificial sequence
  SiRNA target sequence
tcgaaaatggttttgatacgaat

SEQ ID NO: 73244 - DNA, 23 bp, Artificial sequence
  SiRNA target sequence
cgaaaatggttttgatacgaatg

SEQ ID NO: 73245 - DNA, 23 bp, Artificial sequence
  SiRNA target sequence
gaaaatggttttgatacgaatgt

SEQ ID NO: 73246 - DNA, 23 bp, Artificial sequence
  SiRNA target sequence
aaaatggttttgatacgaatgta

SEQ ID NO: 73247 - DNA, 23 bp, Artificial sequence
  SiRNA target sequence
aaatggttttgatacgaatgtag

SEQ ID NO: 73248 - DNA, 23 bp, Artificial sequence
  SiRNA target sequence
aatggttttgatacgaatgtagg

SEQ ID NO: 73249 - DNA, 23 bp, Artificial sequence
  SiRNA target sequence
atggttttgatacgaatgtagga

SEQ ID NO: 73250 - DNA, 23 bp, Artificial sequence
  SiRNA target sequence
tggttttgatacgaatgtaggag

SEQ ID NO: 73251 - DNA, 23 bp, Artificial sequence
  SiRNA target sequence
ggttttgatacgaatgtaggaga

SEQ ID NO: 73252 - DNA, 23 bp, Artificial sequence
  SiRNA target sequence
gttttgatacgaatgtaggagaa

SEQ ID NO: 73253 - DNA, 23 bp, Artificial sequence
  SiRNA target sequence
ttttgatacgaatgtaggagaaa

SEQ ID NO: 73254 - DNA, 23 bp, Artificial sequence
  SiRNA target sequence
tttgatacgaatgtaggagaaag

SEQ ID NO: 73255 - DNA, 23 bp, Artificial sequence
  SiRNA target sequence
ttgatacgaatgtaggagaaaga

SEQ ID NO: 73256 - DNA, 23 bp, Artificial sequence
  SiRNA target sequence
tgatacgaatgtaggagaaagag

SEQ ID NO: 73257 - DNA, 23 bp, Artificial sequence
  SiRNA target sequence
gatacgaatgtaggagaaagagg

SEQ ID NO: 73258 - DNA, 23 bp, Artificial sequence
  SiRNA target sequence
atacgaatgtaggagaaagagga

SEQ ID NO: 73259 - DNA, 23 bp, Artificial sequence
  SiRNA target sequence
tacgaatgtaggagaaagaggaa

SEQ ID NO: 73260 - DNA, 23 bp, Artificial sequence
  SiRNA target sequence
acgaatgtaggagaaagaggaag

SEQ ID NO: 73261 - DNA, 23 bp, Artificial sequence
  SiRNA target sequence
cgaatgtaggagaaagaggaagg

SEQ ID NO: 73262 - DNA, 23 bp, Artificial sequence
  SiRNA target sequence
gaatgtaggagaaagaggaaggt

SEQ ID NO: 73263 - DNA, 23 bp, Artificial sequence
  SiRNA target sequence
aatgtaggagaaagaggaaggtt

SEQ ID NO: 73264 - DNA, 23 bp, Artificial sequence
  SiRNA target sequence
atgtaggagaaagaggaaggtta

SEQ ID NO: 73265 - DNA, 23 bp, Artificial sequence
  SiRNA target sequence
tgtaggagaaagaggaaggttat

SEQ ID NO: 73266 - DNA, 23 bp, Artificial sequence
  SiRNA target sequence
gtaggagaaagaggaaggttatt

SEQ ID NO: 73267 - DNA, 23 bp, Artificial sequence
  SiRNA target sequence
taggagaaagaggaaggttatta

SEQ ID NO: 73268 - DNA, 23 bp, Artificial sequence
  SiRNA target sequence
aggagaaagaggaaggttattaa

SEQ ID NO: 73269 - DNA, 23 bp, Artificial sequence
  SiRNA target sequence
ggagaaagaggaaggttattaag

SEQ ID NO: 73270 - DNA, 23 bp, Artificial sequence
  SiRNA target sequence
gagaaagaggaaggttattaagt

SEQ ID NO: 73271 - DNA, 23 bp, Artificial sequence
  SiRNA target sequence
agaaagaggaaggttattaagtg

SEQ ID NO: 73272 - DNA, 23 bp, Artificial sequence
  SiRNA target sequence
gaaagaggaaggttattaagtgg

SEQ ID NO: 73273 - DNA, 23 bp, Artificial sequence
  SiRNA target sequence
aaagaggaaggttattaagtggt

SEQ ID NO: 73274 - DNA, 23 bp, Artificial sequence
  SiRNA target sequence
aagaggaaggttattaagtggtg

SEQ ID NO: 73275 - DNA, 23 bp, Artificial sequence
  SiRNA target sequence
agaggaaggttattaagtggtgg

SEQ ID NO: 73276 - DNA, 23 bp, Artificial sequence
  SiRNA target sequence
gaggaaggttattaagtggtgga

SEQ ID NO: 73277 - DNA, 23 bp, Artificial sequence
  SiRNA target sequence
aggaaggttattaagtggtggag

SEQ ID NO: 73278 - DNA, 23 bp, Artificial sequence
  SiRNA target sequence
ggaaggttattaagtggtggaga

SEQ ID NO: 73279 - DNA, 23 bp, Artificial sequence
  SiRNA target sequence
gaaggttattaagtggtggagaa

SEQ ID NO: 73280 - DNA, 23 bp, Artificial sequence
  SiRNA target sequence
aaggttattaagtggtggagaaa

SEQ ID NO: 73281 - DNA, 23 bp, Artificial sequence
  SiRNA target sequence
aggttattaagtggtggagaaaa

SEQ ID NO: 73282 - DNA, 23 bp, Artificial sequence
  SiRNA target sequence
ggttattaagtggtggagaaaag

SEQ ID NO: 73283 - DNA, 23 bp, Artificial sequence
  SiRNA target sequence
gttattaagtggtggagaaaagc

SEQ ID NO: 73284 - DNA, 23 bp, Artificial sequence
  SiRNA target sequence
ttattaagtggtggagaaaagca

SEQ ID NO: 73285 - DNA, 23 bp, Artificial sequence
  SiRNA target sequence
tattaagtggtggagaaaagcaa

SEQ ID NO: 73286 - DNA, 23 bp, Artificial sequence
  SiRNA target sequence
attaagtggtggagaaaagcaaa

SEQ ID NO: 73287 - DNA, 23 bp, Artificial sequence
  SiRNA target sequence
ttaagtggtggagaaaagcaaaa

SEQ ID NO: 73288 - DNA, 23 bp, Artificial sequence
  SiRNA target sequence
taagtggtggagaaaagcaaaag

SEQ ID NO: 73289 - DNA, 23 bp, Artificial sequence
  SiRNA target sequence
aagtggtggagaaaagcaaaaga

SEQ ID NO: 73290 - DNA, 23 bp, Artificial sequence
  SiRNA target sequence
agtggtggagaaaagcaaaagat

SEQ ID NO: 73291 - DNA, 23 bp, Artificial sequence
  SiRNA target sequence
gtggtggagaaaagcaaaagatt

SEQ ID NO: 73292 - DNA, 23 bp, Artificial sequence
  SiRNA target sequence
tggtggagaaaagcaaaagattt

SEQ ID NO: 73293 - DNA, 23 bp, Artificial sequence
  SiRNA target sequence
ggtggagaaaagcaaaagatttt

SEQ ID NO: 73294 - DNA, 23 bp, Artificial sequence
  SiRNA target sequence
gtggagaaaagcaaaagatttta

SEQ ID NO: 73295 - DNA, 23 bp, Artificial sequence
  SiRNA target sequence
tggagaaaagcaaaagattttat

SEQ ID NO: 73296 - DNA, 23 bp, Artificial sequence
  SiRNA target sequence
ggagaaaagcaaaagattttatt

SEQ ID NO: 73297 - DNA, 23 bp, Artificial sequence
  SiRNA target sequence
gagaaaagcaaaagattttatta

SEQ ID NO: 73298 - DNA, 23 bp, Artificial sequence
  SiRNA target sequence
agaaaagcaaaagattttattaa

SEQ ID NO: 73299 - DNA, 23 bp, Artificial sequence
  SiRNA target sequence
gaaaagcaaaagattttattaat

SEQ ID NO: 73300 - DNA, 23 bp, Artificial sequence
  SiRNA target sequence
aaaagcaaaagattttattaatg

SEQ ID NO: 73301 - DNA, 23 bp, Artificial sequence
  SiRNA target sequence
aaagcaaaagattttattaatgc

SEQ ID NO: 73302 - DNA, 23 bp, Artificial sequence
  SiRNA target sequence
aagcaaaagattttattaatgcg

SEQ ID NO: 73303 - DNA, 23 bp, Artificial sequence
  SiRNA target sequence
agcaaaagattttattaatgcgt

SEQ ID NO: 73304 - DNA, 23 bp, Artificial sequence
  SiRNA target sequence
gcaaaagattttattaatgcgta

SEQ ID NO: 73305 - DNA, 23 bp, Artificial sequence
  SiRNA target sequence
caaaagattttattaatgcgtac

SEQ ID NO: 73306 - DNA, 23 bp, Artificial sequence
  SiRNA target sequence
aaaagattttattaatgcgtact

SEQ ID NO: 73307 - DNA, 23 bp, Artificial sequence
  SiRNA target sequence
aaagattttattaatgcgtacta

SEQ ID NO: 73308 - DNA, 23 bp, Artificial sequence
  SiRNA target sequence
aagattttattaatgcgtactat

SEQ ID NO: 73309 - DNA, 23 bp, Artificial sequence
  SiRNA target sequence
agattttattaatgcgtactatg

SEQ ID NO: 73310 - DNA, 23 bp, Artificial sequence
  SiRNA target sequence
gattttattaatgcgtactatgt

SEQ ID NO: 73311 - DNA, 23 bp, Artificial sequence
  SiRNA target sequence
attttattaatgcgtactatgtt

SEQ ID NO: 73312 - DNA, 23 bp, Artificial sequence
  SiRNA target sequence
ttttattaatgcgtactatgtta

SEQ ID NO: 73313 - DNA, 23 bp, Artificial sequence
  SiRNA target sequence
tttattaatgcgtactatgttaa

SEQ ID NO: 73314 - DNA, 23 bp, Artificial sequence
  SiRNA target sequence
ttattaatgcgtactatgttaag

SEQ ID NO: 73315 - DNA, 23 bp, Artificial sequence
  SiRNA target sequence
tattaatgcgtactatgttaaga

SEQ ID NO: 73316 - DNA, 23 bp, Artificial sequence
  SiRNA target sequence
attaatgcgtactatgttaagaa

SEQ ID NO: 73317 - DNA, 23 bp, Artificial sequence
  SiRNA target sequence
ttaatgcgtactatgttaagaaa

SEQ ID NO: 73318 - DNA, 23 bp, Artificial sequence
  SiRNA target sequence
taatgcgtactatgttaagaaac

SEQ ID NO: 73319 - DNA, 23 bp, Artificial sequence
  SiRNA target sequence
aatgcgtactatgttaagaaaca

SEQ ID NO: 73320 - DNA, 23 bp, Artificial sequence
  SiRNA target sequence
atgcgtactatgttaagaaacaa

SEQ ID NO: 73321 - DNA, 23 bp, Artificial sequence
  SiRNA target sequence
tgcgtactatgttaagaaacaag

SEQ ID NO: 73322 - DNA, 23 bp, Artificial sequence
  SiRNA target sequence
gcgtactatgttaagaaacaagg

SEQ ID NO: 73323 - DNA, 23 bp, Artificial sequence
  SiRNA target sequence
cgtactatgttaagaaacaagga

SEQ ID NO: 73324 - DNA, 23 bp, Artificial sequence
  SiRNA target sequence
gtactatgttaagaaacaaggag

SEQ ID NO: 73325 - DNA, 23 bp, Artificial sequence
  SiRNA target sequence
tactatgttaagaaacaaggaga

SEQ ID NO: 73326 - DNA, 23 bp, Artificial sequence
  SiRNA target sequence
actatgttaagaaacaaggagat

SEQ ID NO: 73327 - DNA, 23 bp, Artificial sequence
  SiRNA target sequence
ctatgttaagaaacaaggagata

SEQ ID NO: 73328 - DNA, 23 bp, Artificial sequence
  SiRNA target sequence
tatgttaagaaacaaggagataa

SEQ ID NO: 73329 - DNA, 23 bp, Artificial sequence
  SiRNA target sequence
atgttaagaaacaaggagataat

SEQ ID NO: 73330 - DNA, 23 bp, Artificial sequence
  SiRNA target sequence
tgttaagaaacaaggagataatg

SEQ ID NO: 73331 - DNA, 23 bp, Artificial sequence
  SiRNA target sequence
gttaagaaacaaggagataatgg

SEQ ID NO: 73332 - DNA, 23 bp, Artificial sequence
  SiRNA target sequence
ttaagaaacaaggagataatggc

SEQ ID NO: 73333 - DNA, 23 bp, Artificial sequence
  SiRNA target sequence
taagaaacaaggagataatggca

SEQ ID NO: 73334 - DNA, 23 bp, Artificial sequence
  SiRNA target sequence
aagaaacaaggagataatggcat

SEQ ID NO: 73335 - DNA, 23 bp, Artificial sequence
  SiRNA target sequence
agaaacaaggagataatggcatt

SEQ ID NO: 73336 - DNA, 23 bp, Artificial sequence
  SiRNA target sequence
gaaacaaggagataatggcatta

SEQ ID NO: 73337 - DNA, 23 bp, Artificial sequence
  SiRNA target sequence
aaacaaggagataatggcattag

SEQ ID NO: 73338 - DNA, 23 bp, Artificial sequence
  SiRNA target sequence
aacaaggagataatggcattaga

SEQ ID NO: 73339 - DNA, 23 bp, Artificial sequence
  SiRNA target sequence
acaaggagataatggcattagat

SEQ ID NO: 73340 - DNA, 23 bp, Artificial sequence
  SiRNA target sequence
caaggagataatggcattagatg

SEQ ID NO: 73341 - DNA, 23 bp, Artificial sequence
  SiRNA target sequence
aaggagataatggcattagatga

SEQ ID NO: 73342 - DNA, 23 bp, Artificial sequence
  SiRNA target sequence
aggagataatggcattagatgaa

SEQ ID NO: 73343 - DNA, 23 bp, Artificial sequence
  SiRNA target sequence
ggagataatggcattagatgaac

SEQ ID NO: 73344 - DNA, 23 bp, Artificial sequence
  SiRNA target sequence
gagataatggcattagatgaacc

SEQ ID NO: 73345 - DNA, 23 bp, Artificial sequence
  SiRNA target sequence
agataatggcattagatgaaccc

SEQ ID NO: 73346 - DNA, 23 bp, Artificial sequence
  SiRNA target sequence
gataatggcattagatgaaccca

SEQ ID NO: 73347 - DNA, 23 bp, Artificial sequence
  SiRNA target sequence
ataatggcattagatgaacccac

SEQ ID NO: 73348 - DNA, 23 bp, Artificial sequence
  SiRNA target sequence
taatggcattagatgaacccact

SEQ ID NO: 73349 - DNA, 23 bp, Artificial sequence
  SiRNA target sequence
aatggcattagatgaacccactg

SEQ ID NO: 73350 - DNA, 23 bp, Artificial sequence
  SiRNA target sequence
atggcattagatgaacccactgc

SEQ ID NO: 73351 - DNA, 23 bp, Artificial sequence
  SiRNA target sequence
tggcattagatgaacccactgca

SEQ ID NO: 73352 - DNA, 23 bp, Artificial sequence
  SiRNA target sequence
ggcattagatgaacccactgcag

SEQ ID NO: 73353 - DNA, 23 bp, Artificial sequence
  SiRNA target sequence
gcattagatgaacccactgcagc

SEQ ID NO: 73354 - DNA, 23 bp, Artificial sequence
  SiRNA target sequence
cattagatgaacccactgcagca

SEQ ID NO: 73355 - DNA, 23 bp, Artificial sequence
  SiRNA target sequence
attagatgaacccactgcagcac

SEQ ID NO: 73356 - DNA, 23 bp, Artificial sequence
  SiRNA target sequence
ttagatgaacccactgcagcact

SEQ ID NO: 73357 - DNA, 23 bp, Artificial sequence
  SiRNA target sequence
tagatgaacccactgcagcactt

SEQ ID NO: 73358 - DNA, 23 bp, Artificial sequence
  SiRNA target sequence
agatgaacccactgcagcacttg

SEQ ID NO: 73359 - DNA, 23 bp, Artificial sequence
  SiRNA target sequence
gatgaacccactgcagcacttga

SEQ ID NO: 73360 - DNA, 23 bp, Artificial sequence
  SiRNA target sequence
atgaacccactgcagcacttgat

SEQ ID NO: 73361 - DNA, 23 bp, Artificial sequence
  SiRNA target sequence
tgaacccactgcagcacttgata

SEQ ID NO: 73362 - DNA, 23 bp, Artificial sequence
  SiRNA target sequence
gaacccactgcagcacttgataa

SEQ ID NO: 73363 - DNA, 23 bp, Artificial sequence
  SiRNA target sequence
aacccactgcagcacttgataag

SEQ ID NO: 73364 - DNA, 23 bp, Artificial sequence
  SiRNA target sequence
acccactgcagcacttgataagg

SEQ ID NO: 73365 - DNA, 23 bp, Artificial sequence
  SiRNA target sequence
cccactgcagcacttgataagga

SEQ ID NO: 73366 - DNA, 23 bp, Artificial sequence
  SiRNA target sequence
ccactgcagcacttgataaggag

SEQ ID NO: 73367 - DNA, 23 bp, Artificial sequence
  SiRNA target sequence
cactgcagcacttgataaggagt

SEQ ID NO: 73368 - DNA, 23 bp, Artificial sequence
  SiRNA target sequence
actgcagcacttgataaggagtc

SEQ ID NO: 73369 - DNA, 23 bp, Artificial sequence
  SiRNA target sequence
ctgcagcacttgataaggagtct

SEQ ID NO: 73370 - DNA, 23 bp, Artificial sequence
  SiRNA target sequence
tgcagcacttgataaggagtctg

SEQ ID NO: 73371 - DNA, 23 bp, Artificial sequence
  SiRNA target sequence
gcagcacttgataaggagtctga

SEQ ID NO: 73372 - DNA, 23 bp, Artificial sequence
  SiRNA target sequence
cagcacttgataaggagtctgaa

SEQ ID NO: 73373 - DNA, 23 bp, Artificial sequence
  SiRNA target sequence
agcacttgataaggagtctgaaa

SEQ ID NO: 73374 - DNA, 23 bp, Artificial sequence
  SiRNA target sequence
gcacttgataaggagtctgaaaa

SEQ ID NO: 73375 - DNA, 23 bp, Artificial sequence
  SiRNA target sequence
cacttgataaggagtctgaaaaa

SEQ ID NO: 73376 - DNA, 23 bp, Artificial sequence
  SiRNA target sequence
acttgataaggagtctgaaaaaa

SEQ ID NO: 73377 - DNA, 23 bp, Artificial sequence
  SiRNA target sequence
cttgataaggagtctgaaaaaaa

SEQ ID NO: 73378 - DNA, 23 bp, Artificial sequence
  SiRNA target sequence
ttgataaggagtctgaaaaaaag

SEQ ID NO: 73379 - DNA, 23 bp, Artificial sequence
  SiRNA target sequence
tgataaggagtctgaaaaaaaga

SEQ ID NO: 73380 - DNA, 23 bp, Artificial sequence
  SiRNA target sequence
gataaggagtctgaaaaaaagat

SEQ ID NO: 73381 - DNA, 23 bp, Artificial sequence
  SiRNA target sequence
ataaggagtctgaaaaaaagatt

SEQ ID NO: 73382 - DNA, 23 bp, Artificial sequence
  SiRNA target sequence
taaggagtctgaaaaaaagattt

SEQ ID NO: 73383 - DNA, 23 bp, Artificial sequence
  SiRNA target sequence
aaggagtctgaaaaaaagatttt

SEQ ID NO: 73384 - DNA, 23 bp, Artificial sequence
  SiRNA target sequence
aggagtctgaaaaaaagatttta

SEQ ID NO: 73385 - DNA, 23 bp, Artificial sequence
  SiRNA target sequence
ggagtctgaaaaaaagattttag

SEQ ID NO: 73386 - DNA, 23 bp, Artificial sequence
  SiRNA target sequence
gagtctgaaaaaaagattttaga

SEQ ID NO: 73387 - DNA, 23 bp, Artificial sequence
  SiRNA target sequence
agtctgaaaaaaagattttagag

SEQ ID NO: 73388 - DNA, 23 bp, Artificial sequence
  SiRNA target sequence
gtctgaaaaaaagattttagaga

SEQ ID NO: 73389 - DNA, 23 bp, Artificial sequence
  SiRNA target sequence
tctgaaaaaaagattttagagat

SEQ ID NO: 73390 - DNA, 23 bp, Artificial sequence
  SiRNA target sequence
ctgaaaaaaagattttagagata

SEQ ID NO: 73391 - DNA, 23 bp, Artificial sequence
  SiRNA target sequence
tgaaaaaaagattttagagataa

SEQ ID NO: 73392 - DNA, 23 bp, Artificial sequence
  SiRNA target sequence
gaaaaaaagattttagagataat

SEQ ID NO: 73393 - DNA, 23 bp, Artificial sequence
  SiRNA target sequence
aaaaaaagattttagagataatt

SEQ ID NO: 73394 - DNA, 23 bp, Artificial sequence
  SiRNA target sequence
aaaaaagattttagagataattt

SEQ ID NO: 73395 - DNA, 23 bp, Artificial sequence
  SiRNA target sequence
aaaaagattttagagataatttt

SEQ ID NO: 73396 - DNA, 23 bp, Artificial sequence
  SiRNA target sequence
aaaagattttagagataatttta

SEQ ID NO: 73397 - DNA, 23 bp, Artificial sequence
  SiRNA target sequence
aaagattttagagataattttac

SEQ ID NO: 73398 - DNA, 23 bp, Artificial sequence
  SiRNA target sequence
aagattttagagataattttaca

SEQ ID NO: 73399 - DNA, 23 bp, Artificial sequence
  SiRNA target sequence
agattttagagataattttacaa

SEQ ID NO: 73400 - DNA, 23 bp, Artificial sequence
  SiRNA target sequence
gattttagagataattttacaac

SEQ ID NO: 73401 - DNA, 23 bp, Artificial sequence
  SiRNA target sequence
attttagagataattttacaaca

SEQ ID NO: 73402 - DNA, 23 bp, Artificial sequence
  SiRNA target sequence
ttttagagataattttacaacag

SEQ ID NO: 73403 - DNA, 23 bp, Artificial sequence
  SiRNA target sequence
tttagagataattttacaacagg

SEQ ID NO: 73404 - DNA, 23 bp, Artificial sequence
  SiRNA target sequence
ttagagataattttacaacagga

SEQ ID NO: 73405 - DNA, 23 bp, Artificial sequence
  SiRNA target sequence
tagagataattttacaacaggaa

SEQ ID NO: 73406 - DNA, 23 bp, Artificial sequence
  SiRNA target sequence
agagataattttacaacaggaag

SEQ ID NO: 73407 - DNA, 23 bp, Artificial sequence
  SiRNA target sequence
gagataattttacaacaggaaga

SEQ ID NO: 73408 - DNA, 23 bp, Artificial sequence
  SiRNA target sequence
agataattttacaacaggaagat

SEQ ID NO: 73409 - DNA, 23 bp, Artificial sequence
  SiRNA target sequence
gataattttacaacaggaagatc

SEQ ID NO: 73410 - DNA, 23 bp, Artificial sequence
  SiRNA target sequence
ataattttacaacaggaagatcg

SEQ ID NO: 73411 - DNA, 23 bp, Artificial sequence
  SiRNA target sequence
taattttacaacaggaagatcga

SEQ ID NO: 73412 - DNA, 23 bp, Artificial sequence
  SiRNA target sequence
aattttacaacaggaagatcgaa

SEQ ID NO: 73413 - DNA, 23 bp, Artificial sequence
  SiRNA target sequence
attttacaacaggaagatcgaac

SEQ ID NO: 73414 - DNA, 23 bp, Artificial sequence
  SiRNA target sequence
ttttacaacaggaagatcgaaca

SEQ ID NO: 73415 - DNA, 23 bp, Artificial sequence
  SiRNA target sequence
tttacaacaggaagatcgaacag

SEQ ID NO: 73416 - DNA, 23 bp, Artificial sequence
  SiRNA target sequence
ttacaacaggaagatcgaacagt

SEQ ID NO: 73417 - DNA, 23 bp, Artificial sequence
  SiRNA target sequence
tacaacaggaagatcgaacagtt

SEQ ID NO: 73418 - DNA, 23 bp, Artificial sequence
  SiRNA target sequence
acaacaggaagatcgaacagttt

SEQ ID NO: 73419 - DNA, 23 bp, Artificial sequence
  SiRNA target sequence
caacaggaagatcgaacagtttt

SEQ ID NO: 73420 - DNA, 23 bp, Artificial sequence
  SiRNA target sequence
aacaggaagatcgaacagttttg

SEQ ID NO: 73421 - DNA, 23 bp, Artificial sequence
  SiRNA target sequence
acaggaagatcgaacagttttga

SEQ ID NO: 73422 - DNA, 23 bp, Artificial sequence
  SiRNA target sequence
caggaagatcgaacagttttgat

SEQ ID NO: 73423 - DNA, 23 bp, Artificial sequence
  SiRNA target sequence
aggaagatcgaacagttttgatg

SEQ ID NO: 73424 - DNA, 23 bp, Artificial sequence
  SiRNA target sequence
ggaagatcgaacagttttgatga

SEQ ID NO: 73425 - DNA, 23 bp, Artificial sequence
  SiRNA target sequence
gaagatcgaacagttttgatgat

SEQ ID NO: 73426 - DNA, 23 bp, Artificial sequence
  SiRNA target sequence
aagatcgaacagttttgatgata

SEQ ID NO: 73427 - DNA, 23 bp, Artificial sequence
  SiRNA target sequence
agatcgaacagttttgatgataa

SEQ ID NO: 73428 - DNA, 23 bp, Artificial sequence
  SiRNA target sequence
gatcgaacagttttgatgataat

SEQ ID NO: 73429 - DNA, 23 bp, Artificial sequence
  SiRNA target sequence
atcgaacagttttgatgataatt

SEQ ID NO: 73430 - DNA, 23 bp, Artificial sequence
  SiRNA target sequence
tcgaacagttttgatgataattc

SEQ ID NO: 73431 - DNA, 23 bp, Artificial sequence
  SiRNA target sequence
cgaacagttttgatgataattca

SEQ ID NO: 73432 - DNA, 23 bp, Artificial sequence
  SiRNA target sequence
gaacagttttgatgataattcat

SEQ ID NO: 73433 - DNA, 23 bp, Artificial sequence
  SiRNA target sequence
aacagttttgatgataattcata

SEQ ID NO: 73434 - DNA, 23 bp, Artificial sequence
  SiRNA target sequence
acagttttgatgataattcataa

SEQ ID NO: 73435 - DNA, 23 bp, Artificial sequence
  SiRNA target sequence
cagttttgatgataattcataat

SEQ ID NO: 73436 - DNA, 23 bp, Artificial sequence
  SiRNA target sequence
agttttgatgataattcataatc

SEQ ID NO: 73437 - DNA, 23 bp, Artificial sequence
  SiRNA target sequence
gttttgatgataattcataatct

SEQ ID NO: 73438 - DNA, 23 bp, Artificial sequence
  SiRNA target sequence
ttttgatgataattcataatcta

SEQ ID NO: 73439 - DNA, 23 bp, Artificial sequence
  SiRNA target sequence
tttgatgataattcataatctag

SEQ ID NO: 73440 - DNA, 23 bp, Artificial sequence
  SiRNA target sequence
ttgatgataattcataatctaga

SEQ ID NO: 73441 - DNA, 23 bp, Artificial sequence
  SiRNA target sequence
tgatgataattcataatctagaa

SEQ ID NO: 73442 - DNA, 23 bp, Artificial sequence
  SiRNA target sequence
gatgataattcataatctagaac

SEQ ID NO: 73443 - DNA, 23 bp, Artificial sequence
  SiRNA target sequence
atgataattcataatctagaact

SEQ ID NO: 73444 - DNA, 23 bp, Artificial sequence
  SiRNA target sequence
tgataattcataatctagaactt

SEQ ID NO: 73445 - DNA, 23 bp, Artificial sequence
  SiRNA target sequence
gataattcataatctagaactta

SEQ ID NO: 73446 - DNA, 23 bp, Artificial sequence
  SiRNA target sequence
ataattcataatctagaacttat

SEQ ID NO: 73447 - DNA, 23 bp, Artificial sequence
  SiRNA target sequence
taattcataatctagaacttatt

SEQ ID NO: 73448 - DNA, 23 bp, Artificial sequence
  SiRNA target sequence
aattcataatctagaacttatta

SEQ ID NO: 73449 - DNA, 23 bp, Artificial sequence
  SiRNA target sequence
attcataatctagaacttattaa

SEQ ID NO: 73450 - DNA, 23 bp, Artificial sequence
  SiRNA target sequence
ttcataatctagaacttattaat

SEQ ID NO: 73451 - DNA, 23 bp, Artificial sequence
  SiRNA target sequence
tcataatctagaacttattaata

SEQ ID NO: 73452 - DNA, 23 bp, Artificial sequence
  SiRNA target sequence
cataatctagaacttattaataa

SEQ ID NO: 73453 - DNA, 23 bp, Artificial sequence
  SiRNA target sequence
ataatctagaacttattaataaa

SEQ ID NO: 73454 - DNA, 23 bp, Artificial sequence
  SiRNA target sequence
taatctagaacttattaataaat

SEQ ID NO: 73455 - DNA, 23 bp, Artificial sequence
  SiRNA target sequence
aatctagaacttattaataaatt

SEQ ID NO: 73456 - DNA, 23 bp, Artificial sequence
  SiRNA target sequence
atctagaacttattaataaattt

SEQ ID NO: 73457 - DNA, 23 bp, Artificial sequence
  SiRNA target sequence
tctagaacttattaataaatttg

SEQ ID NO: 73458 - DNA, 23 bp, Artificial sequence
  SiRNA target sequence
ctagaacttattaataaatttga

SEQ ID NO: 73459 - DNA, 23 bp, Artificial sequence
  SiRNA target sequence
tagaacttattaataaatttgat

SEQ ID NO: 73460 - DNA, 23 bp, Artificial sequence
  SiRNA target sequence
agaacttattaataaatttgata

SEQ ID NO: 73461 - DNA, 23 bp, Artificial sequence
  SiRNA target sequence
gaacttattaataaatttgataa

SEQ ID NO: 73462 - DNA, 23 bp, Artificial sequence
  SiRNA target sequence
aacttattaataaatttgataaa

SEQ ID NO: 73463 - DNA, 23 bp, Artificial sequence
  SiRNA target sequence
acttattaataaatttgataaaa

SEQ ID NO: 73464 - DNA, 23 bp, Artificial sequence
  SiRNA target sequence
cttattaataaatttgataaaat

SEQ ID NO: 73465 - DNA, 23 bp, Artificial sequence
  SiRNA target sequence
ttattaataaatttgataaaata

SEQ ID NO: 73466 - DNA, 23 bp, Artificial sequence
  SiRNA target sequence
tattaataaatttgataaaataa

SEQ ID NO: 73467 - DNA, 23 bp, Artificial sequence
  SiRNA target sequence
attaataaatttgataaaataat

SEQ ID NO: 73468 - DNA, 23 bp, Artificial sequence
  SiRNA target sequence
ttaataaatttgataaaataatt

SEQ ID NO: 73469 - DNA, 23 bp, Artificial sequence
  SiRNA target sequence
taataaatttgataaaataattt

SEQ ID NO: 73470 - DNA, 23 bp, Artificial sequence
  SiRNA target sequence
aataaatttgataaaataattta

SEQ ID NO: 73471 - DNA, 23 bp, Artificial sequence
  SiRNA target sequence
ataaatttgataaaataatttac

SEQ ID NO: 73472 - DNA, 23 bp, Artificial sequence
  SiRNA target sequence
taaatttgataaaataatttaca

SEQ ID NO: 73473 - DNA, 23 bp, Artificial sequence
  SiRNA target sequence
aaatttgataaaataatttacat

SEQ ID NO: 73474 - DNA, 23 bp, Artificial sequence
  SiRNA target sequence
aatttgataaaataatttacatt

SEQ ID NO: 73475 - DNA, 23 bp, Artificial sequence
  SiRNA target sequence
atttgataaaataatttacattg

SEQ ID NO: 73476 - DNA, 23 bp, Artificial sequence
  SiRNA target sequence
tttgataaaataatttacattga

SEQ ID NO: 73477 - DNA, 23 bp, Artificial sequence
  SiRNA target sequence
ttgataaaataatttacattgat

SEQ ID NO: 73478 - DNA, 23 bp, Artificial sequence
  SiRNA target sequence
tgataaaataatttacattgatg

SEQ ID NO: 73479 - DNA, 23 bp, Artificial sequence
  SiRNA target sequence
gataaaataatttacattgatga

SEQ ID NO: 73480 - DNA, 23 bp, Artificial sequence
  SiRNA target sequence
ataaaataatttacattgatgaa

SEQ ID NO: 73481 - DNA, 23 bp, Artificial sequence
  SiRNA target sequence
taaaataatttacattgatgaaa

SEQ ID NO: 73482 - DNA, 23 bp, Artificial sequence
  SiRNA target sequence
aaaataatttacattgatgaaaa

SEQ ID NO: 73483 - DNA, 23 bp, Artificial sequence
  SiRNA target sequence
aaataatttacattgatgaaaat

SEQ ID NO: 73484 - DNA, 23 bp, Artificial sequence
  SiRNA target sequence
aataatttacattgatgaaaata

SEQ ID NO: 73485 - DNA, 23 bp, Artificial sequence
  SiRNA target sequence
ataatttacattgatgaaaataa

SEQ ID NO: 73486 - DNA, 23 bp, Artificial sequence
  SiRNA target sequence
taatttacattgatgaaaataat

SEQ ID NO: 73487 - DNA, 23 bp, Artificial sequence
  SiRNA target sequence
aatttacattgatgaaaataata

SEQ ID NO: 73488 - DNA, 23 bp, Artificial sequence
  SiRNA target sequence
atttacattgatgaaaataatat

SEQ ID NO: 73489 - DNA, 23 bp, Artificial sequence
  SiRNA target sequence
tttacattgatgaaaataatata

SEQ ID NO: 73490 - DNA, 23 bp, Artificial sequence
  SiRNA target sequence
ttacattgatgaaaataatatag

SEQ ID NO: 73491 - DNA, 23 bp, Artificial sequence
  SiRNA target sequence
tacattgatgaaaataatataga

SEQ ID NO: 73492 - DNA, 23 bp, Artificial sequence
  SiRNA target sequence
acattgatgaaaataatatagaa

SEQ ID NO: 73493 - DNA, 23 bp, Artificial sequence
  SiRNA target sequence
cattgatgaaaataatatagaag

SEQ ID NO: 73494 - DNA, 23 bp, Artificial sequence
  SiRNA target sequence
attgatgaaaataatatagaagt

SEQ ID NO: 73495 - DNA, 23 bp, Artificial sequence
  SiRNA target sequence
ttgatgaaaataatatagaagtc

SEQ ID NO: 73496 - DNA, 23 bp, Artificial sequence
  SiRNA target sequence
tgatgaaaataatatagaagtct

SEQ ID NO: 73497 - DNA, 23 bp, Artificial sequence
  SiRNA target sequence
gatgaaaataatatagaagtcta

SEQ ID NO: 73498 - DNA, 23 bp, Artificial sequence
  SiRNA target sequence
atgaaaataatatagaagtctat

SEQ ID NO: 73499 - DNA, 23 bp, Artificial sequence
  SiRNA target sequence
tgaaaataatatagaagtctata

SEQ ID NO: 73500 - DNA, 23 bp, Artificial sequence
  SiRNA target sequence
gaaaataatatagaagtctataa

SEQ ID NO: 73501 - DNA, 23 bp, Artificial sequence
  SiRNA target sequence
aaaataatatagaagtctataaa

SEQ ID NO: 73502 - DNA, 23 bp, Artificial sequence
  SiRNA target sequence
aaataatatagaagtctataaaa

SEQ ID NO: 73503 - DNA, 23 bp, Artificial sequence
  SiRNA target sequence
aataatatagaagtctataaaaa

SEQ ID NO: 73504 - DNA, 23 bp, Artificial sequence
  SiRNA target sequence
ataatatagaagtctataaaaat

SEQ ID NO: 73505 - DNA, 23 bp, Artificial sequence
  SiRNA target sequence
taatatagaagtctataaaaatg

SEQ ID NO: 73506 - DNA, 23 bp, Artificial sequence
  SiRNA target sequence
aatatagaagtctataaaaatga

SEQ ID NO: 73507 - DNA, 23 bp, Artificial sequence
  SiRNA target sequence
atatagaagtctataaaaatgat

SEQ ID NO: 73508 - DNA, 23 bp, Artificial sequence
  SiRNA target sequence
tatagaagtctataaaaatgata

SEQ ID NO: 73509 - DNA, 23 bp, Artificial sequence
  SiRNA target sequence
atagaagtctataaaaatgatat

SEQ ID NO: 73510 - DNA, 23 bp, Artificial sequence
  SiRNA target sequence
tagaagtctataaaaatgatatt

SEQ ID NO: 73511 - DNA, 23 bp, Artificial sequence
  SiRNA target sequence
agaagtctataaaaatgatattg

SEQ ID NO: 73512 - DNA, 23 bp, Artificial sequence
  SiRNA target sequence
gaagtctataaaaatgatattga

SEQ ID NO: 73513 - DNA, 23 bp, Artificial sequence
  SiRNA target sequence
aagtctataaaaatgatattgaa

SEQ ID NO: 73514 - DNA, 23 bp, Artificial sequence
  SiRNA target sequence
agtctataaaaatgatattgaag

SEQ ID NO: 73515 - DNA, 23 bp, Artificial sequence
  SiRNA target sequence
gtctataaaaatgatattgaagg

SEQ ID NO: 73516 - DNA, 23 bp, Artificial sequence
  SiRNA target sequence
tctataaaaatgatattgaagga

SEQ ID NO: 73517 - DNA, 23 bp, Artificial sequence
  SiRNA target sequence
ctataaaaatgatattgaaggac

SEQ ID NO: 73518 - DNA, 23 bp, Artificial sequence
  SiRNA target sequence
tataaaaatgatattgaaggaca

SEQ ID NO: 73519 - DNA, 23 bp, Artificial sequence
  SiRNA target sequence
ataaaaatgatattgaaggacaa

SEQ ID NO: 73520 - DNA, 23 bp, Artificial sequence
  SiRNA target sequence
taaaaatgatattgaaggacaaa

SEQ ID NO: 73521 - DNA, 23 bp, Artificial sequence
  SiRNA target sequence
aaaaatgatattgaaggacaaaa

SEQ ID NO: 73522 - DNA, 23 bp, Artificial sequence
  SiRNA target sequence
aaaatgatattgaaggacaaaaa

SEQ ID NO: 73523 - DNA, 23 bp, Artificial sequence
  SiRNA target sequence
aaatgatattgaaggacaaaaaa

SEQ ID NO: 73524 - DNA, 23 bp, Artificial sequence
  SiRNA target sequence
aatgatattgaaggacaaaaaaa

SEQ ID NO: 73525 - DNA, 23 bp, Artificial sequence
  SiRNA target sequence
atgatattgaaggacaaaaaaag

SEQ ID NO: 73526 - DNA, 23 bp, Artificial sequence
  SiRNA target sequence
tgatattgaaggacaaaaaaagt

SEQ ID NO: 73527 - DNA, 23 bp, Artificial sequence
  SiRNA target sequence
gatattgaaggacaaaaaaagtt

SEQ ID NO: 73528 - DNA, 23 bp, Artificial sequence
  SiRNA target sequence
atattgaaggacaaaaaaagttt

SEQ ID NO: 73529 - DNA, 23 bp, Artificial sequence
  SiRNA target sequence
tattgaaggacaaaaaaagtttt

SEQ ID NO: 73530 - DNA, 23 bp, Artificial sequence
  SiRNA target sequence
attgaaggacaaaaaaagttttc

SEQ ID NO: 73531 - DNA, 23 bp, Artificial sequence
  SiRNA target sequence
ttgaaggacaaaaaaagttttct

SEQ ID NO: 73532 - DNA, 23 bp, Artificial sequence
  SiRNA target sequence
tgaaggacaaaaaaagttttcta

SEQ ID NO: 73533 - DNA, 23 bp, Artificial sequence
  SiRNA target sequence
gaaggacaaaaaaagttttctac

SEQ ID NO: 73534 - DNA, 23 bp, Artificial sequence
  SiRNA target sequence
aaggacaaaaaaagttttctaca

SEQ ID NO: 73535 - DNA, 23 bp, Artificial sequence
  SiRNA target sequence
aggacaaaaaaagttttctacaa

SEQ ID NO: 73536 - DNA, 23 bp, Artificial sequence
  SiRNA target sequence
ggacaaaaaaagttttctacaaa

SEQ ID NO: 73537 - DNA, 23 bp, Artificial sequence
  SiRNA target sequence
gacaaaaaaagttttctacaaat

SEQ ID NO: 73538 - DNA, 23 bp, Artificial sequence
  SiRNA target sequence
acaaaaaaagttttctacaaatt

SEQ ID NO: 73539 - DNA, 23 bp, Artificial sequence
  SiRNA target sequence
caaaaaaagttttctacaaattt

SEQ ID NO: 73540 - DNA, 23 bp, Artificial sequence
  SiRNA target sequence
aaaaaaagttttctacaaattta

SEQ ID NO: 73541 - DNA, 23 bp, Artificial sequence
  SiRNA target sequence
aaaaaagttttctacaaatttac

SEQ ID NO: 73542 - DNA, 23 bp, Artificial sequence
  SiRNA target sequence
aaaaagttttctacaaatttaca

SEQ ID NO: 73543 - DNA, 23 bp, Artificial sequence
  SiRNA target sequence
aaaagttttctacaaatttacaa

SEQ ID NO: 73544 - DNA, 23 bp, Artificial sequence
  SiRNA target sequence
aaagttttctacaaatttacaat

SEQ ID NO: 73545 - DNA, 23 bp, Artificial sequence
  SiRNA target sequence
aagttttctacaaatttacaata

SEQ ID NO: 73546 - DNA, 23 bp, Artificial sequence
  SiRNA target sequence
agttttctacaaatttacaatat

SEQ ID NO: 73547 - DNA, 23 bp, Artificial sequence
  SiRNA target sequence
gttttctacaaatttacaatatt

SEQ ID NO: 73548 - DNA, 23 bp, Artificial sequence
  SiRNA target sequence
ttttctacaaatttacaatattt

SEQ ID NO: 73549 - DNA, 23 bp, Artificial sequence
  SiRNA target sequence
tttctacaaatttacaatatttt

SEQ ID NO: 73550 - DNA, 23 bp, Artificial sequence
  SiRNA target sequence
ttctacaaatttacaatattttt

SEQ ID NO: 73551 - DNA, 23 bp, Artificial sequence
  SiRNA target sequence
tctacaaatttacaatatttttt

SEQ ID NO: 73552 - DNA, 23 bp, Artificial sequence
  SiRNA target sequence
ctacaaatttacaatatttttta

SEQ ID NO: 73553 - DNA, 23 bp, Artificial sequence
  SiRNA target sequence
tacaaatttacaatattttttat

SEQ ID NO: 73554 - DNA, 23 bp, Artificial sequence
  SiRNA target sequence
acaaatttacaatattttttatc

SEQ ID NO: 73555 - DNA, 23 bp, Artificial sequence
  SiRNA target sequence
caaatttacaatattttttatca

SEQ ID NO: 73556 - DNA, 23 bp, Artificial sequence
  SiRNA target sequence
aaatttacaatattttttatcat

SEQ ID NO: 73557 - DNA, 23 bp, Artificial sequence
  SiRNA target sequence
aatttacaatattttttatcata

SEQ ID NO: 73558 - DNA, 23 bp, Artificial sequence
  SiRNA target sequence
atttacaatattttttatcatac

SEQ ID NO: 73559 - DNA, 23 bp, Artificial sequence
  SiRNA target sequence
tttacaatattttttatcataca

SEQ ID NO: 73560 - DNA, 23 bp, Artificial sequence
  SiRNA target sequence
ttacaatattttttatcatacaa

SEQ ID NO: 73561 - DNA, 23 bp, Artificial sequence
  SiRNA target sequence
tacaatattttttatcatacaaa

SEQ ID NO: 73562 - DNA, 23 bp, Artificial sequence
  SiRNA target sequence
acaatattttttatcatacaaat

SEQ ID NO: 73563 - DNA, 23 bp, Artificial sequence
  SiRNA target sequence
caatattttttatcatacaaatt

SEQ ID NO: 73564 - DNA, 23 bp, Artificial sequence
  SiRNA target sequence
aatattttttatcatacaaatta

SEQ ID NO: 73565 - DNA, 23 bp, Artificial sequence
  SiRNA target sequence
atattttttatcatacaaattag

SEQ ID NO: 73566 - DNA, 23 bp, Artificial sequence
  SiRNA target sequence
tattttttatcatacaaattagg

SEQ ID NO: 73567 - DNA, 23 bp, Artificial sequence
  SiRNA target sequence
attttttatcatacaaattaggt

SEQ ID NO: 73568 - DNA, 23 bp, Artificial sequence
  SiRNA target sequence
ttttttatcatacaaattaggta

SEQ ID NO: 73569 - DNA, 23 bp, Artificial sequence
  SiRNA target sequence
tttttatcatacaaattaggtaa

SEQ ID NO: 73570 - DNA, 23 bp, Artificial sequence
  SiRNA target sequence
ttttatcatacaaattaggtaaa

SEQ ID NO: 73571 - DNA, 23 bp, Artificial sequence
  SiRNA target sequence
tttatcatacaaattaggtaaat

SEQ ID NO: 73572 - DNA, 23 bp, Artificial sequence
  SiRNA target sequence
ttatcatacaaattaggtaaata

SEQ ID NO: 73573 - DNA, 23 bp, Artificial sequence
  SiRNA target sequence
tatcatacaaattaggtaaataa

SEQ ID NO: 73574 - DNA, 24 bp, Artificial sequence
  SiRNA target sequence
atgaaaaaaatttcgaatagaaaa

SEQ ID NO: 73575 - DNA, 24 bp, Artificial sequence
  SiRNA target sequence
tgaaaaaaatttcgaatagaaaaa

SEQ ID NO: 73576 - DNA, 24 bp, Artificial sequence
  SiRNA target sequence
gaaaaaaatttcgaatagaaaaat

SEQ ID NO: 73577 - DNA, 24 bp, Artificial sequence
  SiRNA target sequence
aaaaaaatttcgaatagaaaaatt

SEQ ID NO: 73578 - DNA, 24 bp, Artificial sequence
  SiRNA target sequence
aaaaaatttcgaatagaaaaatta

SEQ ID NO: 73579 - DNA, 24 bp, Artificial sequence
  SiRNA target sequence
aaaaatttcgaatagaaaaattat

SEQ ID NO: 73580 - DNA, 24 bp, Artificial sequence
  SiRNA target sequence
aaaatttcgaatagaaaaattatc

SEQ ID NO: 73581 - DNA, 24 bp, Artificial sequence
  SiRNA target sequence
aaatttcgaatagaaaaattatca

SEQ ID NO: 73582 - DNA, 24 bp, Artificial sequence
  SiRNA target sequence
aatttcgaatagaaaaattatcaa

SEQ ID NO: 73583 - DNA, 24 bp, Artificial sequence
  SiRNA target sequence
atttcgaatagaaaaattatcaaa

SEQ ID NO: 73584 - DNA, 24 bp, Artificial sequence
  SiRNA target sequence
tttcgaatagaaaaattatcaaag

SEQ ID NO: 73585 - DNA, 24 bp, Artificial sequence
  SiRNA target sequence
ttcgaatagaaaaattatcaaaga

SEQ ID NO: 73586 - DNA, 24 bp, Artificial sequence
  SiRNA target sequence
tcgaatagaaaaattatcaaagaa

SEQ ID NO: 73587 - DNA, 24 bp, Artificial sequence
  SiRNA target sequence
cgaatagaaaaattatcaaagaaa

SEQ ID NO: 73588 - DNA, 24 bp, Artificial sequence
  SiRNA target sequence
gaatagaaaaattatcaaagaaat

SEQ ID NO: 73589 - DNA, 24 bp, Artificial sequence
  SiRNA target sequence
aatagaaaaattatcaaagaaatt

SEQ ID NO: 73590 - DNA, 24 bp, Artificial sequence
  SiRNA target sequence
atagaaaaattatcaaagaaatta

SEQ ID NO: 73591 - DNA, 24 bp, Artificial sequence
  SiRNA target sequence
tagaaaaattatcaaagaaattat

SEQ ID NO: 73592 - DNA, 24 bp, Artificial sequence
  SiRNA target sequence
agaaaaattatcaaagaaattatt

SEQ ID NO: 73593 - DNA, 24 bp, Artificial sequence
  SiRNA target sequence
gaaaaattatcaaagaaattattt

SEQ ID NO: 73594 - DNA, 24 bp, Artificial sequence
  SiRNA target sequence
aaaaattatcaaagaaattattta

SEQ ID NO: 73595 - DNA, 24 bp, Artificial sequence
  SiRNA target sequence
aaaattatcaaagaaattatttac

SEQ ID NO: 73596 - DNA, 24 bp, Artificial sequence
  SiRNA target sequence
aaattatcaaagaaattatttaca

SEQ ID NO: 73597 - DNA, 24 bp, Artificial sequence
  SiRNA target sequence
aattatcaaagaaattatttacaa

SEQ ID NO: 73598 - DNA, 24 bp, Artificial sequence
  SiRNA target sequence
attatcaaagaaattatttacaat

SEQ ID NO: 73599 - DNA, 24 bp, Artificial sequence
  SiRNA target sequence
ttatcaaagaaattatttacaatg

SEQ ID NO: 73600 - DNA, 24 bp, Artificial sequence
  SiRNA target sequence
tatcaaagaaattatttacaatga

SEQ ID NO: 73601 - DNA, 24 bp, Artificial sequence
  SiRNA target sequence
atcaaagaaattatttacaatgat

SEQ ID NO: 73602 - DNA, 24 bp, Artificial sequence
  SiRNA target sequence
tcaaagaaattatttacaatgatt

SEQ ID NO: 73603 - DNA, 24 bp, Artificial sequence
  SiRNA target sequence
caaagaaattatttacaatgattt

SEQ ID NO: 73604 - DNA, 24 bp, Artificial sequence
  SiRNA target sequence
aaagaaattatttacaatgattta

SEQ ID NO: 73605 - DNA, 24 bp, Artificial sequence
  SiRNA target sequence
aagaaattatttacaatgatttat

SEQ ID NO: 73606 - DNA, 24 bp, Artificial sequence
  SiRNA target sequence
agaaattatttacaatgatttatt

SEQ ID NO: 73607 - DNA, 24 bp, Artificial sequence
  SiRNA target sequence
gaaattatttacaatgatttatta

SEQ ID NO: 73608 - DNA, 24 bp, Artificial sequence
  SiRNA target sequence
aaattatttacaatgatttattaa

SEQ ID NO: 73609 - DNA, 24 bp, Artificial sequence
  SiRNA target sequence
aattatttacaatgatttattaaa

SEQ ID NO: 73610 - DNA, 24 bp, Artificial sequence
  SiRNA target sequence
attatttacaatgatttattaaaa

SEQ ID NO: 73611 - DNA, 24 bp, Artificial sequence
  SiRNA target sequence
ttatttacaatgatttattaaaaa

SEQ ID NO: 73612 - DNA, 24 bp, Artificial sequence
  SiRNA target sequence
tatttacaatgatttattaaaaat

SEQ ID NO: 73613 - DNA, 24 bp, Artificial sequence
  SiRNA target sequence
atttacaatgatttattaaaaata

SEQ ID NO: 73614 - DNA, 24 bp, Artificial sequence
  SiRNA target sequence
tttacaatgatttattaaaaataa

SEQ ID NO: 73615 - DNA, 24 bp, Artificial sequence
  SiRNA target sequence
ttacaatgatttattaaaaataag

SEQ ID NO: 73616 - DNA, 24 bp, Artificial sequence
  SiRNA target sequence
tacaatgatttattaaaaataaga

SEQ ID NO: 73617 - DNA, 24 bp, Artificial sequence
  SiRNA target sequence
acaatgatttattaaaaataagaa

SEQ ID NO: 73618 - DNA, 24 bp, Artificial sequence
  SiRNA target sequence
caatgatttattaaaaataagaat

SEQ ID NO: 73619 - DNA, 24 bp, Artificial sequence
  SiRNA target sequence
aatgatttattaaaaataagaatg

SEQ ID NO: 73620 - DNA, 24 bp, Artificial sequence
  SiRNA target sequence
atgatttattaaaaataagaatgt

SEQ ID NO: 73621 - DNA, 24 bp, Artificial sequence
  SiRNA target sequence
tgatttattaaaaataagaatgtt

SEQ ID NO: 73622 - DNA, 24 bp, Artificial sequence
  SiRNA target sequence
gatttattaaaaataagaatgttg

SEQ ID NO: 73623 - DNA, 24 bp, Artificial sequence
  SiRNA target sequence
atttattaaaaataagaatgttgc

SEQ ID NO: 73624 - DNA, 24 bp, Artificial sequence
  SiRNA target sequence
tttattaaaaataagaatgttgcg

SEQ ID NO: 73625 - DNA, 24 bp, Artificial sequence
  SiRNA target sequence
ttattaaaaataagaatgttgcga

SEQ ID NO: 73626 - DNA, 24 bp, Artificial sequence
  SiRNA target sequence
tattaaaaataagaatgttgcgat

SEQ ID NO: 73627 - DNA, 24 bp, Artificial sequence
  SiRNA target sequence
attaaaaataagaatgttgcgata

SEQ ID NO: 73628 - DNA, 24 bp, Artificial sequence
  SiRNA target sequence
ttaaaaataagaatgttgcgatat

SEQ ID NO: 73629 - DNA, 24 bp, Artificial sequence
  SiRNA target sequence
taaaaataagaatgttgcgatatg

SEQ ID NO: 73630 - DNA, 24 bp, Artificial sequence
  SiRNA target sequence
aaaaataagaatgttgcgatatgt

SEQ ID NO: 73631 - DNA, 24 bp, Artificial sequence
  SiRNA target sequence
aaaataagaatgttgcgatatgtt

SEQ ID NO: 73632 - DNA, 24 bp, Artificial sequence
  SiRNA target sequence
aaataagaatgttgcgatatgtta

SEQ ID NO: 73633 - DNA, 24 bp, Artificial sequence
  SiRNA target sequence
aataagaatgttgcgatatgttat

SEQ ID NO: 73634 - DNA, 24 bp, Artificial sequence
  SiRNA target sequence
ataagaatgttgcgatatgttatt

SEQ ID NO: 73635 - DNA, 24 bp, Artificial sequence
  SiRNA target sequence
taagaatgttgcgatatgttattg

SEQ ID NO: 73636 - DNA, 24 bp, Artificial sequence
  SiRNA target sequence
aagaatgttgcgatatgttattgt

SEQ ID NO: 73637 - DNA, 24 bp, Artificial sequence
  SiRNA target sequence
agaatgttgcgatatgttattgta

SEQ ID NO: 73638 - DNA, 24 bp, Artificial sequence
  SiRNA target sequence
gaatgttgcgatatgttattgtac

SEQ ID NO: 73639 - DNA, 24 bp, Artificial sequence
  SiRNA target sequence
aatgttgcgatatgttattgtacc

SEQ ID NO: 73640 - DNA, 24 bp, Artificial sequence
  SiRNA target sequence
atgttgcgatatgttattgtacca

SEQ ID NO: 73641 - DNA, 24 bp, Artificial sequence
  SiRNA target sequence
tgttgcgatatgttattgtaccaa

SEQ ID NO: 73642 - DNA, 24 bp, Artificial sequence
  SiRNA target sequence
gttgcgatatgttattgtaccaat

SEQ ID NO: 73643 - DNA, 24 bp, Artificial sequence
  SiRNA target sequence
ttgcgatatgttattgtaccaata

SEQ ID NO: 73644 - DNA, 24 bp, Artificial sequence
  SiRNA target sequence
tgcgatatgttattgtaccaataa

SEQ ID NO: 73645 - DNA, 24 bp, Artificial sequence
  SiRNA target sequence
gcgatatgttattgtaccaataat

SEQ ID NO: 73646 - DNA, 24 bp, Artificial sequence
  SiRNA target sequence
cgatatgttattgtaccaataata

SEQ ID NO: 73647 - DNA, 24 bp, Artificial sequence
  SiRNA target sequence
gatatgttattgtaccaataatat

SEQ ID NO: 73648 - DNA, 24 bp, Artificial sequence
  SiRNA target sequence
atatgttattgtaccaataatatt

SEQ ID NO: 73649 - DNA, 24 bp, Artificial sequence
  SiRNA target sequence
tatgttattgtaccaataatattt

SEQ ID NO: 73650 - DNA, 24 bp, Artificial sequence
  SiRNA target sequence
atgttattgtaccaataatatttt

SEQ ID NO: 73651 - DNA, 24 bp, Artificial sequence
  SiRNA target sequence
tgttattgtaccaataatattttt

SEQ ID NO: 73652 - DNA, 24 bp, Artificial sequence
  SiRNA target sequence
gttattgtaccaataatattttta

SEQ ID NO: 73653 - DNA, 24 bp, Artificial sequence
  SiRNA target sequence
ttattgtaccaataatatttttaa

SEQ ID NO: 73654 - DNA, 24 bp, Artificial sequence
  SiRNA target sequence
tattgtaccaataatatttttaac

SEQ ID NO: 73655 - DNA, 24 bp, Artificial sequence
  SiRNA target sequence
attgtaccaataatatttttaact

SEQ ID NO: 73656 - DNA, 24 bp, Artificial sequence
  SiRNA target sequence
ttgtaccaataatatttttaacta

SEQ ID NO: 73657 - DNA, 24 bp, Artificial sequence
  SiRNA target sequence
tgtaccaataatatttttaactat

SEQ ID NO: 73658 - DNA, 24 bp, Artificial sequence
  SiRNA target sequence
gtaccaataatatttttaactata

SEQ ID NO: 73659 - DNA, 24 bp, Artificial sequence
  SiRNA target sequence
taccaataatatttttaactatat

SEQ ID NO: 73660 - DNA, 24 bp, Artificial sequence
  SiRNA target sequence
accaataatatttttaactatatt

SEQ ID NO: 73661 - DNA, 24 bp, Artificial sequence
  SiRNA target sequence
ccaataatatttttaactatattt

SEQ ID NO: 73662 - DNA, 24 bp, Artificial sequence
  SiRNA target sequence
caataatatttttaactatatttt

SEQ ID NO: 73663 - DNA, 24 bp, Artificial sequence
  SiRNA target sequence
aataatatttttaactatatttta

SEQ ID NO: 73664 - DNA, 24 bp, Artificial sequence
  SiRNA target sequence
ataatatttttaactatattttac

SEQ ID NO: 73665 - DNA, 24 bp, Artificial sequence
  SiRNA target sequence
taatatttttaactatattttaca

SEQ ID NO: 73666 - DNA, 24 bp, Artificial sequence
  SiRNA target sequence
aatatttttaactatattttacac

SEQ ID NO: 73667 - DNA, 24 bp, Artificial sequence
  SiRNA target sequence
atatttttaactatattttacact

SEQ ID NO: 73668 - DNA, 24 bp, Artificial sequence
  SiRNA target sequence
tatttttaactatattttacactg

SEQ ID NO: 73669 - DNA, 24 bp, Artificial sequence
  SiRNA target sequence
atttttaactatattttacactgt

SEQ ID NO: 73670 - DNA, 24 bp, Artificial sequence
  SiRNA target sequence
tttttaactatattttacactgtt

SEQ ID NO: 73671 - DNA, 24 bp, Artificial sequence
  SiRNA target sequence
ttttaactatattttacactgttt

SEQ ID NO: 73672 - DNA, 24 bp, Artificial sequence
  SiRNA target sequence
tttaactatattttacactgtttt

SEQ ID NO: 73673 - DNA, 24 bp, Artificial sequence
  SiRNA target sequence
ttaactatattttacactgtttta

SEQ ID NO: 73674 - DNA, 24 bp, Artificial sequence
  SiRNA target sequence
taactatattttacactgttttag

SEQ ID NO: 73675 - DNA, 24 bp, Artificial sequence
  SiRNA target sequence
aactatattttacactgttttaga

SEQ ID NO: 73676 - DNA, 24 bp, Artificial sequence
  SiRNA target sequence
actatattttacactgttttagag

SEQ ID NO: 73677 - DNA, 24 bp, Artificial sequence
  SiRNA target sequence
ctatattttacactgttttagaga

SEQ ID NO: 73678 - DNA, 24 bp, Artificial sequence
  SiRNA target sequence
tatattttacactgttttagagat

SEQ ID NO: 73679 - DNA, 24 bp, Artificial sequence
  SiRNA target sequence
atattttacactgttttagagata

SEQ ID NO: 73680 - DNA, 24 bp, Artificial sequence
  SiRNA target sequence
tattttacactgttttagagataa

SEQ ID NO: 73681 - DNA, 24 bp, Artificial sequence
  SiRNA target sequence
attttacactgttttagagataaa

SEQ ID NO: 73682 - DNA, 24 bp, Artificial sequence
  SiRNA target sequence
ttttacactgttttagagataaaa

SEQ ID NO: 73683 - DNA, 24 bp, Artificial sequence
  SiRNA target sequence
tttacactgttttagagataaaaa

SEQ ID NO: 73684 - DNA, 24 bp, Artificial sequence
  SiRNA target sequence
ttacactgttttagagataaaaat

SEQ ID NO: 73685 - DNA, 24 bp, Artificial sequence
  SiRNA target sequence
tacactgttttagagataaaaata

SEQ ID NO: 73686 - DNA, 24 bp, Artificial sequence
  SiRNA target sequence
acactgttttagagataaaaataa

SEQ ID NO: 73687 - DNA, 24 bp, Artificial sequence
  SiRNA target sequence
cactgttttagagataaaaataag

SEQ ID NO: 73688 - DNA, 24 bp, Artificial sequence
  SiRNA target sequence
actgttttagagataaaaataagt

SEQ ID NO: 73689 - DNA, 24 bp, Artificial sequence
  SiRNA target sequence
ctgttttagagataaaaataagta

SEQ ID NO: 73690 - DNA, 24 bp, Artificial sequence
  SiRNA target sequence
tgttttagagataaaaataagtac

SEQ ID NO: 73691 - DNA, 24 bp, Artificial sequence
  SiRNA target sequence
gttttagagataaaaataagtaca

SEQ ID NO: 73692 - DNA, 24 bp, Artificial sequence
  SiRNA target sequence
ttttagagataaaaataagtacat

SEQ ID NO: 73693 - DNA, 24 bp, Artificial sequence
  SiRNA target sequence
tttagagataaaaataagtacatt

SEQ ID NO: 73694 - DNA, 24 bp, Artificial sequence
  SiRNA target sequence
ttagagataaaaataagtacatta

SEQ ID NO: 73695 - DNA, 24 bp, Artificial sequence
  SiRNA target sequence
tagagataaaaataagtacattag

SEQ ID NO: 73696 - DNA, 24 bp, Artificial sequence
  SiRNA target sequence
agagataaaaataagtacattagt

SEQ ID NO: 73697 - DNA, 24 bp, Artificial sequence
  SiRNA target sequence
gagataaaaataagtacattagta

SEQ ID NO: 73698 - DNA, 24 bp, Artificial sequence
  SiRNA target sequence
agataaaaataagtacattagtaa

SEQ ID NO: 73699 - DNA, 24 bp, Artificial sequence
  SiRNA target sequence
gataaaaataagtacattagtaaa

SEQ ID NO: 73700 - DNA, 24 bp, Artificial sequence
  SiRNA target sequence
ataaaaataagtacattagtaaag

SEQ ID NO: 73701 - DNA, 24 bp, Artificial sequence
  SiRNA target sequence
taaaaataagtacattagtaaaga

SEQ ID NO: 73702 - DNA, 24 bp, Artificial sequence
  SiRNA target sequence
aaaaataagtacattagtaaagaa

SEQ ID NO: 73703 - DNA, 24 bp, Artificial sequence
  SiRNA target sequence
aaaataagtacattagtaaagaat

SEQ ID NO: 73704 - DNA, 24 bp, Artificial sequence
  SiRNA target sequence
aaataagtacattagtaaagaatc

SEQ ID NO: 73705 - DNA, 24 bp, Artificial sequence
  SiRNA target sequence
aataagtacattagtaaagaatct

SEQ ID NO: 73706 - DNA, 24 bp, Artificial sequence
  SiRNA target sequence
ataagtacattagtaaagaatctt

SEQ ID NO: 73707 - DNA, 24 bp, Artificial sequence
  SiRNA target sequence
taagtacattagtaaagaatctta

SEQ ID NO: 73708 - DNA, 24 bp, Artificial sequence
  SiRNA target sequence
aagtacattagtaaagaatcttaa

SEQ ID NO: 73709 - DNA, 24 bp, Artificial sequence
  SiRNA target sequence
agtacattagtaaagaatcttaat

SEQ ID NO: 73710 - DNA, 24 bp, Artificial sequence
  SiRNA target sequence
gtacattagtaaagaatcttaatc

SEQ ID NO: 73711 - DNA, 24 bp, Artificial sequence
  SiRNA target sequence
tacattagtaaagaatcttaatca

SEQ ID NO: 73712 - DNA, 24 bp, Artificial sequence
  SiRNA target sequence
acattagtaaagaatcttaatcaa

SEQ ID NO: 73713 - DNA, 24 bp, Artificial sequence
  SiRNA target sequence
cattagtaaagaatcttaatcaat

SEQ ID NO: 73714 - DNA, 24 bp, Artificial sequence
  SiRNA target sequence
attagtaaagaatcttaatcaatc

SEQ ID NO: 73715 - DNA, 24 bp, Artificial sequence
  SiRNA target sequence
ttagtaaagaatcttaatcaatct

SEQ ID NO: 73716 - DNA, 24 bp, Artificial sequence
  SiRNA target sequence
tagtaaagaatcttaatcaatcta

SEQ ID NO: 73717 - DNA, 24 bp, Artificial sequence
  SiRNA target sequence
agtaaagaatcttaatcaatctat

SEQ ID NO: 73718 - DNA, 24 bp, Artificial sequence
  SiRNA target sequence
gtaaagaatcttaatcaatctatc

SEQ ID NO: 73719 - DNA, 24 bp, Artificial sequence
  SiRNA target sequence
taaagaatcttaatcaatctatcg

SEQ ID NO: 73720 - DNA, 24 bp, Artificial sequence
  SiRNA target sequence
aaagaatcttaatcaatctatcgc

SEQ ID NO: 73721 - DNA, 24 bp, Artificial sequence
  SiRNA target sequence
aagaatcttaatcaatctatcgca

SEQ ID NO: 73722 - DNA, 24 bp, Artificial sequence
  SiRNA target sequence
agaatcttaatcaatctatcgcaa

SEQ ID NO: 73723 - DNA, 24 bp, Artificial sequence
  SiRNA target sequence
gaatcttaatcaatctatcgcaaa

SEQ ID NO: 73724 - DNA, 24 bp, Artificial sequence
  SiRNA target sequence
aatcttaatcaatctatcgcaaat

SEQ ID NO: 73725 - DNA, 24 bp, Artificial sequence
  SiRNA target sequence
atcttaatcaatctatcgcaaatc

SEQ ID NO: 73726 - DNA, 24 bp, Artificial sequence
  SiRNA target sequence
tcttaatcaatctatcgcaaatcg

SEQ ID NO: 73727 - DNA, 24 bp, Artificial sequence
  SiRNA target sequence
cttaatcaatctatcgcaaatcga

SEQ ID NO: 73728 - DNA, 24 bp, Artificial sequence
  SiRNA target sequence
ttaatcaatctatcgcaaatcgaa

SEQ ID NO: 73729 - DNA, 24 bp, Artificial sequence
  SiRNA target sequence
taatcaatctatcgcaaatcgaaa

SEQ ID NO: 73730 - DNA, 24 bp, Artificial sequence
  SiRNA target sequence
aatcaatctatcgcaaatcgaaaa

SEQ ID NO: 73731 - DNA, 24 bp, Artificial sequence
  SiRNA target sequence
atcaatctatcgcaaatcgaaaag

SEQ ID NO: 73732 - DNA, 24 bp, Artificial sequence
  SiRNA target sequence
tcaatctatcgcaaatcgaaaagg

SEQ ID NO: 73733 - DNA, 24 bp, Artificial sequence
  SiRNA target sequence
caatctatcgcaaatcgaaaaggt

SEQ ID NO: 73734 - DNA, 24 bp, Artificial sequence
  SiRNA target sequence
aatctatcgcaaatcgaaaaggtg

SEQ ID NO: 73735 - DNA, 24 bp, Artificial sequence
  SiRNA target sequence
atctatcgcaaatcgaaaaggtga

SEQ ID NO: 73736 - DNA, 24 bp, Artificial sequence
  SiRNA target sequence
tctatcgcaaatcgaaaaggtgaa

SEQ ID NO: 73737 - DNA, 24 bp, Artificial sequence
  SiRNA target sequence
ctatcgcaaatcgaaaaggtgaac

SEQ ID NO: 73738 - DNA, 24 bp, Artificial sequence
  SiRNA target sequence
tatcgcaaatcgaaaaggtgaaca

SEQ ID NO: 73739 - DNA, 24 bp, Artificial sequence
  SiRNA target sequence
atcgcaaatcgaaaaggtgaacac

SEQ ID NO: 73740 - DNA, 24 bp, Artificial sequence
  SiRNA target sequence
tcgcaaatcgaaaaggtgaacaca

SEQ ID NO: 73741 - DNA, 24 bp, Artificial sequence
  SiRNA target sequence
cgcaaatcgaaaaggtgaacacac

SEQ ID NO: 73742 - DNA, 24 bp, Artificial sequence
  SiRNA target sequence
gcaaatcgaaaaggtgaacacaca

SEQ ID NO: 73743 - DNA, 24 bp, Artificial sequence
  SiRNA target sequence
caaatcgaaaaggtgaacacacag

SEQ ID NO: 73744 - DNA, 24 bp, Artificial sequence
  SiRNA target sequence
aaatcgaaaaggtgaacacacagc

SEQ ID NO: 73745 - DNA, 24 bp, Artificial sequence
  SiRNA target sequence
aatcgaaaaggtgaacacacagca

SEQ ID NO: 73746 - DNA, 24 bp, Artificial sequence
  SiRNA target sequence
atcgaaaaggtgaacacacagcac

SEQ ID NO: 73747 - DNA, 24 bp, Artificial sequence
  SiRNA target sequence
tcgaaaaggtgaacacacagcact

SEQ ID NO: 73748 - DNA, 24 bp, Artificial sequence
  SiRNA target sequence
cgaaaaggtgaacacacagcactt

SEQ ID NO: 73749 - DNA, 24 bp, Artificial sequence
  SiRNA target sequence
gaaaaggtgaacacacagcacttg

SEQ ID NO: 73750 - DNA, 24 bp, Artificial sequence
  SiRNA target sequence
aaaaggtgaacacacagcacttga

SEQ ID NO: 73751 - DNA, 24 bp, Artificial sequence
  SiRNA target sequence
aaaggtgaacacacagcacttgaa

SEQ ID NO: 73752 - DNA, 24 bp, Artificial sequence
  SiRNA target sequence
aaggtgaacacacagcacttgaaa

SEQ ID NO: 73753 - DNA, 24 bp, Artificial sequence
  SiRNA target sequence
aggtgaacacacagcacttgaaag

SEQ ID NO: 73754 - DNA, 24 bp, Artificial sequence
  SiRNA target sequence
ggtgaacacacagcacttgaaaga

SEQ ID NO: 73755 - DNA, 24 bp, Artificial sequence
  SiRNA target sequence
gtgaacacacagcacttgaaagat

SEQ ID NO: 73756 - DNA, 24 bp, Artificial sequence
  SiRNA target sequence
tgaacacacagcacttgaaagatt

SEQ ID NO: 73757 - DNA, 24 bp, Artificial sequence
  SiRNA target sequence
gaacacacagcacttgaaagattt

SEQ ID NO: 73758 - DNA, 24 bp, Artificial sequence
  SiRNA target sequence
aacacacagcacttgaaagatttg

SEQ ID NO: 73759 - DNA, 24 bp, Artificial sequence
  SiRNA target sequence
acacacagcacttgaaagatttgt

SEQ ID NO: 73760 - DNA, 24 bp, Artificial sequence
  SiRNA target sequence
cacacagcacttgaaagatttgtg

SEQ ID NO: 73761 - DNA, 24 bp, Artificial sequence
  SiRNA target sequence
acacagcacttgaaagatttgtgt

SEQ ID NO: 73762 - DNA, 24 bp, Artificial sequence
  SiRNA target sequence
cacagcacttgaaagatttgtgtt

SEQ ID NO: 73763 - DNA, 24 bp, Artificial sequence
  SiRNA target sequence
acagcacttgaaagatttgtgtta

SEQ ID NO: 73764 - DNA, 24 bp, Artificial sequence
  SiRNA target sequence
cagcacttgaaagatttgtgttac

SEQ ID NO: 73765 - DNA, 24 bp, Artificial sequence
  SiRNA target sequence
agcacttgaaagatttgtgttaca

SEQ ID NO: 73766 - DNA, 24 bp, Artificial sequence
  SiRNA target sequence
gcacttgaaagatttgtgttacag

SEQ ID NO: 73767 - DNA, 24 bp, Artificial sequence
  SiRNA target sequence
cacttgaaagatttgtgttacagt

SEQ ID NO: 73768 - DNA, 24 bp, Artificial sequence
  SiRNA target sequence
acttgaaagatttgtgttacagtc

SEQ ID NO: 73769 - DNA, 24 bp, Artificial sequence
  SiRNA target sequence
cttgaaagatttgtgttacagtca

SEQ ID NO: 73770 - DNA, 24 bp, Artificial sequence
  SiRNA target sequence
ttgaaagatttgtgttacagtcac

SEQ ID NO: 73771 - DNA, 24 bp, Artificial sequence
  SiRNA target sequence
tgaaagatttgtgttacagtcact

SEQ ID NO: 73772 - DNA, 24 bp, Artificial sequence
  SiRNA target sequence
gaaagatttgtgttacagtcactc

SEQ ID NO: 73773 - DNA, 24 bp, Artificial sequence
  SiRNA target sequence
aaagatttgtgttacagtcactct

SEQ ID NO: 73774 - DNA, 24 bp, Artificial sequence
  SiRNA target sequence
aagatttgtgttacagtcactctt

SEQ ID NO: 73775 - DNA, 24 bp, Artificial sequence
  SiRNA target sequence
agatttgtgttacagtcactctta

SEQ ID NO: 73776 - DNA, 24 bp, Artificial sequence
  SiRNA target sequence
gatttgtgttacagtcactcttag

SEQ ID NO: 73777 - DNA, 24 bp, Artificial sequence
  SiRNA target sequence
atttgtgttacagtcactcttagt

SEQ ID NO: 73778 - DNA, 24 bp, Artificial sequence
  SiRNA target sequence
tttgtgttacagtcactcttagtg

SEQ ID NO: 73779 - DNA, 24 bp, Artificial sequence
  SiRNA target sequence
ttgtgttacagtcactcttagtgg

SEQ ID NO: 73780 - DNA, 24 bp, Artificial sequence
  SiRNA target sequence
tgtgttacagtcactcttagtggc

SEQ ID NO: 73781 - DNA, 24 bp, Artificial sequence
  SiRNA target sequence
gtgttacagtcactcttagtggct

SEQ ID NO: 73782 - DNA, 24 bp, Artificial sequence
  SiRNA target sequence
tgttacagtcactcttagtggctg

SEQ ID NO: 73783 - DNA, 24 bp, Artificial sequence
  SiRNA target sequence
gttacagtcactcttagtggctgt

SEQ ID NO: 73784 - DNA, 24 bp, Artificial sequence
  SiRNA target sequence
ttacagtcactcttagtggctgta

SEQ ID NO: 73785 - DNA, 24 bp, Artificial sequence
  SiRNA target sequence
tacagtcactcttagtggctgtat

SEQ ID NO: 73786 - DNA, 24 bp, Artificial sequence
  SiRNA target sequence
acagtcactcttagtggctgtatt

SEQ ID NO: 73787 - DNA, 24 bp, Artificial sequence
  SiRNA target sequence
cagtcactcttagtggctgtattg

SEQ ID NO: 73788 - DNA, 24 bp, Artificial sequence
  SiRNA target sequence
agtcactcttagtggctgtattga

SEQ ID NO: 73789 - DNA, 24 bp, Artificial sequence
  SiRNA target sequence
gtcactcttagtggctgtattgac

SEQ ID NO: 73790 - DNA, 24 bp, Artificial sequence
  SiRNA target sequence
tcactcttagtggctgtattgacc

SEQ ID NO: 73791 - DNA, 24 bp, Artificial sequence
  SiRNA target sequence
cactcttagtggctgtattgaccg

SEQ ID NO: 73792 - DNA, 24 bp, Artificial sequence
  SiRNA target sequence
actcttagtggctgtattgaccga

SEQ ID NO: 73793 - DNA, 24 bp, Artificial sequence
  SiRNA target sequence
ctcttagtggctgtattgaccgaa

SEQ ID NO: 73794 - DNA, 24 bp, Artificial sequence
  SiRNA target sequence
tcttagtggctgtattgaccgaac

SEQ ID NO: 73795 - DNA, 24 bp, Artificial sequence
  SiRNA target sequence
cttagtggctgtattgaccgaact

SEQ ID NO: 73796 - DNA, 24 bp, Artificial sequence
  SiRNA target sequence
ttagtggctgtattgaccgaactt

SEQ ID NO: 73797 - DNA, 24 bp, Artificial sequence
  SiRNA target sequence
tagtggctgtattgaccgaactta

SEQ ID NO: 73798 - DNA, 24 bp, Artificial sequence
  SiRNA target sequence
agtggctgtattgaccgaacttaa

SEQ ID NO: 73799 - DNA, 24 bp, Artificial sequence
  SiRNA target sequence
gtggctgtattgaccgaacttaat

SEQ ID NO: 73800 - DNA, 24 bp, Artificial sequence
  SiRNA target sequence
tggctgtattgaccgaacttaatg

SEQ ID NO: 73801 - DNA, 24 bp, Artificial sequence
  SiRNA target sequence
ggctgtattgaccgaacttaatgg

SEQ ID NO: 73802 - DNA, 24 bp, Artificial sequence
  SiRNA target sequence
gctgtattgaccgaacttaatgga

SEQ ID NO: 73803 - DNA, 24 bp, Artificial sequence
  SiRNA target sequence
ctgtattgaccgaacttaatggat

SEQ ID NO: 73804 - DNA, 24 bp, Artificial sequence
  SiRNA target sequence
tgtattgaccgaacttaatggatt

SEQ ID NO: 73805 - DNA, 24 bp, Artificial sequence
  SiRNA target sequence
gtattgaccgaacttaatggattt

SEQ ID NO: 73806 - DNA, 24 bp, Artificial sequence
  SiRNA target sequence
tattgaccgaacttaatggattta

SEQ ID NO: 73807 - DNA, 24 bp, Artificial sequence
  SiRNA target sequence
attgaccgaacttaatggatttat

SEQ ID NO: 73808 - DNA, 24 bp, Artificial sequence
  SiRNA target sequence
ttgaccgaacttaatggatttatt

SEQ ID NO: 73809 - DNA, 24 bp, Artificial sequence
  SiRNA target sequence
tgaccgaacttaatggatttattt

SEQ ID NO: 73810 - DNA, 24 bp, Artificial sequence
  SiRNA target sequence
gaccgaacttaatggatttatttt

SEQ ID NO: 73811 - DNA, 24 bp, Artificial sequence
  SiRNA target sequence
accgaacttaatggatttattttt

SEQ ID NO: 73812 - DNA, 24 bp, Artificial sequence
  SiRNA target sequence
ccgaacttaatggatttattttta

SEQ ID NO: 73813 - DNA, 24 bp, Artificial sequence
  SiRNA target sequence
cgaacttaatggatttatttttac

SEQ ID NO: 73814 - DNA, 24 bp, Artificial sequence
  SiRNA target sequence
gaacttaatggatttatttttaca

SEQ ID NO: 73815 - DNA, 24 bp, Artificial sequence
  SiRNA target sequence
aacttaatggatttatttttacag

SEQ ID NO: 73816 - DNA, 24 bp, Artificial sequence
  SiRNA target sequence
acttaatggatttatttttacagg

SEQ ID NO: 73817 - DNA, 24 bp, Artificial sequence
  SiRNA target sequence
cttaatggatttatttttacaggt

SEQ ID NO: 73818 - DNA, 24 bp, Artificial sequence
  SiRNA target sequence
ttaatggatttatttttacaggtg

SEQ ID NO: 73819 - DNA, 24 bp, Artificial sequence
  SiRNA target sequence
taatggatttatttttacaggtgt

SEQ ID NO: 73820 - DNA, 24 bp, Artificial sequence
  SiRNA target sequence
aatggatttatttttacaggtgta

SEQ ID NO: 73821 - DNA, 24 bp, Artificial sequence
  SiRNA target sequence
atggatttatttttacaggtgtag

SEQ ID NO: 73822 - DNA, 24 bp, Artificial sequence
  SiRNA target sequence
tggatttatttttacaggtgtagt

SEQ ID NO: 73823 - DNA, 24 bp, Artificial sequence
  SiRNA target sequence
ggatttatttttacaggtgtagtg

SEQ ID NO: 73824 - DNA, 24 bp, Artificial sequence
  SiRNA target sequence
gatttatttttacaggtgtagtgc

SEQ ID NO: 73825 - DNA, 24 bp, Artificial sequence
  SiRNA target sequence
atttatttttacaggtgtagtgca

SEQ ID NO: 73826 - DNA, 24 bp, Artificial sequence
  SiRNA target sequence
tttatttttacaggtgtagtgcaa

SEQ ID NO: 73827 - DNA, 24 bp, Artificial sequence
  SiRNA target sequence
ttatttttacaggtgtagtgcaat

SEQ ID NO: 73828 - DNA, 24 bp, Artificial sequence
  SiRNA target sequence
tatttttacaggtgtagtgcaata

SEQ ID NO: 73829 - DNA, 24 bp, Artificial sequence
  SiRNA target sequence
atttttacaggtgtagtgcaatat

SEQ ID NO: 73830 - DNA, 24 bp, Artificial sequence
  SiRNA target sequence
tttttacaggtgtagtgcaatata

SEQ ID NO: 73831 - DNA, 24 bp, Artificial sequence
  SiRNA target sequence
ttttacaggtgtagtgcaatatat

SEQ ID NO: 73832 - DNA, 24 bp, Artificial sequence
  SiRNA target sequence
tttacaggtgtagtgcaatatatt

SEQ ID NO: 73833 - DNA, 24 bp, Artificial sequence
  SiRNA target sequence
ttacaggtgtagtgcaatatattt

SEQ ID NO: 73834 - DNA, 24 bp, Artificial sequence
  SiRNA target sequence
tacaggtgtagtgcaatatattta

SEQ ID NO: 73835 - DNA, 24 bp, Artificial sequence
  SiRNA target sequence
acaggtgtagtgcaatatatttat

SEQ ID NO: 73836 - DNA, 24 bp, Artificial sequence
  SiRNA target sequence
caggtgtagtgcaatatatttata

SEQ ID NO: 73837 - DNA, 24 bp, Artificial sequence
  SiRNA target sequence
aggtgtagtgcaatatatttatag

SEQ ID NO: 73838 - DNA, 24 bp, Artificial sequence
  SiRNA target sequence
ggtgtagtgcaatatatttataga

SEQ ID NO: 73839 - DNA, 24 bp, Artificial sequence
  SiRNA target sequence
gtgtagtgcaatatatttatagaa

SEQ ID NO: 73840 - DNA, 24 bp, Artificial sequence
  SiRNA target sequence
tgtagtgcaatatatttatagaaa

SEQ ID NO: 73841 - DNA, 24 bp, Artificial sequence
  SiRNA target sequence
gtagtgcaatatatttatagaaat

SEQ ID NO: 73842 - DNA, 24 bp, Artificial sequence
  SiRNA target sequence
tagtgcaatatatttatagaaata

SEQ ID NO: 73843 - DNA, 24 bp, Artificial sequence
  SiRNA target sequence
agtgcaatatatttatagaaatac

SEQ ID NO: 73844 - DNA, 24 bp, Artificial sequence
  SiRNA target sequence
gtgcaatatatttatagaaatacg

SEQ ID NO: 73845 - DNA, 24 bp, Artificial sequence
  SiRNA target sequence
tgcaatatatttatagaaatacgg

SEQ ID NO: 73846 - DNA, 24 bp, Artificial sequence
  SiRNA target sequence
gcaatatatttatagaaatacggc

SEQ ID NO: 73847 - DNA, 24 bp, Artificial sequence
  SiRNA target sequence
caatatatttatagaaatacggca

SEQ ID NO: 73848 - DNA, 24 bp, Artificial sequence
  SiRNA target sequence
aatatatttatagaaatacggcaa

SEQ ID NO: 73849 - DNA, 24 bp, Artificial sequence
  SiRNA target sequence
atatatttatagaaatacggcaaa

SEQ ID NO: 73850 - DNA, 24 bp, Artificial sequence
  SiRNA target sequence
tatatttatagaaatacggcaaaa

SEQ ID NO: 73851 - DNA, 24 bp, Artificial sequence
  SiRNA target sequence
atatttatagaaatacggcaaaat

SEQ ID NO: 73852 - DNA, 24 bp, Artificial sequence
  SiRNA target sequence
tatttatagaaatacggcaaaatc

SEQ ID NO: 73853 - DNA, 24 bp, Artificial sequence
  SiRNA target sequence
atttatagaaatacggcaaaatct

SEQ ID NO: 73854 - DNA, 24 bp, Artificial sequence
  SiRNA target sequence
tttatagaaatacggcaaaatcta

SEQ ID NO: 73855 - DNA, 24 bp, Artificial sequence
  SiRNA target sequence
ttatagaaatacggcaaaatctac

SEQ ID NO: 73856 - DNA, 24 bp, Artificial sequence
  SiRNA target sequence
tatagaaatacggcaaaatctaca

SEQ ID NO: 73857 - DNA, 24 bp, Artificial sequence
  SiRNA target sequence
atagaaatacggcaaaatctacat

SEQ ID NO: 73858 - DNA, 24 bp, Artificial sequence
  SiRNA target sequence
tagaaatacggcaaaatctacatt

SEQ ID NO: 73859 - DNA, 24 bp, Artificial sequence
  SiRNA target sequence
agaaatacggcaaaatctacattc

SEQ ID NO: 73860 - DNA, 24 bp, Artificial sequence
  SiRNA target sequence
gaaatacggcaaaatctacattca

SEQ ID NO: 73861 - DNA, 24 bp, Artificial sequence
  SiRNA target sequence
aaatacggcaaaatctacattcaa

SEQ ID NO: 73862 - DNA, 24 bp, Artificial sequence
  SiRNA target sequence
aatacggcaaaatctacattcaaa

SEQ ID NO: 73863 - DNA, 24 bp, Artificial sequence
  SiRNA target sequence
atacggcaaaatctacattcaaag

SEQ ID NO: 73864 - DNA, 24 bp, Artificial sequence
  SiRNA target sequence
tacggcaaaatctacattcaaagg

SEQ ID NO: 73865 - DNA, 24 bp, Artificial sequence
  SiRNA target sequence
acggcaaaatctacattcaaaggc

SEQ ID NO: 73866 - DNA, 24 bp, Artificial sequence
  SiRNA target sequence
cggcaaaatctacattcaaaggct

SEQ ID NO: 73867 - DNA, 24 bp, Artificial sequence
  SiRNA target sequence
ggcaaaatctacattcaaaggctt

SEQ ID NO: 73868 - DNA, 24 bp, Artificial sequence
  SiRNA target sequence
gcaaaatctacattcaaaggcttc

SEQ ID NO: 73869 - DNA, 24 bp, Artificial sequence
  SiRNA target sequence
caaaatctacattcaaaggcttca

SEQ ID NO: 73870 - DNA, 24 bp, Artificial sequence
  SiRNA target sequence
aaaatctacattcaaaggcttcat

SEQ ID NO: 73871 - DNA, 24 bp, Artificial sequence
  SiRNA target sequence
aaatctacattcaaaggcttcatt

SEQ ID NO: 73872 - DNA, 24 bp, Artificial sequence
  SiRNA target sequence
aatctacattcaaaggcttcattt

SEQ ID NO: 73873 - DNA, 24 bp, Artificial sequence
  SiRNA target sequence
atctacattcaaaggcttcatttc

SEQ ID NO: 73874 - DNA, 24 bp, Artificial sequence
  SiRNA target sequence
tctacattcaaaggcttcatttct

SEQ ID NO: 73875 - DNA, 24 bp, Artificial sequence
  SiRNA target sequence
ctacattcaaaggcttcatttctc

SEQ ID NO: 73876 - DNA, 24 bp, Artificial sequence
  SiRNA target sequence
tacattcaaaggcttcatttctct

SEQ ID NO: 73877 - DNA, 24 bp, Artificial sequence
  SiRNA target sequence
acattcaaaggcttcatttctctt

SEQ ID NO: 73878 - DNA, 24 bp, Artificial sequence
  SiRNA target sequence
cattcaaaggcttcatttctcttt

SEQ ID NO: 73879 - DNA, 24 bp, Artificial sequence
  SiRNA target sequence
attcaaaggcttcatttctctttc

SEQ ID NO: 73880 - DNA, 24 bp, Artificial sequence
  SiRNA target sequence
ttcaaaggcttcatttctctttca

SEQ ID NO: 73881 - DNA, 24 bp, Artificial sequence
  SiRNA target sequence
tcaaaggcttcatttctctttcac

SEQ ID NO: 73882 - DNA, 24 bp, Artificial sequence
  SiRNA target sequence
caaaggcttcatttctctttcacc

SEQ ID NO: 73883 - DNA, 24 bp, Artificial sequence
  SiRNA target sequence
aaaggcttcatttctctttcacct

SEQ ID NO: 73884 - DNA, 24 bp, Artificial sequence
  SiRNA target sequence
aaggcttcatttctctttcaccta

SEQ ID NO: 73885 - DNA, 24 bp, Artificial sequence
  SiRNA target sequence
aggcttcatttctctttcacctaa

SEQ ID NO: 73886 - DNA, 24 bp, Artificial sequence
  SiRNA target sequence
ggcttcatttctctttcacctaaa

SEQ ID NO: 73887 - DNA, 24 bp, Artificial sequence
  SiRNA target sequence
gcttcatttctctttcacctaaaa

SEQ ID NO: 73888 - DNA, 24 bp, Artificial sequence
  SiRNA target sequence
cttcatttctctttcacctaaaaa

SEQ ID NO: 73889 - DNA, 24 bp, Artificial sequence
  SiRNA target sequence
ttcatttctctttcacctaaaaat

SEQ ID NO: 73890 - DNA, 24 bp, Artificial sequence
  SiRNA target sequence
tcatttctctttcacctaaaaatt

SEQ ID NO: 73891 - DNA, 24 bp, Artificial sequence
  SiRNA target sequence
catttctctttcacctaaaaattt

SEQ ID NO: 73892 - DNA, 24 bp, Artificial sequence
  SiRNA target sequence
atttctctttcacctaaaaatttt

SEQ ID NO: 73893 - DNA, 24 bp, Artificial sequence
  SiRNA target sequence
tttctctttcacctaaaaatttta

SEQ ID NO: 73894 - DNA, 24 bp, Artificial sequence
  SiRNA target sequence
ttctctttcacctaaaaattttag

SEQ ID NO: 73895 - DNA, 24 bp, Artificial sequence
  SiRNA target sequence
tctctttcacctaaaaattttagt

SEQ ID NO: 73896 - DNA, 24 bp, Artificial sequence
  SiRNA target sequence
ctctttcacctaaaaattttagta

SEQ ID NO: 73897 - DNA, 24 bp, Artificial sequence
  SiRNA target sequence
tctttcacctaaaaattttagtac

SEQ ID NO: 73898 - DNA, 24 bp, Artificial sequence
  SiRNA target sequence
ctttcacctaaaaattttagtacc

SEQ ID NO: 73899 - DNA, 24 bp, Artificial sequence
  SiRNA target sequence
tttcacctaaaaattttagtacca

SEQ ID NO: 73900 - DNA, 24 bp, Artificial sequence
  SiRNA target sequence
ttcacctaaaaattttagtaccat

SEQ ID NO: 73901 - DNA, 24 bp, Artificial sequence
  SiRNA target sequence
tcacctaaaaattttagtaccata

SEQ ID NO: 73902 - DNA, 24 bp, Artificial sequence
  SiRNA target sequence
cacctaaaaattttagtaccatag

SEQ ID NO: 73903 - DNA, 24 bp, Artificial sequence
  SiRNA target sequence
acctaaaaattttagtaccatagg

SEQ ID NO: 73904 - DNA, 24 bp, Artificial sequence
  SiRNA target sequence
cctaaaaattttagtaccataggt

SEQ ID NO: 73905 - DNA, 24 bp, Artificial sequence
  SiRNA target sequence
ctaaaaattttagtaccataggtg

SEQ ID NO: 73906 - DNA, 24 bp, Artificial sequence
  SiRNA target sequence
taaaaattttagtaccataggtgg

SEQ ID NO: 73907 - DNA, 24 bp, Artificial sequence
  SiRNA target sequence
aaaaattttagtaccataggtggc

SEQ ID NO: 73908 - DNA, 24 bp, Artificial sequence
  SiRNA target sequence
aaaattttagtaccataggtggcg

SEQ ID NO: 73909 - DNA, 24 bp, Artificial sequence
  SiRNA target sequence
aaattttagtaccataggtggcgg

SEQ ID NO: 73910 - DNA, 24 bp, Artificial sequence
  SiRNA target sequence
aattttagtaccataggtggcgga

SEQ ID NO: 73911 - DNA, 24 bp, Artificial sequence
  SiRNA target sequence
attttagtaccataggtggcggag

SEQ ID NO: 73912 - DNA, 24 bp, Artificial sequence
  SiRNA target sequence
ttttagtaccataggtggcggaga

SEQ ID NO: 73913 - DNA, 24 bp, Artificial sequence
  SiRNA target sequence
tttagtaccataggtggcggagaa

SEQ ID NO: 73914 - DNA, 24 bp, Artificial sequence
  SiRNA target sequence
ttagtaccataggtggcggagaaa

SEQ ID NO: 73915 - DNA, 24 bp, Artificial sequence
  SiRNA target sequence
tagtaccataggtggcggagaaat

SEQ ID NO: 73916 - DNA, 24 bp, Artificial sequence
  SiRNA target sequence
agtaccataggtggcggagaaatt

SEQ ID NO: 73917 - DNA, 24 bp, Artificial sequence
  SiRNA target sequence
gtaccataggtggcggagaaattc

SEQ ID NO: 73918 - DNA, 24 bp, Artificial sequence
  SiRNA target sequence
taccataggtggcggagaaattca

SEQ ID NO: 73919 - DNA, 24 bp, Artificial sequence
  SiRNA target sequence
accataggtggcggagaaattcaa

SEQ ID NO: 73920 - DNA, 24 bp, Artificial sequence
  SiRNA target sequence
ccataggtggcggagaaattcaaa

SEQ ID NO: 73921 - DNA, 24 bp, Artificial sequence
  SiRNA target sequence
cataggtggcggagaaattcaaac

SEQ ID NO: 73922 - DNA, 24 bp, Artificial sequence
  SiRNA target sequence
ataggtggcggagaaattcaaaca

SEQ ID NO: 73923 - DNA, 24 bp, Artificial sequence
  SiRNA target sequence
taggtggcggagaaattcaaacaa

SEQ ID NO: 73924 - DNA, 24 bp, Artificial sequence
  SiRNA target sequence
aggtggcggagaaattcaaacaat

SEQ ID NO: 73925 - DNA, 24 bp, Artificial sequence
  SiRNA target sequence
ggtggcggagaaattcaaacaata

SEQ ID NO: 73926 - DNA, 24 bp, Artificial sequence
  SiRNA target sequence
gtggcggagaaattcaaacaataa

SEQ ID NO: 73927 - DNA, 24 bp, Artificial sequence
  SiRNA target sequence
tggcggagaaattcaaacaataat

SEQ ID NO: 73928 - DNA, 24 bp, Artificial sequence
  SiRNA target sequence
ggcggagaaattcaaacaataata

SEQ ID NO: 73929 - DNA, 24 bp, Artificial sequence
  SiRNA target sequence
gcggagaaattcaaacaataatag

SEQ ID NO: 73930 - DNA, 24 bp, Artificial sequence
  SiRNA target sequence
cggagaaattcaaacaataataga

SEQ ID NO: 73931 - DNA, 24 bp, Artificial sequence
  SiRNA target sequence
ggagaaattcaaacaataatagat

SEQ ID NO: 73932 - DNA, 24 bp, Artificial sequence
  SiRNA target sequence
gagaaattcaaacaataatagata

SEQ ID NO: 73933 - DNA, 24 bp, Artificial sequence
  SiRNA target sequence
agaaattcaaacaataatagatag

SEQ ID NO: 73934 - DNA, 24 bp, Artificial sequence
  SiRNA target sequence
gaaattcaaacaataatagataga

SEQ ID NO: 73935 - DNA, 24 bp, Artificial sequence
  SiRNA target sequence
aaattcaaacaataatagatagaa

SEQ ID NO: 73936 - DNA, 24 bp, Artificial sequence
  SiRNA target sequence
aattcaaacaataatagatagaaa

SEQ ID NO: 73937 - DNA, 24 bp, Artificial sequence
  SiRNA target sequence
attcaaacaataatagatagaaaa

SEQ ID NO: 73938 - DNA, 24 bp, Artificial sequence
  SiRNA target sequence
ttcaaacaataatagatagaaaat

SEQ ID NO: 73939 - DNA, 24 bp, Artificial sequence
  SiRNA target sequence
tcaaacaataatagatagaaaatc

SEQ ID NO: 73940 - DNA, 24 bp, Artificial sequence
  SiRNA target sequence
caaacaataatagatagaaaatca

SEQ ID NO: 73941 - DNA, 24 bp, Artificial sequence
  SiRNA target sequence
aaacaataatagatagaaaatcaa

SEQ ID NO: 73942 - DNA, 24 bp, Artificial sequence
  SiRNA target sequence
aacaataatagatagaaaatcaaa

SEQ ID NO: 73943 - DNA, 24 bp, Artificial sequence
  SiRNA target sequence
acaataatagatagaaaatcaaaa

SEQ ID NO: 73944 - DNA, 24 bp, Artificial sequence
  SiRNA target sequence
caataatagatagaaaatcaaaat

SEQ ID NO: 73945 - DNA, 24 bp, Artificial sequence
  SiRNA target sequence
aataatagatagaaaatcaaaatc

SEQ ID NO: 73946 - DNA, 24 bp, Artificial sequence
  SiRNA target sequence
ataatagatagaaaatcaaaatct

SEQ ID NO: 73947 - DNA, 24 bp, Artificial sequence
  SiRNA target sequence
taatagatagaaaatcaaaatctg

SEQ ID NO: 73948 - DNA, 24 bp, Artificial sequence
  SiRNA target sequence
aatagatagaaaatcaaaatctgc

SEQ ID NO: 73949 - DNA, 24 bp, Artificial sequence
  SiRNA target sequence
atagatagaaaatcaaaatctgca

SEQ ID NO: 73950 - DNA, 24 bp, Artificial sequence
  SiRNA target sequence
tagatagaaaatcaaaatctgcaa

SEQ ID NO: 73951 - DNA, 24 bp, Artificial sequence
  SiRNA target sequence
agatagaaaatcaaaatctgcaag

SEQ ID NO: 73952 - DNA, 24 bp, Artificial sequence
  SiRNA target sequence
gatagaaaatcaaaatctgcaagt

SEQ ID NO: 73953 - DNA, 24 bp, Artificial sequence
  SiRNA target sequence
atagaaaatcaaaatctgcaagtg

SEQ ID NO: 73954 - DNA, 24 bp, Artificial sequence
  SiRNA target sequence
tagaaaatcaaaatctgcaagtga

SEQ ID NO: 73955 - DNA, 24 bp, Artificial sequence
  SiRNA target sequence
agaaaatcaaaatctgcaagtgaa

SEQ ID NO: 73956 - DNA, 24 bp, Artificial sequence
  SiRNA target sequence
gaaaatcaaaatctgcaagtgaac

SEQ ID NO: 73957 - DNA, 24 bp, Artificial sequence
  SiRNA target sequence
aaaatcaaaatctgcaagtgaact

SEQ ID NO: 73958 - DNA, 24 bp, Artificial sequence
  SiRNA target sequence
aaatcaaaatctgcaagtgaactt

SEQ ID NO: 73959 - DNA, 24 bp, Artificial sequence
  SiRNA target sequence
aatcaaaatctgcaagtgaactta

SEQ ID NO: 73960 - DNA, 24 bp, Artificial sequence
  SiRNA target sequence
atcaaaatctgcaagtgaacttat

SEQ ID NO: 73961 - DNA, 24 bp, Artificial sequence
  SiRNA target sequence
tcaaaatctgcaagtgaacttatt

SEQ ID NO: 73962 - DNA, 24 bp, Artificial sequence
  SiRNA target sequence
caaaatctgcaagtgaacttattg

SEQ ID NO: 73963 - DNA, 24 bp, Artificial sequence
  SiRNA target sequence
aaaatctgcaagtgaacttattga

SEQ ID NO: 73964 - DNA, 24 bp, Artificial sequence
  SiRNA target sequence
aaatctgcaagtgaacttattgaa

SEQ ID NO: 73965 - DNA, 24 bp, Artificial sequence
  SiRNA target sequence
aatctgcaagtgaacttattgaag

SEQ ID NO: 73966 - DNA, 24 bp, Artificial sequence
  SiRNA target sequence
atctgcaagtgaacttattgaagt

SEQ ID NO: 73967 - DNA, 24 bp, Artificial sequence
  SiRNA target sequence
tctgcaagtgaacttattgaagtg

SEQ ID NO: 73968 - DNA, 24 bp, Artificial sequence
  SiRNA target sequence
ctgcaagtgaacttattgaagtgt

SEQ ID NO: 73969 - DNA, 24 bp, Artificial sequence
  SiRNA target sequence
tgcaagtgaacttattgaagtgtt

SEQ ID NO: 73970 - DNA, 24 bp, Artificial sequence
  SiRNA target sequence
gcaagtgaacttattgaagtgttt

SEQ ID NO: 73971 - DNA, 24 bp, Artificial sequence
  SiRNA target sequence
caagtgaacttattgaagtgtttc

SEQ ID NO: 73972 - DNA, 24 bp, Artificial sequence
  SiRNA target sequence
aagtgaacttattgaagtgtttct

SEQ ID NO: 73973 - DNA, 24 bp, Artificial sequence
  SiRNA target sequence
agtgaacttattgaagtgtttctt

SEQ ID NO: 73974 - DNA, 24 bp, Artificial sequence
  SiRNA target sequence
gtgaacttattgaagtgtttctta

SEQ ID NO: 73975 - DNA, 24 bp, Artificial sequence
  SiRNA target sequence
tgaacttattgaagtgtttcttac

SEQ ID NO: 73976 - DNA, 24 bp, Artificial sequence
  SiRNA target sequence
gaacttattgaagtgtttcttaca

SEQ ID NO: 73977 - DNA, 24 bp, Artificial sequence
  SiRNA target sequence
aacttattgaagtgtttcttacaa

SEQ ID NO: 73978 - DNA, 24 bp, Artificial sequence
  SiRNA target sequence
acttattgaagtgtttcttacaag

SEQ ID NO: 73979 - DNA, 24 bp, Artificial sequence
  SiRNA target sequence
cttattgaagtgtttcttacaagc

SEQ ID NO: 73980 - DNA, 24 bp, Artificial sequence
  SiRNA target sequence
ttattgaagtgtttcttacaagct

SEQ ID NO: 73981 - DNA, 24 bp, Artificial sequence
  SiRNA target sequence
tattgaagtgtttcttacaagctt

SEQ ID NO: 73982 - DNA, 24 bp, Artificial sequence
  SiRNA target sequence
attgaagtgtttcttacaagcttg

SEQ ID NO: 73983 - DNA, 24 bp, Artificial sequence
  SiRNA target sequence
ttgaagtgtttcttacaagcttgc

SEQ ID NO: 73984 - DNA, 24 bp, Artificial sequence
  SiRNA target sequence
tgaagtgtttcttacaagcttgct

SEQ ID NO: 73985 - DNA, 24 bp, Artificial sequence
  SiRNA target sequence
gaagtgtttcttacaagcttgctt

SEQ ID NO: 73986 - DNA, 24 bp, Artificial sequence
  SiRNA target sequence
aagtgtttcttacaagcttgcttc

SEQ ID NO: 73987 - DNA, 24 bp, Artificial sequence
  SiRNA target sequence
agtgtttcttacaagcttgcttcc

SEQ ID NO: 73988 - DNA, 24 bp, Artificial sequence
  SiRNA target sequence
gtgtttcttacaagcttgcttcca

SEQ ID NO: 73989 - DNA, 24 bp, Artificial sequence
  SiRNA target sequence
tgtttcttacaagcttgcttccaa

SEQ ID NO: 73990 - DNA, 24 bp, Artificial sequence
  SiRNA target sequence
gtttcttacaagcttgcttccaat

SEQ ID NO: 73991 - DNA, 24 bp, Artificial sequence
  SiRNA target sequence
tttcttacaagcttgcttccaata

SEQ ID NO: 73992 - DNA, 24 bp, Artificial sequence
  SiRNA target sequence
ttcttacaagcttgcttccaatat

SEQ ID NO: 73993 - DNA, 24 bp, Artificial sequence
  SiRNA target sequence
tcttacaagcttgcttccaatatg

SEQ ID NO: 73994 - DNA, 24 bp, Artificial sequence
  SiRNA target sequence
cttacaagcttgcttccaatatgc

SEQ ID NO: 73995 - DNA, 24 bp, Artificial sequence
  SiRNA target sequence
ttacaagcttgcttccaatatgcc

SEQ ID NO: 73996 - DNA, 24 bp, Artificial sequence
  SiRNA target sequence
tacaagcttgcttccaatatgcct

SEQ ID NO: 73997 - DNA, 24 bp, Artificial sequence
  SiRNA target sequence
acaagcttgcttccaatatgcctt

SEQ ID NO: 73998 - DNA, 24 bp, Artificial sequence
  SiRNA target sequence
caagcttgcttccaatatgcctta

SEQ ID NO: 73999 - DNA, 24 bp, Artificial sequence
  SiRNA target sequence
aagcttgcttccaatatgccttaa

SEQ ID NO: 74000 - DNA, 24 bp, Artificial sequence
  SiRNA target sequence
agcttgcttccaatatgccttaaa

SEQ ID NO: 74001 - DNA, 24 bp, Artificial sequence
  SiRNA target sequence
gcttgcttccaatatgccttaaac

SEQ ID NO: 74002 - DNA, 24 bp, Artificial sequence
  SiRNA target sequence
cttgcttccaatatgccttaaact

SEQ ID NO: 74003 - DNA, 24 bp, Artificial sequence
  SiRNA target sequence
ttgcttccaatatgccttaaactt

SEQ ID NO: 74004 - DNA, 24 bp, Artificial sequence
  SiRNA target sequence
tgcttccaatatgccttaaacttt

SEQ ID NO: 74005 - DNA, 24 bp, Artificial sequence
  SiRNA target sequence
gcttccaatatgccttaaactttt

SEQ ID NO: 74006 - DNA, 24 bp, Artificial sequence
  SiRNA target sequence
cttccaatatgccttaaactttta

SEQ ID NO: 74007 - DNA, 24 bp, Artificial sequence
  SiRNA target sequence
ttccaatatgccttaaacttttat

SEQ ID NO: 74008 - DNA, 24 bp, Artificial sequence
  SiRNA target sequence
tccaatatgccttaaacttttatt

SEQ ID NO: 74009 - DNA, 24 bp, Artificial sequence
  SiRNA target sequence
ccaatatgccttaaacttttattt

SEQ ID NO: 74010 - DNA, 24 bp, Artificial sequence
  SiRNA target sequence
caatatgccttaaacttttatttg

SEQ ID NO: 74011 - DNA, 24 bp, Artificial sequence
  SiRNA target sequence
aatatgccttaaacttttatttgc

SEQ ID NO: 74012 - DNA, 24 bp, Artificial sequence
  SiRNA target sequence
atatgccttaaacttttatttgcc

SEQ ID NO: 74013 - DNA, 24 bp, Artificial sequence
  SiRNA target sequence
tatgccttaaacttttatttgccc

SEQ ID NO: 74014 - DNA, 24 bp, Artificial sequence
  SiRNA target sequence
atgccttaaacttttatttgccct

SEQ ID NO: 74015 - DNA, 24 bp, Artificial sequence
  SiRNA target sequence
tgccttaaacttttatttgccctt

SEQ ID NO: 74016 - DNA, 24 bp, Artificial sequence
  SiRNA target sequence
gccttaaacttttatttgccctta

SEQ ID NO: 74017 - DNA, 24 bp, Artificial sequence
  SiRNA target sequence
ccttaaacttttatttgcccttat

SEQ ID NO: 74018 - DNA, 24 bp, Artificial sequence
  SiRNA target sequence
cttaaacttttatttgcccttatt

SEQ ID NO: 74019 - DNA, 24 bp, Artificial sequence
  SiRNA target sequence
ttaaacttttatttgcccttattg

SEQ ID NO: 74020 - DNA, 24 bp, Artificial sequence
  SiRNA target sequence
taaacttttatttgcccttattgc

SEQ ID NO: 74021 - DNA, 24 bp, Artificial sequence
  SiRNA target sequence
aaacttttatttgcccttattgca

SEQ ID NO: 74022 - DNA, 24 bp, Artificial sequence
  SiRNA target sequence
aacttttatttgcccttattgcag

SEQ ID NO: 74023 - DNA, 24 bp, Artificial sequence
  SiRNA target sequence
acttttatttgcccttattgcagt

SEQ ID NO: 74024 - DNA, 24 bp, Artificial sequence
  SiRNA target sequence
cttttatttgcccttattgcagtt

SEQ ID NO: 74025 - DNA, 24 bp, Artificial sequence
  SiRNA target sequence
ttttatttgcccttattgcagtta

SEQ ID NO: 74026 - DNA, 24 bp, Artificial sequence
  SiRNA target sequence
tttatttgcccttattgcagttat

SEQ ID NO: 74027 - DNA, 24 bp, Artificial sequence
  SiRNA target sequence
ttatttgcccttattgcagttata

SEQ ID NO: 74028 - DNA, 24 bp, Artificial sequence
  SiRNA target sequence
tatttgcccttattgcagttataa

SEQ ID NO: 74029 - DNA, 24 bp, Artificial sequence
  SiRNA target sequence
atttgcccttattgcagttataaa

SEQ ID NO: 74030 - DNA, 24 bp, Artificial sequence
  SiRNA target sequence
tttgcccttattgcagttataaaa

SEQ ID NO: 74031 - DNA, 24 bp, Artificial sequence
  SiRNA target sequence
ttgcccttattgcagttataaaaa

SEQ ID NO: 74032 - DNA, 24 bp, Artificial sequence
  SiRNA target sequence
tgcccttattgcagttataaaaaa

SEQ ID NO: 74033 - DNA, 24 bp, Artificial sequence
  SiRNA target sequence
gcccttattgcagttataaaaaat

SEQ ID NO: 74034 - DNA, 24 bp, Artificial sequence
  SiRNA target sequence
cccttattgcagttataaaaaata

SEQ ID NO: 74035 - DNA, 24 bp, Artificial sequence
  SiRNA target sequence
ccttattgcagttataaaaaatat

SEQ ID NO: 74036 - DNA, 24 bp, Artificial sequence
  SiRNA target sequence
cttattgcagttataaaaaatatg

SEQ ID NO: 74037 - DNA, 24 bp, Artificial sequence
  SiRNA target sequence
ttattgcagttataaaaaatatgg

SEQ ID NO: 74038 - DNA, 24 bp, Artificial sequence
  SiRNA target sequence
tattgcagttataaaaaatatggg

SEQ ID NO: 74039 - DNA, 24 bp, Artificial sequence
  SiRNA target sequence
attgcagttataaaaaatatggga

SEQ ID NO: 74040 - DNA, 24 bp, Artificial sequence
  SiRNA target sequence
ttgcagttataaaaaatatgggag

SEQ ID NO: 74041 - DNA, 24 bp, Artificial sequence
  SiRNA target sequence
tgcagttataaaaaatatgggagg

SEQ ID NO: 74042 - DNA, 24 bp, Artificial sequence
  SiRNA target sequence
gcagttataaaaaatatgggaggt

SEQ ID NO: 74043 - DNA, 24 bp, Artificial sequence
  SiRNA target sequence
cagttataaaaaatatgggaggtc

SEQ ID NO: 74044 - DNA, 24 bp, Artificial sequence
  SiRNA target sequence
agttataaaaaatatgggaggtct

SEQ ID NO: 74045 - DNA, 24 bp, Artificial sequence
  SiRNA target sequence
gttataaaaaatatgggaggtctt

SEQ ID NO: 74046 - DNA, 24 bp, Artificial sequence
  SiRNA target sequence
ttataaaaaatatgggaggtcttg

SEQ ID NO: 74047 - DNA, 24 bp, Artificial sequence
  SiRNA target sequence
tataaaaaatatgggaggtcttgc

SEQ ID NO: 74048 - DNA, 24 bp, Artificial sequence
  SiRNA target sequence
ataaaaaatatgggaggtcttgcg

SEQ ID NO: 74049 - DNA, 24 bp, Artificial sequence
  SiRNA target sequence
taaaaaatatgggaggtcttgcgg

SEQ ID NO: 74050 - DNA, 24 bp, Artificial sequence
  SiRNA target sequence
aaaaaatatgggaggtcttgcggg

SEQ ID NO: 74051 - DNA, 24 bp, Artificial sequence
  SiRNA target sequence
aaaaatatgggaggtcttgcgggc

SEQ ID NO: 74052 - DNA, 24 bp, Artificial sequence
  SiRNA target sequence
aaaatatgggaggtcttgcgggct

SEQ ID NO: 74053 - DNA, 24 bp, Artificial sequence
  SiRNA target sequence
aaatatgggaggtcttgcgggctt

SEQ ID NO: 74054 - DNA, 24 bp, Artificial sequence
  SiRNA target sequence
aatatgggaggtcttgcgggcttc

SEQ ID NO: 74055 - DNA, 24 bp, Artificial sequence
  SiRNA target sequence
atatgggaggtcttgcgggcttca

SEQ ID NO: 74056 - DNA, 24 bp, Artificial sequence
  SiRNA target sequence
tatgggaggtcttgcgggcttcat

SEQ ID NO: 74057 - DNA, 24 bp, Artificial sequence
  SiRNA target sequence
atgggaggtcttgcgggcttcata

SEQ ID NO: 74058 - DNA, 24 bp, Artificial sequence
  SiRNA target sequence
tgggaggtcttgcgggcttcataa

SEQ ID NO: 74059 - DNA, 24 bp, Artificial sequence
  SiRNA target sequence
gggaggtcttgcgggcttcataat

SEQ ID NO: 74060 - DNA, 24 bp, Artificial sequence
  SiRNA target sequence
ggaggtcttgcgggcttcataatg

SEQ ID NO: 74061 - DNA, 24 bp, Artificial sequence
  SiRNA target sequence
gaggtcttgcgggcttcataatgt

SEQ ID NO: 74062 - DNA, 24 bp, Artificial sequence
  SiRNA target sequence
aggtcttgcgggcttcataatgtt

SEQ ID NO: 74063 - DNA, 24 bp, Artificial sequence
  SiRNA target sequence
ggtcttgcgggcttcataatgttt

SEQ ID NO: 74064 - DNA, 24 bp, Artificial sequence
  SiRNA target sequence
gtcttgcgggcttcataatgtttg

SEQ ID NO: 74065 - DNA, 24 bp, Artificial sequence
  SiRNA target sequence
tcttgcgggcttcataatgtttgt

SEQ ID NO: 74066 - DNA, 24 bp, Artificial sequence
  SiRNA target sequence
cttgcgggcttcataatgtttgtt

SEQ ID NO: 74067 - DNA, 24 bp, Artificial sequence
  SiRNA target sequence
ttgcgggcttcataatgtttgttt

SEQ ID NO: 74068 - DNA, 24 bp, Artificial sequence
  SiRNA target sequence
tgcgggcttcataatgtttgtttg

SEQ ID NO: 74069 - DNA, 24 bp, Artificial sequence
  SiRNA target sequence
gcgggcttcataatgtttgtttgt

SEQ ID NO: 74070 - DNA, 24 bp, Artificial sequence
  SiRNA target sequence
cgggcttcataatgtttgtttgtg

SEQ ID NO: 74071 - DNA, 24 bp, Artificial sequence
  SiRNA target sequence
gggcttcataatgtttgtttgtgt

SEQ ID NO: 74072 - DNA, 24 bp, Artificial sequence
  SiRNA target sequence
ggcttcataatgtttgtttgtgtt

SEQ ID NO: 74073 - DNA, 24 bp, Artificial sequence
  SiRNA target sequence
gcttcataatgtttgtttgtgttt

SEQ ID NO: 74074 - DNA, 24 bp, Artificial sequence
  SiRNA target sequence
cttcataatgtttgtttgtgtttc

SEQ ID NO: 74075 - DNA, 24 bp, Artificial sequence
  SiRNA target sequence
ttcataatgtttgtttgtgtttct

SEQ ID NO: 74076 - DNA, 24 bp, Artificial sequence
  SiRNA target sequence
tcataatgtttgtttgtgtttctt

SEQ ID NO: 74077 - DNA, 24 bp, Artificial sequence
  SiRNA target sequence
cataatgtttgtttgtgtttcttg

SEQ ID NO: 74078 - DNA, 24 bp, Artificial sequence
  SiRNA target sequence
ataatgtttgtttgtgtttcttgc

SEQ ID NO: 74079 - DNA, 24 bp, Artificial sequence
  SiRNA target sequence
taatgtttgtttgtgtttcttgct

SEQ ID NO: 74080 - DNA, 24 bp, Artificial sequence
  SiRNA target sequence
aatgtttgtttgtgtttcttgcta

SEQ ID NO: 74081 - DNA, 24 bp, Artificial sequence
  SiRNA target sequence
atgtttgtttgtgtttcttgctat

SEQ ID NO: 74082 - DNA, 24 bp, Artificial sequence
  SiRNA target sequence
tgtttgtttgtgtttcttgctatg

SEQ ID NO: 74083 - DNA, 24 bp, Artificial sequence
  SiRNA target sequence
gtttgtttgtgtttcttgctatgc

SEQ ID NO: 74084 - DNA, 24 bp, Artificial sequence
  SiRNA target sequence
tttgtttgtgtttcttgctatgcg

SEQ ID NO: 74085 - DNA, 24 bp, Artificial sequence
  SiRNA target sequence
ttgtttgtgtttcttgctatgcga

SEQ ID NO: 74086 - DNA, 24 bp, Artificial sequence
  SiRNA target sequence
tgtttgtgtttcttgctatgcgac

SEQ ID NO: 74087 - DNA, 24 bp, Artificial sequence
  SiRNA target sequence
gtttgtgtttcttgctatgcgact

SEQ ID NO: 74088 - DNA, 24 bp, Artificial sequence
  SiRNA target sequence
tttgtgtttcttgctatgcgactg

SEQ ID NO: 74089 - DNA, 24 bp, Artificial sequence
  SiRNA target sequence
ttgtgtttcttgctatgcgactgt

SEQ ID NO: 74090 - DNA, 24 bp, Artificial sequence
  SiRNA target sequence
tgtgtttcttgctatgcgactgtg

SEQ ID NO: 74091 - DNA, 24 bp, Artificial sequence
  SiRNA target sequence
gtgtttcttgctatgcgactgtga

SEQ ID NO: 74092 - DNA, 24 bp, Artificial sequence
  SiRNA target sequence
tgtttcttgctatgcgactgtgac

SEQ ID NO: 74093 - DNA, 24 bp, Artificial sequence
  SiRNA target sequence
gtttcttgctatgcgactgtgact

SEQ ID NO: 74094 - DNA, 24 bp, Artificial sequence
  SiRNA target sequence
tttcttgctatgcgactgtgacta

SEQ ID NO: 74095 - DNA, 24 bp, Artificial sequence
  SiRNA target sequence
ttcttgctatgcgactgtgactat

SEQ ID NO: 74096 - DNA, 24 bp, Artificial sequence
  SiRNA target sequence
tcttgctatgcgactgtgactata

SEQ ID NO: 74097 - DNA, 24 bp, Artificial sequence
  SiRNA target sequence
cttgctatgcgactgtgactatat

SEQ ID NO: 74098 - DNA, 24 bp, Artificial sequence
  SiRNA target sequence
ttgctatgcgactgtgactatatt

SEQ ID NO: 74099 - DNA, 24 bp, Artificial sequence
  SiRNA target sequence
tgctatgcgactgtgactatattg

SEQ ID NO: 74100 - DNA, 24 bp, Artificial sequence
  SiRNA target sequence
gctatgcgactgtgactatattga

SEQ ID NO: 74101 - DNA, 24 bp, Artificial sequence
  SiRNA target sequence
ctatgcgactgtgactatattgat

SEQ ID NO: 74102 - DNA, 24 bp, Artificial sequence
  SiRNA target sequence
tatgcgactgtgactatattgata

SEQ ID NO: 74103 - DNA, 24 bp, Artificial sequence
  SiRNA target sequence
atgcgactgtgactatattgatag

SEQ ID NO: 74104 - DNA, 24 bp, Artificial sequence
  SiRNA target sequence
tgcgactgtgactatattgatagc

SEQ ID NO: 74105 - DNA, 24 bp, Artificial sequence
  SiRNA target sequence
gcgactgtgactatattgatagca

SEQ ID NO: 74106 - DNA, 24 bp, Artificial sequence
  SiRNA target sequence
cgactgtgactatattgatagcac

SEQ ID NO: 74107 - DNA, 24 bp, Artificial sequence
  SiRNA target sequence
gactgtgactatattgatagcaca

SEQ ID NO: 74108 - DNA, 24 bp, Artificial sequence
  SiRNA target sequence
actgtgactatattgatagcacaa

SEQ ID NO: 74109 - DNA, 24 bp, Artificial sequence
  SiRNA target sequence
ctgtgactatattgatagcacaat

SEQ ID NO: 74110 - DNA, 24 bp, Artificial sequence
  SiRNA target sequence
tgtgactatattgatagcacaatg

SEQ ID NO: 74111 - DNA, 24 bp, Artificial sequence
  SiRNA target sequence
gtgactatattgatagcacaatgg

SEQ ID NO: 74112 - DNA, 24 bp, Artificial sequence
  SiRNA target sequence
tgactatattgatagcacaatgga

SEQ ID NO: 74113 - DNA, 24 bp, Artificial sequence
  SiRNA target sequence
gactatattgatagcacaatggag

SEQ ID NO: 74114 - DNA, 24 bp, Artificial sequence
  SiRNA target sequence
actatattgatagcacaatggaga

SEQ ID NO: 74115 - DNA, 24 bp, Artificial sequence
  SiRNA target sequence
ctatattgatagcacaatggagat

SEQ ID NO: 74116 - DNA, 24 bp, Artificial sequence
  SiRNA target sequence
tatattgatagcacaatggagatc

SEQ ID NO: 74117 - DNA, 24 bp, Artificial sequence
  SiRNA target sequence
atattgatagcacaatggagatct

SEQ ID NO: 74118 - DNA, 24 bp, Artificial sequence
  SiRNA target sequence
tattgatagcacaatggagatcta

SEQ ID NO: 74119 - DNA, 24 bp, Artificial sequence
  SiRNA target sequence
attgatagcacaatggagatctaa

SEQ ID NO: 74120 - DNA, 24 bp, Artificial sequence
  SiRNA target sequence
ttgatagcacaatggagatctaat

SEQ ID NO: 74121 - DNA, 24 bp, Artificial sequence
  SiRNA target sequence
tgatagcacaatggagatctaata

SEQ ID NO: 74122 - DNA, 24 bp, Artificial sequence
  SiRNA target sequence
gatagcacaatggagatctaatat

SEQ ID NO: 74123 - DNA, 24 bp, Artificial sequence
  SiRNA target sequence
atagcacaatggagatctaatatt

SEQ ID NO: 74124 - DNA, 24 bp, Artificial sequence
  SiRNA target sequence
tagcacaatggagatctaatatta

SEQ ID NO: 74125 - DNA, 24 bp, Artificial sequence
  SiRNA target sequence
agcacaatggagatctaatattag

SEQ ID NO: 74126 - DNA, 24 bp, Artificial sequence
  SiRNA target sequence
gcacaatggagatctaatattaga

SEQ ID NO: 74127 - DNA, 24 bp, Artificial sequence
  SiRNA target sequence
cacaatggagatctaatattagaa

SEQ ID NO: 74128 - DNA, 24 bp, Artificial sequence
  SiRNA target sequence
acaatggagatctaatattagaag

SEQ ID NO: 74129 - DNA, 24 bp, Artificial sequence
  SiRNA target sequence
caatggagatctaatattagaaga

SEQ ID NO: 74130 - DNA, 24 bp, Artificial sequence
  SiRNA target sequence
aatggagatctaatattagaagag

SEQ ID NO: 74131 - DNA, 24 bp, Artificial sequence
  SiRNA target sequence
atggagatctaatattagaagaga

SEQ ID NO: 74132 - DNA, 24 bp, Artificial sequence
  SiRNA target sequence
tggagatctaatattagaagagaa

SEQ ID NO: 74133 - DNA, 24 bp, Artificial sequence
  SiRNA target sequence
ggagatctaatattagaagagaac

SEQ ID NO: 74134 - DNA, 24 bp, Artificial sequence
  SiRNA target sequence
gagatctaatattagaagagaact

SEQ ID NO: 74135 - DNA, 24 bp, Artificial sequence
  SiRNA target sequence
agatctaatattagaagagaactt

SEQ ID NO: 74136 - DNA, 24 bp, Artificial sequence
  SiRNA target sequence
gatctaatattagaagagaactta

SEQ ID NO: 74137 - DNA, 24 bp, Artificial sequence
  SiRNA target sequence
atctaatattagaagagaacttaa

SEQ ID NO: 74138 - DNA, 24 bp, Artificial sequence
  SiRNA target sequence
tctaatattagaagagaacttaat

SEQ ID NO: 74139 - DNA, 24 bp, Artificial sequence
  SiRNA target sequence
ctaatattagaagagaacttaata

SEQ ID NO: 74140 - DNA, 24 bp, Artificial sequence
  SiRNA target sequence
taatattagaagagaacttaataa

SEQ ID NO: 74141 - DNA, 24 bp, Artificial sequence
  SiRNA target sequence
aatattagaagagaacttaataac

SEQ ID NO: 74142 - DNA, 24 bp, Artificial sequence
  SiRNA target sequence
atattagaagagaacttaataact

SEQ ID NO: 74143 - DNA, 24 bp, Artificial sequence
  SiRNA target sequence
tattagaagagaacttaataactc

SEQ ID NO: 74144 - DNA, 24 bp, Artificial sequence
  SiRNA target sequence
attagaagagaacttaataactct

SEQ ID NO: 74145 - DNA, 24 bp, Artificial sequence
  SiRNA target sequence
ttagaagagaacttaataactctg

SEQ ID NO: 74146 - DNA, 24 bp, Artificial sequence
  SiRNA target sequence
tagaagagaacttaataactctga

SEQ ID NO: 74147 - DNA, 24 bp, Artificial sequence
  SiRNA target sequence
agaagagaacttaataactctgaa

SEQ ID NO: 74148 - DNA, 24 bp, Artificial sequence
  SiRNA target sequence
gaagagaacttaataactctgaaa

SEQ ID NO: 74149 - DNA, 24 bp, Artificial sequence
  SiRNA target sequence
aagagaacttaataactctgaaaa

SEQ ID NO: 74150 - DNA, 24 bp, Artificial sequence
  SiRNA target sequence
agagaacttaataactctgaaaat

SEQ ID NO: 74151 - DNA, 24 bp, Artificial sequence
  SiRNA target sequence
gagaacttaataactctgaaaata

SEQ ID NO: 74152 - DNA, 24 bp, Artificial sequence
  SiRNA target sequence
agaacttaataactctgaaaatag

SEQ ID NO: 74153 - DNA, 24 bp, Artificial sequence
  SiRNA target sequence
gaacttaataactctgaaaataga

SEQ ID NO: 74154 - DNA, 24 bp, Artificial sequence
  SiRNA target sequence
aacttaataactctgaaaatagat

SEQ ID NO: 74155 - DNA, 24 bp, Artificial sequence
  SiRNA target sequence
acttaataactctgaaaatagatc

SEQ ID NO: 74156 - DNA, 24 bp, Artificial sequence
  SiRNA target sequence
cttaataactctgaaaatagatct

SEQ ID NO: 74157 - DNA, 24 bp, Artificial sequence
  SiRNA target sequence
ttaataactctgaaaatagatcta

SEQ ID NO: 74158 - DNA, 24 bp, Artificial sequence
  SiRNA target sequence
taataactctgaaaatagatctag

SEQ ID NO: 74159 - DNA, 24 bp, Artificial sequence
  SiRNA target sequence
aataactctgaaaatagatctagt

SEQ ID NO: 74160 - DNA, 24 bp, Artificial sequence
  SiRNA target sequence
ataactctgaaaatagatctagta

SEQ ID NO: 74161 - DNA, 24 bp, Artificial sequence
  SiRNA target sequence
taactctgaaaatagatctagtaa

SEQ ID NO: 74162 - DNA, 24 bp, Artificial sequence
  SiRNA target sequence
aactctgaaaatagatctagtaat

SEQ ID NO: 74163 - DNA, 24 bp, Artificial sequence
  SiRNA target sequence
actctgaaaatagatctagtaata

SEQ ID NO: 74164 - DNA, 24 bp, Artificial sequence
  SiRNA target sequence
ctctgaaaatagatctagtaataa

SEQ ID NO: 74165 - DNA, 24 bp, Artificial sequence
  SiRNA target sequence
tctgaaaatagatctagtaataaa

SEQ ID NO: 74166 - DNA, 24 bp, Artificial sequence
  SiRNA target sequence
ctgaaaatagatctagtaataaac

SEQ ID NO: 74167 - DNA, 24 bp, Artificial sequence
  SiRNA target sequence
tgaaaatagatctagtaataaact

SEQ ID NO: 74168 - DNA, 24 bp, Artificial sequence
  SiRNA target sequence
gaaaatagatctagtaataaacta

SEQ ID NO: 74169 - DNA, 24 bp, Artificial sequence
  SiRNA target sequence
aaaatagatctagtaataaactac

SEQ ID NO: 74170 - DNA, 24 bp, Artificial sequence
  SiRNA target sequence
aaatagatctagtaataaactaca

SEQ ID NO: 74171 - DNA, 24 bp, Artificial sequence
  SiRNA target sequence
aatagatctagtaataaactacaa

SEQ ID NO: 74172 - DNA, 24 bp, Artificial sequence
  SiRNA target sequence
atagatctagtaataaactacaag

SEQ ID NO: 74173 - DNA, 24 bp, Artificial sequence
  SiRNA target sequence
tagatctagtaataaactacaaga

SEQ ID NO: 74174 - DNA, 24 bp, Artificial sequence
  SiRNA target sequence
agatctagtaataaactacaagat

SEQ ID NO: 74175 - DNA, 24 bp, Artificial sequence
  SiRNA target sequence
gatctagtaataaactacaagatg

SEQ ID NO: 74176 - DNA, 24 bp, Artificial sequence
  SiRNA target sequence
atctagtaataaactacaagatgg

SEQ ID NO: 74177 - DNA, 24 bp, Artificial sequence
  SiRNA target sequence
tctagtaataaactacaagatgga

SEQ ID NO: 74178 - DNA, 24 bp, Artificial sequence
  SiRNA target sequence
ctagtaataaactacaagatggat

SEQ ID NO: 74179 - DNA, 24 bp, Artificial sequence
  SiRNA target sequence
tagtaataaactacaagatggatt

SEQ ID NO: 74180 - DNA, 24 bp, Artificial sequence
  SiRNA target sequence
agtaataaactacaagatggatta

SEQ ID NO: 74181 - DNA, 24 bp, Artificial sequence
  SiRNA target sequence
gtaataaactacaagatggattaa

SEQ ID NO: 74182 - DNA, 24 bp, Artificial sequence
  SiRNA target sequence
taataaactacaagatggattaaa

SEQ ID NO: 74183 - DNA, 24 bp, Artificial sequence
  SiRNA target sequence
aataaactacaagatggattaaat

SEQ ID NO: 74184 - DNA, 24 bp, Artificial sequence
  SiRNA target sequence
ataaactacaagatggattaaata

SEQ ID NO: 74185 - DNA, 24 bp, Artificial sequence
  SiRNA target sequence
taaactacaagatggattaaataa

SEQ ID NO: 74186 - DNA, 24 bp, Artificial sequence
  SiRNA target sequence
aaactacaagatggattaaataat

SEQ ID NO: 74187 - DNA, 24 bp, Artificial sequence
  SiRNA target sequence
aactacaagatggattaaataatc

SEQ ID NO: 74188 - DNA, 24 bp, Artificial sequence
  SiRNA target sequence
actacaagatggattaaataatca

SEQ ID NO: 74189 - DNA, 24 bp, Artificial sequence
  SiRNA target sequence
ctacaagatggattaaataatcat

SEQ ID NO: 74190 - DNA, 24 bp, Artificial sequence
  SiRNA target sequence
tacaagatggattaaataatcatg

SEQ ID NO: 74191 - DNA, 24 bp, Artificial sequence
  SiRNA target sequence
acaagatggattaaataatcatga

SEQ ID NO: 74192 - DNA, 24 bp, Artificial sequence
  SiRNA target sequence
caagatggattaaataatcatgaa

SEQ ID NO: 74193 - DNA, 24 bp, Artificial sequence
  SiRNA target sequence
aagatggattaaataatcatgaaa

SEQ ID NO: 74194 - DNA, 24 bp, Artificial sequence
  SiRNA target sequence
agatggattaaataatcatgaaac

SEQ ID NO: 74195 - DNA, 24 bp, Artificial sequence
  SiRNA target sequence
gatggattaaataatcatgaaaca

SEQ ID NO: 74196 - DNA, 24 bp, Artificial sequence
  SiRNA target sequence
atggattaaataatcatgaaacaa

SEQ ID NO: 74197 - DNA, 24 bp, Artificial sequence
  SiRNA target sequence
tggattaaataatcatgaaacaat

SEQ ID NO: 74198 - DNA, 24 bp, Artificial sequence
  SiRNA target sequence
ggattaaataatcatgaaacaatc

SEQ ID NO: 74199 - DNA, 24 bp, Artificial sequence
  SiRNA target sequence
gattaaataatcatgaaacaatcg

SEQ ID NO: 74200 - DNA, 24 bp, Artificial sequence
  SiRNA target sequence
attaaataatcatgaaacaatcgt

SEQ ID NO: 74201 - DNA, 24 bp, Artificial sequence
  SiRNA target sequence
ttaaataatcatgaaacaatcgtc

SEQ ID NO: 74202 - DNA, 24 bp, Artificial sequence
  SiRNA target sequence
taaataatcatgaaacaatcgtct

SEQ ID NO: 74203 - DNA, 24 bp, Artificial sequence
  SiRNA target sequence
aaataatcatgaaacaatcgtctc

SEQ ID NO: 74204 - DNA, 24 bp, Artificial sequence
  SiRNA target sequence
aataatcatgaaacaatcgtctcc

SEQ ID NO: 74205 - DNA, 24 bp, Artificial sequence
  SiRNA target sequence
ataatcatgaaacaatcgtctcct

SEQ ID NO: 74206 - DNA, 24 bp, Artificial sequence
  SiRNA target sequence
taatcatgaaacaatcgtctcctt

SEQ ID NO: 74207 - DNA, 24 bp, Artificial sequence
  SiRNA target sequence
aatcatgaaacaatcgtctccttt

SEQ ID NO: 74208 - DNA, 24 bp, Artificial sequence
  SiRNA target sequence
atcatgaaacaatcgtctcctttg

SEQ ID NO: 74209 - DNA, 24 bp, Artificial sequence
  SiRNA target sequence
tcatgaaacaatcgtctcctttgg

SEQ ID NO: 74210 - DNA, 24 bp, Artificial sequence
  SiRNA target sequence
catgaaacaatcgtctcctttggg

SEQ ID NO: 74211 - DNA, 24 bp, Artificial sequence
  SiRNA target sequence
atgaaacaatcgtctcctttggga

SEQ ID NO: 74212 - DNA, 24 bp, Artificial sequence
  SiRNA target sequence
tgaaacaatcgtctcctttgggac

SEQ ID NO: 74213 - DNA, 24 bp, Artificial sequence
  SiRNA target sequence
gaaacaatcgtctcctttgggact

SEQ ID NO: 74214 - DNA, 24 bp, Artificial sequence
  SiRNA target sequence
aaacaatcgtctcctttgggacta

SEQ ID NO: 74215 - DNA, 24 bp, Artificial sequence
  SiRNA target sequence
aacaatcgtctcctttgggactac

SEQ ID NO: 74216 - DNA, 24 bp, Artificial sequence
  SiRNA target sequence
acaatcgtctcctttgggactaca

SEQ ID NO: 74217 - DNA, 24 bp, Artificial sequence
  SiRNA target sequence
caatcgtctcctttgggactacag

SEQ ID NO: 74218 - DNA, 24 bp, Artificial sequence
  SiRNA target sequence
aatcgtctcctttgggactacaga

SEQ ID NO: 74219 - DNA, 24 bp, Artificial sequence
  SiRNA target sequence
atcgtctcctttgggactacagat

SEQ ID NO: 74220 - DNA, 24 bp, Artificial sequence
  SiRNA target sequence
tcgtctcctttgggactacagatc

SEQ ID NO: 74221 - DNA, 24 bp, Artificial sequence
  SiRNA target sequence
cgtctcctttgggactacagatct

SEQ ID NO: 74222 - DNA, 24 bp, Artificial sequence
  SiRNA target sequence
gtctcctttgggactacagatctt

SEQ ID NO: 74223 - DNA, 24 bp, Artificial sequence
  SiRNA target sequence
tctcctttgggactacagatcttg

SEQ ID NO: 74224 - DNA, 24 bp, Artificial sequence
  SiRNA target sequence
ctcctttgggactacagatcttga

SEQ ID NO: 74225 - DNA, 24 bp, Artificial sequence
  SiRNA target sequence
tcctttgggactacagatcttgaa

SEQ ID NO: 74226 - DNA, 24 bp, Artificial sequence
  SiRNA target sequence
cctttgggactacagatcttgaag

SEQ ID NO: 74227 - DNA, 24 bp, Artificial sequence
  SiRNA target sequence
ctttgggactacagatcttgaagt

SEQ ID NO: 74228 - DNA, 24 bp, Artificial sequence
  SiRNA target sequence
tttgggactacagatcttgaagta

SEQ ID NO: 74229 - DNA, 24 bp, Artificial sequence
  SiRNA target sequence
ttgggactacagatcttgaagtag

SEQ ID NO: 74230 - DNA, 24 bp, Artificial sequence
  SiRNA target sequence
tgggactacagatcttgaagtaga

SEQ ID NO: 74231 - DNA, 24 bp, Artificial sequence
  SiRNA target sequence
gggactacagatcttgaagtagat

SEQ ID NO: 74232 - DNA, 24 bp, Artificial sequence
  SiRNA target sequence
ggactacagatcttgaagtagatg

SEQ ID NO: 74233 - DNA, 24 bp, Artificial sequence
  SiRNA target sequence
gactacagatcttgaagtagatga

SEQ ID NO: 74234 - DNA, 24 bp, Artificial sequence
  SiRNA target sequence
actacagatcttgaagtagatgaa

SEQ ID NO: 74235 - DNA, 24 bp, Artificial sequence
  SiRNA target sequence
ctacagatcttgaagtagatgaat

SEQ ID NO: 74236 - DNA, 24 bp, Artificial sequence
  SiRNA target sequence
tacagatcttgaagtagatgaata

SEQ ID NO: 74237 - DNA, 24 bp, Artificial sequence
  SiRNA target sequence
acagatcttgaagtagatgaatat

SEQ ID NO: 74238 - DNA, 24 bp, Artificial sequence
  SiRNA target sequence
cagatcttgaagtagatgaatatg

SEQ ID NO: 74239 - DNA, 24 bp, Artificial sequence
  SiRNA target sequence
agatcttgaagtagatgaatatga

SEQ ID NO: 74240 - DNA, 24 bp, Artificial sequence
  SiRNA target sequence
gatcttgaagtagatgaatatgat

SEQ ID NO: 74241 - DNA, 24 bp, Artificial sequence
  SiRNA target sequence
atcttgaagtagatgaatatgatc

SEQ ID NO: 74242 - DNA, 24 bp, Artificial sequence
  SiRNA target sequence
tcttgaagtagatgaatatgatca

SEQ ID NO: 74243 - DNA, 24 bp, Artificial sequence
  SiRNA target sequence
cttgaagtagatgaatatgatcag

SEQ ID NO: 74244 - DNA, 24 bp, Artificial sequence
  SiRNA target sequence
ttgaagtagatgaatatgatcagt

SEQ ID NO: 74245 - DNA, 24 bp, Artificial sequence
  SiRNA target sequence
tgaagtagatgaatatgatcagtt

SEQ ID NO: 74246 - DNA, 24 bp, Artificial sequence
  SiRNA target sequence
gaagtagatgaatatgatcagttt

SEQ ID NO: 74247 - DNA, 24 bp, Artificial sequence
  SiRNA target sequence
aagtagatgaatatgatcagtttc

SEQ ID NO: 74248 - DNA, 24 bp, Artificial sequence
  SiRNA target sequence
agtagatgaatatgatcagtttct

SEQ ID NO: 74249 - DNA, 24 bp, Artificial sequence
  SiRNA target sequence
gtagatgaatatgatcagtttctt

SEQ ID NO: 74250 - DNA, 24 bp, Artificial sequence
  SiRNA target sequence
tagatgaatatgatcagtttctta

SEQ ID NO: 74251 - DNA, 24 bp, Artificial sequence
  SiRNA target sequence
agatgaatatgatcagtttcttaa

SEQ ID NO: 74252 - DNA, 24 bp, Artificial sequence
  SiRNA target sequence
gatgaatatgatcagtttcttaaa

SEQ ID NO: 74253 - DNA, 24 bp, Artificial sequence
  SiRNA target sequence
atgaatatgatcagtttcttaaaa

SEQ ID NO: 74254 - DNA, 24 bp, Artificial sequence
  SiRNA target sequence
tgaatatgatcagtttcttaaaat

SEQ ID NO: 74255 - DNA, 24 bp, Artificial sequence
  SiRNA target sequence
gaatatgatcagtttcttaaaatt

SEQ ID NO: 74256 - DNA, 24 bp, Artificial sequence
  SiRNA target sequence
aatatgatcagtttcttaaaatta

SEQ ID NO: 74257 - DNA, 24 bp, Artificial sequence
  SiRNA target sequence
atatgatcagtttcttaaaattaa

SEQ ID NO: 74258 - DNA, 24 bp, Artificial sequence
  SiRNA target sequence
tatgatcagtttcttaaaattaat

SEQ ID NO: 74259 - DNA, 24 bp, Artificial sequence
  SiRNA target sequence
atgatcagtttcttaaaattaatg

SEQ ID NO: 74260 - DNA, 24 bp, Artificial sequence
  SiRNA target sequence
tgatcagtttcttaaaattaatgc

SEQ ID NO: 74261 - DNA, 24 bp, Artificial sequence
  SiRNA target sequence
gatcagtttcttaaaattaatgca

SEQ ID NO: 74262 - DNA, 24 bp, Artificial sequence
  SiRNA target sequence
atcagtttcttaaaattaatgcat

SEQ ID NO: 74263 - DNA, 24 bp, Artificial sequence
  SiRNA target sequence
tcagtttcttaaaattaatgcatc

SEQ ID NO: 74264 - DNA, 24 bp, Artificial sequence
  SiRNA target sequence
cagtttcttaaaattaatgcatct

SEQ ID NO: 74265 - DNA, 24 bp, Artificial sequence
  SiRNA target sequence
agtttcttaaaattaatgcatcta

SEQ ID NO: 74266 - DNA, 24 bp, Artificial sequence
  SiRNA target sequence
gtttcttaaaattaatgcatctaa

SEQ ID NO: 74267 - DNA, 24 bp, Artificial sequence
  SiRNA target sequence
tttcttaaaattaatgcatctaat

SEQ ID NO: 74268 - DNA, 24 bp, Artificial sequence
  SiRNA target sequence
ttcttaaaattaatgcatctaata

SEQ ID NO: 74269 - DNA, 24 bp, Artificial sequence
  SiRNA target sequence
tcttaaaattaatgcatctaatag

SEQ ID NO: 74270 - DNA, 24 bp, Artificial sequence
  SiRNA target sequence
cttaaaattaatgcatctaatagt

SEQ ID NO: 74271 - DNA, 24 bp, Artificial sequence
  SiRNA target sequence
ttaaaattaatgcatctaatagta

SEQ ID NO: 74272 - DNA, 24 bp, Artificial sequence
  SiRNA target sequence
taaaattaatgcatctaatagtaa

SEQ ID NO: 74273 - DNA, 24 bp, Artificial sequence
  SiRNA target sequence
aaaattaatgcatctaatagtaac

SEQ ID NO: 74274 - DNA, 24 bp, Artificial sequence
  SiRNA target sequence
aaattaatgcatctaatagtaaca

SEQ ID NO: 74275 - DNA, 24 bp, Artificial sequence
  SiRNA target sequence
aattaatgcatctaatagtaacag

SEQ ID NO: 74276 - DNA, 24 bp, Artificial sequence
  SiRNA target sequence
attaatgcatctaatagtaacaga

SEQ ID NO: 74277 - DNA, 24 bp, Artificial sequence
  SiRNA target sequence
ttaatgcatctaatagtaacagat

SEQ ID NO: 74278 - DNA, 24 bp, Artificial sequence
  SiRNA target sequence
taatgcatctaatagtaacagatt

SEQ ID NO: 74279 - DNA, 24 bp, Artificial sequence
  SiRNA target sequence
aatgcatctaatagtaacagatta

SEQ ID NO: 74280 - DNA, 24 bp, Artificial sequence
  SiRNA target sequence
atgcatctaatagtaacagattat

SEQ ID NO: 74281 - DNA, 24 bp, Artificial sequence
  SiRNA target sequence
tgcatctaatagtaacagattatg

SEQ ID NO: 74282 - DNA, 24 bp, Artificial sequence
  SiRNA target sequence
gcatctaatagtaacagattatgg

SEQ ID NO: 74283 - DNA, 24 bp, Artificial sequence
  SiRNA target sequence
catctaatagtaacagattatgga

SEQ ID NO: 74284 - DNA, 24 bp, Artificial sequence
  SiRNA target sequence
atctaatagtaacagattatggag

SEQ ID NO: 74285 - DNA, 24 bp, Artificial sequence
  SiRNA target sequence
tctaatagtaacagattatggaga

SEQ ID NO: 74286 - DNA, 24 bp, Artificial sequence
  SiRNA target sequence
ctaatagtaacagattatggagag

SEQ ID NO: 74287 - DNA, 24 bp, Artificial sequence
  SiRNA target sequence
taatagtaacagattatggagagc

SEQ ID NO: 74288 - DNA, 24 bp, Artificial sequence
  SiRNA target sequence
aatagtaacagattatggagagca

SEQ ID NO: 74289 - DNA, 24 bp, Artificial sequence
  SiRNA target sequence
atagtaacagattatggagagcac

SEQ ID NO: 74290 - DNA, 24 bp, Artificial sequence
  SiRNA target sequence
tagtaacagattatggagagcact

SEQ ID NO: 74291 - DNA, 24 bp, Artificial sequence
  SiRNA target sequence
agtaacagattatggagagcactg

SEQ ID NO: 74292 - DNA, 24 bp, Artificial sequence
  SiRNA target sequence
gtaacagattatggagagcactgt

SEQ ID NO: 74293 - DNA, 24 bp, Artificial sequence
  SiRNA target sequence
taacagattatggagagcactgta

SEQ ID NO: 74294 - DNA, 24 bp, Artificial sequence
  SiRNA target sequence
aacagattatggagagcactgtac

SEQ ID NO: 74295 - DNA, 24 bp, Artificial sequence
  SiRNA target sequence
acagattatggagagcactgtaca

SEQ ID NO: 74296 - DNA, 24 bp, Artificial sequence
  SiRNA target sequence
cagattatggagagcactgtacat

SEQ ID NO: 74297 - DNA, 24 bp, Artificial sequence
  SiRNA target sequence
agattatggagagcactgtacatt

SEQ ID NO: 74298 - DNA, 24 bp, Artificial sequence
  SiRNA target sequence
gattatggagagcactgtacattt

SEQ ID NO: 74299 - DNA, 24 bp, Artificial sequence
  SiRNA target sequence
attatggagagcactgtacatttt

SEQ ID NO: 74300 - DNA, 24 bp, Artificial sequence
  SiRNA target sequence
ttatggagagcactgtacatttta

SEQ ID NO: 74301 - DNA, 24 bp, Artificial sequence
  SiRNA target sequence
tatggagagcactgtacattttaa

SEQ ID NO: 74302 - DNA, 24 bp, Artificial sequence
  SiRNA target sequence
atggagagcactgtacattttaaa

SEQ ID NO: 74303 - DNA, 24 bp, Artificial sequence
  SiRNA target sequence
tggagagcactgtacattttaaat

SEQ ID NO: 74304 - DNA, 24 bp, Artificial sequence
  SiRNA target sequence
ggagagcactgtacattttaaatt

SEQ ID NO: 74305 - DNA, 24 bp, Artificial sequence
  SiRNA target sequence
gagagcactgtacattttaaattt

SEQ ID NO: 74306 - DNA, 24 bp, Artificial sequence
  SiRNA target sequence
agagcactgtacattttaaattta

SEQ ID NO: 74307 - DNA, 24 bp, Artificial sequence
  SiRNA target sequence
gagcactgtacattttaaatttat

SEQ ID NO: 74308 - DNA, 24 bp, Artificial sequence
  SiRNA target sequence
agcactgtacattttaaatttatc

SEQ ID NO: 74309 - DNA, 24 bp, Artificial sequence
  SiRNA target sequence
gcactgtacattttaaatttatct

SEQ ID NO: 74310 - DNA, 24 bp, Artificial sequence
  SiRNA target sequence
cactgtacattttaaatttatctc

SEQ ID NO: 74311 - DNA, 24 bp, Artificial sequence
  SiRNA target sequence
actgtacattttaaatttatctca

SEQ ID NO: 74312 - DNA, 24 bp, Artificial sequence
  SiRNA target sequence
ctgtacattttaaatttatctcag

SEQ ID NO: 74313 - DNA, 24 bp, Artificial sequence
  SiRNA target sequence
tgtacattttaaatttatctcaga

SEQ ID NO: 74314 - DNA, 24 bp, Artificial sequence
  SiRNA target sequence
gtacattttaaatttatctcagag

SEQ ID NO: 74315 - DNA, 24 bp, Artificial sequence
  SiRNA target sequence
tacattttaaatttatctcagaga

SEQ ID NO: 74316 - DNA, 24 bp, Artificial sequence
  SiRNA target sequence
acattttaaatttatctcagagag

SEQ ID NO: 74317 - DNA, 24 bp, Artificial sequence
  SiRNA target sequence
cattttaaatttatctcagagagc

SEQ ID NO: 74318 - DNA, 24 bp, Artificial sequence
  SiRNA target sequence
attttaaatttatctcagagagca

SEQ ID NO: 74319 - DNA, 24 bp, Artificial sequence
  SiRNA target sequence
ttttaaatttatctcagagagcaa

SEQ ID NO: 74320 - DNA, 24 bp, Artificial sequence
  SiRNA target sequence
tttaaatttatctcagagagcaat

SEQ ID NO: 74321 - DNA, 24 bp, Artificial sequence
  SiRNA target sequence
ttaaatttatctcagagagcaatt

SEQ ID NO: 74322 - DNA, 24 bp, Artificial sequence
  SiRNA target sequence
taaatttatctcagagagcaattt

SEQ ID NO: 74323 - DNA, 24 bp, Artificial sequence
  SiRNA target sequence
aaatttatctcagagagcaatttt

SEQ ID NO: 74324 - DNA, 24 bp, Artificial sequence
  SiRNA target sequence
aatttatctcagagagcaattttt

SEQ ID NO: 74325 - DNA, 24 bp, Artificial sequence
  SiRNA target sequence
atttatctcagagagcaatttttc

SEQ ID NO: 74326 - DNA, 24 bp, Artificial sequence
  SiRNA target sequence
tttatctcagagagcaatttttct

SEQ ID NO: 74327 - DNA, 24 bp, Artificial sequence
  SiRNA target sequence
ttatctcagagagcaatttttctc

SEQ ID NO: 74328 - DNA, 24 bp, Artificial sequence
  SiRNA target sequence
tatctcagagagcaatttttctct

SEQ ID NO: 74329 - DNA, 24 bp, Artificial sequence
  SiRNA target sequence
atctcagagagcaatttttctctt

SEQ ID NO: 74330 - DNA, 24 bp, Artificial sequence
  SiRNA target sequence
tctcagagagcaatttttctctta

SEQ ID NO: 74331 - DNA, 24 bp, Artificial sequence
  SiRNA target sequence
ctcagagagcaatttttctcttac

SEQ ID NO: 74332 - DNA, 24 bp, Artificial sequence
  SiRNA target sequence
tcagagagcaatttttctcttaca

SEQ ID NO: 74333 - DNA, 24 bp, Artificial sequence
  SiRNA target sequence
cagagagcaatttttctcttacaa

SEQ ID NO: 74334 - DNA, 24 bp, Artificial sequence
  SiRNA target sequence
agagagcaatttttctcttacaaa

SEQ ID NO: 74335 - DNA, 24 bp, Artificial sequence
  SiRNA target sequence
gagagcaatttttctcttacaaag

SEQ ID NO: 74336 - DNA, 24 bp, Artificial sequence
  SiRNA target sequence
agagcaatttttctcttacaaagt

SEQ ID NO: 74337 - DNA, 24 bp, Artificial sequence
  SiRNA target sequence
gagcaatttttctcttacaaagtt

SEQ ID NO: 74338 - DNA, 24 bp, Artificial sequence
  SiRNA target sequence
agcaatttttctcttacaaagttt

SEQ ID NO: 74339 - DNA, 24 bp, Artificial sequence
  SiRNA target sequence
gcaatttttctcttacaaagtttt

SEQ ID NO: 74340 - DNA, 24 bp, Artificial sequence
  SiRNA target sequence
caatttttctcttacaaagttttt

SEQ ID NO: 74341 - DNA, 24 bp, Artificial sequence
  SiRNA target sequence
aatttttctcttacaaagtttttt

SEQ ID NO: 74342 - DNA, 24 bp, Artificial sequence
  SiRNA target sequence
atttttctcttacaaagttttttt

SEQ ID NO: 74343 - DNA, 24 bp, Artificial sequence
  SiRNA target sequence
tttttctcttacaaagttttttta

SEQ ID NO: 74344 - DNA, 24 bp, Artificial sequence
  SiRNA target sequence
ttttctcttacaaagtttttttat

SEQ ID NO: 74345 - DNA, 24 bp, Artificial sequence
  SiRNA target sequence
tttctcttacaaagtttttttatt

SEQ ID NO: 74346 - DNA, 24 bp, Artificial sequence
  SiRNA target sequence
ttctcttacaaagtttttttatta

SEQ ID NO: 74347 - DNA, 24 bp, Artificial sequence
  SiRNA target sequence
tctcttacaaagtttttttattat

SEQ ID NO: 74348 - DNA, 24 bp, Artificial sequence
  SiRNA target sequence
ctcttacaaagtttttttattatt

SEQ ID NO: 74349 - DNA, 24 bp, Artificial sequence
  SiRNA target sequence
tcttacaaagtttttttattattt

SEQ ID NO: 74350 - DNA, 24 bp, Artificial sequence
  SiRNA target sequence
cttacaaagtttttttattattta

SEQ ID NO: 74351 - DNA, 24 bp, Artificial sequence
  SiRNA target sequence
ttacaaagtttttttattatttat

SEQ ID NO: 74352 - DNA, 24 bp, Artificial sequence
  SiRNA target sequence
tacaaagtttttttattatttatg

SEQ ID NO: 74353 - DNA, 24 bp, Artificial sequence
  SiRNA target sequence
acaaagtttttttattatttatgc

SEQ ID NO: 74354 - DNA, 24 bp, Artificial sequence
  SiRNA target sequence
caaagtttttttattatttatgca

SEQ ID NO: 74355 - DNA, 24 bp, Artificial sequence
  SiRNA target sequence
aaagtttttttattatttatgcag

SEQ ID NO: 74356 - DNA, 24 bp, Artificial sequence
  SiRNA target sequence
aagtttttttattatttatgcagg

SEQ ID NO: 74357 - DNA, 24 bp, Artificial sequence
  SiRNA target sequence
agtttttttattatttatgcagga

SEQ ID NO: 74358 - DNA, 24 bp, Artificial sequence
  SiRNA target sequence
gtttttttattatttatgcaggaa

SEQ ID NO: 74359 - DNA, 24 bp, Artificial sequence
  SiRNA target sequence
tttttttattatttatgcaggaat

SEQ ID NO: 74360 - DNA, 24 bp, Artificial sequence
  SiRNA target sequence
ttttttattatttatgcaggaata

SEQ ID NO: 74361 - DNA, 24 bp, Artificial sequence
  SiRNA target sequence
tttttattatttatgcaggaatat

SEQ ID NO: 74362 - DNA, 24 bp, Artificial sequence
  SiRNA target sequence
ttttattatttatgcaggaatatc

SEQ ID NO: 74363 - DNA, 24 bp, Artificial sequence
  SiRNA target sequence
tttattatttatgcaggaatatca

SEQ ID NO: 74364 - DNA, 24 bp, Artificial sequence
  SiRNA target sequence
ttattatttatgcaggaatatcag

SEQ ID NO: 74365 - DNA, 24 bp, Artificial sequence
  SiRNA target sequence
tattatttatgcaggaatatcagg

SEQ ID NO: 74366 - DNA, 24 bp, Artificial sequence
  SiRNA target sequence
attatttatgcaggaatatcagga

SEQ ID NO: 74367 - DNA, 24 bp, Artificial sequence
  SiRNA target sequence
ttatttatgcaggaatatcaggaa

SEQ ID NO: 74368 - DNA, 24 bp, Artificial sequence
  SiRNA target sequence
tatttatgcaggaatatcaggaat

SEQ ID NO: 74369 - DNA, 24 bp, Artificial sequence
  SiRNA target sequence
atttatgcaggaatatcaggaata

SEQ ID NO: 74370 - DNA, 24 bp, Artificial sequence
  SiRNA target sequence
tttatgcaggaatatcaggaatat

SEQ ID NO: 74371 - DNA, 24 bp, Artificial sequence
  SiRNA target sequence
ttatgcaggaatatcaggaatatt

SEQ ID NO: 74372 - DNA, 24 bp, Artificial sequence
  SiRNA target sequence
tatgcaggaatatcaggaatatta

SEQ ID NO: 74373 - DNA, 24 bp, Artificial sequence
  SiRNA target sequence
atgcaggaatatcaggaatattat

SEQ ID NO: 74374 - DNA, 24 bp, Artificial sequence
  SiRNA target sequence
tgcaggaatatcaggaatattatc

SEQ ID NO: 74375 - DNA, 24 bp, Artificial sequence
  SiRNA target sequence
gcaggaatatcaggaatattatct

SEQ ID NO: 74376 - DNA, 24 bp, Artificial sequence
  SiRNA target sequence
caggaatatcaggaatattatctc

SEQ ID NO: 74377 - DNA, 24 bp, Artificial sequence
  SiRNA target sequence
aggaatatcaggaatattatctca

SEQ ID NO: 74378 - DNA, 24 bp, Artificial sequence
  SiRNA target sequence
ggaatatcaggaatattatctcaa

SEQ ID NO: 74379 - DNA, 24 bp, Artificial sequence
  SiRNA target sequence
gaatatcaggaatattatctcaaa

SEQ ID NO: 74380 - DNA, 24 bp, Artificial sequence
  SiRNA target sequence
aatatcaggaatattatctcaaaa

SEQ ID NO: 74381 - DNA, 24 bp, Artificial sequence
  SiRNA target sequence
atatcaggaatattatctcaaaat

SEQ ID NO: 74382 - DNA, 24 bp, Artificial sequence
  SiRNA target sequence
tatcaggaatattatctcaaaata

SEQ ID NO: 74383 - DNA, 24 bp, Artificial sequence
  SiRNA target sequence
atcaggaatattatctcaaaatat

SEQ ID NO: 74384 - DNA, 24 bp, Artificial sequence
  SiRNA target sequence
tcaggaatattatctcaaaatatg

SEQ ID NO: 74385 - DNA, 24 bp, Artificial sequence
  SiRNA target sequence
caggaatattatctcaaaatatgt

SEQ ID NO: 74386 - DNA, 24 bp, Artificial sequence
  SiRNA target sequence
aggaatattatctcaaaatatgtc

SEQ ID NO: 74387 - DNA, 24 bp, Artificial sequence
  SiRNA target sequence
ggaatattatctcaaaatatgtca

SEQ ID NO: 74388 - DNA, 24 bp, Artificial sequence
  SiRNA target sequence
gaatattatctcaaaatatgtcat

SEQ ID NO: 74389 - DNA, 24 bp, Artificial sequence
  SiRNA target sequence
aatattatctcaaaatatgtcatc

SEQ ID NO: 74390 - DNA, 24 bp, Artificial sequence
  SiRNA target sequence
atattatctcaaaatatgtcatct

SEQ ID NO: 74391 - DNA, 24 bp, Artificial sequence
  SiRNA target sequence
tattatctcaaaatatgtcatcta

SEQ ID NO: 74392 - DNA, 24 bp, Artificial sequence
  SiRNA target sequence
attatctcaaaatatgtcatctaa

SEQ ID NO: 74393 - DNA, 24 bp, Artificial sequence
  SiRNA target sequence
ttatctcaaaatatgtcatctaac

SEQ ID NO: 74394 - DNA, 24 bp, Artificial sequence
  SiRNA target sequence
tatctcaaaatatgtcatctaacc

SEQ ID NO: 74395 - DNA, 24 bp, Artificial sequence
  SiRNA target sequence
atctcaaaatatgtcatctaacca

SEQ ID NO: 74396 - DNA, 24 bp, Artificial sequence
  SiRNA target sequence
tctcaaaatatgtcatctaaccaa

SEQ ID NO: 74397 - DNA, 24 bp, Artificial sequence
  SiRNA target sequence
ctcaaaatatgtcatctaaccaac

SEQ ID NO: 74398 - DNA, 24 bp, Artificial sequence
  SiRNA target sequence
tcaaaatatgtcatctaaccaact

SEQ ID NO: 74399 - DNA, 24 bp, Artificial sequence
  SiRNA target sequence
caaaatatgtcatctaaccaactc

SEQ ID NO: 74400 - DNA, 24 bp, Artificial sequence
  SiRNA target sequence
aaaatatgtcatctaaccaactca

SEQ ID NO: 74401 - DNA, 24 bp, Artificial sequence
  SiRNA target sequence
aaatatgtcatctaaccaactcat

SEQ ID NO: 74402 - DNA, 24 bp, Artificial sequence
  SiRNA target sequence
aatatgtcatctaaccaactcatt

SEQ ID NO: 74403 - DNA, 24 bp, Artificial sequence
  SiRNA target sequence
atatgtcatctaaccaactcattt

SEQ ID NO: 74404 - DNA, 24 bp, Artificial sequence
  SiRNA target sequence
tatgtcatctaaccaactcattta

SEQ ID NO: 74405 - DNA, 24 bp, Artificial sequence
  SiRNA target sequence
atgtcatctaaccaactcatttat

SEQ ID NO: 74406 - DNA, 24 bp, Artificial sequence
  SiRNA target sequence
tgtcatctaaccaactcatttatt

SEQ ID NO: 74407 - DNA, 24 bp, Artificial sequence
  SiRNA target sequence
gtcatctaaccaactcatttattt

SEQ ID NO: 74408 - DNA, 24 bp, Artificial sequence
  SiRNA target sequence
tcatctaaccaactcatttattta

SEQ ID NO: 74409 - DNA, 24 bp, Artificial sequence
  SiRNA target sequence
catctaaccaactcatttatttaa

SEQ ID NO: 74410 - DNA, 24 bp, Artificial sequence
  SiRNA target sequence
atctaaccaactcatttatttaat

SEQ ID NO: 74411 - DNA, 24 bp, Artificial sequence
  SiRNA target sequence
tctaaccaactcatttatttaatg

SEQ ID NO: 74412 - DNA, 24 bp, Artificial sequence
  SiRNA target sequence
ctaaccaactcatttatttaatgt

SEQ ID NO: 74413 - DNA, 24 bp, Artificial sequence
  SiRNA target sequence
taaccaactcatttatttaatgtc

SEQ ID NO: 74414 - DNA, 24 bp, Artificial sequence
  SiRNA target sequence
aaccaactcatttatttaatgtcc

SEQ ID NO: 74415 - DNA, 24 bp, Artificial sequence
  SiRNA target sequence
accaactcatttatttaatgtcca

SEQ ID NO: 74416 - DNA, 24 bp, Artificial sequence
  SiRNA target sequence
ccaactcatttatttaatgtccat

SEQ ID NO: 74417 - DNA, 24 bp, Artificial sequence
  SiRNA target sequence
caactcatttatttaatgtccatt

SEQ ID NO: 74418 - DNA, 24 bp, Artificial sequence
  SiRNA target sequence
aactcatttatttaatgtccatta

SEQ ID NO: 74419 - DNA, 24 bp, Artificial sequence
  SiRNA target sequence
actcatttatttaatgtccattac

SEQ ID NO: 74420 - DNA, 24 bp, Artificial sequence
  SiRNA target sequence
ctcatttatttaatgtccattaca

SEQ ID NO: 74421 - DNA, 24 bp, Artificial sequence
  SiRNA target sequence
tcatttatttaatgtccattacat

SEQ ID NO: 74422 - DNA, 24 bp, Artificial sequence
  SiRNA target sequence
catttatttaatgtccattacatc

SEQ ID NO: 74423 - DNA, 24 bp, Artificial sequence
  SiRNA target sequence
atttatttaatgtccattacatct

SEQ ID NO: 74424 - DNA, 24 bp, Artificial sequence
  SiRNA target sequence
tttatttaatgtccattacatcta

SEQ ID NO: 74425 - DNA, 24 bp, Artificial sequence
  SiRNA target sequence
ttatttaatgtccattacatctac

SEQ ID NO: 74426 - DNA, 24 bp, Artificial sequence
  SiRNA target sequence
tatttaatgtccattacatctacg

SEQ ID NO: 74427 - DNA, 24 bp, Artificial sequence
  SiRNA target sequence
atttaatgtccattacatctacgg

SEQ ID NO: 74428 - DNA, 24 bp, Artificial sequence
  SiRNA target sequence
tttaatgtccattacatctacggt

SEQ ID NO: 74429 - DNA, 24 bp, Artificial sequence
  SiRNA target sequence
ttaatgtccattacatctacggtt

SEQ ID NO: 74430 - DNA, 24 bp, Artificial sequence
  SiRNA target sequence
taatgtccattacatctacggtta

SEQ ID NO: 74431 - DNA, 24 bp, Artificial sequence
  SiRNA target sequence
aatgtccattacatctacggttac

SEQ ID NO: 74432 - DNA, 24 bp, Artificial sequence
  SiRNA target sequence
atgtccattacatctacggttact

SEQ ID NO: 74433 - DNA, 24 bp, Artificial sequence
  SiRNA target sequence
tgtccattacatctacggttacta

SEQ ID NO: 74434 - DNA, 24 bp, Artificial sequence
  SiRNA target sequence
gtccattacatctacggttactat

SEQ ID NO: 74435 - DNA, 24 bp, Artificial sequence
  SiRNA target sequence
tccattacatctacggttactatt

SEQ ID NO: 74436 - DNA, 24 bp, Artificial sequence
  SiRNA target sequence
ccattacatctacggttactatta

SEQ ID NO: 74437 - DNA, 24 bp, Artificial sequence
  SiRNA target sequence
cattacatctacggttactattaa

SEQ ID NO: 74438 - DNA, 24 bp, Artificial sequence
  SiRNA target sequence
attacatctacggttactattaat

SEQ ID NO: 74439 - DNA, 24 bp, Artificial sequence
  SiRNA target sequence
ttacatctacggttactattaatt

SEQ ID NO: 74440 - DNA, 24 bp, Artificial sequence
  SiRNA target sequence
tacatctacggttactattaattt

SEQ ID NO: 74441 - DNA, 24 bp, Artificial sequence
  SiRNA target sequence
acatctacggttactattaattta

SEQ ID NO: 74442 - DNA, 24 bp, Artificial sequence
  SiRNA target sequence
catctacggttactattaatttaa

SEQ ID NO: 74443 - DNA, 24 bp, Artificial sequence
  SiRNA target sequence
atctacggttactattaatttaag

SEQ ID NO: 74444 - DNA, 24 bp, Artificial sequence
  SiRNA target sequence
tctacggttactattaatttaagt

SEQ ID NO: 74445 - DNA, 24 bp, Artificial sequence
  SiRNA target sequence
ctacggttactattaatttaagta

SEQ ID NO: 74446 - DNA, 24 bp, Artificial sequence
  SiRNA target sequence
tacggttactattaatttaagtaa

SEQ ID NO: 74447 - DNA, 24 bp, Artificial sequence
  SiRNA target sequence
acggttactattaatttaagtaac

SEQ ID NO: 74448 - DNA, 24 bp, Artificial sequence
  SiRNA target sequence
cggttactattaatttaagtaact

SEQ ID NO: 74449 - DNA, 24 bp, Artificial sequence
  SiRNA target sequence
ggttactattaatttaagtaactt

SEQ ID NO: 74450 - DNA, 24 bp, Artificial sequence
  SiRNA target sequence
gttactattaatttaagtaacttg

SEQ ID NO: 74451 - DNA, 24 bp, Artificial sequence
  SiRNA target sequence
ttactattaatttaagtaacttgg

SEQ ID NO: 74452 - DNA, 24 bp, Artificial sequence
  SiRNA target sequence
tactattaatttaagtaacttggg

SEQ ID NO: 74453 - DNA, 24 bp, Artificial sequence
  SiRNA target sequence
actattaatttaagtaacttgggt

SEQ ID NO: 74454 - DNA, 24 bp, Artificial sequence
  SiRNA target sequence
ctattaatttaagtaacttgggtt

SEQ ID NO: 74455 - DNA, 24 bp, Artificial sequence
  SiRNA target sequence
tattaatttaagtaacttgggtta

SEQ ID NO: 74456 - DNA, 24 bp, Artificial sequence
  SiRNA target sequence
attaatttaagtaacttgggttac

SEQ ID NO: 74457 - DNA, 24 bp, Artificial sequence
  SiRNA target sequence
ttaatttaagtaacttgggttact

SEQ ID NO: 74458 - DNA, 24 bp, Artificial sequence
  SiRNA target sequence
taatttaagtaacttgggttactt

SEQ ID NO: 74459 - DNA, 24 bp, Artificial sequence
  SiRNA target sequence
aatttaagtaacttgggttactta

SEQ ID NO: 74460 - DNA, 24 bp, Artificial sequence
  SiRNA target sequence
atttaagtaacttgggttacttat

SEQ ID NO: 74461 - DNA, 24 bp, Artificial sequence
  SiRNA target sequence
tttaagtaacttgggttacttata

SEQ ID NO: 74462 - DNA, 24 bp, Artificial sequence
  SiRNA target sequence
ttaagtaacttgggttacttatac

SEQ ID NO: 74463 - DNA, 24 bp, Artificial sequence
  SiRNA target sequence
taagtaacttgggttacttataca

SEQ ID NO: 74464 - DNA, 24 bp, Artificial sequence
  SiRNA target sequence
aagtaacttgggttacttatacac

SEQ ID NO: 74465 - DNA, 24 bp, Artificial sequence
  SiRNA target sequence
agtaacttgggttacttatacact

SEQ ID NO: 74466 - DNA, 24 bp, Artificial sequence
  SiRNA target sequence
gtaacttgggttacttatacacta

SEQ ID NO: 74467 - DNA, 24 bp, Artificial sequence
  SiRNA target sequence
taacttgggttacttatacactag

SEQ ID NO: 74468 - DNA, 24 bp, Artificial sequence
  SiRNA target sequence
aacttgggttacttatacactaga

SEQ ID NO: 74469 - DNA, 24 bp, Artificial sequence
  SiRNA target sequence
acttgggttacttatacactagat

SEQ ID NO: 74470 - DNA, 24 bp, Artificial sequence
  SiRNA target sequence
cttgggttacttatacactagata

SEQ ID NO: 74471 - DNA, 24 bp, Artificial sequence
  SiRNA target sequence
ttgggttacttatacactagatat

SEQ ID NO: 74472 - DNA, 24 bp, Artificial sequence
  SiRNA target sequence
tgggttacttatacactagatata

SEQ ID NO: 74473 - DNA, 24 bp, Artificial sequence
  SiRNA target sequence
gggttacttatacactagatatac

SEQ ID NO: 74474 - DNA, 24 bp, Artificial sequence
  SiRNA target sequence
ggttacttatacactagatataca

SEQ ID NO: 74475 - DNA, 24 bp, Artificial sequence
  SiRNA target sequence
gttacttatacactagatatacac

SEQ ID NO: 74476 - DNA, 24 bp, Artificial sequence
  SiRNA target sequence
ttacttatacactagatatacaca

SEQ ID NO: 74477 - DNA, 24 bp, Artificial sequence
  SiRNA target sequence
tacttatacactagatatacacaa

SEQ ID NO: 74478 - DNA, 24 bp, Artificial sequence
  SiRNA target sequence
acttatacactagatatacacaag

SEQ ID NO: 74479 - DNA, 24 bp, Artificial sequence
  SiRNA target sequence
cttatacactagatatacacaagc

SEQ ID NO: 74480 - DNA, 24 bp, Artificial sequence
  SiRNA target sequence
ttatacactagatatacacaagca

SEQ ID NO: 74481 - DNA, 24 bp, Artificial sequence
  SiRNA target sequence
tatacactagatatacacaagcaa

SEQ ID NO: 74482 - DNA, 24 bp, Artificial sequence
  SiRNA target sequence
atacactagatatacacaagcaat

SEQ ID NO: 74483 - DNA, 24 bp, Artificial sequence
  SiRNA target sequence
tacactagatatacacaagcaata

SEQ ID NO: 74484 - DNA, 24 bp, Artificial sequence
  SiRNA target sequence
acactagatatacacaagcaataa

SEQ ID NO: 74485 - DNA, 24 bp, Artificial sequence
  SiRNA target sequence
cactagatatacacaagcaataat

SEQ ID NO: 74486 - DNA, 24 bp, Artificial sequence
  SiRNA target sequence
actagatatacacaagcaataatt

SEQ ID NO: 74487 - DNA, 24 bp, Artificial sequence
  SiRNA target sequence
ctagatatacacaagcaataatta

SEQ ID NO: 74488 - DNA, 24 bp, Artificial sequence
  SiRNA target sequence
tagatatacacaagcaataattaa

SEQ ID NO: 74489 - DNA, 24 bp, Artificial sequence
  SiRNA target sequence
agatatacacaagcaataattaat

SEQ ID NO: 74490 - DNA, 24 bp, Artificial sequence
  SiRNA target sequence
gatatacacaagcaataattaatg

SEQ ID NO: 74491 - DNA, 24 bp, Artificial sequence
  SiRNA target sequence
atatacacaagcaataattaatgc

SEQ ID NO: 74492 - DNA, 24 bp, Artificial sequence
  SiRNA target sequence
tatacacaagcaataattaatgca

SEQ ID NO: 74493 - DNA, 24 bp, Artificial sequence
  SiRNA target sequence
atacacaagcaataattaatgcaa

SEQ ID NO: 74494 - DNA, 24 bp, Artificial sequence
  SiRNA target sequence
tacacaagcaataattaatgcaag

SEQ ID NO: 74495 - DNA, 24 bp, Artificial sequence
  SiRNA target sequence
acacaagcaataattaatgcaaga

SEQ ID NO: 74496 - DNA, 24 bp, Artificial sequence
  SiRNA target sequence
cacaagcaataattaatgcaagat

SEQ ID NO: 74497 - DNA, 24 bp, Artificial sequence
  SiRNA target sequence
acaagcaataattaatgcaagatc

SEQ ID NO: 74498 - DNA, 24 bp, Artificial sequence
  SiRNA target sequence
caagcaataattaatgcaagatct

SEQ ID NO: 74499 - DNA, 24 bp, Artificial sequence
  SiRNA target sequence
aagcaataattaatgcaagatcta

SEQ ID NO: 74500 - DNA, 24 bp, Artificial sequence
  SiRNA target sequence
agcaataattaatgcaagatctac

SEQ ID NO: 74501 - DNA, 24 bp, Artificial sequence
  SiRNA target sequence
gcaataattaatgcaagatctact

SEQ ID NO: 74502 - DNA, 24 bp, Artificial sequence
  SiRNA target sequence
caataattaatgcaagatctactt

SEQ ID NO: 74503 - DNA, 24 bp, Artificial sequence
  SiRNA target sequence
aataattaatgcaagatctactta

SEQ ID NO: 74504 - DNA, 24 bp, Artificial sequence
  SiRNA target sequence
ataattaatgcaagatctacttat

SEQ ID NO: 74505 - DNA, 24 bp, Artificial sequence
  SiRNA target sequence
taattaatgcaagatctacttatg

SEQ ID NO: 74506 - DNA, 24 bp, Artificial sequence
  SiRNA target sequence
aattaatgcaagatctacttatga

SEQ ID NO: 74507 - DNA, 24 bp, Artificial sequence
  SiRNA target sequence
attaatgcaagatctacttatgat

SEQ ID NO: 74508 - DNA, 24 bp, Artificial sequence
  SiRNA target sequence
ttaatgcaagatctacttatgata

SEQ ID NO: 74509 - DNA, 24 bp, Artificial sequence
  SiRNA target sequence
taatgcaagatctacttatgatac

SEQ ID NO: 74510 - DNA, 24 bp, Artificial sequence
  SiRNA target sequence
aatgcaagatctacttatgataca

SEQ ID NO: 74511 - DNA, 24 bp, Artificial sequence
  SiRNA target sequence
atgcaagatctacttatgatacaa

SEQ ID NO: 74512 - DNA, 24 bp, Artificial sequence
  SiRNA target sequence
tgcaagatctacttatgatacaat

SEQ ID NO: 74513 - DNA, 24 bp, Artificial sequence
  SiRNA target sequence
gcaagatctacttatgatacaatg

SEQ ID NO: 74514 - DNA, 24 bp, Artificial sequence
  SiRNA target sequence
caagatctacttatgatacaatgt

SEQ ID NO: 74515 - DNA, 24 bp, Artificial sequence
  SiRNA target sequence
aagatctacttatgatacaatgtt

SEQ ID NO: 74516 - DNA, 24 bp, Artificial sequence
  SiRNA target sequence
agatctacttatgatacaatgtta

SEQ ID NO: 74517 - DNA, 24 bp, Artificial sequence
  SiRNA target sequence
gatctacttatgatacaatgttag

SEQ ID NO: 74518 - DNA, 24 bp, Artificial sequence
  SiRNA target sequence
atctacttatgatacaatgttaga

SEQ ID NO: 74519 - DNA, 24 bp, Artificial sequence
  SiRNA target sequence
tctacttatgatacaatgttagat

SEQ ID NO: 74520 - DNA, 24 bp, Artificial sequence
  SiRNA target sequence
ctacttatgatacaatgttagata

SEQ ID NO: 74521 - DNA, 24 bp, Artificial sequence
  SiRNA target sequence
tacttatgatacaatgttagatat

SEQ ID NO: 74522 - DNA, 24 bp, Artificial sequence
  SiRNA target sequence
acttatgatacaatgttagatata

SEQ ID NO: 74523 - DNA, 24 bp, Artificial sequence
  SiRNA target sequence
cttatgatacaatgttagatataa

SEQ ID NO: 74524 - DNA, 24 bp, Artificial sequence
  SiRNA target sequence
ttatgatacaatgttagatataaa

SEQ ID NO: 74525 - DNA, 24 bp, Artificial sequence
  SiRNA target sequence
tatgatacaatgttagatataaaa

SEQ ID NO: 74526 - DNA, 24 bp, Artificial sequence
  SiRNA target sequence
atgatacaatgttagatataaaaa

SEQ ID NO: 74527 - DNA, 24 bp, Artificial sequence
  SiRNA target sequence
tgatacaatgttagatataaaaaa

SEQ ID NO: 74528 - DNA, 24 bp, Artificial sequence
  SiRNA target sequence
gatacaatgttagatataaaaaaa

SEQ ID NO: 74529 - DNA, 24 bp, Artificial sequence
  SiRNA target sequence
atacaatgttagatataaaaaaag

SEQ ID NO: 74530 - DNA, 24 bp, Artificial sequence
  SiRNA target sequence
tacaatgttagatataaaaaaaga

SEQ ID NO: 74531 - DNA, 24 bp, Artificial sequence
  SiRNA target sequence
acaatgttagatataaaaaaagag

SEQ ID NO: 74532 - DNA, 24 bp, Artificial sequence
  SiRNA target sequence
caatgttagatataaaaaaagaga

SEQ ID NO: 74533 - DNA, 24 bp, Artificial sequence
  SiRNA target sequence
aatgttagatataaaaaaagagaa

SEQ ID NO: 74534 - DNA, 24 bp, Artificial sequence
  SiRNA target sequence
atgttagatataaaaaaagagaat

SEQ ID NO: 74535 - DNA, 24 bp, Artificial sequence
  SiRNA target sequence
tgttagatataaaaaaagagaata

SEQ ID NO: 74536 - DNA, 24 bp, Artificial sequence
  SiRNA target sequence
gttagatataaaaaaagagaataa

SEQ ID NO: 74537 - DNA, 24 bp, Artificial sequence
  SiRNA target sequence
ttagatataaaaaaagagaataat

SEQ ID NO: 74538 - DNA, 24 bp, Artificial sequence
  SiRNA target sequence
tagatataaaaaaagagaataata

SEQ ID NO: 74539 - DNA, 24 bp, Artificial sequence
  SiRNA target sequence
agatataaaaaaagagaataataa

SEQ ID NO: 74540 - DNA, 24 bp, Artificial sequence
  SiRNA target sequence
gatataaaaaaagagaataataag

SEQ ID NO: 74541 - DNA, 24 bp, Artificial sequence
  SiRNA target sequence
atataaaaaaagagaataataagt

SEQ ID NO: 74542 - DNA, 24 bp, Artificial sequence
  SiRNA target sequence
tataaaaaaagagaataataagtt

SEQ ID NO: 74543 - DNA, 24 bp, Artificial sequence
  SiRNA target sequence
ataaaaaaagagaataataagttt

SEQ ID NO: 74544 - DNA, 24 bp, Artificial sequence
  SiRNA target sequence
taaaaaaagagaataataagttta

SEQ ID NO: 74545 - DNA, 24 bp, Artificial sequence
  SiRNA target sequence
aaaaaaagagaataataagtttaa

SEQ ID NO: 74546 - DNA, 24 bp, Artificial sequence
  SiRNA target sequence
aaaaaagagaataataagtttaag

SEQ ID NO: 74547 - DNA, 24 bp, Artificial sequence
  SiRNA target sequence
aaaaagagaataataagtttaaga

SEQ ID NO: 74548 - DNA, 24 bp, Artificial sequence
  SiRNA target sequence
aaaagagaataataagtttaagat

SEQ ID NO: 74549 - DNA, 24 bp, Artificial sequence
  SiRNA target sequence
aaagagaataataagtttaagatt

SEQ ID NO: 74550 - DNA, 24 bp, Artificial sequence
  SiRNA target sequence
aagagaataataagtttaagatta

SEQ ID NO: 74551 - DNA, 24 bp, Artificial sequence
  SiRNA target sequence
agagaataataagtttaagattac

SEQ ID NO: 74552 - DNA, 24 bp, Artificial sequence
  SiRNA target sequence
gagaataataagtttaagattaca

SEQ ID NO: 74553 - DNA, 24 bp, Artificial sequence
  SiRNA target sequence
agaataataagtttaagattacag

SEQ ID NO: 74554 - DNA, 24 bp, Artificial sequence
  SiRNA target sequence
gaataataagtttaagattacaga

SEQ ID NO: 74555 - DNA, 24 bp, Artificial sequence
  SiRNA target sequence
aataataagtttaagattacagaa

SEQ ID NO: 74556 - DNA, 24 bp, Artificial sequence
  SiRNA target sequence
ataataagtttaagattacagaat

SEQ ID NO: 74557 - DNA, 24 bp, Artificial sequence
  SiRNA target sequence
taataagtttaagattacagaatt

SEQ ID NO: 74558 - DNA, 24 bp, Artificial sequence
  SiRNA target sequence
aataagtttaagattacagaattt

SEQ ID NO: 74559 - DNA, 24 bp, Artificial sequence
  SiRNA target sequence
ataagtttaagattacagaattta

SEQ ID NO: 74560 - DNA, 24 bp, Artificial sequence
  SiRNA target sequence
taagtttaagattacagaatttaa

SEQ ID NO: 74561 - DNA, 24 bp, Artificial sequence
  SiRNA target sequence
aagtttaagattacagaatttaaa

SEQ ID NO: 74562 - DNA, 24 bp, Artificial sequence
  SiRNA target sequence
agtttaagattacagaatttaaag

SEQ ID NO: 74563 - DNA, 24 bp, Artificial sequence
  SiRNA target sequence
gtttaagattacagaatttaaaga

SEQ ID NO: 74564 - DNA, 24 bp, Artificial sequence
  SiRNA target sequence
tttaagattacagaatttaaagaa

SEQ ID NO: 74565 - DNA, 24 bp, Artificial sequence
  SiRNA target sequence
ttaagattacagaatttaaagaaa

SEQ ID NO: 74566 - DNA, 24 bp, Artificial sequence
  SiRNA target sequence
taagattacagaatttaaagaaag

SEQ ID NO: 74567 - DNA, 24 bp, Artificial sequence
  SiRNA target sequence
aagattacagaatttaaagaaagt

SEQ ID NO: 74568 - DNA, 24 bp, Artificial sequence
  SiRNA target sequence
agattacagaatttaaagaaagta

SEQ ID NO: 74569 - DNA, 24 bp, Artificial sequence
  SiRNA target sequence
gattacagaatttaaagaaagtat

SEQ ID NO: 74570 - DNA, 24 bp, Artificial sequence
  SiRNA target sequence
attacagaatttaaagaaagtatt

SEQ ID NO: 74571 - DNA, 24 bp, Artificial sequence
  SiRNA target sequence
ttacagaatttaaagaaagtatta

SEQ ID NO: 74572 - DNA, 24 bp, Artificial sequence
  SiRNA target sequence
tacagaatttaaagaaagtattaa

SEQ ID NO: 74573 - DNA, 24 bp, Artificial sequence
  SiRNA target sequence
acagaatttaaagaaagtattaag

SEQ ID NO: 74574 - DNA, 24 bp, Artificial sequence
  SiRNA target sequence
cagaatttaaagaaagtattaagt

SEQ ID NO: 74575 - DNA, 24 bp, Artificial sequence
  SiRNA target sequence
agaatttaaagaaagtattaagtt

SEQ ID NO: 74576 - DNA, 24 bp, Artificial sequence
  SiRNA target sequence
gaatttaaagaaagtattaagttt

SEQ ID NO: 74577 - DNA, 24 bp, Artificial sequence
  SiRNA target sequence
aatttaaagaaagtattaagttta

SEQ ID NO: 74578 - DNA, 24 bp, Artificial sequence
  SiRNA target sequence
atttaaagaaagtattaagtttaa

SEQ ID NO: 74579 - DNA, 24 bp, Artificial sequence
  SiRNA target sequence
tttaaagaaagtattaagtttaat

SEQ ID NO: 74580 - DNA, 24 bp, Artificial sequence
  SiRNA target sequence
ttaaagaaagtattaagtttaata

SEQ ID NO: 74581 - DNA, 24 bp, Artificial sequence
  SiRNA target sequence
taaagaaagtattaagtttaataa

SEQ ID NO: 74582 - DNA, 24 bp, Artificial sequence
  SiRNA target sequence
aaagaaagtattaagtttaataat

SEQ ID NO: 74583 - DNA, 24 bp, Artificial sequence
  SiRNA target sequence
aagaaagtattaagtttaataatt

SEQ ID NO: 74584 - DNA, 24 bp, Artificial sequence
  SiRNA target sequence
agaaagtattaagtttaataattt

SEQ ID NO: 74585 - DNA, 24 bp, Artificial sequence
  SiRNA target sequence
gaaagtattaagtttaataatttg

SEQ ID NO: 74586 - DNA, 24 bp, Artificial sequence
  SiRNA target sequence
aaagtattaagtttaataatttgt

SEQ ID NO: 74587 - DNA, 24 bp, Artificial sequence
  SiRNA target sequence
aagtattaagtttaataatttgtc

SEQ ID NO: 74588 - DNA, 24 bp, Artificial sequence
  SiRNA target sequence
agtattaagtttaataatttgtca

SEQ ID NO: 74589 - DNA, 24 bp, Artificial sequence
  SiRNA target sequence
gtattaagtttaataatttgtcat

SEQ ID NO: 74590 - DNA, 24 bp, Artificial sequence
  SiRNA target sequence
tattaagtttaataatttgtcatt

SEQ ID NO: 74591 - DNA, 24 bp, Artificial sequence
  SiRNA target sequence
attaagtttaataatttgtcattt

SEQ ID NO: 74592 - DNA, 24 bp, Artificial sequence
  SiRNA target sequence
ttaagtttaataatttgtcatttg

SEQ ID NO: 74593 - DNA, 24 bp, Artificial sequence
  SiRNA target sequence
taagtttaataatttgtcatttgg

SEQ ID NO: 74594 - DNA, 24 bp, Artificial sequence
  SiRNA target sequence
aagtttaataatttgtcatttggt

SEQ ID NO: 74595 - DNA, 24 bp, Artificial sequence
  SiRNA target sequence
agtttaataatttgtcatttggtt

SEQ ID NO: 74596 - DNA, 24 bp, Artificial sequence
  SiRNA target sequence
gtttaataatttgtcatttggtta

SEQ ID NO: 74597 - DNA, 24 bp, Artificial sequence
  SiRNA target sequence
tttaataatttgtcatttggttat

SEQ ID NO: 74598 - DNA, 24 bp, Artificial sequence
  SiRNA target sequence
ttaataatttgtcatttggttatg

SEQ ID NO: 74599 - DNA, 24 bp, Artificial sequence
  SiRNA target sequence
taataatttgtcatttggttatga

SEQ ID NO: 74600 - DNA, 24 bp, Artificial sequence
  SiRNA target sequence
aataatttgtcatttggttatgaa

SEQ ID NO: 74601 - DNA, 24 bp, Artificial sequence
  SiRNA target sequence
ataatttgtcatttggttatgaaa

SEQ ID NO: 74602 - DNA, 24 bp, Artificial sequence
  SiRNA target sequence
taatttgtcatttggttatgaaag

SEQ ID NO: 74603 - DNA, 24 bp, Artificial sequence
  SiRNA target sequence
aatttgtcatttggttatgaaagt

SEQ ID NO: 74604 - DNA, 24 bp, Artificial sequence
  SiRNA target sequence
atttgtcatttggttatgaaagta

SEQ ID NO: 74605 - DNA, 24 bp, Artificial sequence
  SiRNA target sequence
tttgtcatttggttatgaaagtag

SEQ ID NO: 74606 - DNA, 24 bp, Artificial sequence
  SiRNA target sequence
ttgtcatttggttatgaaagtaga

SEQ ID NO: 74607 - DNA, 24 bp, Artificial sequence
  SiRNA target sequence
tgtcatttggttatgaaagtagac

SEQ ID NO: 74608 - DNA, 24 bp, Artificial sequence
  SiRNA target sequence
gtcatttggttatgaaagtagaca

SEQ ID NO: 74609 - DNA, 24 bp, Artificial sequence
  SiRNA target sequence
tcatttggttatgaaagtagacaa

SEQ ID NO: 74610 - DNA, 24 bp, Artificial sequence
  SiRNA target sequence
catttggttatgaaagtagacaaa

SEQ ID NO: 74611 - DNA, 24 bp, Artificial sequence
  SiRNA target sequence
atttggttatgaaagtagacaaat

SEQ ID NO: 74612 - DNA, 24 bp, Artificial sequence
  SiRNA target sequence
tttggttatgaaagtagacaaatt

SEQ ID NO: 74613 - DNA, 24 bp, Artificial sequence
  SiRNA target sequence
ttggttatgaaagtagacaaattt

SEQ ID NO: 74614 - DNA, 24 bp, Artificial sequence
  SiRNA target sequence
tggttatgaaagtagacaaatttt

SEQ ID NO: 74615 - DNA, 24 bp, Artificial sequence
  SiRNA target sequence
ggttatgaaagtagacaaattttt

SEQ ID NO: 74616 - DNA, 24 bp, Artificial sequence
  SiRNA target sequence
gttatgaaagtagacaaattttta

SEQ ID NO: 74617 - DNA, 24 bp, Artificial sequence
  SiRNA target sequence
ttatgaaagtagacaaatttttaa

SEQ ID NO: 74618 - DNA, 24 bp, Artificial sequence
  SiRNA target sequence
tatgaaagtagacaaatttttaat

SEQ ID NO: 74619 - DNA, 24 bp, Artificial sequence
  SiRNA target sequence
atgaaagtagacaaatttttaata

SEQ ID NO: 74620 - DNA, 24 bp, Artificial sequence
  SiRNA target sequence
tgaaagtagacaaatttttaataa

SEQ ID NO: 74621 - DNA, 24 bp, Artificial sequence
  SiRNA target sequence
gaaagtagacaaatttttaataaa

SEQ ID NO: 74622 - DNA, 24 bp, Artificial sequence
  SiRNA target sequence
aaagtagacaaatttttaataaaa

SEQ ID NO: 74623 - DNA, 24 bp, Artificial sequence
  SiRNA target sequence
aagtagacaaatttttaataaaat

SEQ ID NO: 74624 - DNA, 24 bp, Artificial sequence
  SiRNA target sequence
agtagacaaatttttaataaaata

SEQ ID NO: 74625 - DNA, 24 bp, Artificial sequence
  SiRNA target sequence
gtagacaaatttttaataaaataa

SEQ ID NO: 74626 - DNA, 24 bp, Artificial sequence
  SiRNA target sequence
tagacaaatttttaataaaataaa

SEQ ID NO: 74627 - DNA, 24 bp, Artificial sequence
  SiRNA target sequence
agacaaatttttaataaaataaat

SEQ ID NO: 74628 - DNA, 24 bp, Artificial sequence
  SiRNA target sequence
gacaaatttttaataaaataaatc

SEQ ID NO: 74629 - DNA, 24 bp, Artificial sequence
  SiRNA target sequence
acaaatttttaataaaataaatct

SEQ ID NO: 74630 - DNA, 24 bp, Artificial sequence
  SiRNA target sequence
caaatttttaataaaataaatcta

SEQ ID NO: 74631 - DNA, 24 bp, Artificial sequence
  SiRNA target sequence
aaatttttaataaaataaatctag

SEQ ID NO: 74632 - DNA, 24 bp, Artificial sequence
  SiRNA target sequence
aatttttaataaaataaatctaga

SEQ ID NO: 74633 - DNA, 24 bp, Artificial sequence
  SiRNA target sequence
atttttaataaaataaatctagaa

SEQ ID NO: 74634 - DNA, 24 bp, Artificial sequence
  SiRNA target sequence
tttttaataaaataaatctagaaa

SEQ ID NO: 74635 - DNA, 24 bp, Artificial sequence
  SiRNA target sequence
ttttaataaaataaatctagaaat

SEQ ID NO: 74636 - DNA, 24 bp, Artificial sequence
  SiRNA target sequence
tttaataaaataaatctagaaata

SEQ ID NO: 74637 - DNA, 24 bp, Artificial sequence
  SiRNA target sequence
ttaataaaataaatctagaaatat

SEQ ID NO: 74638 - DNA, 24 bp, Artificial sequence
  SiRNA target sequence
taataaaataaatctagaaatata

SEQ ID NO: 74639 - DNA, 24 bp, Artificial sequence
  SiRNA target sequence
aataaaataaatctagaaatatac

SEQ ID NO: 74640 - DNA, 24 bp, Artificial sequence
  SiRNA target sequence
ataaaataaatctagaaatataca

SEQ ID NO: 74641 - DNA, 24 bp, Artificial sequence
  SiRNA target sequence
taaaataaatctagaaatatacaa

SEQ ID NO: 74642 - DNA, 24 bp, Artificial sequence
  SiRNA target sequence
aaaataaatctagaaatatacaaa

SEQ ID NO: 74643 - DNA, 24 bp, Artificial sequence
  SiRNA target sequence
aaataaatctagaaatatacaaag

SEQ ID NO: 74644 - DNA, 24 bp, Artificial sequence
  SiRNA target sequence
aataaatctagaaatatacaaagg

SEQ ID NO: 74645 - DNA, 24 bp, Artificial sequence
  SiRNA target sequence
ataaatctagaaatatacaaagga

SEQ ID NO: 74646 - DNA, 24 bp, Artificial sequence
  SiRNA target sequence
taaatctagaaatatacaaaggag

SEQ ID NO: 74647 - DNA, 24 bp, Artificial sequence
  SiRNA target sequence
aaatctagaaatatacaaaggaga

SEQ ID NO: 74648 - DNA, 24 bp, Artificial sequence
  SiRNA target sequence
aatctagaaatatacaaaggagaa

SEQ ID NO: 74649 - DNA, 24 bp, Artificial sequence
  SiRNA target sequence
atctagaaatatacaaaggagaaa

SEQ ID NO: 74650 - DNA, 24 bp, Artificial sequence
  SiRNA target sequence
tctagaaatatacaaaggagaaaa

SEQ ID NO: 74651 - DNA, 24 bp, Artificial sequence
  SiRNA target sequence
ctagaaatatacaaaggagaaaaa

SEQ ID NO: 74652 - DNA, 24 bp, Artificial sequence
  SiRNA target sequence
tagaaatatacaaaggagaaaaag

SEQ ID NO: 74653 - DNA, 24 bp, Artificial sequence
  SiRNA target sequence
agaaatatacaaaggagaaaaagt

SEQ ID NO: 74654 - DNA, 24 bp, Artificial sequence
  SiRNA target sequence
gaaatatacaaaggagaaaaagta

SEQ ID NO: 74655 - DNA, 24 bp, Artificial sequence
  SiRNA target sequence
aaatatacaaaggagaaaaagtag

SEQ ID NO: 74656 - DNA, 24 bp, Artificial sequence
  SiRNA target sequence
aatatacaaaggagaaaaagtagc

SEQ ID NO: 74657 - DNA, 24 bp, Artificial sequence
  SiRNA target sequence
atatacaaaggagaaaaagtagca

SEQ ID NO: 74658 - DNA, 24 bp, Artificial sequence
  SiRNA target sequence
tatacaaaggagaaaaagtagcaa

SEQ ID NO: 74659 - DNA, 24 bp, Artificial sequence
  SiRNA target sequence
atacaaaggagaaaaagtagcaat

SEQ ID NO: 74660 - DNA, 24 bp, Artificial sequence
  SiRNA target sequence
tacaaaggagaaaaagtagcaatt

SEQ ID NO: 74661 - DNA, 24 bp, Artificial sequence
  SiRNA target sequence
acaaaggagaaaaagtagcaatta

SEQ ID NO: 74662 - DNA, 24 bp, Artificial sequence
  SiRNA target sequence
caaaggagaaaaagtagcaattat

SEQ ID NO: 74663 - DNA, 24 bp, Artificial sequence
  SiRNA target sequence
aaaggagaaaaagtagcaattata

SEQ ID NO: 74664 - DNA, 24 bp, Artificial sequence
  SiRNA target sequence
aaggagaaaaagtagcaattatag

SEQ ID NO: 74665 - DNA, 24 bp, Artificial sequence
  SiRNA target sequence
aggagaaaaagtagcaattatagg

SEQ ID NO: 74666 - DNA, 24 bp, Artificial sequence
  SiRNA target sequence
ggagaaaaagtagcaattataggt

SEQ ID NO: 74667 - DNA, 24 bp, Artificial sequence
  SiRNA target sequence
gagaaaaagtagcaattataggta

SEQ ID NO: 74668 - DNA, 24 bp, Artificial sequence
  SiRNA target sequence
agaaaaagtagcaattataggtaa

SEQ ID NO: 74669 - DNA, 24 bp, Artificial sequence
  SiRNA target sequence
gaaaaagtagcaattataggtaaa

SEQ ID NO: 74670 - DNA, 24 bp, Artificial sequence
  SiRNA target sequence
aaaaagtagcaattataggtaaaa

SEQ ID NO: 74671 - DNA, 24 bp, Artificial sequence
  SiRNA target sequence
aaaagtagcaattataggtaaaaa

SEQ ID NO: 74672 - DNA, 24 bp, Artificial sequence
  SiRNA target sequence
aaagtagcaattataggtaaaaat

SEQ ID NO: 74673 - DNA, 24 bp, Artificial sequence
  SiRNA target sequence
aagtagcaattataggtaaaaatg

SEQ ID NO: 74674 - DNA, 24 bp, Artificial sequence
  SiRNA target sequence
agtagcaattataggtaaaaatgg

SEQ ID NO: 74675 - DNA, 24 bp, Artificial sequence
  SiRNA target sequence
gtagcaattataggtaaaaatggt

SEQ ID NO: 74676 - DNA, 24 bp, Artificial sequence
  SiRNA target sequence
tagcaattataggtaaaaatggta

SEQ ID NO: 74677 - DNA, 24 bp, Artificial sequence
  SiRNA target sequence
agcaattataggtaaaaatggtag

SEQ ID NO: 74678 - DNA, 24 bp, Artificial sequence
  SiRNA target sequence
gcaattataggtaaaaatggtagt

SEQ ID NO: 74679 - DNA, 24 bp, Artificial sequence
  SiRNA target sequence
caattataggtaaaaatggtagtg

SEQ ID NO: 74680 - DNA, 24 bp, Artificial sequence
  SiRNA target sequence
aattataggtaaaaatggtagtgg

SEQ ID NO: 74681 - DNA, 24 bp, Artificial sequence
  SiRNA target sequence
attataggtaaaaatggtagtggt

SEQ ID NO: 74682 - DNA, 24 bp, Artificial sequence
  SiRNA target sequence
ttataggtaaaaatggtagtggta

SEQ ID NO: 74683 - DNA, 24 bp, Artificial sequence
  SiRNA target sequence
tataggtaaaaatggtagtggtaa

SEQ ID NO: 74684 - DNA, 24 bp, Artificial sequence
  SiRNA target sequence
ataggtaaaaatggtagtggtaaa

SEQ ID NO: 74685 - DNA, 24 bp, Artificial sequence
  SiRNA target sequence
taggtaaaaatggtagtggtaaat

SEQ ID NO: 74686 - DNA, 24 bp, Artificial sequence
  SiRNA target sequence
aggtaaaaatggtagtggtaaatc

SEQ ID NO: 74687 - DNA, 24 bp, Artificial sequence
  SiRNA target sequence
ggtaaaaatggtagtggtaaatca

SEQ ID NO: 74688 - DNA, 24 bp, Artificial sequence
  SiRNA target sequence
gtaaaaatggtagtggtaaatcaa

SEQ ID NO: 74689 - DNA, 24 bp, Artificial sequence
  SiRNA target sequence
taaaaatggtagtggtaaatcaac

SEQ ID NO: 74690 - DNA, 24 bp, Artificial sequence
  SiRNA target sequence
aaaaatggtagtggtaaatcaaca

SEQ ID NO: 74691 - DNA, 24 bp, Artificial sequence
  SiRNA target sequence
aaaatggtagtggtaaatcaacat

SEQ ID NO: 74692 - DNA, 24 bp, Artificial sequence
  SiRNA target sequence
aaatggtagtggtaaatcaacatt

SEQ ID NO: 74693 - DNA, 24 bp, Artificial sequence
  SiRNA target sequence
aatggtagtggtaaatcaacatta

SEQ ID NO: 74694 - DNA, 24 bp, Artificial sequence
  SiRNA target sequence
atggtagtggtaaatcaacattac

SEQ ID NO: 74695 - DNA, 24 bp, Artificial sequence
  SiRNA target sequence
tggtagtggtaaatcaacattact

SEQ ID NO: 74696 - DNA, 24 bp, Artificial sequence
  SiRNA target sequence
ggtagtggtaaatcaacattacta

SEQ ID NO: 74697 - DNA, 24 bp, Artificial sequence
  SiRNA target sequence
gtagtggtaaatcaacattactaa

SEQ ID NO: 74698 - DNA, 24 bp, Artificial sequence
  SiRNA target sequence
tagtggtaaatcaacattactaaa

SEQ ID NO: 74699 - DNA, 24 bp, Artificial sequence
  SiRNA target sequence
agtggtaaatcaacattactaaaa

SEQ ID NO: 74700 - DNA, 24 bp, Artificial sequence
  SiRNA target sequence
gtggtaaatcaacattactaaaac

SEQ ID NO: 74701 - DNA, 24 bp, Artificial sequence
  SiRNA target sequence
tggtaaatcaacattactaaaact

SEQ ID NO: 74702 - DNA, 24 bp, Artificial sequence
  SiRNA target sequence
ggtaaatcaacattactaaaacta

SEQ ID NO: 74703 - DNA, 24 bp, Artificial sequence
  SiRNA target sequence
gtaaatcaacattactaaaactac

SEQ ID NO: 74704 - DNA, 24 bp, Artificial sequence
  SiRNA target sequence
taaatcaacattactaaaactact

SEQ ID NO: 74705 - DNA, 24 bp, Artificial sequence
  SiRNA target sequence
aaatcaacattactaaaactactg

SEQ ID NO: 74706 - DNA, 24 bp, Artificial sequence
  SiRNA target sequence
aatcaacattactaaaactactgc

SEQ ID NO: 74707 - DNA, 24 bp, Artificial sequence
  SiRNA target sequence
atcaacattactaaaactactgct

SEQ ID NO: 74708 - DNA, 24 bp, Artificial sequence
  SiRNA target sequence
tcaacattactaaaactactgctt

SEQ ID NO: 74709 - DNA, 24 bp, Artificial sequence
  SiRNA target sequence
caacattactaaaactactgctta

SEQ ID NO: 74710 - DNA, 24 bp, Artificial sequence
  SiRNA target sequence
aacattactaaaactactgcttaa

SEQ ID NO: 74711 - DNA, 24 bp, Artificial sequence
  SiRNA target sequence
acattactaaaactactgcttaaa

SEQ ID NO: 74712 - DNA, 24 bp, Artificial sequence
  SiRNA target sequence
cattactaaaactactgcttaaat

SEQ ID NO: 74713 - DNA, 24 bp, Artificial sequence
  SiRNA target sequence
attactaaaactactgcttaaatt

SEQ ID NO: 74714 - DNA, 24 bp, Artificial sequence
  SiRNA target sequence
ttactaaaactactgcttaaattt

SEQ ID NO: 74715 - DNA, 24 bp, Artificial sequence
  SiRNA target sequence
tactaaaactactgcttaaatttg

SEQ ID NO: 74716 - DNA, 24 bp, Artificial sequence
  SiRNA target sequence
actaaaactactgcttaaatttga

SEQ ID NO: 74717 - DNA, 24 bp, Artificial sequence
  SiRNA target sequence
ctaaaactactgcttaaatttgat

SEQ ID NO: 74718 - DNA, 24 bp, Artificial sequence
  SiRNA target sequence
taaaactactgcttaaatttgatg

SEQ ID NO: 74719 - DNA, 24 bp, Artificial sequence
  SiRNA target sequence
aaaactactgcttaaatttgatga

SEQ ID NO: 74720 - DNA, 24 bp, Artificial sequence
  SiRNA target sequence
aaactactgcttaaatttgatgaa

SEQ ID NO: 74721 - DNA, 24 bp, Artificial sequence
  SiRNA target sequence
aactactgcttaaatttgatgaag

SEQ ID NO: 74722 - DNA, 24 bp, Artificial sequence
  SiRNA target sequence
actactgcttaaatttgatgaaga

SEQ ID NO: 74723 - DNA, 24 bp, Artificial sequence
  SiRNA target sequence
ctactgcttaaatttgatgaagat

SEQ ID NO: 74724 - DNA, 24 bp, Artificial sequence
  SiRNA target sequence
tactgcttaaatttgatgaagatt

SEQ ID NO: 74725 - DNA, 24 bp, Artificial sequence
  SiRNA target sequence
actgcttaaatttgatgaagatta

SEQ ID NO: 74726 - DNA, 24 bp, Artificial sequence
  SiRNA target sequence
ctgcttaaatttgatgaagattac

SEQ ID NO: 74727 - DNA, 24 bp, Artificial sequence
  SiRNA target sequence
tgcttaaatttgatgaagattaca

SEQ ID NO: 74728 - DNA, 24 bp, Artificial sequence
  SiRNA target sequence
gcttaaatttgatgaagattacaa

SEQ ID NO: 74729 - DNA, 24 bp, Artificial sequence
  SiRNA target sequence
cttaaatttgatgaagattacaaa

SEQ ID NO: 74730 - DNA, 24 bp, Artificial sequence
  SiRNA target sequence
ttaaatttgatgaagattacaaag

SEQ ID NO: 74731 - DNA, 24 bp, Artificial sequence
  SiRNA target sequence
taaatttgatgaagattacaaagg

SEQ ID NO: 74732 - DNA, 24 bp, Artificial sequence
  SiRNA target sequence
aaatttgatgaagattacaaaggt

SEQ ID NO: 74733 - DNA, 24 bp, Artificial sequence
  SiRNA target sequence
aatttgatgaagattacaaaggta

SEQ ID NO: 74734 - DNA, 24 bp, Artificial sequence
  SiRNA target sequence
atttgatgaagattacaaaggtag

SEQ ID NO: 74735 - DNA, 24 bp, Artificial sequence
  SiRNA target sequence
tttgatgaagattacaaaggtagc

SEQ ID NO: 74736 - DNA, 24 bp, Artificial sequence
  SiRNA target sequence
ttgatgaagattacaaaggtagca

SEQ ID NO: 74737 - DNA, 24 bp, Artificial sequence
  SiRNA target sequence
tgatgaagattacaaaggtagcat

SEQ ID NO: 74738 - DNA, 24 bp, Artificial sequence
  SiRNA target sequence
gatgaagattacaaaggtagcatt

SEQ ID NO: 74739 - DNA, 24 bp, Artificial sequence
  SiRNA target sequence
atgaagattacaaaggtagcattt

SEQ ID NO: 74740 - DNA, 24 bp, Artificial sequence
  SiRNA target sequence
tgaagattacaaaggtagcatttt

SEQ ID NO: 74741 - DNA, 24 bp, Artificial sequence
  SiRNA target sequence
gaagattacaaaggtagcatttta

SEQ ID NO: 74742 - DNA, 24 bp, Artificial sequence
  SiRNA target sequence
aagattacaaaggtagcattttaa

SEQ ID NO: 74743 - DNA, 24 bp, Artificial sequence
  SiRNA target sequence
agattacaaaggtagcattttaat

SEQ ID NO: 74744 - DNA, 24 bp, Artificial sequence
  SiRNA target sequence
gattacaaaggtagcattttaata

SEQ ID NO: 74745 - DNA, 24 bp, Artificial sequence
  SiRNA target sequence
attacaaaggtagcattttaatag

SEQ ID NO: 74746 - DNA, 24 bp, Artificial sequence
  SiRNA target sequence
ttacaaaggtagcattttaataga

SEQ ID NO: 74747 - DNA, 24 bp, Artificial sequence
  SiRNA target sequence
tacaaaggtagcattttaatagat

SEQ ID NO: 74748 - DNA, 24 bp, Artificial sequence
  SiRNA target sequence
acaaaggtagcattttaatagatg

SEQ ID NO: 74749 - DNA, 24 bp, Artificial sequence
  SiRNA target sequence
caaaggtagcattttaatagatga

SEQ ID NO: 74750 - DNA, 24 bp, Artificial sequence
  SiRNA target sequence
aaaggtagcattttaatagatgac

SEQ ID NO: 74751 - DNA, 24 bp, Artificial sequence
  SiRNA target sequence
aaggtagcattttaatagatgaca

SEQ ID NO: 74752 - DNA, 24 bp, Artificial sequence
  SiRNA target sequence
aggtagcattttaatagatgacat

SEQ ID NO: 74753 - DNA, 24 bp, Artificial sequence
  SiRNA target sequence
ggtagcattttaatagatgacatt

SEQ ID NO: 74754 - DNA, 24 bp, Artificial sequence
  SiRNA target sequence
gtagcattttaatagatgacattg

SEQ ID NO: 74755 - DNA, 24 bp, Artificial sequence
  SiRNA target sequence
tagcattttaatagatgacattga

SEQ ID NO: 74756 - DNA, 24 bp, Artificial sequence
  SiRNA target sequence
agcattttaatagatgacattgat

SEQ ID NO: 74757 - DNA, 24 bp, Artificial sequence
  SiRNA target sequence
gcattttaatagatgacattgata

SEQ ID NO: 74758 - DNA, 24 bp, Artificial sequence
  SiRNA target sequence
cattttaatagatgacattgatat

SEQ ID NO: 74759 - DNA, 24 bp, Artificial sequence
  SiRNA target sequence
attttaatagatgacattgatatt

SEQ ID NO: 74760 - DNA, 24 bp, Artificial sequence
  SiRNA target sequence
ttttaatagatgacattgatatta

SEQ ID NO: 74761 - DNA, 24 bp, Artificial sequence
  SiRNA target sequence
tttaatagatgacattgatattaa

SEQ ID NO: 74762 - DNA, 24 bp, Artificial sequence
  SiRNA target sequence
ttaatagatgacattgatattaaa

SEQ ID NO: 74763 - DNA, 24 bp, Artificial sequence
  SiRNA target sequence
taatagatgacattgatattaaaa

SEQ ID NO: 74764 - DNA, 24 bp, Artificial sequence
  SiRNA target sequence
aatagatgacattgatattaaaaa

SEQ ID NO: 74765 - DNA, 24 bp, Artificial sequence
  SiRNA target sequence
atagatgacattgatattaaaaaa

SEQ ID NO: 74766 - DNA, 24 bp, Artificial sequence
  SiRNA target sequence
tagatgacattgatattaaaaaaa

SEQ ID NO: 74767 - DNA, 24 bp, Artificial sequence
  SiRNA target sequence
agatgacattgatattaaaaaaat

SEQ ID NO: 74768 - DNA, 24 bp, Artificial sequence
  SiRNA target sequence
gatgacattgatattaaaaaaatc

SEQ ID NO: 74769 - DNA, 24 bp, Artificial sequence
  SiRNA target sequence
atgacattgatattaaaaaaatca

SEQ ID NO: 74770 - DNA, 24 bp, Artificial sequence
  SiRNA target sequence
tgacattgatattaaaaaaatcaa

SEQ ID NO: 74771 - DNA, 24 bp, Artificial sequence
  SiRNA target sequence
gacattgatattaaaaaaatcaaa

SEQ ID NO: 74772 - DNA, 24 bp, Artificial sequence
  SiRNA target sequence
acattgatattaaaaaaatcaaag

SEQ ID NO: 74773 - DNA, 24 bp, Artificial sequence
  SiRNA target sequence
cattgatattaaaaaaatcaaaga

SEQ ID NO: 74774 - DNA, 24 bp, Artificial sequence
  SiRNA target sequence
attgatattaaaaaaatcaaagac

SEQ ID NO: 74775 - DNA, 24 bp, Artificial sequence
  SiRNA target sequence
ttgatattaaaaaaatcaaagacg

SEQ ID NO: 74776 - DNA, 24 bp, Artificial sequence
  SiRNA target sequence
tgatattaaaaaaatcaaagacga

SEQ ID NO: 74777 - DNA, 24 bp, Artificial sequence
  SiRNA target sequence
gatattaaaaaaatcaaagacgaa

SEQ ID NO: 74778 - DNA, 24 bp, Artificial sequence
  SiRNA target sequence
atattaaaaaaatcaaagacgaat

SEQ ID NO: 74779 - DNA, 24 bp, Artificial sequence
  SiRNA target sequence
tattaaaaaaatcaaagacgaatt

SEQ ID NO: 74780 - DNA, 24 bp, Artificial sequence
  SiRNA target sequence
attaaaaaaatcaaagacgaattt

SEQ ID NO: 74781 - DNA, 24 bp, Artificial sequence
  SiRNA target sequence
ttaaaaaaatcaaagacgaatttt

SEQ ID NO: 74782 - DNA, 24 bp, Artificial sequence
  SiRNA target sequence
taaaaaaatcaaagacgaatttta

SEQ ID NO: 74783 - DNA, 24 bp, Artificial sequence
  SiRNA target sequence
aaaaaaatcaaagacgaattttat

SEQ ID NO: 74784 - DNA, 24 bp, Artificial sequence
  SiRNA target sequence
aaaaaatcaaagacgaattttata

SEQ ID NO: 74785 - DNA, 24 bp, Artificial sequence
  SiRNA target sequence
aaaaatcaaagacgaattttatag

SEQ ID NO: 74786 - DNA, 24 bp, Artificial sequence
  SiRNA target sequence
aaaatcaaagacgaattttatagg

SEQ ID NO: 74787 - DNA, 24 bp, Artificial sequence
  SiRNA target sequence
aaatcaaagacgaattttatagga

SEQ ID NO: 74788 - DNA, 24 bp, Artificial sequence
  SiRNA target sequence
aatcaaagacgaattttataggaa

SEQ ID NO: 74789 - DNA, 24 bp, Artificial sequence
  SiRNA target sequence
atcaaagacgaattttataggaat

SEQ ID NO: 74790 - DNA, 24 bp, Artificial sequence
  SiRNA target sequence
tcaaagacgaattttataggaatt

SEQ ID NO: 74791 - DNA, 24 bp, Artificial sequence
  SiRNA target sequence
caaagacgaattttataggaattt

SEQ ID NO: 74792 - DNA, 24 bp, Artificial sequence
  SiRNA target sequence
aaagacgaattttataggaattta

SEQ ID NO: 74793 - DNA, 24 bp, Artificial sequence
  SiRNA target sequence
aagacgaattttataggaatttat

SEQ ID NO: 74794 - DNA, 24 bp, Artificial sequence
  SiRNA target sequence
agacgaattttataggaatttatt

SEQ ID NO: 74795 - DNA, 24 bp, Artificial sequence
  SiRNA target sequence
gacgaattttataggaatttatta

SEQ ID NO: 74796 - DNA, 24 bp, Artificial sequence
  SiRNA target sequence
acgaattttataggaatttattag

SEQ ID NO: 74797 - DNA, 24 bp, Artificial sequence
  SiRNA target sequence
cgaattttataggaatttattagg

SEQ ID NO: 74798 - DNA, 24 bp, Artificial sequence
  SiRNA target sequence
gaattttataggaatttattaggt

SEQ ID NO: 74799 - DNA, 24 bp, Artificial sequence
  SiRNA target sequence
aattttataggaatttattaggtt

SEQ ID NO: 74800 - DNA, 24 bp, Artificial sequence
  SiRNA target sequence
attttataggaatttattaggtta

SEQ ID NO: 74801 - DNA, 24 bp, Artificial sequence
  SiRNA target sequence
ttttataggaatttattaggttac

SEQ ID NO: 74802 - DNA, 24 bp, Artificial sequence
  SiRNA target sequence
tttataggaatttattaggttaca

SEQ ID NO: 74803 - DNA, 24 bp, Artificial sequence
  SiRNA target sequence
ttataggaatttattaggttacat

SEQ ID NO: 74804 - DNA, 24 bp, Artificial sequence
  SiRNA target sequence
tataggaatttattaggttacata

SEQ ID NO: 74805 - DNA, 24 bp, Artificial sequence
  SiRNA target sequence
ataggaatttattaggttacatac

SEQ ID NO: 74806 - DNA, 24 bp, Artificial sequence
  SiRNA target sequence
taggaatttattaggttacatacc

SEQ ID NO: 74807 - DNA, 24 bp, Artificial sequence
  SiRNA target sequence
aggaatttattaggttacatacca

SEQ ID NO: 74808 - DNA, 24 bp, Artificial sequence
  SiRNA target sequence
ggaatttattaggttacataccac

SEQ ID NO: 74809 - DNA, 24 bp, Artificial sequence
  SiRNA target sequence
gaatttattaggttacataccaca

SEQ ID NO: 74810 - DNA, 24 bp, Artificial sequence
  SiRNA target sequence
aatttattaggttacataccacag

SEQ ID NO: 74811 - DNA, 24 bp, Artificial sequence
  SiRNA target sequence
atttattaggttacataccacaga

SEQ ID NO: 74812 - DNA, 24 bp, Artificial sequence
  SiRNA target sequence
tttattaggttacataccacagaa

SEQ ID NO: 74813 - DNA, 24 bp, Artificial sequence
  SiRNA target sequence
ttattaggttacataccacagaat

SEQ ID NO: 74814 - DNA, 24 bp, Artificial sequence
  SiRNA target sequence
tattaggttacataccacagaata

SEQ ID NO: 74815 - DNA, 24 bp, Artificial sequence
  SiRNA target sequence
attaggttacataccacagaatac

SEQ ID NO: 74816 - DNA, 24 bp, Artificial sequence
  SiRNA target sequence
ttaggttacataccacagaataca

SEQ ID NO: 74817 - DNA, 24 bp, Artificial sequence
  SiRNA target sequence
taggttacataccacagaatacat

SEQ ID NO: 74818 - DNA, 24 bp, Artificial sequence
  SiRNA target sequence
aggttacataccacagaatacatt

SEQ ID NO: 74819 - DNA, 24 bp, Artificial sequence
  SiRNA target sequence
ggttacataccacagaatacattt

SEQ ID NO: 74820 - DNA, 24 bp, Artificial sequence
  SiRNA target sequence
gttacataccacagaatacatttt

SEQ ID NO: 74821 - DNA, 24 bp, Artificial sequence
  SiRNA target sequence
ttacataccacagaatacattttt

SEQ ID NO: 74822 - DNA, 24 bp, Artificial sequence
  SiRNA target sequence
tacataccacagaatacatttttg

SEQ ID NO: 74823 - DNA, 24 bp, Artificial sequence
  SiRNA target sequence
acataccacagaatacatttttgt

SEQ ID NO: 74824 - DNA, 24 bp, Artificial sequence
  SiRNA target sequence
cataccacagaatacatttttgtt

SEQ ID NO: 74825 - DNA, 24 bp, Artificial sequence
  SiRNA target sequence
ataccacagaatacatttttgttt

SEQ ID NO: 74826 - DNA, 24 bp, Artificial sequence
  SiRNA target sequence
taccacagaatacatttttgttta

SEQ ID NO: 74827 - DNA, 24 bp, Artificial sequence
  SiRNA target sequence
accacagaatacatttttgtttaa

SEQ ID NO: 74828 - DNA, 24 bp, Artificial sequence
  SiRNA target sequence
ccacagaatacatttttgtttaat

SEQ ID NO: 74829 - DNA, 24 bp, Artificial sequence
  SiRNA target sequence
cacagaatacatttttgtttaatg

SEQ ID NO: 74830 - DNA, 24 bp, Artificial sequence
  SiRNA target sequence
acagaatacatttttgtttaatga

SEQ ID NO: 74831 - DNA, 24 bp, Artificial sequence
  SiRNA target sequence
cagaatacatttttgtttaatgaa

SEQ ID NO: 74832 - DNA, 24 bp, Artificial sequence
  SiRNA target sequence
agaatacatttttgtttaatgaat

SEQ ID NO: 74833 - DNA, 24 bp, Artificial sequence
  SiRNA target sequence
gaatacatttttgtttaatgaatc

SEQ ID NO: 74834 - DNA, 24 bp, Artificial sequence
  SiRNA target sequence
aatacatttttgtttaatgaatct

SEQ ID NO: 74835 - DNA, 24 bp, Artificial sequence
  SiRNA target sequence
atacatttttgtttaatgaatctg

SEQ ID NO: 74836 - DNA, 24 bp, Artificial sequence
  SiRNA target sequence
tacatttttgtttaatgaatctgt

SEQ ID NO: 74837 - DNA, 24 bp, Artificial sequence
  SiRNA target sequence
acatttttgtttaatgaatctgta

SEQ ID NO: 74838 - DNA, 24 bp, Artificial sequence
  SiRNA target sequence
catttttgtttaatgaatctgtaa

SEQ ID NO: 74839 - DNA, 24 bp, Artificial sequence
  SiRNA target sequence
atttttgtttaatgaatctgtaaa

SEQ ID NO: 74840 - DNA, 24 bp, Artificial sequence
  SiRNA target sequence
tttttgtttaatgaatctgtaaaa

SEQ ID NO: 74841 - DNA, 24 bp, Artificial sequence
  SiRNA target sequence
ttttgtttaatgaatctgtaaaat

SEQ ID NO: 74842 - DNA, 24 bp, Artificial sequence
  SiRNA target sequence
tttgtttaatgaatctgtaaaata

SEQ ID NO: 74843 - DNA, 24 bp, Artificial sequence
  SiRNA target sequence
ttgtttaatgaatctgtaaaatat

SEQ ID NO: 74844 - DNA, 24 bp, Artificial sequence
  SiRNA target sequence
tgtttaatgaatctgtaaaatata

SEQ ID NO: 74845 - DNA, 24 bp, Artificial sequence
  SiRNA target sequence
gtttaatgaatctgtaaaatataa

SEQ ID NO: 74846 - DNA, 24 bp, Artificial sequence
  SiRNA target sequence
tttaatgaatctgtaaaatataat

SEQ ID NO: 74847 - DNA, 24 bp, Artificial sequence
  SiRNA target sequence
ttaatgaatctgtaaaatataata

SEQ ID NO: 74848 - DNA, 24 bp, Artificial sequence
  SiRNA target sequence
taatgaatctgtaaaatataatat

SEQ ID NO: 74849 - DNA, 24 bp, Artificial sequence
  SiRNA target sequence
aatgaatctgtaaaatataatatt

SEQ ID NO: 74850 - DNA, 24 bp, Artificial sequence
  SiRNA target sequence
atgaatctgtaaaatataatatta

SEQ ID NO: 74851 - DNA, 24 bp, Artificial sequence
  SiRNA target sequence
tgaatctgtaaaatataatattaa

SEQ ID NO: 74852 - DNA, 24 bp, Artificial sequence
  SiRNA target sequence
gaatctgtaaaatataatattaaa

SEQ ID NO: 74853 - DNA, 24 bp, Artificial sequence
  SiRNA target sequence
aatctgtaaaatataatattaaat

SEQ ID NO: 74854 - DNA, 24 bp, Artificial sequence
  SiRNA target sequence
atctgtaaaatataatattaaata

SEQ ID NO: 74855 - DNA, 24 bp, Artificial sequence
  SiRNA target sequence
tctgtaaaatataatattaaatac

SEQ ID NO: 74856 - DNA, 24 bp, Artificial sequence
  SiRNA target sequence
ctgtaaaatataatattaaatacg

SEQ ID NO: 74857 - DNA, 24 bp, Artificial sequence
  SiRNA target sequence
tgtaaaatataatattaaatacgg

SEQ ID NO: 74858 - DNA, 24 bp, Artificial sequence
  SiRNA target sequence
gtaaaatataatattaaatacgga

SEQ ID NO: 74859 - DNA, 24 bp, Artificial sequence
  SiRNA target sequence
taaaatataatattaaatacggat

SEQ ID NO: 74860 - DNA, 24 bp, Artificial sequence
  SiRNA target sequence
aaaatataatattaaatacggatc

SEQ ID NO: 74861 - DNA, 24 bp, Artificial sequence
  SiRNA target sequence
aaatataatattaaatacggatct

SEQ ID NO: 74862 - DNA, 24 bp, Artificial sequence
  SiRNA target sequence
aatataatattaaatacggatctt

SEQ ID NO: 74863 - DNA, 24 bp, Artificial sequence
  SiRNA target sequence
atataatattaaatacggatcttt

SEQ ID NO: 74864 - DNA, 24 bp, Artificial sequence
  SiRNA target sequence
tataatattaaatacggatctttt

SEQ ID NO: 74865 - DNA, 24 bp, Artificial sequence
  SiRNA target sequence
ataatattaaatacggatcttttg

SEQ ID NO: 74866 - DNA, 24 bp, Artificial sequence
  SiRNA target sequence
taatattaaatacggatcttttgg

SEQ ID NO: 74867 - DNA, 24 bp, Artificial sequence
  SiRNA target sequence
aatattaaatacggatcttttggt

SEQ ID NO: 74868 - DNA, 24 bp, Artificial sequence
  SiRNA target sequence
atattaaatacggatcttttggta

SEQ ID NO: 74869 - DNA, 24 bp, Artificial sequence
  SiRNA target sequence
tattaaatacggatcttttggtat

SEQ ID NO: 74870 - DNA, 24 bp, Artificial sequence
  SiRNA target sequence
attaaatacggatcttttggtatt

SEQ ID NO: 74871 - DNA, 24 bp, Artificial sequence
  SiRNA target sequence
ttaaatacggatcttttggtattt

SEQ ID NO: 74872 - DNA, 24 bp, Artificial sequence
  SiRNA target sequence
taaatacggatcttttggtatttc

SEQ ID NO: 74873 - DNA, 24 bp, Artificial sequence
  SiRNA target sequence
aaatacggatcttttggtatttca

SEQ ID NO: 74874 - DNA, 24 bp, Artificial sequence
  SiRNA target sequence
aatacggatcttttggtatttcag

SEQ ID NO: 74875 - DNA, 24 bp, Artificial sequence
  SiRNA target sequence
atacggatcttttggtatttcaga

SEQ ID NO: 74876 - DNA, 24 bp, Artificial sequence
  SiRNA target sequence
tacggatcttttggtatttcagac

SEQ ID NO: 74877 - DNA, 24 bp, Artificial sequence
  SiRNA target sequence
acggatcttttggtatttcagacg

SEQ ID NO: 74878 - DNA, 24 bp, Artificial sequence
  SiRNA target sequence
cggatcttttggtatttcagacga

SEQ ID NO: 74879 - DNA, 24 bp, Artificial sequence
  SiRNA target sequence
ggatcttttggtatttcagacgag

SEQ ID NO: 74880 - DNA, 24 bp, Artificial sequence
  SiRNA target sequence
gatcttttggtatttcagacgagg

SEQ ID NO: 74881 - DNA, 24 bp, Artificial sequence
  SiRNA target sequence
atcttttggtatttcagacgagga

SEQ ID NO: 74882 - DNA, 24 bp, Artificial sequence
  SiRNA target sequence
tcttttggtatttcagacgaggat

SEQ ID NO: 74883 - DNA, 24 bp, Artificial sequence
  SiRNA target sequence
cttttggtatttcagacgaggata

SEQ ID NO: 74884 - DNA, 24 bp, Artificial sequence
  SiRNA target sequence
ttttggtatttcagacgaggatat

SEQ ID NO: 74885 - DNA, 24 bp, Artificial sequence
  SiRNA target sequence
tttggtatttcagacgaggatatt

SEQ ID NO: 74886 - DNA, 24 bp, Artificial sequence
  SiRNA target sequence
ttggtatttcagacgaggatattt

SEQ ID NO: 74887 - DNA, 24 bp, Artificial sequence
  SiRNA target sequence
tggtatttcagacgaggatatttt

SEQ ID NO: 74888 - DNA, 24 bp, Artificial sequence
  SiRNA target sequence
ggtatttcagacgaggatattttt

SEQ ID NO: 74889 - DNA, 24 bp, Artificial sequence
  SiRNA target sequence
gtatttcagacgaggatatttttg

SEQ ID NO: 74890 - DNA, 24 bp, Artificial sequence
  SiRNA target sequence
tatttcagacgaggatatttttgc

SEQ ID NO: 74891 - DNA, 24 bp, Artificial sequence
  SiRNA target sequence
atttcagacgaggatatttttgca

SEQ ID NO: 74892 - DNA, 24 bp, Artificial sequence
  SiRNA target sequence
tttcagacgaggatatttttgcat

SEQ ID NO: 74893 - DNA, 24 bp, Artificial sequence
  SiRNA target sequence
ttcagacgaggatatttttgcatt

SEQ ID NO: 74894 - DNA, 24 bp, Artificial sequence
  SiRNA target sequence
tcagacgaggatatttttgcattg

SEQ ID NO: 74895 - DNA, 24 bp, Artificial sequence
  SiRNA target sequence
cagacgaggatatttttgcattgt

SEQ ID NO: 74896 - DNA, 24 bp, Artificial sequence
  SiRNA target sequence
agacgaggatatttttgcattgtg

SEQ ID NO: 74897 - DNA, 24 bp, Artificial sequence
  SiRNA target sequence
gacgaggatatttttgcattgtgt

SEQ ID NO: 74898 - DNA, 24 bp, Artificial sequence
  SiRNA target sequence
acgaggatatttttgcattgtgta

SEQ ID NO: 74899 - DNA, 24 bp, Artificial sequence
  SiRNA target sequence
cgaggatatttttgcattgtgtaa

SEQ ID NO: 74900 - DNA, 24 bp, Artificial sequence
  SiRNA target sequence
gaggatatttttgcattgtgtaaa

SEQ ID NO: 74901 - DNA, 24 bp, Artificial sequence
  SiRNA target sequence
aggatatttttgcattgtgtaaag

SEQ ID NO: 74902 - DNA, 24 bp, Artificial sequence
  SiRNA target sequence
ggatatttttgcattgtgtaaaga

SEQ ID NO: 74903 - DNA, 24 bp, Artificial sequence
  SiRNA target sequence
gatatttttgcattgtgtaaagag

SEQ ID NO: 74904 - DNA, 24 bp, Artificial sequence
  SiRNA target sequence
atatttttgcattgtgtaaagagt

SEQ ID NO: 74905 - DNA, 24 bp, Artificial sequence
  SiRNA target sequence
tatttttgcattgtgtaaagagtt

SEQ ID NO: 74906 - DNA, 24 bp, Artificial sequence
  SiRNA target sequence
atttttgcattgtgtaaagagttt

SEQ ID NO: 74907 - DNA, 24 bp, Artificial sequence
  SiRNA target sequence
tttttgcattgtgtaaagagtttg

SEQ ID NO: 74908 - DNA, 24 bp, Artificial sequence
  SiRNA target sequence
ttttgcattgtgtaaagagtttgg

SEQ ID NO: 74909 - DNA, 24 bp, Artificial sequence
  SiRNA target sequence
tttgcattgtgtaaagagtttgga

SEQ ID NO: 74910 - DNA, 24 bp, Artificial sequence
  SiRNA target sequence
ttgcattgtgtaaagagtttggat

SEQ ID NO: 74911 - DNA, 24 bp, Artificial sequence
  SiRNA target sequence
tgcattgtgtaaagagtttggatt

SEQ ID NO: 74912 - DNA, 24 bp, Artificial sequence
  SiRNA target sequence
gcattgtgtaaagagtttggatta

SEQ ID NO: 74913 - DNA, 24 bp, Artificial sequence
  SiRNA target sequence
cattgtgtaaagagtttggattat

SEQ ID NO: 74914 - DNA, 24 bp, Artificial sequence
  SiRNA target sequence
attgtgtaaagagtttggattata

SEQ ID NO: 74915 - DNA, 24 bp, Artificial sequence
  SiRNA target sequence
ttgtgtaaagagtttggattatat

SEQ ID NO: 74916 - DNA, 24 bp, Artificial sequence
  SiRNA target sequence
tgtgtaaagagtttggattatatg

SEQ ID NO: 74917 - DNA, 24 bp, Artificial sequence
  SiRNA target sequence
gtgtaaagagtttggattatatga

SEQ ID NO: 74918 - DNA, 24 bp, Artificial sequence
  SiRNA target sequence
tgtaaagagtttggattatatgac

SEQ ID NO: 74919 - DNA, 24 bp, Artificial sequence
  SiRNA target sequence
gtaaagagtttggattatatgacg

SEQ ID NO: 74920 - DNA, 24 bp, Artificial sequence
  SiRNA target sequence
taaagagtttggattatatgacgt

SEQ ID NO: 74921 - DNA, 24 bp, Artificial sequence
  SiRNA target sequence
aaagagtttggattatatgacgtt

SEQ ID NO: 74922 - DNA, 24 bp, Artificial sequence
  SiRNA target sequence
aagagtttggattatatgacgttt

SEQ ID NO: 74923 - DNA, 24 bp, Artificial sequence
  SiRNA target sequence
agagtttggattatatgacgtttt

SEQ ID NO: 74924 - DNA, 24 bp, Artificial sequence
  SiRNA target sequence
gagtttggattatatgacgttttc

SEQ ID NO: 74925 - DNA, 24 bp, Artificial sequence
  SiRNA target sequence
agtttggattatatgacgttttca

SEQ ID NO: 74926 - DNA, 24 bp, Artificial sequence
  SiRNA target sequence
gtttggattatatgacgttttcat

SEQ ID NO: 74927 - DNA, 24 bp, Artificial sequence
  SiRNA target sequence
tttggattatatgacgttttcatg

SEQ ID NO: 74928 - DNA, 24 bp, Artificial sequence
  SiRNA target sequence
ttggattatatgacgttttcatga

SEQ ID NO: 74929 - DNA, 24 bp, Artificial sequence
  SiRNA target sequence
tggattatatgacgttttcatgaa

SEQ ID NO: 74930 - DNA, 24 bp, Artificial sequence
  SiRNA target sequence
ggattatatgacgttttcatgaac

SEQ ID NO: 74931 - DNA, 24 bp, Artificial sequence
  SiRNA target sequence
gattatatgacgttttcatgaacc

SEQ ID NO: 74932 - DNA, 24 bp, Artificial sequence
  SiRNA target sequence
attatatgacgttttcatgaacct

SEQ ID NO: 74933 - DNA, 24 bp, Artificial sequence
  SiRNA target sequence
ttatatgacgttttcatgaacctc

SEQ ID NO: 74934 - DNA, 24 bp, Artificial sequence
  SiRNA target sequence
tatatgacgttttcatgaacctcg

SEQ ID NO: 74935 - DNA, 24 bp, Artificial sequence
  SiRNA target sequence
atatgacgttttcatgaacctcga

SEQ ID NO: 74936 - DNA, 24 bp, Artificial sequence
  SiRNA target sequence
tatgacgttttcatgaacctcgaa

SEQ ID NO: 74937 - DNA, 24 bp, Artificial sequence
  SiRNA target sequence
atgacgttttcatgaacctcgaaa

SEQ ID NO: 74938 - DNA, 24 bp, Artificial sequence
  SiRNA target sequence
tgacgttttcatgaacctcgaaaa

SEQ ID NO: 74939 - DNA, 24 bp, Artificial sequence
  SiRNA target sequence
gacgttttcatgaacctcgaaaat

SEQ ID NO: 74940 - DNA, 24 bp, Artificial sequence
  SiRNA target sequence
acgttttcatgaacctcgaaaatg

SEQ ID NO: 74941 - DNA, 24 bp, Artificial sequence
  SiRNA target sequence
cgttttcatgaacctcgaaaatgg

SEQ ID NO: 74942 - DNA, 24 bp, Artificial sequence
  SiRNA target sequence
gttttcatgaacctcgaaaatggt

SEQ ID NO: 74943 - DNA, 24 bp, Artificial sequence
  SiRNA target sequence
ttttcatgaacctcgaaaatggtt

SEQ ID NO: 74944 - DNA, 24 bp, Artificial sequence
  SiRNA target sequence
tttcatgaacctcgaaaatggttt

SEQ ID NO: 74945 - DNA, 24 bp, Artificial sequence
  SiRNA target sequence
ttcatgaacctcgaaaatggtttt

SEQ ID NO: 74946 - DNA, 24 bp, Artificial sequence
  SiRNA target sequence
tcatgaacctcgaaaatggttttg

SEQ ID NO: 74947 - DNA, 24 bp, Artificial sequence
  SiRNA target sequence
catgaacctcgaaaatggttttga

SEQ ID NO: 74948 - DNA, 24 bp, Artificial sequence
  SiRNA target sequence
atgaacctcgaaaatggttttgat

SEQ ID NO: 74949 - DNA, 24 bp, Artificial sequence
  SiRNA target sequence
tgaacctcgaaaatggttttgata

SEQ ID NO: 74950 - DNA, 24 bp, Artificial sequence
  SiRNA target sequence
gaacctcgaaaatggttttgatac

SEQ ID NO: 74951 - DNA, 24 bp, Artificial sequence
  SiRNA target sequence
aacctcgaaaatggttttgatacg

SEQ ID NO: 74952 - DNA, 24 bp, Artificial sequence
  SiRNA target sequence
acctcgaaaatggttttgatacga

SEQ ID NO: 74953 - DNA, 24 bp, Artificial sequence
  SiRNA target sequence
cctcgaaaatggttttgatacgaa

SEQ ID NO: 74954 - DNA, 24 bp, Artificial sequence
  SiRNA target sequence
ctcgaaaatggttttgatacgaat

SEQ ID NO: 74955 - DNA, 24 bp, Artificial sequence
  SiRNA target sequence
tcgaaaatggttttgatacgaatg

SEQ ID NO: 74956 - DNA, 24 bp, Artificial sequence
  SiRNA target sequence
cgaaaatggttttgatacgaatgt

SEQ ID NO: 74957 - DNA, 24 bp, Artificial sequence
  SiRNA target sequence
gaaaatggttttgatacgaatgta

SEQ ID NO: 74958 - DNA, 24 bp, Artificial sequence
  SiRNA target sequence
aaaatggttttgatacgaatgtag

SEQ ID NO: 74959 - DNA, 24 bp, Artificial sequence
  SiRNA target sequence
aaatggttttgatacgaatgtagg

SEQ ID NO: 74960 - DNA, 24 bp, Artificial sequence
  SiRNA target sequence
aatggttttgatacgaatgtagga

SEQ ID NO: 74961 - DNA, 24 bp, Artificial sequence
  SiRNA target sequence
atggttttgatacgaatgtaggag

SEQ ID NO: 74962 - DNA, 24 bp, Artificial sequence
  SiRNA target sequence
tggttttgatacgaatgtaggaga

SEQ ID NO: 74963 - DNA, 24 bp, Artificial sequence
  SiRNA target sequence
ggttttgatacgaatgtaggagaa

SEQ ID NO: 74964 - DNA, 24 bp, Artificial sequence
  SiRNA target sequence
gttttgatacgaatgtaggagaaa

SEQ ID NO: 74965 - DNA, 24 bp, Artificial sequence
  SiRNA target sequence
ttttgatacgaatgtaggagaaag

SEQ ID NO: 74966 - DNA, 24 bp, Artificial sequence
  SiRNA target sequence
tttgatacgaatgtaggagaaaga

SEQ ID NO: 74967 - DNA, 24 bp, Artificial sequence
  SiRNA target sequence
ttgatacgaatgtaggagaaagag

SEQ ID NO: 74968 - DNA, 24 bp, Artificial sequence
  SiRNA target sequence
tgatacgaatgtaggagaaagagg

SEQ ID NO: 74969 - DNA, 24 bp, Artificial sequence
  SiRNA target sequence
gatacgaatgtaggagaaagagga

SEQ ID NO: 74970 - DNA, 24 bp, Artificial sequence
  SiRNA target sequence
atacgaatgtaggagaaagaggaa

SEQ ID NO: 74971 - DNA, 24 bp, Artificial sequence
  SiRNA target sequence
tacgaatgtaggagaaagaggaag

SEQ ID NO: 74972 - DNA, 24 bp, Artificial sequence
  SiRNA target sequence
acgaatgtaggagaaagaggaagg

SEQ ID NO: 74973 - DNA, 24 bp, Artificial sequence
  SiRNA target sequence
cgaatgtaggagaaagaggaaggt

SEQ ID NO: 74974 - DNA, 24 bp, Artificial sequence
  SiRNA target sequence
gaatgtaggagaaagaggaaggtt

SEQ ID NO: 74975 - DNA, 24 bp, Artificial sequence
  SiRNA target sequence
aatgtaggagaaagaggaaggtta

SEQ ID NO: 74976 - DNA, 24 bp, Artificial sequence
  SiRNA target sequence
atgtaggagaaagaggaaggttat

SEQ ID NO: 74977 - DNA, 24 bp, Artificial sequence
  SiRNA target sequence
tgtaggagaaagaggaaggttatt

SEQ ID NO: 74978 - DNA, 24 bp, Artificial sequence
  SiRNA target sequence
gtaggagaaagaggaaggttatta

SEQ ID NO: 74979 - DNA, 24 bp, Artificial sequence
  SiRNA target sequence
taggagaaagaggaaggttattaa

SEQ ID NO: 74980 - DNA, 24 bp, Artificial sequence
  SiRNA target sequence
aggagaaagaggaaggttattaag

SEQ ID NO: 74981 - DNA, 24 bp, Artificial sequence
  SiRNA target sequence
ggagaaagaggaaggttattaagt

SEQ ID NO: 74982 - DNA, 24 bp, Artificial sequence
  SiRNA target sequence
gagaaagaggaaggttattaagtg

SEQ ID NO: 74983 - DNA, 24 bp, Artificial sequence
  SiRNA target sequence
agaaagaggaaggttattaagtgg

SEQ ID NO: 74984 - DNA, 24 bp, Artificial sequence
  SiRNA target sequence
gaaagaggaaggttattaagtggt

SEQ ID NO: 74985 - DNA, 24 bp, Artificial sequence
  SiRNA target sequence
aaagaggaaggttattaagtggtg

SEQ ID NO: 74986 - DNA, 24 bp, Artificial sequence
  SiRNA target sequence
aagaggaaggttattaagtggtgg

SEQ ID NO: 74987 - DNA, 24 bp, Artificial sequence
  SiRNA target sequence
agaggaaggttattaagtggtgga

SEQ ID NO: 74988 - DNA, 24 bp, Artificial sequence
  SiRNA target sequence
gaggaaggttattaagtggtggag

SEQ ID NO: 74989 - DNA, 24 bp, Artificial sequence
  SiRNA target sequence
aggaaggttattaagtggtggaga

SEQ ID NO: 74990 - DNA, 24 bp, Artificial sequence
  SiRNA target sequence
ggaaggttattaagtggtggagaa

SEQ ID NO: 74991 - DNA, 24 bp, Artificial sequence
  SiRNA target sequence
gaaggttattaagtggtggagaaa

SEQ ID NO: 74992 - DNA, 24 bp, Artificial sequence
  SiRNA target sequence
aaggttattaagtggtggagaaaa

SEQ ID NO: 74993 - DNA, 24 bp, Artificial sequence
  SiRNA target sequence
aggttattaagtggtggagaaaag

SEQ ID NO: 74994 - DNA, 24 bp, Artificial sequence
  SiRNA target sequence
ggttattaagtggtggagaaaagc

SEQ ID NO: 74995 - DNA, 24 bp, Artificial sequence
  SiRNA target sequence
gttattaagtggtggagaaaagca

SEQ ID NO: 74996 - DNA, 24 bp, Artificial sequence
  SiRNA target sequence
ttattaagtggtggagaaaagcaa

SEQ ID NO: 74997 - DNA, 24 bp, Artificial sequence
  SiRNA target sequence
tattaagtggtggagaaaagcaaa

SEQ ID NO: 74998 - DNA, 24 bp, Artificial sequence
  SiRNA target sequence
attaagtggtggagaaaagcaaaa

SEQ ID NO: 74999 - DNA, 24 bp, Artificial sequence
  SiRNA target sequence
ttaagtggtggagaaaagcaaaag

SEQ ID NO: 75000 - DNA, 24 bp, Artificial sequence
  SiRNA target sequence
taagtggtggagaaaagcaaaaga

SEQ ID NO: 75001 - DNA, 24 bp, Artificial sequence
  SiRNA target sequence
aagtggtggagaaaagcaaaagat

SEQ ID NO: 75002 - DNA, 24 bp, Artificial sequence
  SiRNA target sequence
agtggtggagaaaagcaaaagatt

SEQ ID NO: 75003 - DNA, 24 bp, Artificial sequence
  SiRNA target sequence
gtggtggagaaaagcaaaagattt

SEQ ID NO: 75004 - DNA, 24 bp, Artificial sequence
  SiRNA target sequence
tggtggagaaaagcaaaagatttt

SEQ ID NO: 75005 - DNA, 24 bp, Artificial sequence
  SiRNA target sequence
ggtggagaaaagcaaaagatttta

SEQ ID NO: 75006 - DNA, 24 bp, Artificial sequence
  SiRNA target sequence
gtggagaaaagcaaaagattttat

SEQ ID NO: 75007 - DNA, 24 bp, Artificial sequence
  SiRNA target sequence
tggagaaaagcaaaagattttatt

SEQ ID NO: 75008 - DNA, 24 bp, Artificial sequence
  SiRNA target sequence
ggagaaaagcaaaagattttatta

SEQ ID NO: 75009 - DNA, 24 bp, Artificial sequence
  SiRNA target sequence
gagaaaagcaaaagattttattaa

SEQ ID NO: 75010 - DNA, 24 bp, Artificial sequence
  SiRNA target sequence
agaaaagcaaaagattttattaat

SEQ ID NO: 75011 - DNA, 24 bp, Artificial sequence
  SiRNA target sequence
gaaaagcaaaagattttattaatg

SEQ ID NO: 75012 - DNA, 24 bp, Artificial sequence
  SiRNA target sequence
aaaagcaaaagattttattaatgc

SEQ ID NO: 75013 - DNA, 24 bp, Artificial sequence
  SiRNA target sequence
aaagcaaaagattttattaatgcg

SEQ ID NO: 75014 - DNA, 24 bp, Artificial sequence
  SiRNA target sequence
aagcaaaagattttattaatgcgt

SEQ ID NO: 75015 - DNA, 24 bp, Artificial sequence
  SiRNA target sequence
agcaaaagattttattaatgcgta

SEQ ID NO: 75016 - DNA, 24 bp, Artificial sequence
  SiRNA target sequence
gcaaaagattttattaatgcgtac

SEQ ID NO: 75017 - DNA, 24 bp, Artificial sequence
  SiRNA target sequence
caaaagattttattaatgcgtact

SEQ ID NO: 75018 - DNA, 24 bp, Artificial sequence
  SiRNA target sequence
aaaagattttattaatgcgtacta

SEQ ID NO: 75019 - DNA, 24 bp, Artificial sequence
  SiRNA target sequence
aaagattttattaatgcgtactat

SEQ ID NO: 75020 - DNA, 24 bp, Artificial sequence
  SiRNA target sequence
aagattttattaatgcgtactatg

SEQ ID NO: 75021 - DNA, 24 bp, Artificial sequence
  SiRNA target sequence
agattttattaatgcgtactatgt

SEQ ID NO: 75022 - DNA, 24 bp, Artificial sequence
  SiRNA target sequence
gattttattaatgcgtactatgtt

SEQ ID NO: 75023 - DNA, 24 bp, Artificial sequence
  SiRNA target sequence
attttattaatgcgtactatgtta

SEQ ID NO: 75024 - DNA, 24 bp, Artificial sequence
  SiRNA target sequence
ttttattaatgcgtactatgttaa

SEQ ID NO: 75025 - DNA, 24 bp, Artificial sequence
  SiRNA target sequence
tttattaatgcgtactatgttaag

SEQ ID NO: 75026 - DNA, 24 bp, Artificial sequence
  SiRNA target sequence
ttattaatgcgtactatgttaaga

SEQ ID NO: 75027 - DNA, 24 bp, Artificial sequence
  SiRNA target sequence
tattaatgcgtactatgttaagaa

SEQ ID NO: 75028 - DNA, 24 bp, Artificial sequence
  SiRNA target sequence
attaatgcgtactatgttaagaaa

SEQ ID NO: 75029 - DNA, 24 bp, Artificial sequence
  SiRNA target sequence
ttaatgcgtactatgttaagaaac

SEQ ID NO: 75030 - DNA, 24 bp, Artificial sequence
  SiRNA target sequence
taatgcgtactatgttaagaaaca

SEQ ID NO: 75031 - DNA, 24 bp, Artificial sequence
  SiRNA target sequence
aatgcgtactatgttaagaaacaa

SEQ ID NO: 75032 - DNA, 24 bp, Artificial sequence
  SiRNA target sequence
atgcgtactatgttaagaaacaag

SEQ ID NO: 75033 - DNA, 24 bp, Artificial sequence
  SiRNA target sequence
tgcgtactatgttaagaaacaagg

SEQ ID NO: 75034 - DNA, 24 bp, Artificial sequence
  SiRNA target sequence
gcgtactatgttaagaaacaagga

SEQ ID NO: 75035 - DNA, 24 bp, Artificial sequence
  SiRNA target sequence
cgtactatgttaagaaacaaggag

SEQ ID NO: 75036 - DNA, 24 bp, Artificial sequence
  SiRNA target sequence
gtactatgttaagaaacaaggaga

SEQ ID NO: 75037 - DNA, 24 bp, Artificial sequence
  SiRNA target sequence
tactatgttaagaaacaaggagat

SEQ ID NO: 75038 - DNA, 24 bp, Artificial sequence
  SiRNA target sequence
actatgttaagaaacaaggagata

SEQ ID NO: 75039 - DNA, 24 bp, Artificial sequence
  SiRNA target sequence
ctatgttaagaaacaaggagataa

SEQ ID NO: 75040 - DNA, 24 bp, Artificial sequence
  SiRNA target sequence
tatgttaagaaacaaggagataat

SEQ ID NO: 75041 - DNA, 24 bp, Artificial sequence
  SiRNA target sequence
atgttaagaaacaaggagataatg

SEQ ID NO: 75042 - DNA, 24 bp, Artificial sequence
  SiRNA target sequence
tgttaagaaacaaggagataatgg

SEQ ID NO: 75043 - DNA, 24 bp, Artificial sequence
  SiRNA target sequence
gttaagaaacaaggagataatggc

SEQ ID NO: 75044 - DNA, 24 bp, Artificial sequence
  SiRNA target sequence
ttaagaaacaaggagataatggca

SEQ ID NO: 75045 - DNA, 24 bp, Artificial sequence
  SiRNA target sequence
taagaaacaaggagataatggcat

SEQ ID NO: 75046 - DNA, 24 bp, Artificial sequence
  SiRNA target sequence
aagaaacaaggagataatggcatt

SEQ ID NO: 75047 - DNA, 24 bp, Artificial sequence
  SiRNA target sequence
agaaacaaggagataatggcatta

SEQ ID NO: 75048 - DNA, 24 bp, Artificial sequence
  SiRNA target sequence
gaaacaaggagataatggcattag

SEQ ID NO: 75049 - DNA, 24 bp, Artificial sequence
  SiRNA target sequence
aaacaaggagataatggcattaga

SEQ ID NO: 75050 - DNA, 24 bp, Artificial sequence
  SiRNA target sequence
aacaaggagataatggcattagat

SEQ ID NO: 75051 - DNA, 24 bp, Artificial sequence
  SiRNA target sequence
acaaggagataatggcattagatg

SEQ ID NO: 75052 - DNA, 24 bp, Artificial sequence
  SiRNA target sequence
caaggagataatggcattagatga

SEQ ID NO: 75053 - DNA, 24 bp, Artificial sequence
  SiRNA target sequence
aaggagataatggcattagatgaa

SEQ ID NO: 75054 - DNA, 24 bp, Artificial sequence
  SiRNA target sequence
aggagataatggcattagatgaac

SEQ ID NO: 75055 - DNA, 24 bp, Artificial sequence
  SiRNA target sequence
ggagataatggcattagatgaacc

SEQ ID NO: 75056 - DNA, 24 bp, Artificial sequence
  SiRNA target sequence
gagataatggcattagatgaaccc

SEQ ID NO: 75057 - DNA, 24 bp, Artificial sequence
  SiRNA target sequence
agataatggcattagatgaaccca

SEQ ID NO: 75058 - DNA, 24 bp, Artificial sequence
  SiRNA target sequence
gataatggcattagatgaacccac

SEQ ID NO: 75059 - DNA, 24 bp, Artificial sequence
  SiRNA target sequence
ataatggcattagatgaacccact

SEQ ID NO: 75060 - DNA, 24 bp, Artificial sequence
  SiRNA target sequence
taatggcattagatgaacccactg

SEQ ID NO: 75061 - DNA, 24 bp, Artificial sequence
  SiRNA target sequence
aatggcattagatgaacccactgc

SEQ ID NO: 75062 - DNA, 24 bp, Artificial sequence
  SiRNA target sequence
atggcattagatgaacccactgca

SEQ ID NO: 75063 - DNA, 24 bp, Artificial sequence
  SiRNA target sequence
tggcattagatgaacccactgcag

SEQ ID NO: 75064 - DNA, 24 bp, Artificial sequence
  SiRNA target sequence
ggcattagatgaacccactgcagc

SEQ ID NO: 75065 - DNA, 24 bp, Artificial sequence
  SiRNA target sequence
gcattagatgaacccactgcagca

SEQ ID NO: 75066 - DNA, 24 bp, Artificial sequence
  SiRNA target sequence
cattagatgaacccactgcagcac

SEQ ID NO: 75067 - DNA, 24 bp, Artificial sequence
  SiRNA target sequence
attagatgaacccactgcagcact

SEQ ID NO: 75068 - DNA, 24 bp, Artificial sequence
  SiRNA target sequence
ttagatgaacccactgcagcactt

SEQ ID NO: 75069 - DNA, 24 bp, Artificial sequence
  SiRNA target sequence
tagatgaacccactgcagcacttg

SEQ ID NO: 75070 - DNA, 24 bp, Artificial sequence
  SiRNA target sequence
agatgaacccactgcagcacttga

SEQ ID NO: 75071 - DNA, 24 bp, Artificial sequence
  SiRNA target sequence
gatgaacccactgcagcacttgat

SEQ ID NO: 75072 - DNA, 24 bp, Artificial sequence
  SiRNA target sequence
atgaacccactgcagcacttgata

SEQ ID NO: 75073 - DNA, 24 bp, Artificial sequence
  SiRNA target sequence
tgaacccactgcagcacttgataa

SEQ ID NO: 75074 - DNA, 24 bp, Artificial sequence
  SiRNA target sequence
gaacccactgcagcacttgataag

SEQ ID NO: 75075 - DNA, 24 bp, Artificial sequence
  SiRNA target sequence
aacccactgcagcacttgataagg

SEQ ID NO: 75076 - DNA, 24 bp, Artificial sequence
  SiRNA target sequence
acccactgcagcacttgataagga

SEQ ID NO: 75077 - DNA, 24 bp, Artificial sequence
  SiRNA target sequence
cccactgcagcacttgataaggag

SEQ ID NO: 75078 - DNA, 24 bp, Artificial sequence
  SiRNA target sequence
ccactgcagcacttgataaggagt

SEQ ID NO: 75079 - DNA, 24 bp, Artificial sequence
  SiRNA target sequence
cactgcagcacttgataaggagtc

SEQ ID NO: 75080 - DNA, 24 bp, Artificial sequence
  SiRNA target sequence
actgcagcacttgataaggagtct

SEQ ID NO: 75081 - DNA, 24 bp, Artificial sequence
  SiRNA target sequence
ctgcagcacttgataaggagtctg

SEQ ID NO: 75082 - DNA, 24 bp, Artificial sequence
  SiRNA target sequence
tgcagcacttgataaggagtctga

SEQ ID NO: 75083 - DNA, 24 bp, Artificial sequence
  SiRNA target sequence
gcagcacttgataaggagtctgaa

SEQ ID NO: 75084 - DNA, 24 bp, Artificial sequence
  SiRNA target sequence
cagcacttgataaggagtctgaaa

SEQ ID NO: 75085 - DNA, 24 bp, Artificial sequence
  SiRNA target sequence
agcacttgataaggagtctgaaaa

SEQ ID NO: 75086 - DNA, 24 bp, Artificial sequence
  SiRNA target sequence
gcacttgataaggagtctgaaaaa

SEQ ID NO: 75087 - DNA, 24 bp, Artificial sequence
  SiRNA target sequence
cacttgataaggagtctgaaaaaa

SEQ ID NO: 75088 - DNA, 24 bp, Artificial sequence
  SiRNA target sequence
acttgataaggagtctgaaaaaaa

SEQ ID NO: 75089 - DNA, 24 bp, Artificial sequence
  SiRNA target sequence
cttgataaggagtctgaaaaaaag

SEQ ID NO: 75090 - DNA, 24 bp, Artificial sequence
  SiRNA target sequence
ttgataaggagtctgaaaaaaaga

SEQ ID NO: 75091 - DNA, 24 bp, Artificial sequence
  SiRNA target sequence
tgataaggagtctgaaaaaaagat

SEQ ID NO: 75092 - DNA, 24 bp, Artificial sequence
  SiRNA target sequence
gataaggagtctgaaaaaaagatt

SEQ ID NO: 75093 - DNA, 24 bp, Artificial sequence
  SiRNA target sequence
ataaggagtctgaaaaaaagattt

SEQ ID NO: 75094 - DNA, 24 bp, Artificial sequence
  SiRNA target sequence
taaggagtctgaaaaaaagatttt

SEQ ID NO: 75095 - DNA, 24 bp, Artificial sequence
  SiRNA target sequence
aaggagtctgaaaaaaagatttta

SEQ ID NO: 75096 - DNA, 24 bp, Artificial sequence
  SiRNA target sequence
aggagtctgaaaaaaagattttag

SEQ ID NO: 75097 - DNA, 24 bp, Artificial sequence
  SiRNA target sequence
ggagtctgaaaaaaagattttaga

SEQ ID NO: 75098 - DNA, 24 bp, Artificial sequence
  SiRNA target sequence
gagtctgaaaaaaagattttagag

SEQ ID NO: 75099 - DNA, 24 bp, Artificial sequence
  SiRNA target sequence
agtctgaaaaaaagattttagaga

SEQ ID NO: 75100 - DNA, 24 bp, Artificial sequence
  SiRNA target sequence
gtctgaaaaaaagattttagagat

SEQ ID NO: 75101 - DNA, 24 bp, Artificial sequence
  SiRNA target sequence
tctgaaaaaaagattttagagata

SEQ ID NO: 75102 - DNA, 24 bp, Artificial sequence
  SiRNA target sequence
ctgaaaaaaagattttagagataa

SEQ ID NO: 75103 - DNA, 24 bp, Artificial sequence
  SiRNA target sequence
tgaaaaaaagattttagagataat

SEQ ID NO: 75104 - DNA, 24 bp, Artificial sequence
  SiRNA target sequence
gaaaaaaagattttagagataatt

SEQ ID NO: 75105 - DNA, 24 bp, Artificial sequence
  SiRNA target sequence
aaaaaaagattttagagataattt

SEQ ID NO: 75106 - DNA, 24 bp, Artificial sequence
  SiRNA target sequence
aaaaaagattttagagataatttt

SEQ ID NO: 75107 - DNA, 24 bp, Artificial sequence
  SiRNA target sequence
aaaaagattttagagataatttta

SEQ ID NO: 75108 - DNA, 24 bp, Artificial sequence
  SiRNA target sequence
aaaagattttagagataattttac

SEQ ID NO: 75109 - DNA, 24 bp, Artificial sequence
  SiRNA target sequence
aaagattttagagataattttaca

SEQ ID NO: 75110 - DNA, 24 bp, Artificial sequence
  SiRNA target sequence
aagattttagagataattttacaa

SEQ ID NO: 75111 - DNA, 24 bp, Artificial sequence
  SiRNA target sequence
agattttagagataattttacaac

SEQ ID NO: 75112 - DNA, 24 bp, Artificial sequence
  SiRNA target sequence
gattttagagataattttacaaca

SEQ ID NO: 75113 - DNA, 24 bp, Artificial sequence
  SiRNA target sequence
attttagagataattttacaacag

SEQ ID NO: 75114 - DNA, 24 bp, Artificial sequence
  SiRNA target sequence
ttttagagataattttacaacagg

SEQ ID NO: 75115 - DNA, 24 bp, Artificial sequence
  SiRNA target sequence
tttagagataattttacaacagga

SEQ ID NO: 75116 - DNA, 24 bp, Artificial sequence
  SiRNA target sequence
ttagagataattttacaacaggaa

SEQ ID NO: 75117 - DNA, 24 bp, Artificial sequence
  SiRNA target sequence
tagagataattttacaacaggaag

SEQ ID NO: 75118 - DNA, 24 bp, Artificial sequence
  SiRNA target sequence
agagataattttacaacaggaaga

SEQ ID NO: 75119 - DNA, 24 bp, Artificial sequence
  SiRNA target sequence
gagataattttacaacaggaagat

SEQ ID NO: 75120 - DNA, 24 bp, Artificial sequence
  SiRNA target sequence
agataattttacaacaggaagatc

SEQ ID NO: 75121 - DNA, 24 bp, Artificial sequence
  SiRNA target sequence
gataattttacaacaggaagatcg

SEQ ID NO: 75122 - DNA, 24 bp, Artificial sequence
  SiRNA target sequence
ataattttacaacaggaagatcga

SEQ ID NO: 75123 - DNA, 24 bp, Artificial sequence
  SiRNA target sequence
taattttacaacaggaagatcgaa

SEQ ID NO: 75124 - DNA, 24 bp, Artificial sequence
  SiRNA target sequence
aattttacaacaggaagatcgaac

SEQ ID NO: 75125 - DNA, 24 bp, Artificial sequence
  SiRNA target sequence
attttacaacaggaagatcgaaca

SEQ ID NO: 75126 - DNA, 24 bp, Artificial sequence
  SiRNA target sequence
ttttacaacaggaagatcgaacag

SEQ ID NO: 75127 - DNA, 24 bp, Artificial sequence
  SiRNA target sequence
tttacaacaggaagatcgaacagt

SEQ ID NO: 75128 - DNA, 24 bp, Artificial sequence
  SiRNA target sequence
ttacaacaggaagatcgaacagtt

SEQ ID NO: 75129 - DNA, 24 bp, Artificial sequence
  SiRNA target sequence
tacaacaggaagatcgaacagttt

SEQ ID NO: 75130 - DNA, 24 bp, Artificial sequence
  SiRNA target sequence
acaacaggaagatcgaacagtttt

SEQ ID NO: 75131 - DNA, 24 bp, Artificial sequence
  SiRNA target sequence
caacaggaagatcgaacagttttg

SEQ ID NO: 75132 - DNA, 24 bp, Artificial sequence
  SiRNA target sequence
aacaggaagatcgaacagttttga

SEQ ID NO: 75133 - DNA, 24 bp, Artificial sequence
  SiRNA target sequence
acaggaagatcgaacagttttgat

SEQ ID NO: 75134 - DNA, 24 bp, Artificial sequence
  SiRNA target sequence
caggaagatcgaacagttttgatg

SEQ ID NO: 75135 - DNA, 24 bp, Artificial sequence
  SiRNA target sequence
aggaagatcgaacagttttgatga

SEQ ID NO: 75136 - DNA, 24 bp, Artificial sequence
  SiRNA target sequence
ggaagatcgaacagttttgatgat

SEQ ID NO: 75137 - DNA, 24 bp, Artificial sequence
  SiRNA target sequence
gaagatcgaacagttttgatgata

SEQ ID NO: 75138 - DNA, 24 bp, Artificial sequence
  SiRNA target sequence
aagatcgaacagttttgatgataa

SEQ ID NO: 75139 - DNA, 24 bp, Artificial sequence
  SiRNA target sequence
agatcgaacagttttgatgataat

SEQ ID NO: 75140 - DNA, 24 bp, Artificial sequence
  SiRNA target sequence
gatcgaacagttttgatgataatt

SEQ ID NO: 75141 - DNA, 24 bp, Artificial sequence
  SiRNA target sequence
atcgaacagttttgatgataattc

SEQ ID NO: 75142 - DNA, 24 bp, Artificial sequence
  SiRNA target sequence
tcgaacagttttgatgataattca

SEQ ID NO: 75143 - DNA, 24 bp, Artificial sequence
  SiRNA target sequence
cgaacagttttgatgataattcat

SEQ ID NO: 75144 - DNA, 24 bp, Artificial sequence
  SiRNA target sequence
gaacagttttgatgataattcata

SEQ ID NO: 75145 - DNA, 24 bp, Artificial sequence
  SiRNA target sequence
aacagttttgatgataattcataa

SEQ ID NO: 75146 - DNA, 24 bp, Artificial sequence
  SiRNA target sequence
acagttttgatgataattcataat

SEQ ID NO: 75147 - DNA, 24 bp, Artificial sequence
  SiRNA target sequence
cagttttgatgataattcataatc

SEQ ID NO: 75148 - DNA, 24 bp, Artificial sequence
  SiRNA target sequence
agttttgatgataattcataatct

SEQ ID NO: 75149 - DNA, 24 bp, Artificial sequence
  SiRNA target sequence
gttttgatgataattcataatcta

SEQ ID NO: 75150 - DNA, 24 bp, Artificial sequence
  SiRNA target sequence
ttttgatgataattcataatctag

SEQ ID NO: 75151 - DNA, 24 bp, Artificial sequence
  SiRNA target sequence
tttgatgataattcataatctaga

SEQ ID NO: 75152 - DNA, 24 bp, Artificial sequence
  SiRNA target sequence
ttgatgataattcataatctagaa

SEQ ID NO: 75153 - DNA, 24 bp, Artificial sequence
  SiRNA target sequence
tgatgataattcataatctagaac

SEQ ID NO: 75154 - DNA, 24 bp, Artificial sequence
  SiRNA target sequence
gatgataattcataatctagaact

SEQ ID NO: 75155 - DNA, 24 bp, Artificial sequence
  SiRNA target sequence
atgataattcataatctagaactt

SEQ ID NO: 75156 - DNA, 24 bp, Artificial sequence
  SiRNA target sequence
tgataattcataatctagaactta

SEQ ID NO: 75157 - DNA, 24 bp, Artificial sequence
  SiRNA target sequence
gataattcataatctagaacttat

SEQ ID NO: 75158 - DNA, 24 bp, Artificial sequence
  SiRNA target sequence
ataattcataatctagaacttatt

SEQ ID NO: 75159 - DNA, 24 bp, Artificial sequence
  SiRNA target sequence
taattcataatctagaacttatta

SEQ ID NO: 75160 - DNA, 24 bp, Artificial sequence
  SiRNA target sequence
aattcataatctagaacttattaa

SEQ ID NO: 75161 - DNA, 24 bp, Artificial sequence
  SiRNA target sequence
attcataatctagaacttattaat

SEQ ID NO: 75162 - DNA, 24 bp, Artificial sequence
  SiRNA target sequence
ttcataatctagaacttattaata

SEQ ID NO: 75163 - DNA, 24 bp, Artificial sequence
  SiRNA target sequence
tcataatctagaacttattaataa

SEQ ID NO: 75164 - DNA, 24 bp, Artificial sequence
  SiRNA target sequence
cataatctagaacttattaataaa

SEQ ID NO: 75165 - DNA, 24 bp, Artificial sequence
  SiRNA target sequence
ataatctagaacttattaataaat

SEQ ID NO: 75166 - DNA, 24 bp, Artificial sequence
  SiRNA target sequence
taatctagaacttattaataaatt

SEQ ID NO: 75167 - DNA, 24 bp, Artificial sequence
  SiRNA target sequence
aatctagaacttattaataaattt

SEQ ID NO: 75168 - DNA, 24 bp, Artificial sequence
  SiRNA target sequence
atctagaacttattaataaatttg

SEQ ID NO: 75169 - DNA, 24 bp, Artificial sequence
  SiRNA target sequence
tctagaacttattaataaatttga

SEQ ID NO: 75170 - DNA, 24 bp, Artificial sequence
  SiRNA target sequence
ctagaacttattaataaatttgat

SEQ ID NO: 75171 - DNA, 24 bp, Artificial sequence
  SiRNA target sequence
tagaacttattaataaatttgata

SEQ ID NO: 75172 - DNA, 24 bp, Artificial sequence
  SiRNA target sequence
agaacttattaataaatttgataa

SEQ ID NO: 75173 - DNA, 24 bp, Artificial sequence
  SiRNA target sequence
gaacttattaataaatttgataaa

SEQ ID NO: 75174 - DNA, 24 bp, Artificial sequence
  SiRNA target sequence
aacttattaataaatttgataaaa

SEQ ID NO: 75175 - DNA, 24 bp, Artificial sequence
  SiRNA target sequence
acttattaataaatttgataaaat

SEQ ID NO: 75176 - DNA, 24 bp, Artificial sequence
  SiRNA target sequence
cttattaataaatttgataaaata

SEQ ID NO: 75177 - DNA, 24 bp, Artificial sequence
  SiRNA target sequence
ttattaataaatttgataaaataa

SEQ ID NO: 75178 - DNA, 24 bp, Artificial sequence
  SiRNA target sequence
tattaataaatttgataaaataat

SEQ ID NO: 75179 - DNA, 24 bp, Artificial sequence
  SiRNA target sequence
attaataaatttgataaaataatt

SEQ ID NO: 75180 - DNA, 24 bp, Artificial sequence
  SiRNA target sequence
ttaataaatttgataaaataattt

SEQ ID NO: 75181 - DNA, 24 bp, Artificial sequence
  SiRNA target sequence
taataaatttgataaaataattta

SEQ ID NO: 75182 - DNA, 24 bp, Artificial sequence
  SiRNA target sequence
aataaatttgataaaataatttac

SEQ ID NO: 75183 - DNA, 24 bp, Artificial sequence
  SiRNA target sequence
ataaatttgataaaataatttaca

SEQ ID NO: 75184 - DNA, 24 bp, Artificial sequence
  SiRNA target sequence
taaatttgataaaataatttacat

SEQ ID NO: 75185 - DNA, 24 bp, Artificial sequence
  SiRNA target sequence
aaatttgataaaataatttacatt

SEQ ID NO: 75186 - DNA, 24 bp, Artificial sequence
  SiRNA target sequence
aatttgataaaataatttacattg

SEQ ID NO: 75187 - DNA, 24 bp, Artificial sequence
  SiRNA target sequence
atttgataaaataatttacattga

SEQ ID NO: 75188 - DNA, 24 bp, Artificial sequence
  SiRNA target sequence
tttgataaaataatttacattgat

SEQ ID NO: 75189 - DNA, 24 bp, Artificial sequence
  SiRNA target sequence
ttgataaaataatttacattgatg

SEQ ID NO: 75190 - DNA, 24 bp, Artificial sequence
  SiRNA target sequence
tgataaaataatttacattgatga

SEQ ID NO: 75191 - DNA, 24 bp, Artificial sequence
  SiRNA target sequence
gataaaataatttacattgatgaa

SEQ ID NO: 75192 - DNA, 24 bp, Artificial sequence
  SiRNA target sequence
ataaaataatttacattgatgaaa

SEQ ID NO: 75193 - DNA, 24 bp, Artificial sequence
  SiRNA target sequence
taaaataatttacattgatgaaaa

SEQ ID NO: 75194 - DNA, 24 bp, Artificial sequence
  SiRNA target sequence
aaaataatttacattgatgaaaat

SEQ ID NO: 75195 - DNA, 24 bp, Artificial sequence
  SiRNA target sequence
aaataatttacattgatgaaaata

SEQ ID NO: 75196 - DNA, 24 bp, Artificial sequence
  SiRNA target sequence
aataatttacattgatgaaaataa

SEQ ID NO: 75197 - DNA, 24 bp, Artificial sequence
  SiRNA target sequence
ataatttacattgatgaaaataat

SEQ ID NO: 75198 - DNA, 24 bp, Artificial sequence
  SiRNA target sequence
taatttacattgatgaaaataata

SEQ ID NO: 75199 - DNA, 24 bp, Artificial sequence
  SiRNA target sequence
aatttacattgatgaaaataatat

SEQ ID NO: 75200 - DNA, 24 bp, Artificial sequence
  SiRNA target sequence
atttacattgatgaaaataatata

SEQ ID NO: 75201 - DNA, 24 bp, Artificial sequence
  SiRNA target sequence
tttacattgatgaaaataatatag

SEQ ID NO: 75202 - DNA, 24 bp, Artificial sequence
  SiRNA target sequence
ttacattgatgaaaataatataga

SEQ ID NO: 75203 - DNA, 24 bp, Artificial sequence
  SiRNA target sequence
tacattgatgaaaataatatagaa

SEQ ID NO: 75204 - DNA, 24 bp, Artificial sequence
  SiRNA target sequence
acattgatgaaaataatatagaag

SEQ ID NO: 75205 - DNA, 24 bp, Artificial sequence
  SiRNA target sequence
cattgatgaaaataatatagaagt

SEQ ID NO: 75206 - DNA, 24 bp, Artificial sequence
  SiRNA target sequence
attgatgaaaataatatagaagtc

SEQ ID NO: 75207 - DNA, 24 bp, Artificial sequence
  SiRNA target sequence
ttgatgaaaataatatagaagtct

SEQ ID NO: 75208 - DNA, 24 bp, Artificial sequence
  SiRNA target sequence
tgatgaaaataatatagaagtcta

SEQ ID NO: 75209 - DNA, 24 bp, Artificial sequence
  SiRNA target sequence
gatgaaaataatatagaagtctat

SEQ ID NO: 75210 - DNA, 24 bp, Artificial sequence
  SiRNA target sequence
atgaaaataatatagaagtctata

SEQ ID NO: 75211 - DNA, 24 bp, Artificial sequence
  SiRNA target sequence
tgaaaataatatagaagtctataa

SEQ ID NO: 75212 - DNA, 24 bp, Artificial sequence
  SiRNA target sequence
gaaaataatatagaagtctataaa

SEQ ID NO: 75213 - DNA, 24 bp, Artificial sequence
  SiRNA target sequence
aaaataatatagaagtctataaaa

SEQ ID NO: 75214 - DNA, 24 bp, Artificial sequence
  SiRNA target sequence
aaataatatagaagtctataaaaa

SEQ ID NO: 75215 - DNA, 24 bp, Artificial sequence
  SiRNA target sequence
aataatatagaagtctataaaaat

SEQ ID NO: 75216 - DNA, 24 bp, Artificial sequence
  SiRNA target sequence
ataatatagaagtctataaaaatg

SEQ ID NO: 75217 - DNA, 24 bp, Artificial sequence
  SiRNA target sequence
taatatagaagtctataaaaatga

SEQ ID NO: 75218 - DNA, 24 bp, Artificial sequence
  SiRNA target sequence
aatatagaagtctataaaaatgat

SEQ ID NO: 75219 - DNA, 24 bp, Artificial sequence
  SiRNA target sequence
atatagaagtctataaaaatgata

SEQ ID NO: 75220 - DNA, 24 bp, Artificial sequence
  SiRNA target sequence
tatagaagtctataaaaatgatat

SEQ ID NO: 75221 - DNA, 24 bp, Artificial sequence
  SiRNA target sequence
atagaagtctataaaaatgatatt

SEQ ID NO: 75222 - DNA, 24 bp, Artificial sequence
  SiRNA target sequence
tagaagtctataaaaatgatattg

SEQ ID NO: 75223 - DNA, 24 bp, Artificial sequence
  SiRNA target sequence
agaagtctataaaaatgatattga

SEQ ID NO: 75224 - DNA, 24 bp, Artificial sequence
  SiRNA target sequence
gaagtctataaaaatgatattgaa

SEQ ID NO: 75225 - DNA, 24 bp, Artificial sequence
  SiRNA target sequence
aagtctataaaaatgatattgaag

SEQ ID NO: 75226 - DNA, 24 bp, Artificial sequence
  SiRNA target sequence
agtctataaaaatgatattgaagg

SEQ ID NO: 75227 - DNA, 24 bp, Artificial sequence
  SiRNA target sequence
gtctataaaaatgatattgaagga

SEQ ID NO: 75228 - DNA, 24 bp, Artificial sequence
  SiRNA target sequence
tctataaaaatgatattgaaggac

SEQ ID NO: 75229 - DNA, 24 bp, Artificial sequence
  SiRNA target sequence
ctataaaaatgatattgaaggaca

SEQ ID NO: 75230 - DNA, 24 bp, Artificial sequence
  SiRNA target sequence
tataaaaatgatattgaaggacaa

SEQ ID NO: 75231 - DNA, 24 bp, Artificial sequence
  SiRNA target sequence
ataaaaatgatattgaaggacaaa

SEQ ID NO: 75232 - DNA, 24 bp, Artificial sequence
  SiRNA target sequence
taaaaatgatattgaaggacaaaa

SEQ ID NO: 75233 - DNA, 24 bp, Artificial sequence
  SiRNA target sequence
aaaaatgatattgaaggacaaaaa

SEQ ID NO: 75234 - DNA, 24 bp, Artificial sequence
  SiRNA target sequence
aaaatgatattgaaggacaaaaaa

SEQ ID NO: 75235 - DNA, 24 bp, Artificial sequence
  SiRNA target sequence
aaatgatattgaaggacaaaaaaa

SEQ ID NO: 75236 - DNA, 24 bp, Artificial sequence
  SiRNA target sequence
aatgatattgaaggacaaaaaaag

SEQ ID NO: 75237 - DNA, 24 bp, Artificial sequence
  SiRNA target sequence
atgatattgaaggacaaaaaaagt

SEQ ID NO: 75238 - DNA, 24 bp, Artificial sequence
  SiRNA target sequence
tgatattgaaggacaaaaaaagtt

SEQ ID NO: 75239 - DNA, 24 bp, Artificial sequence
  SiRNA target sequence
gatattgaaggacaaaaaaagttt

SEQ ID NO: 75240 - DNA, 24 bp, Artificial sequence
  SiRNA target sequence
atattgaaggacaaaaaaagtttt

SEQ ID NO: 75241 - DNA, 24 bp, Artificial sequence
  SiRNA target sequence
tattgaaggacaaaaaaagttttc

SEQ ID NO: 75242 - DNA, 24 bp, Artificial sequence
  SiRNA target sequence
attgaaggacaaaaaaagttttct

SEQ ID NO: 75243 - DNA, 24 bp, Artificial sequence
  SiRNA target sequence
ttgaaggacaaaaaaagttttcta

SEQ ID NO: 75244 - DNA, 24 bp, Artificial sequence
  SiRNA target sequence
tgaaggacaaaaaaagttttctac

SEQ ID NO: 75245 - DNA, 24 bp, Artificial sequence
  SiRNA target sequence
gaaggacaaaaaaagttttctaca

SEQ ID NO: 75246 - DNA, 24 bp, Artificial sequence
  SiRNA target sequence
aaggacaaaaaaagttttctacaa

SEQ ID NO: 75247 - DNA, 24 bp, Artificial sequence
  SiRNA target sequence
aggacaaaaaaagttttctacaaa

SEQ ID NO: 75248 - DNA, 24 bp, Artificial sequence
  SiRNA target sequence
ggacaaaaaaagttttctacaaat

SEQ ID NO: 75249 - DNA, 24 bp, Artificial sequence
  SiRNA target sequence
gacaaaaaaagttttctacaaatt

SEQ ID NO: 75250 - DNA, 24 bp, Artificial sequence
  SiRNA target sequence
acaaaaaaagttttctacaaattt

SEQ ID NO: 75251 - DNA, 24 bp, Artificial sequence
  SiRNA target sequence
caaaaaaagttttctacaaattta

SEQ ID NO: 75252 - DNA, 24 bp, Artificial sequence
  SiRNA target sequence
aaaaaaagttttctacaaatttac

SEQ ID NO: 75253 - DNA, 24 bp, Artificial sequence
  SiRNA target sequence
aaaaaagttttctacaaatttaca

SEQ ID NO: 75254 - DNA, 24 bp, Artificial sequence
  SiRNA target sequence
aaaaagttttctacaaatttacaa

SEQ ID NO: 75255 - DNA, 24 bp, Artificial sequence
  SiRNA target sequence
aaaagttttctacaaatttacaat

SEQ ID NO: 75256 - DNA, 24 bp, Artificial sequence
  SiRNA target sequence
aaagttttctacaaatttacaata

SEQ ID NO: 75257 - DNA, 24 bp, Artificial sequence
  SiRNA target sequence
aagttttctacaaatttacaatat

SEQ ID NO: 75258 - DNA, 24 bp, Artificial sequence
  SiRNA target sequence
agttttctacaaatttacaatatt

SEQ ID NO: 75259 - DNA, 24 bp, Artificial sequence
  SiRNA target sequence
gttttctacaaatttacaatattt

SEQ ID NO: 75260 - DNA, 24 bp, Artificial sequence
  SiRNA target sequence
ttttctacaaatttacaatatttt

SEQ ID NO: 75261 - DNA, 24 bp, Artificial sequence
  SiRNA target sequence
tttctacaaatttacaatattttt

SEQ ID NO: 75262 - DNA, 24 bp, Artificial sequence
  SiRNA target sequence
ttctacaaatttacaatatttttt

SEQ ID NO: 75263 - DNA, 24 bp, Artificial sequence
  SiRNA target sequence
tctacaaatttacaatatttttta

SEQ ID NO: 75264 - DNA, 24 bp, Artificial sequence
  SiRNA target sequence
ctacaaatttacaatattttttat

SEQ ID NO: 75265 - DNA, 24 bp, Artificial sequence
  SiRNA target sequence
tacaaatttacaatattttttatc

SEQ ID NO: 75266 - DNA, 24 bp, Artificial sequence
  SiRNA target sequence
acaaatttacaatattttttatca

SEQ ID NO: 75267 - DNA, 24 bp, Artificial sequence
  SiRNA target sequence
caaatttacaatattttttatcat

SEQ ID NO: 75268 - DNA, 24 bp, Artificial sequence
  SiRNA target sequence
aaatttacaatattttttatcata

SEQ ID NO: 75269 - DNA, 24 bp, Artificial sequence
  SiRNA target sequence
aatttacaatattttttatcatac

SEQ ID NO: 75270 - DNA, 24 bp, Artificial sequence
  SiRNA target sequence
atttacaatattttttatcataca

SEQ ID NO: 75271 - DNA, 24 bp, Artificial sequence
  SiRNA target sequence
tttacaatattttttatcatacaa

SEQ ID NO: 75272 - DNA, 24 bp, Artificial sequence
  SiRNA target sequence
ttacaatattttttatcatacaaa

SEQ ID NO: 75273 - DNA, 24 bp, Artificial sequence
  SiRNA target sequence
tacaatattttttatcatacaaat

SEQ ID NO: 75274 - DNA, 24 bp, Artificial sequence
  SiRNA target sequence
acaatattttttatcatacaaatt

SEQ ID NO: 75275 - DNA, 24 bp, Artificial sequence
  SiRNA target sequence
caatattttttatcatacaaatta

SEQ ID NO: 75276 - DNA, 24 bp, Artificial sequence
  SiRNA target sequence
aatattttttatcatacaaattag

SEQ ID NO: 75277 - DNA, 24 bp, Artificial sequence
  SiRNA target sequence
atattttttatcatacaaattagg

SEQ ID NO: 75278 - DNA, 24 bp, Artificial sequence
  SiRNA target sequence
tattttttatcatacaaattaggt

SEQ ID NO: 75279 - DNA, 24 bp, Artificial sequence
  SiRNA target sequence
attttttatcatacaaattaggta

SEQ ID NO: 75280 - DNA, 24 bp, Artificial sequence
  SiRNA target sequence
ttttttatcatacaaattaggtaa

SEQ ID NO: 75281 - DNA, 24 bp, Artificial sequence
  SiRNA target sequence
tttttatcatacaaattaggtaaa

SEQ ID NO: 75282 - DNA, 24 bp, Artificial sequence
  SiRNA target sequence
ttttatcatacaaattaggtaaat

SEQ ID NO: 75283 - DNA, 24 bp, Artificial sequence
  SiRNA target sequence
tttatcatacaaattaggtaaata

SEQ ID NO: 75284 - DNA, 24 bp, Artificial sequence
  SiRNA target sequence
ttatcatacaaattaggtaaataa

SEQ ID NO: 75285 - DNA, 25 bp, Artificial sequence
  SiRNA target sequence
atgaaaaaaatttcgaatagaaaaa

SEQ ID NO: 75286 - DNA, 25 bp, Artificial sequence
  SiRNA target sequence
tgaaaaaaatttcgaatagaaaaat

SEQ ID NO: 75287 - DNA, 25 bp, Artificial sequence
  SiRNA target sequence
gaaaaaaatttcgaatagaaaaatt

SEQ ID NO: 75288 - DNA, 25 bp, Artificial sequence
  SiRNA target sequence
aaaaaaatttcgaatagaaaaatta

SEQ ID NO: 75289 - DNA, 25 bp, Artificial sequence
  SiRNA target sequence
aaaaaatttcgaatagaaaaattat

SEQ ID NO: 75290 - DNA, 25 bp, Artificial sequence
  SiRNA target sequence
aaaaatttcgaatagaaaaattatc

SEQ ID NO: 75291 - DNA, 25 bp, Artificial sequence
  SiRNA target sequence
aaaatttcgaatagaaaaattatca

SEQ ID NO: 75292 - DNA, 25 bp, Artificial sequence
  SiRNA target sequence
aaatttcgaatagaaaaattatcaa

SEQ ID NO: 75293 - DNA, 25 bp, Artificial sequence
  SiRNA target sequence
aatttcgaatagaaaaattatcaaa

SEQ ID NO: 75294 - DNA, 25 bp, Artificial sequence
  SiRNA target sequence
atttcgaatagaaaaattatcaaag

SEQ ID NO: 75295 - DNA, 25 bp, Artificial sequence
  SiRNA target sequence
tttcgaatagaaaaattatcaaaga

SEQ ID NO: 75296 - DNA, 25 bp, Artificial sequence
  SiRNA target sequence
ttcgaatagaaaaattatcaaagaa

SEQ ID NO: 75297 - DNA, 25 bp, Artificial sequence
  SiRNA target sequence
tcgaatagaaaaattatcaaagaaa

SEQ ID NO: 75298 - DNA, 25 bp, Artificial sequence
  SiRNA target sequence
cgaatagaaaaattatcaaagaaat

SEQ ID NO: 75299 - DNA, 25 bp, Artificial sequence
  SiRNA target sequence
gaatagaaaaattatcaaagaaatt

SEQ ID NO: 75300 - DNA, 25 bp, Artificial sequence
  SiRNA target sequence
aatagaaaaattatcaaagaaatta

SEQ ID NO: 75301 - DNA, 25 bp, Artificial sequence
  SiRNA target sequence
atagaaaaattatcaaagaaattat

SEQ ID NO: 75302 - DNA, 25 bp, Artificial sequence
  SiRNA target sequence
tagaaaaattatcaaagaaattatt

SEQ ID NO: 75303 - DNA, 25 bp, Artificial sequence
  SiRNA target sequence
agaaaaattatcaaagaaattattt

SEQ ID NO: 75304 - DNA, 25 bp, Artificial sequence
  SiRNA target sequence
gaaaaattatcaaagaaattattta

SEQ ID NO: 75305 - DNA, 25 bp, Artificial sequence
  SiRNA target sequence
aaaaattatcaaagaaattatttac

SEQ ID NO: 75306 - DNA, 25 bp, Artificial sequence
  SiRNA target sequence
aaaattatcaaagaaattatttaca

SEQ ID NO: 75307 - DNA, 25 bp, Artificial sequence
  SiRNA target sequence
aaattatcaaagaaattatttacaa

SEQ ID NO: 75308 - DNA, 25 bp, Artificial sequence
  SiRNA target sequence
aattatcaaagaaattatttacaat

SEQ ID NO: 75309 - DNA, 25 bp, Artificial sequence
  SiRNA target sequence
attatcaaagaaattatttacaatg

SEQ ID NO: 75310 - DNA, 25 bp, Artificial sequence
  SiRNA target sequence
ttatcaaagaaattatttacaatga

SEQ ID NO: 75311 - DNA, 25 bp, Artificial sequence
  SiRNA target sequence
tatcaaagaaattatttacaatgat

SEQ ID NO: 75312 - DNA, 25 bp, Artificial sequence
  SiRNA target sequence
atcaaagaaattatttacaatgatt

SEQ ID NO: 75313 - DNA, 25 bp, Artificial sequence
  SiRNA target sequence
tcaaagaaattatttacaatgattt

SEQ ID NO: 75314 - DNA, 25 bp, Artificial sequence
  SiRNA target sequence
caaagaaattatttacaatgattta

SEQ ID NO: 75315 - DNA, 25 bp, Artificial sequence
  SiRNA target sequence
aaagaaattatttacaatgatttat

SEQ ID NO: 75316 - DNA, 25 bp, Artificial sequence
  SiRNA target sequence
aagaaattatttacaatgatttatt

SEQ ID NO: 75317 - DNA, 25 bp, Artificial sequence
  SiRNA target sequence
agaaattatttacaatgatttatta

SEQ ID NO: 75318 - DNA, 25 bp, Artificial sequence
  SiRNA target sequence
gaaattatttacaatgatttattaa

SEQ ID NO: 75319 - DNA, 25 bp, Artificial sequence
  SiRNA target sequence
aaattatttacaatgatttattaaa

SEQ ID NO: 75320 - DNA, 25 bp, Artificial sequence
  SiRNA target sequence
aattatttacaatgatttattaaaa

SEQ ID NO: 75321 - DNA, 25 bp, Artificial sequence
  SiRNA target sequence
attatttacaatgatttattaaaaa

SEQ ID NO: 75322 - DNA, 25 bp, Artificial sequence
  SiRNA target sequence
ttatttacaatgatttattaaaaat

SEQ ID NO: 75323 - DNA, 25 bp, Artificial sequence
  SiRNA target sequence
tatttacaatgatttattaaaaata

SEQ ID NO: 75324 - DNA, 25 bp, Artificial sequence
  SiRNA target sequence
atttacaatgatttattaaaaataa

SEQ ID NO: 75325 - DNA, 25 bp, Artificial sequence
  SiRNA target sequence
tttacaatgatttattaaaaataag

SEQ ID NO: 75326 - DNA, 25 bp, Artificial sequence
  SiRNA target sequence
ttacaatgatttattaaaaataaga

SEQ ID NO: 75327 - DNA, 25 bp, Artificial sequence
  SiRNA target sequence
tacaatgatttattaaaaataagaa

SEQ ID NO: 75328 - DNA, 25 bp, Artificial sequence
  SiRNA target sequence
acaatgatttattaaaaataagaat

SEQ ID NO: 75329 - DNA, 25 bp, Artificial sequence
  SiRNA target sequence
caatgatttattaaaaataagaatg

SEQ ID NO: 75330 - DNA, 25 bp, Artificial sequence
  SiRNA target sequence
aatgatttattaaaaataagaatgt

SEQ ID NO: 75331 - DNA, 25 bp, Artificial sequence
  SiRNA target sequence
atgatttattaaaaataagaatgtt

SEQ ID NO: 75332 - DNA, 25 bp, Artificial sequence
  SiRNA target sequence
tgatttattaaaaataagaatgttg

SEQ ID NO: 75333 - DNA, 25 bp, Artificial sequence
  SiRNA target sequence
gatttattaaaaataagaatgttgc

SEQ ID NO: 75334 - DNA, 25 bp, Artificial sequence
  SiRNA target sequence
atttattaaaaataagaatgttgcg

SEQ ID NO: 75335 - DNA, 25 bp, Artificial sequence
  SiRNA target sequence
tttattaaaaataagaatgttgcga

SEQ ID NO: 75336 - DNA, 25 bp, Artificial sequence
  SiRNA target sequence
ttattaaaaataagaatgttgcgat

SEQ ID NO: 75337 - DNA, 25 bp, Artificial sequence
  SiRNA target sequence
tattaaaaataagaatgttgcgata

SEQ ID NO: 75338 - DNA, 25 bp, Artificial sequence
  SiRNA target sequence
attaaaaataagaatgttgcgatat

SEQ ID NO: 75339 - DNA, 25 bp, Artificial sequence
  SiRNA target sequence
ttaaaaataagaatgttgcgatatg

SEQ ID NO: 75340 - DNA, 25 bp, Artificial sequence
  SiRNA target sequence
taaaaataagaatgttgcgatatgt

SEQ ID NO: 75341 - DNA, 25 bp, Artificial sequence
  SiRNA target sequence
aaaaataagaatgttgcgatatgtt

SEQ ID NO: 75342 - DNA, 25 bp, Artificial sequence
  SiRNA target sequence
aaaataagaatgttgcgatatgtta

SEQ ID NO: 75343 - DNA, 25 bp, Artificial sequence
  SiRNA target sequence
aaataagaatgttgcgatatgttat

SEQ ID NO: 75344 - DNA, 25 bp, Artificial sequence
  SiRNA target sequence
aataagaatgttgcgatatgttatt

SEQ ID NO: 75345 - DNA, 25 bp, Artificial sequence
  SiRNA target sequence
ataagaatgttgcgatatgttattg

SEQ ID NO: 75346 - DNA, 25 bp, Artificial sequence
  SiRNA target sequence
taagaatgttgcgatatgttattgt

SEQ ID NO: 75347 - DNA, 25 bp, Artificial sequence
  SiRNA target sequence
aagaatgttgcgatatgttattgta

SEQ ID NO: 75348 - DNA, 25 bp, Artificial sequence
  SiRNA target sequence
agaatgttgcgatatgttattgtac

SEQ ID NO: 75349 - DNA, 25 bp, Artificial sequence
  SiRNA target sequence
gaatgttgcgatatgttattgtacc

SEQ ID NO: 75350 - DNA, 25 bp, Artificial sequence
  SiRNA target sequence
aatgttgcgatatgttattgtacca

SEQ ID NO: 75351 - DNA, 25 bp, Artificial sequence
  SiRNA target sequence
atgttgcgatatgttattgtaccaa

SEQ ID NO: 75352 - DNA, 25 bp, Artificial sequence
  SiRNA target sequence
tgttgcgatatgttattgtaccaat

SEQ ID NO: 75353 - DNA, 25 bp, Artificial sequence
  SiRNA target sequence
gttgcgatatgttattgtaccaata

SEQ ID NO: 75354 - DNA, 25 bp, Artificial sequence
  SiRNA target sequence
ttgcgatatgttattgtaccaataa

SEQ ID NO: 75355 - DNA, 25 bp, Artificial sequence
  SiRNA target sequence
tgcgatatgttattgtaccaataat

SEQ ID NO: 75356 - DNA, 25 bp, Artificial sequence
  SiRNA target sequence
gcgatatgttattgtaccaataata

SEQ ID NO: 75357 - DNA, 25 bp, Artificial sequence
  SiRNA target sequence
cgatatgttattgtaccaataatat

SEQ ID NO: 75358 - DNA, 25 bp, Artificial sequence
  SiRNA target sequence
gatatgttattgtaccaataatatt

SEQ ID NO: 75359 - DNA, 25 bp, Artificial sequence
  SiRNA target sequence
atatgttattgtaccaataatattt

SEQ ID NO: 75360 - DNA, 25 bp, Artificial sequence
  SiRNA target sequence
tatgttattgtaccaataatatttt

SEQ ID NO: 75361 - DNA, 25 bp, Artificial sequence
  SiRNA target sequence
atgttattgtaccaataatattttt

SEQ ID NO: 75362 - DNA, 25 bp, Artificial sequence
  SiRNA target sequence
tgttattgtaccaataatattttta

SEQ ID NO: 75363 - DNA, 25 bp, Artificial sequence
  SiRNA target sequence
gttattgtaccaataatatttttaa

SEQ ID NO: 75364 - DNA, 25 bp, Artificial sequence
  SiRNA target sequence
ttattgtaccaataatatttttaac

SEQ ID NO: 75365 - DNA, 25 bp, Artificial sequence
  SiRNA target sequence
tattgtaccaataatatttttaact

SEQ ID NO: 75366 - DNA, 25 bp, Artificial sequence
  SiRNA target sequence
attgtaccaataatatttttaacta

SEQ ID NO: 75367 - DNA, 25 bp, Artificial sequence
  SiRNA target sequence
ttgtaccaataatatttttaactat

SEQ ID NO: 75368 - DNA, 25 bp, Artificial sequence
  SiRNA target sequence
tgtaccaataatatttttaactata

SEQ ID NO: 75369 - DNA, 25 bp, Artificial sequence
  SiRNA target sequence
gtaccaataatatttttaactatat

SEQ ID NO: 75370 - DNA, 25 bp, Artificial sequence
  SiRNA target sequence
taccaataatatttttaactatatt

SEQ ID NO: 75371 - DNA, 25 bp, Artificial sequence
  SiRNA target sequence
accaataatatttttaactatattt

SEQ ID NO: 75372 - DNA, 25 bp, Artificial sequence
  SiRNA target sequence
ccaataatatttttaactatatttt

SEQ ID NO: 75373 - DNA, 25 bp, Artificial sequence
  SiRNA target sequence
caataatatttttaactatatttta

SEQ ID NO: 75374 - DNA, 25 bp, Artificial sequence
  SiRNA target sequence
aataatatttttaactatattttac

SEQ ID NO: 75375 - DNA, 25 bp, Artificial sequence
  SiRNA target sequence
ataatatttttaactatattttaca

SEQ ID NO: 75376 - DNA, 25 bp, Artificial sequence
  SiRNA target sequence
taatatttttaactatattttacac

SEQ ID NO: 75377 - DNA, 25 bp, Artificial sequence
  SiRNA target sequence
aatatttttaactatattttacact

SEQ ID NO: 75378 - DNA, 25 bp, Artificial sequence
  SiRNA target sequence
atatttttaactatattttacactg

SEQ ID NO: 75379 - DNA, 25 bp, Artificial sequence
  SiRNA target sequence
tatttttaactatattttacactgt

SEQ ID NO: 75380 - DNA, 25 bp, Artificial sequence
  SiRNA target sequence
atttttaactatattttacactgtt

SEQ ID NO: 75381 - DNA, 25 bp, Artificial sequence
  SiRNA target sequence
tttttaactatattttacactgttt

SEQ ID NO: 75382 - DNA, 25 bp, Artificial sequence
  SiRNA target sequence
ttttaactatattttacactgtttt

SEQ ID NO: 75383 - DNA, 25 bp, Artificial sequence
  SiRNA target sequence
tttaactatattttacactgtttta

SEQ ID NO: 75384 - DNA, 25 bp, Artificial sequence
  SiRNA target sequence
ttaactatattttacactgttttag

SEQ ID NO: 75385 - DNA, 25 bp, Artificial sequence
  SiRNA target sequence
taactatattttacactgttttaga

SEQ ID NO: 75386 - DNA, 25 bp, Artificial sequence
  SiRNA target sequence
aactatattttacactgttttagag

SEQ ID NO: 75387 - DNA, 25 bp, Artificial sequence
  SiRNA target sequence
actatattttacactgttttagaga

SEQ ID NO: 75388 - DNA, 25 bp, Artificial sequence
  SiRNA target sequence
ctatattttacactgttttagagat

SEQ ID NO: 75389 - DNA, 25 bp, Artificial sequence
  SiRNA target sequence
tatattttacactgttttagagata

SEQ ID NO: 75390 - DNA, 25 bp, Artificial sequence
  SiRNA target sequence
atattttacactgttttagagataa

SEQ ID NO: 75391 - DNA, 25 bp, Artificial sequence
  SiRNA target sequence
tattttacactgttttagagataaa

SEQ ID NO: 75392 - DNA, 25 bp, Artificial sequence
  SiRNA target sequence
attttacactgttttagagataaaa

SEQ ID NO: 75393 - DNA, 25 bp, Artificial sequence
  SiRNA target sequence
ttttacactgttttagagataaaaa

SEQ ID NO: 75394 - DNA, 25 bp, Artificial sequence
  SiRNA target sequence
tttacactgttttagagataaaaat

SEQ ID NO: 75395 - DNA, 25 bp, Artificial sequence
  SiRNA target sequence
ttacactgttttagagataaaaata

SEQ ID NO: 75396 - DNA, 25 bp, Artificial sequence
  SiRNA target sequence
tacactgttttagagataaaaataa

SEQ ID NO: 75397 - DNA, 25 bp, Artificial sequence
  SiRNA target sequence
acactgttttagagataaaaataag

SEQ ID NO: 75398 - DNA, 25 bp, Artificial sequence
  SiRNA target sequence
cactgttttagagataaaaataagt

SEQ ID NO: 75399 - DNA, 25 bp, Artificial sequence
  SiRNA target sequence
actgttttagagataaaaataagta

SEQ ID NO: 75400 - DNA, 25 bp, Artificial sequence
  SiRNA target sequence
ctgttttagagataaaaataagtac

SEQ ID NO: 75401 - DNA, 25 bp, Artificial sequence
  SiRNA target sequence
tgttttagagataaaaataagtaca

SEQ ID NO: 75402 - DNA, 25 bp, Artificial sequence
  SiRNA target sequence
gttttagagataaaaataagtacat

SEQ ID NO: 75403 - DNA, 25 bp, Artificial sequence
  SiRNA target sequence
ttttagagataaaaataagtacatt

SEQ ID NO: 75404 - DNA, 25 bp, Artificial sequence
  SiRNA target sequence
tttagagataaaaataagtacatta

SEQ ID NO: 75405 - DNA, 25 bp, Artificial sequence
  SiRNA target sequence
ttagagataaaaataagtacattag

SEQ ID NO: 75406 - DNA, 25 bp, Artificial sequence
  SiRNA target sequence
tagagataaaaataagtacattagt

SEQ ID NO: 75407 - DNA, 25 bp, Artificial sequence
  SiRNA target sequence
agagataaaaataagtacattagta

SEQ ID NO: 75408 - DNA, 25 bp, Artificial sequence
  SiRNA target sequence
gagataaaaataagtacattagtaa

SEQ ID NO: 75409 - DNA, 25 bp, Artificial sequence
  SiRNA target sequence
agataaaaataagtacattagtaaa

SEQ ID NO: 75410 - DNA, 25 bp, Artificial sequence
  SiRNA target sequence
gataaaaataagtacattagtaaag

SEQ ID NO: 75411 - DNA, 25 bp, Artificial sequence
  SiRNA target sequence
ataaaaataagtacattagtaaaga

SEQ ID NO: 75412 - DNA, 25 bp, Artificial sequence
  SiRNA target sequence
taaaaataagtacattagtaaagaa

SEQ ID NO: 75413 - DNA, 25 bp, Artificial sequence
  SiRNA target sequence
aaaaataagtacattagtaaagaat

SEQ ID NO: 75414 - DNA, 25 bp, Artificial sequence
  SiRNA target sequence
aaaataagtacattagtaaagaatc

SEQ ID NO: 75415 - DNA, 25 bp, Artificial sequence
  SiRNA target sequence
aaataagtacattagtaaagaatct

SEQ ID NO: 75416 - DNA, 25 bp, Artificial sequence
  SiRNA target sequence
aataagtacattagtaaagaatctt

SEQ ID NO: 75417 - DNA, 25 bp, Artificial sequence
  SiRNA target sequence
ataagtacattagtaaagaatctta

SEQ ID NO: 75418 - DNA, 25 bp, Artificial sequence
  SiRNA target sequence
taagtacattagtaaagaatcttaa

SEQ ID NO: 75419 - DNA, 25 bp, Artificial sequence
  SiRNA target sequence
aagtacattagtaaagaatcttaat

SEQ ID NO: 75420 - DNA, 25 bp, Artificial sequence
  SiRNA target sequence
agtacattagtaaagaatcttaatc

SEQ ID NO: 75421 - DNA, 25 bp, Artificial sequence
  SiRNA target sequence
gtacattagtaaagaatcttaatca

SEQ ID NO: 75422 - DNA, 25 bp, Artificial sequence
  SiRNA target sequence
tacattagtaaagaatcttaatcaa

SEQ ID NO: 75423 - DNA, 25 bp, Artificial sequence
  SiRNA target sequence
acattagtaaagaatcttaatcaat

SEQ ID NO: 75424 - DNA, 25 bp, Artificial sequence
  SiRNA target sequence
cattagtaaagaatcttaatcaatc

SEQ ID NO: 75425 - DNA, 25 bp, Artificial sequence
  SiRNA target sequence
attagtaaagaatcttaatcaatct

SEQ ID NO: 75426 - DNA, 25 bp, Artificial sequence
  SiRNA target sequence
ttagtaaagaatcttaatcaatcta

SEQ ID NO: 75427 - DNA, 25 bp, Artificial sequence
  SiRNA target sequence
tagtaaagaatcttaatcaatctat

SEQ ID NO: 75428 - DNA, 25 bp, Artificial sequence
  SiRNA target sequence
agtaaagaatcttaatcaatctatc

SEQ ID NO: 75429 - DNA, 25 bp, Artificial sequence
  SiRNA target sequence
gtaaagaatcttaatcaatctatcg

SEQ ID NO: 75430 - DNA, 25 bp, Artificial sequence
  SiRNA target sequence
taaagaatcttaatcaatctatcgc

SEQ ID NO: 75431 - DNA, 25 bp, Artificial sequence
  SiRNA target sequence
aaagaatcttaatcaatctatcgca

SEQ ID NO: 75432 - DNA, 25 bp, Artificial sequence
  SiRNA target sequence
aagaatcttaatcaatctatcgcaa

SEQ ID NO: 75433 - DNA, 25 bp, Artificial sequence
  SiRNA target sequence
agaatcttaatcaatctatcgcaaa

SEQ ID NO: 75434 - DNA, 25 bp, Artificial sequence
  SiRNA target sequence
gaatcttaatcaatctatcgcaaat

SEQ ID NO: 75435 - DNA, 25 bp, Artificial sequence
  SiRNA target sequence
aatcttaatcaatctatcgcaaatc

SEQ ID NO: 75436 - DNA, 25 bp, Artificial sequence
  SiRNA target sequence
atcttaatcaatctatcgcaaatcg

SEQ ID NO: 75437 - DNA, 25 bp, Artificial sequence
  SiRNA target sequence
tcttaatcaatctatcgcaaatcga

SEQ ID NO: 75438 - DNA, 25 bp, Artificial sequence
  SiRNA target sequence
cttaatcaatctatcgcaaatcgaa

SEQ ID NO: 75439 - DNA, 25 bp, Artificial sequence
  SiRNA target sequence
ttaatcaatctatcgcaaatcgaaa

SEQ ID NO: 75440 - DNA, 25 bp, Artificial sequence
  SiRNA target sequence
taatcaatctatcgcaaatcgaaaa

SEQ ID NO: 75441 - DNA, 25 bp, Artificial sequence
  SiRNA target sequence
aatcaatctatcgcaaatcgaaaag

SEQ ID NO: 75442 - DNA, 25 bp, Artificial sequence
  SiRNA target sequence
atcaatctatcgcaaatcgaaaagg

SEQ ID NO: 75443 - DNA, 25 bp, Artificial sequence
  SiRNA target sequence
tcaatctatcgcaaatcgaaaaggt

SEQ ID NO: 75444 - DNA, 25 bp, Artificial sequence
  SiRNA target sequence
caatctatcgcaaatcgaaaaggtg

SEQ ID NO: 75445 - DNA, 25 bp, Artificial sequence
  SiRNA target sequence
aatctatcgcaaatcgaaaaggtga

SEQ ID NO: 75446 - DNA, 25 bp, Artificial sequence
  SiRNA target sequence
atctatcgcaaatcgaaaaggtgaa

SEQ ID NO: 75447 - DNA, 25 bp, Artificial sequence
  SiRNA target sequence
tctatcgcaaatcgaaaaggtgaac

SEQ ID NO: 75448 - DNA, 25 bp, Artificial sequence
  SiRNA target sequence
ctatcgcaaatcgaaaaggtgaaca

SEQ ID NO: 75449 - DNA, 25 bp, Artificial sequence
  SiRNA target sequence
tatcgcaaatcgaaaaggtgaacac

SEQ ID NO: 75450 - DNA, 25 bp, Artificial sequence
  SiRNA target sequence
atcgcaaatcgaaaaggtgaacaca

SEQ ID NO: 75451 - DNA, 25 bp, Artificial sequence
  SiRNA target sequence
tcgcaaatcgaaaaggtgaacacac

SEQ ID NO: 75452 - DNA, 25 bp, Artificial sequence
  SiRNA target sequence
cgcaaatcgaaaaggtgaacacaca

SEQ ID NO: 75453 - DNA, 25 bp, Artificial sequence
  SiRNA target sequence
gcaaatcgaaaaggtgaacacacag

SEQ ID NO: 75454 - DNA, 25 bp, Artificial sequence
  SiRNA target sequence
caaatcgaaaaggtgaacacacagc

SEQ ID NO: 75455 - DNA, 25 bp, Artificial sequence
  SiRNA target sequence
aaatcgaaaaggtgaacacacagca

SEQ ID NO: 75456 - DNA, 25 bp, Artificial sequence
  SiRNA target sequence
aatcgaaaaggtgaacacacagcac

SEQ ID NO: 75457 - DNA, 25 bp, Artificial sequence
  SiRNA target sequence
atcgaaaaggtgaacacacagcact

SEQ ID NO: 75458 - DNA, 25 bp, Artificial sequence
  SiRNA target sequence
tcgaaaaggtgaacacacagcactt

SEQ ID NO: 75459 - DNA, 25 bp, Artificial sequence
  SiRNA target sequence
cgaaaaggtgaacacacagcacttg

SEQ ID NO: 75460 - DNA, 25 bp, Artificial sequence
  SiRNA target sequence
gaaaaggtgaacacacagcacttga

SEQ ID NO: 75461 - DNA, 25 bp, Artificial sequence
  SiRNA target sequence
aaaaggtgaacacacagcacttgaa

SEQ ID NO: 75462 - DNA, 25 bp, Artificial sequence
  SiRNA target sequence
aaaggtgaacacacagcacttgaaa

SEQ ID NO: 75463 - DNA, 25 bp, Artificial sequence
  SiRNA target sequence
aaggtgaacacacagcacttgaaag

SEQ ID NO: 75464 - DNA, 25 bp, Artificial sequence
  SiRNA target sequence
aggtgaacacacagcacttgaaaga

SEQ ID NO: 75465 - DNA, 25 bp, Artificial sequence
  SiRNA target sequence
ggtgaacacacagcacttgaaagat

SEQ ID NO: 75466 - DNA, 25 bp, Artificial sequence
  SiRNA target sequence
gtgaacacacagcacttgaaagatt

SEQ ID NO: 75467 - DNA, 25 bp, Artificial sequence
  SiRNA target sequence
tgaacacacagcacttgaaagattt

SEQ ID NO: 75468 - DNA, 25 bp, Artificial sequence
  SiRNA target sequence
gaacacacagcacttgaaagatttg

SEQ ID NO: 75469 - DNA, 25 bp, Artificial sequence
  SiRNA target sequence
aacacacagcacttgaaagatttgt

SEQ ID NO: 75470 - DNA, 25 bp, Artificial sequence
  SiRNA target sequence
acacacagcacttgaaagatttgtg

SEQ ID NO: 75471 - DNA, 25 bp, Artificial sequence
  SiRNA target sequence
cacacagcacttgaaagatttgtgt

SEQ ID NO: 75472 - DNA, 25 bp, Artificial sequence
  SiRNA target sequence
acacagcacttgaaagatttgtgtt

SEQ ID NO: 75473 - DNA, 25 bp, Artificial sequence
  SiRNA target sequence
cacagcacttgaaagatttgtgtta

SEQ ID NO: 75474 - DNA, 25 bp, Artificial sequence
  SiRNA target sequence
acagcacttgaaagatttgtgttac

SEQ ID NO: 75475 - DNA, 25 bp, Artificial sequence
  SiRNA target sequence
cagcacttgaaagatttgtgttaca

SEQ ID NO: 75476 - DNA, 25 bp, Artificial sequence
  SiRNA target sequence
agcacttgaaagatttgtgttacag

SEQ ID NO: 75477 - DNA, 25 bp, Artificial sequence
  SiRNA target sequence
gcacttgaaagatttgtgttacagt

SEQ ID NO: 75478 - DNA, 25 bp, Artificial sequence
  SiRNA target sequence
cacttgaaagatttgtgttacagtc

SEQ ID NO: 75479 - DNA, 25 bp, Artificial sequence
  SiRNA target sequence
acttgaaagatttgtgttacagtca

SEQ ID NO: 75480 - DNA, 25 bp, Artificial sequence
  SiRNA target sequence
cttgaaagatttgtgttacagtcac

SEQ ID NO: 75481 - DNA, 25 bp, Artificial sequence
  SiRNA target sequence
ttgaaagatttgtgttacagtcact

SEQ ID NO: 75482 - DNA, 25 bp, Artificial sequence
  SiRNA target sequence
tgaaagatttgtgttacagtcactc

SEQ ID NO: 75483 - DNA, 25 bp, Artificial sequence
  SiRNA target sequence
gaaagatttgtgttacagtcactct

SEQ ID NO: 75484 - DNA, 25 bp, Artificial sequence
  SiRNA target sequence
aaagatttgtgttacagtcactctt

SEQ ID NO: 75485 - DNA, 25 bp, Artificial sequence
  SiRNA target sequence
aagatttgtgttacagtcactctta

SEQ ID NO: 75486 - DNA, 25 bp, Artificial sequence
  SiRNA target sequence
agatttgtgttacagtcactcttag

SEQ ID NO: 75487 - DNA, 25 bp, Artificial sequence
  SiRNA target sequence
gatttgtgttacagtcactcttagt

SEQ ID NO: 75488 - DNA, 25 bp, Artificial sequence
  SiRNA target sequence
atttgtgttacagtcactcttagtg

SEQ ID NO: 75489 - DNA, 25 bp, Artificial sequence
  SiRNA target sequence
tttgtgttacagtcactcttagtgg

SEQ ID NO: 75490 - DNA, 25 bp, Artificial sequence
  SiRNA target sequence
ttgtgttacagtcactcttagtggc

SEQ ID NO: 75491 - DNA, 25 bp, Artificial sequence
  SiRNA target sequence
tgtgttacagtcactcttagtggct

SEQ ID NO: 75492 - DNA, 25 bp, Artificial sequence
  SiRNA target sequence
gtgttacagtcactcttagtggctg

SEQ ID NO: 75493 - DNA, 25 bp, Artificial sequence
  SiRNA target sequence
tgttacagtcactcttagtggctgt

SEQ ID NO: 75494 - DNA, 25 bp, Artificial sequence
  SiRNA target sequence
gttacagtcactcttagtggctgta

SEQ ID NO: 75495 - DNA, 25 bp, Artificial sequence
  SiRNA target sequence
ttacagtcactcttagtggctgtat

SEQ ID NO: 75496 - DNA, 25 bp, Artificial sequence
  SiRNA target sequence
tacagtcactcttagtggctgtatt

SEQ ID NO: 75497 - DNA, 25 bp, Artificial sequence
  SiRNA target sequence
acagtcactcttagtggctgtattg

SEQ ID NO: 75498 - DNA, 25 bp, Artificial sequence
  SiRNA target sequence
cagtcactcttagtggctgtattga

SEQ ID NO: 75499 - DNA, 25 bp, Artificial sequence
  SiRNA target sequence
agtcactcttagtggctgtattgac

SEQ ID NO: 75500 - DNA, 25 bp, Artificial sequence
  SiRNA target sequence
gtcactcttagtggctgtattgacc

SEQ ID NO: 75501 - DNA, 25 bp, Artificial sequence
  SiRNA target sequence
tcactcttagtggctgtattgaccg

SEQ ID NO: 75502 - DNA, 25 bp, Artificial sequence
  SiRNA target sequence
cactcttagtggctgtattgaccga

SEQ ID NO: 75503 - DNA, 25 bp, Artificial sequence
  SiRNA target sequence
actcttagtggctgtattgaccgaa

SEQ ID NO: 75504 - DNA, 25 bp, Artificial sequence
  SiRNA target sequence
ctcttagtggctgtattgaccgaac

SEQ ID NO: 75505 - DNA, 25 bp, Artificial sequence
  SiRNA target sequence
tcttagtggctgtattgaccgaact

SEQ ID NO: 75506 - DNA, 25 bp, Artificial sequence
  SiRNA target sequence
cttagtggctgtattgaccgaactt

SEQ ID NO: 75507 - DNA, 25 bp, Artificial sequence
  SiRNA target sequence
ttagtggctgtattgaccgaactta

SEQ ID NO: 75508 - DNA, 25 bp, Artificial sequence
  SiRNA target sequence
tagtggctgtattgaccgaacttaa

SEQ ID NO: 75509 - DNA, 25 bp, Artificial sequence
  SiRNA target sequence
agtggctgtattgaccgaacttaat

SEQ ID NO: 75510 - DNA, 25 bp, Artificial sequence
  SiRNA target sequence
gtggctgtattgaccgaacttaatg

SEQ ID NO: 75511 - DNA, 25 bp, Artificial sequence
  SiRNA target sequence
tggctgtattgaccgaacttaatgg

SEQ ID NO: 75512 - DNA, 25 bp, Artificial sequence
  SiRNA target sequence
ggctgtattgaccgaacttaatgga

SEQ ID NO: 75513 - DNA, 25 bp, Artificial sequence
  SiRNA target sequence
gctgtattgaccgaacttaatggat

SEQ ID NO: 75514 - DNA, 25 bp, Artificial sequence
  SiRNA target sequence
ctgtattgaccgaacttaatggatt

SEQ ID NO: 75515 - DNA, 25 bp, Artificial sequence
  SiRNA target sequence
tgtattgaccgaacttaatggattt

SEQ ID NO: 75516 - DNA, 25 bp, Artificial sequence
  SiRNA target sequence
gtattgaccgaacttaatggattta

SEQ ID NO: 75517 - DNA, 25 bp, Artificial sequence
  SiRNA target sequence
tattgaccgaacttaatggatttat

SEQ ID NO: 75518 - DNA, 25 bp, Artificial sequence
  SiRNA target sequence
attgaccgaacttaatggatttatt

SEQ ID NO: 75519 - DNA, 25 bp, Artificial sequence
  SiRNA target sequence
ttgaccgaacttaatggatttattt

SEQ ID NO: 75520 - DNA, 25 bp, Artificial sequence
  SiRNA target sequence
tgaccgaacttaatggatttatttt

SEQ ID NO: 75521 - DNA, 25 bp, Artificial sequence
  SiRNA target sequence
gaccgaacttaatggatttattttt

SEQ ID NO: 75522 - DNA, 25 bp, Artificial sequence
  SiRNA target sequence
accgaacttaatggatttattttta

SEQ ID NO: 75523 - DNA, 25 bp, Artificial sequence
  SiRNA target sequence
ccgaacttaatggatttatttttac

SEQ ID NO: 75524 - DNA, 25 bp, Artificial sequence
  SiRNA target sequence
cgaacttaatggatttatttttaca

SEQ ID NO: 75525 - DNA, 25 bp, Artificial sequence
  SiRNA target sequence
gaacttaatggatttatttttacag

SEQ ID NO: 75526 - DNA, 25 bp, Artificial sequence
  SiRNA target sequence
aacttaatggatttatttttacagg

SEQ ID NO: 75527 - DNA, 25 bp, Artificial sequence
  SiRNA target sequence
acttaatggatttatttttacaggt

SEQ ID NO: 75528 - DNA, 25 bp, Artificial sequence
  SiRNA target sequence
cttaatggatttatttttacaggtg

SEQ ID NO: 75529 - DNA, 25 bp, Artificial sequence
  SiRNA target sequence
ttaatggatttatttttacaggtgt

SEQ ID NO: 75530 - DNA, 25 bp, Artificial sequence
  SiRNA target sequence
taatggatttatttttacaggtgta

SEQ ID NO: 75531 - DNA, 25 bp, Artificial sequence
  SiRNA target sequence
aatggatttatttttacaggtgtag

SEQ ID NO: 75532 - DNA, 25 bp, Artificial sequence
  SiRNA target sequence
atggatttatttttacaggtgtagt

SEQ ID NO: 75533 - DNA, 25 bp, Artificial sequence
  SiRNA target sequence
tggatttatttttacaggtgtagtg

SEQ ID NO: 75534 - DNA, 25 bp, Artificial sequence
  SiRNA target sequence
ggatttatttttacaggtgtagtgc

SEQ ID NO: 75535 - DNA, 25 bp, Artificial sequence
  SiRNA target sequence
gatttatttttacaggtgtagtgca

SEQ ID NO: 75536 - DNA, 25 bp, Artificial sequence
  SiRNA target sequence
atttatttttacaggtgtagtgcaa

SEQ ID NO: 75537 - DNA, 25 bp, Artificial sequence
  SiRNA target sequence
tttatttttacaggtgtagtgcaat

SEQ ID NO: 75538 - DNA, 25 bp, Artificial sequence
  SiRNA target sequence
ttatttttacaggtgtagtgcaata

SEQ ID NO: 75539 - DNA, 25 bp, Artificial sequence
  SiRNA target sequence
tatttttacaggtgtagtgcaatat

SEQ ID NO: 75540 - DNA, 25 bp, Artificial sequence
  SiRNA target sequence
atttttacaggtgtagtgcaatata

SEQ ID NO: 75541 - DNA, 25 bp, Artificial sequence
  SiRNA target sequence
tttttacaggtgtagtgcaatatat

SEQ ID NO: 75542 - DNA, 25 bp, Artificial sequence
  SiRNA target sequence
ttttacaggtgtagtgcaatatatt

SEQ ID NO: 75543 - DNA, 25 bp, Artificial sequence
  SiRNA target sequence
tttacaggtgtagtgcaatatattt

SEQ ID NO: 75544 - DNA, 25 bp, Artificial sequence
  SiRNA target sequence
ttacaggtgtagtgcaatatattta

SEQ ID NO: 75545 - DNA, 25 bp, Artificial sequence
  SiRNA target sequence
tacaggtgtagtgcaatatatttat

SEQ ID NO: 75546 - DNA, 25 bp, Artificial sequence
  SiRNA target sequence
acaggtgtagtgcaatatatttata

SEQ ID NO: 75547 - DNA, 25 bp, Artificial sequence
  SiRNA target sequence
caggtgtagtgcaatatatttatag

SEQ ID NO: 75548 - DNA, 25 bp, Artificial sequence
  SiRNA target sequence
aggtgtagtgcaatatatttataga

SEQ ID NO: 75549 - DNA, 25 bp, Artificial sequence
  SiRNA target sequence
ggtgtagtgcaatatatttatagaa

SEQ ID NO: 75550 - DNA, 25 bp, Artificial sequence
  SiRNA target sequence
gtgtagtgcaatatatttatagaaa

SEQ ID NO: 75551 - DNA, 25 bp, Artificial sequence
  SiRNA target sequence
tgtagtgcaatatatttatagaaat

SEQ ID NO: 75552 - DNA, 25 bp, Artificial sequence
  SiRNA target sequence
gtagtgcaatatatttatagaaata

SEQ ID NO: 75553 - DNA, 25 bp, Artificial sequence
  SiRNA target sequence
tagtgcaatatatttatagaaatac

SEQ ID NO: 75554 - DNA, 25 bp, Artificial sequence
  SiRNA target sequence
agtgcaatatatttatagaaatacg

SEQ ID NO: 75555 - DNA, 25 bp, Artificial sequence
  SiRNA target sequence
gtgcaatatatttatagaaatacgg

SEQ ID NO: 75556 - DNA, 25 bp, Artificial sequence
  SiRNA target sequence
tgcaatatatttatagaaatacggc

SEQ ID NO: 75557 - DNA, 25 bp, Artificial sequence
  SiRNA target sequence
gcaatatatttatagaaatacggca

SEQ ID NO: 75558 - DNA, 25 bp, Artificial sequence
  SiRNA target sequence
caatatatttatagaaatacggcaa

SEQ ID NO: 75559 - DNA, 25 bp, Artificial sequence
  SiRNA target sequence
aatatatttatagaaatacggcaaa

SEQ ID NO: 75560 - DNA, 25 bp, Artificial sequence
  SiRNA target sequence
atatatttatagaaatacggcaaaa

SEQ ID NO: 75561 - DNA, 25 bp, Artificial sequence
  SiRNA target sequence
tatatttatagaaatacggcaaaat

SEQ ID NO: 75562 - DNA, 25 bp, Artificial sequence
  SiRNA target sequence
atatttatagaaatacggcaaaatc

SEQ ID NO: 75563 - DNA, 25 bp, Artificial sequence
  SiRNA target sequence
tatttatagaaatacggcaaaatct

SEQ ID NO: 75564 - DNA, 25 bp, Artificial sequence
  SiRNA target sequence
atttatagaaatacggcaaaatcta

SEQ ID NO: 75565 - DNA, 25 bp, Artificial sequence
  SiRNA target sequence
tttatagaaatacggcaaaatctac

SEQ ID NO: 75566 - DNA, 25 bp, Artificial sequence
  SiRNA target sequence
ttatagaaatacggcaaaatctaca

SEQ ID NO: 75567 - DNA, 25 bp, Artificial sequence
  SiRNA target sequence
tatagaaatacggcaaaatctacat

SEQ ID NO: 75568 - DNA, 25 bp, Artificial sequence
  SiRNA target sequence
atagaaatacggcaaaatctacatt

SEQ ID NO: 75569 - DNA, 25 bp, Artificial sequence
  SiRNA target sequence
tagaaatacggcaaaatctacattc

SEQ ID NO: 75570 - DNA, 25 bp, Artificial sequence
  SiRNA target sequence
agaaatacggcaaaatctacattca

SEQ ID NO: 75571 - DNA, 25 bp, Artificial sequence
  SiRNA target sequence
gaaatacggcaaaatctacattcaa

SEQ ID NO: 75572 - DNA, 25 bp, Artificial sequence
  SiRNA target sequence
aaatacggcaaaatctacattcaaa

SEQ ID NO: 75573 - DNA, 25 bp, Artificial sequence
  SiRNA target sequence
aatacggcaaaatctacattcaaag

SEQ ID NO: 75574 - DNA, 25 bp, Artificial sequence
  SiRNA target sequence
atacggcaaaatctacattcaaagg

SEQ ID NO: 75575 - DNA, 25 bp, Artificial sequence
  SiRNA target sequence
tacggcaaaatctacattcaaaggc

SEQ ID NO: 75576 - DNA, 25 bp, Artificial sequence
  SiRNA target sequence
acggcaaaatctacattcaaaggct

SEQ ID NO: 75577 - DNA, 25 bp, Artificial sequence
  SiRNA target sequence
cggcaaaatctacattcaaaggctt

SEQ ID NO: 75578 - DNA, 25 bp, Artificial sequence
  SiRNA target sequence
ggcaaaatctacattcaaaggcttc

SEQ ID NO: 75579 - DNA, 25 bp, Artificial sequence
  SiRNA target sequence
gcaaaatctacattcaaaggcttca

SEQ ID NO: 75580 - DNA, 25 bp, Artificial sequence
  SiRNA target sequence
caaaatctacattcaaaggcttcat

SEQ ID NO: 75581 - DNA, 25 bp, Artificial sequence
  SiRNA target sequence
aaaatctacattcaaaggcttcatt

SEQ ID NO: 75582 - DNA, 25 bp, Artificial sequence
  SiRNA target sequence
aaatctacattcaaaggcttcattt

SEQ ID NO: 75583 - DNA, 25 bp, Artificial sequence
  SiRNA target sequence
aatctacattcaaaggcttcatttc

SEQ ID NO: 75584 - DNA, 25 bp, Artificial sequence
  SiRNA target sequence
atctacattcaaaggcttcatttct

SEQ ID NO: 75585 - DNA, 25 bp, Artificial sequence
  SiRNA target sequence
tctacattcaaaggcttcatttctc

SEQ ID NO: 75586 - DNA, 25 bp, Artificial sequence
  SiRNA target sequence
ctacattcaaaggcttcatttctct

SEQ ID NO: 75587 - DNA, 25 bp, Artificial sequence
  SiRNA target sequence
tacattcaaaggcttcatttctctt

SEQ ID NO: 75588 - DNA, 25 bp, Artificial sequence
  SiRNA target sequence
acattcaaaggcttcatttctcttt

SEQ ID NO: 75589 - DNA, 25 bp, Artificial sequence
  SiRNA target sequence
cattcaaaggcttcatttctctttc

SEQ ID NO: 75590 - DNA, 25 bp, Artificial sequence
  SiRNA target sequence
attcaaaggcttcatttctctttca

SEQ ID NO: 75591 - DNA, 25 bp, Artificial sequence
  SiRNA target sequence
ttcaaaggcttcatttctctttcac

SEQ ID NO: 75592 - DNA, 25 bp, Artificial sequence
  SiRNA target sequence
tcaaaggcttcatttctctttcacc

SEQ ID NO: 75593 - DNA, 25 bp, Artificial sequence
  SiRNA target sequence
caaaggcttcatttctctttcacct

SEQ ID NO: 75594 - DNA, 25 bp, Artificial sequence
  SiRNA target sequence
aaaggcttcatttctctttcaccta

SEQ ID NO: 75595 - DNA, 25 bp, Artificial sequence
  SiRNA target sequence
aaggcttcatttctctttcacctaa

SEQ ID NO: 75596 - DNA, 25 bp, Artificial sequence
  SiRNA target sequence
aggcttcatttctctttcacctaaa

SEQ ID NO: 75597 - DNA, 25 bp, Artificial sequence
  SiRNA target sequence
ggcttcatttctctttcacctaaaa

SEQ ID NO: 75598 - DNA, 25 bp, Artificial sequence
  SiRNA target sequence
gcttcatttctctttcacctaaaaa

SEQ ID NO: 75599 - DNA, 25 bp, Artificial sequence
  SiRNA target sequence
cttcatttctctttcacctaaaaat

SEQ ID NO: 75600 - DNA, 25 bp, Artificial sequence
  SiRNA target sequence
ttcatttctctttcacctaaaaatt

SEQ ID NO: 75601 - DNA, 25 bp, Artificial sequence
  SiRNA target sequence
tcatttctctttcacctaaaaattt

SEQ ID NO: 75602 - DNA, 25 bp, Artificial sequence
  SiRNA target sequence
catttctctttcacctaaaaatttt

SEQ ID NO: 75603 - DNA, 25 bp, Artificial sequence
  SiRNA target sequence
atttctctttcacctaaaaatttta

SEQ ID NO: 75604 - DNA, 25 bp, Artificial sequence
  SiRNA target sequence
tttctctttcacctaaaaattttag

SEQ ID NO: 75605 - DNA, 25 bp, Artificial sequence
  SiRNA target sequence
ttctctttcacctaaaaattttagt

SEQ ID NO: 75606 - DNA, 25 bp, Artificial sequence
  SiRNA target sequence
tctctttcacctaaaaattttagta

SEQ ID NO: 75607 - DNA, 25 bp, Artificial sequence
  SiRNA target sequence
ctctttcacctaaaaattttagtac

SEQ ID NO: 75608 - DNA, 25 bp, Artificial sequence
  SiRNA target sequence
tctttcacctaaaaattttagtacc

SEQ ID NO: 75609 - DNA, 25 bp, Artificial sequence
  SiRNA target sequence
ctttcacctaaaaattttagtacca

SEQ ID NO: 75610 - DNA, 25 bp, Artificial sequence
  SiRNA target sequence
tttcacctaaaaattttagtaccat

SEQ ID NO: 75611 - DNA, 25 bp, Artificial sequence
  SiRNA target sequence
ttcacctaaaaattttagtaccata

SEQ ID NO: 75612 - DNA, 25 bp, Artificial sequence
  SiRNA target sequence
tcacctaaaaattttagtaccatag

SEQ ID NO: 75613 - DNA, 25 bp, Artificial sequence
  SiRNA target sequence
cacctaaaaattttagtaccatagg

SEQ ID NO: 75614 - DNA, 25 bp, Artificial sequence
  SiRNA target sequence
acctaaaaattttagtaccataggt

SEQ ID NO: 75615 - DNA, 25 bp, Artificial sequence
  SiRNA target sequence
cctaaaaattttagtaccataggtg

SEQ ID NO: 75616 - DNA, 25 bp, Artificial sequence
  SiRNA target sequence
ctaaaaattttagtaccataggtgg

SEQ ID NO: 75617 - DNA, 25 bp, Artificial sequence
  SiRNA target sequence
taaaaattttagtaccataggtggc

SEQ ID NO: 75618 - DNA, 25 bp, Artificial sequence
  SiRNA target sequence
aaaaattttagtaccataggtggcg

SEQ ID NO: 75619 - DNA, 25 bp, Artificial sequence
  SiRNA target sequence
aaaattttagtaccataggtggcgg

SEQ ID NO: 75620 - DNA, 25 bp, Artificial sequence
  SiRNA target sequence
aaattttagtaccataggtggcgga

SEQ ID NO: 75621 - DNA, 25 bp, Artificial sequence
  SiRNA target sequence
aattttagtaccataggtggcggag

SEQ ID NO: 75622 - DNA, 25 bp, Artificial sequence
  SiRNA target sequence
attttagtaccataggtggcggaga

SEQ ID NO: 75623 - DNA, 25 bp, Artificial sequence
  SiRNA target sequence
ttttagtaccataggtggcggagaa

SEQ ID NO: 75624 - DNA, 25 bp, Artificial sequence
  SiRNA target sequence
tttagtaccataggtggcggagaaa

SEQ ID NO: 75625 - DNA, 25 bp, Artificial sequence
  SiRNA target sequence
ttagtaccataggtggcggagaaat

SEQ ID NO: 75626 - DNA, 25 bp, Artificial sequence
  SiRNA target sequence
tagtaccataggtggcggagaaatt

SEQ ID NO: 75627 - DNA, 25 bp, Artificial sequence
  SiRNA target sequence
agtaccataggtggcggagaaattc

SEQ ID NO: 75628 - DNA, 25 bp, Artificial sequence
  SiRNA target sequence
gtaccataggtggcggagaaattca

SEQ ID NO: 75629 - DNA, 25 bp, Artificial sequence
  SiRNA target sequence
taccataggtggcggagaaattcaa

SEQ ID NO: 75630 - DNA, 25 bp, Artificial sequence
  SiRNA target sequence
accataggtggcggagaaattcaaa

SEQ ID NO: 75631 - DNA, 25 bp, Artificial sequence
  SiRNA target sequence
ccataggtggcggagaaattcaaac

SEQ ID NO: 75632 - DNA, 25 bp, Artificial sequence
  SiRNA target sequence
cataggtggcggagaaattcaaaca

SEQ ID NO: 75633 - DNA, 25 bp, Artificial sequence
  SiRNA target sequence
ataggtggcggagaaattcaaacaa

SEQ ID NO: 75634 - DNA, 25 bp, Artificial sequence
  SiRNA target sequence
taggtggcggagaaattcaaacaat

SEQ ID NO: 75635 - DNA, 25 bp, Artificial sequence
  SiRNA target sequence
aggtggcggagaaattcaaacaata

SEQ ID NO: 75636 - DNA, 25 bp, Artificial sequence
  SiRNA target sequence
ggtggcggagaaattcaaacaataa

SEQ ID NO: 75637 - DNA, 25 bp, Artificial sequence
  SiRNA target sequence
gtggcggagaaattcaaacaataat

SEQ ID NO: 75638 - DNA, 25 bp, Artificial sequence
  SiRNA target sequence
tggcggagaaattcaaacaataata

SEQ ID NO: 75639 - DNA, 25 bp, Artificial sequence
  SiRNA target sequence
ggcggagaaattcaaacaataatag

SEQ ID NO: 75640 - DNA, 25 bp, Artificial sequence
  SiRNA target sequence
gcggagaaattcaaacaataataga

SEQ ID NO: 75641 - DNA, 25 bp, Artificial sequence
  SiRNA target sequence
cggagaaattcaaacaataatagat

SEQ ID NO: 75642 - DNA, 25 bp, Artificial sequence
  SiRNA target sequence
ggagaaattcaaacaataatagata

SEQ ID NO: 75643 - DNA, 25 bp, Artificial sequence
  SiRNA target sequence
gagaaattcaaacaataatagatag

SEQ ID NO: 75644 - DNA, 25 bp, Artificial sequence
  SiRNA target sequence
agaaattcaaacaataatagataga

SEQ ID NO: 75645 - DNA, 25 bp, Artificial sequence
  SiRNA target sequence
gaaattcaaacaataatagatagaa

SEQ ID NO: 75646 - DNA, 25 bp, Artificial sequence
  SiRNA target sequence
aaattcaaacaataatagatagaaa

SEQ ID NO: 75647 - DNA, 25 bp, Artificial sequence
  SiRNA target sequence
aattcaaacaataatagatagaaaa

SEQ ID NO: 75648 - DNA, 25 bp, Artificial sequence
  SiRNA target sequence
attcaaacaataatagatagaaaat

SEQ ID NO: 75649 - DNA, 25 bp, Artificial sequence
  SiRNA target sequence
ttcaaacaataatagatagaaaatc

SEQ ID NO: 75650 - DNA, 25 bp, Artificial sequence
  SiRNA target sequence
tcaaacaataatagatagaaaatca

SEQ ID NO: 75651 - DNA, 25 bp, Artificial sequence
  SiRNA target sequence
caaacaataatagatagaaaatcaa

SEQ ID NO: 75652 - DNA, 25 bp, Artificial sequence
  SiRNA target sequence
aaacaataatagatagaaaatcaaa

SEQ ID NO: 75653 - DNA, 25 bp, Artificial sequence
  SiRNA target sequence
aacaataatagatagaaaatcaaaa

SEQ ID NO: 75654 - DNA, 25 bp, Artificial sequence
  SiRNA target sequence
acaataatagatagaaaatcaaaat

SEQ ID NO: 75655 - DNA, 25 bp, Artificial sequence
  SiRNA target sequence
caataatagatagaaaatcaaaatc

SEQ ID NO: 75656 - DNA, 25 bp, Artificial sequence
  SiRNA target sequence
aataatagatagaaaatcaaaatct

SEQ ID NO: 75657 - DNA, 25 bp, Artificial sequence
  SiRNA target sequence
ataatagatagaaaatcaaaatctg

SEQ ID NO: 75658 - DNA, 25 bp, Artificial sequence
  SiRNA target sequence
taatagatagaaaatcaaaatctgc

SEQ ID NO: 75659 - DNA, 25 bp, Artificial sequence
  SiRNA target sequence
aatagatagaaaatcaaaatctgca

SEQ ID NO: 75660 - DNA, 25 bp, Artificial sequence
  SiRNA target sequence
atagatagaaaatcaaaatctgcaa

SEQ ID NO: 75661 - DNA, 25 bp, Artificial sequence
  SiRNA target sequence
tagatagaaaatcaaaatctgcaag

SEQ ID NO: 75662 - DNA, 25 bp, Artificial sequence
  SiRNA target sequence
agatagaaaatcaaaatctgcaagt

SEQ ID NO: 75663 - DNA, 25 bp, Artificial sequence
  SiRNA target sequence
gatagaaaatcaaaatctgcaagtg

SEQ ID NO: 75664 - DNA, 25 bp, Artificial sequence
  SiRNA target sequence
atagaaaatcaaaatctgcaagtga

SEQ ID NO: 75665 - DNA, 25 bp, Artificial sequence
  SiRNA target sequence
tagaaaatcaaaatctgcaagtgaa

SEQ ID NO: 75666 - DNA, 25 bp, Artificial sequence
  SiRNA target sequence
agaaaatcaaaatctgcaagtgaac

SEQ ID NO: 75667 - DNA, 25 bp, Artificial sequence
  SiRNA target sequence
gaaaatcaaaatctgcaagtgaact

SEQ ID NO: 75668 - DNA, 25 bp, Artificial sequence
  SiRNA target sequence
aaaatcaaaatctgcaagtgaactt

SEQ ID NO: 75669 - DNA, 25 bp, Artificial sequence
  SiRNA target sequence
aaatcaaaatctgcaagtgaactta

SEQ ID NO: 75670 - DNA, 25 bp, Artificial sequence
  SiRNA target sequence
aatcaaaatctgcaagtgaacttat

SEQ ID NO: 75671 - DNA, 25 bp, Artificial sequence
  SiRNA target sequence
atcaaaatctgcaagtgaacttatt

SEQ ID NO: 75672 - DNA, 25 bp, Artificial sequence
  SiRNA target sequence
tcaaaatctgcaagtgaacttattg

SEQ ID NO: 75673 - DNA, 25 bp, Artificial sequence
  SiRNA target sequence
caaaatctgcaagtgaacttattga

SEQ ID NO: 75674 - DNA, 25 bp, Artificial sequence
  SiRNA target sequence
aaaatctgcaagtgaacttattgaa

SEQ ID NO: 75675 - DNA, 25 bp, Artificial sequence
  SiRNA target sequence
aaatctgcaagtgaacttattgaag

SEQ ID NO: 75676 - DNA, 25 bp, Artificial sequence
  SiRNA target sequence
aatctgcaagtgaacttattgaagt

SEQ ID NO: 75677 - DNA, 25 bp, Artificial sequence
  SiRNA target sequence
atctgcaagtgaacttattgaagtg

SEQ ID NO: 75678 - DNA, 25 bp, Artificial sequence
  SiRNA target sequence
tctgcaagtgaacttattgaagtgt

SEQ ID NO: 75679 - DNA, 25 bp, Artificial sequence
  SiRNA target sequence
ctgcaagtgaacttattgaagtgtt

SEQ ID NO: 75680 - DNA, 25 bp, Artificial sequence
  SiRNA target sequence
tgcaagtgaacttattgaagtgttt

SEQ ID NO: 75681 - DNA, 25 bp, Artificial sequence
  SiRNA target sequence
gcaagtgaacttattgaagtgtttc

SEQ ID NO: 75682 - DNA, 25 bp, Artificial sequence
  SiRNA target sequence
caagtgaacttattgaagtgtttct

SEQ ID NO: 75683 - DNA, 25 bp, Artificial sequence
  SiRNA target sequence
aagtgaacttattgaagtgtttctt

SEQ ID NO: 75684 - DNA, 25 bp, Artificial sequence
  SiRNA target sequence
agtgaacttattgaagtgtttctta

SEQ ID NO: 75685 - DNA, 25 bp, Artificial sequence
  SiRNA target sequence
gtgaacttattgaagtgtttcttac

SEQ ID NO: 75686 - DNA, 25 bp, Artificial sequence
  SiRNA target sequence
tgaacttattgaagtgtttcttaca

SEQ ID NO: 75687 - DNA, 25 bp, Artificial sequence
  SiRNA target sequence
gaacttattgaagtgtttcttacaa

SEQ ID NO: 75688 - DNA, 25 bp, Artificial sequence
  SiRNA target sequence
aacttattgaagtgtttcttacaag

SEQ ID NO: 75689 - DNA, 25 bp, Artificial sequence
  SiRNA target sequence
acttattgaagtgtttcttacaagc

SEQ ID NO: 75690 - DNA, 25 bp, Artificial sequence
  SiRNA target sequence
cttattgaagtgtttcttacaagct

SEQ ID NO: 75691 - DNA, 25 bp, Artificial sequence
  SiRNA target sequence
ttattgaagtgtttcttacaagctt

SEQ ID NO: 75692 - DNA, 25 bp, Artificial sequence
  SiRNA target sequence
tattgaagtgtttcttacaagcttg

SEQ ID NO: 75693 - DNA, 25 bp, Artificial sequence
  SiRNA target sequence
attgaagtgtttcttacaagcttgc

SEQ ID NO: 75694 - DNA, 25 bp, Artificial sequence
  SiRNA target sequence
ttgaagtgtttcttacaagcttgct

SEQ ID NO: 75695 - DNA, 25 bp, Artificial sequence
  SiRNA target sequence
tgaagtgtttcttacaagcttgctt

SEQ ID NO: 75696 - DNA, 25 bp, Artificial sequence
  SiRNA target sequence
gaagtgtttcttacaagcttgcttc

SEQ ID NO: 75697 - DNA, 25 bp, Artificial sequence
  SiRNA target sequence
aagtgtttcttacaagcttgcttcc

SEQ ID NO: 75698 - DNA, 25 bp, Artificial sequence
  SiRNA target sequence
agtgtttcttacaagcttgcttcca

SEQ ID NO: 75699 - DNA, 25 bp, Artificial sequence
  SiRNA target sequence
gtgtttcttacaagcttgcttccaa

SEQ ID NO: 75700 - DNA, 25 bp, Artificial sequence
  SiRNA target sequence
tgtttcttacaagcttgcttccaat

SEQ ID NO: 75701 - DNA, 25 bp, Artificial sequence
  SiRNA target sequence
gtttcttacaagcttgcttccaata

SEQ ID NO: 75702 - DNA, 25 bp, Artificial sequence
  SiRNA target sequence
tttcttacaagcttgcttccaatat

SEQ ID NO: 75703 - DNA, 25 bp, Artificial sequence
  SiRNA target sequence
ttcttacaagcttgcttccaatatg

SEQ ID NO: 75704 - DNA, 25 bp, Artificial sequence
  SiRNA target sequence
tcttacaagcttgcttccaatatgc

SEQ ID NO: 75705 - DNA, 25 bp, Artificial sequence
  SiRNA target sequence
cttacaagcttgcttccaatatgcc

SEQ ID NO: 75706 - DNA, 25 bp, Artificial sequence
  SiRNA target sequence
ttacaagcttgcttccaatatgcct

SEQ ID NO: 75707 - DNA, 25 bp, Artificial sequence
  SiRNA target sequence
tacaagcttgcttccaatatgcctt

SEQ ID NO: 75708 - DNA, 25 bp, Artificial sequence
  SiRNA target sequence
acaagcttgcttccaatatgcctta

SEQ ID NO: 75709 - DNA, 25 bp, Artificial sequence
  SiRNA target sequence
caagcttgcttccaatatgccttaa

SEQ ID NO: 75710 - DNA, 25 bp, Artificial sequence
  SiRNA target sequence
aagcttgcttccaatatgccttaaa

SEQ ID NO: 75711 - DNA, 25 bp, Artificial sequence
  SiRNA target sequence
agcttgcttccaatatgccttaaac

SEQ ID NO: 75712 - DNA, 25 bp, Artificial sequence
  SiRNA target sequence
gcttgcttccaatatgccttaaact

SEQ ID NO: 75713 - DNA, 25 bp, Artificial sequence
  SiRNA target sequence
cttgcttccaatatgccttaaactt

SEQ ID NO: 75714 - DNA, 25 bp, Artificial sequence
  SiRNA target sequence
ttgcttccaatatgccttaaacttt

SEQ ID NO: 75715 - DNA, 25 bp, Artificial sequence
  SiRNA target sequence
tgcttccaatatgccttaaactttt

SEQ ID NO: 75716 - DNA, 25 bp, Artificial sequence
  SiRNA target sequence
gcttccaatatgccttaaactttta

SEQ ID NO: 75717 - DNA, 25 bp, Artificial sequence
  SiRNA target sequence
cttccaatatgccttaaacttttat

SEQ ID NO: 75718 - DNA, 25 bp, Artificial sequence
  SiRNA target sequence
ttccaatatgccttaaacttttatt

SEQ ID NO: 75719 - DNA, 25 bp, Artificial sequence
  SiRNA target sequence
tccaatatgccttaaacttttattt

SEQ ID NO: 75720 - DNA, 25 bp, Artificial sequence
  SiRNA target sequence
ccaatatgccttaaacttttatttg

SEQ ID NO: 75721 - DNA, 25 bp, Artificial sequence
  SiRNA target sequence
caatatgccttaaacttttatttgc

SEQ ID NO: 75722 - DNA, 25 bp, Artificial sequence
  SiRNA target sequence
aatatgccttaaacttttatttgcc

SEQ ID NO: 75723 - DNA, 25 bp, Artificial sequence
  SiRNA target sequence
atatgccttaaacttttatttgccc

SEQ ID NO: 75724 - DNA, 25 bp, Artificial sequence
  SiRNA target sequence
tatgccttaaacttttatttgccct

SEQ ID NO: 75725 - DNA, 25 bp, Artificial sequence
  SiRNA target sequence
atgccttaaacttttatttgccctt

SEQ ID NO: 75726 - DNA, 25 bp, Artificial sequence
  SiRNA target sequence
tgccttaaacttttatttgccctta

SEQ ID NO: 75727 - DNA, 25 bp, Artificial sequence
  SiRNA target sequence
gccttaaacttttatttgcccttat

SEQ ID NO: 75728 - DNA, 25 bp, Artificial sequence
  SiRNA target sequence
ccttaaacttttatttgcccttatt

SEQ ID NO: 75729 - DNA, 25 bp, Artificial sequence
  SiRNA target sequence
cttaaacttttatttgcccttattg

SEQ ID NO: 75730 - DNA, 25 bp, Artificial sequence
  SiRNA target sequence
ttaaacttttatttgcccttattgc

SEQ ID NO: 75731 - DNA, 25 bp, Artificial sequence
  SiRNA target sequence
taaacttttatttgcccttattgca

SEQ ID NO: 75732 - DNA, 25 bp, Artificial sequence
  SiRNA target sequence
aaacttttatttgcccttattgcag

SEQ ID NO: 75733 - DNA, 25 bp, Artificial sequence
  SiRNA target sequence
aacttttatttgcccttattgcagt

SEQ ID NO: 75734 - DNA, 25 bp, Artificial sequence
  SiRNA target sequence
acttttatttgcccttattgcagtt

SEQ ID NO: 75735 - DNA, 25 bp, Artificial sequence
  SiRNA target sequence
cttttatttgcccttattgcagtta

SEQ ID NO: 75736 - DNA, 25 bp, Artificial sequence
  SiRNA target sequence
ttttatttgcccttattgcagttat

SEQ ID NO: 75737 - DNA, 25 bp, Artificial sequence
  SiRNA target sequence
tttatttgcccttattgcagttata

SEQ ID NO: 75738 - DNA, 25 bp, Artificial sequence
  SiRNA target sequence
ttatttgcccttattgcagttataa

SEQ ID NO: 75739 - DNA, 25 bp, Artificial sequence
  SiRNA target sequence
tatttgcccttattgcagttataaa

SEQ ID NO: 75740 - DNA, 25 bp, Artificial sequence
  SiRNA target sequence
atttgcccttattgcagttataaaa

SEQ ID NO: 75741 - DNA, 25 bp, Artificial sequence
  SiRNA target sequence
tttgcccttattgcagttataaaaa

SEQ ID NO: 75742 - DNA, 25 bp, Artificial sequence
  SiRNA target sequence
ttgcccttattgcagttataaaaaa

SEQ ID NO: 75743 - DNA, 25 bp, Artificial sequence
  SiRNA target sequence
tgcccttattgcagttataaaaaat

SEQ ID NO: 75744 - DNA, 25 bp, Artificial sequence
  SiRNA target sequence
gcccttattgcagttataaaaaata

SEQ ID NO: 75745 - DNA, 25 bp, Artificial sequence
  SiRNA target sequence
cccttattgcagttataaaaaatat

SEQ ID NO: 75746 - DNA, 25 bp, Artificial sequence
  SiRNA target sequence
ccttattgcagttataaaaaatatg

SEQ ID NO: 75747 - DNA, 25 bp, Artificial sequence
  SiRNA target sequence
cttattgcagttataaaaaatatgg

SEQ ID NO: 75748 - DNA, 25 bp, Artificial sequence
  SiRNA target sequence
ttattgcagttataaaaaatatggg

SEQ ID NO: 75749 - DNA, 25 bp, Artificial sequence
  SiRNA target sequence
tattgcagttataaaaaatatggga

SEQ ID NO: 75750 - DNA, 25 bp, Artificial sequence
  SiRNA target sequence
attgcagttataaaaaatatgggag

SEQ ID NO: 75751 - DNA, 25 bp, Artificial sequence
  SiRNA target sequence
ttgcagttataaaaaatatgggagg

SEQ ID NO: 75752 - DNA, 25 bp, Artificial sequence
  SiRNA target sequence
tgcagttataaaaaatatgggaggt

SEQ ID NO: 75753 - DNA, 25 bp, Artificial sequence
  SiRNA target sequence
gcagttataaaaaatatgggaggtc

SEQ ID NO: 75754 - DNA, 25 bp, Artificial sequence
  SiRNA target sequence
cagttataaaaaatatgggaggtct

SEQ ID NO: 75755 - DNA, 25 bp, Artificial sequence
  SiRNA target sequence
agttataaaaaatatgggaggtctt

SEQ ID NO: 75756 - DNA, 25 bp, Artificial sequence
  SiRNA target sequence
gttataaaaaatatgggaggtcttg

SEQ ID NO: 75757 - DNA, 25 bp, Artificial sequence
  SiRNA target sequence
ttataaaaaatatgggaggtcttgc

SEQ ID NO: 75758 - DNA, 25 bp, Artificial sequence
  SiRNA target sequence
tataaaaaatatgggaggtcttgcg

SEQ ID NO: 75759 - DNA, 25 bp, Artificial sequence
  SiRNA target sequence
ataaaaaatatgggaggtcttgcgg

SEQ ID NO: 75760 - DNA, 25 bp, Artificial sequence
  SiRNA target sequence
taaaaaatatgggaggtcttgcggg

SEQ ID NO: 75761 - DNA, 25 bp, Artificial sequence
  SiRNA target sequence
aaaaaatatgggaggtcttgcgggc

SEQ ID NO: 75762 - DNA, 25 bp, Artificial sequence
  SiRNA target sequence
aaaaatatgggaggtcttgcgggct

SEQ ID NO: 75763 - DNA, 25 bp, Artificial sequence
  SiRNA target sequence
aaaatatgggaggtcttgcgggctt

SEQ ID NO: 75764 - DNA, 25 bp, Artificial sequence
  SiRNA target sequence
aaatatgggaggtcttgcgggcttc

SEQ ID NO: 75765 - DNA, 25 bp, Artificial sequence
  SiRNA target sequence
aatatgggaggtcttgcgggcttca

SEQ ID NO: 75766 - DNA, 25 bp, Artificial sequence
  SiRNA target sequence
atatgggaggtcttgcgggcttcat

SEQ ID NO: 75767 - DNA, 25 bp, Artificial sequence
  SiRNA target sequence
tatgggaggtcttgcgggcttcata

SEQ ID NO: 75768 - DNA, 25 bp, Artificial sequence
  SiRNA target sequence
atgggaggtcttgcgggcttcataa

SEQ ID NO: 75769 - DNA, 25 bp, Artificial sequence
  SiRNA target sequence
tgggaggtcttgcgggcttcataat

SEQ ID NO: 75770 - DNA, 25 bp, Artificial sequence
  SiRNA target sequence
gggaggtcttgcgggcttcataatg

SEQ ID NO: 75771 - DNA, 25 bp, Artificial sequence
  SiRNA target sequence
ggaggtcttgcgggcttcataatgt

SEQ ID NO: 75772 - DNA, 25 bp, Artificial sequence
  SiRNA target sequence
gaggtcttgcgggcttcataatgtt

SEQ ID NO: 75773 - DNA, 25 bp, Artificial sequence
  SiRNA target sequence
aggtcttgcgggcttcataatgttt

SEQ ID NO: 75774 - DNA, 25 bp, Artificial sequence
  SiRNA target sequence
ggtcttgcgggcttcataatgtttg

SEQ ID NO: 75775 - DNA, 25 bp, Artificial sequence
  SiRNA target sequence
gtcttgcgggcttcataatgtttgt

SEQ ID NO: 75776 - DNA, 25 bp, Artificial sequence
  SiRNA target sequence
tcttgcgggcttcataatgtttgtt

SEQ ID NO: 75777 - DNA, 25 bp, Artificial sequence
  SiRNA target sequence
cttgcgggcttcataatgtttgttt

SEQ ID NO: 75778 - DNA, 25 bp, Artificial sequence
  SiRNA target sequence
ttgcgggcttcataatgtttgtttg

SEQ ID NO: 75779 - DNA, 25 bp, Artificial sequence
  SiRNA target sequence
tgcgggcttcataatgtttgtttgt

SEQ ID NO: 75780 - DNA, 25 bp, Artificial sequence
  SiRNA target sequence
gcgggcttcataatgtttgtttgtg

SEQ ID NO: 75781 - DNA, 25 bp, Artificial sequence
  SiRNA target sequence
cgggcttcataatgtttgtttgtgt

SEQ ID NO: 75782 - DNA, 25 bp, Artificial sequence
  SiRNA target sequence
gggcttcataatgtttgtttgtgtt

SEQ ID NO: 75783 - DNA, 25 bp, Artificial sequence
  SiRNA target sequence
ggcttcataatgtttgtttgtgttt

SEQ ID NO: 75784 - DNA, 25 bp, Artificial sequence
  SiRNA target sequence
gcttcataatgtttgtttgtgtttc

SEQ ID NO: 75785 - DNA, 25 bp, Artificial sequence
  SiRNA target sequence
cttcataatgtttgtttgtgtttct

SEQ ID NO: 75786 - DNA, 25 bp, Artificial sequence
  SiRNA target sequence
ttcataatgtttgtttgtgtttctt

SEQ ID NO: 75787 - DNA, 25 bp, Artificial sequence
  SiRNA target sequence
tcataatgtttgtttgtgtttcttg

SEQ ID NO: 75788 - DNA, 25 bp, Artificial sequence
  SiRNA target sequence
cataatgtttgtttgtgtttcttgc

SEQ ID NO: 75789 - DNA, 25 bp, Artificial sequence
  SiRNA target sequence
ataatgtttgtttgtgtttcttgct

SEQ ID NO: 75790 - DNA, 25 bp, Artificial sequence
  SiRNA target sequence
taatgtttgtttgtgtttcttgcta

SEQ ID NO: 75791 - DNA, 25 bp, Artificial sequence
  SiRNA target sequence
aatgtttgtttgtgtttcttgctat

SEQ ID NO: 75792 - DNA, 25 bp, Artificial sequence
  SiRNA target sequence
atgtttgtttgtgtttcttgctatg

SEQ ID NO: 75793 - DNA, 25 bp, Artificial sequence
  SiRNA target sequence
tgtttgtttgtgtttcttgctatgc

SEQ ID NO: 75794 - DNA, 25 bp, Artificial sequence
  SiRNA target sequence
gtttgtttgtgtttcttgctatgcg

SEQ ID NO: 75795 - DNA, 25 bp, Artificial sequence
  SiRNA target sequence
tttgtttgtgtttcttgctatgcga

SEQ ID NO: 75796 - DNA, 25 bp, Artificial sequence
  SiRNA target sequence
ttgtttgtgtttcttgctatgcgac

SEQ ID NO: 75797 - DNA, 25 bp, Artificial sequence
  SiRNA target sequence
tgtttgtgtttcttgctatgcgact

SEQ ID NO: 75798 - DNA, 25 bp, Artificial sequence
  SiRNA target sequence
gtttgtgtttcttgctatgcgactg

SEQ ID NO: 75799 - DNA, 25 bp, Artificial sequence
  SiRNA target sequence
tttgtgtttcttgctatgcgactgt

SEQ ID NO: 75800 - DNA, 25 bp, Artificial sequence
  SiRNA target sequence
ttgtgtttcttgctatgcgactgtg

SEQ ID NO: 75801 - DNA, 25 bp, Artificial sequence
  SiRNA target sequence
tgtgtttcttgctatgcgactgtga

SEQ ID NO: 75802 - DNA, 25 bp, Artificial sequence
  SiRNA target sequence
gtgtttcttgctatgcgactgtgac

SEQ ID NO: 75803 - DNA, 25 bp, Artificial sequence
  SiRNA target sequence
tgtttcttgctatgcgactgtgact

SEQ ID NO: 75804 - DNA, 25 bp, Artificial sequence
  SiRNA target sequence
gtttcttgctatgcgactgtgacta

SEQ ID NO: 75805 - DNA, 25 bp, Artificial sequence
  SiRNA target sequence
tttcttgctatgcgactgtgactat

SEQ ID NO: 75806 - DNA, 25 bp, Artificial sequence
  SiRNA target sequence
ttcttgctatgcgactgtgactata

SEQ ID NO: 75807 - DNA, 25 bp, Artificial sequence
  SiRNA target sequence
tcttgctatgcgactgtgactatat

SEQ ID NO: 75808 - DNA, 25 bp, Artificial sequence
  SiRNA target sequence
cttgctatgcgactgtgactatatt

SEQ ID NO: 75809 - DNA, 25 bp, Artificial sequence
  SiRNA target sequence
ttgctatgcgactgtgactatattg

SEQ ID NO: 75810 - DNA, 25 bp, Artificial sequence
  SiRNA target sequence
tgctatgcgactgtgactatattga

SEQ ID NO: 75811 - DNA, 25 bp, Artificial sequence
  SiRNA target sequence
gctatgcgactgtgactatattgat

SEQ ID NO: 75812 - DNA, 25 bp, Artificial sequence
  SiRNA target sequence
ctatgcgactgtgactatattgata

SEQ ID NO: 75813 - DNA, 25 bp, Artificial sequence
  SiRNA target sequence
tatgcgactgtgactatattgatag

SEQ ID NO: 75814 - DNA, 25 bp, Artificial sequence
  SiRNA target sequence
atgcgactgtgactatattgatagc

SEQ ID NO: 75815 - DNA, 25 bp, Artificial sequence
  SiRNA target sequence
tgcgactgtgactatattgatagca

SEQ ID NO: 75816 - DNA, 25 bp, Artificial sequence
  SiRNA target sequence
gcgactgtgactatattgatagcac

SEQ ID NO: 75817 - DNA, 25 bp, Artificial sequence
  SiRNA target sequence
cgactgtgactatattgatagcaca

SEQ ID NO: 75818 - DNA, 25 bp, Artificial sequence
  SiRNA target sequence
gactgtgactatattgatagcacaa

SEQ ID NO: 75819 - DNA, 25 bp, Artificial sequence
  SiRNA target sequence
actgtgactatattgatagcacaat

SEQ ID NO: 75820 - DNA, 25 bp, Artificial sequence
  SiRNA target sequence
ctgtgactatattgatagcacaatg

SEQ ID NO: 75821 - DNA, 25 bp, Artificial sequence
  SiRNA target sequence
tgtgactatattgatagcacaatgg

SEQ ID NO: 75822 - DNA, 25 bp, Artificial sequence
  SiRNA target sequence
gtgactatattgatagcacaatgga

SEQ ID NO: 75823 - DNA, 25 bp, Artificial sequence
  SiRNA target sequence
tgactatattgatagcacaatggag

SEQ ID NO: 75824 - DNA, 25 bp, Artificial sequence
  SiRNA target sequence
gactatattgatagcacaatggaga

SEQ ID NO: 75825 - DNA, 25 bp, Artificial sequence
  SiRNA target sequence
actatattgatagcacaatggagat

SEQ ID NO: 75826 - DNA, 25 bp, Artificial sequence
  SiRNA target sequence
ctatattgatagcacaatggagatc

SEQ ID NO: 75827 - DNA, 25 bp, Artificial sequence
  SiRNA target sequence
tatattgatagcacaatggagatct

SEQ ID NO: 75828 - DNA, 25 bp, Artificial sequence
  SiRNA target sequence
atattgatagcacaatggagatcta

SEQ ID NO: 75829 - DNA, 25 bp, Artificial sequence
  SiRNA target sequence
tattgatagcacaatggagatctaa

SEQ ID NO: 75830 - DNA, 25 bp, Artificial sequence
  SiRNA target sequence
attgatagcacaatggagatctaat

SEQ ID NO: 75831 - DNA, 25 bp, Artificial sequence
  SiRNA target sequence
ttgatagcacaatggagatctaata

SEQ ID NO: 75832 - DNA, 25 bp, Artificial sequence
  SiRNA target sequence
tgatagcacaatggagatctaatat

SEQ ID NO: 75833 - DNA, 25 bp, Artificial sequence
  SiRNA target sequence
gatagcacaatggagatctaatatt

SEQ ID NO: 75834 - DNA, 25 bp, Artificial sequence
  SiRNA target sequence
atagcacaatggagatctaatatta

SEQ ID NO: 75835 - DNA, 25 bp, Artificial sequence
  SiRNA target sequence
tagcacaatggagatctaatattag

SEQ ID NO: 75836 - DNA, 25 bp, Artificial sequence
  SiRNA target sequence
agcacaatggagatctaatattaga

SEQ ID NO: 75837 - DNA, 25 bp, Artificial sequence
  SiRNA target sequence
gcacaatggagatctaatattagaa

SEQ ID NO: 75838 - DNA, 25 bp, Artificial sequence
  SiRNA target sequence
cacaatggagatctaatattagaag

SEQ ID NO: 75839 - DNA, 25 bp, Artificial sequence
  SiRNA target sequence
acaatggagatctaatattagaaga

SEQ ID NO: 75840 - DNA, 25 bp, Artificial sequence
  SiRNA target sequence
caatggagatctaatattagaagag

SEQ ID NO: 75841 - DNA, 25 bp, Artificial sequence
  SiRNA target sequence
aatggagatctaatattagaagaga

SEQ ID NO: 75842 - DNA, 25 bp, Artificial sequence
  SiRNA target sequence
atggagatctaatattagaagagaa

SEQ ID NO: 75843 - DNA, 25 bp, Artificial sequence
  SiRNA target sequence
tggagatctaatattagaagagaac

SEQ ID NO: 75844 - DNA, 25 bp, Artificial sequence
  SiRNA target sequence
ggagatctaatattagaagagaact

SEQ ID NO: 75845 - DNA, 25 bp, Artificial sequence
  SiRNA target sequence
gagatctaatattagaagagaactt

SEQ ID NO: 75846 - DNA, 25 bp, Artificial sequence
  SiRNA target sequence
agatctaatattagaagagaactta

SEQ ID NO: 75847 - DNA, 25 bp, Artificial sequence
  SiRNA target sequence
gatctaatattagaagagaacttaa

SEQ ID NO: 75848 - DNA, 25 bp, Artificial sequence
  SiRNA target sequence
atctaatattagaagagaacttaat

SEQ ID NO: 75849 - DNA, 25 bp, Artificial sequence
  SiRNA target sequence
tctaatattagaagagaacttaata

SEQ ID NO: 75850 - DNA, 25 bp, Artificial sequence
  SiRNA target sequence
ctaatattagaagagaacttaataa

SEQ ID NO: 75851 - DNA, 25 bp, Artificial sequence
  SiRNA target sequence
taatattagaagagaacttaataac

SEQ ID NO: 75852 - DNA, 25 bp, Artificial sequence
  SiRNA target sequence
aatattagaagagaacttaataact

SEQ ID NO: 75853 - DNA, 25 bp, Artificial sequence
  SiRNA target sequence
atattagaagagaacttaataactc

SEQ ID NO: 75854 - DNA, 25 bp, Artificial sequence
  SiRNA target sequence
tattagaagagaacttaataactct

SEQ ID NO: 75855 - DNA, 25 bp, Artificial sequence
  SiRNA target sequence
attagaagagaacttaataactctg

SEQ ID NO: 75856 - DNA, 25 bp, Artificial sequence
  SiRNA target sequence
ttagaagagaacttaataactctga

SEQ ID NO: 75857 - DNA, 25 bp, Artificial sequence
  SiRNA target sequence
tagaagagaacttaataactctgaa

SEQ ID NO: 75858 - DNA, 25 bp, Artificial sequence
  SiRNA target sequence
agaagagaacttaataactctgaaa

SEQ ID NO: 75859 - DNA, 25 bp, Artificial sequence
  SiRNA target sequence
gaagagaacttaataactctgaaaa

SEQ ID NO: 75860 - DNA, 25 bp, Artificial sequence
  SiRNA target sequence
aagagaacttaataactctgaaaat

SEQ ID NO: 75861 - DNA, 25 bp, Artificial sequence
  SiRNA target sequence
agagaacttaataactctgaaaata

SEQ ID NO: 75862 - DNA, 25 bp, Artificial sequence
  SiRNA target sequence
gagaacttaataactctgaaaatag

SEQ ID NO: 75863 - DNA, 25 bp, Artificial sequence
  SiRNA target sequence
agaacttaataactctgaaaataga

SEQ ID NO: 75864 - DNA, 25 bp, Artificial sequence
  SiRNA target sequence
gaacttaataactctgaaaatagat

SEQ ID NO: 75865 - DNA, 25 bp, Artificial sequence
  SiRNA target sequence
aacttaataactctgaaaatagatc

SEQ ID NO: 75866 - DNA, 25 bp, Artificial sequence
  SiRNA target sequence
acttaataactctgaaaatagatct

SEQ ID NO: 75867 - DNA, 25 bp, Artificial sequence
  SiRNA target sequence
cttaataactctgaaaatagatcta

SEQ ID NO: 75868 - DNA, 25 bp, Artificial sequence
  SiRNA target sequence
ttaataactctgaaaatagatctag

SEQ ID NO: 75869 - DNA, 25 bp, Artificial sequence
  SiRNA target sequence
taataactctgaaaatagatctagt

SEQ ID NO: 75870 - DNA, 25 bp, Artificial sequence
  SiRNA target sequence
aataactctgaaaatagatctagta

SEQ ID NO: 75871 - DNA, 25 bp, Artificial sequence
  SiRNA target sequence
ataactctgaaaatagatctagtaa

SEQ ID NO: 75872 - DNA, 25 bp, Artificial sequence
  SiRNA target sequence
taactctgaaaatagatctagtaat

SEQ ID NO: 75873 - DNA, 25 bp, Artificial sequence
  SiRNA target sequence
aactctgaaaatagatctagtaata

SEQ ID NO: 75874 - DNA, 25 bp, Artificial sequence
  SiRNA target sequence
actctgaaaatagatctagtaataa

SEQ ID NO: 75875 - DNA, 25 bp, Artificial sequence
  SiRNA target sequence
ctctgaaaatagatctagtaataaa

SEQ ID NO: 75876 - DNA, 25 bp, Artificial sequence
  SiRNA target sequence
tctgaaaatagatctagtaataaac

SEQ ID NO: 75877 - DNA, 25 bp, Artificial sequence
  SiRNA target sequence
ctgaaaatagatctagtaataaact

SEQ ID NO: 75878 - DNA, 25 bp, Artificial sequence
  SiRNA target sequence
tgaaaatagatctagtaataaacta

SEQ ID NO: 75879 - DNA, 25 bp, Artificial sequence
  SiRNA target sequence
gaaaatagatctagtaataaactac

SEQ ID NO: 75880 - DNA, 25 bp, Artificial sequence
  SiRNA target sequence
aaaatagatctagtaataaactaca

SEQ ID NO: 75881 - DNA, 25 bp, Artificial sequence
  SiRNA target sequence
aaatagatctagtaataaactacaa

SEQ ID NO: 75882 - DNA, 25 bp, Artificial sequence
  SiRNA target sequence
aatagatctagtaataaactacaag

SEQ ID NO: 75883 - DNA, 25 bp, Artificial sequence
  SiRNA target sequence
atagatctagtaataaactacaaga

SEQ ID NO: 75884 - DNA, 25 bp, Artificial sequence
  SiRNA target sequence
tagatctagtaataaactacaagat

SEQ ID NO: 75885 - DNA, 25 bp, Artificial sequence
  SiRNA target sequence
agatctagtaataaactacaagatg

SEQ ID NO: 75886 - DNA, 25 bp, Artificial sequence
  SiRNA target sequence
gatctagtaataaactacaagatgg

SEQ ID NO: 75887 - DNA, 25 bp, Artificial sequence
  SiRNA target sequence
atctagtaataaactacaagatgga

SEQ ID NO: 75888 - DNA, 25 bp, Artificial sequence
  SiRNA target sequence
tctagtaataaactacaagatggat

SEQ ID NO: 75889 - DNA, 25 bp, Artificial sequence
  SiRNA target sequence
ctagtaataaactacaagatggatt

SEQ ID NO: 75890 - DNA, 25 bp, Artificial sequence
  SiRNA target sequence
tagtaataaactacaagatggatta

SEQ ID NO: 75891 - DNA, 25 bp, Artificial sequence
  SiRNA target sequence
agtaataaactacaagatggattaa

SEQ ID NO: 75892 - DNA, 25 bp, Artificial sequence
  SiRNA target sequence
gtaataaactacaagatggattaaa

SEQ ID NO: 75893 - DNA, 25 bp, Artificial sequence
  SiRNA target sequence
taataaactacaagatggattaaat

SEQ ID NO: 75894 - DNA, 25 bp, Artificial sequence
  SiRNA target sequence
aataaactacaagatggattaaata

SEQ ID NO: 75895 - DNA, 25 bp, Artificial sequence
  SiRNA target sequence
ataaactacaagatggattaaataa

SEQ ID NO: 75896 - DNA, 25 bp, Artificial sequence
  SiRNA target sequence
taaactacaagatggattaaataat

SEQ ID NO: 75897 - DNA, 25 bp, Artificial sequence
  SiRNA target sequence
aaactacaagatggattaaataatc

SEQ ID NO: 75898 - DNA, 25 bp, Artificial sequence
  SiRNA target sequence
aactacaagatggattaaataatca

SEQ ID NO: 75899 - DNA, 25 bp, Artificial sequence
  SiRNA target sequence
actacaagatggattaaataatcat

SEQ ID NO: 75900 - DNA, 25 bp, Artificial sequence
  SiRNA target sequence
ctacaagatggattaaataatcatg

SEQ ID NO: 75901 - DNA, 25 bp, Artificial sequence
  SiRNA target sequence
tacaagatggattaaataatcatga

SEQ ID NO: 75902 - DNA, 25 bp, Artificial sequence
  SiRNA target sequence
acaagatggattaaataatcatgaa

SEQ ID NO: 75903 - DNA, 25 bp, Artificial sequence
  SiRNA target sequence
caagatggattaaataatcatgaaa

SEQ ID NO: 75904 - DNA, 25 bp, Artificial sequence
  SiRNA target sequence
aagatggattaaataatcatgaaac

SEQ ID NO: 75905 - DNA, 25 bp, Artificial sequence
  SiRNA target sequence
agatggattaaataatcatgaaaca

SEQ ID NO: 75906 - DNA, 25 bp, Artificial sequence
  SiRNA target sequence
gatggattaaataatcatgaaacaa

SEQ ID NO: 75907 - DNA, 25 bp, Artificial sequence
  SiRNA target sequence
atggattaaataatcatgaaacaat

SEQ ID NO: 75908 - DNA, 25 bp, Artificial sequence
  SiRNA target sequence
tggattaaataatcatgaaacaatc

SEQ ID NO: 75909 - DNA, 25 bp, Artificial sequence
  SiRNA target sequence
ggattaaataatcatgaaacaatcg

SEQ ID NO: 75910 - DNA, 25 bp, Artificial sequence
  SiRNA target sequence
gattaaataatcatgaaacaatcgt

SEQ ID NO: 75911 - DNA, 25 bp, Artificial sequence
  SiRNA target sequence
attaaataatcatgaaacaatcgtc

SEQ ID NO: 75912 - DNA, 25 bp, Artificial sequence
  SiRNA target sequence
ttaaataatcatgaaacaatcgtct

SEQ ID NO: 75913 - DNA, 25 bp, Artificial sequence
  SiRNA target sequence
taaataatcatgaaacaatcgtctc

SEQ ID NO: 75914 - DNA, 25 bp, Artificial sequence
  SiRNA target sequence
aaataatcatgaaacaatcgtctcc

SEQ ID NO: 75915 - DNA, 25 bp, Artificial sequence
  SiRNA target sequence
aataatcatgaaacaatcgtctcct

SEQ ID NO: 75916 - DNA, 25 bp, Artificial sequence
  SiRNA target sequence
ataatcatgaaacaatcgtctcctt

SEQ ID NO: 75917 - DNA, 25 bp, Artificial sequence
  SiRNA target sequence
taatcatgaaacaatcgtctccttt

SEQ ID NO: 75918 - DNA, 25 bp, Artificial sequence
  SiRNA target sequence
aatcatgaaacaatcgtctcctttg

SEQ ID NO: 75919 - DNA, 25 bp, Artificial sequence
  SiRNA target sequence
atcatgaaacaatcgtctcctttgg

SEQ ID NO: 75920 - DNA, 25 bp, Artificial sequence
  SiRNA target sequence
tcatgaaacaatcgtctcctttggg

SEQ ID NO: 75921 - DNA, 25 bp, Artificial sequence
  SiRNA target sequence
catgaaacaatcgtctcctttggga

SEQ ID NO: 75922 - DNA, 25 bp, Artificial sequence
  SiRNA target sequence
atgaaacaatcgtctcctttgggac

SEQ ID NO: 75923 - DNA, 25 bp, Artificial sequence
  SiRNA target sequence
tgaaacaatcgtctcctttgggact

SEQ ID NO: 75924 - DNA, 25 bp, Artificial sequence
  SiRNA target sequence
gaaacaatcgtctcctttgggacta

SEQ ID NO: 75925 - DNA, 25 bp, Artificial sequence
  SiRNA target sequence
aaacaatcgtctcctttgggactac

SEQ ID NO: 75926 - DNA, 25 bp, Artificial sequence
  SiRNA target sequence
aacaatcgtctcctttgggactaca

SEQ ID NO: 75927 - DNA, 25 bp, Artificial sequence
  SiRNA target sequence
acaatcgtctcctttgggactacag

SEQ ID NO: 75928 - DNA, 25 bp, Artificial sequence
  SiRNA target sequence
caatcgtctcctttgggactacaga

SEQ ID NO: 75929 - DNA, 25 bp, Artificial sequence
  SiRNA target sequence
aatcgtctcctttgggactacagat

SEQ ID NO: 75930 - DNA, 25 bp, Artificial sequence
  SiRNA target sequence
atcgtctcctttgggactacagatc

SEQ ID NO: 75931 - DNA, 25 bp, Artificial sequence
  SiRNA target sequence
tcgtctcctttgggactacagatct

SEQ ID NO: 75932 - DNA, 25 bp, Artificial sequence
  SiRNA target sequence
cgtctcctttgggactacagatctt

SEQ ID NO: 75933 - DNA, 25 bp, Artificial sequence
  SiRNA target sequence
gtctcctttgggactacagatcttg

SEQ ID NO: 75934 - DNA, 25 bp, Artificial sequence
  SiRNA target sequence
tctcctttgggactacagatcttga

SEQ ID NO: 75935 - DNA, 25 bp, Artificial sequence
  SiRNA target sequence
ctcctttgggactacagatcttgaa

SEQ ID NO: 75936 - DNA, 25 bp, Artificial sequence
  SiRNA target sequence
tcctttgggactacagatcttgaag

SEQ ID NO: 75937 - DNA, 25 bp, Artificial sequence
  SiRNA target sequence
cctttgggactacagatcttgaagt

SEQ ID NO: 75938 - DNA, 25 bp, Artificial sequence
  SiRNA target sequence
ctttgggactacagatcttgaagta

SEQ ID NO: 75939 - DNA, 25 bp, Artificial sequence
  SiRNA target sequence
tttgggactacagatcttgaagtag

SEQ ID NO: 75940 - DNA, 25 bp, Artificial sequence
  SiRNA target sequence
ttgggactacagatcttgaagtaga

SEQ ID NO: 75941 - DNA, 25 bp, Artificial sequence
  SiRNA target sequence
tgggactacagatcttgaagtagat

SEQ ID NO: 75942 - DNA, 25 bp, Artificial sequence
  SiRNA target sequence
gggactacagatcttgaagtagatg

SEQ ID NO: 75943 - DNA, 25 bp, Artificial sequence
  SiRNA target sequence
ggactacagatcttgaagtagatga

SEQ ID NO: 75944 - DNA, 25 bp, Artificial sequence
  SiRNA target sequence
gactacagatcttgaagtagatgaa

SEQ ID NO: 75945 - DNA, 25 bp, Artificial sequence
  SiRNA target sequence
actacagatcttgaagtagatgaat

SEQ ID NO: 75946 - DNA, 25 bp, Artificial sequence
  SiRNA target sequence
ctacagatcttgaagtagatgaata

SEQ ID NO: 75947 - DNA, 25 bp, Artificial sequence
  SiRNA target sequence
tacagatcttgaagtagatgaatat

SEQ ID NO: 75948 - DNA, 25 bp, Artificial sequence
  SiRNA target sequence
acagatcttgaagtagatgaatatg

SEQ ID NO: 75949 - DNA, 25 bp, Artificial sequence
  SiRNA target sequence
cagatcttgaagtagatgaatatga

SEQ ID NO: 75950 - DNA, 25 bp, Artificial sequence
  SiRNA target sequence
agatcttgaagtagatgaatatgat

SEQ ID NO: 75951 - DNA, 25 bp, Artificial sequence
  SiRNA target sequence
gatcttgaagtagatgaatatgatc

SEQ ID NO: 75952 - DNA, 25 bp, Artificial sequence
  SiRNA target sequence
atcttgaagtagatgaatatgatca

SEQ ID NO: 75953 - DNA, 25 bp, Artificial sequence
  SiRNA target sequence
tcttgaagtagatgaatatgatcag

SEQ ID NO: 75954 - DNA, 25 bp, Artificial sequence
  SiRNA target sequence
cttgaagtagatgaatatgatcagt

SEQ ID NO: 75955 - DNA, 25 bp, Artificial sequence
  SiRNA target sequence
ttgaagtagatgaatatgatcagtt

SEQ ID NO: 75956 - DNA, 25 bp, Artificial sequence
  SiRNA target sequence
tgaagtagatgaatatgatcagttt

SEQ ID NO: 75957 - DNA, 25 bp, Artificial sequence
  SiRNA target sequence
gaagtagatgaatatgatcagtttc

SEQ ID NO: 75958 - DNA, 25 bp, Artificial sequence
  SiRNA target sequence
aagtagatgaatatgatcagtttct

SEQ ID NO: 75959 - DNA, 25 bp, Artificial sequence
  SiRNA target sequence
agtagatgaatatgatcagtttctt

SEQ ID NO: 75960 - DNA, 25 bp, Artificial sequence
  SiRNA target sequence
gtagatgaatatgatcagtttctta

SEQ ID NO: 75961 - DNA, 25 bp, Artificial sequence
  SiRNA target sequence
tagatgaatatgatcagtttcttaa

SEQ ID NO: 75962 - DNA, 25 bp, Artificial sequence
  SiRNA target sequence
agatgaatatgatcagtttcttaaa

SEQ ID NO: 75963 - DNA, 25 bp, Artificial sequence
  SiRNA target sequence
gatgaatatgatcagtttcttaaaa

SEQ ID NO: 75964 - DNA, 25 bp, Artificial sequence
  SiRNA target sequence
atgaatatgatcagtttcttaaaat

SEQ ID NO: 75965 - DNA, 25 bp, Artificial sequence
  SiRNA target sequence
tgaatatgatcagtttcttaaaatt

SEQ ID NO: 75966 - DNA, 25 bp, Artificial sequence
  SiRNA target sequence
gaatatgatcagtttcttaaaatta

SEQ ID NO: 75967 - DNA, 25 bp, Artificial sequence
  SiRNA target sequence
aatatgatcagtttcttaaaattaa

SEQ ID NO: 75968 - DNA, 25 bp, Artificial sequence
  SiRNA target sequence
atatgatcagtttcttaaaattaat

SEQ ID NO: 75969 - DNA, 25 bp, Artificial sequence
  SiRNA target sequence
tatgatcagtttcttaaaattaatg

SEQ ID NO: 75970 - DNA, 25 bp, Artificial sequence
  SiRNA target sequence
atgatcagtttcttaaaattaatgc

SEQ ID NO: 75971 - DNA, 25 bp, Artificial sequence
  SiRNA target sequence
tgatcagtttcttaaaattaatgca

SEQ ID NO: 75972 - DNA, 25 bp, Artificial sequence
  SiRNA target sequence
gatcagtttcttaaaattaatgcat

SEQ ID NO: 75973 - DNA, 25 bp, Artificial sequence
  SiRNA target sequence
atcagtttcttaaaattaatgcatc

SEQ ID NO: 75974 - DNA, 25 bp, Artificial sequence
  SiRNA target sequence
tcagtttcttaaaattaatgcatct

SEQ ID NO: 75975 - DNA, 25 bp, Artificial sequence
  SiRNA target sequence
cagtttcttaaaattaatgcatcta

SEQ ID NO: 75976 - DNA, 25 bp, Artificial sequence
  SiRNA target sequence
agtttcttaaaattaatgcatctaa

SEQ ID NO: 75977 - DNA, 25 bp, Artificial sequence
  SiRNA target sequence
gtttcttaaaattaatgcatctaat

SEQ ID NO: 75978 - DNA, 25 bp, Artificial sequence
  SiRNA target sequence
tttcttaaaattaatgcatctaata

SEQ ID NO: 75979 - DNA, 25 bp, Artificial sequence
  SiRNA target sequence
ttcttaaaattaatgcatctaatag

SEQ ID NO: 75980 - DNA, 25 bp, Artificial sequence
  SiRNA target sequence
tcttaaaattaatgcatctaatagt

SEQ ID NO: 75981 - DNA, 25 bp, Artificial sequence
  SiRNA target sequence
cttaaaattaatgcatctaatagta

SEQ ID NO: 75982 - DNA, 25 bp, Artificial sequence
  SiRNA target sequence
ttaaaattaatgcatctaatagtaa

SEQ ID NO: 75983 - DNA, 25 bp, Artificial sequence
  SiRNA target sequence
taaaattaatgcatctaatagtaac

SEQ ID NO: 75984 - DNA, 25 bp, Artificial sequence
  SiRNA target sequence
aaaattaatgcatctaatagtaaca

SEQ ID NO: 75985 - DNA, 25 bp, Artificial sequence
  SiRNA target sequence
aaattaatgcatctaatagtaacag

SEQ ID NO: 75986 - DNA, 25 bp, Artificial sequence
  SiRNA target sequence
aattaatgcatctaatagtaacaga

SEQ ID NO: 75987 - DNA, 25 bp, Artificial sequence
  SiRNA target sequence
attaatgcatctaatagtaacagat

SEQ ID NO: 75988 - DNA, 25 bp, Artificial sequence
  SiRNA target sequence
ttaatgcatctaatagtaacagatt

SEQ ID NO: 75989 - DNA, 25 bp, Artificial sequence
  SiRNA target sequence
taatgcatctaatagtaacagatta

SEQ ID NO: 75990 - DNA, 25 bp, Artificial sequence
  SiRNA target sequence
aatgcatctaatagtaacagattat

SEQ ID NO: 75991 - DNA, 25 bp, Artificial sequence
  SiRNA target sequence
atgcatctaatagtaacagattatg

SEQ ID NO: 75992 - DNA, 25 bp, Artificial sequence
  SiRNA target sequence
tgcatctaatagtaacagattatgg

SEQ ID NO: 75993 - DNA, 25 bp, Artificial sequence
  SiRNA target sequence
gcatctaatagtaacagattatgga

SEQ ID NO: 75994 - DNA, 25 bp, Artificial sequence
  SiRNA target sequence
catctaatagtaacagattatggag

SEQ ID NO: 75995 - DNA, 25 bp, Artificial sequence
  SiRNA target sequence
atctaatagtaacagattatggaga

SEQ ID NO: 75996 - DNA, 25 bp, Artificial sequence
  SiRNA target sequence
tctaatagtaacagattatggagag

SEQ ID NO: 75997 - DNA, 25 bp, Artificial sequence
  SiRNA target sequence
ctaatagtaacagattatggagagc

SEQ ID NO: 75998 - DNA, 25 bp, Artificial sequence
  SiRNA target sequence
taatagtaacagattatggagagca

SEQ ID NO: 75999 - DNA, 25 bp, Artificial sequence
  SiRNA target sequence
aatagtaacagattatggagagcac

SEQ ID NO: 76000 - DNA, 25 bp, Artificial sequence
  SiRNA target sequence
atagtaacagattatggagagcact

SEQ ID NO: 76001 - DNA, 25 bp, Artificial sequence
  SiRNA target sequence
tagtaacagattatggagagcactg

SEQ ID NO: 76002 - DNA, 25 bp, Artificial sequence
  SiRNA target sequence
agtaacagattatggagagcactgt

SEQ ID NO: 76003 - DNA, 25 bp, Artificial sequence
  SiRNA target sequence
gtaacagattatggagagcactgta

SEQ ID NO: 76004 - DNA, 25 bp, Artificial sequence
  SiRNA target sequence
taacagattatggagagcactgtac

SEQ ID NO: 76005 - DNA, 25 bp, Artificial sequence
  SiRNA target sequence
aacagattatggagagcactgtaca

SEQ ID NO: 76006 - DNA, 25 bp, Artificial sequence
  SiRNA target sequence
acagattatggagagcactgtacat

SEQ ID NO: 76007 - DNA, 25 bp, Artificial sequence
  SiRNA target sequence
cagattatggagagcactgtacatt

SEQ ID NO: 76008 - DNA, 25 bp, Artificial sequence
  SiRNA target sequence
agattatggagagcactgtacattt

SEQ ID NO: 76009 - DNA, 25 bp, Artificial sequence
  SiRNA target sequence
gattatggagagcactgtacatttt

SEQ ID NO: 76010 - DNA, 25 bp, Artificial sequence
  SiRNA target sequence
attatggagagcactgtacatttta

SEQ ID NO: 76011 - DNA, 25 bp, Artificial sequence
  SiRNA target sequence
ttatggagagcactgtacattttaa

SEQ ID NO: 76012 - DNA, 25 bp, Artificial sequence
  SiRNA target sequence
tatggagagcactgtacattttaaa

SEQ ID NO: 76013 - DNA, 25 bp, Artificial sequence
  SiRNA target sequence
atggagagcactgtacattttaaat

SEQ ID NO: 76014 - DNA, 25 bp, Artificial sequence
  SiRNA target sequence
tggagagcactgtacattttaaatt

SEQ ID NO: 76015 - DNA, 25 bp, Artificial sequence
  SiRNA target sequence
ggagagcactgtacattttaaattt

SEQ ID NO: 76016 - DNA, 25 bp, Artificial sequence
  SiRNA target sequence
gagagcactgtacattttaaattta

SEQ ID NO: 76017 - DNA, 25 bp, Artificial sequence
  SiRNA target sequence
agagcactgtacattttaaatttat

SEQ ID NO: 76018 - DNA, 25 bp, Artificial sequence
  SiRNA target sequence
gagcactgtacattttaaatttatc

SEQ ID NO: 76019 - DNA, 25 bp, Artificial sequence
  SiRNA target sequence
agcactgtacattttaaatttatct

SEQ ID NO: 76020 - DNA, 25 bp, Artificial sequence
  SiRNA target sequence
gcactgtacattttaaatttatctc

SEQ ID NO: 76021 - DNA, 25 bp, Artificial sequence
  SiRNA target sequence
cactgtacattttaaatttatctca

SEQ ID NO: 76022 - DNA, 25 bp, Artificial sequence
  SiRNA target sequence
actgtacattttaaatttatctcag

SEQ ID NO: 76023 - DNA, 25 bp, Artificial sequence
  SiRNA target sequence
ctgtacattttaaatttatctcaga

SEQ ID NO: 76024 - DNA, 25 bp, Artificial sequence
  SiRNA target sequence
tgtacattttaaatttatctcagag

SEQ ID NO: 76025 - DNA, 25 bp, Artificial sequence
  SiRNA target sequence
gtacattttaaatttatctcagaga

SEQ ID NO: 76026 - DNA, 25 bp, Artificial sequence
  SiRNA target sequence
tacattttaaatttatctcagagag

SEQ ID NO: 76027 - DNA, 25 bp, Artificial sequence
  SiRNA target sequence
acattttaaatttatctcagagagc

SEQ ID NO: 76028 - DNA, 25 bp, Artificial sequence
  SiRNA target sequence
cattttaaatttatctcagagagca

SEQ ID NO: 76029 - DNA, 25 bp, Artificial sequence
  SiRNA target sequence
attttaaatttatctcagagagcaa

SEQ ID NO: 76030 - DNA, 25 bp, Artificial sequence
  SiRNA target sequence
ttttaaatttatctcagagagcaat

SEQ ID NO: 76031 - DNA, 25 bp, Artificial sequence
  SiRNA target sequence
tttaaatttatctcagagagcaatt

SEQ ID NO: 76032 - DNA, 25 bp, Artificial sequence
  SiRNA target sequence
ttaaatttatctcagagagcaattt

SEQ ID NO: 76033 - DNA, 25 bp, Artificial sequence
  SiRNA target sequence
taaatttatctcagagagcaatttt

SEQ ID NO: 76034 - DNA, 25 bp, Artificial sequence
  SiRNA target sequence
aaatttatctcagagagcaattttt

SEQ ID NO: 76035 - DNA, 25 bp, Artificial sequence
  SiRNA target sequence
aatttatctcagagagcaatttttc

SEQ ID NO: 76036 - DNA, 25 bp, Artificial sequence
  SiRNA target sequence
atttatctcagagagcaatttttct

SEQ ID NO: 76037 - DNA, 25 bp, Artificial sequence
  SiRNA target sequence
tttatctcagagagcaatttttctc

SEQ ID NO: 76038 - DNA, 25 bp, Artificial sequence
  SiRNA target sequence
ttatctcagagagcaatttttctct

SEQ ID NO: 76039 - DNA, 25 bp, Artificial sequence
  SiRNA target sequence
tatctcagagagcaatttttctctt

SEQ ID NO: 76040 - DNA, 25 bp, Artificial sequence
  SiRNA target sequence
atctcagagagcaatttttctctta

SEQ ID NO: 76041 - DNA, 25 bp, Artificial sequence
  SiRNA target sequence
tctcagagagcaatttttctcttac

SEQ ID NO: 76042 - DNA, 25 bp, Artificial sequence
  SiRNA target sequence
ctcagagagcaatttttctcttaca

SEQ ID NO: 76043 - DNA, 25 bp, Artificial sequence
  SiRNA target sequence
tcagagagcaatttttctcttacaa

SEQ ID NO: 76044 - DNA, 25 bp, Artificial sequence
  SiRNA target sequence
cagagagcaatttttctcttacaaa

SEQ ID NO: 76045 - DNA, 25 bp, Artificial sequence
  SiRNA target sequence
agagagcaatttttctcttacaaag

SEQ ID NO: 76046 - DNA, 25 bp, Artificial sequence
  SiRNA target sequence
gagagcaatttttctcttacaaagt

SEQ ID NO: 76047 - DNA, 25 bp, Artificial sequence
  SiRNA target sequence
agagcaatttttctcttacaaagtt

SEQ ID NO: 76048 - DNA, 25 bp, Artificial sequence
  SiRNA target sequence
gagcaatttttctcttacaaagttt

SEQ ID NO: 76049 - DNA, 25 bp, Artificial sequence
  SiRNA target sequence
agcaatttttctcttacaaagtttt

SEQ ID NO: 76050 - DNA, 25 bp, Artificial sequence
  SiRNA target sequence
gcaatttttctcttacaaagttttt

SEQ ID NO: 76051 - DNA, 25 bp, Artificial sequence
  SiRNA target sequence
caatttttctcttacaaagtttttt

SEQ ID NO: 76052 - DNA, 25 bp, Artificial sequence
  SiRNA target sequence
aatttttctcttacaaagttttttt

SEQ ID NO: 76053 - DNA, 25 bp, Artificial sequence
  SiRNA target sequence
atttttctcttacaaagttttttta

SEQ ID NO: 76054 - DNA, 25 bp, Artificial sequence
  SiRNA target sequence
tttttctcttacaaagtttttttat

SEQ ID NO: 76055 - DNA, 25 bp, Artificial sequence
  SiRNA target sequence
ttttctcttacaaagtttttttatt

SEQ ID NO: 76056 - DNA, 25 bp, Artificial sequence
  SiRNA target sequence
tttctcttacaaagtttttttatta

SEQ ID NO: 76057 - DNA, 25 bp, Artificial sequence
  SiRNA target sequence
ttctcttacaaagtttttttattat

SEQ ID NO: 76058 - DNA, 25 bp, Artificial sequence
  SiRNA target sequence
tctcttacaaagtttttttattatt

SEQ ID NO: 76059 - DNA, 25 bp, Artificial sequence
  SiRNA target sequence
ctcttacaaagtttttttattattt

SEQ ID NO: 76060 - DNA, 25 bp, Artificial sequence
  SiRNA target sequence
tcttacaaagtttttttattattta

SEQ ID NO: 76061 - DNA, 25 bp, Artificial sequence
  SiRNA target sequence
cttacaaagtttttttattatttat

SEQ ID NO: 76062 - DNA, 25 bp, Artificial sequence
  SiRNA target sequence
ttacaaagtttttttattatttatg

SEQ ID NO: 76063 - DNA, 25 bp, Artificial sequence
  SiRNA target sequence
tacaaagtttttttattatttatgc

SEQ ID NO: 76064 - DNA, 25 bp, Artificial sequence
  SiRNA target sequence
acaaagtttttttattatttatgca

SEQ ID NO: 76065 - DNA, 25 bp, Artificial sequence
  SiRNA target sequence
caaagtttttttattatttatgcag

SEQ ID NO: 76066 - DNA, 25 bp, Artificial sequence
  SiRNA target sequence
aaagtttttttattatttatgcagg

SEQ ID NO: 76067 - DNA, 25 bp, Artificial sequence
  SiRNA target sequence
aagtttttttattatttatgcagga

SEQ ID NO: 76068 - DNA, 25 bp, Artificial sequence
  SiRNA target sequence
agtttttttattatttatgcaggaa

SEQ ID NO: 76069 - DNA, 25 bp, Artificial sequence
  SiRNA target sequence
gtttttttattatttatgcaggaat

SEQ ID NO: 76070 - DNA, 25 bp, Artificial sequence
  SiRNA target sequence
tttttttattatttatgcaggaata

SEQ ID NO: 76071 - DNA, 25 bp, Artificial sequence
  SiRNA target sequence
ttttttattatttatgcaggaatat

SEQ ID NO: 76072 - DNA, 25 bp, Artificial sequence
  SiRNA target sequence
tttttattatttatgcaggaatatc

SEQ ID NO: 76073 - DNA, 25 bp, Artificial sequence
  SiRNA target sequence
ttttattatttatgcaggaatatca

SEQ ID NO: 76074 - DNA, 25 bp, Artificial sequence
  SiRNA target sequence
tttattatttatgcaggaatatcag

SEQ ID NO: 76075 - DNA, 25 bp, Artificial sequence
  SiRNA target sequence
ttattatttatgcaggaatatcagg

SEQ ID NO: 76076 - DNA, 25 bp, Artificial sequence
  SiRNA target sequence
tattatttatgcaggaatatcagga

SEQ ID NO: 76077 - DNA, 25 bp, Artificial sequence
  SiRNA target sequence
attatttatgcaggaatatcaggaa

SEQ ID NO: 76078 - DNA, 25 bp, Artificial sequence
  SiRNA target sequence
ttatttatgcaggaatatcaggaat

SEQ ID NO: 76079 - DNA, 25 bp, Artificial sequence
  SiRNA target sequence
tatttatgcaggaatatcaggaata

SEQ ID NO: 76080 - DNA, 25 bp, Artificial sequence
  SiRNA target sequence
atttatgcaggaatatcaggaatat

SEQ ID NO: 76081 - DNA, 25 bp, Artificial sequence
  SiRNA target sequence
tttatgcaggaatatcaggaatatt

SEQ ID NO: 76082 - DNA, 25 bp, Artificial sequence
  SiRNA target sequence
ttatgcaggaatatcaggaatatta

SEQ ID NO: 76083 - DNA, 25 bp, Artificial sequence
  SiRNA target sequence
tatgcaggaatatcaggaatattat

SEQ ID NO: 76084 - DNA, 25 bp, Artificial sequence
  SiRNA target sequence
atgcaggaatatcaggaatattatc

SEQ ID NO: 76085 - DNA, 25 bp, Artificial sequence
  SiRNA target sequence
tgcaggaatatcaggaatattatct

SEQ ID NO: 76086 - DNA, 25 bp, Artificial sequence
  SiRNA target sequence
gcaggaatatcaggaatattatctc

SEQ ID NO: 76087 - DNA, 25 bp, Artificial sequence
  SiRNA target sequence
caggaatatcaggaatattatctca

SEQ ID NO: 76088 - DNA, 25 bp, Artificial sequence
  SiRNA target sequence
aggaatatcaggaatattatctcaa

SEQ ID NO: 76089 - DNA, 25 bp, Artificial sequence
  SiRNA target sequence
ggaatatcaggaatattatctcaaa

SEQ ID NO: 76090 - DNA, 25 bp, Artificial sequence
  SiRNA target sequence
gaatatcaggaatattatctcaaaa

SEQ ID NO: 76091 - DNA, 25 bp, Artificial sequence
  SiRNA target sequence
aatatcaggaatattatctcaaaat

SEQ ID NO: 76092 - DNA, 25 bp, Artificial sequence
  SiRNA target sequence
atatcaggaatattatctcaaaata

SEQ ID NO: 76093 - DNA, 25 bp, Artificial sequence
  SiRNA target sequence
tatcaggaatattatctcaaaatat

SEQ ID NO: 76094 - DNA, 25 bp, Artificial sequence
  SiRNA target sequence
atcaggaatattatctcaaaatatg

SEQ ID NO: 76095 - DNA, 25 bp, Artificial sequence
  SiRNA target sequence
tcaggaatattatctcaaaatatgt

SEQ ID NO: 76096 - DNA, 25 bp, Artificial sequence
  SiRNA target sequence
caggaatattatctcaaaatatgtc

SEQ ID NO: 76097 - DNA, 25 bp, Artificial sequence
  SiRNA target sequence
aggaatattatctcaaaatatgtca

SEQ ID NO: 76098 - DNA, 25 bp, Artificial sequence
  SiRNA target sequence
ggaatattatctcaaaatatgtcat

SEQ ID NO: 76099 - DNA, 25 bp, Artificial sequence
  SiRNA target sequence
gaatattatctcaaaatatgtcatc

SEQ ID NO: 76100 - DNA, 25 bp, Artificial sequence
  SiRNA target sequence
aatattatctcaaaatatgtcatct

SEQ ID NO: 76101 - DNA, 25 bp, Artificial sequence
  SiRNA target sequence
atattatctcaaaatatgtcatcta

SEQ ID NO: 76102 - DNA, 25 bp, Artificial sequence
  SiRNA target sequence
tattatctcaaaatatgtcatctaa

SEQ ID NO: 76103 - DNA, 25 bp, Artificial sequence
  SiRNA target sequence
attatctcaaaatatgtcatctaac

SEQ ID NO: 76104 - DNA, 25 bp, Artificial sequence
  SiRNA target sequence
ttatctcaaaatatgtcatctaacc

SEQ ID NO: 76105 - DNA, 25 bp, Artificial sequence
  SiRNA target sequence
tatctcaaaatatgtcatctaacca

SEQ ID NO: 76106 - DNA, 25 bp, Artificial sequence
  SiRNA target sequence
atctcaaaatatgtcatctaaccaa

SEQ ID NO: 76107 - DNA, 25 bp, Artificial sequence
  SiRNA target sequence
tctcaaaatatgtcatctaaccaac

SEQ ID NO: 76108 - DNA, 25 bp, Artificial sequence
  SiRNA target sequence
ctcaaaatatgtcatctaaccaact

SEQ ID NO: 76109 - DNA, 25 bp, Artificial sequence
  SiRNA target sequence
tcaaaatatgtcatctaaccaactc

SEQ ID NO: 76110 - DNA, 25 bp, Artificial sequence
  SiRNA target sequence
caaaatatgtcatctaaccaactca

SEQ ID NO: 76111 - DNA, 25 bp, Artificial sequence
  SiRNA target sequence
aaaatatgtcatctaaccaactcat

SEQ ID NO: 76112 - DNA, 25 bp, Artificial sequence
  SiRNA target sequence
aaatatgtcatctaaccaactcatt

SEQ ID NO: 76113 - DNA, 25 bp, Artificial sequence
  SiRNA target sequence
aatatgtcatctaaccaactcattt

SEQ ID NO: 76114 - DNA, 25 bp, Artificial sequence
  SiRNA target sequence
atatgtcatctaaccaactcattta

SEQ ID NO: 76115 - DNA, 25 bp, Artificial sequence
  SiRNA target sequence
tatgtcatctaaccaactcatttat

SEQ ID NO: 76116 - DNA, 25 bp, Artificial sequence
  SiRNA target sequence
atgtcatctaaccaactcatttatt

SEQ ID NO: 76117 - DNA, 25 bp, Artificial sequence
  SiRNA target sequence
tgtcatctaaccaactcatttattt

SEQ ID NO: 76118 - DNA, 25 bp, Artificial sequence
  SiRNA target sequence
gtcatctaaccaactcatttattta

SEQ ID NO: 76119 - DNA, 25 bp, Artificial sequence
  SiRNA target sequence
tcatctaaccaactcatttatttaa

SEQ ID NO: 76120 - DNA, 25 bp, Artificial sequence
  SiRNA target sequence
catctaaccaactcatttatttaat

SEQ ID NO: 76121 - DNA, 25 bp, Artificial sequence
  SiRNA target sequence
atctaaccaactcatttatttaatg

SEQ ID NO: 76122 - DNA, 25 bp, Artificial sequence
  SiRNA target sequence
tctaaccaactcatttatttaatgt

SEQ ID NO: 76123 - DNA, 25 bp, Artificial sequence
  SiRNA target sequence
ctaaccaactcatttatttaatgtc

SEQ ID NO: 76124 - DNA, 25 bp, Artificial sequence
  SiRNA target sequence
taaccaactcatttatttaatgtcc

SEQ ID NO: 76125 - DNA, 25 bp, Artificial sequence
  SiRNA target sequence
aaccaactcatttatttaatgtcca

SEQ ID NO: 76126 - DNA, 25 bp, Artificial sequence
  SiRNA target sequence
accaactcatttatttaatgtccat

SEQ ID NO: 76127 - DNA, 25 bp, Artificial sequence
  SiRNA target sequence
ccaactcatttatttaatgtccatt

SEQ ID NO: 76128 - DNA, 25 bp, Artificial sequence
  SiRNA target sequence
caactcatttatttaatgtccatta

SEQ ID NO: 76129 - DNA, 25 bp, Artificial sequence
  SiRNA target sequence
aactcatttatttaatgtccattac

SEQ ID NO: 76130 - DNA, 25 bp, Artificial sequence
  SiRNA target sequence
actcatttatttaatgtccattaca

SEQ ID NO: 76131 - DNA, 25 bp, Artificial sequence
  SiRNA target sequence
ctcatttatttaatgtccattacat

SEQ ID NO: 76132 - DNA, 25 bp, Artificial sequence
  SiRNA target sequence
tcatttatttaatgtccattacatc

SEQ ID NO: 76133 - DNA, 25 bp, Artificial sequence
  SiRNA target sequence
catttatttaatgtccattacatct

SEQ ID NO: 76134 - DNA, 25 bp, Artificial sequence
  SiRNA target sequence
atttatttaatgtccattacatcta

SEQ ID NO: 76135 - DNA, 25 bp, Artificial sequence
  SiRNA target sequence
tttatttaatgtccattacatctac

SEQ ID NO: 76136 - DNA, 25 bp, Artificial sequence
  SiRNA target sequence
ttatttaatgtccattacatctacg

SEQ ID NO: 76137 - DNA, 25 bp, Artificial sequence
  SiRNA target sequence
tatttaatgtccattacatctacgg

SEQ ID NO: 76138 - DNA, 25 bp, Artificial sequence
  SiRNA target sequence
atttaatgtccattacatctacggt

SEQ ID NO: 76139 - DNA, 25 bp, Artificial sequence
  SiRNA target sequence
tttaatgtccattacatctacggtt

SEQ ID NO: 76140 - DNA, 25 bp, Artificial sequence
  SiRNA target sequence
ttaatgtccattacatctacggtta

SEQ ID NO: 76141 - DNA, 25 bp, Artificial sequence
  SiRNA target sequence
taatgtccattacatctacggttac

SEQ ID NO: 76142 - DNA, 25 bp, Artificial sequence
  SiRNA target sequence
aatgtccattacatctacggttact

SEQ ID NO: 76143 - DNA, 25 bp, Artificial sequence
  SiRNA target sequence
atgtccattacatctacggttacta

SEQ ID NO: 76144 - DNA, 25 bp, Artificial sequence
  SiRNA target sequence
tgtccattacatctacggttactat

SEQ ID NO: 76145 - DNA, 25 bp, Artificial sequence
  SiRNA target sequence
gtccattacatctacggttactatt

SEQ ID NO: 76146 - DNA, 25 bp, Artificial sequence
  SiRNA target sequence
tccattacatctacggttactatta

SEQ ID NO: 76147 - DNA, 25 bp, Artificial sequence
  SiRNA target sequence
ccattacatctacggttactattaa

SEQ ID NO: 76148 - DNA, 25 bp, Artificial sequence
  SiRNA target sequence
cattacatctacggttactattaat

SEQ ID NO: 76149 - DNA, 25 bp, Artificial sequence
  SiRNA target sequence
attacatctacggttactattaatt

SEQ ID NO: 76150 - DNA, 25 bp, Artificial sequence
  SiRNA target sequence
ttacatctacggttactattaattt

SEQ ID NO: 76151 - DNA, 25 bp, Artificial sequence
  SiRNA target sequence
tacatctacggttactattaattta

SEQ ID NO: 76152 - DNA, 25 bp, Artificial sequence
  SiRNA target sequence
acatctacggttactattaatttaa

SEQ ID NO: 76153 - DNA, 25 bp, Artificial sequence
  SiRNA target sequence
catctacggttactattaatttaag

SEQ ID NO: 76154 - DNA, 25 bp, Artificial sequence
  SiRNA target sequence
atctacggttactattaatttaagt

SEQ ID NO: 76155 - DNA, 25 bp, Artificial sequence
  SiRNA target sequence
tctacggttactattaatttaagta

SEQ ID NO: 76156 - DNA, 25 bp, Artificial sequence
  SiRNA target sequence
ctacggttactattaatttaagtaa

SEQ ID NO: 76157 - DNA, 25 bp, Artificial sequence
  SiRNA target sequence
tacggttactattaatttaagtaac

SEQ ID NO: 76158 - DNA, 25 bp, Artificial sequence
  SiRNA target sequence
acggttactattaatttaagtaact

SEQ ID NO: 76159 - DNA, 25 bp, Artificial sequence
  SiRNA target sequence
cggttactattaatttaagtaactt

SEQ ID NO: 76160 - DNA, 25 bp, Artificial sequence
  SiRNA target sequence
ggttactattaatttaagtaacttg

SEQ ID NO: 76161 - DNA, 25 bp, Artificial sequence
  SiRNA target sequence
gttactattaatttaagtaacttgg

SEQ ID NO: 76162 - DNA, 25 bp, Artificial sequence
  SiRNA target sequence
ttactattaatttaagtaacttggg

SEQ ID NO: 76163 - DNA, 25 bp, Artificial sequence
  SiRNA target sequence
tactattaatttaagtaacttgggt

SEQ ID NO: 76164 - DNA, 25 bp, Artificial sequence
  SiRNA target sequence
actattaatttaagtaacttgggtt

SEQ ID NO: 76165 - DNA, 25 bp, Artificial sequence
  SiRNA target sequence
ctattaatttaagtaacttgggtta

SEQ ID NO: 76166 - DNA, 25 bp, Artificial sequence
  SiRNA target sequence
tattaatttaagtaacttgggttac

SEQ ID NO: 76167 - DNA, 25 bp, Artificial sequence
  SiRNA target sequence
attaatttaagtaacttgggttact

SEQ ID NO: 76168 - DNA, 25 bp, Artificial sequence
  SiRNA target sequence
ttaatttaagtaacttgggttactt

SEQ ID NO: 76169 - DNA, 25 bp, Artificial sequence
  SiRNA target sequence
taatttaagtaacttgggttactta

SEQ ID NO: 76170 - DNA, 25 bp, Artificial sequence
  SiRNA target sequence
aatttaagtaacttgggttacttat

SEQ ID NO: 76171 - DNA, 25 bp, Artificial sequence
  SiRNA target sequence
atttaagtaacttgggttacttata

SEQ ID NO: 76172 - DNA, 25 bp, Artificial sequence
  SiRNA target sequence
tttaagtaacttgggttacttatac

SEQ ID NO: 76173 - DNA, 25 bp, Artificial sequence
  SiRNA target sequence
ttaagtaacttgggttacttataca

SEQ ID NO: 76174 - DNA, 25 bp, Artificial sequence
  SiRNA target sequence
taagtaacttgggttacttatacac

SEQ ID NO: 76175 - DNA, 25 bp, Artificial sequence
  SiRNA target sequence
aagtaacttgggttacttatacact

SEQ ID NO: 76176 - DNA, 25 bp, Artificial sequence
  SiRNA target sequence
agtaacttgggttacttatacacta

SEQ ID NO: 76177 - DNA, 25 bp, Artificial sequence
  SiRNA target sequence
gtaacttgggttacttatacactag

SEQ ID NO: 76178 - DNA, 25 bp, Artificial sequence
  SiRNA target sequence
taacttgggttacttatacactaga

SEQ ID NO: 76179 - DNA, 25 bp, Artificial sequence
  SiRNA target sequence
aacttgggttacttatacactagat

SEQ ID NO: 76180 - DNA, 25 bp, Artificial sequence
  SiRNA target sequence
acttgggttacttatacactagata

SEQ ID NO: 76181 - DNA, 25 bp, Artificial sequence
  SiRNA target sequence
cttgggttacttatacactagatat

SEQ ID NO: 76182 - DNA, 25 bp, Artificial sequence
  SiRNA target sequence
ttgggttacttatacactagatata

SEQ ID NO: 76183 - DNA, 25 bp, Artificial sequence
  SiRNA target sequence
tgggttacttatacactagatatac

SEQ ID NO: 76184 - DNA, 25 bp, Artificial sequence
  SiRNA target sequence
gggttacttatacactagatataca

SEQ ID NO: 76185 - DNA, 25 bp, Artificial sequence
  SiRNA target sequence
ggttacttatacactagatatacac

SEQ ID NO: 76186 - DNA, 25 bp, Artificial sequence
  SiRNA target sequence
gttacttatacactagatatacaca

SEQ ID NO: 76187 - DNA, 25 bp, Artificial sequence
  SiRNA target sequence
ttacttatacactagatatacacaa

SEQ ID NO: 76188 - DNA, 25 bp, Artificial sequence
  SiRNA target sequence
tacttatacactagatatacacaag

SEQ ID NO: 76189 - DNA, 25 bp, Artificial sequence
  SiRNA target sequence
acttatacactagatatacacaagc

SEQ ID NO: 76190 - DNA, 25 bp, Artificial sequence
  SiRNA target sequence
cttatacactagatatacacaagca

SEQ ID NO: 76191 - DNA, 25 bp, Artificial sequence
  SiRNA target sequence
ttatacactagatatacacaagcaa

SEQ ID NO: 76192 - DNA, 25 bp, Artificial sequence
  SiRNA target sequence
tatacactagatatacacaagcaat

SEQ ID NO: 76193 - DNA, 25 bp, Artificial sequence
  SiRNA target sequence
atacactagatatacacaagcaata

SEQ ID NO: 76194 - DNA, 25 bp, Artificial sequence
  SiRNA target sequence
tacactagatatacacaagcaataa

SEQ ID NO: 76195 - DNA, 25 bp, Artificial sequence
  SiRNA target sequence
acactagatatacacaagcaataat

SEQ ID NO: 76196 - DNA, 25 bp, Artificial sequence
  SiRNA target sequence
cactagatatacacaagcaataatt

SEQ ID NO: 76197 - DNA, 25 bp, Artificial sequence
  SiRNA target sequence
actagatatacacaagcaataatta

SEQ ID NO: 76198 - DNA, 25 bp, Artificial sequence
  SiRNA target sequence
ctagatatacacaagcaataattaa

SEQ ID NO: 76199 - DNA, 25 bp, Artificial sequence
  SiRNA target sequence
tagatatacacaagcaataattaat

SEQ ID NO: 76200 - DNA, 25 bp, Artificial sequence
  SiRNA target sequence
agatatacacaagcaataattaatg

SEQ ID NO: 76201 - DNA, 25 bp, Artificial sequence
  SiRNA target sequence
gatatacacaagcaataattaatgc

SEQ ID NO: 76202 - DNA, 25 bp, Artificial sequence
  SiRNA target sequence
atatacacaagcaataattaatgca

SEQ ID NO: 76203 - DNA, 25 bp, Artificial sequence
  SiRNA target sequence
tatacacaagcaataattaatgcaa

SEQ ID NO: 76204 - DNA, 25 bp, Artificial sequence
  SiRNA target sequence
atacacaagcaataattaatgcaag

SEQ ID NO: 76205 - DNA, 25 bp, Artificial sequence
  SiRNA target sequence
tacacaagcaataattaatgcaaga

SEQ ID NO: 76206 - DNA, 25 bp, Artificial sequence
  SiRNA target sequence
acacaagcaataattaatgcaagat

SEQ ID NO: 76207 - DNA, 25 bp, Artificial sequence
  SiRNA target sequence
cacaagcaataattaatgcaagatc

SEQ ID NO: 76208 - DNA, 25 bp, Artificial sequence
  SiRNA target sequence
acaagcaataattaatgcaagatct

SEQ ID NO: 76209 - DNA, 25 bp, Artificial sequence
  SiRNA target sequence
caagcaataattaatgcaagatcta

SEQ ID NO: 76210 - DNA, 25 bp, Artificial sequence
  SiRNA target sequence
aagcaataattaatgcaagatctac

SEQ ID NO: 76211 - DNA, 25 bp, Artificial sequence
  SiRNA target sequence
agcaataattaatgcaagatctact

SEQ ID NO: 76212 - DNA, 25 bp, Artificial sequence
  SiRNA target sequence
gcaataattaatgcaagatctactt

SEQ ID NO: 76213 - DNA, 25 bp, Artificial sequence
  SiRNA target sequence
caataattaatgcaagatctactta

SEQ ID NO: 76214 - DNA, 25 bp, Artificial sequence
  SiRNA target sequence
aataattaatgcaagatctacttat

SEQ ID NO: 76215 - DNA, 25 bp, Artificial sequence
  SiRNA target sequence
ataattaatgcaagatctacttatg

SEQ ID NO: 76216 - DNA, 25 bp, Artificial sequence
  SiRNA target sequence
taattaatgcaagatctacttatga

SEQ ID NO: 76217 - DNA, 25 bp, Artificial sequence
  SiRNA target sequence
aattaatgcaagatctacttatgat

SEQ ID NO: 76218 - DNA, 25 bp, Artificial sequence
  SiRNA target sequence
attaatgcaagatctacttatgata

SEQ ID NO: 76219 - DNA, 25 bp, Artificial sequence
  SiRNA target sequence
ttaatgcaagatctacttatgatac

SEQ ID NO: 76220 - DNA, 25 bp, Artificial sequence
  SiRNA target sequence
taatgcaagatctacttatgataca

SEQ ID NO: 76221 - DNA, 25 bp, Artificial sequence
  SiRNA target sequence
aatgcaagatctacttatgatacaa

SEQ ID NO: 76222 - DNA, 25 bp, Artificial sequence
  SiRNA target sequence
atgcaagatctacttatgatacaat

SEQ ID NO: 76223 - DNA, 25 bp, Artificial sequence
  SiRNA target sequence
tgcaagatctacttatgatacaatg

SEQ ID NO: 76224 - DNA, 25 bp, Artificial sequence
  SiRNA target sequence
gcaagatctacttatgatacaatgt

SEQ ID NO: 76225 - DNA, 25 bp, Artificial sequence
  SiRNA target sequence
caagatctacttatgatacaatgtt

SEQ ID NO: 76226 - DNA, 25 bp, Artificial sequence
  SiRNA target sequence
aagatctacttatgatacaatgtta

SEQ ID NO: 76227 - DNA, 25 bp, Artificial sequence
  SiRNA target sequence
agatctacttatgatacaatgttag

SEQ ID NO: 76228 - DNA, 25 bp, Artificial sequence
  SiRNA target sequence
gatctacttatgatacaatgttaga

SEQ ID NO: 76229 - DNA, 25 bp, Artificial sequence
  SiRNA target sequence
atctacttatgatacaatgttagat

SEQ ID NO: 76230 - DNA, 25 bp, Artificial sequence
  SiRNA target sequence
tctacttatgatacaatgttagata

SEQ ID NO: 76231 - DNA, 25 bp, Artificial sequence
  SiRNA target sequence
ctacttatgatacaatgttagatat

SEQ ID NO: 76232 - DNA, 25 bp, Artificial sequence
  SiRNA target sequence
tacttatgatacaatgttagatata

SEQ ID NO: 76233 - DNA, 25 bp, Artificial sequence
  SiRNA target sequence
acttatgatacaatgttagatataa

SEQ ID NO: 76234 - DNA, 25 bp, Artificial sequence
  SiRNA target sequence
cttatgatacaatgttagatataaa

SEQ ID NO: 76235 - DNA, 25 bp, Artificial sequence
  SiRNA target sequence
ttatgatacaatgttagatataaaa

SEQ ID NO: 76236 - DNA, 25 bp, Artificial sequence
  SiRNA target sequence
tatgatacaatgttagatataaaaa

SEQ ID NO: 76237 - DNA, 25 bp, Artificial sequence
  SiRNA target sequence
atgatacaatgttagatataaaaaa

SEQ ID NO: 76238 - DNA, 25 bp, Artificial sequence
  SiRNA target sequence
tgatacaatgttagatataaaaaaa

SEQ ID NO: 76239 - DNA, 25 bp, Artificial sequence
  SiRNA target sequence
gatacaatgttagatataaaaaaag

SEQ ID NO: 76240 - DNA, 25 bp, Artificial sequence
  SiRNA target sequence
atacaatgttagatataaaaaaaga

SEQ ID NO: 76241 - DNA, 25 bp, Artificial sequence
  SiRNA target sequence
tacaatgttagatataaaaaaagag

SEQ ID NO: 76242 - DNA, 25 bp, Artificial sequence
  SiRNA target sequence
acaatgttagatataaaaaaagaga

SEQ ID NO: 76243 - DNA, 25 bp, Artificial sequence
  SiRNA target sequence
caatgttagatataaaaaaagagaa

SEQ ID NO: 76244 - DNA, 25 bp, Artificial sequence
  SiRNA target sequence
aatgttagatataaaaaaagagaat

SEQ ID NO: 76245 - DNA, 25 bp, Artificial sequence
  SiRNA target sequence
atgttagatataaaaaaagagaata

SEQ ID NO: 76246 - DNA, 25 bp, Artificial sequence
  SiRNA target sequence
tgttagatataaaaaaagagaataa

SEQ ID NO: 76247 - DNA, 25 bp, Artificial sequence
  SiRNA target sequence
gttagatataaaaaaagagaataat

SEQ ID NO: 76248 - DNA, 25 bp, Artificial sequence
  SiRNA target sequence
ttagatataaaaaaagagaataata

SEQ ID NO: 76249 - DNA, 25 bp, Artificial sequence
  SiRNA target sequence
tagatataaaaaaagagaataataa

SEQ ID NO: 76250 - DNA, 25 bp, Artificial sequence
  SiRNA target sequence
agatataaaaaaagagaataataag

SEQ ID NO: 76251 - DNA, 25 bp, Artificial sequence
  SiRNA target sequence
gatataaaaaaagagaataataagt

SEQ ID NO: 76252 - DNA, 25 bp, Artificial sequence
  SiRNA target sequence
atataaaaaaagagaataataagtt

SEQ ID NO: 76253 - DNA, 25 bp, Artificial sequence
  SiRNA target sequence
tataaaaaaagagaataataagttt

SEQ ID NO: 76254 - DNA, 25 bp, Artificial sequence
  SiRNA target sequence
ataaaaaaagagaataataagttta

SEQ ID NO: 76255 - DNA, 25 bp, Artificial sequence
  SiRNA target sequence
taaaaaaagagaataataagtttaa

SEQ ID NO: 76256 - DNA, 25 bp, Artificial sequence
  SiRNA target sequence
aaaaaaagagaataataagtttaag

SEQ ID NO: 76257 - DNA, 25 bp, Artificial sequence
  SiRNA target sequence
aaaaaagagaataataagtttaaga

SEQ ID NO: 76258 - DNA, 25 bp, Artificial sequence
  SiRNA target sequence
aaaaagagaataataagtttaagat

SEQ ID NO: 76259 - DNA, 25 bp, Artificial sequence
  SiRNA target sequence
aaaagagaataataagtttaagatt

SEQ ID NO: 76260 - DNA, 25 bp, Artificial sequence
  SiRNA target sequence
aaagagaataataagtttaagatta

SEQ ID NO: 76261 - DNA, 25 bp, Artificial sequence
  SiRNA target sequence
aagagaataataagtttaagattac

SEQ ID NO: 76262 - DNA, 25 bp, Artificial sequence
  SiRNA target sequence
agagaataataagtttaagattaca

SEQ ID NO: 76263 - DNA, 25 bp, Artificial sequence
  SiRNA target sequence
gagaataataagtttaagattacag

SEQ ID NO: 76264 - DNA, 25 bp, Artificial sequence
  SiRNA target sequence
agaataataagtttaagattacaga

SEQ ID NO: 76265 - DNA, 25 bp, Artificial sequence
  SiRNA target sequence
gaataataagtttaagattacagaa

SEQ ID NO: 76266 - DNA, 25 bp, Artificial sequence
  SiRNA target sequence
aataataagtttaagattacagaat

SEQ ID NO: 76267 - DNA, 25 bp, Artificial sequence
  SiRNA target sequence
ataataagtttaagattacagaatt

SEQ ID NO: 76268 - DNA, 25 bp, Artificial sequence
  SiRNA target sequence
taataagtttaagattacagaattt

SEQ ID NO: 76269 - DNA, 25 bp, Artificial sequence
  SiRNA target sequence
aataagtttaagattacagaattta

SEQ ID NO: 76270 - DNA, 25 bp, Artificial sequence
  SiRNA target sequence
ataagtttaagattacagaatttaa

SEQ ID NO: 76271 - DNA, 25 bp, Artificial sequence
  SiRNA target sequence
taagtttaagattacagaatttaaa

SEQ ID NO: 76272 - DNA, 25 bp, Artificial sequence
  SiRNA target sequence
aagtttaagattacagaatttaaag

SEQ ID NO: 76273 - DNA, 25 bp, Artificial sequence
  SiRNA target sequence
agtttaagattacagaatttaaaga

SEQ ID NO: 76274 - DNA, 25 bp, Artificial sequence
  SiRNA target sequence
gtttaagattacagaatttaaagaa

SEQ ID NO: 76275 - DNA, 25 bp, Artificial sequence
  SiRNA target sequence
tttaagattacagaatttaaagaaa

SEQ ID NO: 76276 - DNA, 25 bp, Artificial sequence
  SiRNA target sequence
ttaagattacagaatttaaagaaag

SEQ ID NO: 76277 - DNA, 25 bp, Artificial sequence
  SiRNA target sequence
taagattacagaatttaaagaaagt

SEQ ID NO: 76278 - DNA, 25 bp, Artificial sequence
  SiRNA target sequence
aagattacagaatttaaagaaagta

SEQ ID NO: 76279 - DNA, 25 bp, Artificial sequence
  SiRNA target sequence
agattacagaatttaaagaaagtat

SEQ ID NO: 76280 - DNA, 25 bp, Artificial sequence
  SiRNA target sequence
gattacagaatttaaagaaagtatt

SEQ ID NO: 76281 - DNA, 25 bp, Artificial sequence
  SiRNA target sequence
attacagaatttaaagaaagtatta

SEQ ID NO: 76282 - DNA, 25 bp, Artificial sequence
  SiRNA target sequence
ttacagaatttaaagaaagtattaa

SEQ ID NO: 76283 - DNA, 25 bp, Artificial sequence
  SiRNA target sequence
tacagaatttaaagaaagtattaag

SEQ ID NO: 76284 - DNA, 25 bp, Artificial sequence
  SiRNA target sequence
acagaatttaaagaaagtattaagt

SEQ ID NO: 76285 - DNA, 25 bp, Artificial sequence
  SiRNA target sequence
cagaatttaaagaaagtattaagtt

SEQ ID NO: 76286 - DNA, 25 bp, Artificial sequence
  SiRNA target sequence
agaatttaaagaaagtattaagttt

SEQ ID NO: 76287 - DNA, 25 bp, Artificial sequence
  SiRNA target sequence
gaatttaaagaaagtattaagttta

SEQ ID NO: 76288 - DNA, 25 bp, Artificial sequence
  SiRNA target sequence
aatttaaagaaagtattaagtttaa

SEQ ID NO: 76289 - DNA, 25 bp, Artificial sequence
  SiRNA target sequence
atttaaagaaagtattaagtttaat

SEQ ID NO: 76290 - DNA, 25 bp, Artificial sequence
  SiRNA target sequence
tttaaagaaagtattaagtttaata

SEQ ID NO: 76291 - DNA, 25 bp, Artificial sequence
  SiRNA target sequence
ttaaagaaagtattaagtttaataa

SEQ ID NO: 76292 - DNA, 25 bp, Artificial sequence
  SiRNA target sequence
taaagaaagtattaagtttaataat

SEQ ID NO: 76293 - DNA, 25 bp, Artificial sequence
  SiRNA target sequence
aaagaaagtattaagtttaataatt

SEQ ID NO: 76294 - DNA, 25 bp, Artificial sequence
  SiRNA target sequence
aagaaagtattaagtttaataattt

SEQ ID NO: 76295 - DNA, 25 bp, Artificial sequence
  SiRNA target sequence
agaaagtattaagtttaataatttg

SEQ ID NO: 76296 - DNA, 25 bp, Artificial sequence
  SiRNA target sequence
gaaagtattaagtttaataatttgt

SEQ ID NO: 76297 - DNA, 25 bp, Artificial sequence
  SiRNA target sequence
aaagtattaagtttaataatttgtc

SEQ ID NO: 76298 - DNA, 25 bp, Artificial sequence
  SiRNA target sequence
aagtattaagtttaataatttgtca

SEQ ID NO: 76299 - DNA, 25 bp, Artificial sequence
  SiRNA target sequence
agtattaagtttaataatttgtcat

SEQ ID NO: 76300 - DNA, 25 bp, Artificial sequence
  SiRNA target sequence
gtattaagtttaataatttgtcatt

SEQ ID NO: 76301 - DNA, 25 bp, Artificial sequence
  SiRNA target sequence
tattaagtttaataatttgtcattt

SEQ ID NO: 76302 - DNA, 25 bp, Artificial sequence
  SiRNA target sequence
attaagtttaataatttgtcatttg

SEQ ID NO: 76303 - DNA, 25 bp, Artificial sequence
  SiRNA target sequence
ttaagtttaataatttgtcatttgg

SEQ ID NO: 76304 - DNA, 25 bp, Artificial sequence
  SiRNA target sequence
taagtttaataatttgtcatttggt

SEQ ID NO: 76305 - DNA, 25 bp, Artificial sequence
  SiRNA target sequence
aagtttaataatttgtcatttggtt

SEQ ID NO: 76306 - DNA, 25 bp, Artificial sequence
  SiRNA target sequence
agtttaataatttgtcatttggtta

SEQ ID NO: 76307 - DNA, 25 bp, Artificial sequence
  SiRNA target sequence
gtttaataatttgtcatttggttat

SEQ ID NO: 76308 - DNA, 25 bp, Artificial sequence
  SiRNA target sequence
tttaataatttgtcatttggttatg

SEQ ID NO: 76309 - DNA, 25 bp, Artificial sequence
  SiRNA target sequence
ttaataatttgtcatttggttatga

SEQ ID NO: 76310 - DNA, 25 bp, Artificial sequence
  SiRNA target sequence
taataatttgtcatttggttatgaa

SEQ ID NO: 76311 - DNA, 25 bp, Artificial sequence
  SiRNA target sequence
aataatttgtcatttggttatgaaa

SEQ ID NO: 76312 - DNA, 25 bp, Artificial sequence
  SiRNA target sequence
ataatttgtcatttggttatgaaag

SEQ ID NO: 76313 - DNA, 25 bp, Artificial sequence
  SiRNA target sequence
taatttgtcatttggttatgaaagt

SEQ ID NO: 76314 - DNA, 25 bp, Artificial sequence
  SiRNA target sequence
aatttgtcatttggttatgaaagta

SEQ ID NO: 76315 - DNA, 25 bp, Artificial sequence
  SiRNA target sequence
atttgtcatttggttatgaaagtag

SEQ ID NO: 76316 - DNA, 25 bp, Artificial sequence
  SiRNA target sequence
tttgtcatttggttatgaaagtaga

SEQ ID NO: 76317 - DNA, 25 bp, Artificial sequence
  SiRNA target sequence
ttgtcatttggttatgaaagtagac

SEQ ID NO: 76318 - DNA, 25 bp, Artificial sequence
  SiRNA target sequence
tgtcatttggttatgaaagtagaca

SEQ ID NO: 76319 - DNA, 25 bp, Artificial sequence
  SiRNA target sequence
gtcatttggttatgaaagtagacaa

SEQ ID NO: 76320 - DNA, 25 bp, Artificial sequence
  SiRNA target sequence
tcatttggttatgaaagtagacaaa

SEQ ID NO: 76321 - DNA, 25 bp, Artificial sequence
  SiRNA target sequence
catttggttatgaaagtagacaaat

SEQ ID NO: 76322 - DNA, 25 bp, Artificial sequence
  SiRNA target sequence
atttggttatgaaagtagacaaatt

SEQ ID NO: 76323 - DNA, 25 bp, Artificial sequence
  SiRNA target sequence
tttggttatgaaagtagacaaattt

SEQ ID NO: 76324 - DNA, 25 bp, Artificial sequence
  SiRNA target sequence
ttggttatgaaagtagacaaatttt

SEQ ID NO: 76325 - DNA, 25 bp, Artificial sequence
  SiRNA target sequence
tggttatgaaagtagacaaattttt

SEQ ID NO: 76326 - DNA, 25 bp, Artificial sequence
  SiRNA target sequence
ggttatgaaagtagacaaattttta

SEQ ID NO: 76327 - DNA, 25 bp, Artificial sequence
  SiRNA target sequence
gttatgaaagtagacaaatttttaa

SEQ ID NO: 76328 - DNA, 25 bp, Artificial sequence
  SiRNA target sequence
ttatgaaagtagacaaatttttaat

SEQ ID NO: 76329 - DNA, 25 bp, Artificial sequence
  SiRNA target sequence
tatgaaagtagacaaatttttaata

SEQ ID NO: 76330 - DNA, 25 bp, Artificial sequence
  SiRNA target sequence
atgaaagtagacaaatttttaataa

SEQ ID NO: 76331 - DNA, 25 bp, Artificial sequence
  SiRNA target sequence
tgaaagtagacaaatttttaataaa

SEQ ID NO: 76332 - DNA, 25 bp, Artificial sequence
  SiRNA target sequence
gaaagtagacaaatttttaataaaa

SEQ ID NO: 76333 - DNA, 25 bp, Artificial sequence
  SiRNA target sequence
aaagtagacaaatttttaataaaat

SEQ ID NO: 76334 - DNA, 25 bp, Artificial sequence
  SiRNA target sequence
aagtagacaaatttttaataaaata

SEQ ID NO: 76335 - DNA, 25 bp, Artificial sequence
  SiRNA target sequence
agtagacaaatttttaataaaataa

SEQ ID NO: 76336 - DNA, 25 bp, Artificial sequence
  SiRNA target sequence
gtagacaaatttttaataaaataaa

SEQ ID NO: 76337 - DNA, 25 bp, Artificial sequence
  SiRNA target sequence
tagacaaatttttaataaaataaat

SEQ ID NO: 76338 - DNA, 25 bp, Artificial sequence
  SiRNA target sequence
agacaaatttttaataaaataaatc

SEQ ID NO: 76339 - DNA, 25 bp, Artificial sequence
  SiRNA target sequence
gacaaatttttaataaaataaatct

SEQ ID NO: 76340 - DNA, 25 bp, Artificial sequence
  SiRNA target sequence
acaaatttttaataaaataaatcta

SEQ ID NO: 76341 - DNA, 25 bp, Artificial sequence
  SiRNA target sequence
caaatttttaataaaataaatctag

SEQ ID NO: 76342 - DNA, 25 bp, Artificial sequence
  SiRNA target sequence
aaatttttaataaaataaatctaga

SEQ ID NO: 76343 - DNA, 25 bp, Artificial sequence
  SiRNA target sequence
aatttttaataaaataaatctagaa

SEQ ID NO: 76344 - DNA, 25 bp, Artificial sequence
  SiRNA target sequence
atttttaataaaataaatctagaaa

SEQ ID NO: 76345 - DNA, 25 bp, Artificial sequence
  SiRNA target sequence
tttttaataaaataaatctagaaat

SEQ ID NO: 76346 - DNA, 25 bp, Artificial sequence
  SiRNA target sequence
ttttaataaaataaatctagaaata

SEQ ID NO: 76347 - DNA, 25 bp, Artificial sequence
  SiRNA target sequence
tttaataaaataaatctagaaatat

SEQ ID NO: 76348 - DNA, 25 bp, Artificial sequence
  SiRNA target sequence
ttaataaaataaatctagaaatata

SEQ ID NO: 76349 - DNA, 25 bp, Artificial sequence
  SiRNA target sequence
taataaaataaatctagaaatatac

SEQ ID NO: 76350 - DNA, 25 bp, Artificial sequence
  SiRNA target sequence
aataaaataaatctagaaatataca

SEQ ID NO: 76351 - DNA, 25 bp, Artificial sequence
  SiRNA target sequence
ataaaataaatctagaaatatacaa

SEQ ID NO: 76352 - DNA, 25 bp, Artificial sequence
  SiRNA target sequence
taaaataaatctagaaatatacaaa

SEQ ID NO: 76353 - DNA, 25 bp, Artificial sequence
  SiRNA target sequence
aaaataaatctagaaatatacaaag

SEQ ID NO: 76354 - DNA, 25 bp, Artificial sequence
  SiRNA target sequence
aaataaatctagaaatatacaaagg

SEQ ID NO: 76355 - DNA, 25 bp, Artificial sequence
  SiRNA target sequence
aataaatctagaaatatacaaagga

SEQ ID NO: 76356 - DNA, 25 bp, Artificial sequence
  SiRNA target sequence
ataaatctagaaatatacaaaggag

SEQ ID NO: 76357 - DNA, 25 bp, Artificial sequence
  SiRNA target sequence
taaatctagaaatatacaaaggaga

SEQ ID NO: 76358 - DNA, 25 bp, Artificial sequence
  SiRNA target sequence
aaatctagaaatatacaaaggagaa

SEQ ID NO: 76359 - DNA, 25 bp, Artificial sequence
  SiRNA target sequence
aatctagaaatatacaaaggagaaa

SEQ ID NO: 76360 - DNA, 25 bp, Artificial sequence
  SiRNA target sequence
atctagaaatatacaaaggagaaaa

SEQ ID NO: 76361 - DNA, 25 bp, Artificial sequence
  SiRNA target sequence
tctagaaatatacaaaggagaaaaa

SEQ ID NO: 76362 - DNA, 25 bp, Artificial sequence
  SiRNA target sequence
ctagaaatatacaaaggagaaaaag

SEQ ID NO: 76363 - DNA, 25 bp, Artificial sequence
  SiRNA target sequence
tagaaatatacaaaggagaaaaagt

SEQ ID NO: 76364 - DNA, 25 bp, Artificial sequence
  SiRNA target sequence
agaaatatacaaaggagaaaaagta

SEQ ID NO: 76365 - DNA, 25 bp, Artificial sequence
  SiRNA target sequence
gaaatatacaaaggagaaaaagtag

SEQ ID NO: 76366 - DNA, 25 bp, Artificial sequence
  SiRNA target sequence
aaatatacaaaggagaaaaagtagc

SEQ ID NO: 76367 - DNA, 25 bp, Artificial sequence
  SiRNA target sequence
aatatacaaaggagaaaaagtagca

SEQ ID NO: 76368 - DNA, 25 bp, Artificial sequence
  SiRNA target sequence
atatacaaaggagaaaaagtagcaa

SEQ ID NO: 76369 - DNA, 25 bp, Artificial sequence
  SiRNA target sequence
tatacaaaggagaaaaagtagcaat

SEQ ID NO: 76370 - DNA, 25 bp, Artificial sequence
  SiRNA target sequence
atacaaaggagaaaaagtagcaatt

SEQ ID NO: 76371 - DNA, 25 bp, Artificial sequence
  SiRNA target sequence
tacaaaggagaaaaagtagcaatta

SEQ ID NO: 76372 - DNA, 25 bp, Artificial sequence
  SiRNA target sequence
acaaaggagaaaaagtagcaattat

SEQ ID NO: 76373 - DNA, 25 bp, Artificial sequence
  SiRNA target sequence
caaaggagaaaaagtagcaattata

SEQ ID NO: 76374 - DNA, 25 bp, Artificial sequence
  SiRNA target sequence
aaaggagaaaaagtagcaattatag

SEQ ID NO: 76375 - DNA, 25 bp, Artificial sequence
  SiRNA target sequence
aaggagaaaaagtagcaattatagg

SEQ ID NO: 76376 - DNA, 25 bp, Artificial sequence
  SiRNA target sequence
aggagaaaaagtagcaattataggt

SEQ ID NO: 76377 - DNA, 25 bp, Artificial sequence
  SiRNA target sequence
ggagaaaaagtagcaattataggta

SEQ ID NO: 76378 - DNA, 25 bp, Artificial sequence
  SiRNA target sequence
gagaaaaagtagcaattataggtaa

SEQ ID NO: 76379 - DNA, 25 bp, Artificial sequence
  SiRNA target sequence
agaaaaagtagcaattataggtaaa

SEQ ID NO: 76380 - DNA, 25 bp, Artificial sequence
  SiRNA target sequence
gaaaaagtagcaattataggtaaaa

SEQ ID NO: 76381 - DNA, 25 bp, Artificial sequence
  SiRNA target sequence
aaaaagtagcaattataggtaaaaa

SEQ ID NO: 76382 - DNA, 25 bp, Artificial sequence
  SiRNA target sequence
aaaagtagcaattataggtaaaaat

SEQ ID NO: 76383 - DNA, 25 bp, Artificial sequence
  SiRNA target sequence
aaagtagcaattataggtaaaaatg

SEQ ID NO: 76384 - DNA, 25 bp, Artificial sequence
  SiRNA target sequence
aagtagcaattataggtaaaaatgg

SEQ ID NO: 76385 - DNA, 25 bp, Artificial sequence
  SiRNA target sequence
agtagcaattataggtaaaaatggt

SEQ ID NO: 76386 - DNA, 25 bp, Artificial sequence
  SiRNA target sequence
gtagcaattataggtaaaaatggta

SEQ ID NO: 76387 - DNA, 25 bp, Artificial sequence
  SiRNA target sequence
tagcaattataggtaaaaatggtag

SEQ ID NO: 76388 - DNA, 25 bp, Artificial sequence
  SiRNA target sequence
agcaattataggtaaaaatggtagt

SEQ ID NO: 76389 - DNA, 25 bp, Artificial sequence
  SiRNA target sequence
gcaattataggtaaaaatggtagtg

SEQ ID NO: 76390 - DNA, 25 bp, Artificial sequence
  SiRNA target sequence
caattataggtaaaaatggtagtgg

SEQ ID NO: 76391 - DNA, 25 bp, Artificial sequence
  SiRNA target sequence
aattataggtaaaaatggtagtggt

SEQ ID NO: 76392 - DNA, 25 bp, Artificial sequence
  SiRNA target sequence
attataggtaaaaatggtagtggta

SEQ ID NO: 76393 - DNA, 25 bp, Artificial sequence
  SiRNA target sequence
ttataggtaaaaatggtagtggtaa

SEQ ID NO: 76394 - DNA, 25 bp, Artificial sequence
  SiRNA target sequence
tataggtaaaaatggtagtggtaaa

SEQ ID NO: 76395 - DNA, 25 bp, Artificial sequence
  SiRNA target sequence
ataggtaaaaatggtagtggtaaat

SEQ ID NO: 76396 - DNA, 25 bp, Artificial sequence
  SiRNA target sequence
taggtaaaaatggtagtggtaaatc

SEQ ID NO: 76397 - DNA, 25 bp, Artificial sequence
  SiRNA target sequence
aggtaaaaatggtagtggtaaatca

SEQ ID NO: 76398 - DNA, 25 bp, Artificial sequence
  SiRNA target sequence
ggtaaaaatggtagtggtaaatcaa

SEQ ID NO: 76399 - DNA, 25 bp, Artificial sequence
  SiRNA target sequence
gtaaaaatggtagtggtaaatcaac

SEQ ID NO: 76400 - DNA, 25 bp, Artificial sequence
  SiRNA target sequence
taaaaatggtagtggtaaatcaaca

SEQ ID NO: 76401 - DNA, 25 bp, Artificial sequence
  SiRNA target sequence
aaaaatggtagtggtaaatcaacat

SEQ ID NO: 76402 - DNA, 25 bp, Artificial sequence
  SiRNA target sequence
aaaatggtagtggtaaatcaacatt

SEQ ID NO: 76403 - DNA, 25 bp, Artificial sequence
  SiRNA target sequence
aaatggtagtggtaaatcaacatta

SEQ ID NO: 76404 - DNA, 25 bp, Artificial sequence
  SiRNA target sequence
aatggtagtggtaaatcaacattac

SEQ ID NO: 76405 - DNA, 25 bp, Artificial sequence
  SiRNA target sequence
atggtagtggtaaatcaacattact

SEQ ID NO: 76406 - DNA, 25 bp, Artificial sequence
  SiRNA target sequence
tggtagtggtaaatcaacattacta

SEQ ID NO: 76407 - DNA, 25 bp, Artificial sequence
  SiRNA target sequence
ggtagtggtaaatcaacattactaa

SEQ ID NO: 76408 - DNA, 25 bp, Artificial sequence
  SiRNA target sequence
gtagtggtaaatcaacattactaaa

SEQ ID NO: 76409 - DNA, 25 bp, Artificial sequence
  SiRNA target sequence
tagtggtaaatcaacattactaaaa

SEQ ID NO: 76410 - DNA, 25 bp, Artificial sequence
  SiRNA target sequence
agtggtaaatcaacattactaaaac

SEQ ID NO: 76411 - DNA, 25 bp, Artificial sequence
  SiRNA target sequence
gtggtaaatcaacattactaaaact

SEQ ID NO: 76412 - DNA, 25 bp, Artificial sequence
  SiRNA target sequence
tggtaaatcaacattactaaaacta

SEQ ID NO: 76413 - DNA, 25 bp, Artificial sequence
  SiRNA target sequence
ggtaaatcaacattactaaaactac

SEQ ID NO: 76414 - DNA, 25 bp, Artificial sequence
  SiRNA target sequence
gtaaatcaacattactaaaactact

SEQ ID NO: 76415 - DNA, 25 bp, Artificial sequence
  SiRNA target sequence
taaatcaacattactaaaactactg

SEQ ID NO: 76416 - DNA, 25 bp, Artificial sequence
  SiRNA target sequence
aaatcaacattactaaaactactgc

SEQ ID NO: 76417 - DNA, 25 bp, Artificial sequence
  SiRNA target sequence
aatcaacattactaaaactactgct

SEQ ID NO: 76418 - DNA, 25 bp, Artificial sequence
  SiRNA target sequence
atcaacattactaaaactactgctt

SEQ ID NO: 76419 - DNA, 25 bp, Artificial sequence
  SiRNA target sequence
tcaacattactaaaactactgctta

SEQ ID NO: 76420 - DNA, 25 bp, Artificial sequence
  SiRNA target sequence
caacattactaaaactactgcttaa

SEQ ID NO: 76421 - DNA, 25 bp, Artificial sequence
  SiRNA target sequence
aacattactaaaactactgcttaaa

SEQ ID NO: 76422 - DNA, 25 bp, Artificial sequence
  SiRNA target sequence
acattactaaaactactgcttaaat

SEQ ID NO: 76423 - DNA, 25 bp, Artificial sequence
  SiRNA target sequence
cattactaaaactactgcttaaatt

SEQ ID NO: 76424 - DNA, 25 bp, Artificial sequence
  SiRNA target sequence
attactaaaactactgcttaaattt

SEQ ID NO: 76425 - DNA, 25 bp, Artificial sequence
  SiRNA target sequence
ttactaaaactactgcttaaatttg

SEQ ID NO: 76426 - DNA, 25 bp, Artificial sequence
  SiRNA target sequence
tactaaaactactgcttaaatttga

SEQ ID NO: 76427 - DNA, 25 bp, Artificial sequence
  SiRNA target sequence
actaaaactactgcttaaatttgat

SEQ ID NO: 76428 - DNA, 25 bp, Artificial sequence
  SiRNA target sequence
ctaaaactactgcttaaatttgatg

SEQ ID NO: 76429 - DNA, 25 bp, Artificial sequence
  SiRNA target sequence
taaaactactgcttaaatttgatga

SEQ ID NO: 76430 - DNA, 25 bp, Artificial sequence
  SiRNA target sequence
aaaactactgcttaaatttgatgaa

SEQ ID NO: 76431 - DNA, 25 bp, Artificial sequence
  SiRNA target sequence
aaactactgcttaaatttgatgaag

SEQ ID NO: 76432 - DNA, 25 bp, Artificial sequence
  SiRNA target sequence
aactactgcttaaatttgatgaaga

SEQ ID NO: 76433 - DNA, 25 bp, Artificial sequence
  SiRNA target sequence
actactgcttaaatttgatgaagat

SEQ ID NO: 76434 - DNA, 25 bp, Artificial sequence
  SiRNA target sequence
ctactgcttaaatttgatgaagatt

SEQ ID NO: 76435 - DNA, 25 bp, Artificial sequence
  SiRNA target sequence
tactgcttaaatttgatgaagatta

SEQ ID NO: 76436 - DNA, 25 bp, Artificial sequence
  SiRNA target sequence
actgcttaaatttgatgaagattac

SEQ ID NO: 76437 - DNA, 25 bp, Artificial sequence
  SiRNA target sequence
ctgcttaaatttgatgaagattaca

SEQ ID NO: 76438 - DNA, 25 bp, Artificial sequence
  SiRNA target sequence
tgcttaaatttgatgaagattacaa

SEQ ID NO: 76439 - DNA, 25 bp, Artificial sequence
  SiRNA target sequence
gcttaaatttgatgaagattacaaa

SEQ ID NO: 76440 - DNA, 25 bp, Artificial sequence
  SiRNA target sequence
cttaaatttgatgaagattacaaag

SEQ ID NO: 76441 - DNA, 25 bp, Artificial sequence
  SiRNA target sequence
ttaaatttgatgaagattacaaagg

SEQ ID NO: 76442 - DNA, 25 bp, Artificial sequence
  SiRNA target sequence
taaatttgatgaagattacaaaggt

SEQ ID NO: 76443 - DNA, 25 bp, Artificial sequence
  SiRNA target sequence
aaatttgatgaagattacaaaggta

SEQ ID NO: 76444 - DNA, 25 bp, Artificial sequence
  SiRNA target sequence
aatttgatgaagattacaaaggtag

SEQ ID NO: 76445 - DNA, 25 bp, Artificial sequence
  SiRNA target sequence
atttgatgaagattacaaaggtagc

SEQ ID NO: 76446 - DNA, 25 bp, Artificial sequence
  SiRNA target sequence
tttgatgaagattacaaaggtagca

SEQ ID NO: 76447 - DNA, 25 bp, Artificial sequence
  SiRNA target sequence
ttgatgaagattacaaaggtagcat

SEQ ID NO: 76448 - DNA, 25 bp, Artificial sequence
  SiRNA target sequence
tgatgaagattacaaaggtagcatt

SEQ ID NO: 76449 - DNA, 25 bp, Artificial sequence
  SiRNA target sequence
gatgaagattacaaaggtagcattt

SEQ ID NO: 76450 - DNA, 25 bp, Artificial sequence
  SiRNA target sequence
atgaagattacaaaggtagcatttt

SEQ ID NO: 76451 - DNA, 25 bp, Artificial sequence
  SiRNA target sequence
tgaagattacaaaggtagcatttta

SEQ ID NO: 76452 - DNA, 25 bp, Artificial sequence
  SiRNA target sequence
gaagattacaaaggtagcattttaa

SEQ ID NO: 76453 - DNA, 25 bp, Artificial sequence
  SiRNA target sequence
aagattacaaaggtagcattttaat

SEQ ID NO: 76454 - DNA, 25 bp, Artificial sequence
  SiRNA target sequence
agattacaaaggtagcattttaata

SEQ ID NO: 76455 - DNA, 25 bp, Artificial sequence
  SiRNA target sequence
gattacaaaggtagcattttaatag

SEQ ID NO: 76456 - DNA, 25 bp, Artificial sequence
  SiRNA target sequence
attacaaaggtagcattttaataga

SEQ ID NO: 76457 - DNA, 25 bp, Artificial sequence
  SiRNA target sequence
ttacaaaggtagcattttaatagat

SEQ ID NO: 76458 - DNA, 25 bp, Artificial sequence
  SiRNA target sequence
tacaaaggtagcattttaatagatg

SEQ ID NO: 76459 - DNA, 25 bp, Artificial sequence
  SiRNA target sequence
acaaaggtagcattttaatagatga

SEQ ID NO: 76460 - DNA, 25 bp, Artificial sequence
  SiRNA target sequence
caaaggtagcattttaatagatgac

SEQ ID NO: 76461 - DNA, 25 bp, Artificial sequence
  SiRNA target sequence
aaaggtagcattttaatagatgaca

SEQ ID NO: 76462 - DNA, 25 bp, Artificial sequence
  SiRNA target sequence
aaggtagcattttaatagatgacat

SEQ ID NO: 76463 - DNA, 25 bp, Artificial sequence
  SiRNA target sequence
aggtagcattttaatagatgacatt

SEQ ID NO: 76464 - DNA, 25 bp, Artificial sequence
  SiRNA target sequence
ggtagcattttaatagatgacattg

SEQ ID NO: 76465 - DNA, 25 bp, Artificial sequence
  SiRNA target sequence
gtagcattttaatagatgacattga

SEQ ID NO: 76466 - DNA, 25 bp, Artificial sequence
  SiRNA target sequence
tagcattttaatagatgacattgat

SEQ ID NO: 76467 - DNA, 25 bp, Artificial sequence
  SiRNA target sequence
agcattttaatagatgacattgata

SEQ ID NO: 76468 - DNA, 25 bp, Artificial sequence
  SiRNA target sequence
gcattttaatagatgacattgatat

SEQ ID NO: 76469 - DNA, 25 bp, Artificial sequence
  SiRNA target sequence
cattttaatagatgacattgatatt

SEQ ID NO: 76470 - DNA, 25 bp, Artificial sequence
  SiRNA target sequence
attttaatagatgacattgatatta

SEQ ID NO: 76471 - DNA, 25 bp, Artificial sequence
  SiRNA target sequence
ttttaatagatgacattgatattaa

SEQ ID NO: 76472 - DNA, 25 bp, Artificial sequence
  SiRNA target sequence
tttaatagatgacattgatattaaa

SEQ ID NO: 76473 - DNA, 25 bp, Artificial sequence
  SiRNA target sequence
ttaatagatgacattgatattaaaa

SEQ ID NO: 76474 - DNA, 25 bp, Artificial sequence
  SiRNA target sequence
taatagatgacattgatattaaaaa

SEQ ID NO: 76475 - DNA, 25 bp, Artificial sequence
  SiRNA target sequence
aatagatgacattgatattaaaaaa

SEQ ID NO: 76476 - DNA, 25 bp, Artificial sequence
  SiRNA target sequence
atagatgacattgatattaaaaaaa

SEQ ID NO: 76477 - DNA, 25 bp, Artificial sequence
  SiRNA target sequence
tagatgacattgatattaaaaaaat

SEQ ID NO: 76478 - DNA, 25 bp, Artificial sequence
  SiRNA target sequence
agatgacattgatattaaaaaaatc

SEQ ID NO: 76479 - DNA, 25 bp, Artificial sequence
  SiRNA target sequence
gatgacattgatattaaaaaaatca

SEQ ID NO: 76480 - DNA, 25 bp, Artificial sequence
  SiRNA target sequence
atgacattgatattaaaaaaatcaa

SEQ ID NO: 76481 - DNA, 25 bp, Artificial sequence
  SiRNA target sequence
tgacattgatattaaaaaaatcaaa

SEQ ID NO: 76482 - DNA, 25 bp, Artificial sequence
  SiRNA target sequence
gacattgatattaaaaaaatcaaag

SEQ ID NO: 76483 - DNA, 25 bp, Artificial sequence
  SiRNA target sequence
acattgatattaaaaaaatcaaaga

SEQ ID NO: 76484 - DNA, 25 bp, Artificial sequence
  SiRNA target sequence
cattgatattaaaaaaatcaaagac

SEQ ID NO: 76485 - DNA, 25 bp, Artificial sequence
  SiRNA target sequence
attgatattaaaaaaatcaaagacg

SEQ ID NO: 76486 - DNA, 25 bp, Artificial sequence
  SiRNA target sequence
ttgatattaaaaaaatcaaagacga

SEQ ID NO: 76487 - DNA, 25 bp, Artificial sequence
  SiRNA target sequence
tgatattaaaaaaatcaaagacgaa

SEQ ID NO: 76488 - DNA, 25 bp, Artificial sequence
  SiRNA target sequence
gatattaaaaaaatcaaagacgaat

SEQ ID NO: 76489 - DNA, 25 bp, Artificial sequence
  SiRNA target sequence
atattaaaaaaatcaaagacgaatt

SEQ ID NO: 76490 - DNA, 25 bp, Artificial sequence
  SiRNA target sequence
tattaaaaaaatcaaagacgaattt

SEQ ID NO: 76491 - DNA, 25 bp, Artificial sequence
  SiRNA target sequence
attaaaaaaatcaaagacgaatttt

SEQ ID NO: 76492 - DNA, 25 bp, Artificial sequence
  SiRNA target sequence
ttaaaaaaatcaaagacgaatttta

SEQ ID NO: 76493 - DNA, 25 bp, Artificial sequence
  SiRNA target sequence
taaaaaaatcaaagacgaattttat

SEQ ID NO: 76494 - DNA, 25 bp, Artificial sequence
  SiRNA target sequence
aaaaaaatcaaagacgaattttata

SEQ ID NO: 76495 - DNA, 25 bp, Artificial sequence
  SiRNA target sequence
aaaaaatcaaagacgaattttatag

SEQ ID NO: 76496 - DNA, 25 bp, Artificial sequence
  SiRNA target sequence
aaaaatcaaagacgaattttatagg

SEQ ID NO: 76497 - DNA, 25 bp, Artificial sequence
  SiRNA target sequence
aaaatcaaagacgaattttatagga

SEQ ID NO: 76498 - DNA, 25 bp, Artificial sequence
  SiRNA target sequence
aaatcaaagacgaattttataggaa

SEQ ID NO: 76499 - DNA, 25 bp, Artificial sequence
  SiRNA target sequence
aatcaaagacgaattttataggaat

SEQ ID NO: 76500 - DNA, 25 bp, Artificial sequence
  SiRNA target sequence
atcaaagacgaattttataggaatt

SEQ ID NO: 76501 - DNA, 25 bp, Artificial sequence
  SiRNA target sequence
tcaaagacgaattttataggaattt

SEQ ID NO: 76502 - DNA, 25 bp, Artificial sequence
  SiRNA target sequence
caaagacgaattttataggaattta

SEQ ID NO: 76503 - DNA, 25 bp, Artificial sequence
  SiRNA target sequence
aaagacgaattttataggaatttat

SEQ ID NO: 76504 - DNA, 25 bp, Artificial sequence
  SiRNA target sequence
aagacgaattttataggaatttatt

SEQ ID NO: 76505 - DNA, 25 bp, Artificial sequence
  SiRNA target sequence
agacgaattttataggaatttatta

SEQ ID NO: 76506 - DNA, 25 bp, Artificial sequence
  SiRNA target sequence
gacgaattttataggaatttattag

SEQ ID NO: 76507 - DNA, 25 bp, Artificial sequence
  SiRNA target sequence
acgaattttataggaatttattagg

SEQ ID NO: 76508 - DNA, 25 bp, Artificial sequence
  SiRNA target sequence
cgaattttataggaatttattaggt

SEQ ID NO: 76509 - DNA, 25 bp, Artificial sequence
  SiRNA target sequence
gaattttataggaatttattaggtt

SEQ ID NO: 76510 - DNA, 25 bp, Artificial sequence
  SiRNA target sequence
aattttataggaatttattaggtta

SEQ ID NO: 76511 - DNA, 25 bp, Artificial sequence
  SiRNA target sequence
attttataggaatttattaggttac

SEQ ID NO: 76512 - DNA, 25 bp, Artificial sequence
  SiRNA target sequence
ttttataggaatttattaggttaca

SEQ ID NO: 76513 - DNA, 25 bp, Artificial sequence
  SiRNA target sequence
tttataggaatttattaggttacat

SEQ ID NO: 76514 - DNA, 25 bp, Artificial sequence
  SiRNA target sequence
ttataggaatttattaggttacata

SEQ ID NO: 76515 - DNA, 25 bp, Artificial sequence
  SiRNA target sequence
tataggaatttattaggttacatac

SEQ ID NO: 76516 - DNA, 25 bp, Artificial sequence
  SiRNA target sequence
ataggaatttattaggttacatacc

SEQ ID NO: 76517 - DNA, 25 bp, Artificial sequence
  SiRNA target sequence
taggaatttattaggttacatacca

SEQ ID NO: 76518 - DNA, 25 bp, Artificial sequence
  SiRNA target sequence
aggaatttattaggttacataccac

SEQ ID NO: 76519 - DNA, 25 bp, Artificial sequence
  SiRNA target sequence
ggaatttattaggttacataccaca

SEQ ID NO: 76520 - DNA, 25 bp, Artificial sequence
  SiRNA target sequence
gaatttattaggttacataccacag

SEQ ID NO: 76521 - DNA, 25 bp, Artificial sequence
  SiRNA target sequence
aatttattaggttacataccacaga

SEQ ID NO: 76522 - DNA, 25 bp, Artificial sequence
  SiRNA target sequence
atttattaggttacataccacagaa

SEQ ID NO: 76523 - DNA, 25 bp, Artificial sequence
  SiRNA target sequence
tttattaggttacataccacagaat

SEQ ID NO: 76524 - DNA, 25 bp, Artificial sequence
  SiRNA target sequence
ttattaggttacataccacagaata

SEQ ID NO: 76525 - DNA, 25 bp, Artificial sequence
  SiRNA target sequence
tattaggttacataccacagaatac

SEQ ID NO: 76526 - DNA, 25 bp, Artificial sequence
  SiRNA target sequence
attaggttacataccacagaataca

SEQ ID NO: 76527 - DNA, 25 bp, Artificial sequence
  SiRNA target sequence
ttaggttacataccacagaatacat

SEQ ID NO: 76528 - DNA, 25 bp, Artificial sequence
  SiRNA target sequence
taggttacataccacagaatacatt

SEQ ID NO: 76529 - DNA, 25 bp, Artificial sequence
  SiRNA target sequence
aggttacataccacagaatacattt

SEQ ID NO: 76530 - DNA, 25 bp, Artificial sequence
  SiRNA target sequence
ggttacataccacagaatacatttt

SEQ ID NO: 76531 - DNA, 25 bp, Artificial sequence
  SiRNA target sequence
gttacataccacagaatacattttt

SEQ ID NO: 76532 - DNA, 25 bp, Artificial sequence
  SiRNA target sequence
ttacataccacagaatacatttttg

SEQ ID NO: 76533 - DNA, 25 bp, Artificial sequence
  SiRNA target sequence
tacataccacagaatacatttttgt

SEQ ID NO: 76534 - DNA, 25 bp, Artificial sequence
  SiRNA target sequence
acataccacagaatacatttttgtt

SEQ ID NO: 76535 - DNA, 25 bp, Artificial sequence
  SiRNA target sequence
cataccacagaatacatttttgttt

SEQ ID NO: 76536 - DNA, 25 bp, Artificial sequence
  SiRNA target sequence
ataccacagaatacatttttgttta

SEQ ID NO: 76537 - DNA, 25 bp, Artificial sequence
  SiRNA target sequence
taccacagaatacatttttgtttaa

SEQ ID NO: 76538 - DNA, 25 bp, Artificial sequence
  SiRNA target sequence
accacagaatacatttttgtttaat

SEQ ID NO: 76539 - DNA, 25 bp, Artificial sequence
  SiRNA target sequence
ccacagaatacatttttgtttaatg

SEQ ID NO: 76540 - DNA, 25 bp, Artificial sequence
  SiRNA target sequence
cacagaatacatttttgtttaatga

SEQ ID NO: 76541 - DNA, 25 bp, Artificial sequence
  SiRNA target sequence
acagaatacatttttgtttaatgaa

SEQ ID NO: 76542 - DNA, 25 bp, Artificial sequence
  SiRNA target sequence
cagaatacatttttgtttaatgaat

SEQ ID NO: 76543 - DNA, 25 bp, Artificial sequence
  SiRNA target sequence
agaatacatttttgtttaatgaatc

SEQ ID NO: 76544 - DNA, 25 bp, Artificial sequence
  SiRNA target sequence
gaatacatttttgtttaatgaatct

SEQ ID NO: 76545 - DNA, 25 bp, Artificial sequence
  SiRNA target sequence
aatacatttttgtttaatgaatctg

SEQ ID NO: 76546 - DNA, 25 bp, Artificial sequence
  SiRNA target sequence
atacatttttgtttaatgaatctgt

SEQ ID NO: 76547 - DNA, 25 bp, Artificial sequence
  SiRNA target sequence
tacatttttgtttaatgaatctgta

SEQ ID NO: 76548 - DNA, 25 bp, Artificial sequence
  SiRNA target sequence
acatttttgtttaatgaatctgtaa

SEQ ID NO: 76549 - DNA, 25 bp, Artificial sequence
  SiRNA target sequence
catttttgtttaatgaatctgtaaa

SEQ ID NO: 76550 - DNA, 25 bp, Artificial sequence
  SiRNA target sequence
atttttgtttaatgaatctgtaaaa

SEQ ID NO: 76551 - DNA, 25 bp, Artificial sequence
  SiRNA target sequence
tttttgtttaatgaatctgtaaaat

SEQ ID NO: 76552 - DNA, 25 bp, Artificial sequence
  SiRNA target sequence
ttttgtttaatgaatctgtaaaata

SEQ ID NO: 76553 - DNA, 25 bp, Artificial sequence
  SiRNA target sequence
tttgtttaatgaatctgtaaaatat

SEQ ID NO: 76554 - DNA, 25 bp, Artificial sequence
  SiRNA target sequence
ttgtttaatgaatctgtaaaatata

SEQ ID NO: 76555 - DNA, 25 bp, Artificial sequence
  SiRNA target sequence
tgtttaatgaatctgtaaaatataa

SEQ ID NO: 76556 - DNA, 25 bp, Artificial sequence
  SiRNA target sequence
gtttaatgaatctgtaaaatataat

SEQ ID NO: 76557 - DNA, 25 bp, Artificial sequence
  SiRNA target sequence
tttaatgaatctgtaaaatataata

SEQ ID NO: 76558 - DNA, 25 bp, Artificial sequence
  SiRNA target sequence
ttaatgaatctgtaaaatataatat

SEQ ID NO: 76559 - DNA, 25 bp, Artificial sequence
  SiRNA target sequence
taatgaatctgtaaaatataatatt

SEQ ID NO: 76560 - DNA, 25 bp, Artificial sequence
  SiRNA target sequence
aatgaatctgtaaaatataatatta

SEQ ID NO: 76561 - DNA, 25 bp, Artificial sequence
  SiRNA target sequence
atgaatctgtaaaatataatattaa

SEQ ID NO: 76562 - DNA, 25 bp, Artificial sequence
  SiRNA target sequence
tgaatctgtaaaatataatattaaa

SEQ ID NO: 76563 - DNA, 25 bp, Artificial sequence
  SiRNA target sequence
gaatctgtaaaatataatattaaat

SEQ ID NO: 76564 - DNA, 25 bp, Artificial sequence
  SiRNA target sequence
aatctgtaaaatataatattaaata

SEQ ID NO: 76565 - DNA, 25 bp, Artificial sequence
  SiRNA target sequence
atctgtaaaatataatattaaatac

SEQ ID NO: 76566 - DNA, 25 bp, Artificial sequence
  SiRNA target sequence
tctgtaaaatataatattaaatacg

SEQ ID NO: 76567 - DNA, 25 bp, Artificial sequence
  SiRNA target sequence
ctgtaaaatataatattaaatacgg

SEQ ID NO: 76568 - DNA, 25 bp, Artificial sequence
  SiRNA target sequence
tgtaaaatataatattaaatacgga

SEQ ID NO: 76569 - DNA, 25 bp, Artificial sequence
  SiRNA target sequence
gtaaaatataatattaaatacggat

SEQ ID NO: 76570 - DNA, 25 bp, Artificial sequence
  SiRNA target sequence
taaaatataatattaaatacggatc

SEQ ID NO: 76571 - DNA, 25 bp, Artificial sequence
  SiRNA target sequence
aaaatataatattaaatacggatct

SEQ ID NO: 76572 - DNA, 25 bp, Artificial sequence
  SiRNA target sequence
aaatataatattaaatacggatctt

SEQ ID NO: 76573 - DNA, 25 bp, Artificial sequence
  SiRNA target sequence
aatataatattaaatacggatcttt

SEQ ID NO: 76574 - DNA, 25 bp, Artificial sequence
  SiRNA target sequence
atataatattaaatacggatctttt

SEQ ID NO: 76575 - DNA, 25 bp, Artificial sequence
  SiRNA target sequence
tataatattaaatacggatcttttg

SEQ ID NO: 76576 - DNA, 25 bp, Artificial sequence
  SiRNA target sequence
ataatattaaatacggatcttttgg

SEQ ID NO: 76577 - DNA, 25 bp, Artificial sequence
  SiRNA target sequence
taatattaaatacggatcttttggt

SEQ ID NO: 76578 - DNA, 25 bp, Artificial sequence
  SiRNA target sequence
aatattaaatacggatcttttggta

SEQ ID NO: 76579 - DNA, 25 bp, Artificial sequence
  SiRNA target sequence
atattaaatacggatcttttggtat

SEQ ID NO: 76580 - DNA, 25 bp, Artificial sequence
  SiRNA target sequence
tattaaatacggatcttttggtatt

SEQ ID NO: 76581 - DNA, 25 bp, Artificial sequence
  SiRNA target sequence
attaaatacggatcttttggtattt

SEQ ID NO: 76582 - DNA, 25 bp, Artificial sequence
  SiRNA target sequence
ttaaatacggatcttttggtatttc

SEQ ID NO: 76583 - DNA, 25 bp, Artificial sequence
  SiRNA target sequence
taaatacggatcttttggtatttca

SEQ ID NO: 76584 - DNA, 25 bp, Artificial sequence
  SiRNA target sequence
aaatacggatcttttggtatttcag

SEQ ID NO: 76585 - DNA, 25 bp, Artificial sequence
  SiRNA target sequence
aatacggatcttttggtatttcaga

SEQ ID NO: 76586 - DNA, 25 bp, Artificial sequence
  SiRNA target sequence
atacggatcttttggtatttcagac

SEQ ID NO: 76587 - DNA, 25 bp, Artificial sequence
  SiRNA target sequence
tacggatcttttggtatttcagacg

SEQ ID NO: 76588 - DNA, 25 bp, Artificial sequence
  SiRNA target sequence
acggatcttttggtatttcagacga

SEQ ID NO: 76589 - DNA, 25 bp, Artificial sequence
  SiRNA target sequence
cggatcttttggtatttcagacgag

SEQ ID NO: 76590 - DNA, 25 bp, Artificial sequence
  SiRNA target sequence
ggatcttttggtatttcagacgagg

SEQ ID NO: 76591 - DNA, 25 bp, Artificial sequence
  SiRNA target sequence
gatcttttggtatttcagacgagga

SEQ ID NO: 76592 - DNA, 25 bp, Artificial sequence
  SiRNA target sequence
atcttttggtatttcagacgaggat

SEQ ID NO: 76593 - DNA, 25 bp, Artificial sequence
  SiRNA target sequence
tcttttggtatttcagacgaggata

SEQ ID NO: 76594 - DNA, 25 bp, Artificial sequence
  SiRNA target sequence
cttttggtatttcagacgaggatat

SEQ ID NO: 76595 - DNA, 25 bp, Artificial sequence
  SiRNA target sequence
ttttggtatttcagacgaggatatt

SEQ ID NO: 76596 - DNA, 25 bp, Artificial sequence
  SiRNA target sequence
tttggtatttcagacgaggatattt

SEQ ID NO: 76597 - DNA, 25 bp, Artificial sequence
  SiRNA target sequence
ttggtatttcagacgaggatatttt

SEQ ID NO: 76598 - DNA, 25 bp, Artificial sequence
  SiRNA target sequence
tggtatttcagacgaggatattttt

SEQ ID NO: 76599 - DNA, 25 bp, Artificial sequence
  SiRNA target sequence
ggtatttcagacgaggatatttttg

SEQ ID NO: 76600 - DNA, 25 bp, Artificial sequence
  SiRNA target sequence
gtatttcagacgaggatatttttgc

SEQ ID NO: 76601 - DNA, 25 bp, Artificial sequence
  SiRNA target sequence
tatttcagacgaggatatttttgca

SEQ ID NO: 76602 - DNA, 25 bp, Artificial sequence
  SiRNA target sequence
atttcagacgaggatatttttgcat

SEQ ID NO: 76603 - DNA, 25 bp, Artificial sequence
  SiRNA target sequence
tttcagacgaggatatttttgcatt

SEQ ID NO: 76604 - DNA, 25 bp, Artificial sequence
  SiRNA target sequence
ttcagacgaggatatttttgcattg

SEQ ID NO: 76605 - DNA, 25 bp, Artificial sequence
  SiRNA target sequence
tcagacgaggatatttttgcattgt

SEQ ID NO: 76606 - DNA, 25 bp, Artificial sequence
  SiRNA target sequence
cagacgaggatatttttgcattgtg

SEQ ID NO: 76607 - DNA, 25 bp, Artificial sequence
  SiRNA target sequence
agacgaggatatttttgcattgtgt

SEQ ID NO: 76608 - DNA, 25 bp, Artificial sequence
  SiRNA target sequence
gacgaggatatttttgcattgtgta

SEQ ID NO: 76609 - DNA, 25 bp, Artificial sequence
  SiRNA target sequence
acgaggatatttttgcattgtgtaa

SEQ ID NO: 76610 - DNA, 25 bp, Artificial sequence
  SiRNA target sequence
cgaggatatttttgcattgtgtaaa

SEQ ID NO: 76611 - DNA, 25 bp, Artificial sequence
  SiRNA target sequence
gaggatatttttgcattgtgtaaag

SEQ ID NO: 76612 - DNA, 25 bp, Artificial sequence
  SiRNA target sequence
aggatatttttgcattgtgtaaaga

SEQ ID NO: 76613 - DNA, 25 bp, Artificial sequence
  SiRNA target sequence
ggatatttttgcattgtgtaaagag

SEQ ID NO: 76614 - DNA, 25 bp, Artificial sequence
  SiRNA target sequence
gatatttttgcattgtgtaaagagt

SEQ ID NO: 76615 - DNA, 25 bp, Artificial sequence
  SiRNA target sequence
atatttttgcattgtgtaaagagtt

SEQ ID NO: 76616 - DNA, 25 bp, Artificial sequence
  SiRNA target sequence
tatttttgcattgtgtaaagagttt

SEQ ID NO: 76617 - DNA, 25 bp, Artificial sequence
  SiRNA target sequence
atttttgcattgtgtaaagagtttg

SEQ ID NO: 76618 - DNA, 25 bp, Artificial sequence
  SiRNA target sequence
tttttgcattgtgtaaagagtttgg

SEQ ID NO: 76619 - DNA, 25 bp, Artificial sequence
  SiRNA target sequence
ttttgcattgtgtaaagagtttgga

SEQ ID NO: 76620 - DNA, 25 bp, Artificial sequence
  SiRNA target sequence
tttgcattgtgtaaagagtttggat

SEQ ID NO: 76621 - DNA, 25 bp, Artificial sequence
  SiRNA target sequence
ttgcattgtgtaaagagtttggatt

SEQ ID NO: 76622 - DNA, 25 bp, Artificial sequence
  SiRNA target sequence
tgcattgtgtaaagagtttggatta

SEQ ID NO: 76623 - DNA, 25 bp, Artificial sequence
  SiRNA target sequence
gcattgtgtaaagagtttggattat

SEQ ID NO: 76624 - DNA, 25 bp, Artificial sequence
  SiRNA target sequence
cattgtgtaaagagtttggattata

SEQ ID NO: 76625 - DNA, 25 bp, Artificial sequence
  SiRNA target sequence
attgtgtaaagagtttggattatat

SEQ ID NO: 76626 - DNA, 25 bp, Artificial sequence
  SiRNA target sequence
ttgtgtaaagagtttggattatatg

SEQ ID NO: 76627 - DNA, 25 bp, Artificial sequence
  SiRNA target sequence
tgtgtaaagagtttggattatatga

SEQ ID NO: 76628 - DNA, 25 bp, Artificial sequence
  SiRNA target sequence
gtgtaaagagtttggattatatgac

SEQ ID NO: 76629 - DNA, 25 bp, Artificial sequence
  SiRNA target sequence
tgtaaagagtttggattatatgacg

SEQ ID NO: 76630 - DNA, 25 bp, Artificial sequence
  SiRNA target sequence
gtaaagagtttggattatatgacgt

SEQ ID NO: 76631 - DNA, 25 bp, Artificial sequence
  SiRNA target sequence
taaagagtttggattatatgacgtt

SEQ ID NO: 76632 - DNA, 25 bp, Artificial sequence
  SiRNA target sequence
aaagagtttggattatatgacgttt

SEQ ID NO: 76633 - DNA, 25 bp, Artificial sequence
  SiRNA target sequence
aagagtttggattatatgacgtttt

SEQ ID NO: 76634 - DNA, 25 bp, Artificial sequence
  SiRNA target sequence
agagtttggattatatgacgttttc

SEQ ID NO: 76635 - DNA, 25 bp, Artificial sequence
  SiRNA target sequence
gagtttggattatatgacgttttca

SEQ ID NO: 76636 - DNA, 25 bp, Artificial sequence
  SiRNA target sequence
agtttggattatatgacgttttcat

SEQ ID NO: 76637 - DNA, 25 bp, Artificial sequence
  SiRNA target sequence
gtttggattatatgacgttttcatg

SEQ ID NO: 76638 - DNA, 25 bp, Artificial sequence
  SiRNA target sequence
tttggattatatgacgttttcatga

SEQ ID NO: 76639 - DNA, 25 bp, Artificial sequence
  SiRNA target sequence
ttggattatatgacgttttcatgaa

SEQ ID NO: 76640 - DNA, 25 bp, Artificial sequence
  SiRNA target sequence
tggattatatgacgttttcatgaac

SEQ ID NO: 76641 - DNA, 25 bp, Artificial sequence
  SiRNA target sequence
ggattatatgacgttttcatgaacc

SEQ ID NO: 76642 - DNA, 25 bp, Artificial sequence
  SiRNA target sequence
gattatatgacgttttcatgaacct

SEQ ID NO: 76643 - DNA, 25 bp, Artificial sequence
  SiRNA target sequence
attatatgacgttttcatgaacctc

SEQ ID NO: 76644 - DNA, 25 bp, Artificial sequence
  SiRNA target sequence
ttatatgacgttttcatgaacctcg

SEQ ID NO: 76645 - DNA, 25 bp, Artificial sequence
  SiRNA target sequence
tatatgacgttttcatgaacctcga

SEQ ID NO: 76646 - DNA, 25 bp, Artificial sequence
  SiRNA target sequence
atatgacgttttcatgaacctcgaa

SEQ ID NO: 76647 - DNA, 25 bp, Artificial sequence
  SiRNA target sequence
tatgacgttttcatgaacctcgaaa

SEQ ID NO: 76648 - DNA, 25 bp, Artificial sequence
  SiRNA target sequence
atgacgttttcatgaacctcgaaaa

SEQ ID NO: 76649 - DNA, 25 bp, Artificial sequence
  SiRNA target sequence
tgacgttttcatgaacctcgaaaat

SEQ ID NO: 76650 - DNA, 25 bp, Artificial sequence
  SiRNA target sequence
gacgttttcatgaacctcgaaaatg

SEQ ID NO: 76651 - DNA, 25 bp, Artificial sequence
  SiRNA target sequence
acgttttcatgaacctcgaaaatgg

SEQ ID NO: 76652 - DNA, 25 bp, Artificial sequence
  SiRNA target sequence
cgttttcatgaacctcgaaaatggt

SEQ ID NO: 76653 - DNA, 25 bp, Artificial sequence
  SiRNA target sequence
gttttcatgaacctcgaaaatggtt

SEQ ID NO: 76654 - DNA, 25 bp, Artificial sequence
  SiRNA target sequence
ttttcatgaacctcgaaaatggttt

SEQ ID NO: 76655 - DNA, 25 bp, Artificial sequence
  SiRNA target sequence
tttcatgaacctcgaaaatggtttt

SEQ ID NO: 76656 - DNA, 25 bp, Artificial sequence
  SiRNA target sequence
ttcatgaacctcgaaaatggttttg

SEQ ID NO: 76657 - DNA, 25 bp, Artificial sequence
  SiRNA target sequence
tcatgaacctcgaaaatggttttga

SEQ ID NO: 76658 - DNA, 25 bp, Artificial sequence
  SiRNA target sequence
catgaacctcgaaaatggttttgat

SEQ ID NO: 76659 - DNA, 25 bp, Artificial sequence
  SiRNA target sequence
atgaacctcgaaaatggttttgata

SEQ ID NO: 76660 - DNA, 25 bp, Artificial sequence
  SiRNA target sequence
tgaacctcgaaaatggttttgatac

SEQ ID NO: 76661 - DNA, 25 bp, Artificial sequence
  SiRNA target sequence
gaacctcgaaaatggttttgatacg

SEQ ID NO: 76662 - DNA, 25 bp, Artificial sequence
  SiRNA target sequence
aacctcgaaaatggttttgatacga

SEQ ID NO: 76663 - DNA, 25 bp, Artificial sequence
  SiRNA target sequence
acctcgaaaatggttttgatacgaa

SEQ ID NO: 76664 - DNA, 25 bp, Artificial sequence
  SiRNA target sequence
cctcgaaaatggttttgatacgaat

SEQ ID NO: 76665 - DNA, 25 bp, Artificial sequence
  SiRNA target sequence
ctcgaaaatggttttgatacgaatg

SEQ ID NO: 76666 - DNA, 25 bp, Artificial sequence
  SiRNA target sequence
tcgaaaatggttttgatacgaatgt

SEQ ID NO: 76667 - DNA, 25 bp, Artificial sequence
  SiRNA target sequence
cgaaaatggttttgatacgaatgta

SEQ ID NO: 76668 - DNA, 25 bp, Artificial sequence
  SiRNA target sequence
gaaaatggttttgatacgaatgtag

SEQ ID NO: 76669 - DNA, 25 bp, Artificial sequence
  SiRNA target sequence
aaaatggttttgatacgaatgtagg

SEQ ID NO: 76670 - DNA, 25 bp, Artificial sequence
  SiRNA target sequence
aaatggttttgatacgaatgtagga

SEQ ID NO: 76671 - DNA, 25 bp, Artificial sequence
  SiRNA target sequence
aatggttttgatacgaatgtaggag

SEQ ID NO: 76672 - DNA, 25 bp, Artificial sequence
  SiRNA target sequence
atggttttgatacgaatgtaggaga

SEQ ID NO: 76673 - DNA, 25 bp, Artificial sequence
  SiRNA target sequence
tggttttgatacgaatgtaggagaa

SEQ ID NO: 76674 - DNA, 25 bp, Artificial sequence
  SiRNA target sequence
ggttttgatacgaatgtaggagaaa

SEQ ID NO: 76675 - DNA, 25 bp, Artificial sequence
  SiRNA target sequence
gttttgatacgaatgtaggagaaag

SEQ ID NO: 76676 - DNA, 25 bp, Artificial sequence
  SiRNA target sequence
ttttgatacgaatgtaggagaaaga

SEQ ID NO: 76677 - DNA, 25 bp, Artificial sequence
  SiRNA target sequence
tttgatacgaatgtaggagaaagag

SEQ ID NO: 76678 - DNA, 25 bp, Artificial sequence
  SiRNA target sequence
ttgatacgaatgtaggagaaagagg

SEQ ID NO: 76679 - DNA, 25 bp, Artificial sequence
  SiRNA target sequence
tgatacgaatgtaggagaaagagga

SEQ ID NO: 76680 - DNA, 25 bp, Artificial sequence
  SiRNA target sequence
gatacgaatgtaggagaaagaggaa

SEQ ID NO: 76681 - DNA, 25 bp, Artificial sequence
  SiRNA target sequence
atacgaatgtaggagaaagaggaag

SEQ ID NO: 76682 - DNA, 25 bp, Artificial sequence
  SiRNA target sequence
tacgaatgtaggagaaagaggaagg

SEQ ID NO: 76683 - DNA, 25 bp, Artificial sequence
  SiRNA target sequence
acgaatgtaggagaaagaggaaggt

SEQ ID NO: 76684 - DNA, 25 bp, Artificial sequence
  SiRNA target sequence
cgaatgtaggagaaagaggaaggtt

SEQ ID NO: 76685 - DNA, 25 bp, Artificial sequence
  SiRNA target sequence
gaatgtaggagaaagaggaaggtta

SEQ ID NO: 76686 - DNA, 25 bp, Artificial sequence
  SiRNA target sequence
aatgtaggagaaagaggaaggttat

SEQ ID NO: 76687 - DNA, 25 bp, Artificial sequence
  SiRNA target sequence
atgtaggagaaagaggaaggttatt

SEQ ID NO: 76688 - DNA, 25 bp, Artificial sequence
  SiRNA target sequence
tgtaggagaaagaggaaggttatta

SEQ ID NO: 76689 - DNA, 25 bp, Artificial sequence
  SiRNA target sequence
gtaggagaaagaggaaggttattaa

SEQ ID NO: 76690 - DNA, 25 bp, Artificial sequence
  SiRNA target sequence
taggagaaagaggaaggttattaag

SEQ ID NO: 76691 - DNA, 25 bp, Artificial sequence
  SiRNA target sequence
aggagaaagaggaaggttattaagt

SEQ ID NO: 76692 - DNA, 25 bp, Artificial sequence
  SiRNA target sequence
ggagaaagaggaaggttattaagtg

SEQ ID NO: 76693 - DNA, 25 bp, Artificial sequence
  SiRNA target sequence
gagaaagaggaaggttattaagtgg

SEQ ID NO: 76694 - DNA, 25 bp, Artificial sequence
  SiRNA target sequence
agaaagaggaaggttattaagtggt

SEQ ID NO: 76695 - DNA, 25 bp, Artificial sequence
  SiRNA target sequence
gaaagaggaaggttattaagtggtg

SEQ ID NO: 76696 - DNA, 25 bp, Artificial sequence
  SiRNA target sequence
aaagaggaaggttattaagtggtgg

SEQ ID NO: 76697 - DNA, 25 bp, Artificial sequence
  SiRNA target sequence
aagaggaaggttattaagtggtgga

SEQ ID NO: 76698 - DNA, 25 bp, Artificial sequence
  SiRNA target sequence
agaggaaggttattaagtggtggag

SEQ ID NO: 76699 - DNA, 25 bp, Artificial sequence
  SiRNA target sequence
gaggaaggttattaagtggtggaga

SEQ ID NO: 76700 - DNA, 25 bp, Artificial sequence
  SiRNA target sequence
aggaaggttattaagtggtggagaa

SEQ ID NO: 76701 - DNA, 25 bp, Artificial sequence
  SiRNA target sequence
ggaaggttattaagtggtggagaaa

SEQ ID NO: 76702 - DNA, 25 bp, Artificial sequence
  SiRNA target sequence
gaaggttattaagtggtggagaaaa

SEQ ID NO: 76703 - DNA, 25 bp, Artificial sequence
  SiRNA target sequence
aaggttattaagtggtggagaaaag

SEQ ID NO: 76704 - DNA, 25 bp, Artificial sequence
  SiRNA target sequence
aggttattaagtggtggagaaaagc

SEQ ID NO: 76705 - DNA, 25 bp, Artificial sequence
  SiRNA target sequence
ggttattaagtggtggagaaaagca

SEQ ID NO: 76706 - DNA, 25 bp, Artificial sequence
  SiRNA target sequence
gttattaagtggtggagaaaagcaa

SEQ ID NO: 76707 - DNA, 25 bp, Artificial sequence
  SiRNA target sequence
ttattaagtggtggagaaaagcaaa

SEQ ID NO: 76708 - DNA, 25 bp, Artificial sequence
  SiRNA target sequence
tattaagtggtggagaaaagcaaaa

SEQ ID NO: 76709 - DNA, 25 bp, Artificial sequence
  SiRNA target sequence
attaagtggtggagaaaagcaaaag

SEQ ID NO: 76710 - DNA, 25 bp, Artificial sequence
  SiRNA target sequence
ttaagtggtggagaaaagcaaaaga

SEQ ID NO: 76711 - DNA, 25 bp, Artificial sequence
  SiRNA target sequence
taagtggtggagaaaagcaaaagat

SEQ ID NO: 76712 - DNA, 25 bp, Artificial sequence
  SiRNA target sequence
aagtggtggagaaaagcaaaagatt

SEQ ID NO: 76713 - DNA, 25 bp, Artificial sequence
  SiRNA target sequence
agtggtggagaaaagcaaaagattt

SEQ ID NO: 76714 - DNA, 25 bp, Artificial sequence
  SiRNA target sequence
gtggtggagaaaagcaaaagatttt

SEQ ID NO: 76715 - DNA, 25 bp, Artificial sequence
  SiRNA target sequence
tggtggagaaaagcaaaagatttta

SEQ ID NO: 76716 - DNA, 25 bp, Artificial sequence
  SiRNA target sequence
ggtggagaaaagcaaaagattttat

SEQ ID NO: 76717 - DNA, 25 bp, Artificial sequence
  SiRNA target sequence
gtggagaaaagcaaaagattttatt

SEQ ID NO: 76718 - DNA, 25 bp, Artificial sequence
  SiRNA target sequence
tggagaaaagcaaaagattttatta

SEQ ID NO: 76719 - DNA, 25 bp, Artificial sequence
  SiRNA target sequence
ggagaaaagcaaaagattttattaa

SEQ ID NO: 76720 - DNA, 25 bp, Artificial sequence
  SiRNA target sequence
gagaaaagcaaaagattttattaat

SEQ ID NO: 76721 - DNA, 25 bp, Artificial sequence
  SiRNA target sequence
agaaaagcaaaagattttattaatg

SEQ ID NO: 76722 - DNA, 25 bp, Artificial sequence
  SiRNA target sequence
gaaaagcaaaagattttattaatgc

SEQ ID NO: 76723 - DNA, 25 bp, Artificial sequence
  SiRNA target sequence
aaaagcaaaagattttattaatgcg

SEQ ID NO: 76724 - DNA, 25 bp, Artificial sequence
  SiRNA target sequence
aaagcaaaagattttattaatgcgt

SEQ ID NO: 76725 - DNA, 25 bp, Artificial sequence
  SiRNA target sequence
aagcaaaagattttattaatgcgta

SEQ ID NO: 76726 - DNA, 25 bp, Artificial sequence
  SiRNA target sequence
agcaaaagattttattaatgcgtac

SEQ ID NO: 76727 - DNA, 25 bp, Artificial sequence
  SiRNA target sequence
gcaaaagattttattaatgcgtact

SEQ ID NO: 76728 - DNA, 25 bp, Artificial sequence
  SiRNA target sequence
caaaagattttattaatgcgtacta

SEQ ID NO: 76729 - DNA, 25 bp, Artificial sequence
  SiRNA target sequence
aaaagattttattaatgcgtactat

SEQ ID NO: 76730 - DNA, 25 bp, Artificial sequence
  SiRNA target sequence
aaagattttattaatgcgtactatg

SEQ ID NO: 76731 - DNA, 25 bp, Artificial sequence
  SiRNA target sequence
aagattttattaatgcgtactatgt

SEQ ID NO: 76732 - DNA, 25 bp, Artificial sequence
  SiRNA target sequence
agattttattaatgcgtactatgtt

SEQ ID NO: 76733 - DNA, 25 bp, Artificial sequence
  SiRNA target sequence
gattttattaatgcgtactatgtta

SEQ ID NO: 76734 - DNA, 25 bp, Artificial sequence
  SiRNA target sequence
attttattaatgcgtactatgttaa

SEQ ID NO: 76735 - DNA, 25 bp, Artificial sequence
  SiRNA target sequence
ttttattaatgcgtactatgttaag

SEQ ID NO: 76736 - DNA, 25 bp, Artificial sequence
  SiRNA target sequence
tttattaatgcgtactatgttaaga

SEQ ID NO: 76737 - DNA, 25 bp, Artificial sequence
  SiRNA target sequence
ttattaatgcgtactatgttaagaa

SEQ ID NO: 76738 - DNA, 25 bp, Artificial sequence
  SiRNA target sequence
tattaatgcgtactatgttaagaaa

SEQ ID NO: 76739 - DNA, 25 bp, Artificial sequence
  SiRNA target sequence
attaatgcgtactatgttaagaaac

SEQ ID NO: 76740 - DNA, 25 bp, Artificial sequence
  SiRNA target sequence
ttaatgcgtactatgttaagaaaca

SEQ ID NO: 76741 - DNA, 25 bp, Artificial sequence
  SiRNA target sequence
taatgcgtactatgttaagaaacaa

SEQ ID NO: 76742 - DNA, 25 bp, Artificial sequence
  SiRNA target sequence
aatgcgtactatgttaagaaacaag

SEQ ID NO: 76743 - DNA, 25 bp, Artificial sequence
  SiRNA target sequence
atgcgtactatgttaagaaacaagg

SEQ ID NO: 76744 - DNA, 25 bp, Artificial sequence
  SiRNA target sequence
tgcgtactatgttaagaaacaagga

SEQ ID NO: 76745 - DNA, 25 bp, Artificial sequence
  SiRNA target sequence
gcgtactatgttaagaaacaaggag

SEQ ID NO: 76746 - DNA, 25 bp, Artificial sequence
  SiRNA target sequence
cgtactatgttaagaaacaaggaga

SEQ ID NO: 76747 - DNA, 25 bp, Artificial sequence
  SiRNA target sequence
gtactatgttaagaaacaaggagat

SEQ ID NO: 76748 - DNA, 25 bp, Artificial sequence
  SiRNA target sequence
tactatgttaagaaacaaggagata

SEQ ID NO: 76749 - DNA, 25 bp, Artificial sequence
  SiRNA target sequence
actatgttaagaaacaaggagataa

SEQ ID NO: 76750 - DNA, 25 bp, Artificial sequence
  SiRNA target sequence
ctatgttaagaaacaaggagataat

SEQ ID NO: 76751 - DNA, 25 bp, Artificial sequence
  SiRNA target sequence
tatgttaagaaacaaggagataatg

SEQ ID NO: 76752 - DNA, 25 bp, Artificial sequence
  SiRNA target sequence
atgttaagaaacaaggagataatgg

SEQ ID NO: 76753 - DNA, 25 bp, Artificial sequence
  SiRNA target sequence
tgttaagaaacaaggagataatggc

SEQ ID NO: 76754 - DNA, 25 bp, Artificial sequence
  SiRNA target sequence
gttaagaaacaaggagataatggca

SEQ ID NO: 76755 - DNA, 25 bp, Artificial sequence
  SiRNA target sequence
ttaagaaacaaggagataatggcat

SEQ ID NO: 76756 - DNA, 25 bp, Artificial sequence
  SiRNA target sequence
taagaaacaaggagataatggcatt

SEQ ID NO: 76757 - DNA, 25 bp, Artificial sequence
  SiRNA target sequence
aagaaacaaggagataatggcatta

SEQ ID NO: 76758 - DNA, 25 bp, Artificial sequence
  SiRNA target sequence
agaaacaaggagataatggcattag

SEQ ID NO: 76759 - DNA, 25 bp, Artificial sequence
  SiRNA target sequence
gaaacaaggagataatggcattaga

SEQ ID NO: 76760 - DNA, 25 bp, Artificial sequence
  SiRNA target sequence
aaacaaggagataatggcattagat

SEQ ID NO: 76761 - DNA, 25 bp, Artificial sequence
  SiRNA target sequence
aacaaggagataatggcattagatg

SEQ ID NO: 76762 - DNA, 25 bp, Artificial sequence
  SiRNA target sequence
acaaggagataatggcattagatga

SEQ ID NO: 76763 - DNA, 25 bp, Artificial sequence
  SiRNA target sequence
caaggagataatggcattagatgaa

SEQ ID NO: 76764 - DNA, 25 bp, Artificial sequence
  SiRNA target sequence
aaggagataatggcattagatgaac

SEQ ID NO: 76765 - DNA, 25 bp, Artificial sequence
  SiRNA target sequence
aggagataatggcattagatgaacc

SEQ ID NO: 76766 - DNA, 25 bp, Artificial sequence
  SiRNA target sequence
ggagataatggcattagatgaaccc

SEQ ID NO: 76767 - DNA, 25 bp, Artificial sequence
  SiRNA target sequence
gagataatggcattagatgaaccca

SEQ ID NO: 76768 - DNA, 25 bp, Artificial sequence
  SiRNA target sequence
agataatggcattagatgaacccac

SEQ ID NO: 76769 - DNA, 25 bp, Artificial sequence
  SiRNA target sequence
gataatggcattagatgaacccact

SEQ ID NO: 76770 - DNA, 25 bp, Artificial sequence
  SiRNA target sequence
ataatggcattagatgaacccactg

SEQ ID NO: 76771 - DNA, 25 bp, Artificial sequence
  SiRNA target sequence
taatggcattagatgaacccactgc

SEQ ID NO: 76772 - DNA, 25 bp, Artificial sequence
  SiRNA target sequence
aatggcattagatgaacccactgca

SEQ ID NO: 76773 - DNA, 25 bp, Artificial sequence
  SiRNA target sequence
atggcattagatgaacccactgcag

SEQ ID NO: 76774 - DNA, 25 bp, Artificial sequence
  SiRNA target sequence
tggcattagatgaacccactgcagc

SEQ ID NO: 76775 - DNA, 25 bp, Artificial sequence
  SiRNA target sequence
ggcattagatgaacccactgcagca

SEQ ID NO: 76776 - DNA, 25 bp, Artificial sequence
  SiRNA target sequence
gcattagatgaacccactgcagcac

SEQ ID NO: 76777 - DNA, 25 bp, Artificial sequence
  SiRNA target sequence
cattagatgaacccactgcagcact

SEQ ID NO: 76778 - DNA, 25 bp, Artificial sequence
  SiRNA target sequence
attagatgaacccactgcagcactt

SEQ ID NO: 76779 - DNA, 25 bp, Artificial sequence
  SiRNA target sequence
ttagatgaacccactgcagcacttg

SEQ ID NO: 76780 - DNA, 25 bp, Artificial sequence
  SiRNA target sequence
tagatgaacccactgcagcacttga

SEQ ID NO: 76781 - DNA, 25 bp, Artificial sequence
  SiRNA target sequence
agatgaacccactgcagcacttgat

SEQ ID NO: 76782 - DNA, 25 bp, Artificial sequence
  SiRNA target sequence
gatgaacccactgcagcacttgata

SEQ ID NO: 76783 - DNA, 25 bp, Artificial sequence
  SiRNA target sequence
atgaacccactgcagcacttgataa

SEQ ID NO: 76784 - DNA, 25 bp, Artificial sequence
  SiRNA target sequence
tgaacccactgcagcacttgataag

SEQ ID NO: 76785 - DNA, 25 bp, Artificial sequence
  SiRNA target sequence
gaacccactgcagcacttgataagg

SEQ ID NO: 76786 - DNA, 25 bp, Artificial sequence
  SiRNA target sequence
aacccactgcagcacttgataagga

SEQ ID NO: 76787 - DNA, 25 bp, Artificial sequence
  SiRNA target sequence
acccactgcagcacttgataaggag

SEQ ID NO: 76788 - DNA, 25 bp, Artificial sequence
  SiRNA target sequence
cccactgcagcacttgataaggagt

SEQ ID NO: 76789 - DNA, 25 bp, Artificial sequence
  SiRNA target sequence
ccactgcagcacttgataaggagtc

SEQ ID NO: 76790 - DNA, 25 bp, Artificial sequence
  SiRNA target sequence
cactgcagcacttgataaggagtct

SEQ ID NO: 76791 - DNA, 25 bp, Artificial sequence
  SiRNA target sequence
actgcagcacttgataaggagtctg

SEQ ID NO: 76792 - DNA, 25 bp, Artificial sequence
  SiRNA target sequence
ctgcagcacttgataaggagtctga

SEQ ID NO: 76793 - DNA, 25 bp, Artificial sequence
  SiRNA target sequence
tgcagcacttgataaggagtctgaa

SEQ ID NO: 76794 - DNA, 25 bp, Artificial sequence
  SiRNA target sequence
gcagcacttgataaggagtctgaaa

SEQ ID NO: 76795 - DNA, 25 bp, Artificial sequence
  SiRNA target sequence
cagcacttgataaggagtctgaaaa

SEQ ID NO: 76796 - DNA, 25 bp, Artificial sequence
  SiRNA target sequence
agcacttgataaggagtctgaaaaa

SEQ ID NO: 76797 - DNA, 25 bp, Artificial sequence
  SiRNA target sequence
gcacttgataaggagtctgaaaaaa

SEQ ID NO: 76798 - DNA, 25 bp, Artificial sequence
  SiRNA target sequence
cacttgataaggagtctgaaaaaaa

SEQ ID NO: 76799 - DNA, 25 bp, Artificial sequence
  SiRNA target sequence
acttgataaggagtctgaaaaaaag

SEQ ID NO: 76800 - DNA, 25 bp, Artificial sequence
  SiRNA target sequence
cttgataaggagtctgaaaaaaaga

SEQ ID NO: 76801 - DNA, 25 bp, Artificial sequence
  SiRNA target sequence
ttgataaggagtctgaaaaaaagat

SEQ ID NO: 76802 - DNA, 25 bp, Artificial sequence
  SiRNA target sequence
tgataaggagtctgaaaaaaagatt

SEQ ID NO: 76803 - DNA, 25 bp, Artificial sequence
  SiRNA target sequence
gataaggagtctgaaaaaaagattt

SEQ ID NO: 76804 - DNA, 25 bp, Artificial sequence
  SiRNA target sequence
ataaggagtctgaaaaaaagatttt

SEQ ID NO: 76805 - DNA, 25 bp, Artificial sequence
  SiRNA target sequence
taaggagtctgaaaaaaagatttta

SEQ ID NO: 76806 - DNA, 25 bp, Artificial sequence
  SiRNA target sequence
aaggagtctgaaaaaaagattttag

SEQ ID NO: 76807 - DNA, 25 bp, Artificial sequence
  SiRNA target sequence
aggagtctgaaaaaaagattttaga

SEQ ID NO: 76808 - DNA, 25 bp, Artificial sequence
  SiRNA target sequence
ggagtctgaaaaaaagattttagag

SEQ ID NO: 76809 - DNA, 25 bp, Artificial sequence
  SiRNA target sequence
gagtctgaaaaaaagattttagaga

SEQ ID NO: 76810 - DNA, 25 bp, Artificial sequence
  SiRNA target sequence
agtctgaaaaaaagattttagagat

SEQ ID NO: 76811 - DNA, 25 bp, Artificial sequence
  SiRNA target sequence
gtctgaaaaaaagattttagagata

SEQ ID NO: 76812 - DNA, 25 bp, Artificial sequence
  SiRNA target sequence
tctgaaaaaaagattttagagataa

SEQ ID NO: 76813 - DNA, 25 bp, Artificial sequence
  SiRNA target sequence
ctgaaaaaaagattttagagataat

SEQ ID NO: 76814 - DNA, 25 bp, Artificial sequence
  SiRNA target sequence
tgaaaaaaagattttagagataatt

SEQ ID NO: 76815 - DNA, 25 bp, Artificial sequence
  SiRNA target sequence
gaaaaaaagattttagagataattt

SEQ ID NO: 76816 - DNA, 25 bp, Artificial sequence
  SiRNA target sequence
aaaaaaagattttagagataatttt

SEQ ID NO: 76817 - DNA, 25 bp, Artificial sequence
  SiRNA target sequence
aaaaaagattttagagataatttta

SEQ ID NO: 76818 - DNA, 25 bp, Artificial sequence
  SiRNA target sequence
aaaaagattttagagataattttac

SEQ ID NO: 76819 - DNA, 25 bp, Artificial sequence
  SiRNA target sequence
aaaagattttagagataattttaca

SEQ ID NO: 76820 - DNA, 25 bp, Artificial sequence
  SiRNA target sequence
aaagattttagagataattttacaa

SEQ ID NO: 76821 - DNA, 25 bp, Artificial sequence
  SiRNA target sequence
aagattttagagataattttacaac

SEQ ID NO: 76822 - DNA, 25 bp, Artificial sequence
  SiRNA target sequence
agattttagagataattttacaaca

SEQ ID NO: 76823 - DNA, 25 bp, Artificial sequence
  SiRNA target sequence
gattttagagataattttacaacag

SEQ ID NO: 76824 - DNA, 25 bp, Artificial sequence
  SiRNA target sequence
attttagagataattttacaacagg

SEQ ID NO: 76825 - DNA, 25 bp, Artificial sequence
  SiRNA target sequence
ttttagagataattttacaacagga

SEQ ID NO: 76826 - DNA, 25 bp, Artificial sequence
  SiRNA target sequence
tttagagataattttacaacaggaa

SEQ ID NO: 76827 - DNA, 25 bp, Artificial sequence
  SiRNA target sequence
ttagagataattttacaacaggaag

SEQ ID NO: 76828 - DNA, 25 bp, Artificial sequence
  SiRNA target sequence
tagagataattttacaacaggaaga

SEQ ID NO: 76829 - DNA, 25 bp, Artificial sequence
  SiRNA target sequence
agagataattttacaacaggaagat

SEQ ID NO: 76830 - DNA, 25 bp, Artificial sequence
  SiRNA target sequence
gagataattttacaacaggaagatc

SEQ ID NO: 76831 - DNA, 25 bp, Artificial sequence
  SiRNA target sequence
agataattttacaacaggaagatcg

SEQ ID NO: 76832 - DNA, 25 bp, Artificial sequence
  SiRNA target sequence
gataattttacaacaggaagatcga

SEQ ID NO: 76833 - DNA, 25 bp, Artificial sequence
  SiRNA target sequence
ataattttacaacaggaagatcgaa

SEQ ID NO: 76834 - DNA, 25 bp, Artificial sequence
  SiRNA target sequence
taattttacaacaggaagatcgaac

SEQ ID NO: 76835 - DNA, 25 bp, Artificial sequence
  SiRNA target sequence
aattttacaacaggaagatcgaaca

SEQ ID NO: 76836 - DNA, 25 bp, Artificial sequence
  SiRNA target sequence
attttacaacaggaagatcgaacag

SEQ ID NO: 76837 - DNA, 25 bp, Artificial sequence
  SiRNA target sequence
ttttacaacaggaagatcgaacagt

SEQ ID NO: 76838 - DNA, 25 bp, Artificial sequence
  SiRNA target sequence
tttacaacaggaagatcgaacagtt

SEQ ID NO: 76839 - DNA, 25 bp, Artificial sequence
  SiRNA target sequence
ttacaacaggaagatcgaacagttt

SEQ ID NO: 76840 - DNA, 25 bp, Artificial sequence
  SiRNA target sequence
tacaacaggaagatcgaacagtttt

SEQ ID NO: 76841 - DNA, 25 bp, Artificial sequence
  SiRNA target sequence
acaacaggaagatcgaacagttttg

SEQ ID NO: 76842 - DNA, 25 bp, Artificial sequence
  SiRNA target sequence
caacaggaagatcgaacagttttga

SEQ ID NO: 76843 - DNA, 25 bp, Artificial sequence
  SiRNA target sequence
aacaggaagatcgaacagttttgat

SEQ ID NO: 76844 - DNA, 25 bp, Artificial sequence
  SiRNA target sequence
acaggaagatcgaacagttttgatg

SEQ ID NO: 76845 - DNA, 25 bp, Artificial sequence
  SiRNA target sequence
caggaagatcgaacagttttgatga

SEQ ID NO: 76846 - DNA, 25 bp, Artificial sequence
  SiRNA target sequence
aggaagatcgaacagttttgatgat

SEQ ID NO: 76847 - DNA, 25 bp, Artificial sequence
  SiRNA target sequence
ggaagatcgaacagttttgatgata

SEQ ID NO: 76848 - DNA, 25 bp, Artificial sequence
  SiRNA target sequence
gaagatcgaacagttttgatgataa

SEQ ID NO: 76849 - DNA, 25 bp, Artificial sequence
  SiRNA target sequence
aagatcgaacagttttgatgataat

SEQ ID NO: 76850 - DNA, 25 bp, Artificial sequence
  SiRNA target sequence
agatcgaacagttttgatgataatt

SEQ ID NO: 76851 - DNA, 25 bp, Artificial sequence
  SiRNA target sequence
gatcgaacagttttgatgataattc

SEQ ID NO: 76852 - DNA, 25 bp, Artificial sequence
  SiRNA target sequence
atcgaacagttttgatgataattca

SEQ ID NO: 76853 - DNA, 25 bp, Artificial sequence
  SiRNA target sequence
tcgaacagttttgatgataattcat

SEQ ID NO: 76854 - DNA, 25 bp, Artificial sequence
  SiRNA target sequence
cgaacagttttgatgataattcata

SEQ ID NO: 76855 - DNA, 25 bp, Artificial sequence
  SiRNA target sequence
gaacagttttgatgataattcataa

SEQ ID NO: 76856 - DNA, 25 bp, Artificial sequence
  SiRNA target sequence
aacagttttgatgataattcataat

SEQ ID NO: 76857 - DNA, 25 bp, Artificial sequence
  SiRNA target sequence
acagttttgatgataattcataatc

SEQ ID NO: 76858 - DNA, 25 bp, Artificial sequence
  SiRNA target sequence
cagttttgatgataattcataatct

SEQ ID NO: 76859 - DNA, 25 bp, Artificial sequence
  SiRNA target sequence
agttttgatgataattcataatcta

SEQ ID NO: 76860 - DNA, 25 bp, Artificial sequence
  SiRNA target sequence
gttttgatgataattcataatctag

SEQ ID NO: 76861 - DNA, 25 bp, Artificial sequence
  SiRNA target sequence
ttttgatgataattcataatctaga

SEQ ID NO: 76862 - DNA, 25 bp, Artificial sequence
  SiRNA target sequence
tttgatgataattcataatctagaa

SEQ ID NO: 76863 - DNA, 25 bp, Artificial sequence
  SiRNA target sequence
ttgatgataattcataatctagaac

SEQ ID NO: 76864 - DNA, 25 bp, Artificial sequence
  SiRNA target sequence
tgatgataattcataatctagaact

SEQ ID NO: 76865 - DNA, 25 bp, Artificial sequence
  SiRNA target sequence
gatgataattcataatctagaactt

SEQ ID NO: 76866 - DNA, 25 bp, Artificial sequence
  SiRNA target sequence
atgataattcataatctagaactta

SEQ ID NO: 76867 - DNA, 25 bp, Artificial sequence
  SiRNA target sequence
tgataattcataatctagaacttat

SEQ ID NO: 76868 - DNA, 25 bp, Artificial sequence
  SiRNA target sequence
gataattcataatctagaacttatt

SEQ ID NO: 76869 - DNA, 25 bp, Artificial sequence
  SiRNA target sequence
ataattcataatctagaacttatta

SEQ ID NO: 76870 - DNA, 25 bp, Artificial sequence
  SiRNA target sequence
taattcataatctagaacttattaa

SEQ ID NO: 76871 - DNA, 25 bp, Artificial sequence
  SiRNA target sequence
aattcataatctagaacttattaat

SEQ ID NO: 76872 - DNA, 25 bp, Artificial sequence
  SiRNA target sequence
attcataatctagaacttattaata

SEQ ID NO: 76873 - DNA, 25 bp, Artificial sequence
  SiRNA target sequence
ttcataatctagaacttattaataa

SEQ ID NO: 76874 - DNA, 25 bp, Artificial sequence
  SiRNA target sequence
tcataatctagaacttattaataaa

SEQ ID NO: 76875 - DNA, 25 bp, Artificial sequence
  SiRNA target sequence
cataatctagaacttattaataaat

SEQ ID NO: 76876 - DNA, 25 bp, Artificial sequence
  SiRNA target sequence
ataatctagaacttattaataaatt

SEQ ID NO: 76877 - DNA, 25 bp, Artificial sequence
  SiRNA target sequence
taatctagaacttattaataaattt

SEQ ID NO: 76878 - DNA, 25 bp, Artificial sequence
  SiRNA target sequence
aatctagaacttattaataaatttg

SEQ ID NO: 76879 - DNA, 25 bp, Artificial sequence
  SiRNA target sequence
atctagaacttattaataaatttga

SEQ ID NO: 76880 - DNA, 25 bp, Artificial sequence
  SiRNA target sequence
tctagaacttattaataaatttgat

SEQ ID NO: 76881 - DNA, 25 bp, Artificial sequence
  SiRNA target sequence
ctagaacttattaataaatttgata

SEQ ID NO: 76882 - DNA, 25 bp, Artificial sequence
  SiRNA target sequence
tagaacttattaataaatttgataa

SEQ ID NO: 76883 - DNA, 25 bp, Artificial sequence
  SiRNA target sequence
agaacttattaataaatttgataaa

SEQ ID NO: 76884 - DNA, 25 bp, Artificial sequence
  SiRNA target sequence
gaacttattaataaatttgataaaa

SEQ ID NO: 76885 - DNA, 25 bp, Artificial sequence
  SiRNA target sequence
aacttattaataaatttgataaaat

SEQ ID NO: 76886 - DNA, 25 bp, Artificial sequence
  SiRNA target sequence
acttattaataaatttgataaaata

SEQ ID NO: 76887 - DNA, 25 bp, Artificial sequence
  SiRNA target sequence
cttattaataaatttgataaaataa

SEQ ID NO: 76888 - DNA, 25 bp, Artificial sequence
  SiRNA target sequence
ttattaataaatttgataaaataat

SEQ ID NO: 76889 - DNA, 25 bp, Artificial sequence
  SiRNA target sequence
tattaataaatttgataaaataatt

SEQ ID NO: 76890 - DNA, 25 bp, Artificial sequence
  SiRNA target sequence
attaataaatttgataaaataattt

SEQ ID NO: 76891 - DNA, 25 bp, Artificial sequence
  SiRNA target sequence
ttaataaatttgataaaataattta

SEQ ID NO: 76892 - DNA, 25 bp, Artificial sequence
  SiRNA target sequence
taataaatttgataaaataatttac

SEQ ID NO: 76893 - DNA, 25 bp, Artificial sequence
  SiRNA target sequence
aataaatttgataaaataatttaca

SEQ ID NO: 76894 - DNA, 25 bp, Artificial sequence
  SiRNA target sequence
ataaatttgataaaataatttacat

SEQ ID NO: 76895 - DNA, 25 bp, Artificial sequence
  SiRNA target sequence
taaatttgataaaataatttacatt

SEQ ID NO: 76896 - DNA, 25 bp, Artificial sequence
  SiRNA target sequence
aaatttgataaaataatttacattg

SEQ ID NO: 76897 - DNA, 25 bp, Artificial sequence
  SiRNA target sequence
aatttgataaaataatttacattga

SEQ ID NO: 76898 - DNA, 25 bp, Artificial sequence
  SiRNA target sequence
atttgataaaataatttacattgat

SEQ ID NO: 76899 - DNA, 25 bp, Artificial sequence
  SiRNA target sequence
tttgataaaataatttacattgatg

SEQ ID NO: 76900 - DNA, 25 bp, Artificial sequence
  SiRNA target sequence
ttgataaaataatttacattgatga

SEQ ID NO: 76901 - DNA, 25 bp, Artificial sequence
  SiRNA target sequence
tgataaaataatttacattgatgaa

SEQ ID NO: 76902 - DNA, 25 bp, Artificial sequence
  SiRNA target sequence
gataaaataatttacattgatgaaa

SEQ ID NO: 76903 - DNA, 25 bp, Artificial sequence
  SiRNA target sequence
ataaaataatttacattgatgaaaa

SEQ ID NO: 76904 - DNA, 25 bp, Artificial sequence
  SiRNA target sequence
taaaataatttacattgatgaaaat

SEQ ID NO: 76905 - DNA, 25 bp, Artificial sequence
  SiRNA target sequence
aaaataatttacattgatgaaaata

SEQ ID NO: 76906 - DNA, 25 bp, Artificial sequence
  SiRNA target sequence
aaataatttacattgatgaaaataa

SEQ ID NO: 76907 - DNA, 25 bp, Artificial sequence
  SiRNA target sequence
aataatttacattgatgaaaataat

SEQ ID NO: 76908 - DNA, 25 bp, Artificial sequence
  SiRNA target sequence
ataatttacattgatgaaaataata

SEQ ID NO: 76909 - DNA, 25 bp, Artificial sequence
  SiRNA target sequence
taatttacattgatgaaaataatat

SEQ ID NO: 76910 - DNA, 25 bp, Artificial sequence
  SiRNA target sequence
aatttacattgatgaaaataatata

SEQ ID NO: 76911 - DNA, 25 bp, Artificial sequence
  SiRNA target sequence
atttacattgatgaaaataatatag

SEQ ID NO: 76912 - DNA, 25 bp, Artificial sequence
  SiRNA target sequence
tttacattgatgaaaataatataga

SEQ ID NO: 76913 - DNA, 25 bp, Artificial sequence
  SiRNA target sequence
ttacattgatgaaaataatatagaa

SEQ ID NO: 76914 - DNA, 25 bp, Artificial sequence
  SiRNA target sequence
tacattgatgaaaataatatagaag

SEQ ID NO: 76915 - DNA, 25 bp, Artificial sequence
  SiRNA target sequence
acattgatgaaaataatatagaagt

SEQ ID NO: 76916 - DNA, 25 bp, Artificial sequence
  SiRNA target sequence
cattgatgaaaataatatagaagtc

SEQ ID NO: 76917 - DNA, 25 bp, Artificial sequence
  SiRNA target sequence
attgatgaaaataatatagaagtct

SEQ ID NO: 76918 - DNA, 25 bp, Artificial sequence
  SiRNA target sequence
ttgatgaaaataatatagaagtcta

SEQ ID NO: 76919 - DNA, 25 bp, Artificial sequence
  SiRNA target sequence
tgatgaaaataatatagaagtctat

SEQ ID NO: 76920 - DNA, 25 bp, Artificial sequence
  SiRNA target sequence
gatgaaaataatatagaagtctata

SEQ ID NO: 76921 - DNA, 25 bp, Artificial sequence
  SiRNA target sequence
atgaaaataatatagaagtctataa

SEQ ID NO: 76922 - DNA, 25 bp, Artificial sequence
  SiRNA target sequence
tgaaaataatatagaagtctataaa

SEQ ID NO: 76923 - DNA, 25 bp, Artificial sequence
  SiRNA target sequence
gaaaataatatagaagtctataaaa

SEQ ID NO: 76924 - DNA, 25 bp, Artificial sequence
  SiRNA target sequence
aaaataatatagaagtctataaaaa

SEQ ID NO: 76925 - DNA, 25 bp, Artificial sequence
  SiRNA target sequence
aaataatatagaagtctataaaaat

SEQ ID NO: 76926 - DNA, 25 bp, Artificial sequence
  SiRNA target sequence
aataatatagaagtctataaaaatg

SEQ ID NO: 76927 - DNA, 25 bp, Artificial sequence
  SiRNA target sequence
ataatatagaagtctataaaaatga

SEQ ID NO: 76928 - DNA, 25 bp, Artificial sequence
  SiRNA target sequence
taatatagaagtctataaaaatgat

SEQ ID NO: 76929 - DNA, 25 bp, Artificial sequence
  SiRNA target sequence
aatatagaagtctataaaaatgata

SEQ ID NO: 76930 - DNA, 25 bp, Artificial sequence
  SiRNA target sequence
atatagaagtctataaaaatgatat

SEQ ID NO: 76931 - DNA, 25 bp, Artificial sequence
  SiRNA target sequence
tatagaagtctataaaaatgatatt

SEQ ID NO: 76932 - DNA, 25 bp, Artificial sequence
  SiRNA target sequence
atagaagtctataaaaatgatattg

SEQ ID NO: 76933 - DNA, 25 bp, Artificial sequence
  SiRNA target sequence
tagaagtctataaaaatgatattga

SEQ ID NO: 76934 - DNA, 25 bp, Artificial sequence
  SiRNA target sequence
agaagtctataaaaatgatattgaa

SEQ ID NO: 76935 - DNA, 25 bp, Artificial sequence
  SiRNA target sequence
gaagtctataaaaatgatattgaag

SEQ ID NO: 76936 - DNA, 25 bp, Artificial sequence
  SiRNA target sequence
aagtctataaaaatgatattgaagg

SEQ ID NO: 76937 - DNA, 25 bp, Artificial sequence
  SiRNA target sequence
agtctataaaaatgatattgaagga

SEQ ID NO: 76938 - DNA, 25 bp, Artificial sequence
  SiRNA target sequence
gtctataaaaatgatattgaaggac

SEQ ID NO: 76939 - DNA, 25 bp, Artificial sequence
  SiRNA target sequence
tctataaaaatgatattgaaggaca

SEQ ID NO: 76940 - DNA, 25 bp, Artificial sequence
  SiRNA target sequence
ctataaaaatgatattgaaggacaa

SEQ ID NO: 76941 - DNA, 25 bp, Artificial sequence
  SiRNA target sequence
tataaaaatgatattgaaggacaaa

SEQ ID NO: 76942 - DNA, 25 bp, Artificial sequence
  SiRNA target sequence
ataaaaatgatattgaaggacaaaa

SEQ ID NO: 76943 - DNA, 25 bp, Artificial sequence
  SiRNA target sequence
taaaaatgatattgaaggacaaaaa

SEQ ID NO: 76944 - DNA, 25 bp, Artificial sequence
  SiRNA target sequence
aaaaatgatattgaaggacaaaaaa

SEQ ID NO: 76945 - DNA, 25 bp, Artificial sequence
  SiRNA target sequence
aaaatgatattgaaggacaaaaaaa

SEQ ID NO: 76946 - DNA, 25 bp, Artificial sequence
  SiRNA target sequence
aaatgatattgaaggacaaaaaaag

SEQ ID NO: 76947 - DNA, 25 bp, Artificial sequence
  SiRNA target sequence
aatgatattgaaggacaaaaaaagt

SEQ ID NO: 76948 - DNA, 25 bp, Artificial sequence
  SiRNA target sequence
atgatattgaaggacaaaaaaagtt

SEQ ID NO: 76949 - DNA, 25 bp, Artificial sequence
  SiRNA target sequence
tgatattgaaggacaaaaaaagttt

SEQ ID NO: 76950 - DNA, 25 bp, Artificial sequence
  SiRNA target sequence
gatattgaaggacaaaaaaagtttt

SEQ ID NO: 76951 - DNA, 25 bp, Artificial sequence
  SiRNA target sequence
atattgaaggacaaaaaaagttttc

SEQ ID NO: 76952 - DNA, 25 bp, Artificial sequence
  SiRNA target sequence
tattgaaggacaaaaaaagttttct

SEQ ID NO: 76953 - DNA, 25 bp, Artificial sequence
  SiRNA target sequence
attgaaggacaaaaaaagttttcta

SEQ ID NO: 76954 - DNA, 25 bp, Artificial sequence
  SiRNA target sequence
ttgaaggacaaaaaaagttttctac

SEQ ID NO: 76955 - DNA, 25 bp, Artificial sequence
  SiRNA target sequence
tgaaggacaaaaaaagttttctaca

SEQ ID NO: 76956 - DNA, 25 bp, Artificial sequence
  SiRNA target sequence
gaaggacaaaaaaagttttctacaa

SEQ ID NO: 76957 - DNA, 25 bp, Artificial sequence
  SiRNA target sequence
aaggacaaaaaaagttttctacaaa

SEQ ID NO: 76958 - DNA, 25 bp, Artificial sequence
  SiRNA target sequence
aggacaaaaaaagttttctacaaat

SEQ ID NO: 76959 - DNA, 25 bp, Artificial sequence
  SiRNA target sequence
ggacaaaaaaagttttctacaaatt

SEQ ID NO: 76960 - DNA, 25 bp, Artificial sequence
  SiRNA target sequence
gacaaaaaaagttttctacaaattt

SEQ ID NO: 76961 - DNA, 25 bp, Artificial sequence
  SiRNA target sequence
acaaaaaaagttttctacaaattta

SEQ ID NO: 76962 - DNA, 25 bp, Artificial sequence
  SiRNA target sequence
caaaaaaagttttctacaaatttac

SEQ ID NO: 76963 - DNA, 25 bp, Artificial sequence
  SiRNA target sequence
aaaaaaagttttctacaaatttaca

SEQ ID NO: 76964 - DNA, 25 bp, Artificial sequence
  SiRNA target sequence
aaaaaagttttctacaaatttacaa

SEQ ID NO: 76965 - DNA, 25 bp, Artificial sequence
  SiRNA target sequence
aaaaagttttctacaaatttacaat

SEQ ID NO: 76966 - DNA, 25 bp, Artificial sequence
  SiRNA target sequence
aaaagttttctacaaatttacaata

SEQ ID NO: 76967 - DNA, 25 bp, Artificial sequence
  SiRNA target sequence
aaagttttctacaaatttacaatat

SEQ ID NO: 76968 - DNA, 25 bp, Artificial sequence
  SiRNA target sequence
aagttttctacaaatttacaatatt

SEQ ID NO: 76969 - DNA, 25 bp, Artificial sequence
  SiRNA target sequence
agttttctacaaatttacaatattt

SEQ ID NO: 76970 - DNA, 25 bp, Artificial sequence
  SiRNA target sequence
gttttctacaaatttacaatatttt

SEQ ID NO: 76971 - DNA, 25 bp, Artificial sequence
  SiRNA target sequence
ttttctacaaatttacaatattttt

SEQ ID NO: 76972 - DNA, 25 bp, Artificial sequence
  SiRNA target sequence
tttctacaaatttacaatatttttt

SEQ ID NO: 76973 - DNA, 25 bp, Artificial sequence
  SiRNA target sequence
ttctacaaatttacaatatttttta

SEQ ID NO: 76974 - DNA, 25 bp, Artificial sequence
  SiRNA target sequence
tctacaaatttacaatattttttat

SEQ ID NO: 76975 - DNA, 25 bp, Artificial sequence
  SiRNA target sequence
ctacaaatttacaatattttttatc

SEQ ID NO: 76976 - DNA, 25 bp, Artificial sequence
  SiRNA target sequence
tacaaatttacaatattttttatca

SEQ ID NO: 76977 - DNA, 25 bp, Artificial sequence
  SiRNA target sequence
acaaatttacaatattttttatcat

SEQ ID NO: 76978 - DNA, 25 bp, Artificial sequence
  SiRNA target sequence
caaatttacaatattttttatcata

SEQ ID NO: 76979 - DNA, 25 bp, Artificial sequence
  SiRNA target sequence
aaatttacaatattttttatcatac

SEQ ID NO: 76980 - DNA, 25 bp, Artificial sequence
  SiRNA target sequence
aatttacaatattttttatcataca

SEQ ID NO: 76981 - DNA, 25 bp, Artificial sequence
  SiRNA target sequence
atttacaatattttttatcatacaa

SEQ ID NO: 76982 - DNA, 25 bp, Artificial sequence
  SiRNA target sequence
tttacaatattttttatcatacaaa

SEQ ID NO: 76983 - DNA, 25 bp, Artificial sequence
  SiRNA target sequence
ttacaatattttttatcatacaaat

SEQ ID NO: 76984 - DNA, 25 bp, Artificial sequence
  SiRNA target sequence
tacaatattttttatcatacaaatt

SEQ ID NO: 76985 - DNA, 25 bp, Artificial sequence
  SiRNA target sequence
acaatattttttatcatacaaatta

SEQ ID NO: 76986 - DNA, 25 bp, Artificial sequence
  SiRNA target sequence
caatattttttatcatacaaattag

SEQ ID NO: 76987 - DNA, 25 bp, Artificial sequence
  SiRNA target sequence
aatattttttatcatacaaattagg

SEQ ID NO: 76988 - DNA, 25 bp, Artificial sequence
  SiRNA target sequence
atattttttatcatacaaattaggt

SEQ ID NO: 76989 - DNA, 25 bp, Artificial sequence
  SiRNA target sequence
tattttttatcatacaaattaggta

SEQ ID NO: 76990 - DNA, 25 bp, Artificial sequence
  SiRNA target sequence
attttttatcatacaaattaggtaa

SEQ ID NO: 76991 - DNA, 25 bp, Artificial sequence
  SiRNA target sequence
ttttttatcatacaaattaggtaaa

SEQ ID NO: 76992 - DNA, 25 bp, Artificial sequence
  SiRNA target sequence
tttttatcatacaaattaggtaaat

SEQ ID NO: 76993 - DNA, 25 bp, Artificial sequence
  SiRNA target sequence
ttttatcatacaaattaggtaaata

SEQ ID NO: 76994 - DNA, 25 bp, Artificial sequence
  SiRNA target sequence
tttatcatacaaattaggtaaataa

SEQ ID NO: 76995 - DNA, 26 bp, Artificial sequence
  SiRNA target sequence
atgaaaaaaatttcgaatagaaaaat

SEQ ID NO: 76996 - DNA, 26 bp, Artificial sequence
  SiRNA target sequence
tgaaaaaaatttcgaatagaaaaatt

SEQ ID NO: 76997 - DNA, 26 bp, Artificial sequence
  SiRNA target sequence
gaaaaaaatttcgaatagaaaaatta

SEQ ID NO: 76998 - DNA, 26 bp, Artificial sequence
  SiRNA target sequence
aaaaaaatttcgaatagaaaaattat

SEQ ID NO: 76999 - DNA, 26 bp, Artificial sequence
  SiRNA target sequence
aaaaaatttcgaatagaaaaattatc

SEQ ID NO: 77000 - DNA, 26 bp, Artificial sequence
  SiRNA target sequence
aaaaatttcgaatagaaaaattatca

SEQ ID NO: 77001 - DNA, 26 bp, Artificial sequence
  SiRNA target sequence
aaaatttcgaatagaaaaattatcaa

SEQ ID NO: 77002 - DNA, 26 bp, Artificial sequence
  SiRNA target sequence
aaatttcgaatagaaaaattatcaaa

SEQ ID NO: 77003 - DNA, 26 bp, Artificial sequence
  SiRNA target sequence
aatttcgaatagaaaaattatcaaag

SEQ ID NO: 77004 - DNA, 26 bp, Artificial sequence
  SiRNA target sequence
atttcgaatagaaaaattatcaaaga

SEQ ID NO: 77005 - DNA, 26 bp, Artificial sequence
  SiRNA target sequence
tttcgaatagaaaaattatcaaagaa

SEQ ID NO: 77006 - DNA, 26 bp, Artificial sequence
  SiRNA target sequence
ttcgaatagaaaaattatcaaagaaa

SEQ ID NO: 77007 - DNA, 26 bp, Artificial sequence
  SiRNA target sequence
tcgaatagaaaaattatcaaagaaat

SEQ ID NO: 77008 - DNA, 26 bp, Artificial sequence
  SiRNA target sequence
cgaatagaaaaattatcaaagaaatt

SEQ ID NO: 77009 - DNA, 26 bp, Artificial sequence
  SiRNA target sequence
gaatagaaaaattatcaaagaaatta

SEQ ID NO: 77010 - DNA, 26 bp, Artificial sequence
  SiRNA target sequence
aatagaaaaattatcaaagaaattat

SEQ ID NO: 77011 - DNA, 26 bp, Artificial sequence
  SiRNA target sequence
atagaaaaattatcaaagaaattatt

SEQ ID NO: 77012 - DNA, 26 bp, Artificial sequence
  SiRNA target sequence
tagaaaaattatcaaagaaattattt

SEQ ID NO: 77013 - DNA, 26 bp, Artificial sequence
  SiRNA target sequence
agaaaaattatcaaagaaattattta

SEQ ID NO: 77014 - DNA, 26 bp, Artificial sequence
  SiRNA target sequence
gaaaaattatcaaagaaattatttac

SEQ ID NO: 77015 - DNA, 26 bp, Artificial sequence
  SiRNA target sequence
aaaaattatcaaagaaattatttaca

SEQ ID NO: 77016 - DNA, 26 bp, Artificial sequence
  SiRNA target sequence
aaaattatcaaagaaattatttacaa

SEQ ID NO: 77017 - DNA, 26 bp, Artificial sequence
  SiRNA target sequence
aaattatcaaagaaattatttacaat

SEQ ID NO: 77018 - DNA, 26 bp, Artificial sequence
  SiRNA target sequence
aattatcaaagaaattatttacaatg

SEQ ID NO: 77019 - DNA, 26 bp, Artificial sequence
  SiRNA target sequence
attatcaaagaaattatttacaatga

SEQ ID NO: 77020 - DNA, 26 bp, Artificial sequence
  SiRNA target sequence
ttatcaaagaaattatttacaatgat

SEQ ID NO: 77021 - DNA, 26 bp, Artificial sequence
  SiRNA target sequence
tatcaaagaaattatttacaatgatt

SEQ ID NO: 77022 - DNA, 26 bp, Artificial sequence
  SiRNA target sequence
atcaaagaaattatttacaatgattt

SEQ ID NO: 77023 - DNA, 26 bp, Artificial sequence
  SiRNA target sequence
tcaaagaaattatttacaatgattta

SEQ ID NO: 77024 - DNA, 26 bp, Artificial sequence
  SiRNA target sequence
caaagaaattatttacaatgatttat

SEQ ID NO: 77025 - DNA, 26 bp, Artificial sequence
  SiRNA target sequence
aaagaaattatttacaatgatttatt

SEQ ID NO: 77026 - DNA, 26 bp, Artificial sequence
  SiRNA target sequence
aagaaattatttacaatgatttatta

SEQ ID NO: 77027 - DNA, 26 bp, Artificial sequence
  SiRNA target sequence
agaaattatttacaatgatttattaa

SEQ ID NO: 77028 - DNA, 26 bp, Artificial sequence
  SiRNA target sequence
gaaattatttacaatgatttattaaa

SEQ ID NO: 77029 - DNA, 26 bp, Artificial sequence
  SiRNA target sequence
aaattatttacaatgatttattaaaa

SEQ ID NO: 77030 - DNA, 26 bp, Artificial sequence
  SiRNA target sequence
aattatttacaatgatttattaaaaa

SEQ ID NO: 77031 - DNA, 26 bp, Artificial sequence
  SiRNA target sequence
attatttacaatgatttattaaaaat

SEQ ID NO: 77032 - DNA, 26 bp, Artificial sequence
  SiRNA target sequence
ttatttacaatgatttattaaaaata

SEQ ID NO: 77033 - DNA, 26 bp, Artificial sequence
  SiRNA target sequence
tatttacaatgatttattaaaaataa

SEQ ID NO: 77034 - DNA, 26 bp, Artificial sequence
  SiRNA target sequence
atttacaatgatttattaaaaataag

SEQ ID NO: 77035 - DNA, 26 bp, Artificial sequence
  SiRNA target sequence
tttacaatgatttattaaaaataaga

SEQ ID NO: 77036 - DNA, 26 bp, Artificial sequence
  SiRNA target sequence
ttacaatgatttattaaaaataagaa

SEQ ID NO: 77037 - DNA, 26 bp, Artificial sequence
  SiRNA target sequence
tacaatgatttattaaaaataagaat

SEQ ID NO: 77038 - DNA, 26 bp, Artificial sequence
  SiRNA target sequence
acaatgatttattaaaaataagaatg

SEQ ID NO: 77039 - DNA, 26 bp, Artificial sequence
  SiRNA target sequence
caatgatttattaaaaataagaatgt

SEQ ID NO: 77040 - DNA, 26 bp, Artificial sequence
  SiRNA target sequence
aatgatttattaaaaataagaatgtt

SEQ ID NO: 77041 - DNA, 26 bp, Artificial sequence
  SiRNA target sequence
atgatttattaaaaataagaatgttg

SEQ ID NO: 77042 - DNA, 26 bp, Artificial sequence
  SiRNA target sequence
tgatttattaaaaataagaatgttgc

SEQ ID NO: 77043 - DNA, 26 bp, Artificial sequence
  SiRNA target sequence
gatttattaaaaataagaatgttgcg

SEQ ID NO: 77044 - DNA, 26 bp, Artificial sequence
  SiRNA target sequence
atttattaaaaataagaatgttgcga

SEQ ID NO: 77045 - DNA, 26 bp, Artificial sequence
  SiRNA target sequence
tttattaaaaataagaatgttgcgat

SEQ ID NO: 77046 - DNA, 26 bp, Artificial sequence
  SiRNA target sequence
ttattaaaaataagaatgttgcgata

SEQ ID NO: 77047 - DNA, 26 bp, Artificial sequence
  SiRNA target sequence
tattaaaaataagaatgttgcgatat

SEQ ID NO: 77048 - DNA, 26 bp, Artificial sequence
  SiRNA target sequence
attaaaaataagaatgttgcgatatg

SEQ ID NO: 77049 - DNA, 26 bp, Artificial sequence
  SiRNA target sequence
ttaaaaataagaatgttgcgatatgt

SEQ ID NO: 77050 - DNA, 26 bp, Artificial sequence
  SiRNA target sequence
taaaaataagaatgttgcgatatgtt

SEQ ID NO: 77051 - DNA, 26 bp, Artificial sequence
  SiRNA target sequence
aaaaataagaatgttgcgatatgtta

SEQ ID NO: 77052 - DNA, 26 bp, Artificial sequence
  SiRNA target sequence
aaaataagaatgttgcgatatgttat

SEQ ID NO: 77053 - DNA, 26 bp, Artificial sequence
  SiRNA target sequence
aaataagaatgttgcgatatgttatt

SEQ ID NO: 77054 - DNA, 26 bp, Artificial sequence
  SiRNA target sequence
aataagaatgttgcgatatgttattg

SEQ ID NO: 77055 - DNA, 26 bp, Artificial sequence
  SiRNA target sequence
ataagaatgttgcgatatgttattgt

SEQ ID NO: 77056 - DNA, 26 bp, Artificial sequence
  SiRNA target sequence
taagaatgttgcgatatgttattgta

SEQ ID NO: 77057 - DNA, 26 bp, Artificial sequence
  SiRNA target sequence
aagaatgttgcgatatgttattgtac

SEQ ID NO: 77058 - DNA, 26 bp, Artificial sequence
  SiRNA target sequence
agaatgttgcgatatgttattgtacc

SEQ ID NO: 77059 - DNA, 26 bp, Artificial sequence
  SiRNA target sequence
gaatgttgcgatatgttattgtacca

SEQ ID NO: 77060 - DNA, 26 bp, Artificial sequence
  SiRNA target sequence
aatgttgcgatatgttattgtaccaa

SEQ ID NO: 77061 - DNA, 26 bp, Artificial sequence
  SiRNA target sequence
atgttgcgatatgttattgtaccaat

SEQ ID NO: 77062 - DNA, 26 bp, Artificial sequence
  SiRNA target sequence
tgttgcgatatgttattgtaccaata

SEQ ID NO: 77063 - DNA, 26 bp, Artificial sequence
  SiRNA target sequence
gttgcgatatgttattgtaccaataa

SEQ ID NO: 77064 - DNA, 26 bp, Artificial sequence
  SiRNA target sequence
ttgcgatatgttattgtaccaataat

SEQ ID NO: 77065 - DNA, 26 bp, Artificial sequence
  SiRNA target sequence
tgcgatatgttattgtaccaataata

SEQ ID NO: 77066 - DNA, 26 bp, Artificial sequence
  SiRNA target sequence
gcgatatgttattgtaccaataatat

SEQ ID NO: 77067 - DNA, 26 bp, Artificial sequence
  SiRNA target sequence
cgatatgttattgtaccaataatatt

SEQ ID NO: 77068 - DNA, 26 bp, Artificial sequence
  SiRNA target sequence
gatatgttattgtaccaataatattt

SEQ ID NO: 77069 - DNA, 26 bp, Artificial sequence
  SiRNA target sequence
atatgttattgtaccaataatatttt

SEQ ID NO: 77070 - DNA, 26 bp, Artificial sequence
  SiRNA target sequence
tatgttattgtaccaataatattttt

SEQ ID NO: 77071 - DNA, 26 bp, Artificial sequence
  SiRNA target sequence
atgttattgtaccaataatattttta

SEQ ID NO: 77072 - DNA, 26 bp, Artificial sequence
  SiRNA target sequence
tgttattgtaccaataatatttttaa

SEQ ID NO: 77073 - DNA, 26 bp, Artificial sequence
  SiRNA target sequence
gttattgtaccaataatatttttaac

SEQ ID NO: 77074 - DNA, 26 bp, Artificial sequence
  SiRNA target sequence
ttattgtaccaataatatttttaact

SEQ ID NO: 77075 - DNA, 26 bp, Artificial sequence
  SiRNA target sequence
tattgtaccaataatatttttaacta

SEQ ID NO: 77076 - DNA, 26 bp, Artificial sequence
  SiRNA target sequence
attgtaccaataatatttttaactat

SEQ ID NO: 77077 - DNA, 26 bp, Artificial sequence
  SiRNA target sequence
ttgtaccaataatatttttaactata

SEQ ID NO: 77078 - DNA, 26 bp, Artificial sequence
  SiRNA target sequence
tgtaccaataatatttttaactatat

SEQ ID NO: 77079 - DNA, 26 bp, Artificial sequence
  SiRNA target sequence
gtaccaataatatttttaactatatt

SEQ ID NO: 77080 - DNA, 26 bp, Artificial sequence
  SiRNA target sequence
taccaataatatttttaactatattt

SEQ ID NO: 77081 - DNA, 26 bp, Artificial sequence
  SiRNA target sequence
accaataatatttttaactatatttt

SEQ ID NO: 77082 - DNA, 26 bp, Artificial sequence
  SiRNA target sequence
ccaataatatttttaactatatttta

SEQ ID NO: 77083 - DNA, 26 bp, Artificial sequence
  SiRNA target sequence
caataatatttttaactatattttac

SEQ ID NO: 77084 - DNA, 26 bp, Artificial sequence
  SiRNA target sequence
aataatatttttaactatattttaca

SEQ ID NO: 77085 - DNA, 26 bp, Artificial sequence
  SiRNA target sequence
ataatatttttaactatattttacac

SEQ ID NO: 77086 - DNA, 26 bp, Artificial sequence
  SiRNA target sequence
taatatttttaactatattttacact

SEQ ID NO: 77087 - DNA, 26 bp, Artificial sequence
  SiRNA target sequence
aatatttttaactatattttacactg

SEQ ID NO: 77088 - DNA, 26 bp, Artificial sequence
  SiRNA target sequence
atatttttaactatattttacactgt

SEQ ID NO: 77089 - DNA, 26 bp, Artificial sequence
  SiRNA target sequence
tatttttaactatattttacactgtt

SEQ ID NO: 77090 - DNA, 26 bp, Artificial sequence
  SiRNA target sequence
atttttaactatattttacactgttt

SEQ ID NO: 77091 - DNA, 26 bp, Artificial sequence
  SiRNA target sequence
tttttaactatattttacactgtttt

SEQ ID NO: 77092 - DNA, 26 bp, Artificial sequence
  SiRNA target sequence
ttttaactatattttacactgtttta

SEQ ID NO: 77093 - DNA, 26 bp, Artificial sequence
  SiRNA target sequence
tttaactatattttacactgttttag

SEQ ID NO: 77094 - DNA, 26 bp, Artificial sequence
  SiRNA target sequence
ttaactatattttacactgttttaga

SEQ ID NO: 77095 - DNA, 26 bp, Artificial sequence
  SiRNA target sequence
taactatattttacactgttttagag

SEQ ID NO: 77096 - DNA, 26 bp, Artificial sequence
  SiRNA target sequence
aactatattttacactgttttagaga

SEQ ID NO: 77097 - DNA, 26 bp, Artificial sequence
  SiRNA target sequence
actatattttacactgttttagagat

SEQ ID NO: 77098 - DNA, 26 bp, Artificial sequence
  SiRNA target sequence
ctatattttacactgttttagagata

SEQ ID NO: 77099 - DNA, 26 bp, Artificial sequence
  SiRNA target sequence
tatattttacactgttttagagataa

SEQ ID NO: 77100 - DNA, 26 bp, Artificial sequence
  SiRNA target sequence
atattttacactgttttagagataaa

SEQ ID NO: 77101 - DNA, 26 bp, Artificial sequence
  SiRNA target sequence
tattttacactgttttagagataaaa

SEQ ID NO: 77102 - DNA, 26 bp, Artificial sequence
  SiRNA target sequence
attttacactgttttagagataaaaa

SEQ ID NO: 77103 - DNA, 26 bp, Artificial sequence
  SiRNA target sequence
ttttacactgttttagagataaaaat

SEQ ID NO: 77104 - DNA, 26 bp, Artificial sequence
  SiRNA target sequence
tttacactgttttagagataaaaata

SEQ ID NO: 77105 - DNA, 26 bp, Artificial sequence
  SiRNA target sequence
ttacactgttttagagataaaaataa

SEQ ID NO: 77106 - DNA, 26 bp, Artificial sequence
  SiRNA target sequence
tacactgttttagagataaaaataag

SEQ ID NO: 77107 - DNA, 26 bp, Artificial sequence
  SiRNA target sequence
acactgttttagagataaaaataagt

SEQ ID NO: 77108 - DNA, 26 bp, Artificial sequence
  SiRNA target sequence
cactgttttagagataaaaataagta

SEQ ID NO: 77109 - DNA, 26 bp, Artificial sequence
  SiRNA target sequence
actgttttagagataaaaataagtac

SEQ ID NO: 77110 - DNA, 26 bp, Artificial sequence
  SiRNA target sequence
ctgttttagagataaaaataagtaca

SEQ ID NO: 77111 - DNA, 26 bp, Artificial sequence
  SiRNA target sequence
tgttttagagataaaaataagtacat

SEQ ID NO: 77112 - DNA, 26 bp, Artificial sequence
  SiRNA target sequence
gttttagagataaaaataagtacatt

SEQ ID NO: 77113 - DNA, 26 bp, Artificial sequence
  SiRNA target sequence
ttttagagataaaaataagtacatta

SEQ ID NO: 77114 - DNA, 26 bp, Artificial sequence
  SiRNA target sequence
tttagagataaaaataagtacattag

SEQ ID NO: 77115 - DNA, 26 bp, Artificial sequence
  SiRNA target sequence
ttagagataaaaataagtacattagt

SEQ ID NO: 77116 - DNA, 26 bp, Artificial sequence
  SiRNA target sequence
tagagataaaaataagtacattagta

SEQ ID NO: 77117 - DNA, 26 bp, Artificial sequence
  SiRNA target sequence
agagataaaaataagtacattagtaa

SEQ ID NO: 77118 - DNA, 26 bp, Artificial sequence
  SiRNA target sequence
gagataaaaataagtacattagtaaa

SEQ ID NO: 77119 - DNA, 26 bp, Artificial sequence
  SiRNA target sequence
agataaaaataagtacattagtaaag

SEQ ID NO: 77120 - DNA, 26 bp, Artificial sequence
  SiRNA target sequence
gataaaaataagtacattagtaaaga

SEQ ID NO: 77121 - DNA, 26 bp, Artificial sequence
  SiRNA target sequence
ataaaaataagtacattagtaaagaa

SEQ ID NO: 77122 - DNA, 26 bp, Artificial sequence
  SiRNA target sequence
taaaaataagtacattagtaaagaat

SEQ ID NO: 77123 - DNA, 26 bp, Artificial sequence
  SiRNA target sequence
aaaaataagtacattagtaaagaatc

SEQ ID NO: 77124 - DNA, 26 bp, Artificial sequence
  SiRNA target sequence
aaaataagtacattagtaaagaatct

SEQ ID NO: 77125 - DNA, 26 bp, Artificial sequence
  SiRNA target sequence
aaataagtacattagtaaagaatctt

SEQ ID NO: 77126 - DNA, 26 bp, Artificial sequence
  SiRNA target sequence
aataagtacattagtaaagaatctta

SEQ ID NO: 77127 - DNA, 26 bp, Artificial sequence
  SiRNA target sequence
ataagtacattagtaaagaatcttaa

SEQ ID NO: 77128 - DNA, 26 bp, Artificial sequence
  SiRNA target sequence
taagtacattagtaaagaatcttaat

SEQ ID NO: 77129 - DNA, 26 bp, Artificial sequence
  SiRNA target sequence
aagtacattagtaaagaatcttaatc

SEQ ID NO: 77130 - DNA, 26 bp, Artificial sequence
  SiRNA target sequence
agtacattagtaaagaatcttaatca

SEQ ID NO: 77131 - DNA, 26 bp, Artificial sequence
  SiRNA target sequence
gtacattagtaaagaatcttaatcaa

SEQ ID NO: 77132 - DNA, 26 bp, Artificial sequence
  SiRNA target sequence
tacattagtaaagaatcttaatcaat

SEQ ID NO: 77133 - DNA, 26 bp, Artificial sequence
  SiRNA target sequence
acattagtaaagaatcttaatcaatc

SEQ ID NO: 77134 - DNA, 26 bp, Artificial sequence
  SiRNA target sequence
cattagtaaagaatcttaatcaatct

SEQ ID NO: 77135 - DNA, 26 bp, Artificial sequence
  SiRNA target sequence
attagtaaagaatcttaatcaatcta

SEQ ID NO: 77136 - DNA, 26 bp, Artificial sequence
  SiRNA target sequence
ttagtaaagaatcttaatcaatctat

SEQ ID NO: 77137 - DNA, 26 bp, Artificial sequence
  SiRNA target sequence
tagtaaagaatcttaatcaatctatc

SEQ ID NO: 77138 - DNA, 26 bp, Artificial sequence
  SiRNA target sequence
agtaaagaatcttaatcaatctatcg

SEQ ID NO: 77139 - DNA, 26 bp, Artificial sequence
  SiRNA target sequence
gtaaagaatcttaatcaatctatcgc

SEQ ID NO: 77140 - DNA, 26 bp, Artificial sequence
  SiRNA target sequence
taaagaatcttaatcaatctatcgca

SEQ ID NO: 77141 - DNA, 26 bp, Artificial sequence
  SiRNA target sequence
aaagaatcttaatcaatctatcgcaa

SEQ ID NO: 77142 - DNA, 26 bp, Artificial sequence
  SiRNA target sequence
aagaatcttaatcaatctatcgcaaa

SEQ ID NO: 77143 - DNA, 26 bp, Artificial sequence
  SiRNA target sequence
agaatcttaatcaatctatcgcaaat

SEQ ID NO: 77144 - DNA, 26 bp, Artificial sequence
  SiRNA target sequence
gaatcttaatcaatctatcgcaaatc

SEQ ID NO: 77145 - DNA, 26 bp, Artificial sequence
  SiRNA target sequence
aatcttaatcaatctatcgcaaatcg

SEQ ID NO: 77146 - DNA, 26 bp, Artificial sequence
  SiRNA target sequence
atcttaatcaatctatcgcaaatcga

SEQ ID NO: 77147 - DNA, 26 bp, Artificial sequence
  SiRNA target sequence
tcttaatcaatctatcgcaaatcgaa

SEQ ID NO: 77148 - DNA, 26 bp, Artificial sequence
  SiRNA target sequence
cttaatcaatctatcgcaaatcgaaa

SEQ ID NO: 77149 - DNA, 26 bp, Artificial sequence
  SiRNA target sequence
ttaatcaatctatcgcaaatcgaaaa

SEQ ID NO: 77150 - DNA, 26 bp, Artificial sequence
  SiRNA target sequence
taatcaatctatcgcaaatcgaaaag

SEQ ID NO: 77151 - DNA, 26 bp, Artificial sequence
  SiRNA target sequence
aatcaatctatcgcaaatcgaaaagg

SEQ ID NO: 77152 - DNA, 26 bp, Artificial sequence
  SiRNA target sequence
atcaatctatcgcaaatcgaaaaggt

SEQ ID NO: 77153 - DNA, 26 bp, Artificial sequence
  SiRNA target sequence
tcaatctatcgcaaatcgaaaaggtg

SEQ ID NO: 77154 - DNA, 26 bp, Artificial sequence
  SiRNA target sequence
caatctatcgcaaatcgaaaaggtga

SEQ ID NO: 77155 - DNA, 26 bp, Artificial sequence
  SiRNA target sequence
aatctatcgcaaatcgaaaaggtgaa

SEQ ID NO: 77156 - DNA, 26 bp, Artificial sequence
  SiRNA target sequence
atctatcgcaaatcgaaaaggtgaac

SEQ ID NO: 77157 - DNA, 26 bp, Artificial sequence
  SiRNA target sequence
tctatcgcaaatcgaaaaggtgaaca

SEQ ID NO: 77158 - DNA, 26 bp, Artificial sequence
  SiRNA target sequence
ctatcgcaaatcgaaaaggtgaacac

SEQ ID NO: 77159 - DNA, 26 bp, Artificial sequence
  SiRNA target sequence
tatcgcaaatcgaaaaggtgaacaca

SEQ ID NO: 77160 - DNA, 26 bp, Artificial sequence
  SiRNA target sequence
atcgcaaatcgaaaaggtgaacacac

SEQ ID NO: 77161 - DNA, 26 bp, Artificial sequence
  SiRNA target sequence
tcgcaaatcgaaaaggtgaacacaca

SEQ ID NO: 77162 - DNA, 26 bp, Artificial sequence
  SiRNA target sequence
cgcaaatcgaaaaggtgaacacacag

SEQ ID NO: 77163 - DNA, 26 bp, Artificial sequence
  SiRNA target sequence
gcaaatcgaaaaggtgaacacacagc

SEQ ID NO: 77164 - DNA, 26 bp, Artificial sequence
  SiRNA target sequence
caaatcgaaaaggtgaacacacagca

SEQ ID NO: 77165 - DNA, 26 bp, Artificial sequence
  SiRNA target sequence
aaatcgaaaaggtgaacacacagcac

SEQ ID NO: 77166 - DNA, 26 bp, Artificial sequence
  SiRNA target sequence
aatcgaaaaggtgaacacacagcact

SEQ ID NO: 77167 - DNA, 26 bp, Artificial sequence
  SiRNA target sequence
atcgaaaaggtgaacacacagcactt

SEQ ID NO: 77168 - DNA, 26 bp, Artificial sequence
  SiRNA target sequence
tcgaaaaggtgaacacacagcacttg

SEQ ID NO: 77169 - DNA, 26 bp, Artificial sequence
  SiRNA target sequence
cgaaaaggtgaacacacagcacttga

SEQ ID NO: 77170 - DNA, 26 bp, Artificial sequence
  SiRNA target sequence
gaaaaggtgaacacacagcacttgaa

SEQ ID NO: 77171 - DNA, 26 bp, Artificial sequence
  SiRNA target sequence
aaaaggtgaacacacagcacttgaaa

SEQ ID NO: 77172 - DNA, 26 bp, Artificial sequence
  SiRNA target sequence
aaaggtgaacacacagcacttgaaag

SEQ ID NO: 77173 - DNA, 26 bp, Artificial sequence
  SiRNA target sequence
aaggtgaacacacagcacttgaaaga

SEQ ID NO: 77174 - DNA, 26 bp, Artificial sequence
  SiRNA target sequence
aggtgaacacacagcacttgaaagat

SEQ ID NO: 77175 - DNA, 26 bp, Artificial sequence
  SiRNA target sequence
ggtgaacacacagcacttgaaagatt

SEQ ID NO: 77176 - DNA, 26 bp, Artificial sequence
  SiRNA target sequence
gtgaacacacagcacttgaaagattt

SEQ ID NO: 77177 - DNA, 26 bp, Artificial sequence
  SiRNA target sequence
tgaacacacagcacttgaaagatttg

SEQ ID NO: 77178 - DNA, 26 bp, Artificial sequence
  SiRNA target sequence
gaacacacagcacttgaaagatttgt

SEQ ID NO: 77179 - DNA, 26 bp, Artificial sequence
  SiRNA target sequence
aacacacagcacttgaaagatttgtg

SEQ ID NO: 77180 - DNA, 26 bp, Artificial sequence
  SiRNA target sequence
acacacagcacttgaaagatttgtgt

SEQ ID NO: 77181 - DNA, 26 bp, Artificial sequence
  SiRNA target sequence
cacacagcacttgaaagatttgtgtt

SEQ ID NO: 77182 - DNA, 26 bp, Artificial sequence
  SiRNA target sequence
acacagcacttgaaagatttgtgtta

SEQ ID NO: 77183 - DNA, 26 bp, Artificial sequence
  SiRNA target sequence
cacagcacttgaaagatttgtgttac

SEQ ID NO: 77184 - DNA, 26 bp, Artificial sequence
  SiRNA target sequence
acagcacttgaaagatttgtgttaca

SEQ ID NO: 77185 - DNA, 26 bp, Artificial sequence
  SiRNA target sequence
cagcacttgaaagatttgtgttacag

SEQ ID NO: 77186 - DNA, 26 bp, Artificial sequence
  SiRNA target sequence
agcacttgaaagatttgtgttacagt

SEQ ID NO: 77187 - DNA, 26 bp, Artificial sequence
  SiRNA target sequence
gcacttgaaagatttgtgttacagtc

SEQ ID NO: 77188 - DNA, 26 bp, Artificial sequence
  SiRNA target sequence
cacttgaaagatttgtgttacagtca

SEQ ID NO: 77189 - DNA, 26 bp, Artificial sequence
  SiRNA target sequence
acttgaaagatttgtgttacagtcac

SEQ ID NO: 77190 - DNA, 26 bp, Artificial sequence
  SiRNA target sequence
cttgaaagatttgtgttacagtcact

SEQ ID NO: 77191 - DNA, 26 bp, Artificial sequence
  SiRNA target sequence
ttgaaagatttgtgttacagtcactc

SEQ ID NO: 77192 - DNA, 26 bp, Artificial sequence
  SiRNA target sequence
tgaaagatttgtgttacagtcactct

SEQ ID NO: 77193 - DNA, 26 bp, Artificial sequence
  SiRNA target sequence
gaaagatttgtgttacagtcactctt

SEQ ID NO: 77194 - DNA, 26 bp, Artificial sequence
  SiRNA target sequence
aaagatttgtgttacagtcactctta

SEQ ID NO: 77195 - DNA, 26 bp, Artificial sequence
  SiRNA target sequence
aagatttgtgttacagtcactcttag

SEQ ID NO: 77196 - DNA, 26 bp, Artificial sequence
  SiRNA target sequence
agatttgtgttacagtcactcttagt

SEQ ID NO: 77197 - DNA, 26 bp, Artificial sequence
  SiRNA target sequence
gatttgtgttacagtcactcttagtg

SEQ ID NO: 77198 - DNA, 26 bp, Artificial sequence
  SiRNA target sequence
atttgtgttacagtcactcttagtgg

SEQ ID NO: 77199 - DNA, 26 bp, Artificial sequence
  SiRNA target sequence
tttgtgttacagtcactcttagtggc

SEQ ID NO: 77200 - DNA, 26 bp, Artificial sequence
  SiRNA target sequence
ttgtgttacagtcactcttagtggct

SEQ ID NO: 77201 - DNA, 26 bp, Artificial sequence
  SiRNA target sequence
tgtgttacagtcactcttagtggctg

SEQ ID NO: 77202 - DNA, 26 bp, Artificial sequence
  SiRNA target sequence
gtgttacagtcactcttagtggctgt

SEQ ID NO: 77203 - DNA, 26 bp, Artificial sequence
  SiRNA target sequence
tgttacagtcactcttagtggctgta

SEQ ID NO: 77204 - DNA, 26 bp, Artificial sequence
  SiRNA target sequence
gttacagtcactcttagtggctgtat

SEQ ID NO: 77205 - DNA, 26 bp, Artificial sequence
  SiRNA target sequence
ttacagtcactcttagtggctgtatt

SEQ ID NO: 77206 - DNA, 26 bp, Artificial sequence
  SiRNA target sequence
tacagtcactcttagtggctgtattg

SEQ ID NO: 77207 - DNA, 26 bp, Artificial sequence
  SiRNA target sequence
acagtcactcttagtggctgtattga

SEQ ID NO: 77208 - DNA, 26 bp, Artificial sequence
  SiRNA target sequence
cagtcactcttagtggctgtattgac

SEQ ID NO: 77209 - DNA, 26 bp, Artificial sequence
  SiRNA target sequence
agtcactcttagtggctgtattgacc

SEQ ID NO: 77210 - DNA, 26 bp, Artificial sequence
  SiRNA target sequence
gtcactcttagtggctgtattgaccg

SEQ ID NO: 77211 - DNA, 26 bp, Artificial sequence
  SiRNA target sequence
tcactcttagtggctgtattgaccga

SEQ ID NO: 77212 - DNA, 26 bp, Artificial sequence
  SiRNA target sequence
cactcttagtggctgtattgaccgaa

SEQ ID NO: 77213 - DNA, 26 bp, Artificial sequence
  SiRNA target sequence
actcttagtggctgtattgaccgaac

SEQ ID NO: 77214 - DNA, 26 bp, Artificial sequence
  SiRNA target sequence
ctcttagtggctgtattgaccgaact

SEQ ID NO: 77215 - DNA, 26 bp, Artificial sequence
  SiRNA target sequence
tcttagtggctgtattgaccgaactt

SEQ ID NO: 77216 - DNA, 26 bp, Artificial sequence
  SiRNA target sequence
cttagtggctgtattgaccgaactta

SEQ ID NO: 77217 - DNA, 26 bp, Artificial sequence
  SiRNA target sequence
ttagtggctgtattgaccgaacttaa

SEQ ID NO: 77218 - DNA, 26 bp, Artificial sequence
  SiRNA target sequence
tagtggctgtattgaccgaacttaat

SEQ ID NO: 77219 - DNA, 26 bp, Artificial sequence
  SiRNA target sequence
agtggctgtattgaccgaacttaatg

SEQ ID NO: 77220 - DNA, 26 bp, Artificial sequence
  SiRNA target sequence
gtggctgtattgaccgaacttaatgg

SEQ ID NO: 77221 - DNA, 26 bp, Artificial sequence
  SiRNA target sequence
tggctgtattgaccgaacttaatgga

SEQ ID NO: 77222 - DNA, 26 bp, Artificial sequence
  SiRNA target sequence
ggctgtattgaccgaacttaatggat

SEQ ID NO: 77223 - DNA, 26 bp, Artificial sequence
  SiRNA target sequence
gctgtattgaccgaacttaatggatt

SEQ ID NO: 77224 - DNA, 26 bp, Artificial sequence
  SiRNA target sequence
ctgtattgaccgaacttaatggattt

SEQ ID NO: 77225 - DNA, 26 bp, Artificial sequence
  SiRNA target sequence
tgtattgaccgaacttaatggattta

SEQ ID NO: 77226 - DNA, 26 bp, Artificial sequence
  SiRNA target sequence
gtattgaccgaacttaatggatttat

SEQ ID NO: 77227 - DNA, 26 bp, Artificial sequence
  SiRNA target sequence
tattgaccgaacttaatggatttatt

SEQ ID NO: 77228 - DNA, 26 bp, Artificial sequence
  SiRNA target sequence
attgaccgaacttaatggatttattt

SEQ ID NO: 77229 - DNA, 26 bp, Artificial sequence
  SiRNA target sequence
ttgaccgaacttaatggatttatttt

SEQ ID NO: 77230 - DNA, 26 bp, Artificial sequence
  SiRNA target sequence
tgaccgaacttaatggatttattttt

SEQ ID NO: 77231 - DNA, 26 bp, Artificial sequence
  SiRNA target sequence
gaccgaacttaatggatttattttta

SEQ ID NO: 77232 - DNA, 26 bp, Artificial sequence
  SiRNA target sequence
accgaacttaatggatttatttttac

SEQ ID NO: 77233 - DNA, 26 bp, Artificial sequence
  SiRNA target sequence
ccgaacttaatggatttatttttaca

SEQ ID NO: 77234 - DNA, 26 bp, Artificial sequence
  SiRNA target sequence
cgaacttaatggatttatttttacag

SEQ ID NO: 77235 - DNA, 26 bp, Artificial sequence
  SiRNA target sequence
gaacttaatggatttatttttacagg

SEQ ID NO: 77236 - DNA, 26 bp, Artificial sequence
  SiRNA target sequence
aacttaatggatttatttttacaggt

SEQ ID NO: 77237 - DNA, 26 bp, Artificial sequence
  SiRNA target sequence
acttaatggatttatttttacaggtg

SEQ ID NO: 77238 - DNA, 26 bp, Artificial sequence
  SiRNA target sequence
cttaatggatttatttttacaggtgt

SEQ ID NO: 77239 - DNA, 26 bp, Artificial sequence
  SiRNA target sequence
ttaatggatttatttttacaggtgta

SEQ ID NO: 77240 - DNA, 26 bp, Artificial sequence
  SiRNA target sequence
taatggatttatttttacaggtgtag

SEQ ID NO: 77241 - DNA, 26 bp, Artificial sequence
  SiRNA target sequence
aatggatttatttttacaggtgtagt

SEQ ID NO: 77242 - DNA, 26 bp, Artificial sequence
  SiRNA target sequence
atggatttatttttacaggtgtagtg

SEQ ID NO: 77243 - DNA, 26 bp, Artificial sequence
  SiRNA target sequence
tggatttatttttacaggtgtagtgc

SEQ ID NO: 77244 - DNA, 26 bp, Artificial sequence
  SiRNA target sequence
ggatttatttttacaggtgtagtgca

SEQ ID NO: 77245 - DNA, 26 bp, Artificial sequence
  SiRNA target sequence
gatttatttttacaggtgtagtgcaa

SEQ ID NO: 77246 - DNA, 26 bp, Artificial sequence
  SiRNA target sequence
atttatttttacaggtgtagtgcaat

SEQ ID NO: 77247 - DNA, 26 bp, Artificial sequence
  SiRNA target sequence
tttatttttacaggtgtagtgcaata

SEQ ID NO: 77248 - DNA, 26 bp, Artificial sequence
  SiRNA target sequence
ttatttttacaggtgtagtgcaatat

SEQ ID NO: 77249 - DNA, 26 bp, Artificial sequence
  SiRNA target sequence
tatttttacaggtgtagtgcaatata

SEQ ID NO: 77250 - DNA, 26 bp, Artificial sequence
  SiRNA target sequence
atttttacaggtgtagtgcaatatat

SEQ ID NO: 77251 - DNA, 26 bp, Artificial sequence
  SiRNA target sequence
tttttacaggtgtagtgcaatatatt

SEQ ID NO: 77252 - DNA, 26 bp, Artificial sequence
  SiRNA target sequence
ttttacaggtgtagtgcaatatattt

SEQ ID NO: 77253 - DNA, 26 bp, Artificial sequence
  SiRNA target sequence
tttacaggtgtagtgcaatatattta

SEQ ID NO: 77254 - DNA, 26 bp, Artificial sequence
  SiRNA target sequence
ttacaggtgtagtgcaatatatttat

SEQ ID NO: 77255 - DNA, 26 bp, Artificial sequence
  SiRNA target sequence
tacaggtgtagtgcaatatatttata

SEQ ID NO: 77256 - DNA, 26 bp, Artificial sequence
  SiRNA target sequence
acaggtgtagtgcaatatatttatag

SEQ ID NO: 77257 - DNA, 26 bp, Artificial sequence
  SiRNA target sequence
caggtgtagtgcaatatatttataga

SEQ ID NO: 77258 - DNA, 26 bp, Artificial sequence
  SiRNA target sequence
aggtgtagtgcaatatatttatagaa

SEQ ID NO: 77259 - DNA, 26 bp, Artificial sequence
  SiRNA target sequence
ggtgtagtgcaatatatttatagaaa

SEQ ID NO: 77260 - DNA, 26 bp, Artificial sequence
  SiRNA target sequence
gtgtagtgcaatatatttatagaaat

SEQ ID NO: 77261 - DNA, 26 bp, Artificial sequence
  SiRNA target sequence
tgtagtgcaatatatttatagaaata

SEQ ID NO: 77262 - DNA, 26 bp, Artificial sequence
  SiRNA target sequence
gtagtgcaatatatttatagaaatac

SEQ ID NO: 77263 - DNA, 26 bp, Artificial sequence
  SiRNA target sequence
tagtgcaatatatttatagaaatacg

SEQ ID NO: 77264 - DNA, 26 bp, Artificial sequence
  SiRNA target sequence
agtgcaatatatttatagaaatacgg

SEQ ID NO: 77265 - DNA, 26 bp, Artificial sequence
  SiRNA target sequence
gtgcaatatatttatagaaatacggc

SEQ ID NO: 77266 - DNA, 26 bp, Artificial sequence
  SiRNA target sequence
tgcaatatatttatagaaatacggca

SEQ ID NO: 77267 - DNA, 26 bp, Artificial sequence
  SiRNA target sequence
gcaatatatttatagaaatacggcaa

SEQ ID NO: 77268 - DNA, 26 bp, Artificial sequence
  SiRNA target sequence
caatatatttatagaaatacggcaaa

SEQ ID NO: 77269 - DNA, 26 bp, Artificial sequence
  SiRNA target sequence
aatatatttatagaaatacggcaaaa

SEQ ID NO: 77270 - DNA, 26 bp, Artificial sequence
  SiRNA target sequence
atatatttatagaaatacggcaaaat

SEQ ID NO: 77271 - DNA, 26 bp, Artificial sequence
  SiRNA target sequence
tatatttatagaaatacggcaaaatc

SEQ ID NO: 77272 - DNA, 26 bp, Artificial sequence
  SiRNA target sequence
atatttatagaaatacggcaaaatct

SEQ ID NO: 77273 - DNA, 26 bp, Artificial sequence
  SiRNA target sequence
tatttatagaaatacggcaaaatcta

SEQ ID NO: 77274 - DNA, 26 bp, Artificial sequence
  SiRNA target sequence
atttatagaaatacggcaaaatctac

SEQ ID NO: 77275 - DNA, 26 bp, Artificial sequence
  SiRNA target sequence
tttatagaaatacggcaaaatctaca

SEQ ID NO: 77276 - DNA, 26 bp, Artificial sequence
  SiRNA target sequence
ttatagaaatacggcaaaatctacat

SEQ ID NO: 77277 - DNA, 26 bp, Artificial sequence
  SiRNA target sequence
tatagaaatacggcaaaatctacatt

SEQ ID NO: 77278 - DNA, 26 bp, Artificial sequence
  SiRNA target sequence
atagaaatacggcaaaatctacattc

SEQ ID NO: 77279 - DNA, 26 bp, Artificial sequence
  SiRNA target sequence
tagaaatacggcaaaatctacattca

SEQ ID NO: 77280 - DNA, 26 bp, Artificial sequence
  SiRNA target sequence
agaaatacggcaaaatctacattcaa

SEQ ID NO: 77281 - DNA, 26 bp, Artificial sequence
  SiRNA target sequence
gaaatacggcaaaatctacattcaaa

SEQ ID NO: 77282 - DNA, 26 bp, Artificial sequence
  SiRNA target sequence
aaatacggcaaaatctacattcaaag

SEQ ID NO: 77283 - DNA, 26 bp, Artificial sequence
  SiRNA target sequence
aatacggcaaaatctacattcaaagg

SEQ ID NO: 77284 - DNA, 26 bp, Artificial sequence
  SiRNA target sequence
atacggcaaaatctacattcaaaggc

SEQ ID NO: 77285 - DNA, 26 bp, Artificial sequence
  SiRNA target sequence
tacggcaaaatctacattcaaaggct

SEQ ID NO: 77286 - DNA, 26 bp, Artificial sequence
  SiRNA target sequence
acggcaaaatctacattcaaaggctt

SEQ ID NO: 77287 - DNA, 26 bp, Artificial sequence
  SiRNA target sequence
cggcaaaatctacattcaaaggcttc

SEQ ID NO: 77288 - DNA, 26 bp, Artificial sequence
  SiRNA target sequence
ggcaaaatctacattcaaaggcttca

SEQ ID NO: 77289 - DNA, 26 bp, Artificial sequence
  SiRNA target sequence
gcaaaatctacattcaaaggcttcat

SEQ ID NO: 77290 - DNA, 26 bp, Artificial sequence
  SiRNA target sequence
caaaatctacattcaaaggcttcatt

SEQ ID NO: 77291 - DNA, 26 bp, Artificial sequence
  SiRNA target sequence
aaaatctacattcaaaggcttcattt

SEQ ID NO: 77292 - DNA, 26 bp, Artificial sequence
  SiRNA target sequence
aaatctacattcaaaggcttcatttc

SEQ ID NO: 77293 - DNA, 26 bp, Artificial sequence
  SiRNA target sequence
aatctacattcaaaggcttcatttct

SEQ ID NO: 77294 - DNA, 26 bp, Artificial sequence
  SiRNA target sequence
atctacattcaaaggcttcatttctc

SEQ ID NO: 77295 - DNA, 26 bp, Artificial sequence
  SiRNA target sequence
tctacattcaaaggcttcatttctct

SEQ ID NO: 77296 - DNA, 26 bp, Artificial sequence
  SiRNA target sequence
ctacattcaaaggcttcatttctctt

SEQ ID NO: 77297 - DNA, 26 bp, Artificial sequence
  SiRNA target sequence
tacattcaaaggcttcatttctcttt

SEQ ID NO: 77298 - DNA, 26 bp, Artificial sequence
  SiRNA target sequence
acattcaaaggcttcatttctctttc

SEQ ID NO: 77299 - DNA, 26 bp, Artificial sequence
  SiRNA target sequence
cattcaaaggcttcatttctctttca

SEQ ID NO: 77300 - DNA, 26 bp, Artificial sequence
  SiRNA target sequence
attcaaaggcttcatttctctttcac

SEQ ID NO: 77301 - DNA, 26 bp, Artificial sequence
  SiRNA target sequence
ttcaaaggcttcatttctctttcacc

SEQ ID NO: 77302 - DNA, 26 bp, Artificial sequence
  SiRNA target sequence
tcaaaggcttcatttctctttcacct

SEQ ID NO: 77303 - DNA, 26 bp, Artificial sequence
  SiRNA target sequence
caaaggcttcatttctctttcaccta

SEQ ID NO: 77304 - DNA, 26 bp, Artificial sequence
  SiRNA target sequence
aaaggcttcatttctctttcacctaa

SEQ ID NO: 77305 - DNA, 26 bp, Artificial sequence
  SiRNA target sequence
aaggcttcatttctctttcacctaaa

SEQ ID NO: 77306 - DNA, 26 bp, Artificial sequence
  SiRNA target sequence
aggcttcatttctctttcacctaaaa

SEQ ID NO: 77307 - DNA, 26 bp, Artificial sequence
  SiRNA target sequence
ggcttcatttctctttcacctaaaaa

SEQ ID NO: 77308 - DNA, 26 bp, Artificial sequence
  SiRNA target sequence
gcttcatttctctttcacctaaaaat

SEQ ID NO: 77309 - DNA, 26 bp, Artificial sequence
  SiRNA target sequence
cttcatttctctttcacctaaaaatt

SEQ ID NO: 77310 - DNA, 26 bp, Artificial sequence
  SiRNA target sequence
ttcatttctctttcacctaaaaattt

SEQ ID NO: 77311 - DNA, 26 bp, Artificial sequence
  SiRNA target sequence
tcatttctctttcacctaaaaatttt

SEQ ID NO: 77312 - DNA, 26 bp, Artificial sequence
  SiRNA target sequence
catttctctttcacctaaaaatttta

SEQ ID NO: 77313 - DNA, 26 bp, Artificial sequence
  SiRNA target sequence
atttctctttcacctaaaaattttag

SEQ ID NO: 77314 - DNA, 26 bp, Artificial sequence
  SiRNA target sequence
tttctctttcacctaaaaattttagt

SEQ ID NO: 77315 - DNA, 26 bp, Artificial sequence
  SiRNA target sequence
ttctctttcacctaaaaattttagta

SEQ ID NO: 77316 - DNA, 26 bp, Artificial sequence
  SiRNA target sequence
tctctttcacctaaaaattttagtac

SEQ ID NO: 77317 - DNA, 26 bp, Artificial sequence
  SiRNA target sequence
ctctttcacctaaaaattttagtacc

SEQ ID NO: 77318 - DNA, 26 bp, Artificial sequence
  SiRNA target sequence
tctttcacctaaaaattttagtacca

SEQ ID NO: 77319 - DNA, 26 bp, Artificial sequence
  SiRNA target sequence
ctttcacctaaaaattttagtaccat

SEQ ID NO: 77320 - DNA, 26 bp, Artificial sequence
  SiRNA target sequence
tttcacctaaaaattttagtaccata

SEQ ID NO: 77321 - DNA, 26 bp, Artificial sequence
  SiRNA target sequence
ttcacctaaaaattttagtaccatag

SEQ ID NO: 77322 - DNA, 26 bp, Artificial sequence
  SiRNA target sequence
tcacctaaaaattttagtaccatagg

SEQ ID NO: 77323 - DNA, 26 bp, Artificial sequence
  SiRNA target sequence
cacctaaaaattttagtaccataggt

SEQ ID NO: 77324 - DNA, 26 bp, Artificial sequence
  SiRNA target sequence
acctaaaaattttagtaccataggtg

SEQ ID NO: 77325 - DNA, 26 bp, Artificial sequence
  SiRNA target sequence
cctaaaaattttagtaccataggtgg

SEQ ID NO: 77326 - DNA, 26 bp, Artificial sequence
  SiRNA target sequence
ctaaaaattttagtaccataggtggc

SEQ ID NO: 77327 - DNA, 26 bp, Artificial sequence
  SiRNA target sequence
taaaaattttagtaccataggtggcg

SEQ ID NO: 77328 - DNA, 26 bp, Artificial sequence
  SiRNA target sequence
aaaaattttagtaccataggtggcgg

SEQ ID NO: 77329 - DNA, 26 bp, Artificial sequence
  SiRNA target sequence
aaaattttagtaccataggtggcgga

SEQ ID NO: 77330 - DNA, 26 bp, Artificial sequence
  SiRNA target sequence
aaattttagtaccataggtggcggag

SEQ ID NO: 77331 - DNA, 26 bp, Artificial sequence
  SiRNA target sequence
aattttagtaccataggtggcggaga

SEQ ID NO: 77332 - DNA, 26 bp, Artificial sequence
  SiRNA target sequence
attttagtaccataggtggcggagaa

SEQ ID NO: 77333 - DNA, 26 bp, Artificial sequence
  SiRNA target sequence
ttttagtaccataggtggcggagaaa

SEQ ID NO: 77334 - DNA, 26 bp, Artificial sequence
  SiRNA target sequence
tttagtaccataggtggcggagaaat

SEQ ID NO: 77335 - DNA, 26 bp, Artificial sequence
  SiRNA target sequence
ttagtaccataggtggcggagaaatt

SEQ ID NO: 77336 - DNA, 26 bp, Artificial sequence
  SiRNA target sequence
tagtaccataggtggcggagaaattc

SEQ ID NO: 77337 - DNA, 26 bp, Artificial sequence
  SiRNA target sequence
agtaccataggtggcggagaaattca

SEQ ID NO: 77338 - DNA, 26 bp, Artificial sequence
  SiRNA target sequence
gtaccataggtggcggagaaattcaa

SEQ ID NO: 77339 - DNA, 26 bp, Artificial sequence
  SiRNA target sequence
taccataggtggcggagaaattcaaa

SEQ ID NO: 77340 - DNA, 26 bp, Artificial sequence
  SiRNA target sequence
accataggtggcggagaaattcaaac

SEQ ID NO: 77341 - DNA, 26 bp, Artificial sequence
  SiRNA target sequence
ccataggtggcggagaaattcaaaca

SEQ ID NO: 77342 - DNA, 26 bp, Artificial sequence
  SiRNA target sequence
cataggtggcggagaaattcaaacaa

SEQ ID NO: 77343 - DNA, 26 bp, Artificial sequence
  SiRNA target sequence
ataggtggcggagaaattcaaacaat

SEQ ID NO: 77344 - DNA, 26 bp, Artificial sequence
  SiRNA target sequence
taggtggcggagaaattcaaacaata

SEQ ID NO: 77345 - DNA, 26 bp, Artificial sequence
  SiRNA target sequence
aggtggcggagaaattcaaacaataa

SEQ ID NO: 77346 - DNA, 26 bp, Artificial sequence
  SiRNA target sequence
ggtggcggagaaattcaaacaataat

SEQ ID NO: 77347 - DNA, 26 bp, Artificial sequence
  SiRNA target sequence
gtggcggagaaattcaaacaataata

SEQ ID NO: 77348 - DNA, 26 bp, Artificial sequence
  SiRNA target sequence
tggcggagaaattcaaacaataatag

SEQ ID NO: 77349 - DNA, 26 bp, Artificial sequence
  SiRNA target sequence
ggcggagaaattcaaacaataataga

SEQ ID NO: 77350 - DNA, 26 bp, Artificial sequence
  SiRNA target sequence
gcggagaaattcaaacaataatagat

SEQ ID NO: 77351 - DNA, 26 bp, Artificial sequence
  SiRNA target sequence
cggagaaattcaaacaataatagata

SEQ ID NO: 77352 - DNA, 26 bp, Artificial sequence
  SiRNA target sequence
ggagaaattcaaacaataatagatag

SEQ ID NO: 77353 - DNA, 26 bp, Artificial sequence
  SiRNA target sequence
gagaaattcaaacaataatagataga

SEQ ID NO: 77354 - DNA, 26 bp, Artificial sequence
  SiRNA target sequence
agaaattcaaacaataatagatagaa

SEQ ID NO: 77355 - DNA, 26 bp, Artificial sequence
  SiRNA target sequence
gaaattcaaacaataatagatagaaa

SEQ ID NO: 77356 - DNA, 26 bp, Artificial sequence
  SiRNA target sequence
aaattcaaacaataatagatagaaaa

SEQ ID NO: 77357 - DNA, 26 bp, Artificial sequence
  SiRNA target sequence
aattcaaacaataatagatagaaaat

SEQ ID NO: 77358 - DNA, 26 bp, Artificial sequence
  SiRNA target sequence
attcaaacaataatagatagaaaatc

SEQ ID NO: 77359 - DNA, 26 bp, Artificial sequence
  SiRNA target sequence
ttcaaacaataatagatagaaaatca

SEQ ID NO: 77360 - DNA, 26 bp, Artificial sequence
  SiRNA target sequence
tcaaacaataatagatagaaaatcaa

SEQ ID NO: 77361 - DNA, 26 bp, Artificial sequence
  SiRNA target sequence
caaacaataatagatagaaaatcaaa

SEQ ID NO: 77362 - DNA, 26 bp, Artificial sequence
  SiRNA target sequence
aaacaataatagatagaaaatcaaaa

SEQ ID NO: 77363 - DNA, 26 bp, Artificial sequence
  SiRNA target sequence
aacaataatagatagaaaatcaaaat

SEQ ID NO: 77364 - DNA, 26 bp, Artificial sequence
  SiRNA target sequence
acaataatagatagaaaatcaaaatc

SEQ ID NO: 77365 - DNA, 26 bp, Artificial sequence
  SiRNA target sequence
caataatagatagaaaatcaaaatct

SEQ ID NO: 77366 - DNA, 26 bp, Artificial sequence
  SiRNA target sequence
aataatagatagaaaatcaaaatctg

SEQ ID NO: 77367 - DNA, 26 bp, Artificial sequence
  SiRNA target sequence
ataatagatagaaaatcaaaatctgc

SEQ ID NO: 77368 - DNA, 26 bp, Artificial sequence
  SiRNA target sequence
taatagatagaaaatcaaaatctgca

SEQ ID NO: 77369 - DNA, 26 bp, Artificial sequence
  SiRNA target sequence
aatagatagaaaatcaaaatctgcaa

SEQ ID NO: 77370 - DNA, 26 bp, Artificial sequence
  SiRNA target sequence
atagatagaaaatcaaaatctgcaag

SEQ ID NO: 77371 - DNA, 26 bp, Artificial sequence
  SiRNA target sequence
tagatagaaaatcaaaatctgcaagt

SEQ ID NO: 77372 - DNA, 26 bp, Artificial sequence
  SiRNA target sequence
agatagaaaatcaaaatctgcaagtg

SEQ ID NO: 77373 - DNA, 26 bp, Artificial sequence
  SiRNA target sequence
gatagaaaatcaaaatctgcaagtga

SEQ ID NO: 77374 - DNA, 26 bp, Artificial sequence
  SiRNA target sequence
atagaaaatcaaaatctgcaagtgaa

SEQ ID NO: 77375 - DNA, 26 bp, Artificial sequence
  SiRNA target sequence
tagaaaatcaaaatctgcaagtgaac

SEQ ID NO: 77376 - DNA, 26 bp, Artificial sequence
  SiRNA target sequence
agaaaatcaaaatctgcaagtgaact

SEQ ID NO: 77377 - DNA, 26 bp, Artificial sequence
  SiRNA target sequence
gaaaatcaaaatctgcaagtgaactt

SEQ ID NO: 77378 - DNA, 26 bp, Artificial sequence
  SiRNA target sequence
aaaatcaaaatctgcaagtgaactta

SEQ ID NO: 77379 - DNA, 26 bp, Artificial sequence
  SiRNA target sequence
aaatcaaaatctgcaagtgaacttat

SEQ ID NO: 77380 - DNA, 26 bp, Artificial sequence
  SiRNA target sequence
aatcaaaatctgcaagtgaacttatt

SEQ ID NO: 77381 - DNA, 26 bp, Artificial sequence
  SiRNA target sequence
atcaaaatctgcaagtgaacttattg

SEQ ID NO: 77382 - DNA, 26 bp, Artificial sequence
  SiRNA target sequence
tcaaaatctgcaagtgaacttattga

SEQ ID NO: 77383 - DNA, 26 bp, Artificial sequence
  SiRNA target sequence
caaaatctgcaagtgaacttattgaa

SEQ ID NO: 77384 - DNA, 26 bp, Artificial sequence
  SiRNA target sequence
aaaatctgcaagtgaacttattgaag

SEQ ID NO: 77385 - DNA, 26 bp, Artificial sequence
  SiRNA target sequence
aaatctgcaagtgaacttattgaagt

SEQ ID NO: 77386 - DNA, 26 bp, Artificial sequence
  SiRNA target sequence
aatctgcaagtgaacttattgaagtg

SEQ ID NO: 77387 - DNA, 26 bp, Artificial sequence
  SiRNA target sequence
atctgcaagtgaacttattgaagtgt

SEQ ID NO: 77388 - DNA, 26 bp, Artificial sequence
  SiRNA target sequence
tctgcaagtgaacttattgaagtgtt

SEQ ID NO: 77389 - DNA, 26 bp, Artificial sequence
  SiRNA target sequence
ctgcaagtgaacttattgaagtgttt

SEQ ID NO: 77390 - DNA, 26 bp, Artificial sequence
  SiRNA target sequence
tgcaagtgaacttattgaagtgtttc

SEQ ID NO: 77391 - DNA, 26 bp, Artificial sequence
  SiRNA target sequence
gcaagtgaacttattgaagtgtttct

SEQ ID NO: 77392 - DNA, 26 bp, Artificial sequence
  SiRNA target sequence
caagtgaacttattgaagtgtttctt

SEQ ID NO: 77393 - DNA, 26 bp, Artificial sequence
  SiRNA target sequence
aagtgaacttattgaagtgtttctta

SEQ ID NO: 77394 - DNA, 26 bp, Artificial sequence
  SiRNA target sequence
agtgaacttattgaagtgtttcttac

SEQ ID NO: 77395 - DNA, 26 bp, Artificial sequence
  SiRNA target sequence
gtgaacttattgaagtgtttcttaca

SEQ ID NO: 77396 - DNA, 26 bp, Artificial sequence
  SiRNA target sequence
tgaacttattgaagtgtttcttacaa

SEQ ID NO: 77397 - DNA, 26 bp, Artificial sequence
  SiRNA target sequence
gaacttattgaagtgtttcttacaag

SEQ ID NO: 77398 - DNA, 26 bp, Artificial sequence
  SiRNA target sequence
aacttattgaagtgtttcttacaagc

SEQ ID NO: 77399 - DNA, 26 bp, Artificial sequence
  SiRNA target sequence
acttattgaagtgtttcttacaagct

SEQ ID NO: 77400 - DNA, 26 bp, Artificial sequence
  SiRNA target sequence
cttattgaagtgtttcttacaagctt

SEQ ID NO: 77401 - DNA, 26 bp, Artificial sequence
  SiRNA target sequence
ttattgaagtgtttcttacaagcttg

SEQ ID NO: 77402 - DNA, 26 bp, Artificial sequence
  SiRNA target sequence
tattgaagtgtttcttacaagcttgc

SEQ ID NO: 77403 - DNA, 26 bp, Artificial sequence
  SiRNA target sequence
attgaagtgtttcttacaagcttgct

SEQ ID NO: 77404 - DNA, 26 bp, Artificial sequence
  SiRNA target sequence
ttgaagtgtttcttacaagcttgctt

SEQ ID NO: 77405 - DNA, 26 bp, Artificial sequence
  SiRNA target sequence
tgaagtgtttcttacaagcttgcttc

SEQ ID NO: 77406 - DNA, 26 bp, Artificial sequence
  SiRNA target sequence
gaagtgtttcttacaagcttgcttcc

SEQ ID NO: 77407 - DNA, 26 bp, Artificial sequence
  SiRNA target sequence
aagtgtttcttacaagcttgcttcca

SEQ ID NO: 77408 - DNA, 26 bp, Artificial sequence
  SiRNA target sequence
agtgtttcttacaagcttgcttccaa

SEQ ID NO: 77409 - DNA, 26 bp, Artificial sequence
  SiRNA target sequence
gtgtttcttacaagcttgcttccaat

SEQ ID NO: 77410 - DNA, 26 bp, Artificial sequence
  SiRNA target sequence
tgtttcttacaagcttgcttccaata

SEQ ID NO: 77411 - DNA, 26 bp, Artificial sequence
  SiRNA target sequence
gtttcttacaagcttgcttccaatat

SEQ ID NO: 77412 - DNA, 26 bp, Artificial sequence
  SiRNA target sequence
tttcttacaagcttgcttccaatatg

SEQ ID NO: 77413 - DNA, 26 bp, Artificial sequence
  SiRNA target sequence
ttcttacaagcttgcttccaatatgc

SEQ ID NO: 77414 - DNA, 26 bp, Artificial sequence
  SiRNA target sequence
tcttacaagcttgcttccaatatgcc

SEQ ID NO: 77415 - DNA, 26 bp, Artificial sequence
  SiRNA target sequence
cttacaagcttgcttccaatatgcct

SEQ ID NO: 77416 - DNA, 26 bp, Artificial sequence
  SiRNA target sequence
ttacaagcttgcttccaatatgcctt

SEQ ID NO: 77417 - DNA, 26 bp, Artificial sequence
  SiRNA target sequence
tacaagcttgcttccaatatgcctta

SEQ ID NO: 77418 - DNA, 26 bp, Artificial sequence
  SiRNA target sequence
acaagcttgcttccaatatgccttaa

SEQ ID NO: 77419 - DNA, 26 bp, Artificial sequence
  SiRNA target sequence
caagcttgcttccaatatgccttaaa

SEQ ID NO: 77420 - DNA, 26 bp, Artificial sequence
  SiRNA target sequence
aagcttgcttccaatatgccttaaac

SEQ ID NO: 77421 - DNA, 26 bp, Artificial sequence
  SiRNA target sequence
agcttgcttccaatatgccttaaact

SEQ ID NO: 77422 - DNA, 26 bp, Artificial sequence
  SiRNA target sequence
gcttgcttccaatatgccttaaactt

SEQ ID NO: 77423 - DNA, 26 bp, Artificial sequence
  SiRNA target sequence
cttgcttccaatatgccttaaacttt

SEQ ID NO: 77424 - DNA, 26 bp, Artificial sequence
  SiRNA target sequence
ttgcttccaatatgccttaaactttt

SEQ ID NO: 77425 - DNA, 26 bp, Artificial sequence
  SiRNA target sequence
tgcttccaatatgccttaaactttta

SEQ ID NO: 77426 - DNA, 26 bp, Artificial sequence
  SiRNA target sequence
gcttccaatatgccttaaacttttat

SEQ ID NO: 77427 - DNA, 26 bp, Artificial sequence
  SiRNA target sequence
cttccaatatgccttaaacttttatt

SEQ ID NO: 77428 - DNA, 26 bp, Artificial sequence
  SiRNA target sequence
ttccaatatgccttaaacttttattt

SEQ ID NO: 77429 - DNA, 26 bp, Artificial sequence
  SiRNA target sequence
tccaatatgccttaaacttttatttg

SEQ ID NO: 77430 - DNA, 26 bp, Artificial sequence
  SiRNA target sequence
ccaatatgccttaaacttttatttgc

SEQ ID NO: 77431 - DNA, 26 bp, Artificial sequence
  SiRNA target sequence
caatatgccttaaacttttatttgcc

SEQ ID NO: 77432 - DNA, 26 bp, Artificial sequence
  SiRNA target sequence
aatatgccttaaacttttatttgccc

SEQ ID NO: 77433 - DNA, 26 bp, Artificial sequence
  SiRNA target sequence
atatgccttaaacttttatttgccct

SEQ ID NO: 77434 - DNA, 26 bp, Artificial sequence
  SiRNA target sequence
tatgccttaaacttttatttgccctt

SEQ ID NO: 77435 - DNA, 26 bp, Artificial sequence
  SiRNA target sequence
atgccttaaacttttatttgccctta

SEQ ID NO: 77436 - DNA, 26 bp, Artificial sequence
  SiRNA target sequence
tgccttaaacttttatttgcccttat

SEQ ID NO: 77437 - DNA, 26 bp, Artificial sequence
  SiRNA target sequence
gccttaaacttttatttgcccttatt

SEQ ID NO: 77438 - DNA, 26 bp, Artificial sequence
  SiRNA target sequence
ccttaaacttttatttgcccttattg

SEQ ID NO: 77439 - DNA, 26 bp, Artificial sequence
  SiRNA target sequence
cttaaacttttatttgcccttattgc

SEQ ID NO: 77440 - DNA, 26 bp, Artificial sequence
  SiRNA target sequence
ttaaacttttatttgcccttattgca

SEQ ID NO: 77441 - DNA, 26 bp, Artificial sequence
  SiRNA target sequence
taaacttttatttgcccttattgcag

SEQ ID NO: 77442 - DNA, 26 bp, Artificial sequence
  SiRNA target sequence
aaacttttatttgcccttattgcagt

SEQ ID NO: 77443 - DNA, 26 bp, Artificial sequence
  SiRNA target sequence
aacttttatttgcccttattgcagtt

SEQ ID NO: 77444 - DNA, 26 bp, Artificial sequence
  SiRNA target sequence
acttttatttgcccttattgcagtta

SEQ ID NO: 77445 - DNA, 26 bp, Artificial sequence
  SiRNA target sequence
cttttatttgcccttattgcagttat

SEQ ID NO: 77446 - DNA, 26 bp, Artificial sequence
  SiRNA target sequence
ttttatttgcccttattgcagttata

SEQ ID NO: 77447 - DNA, 26 bp, Artificial sequence
  SiRNA target sequence
tttatttgcccttattgcagttataa

SEQ ID NO: 77448 - DNA, 26 bp, Artificial sequence
  SiRNA target sequence
ttatttgcccttattgcagttataaa

SEQ ID NO: 77449 - DNA, 26 bp, Artificial sequence
  SiRNA target sequence
tatttgcccttattgcagttataaaa

SEQ ID NO: 77450 - DNA, 26 bp, Artificial sequence
  SiRNA target sequence
atttgcccttattgcagttataaaaa

SEQ ID NO: 77451 - DNA, 26 bp, Artificial sequence
  SiRNA target sequence
tttgcccttattgcagttataaaaaa

SEQ ID NO: 77452 - DNA, 26 bp, Artificial sequence
  SiRNA target sequence
ttgcccttattgcagttataaaaaat

SEQ ID NO: 77453 - DNA, 26 bp, Artificial sequence
  SiRNA target sequence
tgcccttattgcagttataaaaaata

SEQ ID NO: 77454 - DNA, 26 bp, Artificial sequence
  SiRNA target sequence
gcccttattgcagttataaaaaatat

SEQ ID NO: 77455 - DNA, 26 bp, Artificial sequence
  SiRNA target sequence
cccttattgcagttataaaaaatatg

SEQ ID NO: 77456 - DNA, 26 bp, Artificial sequence
  SiRNA target sequence
ccttattgcagttataaaaaatatgg

SEQ ID NO: 77457 - DNA, 26 bp, Artificial sequence
  SiRNA target sequence
cttattgcagttataaaaaatatggg

SEQ ID NO: 77458 - DNA, 26 bp, Artificial sequence
  SiRNA target sequence
ttattgcagttataaaaaatatggga

SEQ ID NO: 77459 - DNA, 26 bp, Artificial sequence
  SiRNA target sequence
tattgcagttataaaaaatatgggag

SEQ ID NO: 77460 - DNA, 26 bp, Artificial sequence
  SiRNA target sequence
attgcagttataaaaaatatgggagg

SEQ ID NO: 77461 - DNA, 26 bp, Artificial sequence
  SiRNA target sequence
ttgcagttataaaaaatatgggaggt

SEQ ID NO: 77462 - DNA, 26 bp, Artificial sequence
  SiRNA target sequence
tgcagttataaaaaatatgggaggtc

SEQ ID NO: 77463 - DNA, 26 bp, Artificial sequence
  SiRNA target sequence
gcagttataaaaaatatgggaggtct

SEQ ID NO: 77464 - DNA, 26 bp, Artificial sequence
  SiRNA target sequence
cagttataaaaaatatgggaggtctt

SEQ ID NO: 77465 - DNA, 26 bp, Artificial sequence
  SiRNA target sequence
agttataaaaaatatgggaggtcttg

SEQ ID NO: 77466 - DNA, 26 bp, Artificial sequence
  SiRNA target sequence
gttataaaaaatatgggaggtcttgc

SEQ ID NO: 77467 - DNA, 26 bp, Artificial sequence
  SiRNA target sequence
ttataaaaaatatgggaggtcttgcg

SEQ ID NO: 77468 - DNA, 26 bp, Artificial sequence
  SiRNA target sequence
tataaaaaatatgggaggtcttgcgg

SEQ ID NO: 77469 - DNA, 26 bp, Artificial sequence
  SiRNA target sequence
ataaaaaatatgggaggtcttgcggg

SEQ ID NO: 77470 - DNA, 26 bp, Artificial sequence
  SiRNA target sequence
taaaaaatatgggaggtcttgcgggc

SEQ ID NO: 77471 - DNA, 26 bp, Artificial sequence
  SiRNA target sequence
aaaaaatatgggaggtcttgcgggct

SEQ ID NO: 77472 - DNA, 26 bp, Artificial sequence
  SiRNA target sequence
aaaaatatgggaggtcttgcgggctt

SEQ ID NO: 77473 - DNA, 26 bp, Artificial sequence
  SiRNA target sequence
aaaatatgggaggtcttgcgggcttc

SEQ ID NO: 77474 - DNA, 26 bp, Artificial sequence
  SiRNA target sequence
aaatatgggaggtcttgcgggcttca

SEQ ID NO: 77475 - DNA, 26 bp, Artificial sequence
  SiRNA target sequence
aatatgggaggtcttgcgggcttcat

SEQ ID NO: 77476 - DNA, 26 bp, Artificial sequence
  SiRNA target sequence
atatgggaggtcttgcgggcttcata

SEQ ID NO: 77477 - DNA, 26 bp, Artificial sequence
  SiRNA target sequence
tatgggaggtcttgcgggcttcataa

SEQ ID NO: 77478 - DNA, 26 bp, Artificial sequence
  SiRNA target sequence
atgggaggtcttgcgggcttcataat

SEQ ID NO: 77479 - DNA, 26 bp, Artificial sequence
  SiRNA target sequence
tgggaggtcttgcgggcttcataatg

SEQ ID NO: 77480 - DNA, 26 bp, Artificial sequence
  SiRNA target sequence
gggaggtcttgcgggcttcataatgt

SEQ ID NO: 77481 - DNA, 26 bp, Artificial sequence
  SiRNA target sequence
ggaggtcttgcgggcttcataatgtt

SEQ ID NO: 77482 - DNA, 26 bp, Artificial sequence
  SiRNA target sequence
gaggtcttgcgggcttcataatgttt

SEQ ID NO: 77483 - DNA, 26 bp, Artificial sequence
  SiRNA target sequence
aggtcttgcgggcttcataatgtttg

SEQ ID NO: 77484 - DNA, 26 bp, Artificial sequence
  SiRNA target sequence
ggtcttgcgggcttcataatgtttgt

SEQ ID NO: 77485 - DNA, 26 bp, Artificial sequence
  SiRNA target sequence
gtcttgcgggcttcataatgtttgtt

SEQ ID NO: 77486 - DNA, 26 bp, Artificial sequence
  SiRNA target sequence
tcttgcgggcttcataatgtttgttt

SEQ ID NO: 77487 - DNA, 26 bp, Artificial sequence
  SiRNA target sequence
cttgcgggcttcataatgtttgtttg

SEQ ID NO: 77488 - DNA, 26 bp, Artificial sequence
  SiRNA target sequence
ttgcgggcttcataatgtttgtttgt

SEQ ID NO: 77489 - DNA, 26 bp, Artificial sequence
  SiRNA target sequence
tgcgggcttcataatgtttgtttgtg

SEQ ID NO: 77490 - DNA, 26 bp, Artificial sequence
  SiRNA target sequence
gcgggcttcataatgtttgtttgtgt

SEQ ID NO: 77491 - DNA, 26 bp, Artificial sequence
  SiRNA target sequence
cgggcttcataatgtttgtttgtgtt

SEQ ID NO: 77492 - DNA, 26 bp, Artificial sequence
  SiRNA target sequence
gggcttcataatgtttgtttgtgttt

SEQ ID NO: 77493 - DNA, 26 bp, Artificial sequence
  SiRNA target sequence
ggcttcataatgtttgtttgtgtttc

SEQ ID NO: 77494 - DNA, 26 bp, Artificial sequence
  SiRNA target sequence
gcttcataatgtttgtttgtgtttct

SEQ ID NO: 77495 - DNA, 26 bp, Artificial sequence
  SiRNA target sequence
cttcataatgtttgtttgtgtttctt

SEQ ID NO: 77496 - DNA, 26 bp, Artificial sequence
  SiRNA target sequence
ttcataatgtttgtttgtgtttcttg

SEQ ID NO: 77497 - DNA, 26 bp, Artificial sequence
  SiRNA target sequence
tcataatgtttgtttgtgtttcttgc

SEQ ID NO: 77498 - DNA, 26 bp, Artificial sequence
  SiRNA target sequence
cataatgtttgtttgtgtttcttgct

SEQ ID NO: 77499 - DNA, 26 bp, Artificial sequence
  SiRNA target sequence
ataatgtttgtttgtgtttcttgcta

SEQ ID NO: 77500 - DNA, 26 bp, Artificial sequence
  SiRNA target sequence
taatgtttgtttgtgtttcttgctat

SEQ ID NO: 77501 - DNA, 26 bp, Artificial sequence
  SiRNA target sequence
aatgtttgtttgtgtttcttgctatg

SEQ ID NO: 77502 - DNA, 26 bp, Artificial sequence
  SiRNA target sequence
atgtttgtttgtgtttcttgctatgc

SEQ ID NO: 77503 - DNA, 26 bp, Artificial sequence
  SiRNA target sequence
tgtttgtttgtgtttcttgctatgcg

SEQ ID NO: 77504 - DNA, 26 bp, Artificial sequence
  SiRNA target sequence
gtttgtttgtgtttcttgctatgcga

SEQ ID NO: 77505 - DNA, 26 bp, Artificial sequence
  SiRNA target sequence
tttgtttgtgtttcttgctatgcgac

SEQ ID NO: 77506 - DNA, 26 bp, Artificial sequence
  SiRNA target sequence
ttgtttgtgtttcttgctatgcgact

SEQ ID NO: 77507 - DNA, 26 bp, Artificial sequence
  SiRNA target sequence
tgtttgtgtttcttgctatgcgactg

SEQ ID NO: 77508 - DNA, 26 bp, Artificial sequence
  SiRNA target sequence
gtttgtgtttcttgctatgcgactgt

SEQ ID NO: 77509 - DNA, 26 bp, Artificial sequence
  SiRNA target sequence
tttgtgtttcttgctatgcgactgtg

SEQ ID NO: 77510 - DNA, 26 bp, Artificial sequence
  SiRNA target sequence
ttgtgtttcttgctatgcgactgtga

SEQ ID NO: 77511 - DNA, 26 bp, Artificial sequence
  SiRNA target sequence
tgtgtttcttgctatgcgactgtgac

SEQ ID NO: 77512 - DNA, 26 bp, Artificial sequence
  SiRNA target sequence
gtgtttcttgctatgcgactgtgact

SEQ ID NO: 77513 - DNA, 26 bp, Artificial sequence
  SiRNA target sequence
tgtttcttgctatgcgactgtgacta

SEQ ID NO: 77514 - DNA, 26 bp, Artificial sequence
  SiRNA target sequence
gtttcttgctatgcgactgtgactat

SEQ ID NO: 77515 - DNA, 26 bp, Artificial sequence
  SiRNA target sequence
tttcttgctatgcgactgtgactata

SEQ ID NO: 77516 - DNA, 26 bp, Artificial sequence
  SiRNA target sequence
ttcttgctatgcgactgtgactatat

SEQ ID NO: 77517 - DNA, 26 bp, Artificial sequence
  SiRNA target sequence
tcttgctatgcgactgtgactatatt

SEQ ID NO: 77518 - DNA, 26 bp, Artificial sequence
  SiRNA target sequence
cttgctatgcgactgtgactatattg

SEQ ID NO: 77519 - DNA, 26 bp, Artificial sequence
  SiRNA target sequence
ttgctatgcgactgtgactatattga

SEQ ID NO: 77520 - DNA, 26 bp, Artificial sequence
  SiRNA target sequence
tgctatgcgactgtgactatattgat

SEQ ID NO: 77521 - DNA, 26 bp, Artificial sequence
  SiRNA target sequence
gctatgcgactgtgactatattgata

SEQ ID NO: 77522 - DNA, 26 bp, Artificial sequence
  SiRNA target sequence
ctatgcgactgtgactatattgatag

SEQ ID NO: 77523 - DNA, 26 bp, Artificial sequence
  SiRNA target sequence
tatgcgactgtgactatattgatagc

SEQ ID NO: 77524 - DNA, 26 bp, Artificial sequence
  SiRNA target sequence
atgcgactgtgactatattgatagca

SEQ ID NO: 77525 - DNA, 26 bp, Artificial sequence
  SiRNA target sequence
tgcgactgtgactatattgatagcac

SEQ ID NO: 77526 - DNA, 26 bp, Artificial sequence
  SiRNA target sequence
gcgactgtgactatattgatagcaca

SEQ ID NO: 77527 - DNA, 26 bp, Artificial sequence
  SiRNA target sequence
cgactgtgactatattgatagcacaa

SEQ ID NO: 77528 - DNA, 26 bp, Artificial sequence
  SiRNA target sequence
gactgtgactatattgatagcacaat

SEQ ID NO: 77529 - DNA, 26 bp, Artificial sequence
  SiRNA target sequence
actgtgactatattgatagcacaatg

SEQ ID NO: 77530 - DNA, 26 bp, Artificial sequence
  SiRNA target sequence
ctgtgactatattgatagcacaatgg

SEQ ID NO: 77531 - DNA, 26 bp, Artificial sequence
  SiRNA target sequence
tgtgactatattgatagcacaatgga

SEQ ID NO: 77532 - DNA, 26 bp, Artificial sequence
  SiRNA target sequence
gtgactatattgatagcacaatggag

SEQ ID NO: 77533 - DNA, 26 bp, Artificial sequence
  SiRNA target sequence
tgactatattgatagcacaatggaga

SEQ ID NO: 77534 - DNA, 26 bp, Artificial sequence
  SiRNA target sequence
gactatattgatagcacaatggagat

SEQ ID NO: 77535 - DNA, 26 bp, Artificial sequence
  SiRNA target sequence
actatattgatagcacaatggagatc

SEQ ID NO: 77536 - DNA, 26 bp, Artificial sequence
  SiRNA target sequence
ctatattgatagcacaatggagatct

SEQ ID NO: 77537 - DNA, 26 bp, Artificial sequence
  SiRNA target sequence
tatattgatagcacaatggagatcta

SEQ ID NO: 77538 - DNA, 26 bp, Artificial sequence
  SiRNA target sequence
atattgatagcacaatggagatctaa

SEQ ID NO: 77539 - DNA, 26 bp, Artificial sequence
  SiRNA target sequence
tattgatagcacaatggagatctaat

SEQ ID NO: 77540 - DNA, 26 bp, Artificial sequence
  SiRNA target sequence
attgatagcacaatggagatctaata

SEQ ID NO: 77541 - DNA, 26 bp, Artificial sequence
  SiRNA target sequence
ttgatagcacaatggagatctaatat

SEQ ID NO: 77542 - DNA, 26 bp, Artificial sequence
  SiRNA target sequence
tgatagcacaatggagatctaatatt

SEQ ID NO: 77543 - DNA, 26 bp, Artificial sequence
  SiRNA target sequence
gatagcacaatggagatctaatatta

SEQ ID NO: 77544 - DNA, 26 bp, Artificial sequence
  SiRNA target sequence
atagcacaatggagatctaatattag

SEQ ID NO: 77545 - DNA, 26 bp, Artificial sequence
  SiRNA target sequence
tagcacaatggagatctaatattaga

SEQ ID NO: 77546 - DNA, 26 bp, Artificial sequence
  SiRNA target sequence
agcacaatggagatctaatattagaa

SEQ ID NO: 77547 - DNA, 26 bp, Artificial sequence
  SiRNA target sequence
gcacaatggagatctaatattagaag

SEQ ID NO: 77548 - DNA, 26 bp, Artificial sequence
  SiRNA target sequence
cacaatggagatctaatattagaaga

SEQ ID NO: 77549 - DNA, 26 bp, Artificial sequence
  SiRNA target sequence
acaatggagatctaatattagaagag

SEQ ID NO: 77550 - DNA, 26 bp, Artificial sequence
  SiRNA target sequence
caatggagatctaatattagaagaga

SEQ ID NO: 77551 - DNA, 26 bp, Artificial sequence
  SiRNA target sequence
aatggagatctaatattagaagagaa

SEQ ID NO: 77552 - DNA, 26 bp, Artificial sequence
  SiRNA target sequence
atggagatctaatattagaagagaac

SEQ ID NO: 77553 - DNA, 26 bp, Artificial sequence
  SiRNA target sequence
tggagatctaatattagaagagaact

SEQ ID NO: 77554 - DNA, 26 bp, Artificial sequence
  SiRNA target sequence
ggagatctaatattagaagagaactt

SEQ ID NO: 77555 - DNA, 26 bp, Artificial sequence
  SiRNA target sequence
gagatctaatattagaagagaactta

SEQ ID NO: 77556 - DNA, 26 bp, Artificial sequence
  SiRNA target sequence
agatctaatattagaagagaacttaa

SEQ ID NO: 77557 - DNA, 26 bp, Artificial sequence
  SiRNA target sequence
gatctaatattagaagagaacttaat

SEQ ID NO: 77558 - DNA, 26 bp, Artificial sequence
  SiRNA target sequence
atctaatattagaagagaacttaata

SEQ ID NO: 77559 - DNA, 26 bp, Artificial sequence
  SiRNA target sequence
tctaatattagaagagaacttaataa

SEQ ID NO: 77560 - DNA, 26 bp, Artificial sequence
  SiRNA target sequence
ctaatattagaagagaacttaataac

SEQ ID NO: 77561 - DNA, 26 bp, Artificial sequence
  SiRNA target sequence
taatattagaagagaacttaataact

SEQ ID NO: 77562 - DNA, 26 bp, Artificial sequence
  SiRNA target sequence
aatattagaagagaacttaataactc

SEQ ID NO: 77563 - DNA, 26 bp, Artificial sequence
  SiRNA target sequence
atattagaagagaacttaataactct

SEQ ID NO: 77564 - DNA, 26 bp, Artificial sequence
  SiRNA target sequence
tattagaagagaacttaataactctg

SEQ ID NO: 77565 - DNA, 26 bp, Artificial sequence
  SiRNA target sequence
attagaagagaacttaataactctga

SEQ ID NO: 77566 - DNA, 26 bp, Artificial sequence
  SiRNA target sequence
ttagaagagaacttaataactctgaa

SEQ ID NO: 77567 - DNA, 26 bp, Artificial sequence
  SiRNA target sequence
tagaagagaacttaataactctgaaa

SEQ ID NO: 77568 - DNA, 26 bp, Artificial sequence
  SiRNA target sequence
agaagagaacttaataactctgaaaa

SEQ ID NO: 77569 - DNA, 26 bp, Artificial sequence
  SiRNA target sequence
gaagagaacttaataactctgaaaat

SEQ ID NO: 77570 - DNA, 26 bp, Artificial sequence
  SiRNA target sequence
aagagaacttaataactctgaaaata

SEQ ID NO: 77571 - DNA, 26 bp, Artificial sequence
  SiRNA target sequence
agagaacttaataactctgaaaatag

SEQ ID NO: 77572 - DNA, 26 bp, Artificial sequence
  SiRNA target sequence
gagaacttaataactctgaaaataga

SEQ ID NO: 77573 - DNA, 26 bp, Artificial sequence
  SiRNA target sequence
agaacttaataactctgaaaatagat

SEQ ID NO: 77574 - DNA, 26 bp, Artificial sequence
  SiRNA target sequence
gaacttaataactctgaaaatagatc

SEQ ID NO: 77575 - DNA, 26 bp, Artificial sequence
  SiRNA target sequence
aacttaataactctgaaaatagatct

SEQ ID NO: 77576 - DNA, 26 bp, Artificial sequence
  SiRNA target sequence
acttaataactctgaaaatagatcta

SEQ ID NO: 77577 - DNA, 26 bp, Artificial sequence
  SiRNA target sequence
cttaataactctgaaaatagatctag

SEQ ID NO: 77578 - DNA, 26 bp, Artificial sequence
  SiRNA target sequence
ttaataactctgaaaatagatctagt

SEQ ID NO: 77579 - DNA, 26 bp, Artificial sequence
  SiRNA target sequence
taataactctgaaaatagatctagta

SEQ ID NO: 77580 - DNA, 26 bp, Artificial sequence
  SiRNA target sequence
aataactctgaaaatagatctagtaa

SEQ ID NO: 77581 - DNA, 26 bp, Artificial sequence
  SiRNA target sequence
ataactctgaaaatagatctagtaat

SEQ ID NO: 77582 - DNA, 26 bp, Artificial sequence
  SiRNA target sequence
taactctgaaaatagatctagtaata

SEQ ID NO: 77583 - DNA, 26 bp, Artificial sequence
  SiRNA target sequence
aactctgaaaatagatctagtaataa

SEQ ID NO: 77584 - DNA, 26 bp, Artificial sequence
  SiRNA target sequence
actctgaaaatagatctagtaataaa

SEQ ID NO: 77585 - DNA, 26 bp, Artificial sequence
  SiRNA target sequence
ctctgaaaatagatctagtaataaac

SEQ ID NO: 77586 - DNA, 26 bp, Artificial sequence
  SiRNA target sequence
tctgaaaatagatctagtaataaact

SEQ ID NO: 77587 - DNA, 26 bp, Artificial sequence
  SiRNA target sequence
ctgaaaatagatctagtaataaacta

SEQ ID NO: 77588 - DNA, 26 bp, Artificial sequence
  SiRNA target sequence
tgaaaatagatctagtaataaactac

SEQ ID NO: 77589 - DNA, 26 bp, Artificial sequence
  SiRNA target sequence
gaaaatagatctagtaataaactaca

SEQ ID NO: 77590 - DNA, 26 bp, Artificial sequence
  SiRNA target sequence
aaaatagatctagtaataaactacaa

SEQ ID NO: 77591 - DNA, 26 bp, Artificial sequence
  SiRNA target sequence
aaatagatctagtaataaactacaag

SEQ ID NO: 77592 - DNA, 26 bp, Artificial sequence
  SiRNA target sequence
aatagatctagtaataaactacaaga

SEQ ID NO: 77593 - DNA, 26 bp, Artificial sequence
  SiRNA target sequence
atagatctagtaataaactacaagat

SEQ ID NO: 77594 - DNA, 26 bp, Artificial sequence
  SiRNA target sequence
tagatctagtaataaactacaagatg

SEQ ID NO: 77595 - DNA, 26 bp, Artificial sequence
  SiRNA target sequence
agatctagtaataaactacaagatgg

SEQ ID NO: 77596 - DNA, 26 bp, Artificial sequence
  SiRNA target sequence
gatctagtaataaactacaagatgga

SEQ ID NO: 77597 - DNA, 26 bp, Artificial sequence
  SiRNA target sequence
atctagtaataaactacaagatggat

SEQ ID NO: 77598 - DNA, 26 bp, Artificial sequence
  SiRNA target sequence
tctagtaataaactacaagatggatt

SEQ ID NO: 77599 - DNA, 26 bp, Artificial sequence
  SiRNA target sequence
ctagtaataaactacaagatggatta

SEQ ID NO: 77600 - DNA, 26 bp, Artificial sequence
  SiRNA target sequence
tagtaataaactacaagatggattaa

SEQ ID NO: 77601 - DNA, 26 bp, Artificial sequence
  SiRNA target sequence
agtaataaactacaagatggattaaa

SEQ ID NO: 77602 - DNA, 26 bp, Artificial sequence
  SiRNA target sequence
gtaataaactacaagatggattaaat

SEQ ID NO: 77603 - DNA, 26 bp, Artificial sequence
  SiRNA target sequence
taataaactacaagatggattaaata

SEQ ID NO: 77604 - DNA, 26 bp, Artificial sequence
  SiRNA target sequence
aataaactacaagatggattaaataa

SEQ ID NO: 77605 - DNA, 26 bp, Artificial sequence
  SiRNA target sequence
ataaactacaagatggattaaataat

SEQ ID NO: 77606 - DNA, 26 bp, Artificial sequence
  SiRNA target sequence
taaactacaagatggattaaataatc

SEQ ID NO: 77607 - DNA, 26 bp, Artificial sequence
  SiRNA target sequence
aaactacaagatggattaaataatca

SEQ ID NO: 77608 - DNA, 26 bp, Artificial sequence
  SiRNA target sequence
aactacaagatggattaaataatcat

SEQ ID NO: 77609 - DNA, 26 bp, Artificial sequence
  SiRNA target sequence
actacaagatggattaaataatcatg

SEQ ID NO: 77610 - DNA, 26 bp, Artificial sequence
  SiRNA target sequence
ctacaagatggattaaataatcatga

SEQ ID NO: 77611 - DNA, 26 bp, Artificial sequence
  SiRNA target sequence
tacaagatggattaaataatcatgaa

SEQ ID NO: 77612 - DNA, 26 bp, Artificial sequence
  SiRNA target sequence
acaagatggattaaataatcatgaaa

SEQ ID NO: 77613 - DNA, 26 bp, Artificial sequence
  SiRNA target sequence
caagatggattaaataatcatgaaac

SEQ ID NO: 77614 - DNA, 26 bp, Artificial sequence
  SiRNA target sequence
aagatggattaaataatcatgaaaca

SEQ ID NO: 77615 - DNA, 26 bp, Artificial sequence
  SiRNA target sequence
agatggattaaataatcatgaaacaa

SEQ ID NO: 77616 - DNA, 26 bp, Artificial sequence
  SiRNA target sequence
gatggattaaataatcatgaaacaat

SEQ ID NO: 77617 - DNA, 26 bp, Artificial sequence
  SiRNA target sequence
atggattaaataatcatgaaacaatc

SEQ ID NO: 77618 - DNA, 26 bp, Artificial sequence
  SiRNA target sequence
tggattaaataatcatgaaacaatcg

SEQ ID NO: 77619 - DNA, 26 bp, Artificial sequence
  SiRNA target sequence
ggattaaataatcatgaaacaatcgt

SEQ ID NO: 77620 - DNA, 26 bp, Artificial sequence
  SiRNA target sequence
gattaaataatcatgaaacaatcgtc

SEQ ID NO: 77621 - DNA, 26 bp, Artificial sequence
  SiRNA target sequence
attaaataatcatgaaacaatcgtct

SEQ ID NO: 77622 - DNA, 26 bp, Artificial sequence
  SiRNA target sequence
ttaaataatcatgaaacaatcgtctc

SEQ ID NO: 77623 - DNA, 26 bp, Artificial sequence
  SiRNA target sequence
taaataatcatgaaacaatcgtctcc

SEQ ID NO: 77624 - DNA, 26 bp, Artificial sequence
  SiRNA target sequence
aaataatcatgaaacaatcgtctcct

SEQ ID NO: 77625 - DNA, 26 bp, Artificial sequence
  SiRNA target sequence
aataatcatgaaacaatcgtctcctt

SEQ ID NO: 77626 - DNA, 26 bp, Artificial sequence
  SiRNA target sequence
ataatcatgaaacaatcgtctccttt

SEQ ID NO: 77627 - DNA, 26 bp, Artificial sequence
  SiRNA target sequence
taatcatgaaacaatcgtctcctttg

SEQ ID NO: 77628 - DNA, 26 bp, Artificial sequence
  SiRNA target sequence
aatcatgaaacaatcgtctcctttgg

SEQ ID NO: 77629 - DNA, 26 bp, Artificial sequence
  SiRNA target sequence
atcatgaaacaatcgtctcctttggg

SEQ ID NO: 77630 - DNA, 26 bp, Artificial sequence
  SiRNA target sequence
tcatgaaacaatcgtctcctttggga

SEQ ID NO: 77631 - DNA, 26 bp, Artificial sequence
  SiRNA target sequence
catgaaacaatcgtctcctttgggac

SEQ ID NO: 77632 - DNA, 26 bp, Artificial sequence
  SiRNA target sequence
atgaaacaatcgtctcctttgggact

SEQ ID NO: 77633 - DNA, 26 bp, Artificial sequence
  SiRNA target sequence
tgaaacaatcgtctcctttgggacta

SEQ ID NO: 77634 - DNA, 26 bp, Artificial sequence
  SiRNA target sequence
gaaacaatcgtctcctttgggactac

SEQ ID NO: 77635 - DNA, 26 bp, Artificial sequence
  SiRNA target sequence
aaacaatcgtctcctttgggactaca

SEQ ID NO: 77636 - DNA, 26 bp, Artificial sequence
  SiRNA target sequence
aacaatcgtctcctttgggactacag

SEQ ID NO: 77637 - DNA, 26 bp, Artificial sequence
  SiRNA target sequence
acaatcgtctcctttgggactacaga

SEQ ID NO: 77638 - DNA, 26 bp, Artificial sequence
  SiRNA target sequence
caatcgtctcctttgggactacagat

SEQ ID NO: 77639 - DNA, 26 bp, Artificial sequence
  SiRNA target sequence
aatcgtctcctttgggactacagatc

SEQ ID NO: 77640 - DNA, 26 bp, Artificial sequence
  SiRNA target sequence
atcgtctcctttgggactacagatct

SEQ ID NO: 77641 - DNA, 26 bp, Artificial sequence
  SiRNA target sequence
tcgtctcctttgggactacagatctt

SEQ ID NO: 77642 - DNA, 26 bp, Artificial sequence
  SiRNA target sequence
cgtctcctttgggactacagatcttg

SEQ ID NO: 77643 - DNA, 26 bp, Artificial sequence
  SiRNA target sequence
gtctcctttgggactacagatcttga

SEQ ID NO: 77644 - DNA, 26 bp, Artificial sequence
  SiRNA target sequence
tctcctttgggactacagatcttgaa

SEQ ID NO: 77645 - DNA, 26 bp, Artificial sequence
  SiRNA target sequence
ctcctttgggactacagatcttgaag

SEQ ID NO: 77646 - DNA, 26 bp, Artificial sequence
  SiRNA target sequence
tcctttgggactacagatcttgaagt

SEQ ID NO: 77647 - DNA, 26 bp, Artificial sequence
  SiRNA target sequence
cctttgggactacagatcttgaagta

SEQ ID NO: 77648 - DNA, 26 bp, Artificial sequence
  SiRNA target sequence
ctttgggactacagatcttgaagtag

SEQ ID NO: 77649 - DNA, 26 bp, Artificial sequence
  SiRNA target sequence
tttgggactacagatcttgaagtaga

SEQ ID NO: 77650 - DNA, 26 bp, Artificial sequence
  SiRNA target sequence
ttgggactacagatcttgaagtagat

SEQ ID NO: 77651 - DNA, 26 bp, Artificial sequence
  SiRNA target sequence
tgggactacagatcttgaagtagatg

SEQ ID NO: 77652 - DNA, 26 bp, Artificial sequence
  SiRNA target sequence
gggactacagatcttgaagtagatga

SEQ ID NO: 77653 - DNA, 26 bp, Artificial sequence
  SiRNA target sequence
ggactacagatcttgaagtagatgaa

SEQ ID NO: 77654 - DNA, 26 bp, Artificial sequence
  SiRNA target sequence
gactacagatcttgaagtagatgaat

SEQ ID NO: 77655 - DNA, 26 bp, Artificial sequence
  SiRNA target sequence
actacagatcttgaagtagatgaata

SEQ ID NO: 77656 - DNA, 26 bp, Artificial sequence
  SiRNA target sequence
ctacagatcttgaagtagatgaatat

SEQ ID NO: 77657 - DNA, 26 bp, Artificial sequence
  SiRNA target sequence
tacagatcttgaagtagatgaatatg

SEQ ID NO: 77658 - DNA, 26 bp, Artificial sequence
  SiRNA target sequence
acagatcttgaagtagatgaatatga

SEQ ID NO: 77659 - DNA, 26 bp, Artificial sequence
  SiRNA target sequence
cagatcttgaagtagatgaatatgat

SEQ ID NO: 77660 - DNA, 26 bp, Artificial sequence
  SiRNA target sequence
agatcttgaagtagatgaatatgatc

SEQ ID NO: 77661 - DNA, 26 bp, Artificial sequence
  SiRNA target sequence
gatcttgaagtagatgaatatgatca

SEQ ID NO: 77662 - DNA, 26 bp, Artificial sequence
  SiRNA target sequence
atcttgaagtagatgaatatgatcag

SEQ ID NO: 77663 - DNA, 26 bp, Artificial sequence
  SiRNA target sequence
tcttgaagtagatgaatatgatcagt

SEQ ID NO: 77664 - DNA, 26 bp, Artificial sequence
  SiRNA target sequence
cttgaagtagatgaatatgatcagtt

SEQ ID NO: 77665 - DNA, 26 bp, Artificial sequence
  SiRNA target sequence
ttgaagtagatgaatatgatcagttt

SEQ ID NO: 77666 - DNA, 26 bp, Artificial sequence
  SiRNA target sequence
tgaagtagatgaatatgatcagtttc

SEQ ID NO: 77667 - DNA, 26 bp, Artificial sequence
  SiRNA target sequence
gaagtagatgaatatgatcagtttct

SEQ ID NO: 77668 - DNA, 26 bp, Artificial sequence
  SiRNA target sequence
aagtagatgaatatgatcagtttctt

SEQ ID NO: 77669 - DNA, 26 bp, Artificial sequence
  SiRNA target sequence
agtagatgaatatgatcagtttctta

SEQ ID NO: 77670 - DNA, 26 bp, Artificial sequence
  SiRNA target sequence
gtagatgaatatgatcagtttcttaa

SEQ ID NO: 77671 - DNA, 26 bp, Artificial sequence
  SiRNA target sequence
tagatgaatatgatcagtttcttaaa

SEQ ID NO: 77672 - DNA, 26 bp, Artificial sequence
  SiRNA target sequence
agatgaatatgatcagtttcttaaaa

SEQ ID NO: 77673 - DNA, 26 bp, Artificial sequence
  SiRNA target sequence
gatgaatatgatcagtttcttaaaat

SEQ ID NO: 77674 - DNA, 26 bp, Artificial sequence
  SiRNA target sequence
atgaatatgatcagtttcttaaaatt

SEQ ID NO: 77675 - DNA, 26 bp, Artificial sequence
  SiRNA target sequence
tgaatatgatcagtttcttaaaatta

SEQ ID NO: 77676 - DNA, 26 bp, Artificial sequence
  SiRNA target sequence
gaatatgatcagtttcttaaaattaa

SEQ ID NO: 77677 - DNA, 26 bp, Artificial sequence
  SiRNA target sequence
aatatgatcagtttcttaaaattaat

SEQ ID NO: 77678 - DNA, 26 bp, Artificial sequence
  SiRNA target sequence
atatgatcagtttcttaaaattaatg

SEQ ID NO: 77679 - DNA, 26 bp, Artificial sequence
  SiRNA target sequence
tatgatcagtttcttaaaattaatgc

SEQ ID NO: 77680 - DNA, 26 bp, Artificial sequence
  SiRNA target sequence
atgatcagtttcttaaaattaatgca

SEQ ID NO: 77681 - DNA, 26 bp, Artificial sequence
  SiRNA target sequence
tgatcagtttcttaaaattaatgcat

SEQ ID NO: 77682 - DNA, 26 bp, Artificial sequence
  SiRNA target sequence
gatcagtttcttaaaattaatgcatc

SEQ ID NO: 77683 - DNA, 26 bp, Artificial sequence
  SiRNA target sequence
atcagtttcttaaaattaatgcatct

SEQ ID NO: 77684 - DNA, 26 bp, Artificial sequence
  SiRNA target sequence
tcagtttcttaaaattaatgcatcta

SEQ ID NO: 77685 - DNA, 26 bp, Artificial sequence
  SiRNA target sequence
cagtttcttaaaattaatgcatctaa

SEQ ID NO: 77686 - DNA, 26 bp, Artificial sequence
  SiRNA target sequence
agtttcttaaaattaatgcatctaat

SEQ ID NO: 77687 - DNA, 26 bp, Artificial sequence
  SiRNA target sequence
gtttcttaaaattaatgcatctaata

SEQ ID NO: 77688 - DNA, 26 bp, Artificial sequence
  SiRNA target sequence
tttcttaaaattaatgcatctaatag

SEQ ID NO: 77689 - DNA, 26 bp, Artificial sequence
  SiRNA target sequence
ttcttaaaattaatgcatctaatagt

SEQ ID NO: 77690 - DNA, 26 bp, Artificial sequence
  SiRNA target sequence
tcttaaaattaatgcatctaatagta

SEQ ID NO: 77691 - DNA, 26 bp, Artificial sequence
  SiRNA target sequence
cttaaaattaatgcatctaatagtaa

SEQ ID NO: 77692 - DNA, 26 bp, Artificial sequence
  SiRNA target sequence
ttaaaattaatgcatctaatagtaac

SEQ ID NO: 77693 - DNA, 26 bp, Artificial sequence
  SiRNA target sequence
taaaattaatgcatctaatagtaaca

SEQ ID NO: 77694 - DNA, 26 bp, Artificial sequence
  SiRNA target sequence
aaaattaatgcatctaatagtaacag

SEQ ID NO: 77695 - DNA, 26 bp, Artificial sequence
  SiRNA target sequence
aaattaatgcatctaatagtaacaga

SEQ ID NO: 77696 - DNA, 26 bp, Artificial sequence
  SiRNA target sequence
aattaatgcatctaatagtaacagat

SEQ ID NO: 77697 - DNA, 26 bp, Artificial sequence
  SiRNA target sequence
attaatgcatctaatagtaacagatt

SEQ ID NO: 77698 - DNA, 26 bp, Artificial sequence
  SiRNA target sequence
ttaatgcatctaatagtaacagatta

SEQ ID NO: 77699 - DNA, 26 bp, Artificial sequence
  SiRNA target sequence
taatgcatctaatagtaacagattat

SEQ ID NO: 77700 - DNA, 26 bp, Artificial sequence
  SiRNA target sequence
aatgcatctaatagtaacagattatg

SEQ ID NO: 77701 - DNA, 26 bp, Artificial sequence
  SiRNA target sequence
atgcatctaatagtaacagattatgg

SEQ ID NO: 77702 - DNA, 26 bp, Artificial sequence
  SiRNA target sequence
tgcatctaatagtaacagattatgga

SEQ ID NO: 77703 - DNA, 26 bp, Artificial sequence
  SiRNA target sequence
gcatctaatagtaacagattatggag

SEQ ID NO: 77704 - DNA, 26 bp, Artificial sequence
  SiRNA target sequence
catctaatagtaacagattatggaga

SEQ ID NO: 77705 - DNA, 26 bp, Artificial sequence
  SiRNA target sequence
atctaatagtaacagattatggagag

SEQ ID NO: 77706 - DNA, 26 bp, Artificial sequence
  SiRNA target sequence
tctaatagtaacagattatggagagc

SEQ ID NO: 77707 - DNA, 26 bp, Artificial sequence
  SiRNA target sequence
ctaatagtaacagattatggagagca

SEQ ID NO: 77708 - DNA, 26 bp, Artificial sequence
  SiRNA target sequence
taatagtaacagattatggagagcac

SEQ ID NO: 77709 - DNA, 26 bp, Artificial sequence
  SiRNA target sequence
aatagtaacagattatggagagcact

SEQ ID NO: 77710 - DNA, 26 bp, Artificial sequence
  SiRNA target sequence
atagtaacagattatggagagcactg

SEQ ID NO: 77711 - DNA, 26 bp, Artificial sequence
  SiRNA target sequence
tagtaacagattatggagagcactgt

SEQ ID NO: 77712 - DNA, 26 bp, Artificial sequence
  SiRNA target sequence
agtaacagattatggagagcactgta

SEQ ID NO: 77713 - DNA, 26 bp, Artificial sequence
  SiRNA target sequence
gtaacagattatggagagcactgtac

SEQ ID NO: 77714 - DNA, 26 bp, Artificial sequence
  SiRNA target sequence
taacagattatggagagcactgtaca

SEQ ID NO: 77715 - DNA, 26 bp, Artificial sequence
  SiRNA target sequence
aacagattatggagagcactgtacat

SEQ ID NO: 77716 - DNA, 26 bp, Artificial sequence
  SiRNA target sequence
acagattatggagagcactgtacatt

SEQ ID NO: 77717 - DNA, 26 bp, Artificial sequence
  SiRNA target sequence
cagattatggagagcactgtacattt

SEQ ID NO: 77718 - DNA, 26 bp, Artificial sequence
  SiRNA target sequence
agattatggagagcactgtacatttt

SEQ ID NO: 77719 - DNA, 26 bp, Artificial sequence
  SiRNA target sequence
gattatggagagcactgtacatttta

SEQ ID NO: 77720 - DNA, 26 bp, Artificial sequence
  SiRNA target sequence
attatggagagcactgtacattttaa

SEQ ID NO: 77721 - DNA, 26 bp, Artificial sequence
  SiRNA target sequence
ttatggagagcactgtacattttaaa

SEQ ID NO: 77722 - DNA, 26 bp, Artificial sequence
  SiRNA target sequence
tatggagagcactgtacattttaaat

SEQ ID NO: 77723 - DNA, 26 bp, Artificial sequence
  SiRNA target sequence
atggagagcactgtacattttaaatt

SEQ ID NO: 77724 - DNA, 26 bp, Artificial sequence
  SiRNA target sequence
tggagagcactgtacattttaaattt

SEQ ID NO: 77725 - DNA, 26 bp, Artificial sequence
  SiRNA target sequence
ggagagcactgtacattttaaattta

SEQ ID NO: 77726 - DNA, 26 bp, Artificial sequence
  SiRNA target sequence
gagagcactgtacattttaaatttat

SEQ ID NO: 77727 - DNA, 26 bp, Artificial sequence
  SiRNA target sequence
agagcactgtacattttaaatttatc

SEQ ID NO: 77728 - DNA, 26 bp, Artificial sequence
  SiRNA target sequence
gagcactgtacattttaaatttatct

SEQ ID NO: 77729 - DNA, 26 bp, Artificial sequence
  SiRNA target sequence
agcactgtacattttaaatttatctc

SEQ ID NO: 77730 - DNA, 26 bp, Artificial sequence
  SiRNA target sequence
gcactgtacattttaaatttatctca

SEQ ID NO: 77731 - DNA, 26 bp, Artificial sequence
  SiRNA target sequence
cactgtacattttaaatttatctcag

SEQ ID NO: 77732 - DNA, 26 bp, Artificial sequence
  SiRNA target sequence
actgtacattttaaatttatctcaga

SEQ ID NO: 77733 - DNA, 26 bp, Artificial sequence
  SiRNA target sequence
ctgtacattttaaatttatctcagag

SEQ ID NO: 77734 - DNA, 26 bp, Artificial sequence
  SiRNA target sequence
tgtacattttaaatttatctcagaga

SEQ ID NO: 77735 - DNA, 26 bp, Artificial sequence
  SiRNA target sequence
gtacattttaaatttatctcagagag

SEQ ID NO: 77736 - DNA, 26 bp, Artificial sequence
  SiRNA target sequence
tacattttaaatttatctcagagagc

SEQ ID NO: 77737 - DNA, 26 bp, Artificial sequence
  SiRNA target sequence
acattttaaatttatctcagagagca

SEQ ID NO: 77738 - DNA, 26 bp, Artificial sequence
  SiRNA target sequence
cattttaaatttatctcagagagcaa

SEQ ID NO: 77739 - DNA, 26 bp, Artificial sequence
  SiRNA target sequence
attttaaatttatctcagagagcaat

SEQ ID NO: 77740 - DNA, 26 bp, Artificial sequence
  SiRNA target sequence
ttttaaatttatctcagagagcaatt

SEQ ID NO: 77741 - DNA, 26 bp, Artificial sequence
  SiRNA target sequence
tttaaatttatctcagagagcaattt

SEQ ID NO: 77742 - DNA, 26 bp, Artificial sequence
  SiRNA target sequence
ttaaatttatctcagagagcaatttt

SEQ ID NO: 77743 - DNA, 26 bp, Artificial sequence
  SiRNA target sequence
taaatttatctcagagagcaattttt

SEQ ID NO: 77744 - DNA, 26 bp, Artificial sequence
  SiRNA target sequence
aaatttatctcagagagcaatttttc

SEQ ID NO: 77745 - DNA, 26 bp, Artificial sequence
  SiRNA target sequence
aatttatctcagagagcaatttttct

SEQ ID NO: 77746 - DNA, 26 bp, Artificial sequence
  SiRNA target sequence
atttatctcagagagcaatttttctc

SEQ ID NO: 77747 - DNA, 26 bp, Artificial sequence
  SiRNA target sequence
tttatctcagagagcaatttttctct

SEQ ID NO: 77748 - DNA, 26 bp, Artificial sequence
  SiRNA target sequence
ttatctcagagagcaatttttctctt

SEQ ID NO: 77749 - DNA, 26 bp, Artificial sequence
  SiRNA target sequence
tatctcagagagcaatttttctctta

SEQ ID NO: 77750 - DNA, 26 bp, Artificial sequence
  SiRNA target sequence
atctcagagagcaatttttctcttac

SEQ ID NO: 77751 - DNA, 26 bp, Artificial sequence
  SiRNA target sequence
tctcagagagcaatttttctcttaca

SEQ ID NO: 77752 - DNA, 26 bp, Artificial sequence
  SiRNA target sequence
ctcagagagcaatttttctcttacaa

SEQ ID NO: 77753 - DNA, 26 bp, Artificial sequence
  SiRNA target sequence
tcagagagcaatttttctcttacaaa

SEQ ID NO: 77754 - DNA, 26 bp, Artificial sequence
  SiRNA target sequence
cagagagcaatttttctcttacaaag

SEQ ID NO: 77755 - DNA, 26 bp, Artificial sequence
  SiRNA target sequence
agagagcaatttttctcttacaaagt

SEQ ID NO: 77756 - DNA, 26 bp, Artificial sequence
  SiRNA target sequence
gagagcaatttttctcttacaaagtt

SEQ ID NO: 77757 - DNA, 26 bp, Artificial sequence
  SiRNA target sequence
agagcaatttttctcttacaaagttt

SEQ ID NO: 77758 - DNA, 26 bp, Artificial sequence
  SiRNA target sequence
gagcaatttttctcttacaaagtttt

SEQ ID NO: 77759 - DNA, 26 bp, Artificial sequence
  SiRNA target sequence
agcaatttttctcttacaaagttttt

SEQ ID NO: 77760 - DNA, 26 bp, Artificial sequence
  SiRNA target sequence
gcaatttttctcttacaaagtttttt

SEQ ID NO: 77761 - DNA, 26 bp, Artificial sequence
  SiRNA target sequence
caatttttctcttacaaagttttttt

SEQ ID NO: 77762 - DNA, 26 bp, Artificial sequence
  SiRNA target sequence
aatttttctcttacaaagttttttta

SEQ ID NO: 77763 - DNA, 26 bp, Artificial sequence
  SiRNA target sequence
atttttctcttacaaagtttttttat

SEQ ID NO: 77764 - DNA, 26 bp, Artificial sequence
  SiRNA target sequence
tttttctcttacaaagtttttttatt

SEQ ID NO: 77765 - DNA, 26 bp, Artificial sequence
  SiRNA target sequence
ttttctcttacaaagtttttttatta

SEQ ID NO: 77766 - DNA, 26 bp, Artificial sequence
  SiRNA target sequence
tttctcttacaaagtttttttattat

SEQ ID NO: 77767 - DNA, 26 bp, Artificial sequence
  SiRNA target sequence
ttctcttacaaagtttttttattatt

SEQ ID NO: 77768 - DNA, 26 bp, Artificial sequence
  SiRNA target sequence
tctcttacaaagtttttttattattt

SEQ ID NO: 77769 - DNA, 26 bp, Artificial sequence
  SiRNA target sequence
ctcttacaaagtttttttattattta

SEQ ID NO: 77770 - DNA, 26 bp, Artificial sequence
  SiRNA target sequence
tcttacaaagtttttttattatttat

SEQ ID NO: 77771 - DNA, 26 bp, Artificial sequence
  SiRNA target sequence
cttacaaagtttttttattatttatg

SEQ ID NO: 77772 - DNA, 26 bp, Artificial sequence
  SiRNA target sequence
ttacaaagtttttttattatttatgc

SEQ ID NO: 77773 - DNA, 26 bp, Artificial sequence
  SiRNA target sequence
tacaaagtttttttattatttatgca

SEQ ID NO: 77774 - DNA, 26 bp, Artificial sequence
  SiRNA target sequence
acaaagtttttttattatttatgcag

SEQ ID NO: 77775 - DNA, 26 bp, Artificial sequence
  SiRNA target sequence
caaagtttttttattatttatgcagg

SEQ ID NO: 77776 - DNA, 26 bp, Artificial sequence
  SiRNA target sequence
aaagtttttttattatttatgcagga

SEQ ID NO: 77777 - DNA, 26 bp, Artificial sequence
  SiRNA target sequence
aagtttttttattatttatgcaggaa

SEQ ID NO: 77778 - DNA, 26 bp, Artificial sequence
  SiRNA target sequence
agtttttttattatttatgcaggaat

SEQ ID NO: 77779 - DNA, 26 bp, Artificial sequence
  SiRNA target sequence
gtttttttattatttatgcaggaata

SEQ ID NO: 77780 - DNA, 26 bp, Artificial sequence
  SiRNA target sequence
tttttttattatttatgcaggaatat

SEQ ID NO: 77781 - DNA, 26 bp, Artificial sequence
  SiRNA target sequence
ttttttattatttatgcaggaatatc

SEQ ID NO: 77782 - DNA, 26 bp, Artificial sequence
  SiRNA target sequence
tttttattatttatgcaggaatatca

SEQ ID NO: 77783 - DNA, 26 bp, Artificial sequence
  SiRNA target sequence
ttttattatttatgcaggaatatcag

SEQ ID NO: 77784 - DNA, 26 bp, Artificial sequence
  SiRNA target sequence
tttattatttatgcaggaatatcagg

SEQ ID NO: 77785 - DNA, 26 bp, Artificial sequence
  SiRNA target sequence
ttattatttatgcaggaatatcagga

SEQ ID NO: 77786 - DNA, 26 bp, Artificial sequence
  SiRNA target sequence
tattatttatgcaggaatatcaggaa

SEQ ID NO: 77787 - DNA, 26 bp, Artificial sequence
  SiRNA target sequence
attatttatgcaggaatatcaggaat

SEQ ID NO: 77788 - DNA, 26 bp, Artificial sequence
  SiRNA target sequence
ttatttatgcaggaatatcaggaata

SEQ ID NO: 77789 - DNA, 26 bp, Artificial sequence
  SiRNA target sequence
tatttatgcaggaatatcaggaatat

SEQ ID NO: 77790 - DNA, 26 bp, Artificial sequence
  SiRNA target sequence
atttatgcaggaatatcaggaatatt

SEQ ID NO: 77791 - DNA, 26 bp, Artificial sequence
  SiRNA target sequence
tttatgcaggaatatcaggaatatta

SEQ ID NO: 77792 - DNA, 26 bp, Artificial sequence
  SiRNA target sequence
ttatgcaggaatatcaggaatattat

SEQ ID NO: 77793 - DNA, 26 bp, Artificial sequence
  SiRNA target sequence
tatgcaggaatatcaggaatattatc

SEQ ID NO: 77794 - DNA, 26 bp, Artificial sequence
  SiRNA target sequence
atgcaggaatatcaggaatattatct

SEQ ID NO: 77795 - DNA, 26 bp, Artificial sequence
  SiRNA target sequence
tgcaggaatatcaggaatattatctc

SEQ ID NO: 77796 - DNA, 26 bp, Artificial sequence
  SiRNA target sequence
gcaggaatatcaggaatattatctca

SEQ ID NO: 77797 - DNA, 26 bp, Artificial sequence
  SiRNA target sequence
caggaatatcaggaatattatctcaa

SEQ ID NO: 77798 - DNA, 26 bp, Artificial sequence
  SiRNA target sequence
aggaatatcaggaatattatctcaaa

SEQ ID NO: 77799 - DNA, 26 bp, Artificial sequence
  SiRNA target sequence
ggaatatcaggaatattatctcaaaa

SEQ ID NO: 77800 - DNA, 26 bp, Artificial sequence
  SiRNA target sequence
gaatatcaggaatattatctcaaaat

SEQ ID NO: 77801 - DNA, 26 bp, Artificial sequence
  SiRNA target sequence
aatatcaggaatattatctcaaaata

SEQ ID NO: 77802 - DNA, 26 bp, Artificial sequence
  SiRNA target sequence
atatcaggaatattatctcaaaatat

SEQ ID NO: 77803 - DNA, 26 bp, Artificial sequence
  SiRNA target sequence
tatcaggaatattatctcaaaatatg

SEQ ID NO: 77804 - DNA, 26 bp, Artificial sequence
  SiRNA target sequence
atcaggaatattatctcaaaatatgt

SEQ ID NO: 77805 - DNA, 26 bp, Artificial sequence
  SiRNA target sequence
tcaggaatattatctcaaaatatgtc

SEQ ID NO: 77806 - DNA, 26 bp, Artificial sequence
  SiRNA target sequence
caggaatattatctcaaaatatgtca

SEQ ID NO: 77807 - DNA, 26 bp, Artificial sequence
  SiRNA target sequence
aggaatattatctcaaaatatgtcat

SEQ ID NO: 77808 - DNA, 26 bp, Artificial sequence
  SiRNA target sequence
ggaatattatctcaaaatatgtcatc

SEQ ID NO: 77809 - DNA, 26 bp, Artificial sequence
  SiRNA target sequence
gaatattatctcaaaatatgtcatct

SEQ ID NO: 77810 - DNA, 26 bp, Artificial sequence
  SiRNA target sequence
aatattatctcaaaatatgtcatcta

SEQ ID NO: 77811 - DNA, 26 bp, Artificial sequence
  SiRNA target sequence
atattatctcaaaatatgtcatctaa

SEQ ID NO: 77812 - DNA, 26 bp, Artificial sequence
  SiRNA target sequence
tattatctcaaaatatgtcatctaac

SEQ ID NO: 77813 - DNA, 26 bp, Artificial sequence
  SiRNA target sequence
attatctcaaaatatgtcatctaacc

SEQ ID NO: 77814 - DNA, 26 bp, Artificial sequence
  SiRNA target sequence
ttatctcaaaatatgtcatctaacca

SEQ ID NO: 77815 - DNA, 26 bp, Artificial sequence
  SiRNA target sequence
tatctcaaaatatgtcatctaaccaa

SEQ ID NO: 77816 - DNA, 26 bp, Artificial sequence
  SiRNA target sequence
atctcaaaatatgtcatctaaccaac

SEQ ID NO: 77817 - DNA, 26 bp, Artificial sequence
  SiRNA target sequence
tctcaaaatatgtcatctaaccaact

SEQ ID NO: 77818 - DNA, 26 bp, Artificial sequence
  SiRNA target sequence
ctcaaaatatgtcatctaaccaactc

SEQ ID NO: 77819 - DNA, 26 bp, Artificial sequence
  SiRNA target sequence
tcaaaatatgtcatctaaccaactca

SEQ ID NO: 77820 - DNA, 26 bp, Artificial sequence
  SiRNA target sequence
caaaatatgtcatctaaccaactcat

SEQ ID NO: 77821 - DNA, 26 bp, Artificial sequence
  SiRNA target sequence
aaaatatgtcatctaaccaactcatt

SEQ ID NO: 77822 - DNA, 26 bp, Artificial sequence
  SiRNA target sequence
aaatatgtcatctaaccaactcattt

SEQ ID NO: 77823 - DNA, 26 bp, Artificial sequence
  SiRNA target sequence
aatatgtcatctaaccaactcattta

SEQ ID NO: 77824 - DNA, 26 bp, Artificial sequence
  SiRNA target sequence
atatgtcatctaaccaactcatttat

SEQ ID NO: 77825 - DNA, 26 bp, Artificial sequence
  SiRNA target sequence
tatgtcatctaaccaactcatttatt

SEQ ID NO: 77826 - DNA, 26 bp, Artificial sequence
  SiRNA target sequence
atgtcatctaaccaactcatttattt

SEQ ID NO: 77827 - DNA, 26 bp, Artificial sequence
  SiRNA target sequence
tgtcatctaaccaactcatttattta

SEQ ID NO: 77828 - DNA, 26 bp, Artificial sequence
  SiRNA target sequence
gtcatctaaccaactcatttatttaa

SEQ ID NO: 77829 - DNA, 26 bp, Artificial sequence
  SiRNA target sequence
tcatctaaccaactcatttatttaat

SEQ ID NO: 77830 - DNA, 26 bp, Artificial sequence
  SiRNA target sequence
catctaaccaactcatttatttaatg

SEQ ID NO: 77831 - DNA, 26 bp, Artificial sequence
  SiRNA target sequence
atctaaccaactcatttatttaatgt

SEQ ID NO: 77832 - DNA, 26 bp, Artificial sequence
  SiRNA target sequence
tctaaccaactcatttatttaatgtc

SEQ ID NO: 77833 - DNA, 26 bp, Artificial sequence
  SiRNA target sequence
ctaaccaactcatttatttaatgtcc

SEQ ID NO: 77834 - DNA, 26 bp, Artificial sequence
  SiRNA target sequence
taaccaactcatttatttaatgtcca

SEQ ID NO: 77835 - DNA, 26 bp, Artificial sequence
  SiRNA target sequence
aaccaactcatttatttaatgtccat

SEQ ID NO: 77836 - DNA, 26 bp, Artificial sequence
  SiRNA target sequence
accaactcatttatttaatgtccatt

SEQ ID NO: 77837 - DNA, 26 bp, Artificial sequence
  SiRNA target sequence
ccaactcatttatttaatgtccatta

SEQ ID NO: 77838 - DNA, 26 bp, Artificial sequence
  SiRNA target sequence
caactcatttatttaatgtccattac

SEQ ID NO: 77839 - DNA, 26 bp, Artificial sequence
  SiRNA target sequence
aactcatttatttaatgtccattaca

SEQ ID NO: 77840 - DNA, 26 bp, Artificial sequence
  SiRNA target sequence
actcatttatttaatgtccattacat

SEQ ID NO: 77841 - DNA, 26 bp, Artificial sequence
  SiRNA target sequence
ctcatttatttaatgtccattacatc

SEQ ID NO: 77842 - DNA, 26 bp, Artificial sequence
  SiRNA target sequence
tcatttatttaatgtccattacatct

SEQ ID NO: 77843 - DNA, 26 bp, Artificial sequence
  SiRNA target sequence
catttatttaatgtccattacatcta

SEQ ID NO: 77844 - DNA, 26 bp, Artificial sequence
  SiRNA target sequence
atttatttaatgtccattacatctac

SEQ ID NO: 77845 - DNA, 26 bp, Artificial sequence
  SiRNA target sequence
tttatttaatgtccattacatctacg

SEQ ID NO: 77846 - DNA, 26 bp, Artificial sequence
  SiRNA target sequence
ttatttaatgtccattacatctacgg

SEQ ID NO: 77847 - DNA, 26 bp, Artificial sequence
  SiRNA target sequence
tatttaatgtccattacatctacggt

SEQ ID NO: 77848 - DNA, 26 bp, Artificial sequence
  SiRNA target sequence
atttaatgtccattacatctacggtt

SEQ ID NO: 77849 - DNA, 26 bp, Artificial sequence
  SiRNA target sequence
tttaatgtccattacatctacggtta

SEQ ID NO: 77850 - DNA, 26 bp, Artificial sequence
  SiRNA target sequence
ttaatgtccattacatctacggttac

SEQ ID NO: 77851 - DNA, 26 bp, Artificial sequence
  SiRNA target sequence
taatgtccattacatctacggttact

SEQ ID NO: 77852 - DNA, 26 bp, Artificial sequence
  SiRNA target sequence
aatgtccattacatctacggttacta

SEQ ID NO: 77853 - DNA, 26 bp, Artificial sequence
  SiRNA target sequence
atgtccattacatctacggttactat

SEQ ID NO: 77854 - DNA, 26 bp, Artificial sequence
  SiRNA target sequence
tgtccattacatctacggttactatt

SEQ ID NO: 77855 - DNA, 26 bp, Artificial sequence
  SiRNA target sequence
gtccattacatctacggttactatta

SEQ ID NO: 77856 - DNA, 26 bp, Artificial sequence
  SiRNA target sequence
tccattacatctacggttactattaa

SEQ ID NO: 77857 - DNA, 26 bp, Artificial sequence
  SiRNA target sequence
ccattacatctacggttactattaat

SEQ ID NO: 77858 - DNA, 26 bp, Artificial sequence
  SiRNA target sequence
cattacatctacggttactattaatt

SEQ ID NO: 77859 - DNA, 26 bp, Artificial sequence
  SiRNA target sequence
attacatctacggttactattaattt

SEQ ID NO: 77860 - DNA, 26 bp, Artificial sequence
  SiRNA target sequence
ttacatctacggttactattaattta

SEQ ID NO: 77861 - DNA, 26 bp, Artificial sequence
  SiRNA target sequence
tacatctacggttactattaatttaa

SEQ ID NO: 77862 - DNA, 26 bp, Artificial sequence
  SiRNA target sequence
acatctacggttactattaatttaag

SEQ ID NO: 77863 - DNA, 26 bp, Artificial sequence
  SiRNA target sequence
catctacggttactattaatttaagt

SEQ ID NO: 77864 - DNA, 26 bp, Artificial sequence
  SiRNA target sequence
atctacggttactattaatttaagta

SEQ ID NO: 77865 - DNA, 26 bp, Artificial sequence
  SiRNA target sequence
tctacggttactattaatttaagtaa

SEQ ID NO: 77866 - DNA, 26 bp, Artificial sequence
  SiRNA target sequence
ctacggttactattaatttaagtaac

SEQ ID NO: 77867 - DNA, 26 bp, Artificial sequence
  SiRNA target sequence
tacggttactattaatttaagtaact

SEQ ID NO: 77868 - DNA, 26 bp, Artificial sequence
  SiRNA target sequence
acggttactattaatttaagtaactt

SEQ ID NO: 77869 - DNA, 26 bp, Artificial sequence
  SiRNA target sequence
cggttactattaatttaagtaacttg

SEQ ID NO: 77870 - DNA, 26 bp, Artificial sequence
  SiRNA target sequence
ggttactattaatttaagtaacttgg

SEQ ID NO: 77871 - DNA, 26 bp, Artificial sequence
  SiRNA target sequence
gttactattaatttaagtaacttggg

SEQ ID NO: 77872 - DNA, 26 bp, Artificial sequence
  SiRNA target sequence
ttactattaatttaagtaacttgggt

SEQ ID NO: 77873 - DNA, 26 bp, Artificial sequence
  SiRNA target sequence
tactattaatttaagtaacttgggtt

SEQ ID NO: 77874 - DNA, 26 bp, Artificial sequence
  SiRNA target sequence
actattaatttaagtaacttgggtta

SEQ ID NO: 77875 - DNA, 26 bp, Artificial sequence
  SiRNA target sequence
ctattaatttaagtaacttgggttac

SEQ ID NO: 77876 - DNA, 26 bp, Artificial sequence
  SiRNA target sequence
tattaatttaagtaacttgggttact

SEQ ID NO: 77877 - DNA, 26 bp, Artificial sequence
  SiRNA target sequence
attaatttaagtaacttgggttactt

SEQ ID NO: 77878 - DNA, 26 bp, Artificial sequence
  SiRNA target sequence
ttaatttaagtaacttgggttactta

SEQ ID NO: 77879 - DNA, 26 bp, Artificial sequence
  SiRNA target sequence
taatttaagtaacttgggttacttat

SEQ ID NO: 77880 - DNA, 26 bp, Artificial sequence
  SiRNA target sequence
aatttaagtaacttgggttacttata

SEQ ID NO: 77881 - DNA, 26 bp, Artificial sequence
  SiRNA target sequence
atttaagtaacttgggttacttatac

SEQ ID NO: 77882 - DNA, 26 bp, Artificial sequence
  SiRNA target sequence
tttaagtaacttgggttacttataca

SEQ ID NO: 77883 - DNA, 26 bp, Artificial sequence
  SiRNA target sequence
ttaagtaacttgggttacttatacac

SEQ ID NO: 77884 - DNA, 26 bp, Artificial sequence
  SiRNA target sequence
taagtaacttgggttacttatacact

SEQ ID NO: 77885 - DNA, 26 bp, Artificial sequence
  SiRNA target sequence
aagtaacttgggttacttatacacta

SEQ ID NO: 77886 - DNA, 26 bp, Artificial sequence
  SiRNA target sequence
agtaacttgggttacttatacactag

SEQ ID NO: 77887 - DNA, 26 bp, Artificial sequence
  SiRNA target sequence
gtaacttgggttacttatacactaga

SEQ ID NO: 77888 - DNA, 26 bp, Artificial sequence
  SiRNA target sequence
taacttgggttacttatacactagat

SEQ ID NO: 77889 - DNA, 26 bp, Artificial sequence
  SiRNA target sequence
aacttgggttacttatacactagata

SEQ ID NO: 77890 - DNA, 26 bp, Artificial sequence
  SiRNA target sequence
acttgggttacttatacactagatat

SEQ ID NO: 77891 - DNA, 26 bp, Artificial sequence
  SiRNA target sequence
cttgggttacttatacactagatata

SEQ ID NO: 77892 - DNA, 26 bp, Artificial sequence
  SiRNA target sequence
ttgggttacttatacactagatatac

SEQ ID NO: 77893 - DNA, 26 bp, Artificial sequence
  SiRNA target sequence
tgggttacttatacactagatataca

SEQ ID NO: 77894 - DNA, 26 bp, Artificial sequence
  SiRNA target sequence
gggttacttatacactagatatacac

SEQ ID NO: 77895 - DNA, 26 bp, Artificial sequence
  SiRNA target sequence
ggttacttatacactagatatacaca

SEQ ID NO: 77896 - DNA, 26 bp, Artificial sequence
  SiRNA target sequence
gttacttatacactagatatacacaa

SEQ ID NO: 77897 - DNA, 26 bp, Artificial sequence
  SiRNA target sequence
ttacttatacactagatatacacaag

SEQ ID NO: 77898 - DNA, 26 bp, Artificial sequence
  SiRNA target sequence
tacttatacactagatatacacaagc

SEQ ID NO: 77899 - DNA, 26 bp, Artificial sequence
  SiRNA target sequence
acttatacactagatatacacaagca

SEQ ID NO: 77900 - DNA, 26 bp, Artificial sequence
  SiRNA target sequence
cttatacactagatatacacaagcaa

SEQ ID NO: 77901 - DNA, 26 bp, Artificial sequence
  SiRNA target sequence
ttatacactagatatacacaagcaat

SEQ ID NO: 77902 - DNA, 26 bp, Artificial sequence
  SiRNA target sequence
tatacactagatatacacaagcaata

SEQ ID NO: 77903 - DNA, 26 bp, Artificial sequence
  SiRNA target sequence
atacactagatatacacaagcaataa

SEQ ID NO: 77904 - DNA, 26 bp, Artificial sequence
  SiRNA target sequence
tacactagatatacacaagcaataat

SEQ ID NO: 77905 - DNA, 26 bp, Artificial sequence
  SiRNA target sequence
acactagatatacacaagcaataatt

SEQ ID NO: 77906 - DNA, 26 bp, Artificial sequence
  SiRNA target sequence
cactagatatacacaagcaataatta

SEQ ID NO: 77907 - DNA, 26 bp, Artificial sequence
  SiRNA target sequence
actagatatacacaagcaataattaa

SEQ ID NO: 77908 - DNA, 26 bp, Artificial sequence
  SiRNA target sequence
ctagatatacacaagcaataattaat

SEQ ID NO: 77909 - DNA, 26 bp, Artificial sequence
  SiRNA target sequence
tagatatacacaagcaataattaatg

SEQ ID NO: 77910 - DNA, 26 bp, Artificial sequence
  SiRNA target sequence
agatatacacaagcaataattaatgc

SEQ ID NO: 77911 - DNA, 26 bp, Artificial sequence
  SiRNA target sequence
gatatacacaagcaataattaatgca

SEQ ID NO: 77912 - DNA, 26 bp, Artificial sequence
  SiRNA target sequence
atatacacaagcaataattaatgcaa

SEQ ID NO: 77913 - DNA, 26 bp, Artificial sequence
  SiRNA target sequence
tatacacaagcaataattaatgcaag

SEQ ID NO: 77914 - DNA, 26 bp, Artificial sequence
  SiRNA target sequence
atacacaagcaataattaatgcaaga

SEQ ID NO: 77915 - DNA, 26 bp, Artificial sequence
  SiRNA target sequence
tacacaagcaataattaatgcaagat

SEQ ID NO: 77916 - DNA, 26 bp, Artificial sequence
  SiRNA target sequence
acacaagcaataattaatgcaagatc

SEQ ID NO: 77917 - DNA, 26 bp, Artificial sequence
  SiRNA target sequence
cacaagcaataattaatgcaagatct

SEQ ID NO: 77918 - DNA, 26 bp, Artificial sequence
  SiRNA target sequence
acaagcaataattaatgcaagatcta

SEQ ID NO: 77919 - DNA, 26 bp, Artificial sequence
  SiRNA target sequence
caagcaataattaatgcaagatctac

SEQ ID NO: 77920 - DNA, 26 bp, Artificial sequence
  SiRNA target sequence
aagcaataattaatgcaagatctact

SEQ ID NO: 77921 - DNA, 26 bp, Artificial sequence
  SiRNA target sequence
agcaataattaatgcaagatctactt

SEQ ID NO: 77922 - DNA, 26 bp, Artificial sequence
  SiRNA target sequence
gcaataattaatgcaagatctactta

SEQ ID NO: 77923 - DNA, 26 bp, Artificial sequence
  SiRNA target sequence
caataattaatgcaagatctacttat

SEQ ID NO: 77924 - DNA, 26 bp, Artificial sequence
  SiRNA target sequence
aataattaatgcaagatctacttatg

SEQ ID NO: 77925 - DNA, 26 bp, Artificial sequence
  SiRNA target sequence
ataattaatgcaagatctacttatga

SEQ ID NO: 77926 - DNA, 26 bp, Artificial sequence
  SiRNA target sequence
taattaatgcaagatctacttatgat

SEQ ID NO: 77927 - DNA, 26 bp, Artificial sequence
  SiRNA target sequence
aattaatgcaagatctacttatgata

SEQ ID NO: 77928 - DNA, 26 bp, Artificial sequence
  SiRNA target sequence
attaatgcaagatctacttatgatac

SEQ ID NO: 77929 - DNA, 26 bp, Artificial sequence
  SiRNA target sequence
ttaatgcaagatctacttatgataca

SEQ ID NO: 77930 - DNA, 26 bp, Artificial sequence
  SiRNA target sequence
taatgcaagatctacttatgatacaa

SEQ ID NO: 77931 - DNA, 26 bp, Artificial sequence
  SiRNA target sequence
aatgcaagatctacttatgatacaat

SEQ ID NO: 77932 - DNA, 26 bp, Artificial sequence
  SiRNA target sequence
atgcaagatctacttatgatacaatg

SEQ ID NO: 77933 - DNA, 26 bp, Artificial sequence
  SiRNA target sequence
tgcaagatctacttatgatacaatgt

SEQ ID NO: 77934 - DNA, 26 bp, Artificial sequence
  SiRNA target sequence
gcaagatctacttatgatacaatgtt

SEQ ID NO: 77935 - DNA, 26 bp, Artificial sequence
  SiRNA target sequence
caagatctacttatgatacaatgtta

SEQ ID NO: 77936 - DNA, 26 bp, Artificial sequence
  SiRNA target sequence
aagatctacttatgatacaatgttag

SEQ ID NO: 77937 - DNA, 26 bp, Artificial sequence
  SiRNA target sequence
agatctacttatgatacaatgttaga

SEQ ID NO: 77938 - DNA, 26 bp, Artificial sequence
  SiRNA target sequence
gatctacttatgatacaatgttagat

SEQ ID NO: 77939 - DNA, 26 bp, Artificial sequence
  SiRNA target sequence
atctacttatgatacaatgttagata

SEQ ID NO: 77940 - DNA, 26 bp, Artificial sequence
  SiRNA target sequence
tctacttatgatacaatgttagatat

SEQ ID NO: 77941 - DNA, 26 bp, Artificial sequence
  SiRNA target sequence
ctacttatgatacaatgttagatata

SEQ ID NO: 77942 - DNA, 26 bp, Artificial sequence
  SiRNA target sequence
tacttatgatacaatgttagatataa

SEQ ID NO: 77943 - DNA, 26 bp, Artificial sequence
  SiRNA target sequence
acttatgatacaatgttagatataaa

SEQ ID NO: 77944 - DNA, 26 bp, Artificial sequence
  SiRNA target sequence
cttatgatacaatgttagatataaaa

SEQ ID NO: 77945 - DNA, 26 bp, Artificial sequence
  SiRNA target sequence
ttatgatacaatgttagatataaaaa

SEQ ID NO: 77946 - DNA, 26 bp, Artificial sequence
  SiRNA target sequence
tatgatacaatgttagatataaaaaa

SEQ ID NO: 77947 - DNA, 26 bp, Artificial sequence
  SiRNA target sequence
atgatacaatgttagatataaaaaaa

SEQ ID NO: 77948 - DNA, 26 bp, Artificial sequence
  SiRNA target sequence
tgatacaatgttagatataaaaaaag

SEQ ID NO: 77949 - DNA, 26 bp, Artificial sequence
  SiRNA target sequence
gatacaatgttagatataaaaaaaga

SEQ ID NO: 77950 - DNA, 26 bp, Artificial sequence
  SiRNA target sequence
atacaatgttagatataaaaaaagag

SEQ ID NO: 77951 - DNA, 26 bp, Artificial sequence
  SiRNA target sequence
tacaatgttagatataaaaaaagaga

SEQ ID NO: 77952 - DNA, 26 bp, Artificial sequence
  SiRNA target sequence
acaatgttagatataaaaaaagagaa

SEQ ID NO: 77953 - DNA, 26 bp, Artificial sequence
  SiRNA target sequence
caatgttagatataaaaaaagagaat

SEQ ID NO: 77954 - DNA, 26 bp, Artificial sequence
  SiRNA target sequence
aatgttagatataaaaaaagagaata

SEQ ID NO: 77955 - DNA, 26 bp, Artificial sequence
  SiRNA target sequence
atgttagatataaaaaaagagaataa

SEQ ID NO: 77956 - DNA, 26 bp, Artificial sequence
  SiRNA target sequence
tgttagatataaaaaaagagaataat

SEQ ID NO: 77957 - DNA, 26 bp, Artificial sequence
  SiRNA target sequence
gttagatataaaaaaagagaataata

SEQ ID NO: 77958 - DNA, 26 bp, Artificial sequence
  SiRNA target sequence
ttagatataaaaaaagagaataataa

SEQ ID NO: 77959 - DNA, 26 bp, Artificial sequence
  SiRNA target sequence
tagatataaaaaaagagaataataag

SEQ ID NO: 77960 - DNA, 26 bp, Artificial sequence
  SiRNA target sequence
agatataaaaaaagagaataataagt

SEQ ID NO: 77961 - DNA, 26 bp, Artificial sequence
  SiRNA target sequence
gatataaaaaaagagaataataagtt

SEQ ID NO: 77962 - DNA, 26 bp, Artificial sequence
  SiRNA target sequence
atataaaaaaagagaataataagttt

SEQ ID NO: 77963 - DNA, 26 bp, Artificial sequence
  SiRNA target sequence
tataaaaaaagagaataataagttta

SEQ ID NO: 77964 - DNA, 26 bp, Artificial sequence
  SiRNA target sequence
ataaaaaaagagaataataagtttaa

SEQ ID NO: 77965 - DNA, 26 bp, Artificial sequence
  SiRNA target sequence
taaaaaaagagaataataagtttaag

SEQ ID NO: 77966 - DNA, 26 bp, Artificial sequence
  SiRNA target sequence
aaaaaaagagaataataagtttaaga

SEQ ID NO: 77967 - DNA, 26 bp, Artificial sequence
  SiRNA target sequence
aaaaaagagaataataagtttaagat

SEQ ID NO: 77968 - DNA, 26 bp, Artificial sequence
  SiRNA target sequence
aaaaagagaataataagtttaagatt

SEQ ID NO: 77969 - DNA, 26 bp, Artificial sequence
  SiRNA target sequence
aaaagagaataataagtttaagatta

SEQ ID NO: 77970 - DNA, 26 bp, Artificial sequence
  SiRNA target sequence
aaagagaataataagtttaagattac

SEQ ID NO: 77971 - DNA, 26 bp, Artificial sequence
  SiRNA target sequence
aagagaataataagtttaagattaca

SEQ ID NO: 77972 - DNA, 26 bp, Artificial sequence
  SiRNA target sequence
agagaataataagtttaagattacag

SEQ ID NO: 77973 - DNA, 26 bp, Artificial sequence
  SiRNA target sequence
gagaataataagtttaagattacaga

SEQ ID NO: 77974 - DNA, 26 bp, Artificial sequence
  SiRNA target sequence
agaataataagtttaagattacagaa

SEQ ID NO: 77975 - DNA, 26 bp, Artificial sequence
  SiRNA target sequence
gaataataagtttaagattacagaat

SEQ ID NO: 77976 - DNA, 26 bp, Artificial sequence
  SiRNA target sequence
aataataagtttaagattacagaatt

SEQ ID NO: 77977 - DNA, 26 bp, Artificial sequence
  SiRNA target sequence
ataataagtttaagattacagaattt

SEQ ID NO: 77978 - DNA, 26 bp, Artificial sequence
  SiRNA target sequence
taataagtttaagattacagaattta

SEQ ID NO: 77979 - DNA, 26 bp, Artificial sequence
  SiRNA target sequence
aataagtttaagattacagaatttaa

SEQ ID NO: 77980 - DNA, 26 bp, Artificial sequence
  SiRNA target sequence
ataagtttaagattacagaatttaaa

SEQ ID NO: 77981 - DNA, 26 bp, Artificial sequence
  SiRNA target sequence
taagtttaagattacagaatttaaag

SEQ ID NO: 77982 - DNA, 26 bp, Artificial sequence
  SiRNA target sequence
aagtttaagattacagaatttaaaga

SEQ ID NO: 77983 - DNA, 26 bp, Artificial sequence
  SiRNA target sequence
agtttaagattacagaatttaaagaa

SEQ ID NO: 77984 - DNA, 26 bp, Artificial sequence
  SiRNA target sequence
gtttaagattacagaatttaaagaaa

SEQ ID NO: 77985 - DNA, 26 bp, Artificial sequence
  SiRNA target sequence
tttaagattacagaatttaaagaaag

SEQ ID NO: 77986 - DNA, 26 bp, Artificial sequence
  SiRNA target sequence
ttaagattacagaatttaaagaaagt

SEQ ID NO: 77987 - DNA, 26 bp, Artificial sequence
  SiRNA target sequence
taagattacagaatttaaagaaagta

SEQ ID NO: 77988 - DNA, 26 bp, Artificial sequence
  SiRNA target sequence
aagattacagaatttaaagaaagtat

SEQ ID NO: 77989 - DNA, 26 bp, Artificial sequence
  SiRNA target sequence
agattacagaatttaaagaaagtatt

SEQ ID NO: 77990 - DNA, 26 bp, Artificial sequence
  SiRNA target sequence
gattacagaatttaaagaaagtatta

SEQ ID NO: 77991 - DNA, 26 bp, Artificial sequence
  SiRNA target sequence
attacagaatttaaagaaagtattaa

SEQ ID NO: 77992 - DNA, 26 bp, Artificial sequence
  SiRNA target sequence
ttacagaatttaaagaaagtattaag

SEQ ID NO: 77993 - DNA, 26 bp, Artificial sequence
  SiRNA target sequence
tacagaatttaaagaaagtattaagt

SEQ ID NO: 77994 - DNA, 26 bp, Artificial sequence
  SiRNA target sequence
acagaatttaaagaaagtattaagtt

SEQ ID NO: 77995 - DNA, 26 bp, Artificial sequence
  SiRNA target sequence
cagaatttaaagaaagtattaagttt

SEQ ID NO: 77996 - DNA, 26 bp, Artificial sequence
  SiRNA target sequence
agaatttaaagaaagtattaagttta

SEQ ID NO: 77997 - DNA, 26 bp, Artificial sequence
  SiRNA target sequence
gaatttaaagaaagtattaagtttaa

SEQ ID NO: 77998 - DNA, 26 bp, Artificial sequence
  SiRNA target sequence
aatttaaagaaagtattaagtttaat

SEQ ID NO: 77999 - DNA, 26 bp, Artificial sequence
  SiRNA target sequence
atttaaagaaagtattaagtttaata

SEQ ID NO: 78000 - DNA, 26 bp, Artificial sequence
  SiRNA target sequence
tttaaagaaagtattaagtttaataa

SEQ ID NO: 78001 - DNA, 26 bp, Artificial sequence
  SiRNA target sequence
ttaaagaaagtattaagtttaataat

SEQ ID NO: 78002 - DNA, 26 bp, Artificial sequence
  SiRNA target sequence
taaagaaagtattaagtttaataatt

SEQ ID NO: 78003 - DNA, 26 bp, Artificial sequence
  SiRNA target sequence
aaagaaagtattaagtttaataattt

SEQ ID NO: 78004 - DNA, 26 bp, Artificial sequence
  SiRNA target sequence
aagaaagtattaagtttaataatttg

SEQ ID NO: 78005 - DNA, 26 bp, Artificial sequence
  SiRNA target sequence
agaaagtattaagtttaataatttgt

SEQ ID NO: 78006 - DNA, 26 bp, Artificial sequence
  SiRNA target sequence
gaaagtattaagtttaataatttgtc

SEQ ID NO: 78007 - DNA, 26 bp, Artificial sequence
  SiRNA target sequence
aaagtattaagtttaataatttgtca

SEQ ID NO: 78008 - DNA, 26 bp, Artificial sequence
  SiRNA target sequence
aagtattaagtttaataatttgtcat

SEQ ID NO: 78009 - DNA, 26 bp, Artificial sequence
  SiRNA target sequence
agtattaagtttaataatttgtcatt

SEQ ID NO: 78010 - DNA, 26 bp, Artificial sequence
  SiRNA target sequence
gtattaagtttaataatttgtcattt

SEQ ID NO: 78011 - DNA, 26 bp, Artificial sequence
  SiRNA target sequence
tattaagtttaataatttgtcatttg

SEQ ID NO: 78012 - DNA, 26 bp, Artificial sequence
  SiRNA target sequence
attaagtttaataatttgtcatttgg

SEQ ID NO: 78013 - DNA, 26 bp, Artificial sequence
  SiRNA target sequence
ttaagtttaataatttgtcatttggt

SEQ ID NO: 78014 - DNA, 26 bp, Artificial sequence
  SiRNA target sequence
taagtttaataatttgtcatttggtt

SEQ ID NO: 78015 - DNA, 26 bp, Artificial sequence
  SiRNA target sequence
aagtttaataatttgtcatttggtta

SEQ ID NO: 78016 - DNA, 26 bp, Artificial sequence
  SiRNA target sequence
agtttaataatttgtcatttggttat

SEQ ID NO: 78017 - DNA, 26 bp, Artificial sequence
  SiRNA target sequence
gtttaataatttgtcatttggttatg

SEQ ID NO: 78018 - DNA, 26 bp, Artificial sequence
  SiRNA target sequence
tttaataatttgtcatttggttatga

SEQ ID NO: 78019 - DNA, 26 bp, Artificial sequence
  SiRNA target sequence
ttaataatttgtcatttggttatgaa

SEQ ID NO: 78020 - DNA, 26 bp, Artificial sequence
  SiRNA target sequence
taataatttgtcatttggttatgaaa

SEQ ID NO: 78021 - DNA, 26 bp, Artificial sequence
  SiRNA target sequence
aataatttgtcatttggttatgaaag

SEQ ID NO: 78022 - DNA, 26 bp, Artificial sequence
  SiRNA target sequence
ataatttgtcatttggttatgaaagt

SEQ ID NO: 78023 - DNA, 26 bp, Artificial sequence
  SiRNA target sequence
taatttgtcatttggttatgaaagta

SEQ ID NO: 78024 - DNA, 26 bp, Artificial sequence
  SiRNA target sequence
aatttgtcatttggttatgaaagtag

SEQ ID NO: 78025 - DNA, 26 bp, Artificial sequence
  SiRNA target sequence
atttgtcatttggttatgaaagtaga

SEQ ID NO: 78026 - DNA, 26 bp, Artificial sequence
  SiRNA target sequence
tttgtcatttggttatgaaagtagac

SEQ ID NO: 78027 - DNA, 26 bp, Artificial sequence
  SiRNA target sequence
ttgtcatttggttatgaaagtagaca

SEQ ID NO: 78028 - DNA, 26 bp, Artificial sequence
  SiRNA target sequence
tgtcatttggttatgaaagtagacaa

SEQ ID NO: 78029 - DNA, 26 bp, Artificial sequence
  SiRNA target sequence
gtcatttggttatgaaagtagacaaa

SEQ ID NO: 78030 - DNA, 26 bp, Artificial sequence
  SiRNA target sequence
tcatttggttatgaaagtagacaaat

SEQ ID NO: 78031 - DNA, 26 bp, Artificial sequence
  SiRNA target sequence
catttggttatgaaagtagacaaatt

SEQ ID NO: 78032 - DNA, 26 bp, Artificial sequence
  SiRNA target sequence
atttggttatgaaagtagacaaattt

SEQ ID NO: 78033 - DNA, 26 bp, Artificial sequence
  SiRNA target sequence
tttggttatgaaagtagacaaatttt

SEQ ID NO: 78034 - DNA, 26 bp, Artificial sequence
  SiRNA target sequence
ttggttatgaaagtagacaaattttt

SEQ ID NO: 78035 - DNA, 26 bp, Artificial sequence
  SiRNA target sequence
tggttatgaaagtagacaaattttta

SEQ ID NO: 78036 - DNA, 26 bp, Artificial sequence
  SiRNA target sequence
ggttatgaaagtagacaaatttttaa

SEQ ID NO: 78037 - DNA, 26 bp, Artificial sequence
  SiRNA target sequence
gttatgaaagtagacaaatttttaat

SEQ ID NO: 78038 - DNA, 26 bp, Artificial sequence
  SiRNA target sequence
ttatgaaagtagacaaatttttaata

SEQ ID NO: 78039 - DNA, 26 bp, Artificial sequence
  SiRNA target sequence
tatgaaagtagacaaatttttaataa

SEQ ID NO: 78040 - DNA, 26 bp, Artificial sequence
  SiRNA target sequence
atgaaagtagacaaatttttaataaa

SEQ ID NO: 78041 - DNA, 26 bp, Artificial sequence
  SiRNA target sequence
tgaaagtagacaaatttttaataaaa

SEQ ID NO: 78042 - DNA, 26 bp, Artificial sequence
  SiRNA target sequence
gaaagtagacaaatttttaataaaat

SEQ ID NO: 78043 - DNA, 26 bp, Artificial sequence
  SiRNA target sequence
aaagtagacaaatttttaataaaata

SEQ ID NO: 78044 - DNA, 26 bp, Artificial sequence
  SiRNA target sequence
aagtagacaaatttttaataaaataa

SEQ ID NO: 78045 - DNA, 26 bp, Artificial sequence
  SiRNA target sequence
agtagacaaatttttaataaaataaa

SEQ ID NO: 78046 - DNA, 26 bp, Artificial sequence
  SiRNA target sequence
gtagacaaatttttaataaaataaat

SEQ ID NO: 78047 - DNA, 26 bp, Artificial sequence
  SiRNA target sequence
tagacaaatttttaataaaataaatc

SEQ ID NO: 78048 - DNA, 26 bp, Artificial sequence
  SiRNA target sequence
agacaaatttttaataaaataaatct

SEQ ID NO: 78049 - DNA, 26 bp, Artificial sequence
  SiRNA target sequence
gacaaatttttaataaaataaatcta

SEQ ID NO: 78050 - DNA, 26 bp, Artificial sequence
  SiRNA target sequence
acaaatttttaataaaataaatctag

SEQ ID NO: 78051 - DNA, 26 bp, Artificial sequence
  SiRNA target sequence
caaatttttaataaaataaatctaga

SEQ ID NO: 78052 - DNA, 26 bp, Artificial sequence
  SiRNA target sequence
aaatttttaataaaataaatctagaa

SEQ ID NO: 78053 - DNA, 26 bp, Artificial sequence
  SiRNA target sequence
aatttttaataaaataaatctagaaa

SEQ ID NO: 78054 - DNA, 26 bp, Artificial sequence
  SiRNA target sequence
atttttaataaaataaatctagaaat

SEQ ID NO: 78055 - DNA, 26 bp, Artificial sequence
  SiRNA target sequence
tttttaataaaataaatctagaaata

SEQ ID NO: 78056 - DNA, 26 bp, Artificial sequence
  SiRNA target sequence
ttttaataaaataaatctagaaatat

SEQ ID NO: 78057 - DNA, 26 bp, Artificial sequence
  SiRNA target sequence
tttaataaaataaatctagaaatata

SEQ ID NO: 78058 - DNA, 26 bp, Artificial sequence
  SiRNA target sequence
ttaataaaataaatctagaaatatac

SEQ ID NO: 78059 - DNA, 26 bp, Artificial sequence
  SiRNA target sequence
taataaaataaatctagaaatataca

SEQ ID NO: 78060 - DNA, 26 bp, Artificial sequence
  SiRNA target sequence
aataaaataaatctagaaatatacaa

SEQ ID NO: 78061 - DNA, 26 bp, Artificial sequence
  SiRNA target sequence
ataaaataaatctagaaatatacaaa

SEQ ID NO: 78062 - DNA, 26 bp, Artificial sequence
  SiRNA target sequence
taaaataaatctagaaatatacaaag

SEQ ID NO: 78063 - DNA, 26 bp, Artificial sequence
  SiRNA target sequence
aaaataaatctagaaatatacaaagg

SEQ ID NO: 78064 - DNA, 26 bp, Artificial sequence
  SiRNA target sequence
aaataaatctagaaatatacaaagga

SEQ ID NO: 78065 - DNA, 26 bp, Artificial sequence
  SiRNA target sequence
aataaatctagaaatatacaaaggag

SEQ ID NO: 78066 - DNA, 26 bp, Artificial sequence
  SiRNA target sequence
ataaatctagaaatatacaaaggaga

SEQ ID NO: 78067 - DNA, 26 bp, Artificial sequence
  SiRNA target sequence
taaatctagaaatatacaaaggagaa

SEQ ID NO: 78068 - DNA, 26 bp, Artificial sequence
  SiRNA target sequence
aaatctagaaatatacaaaggagaaa

SEQ ID NO: 78069 - DNA, 26 bp, Artificial sequence
  SiRNA target sequence
aatctagaaatatacaaaggagaaaa

SEQ ID NO: 78070 - DNA, 26 bp, Artificial sequence
  SiRNA target sequence
atctagaaatatacaaaggagaaaaa

SEQ ID NO: 78071 - DNA, 26 bp, Artificial sequence
  SiRNA target sequence
tctagaaatatacaaaggagaaaaag

SEQ ID NO: 78072 - DNA, 26 bp, Artificial sequence
  SiRNA target sequence
ctagaaatatacaaaggagaaaaagt

SEQ ID NO: 78073 - DNA, 26 bp, Artificial sequence
  SiRNA target sequence
tagaaatatacaaaggagaaaaagta

SEQ ID NO: 78074 - DNA, 26 bp, Artificial sequence
  SiRNA target sequence
agaaatatacaaaggagaaaaagtag

SEQ ID NO: 78075 - DNA, 26 bp, Artificial sequence
  SiRNA target sequence
gaaatatacaaaggagaaaaagtagc

SEQ ID NO: 78076 - DNA, 26 bp, Artificial sequence
  SiRNA target sequence
aaatatacaaaggagaaaaagtagca

SEQ ID NO: 78077 - DNA, 26 bp, Artificial sequence
  SiRNA target sequence
aatatacaaaggagaaaaagtagcaa

SEQ ID NO: 78078 - DNA, 26 bp, Artificial sequence
  SiRNA target sequence
atatacaaaggagaaaaagtagcaat

SEQ ID NO: 78079 - DNA, 26 bp, Artificial sequence
  SiRNA target sequence
tatacaaaggagaaaaagtagcaatt

SEQ ID NO: 78080 - DNA, 26 bp, Artificial sequence
  SiRNA target sequence
atacaaaggagaaaaagtagcaatta

SEQ ID NO: 78081 - DNA, 26 bp, Artificial sequence
  SiRNA target sequence
tacaaaggagaaaaagtagcaattat

SEQ ID NO: 78082 - DNA, 26 bp, Artificial sequence
  SiRNA target sequence
acaaaggagaaaaagtagcaattata

SEQ ID NO: 78083 - DNA, 26 bp, Artificial sequence
  SiRNA target sequence
caaaggagaaaaagtagcaattatag

SEQ ID NO: 78084 - DNA, 26 bp, Artificial sequence
  SiRNA target sequence
aaaggagaaaaagtagcaattatagg

SEQ ID NO: 78085 - DNA, 26 bp, Artificial sequence
  SiRNA target sequence
aaggagaaaaagtagcaattataggt

SEQ ID NO: 78086 - DNA, 26 bp, Artificial sequence
  SiRNA target sequence
aggagaaaaagtagcaattataggta

SEQ ID NO: 78087 - DNA, 26 bp, Artificial sequence
  SiRNA target sequence
ggagaaaaagtagcaattataggtaa

SEQ ID NO: 78088 - DNA, 26 bp, Artificial sequence
  SiRNA target sequence
gagaaaaagtagcaattataggtaaa

SEQ ID NO: 78089 - DNA, 26 bp, Artificial sequence
  SiRNA target sequence
agaaaaagtagcaattataggtaaaa

SEQ ID NO: 78090 - DNA, 26 bp, Artificial sequence
  SiRNA target sequence
gaaaaagtagcaattataggtaaaaa

SEQ ID NO: 78091 - DNA, 26 bp, Artificial sequence
  SiRNA target sequence
aaaaagtagcaattataggtaaaaat

SEQ ID NO: 78092 - DNA, 26 bp, Artificial sequence
  SiRNA target sequence
aaaagtagcaattataggtaaaaatg

SEQ ID NO: 78093 - DNA, 26 bp, Artificial sequence
  SiRNA target sequence
aaagtagcaattataggtaaaaatgg

SEQ ID NO: 78094 - DNA, 26 bp, Artificial sequence
  SiRNA target sequence
aagtagcaattataggtaaaaatggt

SEQ ID NO: 78095 - DNA, 26 bp, Artificial sequence
  SiRNA target sequence
agtagcaattataggtaaaaatggta

SEQ ID NO: 78096 - DNA, 26 bp, Artificial sequence
  SiRNA target sequence
gtagcaattataggtaaaaatggtag

SEQ ID NO: 78097 - DNA, 26 bp, Artificial sequence
  SiRNA target sequence
tagcaattataggtaaaaatggtagt

SEQ ID NO: 78098 - DNA, 26 bp, Artificial sequence
  SiRNA target sequence
agcaattataggtaaaaatggtagtg

SEQ ID NO: 78099 - DNA, 26 bp, Artificial sequence
  SiRNA target sequence
gcaattataggtaaaaatggtagtgg

SEQ ID NO: 78100 - DNA, 26 bp, Artificial sequence
  SiRNA target sequence
caattataggtaaaaatggtagtggt

SEQ ID NO: 78101 - DNA, 26 bp, Artificial sequence
  SiRNA target sequence
aattataggtaaaaatggtagtggta

SEQ ID NO: 78102 - DNA, 26 bp, Artificial sequence
  SiRNA target sequence
attataggtaaaaatggtagtggtaa

SEQ ID NO: 78103 - DNA, 26 bp, Artificial sequence
  SiRNA target sequence
ttataggtaaaaatggtagtggtaaa

SEQ ID NO: 78104 - DNA, 26 bp, Artificial sequence
  SiRNA target sequence
tataggtaaaaatggtagtggtaaat

SEQ ID NO: 78105 - DNA, 26 bp, Artificial sequence
  SiRNA target sequence
ataggtaaaaatggtagtggtaaatc

SEQ ID NO: 78106 - DNA, 26 bp, Artificial sequence
  SiRNA target sequence
taggtaaaaatggtagtggtaaatca

SEQ ID NO: 78107 - DNA, 26 bp, Artificial sequence
  SiRNA target sequence
aggtaaaaatggtagtggtaaatcaa

SEQ ID NO: 78108 - DNA, 26 bp, Artificial sequence
  SiRNA target sequence
ggtaaaaatggtagtggtaaatcaac

SEQ ID NO: 78109 - DNA, 26 bp, Artificial sequence
  SiRNA target sequence
gtaaaaatggtagtggtaaatcaaca

SEQ ID NO: 78110 - DNA, 26 bp, Artificial sequence
  SiRNA target sequence
taaaaatggtagtggtaaatcaacat

SEQ ID NO: 78111 - DNA, 26 bp, Artificial sequence
  SiRNA target sequence
aaaaatggtagtggtaaatcaacatt

SEQ ID NO: 78112 - DNA, 26 bp, Artificial sequence
  SiRNA target sequence
aaaatggtagtggtaaatcaacatta

SEQ ID NO: 78113 - DNA, 26 bp, Artificial sequence
  SiRNA target sequence
aaatggtagtggtaaatcaacattac

SEQ ID NO: 78114 - DNA, 26 bp, Artificial sequence
  SiRNA target sequence
aatggtagtggtaaatcaacattact

SEQ ID NO: 78115 - DNA, 26 bp, Artificial sequence
  SiRNA target sequence
atggtagtggtaaatcaacattacta

SEQ ID NO: 78116 - DNA, 26 bp, Artificial sequence
  SiRNA target sequence
tggtagtggtaaatcaacattactaa

SEQ ID NO: 78117 - DNA, 26 bp, Artificial sequence
  SiRNA target sequence
ggtagtggtaaatcaacattactaaa

SEQ ID NO: 78118 - DNA, 26 bp, Artificial sequence
  SiRNA target sequence
gtagtggtaaatcaacattactaaaa

SEQ ID NO: 78119 - DNA, 26 bp, Artificial sequence
  SiRNA target sequence
tagtggtaaatcaacattactaaaac

SEQ ID NO: 78120 - DNA, 26 bp, Artificial sequence
  SiRNA target sequence
agtggtaaatcaacattactaaaact

SEQ ID NO: 78121 - DNA, 26 bp, Artificial sequence
  SiRNA target sequence
gtggtaaatcaacattactaaaacta

SEQ ID NO: 78122 - DNA, 26 bp, Artificial sequence
  SiRNA target sequence
tggtaaatcaacattactaaaactac

SEQ ID NO: 78123 - DNA, 26 bp, Artificial sequence
  SiRNA target sequence
ggtaaatcaacattactaaaactact

SEQ ID NO: 78124 - DNA, 26 bp, Artificial sequence
  SiRNA target sequence
gtaaatcaacattactaaaactactg

SEQ ID NO: 78125 - DNA, 26 bp, Artificial sequence
  SiRNA target sequence
taaatcaacattactaaaactactgc

SEQ ID NO: 78126 - DNA, 26 bp, Artificial sequence
  SiRNA target sequence
aaatcaacattactaaaactactgct

SEQ ID NO: 78127 - DNA, 26 bp, Artificial sequence
  SiRNA target sequence
aatcaacattactaaaactactgctt

SEQ ID NO: 78128 - DNA, 26 bp, Artificial sequence
  SiRNA target sequence
atcaacattactaaaactactgctta

SEQ ID NO: 78129 - DNA, 26 bp, Artificial sequence
  SiRNA target sequence
tcaacattactaaaactactgcttaa

SEQ ID NO: 78130 - DNA, 26 bp, Artificial sequence
  SiRNA target sequence
caacattactaaaactactgcttaaa

SEQ ID NO: 78131 - DNA, 26 bp, Artificial sequence
  SiRNA target sequence
aacattactaaaactactgcttaaat

SEQ ID NO: 78132 - DNA, 26 bp, Artificial sequence
  SiRNA target sequence
acattactaaaactactgcttaaatt

SEQ ID NO: 78133 - DNA, 26 bp, Artificial sequence
  SiRNA target sequence
cattactaaaactactgcttaaattt

SEQ ID NO: 78134 - DNA, 26 bp, Artificial sequence
  SiRNA target sequence
attactaaaactactgcttaaatttg

SEQ ID NO: 78135 - DNA, 26 bp, Artificial sequence
  SiRNA target sequence
ttactaaaactactgcttaaatttga

SEQ ID NO: 78136 - DNA, 26 bp, Artificial sequence
  SiRNA target sequence
tactaaaactactgcttaaatttgat

SEQ ID NO: 78137 - DNA, 26 bp, Artificial sequence
  SiRNA target sequence
actaaaactactgcttaaatttgatg

SEQ ID NO: 78138 - DNA, 26 bp, Artificial sequence
  SiRNA target sequence
ctaaaactactgcttaaatttgatga

SEQ ID NO: 78139 - DNA, 26 bp, Artificial sequence
  SiRNA target sequence
taaaactactgcttaaatttgatgaa

SEQ ID NO: 78140 - DNA, 26 bp, Artificial sequence
  SiRNA target sequence
aaaactactgcttaaatttgatgaag

SEQ ID NO: 78141 - DNA, 26 bp, Artificial sequence
  SiRNA target sequence
aaactactgcttaaatttgatgaaga

SEQ ID NO: 78142 - DNA, 26 bp, Artificial sequence
  SiRNA target sequence
aactactgcttaaatttgatgaagat

SEQ ID NO: 78143 - DNA, 26 bp, Artificial sequence
  SiRNA target sequence
actactgcttaaatttgatgaagatt

SEQ ID NO: 78144 - DNA, 26 bp, Artificial sequence
  SiRNA target sequence
ctactgcttaaatttgatgaagatta

SEQ ID NO: 78145 - DNA, 26 bp, Artificial sequence
  SiRNA target sequence
tactgcttaaatttgatgaagattac

SEQ ID NO: 78146 - DNA, 26 bp, Artificial sequence
  SiRNA target sequence
actgcttaaatttgatgaagattaca

SEQ ID NO: 78147 - DNA, 26 bp, Artificial sequence
  SiRNA target sequence
ctgcttaaatttgatgaagattacaa

SEQ ID NO: 78148 - DNA, 26 bp, Artificial sequence
  SiRNA target sequence
tgcttaaatttgatgaagattacaaa

SEQ ID NO: 78149 - DNA, 26 bp, Artificial sequence
  SiRNA target sequence
gcttaaatttgatgaagattacaaag

SEQ ID NO: 78150 - DNA, 26 bp, Artificial sequence
  SiRNA target sequence
cttaaatttgatgaagattacaaagg

SEQ ID NO: 78151 - DNA, 26 bp, Artificial sequence
  SiRNA target sequence
ttaaatttgatgaagattacaaaggt

SEQ ID NO: 78152 - DNA, 26 bp, Artificial sequence
  SiRNA target sequence
taaatttgatgaagattacaaaggta

SEQ ID NO: 78153 - DNA, 26 bp, Artificial sequence
  SiRNA target sequence
aaatttgatgaagattacaaaggtag

SEQ ID NO: 78154 - DNA, 26 bp, Artificial sequence
  SiRNA target sequence
aatttgatgaagattacaaaggtagc

SEQ ID NO: 78155 - DNA, 26 bp, Artificial sequence
  SiRNA target sequence
atttgatgaagattacaaaggtagca

SEQ ID NO: 78156 - DNA, 26 bp, Artificial sequence
  SiRNA target sequence
tttgatgaagattacaaaggtagcat

SEQ ID NO: 78157 - DNA, 26 bp, Artificial sequence
  SiRNA target sequence
ttgatgaagattacaaaggtagcatt

SEQ ID NO: 78158 - DNA, 26 bp, Artificial sequence
  SiRNA target sequence
tgatgaagattacaaaggtagcattt

SEQ ID NO: 78159 - DNA, 26 bp, Artificial sequence
  SiRNA target sequence
gatgaagattacaaaggtagcatttt

SEQ ID NO: 78160 - DNA, 26 bp, Artificial sequence
  SiRNA target sequence
atgaagattacaaaggtagcatttta

SEQ ID NO: 78161 - DNA, 26 bp, Artificial sequence
  SiRNA target sequence
tgaagattacaaaggtagcattttaa

SEQ ID NO: 78162 - DNA, 26 bp, Artificial sequence
  SiRNA target sequence
gaagattacaaaggtagcattttaat

SEQ ID NO: 78163 - DNA, 26 bp, Artificial sequence
  SiRNA target sequence
aagattacaaaggtagcattttaata

SEQ ID NO: 78164 - DNA, 26 bp, Artificial sequence
  SiRNA target sequence
agattacaaaggtagcattttaatag

SEQ ID NO: 78165 - DNA, 26 bp, Artificial sequence
  SiRNA target sequence
gattacaaaggtagcattttaataga

SEQ ID NO: 78166 - DNA, 26 bp, Artificial sequence
  SiRNA target sequence
attacaaaggtagcattttaatagat

SEQ ID NO: 78167 - DNA, 26 bp, Artificial sequence
  SiRNA target sequence
ttacaaaggtagcattttaatagatg

SEQ ID NO: 78168 - DNA, 26 bp, Artificial sequence
  SiRNA target sequence
tacaaaggtagcattttaatagatga

SEQ ID NO: 78169 - DNA, 26 bp, Artificial sequence
  SiRNA target sequence
acaaaggtagcattttaatagatgac

SEQ ID NO: 78170 - DNA, 26 bp, Artificial sequence
  SiRNA target sequence
caaaggtagcattttaatagatgaca

SEQ ID NO: 78171 - DNA, 26 bp, Artificial sequence
  SiRNA target sequence
aaaggtagcattttaatagatgacat

SEQ ID NO: 78172 - DNA, 26 bp, Artificial sequence
  SiRNA target sequence
aaggtagcattttaatagatgacatt

SEQ ID NO: 78173 - DNA, 26 bp, Artificial sequence
  SiRNA target sequence
aggtagcattttaatagatgacattg

SEQ ID NO: 78174 - DNA, 26 bp, Artificial sequence
  SiRNA target sequence
ggtagcattttaatagatgacattga

SEQ ID NO: 78175 - DNA, 26 bp, Artificial sequence
  SiRNA target sequence
gtagcattttaatagatgacattgat

SEQ ID NO: 78176 - DNA, 26 bp, Artificial sequence
  SiRNA target sequence
tagcattttaatagatgacattgata

SEQ ID NO: 78177 - DNA, 26 bp, Artificial sequence
  SiRNA target sequence
agcattttaatagatgacattgatat

SEQ ID NO: 78178 - DNA, 26 bp, Artificial sequence
  SiRNA target sequence
gcattttaatagatgacattgatatt

SEQ ID NO: 78179 - DNA, 26 bp, Artificial sequence
  SiRNA target sequence
cattttaatagatgacattgatatta

SEQ ID NO: 78180 - DNA, 26 bp, Artificial sequence
  SiRNA target sequence
attttaatagatgacattgatattaa

SEQ ID NO: 78181 - DNA, 26 bp, Artificial sequence
  SiRNA target sequence
ttttaatagatgacattgatattaaa

SEQ ID NO: 78182 - DNA, 26 bp, Artificial sequence
  SiRNA target sequence
tttaatagatgacattgatattaaaa

SEQ ID NO: 78183 - DNA, 26 bp, Artificial sequence
  SiRNA target sequence
ttaatagatgacattgatattaaaaa

SEQ ID NO: 78184 - DNA, 26 bp, Artificial sequence
  SiRNA target sequence
taatagatgacattgatattaaaaaa

SEQ ID NO: 78185 - DNA, 26 bp, Artificial sequence
  SiRNA target sequence
aatagatgacattgatattaaaaaaa

SEQ ID NO: 78186 - DNA, 26 bp, Artificial sequence
  SiRNA target sequence
atagatgacattgatattaaaaaaat

SEQ ID NO: 78187 - DNA, 26 bp, Artificial sequence
  SiRNA target sequence
tagatgacattgatattaaaaaaatc

SEQ ID NO: 78188 - DNA, 26 bp, Artificial sequence
  SiRNA target sequence
agatgacattgatattaaaaaaatca

SEQ ID NO: 78189 - DNA, 26 bp, Artificial sequence
  SiRNA target sequence
gatgacattgatattaaaaaaatcaa

SEQ ID NO: 78190 - DNA, 26 bp, Artificial sequence
  SiRNA target sequence
atgacattgatattaaaaaaatcaaa

SEQ ID NO: 78191 - DNA, 26 bp, Artificial sequence
  SiRNA target sequence
tgacattgatattaaaaaaatcaaag

SEQ ID NO: 78192 - DNA, 26 bp, Artificial sequence
  SiRNA target sequence
gacattgatattaaaaaaatcaaaga

SEQ ID NO: 78193 - DNA, 26 bp, Artificial sequence
  SiRNA target sequence
acattgatattaaaaaaatcaaagac

SEQ ID NO: 78194 - DNA, 26 bp, Artificial sequence
  SiRNA target sequence
cattgatattaaaaaaatcaaagacg

SEQ ID NO: 78195 - DNA, 26 bp, Artificial sequence
  SiRNA target sequence
attgatattaaaaaaatcaaagacga

SEQ ID NO: 78196 - DNA, 26 bp, Artificial sequence
  SiRNA target sequence
ttgatattaaaaaaatcaaagacgaa

SEQ ID NO: 78197 - DNA, 26 bp, Artificial sequence
  SiRNA target sequence
tgatattaaaaaaatcaaagacgaat

SEQ ID NO: 78198 - DNA, 26 bp, Artificial sequence
  SiRNA target sequence
gatattaaaaaaatcaaagacgaatt

SEQ ID NO: 78199 - DNA, 26 bp, Artificial sequence
  SiRNA target sequence
atattaaaaaaatcaaagacgaattt

SEQ ID NO: 78200 - DNA, 26 bp, Artificial sequence
  SiRNA target sequence
tattaaaaaaatcaaagacgaatttt

SEQ ID NO: 78201 - DNA, 26 bp, Artificial sequence
  SiRNA target sequence
attaaaaaaatcaaagacgaatttta

SEQ ID NO: 78202 - DNA, 26 bp, Artificial sequence
  SiRNA target sequence
ttaaaaaaatcaaagacgaattttat

SEQ ID NO: 78203 - DNA, 26 bp, Artificial sequence
  SiRNA target sequence
taaaaaaatcaaagacgaattttata

SEQ ID NO: 78204 - DNA, 26 bp, Artificial sequence
  SiRNA target sequence
aaaaaaatcaaagacgaattttatag

SEQ ID NO: 78205 - DNA, 26 bp, Artificial sequence
  SiRNA target sequence
aaaaaatcaaagacgaattttatagg

SEQ ID NO: 78206 - DNA, 26 bp, Artificial sequence
  SiRNA target sequence
aaaaatcaaagacgaattttatagga

SEQ ID NO: 78207 - DNA, 26 bp, Artificial sequence
  SiRNA target sequence
aaaatcaaagacgaattttataggaa

SEQ ID NO: 78208 - DNA, 26 bp, Artificial sequence
  SiRNA target sequence
aaatcaaagacgaattttataggaat

SEQ ID NO: 78209 - DNA, 26 bp, Artificial sequence
  SiRNA target sequence
aatcaaagacgaattttataggaatt

SEQ ID NO: 78210 - DNA, 26 bp, Artificial sequence
  SiRNA target sequence
atcaaagacgaattttataggaattt

SEQ ID NO: 78211 - DNA, 26 bp, Artificial sequence
  SiRNA target sequence
tcaaagacgaattttataggaattta

SEQ ID NO: 78212 - DNA, 26 bp, Artificial sequence
  SiRNA target sequence
caaagacgaattttataggaatttat

SEQ ID NO: 78213 - DNA, 26 bp, Artificial sequence
  SiRNA target sequence
aaagacgaattttataggaatttatt

SEQ ID NO: 78214 - DNA, 26 bp, Artificial sequence
  SiRNA target sequence
aagacgaattttataggaatttatta

SEQ ID NO: 78215 - DNA, 26 bp, Artificial sequence
  SiRNA target sequence
agacgaattttataggaatttattag

SEQ ID NO: 78216 - DNA, 26 bp, Artificial sequence
  SiRNA target sequence
gacgaattttataggaatttattagg

SEQ ID NO: 78217 - DNA, 26 bp, Artificial sequence
  SiRNA target sequence
acgaattttataggaatttattaggt

SEQ ID NO: 78218 - DNA, 26 bp, Artificial sequence
  SiRNA target sequence
cgaattttataggaatttattaggtt

SEQ ID NO: 78219 - DNA, 26 bp, Artificial sequence
  SiRNA target sequence
gaattttataggaatttattaggtta

SEQ ID NO: 78220 - DNA, 26 bp, Artificial sequence
  SiRNA target sequence
aattttataggaatttattaggttac

SEQ ID NO: 78221 - DNA, 26 bp, Artificial sequence
  SiRNA target sequence
attttataggaatttattaggttaca

SEQ ID NO: 78222 - DNA, 26 bp, Artificial sequence
  SiRNA target sequence
ttttataggaatttattaggttacat

SEQ ID NO: 78223 - DNA, 26 bp, Artificial sequence
  SiRNA target sequence
tttataggaatttattaggttacata

SEQ ID NO: 78224 - DNA, 26 bp, Artificial sequence
  SiRNA target sequence
ttataggaatttattaggttacatac

SEQ ID NO: 78225 - DNA, 26 bp, Artificial sequence
  SiRNA target sequence
tataggaatttattaggttacatacc

SEQ ID NO: 78226 - DNA, 26 bp, Artificial sequence
  SiRNA target sequence
ataggaatttattaggttacatacca

SEQ ID NO: 78227 - DNA, 26 bp, Artificial sequence
  SiRNA target sequence
taggaatttattaggttacataccac

SEQ ID NO: 78228 - DNA, 26 bp, Artificial sequence
  SiRNA target sequence
aggaatttattaggttacataccaca

SEQ ID NO: 78229 - DNA, 26 bp, Artificial sequence
  SiRNA target sequence
ggaatttattaggttacataccacag

SEQ ID NO: 78230 - DNA, 26 bp, Artificial sequence
  SiRNA target sequence
gaatttattaggttacataccacaga

SEQ ID NO: 78231 - DNA, 26 bp, Artificial sequence
  SiRNA target sequence
aatttattaggttacataccacagaa

SEQ ID NO: 78232 - DNA, 26 bp, Artificial sequence
  SiRNA target sequence
atttattaggttacataccacagaat

SEQ ID NO: 78233 - DNA, 26 bp, Artificial sequence
  SiRNA target sequence
tttattaggttacataccacagaata

SEQ ID NO: 78234 - DNA, 26 bp, Artificial sequence
  SiRNA target sequence
ttattaggttacataccacagaatac

SEQ ID NO: 78235 - DNA, 26 bp, Artificial sequence
  SiRNA target sequence
tattaggttacataccacagaataca

SEQ ID NO: 78236 - DNA, 26 bp, Artificial sequence
  SiRNA target sequence
attaggttacataccacagaatacat

SEQ ID NO: 78237 - DNA, 26 bp, Artificial sequence
  SiRNA target sequence
ttaggttacataccacagaatacatt

SEQ ID NO: 78238 - DNA, 26 bp, Artificial sequence
  SiRNA target sequence
taggttacataccacagaatacattt

SEQ ID NO: 78239 - DNA, 26 bp, Artificial sequence
  SiRNA target sequence
aggttacataccacagaatacatttt

SEQ ID NO: 78240 - DNA, 26 bp, Artificial sequence
  SiRNA target sequence
ggttacataccacagaatacattttt

SEQ ID NO: 78241 - DNA, 26 bp, Artificial sequence
  SiRNA target sequence
gttacataccacagaatacatttttg

SEQ ID NO: 78242 - DNA, 26 bp, Artificial sequence
  SiRNA target sequence
ttacataccacagaatacatttttgt

SEQ ID NO: 78243 - DNA, 26 bp, Artificial sequence
  SiRNA target sequence
tacataccacagaatacatttttgtt

SEQ ID NO: 78244 - DNA, 26 bp, Artificial sequence
  SiRNA target sequence
acataccacagaatacatttttgttt

SEQ ID NO: 78245 - DNA, 26 bp, Artificial sequence
  SiRNA target sequence
cataccacagaatacatttttgttta

SEQ ID NO: 78246 - DNA, 26 bp, Artificial sequence
  SiRNA target sequence
ataccacagaatacatttttgtttaa

SEQ ID NO: 78247 - DNA, 26 bp, Artificial sequence
  SiRNA target sequence
taccacagaatacatttttgtttaat

SEQ ID NO: 78248 - DNA, 26 bp, Artificial sequence
  SiRNA target sequence
accacagaatacatttttgtttaatg

SEQ ID NO: 78249 - DNA, 26 bp, Artificial sequence
  SiRNA target sequence
ccacagaatacatttttgtttaatga

SEQ ID NO: 78250 - DNA, 26 bp, Artificial sequence
  SiRNA target sequence
cacagaatacatttttgtttaatgaa

SEQ ID NO: 78251 - DNA, 26 bp, Artificial sequence
  SiRNA target sequence
acagaatacatttttgtttaatgaat

SEQ ID NO: 78252 - DNA, 26 bp, Artificial sequence
  SiRNA target sequence
cagaatacatttttgtttaatgaatc

SEQ ID NO: 78253 - DNA, 26 bp, Artificial sequence
  SiRNA target sequence
agaatacatttttgtttaatgaatct

SEQ ID NO: 78254 - DNA, 26 bp, Artificial sequence
  SiRNA target sequence
gaatacatttttgtttaatgaatctg

SEQ ID NO: 78255 - DNA, 26 bp, Artificial sequence
  SiRNA target sequence
aatacatttttgtttaatgaatctgt

SEQ ID NO: 78256 - DNA, 26 bp, Artificial sequence
  SiRNA target sequence
atacatttttgtttaatgaatctgta

SEQ ID NO: 78257 - DNA, 26 bp, Artificial sequence
  SiRNA target sequence
tacatttttgtttaatgaatctgtaa

SEQ ID NO: 78258 - DNA, 26 bp, Artificial sequence
  SiRNA target sequence
acatttttgtttaatgaatctgtaaa

SEQ ID NO: 78259 - DNA, 26 bp, Artificial sequence
  SiRNA target sequence
catttttgtttaatgaatctgtaaaa

SEQ ID NO: 78260 - DNA, 26 bp, Artificial sequence
  SiRNA target sequence
atttttgtttaatgaatctgtaaaat

SEQ ID NO: 78261 - DNA, 26 bp, Artificial sequence
  SiRNA target sequence
tttttgtttaatgaatctgtaaaata

SEQ ID NO: 78262 - DNA, 26 bp, Artificial sequence
  SiRNA target sequence
ttttgtttaatgaatctgtaaaatat

SEQ ID NO: 78263 - DNA, 26 bp, Artificial sequence
  SiRNA target sequence
tttgtttaatgaatctgtaaaatata

SEQ ID NO: 78264 - DNA, 26 bp, Artificial sequence
  SiRNA target sequence
ttgtttaatgaatctgtaaaatataa

SEQ ID NO: 78265 - DNA, 26 bp, Artificial sequence
  SiRNA target sequence
tgtttaatgaatctgtaaaatataat

SEQ ID NO: 78266 - DNA, 26 bp, Artificial sequence
  SiRNA target sequence
gtttaatgaatctgtaaaatataata

SEQ ID NO: 78267 - DNA, 26 bp, Artificial sequence
  SiRNA target sequence
tttaatgaatctgtaaaatataatat

SEQ ID NO: 78268 - DNA, 26 bp, Artificial sequence
  SiRNA target sequence
ttaatgaatctgtaaaatataatatt

SEQ ID NO: 78269 - DNA, 26 bp, Artificial sequence
  SiRNA target sequence
taatgaatctgtaaaatataatatta

SEQ ID NO: 78270 - DNA, 26 bp, Artificial sequence
  SiRNA target sequence
aatgaatctgtaaaatataatattaa

SEQ ID NO: 78271 - DNA, 26 bp, Artificial sequence
  SiRNA target sequence
atgaatctgtaaaatataatattaaa

SEQ ID NO: 78272 - DNA, 26 bp, Artificial sequence
  SiRNA target sequence
tgaatctgtaaaatataatattaaat

SEQ ID NO: 78273 - DNA, 26 bp, Artificial sequence
  SiRNA target sequence
gaatctgtaaaatataatattaaata

SEQ ID NO: 78274 - DNA, 26 bp, Artificial sequence
  SiRNA target sequence
aatctgtaaaatataatattaaatac

SEQ ID NO: 78275 - DNA, 26 bp, Artificial sequence
  SiRNA target sequence
atctgtaaaatataatattaaatacg

SEQ ID NO: 78276 - DNA, 26 bp, Artificial sequence
  SiRNA target sequence
tctgtaaaatataatattaaatacgg

SEQ ID NO: 78277 - DNA, 26 bp, Artificial sequence
  SiRNA target sequence
ctgtaaaatataatattaaatacgga

SEQ ID NO: 78278 - DNA, 26 bp, Artificial sequence
  SiRNA target sequence
tgtaaaatataatattaaatacggat

SEQ ID NO: 78279 - DNA, 26 bp, Artificial sequence
  SiRNA target sequence
gtaaaatataatattaaatacggatc

SEQ ID NO: 78280 - DNA, 26 bp, Artificial sequence
  SiRNA target sequence
taaaatataatattaaatacggatct

SEQ ID NO: 78281 - DNA, 26 bp, Artificial sequence
  SiRNA target sequence
aaaatataatattaaatacggatctt

SEQ ID NO: 78282 - DNA, 26 bp, Artificial sequence
  SiRNA target sequence
aaatataatattaaatacggatcttt

SEQ ID NO: 78283 - DNA, 26 bp, Artificial sequence
  SiRNA target sequence
aatataatattaaatacggatctttt

SEQ ID NO: 78284 - DNA, 26 bp, Artificial sequence
  SiRNA target sequence
atataatattaaatacggatcttttg

SEQ ID NO: 78285 - DNA, 26 bp, Artificial sequence
  SiRNA target sequence
tataatattaaatacggatcttttgg

SEQ ID NO: 78286 - DNA, 26 bp, Artificial sequence
  SiRNA target sequence
ataatattaaatacggatcttttggt

SEQ ID NO: 78287 - DNA, 26 bp, Artificial sequence
  SiRNA target sequence
taatattaaatacggatcttttggta

SEQ ID NO: 78288 - DNA, 26 bp, Artificial sequence
  SiRNA target sequence
aatattaaatacggatcttttggtat

SEQ ID NO: 78289 - DNA, 26 bp, Artificial sequence
  SiRNA target sequence
atattaaatacggatcttttggtatt

SEQ ID NO: 78290 - DNA, 26 bp, Artificial sequence
  SiRNA target sequence
tattaaatacggatcttttggtattt

SEQ ID NO: 78291 - DNA, 26 bp, Artificial sequence
  SiRNA target sequence
attaaatacggatcttttggtatttc

SEQ ID NO: 78292 - DNA, 26 bp, Artificial sequence
  SiRNA target sequence
ttaaatacggatcttttggtatttca

SEQ ID NO: 78293 - DNA, 26 bp, Artificial sequence
  SiRNA target sequence
taaatacggatcttttggtatttcag

SEQ ID NO: 78294 - DNA, 26 bp, Artificial sequence
  SiRNA target sequence
aaatacggatcttttggtatttcaga

SEQ ID NO: 78295 - DNA, 26 bp, Artificial sequence
  SiRNA target sequence
aatacggatcttttggtatttcagac

SEQ ID NO: 78296 - DNA, 26 bp, Artificial sequence
  SiRNA target sequence
atacggatcttttggtatttcagacg

SEQ ID NO: 78297 - DNA, 26 bp, Artificial sequence
  SiRNA target sequence
tacggatcttttggtatttcagacga

SEQ ID NO: 78298 - DNA, 26 bp, Artificial sequence
  SiRNA target sequence
acggatcttttggtatttcagacgag

SEQ ID NO: 78299 - DNA, 26 bp, Artificial sequence
  SiRNA target sequence
cggatcttttggtatttcagacgagg

SEQ ID NO: 78300 - DNA, 26 bp, Artificial sequence
  SiRNA target sequence
ggatcttttggtatttcagacgagga

SEQ ID NO: 78301 - DNA, 26 bp, Artificial sequence
  SiRNA target sequence
gatcttttggtatttcagacgaggat

SEQ ID NO: 78302 - DNA, 26 bp, Artificial sequence
  SiRNA target sequence
atcttttggtatttcagacgaggata

SEQ ID NO: 78303 - DNA, 26 bp, Artificial sequence
  SiRNA target sequence
tcttttggtatttcagacgaggatat

SEQ ID NO: 78304 - DNA, 26 bp, Artificial sequence
  SiRNA target sequence
cttttggtatttcagacgaggatatt

SEQ ID NO: 78305 - DNA, 26 bp, Artificial sequence
  SiRNA target sequence
ttttggtatttcagacgaggatattt

SEQ ID NO: 78306 - DNA, 26 bp, Artificial sequence
  SiRNA target sequence
tttggtatttcagacgaggatatttt

SEQ ID NO: 78307 - DNA, 26 bp, Artificial sequence
  SiRNA target sequence
ttggtatttcagacgaggatattttt

SEQ ID NO: 78308 - DNA, 26 bp, Artificial sequence
  SiRNA target sequence
tggtatttcagacgaggatatttttg

SEQ ID NO: 78309 - DNA, 26 bp, Artificial sequence
  SiRNA target sequence
ggtatttcagacgaggatatttttgc

SEQ ID NO: 78310 - DNA, 26 bp, Artificial sequence
  SiRNA target sequence
gtatttcagacgaggatatttttgca

SEQ ID NO: 78311 - DNA, 26 bp, Artificial sequence
  SiRNA target sequence
tatttcagacgaggatatttttgcat

SEQ ID NO: 78312 - DNA, 26 bp, Artificial sequence
  SiRNA target sequence
atttcagacgaggatatttttgcatt

SEQ ID NO: 78313 - DNA, 26 bp, Artificial sequence
  SiRNA target sequence
tttcagacgaggatatttttgcattg

SEQ ID NO: 78314 - DNA, 26 bp, Artificial sequence
  SiRNA target sequence
ttcagacgaggatatttttgcattgt

SEQ ID NO: 78315 - DNA, 26 bp, Artificial sequence
  SiRNA target sequence
tcagacgaggatatttttgcattgtg

SEQ ID NO: 78316 - DNA, 26 bp, Artificial sequence
  SiRNA target sequence
cagacgaggatatttttgcattgtgt

SEQ ID NO: 78317 - DNA, 26 bp, Artificial sequence
  SiRNA target sequence
agacgaggatatttttgcattgtgta

SEQ ID NO: 78318 - DNA, 26 bp, Artificial sequence
  SiRNA target sequence
gacgaggatatttttgcattgtgtaa

SEQ ID NO: 78319 - DNA, 26 bp, Artificial sequence
  SiRNA target sequence
acgaggatatttttgcattgtgtaaa

SEQ ID NO: 78320 - DNA, 26 bp, Artificial sequence
  SiRNA target sequence
cgaggatatttttgcattgtgtaaag

SEQ ID NO: 78321 - DNA, 26 bp, Artificial sequence
  SiRNA target sequence
gaggatatttttgcattgtgtaaaga

SEQ ID NO: 78322 - DNA, 26 bp, Artificial sequence
  SiRNA target sequence
aggatatttttgcattgtgtaaagag

SEQ ID NO: 78323 - DNA, 26 bp, Artificial sequence
  SiRNA target sequence
ggatatttttgcattgtgtaaagagt

SEQ ID NO: 78324 - DNA, 26 bp, Artificial sequence
  SiRNA target sequence
gatatttttgcattgtgtaaagagtt

SEQ ID NO: 78325 - DNA, 26 bp, Artificial sequence
  SiRNA target sequence
atatttttgcattgtgtaaagagttt

SEQ ID NO: 78326 - DNA, 26 bp, Artificial sequence
  SiRNA target sequence
tatttttgcattgtgtaaagagtttg

SEQ ID NO: 78327 - DNA, 26 bp, Artificial sequence
  SiRNA target sequence
atttttgcattgtgtaaagagtttgg

SEQ ID NO: 78328 - DNA, 26 bp, Artificial sequence
  SiRNA target sequence
tttttgcattgtgtaaagagtttgga

SEQ ID NO: 78329 - DNA, 26 bp, Artificial sequence
  SiRNA target sequence
ttttgcattgtgtaaagagtttggat

SEQ ID NO: 78330 - DNA, 26 bp, Artificial sequence
  SiRNA target sequence
tttgcattgtgtaaagagtttggatt

SEQ ID NO: 78331 - DNA, 26 bp, Artificial sequence
  SiRNA target sequence
ttgcattgtgtaaagagtttggatta

SEQ ID NO: 78332 - DNA, 26 bp, Artificial sequence
  SiRNA target sequence
tgcattgtgtaaagagtttggattat

SEQ ID NO: 78333 - DNA, 26 bp, Artificial sequence
  SiRNA target sequence
gcattgtgtaaagagtttggattata

SEQ ID NO: 78334 - DNA, 26 bp, Artificial sequence
  SiRNA target sequence
cattgtgtaaagagtttggattatat

SEQ ID NO: 78335 - DNA, 26 bp, Artificial sequence
  SiRNA target sequence
attgtgtaaagagtttggattatatg

SEQ ID NO: 78336 - DNA, 26 bp, Artificial sequence
  SiRNA target sequence
ttgtgtaaagagtttggattatatga

SEQ ID NO: 78337 - DNA, 26 bp, Artificial sequence
  SiRNA target sequence
tgtgtaaagagtttggattatatgac

SEQ ID NO: 78338 - DNA, 26 bp, Artificial sequence
  SiRNA target sequence
gtgtaaagagtttggattatatgacg

SEQ ID NO: 78339 - DNA, 26 bp, Artificial sequence
  SiRNA target sequence
tgtaaagagtttggattatatgacgt

SEQ ID NO: 78340 - DNA, 26 bp, Artificial sequence
  SiRNA target sequence
gtaaagagtttggattatatgacgtt

SEQ ID NO: 78341 - DNA, 26 bp, Artificial sequence
  SiRNA target sequence
taaagagtttggattatatgacgttt

SEQ ID NO: 78342 - DNA, 26 bp, Artificial sequence
  SiRNA target sequence
aaagagtttggattatatgacgtttt

SEQ ID NO: 78343 - DNA, 26 bp, Artificial sequence
  SiRNA target sequence
aagagtttggattatatgacgttttc

SEQ ID NO: 78344 - DNA, 26 bp, Artificial sequence
  SiRNA target sequence
agagtttggattatatgacgttttca

SEQ ID NO: 78345 - DNA, 26 bp, Artificial sequence
  SiRNA target sequence
gagtttggattatatgacgttttcat

SEQ ID NO: 78346 - DNA, 26 bp, Artificial sequence
  SiRNA target sequence
agtttggattatatgacgttttcatg

SEQ ID NO: 78347 - DNA, 26 bp, Artificial sequence
  SiRNA target sequence
gtttggattatatgacgttttcatga

SEQ ID NO: 78348 - DNA, 26 bp, Artificial sequence
  SiRNA target sequence
tttggattatatgacgttttcatgaa

SEQ ID NO: 78349 - DNA, 26 bp, Artificial sequence
  SiRNA target sequence
ttggattatatgacgttttcatgaac

SEQ ID NO: 78350 - DNA, 26 bp, Artificial sequence
  SiRNA target sequence
tggattatatgacgttttcatgaacc

SEQ ID NO: 78351 - DNA, 26 bp, Artificial sequence
  SiRNA target sequence
ggattatatgacgttttcatgaacct

SEQ ID NO: 78352 - DNA, 26 bp, Artificial sequence
  SiRNA target sequence
gattatatgacgttttcatgaacctc

SEQ ID NO: 78353 - DNA, 26 bp, Artificial sequence
  SiRNA target sequence
attatatgacgttttcatgaacctcg

SEQ ID NO: 78354 - DNA, 26 bp, Artificial sequence
  SiRNA target sequence
ttatatgacgttttcatgaacctcga

SEQ ID NO: 78355 - DNA, 26 bp, Artificial sequence
  SiRNA target sequence
tatatgacgttttcatgaacctcgaa

SEQ ID NO: 78356 - DNA, 26 bp, Artificial sequence
  SiRNA target sequence
atatgacgttttcatgaacctcgaaa

SEQ ID NO: 78357 - DNA, 26 bp, Artificial sequence
  SiRNA target sequence
tatgacgttttcatgaacctcgaaaa

SEQ ID NO: 78358 - DNA, 26 bp, Artificial sequence
  SiRNA target sequence
atgacgttttcatgaacctcgaaaat

SEQ ID NO: 78359 - DNA, 26 bp, Artificial sequence
  SiRNA target sequence
tgacgttttcatgaacctcgaaaatg

SEQ ID NO: 78360 - DNA, 26 bp, Artificial sequence
  SiRNA target sequence
gacgttttcatgaacctcgaaaatgg

SEQ ID NO: 78361 - DNA, 26 bp, Artificial sequence
  SiRNA target sequence
acgttttcatgaacctcgaaaatggt

SEQ ID NO: 78362 - DNA, 26 bp, Artificial sequence
  SiRNA target sequence
cgttttcatgaacctcgaaaatggtt

SEQ ID NO: 78363 - DNA, 26 bp, Artificial sequence
  SiRNA target sequence
gttttcatgaacctcgaaaatggttt

SEQ ID NO: 78364 - DNA, 26 bp, Artificial sequence
  SiRNA target sequence
ttttcatgaacctcgaaaatggtttt

SEQ ID NO: 78365 - DNA, 26 bp, Artificial sequence
  SiRNA target sequence
tttcatgaacctcgaaaatggttttg

SEQ ID NO: 78366 - DNA, 26 bp, Artificial sequence
  SiRNA target sequence
ttcatgaacctcgaaaatggttttga

SEQ ID NO: 78367 - DNA, 26 bp, Artificial sequence
  SiRNA target sequence
tcatgaacctcgaaaatggttttgat

SEQ ID NO: 78368 - DNA, 26 bp, Artificial sequence
  SiRNA target sequence
catgaacctcgaaaatggttttgata

SEQ ID NO: 78369 - DNA, 26 bp, Artificial sequence
  SiRNA target sequence
atgaacctcgaaaatggttttgatac

SEQ ID NO: 78370 - DNA, 26 bp, Artificial sequence
  SiRNA target sequence
tgaacctcgaaaatggttttgatacg

SEQ ID NO: 78371 - DNA, 26 bp, Artificial sequence
  SiRNA target sequence
gaacctcgaaaatggttttgatacga

SEQ ID NO: 78372 - DNA, 26 bp, Artificial sequence
  SiRNA target sequence
aacctcgaaaatggttttgatacgaa

SEQ ID NO: 78373 - DNA, 26 bp, Artificial sequence
  SiRNA target sequence
acctcgaaaatggttttgatacgaat

SEQ ID NO: 78374 - DNA, 26 bp, Artificial sequence
  SiRNA target sequence
cctcgaaaatggttttgatacgaatg

SEQ ID NO: 78375 - DNA, 26 bp, Artificial sequence
  SiRNA target sequence
ctcgaaaatggttttgatacgaatgt

SEQ ID NO: 78376 - DNA, 26 bp, Artificial sequence
  SiRNA target sequence
tcgaaaatggttttgatacgaatgta

SEQ ID NO: 78377 - DNA, 26 bp, Artificial sequence
  SiRNA target sequence
cgaaaatggttttgatacgaatgtag

SEQ ID NO: 78378 - DNA, 26 bp, Artificial sequence
  SiRNA target sequence
gaaaatggttttgatacgaatgtagg

SEQ ID NO: 78379 - DNA, 26 bp, Artificial sequence
  SiRNA target sequence
aaaatggttttgatacgaatgtagga

SEQ ID NO: 78380 - DNA, 26 bp, Artificial sequence
  SiRNA target sequence
aaatggttttgatacgaatgtaggag

SEQ ID NO: 78381 - DNA, 26 bp, Artificial sequence
  SiRNA target sequence
aatggttttgatacgaatgtaggaga

SEQ ID NO: 78382 - DNA, 26 bp, Artificial sequence
  SiRNA target sequence
atggttttgatacgaatgtaggagaa

SEQ ID NO: 78383 - DNA, 26 bp, Artificial sequence
  SiRNA target sequence
tggttttgatacgaatgtaggagaaa

SEQ ID NO: 78384 - DNA, 26 bp, Artificial sequence
  SiRNA target sequence
ggttttgatacgaatgtaggagaaag

SEQ ID NO: 78385 - DNA, 26 bp, Artificial sequence
  SiRNA target sequence
gttttgatacgaatgtaggagaaaga

SEQ ID NO: 78386 - DNA, 26 bp, Artificial sequence
  SiRNA target sequence
ttttgatacgaatgtaggagaaagag

SEQ ID NO: 78387 - DNA, 26 bp, Artificial sequence
  SiRNA target sequence
tttgatacgaatgtaggagaaagagg

SEQ ID NO: 78388 - DNA, 26 bp, Artificial sequence
  SiRNA target sequence
ttgatacgaatgtaggagaaagagga

SEQ ID NO: 78389 - DNA, 26 bp, Artificial sequence
  SiRNA target sequence
tgatacgaatgtaggagaaagaggaa

SEQ ID NO: 78390 - DNA, 26 bp, Artificial sequence
  SiRNA target sequence
gatacgaatgtaggagaaagaggaag

SEQ ID NO: 78391 - DNA, 26 bp, Artificial sequence
  SiRNA target sequence
atacgaatgtaggagaaagaggaagg

SEQ ID NO: 78392 - DNA, 26 bp, Artificial sequence
  SiRNA target sequence
tacgaatgtaggagaaagaggaaggt

SEQ ID NO: 78393 - DNA, 26 bp, Artificial sequence
  SiRNA target sequence
acgaatgtaggagaaagaggaaggtt

SEQ ID NO: 78394 - DNA, 26 bp, Artificial sequence
  SiRNA target sequence
cgaatgtaggagaaagaggaaggtta

SEQ ID NO: 78395 - DNA, 26 bp, Artificial sequence
  SiRNA target sequence
gaatgtaggagaaagaggaaggttat

SEQ ID NO: 78396 - DNA, 26 bp, Artificial sequence
  SiRNA target sequence
aatgtaggagaaagaggaaggttatt

SEQ ID NO: 78397 - DNA, 26 bp, Artificial sequence
  SiRNA target sequence
atgtaggagaaagaggaaggttatta

SEQ ID NO: 78398 - DNA, 26 bp, Artificial sequence
  SiRNA target sequence
tgtaggagaaagaggaaggttattaa

SEQ ID NO: 78399 - DNA, 26 bp, Artificial sequence
  SiRNA target sequence
gtaggagaaagaggaaggttattaag

SEQ ID NO: 78400 - DNA, 26 bp, Artificial sequence
  SiRNA target sequence
taggagaaagaggaaggttattaagt

SEQ ID NO: 78401 - DNA, 26 bp, Artificial sequence
  SiRNA target sequence
aggagaaagaggaaggttattaagtg

SEQ ID NO: 78402 - DNA, 26 bp, Artificial sequence
  SiRNA target sequence
ggagaaagaggaaggttattaagtgg

SEQ ID NO: 78403 - DNA, 26 bp, Artificial sequence
  SiRNA target sequence
gagaaagaggaaggttattaagtggt

SEQ ID NO: 78404 - DNA, 26 bp, Artificial sequence
  SiRNA target sequence
agaaagaggaaggttattaagtggtg

SEQ ID NO: 78405 - DNA, 26 bp, Artificial sequence
  SiRNA target sequence
gaaagaggaaggttattaagtggtgg

SEQ ID NO: 78406 - DNA, 26 bp, Artificial sequence
  SiRNA target sequence
aaagaggaaggttattaagtggtgga

SEQ ID NO: 78407 - DNA, 26 bp, Artificial sequence
  SiRNA target sequence
aagaggaaggttattaagtggtggag

SEQ ID NO: 78408 - DNA, 26 bp, Artificial sequence
  SiRNA target sequence
agaggaaggttattaagtggtggaga

SEQ ID NO: 78409 - DNA, 26 bp, Artificial sequence
  SiRNA target sequence
gaggaaggttattaagtggtggagaa

SEQ ID NO: 78410 - DNA, 26 bp, Artificial sequence
  SiRNA target sequence
aggaaggttattaagtggtggagaaa

SEQ ID NO: 78411 - DNA, 26 bp, Artificial sequence
  SiRNA target sequence
ggaaggttattaagtggtggagaaaa

SEQ ID NO: 78412 - DNA, 26 bp, Artificial sequence
  SiRNA target sequence
gaaggttattaagtggtggagaaaag

SEQ ID NO: 78413 - DNA, 26 bp, Artificial sequence
  SiRNA target sequence
aaggttattaagtggtggagaaaagc

SEQ ID NO: 78414 - DNA, 26 bp, Artificial sequence
  SiRNA target sequence
aggttattaagtggtggagaaaagca

SEQ ID NO: 78415 - DNA, 26 bp, Artificial sequence
  SiRNA target sequence
ggttattaagtggtggagaaaagcaa

SEQ ID NO: 78416 - DNA, 26 bp, Artificial sequence
  SiRNA target sequence
gttattaagtggtggagaaaagcaaa

SEQ ID NO: 78417 - DNA, 26 bp, Artificial sequence
  SiRNA target sequence
ttattaagtggtggagaaaagcaaaa

SEQ ID NO: 78418 - DNA, 26 bp, Artificial sequence
  SiRNA target sequence
tattaagtggtggagaaaagcaaaag

SEQ ID NO: 78419 - DNA, 26 bp, Artificial sequence
  SiRNA target sequence
attaagtggtggagaaaagcaaaaga

SEQ ID NO: 78420 - DNA, 26 bp, Artificial sequence
  SiRNA target sequence
ttaagtggtggagaaaagcaaaagat

SEQ ID NO: 78421 - DNA, 26 bp, Artificial sequence
  SiRNA target sequence
taagtggtggagaaaagcaaaagatt

SEQ ID NO: 78422 - DNA, 26 bp, Artificial sequence
  SiRNA target sequence
aagtggtggagaaaagcaaaagattt

SEQ ID NO: 78423 - DNA, 26 bp, Artificial sequence
  SiRNA target sequence
agtggtggagaaaagcaaaagatttt

SEQ ID NO: 78424 - DNA, 26 bp, Artificial sequence
  SiRNA target sequence
gtggtggagaaaagcaaaagatttta

SEQ ID NO: 78425 - DNA, 26 bp, Artificial sequence
  SiRNA target sequence
tggtggagaaaagcaaaagattttat

SEQ ID NO: 78426 - DNA, 26 bp, Artificial sequence
  SiRNA target sequence
ggtggagaaaagcaaaagattttatt

SEQ ID NO: 78427 - DNA, 26 bp, Artificial sequence
  SiRNA target sequence
gtggagaaaagcaaaagattttatta

SEQ ID NO: 78428 - DNA, 26 bp, Artificial sequence
  SiRNA target sequence
tggagaaaagcaaaagattttattaa

SEQ ID NO: 78429 - DNA, 26 bp, Artificial sequence
  SiRNA target sequence
ggagaaaagcaaaagattttattaat

SEQ ID NO: 78430 - DNA, 26 bp, Artificial sequence
  SiRNA target sequence
gagaaaagcaaaagattttattaatg

SEQ ID NO: 78431 - DNA, 26 bp, Artificial sequence
  SiRNA target sequence
agaaaagcaaaagattttattaatgc

SEQ ID NO: 78432 - DNA, 26 bp, Artificial sequence
  SiRNA target sequence
gaaaagcaaaagattttattaatgcg

SEQ ID NO: 78433 - DNA, 26 bp, Artificial sequence
  SiRNA target sequence
aaaagcaaaagattttattaatgcgt

SEQ ID NO: 78434 - DNA, 26 bp, Artificial sequence
  SiRNA target sequence
aaagcaaaagattttattaatgcgta

SEQ ID NO: 78435 - DNA, 26 bp, Artificial sequence
  SiRNA target sequence
aagcaaaagattttattaatgcgtac

SEQ ID NO: 78436 - DNA, 26 bp, Artificial sequence
  SiRNA target sequence
agcaaaagattttattaatgcgtact

SEQ ID NO: 78437 - DNA, 26 bp, Artificial sequence
  SiRNA target sequence
gcaaaagattttattaatgcgtacta

SEQ ID NO: 78438 - DNA, 26 bp, Artificial sequence
  SiRNA target sequence
caaaagattttattaatgcgtactat

SEQ ID NO: 78439 - DNA, 26 bp, Artificial sequence
  SiRNA target sequence
aaaagattttattaatgcgtactatg

SEQ ID NO: 78440 - DNA, 26 bp, Artificial sequence
  SiRNA target sequence
aaagattttattaatgcgtactatgt

SEQ ID NO: 78441 - DNA, 26 bp, Artificial sequence
  SiRNA target sequence
aagattttattaatgcgtactatgtt

SEQ ID NO: 78442 - DNA, 26 bp, Artificial sequence
  SiRNA target sequence
agattttattaatgcgtactatgtta

SEQ ID NO: 78443 - DNA, 26 bp, Artificial sequence
  SiRNA target sequence
gattttattaatgcgtactatgttaa

SEQ ID NO: 78444 - DNA, 26 bp, Artificial sequence
  SiRNA target sequence
attttattaatgcgtactatgttaag

SEQ ID NO: 78445 - DNA, 26 bp, Artificial sequence
  SiRNA target sequence
ttttattaatgcgtactatgttaaga

SEQ ID NO: 78446 - DNA, 26 bp, Artificial sequence
  SiRNA target sequence
tttattaatgcgtactatgttaagaa

SEQ ID NO: 78447 - DNA, 26 bp, Artificial sequence
  SiRNA target sequence
ttattaatgcgtactatgttaagaaa

SEQ ID NO: 78448 - DNA, 26 bp, Artificial sequence
  SiRNA target sequence
tattaatgcgtactatgttaagaaac

SEQ ID NO: 78449 - DNA, 26 bp, Artificial sequence
  SiRNA target sequence
attaatgcgtactatgttaagaaaca

SEQ ID NO: 78450 - DNA, 26 bp, Artificial sequence
  SiRNA target sequence
ttaatgcgtactatgttaagaaacaa

SEQ ID NO: 78451 - DNA, 26 bp, Artificial sequence
  SiRNA target sequence
taatgcgtactatgttaagaaacaag

SEQ ID NO: 78452 - DNA, 26 bp, Artificial sequence
  SiRNA target sequence
aatgcgtactatgttaagaaacaagg

SEQ ID NO: 78453 - DNA, 26 bp, Artificial sequence
  SiRNA target sequence
atgcgtactatgttaagaaacaagga

SEQ ID NO: 78454 - DNA, 26 bp, Artificial sequence
  SiRNA target sequence
tgcgtactatgttaagaaacaaggag

SEQ ID NO: 78455 - DNA, 26 bp, Artificial sequence
  SiRNA target sequence
gcgtactatgttaagaaacaaggaga

SEQ ID NO: 78456 - DNA, 26 bp, Artificial sequence
  SiRNA target sequence
cgtactatgttaagaaacaaggagat

SEQ ID NO: 78457 - DNA, 26 bp, Artificial sequence
  SiRNA target sequence
gtactatgttaagaaacaaggagata

SEQ ID NO: 78458 - DNA, 26 bp, Artificial sequence
  SiRNA target sequence
tactatgttaagaaacaaggagataa

SEQ ID NO: 78459 - DNA, 26 bp, Artificial sequence
  SiRNA target sequence
actatgttaagaaacaaggagataat

SEQ ID NO: 78460 - DNA, 26 bp, Artificial sequence
  SiRNA target sequence
ctatgttaagaaacaaggagataatg

SEQ ID NO: 78461 - DNA, 26 bp, Artificial sequence
  SiRNA target sequence
tatgttaagaaacaaggagataatgg

SEQ ID NO: 78462 - DNA, 26 bp, Artificial sequence
  SiRNA target sequence
atgttaagaaacaaggagataatggc

SEQ ID NO: 78463 - DNA, 26 bp, Artificial sequence
  SiRNA target sequence
tgttaagaaacaaggagataatggca

SEQ ID NO: 78464 - DNA, 26 bp, Artificial sequence
  SiRNA target sequence
gttaagaaacaaggagataatggcat

SEQ ID NO: 78465 - DNA, 26 bp, Artificial sequence
  SiRNA target sequence
ttaagaaacaaggagataatggcatt

SEQ ID NO: 78466 - DNA, 26 bp, Artificial sequence
  SiRNA target sequence
taagaaacaaggagataatggcatta

SEQ ID NO: 78467 - DNA, 26 bp, Artificial sequence
  SiRNA target sequence
aagaaacaaggagataatggcattag

SEQ ID NO: 78468 - DNA, 26 bp, Artificial sequence
  SiRNA target sequence
agaaacaaggagataatggcattaga

SEQ ID NO: 78469 - DNA, 26 bp, Artificial sequence
  SiRNA target sequence
gaaacaaggagataatggcattagat

SEQ ID NO: 78470 - DNA, 26 bp, Artificial sequence
  SiRNA target sequence
aaacaaggagataatggcattagatg

SEQ ID NO: 78471 - DNA, 26 bp, Artificial sequence
  SiRNA target sequence
aacaaggagataatggcattagatga

SEQ ID NO: 78472 - DNA, 26 bp, Artificial sequence
  SiRNA target sequence
acaaggagataatggcattagatgaa

SEQ ID NO: 78473 - DNA, 26 bp, Artificial sequence
  SiRNA target sequence
caaggagataatggcattagatgaac

SEQ ID NO: 78474 - DNA, 26 bp, Artificial sequence
  SiRNA target sequence
aaggagataatggcattagatgaacc

SEQ ID NO: 78475 - DNA, 26 bp, Artificial sequence
  SiRNA target sequence
aggagataatggcattagatgaaccc

SEQ ID NO: 78476 - DNA, 26 bp, Artificial sequence
  SiRNA target sequence
ggagataatggcattagatgaaccca

SEQ ID NO: 78477 - DNA, 26 bp, Artificial sequence
  SiRNA target sequence
gagataatggcattagatgaacccac

SEQ ID NO: 78478 - DNA, 26 bp, Artificial sequence
  SiRNA target sequence
agataatggcattagatgaacccact

SEQ ID NO: 78479 - DNA, 26 bp, Artificial sequence
  SiRNA target sequence
gataatggcattagatgaacccactg

SEQ ID NO: 78480 - DNA, 26 bp, Artificial sequence
  SiRNA target sequence
ataatggcattagatgaacccactgc

SEQ ID NO: 78481 - DNA, 26 bp, Artificial sequence
  SiRNA target sequence
taatggcattagatgaacccactgca

SEQ ID NO: 78482 - DNA, 26 bp, Artificial sequence
  SiRNA target sequence
aatggcattagatgaacccactgcag

SEQ ID NO: 78483 - DNA, 26 bp, Artificial sequence
  SiRNA target sequence
atggcattagatgaacccactgcagc

SEQ ID NO: 78484 - DNA, 26 bp, Artificial sequence
  SiRNA target sequence
tggcattagatgaacccactgcagca

SEQ ID NO: 78485 - DNA, 26 bp, Artificial sequence
  SiRNA target sequence
ggcattagatgaacccactgcagcac

SEQ ID NO: 78486 - DNA, 26 bp, Artificial sequence
  SiRNA target sequence
gcattagatgaacccactgcagcact

SEQ ID NO: 78487 - DNA, 26 bp, Artificial sequence
  SiRNA target sequence
cattagatgaacccactgcagcactt

SEQ ID NO: 78488 - DNA, 26 bp, Artificial sequence
  SiRNA target sequence
attagatgaacccactgcagcacttg

SEQ ID NO: 78489 - DNA, 26 bp, Artificial sequence
  SiRNA target sequence
ttagatgaacccactgcagcacttga

SEQ ID NO: 78490 - DNA, 26 bp, Artificial sequence
  SiRNA target sequence
tagatgaacccactgcagcacttgat

SEQ ID NO: 78491 - DNA, 26 bp, Artificial sequence
  SiRNA target sequence
agatgaacccactgcagcacttgata

SEQ ID NO: 78492 - DNA, 26 bp, Artificial sequence
  SiRNA target sequence
gatgaacccactgcagcacttgataa

SEQ ID NO: 78493 - DNA, 26 bp, Artificial sequence
  SiRNA target sequence
atgaacccactgcagcacttgataag

SEQ ID NO: 78494 - DNA, 26 bp, Artificial sequence
  SiRNA target sequence
tgaacccactgcagcacttgataagg

SEQ ID NO: 78495 - DNA, 26 bp, Artificial sequence
  SiRNA target sequence
gaacccactgcagcacttgataagga

SEQ ID NO: 78496 - DNA, 26 bp, Artificial sequence
  SiRNA target sequence
aacccactgcagcacttgataaggag

SEQ ID NO: 78497 - DNA, 26 bp, Artificial sequence
  SiRNA target sequence
acccactgcagcacttgataaggagt

SEQ ID NO: 78498 - DNA, 26 bp, Artificial sequence
  SiRNA target sequence
cccactgcagcacttgataaggagtc

SEQ ID NO: 78499 - DNA, 26 bp, Artificial sequence
  SiRNA target sequence
ccactgcagcacttgataaggagtct

SEQ ID NO: 78500 - DNA, 26 bp, Artificial sequence
  SiRNA target sequence
cactgcagcacttgataaggagtctg

SEQ ID NO: 78501 - DNA, 26 bp, Artificial sequence
  SiRNA target sequence
actgcagcacttgataaggagtctga

SEQ ID NO: 78502 - DNA, 26 bp, Artificial sequence
  SiRNA target sequence
ctgcagcacttgataaggagtctgaa

SEQ ID NO: 78503 - DNA, 26 bp, Artificial sequence
  SiRNA target sequence
tgcagcacttgataaggagtctgaaa

SEQ ID NO: 78504 - DNA, 26 bp, Artificial sequence
  SiRNA target sequence
gcagcacttgataaggagtctgaaaa

SEQ ID NO: 78505 - DNA, 26 bp, Artificial sequence
  SiRNA target sequence
cagcacttgataaggagtctgaaaaa

SEQ ID NO: 78506 - DNA, 26 bp, Artificial sequence
  SiRNA target sequence
agcacttgataaggagtctgaaaaaa

SEQ ID NO: 78507 - DNA, 26 bp, Artificial sequence
  SiRNA target sequence
gcacttgataaggagtctgaaaaaaa

SEQ ID NO: 78508 - DNA, 26 bp, Artificial sequence
  SiRNA target sequence
cacttgataaggagtctgaaaaaaag

SEQ ID NO: 78509 - DNA, 26 bp, Artificial sequence
  SiRNA target sequence
acttgataaggagtctgaaaaaaaga

SEQ ID NO: 78510 - DNA, 26 bp, Artificial sequence
  SiRNA target sequence
cttgataaggagtctgaaaaaaagat

SEQ ID NO: 78511 - DNA, 26 bp, Artificial sequence
  SiRNA target sequence
ttgataaggagtctgaaaaaaagatt

SEQ ID NO: 78512 - DNA, 26 bp, Artificial sequence
  SiRNA target sequence
tgataaggagtctgaaaaaaagattt

SEQ ID NO: 78513 - DNA, 26 bp, Artificial sequence
  SiRNA target sequence
gataaggagtctgaaaaaaagatttt

SEQ ID NO: 78514 - DNA, 26 bp, Artificial sequence
  SiRNA target sequence
ataaggagtctgaaaaaaagatttta

SEQ ID NO: 78515 - DNA, 26 bp, Artificial sequence
  SiRNA target sequence
taaggagtctgaaaaaaagattttag

SEQ ID NO: 78516 - DNA, 26 bp, Artificial sequence
  SiRNA target sequence
aaggagtctgaaaaaaagattttaga

SEQ ID NO: 78517 - DNA, 26 bp, Artificial sequence
  SiRNA target sequence
aggagtctgaaaaaaagattttagag

SEQ ID NO: 78518 - DNA, 26 bp, Artificial sequence
  SiRNA target sequence
ggagtctgaaaaaaagattttagaga

SEQ ID NO: 78519 - DNA, 26 bp, Artificial sequence
  SiRNA target sequence
gagtctgaaaaaaagattttagagat

SEQ ID NO: 78520 - DNA, 26 bp, Artificial sequence
  SiRNA target sequence
agtctgaaaaaaagattttagagata

SEQ ID NO: 78521 - DNA, 26 bp, Artificial sequence
  SiRNA target sequence
gtctgaaaaaaagattttagagataa

SEQ ID NO: 78522 - DNA, 26 bp, Artificial sequence
  SiRNA target sequence
tctgaaaaaaagattttagagataat

SEQ ID NO: 78523 - DNA, 26 bp, Artificial sequence
  SiRNA target sequence
ctgaaaaaaagattttagagataatt

SEQ ID NO: 78524 - DNA, 26 bp, Artificial sequence
  SiRNA target sequence
tgaaaaaaagattttagagataattt

SEQ ID NO: 78525 - DNA, 26 bp, Artificial sequence
  SiRNA target sequence
gaaaaaaagattttagagataatttt

SEQ ID NO: 78526 - DNA, 26 bp, Artificial sequence
  SiRNA target sequence
aaaaaaagattttagagataatttta

SEQ ID NO: 78527 - DNA, 26 bp, Artificial sequence
  SiRNA target sequence
aaaaaagattttagagataattttac

SEQ ID NO: 78528 - DNA, 26 bp, Artificial sequence
  SiRNA target sequence
aaaaagattttagagataattttaca

SEQ ID NO: 78529 - DNA, 26 bp, Artificial sequence
  SiRNA target sequence
aaaagattttagagataattttacaa

SEQ ID NO: 78530 - DNA, 26 bp, Artificial sequence
  SiRNA target sequence
aaagattttagagataattttacaac

SEQ ID NO: 78531 - DNA, 26 bp, Artificial sequence
  SiRNA target sequence
aagattttagagataattttacaaca

SEQ ID NO: 78532 - DNA, 26 bp, Artificial sequence
  SiRNA target sequence
agattttagagataattttacaacag

SEQ ID NO: 78533 - DNA, 26 bp, Artificial sequence
  SiRNA target sequence
gattttagagataattttacaacagg

SEQ ID NO: 78534 - DNA, 26 bp, Artificial sequence
  SiRNA target sequence
attttagagataattttacaacagga

SEQ ID NO: 78535 - DNA, 26 bp, Artificial sequence
  SiRNA target sequence
ttttagagataattttacaacaggaa

SEQ ID NO: 78536 - DNA, 26 bp, Artificial sequence
  SiRNA target sequence
tttagagataattttacaacaggaag

SEQ ID NO: 78537 - DNA, 26 bp, Artificial sequence
  SiRNA target sequence
ttagagataattttacaacaggaaga

SEQ ID NO: 78538 - DNA, 26 bp, Artificial sequence
  SiRNA target sequence
tagagataattttacaacaggaagat

SEQ ID NO: 78539 - DNA, 26 bp, Artificial sequence
  SiRNA target sequence
agagataattttacaacaggaagatc

SEQ ID NO: 78540 - DNA, 26 bp, Artificial sequence
  SiRNA target sequence
gagataattttacaacaggaagatcg

SEQ ID NO: 78541 - DNA, 26 bp, Artificial sequence
  SiRNA target sequence
agataattttacaacaggaagatcga

SEQ ID NO: 78542 - DNA, 26 bp, Artificial sequence
  SiRNA target sequence
gataattttacaacaggaagatcgaa

SEQ ID NO: 78543 - DNA, 26 bp, Artificial sequence
  SiRNA target sequence
ataattttacaacaggaagatcgaac

SEQ ID NO: 78544 - DNA, 26 bp, Artificial sequence
  SiRNA target sequence
taattttacaacaggaagatcgaaca

SEQ ID NO: 78545 - DNA, 26 bp, Artificial sequence
  SiRNA target sequence
aattttacaacaggaagatcgaacag

SEQ ID NO: 78546 - DNA, 26 bp, Artificial sequence
  SiRNA target sequence
attttacaacaggaagatcgaacagt

SEQ ID NO: 78547 - DNA, 26 bp, Artificial sequence
  SiRNA target sequence
ttttacaacaggaagatcgaacagtt

SEQ ID NO: 78548 - DNA, 26 bp, Artificial sequence
  SiRNA target sequence
tttacaacaggaagatcgaacagttt

SEQ ID NO: 78549 - DNA, 26 bp, Artificial sequence
  SiRNA target sequence
ttacaacaggaagatcgaacagtttt

SEQ ID NO: 78550 - DNA, 26 bp, Artificial sequence
  SiRNA target sequence
tacaacaggaagatcgaacagttttg

SEQ ID NO: 78551 - DNA, 26 bp, Artificial sequence
  SiRNA target sequence
acaacaggaagatcgaacagttttga

SEQ ID NO: 78552 - DNA, 26 bp, Artificial sequence
  SiRNA target sequence
caacaggaagatcgaacagttttgat

SEQ ID NO: 78553 - DNA, 26 bp, Artificial sequence
  SiRNA target sequence
aacaggaagatcgaacagttttgatg

SEQ ID NO: 78554 - DNA, 26 bp, Artificial sequence
  SiRNA target sequence
acaggaagatcgaacagttttgatga

SEQ ID NO: 78555 - DNA, 26 bp, Artificial sequence
  SiRNA target sequence
caggaagatcgaacagttttgatgat

SEQ ID NO: 78556 - DNA, 26 bp, Artificial sequence
  SiRNA target sequence
aggaagatcgaacagttttgatgata

SEQ ID NO: 78557 - DNA, 26 bp, Artificial sequence
  SiRNA target sequence
ggaagatcgaacagttttgatgataa

SEQ ID NO: 78558 - DNA, 26 bp, Artificial sequence
  SiRNA target sequence
gaagatcgaacagttttgatgataat

SEQ ID NO: 78559 - DNA, 26 bp, Artificial sequence
  SiRNA target sequence
aagatcgaacagttttgatgataatt

SEQ ID NO: 78560 - DNA, 26 bp, Artificial sequence
  SiRNA target sequence
agatcgaacagttttgatgataattc

SEQ ID NO: 78561 - DNA, 26 bp, Artificial sequence
  SiRNA target sequence
gatcgaacagttttgatgataattca

SEQ ID NO: 78562 - DNA, 26 bp, Artificial sequence
  SiRNA target sequence
atcgaacagttttgatgataattcat

SEQ ID NO: 78563 - DNA, 26 bp, Artificial sequence
  SiRNA target sequence
tcgaacagttttgatgataattcata

SEQ ID NO: 78564 - DNA, 26 bp, Artificial sequence
  SiRNA target sequence
cgaacagttttgatgataattcataa

SEQ ID NO: 78565 - DNA, 26 bp, Artificial sequence
  SiRNA target sequence
gaacagttttgatgataattcataat

SEQ ID NO: 78566 - DNA, 26 bp, Artificial sequence
  SiRNA target sequence
aacagttttgatgataattcataatc

SEQ ID NO: 78567 - DNA, 26 bp, Artificial sequence
  SiRNA target sequence
acagttttgatgataattcataatct

SEQ ID NO: 78568 - DNA, 26 bp, Artificial sequence
  SiRNA target sequence
cagttttgatgataattcataatcta

SEQ ID NO: 78569 - DNA, 26 bp, Artificial sequence
  SiRNA target sequence
agttttgatgataattcataatctag

SEQ ID NO: 78570 - DNA, 26 bp, Artificial sequence
  SiRNA target sequence
gttttgatgataattcataatctaga

SEQ ID NO: 78571 - DNA, 26 bp, Artificial sequence
  SiRNA target sequence
ttttgatgataattcataatctagaa

SEQ ID NO: 78572 - DNA, 26 bp, Artificial sequence
  SiRNA target sequence
tttgatgataattcataatctagaac

SEQ ID NO: 78573 - DNA, 26 bp, Artificial sequence
  SiRNA target sequence
ttgatgataattcataatctagaact

SEQ ID NO: 78574 - DNA, 26 bp, Artificial sequence
  SiRNA target sequence
tgatgataattcataatctagaactt

SEQ ID NO: 78575 - DNA, 26 bp, Artificial sequence
  SiRNA target sequence
gatgataattcataatctagaactta

SEQ ID NO: 78576 - DNA, 26 bp, Artificial sequence
  SiRNA target sequence
atgataattcataatctagaacttat

SEQ ID NO: 78577 - DNA, 26 bp, Artificial sequence
  SiRNA target sequence
tgataattcataatctagaacttatt

SEQ ID NO: 78578 - DNA, 26 bp, Artificial sequence
  SiRNA target sequence
gataattcataatctagaacttatta

SEQ ID NO: 78579 - DNA, 26 bp, Artificial sequence
  SiRNA target sequence
ataattcataatctagaacttattaa

SEQ ID NO: 78580 - DNA, 26 bp, Artificial sequence
  SiRNA target sequence
taattcataatctagaacttattaat

SEQ ID NO: 78581 - DNA, 26 bp, Artificial sequence
  SiRNA target sequence
aattcataatctagaacttattaata

SEQ ID NO: 78582 - DNA, 26 bp, Artificial sequence
  SiRNA target sequence
attcataatctagaacttattaataa

SEQ ID NO: 78583 - DNA, 26 bp, Artificial sequence
  SiRNA target sequence
ttcataatctagaacttattaataaa

SEQ ID NO: 78584 - DNA, 26 bp, Artificial sequence
  SiRNA target sequence
tcataatctagaacttattaataaat

SEQ ID NO: 78585 - DNA, 26 bp, Artificial sequence
  SiRNA target sequence
cataatctagaacttattaataaatt

SEQ ID NO: 78586 - DNA, 26 bp, Artificial sequence
  SiRNA target sequence
ataatctagaacttattaataaattt

SEQ ID NO: 78587 - DNA, 26 bp, Artificial sequence
  SiRNA target sequence
taatctagaacttattaataaatttg

SEQ ID NO: 78588 - DNA, 26 bp, Artificial sequence
  SiRNA target sequence
aatctagaacttattaataaatttga

SEQ ID NO: 78589 - DNA, 26 bp, Artificial sequence
  SiRNA target sequence
atctagaacttattaataaatttgat

SEQ ID NO: 78590 - DNA, 26 bp, Artificial sequence
  SiRNA target sequence
tctagaacttattaataaatttgata

SEQ ID NO: 78591 - DNA, 26 bp, Artificial sequence
  SiRNA target sequence
ctagaacttattaataaatttgataa

SEQ ID NO: 78592 - DNA, 26 bp, Artificial sequence
  SiRNA target sequence
tagaacttattaataaatttgataaa

SEQ ID NO: 78593 - DNA, 26 bp, Artificial sequence
  SiRNA target sequence
agaacttattaataaatttgataaaa

SEQ ID NO: 78594 - DNA, 26 bp, Artificial sequence
  SiRNA target sequence
gaacttattaataaatttgataaaat

SEQ ID NO: 78595 - DNA, 26 bp, Artificial sequence
  SiRNA target sequence
aacttattaataaatttgataaaata

SEQ ID NO: 78596 - DNA, 26 bp, Artificial sequence
  SiRNA target sequence
acttattaataaatttgataaaataa

SEQ ID NO: 78597 - DNA, 26 bp, Artificial sequence
  SiRNA target sequence
cttattaataaatttgataaaataat

SEQ ID NO: 78598 - DNA, 26 bp, Artificial sequence
  SiRNA target sequence
ttattaataaatttgataaaataatt

SEQ ID NO: 78599 - DNA, 26 bp, Artificial sequence
  SiRNA target sequence
tattaataaatttgataaaataattt

SEQ ID NO: 78600 - DNA, 26 bp, Artificial sequence
  SiRNA target sequence
attaataaatttgataaaataattta

SEQ ID NO: 78601 - DNA, 26 bp, Artificial sequence
  SiRNA target sequence
ttaataaatttgataaaataatttac

SEQ ID NO: 78602 - DNA, 26 bp, Artificial sequence
  SiRNA target sequence
taataaatttgataaaataatttaca

SEQ ID NO: 78603 - DNA, 26 bp, Artificial sequence
  SiRNA target sequence
aataaatttgataaaataatttacat

SEQ ID NO: 78604 - DNA, 26 bp, Artificial sequence
  SiRNA target sequence
ataaatttgataaaataatttacatt

SEQ ID NO: 78605 - DNA, 26 bp, Artificial sequence
  SiRNA target sequence
taaatttgataaaataatttacattg

SEQ ID NO: 78606 - DNA, 26 bp, Artificial sequence
  SiRNA target sequence
aaatttgataaaataatttacattga

SEQ ID NO: 78607 - DNA, 26 bp, Artificial sequence
  SiRNA target sequence
aatttgataaaataatttacattgat

SEQ ID NO: 78608 - DNA, 26 bp, Artificial sequence
  SiRNA target sequence
atttgataaaataatttacattgatg

SEQ ID NO: 78609 - DNA, 26 bp, Artificial sequence
  SiRNA target sequence
tttgataaaataatttacattgatga

SEQ ID NO: 78610 - DNA, 26 bp, Artificial sequence
  SiRNA target sequence
ttgataaaataatttacattgatgaa

SEQ ID NO: 78611 - DNA, 26 bp, Artificial sequence
  SiRNA target sequence
tgataaaataatttacattgatgaaa

SEQ ID NO: 78612 - DNA, 26 bp, Artificial sequence
  SiRNA target sequence
gataaaataatttacattgatgaaaa

SEQ ID NO: 78613 - DNA, 26 bp, Artificial sequence
  SiRNA target sequence
ataaaataatttacattgatgaaaat

SEQ ID NO: 78614 - DNA, 26 bp, Artificial sequence
  SiRNA target sequence
taaaataatttacattgatgaaaata

SEQ ID NO: 78615 - DNA, 26 bp, Artificial sequence
  SiRNA target sequence
aaaataatttacattgatgaaaataa

SEQ ID NO: 78616 - DNA, 26 bp, Artificial sequence
  SiRNA target sequence
aaataatttacattgatgaaaataat

SEQ ID NO: 78617 - DNA, 26 bp, Artificial sequence
  SiRNA target sequence
aataatttacattgatgaaaataata

SEQ ID NO: 78618 - DNA, 26 bp, Artificial sequence
  SiRNA target sequence
ataatttacattgatgaaaataatat

SEQ ID NO: 78619 - DNA, 26 bp, Artificial sequence
  SiRNA target sequence
taatttacattgatgaaaataatata

SEQ ID NO: 78620 - DNA, 26 bp, Artificial sequence
  SiRNA target sequence
aatttacattgatgaaaataatatag

SEQ ID NO: 78621 - DNA, 26 bp, Artificial sequence
  SiRNA target sequence
atttacattgatgaaaataatataga

SEQ ID NO: 78622 - DNA, 26 bp, Artificial sequence
  SiRNA target sequence
tttacattgatgaaaataatatagaa

SEQ ID NO: 78623 - DNA, 26 bp, Artificial sequence
  SiRNA target sequence
ttacattgatgaaaataatatagaag

SEQ ID NO: 78624 - DNA, 26 bp, Artificial sequence
  SiRNA target sequence
tacattgatgaaaataatatagaagt

SEQ ID NO: 78625 - DNA, 26 bp, Artificial sequence
  SiRNA target sequence
acattgatgaaaataatatagaagtc

SEQ ID NO: 78626 - DNA, 26 bp, Artificial sequence
  SiRNA target sequence
cattgatgaaaataatatagaagtct

SEQ ID NO: 78627 - DNA, 26 bp, Artificial sequence
  SiRNA target sequence
attgatgaaaataatatagaagtcta

SEQ ID NO: 78628 - DNA, 26 bp, Artificial sequence
  SiRNA target sequence
ttgatgaaaataatatagaagtctat

SEQ ID NO: 78629 - DNA, 26 bp, Artificial sequence
  SiRNA target sequence
tgatgaaaataatatagaagtctata

SEQ ID NO: 78630 - DNA, 26 bp, Artificial sequence
  SiRNA target sequence
gatgaaaataatatagaagtctataa

SEQ ID NO: 78631 - DNA, 26 bp, Artificial sequence
  SiRNA target sequence
atgaaaataatatagaagtctataaa

SEQ ID NO: 78632 - DNA, 26 bp, Artificial sequence
  SiRNA target sequence
tgaaaataatatagaagtctataaaa

SEQ ID NO: 78633 - DNA, 26 bp, Artificial sequence
  SiRNA target sequence
gaaaataatatagaagtctataaaaa

SEQ ID NO: 78634 - DNA, 26 bp, Artificial sequence
  SiRNA target sequence
aaaataatatagaagtctataaaaat

SEQ ID NO: 78635 - DNA, 26 bp, Artificial sequence
  SiRNA target sequence
aaataatatagaagtctataaaaatg

SEQ ID NO: 78636 - DNA, 26 bp, Artificial sequence
  SiRNA target sequence
aataatatagaagtctataaaaatga

SEQ ID NO: 78637 - DNA, 26 bp, Artificial sequence
  SiRNA target sequence
ataatatagaagtctataaaaatgat

SEQ ID NO: 78638 - DNA, 26 bp, Artificial sequence
  SiRNA target sequence
taatatagaagtctataaaaatgata

SEQ ID NO: 78639 - DNA, 26 bp, Artificial sequence
  SiRNA target sequence
aatatagaagtctataaaaatgatat

SEQ ID NO: 78640 - DNA, 26 bp, Artificial sequence
  SiRNA target sequence
atatagaagtctataaaaatgatatt

SEQ ID NO: 78641 - DNA, 26 bp, Artificial sequence
  SiRNA target sequence
tatagaagtctataaaaatgatattg

SEQ ID NO: 78642 - DNA, 26 bp, Artificial sequence
  SiRNA target sequence
atagaagtctataaaaatgatattga

SEQ ID NO: 78643 - DNA, 26 bp, Artificial sequence
  SiRNA target sequence
tagaagtctataaaaatgatattgaa

SEQ ID NO: 78644 - DNA, 26 bp, Artificial sequence
  SiRNA target sequence
agaagtctataaaaatgatattgaag

SEQ ID NO: 78645 - DNA, 26 bp, Artificial sequence
  SiRNA target sequence
gaagtctataaaaatgatattgaagg

SEQ ID NO: 78646 - DNA, 26 bp, Artificial sequence
  SiRNA target sequence
aagtctataaaaatgatattgaagga

SEQ ID NO: 78647 - DNA, 26 bp, Artificial sequence
  SiRNA target sequence
agtctataaaaatgatattgaaggac

SEQ ID NO: 78648 - DNA, 26 bp, Artificial sequence
  SiRNA target sequence
gtctataaaaatgatattgaaggaca

SEQ ID NO: 78649 - DNA, 26 bp, Artificial sequence
  SiRNA target sequence
tctataaaaatgatattgaaggacaa

SEQ ID NO: 78650 - DNA, 26 bp, Artificial sequence
  SiRNA target sequence
ctataaaaatgatattgaaggacaaa

SEQ ID NO: 78651 - DNA, 26 bp, Artificial sequence
  SiRNA target sequence
tataaaaatgatattgaaggacaaaa

SEQ ID NO: 78652 - DNA, 26 bp, Artificial sequence
  SiRNA target sequence
ataaaaatgatattgaaggacaaaaa

SEQ ID NO: 78653 - DNA, 26 bp, Artificial sequence
  SiRNA target sequence
taaaaatgatattgaaggacaaaaaa

SEQ ID NO: 78654 - DNA, 26 bp, Artificial sequence
  SiRNA target sequence
aaaaatgatattgaaggacaaaaaaa

SEQ ID NO: 78655 - DNA, 26 bp, Artificial sequence
  SiRNA target sequence
aaaatgatattgaaggacaaaaaaag

SEQ ID NO: 78656 - DNA, 26 bp, Artificial sequence
  SiRNA target sequence
aaatgatattgaaggacaaaaaaagt

SEQ ID NO: 78657 - DNA, 26 bp, Artificial sequence
  SiRNA target sequence
aatgatattgaaggacaaaaaaagtt

SEQ ID NO: 78658 - DNA, 26 bp, Artificial sequence
  SiRNA target sequence
atgatattgaaggacaaaaaaagttt

SEQ ID NO: 78659 - DNA, 26 bp, Artificial sequence
  SiRNA target sequence
tgatattgaaggacaaaaaaagtttt

SEQ ID NO: 78660 - DNA, 26 bp, Artificial sequence
  SiRNA target sequence
gatattgaaggacaaaaaaagttttc

SEQ ID NO: 78661 - DNA, 26 bp, Artificial sequence
  SiRNA target sequence
atattgaaggacaaaaaaagttttct

SEQ ID NO: 78662 - DNA, 26 bp, Artificial sequence
  SiRNA target sequence
tattgaaggacaaaaaaagttttcta

SEQ ID NO: 78663 - DNA, 26 bp, Artificial sequence
  SiRNA target sequence
attgaaggacaaaaaaagttttctac

SEQ ID NO: 78664 - DNA, 26 bp, Artificial sequence
  SiRNA target sequence
ttgaaggacaaaaaaagttttctaca

SEQ ID NO: 78665 - DNA, 26 bp, Artificial sequence
  SiRNA target sequence
tgaaggacaaaaaaagttttctacaa

SEQ ID NO: 78666 - DNA, 26 bp, Artificial sequence
  SiRNA target sequence
gaaggacaaaaaaagttttctacaaa

SEQ ID NO: 78667 - DNA, 26 bp, Artificial sequence
  SiRNA target sequence
aaggacaaaaaaagttttctacaaat

SEQ ID NO: 78668 - DNA, 26 bp, Artificial sequence
  SiRNA target sequence
aggacaaaaaaagttttctacaaatt

SEQ ID NO: 78669 - DNA, 26 bp, Artificial sequence
  SiRNA target sequence
ggacaaaaaaagttttctacaaattt

SEQ ID NO: 78670 - DNA, 26 bp, Artificial sequence
  SiRNA target sequence
gacaaaaaaagttttctacaaattta

SEQ ID NO: 78671 - DNA, 26 bp, Artificial sequence
  SiRNA target sequence
acaaaaaaagttttctacaaatttac

SEQ ID NO: 78672 - DNA, 26 bp, Artificial sequence
  SiRNA target sequence
caaaaaaagttttctacaaatttaca

SEQ ID NO: 78673 - DNA, 26 bp, Artificial sequence
  SiRNA target sequence
aaaaaaagttttctacaaatttacaa

SEQ ID NO: 78674 - DNA, 26 bp, Artificial sequence
  SiRNA target sequence
aaaaaagttttctacaaatttacaat

SEQ ID NO: 78675 - DNA, 26 bp, Artificial sequence
  SiRNA target sequence
aaaaagttttctacaaatttacaata

SEQ ID NO: 78676 - DNA, 26 bp, Artificial sequence
  SiRNA target sequence
aaaagttttctacaaatttacaatat

SEQ ID NO: 78677 - DNA, 26 bp, Artificial sequence
  SiRNA target sequence
aaagttttctacaaatttacaatatt

SEQ ID NO: 78678 - DNA, 26 bp, Artificial sequence
  SiRNA target sequence
aagttttctacaaatttacaatattt

SEQ ID NO: 78679 - DNA, 26 bp, Artificial sequence
  SiRNA target sequence
agttttctacaaatttacaatatttt

SEQ ID NO: 78680 - DNA, 26 bp, Artificial sequence
  SiRNA target sequence
gttttctacaaatttacaatattttt

SEQ ID NO: 78681 - DNA, 26 bp, Artificial sequence
  SiRNA target sequence
ttttctacaaatttacaatatttttt

SEQ ID NO: 78682 - DNA, 26 bp, Artificial sequence
  SiRNA target sequence
tttctacaaatttacaatatttttta

SEQ ID NO: 78683 - DNA, 26 bp, Artificial sequence
  SiRNA target sequence
ttctacaaatttacaatattttttat

SEQ ID NO: 78684 - DNA, 26 bp, Artificial sequence
  SiRNA target sequence
tctacaaatttacaatattttttatc

SEQ ID NO: 78685 - DNA, 26 bp, Artificial sequence
  SiRNA target sequence
ctacaaatttacaatattttttatca

SEQ ID NO: 78686 - DNA, 26 bp, Artificial sequence
  SiRNA target sequence
tacaaatttacaatattttttatcat

SEQ ID NO: 78687 - DNA, 26 bp, Artificial sequence
  SiRNA target sequence
acaaatttacaatattttttatcata

SEQ ID NO: 78688 - DNA, 26 bp, Artificial sequence
  SiRNA target sequence
caaatttacaatattttttatcatac

SEQ ID NO: 78689 - DNA, 26 bp, Artificial sequence
  SiRNA target sequence
aaatttacaatattttttatcataca

SEQ ID NO: 78690 - DNA, 26 bp, Artificial sequence
  SiRNA target sequence
aatttacaatattttttatcatacaa

SEQ ID NO: 78691 - DNA, 26 bp, Artificial sequence
  SiRNA target sequence
atttacaatattttttatcatacaaa

SEQ ID NO: 78692 - DNA, 26 bp, Artificial sequence
  SiRNA target sequence
tttacaatattttttatcatacaaat

SEQ ID NO: 78693 - DNA, 26 bp, Artificial sequence
  SiRNA target sequence
ttacaatattttttatcatacaaatt

SEQ ID NO: 78694 - DNA, 26 bp, Artificial sequence
  SiRNA target sequence
tacaatattttttatcatacaaatta

SEQ ID NO: 78695 - DNA, 26 bp, Artificial sequence
  SiRNA target sequence
acaatattttttatcatacaaattag

SEQ ID NO: 78696 - DNA, 26 bp, Artificial sequence
  SiRNA target sequence
caatattttttatcatacaaattagg

SEQ ID NO: 78697 - DNA, 26 bp, Artificial sequence
  SiRNA target sequence
aatattttttatcatacaaattaggt

SEQ ID NO: 78698 - DNA, 26 bp, Artificial sequence
  SiRNA target sequence
atattttttatcatacaaattaggta

SEQ ID NO: 78699 - DNA, 26 bp, Artificial sequence
  SiRNA target sequence
tattttttatcatacaaattaggtaa

SEQ ID NO: 78700 - DNA, 26 bp, Artificial sequence
  SiRNA target sequence
attttttatcatacaaattaggtaaa

SEQ ID NO: 78701 - DNA, 26 bp, Artificial sequence
  SiRNA target sequence
ttttttatcatacaaattaggtaaat

SEQ ID NO: 78702 - DNA, 26 bp, Artificial sequence
  SiRNA target sequence
tttttatcatacaaattaggtaaata

SEQ ID NO: 78703 - DNA, 26 bp, Artificial sequence
  SiRNA target sequence
ttttatcatacaaattaggtaaataa

SEQ ID NO: 78704 - DNA, 27 bp, Artificial sequence
  SiRNA target sequence
atgaaaaaaatttcgaatagaaaaatt

SEQ ID NO: 78705 - DNA, 27 bp, Artificial sequence
  SiRNA target sequence
tgaaaaaaatttcgaatagaaaaatta

SEQ ID NO: 78706 - DNA, 27 bp, Artificial sequence
  SiRNA target sequence
gaaaaaaatttcgaatagaaaaattat

SEQ ID NO: 78707 - DNA, 27 bp, Artificial sequence
  SiRNA target sequence
aaaaaaatttcgaatagaaaaattatc

SEQ ID NO: 78708 - DNA, 27 bp, Artificial sequence
  SiRNA target sequence
aaaaaatttcgaatagaaaaattatca

SEQ ID NO: 78709 - DNA, 27 bp, Artificial sequence
  SiRNA target sequence
aaaaatttcgaatagaaaaattatcaa

SEQ ID NO: 78710 - DNA, 27 bp, Artificial sequence
  SiRNA target sequence
aaaatttcgaatagaaaaattatcaaa

SEQ ID NO: 78711 - DNA, 27 bp, Artificial sequence
  SiRNA target sequence
aaatttcgaatagaaaaattatcaaag

SEQ ID NO: 78712 - DNA, 27 bp, Artificial sequence
  SiRNA target sequence
aatttcgaatagaaaaattatcaaaga

SEQ ID NO: 78713 - DNA, 27 bp, Artificial sequence
  SiRNA target sequence
atttcgaatagaaaaattatcaaagaa

SEQ ID NO: 78714 - DNA, 27 bp, Artificial sequence
  SiRNA target sequence
tttcgaatagaaaaattatcaaagaaa

SEQ ID NO: 78715 - DNA, 27 bp, Artificial sequence
  SiRNA target sequence
ttcgaatagaaaaattatcaaagaaat

SEQ ID NO: 78716 - DNA, 27 bp, Artificial sequence
  SiRNA target sequence
tcgaatagaaaaattatcaaagaaatt

SEQ ID NO: 78717 - DNA, 27 bp, Artificial sequence
  SiRNA target sequence
cgaatagaaaaattatcaaagaaatta

SEQ ID NO: 78718 - DNA, 27 bp, Artificial sequence
  SiRNA target sequence
gaatagaaaaattatcaaagaaattat

SEQ ID NO: 78719 - DNA, 27 bp, Artificial sequence
  SiRNA target sequence
aatagaaaaattatcaaagaaattatt

SEQ ID NO: 78720 - DNA, 27 bp, Artificial sequence
  SiRNA target sequence
atagaaaaattatcaaagaaattattt

SEQ ID NO: 78721 - DNA, 27 bp, Artificial sequence
  SiRNA target sequence
tagaaaaattatcaaagaaattattta

SEQ ID NO: 78722 - DNA, 27 bp, Artificial sequence
  SiRNA target sequence
agaaaaattatcaaagaaattatttac

SEQ ID NO: 78723 - DNA, 27 bp, Artificial sequence
  SiRNA target sequence
gaaaaattatcaaagaaattatttaca

SEQ ID NO: 78724 - DNA, 27 bp, Artificial sequence
  SiRNA target sequence
aaaaattatcaaagaaattatttacaa

SEQ ID NO: 78725 - DNA, 27 bp, Artificial sequence
  SiRNA target sequence
aaaattatcaaagaaattatttacaat

SEQ ID NO: 78726 - DNA, 27 bp, Artificial sequence
  SiRNA target sequence
aaattatcaaagaaattatttacaatg

SEQ ID NO: 78727 - DNA, 27 bp, Artificial sequence
  SiRNA target sequence
aattatcaaagaaattatttacaatga

SEQ ID NO: 78728 - DNA, 27 bp, Artificial sequence
  SiRNA target sequence
attatcaaagaaattatttacaatgat

SEQ ID NO: 78729 - DNA, 27 bp, Artificial sequence
  SiRNA target sequence
ttatcaaagaaattatttacaatgatt

SEQ ID NO: 78730 - DNA, 27 bp, Artificial sequence
  SiRNA target sequence
tatcaaagaaattatttacaatgattt

SEQ ID NO: 78731 - DNA, 27 bp, Artificial sequence
  SiRNA target sequence
atcaaagaaattatttacaatgattta

SEQ ID NO: 78732 - DNA, 27 bp, Artificial sequence
  SiRNA target sequence
tcaaagaaattatttacaatgatttat

SEQ ID NO: 78733 - DNA, 27 bp, Artificial sequence
  SiRNA target sequence
caaagaaattatttacaatgatttatt

SEQ ID NO: 78734 - DNA, 27 bp, Artificial sequence
  SiRNA target sequence
aaagaaattatttacaatgatttatta

SEQ ID NO: 78735 - DNA, 27 bp, Artificial sequence
  SiRNA target sequence
aagaaattatttacaatgatttattaa

SEQ ID NO: 78736 - DNA, 27 bp, Artificial sequence
  SiRNA target sequence
agaaattatttacaatgatttattaaa

SEQ ID NO: 78737 - DNA, 27 bp, Artificial sequence
  SiRNA target sequence
gaaattatttacaatgatttattaaaa

SEQ ID NO: 78738 - DNA, 27 bp, Artificial sequence
  SiRNA target sequence
aaattatttacaatgatttattaaaaa

SEQ ID NO: 78739 - DNA, 27 bp, Artificial sequence
  SiRNA target sequence
aattatttacaatgatttattaaaaat

SEQ ID NO: 78740 - DNA, 27 bp, Artificial sequence
  SiRNA target sequence
attatttacaatgatttattaaaaata

SEQ ID NO: 78741 - DNA, 27 bp, Artificial sequence
  SiRNA target sequence
ttatttacaatgatttattaaaaataa

SEQ ID NO: 78742 - DNA, 27 bp, Artificial sequence
  SiRNA target sequence
tatttacaatgatttattaaaaataag

SEQ ID NO: 78743 - DNA, 27 bp, Artificial sequence
  SiRNA target sequence
atttacaatgatttattaaaaataaga

SEQ ID NO: 78744 - DNA, 27 bp, Artificial sequence
  SiRNA target sequence
tttacaatgatttattaaaaataagaa

SEQ ID NO: 78745 - DNA, 27 bp, Artificial sequence
  SiRNA target sequence
ttacaatgatttattaaaaataagaat

SEQ ID NO: 78746 - DNA, 27 bp, Artificial sequence
  SiRNA target sequence
tacaatgatttattaaaaataagaatg

SEQ ID NO: 78747 - DNA, 27 bp, Artificial sequence
  SiRNA target sequence
acaatgatttattaaaaataagaatgt

SEQ ID NO: 78748 - DNA, 27 bp, Artificial sequence
  SiRNA target sequence
caatgatttattaaaaataagaatgtt

SEQ ID NO: 78749 - DNA, 27 bp, Artificial sequence
  SiRNA target sequence
aatgatttattaaaaataagaatgttg

SEQ ID NO: 78750 - DNA, 27 bp, Artificial sequence
  SiRNA target sequence
atgatttattaaaaataagaatgttgc

SEQ ID NO: 78751 - DNA, 27 bp, Artificial sequence
  SiRNA target sequence
tgatttattaaaaataagaatgttgcg

SEQ ID NO: 78752 - DNA, 27 bp, Artificial sequence
  SiRNA target sequence
gatttattaaaaataagaatgttgcga

SEQ ID NO: 78753 - DNA, 27 bp, Artificial sequence
  SiRNA target sequence
atttattaaaaataagaatgttgcgat

SEQ ID NO: 78754 - DNA, 27 bp, Artificial sequence
  SiRNA target sequence
tttattaaaaataagaatgttgcgata

SEQ ID NO: 78755 - DNA, 27 bp, Artificial sequence
  SiRNA target sequence
ttattaaaaataagaatgttgcgatat

SEQ ID NO: 78756 - DNA, 27 bp, Artificial sequence
  SiRNA target sequence
tattaaaaataagaatgttgcgatatg

SEQ ID NO: 78757 - DNA, 27 bp, Artificial sequence
  SiRNA target sequence
attaaaaataagaatgttgcgatatgt

SEQ ID NO: 78758 - DNA, 27 bp, Artificial sequence
  SiRNA target sequence
ttaaaaataagaatgttgcgatatgtt

SEQ ID NO: 78759 - DNA, 27 bp, Artificial sequence
  SiRNA target sequence
taaaaataagaatgttgcgatatgtta

SEQ ID NO: 78760 - DNA, 27 bp, Artificial sequence
  SiRNA target sequence
aaaaataagaatgttgcgatatgttat

SEQ ID NO: 78761 - DNA, 27 bp, Artificial sequence
  SiRNA target sequence
aaaataagaatgttgcgatatgttatt

SEQ ID NO: 78762 - DNA, 27 bp, Artificial sequence
  SiRNA target sequence
aaataagaatgttgcgatatgttattg

SEQ ID NO: 78763 - DNA, 27 bp, Artificial sequence
  SiRNA target sequence
aataagaatgttgcgatatgttattgt

SEQ ID NO: 78764 - DNA, 27 bp, Artificial sequence
  SiRNA target sequence
ataagaatgttgcgatatgttattgta

SEQ ID NO: 78765 - DNA, 27 bp, Artificial sequence
  SiRNA target sequence
taagaatgttgcgatatgttattgtac

SEQ ID NO: 78766 - DNA, 27 bp, Artificial sequence
  SiRNA target sequence
aagaatgttgcgatatgttattgtacc

SEQ ID NO: 78767 - DNA, 27 bp, Artificial sequence
  SiRNA target sequence
agaatgttgcgatatgttattgtacca

SEQ ID NO: 78768 - DNA, 27 bp, Artificial sequence
  SiRNA target sequence
gaatgttgcgatatgttattgtaccaa

SEQ ID NO: 78769 - DNA, 27 bp, Artificial sequence
  SiRNA target sequence
aatgttgcgatatgttattgtaccaat

SEQ ID NO: 78770 - DNA, 27 bp, Artificial sequence
  SiRNA target sequence
atgttgcgatatgttattgtaccaata

SEQ ID NO: 78771 - DNA, 27 bp, Artificial sequence
  SiRNA target sequence
tgttgcgatatgttattgtaccaataa

SEQ ID NO: 78772 - DNA, 27 bp, Artificial sequence
  SiRNA target sequence
gttgcgatatgttattgtaccaataat

SEQ ID NO: 78773 - DNA, 27 bp, Artificial sequence
  SiRNA target sequence
ttgcgatatgttattgtaccaataata

SEQ ID NO: 78774 - DNA, 27 bp, Artificial sequence
  SiRNA target sequence
tgcgatatgttattgtaccaataatat

SEQ ID NO: 78775 - DNA, 27 bp, Artificial sequence
  SiRNA target sequence
gcgatatgttattgtaccaataatatt

SEQ ID NO: 78776 - DNA, 27 bp, Artificial sequence
  SiRNA target sequence
cgatatgttattgtaccaataatattt

SEQ ID NO: 78777 - DNA, 27 bp, Artificial sequence
  SiRNA target sequence
gatatgttattgtaccaataatatttt

SEQ ID NO: 78778 - DNA, 27 bp, Artificial sequence
  SiRNA target sequence
atatgttattgtaccaataatattttt

SEQ ID NO: 78779 - DNA, 27 bp, Artificial sequence
  SiRNA target sequence
tatgttattgtaccaataatattttta

SEQ ID NO: 78780 - DNA, 27 bp, Artificial sequence
  SiRNA target sequence
atgttattgtaccaataatatttttaa

SEQ ID NO: 78781 - DNA, 27 bp, Artificial sequence
  SiRNA target sequence
tgttattgtaccaataatatttttaac

SEQ ID NO: 78782 - DNA, 27 bp, Artificial sequence
  SiRNA target sequence
gttattgtaccaataatatttttaact

SEQ ID NO: 78783 - DNA, 27 bp, Artificial sequence
  SiRNA target sequence
ttattgtaccaataatatttttaacta

SEQ ID NO: 78784 - DNA, 27 bp, Artificial sequence
  SiRNA target sequence
tattgtaccaataatatttttaactat

SEQ ID NO: 78785 - DNA, 27 bp, Artificial sequence
  SiRNA target sequence
attgtaccaataatatttttaactata

SEQ ID NO: 78786 - DNA, 27 bp, Artificial sequence
  SiRNA target sequence
ttgtaccaataatatttttaactatat

SEQ ID NO: 78787 - DNA, 27 bp, Artificial sequence
  SiRNA target sequence
tgtaccaataatatttttaactatatt

SEQ ID NO: 78788 - DNA, 27 bp, Artificial sequence
  SiRNA target sequence
gtaccaataatatttttaactatattt

SEQ ID NO: 78789 - DNA, 27 bp, Artificial sequence
  SiRNA target sequence
taccaataatatttttaactatatttt

SEQ ID NO: 78790 - DNA, 27 bp, Artificial sequence
  SiRNA target sequence
accaataatatttttaactatatttta

SEQ ID NO: 78791 - DNA, 27 bp, Artificial sequence
  SiRNA target sequence
ccaataatatttttaactatattttac

SEQ ID NO: 78792 - DNA, 27 bp, Artificial sequence
  SiRNA target sequence
caataatatttttaactatattttaca

SEQ ID NO: 78793 - DNA, 27 bp, Artificial sequence
  SiRNA target sequence
aataatatttttaactatattttacac

SEQ ID NO: 78794 - DNA, 27 bp, Artificial sequence
  SiRNA target sequence
ataatatttttaactatattttacact

SEQ ID NO: 78795 - DNA, 27 bp, Artificial sequence
  SiRNA target sequence
taatatttttaactatattttacactg

SEQ ID NO: 78796 - DNA, 27 bp, Artificial sequence
  SiRNA target sequence
aatatttttaactatattttacactgt

SEQ ID NO: 78797 - DNA, 27 bp, Artificial sequence
  SiRNA target sequence
atatttttaactatattttacactgtt

SEQ ID NO: 78798 - DNA, 27 bp, Artificial sequence
  SiRNA target sequence
tatttttaactatattttacactgttt

SEQ ID NO: 78799 - DNA, 27 bp, Artificial sequence
  SiRNA target sequence
atttttaactatattttacactgtttt

SEQ ID NO: 78800 - DNA, 27 bp, Artificial sequence
  SiRNA target sequence
tttttaactatattttacactgtttta

SEQ ID NO: 78801 - DNA, 27 bp, Artificial sequence
  SiRNA target sequence
ttttaactatattttacactgttttag

SEQ ID NO: 78802 - DNA, 27 bp, Artificial sequence
  SiRNA target sequence
tttaactatattttacactgttttaga

SEQ ID NO: 78803 - DNA, 27 bp, Artificial sequence
  SiRNA target sequence
ttaactatattttacactgttttagag

SEQ ID NO: 78804 - DNA, 27 bp, Artificial sequence
  SiRNA target sequence
taactatattttacactgttttagaga

SEQ ID NO: 78805 - DNA, 27 bp, Artificial sequence
  SiRNA target sequence
aactatattttacactgttttagagat

SEQ ID NO: 78806 - DNA, 27 bp, Artificial sequence
  SiRNA target sequence
actatattttacactgttttagagata

SEQ ID NO: 78807 - DNA, 27 bp, Artificial sequence
  SiRNA target sequence
ctatattttacactgttttagagataa

SEQ ID NO: 78808 - DNA, 27 bp, Artificial sequence
  SiRNA target sequence
tatattttacactgttttagagataaa

SEQ ID NO: 78809 - DNA, 27 bp, Artificial sequence
  SiRNA target sequence
atattttacactgttttagagataaaa

SEQ ID NO: 78810 - DNA, 27 bp, Artificial sequence
  SiRNA target sequence
tattttacactgttttagagataaaaa

SEQ ID NO: 78811 - DNA, 27 bp, Artificial sequence
  SiRNA target sequence
attttacactgttttagagataaaaat

SEQ ID NO: 78812 - DNA, 27 bp, Artificial sequence
  SiRNA target sequence
ttttacactgttttagagataaaaata

SEQ ID NO: 78813 - DNA, 27 bp, Artificial sequence
  SiRNA target sequence
tttacactgttttagagataaaaataa

SEQ ID NO: 78814 - DNA, 27 bp, Artificial sequence
  SiRNA target sequence
ttacactgttttagagataaaaataag

SEQ ID NO: 78815 - DNA, 27 bp, Artificial sequence
  SiRNA target sequence
tacactgttttagagataaaaataagt

SEQ ID NO: 78816 - DNA, 27 bp, Artificial sequence
  SiRNA target sequence
acactgttttagagataaaaataagta

SEQ ID NO: 78817 - DNA, 27 bp, Artificial sequence
  SiRNA target sequence
cactgttttagagataaaaataagtac

SEQ ID NO: 78818 - DNA, 27 bp, Artificial sequence
  SiRNA target sequence
actgttttagagataaaaataagtaca

SEQ ID NO: 78819 - DNA, 27 bp, Artificial sequence
  SiRNA target sequence
ctgttttagagataaaaataagtacat

SEQ ID NO: 78820 - DNA, 27 bp, Artificial sequence
  SiRNA target sequence
tgttttagagataaaaataagtacatt

SEQ ID NO: 78821 - DNA, 27 bp, Artificial sequence
  SiRNA target sequence
gttttagagataaaaataagtacatta

SEQ ID NO: 78822 - DNA, 27 bp, Artificial sequence
  SiRNA target sequence
ttttagagataaaaataagtacattag

SEQ ID NO: 78823 - DNA, 27 bp, Artificial sequence
  SiRNA target sequence
tttagagataaaaataagtacattagt

SEQ ID NO: 78824 - DNA, 27 bp, Artificial sequence
  SiRNA target sequence
ttagagataaaaataagtacattagta

SEQ ID NO: 78825 - DNA, 27 bp, Artificial sequence
  SiRNA target sequence
tagagataaaaataagtacattagtaa

SEQ ID NO: 78826 - DNA, 27 bp, Artificial sequence
  SiRNA target sequence
agagataaaaataagtacattagtaaa

SEQ ID NO: 78827 - DNA, 27 bp, Artificial sequence
  SiRNA target sequence
gagataaaaataagtacattagtaaag

SEQ ID NO: 78828 - DNA, 27 bp, Artificial sequence
  SiRNA target sequence
agataaaaataagtacattagtaaaga

SEQ ID NO: 78829 - DNA, 27 bp, Artificial sequence
  SiRNA target sequence
gataaaaataagtacattagtaaagaa

SEQ ID NO: 78830 - DNA, 27 bp, Artificial sequence
  SiRNA target sequence
ataaaaataagtacattagtaaagaat

SEQ ID NO: 78831 - DNA, 27 bp, Artificial sequence
  SiRNA target sequence
taaaaataagtacattagtaaagaatc

SEQ ID NO: 78832 - DNA, 27 bp, Artificial sequence
  SiRNA target sequence
aaaaataagtacattagtaaagaatct

SEQ ID NO: 78833 - DNA, 27 bp, Artificial sequence
  SiRNA target sequence
aaaataagtacattagtaaagaatctt

SEQ ID NO: 78834 - DNA, 27 bp, Artificial sequence
  SiRNA target sequence
aaataagtacattagtaaagaatctta

SEQ ID NO: 78835 - DNA, 27 bp, Artificial sequence
  SiRNA target sequence
aataagtacattagtaaagaatcttaa

SEQ ID NO: 78836 - DNA, 27 bp, Artificial sequence
  SiRNA target sequence
ataagtacattagtaaagaatcttaat

SEQ ID NO: 78837 - DNA, 27 bp, Artificial sequence
  SiRNA target sequence
taagtacattagtaaagaatcttaatc

SEQ ID NO: 78838 - DNA, 27 bp, Artificial sequence
  SiRNA target sequence
aagtacattagtaaagaatcttaatca

SEQ ID NO: 78839 - DNA, 27 bp, Artificial sequence
  SiRNA target sequence
agtacattagtaaagaatcttaatcaa

SEQ ID NO: 78840 - DNA, 27 bp, Artificial sequence
  SiRNA target sequence
gtacattagtaaagaatcttaatcaat

SEQ ID NO: 78841 - DNA, 27 bp, Artificial sequence
  SiRNA target sequence
tacattagtaaagaatcttaatcaatc

SEQ ID NO: 78842 - DNA, 27 bp, Artificial sequence
  SiRNA target sequence
acattagtaaagaatcttaatcaatct

SEQ ID NO: 78843 - DNA, 27 bp, Artificial sequence
  SiRNA target sequence
cattagtaaagaatcttaatcaatcta

SEQ ID NO: 78844 - DNA, 27 bp, Artificial sequence
  SiRNA target sequence
attagtaaagaatcttaatcaatctat

SEQ ID NO: 78845 - DNA, 27 bp, Artificial sequence
  SiRNA target sequence
ttagtaaagaatcttaatcaatctatc

SEQ ID NO: 78846 - DNA, 27 bp, Artificial sequence
  SiRNA target sequence
tagtaaagaatcttaatcaatctatcg

SEQ ID NO: 78847 - DNA, 27 bp, Artificial sequence
  SiRNA target sequence
agtaaagaatcttaatcaatctatcgc

SEQ ID NO: 78848 - DNA, 27 bp, Artificial sequence
  SiRNA target sequence
gtaaagaatcttaatcaatctatcgca

SEQ ID NO: 78849 - DNA, 27 bp, Artificial sequence
  SiRNA target sequence
taaagaatcttaatcaatctatcgcaa

SEQ ID NO: 78850 - DNA, 27 bp, Artificial sequence
  SiRNA target sequence
aaagaatcttaatcaatctatcgcaaa

SEQ ID NO: 78851 - DNA, 27 bp, Artificial sequence
  SiRNA target sequence
aagaatcttaatcaatctatcgcaaat

SEQ ID NO: 78852 - DNA, 27 bp, Artificial sequence
  SiRNA target sequence
agaatcttaatcaatctatcgcaaatc

SEQ ID NO: 78853 - DNA, 27 bp, Artificial sequence
  SiRNA target sequence
gaatcttaatcaatctatcgcaaatcg

SEQ ID NO: 78854 - DNA, 27 bp, Artificial sequence
  SiRNA target sequence
aatcttaatcaatctatcgcaaatcga

SEQ ID NO: 78855 - DNA, 27 bp, Artificial sequence
  SiRNA target sequence
atcttaatcaatctatcgcaaatcgaa

SEQ ID NO: 78856 - DNA, 27 bp, Artificial sequence
  SiRNA target sequence
tcttaatcaatctatcgcaaatcgaaa

SEQ ID NO: 78857 - DNA, 27 bp, Artificial sequence
  SiRNA target sequence
cttaatcaatctatcgcaaatcgaaaa

SEQ ID NO: 78858 - DNA, 27 bp, Artificial sequence
  SiRNA target sequence
ttaatcaatctatcgcaaatcgaaaag

SEQ ID NO: 78859 - DNA, 27 bp, Artificial sequence
  SiRNA target sequence
taatcaatctatcgcaaatcgaaaagg

SEQ ID NO: 78860 - DNA, 27 bp, Artificial sequence
  SiRNA target sequence
aatcaatctatcgcaaatcgaaaaggt

SEQ ID NO: 78861 - DNA, 27 bp, Artificial sequence
  SiRNA target sequence
atcaatctatcgcaaatcgaaaaggtg

SEQ ID NO: 78862 - DNA, 27 bp, Artificial sequence
  SiRNA target sequence
tcaatctatcgcaaatcgaaaaggtga

SEQ ID NO: 78863 - DNA, 27 bp, Artificial sequence
  SiRNA target sequence
caatctatcgcaaatcgaaaaggtgaa

SEQ ID NO: 78864 - DNA, 27 bp, Artificial sequence
  SiRNA target sequence
aatctatcgcaaatcgaaaaggtgaac

SEQ ID NO: 78865 - DNA, 27 bp, Artificial sequence
  SiRNA target sequence
atctatcgcaaatcgaaaaggtgaaca

SEQ ID NO: 78866 - DNA, 27 bp, Artificial sequence
  SiRNA target sequence
tctatcgcaaatcgaaaaggtgaacac

SEQ ID NO: 78867 - DNA, 27 bp, Artificial sequence
  SiRNA target sequence
ctatcgcaaatcgaaaaggtgaacaca

SEQ ID NO: 78868 - DNA, 27 bp, Artificial sequence
  SiRNA target sequence
tatcgcaaatcgaaaaggtgaacacac

SEQ ID NO: 78869 - DNA, 27 bp, Artificial sequence
  SiRNA target sequence
atcgcaaatcgaaaaggtgaacacaca

SEQ ID NO: 78870 - DNA, 27 bp, Artificial sequence
  SiRNA target sequence
tcgcaaatcgaaaaggtgaacacacag

SEQ ID NO: 78871 - DNA, 27 bp, Artificial sequence
  SiRNA target sequence
cgcaaatcgaaaaggtgaacacacagc

SEQ ID NO: 78872 - DNA, 27 bp, Artificial sequence
  SiRNA target sequence
gcaaatcgaaaaggtgaacacacagca

SEQ ID NO: 78873 - DNA, 27 bp, Artificial sequence
  SiRNA target sequence
caaatcgaaaaggtgaacacacagcac

SEQ ID NO: 78874 - DNA, 27 bp, Artificial sequence
  SiRNA target sequence
aaatcgaaaaggtgaacacacagcact

SEQ ID NO: 78875 - DNA, 27 bp, Artificial sequence
  SiRNA target sequence
aatcgaaaaggtgaacacacagcactt

SEQ ID NO: 78876 - DNA, 27 bp, Artificial sequence
  SiRNA target sequence
atcgaaaaggtgaacacacagcacttg

SEQ ID NO: 78877 - DNA, 27 bp, Artificial sequence
  SiRNA target sequence
tcgaaaaggtgaacacacagcacttga

SEQ ID NO: 78878 - DNA, 27 bp, Artificial sequence
  SiRNA target sequence
cgaaaaggtgaacacacagcacttgaa

SEQ ID NO: 78879 - DNA, 27 bp, Artificial sequence
  SiRNA target sequence
gaaaaggtgaacacacagcacttgaaa

SEQ ID NO: 78880 - DNA, 27 bp, Artificial sequence
  SiRNA target sequence
aaaaggtgaacacacagcacttgaaag

SEQ ID NO: 78881 - DNA, 27 bp, Artificial sequence
  SiRNA target sequence
aaaggtgaacacacagcacttgaaaga

SEQ ID NO: 78882 - DNA, 27 bp, Artificial sequence
  SiRNA target sequence
aaggtgaacacacagcacttgaaagat

SEQ ID NO: 78883 - DNA, 27 bp, Artificial sequence
  SiRNA target sequence
aggtgaacacacagcacttgaaagatt

SEQ ID NO: 78884 - DNA, 27 bp, Artificial sequence
  SiRNA target sequence
ggtgaacacacagcacttgaaagattt

SEQ ID NO: 78885 - DNA, 27 bp, Artificial sequence
  SiRNA target sequence
gtgaacacacagcacttgaaagatttg

SEQ ID NO: 78886 - DNA, 27 bp, Artificial sequence
  SiRNA target sequence
tgaacacacagcacttgaaagatttgt

SEQ ID NO: 78887 - DNA, 27 bp, Artificial sequence
  SiRNA target sequence
gaacacacagcacttgaaagatttgtg

SEQ ID NO: 78888 - DNA, 27 bp, Artificial sequence
  SiRNA target sequence
aacacacagcacttgaaagatttgtgt

SEQ ID NO: 78889 - DNA, 27 bp, Artificial sequence
  SiRNA target sequence
acacacagcacttgaaagatttgtgtt

SEQ ID NO: 78890 - DNA, 27 bp, Artificial sequence
  SiRNA target sequence
cacacagcacttgaaagatttgtgtta

SEQ ID NO: 78891 - DNA, 27 bp, Artificial sequence
  SiRNA target sequence
acacagcacttgaaagatttgtgttac

SEQ ID NO: 78892 - DNA, 27 bp, Artificial sequence
  SiRNA target sequence
cacagcacttgaaagatttgtgttaca

SEQ ID NO: 78893 - DNA, 27 bp, Artificial sequence
  SiRNA target sequence
acagcacttgaaagatttgtgttacag

SEQ ID NO: 78894 - DNA, 27 bp, Artificial sequence
  SiRNA target sequence
cagcacttgaaagatttgtgttacagt

SEQ ID NO: 78895 - DNA, 27 bp, Artificial sequence
  SiRNA target sequence
agcacttgaaagatttgtgttacagtc

SEQ ID NO: 78896 - DNA, 27 bp, Artificial sequence
  SiRNA target sequence
gcacttgaaagatttgtgttacagtca

SEQ ID NO: 78897 - DNA, 27 bp, Artificial sequence
  SiRNA target sequence
cacttgaaagatttgtgttacagtcac

SEQ ID NO: 78898 - DNA, 27 bp, Artificial sequence
  SiRNA target sequence
acttgaaagatttgtgttacagtcact

SEQ ID NO: 78899 - DNA, 27 bp, Artificial sequence
  SiRNA target sequence
cttgaaagatttgtgttacagtcactc

SEQ ID NO: 78900 - DNA, 27 bp, Artificial sequence
  SiRNA target sequence
ttgaaagatttgtgttacagtcactct

SEQ ID NO: 78901 - DNA, 27 bp, Artificial sequence
  SiRNA target sequence
tgaaagatttgtgttacagtcactctt

SEQ ID NO: 78902 - DNA, 27 bp, Artificial sequence
  SiRNA target sequence
gaaagatttgtgttacagtcactctta

SEQ ID NO: 78903 - DNA, 27 bp, Artificial sequence
  SiRNA target sequence
aaagatttgtgttacagtcactcttag

SEQ ID NO: 78904 - DNA, 27 bp, Artificial sequence
  SiRNA target sequence
aagatttgtgttacagtcactcttagt

SEQ ID NO: 78905 - DNA, 27 bp, Artificial sequence
  SiRNA target sequence
agatttgtgttacagtcactcttagtg

SEQ ID NO: 78906 - DNA, 27 bp, Artificial sequence
  SiRNA target sequence
gatttgtgttacagtcactcttagtgg

SEQ ID NO: 78907 - DNA, 27 bp, Artificial sequence
  SiRNA target sequence
atttgtgttacagtcactcttagtggc

SEQ ID NO: 78908 - DNA, 27 bp, Artificial sequence
  SiRNA target sequence
tttgtgttacagtcactcttagtggct

SEQ ID NO: 78909 - DNA, 27 bp, Artificial sequence
  SiRNA target sequence
ttgtgttacagtcactcttagtggctg

SEQ ID NO: 78910 - DNA, 27 bp, Artificial sequence
  SiRNA target sequence
tgtgttacagtcactcttagtggctgt

SEQ ID NO: 78911 - DNA, 27 bp, Artificial sequence
  SiRNA target sequence
gtgttacagtcactcttagtggctgta

SEQ ID NO: 78912 - DNA, 27 bp, Artificial sequence
  SiRNA target sequence
tgttacagtcactcttagtggctgtat

SEQ ID NO: 78913 - DNA, 27 bp, Artificial sequence
  SiRNA target sequence
gttacagtcactcttagtggctgtatt

SEQ ID NO: 78914 - DNA, 27 bp, Artificial sequence
  SiRNA target sequence
ttacagtcactcttagtggctgtattg

SEQ ID NO: 78915 - DNA, 27 bp, Artificial sequence
  SiRNA target sequence
tacagtcactcttagtggctgtattga

SEQ ID NO: 78916 - DNA, 27 bp, Artificial sequence
  SiRNA target sequence
acagtcactcttagtggctgtattgac

SEQ ID NO: 78917 - DNA, 27 bp, Artificial sequence
  SiRNA target sequence
cagtcactcttagtggctgtattgacc

SEQ ID NO: 78918 - DNA, 27 bp, Artificial sequence
  SiRNA target sequence
agtcactcttagtggctgtattgaccg

SEQ ID NO: 78919 - DNA, 27 bp, Artificial sequence
  SiRNA target sequence
gtcactcttagtggctgtattgaccga

SEQ ID NO: 78920 - DNA, 27 bp, Artificial sequence
  SiRNA target sequence
tcactcttagtggctgtattgaccgaa

SEQ ID NO: 78921 - DNA, 27 bp, Artificial sequence
  SiRNA target sequence
cactcttagtggctgtattgaccgaac

SEQ ID NO: 78922 - DNA, 27 bp, Artificial sequence
  SiRNA target sequence
actcttagtggctgtattgaccgaact

SEQ ID NO: 78923 - DNA, 27 bp, Artificial sequence
  SiRNA target sequence
ctcttagtggctgtattgaccgaactt

SEQ ID NO: 78924 - DNA, 27 bp, Artificial sequence
  SiRNA target sequence
tcttagtggctgtattgaccgaactta

SEQ ID NO: 78925 - DNA, 27 bp, Artificial sequence
  SiRNA target sequence
cttagtggctgtattgaccgaacttaa

SEQ ID NO: 78926 - DNA, 27 bp, Artificial sequence
  SiRNA target sequence
ttagtggctgtattgaccgaacttaat

SEQ ID NO: 78927 - DNA, 27 bp, Artificial sequence
  SiRNA target sequence
tagtggctgtattgaccgaacttaatg

SEQ ID NO: 78928 - DNA, 27 bp, Artificial sequence
  SiRNA target sequence
agtggctgtattgaccgaacttaatgg

SEQ ID NO: 78929 - DNA, 27 bp, Artificial sequence
  SiRNA target sequence
gtggctgtattgaccgaacttaatgga

SEQ ID NO: 78930 - DNA, 27 bp, Artificial sequence
  SiRNA target sequence
tggctgtattgaccgaacttaatggat

SEQ ID NO: 78931 - DNA, 27 bp, Artificial sequence
  SiRNA target sequence
ggctgtattgaccgaacttaatggatt

SEQ ID NO: 78932 - DNA, 27 bp, Artificial sequence
  SiRNA target sequence
gctgtattgaccgaacttaatggattt

SEQ ID NO: 78933 - DNA, 27 bp, Artificial sequence
  SiRNA target sequence
ctgtattgaccgaacttaatggattta

SEQ ID NO: 78934 - DNA, 27 bp, Artificial sequence
  SiRNA target sequence
tgtattgaccgaacttaatggatttat

SEQ ID NO: 78935 - DNA, 27 bp, Artificial sequence
  SiRNA target sequence
gtattgaccgaacttaatggatttatt

SEQ ID NO: 78936 - DNA, 27 bp, Artificial sequence
  SiRNA target sequence
tattgaccgaacttaatggatttattt

SEQ ID NO: 78937 - DNA, 27 bp, Artificial sequence
  SiRNA target sequence
attgaccgaacttaatggatttatttt

SEQ ID NO: 78938 - DNA, 27 bp, Artificial sequence
  SiRNA target sequence
ttgaccgaacttaatggatttattttt

SEQ ID NO: 78939 - DNA, 27 bp, Artificial sequence
  SiRNA target sequence
tgaccgaacttaatggatttattttta

SEQ ID NO: 78940 - DNA, 27 bp, Artificial sequence
  SiRNA target sequence
gaccgaacttaatggatttatttttac

SEQ ID NO: 78941 - DNA, 27 bp, Artificial sequence
  SiRNA target sequence
accgaacttaatggatttatttttaca

SEQ ID NO: 78942 - DNA, 27 bp, Artificial sequence
  SiRNA target sequence
ccgaacttaatggatttatttttacag

SEQ ID NO: 78943 - DNA, 27 bp, Artificial sequence
  SiRNA target sequence
cgaacttaatggatttatttttacagg

SEQ ID NO: 78944 - DNA, 27 bp, Artificial sequence
  SiRNA target sequence
gaacttaatggatttatttttacaggt

SEQ ID NO: 78945 - DNA, 27 bp, Artificial sequence
  SiRNA target sequence
aacttaatggatttatttttacaggtg

SEQ ID NO: 78946 - DNA, 27 bp, Artificial sequence
  SiRNA target sequence
acttaatggatttatttttacaggtgt

SEQ ID NO: 78947 - DNA, 27 bp, Artificial sequence
  SiRNA target sequence
cttaatggatttatttttacaggtgta

SEQ ID NO: 78948 - DNA, 27 bp, Artificial sequence
  SiRNA target sequence
ttaatggatttatttttacaggtgtag

SEQ ID NO: 78949 - DNA, 27 bp, Artificial sequence
  SiRNA target sequence
taatggatttatttttacaggtgtagt

SEQ ID NO: 78950 - DNA, 27 bp, Artificial sequence
  SiRNA target sequence
aatggatttatttttacaggtgtagtg

SEQ ID NO: 78951 - DNA, 27 bp, Artificial sequence
  SiRNA target sequence
atggatttatttttacaggtgtagtgc

SEQ ID NO: 78952 - DNA, 27 bp, Artificial sequence
  SiRNA target sequence
tggatttatttttacaggtgtagtgca

SEQ ID NO: 78953 - DNA, 27 bp, Artificial sequence
  SiRNA target sequence
ggatttatttttacaggtgtagtgcaa

SEQ ID NO: 78954 - DNA, 27 bp, Artificial sequence
  SiRNA target sequence
gatttatttttacaggtgtagtgcaat

SEQ ID NO: 78955 - DNA, 27 bp, Artificial sequence
  SiRNA target sequence
atttatttttacaggtgtagtgcaata

SEQ ID NO: 78956 - DNA, 27 bp, Artificial sequence
  SiRNA target sequence
tttatttttacaggtgtagtgcaatat

SEQ ID NO: 78957 - DNA, 27 bp, Artificial sequence
  SiRNA target sequence
ttatttttacaggtgtagtgcaatata

SEQ ID NO: 78958 - DNA, 27 bp, Artificial sequence
  SiRNA target sequence
tatttttacaggtgtagtgcaatatat

SEQ ID NO: 78959 - DNA, 27 bp, Artificial sequence
  SiRNA target sequence
atttttacaggtgtagtgcaatatatt

SEQ ID NO: 78960 - DNA, 27 bp, Artificial sequence
  SiRNA target sequence
tttttacaggtgtagtgcaatatattt

SEQ ID NO: 78961 - DNA, 27 bp, Artificial sequence
  SiRNA target sequence
ttttacaggtgtagtgcaatatattta

SEQ ID NO: 78962 - DNA, 27 bp, Artificial sequence
  SiRNA target sequence
tttacaggtgtagtgcaatatatttat

SEQ ID NO: 78963 - DNA, 27 bp, Artificial sequence
  SiRNA target sequence
ttacaggtgtagtgcaatatatttata

SEQ ID NO: 78964 - DNA, 27 bp, Artificial sequence
  SiRNA target sequence
tacaggtgtagtgcaatatatttatag

SEQ ID NO: 78965 - DNA, 27 bp, Artificial sequence
  SiRNA target sequence
acaggtgtagtgcaatatatttataga

SEQ ID NO: 78966 - DNA, 27 bp, Artificial sequence
  SiRNA target sequence
caggtgtagtgcaatatatttatagaa

SEQ ID NO: 78967 - DNA, 27 bp, Artificial sequence
  SiRNA target sequence
aggtgtagtgcaatatatttatagaaa

SEQ ID NO: 78968 - DNA, 27 bp, Artificial sequence
  SiRNA target sequence
ggtgtagtgcaatatatttatagaaat

SEQ ID NO: 78969 - DNA, 27 bp, Artificial sequence
  SiRNA target sequence
gtgtagtgcaatatatttatagaaata

SEQ ID NO: 78970 - DNA, 27 bp, Artificial sequence
  SiRNA target sequence
tgtagtgcaatatatttatagaaatac

SEQ ID NO: 78971 - DNA, 27 bp, Artificial sequence
  SiRNA target sequence
gtagtgcaatatatttatagaaatacg

SEQ ID NO: 78972 - DNA, 27 bp, Artificial sequence
  SiRNA target sequence
tagtgcaatatatttatagaaatacgg

SEQ ID NO: 78973 - DNA, 27 bp, Artificial sequence
  SiRNA target sequence
agtgcaatatatttatagaaatacggc

SEQ ID NO: 78974 - DNA, 27 bp, Artificial sequence
  SiRNA target sequence
gtgcaatatatttatagaaatacggca

SEQ ID NO: 78975 - DNA, 27 bp, Artificial sequence
  SiRNA target sequence
tgcaatatatttatagaaatacggcaa

SEQ ID NO: 78976 - DNA, 27 bp, Artificial sequence
  SiRNA target sequence
gcaatatatttatagaaatacggcaaa

SEQ ID NO: 78977 - DNA, 27 bp, Artificial sequence
  SiRNA target sequence
caatatatttatagaaatacggcaaaa

SEQ ID NO: 78978 - DNA, 27 bp, Artificial sequence
  SiRNA target sequence
aatatatttatagaaatacggcaaaat

SEQ ID NO: 78979 - DNA, 27 bp, Artificial sequence
  SiRNA target sequence
atatatttatagaaatacggcaaaatc

SEQ ID NO: 78980 - DNA, 27 bp, Artificial sequence
  SiRNA target sequence
tatatttatagaaatacggcaaaatct

SEQ ID NO: 78981 - DNA, 27 bp, Artificial sequence
  SiRNA target sequence
atatttatagaaatacggcaaaatcta

SEQ ID NO: 78982 - DNA, 27 bp, Artificial sequence
  SiRNA target sequence
tatttatagaaatacggcaaaatctac

SEQ ID NO: 78983 - DNA, 27 bp, Artificial sequence
  SiRNA target sequence
atttatagaaatacggcaaaatctaca

SEQ ID NO: 78984 - DNA, 27 bp, Artificial sequence
  SiRNA target sequence
tttatagaaatacggcaaaatctacat

SEQ ID NO: 78985 - DNA, 27 bp, Artificial sequence
  SiRNA target sequence
ttatagaaatacggcaaaatctacatt

SEQ ID NO: 78986 - DNA, 27 bp, Artificial sequence
  SiRNA target sequence
tatagaaatacggcaaaatctacattc

SEQ ID NO: 78987 - DNA, 27 bp, Artificial sequence
  SiRNA target sequence
atagaaatacggcaaaatctacattca

SEQ ID NO: 78988 - DNA, 27 bp, Artificial sequence
  SiRNA target sequence
tagaaatacggcaaaatctacattcaa

SEQ ID NO: 78989 - DNA, 27 bp, Artificial sequence
  SiRNA target sequence
agaaatacggcaaaatctacattcaaa

SEQ ID NO: 78990 - DNA, 27 bp, Artificial sequence
  SiRNA target sequence
gaaatacggcaaaatctacattcaaag

SEQ ID NO: 78991 - DNA, 27 bp, Artificial sequence
  SiRNA target sequence
aaatacggcaaaatctacattcaaagg

SEQ ID NO: 78992 - DNA, 27 bp, Artificial sequence
  SiRNA target sequence
aatacggcaaaatctacattcaaaggc

SEQ ID NO: 78993 - DNA, 27 bp, Artificial sequence
  SiRNA target sequence
atacggcaaaatctacattcaaaggct

SEQ ID NO: 78994 - DNA, 27 bp, Artificial sequence
  SiRNA target sequence
tacggcaaaatctacattcaaaggctt

SEQ ID NO: 78995 - DNA, 27 bp, Artificial sequence
  SiRNA target sequence
acggcaaaatctacattcaaaggcttc

SEQ ID NO: 78996 - DNA, 27 bp, Artificial sequence
  SiRNA target sequence
cggcaaaatctacattcaaaggcttca

SEQ ID NO: 78997 - DNA, 27 bp, Artificial sequence
  SiRNA target sequence
ggcaaaatctacattcaaaggcttcat

SEQ ID NO: 78998 - DNA, 27 bp, Artificial sequence
  SiRNA target sequence
gcaaaatctacattcaaaggcttcatt

SEQ ID NO: 78999 - DNA, 27 bp, Artificial sequence
  SiRNA target sequence
caaaatctacattcaaaggcttcattt

SEQ ID NO: 79000 - DNA, 27 bp, Artificial sequence
  SiRNA target sequence
aaaatctacattcaaaggcttcatttc

SEQ ID NO: 79001 - DNA, 27 bp, Artificial sequence
  SiRNA target sequence
aaatctacattcaaaggcttcatttct

SEQ ID NO: 79002 - DNA, 27 bp, Artificial sequence
  SiRNA target sequence
aatctacattcaaaggcttcatttctc

SEQ ID NO: 79003 - DNA, 27 bp, Artificial sequence
  SiRNA target sequence
atctacattcaaaggcttcatttctct

SEQ ID NO: 79004 - DNA, 27 bp, Artificial sequence
  SiRNA target sequence
tctacattcaaaggcttcatttctctt

SEQ ID NO: 79005 - DNA, 27 bp, Artificial sequence
  SiRNA target sequence
ctacattcaaaggcttcatttctcttt

SEQ ID NO: 79006 - DNA, 27 bp, Artificial sequence
  SiRNA target sequence
tacattcaaaggcttcatttctctttc

SEQ ID NO: 79007 - DNA, 27 bp, Artificial sequence
  SiRNA target sequence
acattcaaaggcttcatttctctttca

SEQ ID NO: 79008 - DNA, 27 bp, Artificial sequence
  SiRNA target sequence
cattcaaaggcttcatttctctttcac

SEQ ID NO: 79009 - DNA, 27 bp, Artificial sequence
  SiRNA target sequence
attcaaaggcttcatttctctttcacc

SEQ ID NO: 79010 - DNA, 27 bp, Artificial sequence
  SiRNA target sequence
ttcaaaggcttcatttctctttcacct

SEQ ID NO: 79011 - DNA, 27 bp, Artificial sequence
  SiRNA target sequence
tcaaaggcttcatttctctttcaccta

SEQ ID NO: 79012 - DNA, 27 bp, Artificial sequence
  SiRNA target sequence
caaaggcttcatttctctttcacctaa

SEQ ID NO: 79013 - DNA, 27 bp, Artificial sequence
  SiRNA target sequence
aaaggcttcatttctctttcacctaaa

SEQ ID NO: 79014 - DNA, 27 bp, Artificial sequence
  SiRNA target sequence
aaggcttcatttctctttcacctaaaa

SEQ ID NO: 79015 - DNA, 27 bp, Artificial sequence
  SiRNA target sequence
aggcttcatttctctttcacctaaaaa

SEQ ID NO: 79016 - DNA, 27 bp, Artificial sequence
  SiRNA target sequence
ggcttcatttctctttcacctaaaaat

SEQ ID NO: 79017 - DNA, 27 bp, Artificial sequence
  SiRNA target sequence
gcttcatttctctttcacctaaaaatt

SEQ ID NO: 79018 - DNA, 27 bp, Artificial sequence
  SiRNA target sequence
cttcatttctctttcacctaaaaattt

SEQ ID NO: 79019 - DNA, 27 bp, Artificial sequence
  SiRNA target sequence
ttcatttctctttcacctaaaaatttt

SEQ ID NO: 79020 - DNA, 27 bp, Artificial sequence
  SiRNA target sequence
tcatttctctttcacctaaaaatttta

SEQ ID NO: 79021 - DNA, 27 bp, Artificial sequence
  SiRNA target sequence
catttctctttcacctaaaaattttag

SEQ ID NO: 79022 - DNA, 27 bp, Artificial sequence
  SiRNA target sequence
atttctctttcacctaaaaattttagt

SEQ ID NO: 79023 - DNA, 27 bp, Artificial sequence
  SiRNA target sequence
tttctctttcacctaaaaattttagta

SEQ ID NO: 79024 - DNA, 27 bp, Artificial sequence
  SiRNA target sequence
ttctctttcacctaaaaattttagtac

SEQ ID NO: 79025 - DNA, 27 bp, Artificial sequence
  SiRNA target sequence
tctctttcacctaaaaattttagtacc

SEQ ID NO: 79026 - DNA, 27 bp, Artificial sequence
  SiRNA target sequence
ctctttcacctaaaaattttagtacca

SEQ ID NO: 79027 - DNA, 27 bp, Artificial sequence
  SiRNA target sequence
tctttcacctaaaaattttagtaccat

SEQ ID NO: 79028 - DNA, 27 bp, Artificial sequence
  SiRNA target sequence
ctttcacctaaaaattttagtaccata

SEQ ID NO: 79029 - DNA, 27 bp, Artificial sequence
  SiRNA target sequence
tttcacctaaaaattttagtaccatag

SEQ ID NO: 79030 - DNA, 27 bp, Artificial sequence
  SiRNA target sequence
ttcacctaaaaattttagtaccatagg

SEQ ID NO: 79031 - DNA, 27 bp, Artificial sequence
  SiRNA target sequence
tcacctaaaaattttagtaccataggt

SEQ ID NO: 79032 - DNA, 27 bp, Artificial sequence
  SiRNA target sequence
cacctaaaaattttagtaccataggtg

SEQ ID NO: 79033 - DNA, 27 bp, Artificial sequence
  SiRNA target sequence
acctaaaaattttagtaccataggtgg

SEQ ID NO: 79034 - DNA, 27 bp, Artificial sequence
  SiRNA target sequence
cctaaaaattttagtaccataggtggc

SEQ ID NO: 79035 - DNA, 27 bp, Artificial sequence
  SiRNA target sequence
ctaaaaattttagtaccataggtggcg

SEQ ID NO: 79036 - DNA, 27 bp, Artificial sequence
  SiRNA target sequence
taaaaattttagtaccataggtggcgg

SEQ ID NO: 79037 - DNA, 27 bp, Artificial sequence
  SiRNA target sequence
aaaaattttagtaccataggtggcgga

SEQ ID NO: 79038 - DNA, 27 bp, Artificial sequence
  SiRNA target sequence
aaaattttagtaccataggtggcggag

SEQ ID NO: 79039 - DNA, 27 bp, Artificial sequence
  SiRNA target sequence
aaattttagtaccataggtggcggaga

SEQ ID NO: 79040 - DNA, 27 bp, Artificial sequence
  SiRNA target sequence
aattttagtaccataggtggcggagaa

SEQ ID NO: 79041 - DNA, 27 bp, Artificial sequence
  SiRNA target sequence
attttagtaccataggtggcggagaaa

SEQ ID NO: 79042 - DNA, 27 bp, Artificial sequence
  SiRNA target sequence
ttttagtaccataggtggcggagaaat

SEQ ID NO: 79043 - DNA, 27 bp, Artificial sequence
  SiRNA target sequence
tttagtaccataggtggcggagaaatt

SEQ ID NO: 79044 - DNA, 27 bp, Artificial sequence
  SiRNA target sequence
ttagtaccataggtggcggagaaattc

SEQ ID NO: 79045 - DNA, 27 bp, Artificial sequence
  SiRNA target sequence
tagtaccataggtggcggagaaattca

SEQ ID NO: 79046 - DNA, 27 bp, Artificial sequence
  SiRNA target sequence
agtaccataggtggcggagaaattcaa

SEQ ID NO: 79047 - DNA, 27 bp, Artificial sequence
  SiRNA target sequence
gtaccataggtggcggagaaattcaaa

SEQ ID NO: 79048 - DNA, 27 bp, Artificial sequence
  SiRNA target sequence
taccataggtggcggagaaattcaaac

SEQ ID NO: 79049 - DNA, 27 bp, Artificial sequence
  SiRNA target sequence
accataggtggcggagaaattcaaaca

SEQ ID NO: 79050 - DNA, 27 bp, Artificial sequence
  SiRNA target sequence
ccataggtggcggagaaattcaaacaa

SEQ ID NO: 79051 - DNA, 27 bp, Artificial sequence
  SiRNA target sequence
cataggtggcggagaaattcaaacaat

SEQ ID NO: 79052 - DNA, 27 bp, Artificial sequence
  SiRNA target sequence
ataggtggcggagaaattcaaacaata

SEQ ID NO: 79053 - DNA, 27 bp, Artificial sequence
  SiRNA target sequence
taggtggcggagaaattcaaacaataa

SEQ ID NO: 79054 - DNA, 27 bp, Artificial sequence
  SiRNA target sequence
aggtggcggagaaattcaaacaataat

SEQ ID NO: 79055 - DNA, 27 bp, Artificial sequence
  SiRNA target sequence
ggtggcggagaaattcaaacaataata

SEQ ID NO: 79056 - DNA, 27 bp, Artificial sequence
  SiRNA target sequence
gtggcggagaaattcaaacaataatag

SEQ ID NO: 79057 - DNA, 27 bp, Artificial sequence
  SiRNA target sequence
tggcggagaaattcaaacaataataga

SEQ ID NO: 79058 - DNA, 27 bp, Artificial sequence
  SiRNA target sequence
ggcggagaaattcaaacaataatagat

SEQ ID NO: 79059 - DNA, 27 bp, Artificial sequence
  SiRNA target sequence
gcggagaaattcaaacaataatagata

SEQ ID NO: 79060 - DNA, 27 bp, Artificial sequence
  SiRNA target sequence
cggagaaattcaaacaataatagatag

SEQ ID NO: 79061 - DNA, 27 bp, Artificial sequence
  SiRNA target sequence
ggagaaattcaaacaataatagataga

SEQ ID NO: 79062 - DNA, 27 bp, Artificial sequence
  SiRNA target sequence
gagaaattcaaacaataatagatagaa

SEQ ID NO: 79063 - DNA, 27 bp, Artificial sequence
  SiRNA target sequence
agaaattcaaacaataatagatagaaa

SEQ ID NO: 79064 - DNA, 27 bp, Artificial sequence
  SiRNA target sequence
gaaattcaaacaataatagatagaaaa

SEQ ID NO: 79065 - DNA, 27 bp, Artificial sequence
  SiRNA target sequence
aaattcaaacaataatagatagaaaat

SEQ ID NO: 79066 - DNA, 27 bp, Artificial sequence
  SiRNA target sequence
aattcaaacaataatagatagaaaatc

SEQ ID NO: 79067 - DNA, 27 bp, Artificial sequence
  SiRNA target sequence
attcaaacaataatagatagaaaatca

SEQ ID NO: 79068 - DNA, 27 bp, Artificial sequence
  SiRNA target sequence
ttcaaacaataatagatagaaaatcaa

SEQ ID NO: 79069 - DNA, 27 bp, Artificial sequence
  SiRNA target sequence
tcaaacaataatagatagaaaatcaaa

SEQ ID NO: 79070 - DNA, 27 bp, Artificial sequence
  SiRNA target sequence
caaacaataatagatagaaaatcaaaa

SEQ ID NO: 79071 - DNA, 27 bp, Artificial sequence
  SiRNA target sequence
aaacaataatagatagaaaatcaaaat

SEQ ID NO: 79072 - DNA, 27 bp, Artificial sequence
  SiRNA target sequence
aacaataatagatagaaaatcaaaatc

SEQ ID NO: 79073 - DNA, 27 bp, Artificial sequence
  SiRNA target sequence
acaataatagatagaaaatcaaaatct

SEQ ID NO: 79074 - DNA, 27 bp, Artificial sequence
  SiRNA target sequence
caataatagatagaaaatcaaaatctg

SEQ ID NO: 79075 - DNA, 27 bp, Artificial sequence
  SiRNA target sequence
aataatagatagaaaatcaaaatctgc

SEQ ID NO: 79076 - DNA, 27 bp, Artificial sequence
  SiRNA target sequence
ataatagatagaaaatcaaaatctgca

SEQ ID NO: 79077 - DNA, 27 bp, Artificial sequence
  SiRNA target sequence
taatagatagaaaatcaaaatctgcaa

SEQ ID NO: 79078 - DNA, 27 bp, Artificial sequence
  SiRNA target sequence
aatagatagaaaatcaaaatctgcaag

SEQ ID NO: 79079 - DNA, 27 bp, Artificial sequence
  SiRNA target sequence
atagatagaaaatcaaaatctgcaagt

SEQ ID NO: 79080 - DNA, 27 bp, Artificial sequence
  SiRNA target sequence
tagatagaaaatcaaaatctgcaagtg

SEQ ID NO: 79081 - DNA, 27 bp, Artificial sequence
  SiRNA target sequence
agatagaaaatcaaaatctgcaagtga

SEQ ID NO: 79082 - DNA, 27 bp, Artificial sequence
  SiRNA target sequence
gatagaaaatcaaaatctgcaagtgaa

SEQ ID NO: 79083 - DNA, 27 bp, Artificial sequence
  SiRNA target sequence
atagaaaatcaaaatctgcaagtgaac

SEQ ID NO: 79084 - DNA, 27 bp, Artificial sequence
  SiRNA target sequence
tagaaaatcaaaatctgcaagtgaact

SEQ ID NO: 79085 - DNA, 27 bp, Artificial sequence
  SiRNA target sequence
agaaaatcaaaatctgcaagtgaactt

SEQ ID NO: 79086 - DNA, 27 bp, Artificial sequence
  SiRNA target sequence
gaaaatcaaaatctgcaagtgaactta

SEQ ID NO: 79087 - DNA, 27 bp, Artificial sequence
  SiRNA target sequence
aaaatcaaaatctgcaagtgaacttat

SEQ ID NO: 79088 - DNA, 27 bp, Artificial sequence
  SiRNA target sequence
aaatcaaaatctgcaagtgaacttatt

SEQ ID NO: 79089 - DNA, 27 bp, Artificial sequence
  SiRNA target sequence
aatcaaaatctgcaagtgaacttattg

SEQ ID NO: 79090 - DNA, 27 bp, Artificial sequence
  SiRNA target sequence
atcaaaatctgcaagtgaacttattga

SEQ ID NO: 79091 - DNA, 27 bp, Artificial sequence
  SiRNA target sequence
tcaaaatctgcaagtgaacttattgaa

SEQ ID NO: 79092 - DNA, 27 bp, Artificial sequence
  SiRNA target sequence
caaaatctgcaagtgaacttattgaag

SEQ ID NO: 79093 - DNA, 27 bp, Artificial sequence
  SiRNA target sequence
aaaatctgcaagtgaacttattgaagt

SEQ ID NO: 79094 - DNA, 27 bp, Artificial sequence
  SiRNA target sequence
aaatctgcaagtgaacttattgaagtg

SEQ ID NO: 79095 - DNA, 27 bp, Artificial sequence
  SiRNA target sequence
aatctgcaagtgaacttattgaagtgt

SEQ ID NO: 79096 - DNA, 27 bp, Artificial sequence
  SiRNA target sequence
atctgcaagtgaacttattgaagtgtt

SEQ ID NO: 79097 - DNA, 27 bp, Artificial sequence
  SiRNA target sequence
tctgcaagtgaacttattgaagtgttt

SEQ ID NO: 79098 - DNA, 27 bp, Artificial sequence
  SiRNA target sequence
ctgcaagtgaacttattgaagtgtttc

SEQ ID NO: 79099 - DNA, 27 bp, Artificial sequence
  SiRNA target sequence
tgcaagtgaacttattgaagtgtttct

SEQ ID NO: 79100 - DNA, 27 bp, Artificial sequence
  SiRNA target sequence
gcaagtgaacttattgaagtgtttctt

SEQ ID NO: 79101 - DNA, 27 bp, Artificial sequence
  SiRNA target sequence
caagtgaacttattgaagtgtttctta

SEQ ID NO: 79102 - DNA, 27 bp, Artificial sequence
  SiRNA target sequence
aagtgaacttattgaagtgtttcttac

SEQ ID NO: 79103 - DNA, 27 bp, Artificial sequence
  SiRNA target sequence
agtgaacttattgaagtgtttcttaca

SEQ ID NO: 79104 - DNA, 27 bp, Artificial sequence
  SiRNA target sequence
gtgaacttattgaagtgtttcttacaa

SEQ ID NO: 79105 - DNA, 27 bp, Artificial sequence
  SiRNA target sequence
tgaacttattgaagtgtttcttacaag

SEQ ID NO: 79106 - DNA, 27 bp, Artificial sequence
  SiRNA target sequence
gaacttattgaagtgtttcttacaagc

SEQ ID NO: 79107 - DNA, 27 bp, Artificial sequence
  SiRNA target sequence
aacttattgaagtgtttcttacaagct

SEQ ID NO: 79108 - DNA, 27 bp, Artificial sequence
  SiRNA target sequence
acttattgaagtgtttcttacaagctt

SEQ ID NO: 79109 - DNA, 27 bp, Artificial sequence
  SiRNA target sequence
cttattgaagtgtttcttacaagcttg

SEQ ID NO: 79110 - DNA, 27 bp, Artificial sequence
  SiRNA target sequence
ttattgaagtgtttcttacaagcttgc

SEQ ID NO: 79111 - DNA, 27 bp, Artificial sequence
  SiRNA target sequence
tattgaagtgtttcttacaagcttgct

SEQ ID NO: 79112 - DNA, 27 bp, Artificial sequence
  SiRNA target sequence
attgaagtgtttcttacaagcttgctt

SEQ ID NO: 79113 - DNA, 27 bp, Artificial sequence
  SiRNA target sequence
ttgaagtgtttcttacaagcttgcttc

SEQ ID NO: 79114 - DNA, 27 bp, Artificial sequence
  SiRNA target sequence
tgaagtgtttcttacaagcttgcttcc

SEQ ID NO: 79115 - DNA, 27 bp, Artificial sequence
  SiRNA target sequence
gaagtgtttcttacaagcttgcttcca

SEQ ID NO: 79116 - DNA, 27 bp, Artificial sequence
  SiRNA target sequence
aagtgtttcttacaagcttgcttccaa

SEQ ID NO: 79117 - DNA, 27 bp, Artificial sequence
  SiRNA target sequence
agtgtttcttacaagcttgcttccaat

SEQ ID NO: 79118 - DNA, 27 bp, Artificial sequence
  SiRNA target sequence
gtgtttcttacaagcttgcttccaata

SEQ ID NO: 79119 - DNA, 27 bp, Artificial sequence
  SiRNA target sequence
tgtttcttacaagcttgcttccaatat

SEQ ID NO: 79120 - DNA, 27 bp, Artificial sequence
  SiRNA target sequence
gtttcttacaagcttgcttccaatatg

SEQ ID NO: 79121 - DNA, 27 bp, Artificial sequence
  SiRNA target sequence
tttcttacaagcttgcttccaatatgc

SEQ ID NO: 79122 - DNA, 27 bp, Artificial sequence
  SiRNA target sequence
ttcttacaagcttgcttccaatatgcc

SEQ ID NO: 79123 - DNA, 27 bp, Artificial sequence
  SiRNA target sequence
tcttacaagcttgcttccaatatgcct

SEQ ID NO: 79124 - DNA, 27 bp, Artificial sequence
  SiRNA target sequence
cttacaagcttgcttccaatatgcctt

SEQ ID NO: 79125 - DNA, 27 bp, Artificial sequence
  SiRNA target sequence
ttacaagcttgcttccaatatgcctta

SEQ ID NO: 79126 - DNA, 27 bp, Artificial sequence
  SiRNA target sequence
tacaagcttgcttccaatatgccttaa

SEQ ID NO: 79127 - DNA, 27 bp, Artificial sequence
  SiRNA target sequence
acaagcttgcttccaatatgccttaaa

SEQ ID NO: 79128 - DNA, 27 bp, Artificial sequence
  SiRNA target sequence
caagcttgcttccaatatgccttaaac

SEQ ID NO: 79129 - DNA, 27 bp, Artificial sequence
  SiRNA target sequence
aagcttgcttccaatatgccttaaact

SEQ ID NO: 79130 - DNA, 27 bp, Artificial sequence
  SiRNA target sequence
agcttgcttccaatatgccttaaactt

SEQ ID NO: 79131 - DNA, 27 bp, Artificial sequence
  SiRNA target sequence
gcttgcttccaatatgccttaaacttt

SEQ ID NO: 79132 - DNA, 27 bp, Artificial sequence
  SiRNA target sequence
cttgcttccaatatgccttaaactttt

SEQ ID NO: 79133 - DNA, 27 bp, Artificial sequence
  SiRNA target sequence
ttgcttccaatatgccttaaactttta

SEQ ID NO: 79134 - DNA, 27 bp, Artificial sequence
  SiRNA target sequence
tgcttccaatatgccttaaacttttat

SEQ ID NO: 79135 - DNA, 27 bp, Artificial sequence
  SiRNA target sequence
gcttccaatatgccttaaacttttatt

SEQ ID NO: 79136 - DNA, 27 bp, Artificial sequence
  SiRNA target sequence
cttccaatatgccttaaacttttattt

SEQ ID NO: 79137 - DNA, 27 bp, Artificial sequence
  SiRNA target sequence
ttccaatatgccttaaacttttatttg

SEQ ID NO: 79138 - DNA, 27 bp, Artificial sequence
  SiRNA target sequence
tccaatatgccttaaacttttatttgc

SEQ ID NO: 79139 - DNA, 27 bp, Artificial sequence
  SiRNA target sequence
ccaatatgccttaaacttttatttgcc

SEQ ID NO: 79140 - DNA, 27 bp, Artificial sequence
  SiRNA target sequence
caatatgccttaaacttttatttgccc

SEQ ID NO: 79141 - DNA, 27 bp, Artificial sequence
  SiRNA target sequence
aatatgccttaaacttttatttgccct

SEQ ID NO: 79142 - DNA, 27 bp, Artificial sequence
  SiRNA target sequence
atatgccttaaacttttatttgccctt

SEQ ID NO: 79143 - DNA, 27 bp, Artificial sequence
  SiRNA target sequence
tatgccttaaacttttatttgccctta

SEQ ID NO: 79144 - DNA, 27 bp, Artificial sequence
  SiRNA target sequence
atgccttaaacttttatttgcccttat

SEQ ID NO: 79145 - DNA, 27 bp, Artificial sequence
  SiRNA target sequence
tgccttaaacttttatttgcccttatt

SEQ ID NO: 79146 - DNA, 27 bp, Artificial sequence
  SiRNA target sequence
gccttaaacttttatttgcccttattg

SEQ ID NO: 79147 - DNA, 27 bp, Artificial sequence
  SiRNA target sequence
ccttaaacttttatttgcccttattgc

SEQ ID NO: 79148 - DNA, 27 bp, Artificial sequence
  SiRNA target sequence
cttaaacttttatttgcccttattgca

SEQ ID NO: 79149 - DNA, 27 bp, Artificial sequence
  SiRNA target sequence
ttaaacttttatttgcccttattgcag

SEQ ID NO: 79150 - DNA, 27 bp, Artificial sequence
  SiRNA target sequence
taaacttttatttgcccttattgcagt

SEQ ID NO: 79151 - DNA, 27 bp, Artificial sequence
  SiRNA target sequence
aaacttttatttgcccttattgcagtt

SEQ ID NO: 79152 - DNA, 27 bp, Artificial sequence
  SiRNA target sequence
aacttttatttgcccttattgcagtta

SEQ ID NO: 79153 - DNA, 27 bp, Artificial sequence
  SiRNA target sequence
acttttatttgcccttattgcagttat

SEQ ID NO: 79154 - DNA, 27 bp, Artificial sequence
  SiRNA target sequence
cttttatttgcccttattgcagttata

SEQ ID NO: 79155 - DNA, 27 bp, Artificial sequence
  SiRNA target sequence
ttttatttgcccttattgcagttataa

SEQ ID NO: 79156 - DNA, 27 bp, Artificial sequence
  SiRNA target sequence
tttatttgcccttattgcagttataaa

SEQ ID NO: 79157 - DNA, 27 bp, Artificial sequence
  SiRNA target sequence
ttatttgcccttattgcagttataaaa

SEQ ID NO: 79158 - DNA, 27 bp, Artificial sequence
  SiRNA target sequence
tatttgcccttattgcagttataaaaa

SEQ ID NO: 79159 - DNA, 27 bp, Artificial sequence
  SiRNA target sequence
atttgcccttattgcagttataaaaaa

SEQ ID NO: 79160 - DNA, 27 bp, Artificial sequence
  SiRNA target sequence
tttgcccttattgcagttataaaaaat

SEQ ID NO: 79161 - DNA, 27 bp, Artificial sequence
  SiRNA target sequence
ttgcccttattgcagttataaaaaata

SEQ ID NO: 79162 - DNA, 27 bp, Artificial sequence
  SiRNA target sequence
tgcccttattgcagttataaaaaatat

SEQ ID NO: 79163 - DNA, 27 bp, Artificial sequence
  SiRNA target sequence
gcccttattgcagttataaaaaatatg

SEQ ID NO: 79164 - DNA, 27 bp, Artificial sequence
  SiRNA target sequence
cccttattgcagttataaaaaatatgg

SEQ ID NO: 79165 - DNA, 27 bp, Artificial sequence
  SiRNA target sequence
ccttattgcagttataaaaaatatggg

SEQ ID NO: 79166 - DNA, 27 bp, Artificial sequence
  SiRNA target sequence
cttattgcagttataaaaaatatggga

SEQ ID NO: 79167 - DNA, 27 bp, Artificial sequence
  SiRNA target sequence
ttattgcagttataaaaaatatgggag

SEQ ID NO: 79168 - DNA, 27 bp, Artificial sequence
  SiRNA target sequence
tattgcagttataaaaaatatgggagg

SEQ ID NO: 79169 - DNA, 27 bp, Artificial sequence
  SiRNA target sequence
attgcagttataaaaaatatgggaggt

SEQ ID NO: 79170 - DNA, 27 bp, Artificial sequence
  SiRNA target sequence
ttgcagttataaaaaatatgggaggtc

SEQ ID NO: 79171 - DNA, 27 bp, Artificial sequence
  SiRNA target sequence
tgcagttataaaaaatatgggaggtct

SEQ ID NO: 79172 - DNA, 27 bp, Artificial sequence
  SiRNA target sequence
gcagttataaaaaatatgggaggtctt

SEQ ID NO: 79173 - DNA, 27 bp, Artificial sequence
  SiRNA target sequence
cagttataaaaaatatgggaggtcttg

SEQ ID NO: 79174 - DNA, 27 bp, Artificial sequence
  SiRNA target sequence
agttataaaaaatatgggaggtcttgc

SEQ ID NO: 79175 - DNA, 27 bp, Artificial sequence
  SiRNA target sequence
gttataaaaaatatgggaggtcttgcg

SEQ ID NO: 79176 - DNA, 27 bp, Artificial sequence
  SiRNA target sequence
ttataaaaaatatgggaggtcttgcgg

SEQ ID NO: 79177 - DNA, 27 bp, Artificial sequence
  SiRNA target sequence
tataaaaaatatgggaggtcttgcggg

SEQ ID NO: 79178 - DNA, 27 bp, Artificial sequence
  SiRNA target sequence
ataaaaaatatgggaggtcttgcgggc

SEQ ID NO: 79179 - DNA, 27 bp, Artificial sequence
  SiRNA target sequence
taaaaaatatgggaggtcttgcgggct

SEQ ID NO: 79180 - DNA, 27 bp, Artificial sequence
  SiRNA target sequence
aaaaaatatgggaggtcttgcgggctt

SEQ ID NO: 79181 - DNA, 27 bp, Artificial sequence
  SiRNA target sequence
aaaaatatgggaggtcttgcgggcttc

SEQ ID NO: 79182 - DNA, 27 bp, Artificial sequence
  SiRNA target sequence
aaaatatgggaggtcttgcgggcttca

SEQ ID NO: 79183 - DNA, 27 bp, Artificial sequence
  SiRNA target sequence
aaatatgggaggtcttgcgggcttcat

SEQ ID NO: 79184 - DNA, 27 bp, Artificial sequence
  SiRNA target sequence
aatatgggaggtcttgcgggcttcata

SEQ ID NO: 79185 - DNA, 27 bp, Artificial sequence
  SiRNA target sequence
atatgggaggtcttgcgggcttcataa

SEQ ID NO: 79186 - DNA, 27 bp, Artificial sequence
  SiRNA target sequence
tatgggaggtcttgcgggcttcataat

SEQ ID NO: 79187 - DNA, 27 bp, Artificial sequence
  SiRNA target sequence
atgggaggtcttgcgggcttcataatg

SEQ ID NO: 79188 - DNA, 27 bp, Artificial sequence
  SiRNA target sequence
tgggaggtcttgcgggcttcataatgt

SEQ ID NO: 79189 - DNA, 27 bp, Artificial sequence
  SiRNA target sequence
gggaggtcttgcgggcttcataatgtt

SEQ ID NO: 79190 - DNA, 27 bp, Artificial sequence
  SiRNA target sequence
ggaggtcttgcgggcttcataatgttt

SEQ ID NO: 79191 - DNA, 27 bp, Artificial sequence
  SiRNA target sequence
gaggtcttgcgggcttcataatgtttg

SEQ ID NO: 79192 - DNA, 27 bp, Artificial sequence
  SiRNA target sequence
aggtcttgcgggcttcataatgtttgt

SEQ ID NO: 79193 - DNA, 27 bp, Artificial sequence
  SiRNA target sequence
ggtcttgcgggcttcataatgtttgtt

SEQ ID NO: 79194 - DNA, 27 bp, Artificial sequence
  SiRNA target sequence
gtcttgcgggcttcataatgtttgttt

SEQ ID NO: 79195 - DNA, 27 bp, Artificial sequence
  SiRNA target sequence
tcttgcgggcttcataatgtttgtttg

SEQ ID NO: 79196 - DNA, 27 bp, Artificial sequence
  SiRNA target sequence
cttgcgggcttcataatgtttgtttgt

SEQ ID NO: 79197 - DNA, 27 bp, Artificial sequence
  SiRNA target sequence
ttgcgggcttcataatgtttgtttgtg

SEQ ID NO: 79198 - DNA, 27 bp, Artificial sequence
  SiRNA target sequence
tgcgggcttcataatgtttgtttgtgt

SEQ ID NO: 79199 - DNA, 27 bp, Artificial sequence
  SiRNA target sequence
gcgggcttcataatgtttgtttgtgtt

SEQ ID NO: 79200 - DNA, 27 bp, Artificial sequence
  SiRNA target sequence
cgggcttcataatgtttgtttgtgttt

SEQ ID NO: 79201 - DNA, 27 bp, Artificial sequence
  SiRNA target sequence
gggcttcataatgtttgtttgtgtttc

SEQ ID NO: 79202 - DNA, 27 bp, Artificial sequence
  SiRNA target sequence
ggcttcataatgtttgtttgtgtttct

SEQ ID NO: 79203 - DNA, 27 bp, Artificial sequence
  SiRNA target sequence
gcttcataatgtttgtttgtgtttctt

SEQ ID NO: 79204 - DNA, 27 bp, Artificial sequence
  SiRNA target sequence
cttcataatgtttgtttgtgtttcttg

SEQ ID NO: 79205 - DNA, 27 bp, Artificial sequence
  SiRNA target sequence
ttcataatgtttgtttgtgtttcttgc

SEQ ID NO: 79206 - DNA, 27 bp, Artificial sequence
  SiRNA target sequence
tcataatgtttgtttgtgtttcttgct

SEQ ID NO: 79207 - DNA, 27 bp, Artificial sequence
  SiRNA target sequence
cataatgtttgtttgtgtttcttgcta

SEQ ID NO: 79208 - DNA, 27 bp, Artificial sequence
  SiRNA target sequence
ataatgtttgtttgtgtttcttgctat

SEQ ID NO: 79209 - DNA, 27 bp, Artificial sequence
  SiRNA target sequence
taatgtttgtttgtgtttcttgctatg

SEQ ID NO: 79210 - DNA, 27 bp, Artificial sequence
  SiRNA target sequence
aatgtttgtttgtgtttcttgctatgc

SEQ ID NO: 79211 - DNA, 27 bp, Artificial sequence
  SiRNA target sequence
atgtttgtttgtgtttcttgctatgcg

SEQ ID NO: 79212 - DNA, 27 bp, Artificial sequence
  SiRNA target sequence
tgtttgtttgtgtttcttgctatgcga

SEQ ID NO: 79213 - DNA, 27 bp, Artificial sequence
  SiRNA target sequence
gtttgtttgtgtttcttgctatgcgac

SEQ ID NO: 79214 - DNA, 27 bp, Artificial sequence
  SiRNA target sequence
tttgtttgtgtttcttgctatgcgact

SEQ ID NO: 79215 - DNA, 27 bp, Artificial sequence
  SiRNA target sequence
ttgtttgtgtttcttgctatgcgactg

SEQ ID NO: 79216 - DNA, 27 bp, Artificial sequence
  SiRNA target sequence
tgtttgtgtttcttgctatgcgactgt

SEQ ID NO: 79217 - DNA, 27 bp, Artificial sequence
  SiRNA target sequence
gtttgtgtttcttgctatgcgactgtg

SEQ ID NO: 79218 - DNA, 27 bp, Artificial sequence
  SiRNA target sequence
tttgtgtttcttgctatgcgactgtga

SEQ ID NO: 79219 - DNA, 27 bp, Artificial sequence
  SiRNA target sequence
ttgtgtttcttgctatgcgactgtgac

SEQ ID NO: 79220 - DNA, 27 bp, Artificial sequence
  SiRNA target sequence
tgtgtttcttgctatgcgactgtgact

SEQ ID NO: 79221 - DNA, 27 bp, Artificial sequence
  SiRNA target sequence
gtgtttcttgctatgcgactgtgacta

SEQ ID NO: 79222 - DNA, 27 bp, Artificial sequence
  SiRNA target sequence
tgtttcttgctatgcgactgtgactat

SEQ ID NO: 79223 - DNA, 27 bp, Artificial sequence
  SiRNA target sequence
gtttcttgctatgcgactgtgactata

SEQ ID NO: 79224 - DNA, 27 bp, Artificial sequence
  SiRNA target sequence
tttcttgctatgcgactgtgactatat

SEQ ID NO: 79225 - DNA, 27 bp, Artificial sequence
  SiRNA target sequence
ttcttgctatgcgactgtgactatatt

SEQ ID NO: 79226 - DNA, 27 bp, Artificial sequence
  SiRNA target sequence
tcttgctatgcgactgtgactatattg

SEQ ID NO: 79227 - DNA, 27 bp, Artificial sequence
  SiRNA target sequence
cttgctatgcgactgtgactatattga

SEQ ID NO: 79228 - DNA, 27 bp, Artificial sequence
  SiRNA target sequence
ttgctatgcgactgtgactatattgat

SEQ ID NO: 79229 - DNA, 27 bp, Artificial sequence
  SiRNA target sequence
tgctatgcgactgtgactatattgata

SEQ ID NO: 79230 - DNA, 27 bp, Artificial sequence
  SiRNA target sequence
gctatgcgactgtgactatattgatag

SEQ ID NO: 79231 - DNA, 27 bp, Artificial sequence
  SiRNA target sequence
ctatgcgactgtgactatattgatagc

SEQ ID NO: 79232 - DNA, 27 bp, Artificial sequence
  SiRNA target sequence
tatgcgactgtgactatattgatagca

SEQ ID NO: 79233 - DNA, 27 bp, Artificial sequence
  SiRNA target sequence
atgcgactgtgactatattgatagcac

SEQ ID NO: 79234 - DNA, 27 bp, Artificial sequence
  SiRNA target sequence
tgcgactgtgactatattgatagcaca

SEQ ID NO: 79235 - DNA, 27 bp, Artificial sequence
  SiRNA target sequence
gcgactgtgactatattgatagcacaa

SEQ ID NO: 79236 - DNA, 27 bp, Artificial sequence
  SiRNA target sequence
cgactgtgactatattgatagcacaat

SEQ ID NO: 79237 - DNA, 27 bp, Artificial sequence
  SiRNA target sequence
gactgtgactatattgatagcacaatg

SEQ ID NO: 79238 - DNA, 27 bp, Artificial sequence
  SiRNA target sequence
actgtgactatattgatagcacaatgg

SEQ ID NO: 79239 - DNA, 27 bp, Artificial sequence
  SiRNA target sequence
ctgtgactatattgatagcacaatgga

SEQ ID NO: 79240 - DNA, 27 bp, Artificial sequence
  SiRNA target sequence
tgtgactatattgatagcacaatggag

SEQ ID NO: 79241 - DNA, 27 bp, Artificial sequence
  SiRNA target sequence
gtgactatattgatagcacaatggaga

SEQ ID NO: 79242 - DNA, 27 bp, Artificial sequence
  SiRNA target sequence
tgactatattgatagcacaatggagat

SEQ ID NO: 79243 - DNA, 27 bp, Artificial sequence
  SiRNA target sequence
gactatattgatagcacaatggagatc

SEQ ID NO: 79244 - DNA, 27 bp, Artificial sequence
  SiRNA target sequence
actatattgatagcacaatggagatct

SEQ ID NO: 79245 - DNA, 27 bp, Artificial sequence
  SiRNA target sequence
ctatattgatagcacaatggagatcta

SEQ ID NO: 79246 - DNA, 27 bp, Artificial sequence
  SiRNA target sequence
tatattgatagcacaatggagatctaa

SEQ ID NO: 79247 - DNA, 27 bp, Artificial sequence
  SiRNA target sequence
atattgatagcacaatggagatctaat

SEQ ID NO: 79248 - DNA, 27 bp, Artificial sequence
  SiRNA target sequence
tattgatagcacaatggagatctaata

SEQ ID NO: 79249 - DNA, 27 bp, Artificial sequence
  SiRNA target sequence
attgatagcacaatggagatctaatat

SEQ ID NO: 79250 - DNA, 27 bp, Artificial sequence
  SiRNA target sequence
ttgatagcacaatggagatctaatatt

SEQ ID NO: 79251 - DNA, 27 bp, Artificial sequence
  SiRNA target sequence
tgatagcacaatggagatctaatatta

SEQ ID NO: 79252 - DNA, 27 bp, Artificial sequence
  SiRNA target sequence
gatagcacaatggagatctaatattag

SEQ ID NO: 79253 - DNA, 27 bp, Artificial sequence
  SiRNA target sequence
atagcacaatggagatctaatattaga

SEQ ID NO: 79254 - DNA, 27 bp, Artificial sequence
  SiRNA target sequence
tagcacaatggagatctaatattagaa

SEQ ID NO: 79255 - DNA, 27 bp, Artificial sequence
  SiRNA target sequence
agcacaatggagatctaatattagaag

SEQ ID NO: 79256 - DNA, 27 bp, Artificial sequence
  SiRNA target sequence
gcacaatggagatctaatattagaaga

SEQ ID NO: 79257 - DNA, 27 bp, Artificial sequence
  SiRNA target sequence
cacaatggagatctaatattagaagag

SEQ ID NO: 79258 - DNA, 27 bp, Artificial sequence
  SiRNA target sequence
acaatggagatctaatattagaagaga

SEQ ID NO: 79259 - DNA, 27 bp, Artificial sequence
  SiRNA target sequence
caatggagatctaatattagaagagaa

SEQ ID NO: 79260 - DNA, 27 bp, Artificial sequence
  SiRNA target sequence
aatggagatctaatattagaagagaac

SEQ ID NO: 79261 - DNA, 27 bp, Artificial sequence
  SiRNA target sequence
atggagatctaatattagaagagaact

SEQ ID NO: 79262 - DNA, 27 bp, Artificial sequence
  SiRNA target sequence
tggagatctaatattagaagagaactt

SEQ ID NO: 79263 - DNA, 27 bp, Artificial sequence
  SiRNA target sequence
ggagatctaatattagaagagaactta

SEQ ID NO: 79264 - DNA, 27 bp, Artificial sequence
  SiRNA target sequence
gagatctaatattagaagagaacttaa

SEQ ID NO: 79265 - DNA, 27 bp, Artificial sequence
  SiRNA target sequence
agatctaatattagaagagaacttaat

SEQ ID NO: 79266 - DNA, 27 bp, Artificial sequence
  SiRNA target sequence
gatctaatattagaagagaacttaata

SEQ ID NO: 79267 - DNA, 27 bp, Artificial sequence
  SiRNA target sequence
atctaatattagaagagaacttaataa

SEQ ID NO: 79268 - DNA, 27 bp, Artificial sequence
  SiRNA target sequence
tctaatattagaagagaacttaataac

SEQ ID NO: 79269 - DNA, 27 bp, Artificial sequence
  SiRNA target sequence
ctaatattagaagagaacttaataact

SEQ ID NO: 79270 - DNA, 27 bp, Artificial sequence
  SiRNA target sequence
taatattagaagagaacttaataactc

SEQ ID NO: 79271 - DNA, 27 bp, Artificial sequence
  SiRNA target sequence
aatattagaagagaacttaataactct

SEQ ID NO: 79272 - DNA, 27 bp, Artificial sequence
  SiRNA target sequence
atattagaagagaacttaataactctg

SEQ ID NO: 79273 - DNA, 27 bp, Artificial sequence
  SiRNA target sequence
tattagaagagaacttaataactctga

SEQ ID NO: 79274 - DNA, 27 bp, Artificial sequence
  SiRNA target sequence
attagaagagaacttaataactctgaa

SEQ ID NO: 79275 - DNA, 27 bp, Artificial sequence
  SiRNA target sequence
ttagaagagaacttaataactctgaaa

SEQ ID NO: 79276 - DNA, 27 bp, Artificial sequence
  SiRNA target sequence
tagaagagaacttaataactctgaaaa

SEQ ID NO: 79277 - DNA, 27 bp, Artificial sequence
  SiRNA target sequence
agaagagaacttaataactctgaaaat

SEQ ID NO: 79278 - DNA, 27 bp, Artificial sequence
  SiRNA target sequence
gaagagaacttaataactctgaaaata

SEQ ID NO: 79279 - DNA, 27 bp, Artificial sequence
  SiRNA target sequence
aagagaacttaataactctgaaaatag

SEQ ID NO: 79280 - DNA, 27 bp, Artificial sequence
  SiRNA target sequence
agagaacttaataactctgaaaataga

SEQ ID NO: 79281 - DNA, 27 bp, Artificial sequence
  SiRNA target sequence
gagaacttaataactctgaaaatagat

SEQ ID NO: 79282 - DNA, 27 bp, Artificial sequence
  SiRNA target sequence
agaacttaataactctgaaaatagatc

SEQ ID NO: 79283 - DNA, 27 bp, Artificial sequence
  SiRNA target sequence
gaacttaataactctgaaaatagatct

SEQ ID NO: 79284 - DNA, 27 bp, Artificial sequence
  SiRNA target sequence
aacttaataactctgaaaatagatcta

SEQ ID NO: 79285 - DNA, 27 bp, Artificial sequence
  SiRNA target sequence
acttaataactctgaaaatagatctag

SEQ ID NO: 79286 - DNA, 27 bp, Artificial sequence
  SiRNA target sequence
cttaataactctgaaaatagatctagt

SEQ ID NO: 79287 - DNA, 27 bp, Artificial sequence
  SiRNA target sequence
ttaataactctgaaaatagatctagta

SEQ ID NO: 79288 - DNA, 27 bp, Artificial sequence
  SiRNA target sequence
taataactctgaaaatagatctagtaa

SEQ ID NO: 79289 - DNA, 27 bp, Artificial sequence
  SiRNA target sequence
aataactctgaaaatagatctagtaat

SEQ ID NO: 79290 - DNA, 27 bp, Artificial sequence
  SiRNA target sequence
ataactctgaaaatagatctagtaata

SEQ ID NO: 79291 - DNA, 27 bp, Artificial sequence
  SiRNA target sequence
taactctgaaaatagatctagtaataa

SEQ ID NO: 79292 - DNA, 27 bp, Artificial sequence
  SiRNA target sequence
aactctgaaaatagatctagtaataaa

SEQ ID NO: 79293 - DNA, 27 bp, Artificial sequence
  SiRNA target sequence
actctgaaaatagatctagtaataaac

SEQ ID NO: 79294 - DNA, 27 bp, Artificial sequence
  SiRNA target sequence
ctctgaaaatagatctagtaataaact

SEQ ID NO: 79295 - DNA, 27 bp, Artificial sequence
  SiRNA target sequence
tctgaaaatagatctagtaataaacta

SEQ ID NO: 79296 - DNA, 27 bp, Artificial sequence
  SiRNA target sequence
ctgaaaatagatctagtaataaactac

SEQ ID NO: 79297 - DNA, 27 bp, Artificial sequence
  SiRNA target sequence
tgaaaatagatctagtaataaactaca

SEQ ID NO: 79298 - DNA, 27 bp, Artificial sequence
  SiRNA target sequence
gaaaatagatctagtaataaactacaa

SEQ ID NO: 79299 - DNA, 27 bp, Artificial sequence
  SiRNA target sequence
aaaatagatctagtaataaactacaag

SEQ ID NO: 79300 - DNA, 27 bp, Artificial sequence
  SiRNA target sequence
aaatagatctagtaataaactacaaga

SEQ ID NO: 79301 - DNA, 27 bp, Artificial sequence
  SiRNA target sequence
aatagatctagtaataaactacaagat

SEQ ID NO: 79302 - DNA, 27 bp, Artificial sequence
  SiRNA target sequence
atagatctagtaataaactacaagatg

SEQ ID NO: 79303 - DNA, 27 bp, Artificial sequence
  SiRNA target sequence
tagatctagtaataaactacaagatgg

SEQ ID NO: 79304 - DNA, 27 bp, Artificial sequence
  SiRNA target sequence
agatctagtaataaactacaagatgga

SEQ ID NO: 79305 - DNA, 27 bp, Artificial sequence
  SiRNA target sequence
gatctagtaataaactacaagatggat

SEQ ID NO: 79306 - DNA, 27 bp, Artificial sequence
  SiRNA target sequence
atctagtaataaactacaagatggatt

SEQ ID NO: 79307 - DNA, 27 bp, Artificial sequence
  SiRNA target sequence
tctagtaataaactacaagatggatta

SEQ ID NO: 79308 - DNA, 27 bp, Artificial sequence
  SiRNA target sequence
ctagtaataaactacaagatggattaa

SEQ ID NO: 79309 - DNA, 27 bp, Artificial sequence
  SiRNA target sequence
tagtaataaactacaagatggattaaa

SEQ ID NO: 79310 - DNA, 27 bp, Artificial sequence
  SiRNA target sequence
agtaataaactacaagatggattaaat

SEQ ID NO: 79311 - DNA, 27 bp, Artificial sequence
  SiRNA target sequence
gtaataaactacaagatggattaaata

SEQ ID NO: 79312 - DNA, 27 bp, Artificial sequence
  SiRNA target sequence
taataaactacaagatggattaaataa

SEQ ID NO: 79313 - DNA, 27 bp, Artificial sequence
  SiRNA target sequence
aataaactacaagatggattaaataat

SEQ ID NO: 79314 - DNA, 27 bp, Artificial sequence
  SiRNA target sequence
ataaactacaagatggattaaataatc

SEQ ID NO: 79315 - DNA, 27 bp, Artificial sequence
  SiRNA target sequence
taaactacaagatggattaaataatca

SEQ ID NO: 79316 - DNA, 27 bp, Artificial sequence
  SiRNA target sequence
aaactacaagatggattaaataatcat

SEQ ID NO: 79317 - DNA, 27 bp, Artificial sequence
  SiRNA target sequence
aactacaagatggattaaataatcatg

SEQ ID NO: 79318 - DNA, 27 bp, Artificial sequence
  SiRNA target sequence
actacaagatggattaaataatcatga

SEQ ID NO: 79319 - DNA, 27 bp, Artificial sequence
  SiRNA target sequence
ctacaagatggattaaataatcatgaa

SEQ ID NO: 79320 - DNA, 27 bp, Artificial sequence
  SiRNA target sequence
tacaagatggattaaataatcatgaaa

SEQ ID NO: 79321 - DNA, 27 bp, Artificial sequence
  SiRNA target sequence
acaagatggattaaataatcatgaaac

SEQ ID NO: 79322 - DNA, 27 bp, Artificial sequence
  SiRNA target sequence
caagatggattaaataatcatgaaaca

SEQ ID NO: 79323 - DNA, 27 bp, Artificial sequence
  SiRNA target sequence
aagatggattaaataatcatgaaacaa

SEQ ID NO: 79324 - DNA, 27 bp, Artificial sequence
  SiRNA target sequence
agatggattaaataatcatgaaacaat

SEQ ID NO: 79325 - DNA, 27 bp, Artificial sequence
  SiRNA target sequence
gatggattaaataatcatgaaacaatc

SEQ ID NO: 79326 - DNA, 27 bp, Artificial sequence
  SiRNA target sequence
atggattaaataatcatgaaacaatcg

SEQ ID NO: 79327 - DNA, 27 bp, Artificial sequence
  SiRNA target sequence
tggattaaataatcatgaaacaatcgt

SEQ ID NO: 79328 - DNA, 27 bp, Artificial sequence
  SiRNA target sequence
ggattaaataatcatgaaacaatcgtc

SEQ ID NO: 79329 - DNA, 27 bp, Artificial sequence
  SiRNA target sequence
gattaaataatcatgaaacaatcgtct

SEQ ID NO: 79330 - DNA, 27 bp, Artificial sequence
  SiRNA target sequence
attaaataatcatgaaacaatcgtctc

SEQ ID NO: 79331 - DNA, 27 bp, Artificial sequence
  SiRNA target sequence
ttaaataatcatgaaacaatcgtctcc

SEQ ID NO: 79332 - DNA, 27 bp, Artificial sequence
  SiRNA target sequence
taaataatcatgaaacaatcgtctcct

SEQ ID NO: 79333 - DNA, 27 bp, Artificial sequence
  SiRNA target sequence
aaataatcatgaaacaatcgtctcctt

SEQ ID NO: 79334 - DNA, 27 bp, Artificial sequence
  SiRNA target sequence
aataatcatgaaacaatcgtctccttt

SEQ ID NO: 79335 - DNA, 27 bp, Artificial sequence
  SiRNA target sequence
ataatcatgaaacaatcgtctcctttg

SEQ ID NO: 79336 - DNA, 27 bp, Artificial sequence
  SiRNA target sequence
taatcatgaaacaatcgtctcctttgg

SEQ ID NO: 79337 - DNA, 27 bp, Artificial sequence
  SiRNA target sequence
aatcatgaaacaatcgtctcctttggg

SEQ ID NO: 79338 - DNA, 27 bp, Artificial sequence
  SiRNA target sequence
atcatgaaacaatcgtctcctttggga

SEQ ID NO: 79339 - DNA, 27 bp, Artificial sequence
  SiRNA target sequence
tcatgaaacaatcgtctcctttgggac

SEQ ID NO: 79340 - DNA, 27 bp, Artificial sequence
  SiRNA target sequence
catgaaacaatcgtctcctttgggact

SEQ ID NO: 79341 - DNA, 27 bp, Artificial sequence
  SiRNA target sequence
atgaaacaatcgtctcctttgggacta

SEQ ID NO: 79342 - DNA, 27 bp, Artificial sequence
  SiRNA target sequence
tgaaacaatcgtctcctttgggactac

SEQ ID NO: 79343 - DNA, 27 bp, Artificial sequence
  SiRNA target sequence
gaaacaatcgtctcctttgggactaca

SEQ ID NO: 79344 - DNA, 27 bp, Artificial sequence
  SiRNA target sequence
aaacaatcgtctcctttgggactacag

SEQ ID NO: 79345 - DNA, 27 bp, Artificial sequence
  SiRNA target sequence
aacaatcgtctcctttgggactacaga

SEQ ID NO: 79346 - DNA, 27 bp, Artificial sequence
  SiRNA target sequence
acaatcgtctcctttgggactacagat

SEQ ID NO: 79347 - DNA, 27 bp, Artificial sequence
  SiRNA target sequence
caatcgtctcctttgggactacagatc

SEQ ID NO: 79348 - DNA, 27 bp, Artificial sequence
  SiRNA target sequence
aatcgtctcctttgggactacagatct

SEQ ID NO: 79349 - DNA, 27 bp, Artificial sequence
  SiRNA target sequence
atcgtctcctttgggactacagatctt

SEQ ID NO: 79350 - DNA, 27 bp, Artificial sequence
  SiRNA target sequence
tcgtctcctttgggactacagatcttg

SEQ ID NO: 79351 - DNA, 27 bp, Artificial sequence
  SiRNA target sequence
cgtctcctttgggactacagatcttga

SEQ ID NO: 79352 - DNA, 27 bp, Artificial sequence
  SiRNA target sequence
gtctcctttgggactacagatcttgaa

SEQ ID NO: 79353 - DNA, 27 bp, Artificial sequence
  SiRNA target sequence
tctcctttgggactacagatcttgaag

SEQ ID NO: 79354 - DNA, 27 bp, Artificial sequence
  SiRNA target sequence
ctcctttgggactacagatcttgaagt

SEQ ID NO: 79355 - DNA, 27 bp, Artificial sequence
  SiRNA target sequence
tcctttgggactacagatcttgaagta

SEQ ID NO: 79356 - DNA, 27 bp, Artificial sequence
  SiRNA target sequence
cctttgggactacagatcttgaagtag

SEQ ID NO: 79357 - DNA, 27 bp, Artificial sequence
  SiRNA target sequence
ctttgggactacagatcttgaagtaga

SEQ ID NO: 79358 - DNA, 27 bp, Artificial sequence
  SiRNA target sequence
tttgggactacagatcttgaagtagat

SEQ ID NO: 79359 - DNA, 27 bp, Artificial sequence
  SiRNA target sequence
ttgggactacagatcttgaagtagatg

SEQ ID NO: 79360 - DNA, 27 bp, Artificial sequence
  SiRNA target sequence
tgggactacagatcttgaagtagatga

SEQ ID NO: 79361 - DNA, 27 bp, Artificial sequence
  SiRNA target sequence
gggactacagatcttgaagtagatgaa

SEQ ID NO: 79362 - DNA, 27 bp, Artificial sequence
  SiRNA target sequence
ggactacagatcttgaagtagatgaat

SEQ ID NO: 79363 - DNA, 27 bp, Artificial sequence
  SiRNA target sequence
gactacagatcttgaagtagatgaata

SEQ ID NO: 79364 - DNA, 27 bp, Artificial sequence
  SiRNA target sequence
actacagatcttgaagtagatgaatat

SEQ ID NO: 79365 - DNA, 27 bp, Artificial sequence
  SiRNA target sequence
ctacagatcttgaagtagatgaatatg

SEQ ID NO: 79366 - DNA, 27 bp, Artificial sequence
  SiRNA target sequence
tacagatcttgaagtagatgaatatga

SEQ ID NO: 79367 - DNA, 27 bp, Artificial sequence
  SiRNA target sequence
acagatcttgaagtagatgaatatgat

SEQ ID NO: 79368 - DNA, 27 bp, Artificial sequence
  SiRNA target sequence
cagatcttgaagtagatgaatatgatc

SEQ ID NO: 79369 - DNA, 27 bp, Artificial sequence
  SiRNA target sequence
agatcttgaagtagatgaatatgatca

SEQ ID NO: 79370 - DNA, 27 bp, Artificial sequence
  SiRNA target sequence
gatcttgaagtagatgaatatgatcag

SEQ ID NO: 79371 - DNA, 27 bp, Artificial sequence
  SiRNA target sequence
atcttgaagtagatgaatatgatcagt

SEQ ID NO: 79372 - DNA, 27 bp, Artificial sequence
  SiRNA target sequence
tcttgaagtagatgaatatgatcagtt

SEQ ID NO: 79373 - DNA, 27 bp, Artificial sequence
  SiRNA target sequence
cttgaagtagatgaatatgatcagttt

SEQ ID NO: 79374 - DNA, 27 bp, Artificial sequence
  SiRNA target sequence
ttgaagtagatgaatatgatcagtttc

SEQ ID NO: 79375 - DNA, 27 bp, Artificial sequence
  SiRNA target sequence
tgaagtagatgaatatgatcagtttct

SEQ ID NO: 79376 - DNA, 27 bp, Artificial sequence
  SiRNA target sequence
gaagtagatgaatatgatcagtttctt

SEQ ID NO: 79377 - DNA, 27 bp, Artificial sequence
  SiRNA target sequence
aagtagatgaatatgatcagtttctta

SEQ ID NO: 79378 - DNA, 27 bp, Artificial sequence
  SiRNA target sequence
agtagatgaatatgatcagtttcttaa

SEQ ID NO: 79379 - DNA, 27 bp, Artificial sequence
  SiRNA target sequence
gtagatgaatatgatcagtttcttaaa

SEQ ID NO: 79380 - DNA, 27 bp, Artificial sequence
  SiRNA target sequence
tagatgaatatgatcagtttcttaaaa

SEQ ID NO: 79381 - DNA, 27 bp, Artificial sequence
  SiRNA target sequence
agatgaatatgatcagtttcttaaaat

SEQ ID NO: 79382 - DNA, 27 bp, Artificial sequence
  SiRNA target sequence
gatgaatatgatcagtttcttaaaatt

SEQ ID NO: 79383 - DNA, 27 bp, Artificial sequence
  SiRNA target sequence
atgaatatgatcagtttcttaaaatta

SEQ ID NO: 79384 - DNA, 27 bp, Artificial sequence
  SiRNA target sequence
tgaatatgatcagtttcttaaaattaa

SEQ ID NO: 79385 - DNA, 27 bp, Artificial sequence
  SiRNA target sequence
gaatatgatcagtttcttaaaattaat

SEQ ID NO: 79386 - DNA, 27 bp, Artificial sequence
  SiRNA target sequence
aatatgatcagtttcttaaaattaatg

SEQ ID NO: 79387 - DNA, 27 bp, Artificial sequence
  SiRNA target sequence
atatgatcagtttcttaaaattaatgc

SEQ ID NO: 79388 - DNA, 27 bp, Artificial sequence
  SiRNA target sequence
tatgatcagtttcttaaaattaatgca

SEQ ID NO: 79389 - DNA, 27 bp, Artificial sequence
  SiRNA target sequence
atgatcagtttcttaaaattaatgcat

SEQ ID NO: 79390 - DNA, 27 bp, Artificial sequence
  SiRNA target sequence
tgatcagtttcttaaaattaatgcatc

SEQ ID NO: 79391 - DNA, 27 bp, Artificial sequence
  SiRNA target sequence
gatcagtttcttaaaattaatgcatct

SEQ ID NO: 79392 - DNA, 27 bp, Artificial sequence
  SiRNA target sequence
atcagtttcttaaaattaatgcatcta

SEQ ID NO: 79393 - DNA, 27 bp, Artificial sequence
  SiRNA target sequence
tcagtttcttaaaattaatgcatctaa

SEQ ID NO: 79394 - DNA, 27 bp, Artificial sequence
  SiRNA target sequence
cagtttcttaaaattaatgcatctaat

SEQ ID NO: 79395 - DNA, 27 bp, Artificial sequence
  SiRNA target sequence
agtttcttaaaattaatgcatctaata

SEQ ID NO: 79396 - DNA, 27 bp, Artificial sequence
  SiRNA target sequence
gtttcttaaaattaatgcatctaatag

SEQ ID NO: 79397 - DNA, 27 bp, Artificial sequence
  SiRNA target sequence
tttcttaaaattaatgcatctaatagt

SEQ ID NO: 79398 - DNA, 27 bp, Artificial sequence
  SiRNA target sequence
ttcttaaaattaatgcatctaatagta

SEQ ID NO: 79399 - DNA, 27 bp, Artificial sequence
  SiRNA target sequence
tcttaaaattaatgcatctaatagtaa

SEQ ID NO: 79400 - DNA, 27 bp, Artificial sequence
  SiRNA target sequence
cttaaaattaatgcatctaatagtaac

SEQ ID NO: 79401 - DNA, 27 bp, Artificial sequence
  SiRNA target sequence
ttaaaattaatgcatctaatagtaaca

SEQ ID NO: 79402 - DNA, 27 bp, Artificial sequence
  SiRNA target sequence
taaaattaatgcatctaatagtaacag

SEQ ID NO: 79403 - DNA, 27 bp, Artificial sequence
  SiRNA target sequence
aaaattaatgcatctaatagtaacaga

SEQ ID NO: 79404 - DNA, 27 bp, Artificial sequence
  SiRNA target sequence
aaattaatgcatctaatagtaacagat

SEQ ID NO: 79405 - DNA, 27 bp, Artificial sequence
  SiRNA target sequence
aattaatgcatctaatagtaacagatt

SEQ ID NO: 79406 - DNA, 27 bp, Artificial sequence
  SiRNA target sequence
attaatgcatctaatagtaacagatta

SEQ ID NO: 79407 - DNA, 27 bp, Artificial sequence
  SiRNA target sequence
ttaatgcatctaatagtaacagattat

SEQ ID NO: 79408 - DNA, 27 bp, Artificial sequence
  SiRNA target sequence
taatgcatctaatagtaacagattatg

SEQ ID NO: 79409 - DNA, 27 bp, Artificial sequence
  SiRNA target sequence
aatgcatctaatagtaacagattatgg

SEQ ID NO: 79410 - DNA, 27 bp, Artificial sequence
  SiRNA target sequence
atgcatctaatagtaacagattatgga

SEQ ID NO: 79411 - DNA, 27 bp, Artificial sequence
  SiRNA target sequence
tgcatctaatagtaacagattatggag

SEQ ID NO: 79412 - DNA, 27 bp, Artificial sequence
  SiRNA target sequence
gcatctaatagtaacagattatggaga

SEQ ID NO: 79413 - DNA, 27 bp, Artificial sequence
  SiRNA target sequence
catctaatagtaacagattatggagag

SEQ ID NO: 79414 - DNA, 27 bp, Artificial sequence
  SiRNA target sequence
atctaatagtaacagattatggagagc

SEQ ID NO: 79415 - DNA, 27 bp, Artificial sequence
  SiRNA target sequence
tctaatagtaacagattatggagagca

SEQ ID NO: 79416 - DNA, 27 bp, Artificial sequence
  SiRNA target sequence
ctaatagtaacagattatggagagcac

SEQ ID NO: 79417 - DNA, 27 bp, Artificial sequence
  SiRNA target sequence
taatagtaacagattatggagagcact

SEQ ID NO: 79418 - DNA, 27 bp, Artificial sequence
  SiRNA target sequence
aatagtaacagattatggagagcactg

SEQ ID NO: 79419 - DNA, 27 bp, Artificial sequence
  SiRNA target sequence
atagtaacagattatggagagcactgt

SEQ ID NO: 79420 - DNA, 27 bp, Artificial sequence
  SiRNA target sequence
tagtaacagattatggagagcactgta

SEQ ID NO: 79421 - DNA, 27 bp, Artificial sequence
  SiRNA target sequence
agtaacagattatggagagcactgtac

SEQ ID NO: 79422 - DNA, 27 bp, Artificial sequence
  SiRNA target sequence
gtaacagattatggagagcactgtaca

SEQ ID NO: 79423 - DNA, 27 bp, Artificial sequence
  SiRNA target sequence
taacagattatggagagcactgtacat

SEQ ID NO: 79424 - DNA, 27 bp, Artificial sequence
  SiRNA target sequence
aacagattatggagagcactgtacatt

SEQ ID NO: 79425 - DNA, 27 bp, Artificial sequence
  SiRNA target sequence
acagattatggagagcactgtacattt

SEQ ID NO: 79426 - DNA, 27 bp, Artificial sequence
  SiRNA target sequence
cagattatggagagcactgtacatttt

SEQ ID NO: 79427 - DNA, 27 bp, Artificial sequence
  SiRNA target sequence
agattatggagagcactgtacatttta

SEQ ID NO: 79428 - DNA, 27 bp, Artificial sequence
  SiRNA target sequence
gattatggagagcactgtacattttaa

SEQ ID NO: 79429 - DNA, 27 bp, Artificial sequence
  SiRNA target sequence
attatggagagcactgtacattttaaa

SEQ ID NO: 79430 - DNA, 27 bp, Artificial sequence
  SiRNA target sequence
ttatggagagcactgtacattttaaat

SEQ ID NO: 79431 - DNA, 27 bp, Artificial sequence
  SiRNA target sequence
tatggagagcactgtacattttaaatt

SEQ ID NO: 79432 - DNA, 27 bp, Artificial sequence
  SiRNA target sequence
atggagagcactgtacattttaaattt

SEQ ID NO: 79433 - DNA, 27 bp, Artificial sequence
  SiRNA target sequence
tggagagcactgtacattttaaattta

SEQ ID NO: 79434 - DNA, 27 bp, Artificial sequence
  SiRNA target sequence
ggagagcactgtacattttaaatttat

SEQ ID NO: 79435 - DNA, 27 bp, Artificial sequence
  SiRNA target sequence
gagagcactgtacattttaaatttatc

SEQ ID NO: 79436 - DNA, 27 bp, Artificial sequence
  SiRNA target sequence
agagcactgtacattttaaatttatct

SEQ ID NO: 79437 - DNA, 27 bp, Artificial sequence
  SiRNA target sequence
gagcactgtacattttaaatttatctc

SEQ ID NO: 79438 - DNA, 27 bp, Artificial sequence
  SiRNA target sequence
agcactgtacattttaaatttatctca

SEQ ID NO: 79439 - DNA, 27 bp, Artificial sequence
  SiRNA target sequence
gcactgtacattttaaatttatctcag

SEQ ID NO: 79440 - DNA, 27 bp, Artificial sequence
  SiRNA target sequence
cactgtacattttaaatttatctcaga

SEQ ID NO: 79441 - DNA, 27 bp, Artificial sequence
  SiRNA target sequence
actgtacattttaaatttatctcagag

SEQ ID NO: 79442 - DNA, 27 bp, Artificial sequence
  SiRNA target sequence
ctgtacattttaaatttatctcagaga

SEQ ID NO: 79443 - DNA, 27 bp, Artificial sequence
  SiRNA target sequence
tgtacattttaaatttatctcagagag

SEQ ID NO: 79444 - DNA, 27 bp, Artificial sequence
  SiRNA target sequence
gtacattttaaatttatctcagagagc

SEQ ID NO: 79445 - DNA, 27 bp, Artificial sequence
  SiRNA target sequence
tacattttaaatttatctcagagagca

SEQ ID NO: 79446 - DNA, 27 bp, Artificial sequence
  SiRNA target sequence
acattttaaatttatctcagagagcaa

SEQ ID NO: 79447 - DNA, 27 bp, Artificial sequence
  SiRNA target sequence
cattttaaatttatctcagagagcaat

SEQ ID NO: 79448 - DNA, 27 bp, Artificial sequence
  SiRNA target sequence
attttaaatttatctcagagagcaatt

SEQ ID NO: 79449 - DNA, 27 bp, Artificial sequence
  SiRNA target sequence
ttttaaatttatctcagagagcaattt

SEQ ID NO: 79450 - DNA, 27 bp, Artificial sequence
  SiRNA target sequence
tttaaatttatctcagagagcaatttt

SEQ ID NO: 79451 - DNA, 27 bp, Artificial sequence
  SiRNA target sequence
ttaaatttatctcagagagcaattttt

SEQ ID NO: 79452 - DNA, 27 bp, Artificial sequence
  SiRNA target sequence
taaatttatctcagagagcaatttttc

SEQ ID NO: 79453 - DNA, 27 bp, Artificial sequence
  SiRNA target sequence
aaatttatctcagagagcaatttttct

SEQ ID NO: 79454 - DNA, 27 bp, Artificial sequence
  SiRNA target sequence
aatttatctcagagagcaatttttctc

SEQ ID NO: 79455 - DNA, 27 bp, Artificial sequence
  SiRNA target sequence
atttatctcagagagcaatttttctct

SEQ ID NO: 79456 - DNA, 27 bp, Artificial sequence
  SiRNA target sequence
tttatctcagagagcaatttttctctt

SEQ ID NO: 79457 - DNA, 27 bp, Artificial sequence
  SiRNA target sequence
ttatctcagagagcaatttttctctta

SEQ ID NO: 79458 - DNA, 27 bp, Artificial sequence
  SiRNA target sequence
tatctcagagagcaatttttctcttac

SEQ ID NO: 79459 - DNA, 27 bp, Artificial sequence
  SiRNA target sequence
atctcagagagcaatttttctcttaca

SEQ ID NO: 79460 - DNA, 27 bp, Artificial sequence
  SiRNA target sequence
tctcagagagcaatttttctcttacaa

SEQ ID NO: 79461 - DNA, 27 bp, Artificial sequence
  SiRNA target sequence
ctcagagagcaatttttctcttacaaa

SEQ ID NO: 79462 - DNA, 27 bp, Artificial sequence
  SiRNA target sequence
tcagagagcaatttttctcttacaaag

SEQ ID NO: 79463 - DNA, 27 bp, Artificial sequence
  SiRNA target sequence
cagagagcaatttttctcttacaaagt

SEQ ID NO: 79464 - DNA, 27 bp, Artificial sequence
  SiRNA target sequence
agagagcaatttttctcttacaaagtt

SEQ ID NO: 79465 - DNA, 27 bp, Artificial sequence
  SiRNA target sequence
gagagcaatttttctcttacaaagttt

SEQ ID NO: 79466 - DNA, 27 bp, Artificial sequence
  SiRNA target sequence
agagcaatttttctcttacaaagtttt

SEQ ID NO: 79467 - DNA, 27 bp, Artificial sequence
  SiRNA target sequence
gagcaatttttctcttacaaagttttt

SEQ ID NO: 79468 - DNA, 27 bp, Artificial sequence
  SiRNA target sequence
agcaatttttctcttacaaagtttttt

SEQ ID NO: 79469 - DNA, 27 bp, Artificial sequence
  SiRNA target sequence
gcaatttttctcttacaaagttttttt

SEQ ID NO: 79470 - DNA, 27 bp, Artificial sequence
  SiRNA target sequence
caatttttctcttacaaagttttttta

SEQ ID NO: 79471 - DNA, 27 bp, Artificial sequence
  SiRNA target sequence
aatttttctcttacaaagtttttttat

SEQ ID NO: 79472 - DNA, 27 bp, Artificial sequence
  SiRNA target sequence
atttttctcttacaaagtttttttatt

SEQ ID NO: 79473 - DNA, 27 bp, Artificial sequence
  SiRNA target sequence
tttttctcttacaaagtttttttatta

SEQ ID NO: 79474 - DNA, 27 bp, Artificial sequence
  SiRNA target sequence
ttttctcttacaaagtttttttattat

SEQ ID NO: 79475 - DNA, 27 bp, Artificial sequence
  SiRNA target sequence
tttctcttacaaagtttttttattatt

SEQ ID NO: 79476 - DNA, 27 bp, Artificial sequence
  SiRNA target sequence
ttctcttacaaagtttttttattattt

SEQ ID NO: 79477 - DNA, 27 bp, Artificial sequence
  SiRNA target sequence
tctcttacaaagtttttttattattta

SEQ ID NO: 79478 - DNA, 27 bp, Artificial sequence
  SiRNA target sequence
ctcttacaaagtttttttattatttat

SEQ ID NO: 79479 - DNA, 27 bp, Artificial sequence
  SiRNA target sequence
tcttacaaagtttttttattatttatg

SEQ ID NO: 79480 - DNA, 27 bp, Artificial sequence
  SiRNA target sequence
cttacaaagtttttttattatttatgc

SEQ ID NO: 79481 - DNA, 27 bp, Artificial sequence
  SiRNA target sequence
ttacaaagtttttttattatttatgca

SEQ ID NO: 79482 - DNA, 27 bp, Artificial sequence
  SiRNA target sequence
tacaaagtttttttattatttatgcag

SEQ ID NO: 79483 - DNA, 27 bp, Artificial sequence
  SiRNA target sequence
acaaagtttttttattatttatgcagg

SEQ ID NO: 79484 - DNA, 27 bp, Artificial sequence
  SiRNA target sequence
caaagtttttttattatttatgcagga

SEQ ID NO: 79485 - DNA, 27 bp, Artificial sequence
  SiRNA target sequence
aaagtttttttattatttatgcaggaa

SEQ ID NO: 79486 - DNA, 27 bp, Artificial sequence
  SiRNA target sequence
aagtttttttattatttatgcaggaat

SEQ ID NO: 79487 - DNA, 27 bp, Artificial sequence
  SiRNA target sequence
agtttttttattatttatgcaggaata

SEQ ID NO: 79488 - DNA, 27 bp, Artificial sequence
  SiRNA target sequence
gtttttttattatttatgcaggaatat

SEQ ID NO: 79489 - DNA, 27 bp, Artificial sequence
  SiRNA target sequence
tttttttattatttatgcaggaatatc

SEQ ID NO: 79490 - DNA, 27 bp, Artificial sequence
  SiRNA target sequence
ttttttattatttatgcaggaatatca

SEQ ID NO: 79491 - DNA, 27 bp, Artificial sequence
  SiRNA target sequence
tttttattatttatgcaggaatatcag

SEQ ID NO: 79492 - DNA, 27 bp, Artificial sequence
  SiRNA target sequence
ttttattatttatgcaggaatatcagg

SEQ ID NO: 79493 - DNA, 27 bp, Artificial sequence
  SiRNA target sequence
tttattatttatgcaggaatatcagga

SEQ ID NO: 79494 - DNA, 27 bp, Artificial sequence
  SiRNA target sequence
ttattatttatgcaggaatatcaggaa

SEQ ID NO: 79495 - DNA, 27 bp, Artificial sequence
  SiRNA target sequence
tattatttatgcaggaatatcaggaat

SEQ ID NO: 79496 - DNA, 27 bp, Artificial sequence
  SiRNA target sequence
attatttatgcaggaatatcaggaata

SEQ ID NO: 79497 - DNA, 27 bp, Artificial sequence
  SiRNA target sequence
ttatttatgcaggaatatcaggaatat

SEQ ID NO: 79498 - DNA, 27 bp, Artificial sequence
  SiRNA target sequence
tatttatgcaggaatatcaggaatatt

SEQ ID NO: 79499 - DNA, 27 bp, Artificial sequence
  SiRNA target sequence
atttatgcaggaatatcaggaatatta

SEQ ID NO: 79500 - DNA, 27 bp, Artificial sequence
  SiRNA target sequence
tttatgcaggaatatcaggaatattat

SEQ ID NO: 79501 - DNA, 27 bp, Artificial sequence
  SiRNA target sequence
ttatgcaggaatatcaggaatattatc

SEQ ID NO: 79502 - DNA, 27 bp, Artificial sequence
  SiRNA target sequence
tatgcaggaatatcaggaatattatct

SEQ ID NO: 79503 - DNA, 27 bp, Artificial sequence
  SiRNA target sequence
atgcaggaatatcaggaatattatctc

SEQ ID NO: 79504 - DNA, 27 bp, Artificial sequence
  SiRNA target sequence
tgcaggaatatcaggaatattatctca

SEQ ID NO: 79505 - DNA, 27 bp, Artificial sequence
  SiRNA target sequence
gcaggaatatcaggaatattatctcaa

SEQ ID NO: 79506 - DNA, 27 bp, Artificial sequence
  SiRNA target sequence
caggaatatcaggaatattatctcaaa

SEQ ID NO: 79507 - DNA, 27 bp, Artificial sequence
  SiRNA target sequence
aggaatatcaggaatattatctcaaaa

SEQ ID NO: 79508 - DNA, 27 bp, Artificial sequence
  SiRNA target sequence
ggaatatcaggaatattatctcaaaat

SEQ ID NO: 79509 - DNA, 27 bp, Artificial sequence
  SiRNA target sequence
gaatatcaggaatattatctcaaaata

SEQ ID NO: 79510 - DNA, 27 bp, Artificial sequence
  SiRNA target sequence
aatatcaggaatattatctcaaaatat

SEQ ID NO: 79511 - DNA, 27 bp, Artificial sequence
  SiRNA target sequence
atatcaggaatattatctcaaaatatg

SEQ ID NO: 79512 - DNA, 27 bp, Artificial sequence
  SiRNA target sequence
tatcaggaatattatctcaaaatatgt

SEQ ID NO: 79513 - DNA, 27 bp, Artificial sequence
  SiRNA target sequence
atcaggaatattatctcaaaatatgtc

SEQ ID NO: 79514 - DNA, 27 bp, Artificial sequence
  SiRNA target sequence
tcaggaatattatctcaaaatatgtca

SEQ ID NO: 79515 - DNA, 27 bp, Artificial sequence
  SiRNA target sequence
caggaatattatctcaaaatatgtcat

SEQ ID NO: 79516 - DNA, 27 bp, Artificial sequence
  SiRNA target sequence
aggaatattatctcaaaatatgtcatc

SEQ ID NO: 79517 - DNA, 27 bp, Artificial sequence
  SiRNA target sequence
ggaatattatctcaaaatatgtcatct

SEQ ID NO: 79518 - DNA, 27 bp, Artificial sequence
  SiRNA target sequence
gaatattatctcaaaatatgtcatcta

SEQ ID NO: 79519 - DNA, 27 bp, Artificial sequence
  SiRNA target sequence
aatattatctcaaaatatgtcatctaa

SEQ ID NO: 79520 - DNA, 27 bp, Artificial sequence
  SiRNA target sequence
atattatctcaaaatatgtcatctaac

SEQ ID NO: 79521 - DNA, 27 bp, Artificial sequence
  SiRNA target sequence
tattatctcaaaatatgtcatctaacc

SEQ ID NO: 79522 - DNA, 27 bp, Artificial sequence
  SiRNA target sequence
attatctcaaaatatgtcatctaacca

SEQ ID NO: 79523 - DNA, 27 bp, Artificial sequence
  SiRNA target sequence
ttatctcaaaatatgtcatctaaccaa

SEQ ID NO: 79524 - DNA, 27 bp, Artificial sequence
  SiRNA target sequence
tatctcaaaatatgtcatctaaccaac

SEQ ID NO: 79525 - DNA, 27 bp, Artificial sequence
  SiRNA target sequence
atctcaaaatatgtcatctaaccaact

SEQ ID NO: 79526 - DNA, 27 bp, Artificial sequence
  SiRNA target sequence
tctcaaaatatgtcatctaaccaactc

SEQ ID NO: 79527 - DNA, 27 bp, Artificial sequence
  SiRNA target sequence
ctcaaaatatgtcatctaaccaactca

SEQ ID NO: 79528 - DNA, 27 bp, Artificial sequence
  SiRNA target sequence
tcaaaatatgtcatctaaccaactcat

SEQ ID NO: 79529 - DNA, 27 bp, Artificial sequence
  SiRNA target sequence
caaaatatgtcatctaaccaactcatt

SEQ ID NO: 79530 - DNA, 27 bp, Artificial sequence
  SiRNA target sequence
aaaatatgtcatctaaccaactcattt

SEQ ID NO: 79531 - DNA, 27 bp, Artificial sequence
  SiRNA target sequence
aaatatgtcatctaaccaactcattta

SEQ ID NO: 79532 - DNA, 27 bp, Artificial sequence
  SiRNA target sequence
aatatgtcatctaaccaactcatttat

SEQ ID NO: 79533 - DNA, 27 bp, Artificial sequence
  SiRNA target sequence
atatgtcatctaaccaactcatttatt

SEQ ID NO: 79534 - DNA, 27 bp, Artificial sequence
  SiRNA target sequence
tatgtcatctaaccaactcatttattt

SEQ ID NO: 79535 - DNA, 27 bp, Artificial sequence
  SiRNA target sequence
atgtcatctaaccaactcatttattta

SEQ ID NO: 79536 - DNA, 27 bp, Artificial sequence
  SiRNA target sequence
tgtcatctaaccaactcatttatttaa

SEQ ID NO: 79537 - DNA, 27 bp, Artificial sequence
  SiRNA target sequence
gtcatctaaccaactcatttatttaat

SEQ ID NO: 79538 - DNA, 27 bp, Artificial sequence
  SiRNA target sequence
tcatctaaccaactcatttatttaatg

SEQ ID NO: 79539 - DNA, 27 bp, Artificial sequence
  SiRNA target sequence
catctaaccaactcatttatttaatgt

SEQ ID NO: 79540 - DNA, 27 bp, Artificial sequence
  SiRNA target sequence
atctaaccaactcatttatttaatgtc

SEQ ID NO: 79541 - DNA, 27 bp, Artificial sequence
  SiRNA target sequence
tctaaccaactcatttatttaatgtcc

SEQ ID NO: 79542 - DNA, 27 bp, Artificial sequence
  SiRNA target sequence
ctaaccaactcatttatttaatgtcca

SEQ ID NO: 79543 - DNA, 27 bp, Artificial sequence
  SiRNA target sequence
taaccaactcatttatttaatgtccat

SEQ ID NO: 79544 - DNA, 27 bp, Artificial sequence
  SiRNA target sequence
aaccaactcatttatttaatgtccatt

SEQ ID NO: 79545 - DNA, 27 bp, Artificial sequence
  SiRNA target sequence
accaactcatttatttaatgtccatta

SEQ ID NO: 79546 - DNA, 27 bp, Artificial sequence
  SiRNA target sequence
ccaactcatttatttaatgtccattac

SEQ ID NO: 79547 - DNA, 27 bp, Artificial sequence
  SiRNA target sequence
caactcatttatttaatgtccattaca

SEQ ID NO: 79548 - DNA, 27 bp, Artificial sequence
  SiRNA target sequence
aactcatttatttaatgtccattacat

SEQ ID NO: 79549 - DNA, 27 bp, Artificial sequence
  SiRNA target sequence
actcatttatttaatgtccattacatc

SEQ ID NO: 79550 - DNA, 27 bp, Artificial sequence
  SiRNA target sequence
ctcatttatttaatgtccattacatct

SEQ ID NO: 79551 - DNA, 27 bp, Artificial sequence
  SiRNA target sequence
tcatttatttaatgtccattacatcta

SEQ ID NO: 79552 - DNA, 27 bp, Artificial sequence
  SiRNA target sequence
catttatttaatgtccattacatctac

SEQ ID NO: 79553 - DNA, 27 bp, Artificial sequence
  SiRNA target sequence
atttatttaatgtccattacatctacg

SEQ ID NO: 79554 - DNA, 27 bp, Artificial sequence
  SiRNA target sequence
tttatttaatgtccattacatctacgg

SEQ ID NO: 79555 - DNA, 27 bp, Artificial sequence
  SiRNA target sequence
ttatttaatgtccattacatctacggt

SEQ ID NO: 79556 - DNA, 27 bp, Artificial sequence
  SiRNA target sequence
tatttaatgtccattacatctacggtt

SEQ ID NO: 79557 - DNA, 27 bp, Artificial sequence
  SiRNA target sequence
atttaatgtccattacatctacggtta

SEQ ID NO: 79558 - DNA, 27 bp, Artificial sequence
  SiRNA target sequence
tttaatgtccattacatctacggttac

SEQ ID NO: 79559 - DNA, 27 bp, Artificial sequence
  SiRNA target sequence
ttaatgtccattacatctacggttact

SEQ ID NO: 79560 - DNA, 27 bp, Artificial sequence
  SiRNA target sequence
taatgtccattacatctacggttacta

SEQ ID NO: 79561 - DNA, 27 bp, Artificial sequence
  SiRNA target sequence
aatgtccattacatctacggttactat

SEQ ID NO: 79562 - DNA, 27 bp, Artificial sequence
  SiRNA target sequence
atgtccattacatctacggttactatt

SEQ ID NO: 79563 - DNA, 27 bp, Artificial sequence
  SiRNA target sequence
tgtccattacatctacggttactatta

SEQ ID NO: 79564 - DNA, 27 bp, Artificial sequence
  SiRNA target sequence
gtccattacatctacggttactattaa

SEQ ID NO: 79565 - DNA, 27 bp, Artificial sequence
  SiRNA target sequence
tccattacatctacggttactattaat

SEQ ID NO: 79566 - DNA, 27 bp, Artificial sequence
  SiRNA target sequence
ccattacatctacggttactattaatt

SEQ ID NO: 79567 - DNA, 27 bp, Artificial sequence
  SiRNA target sequence
cattacatctacggttactattaattt

SEQ ID NO: 79568 - DNA, 27 bp, Artificial sequence
  SiRNA target sequence
attacatctacggttactattaattta

SEQ ID NO: 79569 - DNA, 27 bp, Artificial sequence
  SiRNA target sequence
ttacatctacggttactattaatttaa

SEQ ID NO: 79570 - DNA, 27 bp, Artificial sequence
  SiRNA target sequence
tacatctacggttactattaatttaag

SEQ ID NO: 79571 - DNA, 27 bp, Artificial sequence
  SiRNA target sequence
acatctacggttactattaatttaagt

SEQ ID NO: 79572 - DNA, 27 bp, Artificial sequence
  SiRNA target sequence
catctacggttactattaatttaagta

SEQ ID NO: 79573 - DNA, 27 bp, Artificial sequence
  SiRNA target sequence
atctacggttactattaatttaagtaa

SEQ ID NO: 79574 - DNA, 27 bp, Artificial sequence
  SiRNA target sequence
tctacggttactattaatttaagtaac

SEQ ID NO: 79575 - DNA, 27 bp, Artificial sequence
  SiRNA target sequence
ctacggttactattaatttaagtaact

SEQ ID NO: 79576 - DNA, 27 bp, Artificial sequence
  SiRNA target sequence
tacggttactattaatttaagtaactt

SEQ ID NO: 79577 - DNA, 27 bp, Artificial sequence
  SiRNA target sequence
acggttactattaatttaagtaacttg

SEQ ID NO: 79578 - DNA, 27 bp, Artificial sequence
  SiRNA target sequence
cggttactattaatttaagtaacttgg

SEQ ID NO: 79579 - DNA, 27 bp, Artificial sequence
  SiRNA target sequence
ggttactattaatttaagtaacttggg

SEQ ID NO: 79580 - DNA, 27 bp, Artificial sequence
  SiRNA target sequence
gttactattaatttaagtaacttgggt

SEQ ID NO: 79581 - DNA, 27 bp, Artificial sequence
  SiRNA target sequence
ttactattaatttaagtaacttgggtt

SEQ ID NO: 79582 - DNA, 27 bp, Artificial sequence
  SiRNA target sequence
tactattaatttaagtaacttgggtta

SEQ ID NO: 79583 - DNA, 27 bp, Artificial sequence
  SiRNA target sequence
actattaatttaagtaacttgggttac

SEQ ID NO: 79584 - DNA, 27 bp, Artificial sequence
  SiRNA target sequence
ctattaatttaagtaacttgggttact

SEQ ID NO: 79585 - DNA, 27 bp, Artificial sequence
  SiRNA target sequence
tattaatttaagtaacttgggttactt

SEQ ID NO: 79586 - DNA, 27 bp, Artificial sequence
  SiRNA target sequence
attaatttaagtaacttgggttactta

SEQ ID NO: 79587 - DNA, 27 bp, Artificial sequence
  SiRNA target sequence
ttaatttaagtaacttgggttacttat

SEQ ID NO: 79588 - DNA, 27 bp, Artificial sequence
  SiRNA target sequence
taatttaagtaacttgggttacttata

SEQ ID NO: 79589 - DNA, 27 bp, Artificial sequence
  SiRNA target sequence
aatttaagtaacttgggttacttatac

SEQ ID NO: 79590 - DNA, 27 bp, Artificial sequence
  SiRNA target sequence
atttaagtaacttgggttacttataca

SEQ ID NO: 79591 - DNA, 27 bp, Artificial sequence
  SiRNA target sequence
tttaagtaacttgggttacttatacac

SEQ ID NO: 79592 - DNA, 27 bp, Artificial sequence
  SiRNA target sequence
ttaagtaacttgggttacttatacact

SEQ ID NO: 79593 - DNA, 27 bp, Artificial sequence
  SiRNA target sequence
taagtaacttgggttacttatacacta

SEQ ID NO: 79594 - DNA, 27 bp, Artificial sequence
  SiRNA target sequence
aagtaacttgggttacttatacactag

SEQ ID NO: 79595 - DNA, 27 bp, Artificial sequence
  SiRNA target sequence
agtaacttgggttacttatacactaga

SEQ ID NO: 79596 - DNA, 27 bp, Artificial sequence
  SiRNA target sequence
gtaacttgggttacttatacactagat

SEQ ID NO: 79597 - DNA, 27 bp, Artificial sequence
  SiRNA target sequence
taacttgggttacttatacactagata

SEQ ID NO: 79598 - DNA, 27 bp, Artificial sequence
  SiRNA target sequence
aacttgggttacttatacactagatat

SEQ ID NO: 79599 - DNA, 27 bp, Artificial sequence
  SiRNA target sequence
acttgggttacttatacactagatata

SEQ ID NO: 79600 - DNA, 27 bp, Artificial sequence
  SiRNA target sequence
cttgggttacttatacactagatatac

SEQ ID NO: 79601 - DNA, 27 bp, Artificial sequence
  SiRNA target sequence
ttgggttacttatacactagatataca

SEQ ID NO: 79602 - DNA, 27 bp, Artificial sequence
  SiRNA target sequence
tgggttacttatacactagatatacac

SEQ ID NO: 79603 - DNA, 27 bp, Artificial sequence
  SiRNA target sequence
gggttacttatacactagatatacaca

SEQ ID NO: 79604 - DNA, 27 bp, Artificial sequence
  SiRNA target sequence
ggttacttatacactagatatacacaa

SEQ ID NO: 79605 - DNA, 27 bp, Artificial sequence
  SiRNA target sequence
gttacttatacactagatatacacaag

SEQ ID NO: 79606 - DNA, 27 bp, Artificial sequence
  SiRNA target sequence
ttacttatacactagatatacacaagc

SEQ ID NO: 79607 - DNA, 27 bp, Artificial sequence
  SiRNA target sequence
tacttatacactagatatacacaagca

SEQ ID NO: 79608 - DNA, 27 bp, Artificial sequence
  SiRNA target sequence
acttatacactagatatacacaagcaa

SEQ ID NO: 79609 - DNA, 27 bp, Artificial sequence
  SiRNA target sequence
cttatacactagatatacacaagcaat

SEQ ID NO: 79610 - DNA, 27 bp, Artificial sequence
  SiRNA target sequence
ttatacactagatatacacaagcaata

SEQ ID NO: 79611 - DNA, 27 bp, Artificial sequence
  SiRNA target sequence
tatacactagatatacacaagcaataa

SEQ ID NO: 79612 - DNA, 27 bp, Artificial sequence
  SiRNA target sequence
atacactagatatacacaagcaataat

SEQ ID NO: 79613 - DNA, 27 bp, Artificial sequence
  SiRNA target sequence
tacactagatatacacaagcaataatt

SEQ ID NO: 79614 - DNA, 27 bp, Artificial sequence
  SiRNA target sequence
acactagatatacacaagcaataatta

SEQ ID NO: 79615 - DNA, 27 bp, Artificial sequence
  SiRNA target sequence
cactagatatacacaagcaataattaa

SEQ ID NO: 79616 - DNA, 27 bp, Artificial sequence
  SiRNA target sequence
actagatatacacaagcaataattaat

SEQ ID NO: 79617 - DNA, 27 bp, Artificial sequence
  SiRNA target sequence
ctagatatacacaagcaataattaatg

SEQ ID NO: 79618 - DNA, 27 bp, Artificial sequence
  SiRNA target sequence
tagatatacacaagcaataattaatgc

SEQ ID NO: 79619 - DNA, 27 bp, Artificial sequence
  SiRNA target sequence
agatatacacaagcaataattaatgca

SEQ ID NO: 79620 - DNA, 27 bp, Artificial sequence
  SiRNA target sequence
gatatacacaagcaataattaatgcaa

SEQ ID NO: 79621 - DNA, 27 bp, Artificial sequence
  SiRNA target sequence
atatacacaagcaataattaatgcaag

SEQ ID NO: 79622 - DNA, 27 bp, Artificial sequence
  SiRNA target sequence
tatacacaagcaataattaatgcaaga

SEQ ID NO: 79623 - DNA, 27 bp, Artificial sequence
  SiRNA target sequence
atacacaagcaataattaatgcaagat

SEQ ID NO: 79624 - DNA, 27 bp, Artificial sequence
  SiRNA target sequence
tacacaagcaataattaatgcaagatc

SEQ ID NO: 79625 - DNA, 27 bp, Artificial sequence
  SiRNA target sequence
acacaagcaataattaatgcaagatct

SEQ ID NO: 79626 - DNA, 27 bp, Artificial sequence
  SiRNA target sequence
cacaagcaataattaatgcaagatcta

SEQ ID NO: 79627 - DNA, 27 bp, Artificial sequence
  SiRNA target sequence
acaagcaataattaatgcaagatctac

SEQ ID NO: 79628 - DNA, 27 bp, Artificial sequence
  SiRNA target sequence
caagcaataattaatgcaagatctact

SEQ ID NO: 79629 - DNA, 27 bp, Artificial sequence
  SiRNA target sequence
aagcaataattaatgcaagatctactt

SEQ ID NO: 79630 - DNA, 27 bp, Artificial sequence
  SiRNA target sequence
agcaataattaatgcaagatctactta

SEQ ID NO: 79631 - DNA, 27 bp, Artificial sequence
  SiRNA target sequence
gcaataattaatgcaagatctacttat

SEQ ID NO: 79632 - DNA, 27 bp, Artificial sequence
  SiRNA target sequence
caataattaatgcaagatctacttatg

SEQ ID NO: 79633 - DNA, 27 bp, Artificial sequence
  SiRNA target sequence
aataattaatgcaagatctacttatga

SEQ ID NO: 79634 - DNA, 27 bp, Artificial sequence
  SiRNA target sequence
ataattaatgcaagatctacttatgat

SEQ ID NO: 79635 - DNA, 27 bp, Artificial sequence
  SiRNA target sequence
taattaatgcaagatctacttatgata

SEQ ID NO: 79636 - DNA, 27 bp, Artificial sequence
  SiRNA target sequence
aattaatgcaagatctacttatgatac

SEQ ID NO: 79637 - DNA, 27 bp, Artificial sequence
  SiRNA target sequence
attaatgcaagatctacttatgataca

SEQ ID NO: 79638 - DNA, 27 bp, Artificial sequence
  SiRNA target sequence
ttaatgcaagatctacttatgatacaa

SEQ ID NO: 79639 - DNA, 27 bp, Artificial sequence
  SiRNA target sequence
taatgcaagatctacttatgatacaat

SEQ ID NO: 79640 - DNA, 27 bp, Artificial sequence
  SiRNA target sequence
aatgcaagatctacttatgatacaatg

SEQ ID NO: 79641 - DNA, 27 bp, Artificial sequence
  SiRNA target sequence
atgcaagatctacttatgatacaatgt

SEQ ID NO: 79642 - DNA, 27 bp, Artificial sequence
  SiRNA target sequence
tgcaagatctacttatgatacaatgtt

SEQ ID NO: 79643 - DNA, 27 bp, Artificial sequence
  SiRNA target sequence
gcaagatctacttatgatacaatgtta

SEQ ID NO: 79644 - DNA, 27 bp, Artificial sequence
  SiRNA target sequence
caagatctacttatgatacaatgttag

SEQ ID NO: 79645 - DNA, 27 bp, Artificial sequence
  SiRNA target sequence
aagatctacttatgatacaatgttaga

SEQ ID NO: 79646 - DNA, 27 bp, Artificial sequence
  SiRNA target sequence
agatctacttatgatacaatgttagat

SEQ ID NO: 79647 - DNA, 27 bp, Artificial sequence
  SiRNA target sequence
gatctacttatgatacaatgttagata

SEQ ID NO: 79648 - DNA, 27 bp, Artificial sequence
  SiRNA target sequence
atctacttatgatacaatgttagatat

SEQ ID NO: 79649 - DNA, 27 bp, Artificial sequence
  SiRNA target sequence
tctacttatgatacaatgttagatata

SEQ ID NO: 79650 - DNA, 27 bp, Artificial sequence
  SiRNA target sequence
ctacttatgatacaatgttagatataa

SEQ ID NO: 79651 - DNA, 27 bp, Artificial sequence
  SiRNA target sequence
tacttatgatacaatgttagatataaa

SEQ ID NO: 79652 - DNA, 27 bp, Artificial sequence
  SiRNA target sequence
acttatgatacaatgttagatataaaa

SEQ ID NO: 79653 - DNA, 27 bp, Artificial sequence
  SiRNA target sequence
cttatgatacaatgttagatataaaaa

SEQ ID NO: 79654 - DNA, 27 bp, Artificial sequence
  SiRNA target sequence
ttatgatacaatgttagatataaaaaa

SEQ ID NO: 79655 - DNA, 27 bp, Artificial sequence
  SiRNA target sequence
tatgatacaatgttagatataaaaaaa

SEQ ID NO: 79656 - DNA, 27 bp, Artificial sequence
  SiRNA target sequence
atgatacaatgttagatataaaaaaag

SEQ ID NO: 79657 - DNA, 27 bp, Artificial sequence
  SiRNA target sequence
tgatacaatgttagatataaaaaaaga

SEQ ID NO: 79658 - DNA, 27 bp, Artificial sequence
  SiRNA target sequence
gatacaatgttagatataaaaaaagag

SEQ ID NO: 79659 - DNA, 27 bp, Artificial sequence
  SiRNA target sequence
atacaatgttagatataaaaaaagaga

SEQ ID NO: 79660 - DNA, 27 bp, Artificial sequence
  SiRNA target sequence
tacaatgttagatataaaaaaagagaa

SEQ ID NO: 79661 - DNA, 27 bp, Artificial sequence
  SiRNA target sequence
acaatgttagatataaaaaaagagaat

SEQ ID NO: 79662 - DNA, 27 bp, Artificial sequence
  SiRNA target sequence
caatgttagatataaaaaaagagaata

SEQ ID NO: 79663 - DNA, 27 bp, Artificial sequence
  SiRNA target sequence
aatgttagatataaaaaaagagaataa

SEQ ID NO: 79664 - DNA, 27 bp, Artificial sequence
  SiRNA target sequence
atgttagatataaaaaaagagaataat

SEQ ID NO: 79665 - DNA, 27 bp, Artificial sequence
  SiRNA target sequence
tgttagatataaaaaaagagaataata

SEQ ID NO: 79666 - DNA, 27 bp, Artificial sequence
  SiRNA target sequence
gttagatataaaaaaagagaataataa

SEQ ID NO: 79667 - DNA, 27 bp, Artificial sequence
  SiRNA target sequence
ttagatataaaaaaagagaataataag

SEQ ID NO: 79668 - DNA, 27 bp, Artificial sequence
  SiRNA target sequence
tagatataaaaaaagagaataataagt

SEQ ID NO: 79669 - DNA, 27 bp, Artificial sequence
  SiRNA target sequence
agatataaaaaaagagaataataagtt

SEQ ID NO: 79670 - DNA, 27 bp, Artificial sequence
  SiRNA target sequence
gatataaaaaaagagaataataagttt

SEQ ID NO: 79671 - DNA, 27 bp, Artificial sequence
  SiRNA target sequence
atataaaaaaagagaataataagttta

SEQ ID NO: 79672 - DNA, 27 bp, Artificial sequence
  SiRNA target sequence
tataaaaaaagagaataataagtttaa

SEQ ID NO: 79673 - DNA, 27 bp, Artificial sequence
  SiRNA target sequence
ataaaaaaagagaataataagtttaag

SEQ ID NO: 79674 - DNA, 27 bp, Artificial sequence
  SiRNA target sequence
taaaaaaagagaataataagtttaaga

SEQ ID NO: 79675 - DNA, 27 bp, Artificial sequence
  SiRNA target sequence
aaaaaaagagaataataagtttaagat

SEQ ID NO: 79676 - DNA, 27 bp, Artificial sequence
  SiRNA target sequence
aaaaaagagaataataagtttaagatt

SEQ ID NO: 79677 - DNA, 27 bp, Artificial sequence
  SiRNA target sequence
aaaaagagaataataagtttaagatta

SEQ ID NO: 79678 - DNA, 27 bp, Artificial sequence
  SiRNA target sequence
aaaagagaataataagtttaagattac

SEQ ID NO: 79679 - DNA, 27 bp, Artificial sequence
  SiRNA target sequence
aaagagaataataagtttaagattaca

SEQ ID NO: 79680 - DNA, 27 bp, Artificial sequence
  SiRNA target sequence
aagagaataataagtttaagattacag

SEQ ID NO: 79681 - DNA, 27 bp, Artificial sequence
  SiRNA target sequence
agagaataataagtttaagattacaga

SEQ ID NO: 79682 - DNA, 27 bp, Artificial sequence
  SiRNA target sequence
gagaataataagtttaagattacagaa

SEQ ID NO: 79683 - DNA, 27 bp, Artificial sequence
  SiRNA target sequence
agaataataagtttaagattacagaat

SEQ ID NO: 79684 - DNA, 27 bp, Artificial sequence
  SiRNA target sequence
gaataataagtttaagattacagaatt

SEQ ID NO: 79685 - DNA, 27 bp, Artificial sequence
  SiRNA target sequence
aataataagtttaagattacagaattt

SEQ ID NO: 79686 - DNA, 27 bp, Artificial sequence
  SiRNA target sequence
ataataagtttaagattacagaattta

SEQ ID NO: 79687 - DNA, 27 bp, Artificial sequence
  SiRNA target sequence
taataagtttaagattacagaatttaa

SEQ ID NO: 79688 - DNA, 27 bp, Artificial sequence
  SiRNA target sequence
aataagtttaagattacagaatttaaa

SEQ ID NO: 79689 - DNA, 27 bp, Artificial sequence
  SiRNA target sequence
ataagtttaagattacagaatttaaag

SEQ ID NO: 79690 - DNA, 27 bp, Artificial sequence
  SiRNA target sequence
taagtttaagattacagaatttaaaga

SEQ ID NO: 79691 - DNA, 27 bp, Artificial sequence
  SiRNA target sequence
aagtttaagattacagaatttaaagaa

SEQ ID NO: 79692 - DNA, 27 bp, Artificial sequence
  SiRNA target sequence
agtttaagattacagaatttaaagaaa

SEQ ID NO: 79693 - DNA, 27 bp, Artificial sequence
  SiRNA target sequence
gtttaagattacagaatttaaagaaag

SEQ ID NO: 79694 - DNA, 27 bp, Artificial sequence
  SiRNA target sequence
tttaagattacagaatttaaagaaagt

SEQ ID NO: 79695 - DNA, 27 bp, Artificial sequence
  SiRNA target sequence
ttaagattacagaatttaaagaaagta

SEQ ID NO: 79696 - DNA, 27 bp, Artificial sequence
  SiRNA target sequence
taagattacagaatttaaagaaagtat

SEQ ID NO: 79697 - DNA, 27 bp, Artificial sequence
  SiRNA target sequence
aagattacagaatttaaagaaagtatt

SEQ ID NO: 79698 - DNA, 27 bp, Artificial sequence
  SiRNA target sequence
agattacagaatttaaagaaagtatta

SEQ ID NO: 79699 - DNA, 27 bp, Artificial sequence
  SiRNA target sequence
gattacagaatttaaagaaagtattaa

SEQ ID NO: 79700 - DNA, 27 bp, Artificial sequence
  SiRNA target sequence
attacagaatttaaagaaagtattaag

SEQ ID NO: 79701 - DNA, 27 bp, Artificial sequence
  SiRNA target sequence
ttacagaatttaaagaaagtattaagt

SEQ ID NO: 79702 - DNA, 27 bp, Artificial sequence
  SiRNA target sequence
tacagaatttaaagaaagtattaagtt

SEQ ID NO: 79703 - DNA, 27 bp, Artificial sequence
  SiRNA target sequence
acagaatttaaagaaagtattaagttt

SEQ ID NO: 79704 - DNA, 27 bp, Artificial sequence
  SiRNA target sequence
cagaatttaaagaaagtattaagttta

SEQ ID NO: 79705 - DNA, 27 bp, Artificial sequence
  SiRNA target sequence
agaatttaaagaaagtattaagtttaa

SEQ ID NO: 79706 - DNA, 27 bp, Artificial sequence
  SiRNA target sequence
gaatttaaagaaagtattaagtttaat

SEQ ID NO: 79707 - DNA, 27 bp, Artificial sequence
  SiRNA target sequence
aatttaaagaaagtattaagtttaata

SEQ ID NO: 79708 - DNA, 27 bp, Artificial sequence
  SiRNA target sequence
atttaaagaaagtattaagtttaataa

SEQ ID NO: 79709 - DNA, 27 bp, Artificial sequence
  SiRNA target sequence
tttaaagaaagtattaagtttaataat

SEQ ID NO: 79710 - DNA, 27 bp, Artificial sequence
  SiRNA target sequence
ttaaagaaagtattaagtttaataatt

SEQ ID NO: 79711 - DNA, 27 bp, Artificial sequence
  SiRNA target sequence
taaagaaagtattaagtttaataattt

SEQ ID NO: 79712 - DNA, 27 bp, Artificial sequence
  SiRNA target sequence
aaagaaagtattaagtttaataatttg

SEQ ID NO: 79713 - DNA, 27 bp, Artificial sequence
  SiRNA target sequence
aagaaagtattaagtttaataatttgt

SEQ ID NO: 79714 - DNA, 27 bp, Artificial sequence
  SiRNA target sequence
agaaagtattaagtttaataatttgtc

SEQ ID NO: 79715 - DNA, 27 bp, Artificial sequence
  SiRNA target sequence
gaaagtattaagtttaataatttgtca

SEQ ID NO: 79716 - DNA, 27 bp, Artificial sequence
  SiRNA target sequence
aaagtattaagtttaataatttgtcat

SEQ ID NO: 79717 - DNA, 27 bp, Artificial sequence
  SiRNA target sequence
aagtattaagtttaataatttgtcatt

SEQ ID NO: 79718 - DNA, 27 bp, Artificial sequence
  SiRNA target sequence
agtattaagtttaataatttgtcattt

SEQ ID NO: 79719 - DNA, 27 bp, Artificial sequence
  SiRNA target sequence
gtattaagtttaataatttgtcatttg

SEQ ID NO: 79720 - DNA, 27 bp, Artificial sequence
  SiRNA target sequence
tattaagtttaataatttgtcatttgg

SEQ ID NO: 79721 - DNA, 27 bp, Artificial sequence
  SiRNA target sequence
attaagtttaataatttgtcatttggt

SEQ ID NO: 79722 - DNA, 27 bp, Artificial sequence
  SiRNA target sequence
ttaagtttaataatttgtcatttggtt

SEQ ID NO: 79723 - DNA, 27 bp, Artificial sequence
  SiRNA target sequence
taagtttaataatttgtcatttggtta

SEQ ID NO: 79724 - DNA, 27 bp, Artificial sequence
  SiRNA target sequence
aagtttaataatttgtcatttggttat

SEQ ID NO: 79725 - DNA, 27 bp, Artificial sequence
  SiRNA target sequence
agtttaataatttgtcatttggttatg

SEQ ID NO: 79726 - DNA, 27 bp, Artificial sequence
  SiRNA target sequence
gtttaataatttgtcatttggttatga

SEQ ID NO: 79727 - DNA, 27 bp, Artificial sequence
  SiRNA target sequence
tttaataatttgtcatttggttatgaa

SEQ ID NO: 79728 - DNA, 27 bp, Artificial sequence
  SiRNA target sequence
ttaataatttgtcatttggttatgaaa

SEQ ID NO: 79729 - DNA, 27 bp, Artificial sequence
  SiRNA target sequence
taataatttgtcatttggttatgaaag

SEQ ID NO: 79730 - DNA, 27 bp, Artificial sequence
  SiRNA target sequence
aataatttgtcatttggttatgaaagt

SEQ ID NO: 79731 - DNA, 27 bp, Artificial sequence
  SiRNA target sequence
ataatttgtcatttggttatgaaagta

SEQ ID NO: 79732 - DNA, 27 bp, Artificial sequence
  SiRNA target sequence
taatttgtcatttggttatgaaagtag

SEQ ID NO: 79733 - DNA, 27 bp, Artificial sequence
  SiRNA target sequence
aatttgtcatttggttatgaaagtaga

SEQ ID NO: 79734 - DNA, 27 bp, Artificial sequence
  SiRNA target sequence
atttgtcatttggttatgaaagtagac

SEQ ID NO: 79735 - DNA, 27 bp, Artificial sequence
  SiRNA target sequence
tttgtcatttggttatgaaagtagaca

SEQ ID NO: 79736 - DNA, 27 bp, Artificial sequence
  SiRNA target sequence
ttgtcatttggttatgaaagtagacaa

SEQ ID NO: 79737 - DNA, 27 bp, Artificial sequence
  SiRNA target sequence
tgtcatttggttatgaaagtagacaaa

SEQ ID NO: 79738 - DNA, 27 bp, Artificial sequence
  SiRNA target sequence
gtcatttggttatgaaagtagacaaat

SEQ ID NO: 79739 - DNA, 27 bp, Artificial sequence
  SiRNA target sequence
tcatttggttatgaaagtagacaaatt

SEQ ID NO: 79740 - DNA, 27 bp, Artificial sequence
  SiRNA target sequence
catttggttatgaaagtagacaaattt

SEQ ID NO: 79741 - DNA, 27 bp, Artificial sequence
  SiRNA target sequence
atttggttatgaaagtagacaaatttt

SEQ ID NO: 79742 - DNA, 27 bp, Artificial sequence
  SiRNA target sequence
tttggttatgaaagtagacaaattttt

SEQ ID NO: 79743 - DNA, 27 bp, Artificial sequence
  SiRNA target sequence
ttggttatgaaagtagacaaattttta

SEQ ID NO: 79744 - DNA, 27 bp, Artificial sequence
  SiRNA target sequence
tggttatgaaagtagacaaatttttaa

SEQ ID NO: 79745 - DNA, 27 bp, Artificial sequence
  SiRNA target sequence
ggttatgaaagtagacaaatttttaat

SEQ ID NO: 79746 - DNA, 27 bp, Artificial sequence
  SiRNA target sequence
gttatgaaagtagacaaatttttaata

SEQ ID NO: 79747 - DNA, 27 bp, Artificial sequence
  SiRNA target sequence
ttatgaaagtagacaaatttttaataa

SEQ ID NO: 79748 - DNA, 27 bp, Artificial sequence
  SiRNA target sequence
tatgaaagtagacaaatttttaataaa

SEQ ID NO: 79749 - DNA, 27 bp, Artificial sequence
  SiRNA target sequence
atgaaagtagacaaatttttaataaaa

SEQ ID NO: 79750 - DNA, 27 bp, Artificial sequence
  SiRNA target sequence
tgaaagtagacaaatttttaataaaat

SEQ ID NO: 79751 - DNA, 27 bp, Artificial sequence
  SiRNA target sequence
gaaagtagacaaatttttaataaaata

SEQ ID NO: 79752 - DNA, 27 bp, Artificial sequence
  SiRNA target sequence
aaagtagacaaatttttaataaaataa

SEQ ID NO: 79753 - DNA, 27 bp, Artificial sequence
  SiRNA target sequence
aagtagacaaatttttaataaaataaa

SEQ ID NO: 79754 - DNA, 27 bp, Artificial sequence
  SiRNA target sequence
agtagacaaatttttaataaaataaat

SEQ ID NO: 79755 - DNA, 27 bp, Artificial sequence
  SiRNA target sequence
gtagacaaatttttaataaaataaatc

SEQ ID NO: 79756 - DNA, 27 bp, Artificial sequence
  SiRNA target sequence
tagacaaatttttaataaaataaatct

SEQ ID NO: 79757 - DNA, 27 bp, Artificial sequence
  SiRNA target sequence
agacaaatttttaataaaataaatcta

SEQ ID NO: 79758 - DNA, 27 bp, Artificial sequence
  SiRNA target sequence
gacaaatttttaataaaataaatctag

SEQ ID NO: 79759 - DNA, 27 bp, Artificial sequence
  SiRNA target sequence
acaaatttttaataaaataaatctaga

SEQ ID NO: 79760 - DNA, 27 bp, Artificial sequence
  SiRNA target sequence
caaatttttaataaaataaatctagaa

SEQ ID NO: 79761 - DNA, 27 bp, Artificial sequence
  SiRNA target sequence
aaatttttaataaaataaatctagaaa

SEQ ID NO: 79762 - DNA, 27 bp, Artificial sequence
  SiRNA target sequence
aatttttaataaaataaatctagaaat

SEQ ID NO: 79763 - DNA, 27 bp, Artificial sequence
  SiRNA target sequence
atttttaataaaataaatctagaaata

SEQ ID NO: 79764 - DNA, 27 bp, Artificial sequence
  SiRNA target sequence
tttttaataaaataaatctagaaatat

SEQ ID NO: 79765 - DNA, 27 bp, Artificial sequence
  SiRNA target sequence
ttttaataaaataaatctagaaatata

SEQ ID NO: 79766 - DNA, 27 bp, Artificial sequence
  SiRNA target sequence
tttaataaaataaatctagaaatatac

SEQ ID NO: 79767 - DNA, 27 bp, Artificial sequence
  SiRNA target sequence
ttaataaaataaatctagaaatataca

SEQ ID NO: 79768 - DNA, 27 bp, Artificial sequence
  SiRNA target sequence
taataaaataaatctagaaatatacaa

SEQ ID NO: 79769 - DNA, 27 bp, Artificial sequence
  SiRNA target sequence
aataaaataaatctagaaatatacaaa

SEQ ID NO: 79770 - DNA, 27 bp, Artificial sequence
  SiRNA target sequence
ataaaataaatctagaaatatacaaag

SEQ ID NO: 79771 - DNA, 27 bp, Artificial sequence
  SiRNA target sequence
taaaataaatctagaaatatacaaagg

SEQ ID NO: 79772 - DNA, 27 bp, Artificial sequence
  SiRNA target sequence
aaaataaatctagaaatatacaaagga

SEQ ID NO: 79773 - DNA, 27 bp, Artificial sequence
  SiRNA target sequence
aaataaatctagaaatatacaaaggag

SEQ ID NO: 79774 - DNA, 27 bp, Artificial sequence
  SiRNA target sequence
aataaatctagaaatatacaaaggaga

SEQ ID NO: 79775 - DNA, 27 bp, Artificial sequence
  SiRNA target sequence
ataaatctagaaatatacaaaggagaa

SEQ ID NO: 79776 - DNA, 27 bp, Artificial sequence
  SiRNA target sequence
taaatctagaaatatacaaaggagaaa

SEQ ID NO: 79777 - DNA, 27 bp, Artificial sequence
  SiRNA target sequence
aaatctagaaatatacaaaggagaaaa

SEQ ID NO: 79778 - DNA, 27 bp, Artificial sequence
  SiRNA target sequence
aatctagaaatatacaaaggagaaaaa

SEQ ID NO: 79779 - DNA, 27 bp, Artificial sequence
  SiRNA target sequence
atctagaaatatacaaaggagaaaaag

SEQ ID NO: 79780 - DNA, 27 bp, Artificial sequence
  SiRNA target sequence
tctagaaatatacaaaggagaaaaagt

SEQ ID NO: 79781 - DNA, 27 bp, Artificial sequence
  SiRNA target sequence
ctagaaatatacaaaggagaaaaagta

SEQ ID NO: 79782 - DNA, 27 bp, Artificial sequence
  SiRNA target sequence
tagaaatatacaaaggagaaaaagtag

SEQ ID NO: 79783 - DNA, 27 bp, Artificial sequence
  SiRNA target sequence
agaaatatacaaaggagaaaaagtagc

SEQ ID NO: 79784 - DNA, 27 bp, Artificial sequence
  SiRNA target sequence
gaaatatacaaaggagaaaaagtagca

SEQ ID NO: 79785 - DNA, 27 bp, Artificial sequence
  SiRNA target sequence
aaatatacaaaggagaaaaagtagcaa

SEQ ID NO: 79786 - DNA, 27 bp, Artificial sequence
  SiRNA target sequence
aatatacaaaggagaaaaagtagcaat

SEQ ID NO: 79787 - DNA, 27 bp, Artificial sequence
  SiRNA target sequence
atatacaaaggagaaaaagtagcaatt

SEQ ID NO: 79788 - DNA, 27 bp, Artificial sequence
  SiRNA target sequence
tatacaaaggagaaaaagtagcaatta

SEQ ID NO: 79789 - DNA, 27 bp, Artificial sequence
  SiRNA target sequence
atacaaaggagaaaaagtagcaattat

SEQ ID NO: 79790 - DNA, 27 bp, Artificial sequence
  SiRNA target sequence
tacaaaggagaaaaagtagcaattata

SEQ ID NO: 79791 - DNA, 27 bp, Artificial sequence
  SiRNA target sequence
acaaaggagaaaaagtagcaattatag

SEQ ID NO: 79792 - DNA, 27 bp, Artificial sequence
  SiRNA target sequence
caaaggagaaaaagtagcaattatagg

SEQ ID NO: 79793 - DNA, 27 bp, Artificial sequence
  SiRNA target sequence
aaaggagaaaaagtagcaattataggt

SEQ ID NO: 79794 - DNA, 27 bp, Artificial sequence
  SiRNA target sequence
aaggagaaaaagtagcaattataggta

SEQ ID NO: 79795 - DNA, 27 bp, Artificial sequence
  SiRNA target sequence
aggagaaaaagtagcaattataggtaa

SEQ ID NO: 79796 - DNA, 27 bp, Artificial sequence
  SiRNA target sequence
ggagaaaaagtagcaattataggtaaa

SEQ ID NO: 79797 - DNA, 27 bp, Artificial sequence
  SiRNA target sequence
gagaaaaagtagcaattataggtaaaa

SEQ ID NO: 79798 - DNA, 27 bp, Artificial sequence
  SiRNA target sequence
agaaaaagtagcaattataggtaaaaa

SEQ ID NO: 79799 - DNA, 27 bp, Artificial sequence
  SiRNA target sequence
gaaaaagtagcaattataggtaaaaat

SEQ ID NO: 79800 - DNA, 27 bp, Artificial sequence
  SiRNA target sequence
aaaaagtagcaattataggtaaaaatg

SEQ ID NO: 79801 - DNA, 27 bp, Artificial sequence
  SiRNA target sequence
aaaagtagcaattataggtaaaaatgg

SEQ ID NO: 79802 - DNA, 27 bp, Artificial sequence
  SiRNA target sequence
aaagtagcaattataggtaaaaatggt

SEQ ID NO: 79803 - DNA, 27 bp, Artificial sequence
  SiRNA target sequence
aagtagcaattataggtaaaaatggta

SEQ ID NO: 79804 - DNA, 27 bp, Artificial sequence
  SiRNA target sequence
agtagcaattataggtaaaaatggtag

SEQ ID NO: 79805 - DNA, 27 bp, Artificial sequence
  SiRNA target sequence
gtagcaattataggtaaaaatggtagt

SEQ ID NO: 79806 - DNA, 27 bp, Artificial sequence
  SiRNA target sequence
tagcaattataggtaaaaatggtagtg

SEQ ID NO: 79807 - DNA, 27 bp, Artificial sequence
  SiRNA target sequence
agcaattataggtaaaaatggtagtgg

SEQ ID NO: 79808 - DNA, 27 bp, Artificial sequence
  SiRNA target sequence
gcaattataggtaaaaatggtagtggt

SEQ ID NO: 79809 - DNA, 27 bp, Artificial sequence
  SiRNA target sequence
caattataggtaaaaatggtagtggta

SEQ ID NO: 79810 - DNA, 27 bp, Artificial sequence
  SiRNA target sequence
aattataggtaaaaatggtagtggtaa

SEQ ID NO: 79811 - DNA, 27 bp, Artificial sequence
  SiRNA target sequence
attataggtaaaaatggtagtggtaaa

SEQ ID NO: 79812 - DNA, 27 bp, Artificial sequence
  SiRNA target sequence
ttataggtaaaaatggtagtggtaaat

SEQ ID NO: 79813 - DNA, 27 bp, Artificial sequence
  SiRNA target sequence
tataggtaaaaatggtagtggtaaatc

SEQ ID NO: 79814 - DNA, 27 bp, Artificial sequence
  SiRNA target sequence
ataggtaaaaatggtagtggtaaatca

SEQ ID NO: 79815 - DNA, 27 bp, Artificial sequence
  SiRNA target sequence
taggtaaaaatggtagtggtaaatcaa

SEQ ID NO: 79816 - DNA, 27 bp, Artificial sequence
  SiRNA target sequence
aggtaaaaatggtagtggtaaatcaac

SEQ ID NO: 79817 - DNA, 27 bp, Artificial sequence
  SiRNA target sequence
ggtaaaaatggtagtggtaaatcaaca

SEQ ID NO: 79818 - DNA, 27 bp, Artificial sequence
  SiRNA target sequence
gtaaaaatggtagtggtaaatcaacat

SEQ ID NO: 79819 - DNA, 27 bp, Artificial sequence
  SiRNA target sequence
taaaaatggtagtggtaaatcaacatt

SEQ ID NO: 79820 - DNA, 27 bp, Artificial sequence
  SiRNA target sequence
aaaaatggtagtggtaaatcaacatta

SEQ ID NO: 79821 - DNA, 27 bp, Artificial sequence
  SiRNA target sequence
aaaatggtagtggtaaatcaacattac

SEQ ID NO: 79822 - DNA, 27 bp, Artificial sequence
  SiRNA target sequence
aaatggtagtggtaaatcaacattact

SEQ ID NO: 79823 - DNA, 27 bp, Artificial sequence
  SiRNA target sequence
aatggtagtggtaaatcaacattacta

SEQ ID NO: 79824 - DNA, 27 bp, Artificial sequence
  SiRNA target sequence
atggtagtggtaaatcaacattactaa

SEQ ID NO: 79825 - DNA, 27 bp, Artificial sequence
  SiRNA target sequence
tggtagtggtaaatcaacattactaaa

SEQ ID NO: 79826 - DNA, 27 bp, Artificial sequence
  SiRNA target sequence
ggtagtggtaaatcaacattactaaaa

SEQ ID NO: 79827 - DNA, 27 bp, Artificial sequence
  SiRNA target sequence
gtagtggtaaatcaacattactaaaac

SEQ ID NO: 79828 - DNA, 27 bp, Artificial sequence
  SiRNA target sequence
tagtggtaaatcaacattactaaaact

SEQ ID NO: 79829 - DNA, 27 bp, Artificial sequence
  SiRNA target sequence
agtggtaaatcaacattactaaaacta

SEQ ID NO: 79830 - DNA, 27 bp, Artificial sequence
  SiRNA target sequence
gtggtaaatcaacattactaaaactac

SEQ ID NO: 79831 - DNA, 27 bp, Artificial sequence
  SiRNA target sequence
tggtaaatcaacattactaaaactact

SEQ ID NO: 79832 - DNA, 27 bp, Artificial sequence
  SiRNA target sequence
ggtaaatcaacattactaaaactactg

SEQ ID NO: 79833 - DNA, 27 bp, Artificial sequence
  SiRNA target sequence
gtaaatcaacattactaaaactactgc

SEQ ID NO: 79834 - DNA, 27 bp, Artificial sequence
  SiRNA target sequence
taaatcaacattactaaaactactgct

SEQ ID NO: 79835 - DNA, 27 bp, Artificial sequence
  SiRNA target sequence
aaatcaacattactaaaactactgctt

SEQ ID NO: 79836 - DNA, 27 bp, Artificial sequence
  SiRNA target sequence
aatcaacattactaaaactactgctta

SEQ ID NO: 79837 - DNA, 27 bp, Artificial sequence
  SiRNA target sequence
atcaacattactaaaactactgcttaa

SEQ ID NO: 79838 - DNA, 27 bp, Artificial sequence
  SiRNA target sequence
tcaacattactaaaactactgcttaaa

SEQ ID NO: 79839 - DNA, 27 bp, Artificial sequence
  SiRNA target sequence
caacattactaaaactactgcttaaat

SEQ ID NO: 79840 - DNA, 27 bp, Artificial sequence
  SiRNA target sequence
aacattactaaaactactgcttaaatt

SEQ ID NO: 79841 - DNA, 27 bp, Artificial sequence
  SiRNA target sequence
acattactaaaactactgcttaaattt

SEQ ID NO: 79842 - DNA, 27 bp, Artificial sequence
  SiRNA target sequence
cattactaaaactactgcttaaatttg

SEQ ID NO: 79843 - DNA, 27 bp, Artificial sequence
  SiRNA target sequence
attactaaaactactgcttaaatttga

SEQ ID NO: 79844 - DNA, 27 bp, Artificial sequence
  SiRNA target sequence
ttactaaaactactgcttaaatttgat

SEQ ID NO: 79845 - DNA, 27 bp, Artificial sequence
  SiRNA target sequence
tactaaaactactgcttaaatttgatg

SEQ ID NO: 79846 - DNA, 27 bp, Artificial sequence
  SiRNA target sequence
actaaaactactgcttaaatttgatga

SEQ ID NO: 79847 - DNA, 27 bp, Artificial sequence
  SiRNA target sequence
ctaaaactactgcttaaatttgatgaa

SEQ ID NO: 79848 - DNA, 27 bp, Artificial sequence
  SiRNA target sequence
taaaactactgcttaaatttgatgaag

SEQ ID NO: 79849 - DNA, 27 bp, Artificial sequence
  SiRNA target sequence
aaaactactgcttaaatttgatgaaga

SEQ ID NO: 79850 - DNA, 27 bp, Artificial sequence
  SiRNA target sequence
aaactactgcttaaatttgatgaagat

SEQ ID NO: 79851 - DNA, 27 bp, Artificial sequence
  SiRNA target sequence
aactactgcttaaatttgatgaagatt

SEQ ID NO: 79852 - DNA, 27 bp, Artificial sequence
  SiRNA target sequence
actactgcttaaatttgatgaagatta

SEQ ID NO: 79853 - DNA, 27 bp, Artificial sequence
  SiRNA target sequence
ctactgcttaaatttgatgaagattac

SEQ ID NO: 79854 - DNA, 27 bp, Artificial sequence
  SiRNA target sequence
tactgcttaaatttgatgaagattaca

SEQ ID NO: 79855 - DNA, 27 bp, Artificial sequence
  SiRNA target sequence
actgcttaaatttgatgaagattacaa

SEQ ID NO: 79856 - DNA, 27 bp, Artificial sequence
  SiRNA target sequence
ctgcttaaatttgatgaagattacaaa

SEQ ID NO: 79857 - DNA, 27 bp, Artificial sequence
  SiRNA target sequence
tgcttaaatttgatgaagattacaaag

SEQ ID NO: 79858 - DNA, 27 bp, Artificial sequence
  SiRNA target sequence
gcttaaatttgatgaagattacaaagg

SEQ ID NO: 79859 - DNA, 27 bp, Artificial sequence
  SiRNA target sequence
cttaaatttgatgaagattacaaaggt

SEQ ID NO: 79860 - DNA, 27 bp, Artificial sequence
  SiRNA target sequence
ttaaatttgatgaagattacaaaggta

SEQ ID NO: 79861 - DNA, 27 bp, Artificial sequence
  SiRNA target sequence
taaatttgatgaagattacaaaggtag

SEQ ID NO: 79862 - DNA, 27 bp, Artificial sequence
  SiRNA target sequence
aaatttgatgaagattacaaaggtagc

SEQ ID NO: 79863 - DNA, 27 bp, Artificial sequence
  SiRNA target sequence
aatttgatgaagattacaaaggtagca

SEQ ID NO: 79864 - DNA, 27 bp, Artificial sequence
  SiRNA target sequence
atttgatgaagattacaaaggtagcat

SEQ ID NO: 79865 - DNA, 27 bp, Artificial sequence
  SiRNA target sequence
tttgatgaagattacaaaggtagcatt

SEQ ID NO: 79866 - DNA, 27 bp, Artificial sequence
  SiRNA target sequence
ttgatgaagattacaaaggtagcattt

SEQ ID NO: 79867 - DNA, 27 bp, Artificial sequence
  SiRNA target sequence
tgatgaagattacaaaggtagcatttt

SEQ ID NO: 79868 - DNA, 27 bp, Artificial sequence
  SiRNA target sequence
gatgaagattacaaaggtagcatttta

SEQ ID NO: 79869 - DNA, 27 bp, Artificial sequence
  SiRNA target sequence
atgaagattacaaaggtagcattttaa

SEQ ID NO: 79870 - DNA, 27 bp, Artificial sequence
  SiRNA target sequence
tgaagattacaaaggtagcattttaat

SEQ ID NO: 79871 - DNA, 27 bp, Artificial sequence
  SiRNA target sequence
gaagattacaaaggtagcattttaata

SEQ ID NO: 79872 - DNA, 27 bp, Artificial sequence
  SiRNA target sequence
aagattacaaaggtagcattttaatag

SEQ ID NO: 79873 - DNA, 27 bp, Artificial sequence
  SiRNA target sequence
agattacaaaggtagcattttaataga

SEQ ID NO: 79874 - DNA, 27 bp, Artificial sequence
  SiRNA target sequence
gattacaaaggtagcattttaatagat

SEQ ID NO: 79875 - DNA, 27 bp, Artificial sequence
  SiRNA target sequence
attacaaaggtagcattttaatagatg

SEQ ID NO: 79876 - DNA, 27 bp, Artificial sequence
  SiRNA target sequence
ttacaaaggtagcattttaatagatga

SEQ ID NO: 79877 - DNA, 27 bp, Artificial sequence
  SiRNA target sequence
tacaaaggtagcattttaatagatgac

SEQ ID NO: 79878 - DNA, 27 bp, Artificial sequence
  SiRNA target sequence
acaaaggtagcattttaatagatgaca

SEQ ID NO: 79879 - DNA, 27 bp, Artificial sequence
  SiRNA target sequence
caaaggtagcattttaatagatgacat

SEQ ID NO: 79880 - DNA, 27 bp, Artificial sequence
  SiRNA target sequence
aaaggtagcattttaatagatgacatt

SEQ ID NO: 79881 - DNA, 27 bp, Artificial sequence
  SiRNA target sequence
aaggtagcattttaatagatgacattg

SEQ ID NO: 79882 - DNA, 27 bp, Artificial sequence
  SiRNA target sequence
aggtagcattttaatagatgacattga

SEQ ID NO: 79883 - DNA, 27 bp, Artificial sequence
  SiRNA target sequence
ggtagcattttaatagatgacattgat

SEQ ID NO: 79884 - DNA, 27 bp, Artificial sequence
  SiRNA target sequence
gtagcattttaatagatgacattgata

SEQ ID NO: 79885 - DNA, 27 bp, Artificial sequence
  SiRNA target sequence
tagcattttaatagatgacattgatat

SEQ ID NO: 79886 - DNA, 27 bp, Artificial sequence
  SiRNA target sequence
agcattttaatagatgacattgatatt

SEQ ID NO: 79887 - DNA, 27 bp, Artificial sequence
  SiRNA target sequence
gcattttaatagatgacattgatatta

SEQ ID NO: 79888 - DNA, 27 bp, Artificial sequence
  SiRNA target sequence
cattttaatagatgacattgatattaa

SEQ ID NO: 79889 - DNA, 27 bp, Artificial sequence
  SiRNA target sequence
attttaatagatgacattgatattaaa

SEQ ID NO: 79890 - DNA, 27 bp, Artificial sequence
  SiRNA target sequence
ttttaatagatgacattgatattaaaa

SEQ ID NO: 79891 - DNA, 27 bp, Artificial sequence
  SiRNA target sequence
tttaatagatgacattgatattaaaaa

SEQ ID NO: 79892 - DNA, 27 bp, Artificial sequence
  SiRNA target sequence
ttaatagatgacattgatattaaaaaa

SEQ ID NO: 79893 - DNA, 27 bp, Artificial sequence
  SiRNA target sequence
taatagatgacattgatattaaaaaaa

SEQ ID NO: 79894 - DNA, 27 bp, Artificial sequence
  SiRNA target sequence
aatagatgacattgatattaaaaaaat

SEQ ID NO: 79895 - DNA, 27 bp, Artificial sequence
  SiRNA target sequence
atagatgacattgatattaaaaaaatc

SEQ ID NO: 79896 - DNA, 27 bp, Artificial sequence
  SiRNA target sequence
tagatgacattgatattaaaaaaatca

SEQ ID NO: 79897 - DNA, 27 bp, Artificial sequence
  SiRNA target sequence
agatgacattgatattaaaaaaatcaa

SEQ ID NO: 79898 - DNA, 27 bp, Artificial sequence
  SiRNA target sequence
gatgacattgatattaaaaaaatcaaa

SEQ ID NO: 79899 - DNA, 27 bp, Artificial sequence
  SiRNA target sequence
atgacattgatattaaaaaaatcaaag

SEQ ID NO: 79900 - DNA, 27 bp, Artificial sequence
  SiRNA target sequence
tgacattgatattaaaaaaatcaaaga

SEQ ID NO: 79901 - DNA, 27 bp, Artificial sequence
  SiRNA target sequence
gacattgatattaaaaaaatcaaagac

SEQ ID NO: 79902 - DNA, 27 bp, Artificial sequence
  SiRNA target sequence
acattgatattaaaaaaatcaaagacg

SEQ ID NO: 79903 - DNA, 27 bp, Artificial sequence
  SiRNA target sequence
cattgatattaaaaaaatcaaagacga

SEQ ID NO: 79904 - DNA, 27 bp, Artificial sequence
  SiRNA target sequence
attgatattaaaaaaatcaaagacgaa

SEQ ID NO: 79905 - DNA, 27 bp, Artificial sequence
  SiRNA target sequence
ttgatattaaaaaaatcaaagacgaat

SEQ ID NO: 79906 - DNA, 27 bp, Artificial sequence
  SiRNA target sequence
tgatattaaaaaaatcaaagacgaatt

SEQ ID NO: 79907 - DNA, 27 bp, Artificial sequence
  SiRNA target sequence
gatattaaaaaaatcaaagacgaattt

SEQ ID NO: 79908 - DNA, 27 bp, Artificial sequence
  SiRNA target sequence
atattaaaaaaatcaaagacgaatttt

SEQ ID NO: 79909 - DNA, 27 bp, Artificial sequence
  SiRNA target sequence
tattaaaaaaatcaaagacgaatttta

SEQ ID NO: 79910 - DNA, 27 bp, Artificial sequence
  SiRNA target sequence
attaaaaaaatcaaagacgaattttat

SEQ ID NO: 79911 - DNA, 27 bp, Artificial sequence
  SiRNA target sequence
ttaaaaaaatcaaagacgaattttata

SEQ ID NO: 79912 - DNA, 27 bp, Artificial sequence
  SiRNA target sequence
taaaaaaatcaaagacgaattttatag

SEQ ID NO: 79913 - DNA, 27 bp, Artificial sequence
  SiRNA target sequence
aaaaaaatcaaagacgaattttatagg

SEQ ID NO: 79914 - DNA, 27 bp, Artificial sequence
  SiRNA target sequence
aaaaaatcaaagacgaattttatagga

SEQ ID NO: 79915 - DNA, 27 bp, Artificial sequence
  SiRNA target sequence
aaaaatcaaagacgaattttataggaa

SEQ ID NO: 79916 - DNA, 27 bp, Artificial sequence
  SiRNA target sequence
aaaatcaaagacgaattttataggaat

SEQ ID NO: 79917 - DNA, 27 bp, Artificial sequence
  SiRNA target sequence
aaatcaaagacgaattttataggaatt

SEQ ID NO: 79918 - DNA, 27 bp, Artificial sequence
  SiRNA target sequence
aatcaaagacgaattttataggaattt

SEQ ID NO: 79919 - DNA, 27 bp, Artificial sequence
  SiRNA target sequence
atcaaagacgaattttataggaattta

SEQ ID NO: 79920 - DNA, 27 bp, Artificial sequence
  SiRNA target sequence
tcaaagacgaattttataggaatttat

SEQ ID NO: 79921 - DNA, 27 bp, Artificial sequence
  SiRNA target sequence
caaagacgaattttataggaatttatt

SEQ ID NO: 79922 - DNA, 27 bp, Artificial sequence
  SiRNA target sequence
aaagacgaattttataggaatttatta

SEQ ID NO: 79923 - DNA, 27 bp, Artificial sequence
  SiRNA target sequence
aagacgaattttataggaatttattag

SEQ ID NO: 79924 - DNA, 27 bp, Artificial sequence
  SiRNA target sequence
agacgaattttataggaatttattagg

SEQ ID NO: 79925 - DNA, 27 bp, Artificial sequence
  SiRNA target sequence
gacgaattttataggaatttattaggt

SEQ ID NO: 79926 - DNA, 27 bp, Artificial sequence
  SiRNA target sequence
acgaattttataggaatttattaggtt

SEQ ID NO: 79927 - DNA, 27 bp, Artificial sequence
  SiRNA target sequence
cgaattttataggaatttattaggtta

SEQ ID NO: 79928 - DNA, 27 bp, Artificial sequence
  SiRNA target sequence
gaattttataggaatttattaggttac

SEQ ID NO: 79929 - DNA, 27 bp, Artificial sequence
  SiRNA target sequence
aattttataggaatttattaggttaca

SEQ ID NO: 79930 - DNA, 27 bp, Artificial sequence
  SiRNA target sequence
attttataggaatttattaggttacat

SEQ ID NO: 79931 - DNA, 27 bp, Artificial sequence
  SiRNA target sequence
ttttataggaatttattaggttacata

SEQ ID NO: 79932 - DNA, 27 bp, Artificial sequence
  SiRNA target sequence
tttataggaatttattaggttacatac

SEQ ID NO: 79933 - DNA, 27 bp, Artificial sequence
  SiRNA target sequence
ttataggaatttattaggttacatacc

SEQ ID NO: 79934 - DNA, 27 bp, Artificial sequence
  SiRNA target sequence
tataggaatttattaggttacatacca

SEQ ID NO: 79935 - DNA, 27 bp, Artificial sequence
  SiRNA target sequence
ataggaatttattaggttacataccac

SEQ ID NO: 79936 - DNA, 27 bp, Artificial sequence
  SiRNA target sequence
taggaatttattaggttacataccaca

SEQ ID NO: 79937 - DNA, 27 bp, Artificial sequence
  SiRNA target sequence
aggaatttattaggttacataccacag

SEQ ID NO: 79938 - DNA, 27 bp, Artificial sequence
  SiRNA target sequence
ggaatttattaggttacataccacaga

SEQ ID NO: 79939 - DNA, 27 bp, Artificial sequence
  SiRNA target sequence
gaatttattaggttacataccacagaa

SEQ ID NO: 79940 - DNA, 27 bp, Artificial sequence
  SiRNA target sequence
aatttattaggttacataccacagaat

SEQ ID NO: 79941 - DNA, 27 bp, Artificial sequence
  SiRNA target sequence
atttattaggttacataccacagaata

SEQ ID NO: 79942 - DNA, 27 bp, Artificial sequence
  SiRNA target sequence
tttattaggttacataccacagaatac

SEQ ID NO: 79943 - DNA, 27 bp, Artificial sequence
  SiRNA target sequence
ttattaggttacataccacagaataca

SEQ ID NO: 79944 - DNA, 27 bp, Artificial sequence
  SiRNA target sequence
tattaggttacataccacagaatacat

SEQ ID NO: 79945 - DNA, 27 bp, Artificial sequence
  SiRNA target sequence
attaggttacataccacagaatacatt

SEQ ID NO: 79946 - DNA, 27 bp, Artificial sequence
  SiRNA target sequence
ttaggttacataccacagaatacattt

SEQ ID NO: 79947 - DNA, 27 bp, Artificial sequence
  SiRNA target sequence
taggttacataccacagaatacatttt

SEQ ID NO: 79948 - DNA, 27 bp, Artificial sequence
  SiRNA target sequence
aggttacataccacagaatacattttt

SEQ ID NO: 79949 - DNA, 27 bp, Artificial sequence
  SiRNA target sequence
ggttacataccacagaatacatttttg

SEQ ID NO: 79950 - DNA, 27 bp, Artificial sequence
  SiRNA target sequence
gttacataccacagaatacatttttgt

SEQ ID NO: 79951 - DNA, 27 bp, Artificial sequence
  SiRNA target sequence
ttacataccacagaatacatttttgtt

SEQ ID NO: 79952 - DNA, 27 bp, Artificial sequence
  SiRNA target sequence
tacataccacagaatacatttttgttt

SEQ ID NO: 79953 - DNA, 27 bp, Artificial sequence
  SiRNA target sequence
acataccacagaatacatttttgttta

SEQ ID NO: 79954 - DNA, 27 bp, Artificial sequence
  SiRNA target sequence
cataccacagaatacatttttgtttaa

SEQ ID NO: 79955 - DNA, 27 bp, Artificial sequence
  SiRNA target sequence
ataccacagaatacatttttgtttaat

SEQ ID NO: 79956 - DNA, 27 bp, Artificial sequence
  SiRNA target sequence
taccacagaatacatttttgtttaatg

SEQ ID NO: 79957 - DNA, 27 bp, Artificial sequence
  SiRNA target sequence
accacagaatacatttttgtttaatga

SEQ ID NO: 79958 - DNA, 27 bp, Artificial sequence
  SiRNA target sequence
ccacagaatacatttttgtttaatgaa

SEQ ID NO: 79959 - DNA, 27 bp, Artificial sequence
  SiRNA target sequence
cacagaatacatttttgtttaatgaat

SEQ ID NO: 79960 - DNA, 27 bp, Artificial sequence
  SiRNA target sequence
acagaatacatttttgtttaatgaatc

SEQ ID NO: 79961 - DNA, 27 bp, Artificial sequence
  SiRNA target sequence
cagaatacatttttgtttaatgaatct

SEQ ID NO: 79962 - DNA, 27 bp, Artificial sequence
  SiRNA target sequence
agaatacatttttgtttaatgaatctg

SEQ ID NO: 79963 - DNA, 27 bp, Artificial sequence
  SiRNA target sequence
gaatacatttttgtttaatgaatctgt

SEQ ID NO: 79964 - DNA, 27 bp, Artificial sequence
  SiRNA target sequence
aatacatttttgtttaatgaatctgta

SEQ ID NO: 79965 - DNA, 27 bp, Artificial sequence
  SiRNA target sequence
atacatttttgtttaatgaatctgtaa

SEQ ID NO: 79966 - DNA, 27 bp, Artificial sequence
  SiRNA target sequence
tacatttttgtttaatgaatctgtaaa

SEQ ID NO: 79967 - DNA, 27 bp, Artificial sequence
  SiRNA target sequence
acatttttgtttaatgaatctgtaaaa

SEQ ID NO: 79968 - DNA, 27 bp, Artificial sequence
  SiRNA target sequence
catttttgtttaatgaatctgtaaaat

SEQ ID NO: 79969 - DNA, 27 bp, Artificial sequence
  SiRNA target sequence
atttttgtttaatgaatctgtaaaata

SEQ ID NO: 79970 - DNA, 27 bp, Artificial sequence
  SiRNA target sequence
tttttgtttaatgaatctgtaaaatat

SEQ ID NO: 79971 - DNA, 27 bp, Artificial sequence
  SiRNA target sequence
ttttgtttaatgaatctgtaaaatata

SEQ ID NO: 79972 - DNA, 27 bp, Artificial sequence
  SiRNA target sequence
tttgtttaatgaatctgtaaaatataa

SEQ ID NO: 79973 - DNA, 27 bp, Artificial sequence
  SiRNA target sequence
ttgtttaatgaatctgtaaaatataat

SEQ ID NO: 79974 - DNA, 27 bp, Artificial sequence
  SiRNA target sequence
tgtttaatgaatctgtaaaatataata

SEQ ID NO: 79975 - DNA, 27 bp, Artificial sequence
  SiRNA target sequence
gtttaatgaatctgtaaaatataatat

SEQ ID NO: 79976 - DNA, 27 bp, Artificial sequence
  SiRNA target sequence
tttaatgaatctgtaaaatataatatt

SEQ ID NO: 79977 - DNA, 27 bp, Artificial sequence
  SiRNA target sequence
ttaatgaatctgtaaaatataatatta

SEQ ID NO: 79978 - DNA, 27 bp, Artificial sequence
  SiRNA target sequence
taatgaatctgtaaaatataatattaa

SEQ ID NO: 79979 - DNA, 27 bp, Artificial sequence
  SiRNA target sequence
aatgaatctgtaaaatataatattaaa

SEQ ID NO: 79980 - DNA, 27 bp, Artificial sequence
  SiRNA target sequence
atgaatctgtaaaatataatattaaat

SEQ ID NO: 79981 - DNA, 27 bp, Artificial sequence
  SiRNA target sequence
tgaatctgtaaaatataatattaaata

SEQ ID NO: 79982 - DNA, 27 bp, Artificial sequence
  SiRNA target sequence
gaatctgtaaaatataatattaaatac

SEQ ID NO: 79983 - DNA, 27 bp, Artificial sequence
  SiRNA target sequence
aatctgtaaaatataatattaaatacg

SEQ ID NO: 79984 - DNA, 27 bp, Artificial sequence
  SiRNA target sequence
atctgtaaaatataatattaaatacgg

SEQ ID NO: 79985 - DNA, 27 bp, Artificial sequence
  SiRNA target sequence
tctgtaaaatataatattaaatacgga

SEQ ID NO: 79986 - DNA, 27 bp, Artificial sequence
  SiRNA target sequence
ctgtaaaatataatattaaatacggat

SEQ ID NO: 79987 - DNA, 27 bp, Artificial sequence
  SiRNA target sequence
tgtaaaatataatattaaatacggatc

SEQ ID NO: 79988 - DNA, 27 bp, Artificial sequence
  SiRNA target sequence
gtaaaatataatattaaatacggatct

SEQ ID NO: 79989 - DNA, 27 bp, Artificial sequence
  SiRNA target sequence
taaaatataatattaaatacggatctt

SEQ ID NO: 79990 - DNA, 27 bp, Artificial sequence
  SiRNA target sequence
aaaatataatattaaatacggatcttt

SEQ ID NO: 79991 - DNA, 27 bp, Artificial sequence
  SiRNA target sequence
aaatataatattaaatacggatctttt

SEQ ID NO: 79992 - DNA, 27 bp, Artificial sequence
  SiRNA target sequence
aatataatattaaatacggatcttttg

SEQ ID NO: 79993 - DNA, 27 bp, Artificial sequence
  SiRNA target sequence
atataatattaaatacggatcttttgg

SEQ ID NO: 79994 - DNA, 27 bp, Artificial sequence
  SiRNA target sequence
tataatattaaatacggatcttttggt

SEQ ID NO: 79995 - DNA, 27 bp, Artificial sequence
  SiRNA target sequence
ataatattaaatacggatcttttggta

SEQ ID NO: 79996 - DNA, 27 bp, Artificial sequence
  SiRNA target sequence
taatattaaatacggatcttttggtat

SEQ ID NO: 79997 - DNA, 27 bp, Artificial sequence
  SiRNA target sequence
aatattaaatacggatcttttggtatt

SEQ ID NO: 79998 - DNA, 27 bp, Artificial sequence
  SiRNA target sequence
atattaaatacggatcttttggtattt

SEQ ID NO: 79999 - DNA, 27 bp, Artificial sequence
  SiRNA target sequence
tattaaatacggatcttttggtatttc

SEQ ID NO: 80000 - DNA, 27 bp, Artificial sequence
  SiRNA target sequence
attaaatacggatcttttggtatttca

SEQ ID NO: 80001 - DNA, 27 bp, Artificial sequence
  SiRNA target sequence
ttaaatacggatcttttggtatttcag

SEQ ID NO: 80002 - DNA, 27 bp, Artificial sequence
  SiRNA target sequence
taaatacggatcttttggtatttcaga

SEQ ID NO: 80003 - DNA, 27 bp, Artificial sequence
  SiRNA target sequence
aaatacggatcttttggtatttcagac

SEQ ID NO: 80004 - DNA, 27 bp, Artificial sequence
  SiRNA target sequence
aatacggatcttttggtatttcagacg

SEQ ID NO: 80005 - DNA, 27 bp, Artificial sequence
  SiRNA target sequence
atacggatcttttggtatttcagacga

SEQ ID NO: 80006 - DNA, 27 bp, Artificial sequence
  SiRNA target sequence
tacggatcttttggtatttcagacgag

SEQ ID NO: 80007 - DNA, 27 bp, Artificial sequence
  SiRNA target sequence
acggatcttttggtatttcagacgagg

SEQ ID NO: 80008 - DNA, 27 bp, Artificial sequence
  SiRNA target sequence
cggatcttttggtatttcagacgagga

SEQ ID NO: 80009 - DNA, 27 bp, Artificial sequence
  SiRNA target sequence
ggatcttttggtatttcagacgaggat

SEQ ID NO: 80010 - DNA, 27 bp, Artificial sequence
  SiRNA target sequence
gatcttttggtatttcagacgaggata

SEQ ID NO: 80011 - DNA, 27 bp, Artificial sequence
  SiRNA target sequence
atcttttggtatttcagacgaggatat

SEQ ID NO: 80012 - DNA, 27 bp, Artificial sequence
  SiRNA target sequence
tcttttggtatttcagacgaggatatt

SEQ ID NO: 80013 - DNA, 27 bp, Artificial sequence
  SiRNA target sequence
cttttggtatttcagacgaggatattt

SEQ ID NO: 80014 - DNA, 27 bp, Artificial sequence
  SiRNA target sequence
ttttggtatttcagacgaggatatttt

SEQ ID NO: 80015 - DNA, 27 bp, Artificial sequence
  SiRNA target sequence
tttggtatttcagacgaggatattttt

SEQ ID NO: 80016 - DNA, 27 bp, Artificial sequence
  SiRNA target sequence
ttggtatttcagacgaggatatttttg

SEQ ID NO: 80017 - DNA, 27 bp, Artificial sequence
  SiRNA target sequence
tggtatttcagacgaggatatttttgc

SEQ ID NO: 80018 - DNA, 27 bp, Artificial sequence
  SiRNA target sequence
ggtatttcagacgaggatatttttgca

SEQ ID NO: 80019 - DNA, 27 bp, Artificial sequence
  SiRNA target sequence
gtatttcagacgaggatatttttgcat

SEQ ID NO: 80020 - DNA, 27 bp, Artificial sequence
  SiRNA target sequence
tatttcagacgaggatatttttgcatt

SEQ ID NO: 80021 - DNA, 27 bp, Artificial sequence
  SiRNA target sequence
atttcagacgaggatatttttgcattg

SEQ ID NO: 80022 - DNA, 27 bp, Artificial sequence
  SiRNA target sequence
tttcagacgaggatatttttgcattgt

SEQ ID NO: 80023 - DNA, 27 bp, Artificial sequence
  SiRNA target sequence
ttcagacgaggatatttttgcattgtg

SEQ ID NO: 80024 - DNA, 27 bp, Artificial sequence
  SiRNA target sequence
tcagacgaggatatttttgcattgtgt

SEQ ID NO: 80025 - DNA, 27 bp, Artificial sequence
  SiRNA target sequence
cagacgaggatatttttgcattgtgta

SEQ ID NO: 80026 - DNA, 27 bp, Artificial sequence
  SiRNA target sequence
agacgaggatatttttgcattgtgtaa

SEQ ID NO: 80027 - DNA, 27 bp, Artificial sequence
  SiRNA target sequence
gacgaggatatttttgcattgtgtaaa

SEQ ID NO: 80028 - DNA, 27 bp, Artificial sequence
  SiRNA target sequence
acgaggatatttttgcattgtgtaaag

SEQ ID NO: 80029 - DNA, 27 bp, Artificial sequence
  SiRNA target sequence
cgaggatatttttgcattgtgtaaaga

SEQ ID NO: 80030 - DNA, 27 bp, Artificial sequence
  SiRNA target sequence
gaggatatttttgcattgtgtaaagag

SEQ ID NO: 80031 - DNA, 27 bp, Artificial sequence
  SiRNA target sequence
aggatatttttgcattgtgtaaagagt

SEQ ID NO: 80032 - DNA, 27 bp, Artificial sequence
  SiRNA target sequence
ggatatttttgcattgtgtaaagagtt

SEQ ID NO: 80033 - DNA, 27 bp, Artificial sequence
  SiRNA target sequence
gatatttttgcattgtgtaaagagttt

SEQ ID NO: 80034 - DNA, 27 bp, Artificial sequence
  SiRNA target sequence
atatttttgcattgtgtaaagagtttg

SEQ ID NO: 80035 - DNA, 27 bp, Artificial sequence
  SiRNA target sequence
tatttttgcattgtgtaaagagtttgg

SEQ ID NO: 80036 - DNA, 27 bp, Artificial sequence
  SiRNA target sequence
atttttgcattgtgtaaagagtttgga

SEQ ID NO: 80037 - DNA, 27 bp, Artificial sequence
  SiRNA target sequence
tttttgcattgtgtaaagagtttggat

SEQ ID NO: 80038 - DNA, 27 bp, Artificial sequence
  SiRNA target sequence
ttttgcattgtgtaaagagtttggatt

SEQ ID NO: 80039 - DNA, 27 bp, Artificial sequence
  SiRNA target sequence
tttgcattgtgtaaagagtttggatta

SEQ ID NO: 80040 - DNA, 27 bp, Artificial sequence
  SiRNA target sequence
ttgcattgtgtaaagagtttggattat

SEQ ID NO: 80041 - DNA, 27 bp, Artificial sequence
  SiRNA target sequence
tgcattgtgtaaagagtttggattata

SEQ ID NO: 80042 - DNA, 27 bp, Artificial sequence
  SiRNA target sequence
gcattgtgtaaagagtttggattatat

SEQ ID NO: 80043 - DNA, 27 bp, Artificial sequence
  SiRNA target sequence
cattgtgtaaagagtttggattatatg

SEQ ID NO: 80044 - DNA, 27 bp, Artificial sequence
  SiRNA target sequence
attgtgtaaagagtttggattatatga

SEQ ID NO: 80045 - DNA, 27 bp, Artificial sequence
  SiRNA target sequence
ttgtgtaaagagtttggattatatgac

SEQ ID NO: 80046 - DNA, 27 bp, Artificial sequence
  SiRNA target sequence
tgtgtaaagagtttggattatatgacg

SEQ ID NO: 80047 - DNA, 27 bp, Artificial sequence
  SiRNA target sequence
gtgtaaagagtttggattatatgacgt

SEQ ID NO: 80048 - DNA, 27 bp, Artificial sequence
  SiRNA target sequence
tgtaaagagtttggattatatgacgtt

SEQ ID NO: 80049 - DNA, 27 bp, Artificial sequence
  SiRNA target sequence
gtaaagagtttggattatatgacgttt

SEQ ID NO: 80050 - DNA, 27 bp, Artificial sequence
  SiRNA target sequence
taaagagtttggattatatgacgtttt

SEQ ID NO: 80051 - DNA, 27 bp, Artificial sequence
  SiRNA target sequence
aaagagtttggattatatgacgttttc

SEQ ID NO: 80052 - DNA, 27 bp, Artificial sequence
  SiRNA target sequence
aagagtttggattatatgacgttttca

SEQ ID NO: 80053 - DNA, 27 bp, Artificial sequence
  SiRNA target sequence
agagtttggattatatgacgttttcat

SEQ ID NO: 80054 - DNA, 27 bp, Artificial sequence
  SiRNA target sequence
gagtttggattatatgacgttttcatg

SEQ ID NO: 80055 - DNA, 27 bp, Artificial sequence
  SiRNA target sequence
agtttggattatatgacgttttcatga

SEQ ID NO: 80056 - DNA, 27 bp, Artificial sequence
  SiRNA target sequence
gtttggattatatgacgttttcatgaa

SEQ ID NO: 80057 - DNA, 27 bp, Artificial sequence
  SiRNA target sequence
tttggattatatgacgttttcatgaac

SEQ ID NO: 80058 - DNA, 27 bp, Artificial sequence
  SiRNA target sequence
ttggattatatgacgttttcatgaacc

SEQ ID NO: 80059 - DNA, 27 bp, Artificial sequence
  SiRNA target sequence
tggattatatgacgttttcatgaacct

SEQ ID NO: 80060 - DNA, 27 bp, Artificial sequence
  SiRNA target sequence
ggattatatgacgttttcatgaacctc

SEQ ID NO: 80061 - DNA, 27 bp, Artificial sequence
  SiRNA target sequence
gattatatgacgttttcatgaacctcg

SEQ ID NO: 80062 - DNA, 27 bp, Artificial sequence
  SiRNA target sequence
attatatgacgttttcatgaacctcga

SEQ ID NO: 80063 - DNA, 27 bp, Artificial sequence
  SiRNA target sequence
ttatatgacgttttcatgaacctcgaa

SEQ ID NO: 80064 - DNA, 27 bp, Artificial sequence
  SiRNA target sequence
tatatgacgttttcatgaacctcgaaa

SEQ ID NO: 80065 - DNA, 27 bp, Artificial sequence
  SiRNA target sequence
atatgacgttttcatgaacctcgaaaa

SEQ ID NO: 80066 - DNA, 27 bp, Artificial sequence
  SiRNA target sequence
tatgacgttttcatgaacctcgaaaat

SEQ ID NO: 80067 - DNA, 27 bp, Artificial sequence
  SiRNA target sequence
atgacgttttcatgaacctcgaaaatg

SEQ ID NO: 80068 - DNA, 27 bp, Artificial sequence
  SiRNA target sequence
tgacgttttcatgaacctcgaaaatgg

SEQ ID NO: 80069 - DNA, 27 bp, Artificial sequence
  SiRNA target sequence
gacgttttcatgaacctcgaaaatggt

SEQ ID NO: 80070 - DNA, 27 bp, Artificial sequence
  SiRNA target sequence
acgttttcatgaacctcgaaaatggtt

SEQ ID NO: 80071 - DNA, 27 bp, Artificial sequence
  SiRNA target sequence
cgttttcatgaacctcgaaaatggttt

SEQ ID NO: 80072 - DNA, 27 bp, Artificial sequence
  SiRNA target sequence
gttttcatgaacctcgaaaatggtttt

SEQ ID NO: 80073 - DNA, 27 bp, Artificial sequence
  SiRNA target sequence
ttttcatgaacctcgaaaatggttttg

SEQ ID NO: 80074 - DNA, 27 bp, Artificial sequence
  SiRNA target sequence
tttcatgaacctcgaaaatggttttga

SEQ ID NO: 80075 - DNA, 27 bp, Artificial sequence
  SiRNA target sequence
ttcatgaacctcgaaaatggttttgat

SEQ ID NO: 80076 - DNA, 27 bp, Artificial sequence
  SiRNA target sequence
tcatgaacctcgaaaatggttttgata

SEQ ID NO: 80077 - DNA, 27 bp, Artificial sequence
  SiRNA target sequence
catgaacctcgaaaatggttttgatac

SEQ ID NO: 80078 - DNA, 27 bp, Artificial sequence
  SiRNA target sequence
atgaacctcgaaaatggttttgatacg

SEQ ID NO: 80079 - DNA, 27 bp, Artificial sequence
  SiRNA target sequence
tgaacctcgaaaatggttttgatacga

SEQ ID NO: 80080 - DNA, 27 bp, Artificial sequence
  SiRNA target sequence
gaacctcgaaaatggttttgatacgaa

SEQ ID NO: 80081 - DNA, 27 bp, Artificial sequence
  SiRNA target sequence
aacctcgaaaatggttttgatacgaat

SEQ ID NO: 80082 - DNA, 27 bp, Artificial sequence
  SiRNA target sequence
acctcgaaaatggttttgatacgaatg

SEQ ID NO: 80083 - DNA, 27 bp, Artificial sequence
  SiRNA target sequence
cctcgaaaatggttttgatacgaatgt

SEQ ID NO: 80084 - DNA, 27 bp, Artificial sequence
  SiRNA target sequence
ctcgaaaatggttttgatacgaatgta

SEQ ID NO: 80085 - DNA, 27 bp, Artificial sequence
  SiRNA target sequence
tcgaaaatggttttgatacgaatgtag

SEQ ID NO: 80086 - DNA, 27 bp, Artificial sequence
  SiRNA target sequence
cgaaaatggttttgatacgaatgtagg

SEQ ID NO: 80087 - DNA, 27 bp, Artificial sequence
  SiRNA target sequence
gaaaatggttttgatacgaatgtagga

SEQ ID NO: 80088 - DNA, 27 bp, Artificial sequence
  SiRNA target sequence
aaaatggttttgatacgaatgtaggag

SEQ ID NO: 80089 - DNA, 27 bp, Artificial sequence
  SiRNA target sequence
aaatggttttgatacgaatgtaggaga

SEQ ID NO: 80090 - DNA, 27 bp, Artificial sequence
  SiRNA target sequence
aatggttttgatacgaatgtaggagaa

SEQ ID NO: 80091 - DNA, 27 bp, Artificial sequence
  SiRNA target sequence
atggttttgatacgaatgtaggagaaa

SEQ ID NO: 80092 - DNA, 27 bp, Artificial sequence
  SiRNA target sequence
tggttttgatacgaatgtaggagaaag

SEQ ID NO: 80093 - DNA, 27 bp, Artificial sequence
  SiRNA target sequence
ggttttgatacgaatgtaggagaaaga

SEQ ID NO: 80094 - DNA, 27 bp, Artificial sequence
  SiRNA target sequence
gttttgatacgaatgtaggagaaagag

SEQ ID NO: 80095 - DNA, 27 bp, Artificial sequence
  SiRNA target sequence
ttttgatacgaatgtaggagaaagagg

SEQ ID NO: 80096 - DNA, 27 bp, Artificial sequence
  SiRNA target sequence
tttgatacgaatgtaggagaaagagga

SEQ ID NO: 80097 - DNA, 27 bp, Artificial sequence
  SiRNA target sequence
ttgatacgaatgtaggagaaagaggaa

SEQ ID NO: 80098 - DNA, 27 bp, Artificial sequence
  SiRNA target sequence
tgatacgaatgtaggagaaagaggaag

SEQ ID NO: 80099 - DNA, 27 bp, Artificial sequence
  SiRNA target sequence
gatacgaatgtaggagaaagaggaagg

SEQ ID NO: 80100 - DNA, 27 bp, Artificial sequence
  SiRNA target sequence
atacgaatgtaggagaaagaggaaggt

SEQ ID NO: 80101 - DNA, 27 bp, Artificial sequence
  SiRNA target sequence
tacgaatgtaggagaaagaggaaggtt

SEQ ID NO: 80102 - DNA, 27 bp, Artificial sequence
  SiRNA target sequence
acgaatgtaggagaaagaggaaggtta

SEQ ID NO: 80103 - DNA, 27 bp, Artificial sequence
  SiRNA target sequence
cgaatgtaggagaaagaggaaggttat

SEQ ID NO: 80104 - DNA, 27 bp, Artificial sequence
  SiRNA target sequence
gaatgtaggagaaagaggaaggttatt

SEQ ID NO: 80105 - DNA, 27 bp, Artificial sequence
  SiRNA target sequence
aatgtaggagaaagaggaaggttatta

SEQ ID NO: 80106 - DNA, 27 bp, Artificial sequence
  SiRNA target sequence
atgtaggagaaagaggaaggttattaa

SEQ ID NO: 80107 - DNA, 27 bp, Artificial sequence
  SiRNA target sequence
tgtaggagaaagaggaaggttattaag

SEQ ID NO: 80108 - DNA, 27 bp, Artificial sequence
  SiRNA target sequence
gtaggagaaagaggaaggttattaagt

SEQ ID NO: 80109 - DNA, 27 bp, Artificial sequence
  SiRNA target sequence
taggagaaagaggaaggttattaagtg

SEQ ID NO: 80110 - DNA, 27 bp, Artificial sequence
  SiRNA target sequence
aggagaaagaggaaggttattaagtgg

SEQ ID NO: 80111 - DNA, 27 bp, Artificial sequence
  SiRNA target sequence
ggagaaagaggaaggttattaagtggt

SEQ ID NO: 80112 - DNA, 27 bp, Artificial sequence
  SiRNA target sequence
gagaaagaggaaggttattaagtggtg

SEQ ID NO: 80113 - DNA, 27 bp, Artificial sequence
  SiRNA target sequence
agaaagaggaaggttattaagtggtgg

SEQ ID NO: 80114 - DNA, 27 bp, Artificial sequence
  SiRNA target sequence
gaaagaggaaggttattaagtggtgga

SEQ ID NO: 80115 - DNA, 27 bp, Artificial sequence
  SiRNA target sequence
aaagaggaaggttattaagtggtggag

SEQ ID NO: 80116 - DNA, 27 bp, Artificial sequence
  SiRNA target sequence
aagaggaaggttattaagtggtggaga

SEQ ID NO: 80117 - DNA, 27 bp, Artificial sequence
  SiRNA target sequence
agaggaaggttattaagtggtggagaa

SEQ ID NO: 80118 - DNA, 27 bp, Artificial sequence
  SiRNA target sequence
gaggaaggttattaagtggtggagaaa

SEQ ID NO: 80119 - DNA, 27 bp, Artificial sequence
  SiRNA target sequence
aggaaggttattaagtggtggagaaaa

SEQ ID NO: 80120 - DNA, 27 bp, Artificial sequence
  SiRNA target sequence
ggaaggttattaagtggtggagaaaag

SEQ ID NO: 80121 - DNA, 27 bp, Artificial sequence
  SiRNA target sequence
gaaggttattaagtggtggagaaaagc

SEQ ID NO: 80122 - DNA, 27 bp, Artificial sequence
  SiRNA target sequence
aaggttattaagtggtggagaaaagca

SEQ ID NO: 80123 - DNA, 27 bp, Artificial sequence
  SiRNA target sequence
aggttattaagtggtggagaaaagcaa

SEQ ID NO: 80124 - DNA, 27 bp, Artificial sequence
  SiRNA target sequence
ggttattaagtggtggagaaaagcaaa

SEQ ID NO: 80125 - DNA, 27 bp, Artificial sequence
  SiRNA target sequence
gttattaagtggtggagaaaagcaaaa

SEQ ID NO: 80126 - DNA, 27 bp, Artificial sequence
  SiRNA target sequence
ttattaagtggtggagaaaagcaaaag

SEQ ID NO: 80127 - DNA, 27 bp, Artificial sequence
  SiRNA target sequence
tattaagtggtggagaaaagcaaaaga

SEQ ID NO: 80128 - DNA, 27 bp, Artificial sequence
  SiRNA target sequence
attaagtggtggagaaaagcaaaagat

SEQ ID NO: 80129 - DNA, 27 bp, Artificial sequence
  SiRNA target sequence
ttaagtggtggagaaaagcaaaagatt

SEQ ID NO: 80130 - DNA, 27 bp, Artificial sequence
  SiRNA target sequence
taagtggtggagaaaagcaaaagattt

SEQ ID NO: 80131 - DNA, 27 bp, Artificial sequence
  SiRNA target sequence
aagtggtggagaaaagcaaaagatttt

SEQ ID NO: 80132 - DNA, 27 bp, Artificial sequence
  SiRNA target sequence
agtggtggagaaaagcaaaagatttta

SEQ ID NO: 80133 - DNA, 27 bp, Artificial sequence
  SiRNA target sequence
gtggtggagaaaagcaaaagattttat

SEQ ID NO: 80134 - DNA, 27 bp, Artificial sequence
  SiRNA target sequence
tggtggagaaaagcaaaagattttatt

SEQ ID NO: 80135 - DNA, 27 bp, Artificial sequence
  SiRNA target sequence
ggtggagaaaagcaaaagattttatta

SEQ ID NO: 80136 - DNA, 27 bp, Artificial sequence
  SiRNA target sequence
gtggagaaaagcaaaagattttattaa

SEQ ID NO: 80137 - DNA, 27 bp, Artificial sequence
  SiRNA target sequence
tggagaaaagcaaaagattttattaat

SEQ ID NO: 80138 - DNA, 27 bp, Artificial sequence
  SiRNA target sequence
ggagaaaagcaaaagattttattaatg

SEQ ID NO: 80139 - DNA, 27 bp, Artificial sequence
  SiRNA target sequence
gagaaaagcaaaagattttattaatgc

SEQ ID NO: 80140 - DNA, 27 bp, Artificial sequence
  SiRNA target sequence
agaaaagcaaaagattttattaatgcg

SEQ ID NO: 80141 - DNA, 27 bp, Artificial sequence
  SiRNA target sequence
gaaaagcaaaagattttattaatgcgt

SEQ ID NO: 80142 - DNA, 27 bp, Artificial sequence
  SiRNA target sequence
aaaagcaaaagattttattaatgcgta

SEQ ID NO: 80143 - DNA, 27 bp, Artificial sequence
  SiRNA target sequence
aaagcaaaagattttattaatgcgtac

SEQ ID NO: 80144 - DNA, 27 bp, Artificial sequence
  SiRNA target sequence
aagcaaaagattttattaatgcgtact

SEQ ID NO: 80145 - DNA, 27 bp, Artificial sequence
  SiRNA target sequence
agcaaaagattttattaatgcgtacta

SEQ ID NO: 80146 - DNA, 27 bp, Artificial sequence
  SiRNA target sequence
gcaaaagattttattaatgcgtactat

SEQ ID NO: 80147 - DNA, 27 bp, Artificial sequence
  SiRNA target sequence
caaaagattttattaatgcgtactatg

SEQ ID NO: 80148 - DNA, 27 bp, Artificial sequence
  SiRNA target sequence
aaaagattttattaatgcgtactatgt

SEQ ID NO: 80149 - DNA, 27 bp, Artificial sequence
  SiRNA target sequence
aaagattttattaatgcgtactatgtt

SEQ ID NO: 80150 - DNA, 27 bp, Artificial sequence
  SiRNA target sequence
aagattttattaatgcgtactatgtta

SEQ ID NO: 80151 - DNA, 27 bp, Artificial sequence
  SiRNA target sequence
agattttattaatgcgtactatgttaa

SEQ ID NO: 80152 - DNA, 27 bp, Artificial sequence
  SiRNA target sequence
gattttattaatgcgtactatgttaag

SEQ ID NO: 80153 - DNA, 27 bp, Artificial sequence
  SiRNA target sequence
attttattaatgcgtactatgttaaga

SEQ ID NO: 80154 - DNA, 27 bp, Artificial sequence
  SiRNA target sequence
ttttattaatgcgtactatgttaagaa

SEQ ID NO: 80155 - DNA, 27 bp, Artificial sequence
  SiRNA target sequence
tttattaatgcgtactatgttaagaaa

SEQ ID NO: 80156 - DNA, 27 bp, Artificial sequence
  SiRNA target sequence
ttattaatgcgtactatgttaagaaac

SEQ ID NO: 80157 - DNA, 27 bp, Artificial sequence
  SiRNA target sequence
tattaatgcgtactatgttaagaaaca

SEQ ID NO: 80158 - DNA, 27 bp, Artificial sequence
  SiRNA target sequence
attaatgcgtactatgttaagaaacaa

SEQ ID NO: 80159 - DNA, 27 bp, Artificial sequence
  SiRNA target sequence
ttaatgcgtactatgttaagaaacaag

SEQ ID NO: 80160 - DNA, 27 bp, Artificial sequence
  SiRNA target sequence
taatgcgtactatgttaagaaacaagg

SEQ ID NO: 80161 - DNA, 27 bp, Artificial sequence
  SiRNA target sequence
aatgcgtactatgttaagaaacaagga

SEQ ID NO: 80162 - DNA, 27 bp, Artificial sequence
  SiRNA target sequence
atgcgtactatgttaagaaacaaggag

SEQ ID NO: 80163 - DNA, 27 bp, Artificial sequence
  SiRNA target sequence
tgcgtactatgttaagaaacaaggaga

SEQ ID NO: 80164 - DNA, 27 bp, Artificial sequence
  SiRNA target sequence
gcgtactatgttaagaaacaaggagat

SEQ ID NO: 80165 - DNA, 27 bp, Artificial sequence
  SiRNA target sequence
cgtactatgttaagaaacaaggagata

SEQ ID NO: 80166 - DNA, 27 bp, Artificial sequence
  SiRNA target sequence
gtactatgttaagaaacaaggagataa

SEQ ID NO: 80167 - DNA, 27 bp, Artificial sequence
  SiRNA target sequence
tactatgttaagaaacaaggagataat

SEQ ID NO: 80168 - DNA, 27 bp, Artificial sequence
  SiRNA target sequence
actatgttaagaaacaaggagataatg

SEQ ID NO: 80169 - DNA, 27 bp, Artificial sequence
  SiRNA target sequence
ctatgttaagaaacaaggagataatgg

SEQ ID NO: 80170 - DNA, 27 bp, Artificial sequence
  SiRNA target sequence
tatgttaagaaacaaggagataatggc

SEQ ID NO: 80171 - DNA, 27 bp, Artificial sequence
  SiRNA target sequence
atgttaagaaacaaggagataatggca

SEQ ID NO: 80172 - DNA, 27 bp, Artificial sequence
  SiRNA target sequence
tgttaagaaacaaggagataatggcat

SEQ ID NO: 80173 - DNA, 27 bp, Artificial sequence
  SiRNA target sequence
gttaagaaacaaggagataatggcatt

SEQ ID NO: 80174 - DNA, 27 bp, Artificial sequence
  SiRNA target sequence
ttaagaaacaaggagataatggcatta

SEQ ID NO: 80175 - DNA, 27 bp, Artificial sequence
  SiRNA target sequence
taagaaacaaggagataatggcattag

SEQ ID NO: 80176 - DNA, 27 bp, Artificial sequence
  SiRNA target sequence
aagaaacaaggagataatggcattaga

SEQ ID NO: 80177 - DNA, 27 bp, Artificial sequence
  SiRNA target sequence
agaaacaaggagataatggcattagat

SEQ ID NO: 80178 - DNA, 27 bp, Artificial sequence
  SiRNA target sequence
gaaacaaggagataatggcattagatg

SEQ ID NO: 80179 - DNA, 27 bp, Artificial sequence
  SiRNA target sequence
aaacaaggagataatggcattagatga

SEQ ID NO: 80180 - DNA, 27 bp, Artificial sequence
  SiRNA target sequence
aacaaggagataatggcattagatgaa

SEQ ID NO: 80181 - DNA, 27 bp, Artificial sequence
  SiRNA target sequence
acaaggagataatggcattagatgaac

SEQ ID NO: 80182 - DNA, 27 bp, Artificial sequence
  SiRNA target sequence
caaggagataatggcattagatgaacc

SEQ ID NO: 80183 - DNA, 27 bp, Artificial sequence
  SiRNA target sequence
aaggagataatggcattagatgaaccc

SEQ ID NO: 80184 - DNA, 27 bp, Artificial sequence
  SiRNA target sequence
aggagataatggcattagatgaaccca

SEQ ID NO: 80185 - DNA, 27 bp, Artificial sequence
  SiRNA target sequence
ggagataatggcattagatgaacccac

SEQ ID NO: 80186 - DNA, 27 bp, Artificial sequence
  SiRNA target sequence
gagataatggcattagatgaacccact

SEQ ID NO: 80187 - DNA, 27 bp, Artificial sequence
  SiRNA target sequence
agataatggcattagatgaacccactg

SEQ ID NO: 80188 - DNA, 27 bp, Artificial sequence
  SiRNA target sequence
gataatggcattagatgaacccactgc

SEQ ID NO: 80189 - DNA, 27 bp, Artificial sequence
  SiRNA target sequence
ataatggcattagatgaacccactgca

SEQ ID NO: 80190 - DNA, 27 bp, Artificial sequence
  SiRNA target sequence
taatggcattagatgaacccactgcag

SEQ ID NO: 80191 - DNA, 27 bp, Artificial sequence
  SiRNA target sequence
aatggcattagatgaacccactgcagc

SEQ ID NO: 80192 - DNA, 27 bp, Artificial sequence
  SiRNA target sequence
atggcattagatgaacccactgcagca

SEQ ID NO: 80193 - DNA, 27 bp, Artificial sequence
  SiRNA target sequence
tggcattagatgaacccactgcagcac

SEQ ID NO: 80194 - DNA, 27 bp, Artificial sequence
  SiRNA target sequence
ggcattagatgaacccactgcagcact

SEQ ID NO: 80195 - DNA, 27 bp, Artificial sequence
  SiRNA target sequence
gcattagatgaacccactgcagcactt

SEQ ID NO: 80196 - DNA, 27 bp, Artificial sequence
  SiRNA target sequence
cattagatgaacccactgcagcacttg

SEQ ID NO: 80197 - DNA, 27 bp, Artificial sequence
  SiRNA target sequence
attagatgaacccactgcagcacttga

SEQ ID NO: 80198 - DNA, 27 bp, Artificial sequence
  SiRNA target sequence
ttagatgaacccactgcagcacttgat

SEQ ID NO: 80199 - DNA, 27 bp, Artificial sequence
  SiRNA target sequence
tagatgaacccactgcagcacttgata

SEQ ID NO: 80200 - DNA, 27 bp, Artificial sequence
  SiRNA target sequence
agatgaacccactgcagcacttgataa

SEQ ID NO: 80201 - DNA, 27 bp, Artificial sequence
  SiRNA target sequence
gatgaacccactgcagcacttgataag

SEQ ID NO: 80202 - DNA, 27 bp, Artificial sequence
  SiRNA target sequence
atgaacccactgcagcacttgataagg

SEQ ID NO: 80203 - DNA, 27 bp, Artificial sequence
  SiRNA target sequence
tgaacccactgcagcacttgataagga

SEQ ID NO: 80204 - DNA, 27 bp, Artificial sequence
  SiRNA target sequence
gaacccactgcagcacttgataaggag

SEQ ID NO: 80205 - DNA, 27 bp, Artificial sequence
  SiRNA target sequence
aacccactgcagcacttgataaggagt

SEQ ID NO: 80206 - DNA, 27 bp, Artificial sequence
  SiRNA target sequence
acccactgcagcacttgataaggagtc

SEQ ID NO: 80207 - DNA, 27 bp, Artificial sequence
  SiRNA target sequence
cccactgcagcacttgataaggagtct

SEQ ID NO: 80208 - DNA, 27 bp, Artificial sequence
  SiRNA target sequence
ccactgcagcacttgataaggagtctg

SEQ ID NO: 80209 - DNA, 27 bp, Artificial sequence
  SiRNA target sequence
cactgcagcacttgataaggagtctga

SEQ ID NO: 80210 - DNA, 27 bp, Artificial sequence
  SiRNA target sequence
actgcagcacttgataaggagtctgaa

SEQ ID NO: 80211 - DNA, 27 bp, Artificial sequence
  SiRNA target sequence
ctgcagcacttgataaggagtctgaaa

SEQ ID NO: 80212 - DNA, 27 bp, Artificial sequence
  SiRNA target sequence
tgcagcacttgataaggagtctgaaaa

SEQ ID NO: 80213 - DNA, 27 bp, Artificial sequence
  SiRNA target sequence
gcagcacttgataaggagtctgaaaaa

SEQ ID NO: 80214 - DNA, 27 bp, Artificial sequence
  SiRNA target sequence
cagcacttgataaggagtctgaaaaaa

SEQ ID NO: 80215 - DNA, 27 bp, Artificial sequence
  SiRNA target sequence
agcacttgataaggagtctgaaaaaaa

SEQ ID NO: 80216 - DNA, 27 bp, Artificial sequence
  SiRNA target sequence
gcacttgataaggagtctgaaaaaaag

SEQ ID NO: 80217 - DNA, 27 bp, Artificial sequence
  SiRNA target sequence
cacttgataaggagtctgaaaaaaaga

SEQ ID NO: 80218 - DNA, 27 bp, Artificial sequence
  SiRNA target sequence
acttgataaggagtctgaaaaaaagat

SEQ ID NO: 80219 - DNA, 27 bp, Artificial sequence
  SiRNA target sequence
cttgataaggagtctgaaaaaaagatt

SEQ ID NO: 80220 - DNA, 27 bp, Artificial sequence
  SiRNA target sequence
ttgataaggagtctgaaaaaaagattt

SEQ ID NO: 80221 - DNA, 27 bp, Artificial sequence
  SiRNA target sequence
tgataaggagtctgaaaaaaagatttt

SEQ ID NO: 80222 - DNA, 27 bp, Artificial sequence
  SiRNA target sequence
gataaggagtctgaaaaaaagatttta

SEQ ID NO: 80223 - DNA, 27 bp, Artificial sequence
  SiRNA target sequence
ataaggagtctgaaaaaaagattttag

SEQ ID NO: 80224 - DNA, 27 bp, Artificial sequence
  SiRNA target sequence
taaggagtctgaaaaaaagattttaga

SEQ ID NO: 80225 - DNA, 27 bp, Artificial sequence
  SiRNA target sequence
aaggagtctgaaaaaaagattttagag

SEQ ID NO: 80226 - DNA, 27 bp, Artificial sequence
  SiRNA target sequence
aggagtctgaaaaaaagattttagaga

SEQ ID NO: 80227 - DNA, 27 bp, Artificial sequence
  SiRNA target sequence
ggagtctgaaaaaaagattttagagat

SEQ ID NO: 80228 - DNA, 27 bp, Artificial sequence
  SiRNA target sequence
gagtctgaaaaaaagattttagagata

SEQ ID NO: 80229 - DNA, 27 bp, Artificial sequence
  SiRNA target sequence
agtctgaaaaaaagattttagagataa

SEQ ID NO: 80230 - DNA, 27 bp, Artificial sequence
  SiRNA target sequence
gtctgaaaaaaagattttagagataat

SEQ ID NO: 80231 - DNA, 27 bp, Artificial sequence
  SiRNA target sequence
tctgaaaaaaagattttagagataatt

SEQ ID NO: 80232 - DNA, 27 bp, Artificial sequence
  SiRNA target sequence
ctgaaaaaaagattttagagataattt

SEQ ID NO: 80233 - DNA, 27 bp, Artificial sequence
  SiRNA target sequence
tgaaaaaaagattttagagataatttt

SEQ ID NO: 80234 - DNA, 27 bp, Artificial sequence
  SiRNA target sequence
gaaaaaaagattttagagataatttta

SEQ ID NO: 80235 - DNA, 27 bp, Artificial sequence
  SiRNA target sequence
aaaaaaagattttagagataattttac

SEQ ID NO: 80236 - DNA, 27 bp, Artificial sequence
  SiRNA target sequence
aaaaaagattttagagataattttaca

SEQ ID NO: 80237 - DNA, 27 bp, Artificial sequence
  SiRNA target sequence
aaaaagattttagagataattttacaa

SEQ ID NO: 80238 - DNA, 27 bp, Artificial sequence
  SiRNA target sequence
aaaagattttagagataattttacaac

SEQ ID NO: 80239 - DNA, 27 bp, Artificial sequence
  SiRNA target sequence
aaagattttagagataattttacaaca

SEQ ID NO: 80240 - DNA, 27 bp, Artificial sequence
  SiRNA target sequence
aagattttagagataattttacaacag

SEQ ID NO: 80241 - DNA, 27 bp, Artificial sequence
  SiRNA target sequence
agattttagagataattttacaacagg

SEQ ID NO: 80242 - DNA, 27 bp, Artificial sequence
  SiRNA target sequence
gattttagagataattttacaacagga

SEQ ID NO: 80243 - DNA, 27 bp, Artificial sequence
  SiRNA target sequence
attttagagataattttacaacaggaa

SEQ ID NO: 80244 - DNA, 27 bp, Artificial sequence
  SiRNA target sequence
ttttagagataattttacaacaggaag

SEQ ID NO: 80245 - DNA, 27 bp, Artificial sequence
  SiRNA target sequence
tttagagataattttacaacaggaaga

SEQ ID NO: 80246 - DNA, 27 bp, Artificial sequence
  SiRNA target sequence
ttagagataattttacaacaggaagat

SEQ ID NO: 80247 - DNA, 27 bp, Artificial sequence
  SiRNA target sequence
tagagataattttacaacaggaagatc

SEQ ID NO: 80248 - DNA, 27 bp, Artificial sequence
  SiRNA target sequence
agagataattttacaacaggaagatcg

SEQ ID NO: 80249 - DNA, 27 bp, Artificial sequence
  SiRNA target sequence
gagataattttacaacaggaagatcga

SEQ ID NO: 80250 - DNA, 27 bp, Artificial sequence
  SiRNA target sequence
agataattttacaacaggaagatcgaa

SEQ ID NO: 80251 - DNA, 27 bp, Artificial sequence
  SiRNA target sequence
gataattttacaacaggaagatcgaac

SEQ ID NO: 80252 - DNA, 27 bp, Artificial sequence
  SiRNA target sequence
ataattttacaacaggaagatcgaaca

SEQ ID NO: 80253 - DNA, 27 bp, Artificial sequence
  SiRNA target sequence
taattttacaacaggaagatcgaacag

SEQ ID NO: 80254 - DNA, 27 bp, Artificial sequence
  SiRNA target sequence
aattttacaacaggaagatcgaacagt

SEQ ID NO: 80255 - DNA, 27 bp, Artificial sequence
  SiRNA target sequence
attttacaacaggaagatcgaacagtt

SEQ ID NO: 80256 - DNA, 27 bp, Artificial sequence
  SiRNA target sequence
ttttacaacaggaagatcgaacagttt

SEQ ID NO: 80257 - DNA, 27 bp, Artificial sequence
  SiRNA target sequence
tttacaacaggaagatcgaacagtttt

SEQ ID NO: 80258 - DNA, 27 bp, Artificial sequence
  SiRNA target sequence
ttacaacaggaagatcgaacagttttg

SEQ ID NO: 80259 - DNA, 27 bp, Artificial sequence
  SiRNA target sequence
tacaacaggaagatcgaacagttttga

SEQ ID NO: 80260 - DNA, 27 bp, Artificial sequence
  SiRNA target sequence
acaacaggaagatcgaacagttttgat

SEQ ID NO: 80261 - DNA, 27 bp, Artificial sequence
  SiRNA target sequence
caacaggaagatcgaacagttttgatg

SEQ ID NO: 80262 - DNA, 27 bp, Artificial sequence
  SiRNA target sequence
aacaggaagatcgaacagttttgatga

SEQ ID NO: 80263 - DNA, 27 bp, Artificial sequence
  SiRNA target sequence
acaggaagatcgaacagttttgatgat

SEQ ID NO: 80264 - DNA, 27 bp, Artificial sequence
  SiRNA target sequence
caggaagatcgaacagttttgatgata

SEQ ID NO: 80265 - DNA, 27 bp, Artificial sequence
  SiRNA target sequence
aggaagatcgaacagttttgatgataa

SEQ ID NO: 80266 - DNA, 27 bp, Artificial sequence
  SiRNA target sequence
ggaagatcgaacagttttgatgataat

SEQ ID NO: 80267 - DNA, 27 bp, Artificial sequence
  SiRNA target sequence
gaagatcgaacagttttgatgataatt

SEQ ID NO: 80268 - DNA, 27 bp, Artificial sequence
  SiRNA target sequence
aagatcgaacagttttgatgataattc

SEQ ID NO: 80269 - DNA, 27 bp, Artificial sequence
  SiRNA target sequence
agatcgaacagttttgatgataattca

SEQ ID NO: 80270 - DNA, 27 bp, Artificial sequence
  SiRNA target sequence
gatcgaacagttttgatgataattcat

SEQ ID NO: 80271 - DNA, 27 bp, Artificial sequence
  SiRNA target sequence
atcgaacagttttgatgataattcata

SEQ ID NO: 80272 - DNA, 27 bp, Artificial sequence
  SiRNA target sequence
tcgaacagttttgatgataattcataa

SEQ ID NO: 80273 - DNA, 27 bp, Artificial sequence
  SiRNA target sequence
cgaacagttttgatgataattcataat

SEQ ID NO: 80274 - DNA, 27 bp, Artificial sequence
  SiRNA target sequence
gaacagttttgatgataattcataatc

SEQ ID NO: 80275 - DNA, 27 bp, Artificial sequence
  SiRNA target sequence
aacagttttgatgataattcataatct

SEQ ID NO: 80276 - DNA, 27 bp, Artificial sequence
  SiRNA target sequence
acagttttgatgataattcataatcta

SEQ ID NO: 80277 - DNA, 27 bp, Artificial sequence
  SiRNA target sequence
cagttttgatgataattcataatctag

SEQ ID NO: 80278 - DNA, 27 bp, Artificial sequence
  SiRNA target sequence
agttttgatgataattcataatctaga

SEQ ID NO: 80279 - DNA, 27 bp, Artificial sequence
  SiRNA target sequence
gttttgatgataattcataatctagaa

SEQ ID NO: 80280 - DNA, 27 bp, Artificial sequence
  SiRNA target sequence
ttttgatgataattcataatctagaac

SEQ ID NO: 80281 - DNA, 27 bp, Artificial sequence
  SiRNA target sequence
tttgatgataattcataatctagaact

SEQ ID NO: 80282 - DNA, 27 bp, Artificial sequence
  SiRNA target sequence
ttgatgataattcataatctagaactt

SEQ ID NO: 80283 - DNA, 27 bp, Artificial sequence
  SiRNA target sequence
tgatgataattcataatctagaactta

SEQ ID NO: 80284 - DNA, 27 bp, Artificial sequence
  SiRNA target sequence
gatgataattcataatctagaacttat

SEQ ID NO: 80285 - DNA, 27 bp, Artificial sequence
  SiRNA target sequence
atgataattcataatctagaacttatt

SEQ ID NO: 80286 - DNA, 27 bp, Artificial sequence
  SiRNA target sequence
tgataattcataatctagaacttatta

SEQ ID NO: 80287 - DNA, 27 bp, Artificial sequence
  SiRNA target sequence
gataattcataatctagaacttattaa

SEQ ID NO: 80288 - DNA, 27 bp, Artificial sequence
  SiRNA target sequence
ataattcataatctagaacttattaat

SEQ ID NO: 80289 - DNA, 27 bp, Artificial sequence
  SiRNA target sequence
taattcataatctagaacttattaata

SEQ ID NO: 80290 - DNA, 27 bp, Artificial sequence
  SiRNA target sequence
aattcataatctagaacttattaataa

SEQ ID NO: 80291 - DNA, 27 bp, Artificial sequence
  SiRNA target sequence
attcataatctagaacttattaataaa

SEQ ID NO: 80292 - DNA, 27 bp, Artificial sequence
  SiRNA target sequence
ttcataatctagaacttattaataaat

SEQ ID NO: 80293 - DNA, 27 bp, Artificial sequence
  SiRNA target sequence
tcataatctagaacttattaataaatt

SEQ ID NO: 80294 - DNA, 27 bp, Artificial sequence
  SiRNA target sequence
cataatctagaacttattaataaattt

SEQ ID NO: 80295 - DNA, 27 bp, Artificial sequence
  SiRNA target sequence
ataatctagaacttattaataaatttg

SEQ ID NO: 80296 - DNA, 27 bp, Artificial sequence
  SiRNA target sequence
taatctagaacttattaataaatttga

SEQ ID NO: 80297 - DNA, 27 bp, Artificial sequence
  SiRNA target sequence
aatctagaacttattaataaatttgat

SEQ ID NO: 80298 - DNA, 27 bp, Artificial sequence
  SiRNA target sequence
atctagaacttattaataaatttgata

SEQ ID NO: 80299 - DNA, 27 bp, Artificial sequence
  SiRNA target sequence
tctagaacttattaataaatttgataa

SEQ ID NO: 80300 - DNA, 27 bp, Artificial sequence
  SiRNA target sequence
ctagaacttattaataaatttgataaa

SEQ ID NO: 80301 - DNA, 27 bp, Artificial sequence
  SiRNA target sequence
tagaacttattaataaatttgataaaa

SEQ ID NO: 80302 - DNA, 27 bp, Artificial sequence
  SiRNA target sequence
agaacttattaataaatttgataaaat

SEQ ID NO: 80303 - DNA, 27 bp, Artificial sequence
  SiRNA target sequence
gaacttattaataaatttgataaaata

SEQ ID NO: 80304 - DNA, 27 bp, Artificial sequence
  SiRNA target sequence
aacttattaataaatttgataaaataa

SEQ ID NO: 80305 - DNA, 27 bp, Artificial sequence
  SiRNA target sequence
acttattaataaatttgataaaataat

SEQ ID NO: 80306 - DNA, 27 bp, Artificial sequence
  SiRNA target sequence
cttattaataaatttgataaaataatt

SEQ ID NO: 80307 - DNA, 27 bp, Artificial sequence
  SiRNA target sequence
ttattaataaatttgataaaataattt

SEQ ID NO: 80308 - DNA, 27 bp, Artificial sequence
  SiRNA target sequence
tattaataaatttgataaaataattta

SEQ ID NO: 80309 - DNA, 27 bp, Artificial sequence
  SiRNA target sequence
attaataaatttgataaaataatttac

SEQ ID NO: 80310 - DNA, 27 bp, Artificial sequence
  SiRNA target sequence
ttaataaatttgataaaataatttaca

SEQ ID NO: 80311 - DNA, 27 bp, Artificial sequence
  SiRNA target sequence
taataaatttgataaaataatttacat

SEQ ID NO: 80312 - DNA, 27 bp, Artificial sequence
  SiRNA target sequence
aataaatttgataaaataatttacatt

SEQ ID NO: 80313 - DNA, 27 bp, Artificial sequence
  SiRNA target sequence
ataaatttgataaaataatttacattg

SEQ ID NO: 80314 - DNA, 27 bp, Artificial sequence
  SiRNA target sequence
taaatttgataaaataatttacattga

SEQ ID NO: 80315 - DNA, 27 bp, Artificial sequence
  SiRNA target sequence
aaatttgataaaataatttacattgat

SEQ ID NO: 80316 - DNA, 27 bp, Artificial sequence
  SiRNA target sequence
aatttgataaaataatttacattgatg

SEQ ID NO: 80317 - DNA, 27 bp, Artificial sequence
  SiRNA target sequence
atttgataaaataatttacattgatga

SEQ ID NO: 80318 - DNA, 27 bp, Artificial sequence
  SiRNA target sequence
tttgataaaataatttacattgatgaa

SEQ ID NO: 80319 - DNA, 27 bp, Artificial sequence
  SiRNA target sequence
ttgataaaataatttacattgatgaaa

SEQ ID NO: 80320 - DNA, 27 bp, Artificial sequence
  SiRNA target sequence
tgataaaataatttacattgatgaaaa

SEQ ID NO: 80321 - DNA, 27 bp, Artificial sequence
  SiRNA target sequence
gataaaataatttacattgatgaaaat

SEQ ID NO: 80322 - DNA, 27 bp, Artificial sequence
  SiRNA target sequence
ataaaataatttacattgatgaaaata

SEQ ID NO: 80323 - DNA, 27 bp, Artificial sequence
  SiRNA target sequence
taaaataatttacattgatgaaaataa

SEQ ID NO: 80324 - DNA, 27 bp, Artificial sequence
  SiRNA target sequence
aaaataatttacattgatgaaaataat

SEQ ID NO: 80325 - DNA, 27 bp, Artificial sequence
  SiRNA target sequence
aaataatttacattgatgaaaataata

SEQ ID NO: 80326 - DNA, 27 bp, Artificial sequence
  SiRNA target sequence
aataatttacattgatgaaaataatat

SEQ ID NO: 80327 - DNA, 27 bp, Artificial sequence
  SiRNA target sequence
ataatttacattgatgaaaataatata

SEQ ID NO: 80328 - DNA, 27 bp, Artificial sequence
  SiRNA target sequence
taatttacattgatgaaaataatatag

SEQ ID NO: 80329 - DNA, 27 bp, Artificial sequence
  SiRNA target sequence
aatttacattgatgaaaataatataga

SEQ ID NO: 80330 - DNA, 27 bp, Artificial sequence
  SiRNA target sequence
atttacattgatgaaaataatatagaa

SEQ ID NO: 80331 - DNA, 27 bp, Artificial sequence
  SiRNA target sequence
tttacattgatgaaaataatatagaag

SEQ ID NO: 80332 - DNA, 27 bp, Artificial sequence
  SiRNA target sequence
ttacattgatgaaaataatatagaagt

SEQ ID NO: 80333 - DNA, 27 bp, Artificial sequence
  SiRNA target sequence
tacattgatgaaaataatatagaagtc

SEQ ID NO: 80334 - DNA, 27 bp, Artificial sequence
  SiRNA target sequence
acattgatgaaaataatatagaagtct

SEQ ID NO: 80335 - DNA, 27 bp, Artificial sequence
  SiRNA target sequence
cattgatgaaaataatatagaagtcta

SEQ ID NO: 80336 - DNA, 27 bp, Artificial sequence
  SiRNA target sequence
attgatgaaaataatatagaagtctat

SEQ ID NO: 80337 - DNA, 27 bp, Artificial sequence
  SiRNA target sequence
ttgatgaaaataatatagaagtctata

SEQ ID NO: 80338 - DNA, 27 bp, Artificial sequence
  SiRNA target sequence
tgatgaaaataatatagaagtctataa

SEQ ID NO: 80339 - DNA, 27 bp, Artificial sequence
  SiRNA target sequence
gatgaaaataatatagaagtctataaa

SEQ ID NO: 80340 - DNA, 27 bp, Artificial sequence
  SiRNA target sequence
atgaaaataatatagaagtctataaaa

SEQ ID NO: 80341 - DNA, 27 bp, Artificial sequence
  SiRNA target sequence
tgaaaataatatagaagtctataaaaa

SEQ ID NO: 80342 - DNA, 27 bp, Artificial sequence
  SiRNA target sequence
gaaaataatatagaagtctataaaaat

SEQ ID NO: 80343 - DNA, 27 bp, Artificial sequence
  SiRNA target sequence
aaaataatatagaagtctataaaaatg

SEQ ID NO: 80344 - DNA, 27 bp, Artificial sequence
  SiRNA target sequence
aaataatatagaagtctataaaaatga

SEQ ID NO: 80345 - DNA, 27 bp, Artificial sequence
  SiRNA target sequence
aataatatagaagtctataaaaatgat

SEQ ID NO: 80346 - DNA, 27 bp, Artificial sequence
  SiRNA target sequence
ataatatagaagtctataaaaatgata

SEQ ID NO: 80347 - DNA, 27 bp, Artificial sequence
  SiRNA target sequence
taatatagaagtctataaaaatgatat

SEQ ID NO: 80348 - DNA, 27 bp, Artificial sequence
  SiRNA target sequence
aatatagaagtctataaaaatgatatt

SEQ ID NO: 80349 - DNA, 27 bp, Artificial sequence
  SiRNA target sequence
atatagaagtctataaaaatgatattg

SEQ ID NO: 80350 - DNA, 27 bp, Artificial sequence
  SiRNA target sequence
tatagaagtctataaaaatgatattga

SEQ ID NO: 80351 - DNA, 27 bp, Artificial sequence
  SiRNA target sequence
atagaagtctataaaaatgatattgaa

SEQ ID NO: 80352 - DNA, 27 bp, Artificial sequence
  SiRNA target sequence
tagaagtctataaaaatgatattgaag

SEQ ID NO: 80353 - DNA, 27 bp, Artificial sequence
  SiRNA target sequence
agaagtctataaaaatgatattgaagg

SEQ ID NO: 80354 - DNA, 27 bp, Artificial sequence
  SiRNA target sequence
gaagtctataaaaatgatattgaagga

SEQ ID NO: 80355 - DNA, 27 bp, Artificial sequence
  SiRNA target sequence
aagtctataaaaatgatattgaaggac

SEQ ID NO: 80356 - DNA, 27 bp, Artificial sequence
  SiRNA target sequence
agtctataaaaatgatattgaaggaca

SEQ ID NO: 80357 - DNA, 27 bp, Artificial sequence
  SiRNA target sequence
gtctataaaaatgatattgaaggacaa

SEQ ID NO: 80358 - DNA, 27 bp, Artificial sequence
  SiRNA target sequence
tctataaaaatgatattgaaggacaaa

SEQ ID NO: 80359 - DNA, 27 bp, Artificial sequence
  SiRNA target sequence
ctataaaaatgatattgaaggacaaaa

SEQ ID NO: 80360 - DNA, 27 bp, Artificial sequence
  SiRNA target sequence
tataaaaatgatattgaaggacaaaaa

SEQ ID NO: 80361 - DNA, 27 bp, Artificial sequence
  SiRNA target sequence
ataaaaatgatattgaaggacaaaaaa

SEQ ID NO: 80362 - DNA, 27 bp, Artificial sequence
  SiRNA target sequence
taaaaatgatattgaaggacaaaaaaa

SEQ ID NO: 80363 - DNA, 27 bp, Artificial sequence
  SiRNA target sequence
aaaaatgatattgaaggacaaaaaaag

SEQ ID NO: 80364 - DNA, 27 bp, Artificial sequence
  SiRNA target sequence
aaaatgatattgaaggacaaaaaaagt

SEQ ID NO: 80365 - DNA, 27 bp, Artificial sequence
  SiRNA target sequence
aaatgatattgaaggacaaaaaaagtt

SEQ ID NO: 80366 - DNA, 27 bp, Artificial sequence
  SiRNA target sequence
aatgatattgaaggacaaaaaaagttt

SEQ ID NO: 80367 - DNA, 27 bp, Artificial sequence
  SiRNA target sequence
atgatattgaaggacaaaaaaagtttt

SEQ ID NO: 80368 - DNA, 27 bp, Artificial sequence
  SiRNA target sequence
tgatattgaaggacaaaaaaagttttc

SEQ ID NO: 80369 - DNA, 27 bp, Artificial sequence
  SiRNA target sequence
gatattgaaggacaaaaaaagttttct

SEQ ID NO: 80370 - DNA, 27 bp, Artificial sequence
  SiRNA target sequence
atattgaaggacaaaaaaagttttcta

SEQ ID NO: 80371 - DNA, 27 bp, Artificial sequence
  SiRNA target sequence
tattgaaggacaaaaaaagttttctac

SEQ ID NO: 80372 - DNA, 27 bp, Artificial sequence
  SiRNA target sequence
attgaaggacaaaaaaagttttctaca

SEQ ID NO: 80373 - DNA, 27 bp, Artificial sequence
  SiRNA target sequence
ttgaaggacaaaaaaagttttctacaa

SEQ ID NO: 80374 - DNA, 27 bp, Artificial sequence
  SiRNA target sequence
tgaaggacaaaaaaagttttctacaaa

SEQ ID NO: 80375 - DNA, 27 bp, Artificial sequence
  SiRNA target sequence
gaaggacaaaaaaagttttctacaaat

SEQ ID NO: 80376 - DNA, 27 bp, Artificial sequence
  SiRNA target sequence
aaggacaaaaaaagttttctacaaatt

SEQ ID NO: 80377 - DNA, 27 bp, Artificial sequence
  SiRNA target sequence
aggacaaaaaaagttttctacaaattt

SEQ ID NO: 80378 - DNA, 27 bp, Artificial sequence
  SiRNA target sequence
ggacaaaaaaagttttctacaaattta

SEQ ID NO: 80379 - DNA, 27 bp, Artificial sequence
  SiRNA target sequence
gacaaaaaaagttttctacaaatttac

SEQ ID NO: 80380 - DNA, 27 bp, Artificial sequence
  SiRNA target sequence
acaaaaaaagttttctacaaatttaca

SEQ ID NO: 80381 - DNA, 27 bp, Artificial sequence
  SiRNA target sequence
caaaaaaagttttctacaaatttacaa

SEQ ID NO: 80382 - DNA, 27 bp, Artificial sequence
  SiRNA target sequence
aaaaaaagttttctacaaatttacaat

SEQ ID NO: 80383 - DNA, 27 bp, Artificial sequence
  SiRNA target sequence
aaaaaagttttctacaaatttacaata

SEQ ID NO: 80384 - DNA, 27 bp, Artificial sequence
  SiRNA target sequence
aaaaagttttctacaaatttacaatat

SEQ ID NO: 80385 - DNA, 27 bp, Artificial sequence
  SiRNA target sequence
aaaagttttctacaaatttacaatatt

SEQ ID NO: 80386 - DNA, 27 bp, Artificial sequence
  SiRNA target sequence
aaagttttctacaaatttacaatattt

SEQ ID NO: 80387 - DNA, 27 bp, Artificial sequence
  SiRNA target sequence
aagttttctacaaatttacaatatttt

SEQ ID NO: 80388 - DNA, 27 bp, Artificial sequence
  SiRNA target sequence
agttttctacaaatttacaatattttt

SEQ ID NO: 80389 - DNA, 27 bp, Artificial sequence
  SiRNA target sequence
gttttctacaaatttacaatatttttt

SEQ ID NO: 80390 - DNA, 27 bp, Artificial sequence
  SiRNA target sequence
ttttctacaaatttacaatatttttta

SEQ ID NO: 80391 - DNA, 27 bp, Artificial sequence
  SiRNA target sequence
tttctacaaatttacaatattttttat

SEQ ID NO: 80392 - DNA, 27 bp, Artificial sequence
  SiRNA target sequence
ttctacaaatttacaatattttttatc

SEQ ID NO: 80393 - DNA, 27 bp, Artificial sequence
  SiRNA target sequence
tctacaaatttacaatattttttatca

SEQ ID NO: 80394 - DNA, 27 bp, Artificial sequence
  SiRNA target sequence
ctacaaatttacaatattttttatcat

SEQ ID NO: 80395 - DNA, 27 bp, Artificial sequence
  SiRNA target sequence
tacaaatttacaatattttttatcata

SEQ ID NO: 80396 - DNA, 27 bp, Artificial sequence
  SiRNA target sequence
acaaatttacaatattttttatcatac

SEQ ID NO: 80397 - DNA, 27 bp, Artificial sequence
  SiRNA target sequence
caaatttacaatattttttatcataca

SEQ ID NO: 80398 - DNA, 27 bp, Artificial sequence
  SiRNA target sequence
aaatttacaatattttttatcatacaa

SEQ ID NO: 80399 - DNA, 27 bp, Artificial sequence
  SiRNA target sequence
aatttacaatattttttatcatacaaa

SEQ ID NO: 80400 - DNA, 27 bp, Artificial sequence
  SiRNA target sequence
atttacaatattttttatcatacaaat

SEQ ID NO: 80401 - DNA, 27 bp, Artificial sequence
  SiRNA target sequence
tttacaatattttttatcatacaaatt

SEQ ID NO: 80402 - DNA, 27 bp, Artificial sequence
  SiRNA target sequence
ttacaatattttttatcatacaaatta

SEQ ID NO: 80403 - DNA, 27 bp, Artificial sequence
  SiRNA target sequence
tacaatattttttatcatacaaattag

SEQ ID NO: 80404 - DNA, 27 bp, Artificial sequence
  SiRNA target sequence
acaatattttttatcatacaaattagg

SEQ ID NO: 80405 - DNA, 27 bp, Artificial sequence
  SiRNA target sequence
caatattttttatcatacaaattaggt

SEQ ID NO: 80406 - DNA, 27 bp, Artificial sequence
  SiRNA target sequence
aatattttttatcatacaaattaggta

SEQ ID NO: 80407 - DNA, 27 bp, Artificial sequence
  SiRNA target sequence
atattttttatcatacaaattaggtaa

SEQ ID NO: 80408 - DNA, 27 bp, Artificial sequence
  SiRNA target sequence
tattttttatcatacaaattaggtaaa

SEQ ID NO: 80409 - DNA, 27 bp, Artificial sequence
  SiRNA target sequence
attttttatcatacaaattaggtaaat

SEQ ID NO: 80410 - DNA, 27 bp, Artificial sequence
  SiRNA target sequence
ttttttatcatacaaattaggtaaata

SEQ ID NO: 80411 - DNA, 27 bp, Artificial sequence
  SiRNA target sequence
tttttatcatacaaattaggtaaataa

SEQ ID NO: 80412 - DNA, 19 bp, Artificial sequence
  SiRNA target sequence
ttattctggttcacaacca

SEQ ID NO: 80413 - DNA, 19 bp, Artificial sequence
  SiRNA target sequence
tattctggttcacaaccac

SEQ ID NO: 80414 - DNA, 19 bp, Artificial sequence
  SiRNA target sequence
attctggttcacaaccaca

SEQ ID NO: 80415 - DNA, 19 bp, Artificial sequence
  SiRNA target sequence
ttctggttcacaaccacaa

SEQ ID NO: 80416 - DNA, 19 bp, Artificial sequence
  SiRNA target sequence
tctggttcacaaccacaac

SEQ ID NO: 80417 - DNA, 19 bp, Artificial sequence
  SiRNA target sequence
ctggttcacaaccacaact

SEQ ID NO: 80418 - DNA, 19 bp, Artificial sequence
  SiRNA target sequence
tggttcacaaccacaactc

SEQ ID NO: 80419 - DNA, 19 bp, Artificial sequence
  SiRNA target sequence
ggttcacaaccacaactcc

SEQ ID NO: 80420 - DNA, 19 bp, Artificial sequence
  SiRNA target sequence
gttcacaaccacaactcca

SEQ ID NO: 80421 - DNA, 19 bp, Artificial sequence
  SiRNA target sequence
ttcacaaccacaactccaa

SEQ ID NO: 80422 - DNA, 19 bp, Artificial sequence
  SiRNA target sequence
tcacaaccacaactccaaa

SEQ ID NO: 80423 - DNA, 19 bp, Artificial sequence
  SiRNA target sequence
cacaaccacaactccaaac

SEQ ID NO: 80424 - DNA, 19 bp, Artificial sequence
  SiRNA target sequence
acaaccacaactccaaaca

SEQ ID NO: 80425 - DNA, 19 bp, Artificial sequence
  SiRNA target sequence
caaccacaactccaaacac

SEQ ID NO: 80426 - DNA, 19 bp, Artificial sequence
  SiRNA target sequence
aaccacaactccaaacacc

SEQ ID NO: 80427 - DNA, 19 bp, Artificial sequence
  SiRNA target sequence
accacaactccaaacacct

SEQ ID NO: 80428 - DNA, 19 bp, Artificial sequence
  SiRNA target sequence
ccacaactccaaacacctt

SEQ ID NO: 80429 - DNA, 19 bp, Artificial sequence
  SiRNA target sequence
cacaactccaaacaccttc

SEQ ID NO: 80430 - DNA, 19 bp, Artificial sequence
  SiRNA target sequence
acaactccaaacaccttct

SEQ ID NO: 80431 - DNA, 19 bp, Artificial sequence
  SiRNA target sequence
caactccaaacaccttcta

SEQ ID NO: 80432 - DNA, 19 bp, Artificial sequence
  SiRNA target sequence
aactccaaacaccttctac

SEQ ID NO: 80433 - DNA, 19 bp, Artificial sequence
  SiRNA target sequence
actccaaacaccttctacc

SEQ ID NO: 80434 - DNA, 19 bp, Artificial sequence
  SiRNA target sequence
ctccaaacaccttctacct

SEQ ID NO: 80435 - DNA, 19 bp, Artificial sequence
  SiRNA target sequence
tccaaacaccttctacctt

SEQ ID NO: 80436 - DNA, 19 bp, Artificial sequence
  SiRNA target sequence
ccaaacaccttctaccttt

SEQ ID NO: 80437 - DNA, 19 bp, Artificial sequence
  SiRNA target sequence
caaacaccttctacctttt

SEQ ID NO: 80438 - DNA, 19 bp, Artificial sequence
  SiRNA target sequence
aaacaccttctaccttttt

SEQ ID NO: 80439 - DNA, 19 bp, Artificial sequence
  SiRNA target sequence
aacaccttctaccttttta

SEQ ID NO: 80440 - DNA, 19 bp, Artificial sequence
  SiRNA target sequence
acaccttctacctttttac

SEQ ID NO: 80441 - DNA, 19 bp, Artificial sequence
  SiRNA target sequence
caccttctacctttttaca

SEQ ID NO: 80442 - DNA, 19 bp, Artificial sequence
  SiRNA target sequence
accttctacctttttacag

SEQ ID NO: 80443 - DNA, 19 bp, Artificial sequence
  SiRNA target sequence
ccttctacctttttacagt

SEQ ID NO: 80444 - DNA, 19 bp, Artificial sequence
  SiRNA target sequence
cttctacctttttacagtc

SEQ ID NO: 80445 - DNA, 19 bp, Artificial sequence
  SiRNA target sequence
ttctacctttttacagtcc

SEQ ID NO: 80446 - DNA, 19 bp, Artificial sequence
  SiRNA target sequence
tctacctttttacagtcca

SEQ ID NO: 80447 - DNA, 19 bp, Artificial sequence
  SiRNA target sequence
ctacctttttacagtccat

SEQ ID NO: 80448 - DNA, 19 bp, Artificial sequence
  SiRNA target sequence
tacctttttacagtccata

SEQ ID NO: 80449 - DNA, 19 bp, Artificial sequence
  SiRNA target sequence
acctttttacagtccataa

SEQ ID NO: 80450 - DNA, 19 bp, Artificial sequence
  SiRNA target sequence
cctttttacagtccataat

SEQ ID NO: 80451 - DNA, 19 bp, Artificial sequence
  SiRNA target sequence
ctttttacagtccataatg

SEQ ID NO: 80452 - DNA, 19 bp, Artificial sequence
  SiRNA target sequence
tttttacagtccataatgg

SEQ ID NO: 80453 - DNA, 19 bp, Artificial sequence
  SiRNA target sequence
ttttacagtccataatggg

SEQ ID NO: 80454 - DNA, 19 bp, Artificial sequence
  SiRNA target sequence
tttacagtccataatgggc

SEQ ID NO: 80455 - DNA, 19 bp, Artificial sequence
  SiRNA target sequence
ttacagtccataatgggct

SEQ ID NO: 80456 - DNA, 19 bp, Artificial sequence
  SiRNA target sequence
tacagtccataatgggctt

SEQ ID NO: 80457 - DNA, 19 bp, Artificial sequence
  SiRNA target sequence
acagtccataatgggcttt

SEQ ID NO: 80458 - DNA, 19 bp, Artificial sequence
  SiRNA target sequence
cagtccataatgggctttc

SEQ ID NO: 80459 - DNA, 19 bp, Artificial sequence
  SiRNA target sequence
agtccataatgggctttcc

SEQ ID NO: 80460 - DNA, 19 bp, Artificial sequence
  SiRNA target sequence
gtccataatgggctttcct

SEQ ID NO: 80461 - DNA, 19 bp, Artificial sequence
  SiRNA target sequence
tccataatgggctttccta

SEQ ID NO: 80462 - DNA, 19 bp, Artificial sequence
  SiRNA target sequence
ccataatgggctttcctaa

SEQ ID NO: 80463 - DNA, 19 bp, Artificial sequence
  SiRNA target sequence
cataatgggctttcctaat

SEQ ID NO: 80464 - DNA, 19 bp, Artificial sequence
  SiRNA target sequence
ataatgggctttcctaatc

SEQ ID NO: 80465 - DNA, 19 bp, Artificial sequence
  SiRNA target sequence
taatgggctttcctaatct

SEQ ID NO: 80466 - DNA, 19 bp, Artificial sequence
  SiRNA target sequence
aatgggctttcctaatctt

SEQ ID NO: 80467 - DNA, 19 bp, Artificial sequence
  SiRNA target sequence
atgggctttcctaatcttt

SEQ ID NO: 80468 - DNA, 19 bp, Artificial sequence
  SiRNA target sequence
tgggctttcctaatctttt

SEQ ID NO: 80469 - DNA, 19 bp, Artificial sequence
  SiRNA target sequence
gggctttcctaatctttta

SEQ ID NO: 80470 - DNA, 19 bp, Artificial sequence
  SiRNA target sequence
ggctttcctaatcttttat

SEQ ID NO: 80471 - DNA, 19 bp, Artificial sequence
  SiRNA target sequence
gctttcctaatcttttatt

SEQ ID NO: 80472 - DNA, 19 bp, Artificial sequence
  SiRNA target sequence
ctttcctaatcttttatta

SEQ ID NO: 80473 - DNA, 19 bp, Artificial sequence
  SiRNA target sequence
tttcctaatcttttattaa

SEQ ID NO: 80474 - DNA, 19 bp, Artificial sequence
  SiRNA target sequence
ttcctaatcttttattaac

SEQ ID NO: 80475 - DNA, 19 bp, Artificial sequence
  SiRNA target sequence
tcctaatcttttattaact

SEQ ID NO: 80476 - DNA, 19 bp, Artificial sequence
  SiRNA target sequence
cctaatcttttattaacta

SEQ ID NO: 80477 - DNA, 19 bp, Artificial sequence
  SiRNA target sequence
ctaatcttttattaactat

SEQ ID NO: 80478 - DNA, 19 bp, Artificial sequence
  SiRNA target sequence
taatcttttattaactatg

SEQ ID NO: 80479 - DNA, 19 bp, Artificial sequence
  SiRNA target sequence
aatcttttattaactatgt

SEQ ID NO: 80480 - DNA, 19 bp, Artificial sequence
  SiRNA target sequence
atcttttattaactatgtt

SEQ ID NO: 80481 - DNA, 19 bp, Artificial sequence
  SiRNA target sequence
tcttttattaactatgtta

SEQ ID NO: 80482 - DNA, 19 bp, Artificial sequence
  SiRNA target sequence
cttttattaactatgttat

SEQ ID NO: 80483 - DNA, 19 bp, Artificial sequence
  SiRNA target sequence
ttttattaactatgttatg

SEQ ID NO: 80484 - DNA, 19 bp, Artificial sequence
  SiRNA target sequence
tttattaactatgttatgt

SEQ ID NO: 80485 - DNA, 19 bp, Artificial sequence
  SiRNA target sequence
ttattaactatgttatgtg

SEQ ID NO: 80486 - DNA, 19 bp, Artificial sequence
  SiRNA target sequence
tattaactatgttatgtgc

SEQ ID NO: 80487 - DNA, 19 bp, Artificial sequence
  SiRNA target sequence
attaactatgttatgtgct

SEQ ID NO: 80488 - DNA, 19 bp, Artificial sequence
  SiRNA target sequence
ttaactatgttatgtgctt

SEQ ID NO: 80489 - DNA, 19 bp, Artificial sequence
  SiRNA target sequence
taactatgttatgtgcttt

SEQ ID NO: 80490 - DNA, 19 bp, Artificial sequence
  SiRNA target sequence
aactatgttatgtgcttta

SEQ ID NO: 80491 - DNA, 19 bp, Artificial sequence
  SiRNA target sequence
actatgttatgtgctttac

SEQ ID NO: 80492 - DNA, 19 bp, Artificial sequence
  SiRNA target sequence
ctatgttatgtgctttaca

SEQ ID NO: 80493 - DNA, 19 bp, Artificial sequence
  SiRNA target sequence
tatgttatgtgctttacat

SEQ ID NO: 80494 - DNA, 19 bp, Artificial sequence
  SiRNA target sequence
atgttatgtgctttacata

SEQ ID NO: 80495 - DNA, 19 bp, Artificial sequence
  SiRNA target sequence
tgttatgtgctttacatag

SEQ ID NO: 80496 - DNA, 19 bp, Artificial sequence
  SiRNA target sequence
gttatgtgctttacatagc

SEQ ID NO: 80497 - DNA, 19 bp, Artificial sequence
  SiRNA target sequence
ttatgtgctttacatagcc

SEQ ID NO: 80498 - DNA, 19 bp, Artificial sequence
  SiRNA target sequence
tatgtgctttacatagcca

SEQ ID NO: 80499 - DNA, 19 bp, Artificial sequence
  SiRNA target sequence
atgtgctttacatagccac

SEQ ID NO: 80500 - DNA, 19 bp, Artificial sequence
  SiRNA target sequence
tgtgctttacatagccact

SEQ ID NO: 80501 - DNA, 19 bp, Artificial sequence
  SiRNA target sequence
gtgctttacatagccactg

SEQ ID NO: 80502 - DNA, 19 bp, Artificial sequence
  SiRNA target sequence
tgctttacatagccactgg

SEQ ID NO: 80503 - DNA, 19 bp, Artificial sequence
  SiRNA target sequence
gctttacatagccactgga

SEQ ID NO: 80504 - DNA, 19 bp, Artificial sequence
  SiRNA target sequence
ctttacatagccactggac

SEQ ID NO: 80505 - DNA, 19 bp, Artificial sequence
  SiRNA target sequence
tttacatagccactggaca

SEQ ID NO: 80506 - DNA, 19 bp, Artificial sequence
  SiRNA target sequence
ttacatagccactggacaa

SEQ ID NO: 80507 - DNA, 19 bp, Artificial sequence
  SiRNA target sequence
tacatagccactggacaaa

SEQ ID NO: 80508 - DNA, 19 bp, Artificial sequence
  SiRNA target sequence
acatagccactggacaaat

SEQ ID NO: 80509 - DNA, 19 bp, Artificial sequence
  SiRNA target sequence
catagccactggacaaatt

SEQ ID NO: 80510 - DNA, 19 bp, Artificial sequence
  SiRNA target sequence
atagccactggacaaattc

SEQ ID NO: 80511 - DNA, 19 bp, Artificial sequence
  SiRNA target sequence
tagccactggacaaattcg

SEQ ID NO: 80512 - DNA, 19 bp, Artificial sequence
  SiRNA target sequence
agccactggacaaattcgt

SEQ ID NO: 80513 - DNA, 19 bp, Artificial sequence
  SiRNA target sequence
gccactggacaaattcgtc

SEQ ID NO: 80514 - DNA, 19 bp, Artificial sequence
  SiRNA target sequence
ccactggacaaattcgtca

SEQ ID NO: 80515 - DNA, 19 bp, Artificial sequence
  SiRNA target sequence
cactggacaaattcgtcat

SEQ ID NO: 80516 - DNA, 19 bp, Artificial sequence
  SiRNA target sequence
actggacaaattcgtcatg

SEQ ID NO: 80517 - DNA, 19 bp, Artificial sequence
  SiRNA target sequence
ctggacaaattcgtcatgt

SEQ ID NO: 80518 - DNA, 19 bp, Artificial sequence
  SiRNA target sequence
tggacaaattcgtcatgtg

SEQ ID NO: 80519 - DNA, 19 bp, Artificial sequence
  SiRNA target sequence
ggacaaattcgtcatgtgt

SEQ ID NO: 80520 - DNA, 19 bp, Artificial sequence
  SiRNA target sequence
gacaaattcgtcatgtgtg

SEQ ID NO: 80521 - DNA, 19 bp, Artificial sequence
  SiRNA target sequence
acaaattcgtcatgtgtgg

SEQ ID NO: 80522 - DNA, 19 bp, Artificial sequence
  SiRNA target sequence
caaattcgtcatgtgtggc

SEQ ID NO: 80523 - DNA, 19 bp, Artificial sequence
  SiRNA target sequence
aaattcgtcatgtgtggca

SEQ ID NO: 80524 - DNA, 19 bp, Artificial sequence
  SiRNA target sequence
aattcgtcatgtgtggcaa

SEQ ID NO: 80525 - DNA, 19 bp, Artificial sequence
  SiRNA target sequence
attcgtcatgtgtggcaac

SEQ ID NO: 80526 - DNA, 19 bp, Artificial sequence
  SiRNA target sequence
ttcgtcatgtgtggcaact

SEQ ID NO: 80527 - DNA, 19 bp, Artificial sequence
  SiRNA target sequence
tcgtcatgtgtggcaactt

SEQ ID NO: 80528 - DNA, 19 bp, Artificial sequence
  SiRNA target sequence
cgtcatgtgtggcaacttg

SEQ ID NO: 80529 - DNA, 19 bp, Artificial sequence
  SiRNA target sequence
gtcatgtgtggcaacttgt

SEQ ID NO: 80530 - DNA, 19 bp, Artificial sequence
  SiRNA target sequence
tcatgtgtggcaacttgtg

SEQ ID NO: 80531 - DNA, 19 bp, Artificial sequence
  SiRNA target sequence
catgtgtggcaacttgtgg

SEQ ID NO: 80532 - DNA, 19 bp, Artificial sequence
  SiRNA target sequence
atgtgtggcaacttgtgga

SEQ ID NO: 80533 - DNA, 19 bp, Artificial sequence
  SiRNA target sequence
tgtgtggcaacttgtggag

SEQ ID NO: 80534 - DNA, 19 bp, Artificial sequence
  SiRNA target sequence
gtgtggcaacttgtggagg

SEQ ID NO: 80535 - DNA, 19 bp, Artificial sequence
  SiRNA target sequence
tgtggcaacttgtggagga

SEQ ID NO: 80536 - DNA, 19 bp, Artificial sequence
  SiRNA target sequence
gtggcaacttgtggaggat

SEQ ID NO: 80537 - DNA, 19 bp, Artificial sequence
  SiRNA target sequence
tggcaacttgtggaggatt

SEQ ID NO: 80538 - DNA, 19 bp, Artificial sequence
  SiRNA target sequence
ggcaacttgtggaggattt

SEQ ID NO: 80539 - DNA, 19 bp, Artificial sequence
  SiRNA target sequence
gcaacttgtggaggattta

SEQ ID NO: 80540 - DNA, 19 bp, Artificial sequence
  SiRNA target sequence
caacttgtggaggatttaa

SEQ ID NO: 80541 - DNA, 19 bp, Artificial sequence
  SiRNA target sequence
aacttgtggaggatttaag

SEQ ID NO: 80542 - DNA, 19 bp, Artificial sequence
  SiRNA target sequence
acttgtggaggatttaagc

SEQ ID NO: 80543 - DNA, 19 bp, Artificial sequence
  SiRNA target sequence
cttgtggaggatttaagct

SEQ ID NO: 80544 - DNA, 19 bp, Artificial sequence
  SiRNA target sequence
ttgtggaggatttaagctt

SEQ ID NO: 80545 - DNA, 19 bp, Artificial sequence
  SiRNA target sequence
tgtggaggatttaagctta

SEQ ID NO: 80546 - DNA, 19 bp, Artificial sequence
  SiRNA target sequence
gtggaggatttaagcttaa

SEQ ID NO: 80547 - DNA, 19 bp, Artificial sequence
  SiRNA target sequence
tggaggatttaagcttaac

SEQ ID NO: 80548 - DNA, 19 bp, Artificial sequence
  SiRNA target sequence
ggaggatttaagcttaaca

SEQ ID NO: 80549 - DNA, 19 bp, Artificial sequence
  SiRNA target sequence
gaggatttaagcttaacag

SEQ ID NO: 80550 - DNA, 19 bp, Artificial sequence
  SiRNA target sequence
aggatttaagcttaacagt

SEQ ID NO: 80551 - DNA, 19 bp, Artificial sequence
  SiRNA target sequence
ggatttaagcttaacagtc

SEQ ID NO: 80552 - DNA, 19 bp, Artificial sequence
  SiRNA target sequence
gatttaagcttaacagtct

SEQ ID NO: 80553 - DNA, 19 bp, Artificial sequence
  SiRNA target sequence
atttaagcttaacagtctt

SEQ ID NO: 80554 - DNA, 19 bp, Artificial sequence
  SiRNA target sequence
tttaagcttaacagtcttt

SEQ ID NO: 80555 - DNA, 19 bp, Artificial sequence
  SiRNA target sequence
ttaagcttaacagtctttg

SEQ ID NO: 80556 - DNA, 19 bp, Artificial sequence
  SiRNA target sequence
taagcttaacagtctttga

SEQ ID NO: 80557 - DNA, 19 bp, Artificial sequence
  SiRNA target sequence
aagcttaacagtctttgaa

SEQ ID NO: 80558 - DNA, 19 bp, Artificial sequence
  SiRNA target sequence
agcttaacagtctttgaaa

SEQ ID NO: 80559 - DNA, 19 bp, Artificial sequence
  SiRNA target sequence
gcttaacagtctttgaaaa

SEQ ID NO: 80560 - DNA, 19 bp, Artificial sequence
  SiRNA target sequence
cttaacagtctttgaaaat

SEQ ID NO: 80561 - DNA, 19 bp, Artificial sequence
  SiRNA target sequence
ttaacagtctttgaaaatg

SEQ ID NO: 80562 - DNA, 19 bp, Artificial sequence
  SiRNA target sequence
taacagtctttgaaaatgt

SEQ ID NO: 80563 - DNA, 19 bp, Artificial sequence
  SiRNA target sequence
aacagtctttgaaaatgtc

SEQ ID NO: 80564 - DNA, 19 bp, Artificial sequence
  SiRNA target sequence
acagtctttgaaaatgtcc

SEQ ID NO: 80565 - DNA, 19 bp, Artificial sequence
  SiRNA target sequence
cagtctttgaaaatgtcca

SEQ ID NO: 80566 - DNA, 19 bp, Artificial sequence
  SiRNA target sequence
agtctttgaaaatgtccac

SEQ ID NO: 80567 - DNA, 19 bp, Artificial sequence
  SiRNA target sequence
gtctttgaaaatgtccaca

SEQ ID NO: 80568 - DNA, 19 bp, Artificial sequence
  SiRNA target sequence
tctttgaaaatgtccacaa

SEQ ID NO: 80569 - DNA, 19 bp, Artificial sequence
  SiRNA target sequence
ctttgaaaatgtccacaac

SEQ ID NO: 80570 - DNA, 19 bp, Artificial sequence
  SiRNA target sequence
tttgaaaatgtccacaaca

SEQ ID NO: 80571 - DNA, 19 bp, Artificial sequence
  SiRNA target sequence
ttgaaaatgtccacaacat

SEQ ID NO: 80572 - DNA, 19 bp, Artificial sequence
  SiRNA target sequence
tgaaaatgtccacaacatt

SEQ ID NO: 80573 - DNA, 19 bp, Artificial sequence
  SiRNA target sequence
gaaaatgtccacaacattc

SEQ ID NO: 80574 - DNA, 19 bp, Artificial sequence
  SiRNA target sequence
aaaatgtccacaacattct

SEQ ID NO: 80575 - DNA, 19 bp, Artificial sequence
  SiRNA target sequence
aaatgtccacaacattctg

SEQ ID NO: 80576 - DNA, 19 bp, Artificial sequence
  SiRNA target sequence
aatgtccacaacattctgc

SEQ ID NO: 80577 - DNA, 19 bp, Artificial sequence
  SiRNA target sequence
atgtccacaacattctgca

SEQ ID NO: 80578 - DNA, 19 bp, Artificial sequence
  SiRNA target sequence
tgtccacaacattctgcac

SEQ ID NO: 80579 - DNA, 19 bp, Artificial sequence
  SiRNA target sequence
gtccacaacattctgcaca

SEQ ID NO: 80580 - DNA, 19 bp, Artificial sequence
  SiRNA target sequence
tccacaacattctgcacag

SEQ ID NO: 80581 - DNA, 19 bp, Artificial sequence
  SiRNA target sequence
ccacaacattctgcacagg

SEQ ID NO: 80582 - DNA, 19 bp, Artificial sequence
  SiRNA target sequence
cacaacattctgcacaggg

SEQ ID NO: 80583 - DNA, 19 bp, Artificial sequence
  SiRNA target sequence
acaacattctgcacagggg

SEQ ID NO: 80584 - DNA, 19 bp, Artificial sequence
  SiRNA target sequence
caacattctgcacagggga

SEQ ID NO: 80585 - DNA, 19 bp, Artificial sequence
  SiRNA target sequence
aacattctgcacaggggaa

SEQ ID NO: 80586 - DNA, 19 bp, Artificial sequence
  SiRNA target sequence
acattctgcacaggggaaa

SEQ ID NO: 80587 - DNA, 19 bp, Artificial sequence
  SiRNA target sequence
cattctgcacaggggaaaa

SEQ ID NO: 80588 - DNA, 19 bp, Artificial sequence
  SiRNA target sequence
attctgcacaggggaaaag

SEQ ID NO: 80589 - DNA, 19 bp, Artificial sequence
  SiRNA target sequence
ttctgcacaggggaaaaga

SEQ ID NO: 80590 - DNA, 19 bp, Artificial sequence
  SiRNA target sequence
tctgcacaggggaaaagag

SEQ ID NO: 80591 - DNA, 19 bp, Artificial sequence
  SiRNA target sequence
ctgcacaggggaaaagaga

SEQ ID NO: 80592 - DNA, 19 bp, Artificial sequence
  SiRNA target sequence
tgcacaggggaaaagagat

SEQ ID NO: 80593 - DNA, 19 bp, Artificial sequence
  SiRNA target sequence
gcacaggggaaaagagatg

SEQ ID NO: 80594 - DNA, 19 bp, Artificial sequence
  SiRNA target sequence
cacaggggaaaagagatga

SEQ ID NO: 80595 - DNA, 19 bp, Artificial sequence
  SiRNA target sequence
acaggggaaaagagatgat

SEQ ID NO: 80596 - DNA, 19 bp, Artificial sequence
  SiRNA target sequence
caggggaaaagagatgata

SEQ ID NO: 80597 - DNA, 19 bp, Artificial sequence
  SiRNA target sequence
aggggaaaagagatgataa

SEQ ID NO: 80598 - DNA, 19 bp, Artificial sequence
  SiRNA target sequence
ggggaaaagagatgataaa

SEQ ID NO: 80599 - DNA, 19 bp, Artificial sequence
  SiRNA target sequence
gggaaaagagatgataaaa

SEQ ID NO: 80600 - DNA, 19 bp, Artificial sequence
  SiRNA target sequence
ggaaaagagatgataaaag

SEQ ID NO: 80601 - DNA, 19 bp, Artificial sequence
  SiRNA target sequence
gaaaagagatgataaaagg

SEQ ID NO: 80602 - DNA, 19 bp, Artificial sequence
  SiRNA target sequence
aaaagagatgataaaaggt

SEQ ID NO: 80603 - DNA, 19 bp, Artificial sequence
  SiRNA target sequence
aaagagatgataaaaggta

SEQ ID NO: 80604 - DNA, 19 bp, Artificial sequence
  SiRNA target sequence
aagagatgataaaaggtaa

SEQ ID NO: 80605 - DNA, 19 bp, Artificial sequence
  SiRNA target sequence
agagatgataaaaggtaaa

SEQ ID NO: 80606 - DNA, 19 bp, Artificial sequence
  SiRNA target sequence
gagatgataaaaggtaaat

SEQ ID NO: 80607 - DNA, 19 bp, Artificial sequence
  SiRNA target sequence
agatgataaaaggtaaata

SEQ ID NO: 80608 - DNA, 19 bp, Artificial sequence
  SiRNA target sequence
gatgataaaaggtaaataa

SEQ ID NO: 80609 - DNA, 19 bp, Artificial sequence
  SiRNA target sequence
atgataaaaggtaaataaa

SEQ ID NO: 80610 - DNA, 19 bp, Artificial sequence
  SiRNA target sequence
tgataaaaggtaaataaat

SEQ ID NO: 80611 - DNA, 19 bp, Artificial sequence
  SiRNA target sequence
gataaaaggtaaataaatt

SEQ ID NO: 80612 - DNA, 19 bp, Artificial sequence
  SiRNA target sequence
ataaaaggtaaataaattg

SEQ ID NO: 80613 - DNA, 19 bp, Artificial sequence
  SiRNA target sequence
taaaaggtaaataaattga

SEQ ID NO: 80614 - DNA, 19 bp, Artificial sequence
  SiRNA target sequence
aaaaggtaaataaattgaa

SEQ ID NO: 80615 - DNA, 19 bp, Artificial sequence
  SiRNA target sequence
aaaggtaaataaattgaag

SEQ ID NO: 80616 - DNA, 19 bp, Artificial sequence
  SiRNA target sequence
aaggtaaataaattgaagt

SEQ ID NO: 80617 - DNA, 19 bp, Artificial sequence
  SiRNA target sequence
aggtaaataaattgaagtg

SEQ ID NO: 80618 - DNA, 19 bp, Artificial sequence
  SiRNA target sequence
ggtaaataaattgaagtgt

SEQ ID NO: 80619 - DNA, 19 bp, Artificial sequence
  SiRNA target sequence
gtaaataaattgaagtgta

SEQ ID NO: 80620 - DNA, 19 bp, Artificial sequence
  SiRNA target sequence
taaataaattgaagtgtat

SEQ ID NO: 80621 - DNA, 19 bp, Artificial sequence
  SiRNA target sequence
aaataaattgaagtgtatc

SEQ ID NO: 80622 - DNA, 19 bp, Artificial sequence
  SiRNA target sequence
aataaattgaagtgtatct

SEQ ID NO: 80623 - DNA, 19 bp, Artificial sequence
  SiRNA target sequence
ataaattgaagtgtatctt

SEQ ID NO: 80624 - DNA, 19 bp, Artificial sequence
  SiRNA target sequence
taaattgaagtgtatcttt

SEQ ID NO: 80625 - DNA, 19 bp, Artificial sequence
  SiRNA target sequence
aaattgaagtgtatctttt

SEQ ID NO: 80626 - DNA, 19 bp, Artificial sequence
  SiRNA target sequence
aattgaagtgtatcttttt

SEQ ID NO: 80627 - DNA, 19 bp, Artificial sequence
  SiRNA target sequence
attgaagtgtatctttttt

SEQ ID NO: 80628 - DNA, 19 bp, Artificial sequence
  SiRNA target sequence
ttgaagtgtatctttttta

SEQ ID NO: 80629 - DNA, 19 bp, Artificial sequence
  SiRNA target sequence
tgaagtgtatcttttttat

SEQ ID NO: 80630 - DNA, 19 bp, Artificial sequence
  SiRNA target sequence
gaagtgtatcttttttatg

SEQ ID NO: 80631 - DNA, 19 bp, Artificial sequence
  SiRNA target sequence
aagtgtatcttttttatgt

SEQ ID NO: 80632 - DNA, 19 bp, Artificial sequence
  SiRNA target sequence
agtgtatcttttttatgtt

SEQ ID NO: 80633 - DNA, 19 bp, Artificial sequence
  SiRNA target sequence
gtgtatcttttttatgttg

SEQ ID NO: 80634 - DNA, 19 bp, Artificial sequence
  SiRNA target sequence
tgtatcttttttatgttgt

SEQ ID NO: 80635 - DNA, 19 bp, Artificial sequence
  SiRNA target sequence
gtatcttttttatgttgta

SEQ ID NO: 80636 - DNA, 19 bp, Artificial sequence
  SiRNA target sequence
tatcttttttatgttgtac

SEQ ID NO: 80637 - DNA, 19 bp, Artificial sequence
  SiRNA target sequence
atcttttttatgttgtact

SEQ ID NO: 80638 - DNA, 19 bp, Artificial sequence
  SiRNA target sequence
tcttttttatgttgtactg

SEQ ID NO: 80639 - DNA, 19 bp, Artificial sequence
  SiRNA target sequence
cttttttatgttgtactgt

SEQ ID NO: 80640 - DNA, 19 bp, Artificial sequence
  SiRNA target sequence
ttttttatgttgtactgta

SEQ ID NO: 80641 - DNA, 19 bp, Artificial sequence
  SiRNA target sequence
tttttatgttgtactgtag

SEQ ID NO: 80642 - DNA, 19 bp, Artificial sequence
  SiRNA target sequence
ttttatgttgtactgtagg

SEQ ID NO: 80643 - DNA, 19 bp, Artificial sequence
  SiRNA target sequence
tttatgttgtactgtagga

SEQ ID NO: 80644 - DNA, 19 bp, Artificial sequence
  SiRNA target sequence
ttatgttgtactgtaggaa

SEQ ID NO: 80645 - DNA, 19 bp, Artificial sequence
  SiRNA target sequence
tatgttgtactgtaggaaa

SEQ ID NO: 80646 - DNA, 19 bp, Artificial sequence
  SiRNA target sequence
atgttgtactgtaggaaat

SEQ ID NO: 80647 - DNA, 19 bp, Artificial sequence
  SiRNA target sequence
tgttgtactgtaggaaatg

SEQ ID NO: 80648 - DNA, 19 bp, Artificial sequence
  SiRNA target sequence
gttgtactgtaggaaatgc

SEQ ID NO: 80649 - DNA, 19 bp, Artificial sequence
  SiRNA target sequence
ttgtactgtaggaaatgca

SEQ ID NO: 80650 - DNA, 19 bp, Artificial sequence
  SiRNA target sequence
tgtactgtaggaaatgcag

SEQ ID NO: 80651 - DNA, 19 bp, Artificial sequence
  SiRNA target sequence
gtactgtaggaaatgcagg

SEQ ID NO: 80652 - DNA, 19 bp, Artificial sequence
  SiRNA target sequence
tactgtaggaaatgcagga

SEQ ID NO: 80653 - DNA, 19 bp, Artificial sequence
  SiRNA target sequence
actgtaggaaatgcaggat

SEQ ID NO: 80654 - DNA, 19 bp, Artificial sequence
  SiRNA target sequence
ctgtaggaaatgcaggata

SEQ ID NO: 80655 - DNA, 19 bp, Artificial sequence
  SiRNA target sequence
tgtaggaaatgcaggataa

SEQ ID NO: 80656 - DNA, 19 bp, Artificial sequence
  SiRNA target sequence
gtaggaaatgcaggataaa

SEQ ID NO: 80657 - DNA, 19 bp, Artificial sequence
  SiRNA target sequence
taggaaatgcaggataaac

SEQ ID NO: 80658 - DNA, 19 bp, Artificial sequence
  SiRNA target sequence
aggaaatgcaggataaaca

SEQ ID NO: 80659 - DNA, 19 bp, Artificial sequence
  SiRNA target sequence
ggaaatgcaggataaacag

SEQ ID NO: 80660 - DNA, 19 bp, Artificial sequence
  SiRNA target sequence
gaaatgcaggataaacagc

SEQ ID NO: 80661 - DNA, 19 bp, Artificial sequence
  SiRNA target sequence
aaatgcaggataaacagct

SEQ ID NO: 80662 - DNA, 19 bp, Artificial sequence
  SiRNA target sequence
aatgcaggataaacagctg

SEQ ID NO: 80663 - DNA, 19 bp, Artificial sequence
  SiRNA target sequence
atgcaggataaacagctgc

SEQ ID NO: 80664 - DNA, 19 bp, Artificial sequence
  SiRNA target sequence
tgcaggataaacagctgcc

SEQ ID NO: 80665 - DNA, 19 bp, Artificial sequence
  SiRNA target sequence
gcaggataaacagctgcca

SEQ ID NO: 80666 - DNA, 19 bp, Artificial sequence
  SiRNA target sequence
caggataaacagctgccat

SEQ ID NO: 80667 - DNA, 19 bp, Artificial sequence
  SiRNA target sequence
aggataaacagctgccatg

SEQ ID NO: 80668 - DNA, 19 bp, Artificial sequence
  SiRNA target sequence
ggataaacagctgccatgg

SEQ ID NO: 80669 - DNA, 19 bp, Artificial sequence
  SiRNA target sequence
gataaacagctgccatggt

SEQ ID NO: 80670 - DNA, 19 bp, Artificial sequence
  SiRNA target sequence
ataaacagctgccatggta

SEQ ID NO: 80671 - DNA, 19 bp, Artificial sequence
  SiRNA target sequence
taaacagctgccatggtat

SEQ ID NO: 80672 - DNA, 19 bp, Artificial sequence
  SiRNA target sequence
aaacagctgccatggtatg

SEQ ID NO: 80673 - DNA, 19 bp, Artificial sequence
  SiRNA target sequence
aacagctgccatggtatgt

SEQ ID NO: 80674 - DNA, 19 bp, Artificial sequence
  SiRNA target sequence
acagctgccatggtatgta

SEQ ID NO: 80675 - DNA, 19 bp, Artificial sequence
  SiRNA target sequence
cagctgccatggtatgtaa

SEQ ID NO: 80676 - DNA, 19 bp, Artificial sequence
  SiRNA target sequence
agctgccatggtatgtaaa

SEQ ID NO: 80677 - DNA, 19 bp, Artificial sequence
  SiRNA target sequence
gctgccatggtatgtaaaa

SEQ ID NO: 80678 - DNA, 19 bp, Artificial sequence
  SiRNA target sequence
ctgccatggtatgtaaaag

SEQ ID NO: 80679 - DNA, 19 bp, Artificial sequence
  SiRNA target sequence
tgccatggtatgtaaaagt

SEQ ID NO: 80680 - DNA, 19 bp, Artificial sequence
  SiRNA target sequence
gccatggtatgtaaaagtg

SEQ ID NO: 80681 - DNA, 19 bp, Artificial sequence
  SiRNA target sequence
ccatggtatgtaaaagtgt

SEQ ID NO: 80682 - DNA, 19 bp, Artificial sequence
  SiRNA target sequence
catggtatgtaaaagtgtc

SEQ ID NO: 80683 - DNA, 19 bp, Artificial sequence
  SiRNA target sequence
atggtatgtaaaagtgtcc

SEQ ID NO: 80684 - DNA, 19 bp, Artificial sequence
  SiRNA target sequence
tggtatgtaaaagtgtcca

SEQ ID NO: 80685 - DNA, 19 bp, Artificial sequence
  SiRNA target sequence
ggtatgtaaaagtgtccat

SEQ ID NO: 80686 - DNA, 19 bp, Artificial sequence
  SiRNA target sequence
gtatgtaaaagtgtccatg

SEQ ID NO: 80687 - DNA, 19 bp, Artificial sequence
  SiRNA target sequence
tatgtaaaagtgtccatgt

SEQ ID NO: 80688 - DNA, 19 bp, Artificial sequence
  SiRNA target sequence
atgtaaaagtgtccatgtt

SEQ ID NO: 80689 - DNA, 19 bp, Artificial sequence
  SiRNA target sequence
tgtaaaagtgtccatgttg

SEQ ID NO: 80690 - DNA, 19 bp, Artificial sequence
  SiRNA target sequence
gtaaaagtgtccatgttgc

SEQ ID NO: 80691 - DNA, 19 bp, Artificial sequence
  SiRNA target sequence
taaaagtgtccatgttgct

SEQ ID NO: 80692 - DNA, 19 bp, Artificial sequence
  SiRNA target sequence
aaaagtgtccatgttgctc

SEQ ID NO: 80693 - DNA, 19 bp, Artificial sequence
  SiRNA target sequence
aaagtgtccatgttgctct

SEQ ID NO: 80694 - DNA, 19 bp, Artificial sequence
  SiRNA target sequence
aagtgtccatgttgctctc

SEQ ID NO: 80695 - DNA, 19 bp, Artificial sequence
  SiRNA target sequence
agtgtccatgttgctctcc

SEQ ID NO: 80696 - DNA, 19 bp, Artificial sequence
  SiRNA target sequence
gtgtccatgttgctctccc

SEQ ID NO: 80697 - DNA, 19 bp, Artificial sequence
  SiRNA target sequence
tgtccatgttgctctcccc

SEQ ID NO: 80698 - DNA, 19 bp, Artificial sequence
  SiRNA target sequence
gtccatgttgctctcccca

SEQ ID NO: 80699 - DNA, 19 bp, Artificial sequence
  SiRNA target sequence
tccatgttgctctccccaa

SEQ ID NO: 80700 - DNA, 19 bp, Artificial sequence
  SiRNA target sequence
ccatgttgctctccccaat

SEQ ID NO: 80701 - DNA, 19 bp, Artificial sequence
  SiRNA target sequence
catgttgctctccccaatc

SEQ ID NO: 80702 - DNA, 19 bp, Artificial sequence
  SiRNA target sequence
atgttgctctccccaatct

SEQ ID NO: 80703 - DNA, 19 bp, Artificial sequence
  SiRNA target sequence
tgttgctctccccaatcta

SEQ ID NO: 80704 - DNA, 19 bp, Artificial sequence
  SiRNA target sequence
gttgctctccccaatctat

SEQ ID NO: 80705 - DNA, 19 bp, Artificial sequence
  SiRNA target sequence
ttgctctccccaatctatc

SEQ ID NO: 80706 - DNA, 19 bp, Artificial sequence
  SiRNA target sequence
tgctctccccaatctatct

SEQ ID NO: 80707 - DNA, 19 bp, Artificial sequence
  SiRNA target sequence
gctctccccaatctatctt

SEQ ID NO: 80708 - DNA, 19 bp, Artificial sequence
  SiRNA target sequence
ctctccccaatctatcttt

SEQ ID NO: 80709 - DNA, 19 bp, Artificial sequence
  SiRNA target sequence
tctccccaatctatcttta

SEQ ID NO: 80710 - DNA, 19 bp, Artificial sequence
  SiRNA target sequence
ctccccaatctatctttaa

SEQ ID NO: 80711 - DNA, 19 bp, Artificial sequence
  SiRNA target sequence
tccccaatctatctttaac

SEQ ID NO: 80712 - DNA, 19 bp, Artificial sequence
  SiRNA target sequence
ccccaatctatctttaact

SEQ ID NO: 80713 - DNA, 19 bp, Artificial sequence
  SiRNA target sequence
cccaatctatctttaactt

SEQ ID NO: 80714 - DNA, 19 bp, Artificial sequence
  SiRNA target sequence
ccaatctatctttaacttc

SEQ ID NO: 80715 - DNA, 19 bp, Artificial sequence
  SiRNA target sequence
caatctatctttaacttcc

SEQ ID NO: 80716 - DNA, 19 bp, Artificial sequence
  SiRNA target sequence
aatctatctttaacttcct

SEQ ID NO: 80717 - DNA, 19 bp, Artificial sequence
  SiRNA target sequence
atctatctttaacttcctt

SEQ ID NO: 80718 - DNA, 19 bp, Artificial sequence
  SiRNA target sequence
tctatctttaacttcctta

SEQ ID NO: 80719 - DNA, 19 bp, Artificial sequence
  SiRNA target sequence
ctatctttaacttccttat

SEQ ID NO: 80720 - DNA, 19 bp, Artificial sequence
  SiRNA target sequence
tatctttaacttccttatt

SEQ ID NO: 80721 - DNA, 19 bp, Artificial sequence
  SiRNA target sequence
atctttaacttccttattt

SEQ ID NO: 80722 - DNA, 19 bp, Artificial sequence
  SiRNA target sequence
tctttaacttccttatttg

SEQ ID NO: 80723 - DNA, 19 bp, Artificial sequence
  SiRNA target sequence
ctttaacttccttatttgt

SEQ ID NO: 80724 - DNA, 19 bp, Artificial sequence
  SiRNA target sequence
tttaacttccttatttgtt

SEQ ID NO: 80725 - DNA, 19 bp, Artificial sequence
  SiRNA target sequence
ttaacttccttatttgtta

SEQ ID NO: 80726 - DNA, 19 bp, Artificial sequence
  SiRNA target sequence
taacttccttatttgttaa

SEQ ID NO: 80727 - DNA, 19 bp, Artificial sequence
  SiRNA target sequence
aacttccttatttgttaat

SEQ ID NO: 80728 - DNA, 19 bp, Artificial sequence
  SiRNA target sequence
acttccttatttgttaatt

SEQ ID NO: 80729 - DNA, 19 bp, Artificial sequence
  SiRNA target sequence
cttccttatttgttaattt

SEQ ID NO: 80730 - DNA, 19 bp, Artificial sequence
  SiRNA target sequence
ttccttatttgttaatttt

SEQ ID NO: 80731 - DNA, 19 bp, Artificial sequence
  SiRNA target sequence
tccttatttgttaattttt

SEQ ID NO: 80732 - DNA, 19 bp, Artificial sequence
  SiRNA target sequence
ccttatttgttaatttttg

SEQ ID NO: 80733 - DNA, 19 bp, Artificial sequence
  SiRNA target sequence
cttatttgttaatttttga

SEQ ID NO: 80734 - DNA, 19 bp, Artificial sequence
  SiRNA target sequence
ttatttgttaatttttgat

SEQ ID NO: 80735 - DNA, 19 bp, Artificial sequence
  SiRNA target sequence
tatttgttaatttttgatt

SEQ ID NO: 80736 - DNA, 19 bp, Artificial sequence
  SiRNA target sequence
atttgttaatttttgatta

SEQ ID NO: 80737 - DNA, 19 bp, Artificial sequence
  SiRNA target sequence
tttgttaatttttgattat

SEQ ID NO: 80738 - DNA, 19 bp, Artificial sequence
  SiRNA target sequence
ttgttaatttttgattatg

SEQ ID NO: 80739 - DNA, 19 bp, Artificial sequence
  SiRNA target sequence
tgttaatttttgattatga

SEQ ID NO: 80740 - DNA, 19 bp, Artificial sequence
  SiRNA target sequence
gttaatttttgattatgaa

SEQ ID NO: 80741 - DNA, 19 bp, Artificial sequence
  SiRNA target sequence
ttaatttttgattatgaat

SEQ ID NO: 80742 - DNA, 19 bp, Artificial sequence
  SiRNA target sequence
taatttttgattatgaatt

SEQ ID NO: 80743 - DNA, 19 bp, Artificial sequence
  SiRNA target sequence
aatttttgattatgaatta

SEQ ID NO: 80744 - DNA, 19 bp, Artificial sequence
  SiRNA target sequence
atttttgattatgaattag

SEQ ID NO: 80745 - DNA, 19 bp, Artificial sequence
  SiRNA target sequence
tttttgattatgaattaga

SEQ ID NO: 80746 - DNA, 19 bp, Artificial sequence
  SiRNA target sequence
ttttgattatgaattagac

SEQ ID NO: 80747 - DNA, 19 bp, Artificial sequence
  SiRNA target sequence
tttgattatgaattagacc

SEQ ID NO: 80748 - DNA, 19 bp, Artificial sequence
  SiRNA target sequence
ttgattatgaattagacct

SEQ ID NO: 80749 - DNA, 19 bp, Artificial sequence
  SiRNA target sequence
tgattatgaattagaccta

SEQ ID NO: 80750 - DNA, 19 bp, Artificial sequence
  SiRNA target sequence
gattatgaattagacctaa

SEQ ID NO: 80751 - DNA, 19 bp, Artificial sequence
  SiRNA target sequence
attatgaattagacctaat

SEQ ID NO: 80752 - DNA, 19 bp, Artificial sequence
  SiRNA target sequence
ttatgaattagacctaatt

SEQ ID NO: 80753 - DNA, 19 bp, Artificial sequence
  SiRNA target sequence
tatgaattagacctaattc

SEQ ID NO: 80754 - DNA, 19 bp, Artificial sequence
  SiRNA target sequence
atgaattagacctaattca

SEQ ID NO: 80755 - DNA, 19 bp, Artificial sequence
  SiRNA target sequence
tgaattagacctaattcac

SEQ ID NO: 80756 - DNA, 19 bp, Artificial sequence
  SiRNA target sequence
gaattagacctaattcacc

SEQ ID NO: 80757 - DNA, 19 bp, Artificial sequence
  SiRNA target sequence
aattagacctaattcacct

SEQ ID NO: 80758 - DNA, 19 bp, Artificial sequence
  SiRNA target sequence
attagacctaattcaccta

SEQ ID NO: 80759 - DNA, 19 bp, Artificial sequence
  SiRNA target sequence
ttagacctaattcacctac

SEQ ID NO: 80760 - DNA, 19 bp, Artificial sequence
  SiRNA target sequence
tagacctaattcacctact

SEQ ID NO: 80761 - DNA, 19 bp, Artificial sequence
  SiRNA target sequence
agacctaattcacctactt

SEQ ID NO: 80762 - DNA, 19 bp, Artificial sequence
  SiRNA target sequence
gacctaattcacctacttt

SEQ ID NO: 80763 - DNA, 19 bp, Artificial sequence
  SiRNA target sequence
acctaattcacctactttt

SEQ ID NO: 80764 - DNA, 19 bp, Artificial sequence
  SiRNA target sequence
cctaattcacctacttttg

SEQ ID NO: 80765 - DNA, 19 bp, Artificial sequence
  SiRNA target sequence
ctaattcacctacttttgg

SEQ ID NO: 80766 - DNA, 19 bp, Artificial sequence
  SiRNA target sequence
taattcacctacttttggt

SEQ ID NO: 80767 - DNA, 19 bp, Artificial sequence
  SiRNA target sequence
aattcacctacttttggtg

SEQ ID NO: 80768 - DNA, 19 bp, Artificial sequence
  SiRNA target sequence
attcacctacttttggtga

SEQ ID NO: 80769 - DNA, 19 bp, Artificial sequence
  SiRNA target sequence
ttcacctacttttggtgaa

SEQ ID NO: 80770 - DNA, 19 bp, Artificial sequence
  SiRNA target sequence
tcacctacttttggtgaaa

SEQ ID NO: 80771 - DNA, 19 bp, Artificial sequence
  SiRNA target sequence
cacctacttttggtgaaat

SEQ ID NO: 80772 - DNA, 19 bp, Artificial sequence
  SiRNA target sequence
acctacttttggtgaaata

SEQ ID NO: 80773 - DNA, 19 bp, Artificial sequence
  SiRNA target sequence
cctacttttggtgaaatag

SEQ ID NO: 80774 - DNA, 19 bp, Artificial sequence
  SiRNA target sequence
ctacttttggtgaaataga

SEQ ID NO: 80775 - DNA, 19 bp, Artificial sequence
  SiRNA target sequence
tacttttggtgaaatagat

SEQ ID NO: 80776 - DNA, 19 bp, Artificial sequence
  SiRNA target sequence
acttttggtgaaatagatt

SEQ ID NO: 80777 - DNA, 19 bp, Artificial sequence
  SiRNA target sequence
cttttggtgaaatagattg

SEQ ID NO: 80778 - DNA, 19 bp, Artificial sequence
  SiRNA target sequence
ttttggtgaaatagattgt

SEQ ID NO: 80779 - DNA, 19 bp, Artificial sequence
  SiRNA target sequence
tttggtgaaatagattgta

SEQ ID NO: 80780 - DNA, 19 bp, Artificial sequence
  SiRNA target sequence
ttggtgaaatagattgtaa

SEQ ID NO: 80781 - DNA, 19 bp, Artificial sequence
  SiRNA target sequence
tggtgaaatagattgtaaa

SEQ ID NO: 80782 - DNA, 19 bp, Artificial sequence
  SiRNA target sequence
ggtgaaatagattgtaaaa

SEQ ID NO: 80783 - DNA, 19 bp, Artificial sequence
  SiRNA target sequence
gtgaaatagattgtaaaac

SEQ ID NO: 80784 - DNA, 19 bp, Artificial sequence
  SiRNA target sequence
tgaaatagattgtaaaaca

SEQ ID NO: 80785 - DNA, 19 bp, Artificial sequence
  SiRNA target sequence
gaaatagattgtaaaacag

SEQ ID NO: 80786 - DNA, 19 bp, Artificial sequence
  SiRNA target sequence
aaatagattgtaaaacaga

SEQ ID NO: 80787 - DNA, 19 bp, Artificial sequence
  SiRNA target sequence
aatagattgtaaaacagat

SEQ ID NO: 80788 - DNA, 19 bp, Artificial sequence
  SiRNA target sequence
atagattgtaaaacagatt

SEQ ID NO: 80789 - DNA, 19 bp, Artificial sequence
  SiRNA target sequence
tagattgtaaaacagattt

SEQ ID NO: 80790 - DNA, 19 bp, Artificial sequence
  SiRNA target sequence
agattgtaaaacagatttt

SEQ ID NO: 80791 - DNA, 19 bp, Artificial sequence
  SiRNA target sequence
gattgtaaaacagattttc

SEQ ID NO: 80792 - DNA, 19 bp, Artificial sequence
  SiRNA target sequence
attgtaaaacagattttcc

SEQ ID NO: 80793 - DNA, 19 bp, Artificial sequence
  SiRNA target sequence
ttgtaaaacagattttcca

SEQ ID NO: 80794 - DNA, 19 bp, Artificial sequence
  SiRNA target sequence
tgtaaaacagattttccaa

SEQ ID NO: 80795 - DNA, 19 bp, Artificial sequence
  SiRNA target sequence
gtaaaacagattttccaag

SEQ ID NO: 80796 - DNA, 19 bp, Artificial sequence
  SiRNA target sequence
taaaacagattttccaagt

SEQ ID NO: 80797 - DNA, 19 bp, Artificial sequence
  SiRNA target sequence
aaaacagattttccaagtg

SEQ ID NO: 80798 - DNA, 19 bp, Artificial sequence
  SiRNA target sequence
aaacagattttccaagtga

SEQ ID NO: 80799 - DNA, 19 bp, Artificial sequence
  SiRNA target sequence
aacagattttccaagtgag

SEQ ID NO: 80800 - DNA, 19 bp, Artificial sequence
  SiRNA target sequence
acagattttccaagtgagt

SEQ ID NO: 80801 - DNA, 19 bp, Artificial sequence
  SiRNA target sequence
cagattttccaagtgagtt

SEQ ID NO: 80802 - DNA, 19 bp, Artificial sequence
  SiRNA target sequence
agattttccaagtgagttg

SEQ ID NO: 80803 - DNA, 19 bp, Artificial sequence
  SiRNA target sequence
gattttccaagtgagttgt

SEQ ID NO: 80804 - DNA, 19 bp, Artificial sequence
  SiRNA target sequence
attttccaagtgagttgtc

SEQ ID NO: 80805 - DNA, 19 bp, Artificial sequence
  SiRNA target sequence
ttttccaagtgagttgtct

SEQ ID NO: 80806 - DNA, 19 bp, Artificial sequence
  SiRNA target sequence
tttccaagtgagttgtctg

SEQ ID NO: 80807 - DNA, 19 bp, Artificial sequence
  SiRNA target sequence
ttccaagtgagttgtctgc

SEQ ID NO: 80808 - DNA, 19 bp, Artificial sequence
  SiRNA target sequence
tccaagtgagttgtctgca

SEQ ID NO: 80809 - DNA, 19 bp, Artificial sequence
  SiRNA target sequence
ccaagtgagttgtctgcat

SEQ ID NO: 80810 - DNA, 19 bp, Artificial sequence
  SiRNA target sequence
caagtgagttgtctgcatg

SEQ ID NO: 80811 - DNA, 19 bp, Artificial sequence
  SiRNA target sequence
aagtgagttgtctgcatgt

SEQ ID NO: 80812 - DNA, 19 bp, Artificial sequence
  SiRNA target sequence
agtgagttgtctgcatgtg

SEQ ID NO: 80813 - DNA, 19 bp, Artificial sequence
  SiRNA target sequence
gtgagttgtctgcatgtgt

SEQ ID NO: 80814 - DNA, 19 bp, Artificial sequence
  SiRNA target sequence
tgagttgtctgcatgtgta

SEQ ID NO: 80815 - DNA, 19 bp, Artificial sequence
  SiRNA target sequence
gagttgtctgcatgtgtat

SEQ ID NO: 80816 - DNA, 19 bp, Artificial sequence
  SiRNA target sequence
agttgtctgcatgtgtatg

SEQ ID NO: 80817 - DNA, 19 bp, Artificial sequence
  SiRNA target sequence
gttgtctgcatgtgtatgc

SEQ ID NO: 80818 - DNA, 19 bp, Artificial sequence
  SiRNA target sequence
ttgtctgcatgtgtatgcg

SEQ ID NO: 80819 - DNA, 19 bp, Artificial sequence
  SiRNA target sequence
tgtctgcatgtgtatgcgg

SEQ ID NO: 80820 - DNA, 19 bp, Artificial sequence
  SiRNA target sequence
gtctgcatgtgtatgcggg

SEQ ID NO: 80821 - DNA, 19 bp, Artificial sequence
  SiRNA target sequence
tctgcatgtgtatgcggga

SEQ ID NO: 80822 - DNA, 19 bp, Artificial sequence
  SiRNA target sequence
ctgcatgtgtatgcgggaa

SEQ ID NO: 80823 - DNA, 19 bp, Artificial sequence
  SiRNA target sequence
tgcatgtgtatgcgggaaa

SEQ ID NO: 80824 - DNA, 19 bp, Artificial sequence
  SiRNA target sequence
gcatgtgtatgcgggaaaa

SEQ ID NO: 80825 - DNA, 19 bp, Artificial sequence
  SiRNA target sequence
catgtgtatgcgggaaaaa

SEQ ID NO: 80826 - DNA, 19 bp, Artificial sequence
  SiRNA target sequence
atgtgtatgcgggaaaaaa

SEQ ID NO: 80827 - DNA, 19 bp, Artificial sequence
  SiRNA target sequence
tgtgtatgcgggaaaaaat

SEQ ID NO: 80828 - DNA, 19 bp, Artificial sequence
  SiRNA target sequence
gtgtatgcgggaaaaaatg

SEQ ID NO: 80829 - DNA, 19 bp, Artificial sequence
  SiRNA target sequence
tgtatgcgggaaaaaatgc

SEQ ID NO: 80830 - DNA, 19 bp, Artificial sequence
  SiRNA target sequence
gtatgcgggaaaaaatgct

SEQ ID NO: 80831 - DNA, 19 bp, Artificial sequence
  SiRNA target sequence
tatgcgggaaaaaatgctg

SEQ ID NO: 80832 - DNA, 19 bp, Artificial sequence
  SiRNA target sequence
atgcgggaaaaaatgctgt

SEQ ID NO: 80833 - DNA, 19 bp, Artificial sequence
  SiRNA target sequence
tgcgggaaaaaatgctgtt

SEQ ID NO: 80834 - DNA, 19 bp, Artificial sequence
  SiRNA target sequence
gcgggaaaaaatgctgttt

SEQ ID NO: 80835 - DNA, 19 bp, Artificial sequence
  SiRNA target sequence
cgggaaaaaatgctgtttt

SEQ ID NO: 80836 - DNA, 19 bp, Artificial sequence
  SiRNA target sequence
gggaaaaaatgctgttttg

SEQ ID NO: 80837 - DNA, 19 bp, Artificial sequence
  SiRNA target sequence
ggaaaaaatgctgttttgc

SEQ ID NO: 80838 - DNA, 19 bp, Artificial sequence
  SiRNA target sequence
gaaaaaatgctgttttgct

SEQ ID NO: 80839 - DNA, 19 bp, Artificial sequence
  SiRNA target sequence
aaaaaatgctgttttgcta

SEQ ID NO: 80840 - DNA, 19 bp, Artificial sequence
  SiRNA target sequence
aaaaatgctgttttgctaa

SEQ ID NO: 80841 - DNA, 19 bp, Artificial sequence
  SiRNA target sequence
aaaatgctgttttgctaaa

SEQ ID NO: 80842 - DNA, 19 bp, Artificial sequence
  SiRNA target sequence
aaatgctgttttgctaaat

SEQ ID NO: 80843 - DNA, 19 bp, Artificial sequence
  SiRNA target sequence
aatgctgttttgctaaata

SEQ ID NO: 80844 - DNA, 19 bp, Artificial sequence
  SiRNA target sequence
atgctgttttgctaaataa

SEQ ID NO: 80845 - DNA, 19 bp, Artificial sequence
  SiRNA target sequence
tgctgttttgctaaataaa

SEQ ID NO: 80846 - DNA, 19 bp, Artificial sequence
  SiRNA target sequence
gctgttttgctaaataaac

SEQ ID NO: 80847 - DNA, 19 bp, Artificial sequence
  SiRNA target sequence
ctgttttgctaaataaaca

SEQ ID NO: 80848 - DNA, 19 bp, Artificial sequence
  SiRNA target sequence
tgttttgctaaataaacaa

SEQ ID NO: 80849 - DNA, 19 bp, Artificial sequence
  SiRNA target sequence
gttttgctaaataaacaat

SEQ ID NO: 80850 - DNA, 19 bp, Artificial sequence
  SiRNA target sequence
ttttgctaaataaacaatc

SEQ ID NO: 80851 - DNA, 19 bp, Artificial sequence
  SiRNA target sequence
tttgctaaataaacaatcc

SEQ ID NO: 80852 - DNA, 19 bp, Artificial sequence
  SiRNA target sequence
ttgctaaataaacaatcca

SEQ ID NO: 80853 - DNA, 19 bp, Artificial sequence
  SiRNA target sequence
tgctaaataaacaatccat

SEQ ID NO: 80854 - DNA, 19 bp, Artificial sequence
  SiRNA target sequence
gctaaataaacaatccata

SEQ ID NO: 80855 - DNA, 19 bp, Artificial sequence
  SiRNA target sequence
ctaaataaacaatccatac

SEQ ID NO: 80856 - DNA, 19 bp, Artificial sequence
  SiRNA target sequence
taaataaacaatccataca

SEQ ID NO: 80857 - DNA, 19 bp, Artificial sequence
  SiRNA target sequence
aaataaacaatccatacac

SEQ ID NO: 80858 - DNA, 19 bp, Artificial sequence
  SiRNA target sequence
aataaacaatccatacacc

SEQ ID NO: 80859 - DNA, 19 bp, Artificial sequence
  SiRNA target sequence
ataaacaatccatacaccc

SEQ ID NO: 80860 - DNA, 19 bp, Artificial sequence
  SiRNA target sequence
taaacaatccatacaccca

SEQ ID NO: 80861 - DNA, 19 bp, Artificial sequence
  SiRNA target sequence
aaacaatccatacacccaa

SEQ ID NO: 80862 - DNA, 19 bp, Artificial sequence
  SiRNA target sequence
aacaatccatacacccaat

SEQ ID NO: 80863 - DNA, 19 bp, Artificial sequence
  SiRNA target sequence
acaatccatacacccaata

SEQ ID NO: 80864 - DNA, 19 bp, Artificial sequence
  SiRNA target sequence
caatccatacacccaataa

SEQ ID NO: 80865 - DNA, 19 bp, Artificial sequence
  SiRNA target sequence
aatccatacacccaataag

SEQ ID NO: 80866 - DNA, 19 bp, Artificial sequence
  SiRNA target sequence
atccatacacccaataaga

SEQ ID NO: 80867 - DNA, 19 bp, Artificial sequence
  SiRNA target sequence
tccatacacccaataagat

SEQ ID NO: 80868 - DNA, 19 bp, Artificial sequence
  SiRNA target sequence
ccatacacccaataagata

SEQ ID NO: 80869 - DNA, 19 bp, Artificial sequence
  SiRNA target sequence
catacacccaataagataa

SEQ ID NO: 80870 - DNA, 19 bp, Artificial sequence
  SiRNA target sequence
atacacccaataagataat

SEQ ID NO: 80871 - DNA, 19 bp, Artificial sequence
  SiRNA target sequence
tacacccaataagataata

SEQ ID NO: 80872 - DNA, 19 bp, Artificial sequence
  SiRNA target sequence
acacccaataagataataa

SEQ ID NO: 80873 - DNA, 19 bp, Artificial sequence
  SiRNA target sequence
cacccaataagataataag

SEQ ID NO: 80874 - DNA, 19 bp, Artificial sequence
  SiRNA target sequence
acccaataagataataagt

SEQ ID NO: 80875 - DNA, 19 bp, Artificial sequence
  SiRNA target sequence
cccaataagataataagtc

SEQ ID NO: 80876 - DNA, 19 bp, Artificial sequence
  SiRNA target sequence
ccaataagataataagtcc

SEQ ID NO: 80877 - DNA, 19 bp, Artificial sequence
  SiRNA target sequence
caataagataataagtcct

SEQ ID NO: 80878 - DNA, 19 bp, Artificial sequence
  SiRNA target sequence
aataagataataagtcctc

SEQ ID NO: 80879 - DNA, 19 bp, Artificial sequence
  SiRNA target sequence
ataagataataagtcctct

SEQ ID NO: 80880 - DNA, 19 bp, Artificial sequence
  SiRNA target sequence
taagataataagtcctctt

SEQ ID NO: 80881 - DNA, 19 bp, Artificial sequence
  SiRNA target sequence
aagataataagtcctctta

SEQ ID NO: 80882 - DNA, 19 bp, Artificial sequence
  SiRNA target sequence
agataataagtcctcttaa

SEQ ID NO: 80883 - DNA, 19 bp, Artificial sequence
  SiRNA target sequence
gataataagtcctcttaat

SEQ ID NO: 80884 - DNA, 19 bp, Artificial sequence
  SiRNA target sequence
ataataagtcctcttaata

SEQ ID NO: 80885 - DNA, 19 bp, Artificial sequence
  SiRNA target sequence
taataagtcctcttaatac

SEQ ID NO: 80886 - DNA, 19 bp, Artificial sequence
  SiRNA target sequence
aataagtcctcttaatact

SEQ ID NO: 80887 - DNA, 19 bp, Artificial sequence
  SiRNA target sequence
ataagtcctcttaatactt

SEQ ID NO: 80888 - DNA, 19 bp, Artificial sequence
  SiRNA target sequence
taagtcctcttaatacttt

SEQ ID NO: 80889 - DNA, 19 bp, Artificial sequence
  SiRNA target sequence
aagtcctcttaatactttc

SEQ ID NO: 80890 - DNA, 19 bp, Artificial sequence
  SiRNA target sequence
agtcctcttaatactttct

SEQ ID NO: 80891 - DNA, 19 bp, Artificial sequence
  SiRNA target sequence
gtcctcttaatactttctg

SEQ ID NO: 80892 - DNA, 19 bp, Artificial sequence
  SiRNA target sequence
tcctcttaatactttctgc

SEQ ID NO: 80893 - DNA, 19 bp, Artificial sequence
  SiRNA target sequence
cctcttaatactttctgct

SEQ ID NO: 80894 - DNA, 19 bp, Artificial sequence
  SiRNA target sequence
ctcttaatactttctgctc

SEQ ID NO: 80895 - DNA, 19 bp, Artificial sequence
  SiRNA target sequence
tcttaatactttctgctct

SEQ ID NO: 80896 - DNA, 19 bp, Artificial sequence
  SiRNA target sequence
cttaatactttctgctctt

SEQ ID NO: 80897 - DNA, 19 bp, Artificial sequence
  SiRNA target sequence
ttaatactttctgctcttt

SEQ ID NO: 80898 - DNA, 19 bp, Artificial sequence
  SiRNA target sequence
taatactttctgctctttg

SEQ ID NO: 80899 - DNA, 19 bp, Artificial sequence
  SiRNA target sequence
aatactttctgctctttgt

SEQ ID NO: 80900 - DNA, 19 bp, Artificial sequence
  SiRNA target sequence
atactttctgctctttgtt

SEQ ID NO: 80901 - DNA, 19 bp, Artificial sequence
  SiRNA target sequence
tactttctgctctttgttc

SEQ ID NO: 80902 - DNA, 19 bp, Artificial sequence
  SiRNA target sequence
actttctgctctttgttca

SEQ ID NO: 80903 - DNA, 19 bp, Artificial sequence
  SiRNA target sequence
ctttctgctctttgttcat

SEQ ID NO: 80904 - DNA, 20 bp, Artificial sequence
  SiRNA target sequence
ttattctggttcacaaccac

SEQ ID NO: 80905 - DNA, 20 bp, Artificial sequence
  SiRNA target sequence
tattctggttcacaaccaca

SEQ ID NO: 80906 - DNA, 20 bp, Artificial sequence
  SiRNA target sequence
attctggttcacaaccacaa

SEQ ID NO: 80907 - DNA, 20 bp, Artificial sequence
  SiRNA target sequence
ttctggttcacaaccacaac

SEQ ID NO: 80908 - DNA, 20 bp, Artificial sequence
  SiRNA target sequence
tctggttcacaaccacaact

SEQ ID NO: 80909 - DNA, 20 bp, Artificial sequence
  SiRNA target sequence
ctggttcacaaccacaactc

SEQ ID NO: 80910 - DNA, 20 bp, Artificial sequence
  SiRNA target sequence
tggttcacaaccacaactcc

SEQ ID NO: 80911 - DNA, 20 bp, Artificial sequence
  SiRNA target sequence
ggttcacaaccacaactcca

SEQ ID NO: 80912 - DNA, 20 bp, Artificial sequence
  SiRNA target sequence
gttcacaaccacaactccaa

SEQ ID NO: 80913 - DNA, 20 bp, Artificial sequence
  SiRNA target sequence
ttcacaaccacaactccaaa

SEQ ID NO: 80914 - DNA, 20 bp, Artificial sequence
  SiRNA target sequence
tcacaaccacaactccaaac

SEQ ID NO: 80915 - DNA, 20 bp, Artificial sequence
  SiRNA target sequence
cacaaccacaactccaaaca

SEQ ID NO: 80916 - DNA, 20 bp, Artificial sequence
  SiRNA target sequence
acaaccacaactccaaacac

SEQ ID NO: 80917 - DNA, 20 bp, Artificial sequence
  SiRNA target sequence
caaccacaactccaaacacc

SEQ ID NO: 80918 - DNA, 20 bp, Artificial sequence
  SiRNA target sequence
aaccacaactccaaacacct

SEQ ID NO: 80919 - DNA, 20 bp, Artificial sequence
  SiRNA target sequence
accacaactccaaacacctt

SEQ ID NO: 80920 - DNA, 20 bp, Artificial sequence
  SiRNA target sequence
ccacaactccaaacaccttc

SEQ ID NO: 80921 - DNA, 20 bp, Artificial sequence
  SiRNA target sequence
cacaactccaaacaccttct

SEQ ID NO: 80922 - DNA, 20 bp, Artificial sequence
  SiRNA target sequence
acaactccaaacaccttcta

SEQ ID NO: 80923 - DNA, 20 bp, Artificial sequence
  SiRNA target sequence
caactccaaacaccttctac

SEQ ID NO: 80924 - DNA, 20 bp, Artificial sequence
  SiRNA target sequence
aactccaaacaccttctacc

SEQ ID NO: 80925 - DNA, 20 bp, Artificial sequence
  SiRNA target sequence
actccaaacaccttctacct

SEQ ID NO: 80926 - DNA, 20 bp, Artificial sequence
  SiRNA target sequence
ctccaaacaccttctacctt

SEQ ID NO: 80927 - DNA, 20 bp, Artificial sequence
  SiRNA target sequence
tccaaacaccttctaccttt

SEQ ID NO: 80928 - DNA, 20 bp, Artificial sequence
  SiRNA target sequence
ccaaacaccttctacctttt

SEQ ID NO: 80929 - DNA, 20 bp, Artificial sequence
  SiRNA target sequence
caaacaccttctaccttttt

SEQ ID NO: 80930 - DNA, 20 bp, Artificial sequence
  SiRNA target sequence
aaacaccttctaccttttta

SEQ ID NO: 80931 - DNA, 20 bp, Artificial sequence
  SiRNA target sequence
aacaccttctacctttttac

SEQ ID NO: 80932 - DNA, 20 bp, Artificial sequence
  SiRNA target sequence
acaccttctacctttttaca

SEQ ID NO: 80933 - DNA, 20 bp, Artificial sequence
  SiRNA target sequence
caccttctacctttttacag

SEQ ID NO: 80934 - DNA, 20 bp, Artificial sequence
  SiRNA target sequence
accttctacctttttacagt

SEQ ID NO: 80935 - DNA, 20 bp, Artificial sequence
  SiRNA target sequence
ccttctacctttttacagtc

SEQ ID NO: 80936 - DNA, 20 bp, Artificial sequence
  SiRNA target sequence
cttctacctttttacagtcc

SEQ ID NO: 80937 - DNA, 20 bp, Artificial sequence
  SiRNA target sequence
ttctacctttttacagtcca

SEQ ID NO: 80938 - DNA, 20 bp, Artificial sequence
  SiRNA target sequence
tctacctttttacagtccat

SEQ ID NO: 80939 - DNA, 20 bp, Artificial sequence
  SiRNA target sequence
ctacctttttacagtccata

SEQ ID NO: 80940 - DNA, 20 bp, Artificial sequence
  SiRNA target sequence
tacctttttacagtccataa

SEQ ID NO: 80941 - DNA, 20 bp, Artificial sequence
  SiRNA target sequence
acctttttacagtccataat

SEQ ID NO: 80942 - DNA, 20 bp, Artificial sequence
  SiRNA target sequence
cctttttacagtccataatg

SEQ ID NO: 80943 - DNA, 20 bp, Artificial sequence
  SiRNA target sequence
ctttttacagtccataatgg

SEQ ID NO: 80944 - DNA, 20 bp, Artificial sequence
  SiRNA target sequence
tttttacagtccataatggg

SEQ ID NO: 80945 - DNA, 20 bp, Artificial sequence
  SiRNA target sequence
ttttacagtccataatgggc

SEQ ID NO: 80946 - DNA, 20 bp, Artificial sequence
  SiRNA target sequence
tttacagtccataatgggct

SEQ ID NO: 80947 - DNA, 20 bp, Artificial sequence
  SiRNA target sequence
ttacagtccataatgggctt

SEQ ID NO: 80948 - DNA, 20 bp, Artificial sequence
  SiRNA target sequence
tacagtccataatgggcttt

SEQ ID NO: 80949 - DNA, 20 bp, Artificial sequence
  SiRNA target sequence
acagtccataatgggctttc

SEQ ID NO: 80950 - DNA, 20 bp, Artificial sequence
  SiRNA target sequence
cagtccataatgggctttcc

SEQ ID NO: 80951 - DNA, 20 bp, Artificial sequence
  SiRNA target sequence
agtccataatgggctttcct

SEQ ID NO: 80952 - DNA, 20 bp, Artificial sequence
  SiRNA target sequence
gtccataatgggctttccta

SEQ ID NO: 80953 - DNA, 20 bp, Artificial sequence
  SiRNA target sequence
tccataatgggctttcctaa

SEQ ID NO: 80954 - DNA, 20 bp, Artificial sequence
  SiRNA target sequence
ccataatgggctttcctaat

SEQ ID NO: 80955 - DNA, 20 bp, Artificial sequence
  SiRNA target sequence
cataatgggctttcctaatc

SEQ ID NO: 80956 - DNA, 20 bp, Artificial sequence
  SiRNA target sequence
ataatgggctttcctaatct

SEQ ID NO: 80957 - DNA, 20 bp, Artificial sequence
  SiRNA target sequence
taatgggctttcctaatctt

SEQ ID NO: 80958 - DNA, 20 bp, Artificial sequence
  SiRNA target sequence
aatgggctttcctaatcttt

SEQ ID NO: 80959 - DNA, 20 bp, Artificial sequence
  SiRNA target sequence
atgggctttcctaatctttt

SEQ ID NO: 80960 - DNA, 20 bp, Artificial sequence
  SiRNA target sequence
tgggctttcctaatctttta

SEQ ID NO: 80961 - DNA, 20 bp, Artificial sequence
  SiRNA target sequence
gggctttcctaatcttttat

SEQ ID NO: 80962 - DNA, 20 bp, Artificial sequence
  SiRNA target sequence
ggctttcctaatcttttatt

SEQ ID NO: 80963 - DNA, 20 bp, Artificial sequence
  SiRNA target sequence
gctttcctaatcttttatta

SEQ ID NO: 80964 - DNA, 20 bp, Artificial sequence
  SiRNA target sequence
ctttcctaatcttttattaa

SEQ ID NO: 80965 - DNA, 20 bp, Artificial sequence
  SiRNA target sequence
tttcctaatcttttattaac

SEQ ID NO: 80966 - DNA, 20 bp, Artificial sequence
  SiRNA target sequence
ttcctaatcttttattaact

SEQ ID NO: 80967 - DNA, 20 bp, Artificial sequence
  SiRNA target sequence
tcctaatcttttattaacta

SEQ ID NO: 80968 - DNA, 20 bp, Artificial sequence
  SiRNA target sequence
cctaatcttttattaactat

SEQ ID NO: 80969 - DNA, 20 bp, Artificial sequence
  SiRNA target sequence
ctaatcttttattaactatg

SEQ ID NO: 80970 - DNA, 20 bp, Artificial sequence
  SiRNA target sequence
taatcttttattaactatgt

SEQ ID NO: 80971 - DNA, 20 bp, Artificial sequence
  SiRNA target sequence
aatcttttattaactatgtt

SEQ ID NO: 80972 - DNA, 20 bp, Artificial sequence
  SiRNA target sequence
atcttttattaactatgtta

SEQ ID NO: 80973 - DNA, 20 bp, Artificial sequence
  SiRNA target sequence
tcttttattaactatgttat

SEQ ID NO: 80974 - DNA, 20 bp, Artificial sequence
  SiRNA target sequence
cttttattaactatgttatg

SEQ ID NO: 80975 - DNA, 20 bp, Artificial sequence
  SiRNA target sequence
ttttattaactatgttatgt

SEQ ID NO: 80976 - DNA, 20 bp, Artificial sequence
  SiRNA target sequence
tttattaactatgttatgtg

SEQ ID NO: 80977 - DNA, 20 bp, Artificial sequence
  SiRNA target sequence
ttattaactatgttatgtgc

SEQ ID NO: 80978 - DNA, 20 bp, Artificial sequence
  SiRNA target sequence
tattaactatgttatgtgct

SEQ ID NO: 80979 - DNA, 20 bp, Artificial sequence
  SiRNA target sequence
attaactatgttatgtgctt

SEQ ID NO: 80980 - DNA, 20 bp, Artificial sequence
  SiRNA target sequence
ttaactatgttatgtgcttt

SEQ ID NO: 80981 - DNA, 20 bp, Artificial sequence
  SiRNA target sequence
taactatgttatgtgcttta

SEQ ID NO: 80982 - DNA, 20 bp, Artificial sequence
  SiRNA target sequence
aactatgttatgtgctttac

SEQ ID NO: 80983 - DNA, 20 bp, Artificial sequence
  SiRNA target sequence
actatgttatgtgctttaca

SEQ ID NO: 80984 - DNA, 20 bp, Artificial sequence
  SiRNA target sequence
ctatgttatgtgctttacat

SEQ ID NO: 80985 - DNA, 20 bp, Artificial sequence
  SiRNA target sequence
tatgttatgtgctttacata

SEQ ID NO: 80986 - DNA, 20 bp, Artificial sequence
  SiRNA target sequence
atgttatgtgctttacatag

SEQ ID NO: 80987 - DNA, 20 bp, Artificial sequence
  SiRNA target sequence
tgttatgtgctttacatagc

SEQ ID NO: 80988 - DNA, 20 bp, Artificial sequence
  SiRNA target sequence
gttatgtgctttacatagcc

SEQ ID NO: 80989 - DNA, 20 bp, Artificial sequence
  SiRNA target sequence
ttatgtgctttacatagcca

SEQ ID NO: 80990 - DNA, 20 bp, Artificial sequence
  SiRNA target sequence
tatgtgctttacatagccac

SEQ ID NO: 80991 - DNA, 20 bp, Artificial sequence
  SiRNA target sequence
atgtgctttacatagccact

SEQ ID NO: 80992 - DNA, 20 bp, Artificial sequence
  SiRNA target sequence
tgtgctttacatagccactg

SEQ ID NO: 80993 - DNA, 20 bp, Artificial sequence
  SiRNA target sequence
gtgctttacatagccactgg

SEQ ID NO: 80994 - DNA, 20 bp, Artificial sequence
  SiRNA target sequence
tgctttacatagccactgga

SEQ ID NO: 80995 - DNA, 20 bp, Artificial sequence
  SiRNA target sequence
gctttacatagccactggac

SEQ ID NO: 80996 - DNA, 20 bp, Artificial sequence
  SiRNA target sequence
ctttacatagccactggaca

SEQ ID NO: 80997 - DNA, 20 bp, Artificial sequence
  SiRNA target sequence
tttacatagccactggacaa

SEQ ID NO: 80998 - DNA, 20 bp, Artificial sequence
  SiRNA target sequence
ttacatagccactggacaaa

SEQ ID NO: 80999 - DNA, 20 bp, Artificial sequence
  SiRNA target sequence
tacatagccactggacaaat

SEQ ID NO: 81000 - DNA, 20 bp, Artificial sequence
  SiRNA target sequence
acatagccactggacaaatt

SEQ ID NO: 81001 - DNA, 20 bp, Artificial sequence
  SiRNA target sequence
catagccactggacaaattc

SEQ ID NO: 81002 - DNA, 20 bp, Artificial sequence
  SiRNA target sequence
atagccactggacaaattcg

SEQ ID NO: 81003 - DNA, 20 bp, Artificial sequence
  SiRNA target sequence
tagccactggacaaattcgt

SEQ ID NO: 81004 - DNA, 20 bp, Artificial sequence
  SiRNA target sequence
agccactggacaaattcgtc

SEQ ID NO: 81005 - DNA, 20 bp, Artificial sequence
  SiRNA target sequence
gccactggacaaattcgtca

SEQ ID NO: 81006 - DNA, 20 bp, Artificial sequence
  SiRNA target sequence
ccactggacaaattcgtcat

SEQ ID NO: 81007 - DNA, 20 bp, Artificial sequence
  SiRNA target sequence
cactggacaaattcgtcatg

SEQ ID NO: 81008 - DNA, 20 bp, Artificial sequence
  SiRNA target sequence
actggacaaattcgtcatgt

SEQ ID NO: 81009 - DNA, 20 bp, Artificial sequence
  SiRNA target sequence
ctggacaaattcgtcatgtg

SEQ ID NO: 81010 - DNA, 20 bp, Artificial sequence
  SiRNA target sequence
tggacaaattcgtcatgtgt

SEQ ID NO: 81011 - DNA, 20 bp, Artificial sequence
  SiRNA target sequence
ggacaaattcgtcatgtgtg

SEQ ID NO: 81012 - DNA, 20 bp, Artificial sequence
  SiRNA target sequence
gacaaattcgtcatgtgtgg

SEQ ID NO: 81013 - DNA, 20 bp, Artificial sequence
  SiRNA target sequence
acaaattcgtcatgtgtggc

SEQ ID NO: 81014 - DNA, 20 bp, Artificial sequence
  SiRNA target sequence
caaattcgtcatgtgtggca

SEQ ID NO: 81015 - DNA, 20 bp, Artificial sequence
  SiRNA target sequence
aaattcgtcatgtgtggcaa

SEQ ID NO: 81016 - DNA, 20 bp, Artificial sequence
  SiRNA target sequence
aattcgtcatgtgtggcaac

SEQ ID NO: 81017 - DNA, 20 bp, Artificial sequence
  SiRNA target sequence
attcgtcatgtgtggcaact

SEQ ID NO: 81018 - DNA, 20 bp, Artificial sequence
  SiRNA target sequence
ttcgtcatgtgtggcaactt

SEQ ID NO: 81019 - DNA, 20 bp, Artificial sequence
  SiRNA target sequence
tcgtcatgtgtggcaacttg

SEQ ID NO: 81020 - DNA, 20 bp, Artificial sequence
  SiRNA target sequence
cgtcatgtgtggcaacttgt

SEQ ID NO: 81021 - DNA, 20 bp, Artificial sequence
  SiRNA target sequence
gtcatgtgtggcaacttgtg

SEQ ID NO: 81022 - DNA, 20 bp, Artificial sequence
  SiRNA target sequence
tcatgtgtggcaacttgtgg

SEQ ID NO: 81023 - DNA, 20 bp, Artificial sequence
  SiRNA target sequence
catgtgtggcaacttgtgga

SEQ ID NO: 81024 - DNA, 20 bp, Artificial sequence
  SiRNA target sequence
atgtgtggcaacttgtggag

SEQ ID NO: 81025 - DNA, 20 bp, Artificial sequence
  SiRNA target sequence
tgtgtggcaacttgtggagg

SEQ ID NO: 81026 - DNA, 20 bp, Artificial sequence
  SiRNA target sequence
gtgtggcaacttgtggagga

SEQ ID NO: 81027 - DNA, 20 bp, Artificial sequence
  SiRNA target sequence
tgtggcaacttgtggaggat

SEQ ID NO: 81028 - DNA, 20 bp, Artificial sequence
  SiRNA target sequence
gtggcaacttgtggaggatt

SEQ ID NO: 81029 - DNA, 20 bp, Artificial sequence
  SiRNA target sequence
tggcaacttgtggaggattt

SEQ ID NO: 81030 - DNA, 20 bp, Artificial sequence
  SiRNA target sequence
ggcaacttgtggaggattta

SEQ ID NO: 81031 - DNA, 20 bp, Artificial sequence
  SiRNA target sequence
gcaacttgtggaggatttaa

SEQ ID NO: 81032 - DNA, 20 bp, Artificial sequence
  SiRNA target sequence
caacttgtggaggatttaag

SEQ ID NO: 81033 - DNA, 20 bp, Artificial sequence
  SiRNA target sequence
aacttgtggaggatttaagc

SEQ ID NO: 81034 - DNA, 20 bp, Artificial sequence
  SiRNA target sequence
acttgtggaggatttaagct

SEQ ID NO: 81035 - DNA, 20 bp, Artificial sequence
  SiRNA target sequence
cttgtggaggatttaagctt

SEQ ID NO: 81036 - DNA, 20 bp, Artificial sequence
  SiRNA target sequence
ttgtggaggatttaagctta

SEQ ID NO: 81037 - DNA, 20 bp, Artificial sequence
  SiRNA target sequence
tgtggaggatttaagcttaa

SEQ ID NO: 81038 - DNA, 20 bp, Artificial sequence
  SiRNA target sequence
gtggaggatttaagcttaac

SEQ ID NO: 81039 - DNA, 20 bp, Artificial sequence
  SiRNA target sequence
tggaggatttaagcttaaca

SEQ ID NO: 81040 - DNA, 20 bp, Artificial sequence
  SiRNA target sequence
ggaggatttaagcttaacag

SEQ ID NO: 81041 - DNA, 20 bp, Artificial sequence
  SiRNA target sequence
gaggatttaagcttaacagt

SEQ ID NO: 81042 - DNA, 20 bp, Artificial sequence
  SiRNA target sequence
aggatttaagcttaacagtc

SEQ ID NO: 81043 - DNA, 20 bp, Artificial sequence
  SiRNA target sequence
ggatttaagcttaacagtct

SEQ ID NO: 81044 - DNA, 20 bp, Artificial sequence
  SiRNA target sequence
gatttaagcttaacagtctt

SEQ ID NO: 81045 - DNA, 20 bp, Artificial sequence
  SiRNA target sequence
atttaagcttaacagtcttt

SEQ ID NO: 81046 - DNA, 20 bp, Artificial sequence
  SiRNA target sequence
tttaagcttaacagtctttg

SEQ ID NO: 81047 - DNA, 20 bp, Artificial sequence
  SiRNA target sequence
ttaagcttaacagtctttga

SEQ ID NO: 81048 - DNA, 20 bp, Artificial sequence
  SiRNA target sequence
taagcttaacagtctttgaa

SEQ ID NO: 81049 - DNA, 20 bp, Artificial sequence
  SiRNA target sequence
aagcttaacagtctttgaaa

SEQ ID NO: 81050 - DNA, 20 bp, Artificial sequence
  SiRNA target sequence
agcttaacagtctttgaaaa

SEQ ID NO: 81051 - DNA, 20 bp, Artificial sequence
  SiRNA target sequence
gcttaacagtctttgaaaat

SEQ ID NO: 81052 - DNA, 20 bp, Artificial sequence
  SiRNA target sequence
cttaacagtctttgaaaatg

SEQ ID NO: 81053 - DNA, 20 bp, Artificial sequence
  SiRNA target sequence
ttaacagtctttgaaaatgt

SEQ ID NO: 81054 - DNA, 20 bp, Artificial sequence
  SiRNA target sequence
taacagtctttgaaaatgtc

SEQ ID NO: 81055 - DNA, 20 bp, Artificial sequence
  SiRNA target sequence
aacagtctttgaaaatgtcc

SEQ ID NO: 81056 - DNA, 20 bp, Artificial sequence
  SiRNA target sequence
acagtctttgaaaatgtcca

SEQ ID NO: 81057 - DNA, 20 bp, Artificial sequence
  SiRNA target sequence
cagtctttgaaaatgtccac

SEQ ID NO: 81058 - DNA, 20 bp, Artificial sequence
  SiRNA target sequence
agtctttgaaaatgtccaca

SEQ ID NO: 81059 - DNA, 20 bp, Artificial sequence
  SiRNA target sequence
gtctttgaaaatgtccacaa

SEQ ID NO: 81060 - DNA, 20 bp, Artificial sequence
  SiRNA target sequence
tctttgaaaatgtccacaac

SEQ ID NO: 81061 - DNA, 20 bp, Artificial sequence
  SiRNA target sequence
ctttgaaaatgtccacaaca

SEQ ID NO: 81062 - DNA, 20 bp, Artificial sequence
  SiRNA target sequence
tttgaaaatgtccacaacat

SEQ ID NO: 81063 - DNA, 20 bp, Artificial sequence
  SiRNA target sequence
ttgaaaatgtccacaacatt

SEQ ID NO: 81064 - DNA, 20 bp, Artificial sequence
  SiRNA target sequence
tgaaaatgtccacaacattc

SEQ ID NO: 81065 - DNA, 20 bp, Artificial sequence
  SiRNA target sequence
gaaaatgtccacaacattct

SEQ ID NO: 81066 - DNA, 20 bp, Artificial sequence
  SiRNA target sequence
aaaatgtccacaacattctg

SEQ ID NO: 81067 - DNA, 20 bp, Artificial sequence
  SiRNA target sequence
aaatgtccacaacattctgc

SEQ ID NO: 81068 - DNA, 20 bp, Artificial sequence
  SiRNA target sequence
aatgtccacaacattctgca

SEQ ID NO: 81069 - DNA, 20 bp, Artificial sequence
  SiRNA target sequence
atgtccacaacattctgcac

SEQ ID NO: 81070 - DNA, 20 bp, Artificial sequence
  SiRNA target sequence
tgtccacaacattctgcaca

SEQ ID NO: 81071 - DNA, 20 bp, Artificial sequence
  SiRNA target sequence
gtccacaacattctgcacag

SEQ ID NO: 81072 - DNA, 20 bp, Artificial sequence
  SiRNA target sequence
tccacaacattctgcacagg

SEQ ID NO: 81073 - DNA, 20 bp, Artificial sequence
  SiRNA target sequence
ccacaacattctgcacaggg

SEQ ID NO: 81074 - DNA, 20 bp, Artificial sequence
  SiRNA target sequence
cacaacattctgcacagggg

SEQ ID NO: 81075 - DNA, 20 bp, Artificial sequence
  SiRNA target sequence
acaacattctgcacagggga

SEQ ID NO: 81076 - DNA, 20 bp, Artificial sequence
  SiRNA target sequence
caacattctgcacaggggaa

SEQ ID NO: 81077 - DNA, 20 bp, Artificial sequence
  SiRNA target sequence
aacattctgcacaggggaaa

SEQ ID NO: 81078 - DNA, 20 bp, Artificial sequence
  SiRNA target sequence
acattctgcacaggggaaaa

SEQ ID NO: 81079 - DNA, 20 bp, Artificial sequence
  SiRNA target sequence
cattctgcacaggggaaaag

SEQ ID NO: 81080 - DNA, 20 bp, Artificial sequence
  SiRNA target sequence
attctgcacaggggaaaaga

SEQ ID NO: 81081 - DNA, 20 bp, Artificial sequence
  SiRNA target sequence
ttctgcacaggggaaaagag

SEQ ID NO: 81082 - DNA, 20 bp, Artificial sequence
  SiRNA target sequence
tctgcacaggggaaaagaga

SEQ ID NO: 81083 - DNA, 20 bp, Artificial sequence
  SiRNA target sequence
ctgcacaggggaaaagagat

SEQ ID NO: 81084 - DNA, 20 bp, Artificial sequence
  SiRNA target sequence
tgcacaggggaaaagagatg

SEQ ID NO: 81085 - DNA, 20 bp, Artificial sequence
  SiRNA target sequence
gcacaggggaaaagagatga

SEQ ID NO: 81086 - DNA, 20 bp, Artificial sequence
  SiRNA target sequence
cacaggggaaaagagatgat

SEQ ID NO: 81087 - DNA, 20 bp, Artificial sequence
  SiRNA target sequence
acaggggaaaagagatgata

SEQ ID NO: 81088 - DNA, 20 bp, Artificial sequence
  SiRNA target sequence
caggggaaaagagatgataa

SEQ ID NO: 81089 - DNA, 20 bp, Artificial sequence
  SiRNA target sequence
aggggaaaagagatgataaa

SEQ ID NO: 81090 - DNA, 20 bp, Artificial sequence
  SiRNA target sequence
ggggaaaagagatgataaaa

SEQ ID NO: 81091 - DNA, 20 bp, Artificial sequence
  SiRNA target sequence
gggaaaagagatgataaaag

SEQ ID NO: 81092 - DNA, 20 bp, Artificial sequence
  SiRNA target sequence
ggaaaagagatgataaaagg

SEQ ID NO: 81093 - DNA, 20 bp, Artificial sequence
  SiRNA target sequence
gaaaagagatgataaaaggt

SEQ ID NO: 81094 - DNA, 20 bp, Artificial sequence
  SiRNA target sequence
aaaagagatgataaaaggta

SEQ ID NO: 81095 - DNA, 20 bp, Artificial sequence
  SiRNA target sequence
aaagagatgataaaaggtaa

SEQ ID NO: 81096 - DNA, 20 bp, Artificial sequence
  SiRNA target sequence
aagagatgataaaaggtaaa

SEQ ID NO: 81097 - DNA, 20 bp, Artificial sequence
  SiRNA target sequence
agagatgataaaaggtaaat

SEQ ID NO: 81098 - DNA, 20 bp, Artificial sequence
  SiRNA target sequence
gagatgataaaaggtaaata

SEQ ID NO: 81099 - DNA, 20 bp, Artificial sequence
  SiRNA target sequence
agatgataaaaggtaaataa

SEQ ID NO: 81100 - DNA, 20 bp, Artificial sequence
  SiRNA target sequence
gatgataaaaggtaaataaa

SEQ ID NO: 81101 - DNA, 20 bp, Artificial sequence
  SiRNA target sequence
atgataaaaggtaaataaat

SEQ ID NO: 81102 - DNA, 20 bp, Artificial sequence
  SiRNA target sequence
tgataaaaggtaaataaatt

SEQ ID NO: 81103 - DNA, 20 bp, Artificial sequence
  SiRNA target sequence
gataaaaggtaaataaattg

SEQ ID NO: 81104 - DNA, 20 bp, Artificial sequence
  SiRNA target sequence
ataaaaggtaaataaattga

SEQ ID NO: 81105 - DNA, 20 bp, Artificial sequence
  SiRNA target sequence
taaaaggtaaataaattgaa

SEQ ID NO: 81106 - DNA, 20 bp, Artificial sequence
  SiRNA target sequence
aaaaggtaaataaattgaag

SEQ ID NO: 81107 - DNA, 20 bp, Artificial sequence
  SiRNA target sequence
aaaggtaaataaattgaagt

SEQ ID NO: 81108 - DNA, 20 bp, Artificial sequence
  SiRNA target sequence
aaggtaaataaattgaagtg

SEQ ID NO: 81109 - DNA, 20 bp, Artificial sequence
  SiRNA target sequence
aggtaaataaattgaagtgt

SEQ ID NO: 81110 - DNA, 20 bp, Artificial sequence
  SiRNA target sequence
ggtaaataaattgaagtgta

SEQ ID NO: 81111 - DNA, 20 bp, Artificial sequence
  SiRNA target sequence
gtaaataaattgaagtgtat

SEQ ID NO: 81112 - DNA, 20 bp, Artificial sequence
  SiRNA target sequence
taaataaattgaagtgtatc

SEQ ID NO: 81113 - DNA, 20 bp, Artificial sequence
  SiRNA target sequence
aaataaattgaagtgtatct

SEQ ID NO: 81114 - DNA, 20 bp, Artificial sequence
  SiRNA target sequence
aataaattgaagtgtatctt

SEQ ID NO: 81115 - DNA, 20 bp, Artificial sequence
  SiRNA target sequence
ataaattgaagtgtatcttt

SEQ ID NO: 81116 - DNA, 20 bp, Artificial sequence
  SiRNA target sequence
taaattgaagtgtatctttt

SEQ ID NO: 81117 - DNA, 20 bp, Artificial sequence
  SiRNA target sequence
aaattgaagtgtatcttttt

SEQ ID NO: 81118 - DNA, 20 bp, Artificial sequence
  SiRNA target sequence
aattgaagtgtatctttttt

SEQ ID NO: 81119 - DNA, 20 bp, Artificial sequence
  SiRNA target sequence
attgaagtgtatctttttta

SEQ ID NO: 81120 - DNA, 20 bp, Artificial sequence
  SiRNA target sequence
ttgaagtgtatcttttttat

SEQ ID NO: 81121 - DNA, 20 bp, Artificial sequence
  SiRNA target sequence
tgaagtgtatcttttttatg

SEQ ID NO: 81122 - DNA, 20 bp, Artificial sequence
  SiRNA target sequence
gaagtgtatcttttttatgt

SEQ ID NO: 81123 - DNA, 20 bp, Artificial sequence
  SiRNA target sequence
aagtgtatcttttttatgtt

SEQ ID NO: 81124 - DNA, 20 bp, Artificial sequence
  SiRNA target sequence
agtgtatcttttttatgttg

SEQ ID NO: 81125 - DNA, 20 bp, Artificial sequence
  SiRNA target sequence
gtgtatcttttttatgttgt

SEQ ID NO: 81126 - DNA, 20 bp, Artificial sequence
  SiRNA target sequence
tgtatcttttttatgttgta

SEQ ID NO: 81127 - DNA, 20 bp, Artificial sequence
  SiRNA target sequence
gtatcttttttatgttgtac

SEQ ID NO: 81128 - DNA, 20 bp, Artificial sequence
  SiRNA target sequence
tatcttttttatgttgtact

SEQ ID NO: 81129 - DNA, 20 bp, Artificial sequence
  SiRNA target sequence
atcttttttatgttgtactg

SEQ ID NO: 81130 - DNA, 20 bp, Artificial sequence
  SiRNA target sequence
tcttttttatgttgtactgt

SEQ ID NO: 81131 - DNA, 20 bp, Artificial sequence
  SiRNA target sequence
cttttttatgttgtactgta

SEQ ID NO: 81132 - DNA, 20 bp, Artificial sequence
  SiRNA target sequence
ttttttatgttgtactgtag

SEQ ID NO: 81133 - DNA, 20 bp, Artificial sequence
  SiRNA target sequence
tttttatgttgtactgtagg

SEQ ID NO: 81134 - DNA, 20 bp, Artificial sequence
  SiRNA target sequence
ttttatgttgtactgtagga

SEQ ID NO: 81135 - DNA, 20 bp, Artificial sequence
  SiRNA target sequence
tttatgttgtactgtaggaa

SEQ ID NO: 81136 - DNA, 20 bp, Artificial sequence
  SiRNA target sequence
ttatgttgtactgtaggaaa

SEQ ID NO: 81137 - DNA, 20 bp, Artificial sequence
  SiRNA target sequence
tatgttgtactgtaggaaat

SEQ ID NO: 81138 - DNA, 20 bp, Artificial sequence
  SiRNA target sequence
atgttgtactgtaggaaatg

SEQ ID NO: 81139 - DNA, 20 bp, Artificial sequence
  SiRNA target sequence
tgttgtactgtaggaaatgc

SEQ ID NO: 81140 - DNA, 20 bp, Artificial sequence
  SiRNA target sequence
gttgtactgtaggaaatgca

SEQ ID NO: 81141 - DNA, 20 bp, Artificial sequence
  SiRNA target sequence
ttgtactgtaggaaatgcag

SEQ ID NO: 81142 - DNA, 20 bp, Artificial sequence
  SiRNA target sequence
tgtactgtaggaaatgcagg

SEQ ID NO: 81143 - DNA, 20 bp, Artificial sequence
  SiRNA target sequence
gtactgtaggaaatgcagga

SEQ ID NO: 81144 - DNA, 20 bp, Artificial sequence
  SiRNA target sequence
tactgtaggaaatgcaggat

SEQ ID NO: 81145 - DNA, 20 bp, Artificial sequence
  SiRNA target sequence
actgtaggaaatgcaggata

SEQ ID NO: 81146 - DNA, 20 bp, Artificial sequence
  SiRNA target sequence
ctgtaggaaatgcaggataa

SEQ ID NO: 81147 - DNA, 20 bp, Artificial sequence
  SiRNA target sequence
tgtaggaaatgcaggataaa

SEQ ID NO: 81148 - DNA, 20 bp, Artificial sequence
  SiRNA target sequence
gtaggaaatgcaggataaac

SEQ ID NO: 81149 - DNA, 20 bp, Artificial sequence
  SiRNA target sequence
taggaaatgcaggataaaca

SEQ ID NO: 81150 - DNA, 20 bp, Artificial sequence
  SiRNA target sequence
aggaaatgcaggataaacag

SEQ ID NO: 81151 - DNA, 20 bp, Artificial sequence
  SiRNA target sequence
ggaaatgcaggataaacagc

SEQ ID NO: 81152 - DNA, 20 bp, Artificial sequence
  SiRNA target sequence
gaaatgcaggataaacagct

SEQ ID NO: 81153 - DNA, 20 bp, Artificial sequence
  SiRNA target sequence
aaatgcaggataaacagctg

SEQ ID NO: 81154 - DNA, 20 bp, Artificial sequence
  SiRNA target sequence
aatgcaggataaacagctgc

SEQ ID NO: 81155 - DNA, 20 bp, Artificial sequence
  SiRNA target sequence
atgcaggataaacagctgcc

SEQ ID NO: 81156 - DNA, 20 bp, Artificial sequence
  SiRNA target sequence
tgcaggataaacagctgcca

SEQ ID NO: 81157 - DNA, 20 bp, Artificial sequence
  SiRNA target sequence
gcaggataaacagctgccat

SEQ ID NO: 81158 - DNA, 20 bp, Artificial sequence
  SiRNA target sequence
caggataaacagctgccatg

SEQ ID NO: 81159 - DNA, 20 bp, Artificial sequence
  SiRNA target sequence
aggataaacagctgccatgg

SEQ ID NO: 81160 - DNA, 20 bp, Artificial sequence
  SiRNA target sequence
ggataaacagctgccatggt

SEQ ID NO: 81161 - DNA, 20 bp, Artificial sequence
  SiRNA target sequence
gataaacagctgccatggta

SEQ ID NO: 81162 - DNA, 20 bp, Artificial sequence
  SiRNA target sequence
ataaacagctgccatggtat

SEQ ID NO: 81163 - DNA, 20 bp, Artificial sequence
  SiRNA target sequence
taaacagctgccatggtatg

SEQ ID NO: 81164 - DNA, 20 bp, Artificial sequence
  SiRNA target sequence
aaacagctgccatggtatgt

SEQ ID NO: 81165 - DNA, 20 bp, Artificial sequence
  SiRNA target sequence
aacagctgccatggtatgta

SEQ ID NO: 81166 - DNA, 20 bp, Artificial sequence
  SiRNA target sequence
acagctgccatggtatgtaa

SEQ ID NO: 81167 - DNA, 20 bp, Artificial sequence
  SiRNA target sequence
cagctgccatggtatgtaaa

SEQ ID NO: 81168 - DNA, 20 bp, Artificial sequence
  SiRNA target sequence
agctgccatggtatgtaaaa

SEQ ID NO: 81169 - DNA, 20 bp, Artificial sequence
  SiRNA target sequence
gctgccatggtatgtaaaag

SEQ ID NO: 81170 - DNA, 20 bp, Artificial sequence
  SiRNA target sequence
ctgccatggtatgtaaaagt

SEQ ID NO: 81171 - DNA, 20 bp, Artificial sequence
  SiRNA target sequence
tgccatggtatgtaaaagtg

SEQ ID NO: 81172 - DNA, 20 bp, Artificial sequence
  SiRNA target sequence
gccatggtatgtaaaagtgt

SEQ ID NO: 81173 - DNA, 20 bp, Artificial sequence
  SiRNA target sequence
ccatggtatgtaaaagtgtc

SEQ ID NO: 81174 - DNA, 20 bp, Artificial sequence
  SiRNA target sequence
catggtatgtaaaagtgtcc

SEQ ID NO: 81175 - DNA, 20 bp, Artificial sequence
  SiRNA target sequence
atggtatgtaaaagtgtcca

SEQ ID NO: 81176 - DNA, 20 bp, Artificial sequence
  SiRNA target sequence
tggtatgtaaaagtgtccat

SEQ ID NO: 81177 - DNA, 20 bp, Artificial sequence
  SiRNA target sequence
ggtatgtaaaagtgtccatg

SEQ ID NO: 81178 - DNA, 20 bp, Artificial sequence
  SiRNA target sequence
gtatgtaaaagtgtccatgt

SEQ ID NO: 81179 - DNA, 20 bp, Artificial sequence
  SiRNA target sequence
tatgtaaaagtgtccatgtt

SEQ ID NO: 81180 - DNA, 20 bp, Artificial sequence
  SiRNA target sequence
atgtaaaagtgtccatgttg

SEQ ID NO: 81181 - DNA, 20 bp, Artificial sequence
  SiRNA target sequence
tgtaaaagtgtccatgttgc

SEQ ID NO: 81182 - DNA, 20 bp, Artificial sequence
  SiRNA target sequence
gtaaaagtgtccatgttgct

SEQ ID NO: 81183 - DNA, 20 bp, Artificial sequence
  SiRNA target sequence
taaaagtgtccatgttgctc

SEQ ID NO: 81184 - DNA, 20 bp, Artificial sequence
  SiRNA target sequence
aaaagtgtccatgttgctct

SEQ ID NO: 81185 - DNA, 20 bp, Artificial sequence
  SiRNA target sequence
aaagtgtccatgttgctctc

SEQ ID NO: 81186 - DNA, 20 bp, Artificial sequence
  SiRNA target sequence
aagtgtccatgttgctctcc

SEQ ID NO: 81187 - DNA, 20 bp, Artificial sequence
  SiRNA target sequence
agtgtccatgttgctctccc

SEQ ID NO: 81188 - DNA, 20 bp, Artificial sequence
  SiRNA target sequence
gtgtccatgttgctctcccc

SEQ ID NO: 81189 - DNA, 20 bp, Artificial sequence
  SiRNA target sequence
tgtccatgttgctctcccca

SEQ ID NO: 81190 - DNA, 20 bp, Artificial sequence
  SiRNA target sequence
gtccatgttgctctccccaa

SEQ ID NO: 81191 - DNA, 20 bp, Artificial sequence
  SiRNA target sequence
tccatgttgctctccccaat

SEQ ID NO: 81192 - DNA, 20 bp, Artificial sequence
  SiRNA target sequence
ccatgttgctctccccaatc

SEQ ID NO: 81193 - DNA, 20 bp, Artificial sequence
  SiRNA target sequence
catgttgctctccccaatct

SEQ ID NO: 81194 - DNA, 20 bp, Artificial sequence
  SiRNA target sequence
atgttgctctccccaatcta

SEQ ID NO: 81195 - DNA, 20 bp, Artificial sequence
  SiRNA target sequence
tgttgctctccccaatctat

SEQ ID NO: 81196 - DNA, 20 bp, Artificial sequence
  SiRNA target sequence
gttgctctccccaatctatc

SEQ ID NO: 81197 - DNA, 20 bp, Artificial sequence
  SiRNA target sequence
ttgctctccccaatctatct

SEQ ID NO: 81198 - DNA, 20 bp, Artificial sequence
  SiRNA target sequence
tgctctccccaatctatctt

SEQ ID NO: 81199 - DNA, 20 bp, Artificial sequence
  SiRNA target sequence
gctctccccaatctatcttt

SEQ ID NO: 81200 - DNA, 20 bp, Artificial sequence
  SiRNA target sequence
ctctccccaatctatcttta

SEQ ID NO: 81201 - DNA, 20 bp, Artificial sequence
  SiRNA target sequence
tctccccaatctatctttaa

SEQ ID NO: 81202 - DNA, 20 bp, Artificial sequence
  SiRNA target sequence
ctccccaatctatctttaac

SEQ ID NO: 81203 - DNA, 20 bp, Artificial sequence
  SiRNA target sequence
tccccaatctatctttaact

SEQ ID NO: 81204 - DNA, 20 bp, Artificial sequence
  SiRNA target sequence
ccccaatctatctttaactt

SEQ ID NO: 81205 - DNA, 20 bp, Artificial sequence
  SiRNA target sequence
cccaatctatctttaacttc

SEQ ID NO: 81206 - DNA, 20 bp, Artificial sequence
  SiRNA target sequence
ccaatctatctttaacttcc

SEQ ID NO: 81207 - DNA, 20 bp, Artificial sequence
  SiRNA target sequence
caatctatctttaacttcct

SEQ ID NO: 81208 - DNA, 20 bp, Artificial sequence
  SiRNA target sequence
aatctatctttaacttcctt

SEQ ID NO: 81209 - DNA, 20 bp, Artificial sequence
  SiRNA target sequence
atctatctttaacttcctta

SEQ ID NO: 81210 - DNA, 20 bp, Artificial sequence
  SiRNA target sequence
tctatctttaacttccttat

SEQ ID NO: 81211 - DNA, 20 bp, Artificial sequence
  SiRNA target sequence
ctatctttaacttccttatt

SEQ ID NO: 81212 - DNA, 20 bp, Artificial sequence
  SiRNA target sequence
tatctttaacttccttattt

SEQ ID NO: 81213 - DNA, 20 bp, Artificial sequence
  SiRNA target sequence
atctttaacttccttatttg

SEQ ID NO: 81214 - DNA, 20 bp, Artificial sequence
  SiRNA target sequence
tctttaacttccttatttgt

SEQ ID NO: 81215 - DNA, 20 bp, Artificial sequence
  SiRNA target sequence
ctttaacttccttatttgtt

SEQ ID NO: 81216 - DNA, 20 bp, Artificial sequence
  SiRNA target sequence
tttaacttccttatttgtta

SEQ ID NO: 81217 - DNA, 20 bp, Artificial sequence
  SiRNA target sequence
ttaacttccttatttgttaa

SEQ ID NO: 81218 - DNA, 20 bp, Artificial sequence
  SiRNA target sequence
taacttccttatttgttaat

SEQ ID NO: 81219 - DNA, 20 bp, Artificial sequence
  SiRNA target sequence
aacttccttatttgttaatt

SEQ ID NO: 81220 - DNA, 20 bp, Artificial sequence
  SiRNA target sequence
acttccttatttgttaattt

SEQ ID NO: 81221 - DNA, 20 bp, Artificial sequence
  SiRNA target sequence
cttccttatttgttaatttt

SEQ ID NO: 81222 - DNA, 20 bp, Artificial sequence
  SiRNA target sequence
ttccttatttgttaattttt

SEQ ID NO: 81223 - DNA, 20 bp, Artificial sequence
  SiRNA target sequence
tccttatttgttaatttttg

SEQ ID NO: 81224 - DNA, 20 bp, Artificial sequence
  SiRNA target sequence
ccttatttgttaatttttga

SEQ ID NO: 81225 - DNA, 20 bp, Artificial sequence
  SiRNA target sequence
cttatttgttaatttttgat

SEQ ID NO: 81226 - DNA, 20 bp, Artificial sequence
  SiRNA target sequence
ttatttgttaatttttgatt

SEQ ID NO: 81227 - DNA, 20 bp, Artificial sequence
  SiRNA target sequence
tatttgttaatttttgatta

SEQ ID NO: 81228 - DNA, 20 bp, Artificial sequence
  SiRNA target sequence
atttgttaatttttgattat

SEQ ID NO: 81229 - DNA, 20 bp, Artificial sequence
  SiRNA target sequence
tttgttaatttttgattatg

SEQ ID NO: 81230 - DNA, 20 bp, Artificial sequence
  SiRNA target sequence
ttgttaatttttgattatga

SEQ ID NO: 81231 - DNA, 20 bp, Artificial sequence
  SiRNA target sequence
tgttaatttttgattatgaa

SEQ ID NO: 81232 - DNA, 20 bp, Artificial sequence
  SiRNA target sequence
gttaatttttgattatgaat

SEQ ID NO: 81233 - DNA, 20 bp, Artificial sequence
  SiRNA target sequence
ttaatttttgattatgaatt

SEQ ID NO: 81234 - DNA, 20 bp, Artificial sequence
  SiRNA target sequence
taatttttgattatgaatta

SEQ ID NO: 81235 - DNA, 20 bp, Artificial sequence
  SiRNA target sequence
aatttttgattatgaattag

SEQ ID NO: 81236 - DNA, 20 bp, Artificial sequence
  SiRNA target sequence
atttttgattatgaattaga

SEQ ID NO: 81237 - DNA, 20 bp, Artificial sequence
  SiRNA target sequence
tttttgattatgaattagac

SEQ ID NO: 81238 - DNA, 20 bp, Artificial sequence
  SiRNA target sequence
ttttgattatgaattagacc

SEQ ID NO: 81239 - DNA, 20 bp, Artificial sequence
  SiRNA target sequence
tttgattatgaattagacct

SEQ ID NO: 81240 - DNA, 20 bp, Artificial sequence
  SiRNA target sequence
ttgattatgaattagaccta

SEQ ID NO: 81241 - DNA, 20 bp, Artificial sequence
  SiRNA target sequence
tgattatgaattagacctaa

SEQ ID NO: 81242 - DNA, 20 bp, Artificial sequence
  SiRNA target sequence
gattatgaattagacctaat

SEQ ID NO: 81243 - DNA, 20 bp, Artificial sequence
  SiRNA target sequence
attatgaattagacctaatt

SEQ ID NO: 81244 - DNA, 20 bp, Artificial sequence
  SiRNA target sequence
ttatgaattagacctaattc

SEQ ID NO: 81245 - DNA, 20 bp, Artificial sequence
  SiRNA target sequence
tatgaattagacctaattca

SEQ ID NO: 81246 - DNA, 20 bp, Artificial sequence
  SiRNA target sequence
atgaattagacctaattcac

SEQ ID NO: 81247 - DNA, 20 bp, Artificial sequence
  SiRNA target sequence
tgaattagacctaattcacc

SEQ ID NO: 81248 - DNA, 20 bp, Artificial sequence
  SiRNA target sequence
gaattagacctaattcacct

SEQ ID NO: 81249 - DNA, 20 bp, Artificial sequence
  SiRNA target sequence
aattagacctaattcaccta

SEQ ID NO: 81250 - DNA, 20 bp, Artificial sequence
  SiRNA target sequence
attagacctaattcacctac

SEQ ID NO: 81251 - DNA, 20 bp, Artificial sequence
  SiRNA target sequence
ttagacctaattcacctact

SEQ ID NO: 81252 - DNA, 20 bp, Artificial sequence
  SiRNA target sequence
tagacctaattcacctactt

SEQ ID NO: 81253 - DNA, 20 bp, Artificial sequence
  SiRNA target sequence
agacctaattcacctacttt

SEQ ID NO: 81254 - DNA, 20 bp, Artificial sequence
  SiRNA target sequence
gacctaattcacctactttt

SEQ ID NO: 81255 - DNA, 20 bp, Artificial sequence
  SiRNA target sequence
acctaattcacctacttttg

SEQ ID NO: 81256 - DNA, 20 bp, Artificial sequence
  SiRNA target sequence
cctaattcacctacttttgg

SEQ ID NO: 81257 - DNA, 20 bp, Artificial sequence
  SiRNA target sequence
ctaattcacctacttttggt

SEQ ID NO: 81258 - DNA, 20 bp, Artificial sequence
  SiRNA target sequence
taattcacctacttttggtg

SEQ ID NO: 81259 - DNA, 20 bp, Artificial sequence
  SiRNA target sequence
aattcacctacttttggtga

SEQ ID NO: 81260 - DNA, 20 bp, Artificial sequence
  SiRNA target sequence
attcacctacttttggtgaa

SEQ ID NO: 81261 - DNA, 20 bp, Artificial sequence
  SiRNA target sequence
ttcacctacttttggtgaaa

SEQ ID NO: 81262 - DNA, 20 bp, Artificial sequence
  SiRNA target sequence
tcacctacttttggtgaaat

SEQ ID NO: 81263 - DNA, 20 bp, Artificial sequence
  SiRNA target sequence
cacctacttttggtgaaata

SEQ ID NO: 81264 - DNA, 20 bp, Artificial sequence
  SiRNA target sequence
acctacttttggtgaaatag

SEQ ID NO: 81265 - DNA, 20 bp, Artificial sequence
  SiRNA target sequence
cctacttttggtgaaataga

SEQ ID NO: 81266 - DNA, 20 bp, Artificial sequence
  SiRNA target sequence
ctacttttggtgaaatagat

SEQ ID NO: 81267 - DNA, 20 bp, Artificial sequence
  SiRNA target sequence
tacttttggtgaaatagatt

SEQ ID NO: 81268 - DNA, 20 bp, Artificial sequence
  SiRNA target sequence
acttttggtgaaatagattg

SEQ ID NO: 81269 - DNA, 20 bp, Artificial sequence
  SiRNA target sequence
cttttggtgaaatagattgt

SEQ ID NO: 81270 - DNA, 20 bp, Artificial sequence
  SiRNA target sequence
ttttggtgaaatagattgta

SEQ ID NO: 81271 - DNA, 20 bp, Artificial sequence
  SiRNA target sequence
tttggtgaaatagattgtaa

SEQ ID NO: 81272 - DNA, 20 bp, Artificial sequence
  SiRNA target sequence
ttggtgaaatagattgtaaa

SEQ ID NO: 81273 - DNA, 20 bp, Artificial sequence
  SiRNA target sequence
tggtgaaatagattgtaaaa

SEQ ID NO: 81274 - DNA, 20 bp, Artificial sequence
  SiRNA target sequence
ggtgaaatagattgtaaaac

SEQ ID NO: 81275 - DNA, 20 bp, Artificial sequence
  SiRNA target sequence
gtgaaatagattgtaaaaca

SEQ ID NO: 81276 - DNA, 20 bp, Artificial sequence
  SiRNA target sequence
tgaaatagattgtaaaacag

SEQ ID NO: 81277 - DNA, 20 bp, Artificial sequence
  SiRNA target sequence
gaaatagattgtaaaacaga

SEQ ID NO: 81278 - DNA, 20 bp, Artificial sequence
  SiRNA target sequence
aaatagattgtaaaacagat

SEQ ID NO: 81279 - DNA, 20 bp, Artificial sequence
  SiRNA target sequence
aatagattgtaaaacagatt

SEQ ID NO: 81280 - DNA, 20 bp, Artificial sequence
  SiRNA target sequence
atagattgtaaaacagattt

SEQ ID NO: 81281 - DNA, 20 bp, Artificial sequence
  SiRNA target sequence
tagattgtaaaacagatttt

SEQ ID NO: 81282 - DNA, 20 bp, Artificial sequence
  SiRNA target sequence
agattgtaaaacagattttc

SEQ ID NO: 81283 - DNA, 20 bp, Artificial sequence
  SiRNA target sequence
gattgtaaaacagattttcc

SEQ ID NO: 81284 - DNA, 20 bp, Artificial sequence
  SiRNA target sequence
attgtaaaacagattttcca

SEQ ID NO: 81285 - DNA, 20 bp, Artificial sequence
  SiRNA target sequence
ttgtaaaacagattttccaa

SEQ ID NO: 81286 - DNA, 20 bp, Artificial sequence
  SiRNA target sequence
tgtaaaacagattttccaag

SEQ ID NO: 81287 - DNA, 20 bp, Artificial sequence
  SiRNA target sequence
gtaaaacagattttccaagt

SEQ ID NO: 81288 - DNA, 20 bp, Artificial sequence
  SiRNA target sequence
taaaacagattttccaagtg

SEQ ID NO: 81289 - DNA, 20 bp, Artificial sequence
  SiRNA target sequence
aaaacagattttccaagtga

SEQ ID NO: 81290 - DNA, 20 bp, Artificial sequence
  SiRNA target sequence
aaacagattttccaagtgag

SEQ ID NO: 81291 - DNA, 20 bp, Artificial sequence
  SiRNA target sequence
aacagattttccaagtgagt

SEQ ID NO: 81292 - DNA, 20 bp, Artificial sequence
  SiRNA target sequence
acagattttccaagtgagtt

SEQ ID NO: 81293 - DNA, 20 bp, Artificial sequence
  SiRNA target sequence
cagattttccaagtgagttg

SEQ ID NO: 81294 - DNA, 20 bp, Artificial sequence
  SiRNA target sequence
agattttccaagtgagttgt

SEQ ID NO: 81295 - DNA, 20 bp, Artificial sequence
  SiRNA target sequence
gattttccaagtgagttgtc

SEQ ID NO: 81296 - DNA, 20 bp, Artificial sequence
  SiRNA target sequence
attttccaagtgagttgtct

SEQ ID NO: 81297 - DNA, 20 bp, Artificial sequence
  SiRNA target sequence
ttttccaagtgagttgtctg

SEQ ID NO: 81298 - DNA, 20 bp, Artificial sequence
  SiRNA target sequence
tttccaagtgagttgtctgc

SEQ ID NO: 81299 - DNA, 20 bp, Artificial sequence
  SiRNA target sequence
ttccaagtgagttgtctgca

SEQ ID NO: 81300 - DNA, 20 bp, Artificial sequence
  SiRNA target sequence
tccaagtgagttgtctgcat

SEQ ID NO: 81301 - DNA, 20 bp, Artificial sequence
  SiRNA target sequence
ccaagtgagttgtctgcatg

SEQ ID NO: 81302 - DNA, 20 bp, Artificial sequence
  SiRNA target sequence
caagtgagttgtctgcatgt

SEQ ID NO: 81303 - DNA, 20 bp, Artificial sequence
  SiRNA target sequence
aagtgagttgtctgcatgtg

SEQ ID NO: 81304 - DNA, 20 bp, Artificial sequence
  SiRNA target sequence
agtgagttgtctgcatgtgt

SEQ ID NO: 81305 - DNA, 20 bp, Artificial sequence
  SiRNA target sequence
gtgagttgtctgcatgtgta

SEQ ID NO: 81306 - DNA, 20 bp, Artificial sequence
  SiRNA target sequence
tgagttgtctgcatgtgtat

SEQ ID NO: 81307 - DNA, 20 bp, Artificial sequence
  SiRNA target sequence
gagttgtctgcatgtgtatg

SEQ ID NO: 81308 - DNA, 20 bp, Artificial sequence
  SiRNA target sequence
agttgtctgcatgtgtatgc

SEQ ID NO: 81309 - DNA, 20 bp, Artificial sequence
  SiRNA target sequence
gttgtctgcatgtgtatgcg

SEQ ID NO: 81310 - DNA, 20 bp, Artificial sequence
  SiRNA target sequence
ttgtctgcatgtgtatgcgg

SEQ ID NO: 81311 - DNA, 20 bp, Artificial sequence
  SiRNA target sequence
tgtctgcatgtgtatgcggg

SEQ ID NO: 81312 - DNA, 20 bp, Artificial sequence
  SiRNA target sequence
gtctgcatgtgtatgcggga

SEQ ID NO: 81313 - DNA, 20 bp, Artificial sequence
  SiRNA target sequence
tctgcatgtgtatgcgggaa

SEQ ID NO: 81314 - DNA, 20 bp, Artificial sequence
  SiRNA target sequence
ctgcatgtgtatgcgggaaa

SEQ ID NO: 81315 - DNA, 20 bp, Artificial sequence
  SiRNA target sequence
tgcatgtgtatgcgggaaaa

SEQ ID NO: 81316 - DNA, 20 bp, Artificial sequence
  SiRNA target sequence
gcatgtgtatgcgggaaaaa

SEQ ID NO: 81317 - DNA, 20 bp, Artificial sequence
  SiRNA target sequence
catgtgtatgcgggaaaaaa

SEQ ID NO: 81318 - DNA, 20 bp, Artificial sequence
  SiRNA target sequence
atgtgtatgcgggaaaaaat

SEQ ID NO: 81319 - DNA, 20 bp, Artificial sequence
  SiRNA target sequence
tgtgtatgcgggaaaaaatg

SEQ ID NO: 81320 - DNA, 20 bp, Artificial sequence
  SiRNA target sequence
gtgtatgcgggaaaaaatgc

SEQ ID NO: 81321 - DNA, 20 bp, Artificial sequence
  SiRNA target sequence
tgtatgcgggaaaaaatgct

SEQ ID NO: 81322 - DNA, 20 bp, Artificial sequence
  SiRNA target sequence
gtatgcgggaaaaaatgctg

SEQ ID NO: 81323 - DNA, 20 bp, Artificial sequence
  SiRNA target sequence
tatgcgggaaaaaatgctgt

SEQ ID NO: 81324 - DNA, 20 bp, Artificial sequence
  SiRNA target sequence
atgcgggaaaaaatgctgtt

SEQ ID NO: 81325 - DNA, 20 bp, Artificial sequence
  SiRNA target sequence
tgcgggaaaaaatgctgttt

SEQ ID NO: 81326 - DNA, 20 bp, Artificial sequence
  SiRNA target sequence
gcgggaaaaaatgctgtttt

SEQ ID NO: 81327 - DNA, 20 bp, Artificial sequence
  SiRNA target sequence
cgggaaaaaatgctgttttg

SEQ ID NO: 81328 - DNA, 20 bp, Artificial sequence
  SiRNA target sequence
gggaaaaaatgctgttttgc

SEQ ID NO: 81329 - DNA, 20 bp, Artificial sequence
  SiRNA target sequence
ggaaaaaatgctgttttgct

SEQ ID NO: 81330 - DNA, 20 bp, Artificial sequence
  SiRNA target sequence
gaaaaaatgctgttttgcta

SEQ ID NO: 81331 - DNA, 20 bp, Artificial sequence
  SiRNA target sequence
aaaaaatgctgttttgctaa

SEQ ID NO: 81332 - DNA, 20 bp, Artificial sequence
  SiRNA target sequence
aaaaatgctgttttgctaaa

SEQ ID NO: 81333 - DNA, 20 bp, Artificial sequence
  SiRNA target sequence
aaaatgctgttttgctaaat

SEQ ID NO: 81334 - DNA, 20 bp, Artificial sequence
  SiRNA target sequence
aaatgctgttttgctaaata

SEQ ID NO: 81335 - DNA, 20 bp, Artificial sequence
  SiRNA target sequence
aatgctgttttgctaaataa

SEQ ID NO: 81336 - DNA, 20 bp, Artificial sequence
  SiRNA target sequence
atgctgttttgctaaataaa

SEQ ID NO: 81337 - DNA, 20 bp, Artificial sequence
  SiRNA target sequence
tgctgttttgctaaataaac

SEQ ID NO: 81338 - DNA, 20 bp, Artificial sequence
  SiRNA target sequence
gctgttttgctaaataaaca

SEQ ID NO: 81339 - DNA, 20 bp, Artificial sequence
  SiRNA target sequence
ctgttttgctaaataaacaa

SEQ ID NO: 81340 - DNA, 20 bp, Artificial sequence
  SiRNA target sequence
tgttttgctaaataaacaat

SEQ ID NO: 81341 - DNA, 20 bp, Artificial sequence
  SiRNA target sequence
gttttgctaaataaacaatc

SEQ ID NO: 81342 - DNA, 20 bp, Artificial sequence
  SiRNA target sequence
ttttgctaaataaacaatcc

SEQ ID NO: 81343 - DNA, 20 bp, Artificial sequence
  SiRNA target sequence
tttgctaaataaacaatcca

SEQ ID NO: 81344 - DNA, 20 bp, Artificial sequence
  SiRNA target sequence
ttgctaaataaacaatccat

SEQ ID NO: 81345 - DNA, 20 bp, Artificial sequence
  SiRNA target sequence
tgctaaataaacaatccata

SEQ ID NO: 81346 - DNA, 20 bp, Artificial sequence
  SiRNA target sequence
gctaaataaacaatccatac

SEQ ID NO: 81347 - DNA, 20 bp, Artificial sequence
  SiRNA target sequence
ctaaataaacaatccataca

SEQ ID NO: 81348 - DNA, 20 bp, Artificial sequence
  SiRNA target sequence
taaataaacaatccatacac

SEQ ID NO: 81349 - DNA, 20 bp, Artificial sequence
  SiRNA target sequence
aaataaacaatccatacacc

SEQ ID NO: 81350 - DNA, 20 bp, Artificial sequence
  SiRNA target sequence
aataaacaatccatacaccc

SEQ ID NO: 81351 - DNA, 20 bp, Artificial sequence
  SiRNA target sequence
ataaacaatccatacaccca

SEQ ID NO: 81352 - DNA, 20 bp, Artificial sequence
  SiRNA target sequence
taaacaatccatacacccaa

SEQ ID NO: 81353 - DNA, 20 bp, Artificial sequence
  SiRNA target sequence
aaacaatccatacacccaat

SEQ ID NO: 81354 - DNA, 20 bp, Artificial sequence
  SiRNA target sequence
aacaatccatacacccaata

SEQ ID NO: 81355 - DNA, 20 bp, Artificial sequence
  SiRNA target sequence
acaatccatacacccaataa

SEQ ID NO: 81356 - DNA, 20 bp, Artificial sequence
  SiRNA target sequence
caatccatacacccaataag

SEQ ID NO: 81357 - DNA, 20 bp, Artificial sequence
  SiRNA target sequence
aatccatacacccaataaga

SEQ ID NO: 81358 - DNA, 20 bp, Artificial sequence
  SiRNA target sequence
atccatacacccaataagat

SEQ ID NO: 81359 - DNA, 20 bp, Artificial sequence
  SiRNA target sequence
tccatacacccaataagata

SEQ ID NO: 81360 - DNA, 20 bp, Artificial sequence
  SiRNA target sequence
ccatacacccaataagataa

SEQ ID NO: 81361 - DNA, 20 bp, Artificial sequence
  SiRNA target sequence
catacacccaataagataat

SEQ ID NO: 81362 - DNA, 20 bp, Artificial sequence
  SiRNA target sequence
atacacccaataagataata

SEQ ID NO: 81363 - DNA, 20 bp, Artificial sequence
  SiRNA target sequence
tacacccaataagataataa

SEQ ID NO: 81364 - DNA, 20 bp, Artificial sequence
  SiRNA target sequence
acacccaataagataataag

SEQ ID NO: 81365 - DNA, 20 bp, Artificial sequence
  SiRNA target sequence
cacccaataagataataagt

SEQ ID NO: 81366 - DNA, 20 bp, Artificial sequence
  SiRNA target sequence
acccaataagataataagtc

SEQ ID NO: 81367 - DNA, 20 bp, Artificial sequence
  SiRNA target sequence
cccaataagataataagtcc

SEQ ID NO: 81368 - DNA, 20 bp, Artificial sequence
  SiRNA target sequence
ccaataagataataagtcct

SEQ ID NO: 81369 - DNA, 20 bp, Artificial sequence
  SiRNA target sequence
caataagataataagtcctc

SEQ ID NO: 81370 - DNA, 20 bp, Artificial sequence
  SiRNA target sequence
aataagataataagtcctct

SEQ ID NO: 81371 - DNA, 20 bp, Artificial sequence
  SiRNA target sequence
ataagataataagtcctctt

SEQ ID NO: 81372 - DNA, 20 bp, Artificial sequence
  SiRNA target sequence
taagataataagtcctctta

SEQ ID NO: 81373 - DNA, 20 bp, Artificial sequence
  SiRNA target sequence
aagataataagtcctcttaa

SEQ ID NO: 81374 - DNA, 20 bp, Artificial sequence
  SiRNA target sequence
agataataagtcctcttaat

SEQ ID NO: 81375 - DNA, 20 bp, Artificial sequence
  SiRNA target sequence
gataataagtcctcttaata

SEQ ID NO: 81376 - DNA, 20 bp, Artificial sequence
  SiRNA target sequence
ataataagtcctcttaatac

SEQ ID NO: 81377 - DNA, 20 bp, Artificial sequence
  SiRNA target sequence
taataagtcctcttaatact

SEQ ID NO: 81378 - DNA, 20 bp, Artificial sequence
  SiRNA target sequence
aataagtcctcttaatactt

SEQ ID NO: 81379 - DNA, 20 bp, Artificial sequence
  SiRNA target sequence
ataagtcctcttaatacttt

SEQ ID NO: 81380 - DNA, 20 bp, Artificial sequence
  SiRNA target sequence
taagtcctcttaatactttc

SEQ ID NO: 81381 - DNA, 20 bp, Artificial sequence
  SiRNA target sequence
aagtcctcttaatactttct

SEQ ID NO: 81382 - DNA, 20 bp, Artificial sequence
  SiRNA target sequence
agtcctcttaatactttctg

SEQ ID NO: 81383 - DNA, 20 bp, Artificial sequence
  SiRNA target sequence
gtcctcttaatactttctgc

SEQ ID NO: 81384 - DNA, 20 bp, Artificial sequence
  SiRNA target sequence
tcctcttaatactttctgct

SEQ ID NO: 81385 - DNA, 20 bp, Artificial sequence
  SiRNA target sequence
cctcttaatactttctgctc

SEQ ID NO: 81386 - DNA, 20 bp, Artificial sequence
  SiRNA target sequence
ctcttaatactttctgctct

SEQ ID NO: 81387 - DNA, 20 bp, Artificial sequence
  SiRNA target sequence
tcttaatactttctgctctt

SEQ ID NO: 81388 - DNA, 20 bp, Artificial sequence
  SiRNA target sequence
cttaatactttctgctcttt

SEQ ID NO: 81389 - DNA, 20 bp, Artificial sequence
  SiRNA target sequence
ttaatactttctgctctttg

SEQ ID NO: 81390 - DNA, 20 bp, Artificial sequence
  SiRNA target sequence
taatactttctgctctttgt

SEQ ID NO: 81391 - DNA, 20 bp, Artificial sequence
  SiRNA target sequence
aatactttctgctctttgtt

SEQ ID NO: 81392 - DNA, 20 bp, Artificial sequence
  SiRNA target sequence
atactttctgctctttgttc

SEQ ID NO: 81393 - DNA, 20 bp, Artificial sequence
  SiRNA target sequence
tactttctgctctttgttca

SEQ ID NO: 81394 - DNA, 20 bp, Artificial sequence
  SiRNA target sequence
actttctgctctttgttcat

SEQ ID NO: 81395 - DNA, 21 bp, Artificial sequence
  SiRNA target sequence
ttattctggttcacaaccaca

SEQ ID NO: 81396 - DNA, 21 bp, Artificial sequence
  SiRNA target sequence
tattctggttcacaaccacaa

SEQ ID NO: 81397 - DNA, 21 bp, Artificial sequence
  SiRNA target sequence
attctggttcacaaccacaac

SEQ ID NO: 81398 - DNA, 21 bp, Artificial sequence
  SiRNA target sequence
ttctggttcacaaccacaact

SEQ ID NO: 81399 - DNA, 21 bp, Artificial sequence
  SiRNA target sequence
tctggttcacaaccacaactc

SEQ ID NO: 81400 - DNA, 21 bp, Artificial sequence
  SiRNA target sequence
ctggttcacaaccacaactcc

SEQ ID NO: 81401 - DNA, 21 bp, Artificial sequence
  SiRNA target sequence
tggttcacaaccacaactcca

SEQ ID NO: 81402 - DNA, 21 bp, Artificial sequence
  SiRNA target sequence
ggttcacaaccacaactccaa

SEQ ID NO: 81403 - DNA, 21 bp, Artificial sequence
  SiRNA target sequence
gttcacaaccacaactccaaa

SEQ ID NO: 81404 - DNA, 21 bp, Artificial sequence
  SiRNA target sequence
ttcacaaccacaactccaaac

SEQ ID NO: 81405 - DNA, 21 bp, Artificial sequence
  SiRNA target sequence
tcacaaccacaactccaaaca

SEQ ID NO: 81406 - DNA, 21 bp, Artificial sequence
  SiRNA target sequence
cacaaccacaactccaaacac

SEQ ID NO: 81407 - DNA, 21 bp, Artificial sequence
  SiRNA target sequence
acaaccacaactccaaacacc

SEQ ID NO: 81408 - DNA, 21 bp, Artificial sequence
  SiRNA target sequence
caaccacaactccaaacacct

SEQ ID NO: 81409 - DNA, 21 bp, Artificial sequence
  SiRNA target sequence
aaccacaactccaaacacctt

SEQ ID NO: 81410 - DNA, 21 bp, Artificial sequence
  SiRNA target sequence
accacaactccaaacaccttc

SEQ ID NO: 81411 - DNA, 21 bp, Artificial sequence
  SiRNA target sequence
ccacaactccaaacaccttct

SEQ ID NO: 81412 - DNA, 21 bp, Artificial sequence
  SiRNA target sequence
cacaactccaaacaccttcta

SEQ ID NO: 81413 - DNA, 21 bp, Artificial sequence
  SiRNA target sequence
acaactccaaacaccttctac

SEQ ID NO: 81414 - DNA, 21 bp, Artificial sequence
  SiRNA target sequence
caactccaaacaccttctacc

SEQ ID NO: 81415 - DNA, 21 bp, Artificial sequence
  SiRNA target sequence
aactccaaacaccttctacct

SEQ ID NO: 81416 - DNA, 21 bp, Artificial sequence
  SiRNA target sequence
actccaaacaccttctacctt

SEQ ID NO: 81417 - DNA, 21 bp, Artificial sequence
  SiRNA target sequence
ctccaaacaccttctaccttt

SEQ ID NO: 81418 - DNA, 21 bp, Artificial sequence
  SiRNA target sequence
tccaaacaccttctacctttt

SEQ ID NO: 81419 - DNA, 21 bp, Artificial sequence
  SiRNA target sequence
ccaaacaccttctaccttttt

SEQ ID NO: 81420 - DNA, 21 bp, Artificial sequence
  SiRNA target sequence
caaacaccttctaccttttta

SEQ ID NO: 81421 - DNA, 21 bp, Artificial sequence
  SiRNA target sequence
aaacaccttctacctttttac

SEQ ID NO: 81422 - DNA, 21 bp, Artificial sequence
  SiRNA target sequence
aacaccttctacctttttaca

SEQ ID NO: 81423 - DNA, 21 bp, Artificial sequence
  SiRNA target sequence
acaccttctacctttttacag

SEQ ID NO: 81424 - DNA, 21 bp, Artificial sequence
  SiRNA target sequence
caccttctacctttttacagt

SEQ ID NO: 81425 - DNA, 21 bp, Artificial sequence
  SiRNA target sequence
accttctacctttttacagtc

SEQ ID NO: 81426 - DNA, 21 bp, Artificial sequence
  SiRNA target sequence
ccttctacctttttacagtcc

SEQ ID NO: 81427 - DNA, 21 bp, Artificial sequence
  SiRNA target sequence
cttctacctttttacagtcca

SEQ ID NO: 81428 - DNA, 21 bp, Artificial sequence
  SiRNA target sequence
ttctacctttttacagtccat

SEQ ID NO: 81429 - DNA, 21 bp, Artificial sequence
  SiRNA target sequence
tctacctttttacagtccata

SEQ ID NO: 81430 - DNA, 21 bp, Artificial sequence
  SiRNA target sequence
ctacctttttacagtccataa

SEQ ID NO: 81431 - DNA, 21 bp, Artificial sequence
  SiRNA target sequence
tacctttttacagtccataat

SEQ ID NO: 81432 - DNA, 21 bp, Artificial sequence
  SiRNA target sequence
acctttttacagtccataatg

SEQ ID NO: 81433 - DNA, 21 bp, Artificial sequence
  SiRNA target sequence
cctttttacagtccataatgg

SEQ ID NO: 81434 - DNA, 21 bp, Artificial sequence
  SiRNA target sequence
ctttttacagtccataatggg

SEQ ID NO: 81435 - DNA, 21 bp, Artificial sequence
  SiRNA target sequence
tttttacagtccataatgggc

SEQ ID NO: 81436 - DNA, 21 bp, Artificial sequence
  SiRNA target sequence
ttttacagtccataatgggct

SEQ ID NO: 81437 - DNA, 21 bp, Artificial sequence
  SiRNA target sequence
tttacagtccataatgggctt

SEQ ID NO: 81438 - DNA, 21 bp, Artificial sequence
  SiRNA target sequence
ttacagtccataatgggcttt

SEQ ID NO: 81439 - DNA, 21 bp, Artificial sequence
  SiRNA target sequence
tacagtccataatgggctttc

SEQ ID NO: 81440 - DNA, 21 bp, Artificial sequence
  SiRNA target sequence
acagtccataatgggctttcc

SEQ ID NO: 81441 - DNA, 21 bp, Artificial sequence
  SiRNA target sequence
cagtccataatgggctttcct

SEQ ID NO: 81442 - DNA, 21 bp, Artificial sequence
  SiRNA target sequence
agtccataatgggctttccta

SEQ ID NO: 81443 - DNA, 21 bp, Artificial sequence
  SiRNA target sequence
gtccataatgggctttcctaa

SEQ ID NO: 81444 - DNA, 21 bp, Artificial sequence
  SiRNA target sequence
tccataatgggctttcctaat

SEQ ID NO: 81445 - DNA, 21 bp, Artificial sequence
  SiRNA target sequence
ccataatgggctttcctaatc

SEQ ID NO: 81446 - DNA, 21 bp, Artificial sequence
  SiRNA target sequence
cataatgggctttcctaatct

SEQ ID NO: 81447 - DNA, 21 bp, Artificial sequence
  SiRNA target sequence
ataatgggctttcctaatctt

SEQ ID NO: 81448 - DNA, 21 bp, Artificial sequence
  SiRNA target sequence
taatgggctttcctaatcttt

SEQ ID NO: 81449 - DNA, 21 bp, Artificial sequence
  SiRNA target sequence
aatgggctttcctaatctttt

SEQ ID NO: 81450 - DNA, 21 bp, Artificial sequence
  SiRNA target sequence
atgggctttcctaatctttta

SEQ ID NO: 81451 - DNA, 21 bp, Artificial sequence
  SiRNA target sequence
tgggctttcctaatcttttat

SEQ ID NO: 81452 - DNA, 21 bp, Artificial sequence
  SiRNA target sequence
gggctttcctaatcttttatt

SEQ ID NO: 81453 - DNA, 21 bp, Artificial sequence
  SiRNA target sequence
ggctttcctaatcttttatta

SEQ ID NO: 81454 - DNA, 21 bp, Artificial sequence
  SiRNA target sequence
gctttcctaatcttttattaa

SEQ ID NO: 81455 - DNA, 21 bp, Artificial sequence
  SiRNA target sequence
ctttcctaatcttttattaac

SEQ ID NO: 81456 - DNA, 21 bp, Artificial sequence
  SiRNA target sequence
tttcctaatcttttattaact

SEQ ID NO: 81457 - DNA, 21 bp, Artificial sequence
  SiRNA target sequence
ttcctaatcttttattaacta

SEQ ID NO: 81458 - DNA, 21 bp, Artificial sequence
  SiRNA target sequence
tcctaatcttttattaactat

SEQ ID NO: 81459 - DNA, 21 bp, Artificial sequence
  SiRNA target sequence
cctaatcttttattaactatg

SEQ ID NO: 81460 - DNA, 21 bp, Artificial sequence
  SiRNA target sequence
ctaatcttttattaactatgt

SEQ ID NO: 81461 - DNA, 21 bp, Artificial sequence
  SiRNA target sequence
taatcttttattaactatgtt

SEQ ID NO: 81462 - DNA, 21 bp, Artificial sequence
  SiRNA target sequence
aatcttttattaactatgtta

SEQ ID NO: 81463 - DNA, 21 bp, Artificial sequence
  SiRNA target sequence
atcttttattaactatgttat

SEQ ID NO: 81464 - DNA, 21 bp, Artificial sequence
  SiRNA target sequence
tcttttattaactatgttatg

SEQ ID NO: 81465 - DNA, 21 bp, Artificial sequence
  SiRNA target sequence
cttttattaactatgttatgt

SEQ ID NO: 81466 - DNA, 21 bp, Artificial sequence
  SiRNA target sequence
ttttattaactatgttatgtg

SEQ ID NO: 81467 - DNA, 21 bp, Artificial sequence
  SiRNA target sequence
tttattaactatgttatgtgc

SEQ ID NO: 81468 - DNA, 21 bp, Artificial sequence
  SiRNA target sequence
ttattaactatgttatgtgct

SEQ ID NO: 81469 - DNA, 21 bp, Artificial sequence
  SiRNA target sequence
tattaactatgttatgtgctt

SEQ ID NO: 81470 - DNA, 21 bp, Artificial sequence
  SiRNA target sequence
attaactatgttatgtgcttt

SEQ ID NO: 81471 - DNA, 21 bp, Artificial sequence
  SiRNA target sequence
ttaactatgttatgtgcttta

SEQ ID NO: 81472 - DNA, 21 bp, Artificial sequence
  SiRNA target sequence
taactatgttatgtgctttac

SEQ ID NO: 81473 - DNA, 21 bp, Artificial sequence
  SiRNA target sequence
aactatgttatgtgctttaca

SEQ ID NO: 81474 - DNA, 21 bp, Artificial sequence
  SiRNA target sequence
actatgttatgtgctttacat

SEQ ID NO: 81475 - DNA, 21 bp, Artificial sequence
  SiRNA target sequence
ctatgttatgtgctttacata

SEQ ID NO: 81476 - DNA, 21 bp, Artificial sequence
  SiRNA target sequence
tatgttatgtgctttacatag

SEQ ID NO: 81477 - DNA, 21 bp, Artificial sequence
  SiRNA target sequence
atgttatgtgctttacatagc

SEQ ID NO: 81478 - DNA, 21 bp, Artificial sequence
  SiRNA target sequence
tgttatgtgctttacatagcc

SEQ ID NO: 81479 - DNA, 21 bp, Artificial sequence
  SiRNA target sequence
gttatgtgctttacatagcca

SEQ ID NO: 81480 - DNA, 21 bp, Artificial sequence
  SiRNA target sequence
ttatgtgctttacatagccac

SEQ ID NO: 81481 - DNA, 21 bp, Artificial sequence
  SiRNA target sequence
tatgtgctttacatagccact

SEQ ID NO: 81482 - DNA, 21 bp, Artificial sequence
  SiRNA target sequence
atgtgctttacatagccactg

SEQ ID NO: 81483 - DNA, 21 bp, Artificial sequence
  SiRNA target sequence
tgtgctttacatagccactgg

SEQ ID NO: 81484 - DNA, 21 bp, Artificial sequence
  SiRNA target sequence
gtgctttacatagccactgga

SEQ ID NO: 81485 - DNA, 21 bp, Artificial sequence
  SiRNA target sequence
tgctttacatagccactggac

SEQ ID NO: 81486 - DNA, 21 bp, Artificial sequence
  SiRNA target sequence
gctttacatagccactggaca

SEQ ID NO: 81487 - DNA, 21 bp, Artificial sequence
  SiRNA target sequence
ctttacatagccactggacaa

SEQ ID NO: 81488 - DNA, 21 bp, Artificial sequence
  SiRNA target sequence
tttacatagccactggacaaa

SEQ ID NO: 81489 - DNA, 21 bp, Artificial sequence
  SiRNA target sequence
ttacatagccactggacaaat

SEQ ID NO: 81490 - DNA, 21 bp, Artificial sequence
  SiRNA target sequence
tacatagccactggacaaatt

SEQ ID NO: 81491 - DNA, 21 bp, Artificial sequence
  SiRNA target sequence
acatagccactggacaaattc

SEQ ID NO: 81492 - DNA, 21 bp, Artificial sequence
  SiRNA target sequence
catagccactggacaaattcg

SEQ ID NO: 81493 - DNA, 21 bp, Artificial sequence
  SiRNA target sequence
atagccactggacaaattcgt

SEQ ID NO: 81494 - DNA, 21 bp, Artificial sequence
  SiRNA target sequence
tagccactggacaaattcgtc

SEQ ID NO: 81495 - DNA, 21 bp, Artificial sequence
  SiRNA target sequence
agccactggacaaattcgtca

SEQ ID NO: 81496 - DNA, 21 bp, Artificial sequence
  SiRNA target sequence
gccactggacaaattcgtcat

SEQ ID NO: 81497 - DNA, 21 bp, Artificial sequence
  SiRNA target sequence
ccactggacaaattcgtcatg

SEQ ID NO: 81498 - DNA, 21 bp, Artificial sequence
  SiRNA target sequence
cactggacaaattcgtcatgt

SEQ ID NO: 81499 - DNA, 21 bp, Artificial sequence
  SiRNA target sequence
actggacaaattcgtcatgtg

SEQ ID NO: 81500 - DNA, 21 bp, Artificial sequence
  SiRNA target sequence
ctggacaaattcgtcatgtgt

SEQ ID NO: 81501 - DNA, 21 bp, Artificial sequence
  SiRNA target sequence
tggacaaattcgtcatgtgtg

SEQ ID NO: 81502 - DNA, 21 bp, Artificial sequence
  SiRNA target sequence
ggacaaattcgtcatgtgtgg

SEQ ID NO: 81503 - DNA, 21 bp, Artificial sequence
  SiRNA target sequence
gacaaattcgtcatgtgtggc

SEQ ID NO: 81504 - DNA, 21 bp, Artificial sequence
  SiRNA target sequence
acaaattcgtcatgtgtggca

SEQ ID NO: 81505 - DNA, 21 bp, Artificial sequence
  SiRNA target sequence
caaattcgtcatgtgtggcaa

SEQ ID NO: 81506 - DNA, 21 bp, Artificial sequence
  SiRNA target sequence
aaattcgtcatgtgtggcaac

SEQ ID NO: 81507 - DNA, 21 bp, Artificial sequence
  SiRNA target sequence
aattcgtcatgtgtggcaact

SEQ ID NO: 81508 - DNA, 21 bp, Artificial sequence
  SiRNA target sequence
attcgtcatgtgtggcaactt

SEQ ID NO: 81509 - DNA, 21 bp, Artificial sequence
  SiRNA target sequence
ttcgtcatgtgtggcaacttg

SEQ ID NO: 81510 - DNA, 21 bp, Artificial sequence
  SiRNA target sequence
tcgtcatgtgtggcaacttgt

SEQ ID NO: 81511 - DNA, 21 bp, Artificial sequence
  SiRNA target sequence
cgtcatgtgtggcaacttgtg

SEQ ID NO: 81512 - DNA, 21 bp, Artificial sequence
  SiRNA target sequence
gtcatgtgtggcaacttgtgg

SEQ ID NO: 81513 - DNA, 21 bp, Artificial sequence
  SiRNA target sequence
tcatgtgtggcaacttgtgga

SEQ ID NO: 81514 - DNA, 21 bp, Artificial sequence
  SiRNA target sequence
catgtgtggcaacttgtggag

SEQ ID NO: 81515 - DNA, 21 bp, Artificial sequence
  SiRNA target sequence
atgtgtggcaacttgtggagg

SEQ ID NO: 81516 - DNA, 21 bp, Artificial sequence
  SiRNA target sequence
tgtgtggcaacttgtggagga

SEQ ID NO: 81517 - DNA, 21 bp, Artificial sequence
  SiRNA target sequence
gtgtggcaacttgtggaggat

SEQ ID NO: 81518 - DNA, 21 bp, Artificial sequence
  SiRNA target sequence
tgtggcaacttgtggaggatt

SEQ ID NO: 81519 - DNA, 21 bp, Artificial sequence
  SiRNA target sequence
gtggcaacttgtggaggattt

SEQ ID NO: 81520 - DNA, 21 bp, Artificial sequence
  SiRNA target sequence
tggcaacttgtggaggattta

SEQ ID NO: 81521 - DNA, 21 bp, Artificial sequence
  SiRNA target sequence
ggcaacttgtggaggatttaa

SEQ ID NO: 81522 - DNA, 21 bp, Artificial sequence
  SiRNA target sequence
gcaacttgtggaggatttaag

SEQ ID NO: 81523 - DNA, 21 bp, Artificial sequence
  SiRNA target sequence
caacttgtggaggatttaagc

SEQ ID NO: 81524 - DNA, 21 bp, Artificial sequence
  SiRNA target sequence
aacttgtggaggatttaagct

SEQ ID NO: 81525 - DNA, 21 bp, Artificial sequence
  SiRNA target sequence
acttgtggaggatttaagctt

SEQ ID NO: 81526 - DNA, 21 bp, Artificial sequence
  SiRNA target sequence
cttgtggaggatttaagctta

SEQ ID NO: 81527 - DNA, 21 bp, Artificial sequence
  SiRNA target sequence
ttgtggaggatttaagcttaa

SEQ ID NO: 81528 - DNA, 21 bp, Artificial sequence
  SiRNA target sequence
tgtggaggatttaagcttaac

SEQ ID NO: 81529 - DNA, 21 bp, Artificial sequence
  SiRNA target sequence
gtggaggatttaagcttaaca

SEQ ID NO: 81530 - DNA, 21 bp, Artificial sequence
  SiRNA target sequence
tggaggatttaagcttaacag

SEQ ID NO: 81531 - DNA, 21 bp, Artificial sequence
  SiRNA target sequence
ggaggatttaagcttaacagt

SEQ ID NO: 81532 - DNA, 21 bp, Artificial sequence
  SiRNA target sequence
gaggatttaagcttaacagtc

SEQ ID NO: 81533 - DNA, 21 bp, Artificial sequence
  SiRNA target sequence
aggatttaagcttaacagtct

SEQ ID NO: 81534 - DNA, 21 bp, Artificial sequence
  SiRNA target sequence
ggatttaagcttaacagtctt

SEQ ID NO: 81535 - DNA, 21 bp, Artificial sequence
  SiRNA target sequence
gatttaagcttaacagtcttt

SEQ ID NO: 81536 - DNA, 21 bp, Artificial sequence
  SiRNA target sequence
atttaagcttaacagtctttg

SEQ ID NO: 81537 - DNA, 21 bp, Artificial sequence
  SiRNA target sequence
tttaagcttaacagtctttga

SEQ ID NO: 81538 - DNA, 21 bp, Artificial sequence
  SiRNA target sequence
ttaagcttaacagtctttgaa

SEQ ID NO: 81539 - DNA, 21 bp, Artificial sequence
  SiRNA target sequence
taagcttaacagtctttgaaa

SEQ ID NO: 81540 - DNA, 21 bp, Artificial sequence
  SiRNA target sequence
aagcttaacagtctttgaaaa

SEQ ID NO: 81541 - DNA, 21 bp, Artificial sequence
  SiRNA target sequence
agcttaacagtctttgaaaat

SEQ ID NO: 81542 - DNA, 21 bp, Artificial sequence
  SiRNA target sequence
gcttaacagtctttgaaaatg

SEQ ID NO: 81543 - DNA, 21 bp, Artificial sequence
  SiRNA target sequence
cttaacagtctttgaaaatgt

SEQ ID NO: 81544 - DNA, 21 bp, Artificial sequence
  SiRNA target sequence
ttaacagtctttgaaaatgtc

SEQ ID NO: 81545 - DNA, 21 bp, Artificial sequence
  SiRNA target sequence
taacagtctttgaaaatgtcc

SEQ ID NO: 81546 - DNA, 21 bp, Artificial sequence
  SiRNA target sequence
aacagtctttgaaaatgtcca

SEQ ID NO: 81547 - DNA, 21 bp, Artificial sequence
  SiRNA target sequence
acagtctttgaaaatgtccac

SEQ ID NO: 81548 - DNA, 21 bp, Artificial sequence
  SiRNA target sequence
cagtctttgaaaatgtccaca

SEQ ID NO: 81549 - DNA, 21 bp, Artificial sequence
  SiRNA target sequence
agtctttgaaaatgtccacaa

SEQ ID NO: 81550 - DNA, 21 bp, Artificial sequence
  SiRNA target sequence
gtctttgaaaatgtccacaac

SEQ ID NO: 81551 - DNA, 21 bp, Artificial sequence
  SiRNA target sequence
tctttgaaaatgtccacaaca

SEQ ID NO: 81552 - DNA, 21 bp, Artificial sequence
  SiRNA target sequence
ctttgaaaatgtccacaacat

SEQ ID NO: 81553 - DNA, 21 bp, Artificial sequence
  SiRNA target sequence
tttgaaaatgtccacaacatt

SEQ ID NO: 81554 - DNA, 21 bp, Artificial sequence
  SiRNA target sequence
ttgaaaatgtccacaacattc

SEQ ID NO: 81555 - DNA, 21 bp, Artificial sequence
  SiRNA target sequence
tgaaaatgtccacaacattct

SEQ ID NO: 81556 - DNA, 21 bp, Artificial sequence
  SiRNA target sequence
gaaaatgtccacaacattctg

SEQ ID NO: 81557 - DNA, 21 bp, Artificial sequence
  SiRNA target sequence
aaaatgtccacaacattctgc

SEQ ID NO: 81558 - DNA, 21 bp, Artificial sequence
  SiRNA target sequence
aaatgtccacaacattctgca

SEQ ID NO: 81559 - DNA, 21 bp, Artificial sequence
  SiRNA target sequence
aatgtccacaacattctgcac

SEQ ID NO: 81560 - DNA, 21 bp, Artificial sequence
  SiRNA target sequence
atgtccacaacattctgcaca

SEQ ID NO: 81561 - DNA, 21 bp, Artificial sequence
  SiRNA target sequence
tgtccacaacattctgcacag

SEQ ID NO: 81562 - DNA, 21 bp, Artificial sequence
  SiRNA target sequence
gtccacaacattctgcacagg

SEQ ID NO: 81563 - DNA, 21 bp, Artificial sequence
  SiRNA target sequence
tccacaacattctgcacaggg

SEQ ID NO: 81564 - DNA, 21 bp, Artificial sequence
  SiRNA target sequence
ccacaacattctgcacagggg

SEQ ID NO: 81565 - DNA, 21 bp, Artificial sequence
  SiRNA target sequence
cacaacattctgcacagggga

SEQ ID NO: 81566 - DNA, 21 bp, Artificial sequence
  SiRNA target sequence
acaacattctgcacaggggaa

SEQ ID NO: 81567 - DNA, 21 bp, Artificial sequence
  SiRNA target sequence
caacattctgcacaggggaaa

SEQ ID NO: 81568 - DNA, 21 bp, Artificial sequence
  SiRNA target sequence
aacattctgcacaggggaaaa

SEQ ID NO: 81569 - DNA, 21 bp, Artificial sequence
  SiRNA target sequence
acattctgcacaggggaaaag

SEQ ID NO: 81570 - DNA, 21 bp, Artificial sequence
  SiRNA target sequence
cattctgcacaggggaaaaga

SEQ ID NO: 81571 - DNA, 21 bp, Artificial sequence
  SiRNA target sequence
attctgcacaggggaaaagag

SEQ ID NO: 81572 - DNA, 21 bp, Artificial sequence
  SiRNA target sequence
ttctgcacaggggaaaagaga

SEQ ID NO: 81573 - DNA, 21 bp, Artificial sequence
  SiRNA target sequence
tctgcacaggggaaaagagat

SEQ ID NO: 81574 - DNA, 21 bp, Artificial sequence
  SiRNA target sequence
ctgcacaggggaaaagagatg

SEQ ID NO: 81575 - DNA, 21 bp, Artificial sequence
  SiRNA target sequence
tgcacaggggaaaagagatga

SEQ ID NO: 81576 - DNA, 21 bp, Artificial sequence
  SiRNA target sequence
gcacaggggaaaagagatgat

SEQ ID NO: 81577 - DNA, 21 bp, Artificial sequence
  SiRNA target sequence
cacaggggaaaagagatgata

SEQ ID NO: 81578 - DNA, 21 bp, Artificial sequence
  SiRNA target sequence
acaggggaaaagagatgataa

SEQ ID NO: 81579 - DNA, 21 bp, Artificial sequence
  SiRNA target sequence
caggggaaaagagatgataaa

SEQ ID NO: 81580 - DNA, 21 bp, Artificial sequence
  SiRNA target sequence
aggggaaaagagatgataaaa

SEQ ID NO: 81581 - DNA, 21 bp, Artificial sequence
  SiRNA target sequence
ggggaaaagagatgataaaag

SEQ ID NO: 81582 - DNA, 21 bp, Artificial sequence
  SiRNA target sequence
gggaaaagagatgataaaagg

SEQ ID NO: 81583 - DNA, 21 bp, Artificial sequence
  SiRNA target sequence
ggaaaagagatgataaaaggt

SEQ ID NO: 81584 - DNA, 21 bp, Artificial sequence
  SiRNA target sequence
gaaaagagatgataaaaggta

SEQ ID NO: 81585 - DNA, 21 bp, Artificial sequence
  SiRNA target sequence
aaaagagatgataaaaggtaa

SEQ ID NO: 81586 - DNA, 21 bp, Artificial sequence
  SiRNA target sequence
aaagagatgataaaaggtaaa

SEQ ID NO: 81587 - DNA, 21 bp, Artificial sequence
  SiRNA target sequence
aagagatgataaaaggtaaat

SEQ ID NO: 81588 - DNA, 21 bp, Artificial sequence
  SiRNA target sequence
agagatgataaaaggtaaata

SEQ ID NO: 81589 - DNA, 21 bp, Artificial sequence
  SiRNA target sequence
gagatgataaaaggtaaataa

SEQ ID NO: 81590 - DNA, 21 bp, Artificial sequence
  SiRNA target sequence
agatgataaaaggtaaataaa

SEQ ID NO: 81591 - DNA, 21 bp, Artificial sequence
  SiRNA target sequence
gatgataaaaggtaaataaat

SEQ ID NO: 81592 - DNA, 21 bp, Artificial sequence
  SiRNA target sequence
atgataaaaggtaaataaatt

SEQ ID NO: 81593 - DNA, 21 bp, Artificial sequence
  SiRNA target sequence
tgataaaaggtaaataaattg

SEQ ID NO: 81594 - DNA, 21 bp, Artificial sequence
  SiRNA target sequence
gataaaaggtaaataaattga

SEQ ID NO: 81595 - DNA, 21 bp, Artificial sequence
  SiRNA target sequence
ataaaaggtaaataaattgaa

SEQ ID NO: 81596 - DNA, 21 bp, Artificial sequence
  SiRNA target sequence
taaaaggtaaataaattgaag

SEQ ID NO: 81597 - DNA, 21 bp, Artificial sequence
  SiRNA target sequence
aaaaggtaaataaattgaagt

SEQ ID NO: 81598 - DNA, 21 bp, Artificial sequence
  SiRNA target sequence
aaaggtaaataaattgaagtg

SEQ ID NO: 81599 - DNA, 21 bp, Artificial sequence
  SiRNA target sequence
aaggtaaataaattgaagtgt

SEQ ID NO: 81600 - DNA, 21 bp, Artificial sequence
  SiRNA target sequence
aggtaaataaattgaagtgta

SEQ ID NO: 81601 - DNA, 21 bp, Artificial sequence
  SiRNA target sequence
ggtaaataaattgaagtgtat

SEQ ID NO: 81602 - DNA, 21 bp, Artificial sequence
  SiRNA target sequence
gtaaataaattgaagtgtatc

SEQ ID NO: 81603 - DNA, 21 bp, Artificial sequence
  SiRNA target sequence
taaataaattgaagtgtatct

SEQ ID NO: 81604 - DNA, 21 bp, Artificial sequence
  SiRNA target sequence
aaataaattgaagtgtatctt

SEQ ID NO: 81605 - DNA, 21 bp, Artificial sequence
  SiRNA target sequence
aataaattgaagtgtatcttt

SEQ ID NO: 81606 - DNA, 21 bp, Artificial sequence
  SiRNA target sequence
ataaattgaagtgtatctttt

SEQ ID NO: 81607 - DNA, 21 bp, Artificial sequence
  SiRNA target sequence
taaattgaagtgtatcttttt

SEQ ID NO: 81608 - DNA, 21 bp, Artificial sequence
  SiRNA target sequence
aaattgaagtgtatctttttt

SEQ ID NO: 81609 - DNA, 21 bp, Artificial sequence
  SiRNA target sequence
aattgaagtgtatctttttta

SEQ ID NO: 81610 - DNA, 21 bp, Artificial sequence
  SiRNA target sequence
attgaagtgtatcttttttat

SEQ ID NO: 81611 - DNA, 21 bp, Artificial sequence
  SiRNA target sequence
ttgaagtgtatcttttttatg

SEQ ID NO: 81612 - DNA, 21 bp, Artificial sequence
  SiRNA target sequence
tgaagtgtatcttttttatgt

SEQ ID NO: 81613 - DNA, 21 bp, Artificial sequence
  SiRNA target sequence
gaagtgtatcttttttatgtt

SEQ ID NO: 81614 - DNA, 21 bp, Artificial sequence
  SiRNA target sequence
aagtgtatcttttttatgttg

SEQ ID NO: 81615 - DNA, 21 bp, Artificial sequence
  SiRNA target sequence
agtgtatcttttttatgttgt

SEQ ID NO: 81616 - DNA, 21 bp, Artificial sequence
  SiRNA target sequence
gtgtatcttttttatgttgta

SEQ ID NO: 81617 - DNA, 21 bp, Artificial sequence
  SiRNA target sequence
tgtatcttttttatgttgtac

SEQ ID NO: 81618 - DNA, 21 bp, Artificial sequence
  SiRNA target sequence
gtatcttttttatgttgtact

SEQ ID NO: 81619 - DNA, 21 bp, Artificial sequence
  SiRNA target sequence
tatcttttttatgttgtactg

SEQ ID NO: 81620 - DNA, 21 bp, Artificial sequence
  SiRNA target sequence
atcttttttatgttgtactgt

SEQ ID NO: 81621 - DNA, 21 bp, Artificial sequence
  SiRNA target sequence
tcttttttatgttgtactgta

SEQ ID NO: 81622 - DNA, 21 bp, Artificial sequence
  SiRNA target sequence
cttttttatgttgtactgtag

SEQ ID NO: 81623 - DNA, 21 bp, Artificial sequence
  SiRNA target sequence
ttttttatgttgtactgtagg

SEQ ID NO: 81624 - DNA, 21 bp, Artificial sequence
  SiRNA target sequence
tttttatgttgtactgtagga

SEQ ID NO: 81625 - DNA, 21 bp, Artificial sequence
  SiRNA target sequence
ttttatgttgtactgtaggaa

SEQ ID NO: 81626 - DNA, 21 bp, Artificial sequence
  SiRNA target sequence
tttatgttgtactgtaggaaa

SEQ ID NO: 81627 - DNA, 21 bp, Artificial sequence
  SiRNA target sequence
ttatgttgtactgtaggaaat

SEQ ID NO: 81628 - DNA, 21 bp, Artificial sequence
  SiRNA target sequence
tatgttgtactgtaggaaatg

SEQ ID NO: 81629 - DNA, 21 bp, Artificial sequence
  SiRNA target sequence
atgttgtactgtaggaaatgc

SEQ ID NO: 81630 - DNA, 21 bp, Artificial sequence
  SiRNA target sequence
tgttgtactgtaggaaatgca

SEQ ID NO: 81631 - DNA, 21 bp, Artificial sequence
  SiRNA target sequence
gttgtactgtaggaaatgcag

SEQ ID NO: 81632 - DNA, 21 bp, Artificial sequence
  SiRNA target sequence
ttgtactgtaggaaatgcagg

SEQ ID NO: 81633 - DNA, 21 bp, Artificial sequence
  SiRNA target sequence
tgtactgtaggaaatgcagga

SEQ ID NO: 81634 - DNA, 21 bp, Artificial sequence
  SiRNA target sequence
gtactgtaggaaatgcaggat

SEQ ID NO: 81635 - DNA, 21 bp, Artificial sequence
  SiRNA target sequence
tactgtaggaaatgcaggata

SEQ ID NO: 81636 - DNA, 21 bp, Artificial sequence
  SiRNA target sequence
actgtaggaaatgcaggataa

SEQ ID NO: 81637 - DNA, 21 bp, Artificial sequence
  SiRNA target sequence
ctgtaggaaatgcaggataaa

SEQ ID NO: 81638 - DNA, 21 bp, Artificial sequence
  SiRNA target sequence
tgtaggaaatgcaggataaac

SEQ ID NO: 81639 - DNA, 21 bp, Artificial sequence
  SiRNA target sequence
gtaggaaatgcaggataaaca

SEQ ID NO: 81640 - DNA, 21 bp, Artificial sequence
  SiRNA target sequence
taggaaatgcaggataaacag

SEQ ID NO: 81641 - DNA, 21 bp, Artificial sequence
  SiRNA target sequence
aggaaatgcaggataaacagc

SEQ ID NO: 81642 - DNA, 21 bp, Artificial sequence
  SiRNA target sequence
ggaaatgcaggataaacagct

SEQ ID NO: 81643 - DNA, 21 bp, Artificial sequence
  SiRNA target sequence
gaaatgcaggataaacagctg

SEQ ID NO: 81644 - DNA, 21 bp, Artificial sequence
  SiRNA target sequence
aaatgcaggataaacagctgc

SEQ ID NO: 81645 - DNA, 21 bp, Artificial sequence
  SiRNA target sequence
aatgcaggataaacagctgcc

SEQ ID NO: 81646 - DNA, 21 bp, Artificial sequence
  SiRNA target sequence
atgcaggataaacagctgcca

SEQ ID NO: 81647 - DNA, 21 bp, Artificial sequence
  SiRNA target sequence
tgcaggataaacagctgccat

SEQ ID NO: 81648 - DNA, 21 bp, Artificial sequence
  SiRNA target sequence
gcaggataaacagctgccatg

SEQ ID NO: 81649 - DNA, 21 bp, Artificial sequence
  SiRNA target sequence
caggataaacagctgccatgg

SEQ ID NO: 81650 - DNA, 21 bp, Artificial sequence
  SiRNA target sequence
aggataaacagctgccatggt

SEQ ID NO: 81651 - DNA, 21 bp, Artificial sequence
  SiRNA target sequence
ggataaacagctgccatggta

SEQ ID NO: 81652 - DNA, 21 bp, Artificial sequence
  SiRNA target sequence
gataaacagctgccatggtat

SEQ ID NO: 81653 - DNA, 21 bp, Artificial sequence
  SiRNA target sequence
ataaacagctgccatggtatg

SEQ ID NO: 81654 - DNA, 21 bp, Artificial sequence
  SiRNA target sequence
taaacagctgccatggtatgt

SEQ ID NO: 81655 - DNA, 21 bp, Artificial sequence
  SiRNA target sequence
aaacagctgccatggtatgta

SEQ ID NO: 81656 - DNA, 21 bp, Artificial sequence
  SiRNA target sequence
aacagctgccatggtatgtaa

SEQ ID NO: 81657 - DNA, 21 bp, Artificial sequence
  SiRNA target sequence
acagctgccatggtatgtaaa

SEQ ID NO: 81658 - DNA, 21 bp, Artificial sequence
  SiRNA target sequence
cagctgccatggtatgtaaaa

SEQ ID NO: 81659 - DNA, 21 bp, Artificial sequence
  SiRNA target sequence
agctgccatggtatgtaaaag

SEQ ID NO: 81660 - DNA, 21 bp, Artificial sequence
  SiRNA target sequence
gctgccatggtatgtaaaagt

SEQ ID NO: 81661 - DNA, 21 bp, Artificial sequence
  SiRNA target sequence
ctgccatggtatgtaaaagtg

SEQ ID NO: 81662 - DNA, 21 bp, Artificial sequence
  SiRNA target sequence
tgccatggtatgtaaaagtgt

SEQ ID NO: 81663 - DNA, 21 bp, Artificial sequence
  SiRNA target sequence
gccatggtatgtaaaagtgtc

SEQ ID NO: 81664 - DNA, 21 bp, Artificial sequence
  SiRNA target sequence
ccatggtatgtaaaagtgtcc

SEQ ID NO: 81665 - DNA, 21 bp, Artificial sequence
  SiRNA target sequence
catggtatgtaaaagtgtcca

SEQ ID NO: 81666 - DNA, 21 bp, Artificial sequence
  SiRNA target sequence
atggtatgtaaaagtgtccat

SEQ ID NO: 81667 - DNA, 21 bp, Artificial sequence
  SiRNA target sequence
tggtatgtaaaagtgtccatg

SEQ ID NO: 81668 - DNA, 21 bp, Artificial sequence
  SiRNA target sequence
ggtatgtaaaagtgtccatgt

SEQ ID NO: 81669 - DNA, 21 bp, Artificial sequence
  SiRNA target sequence
gtatgtaaaagtgtccatgtt

SEQ ID NO: 81670 - DNA, 21 bp, Artificial sequence
  SiRNA target sequence
tatgtaaaagtgtccatgttg

SEQ ID NO: 81671 - DNA, 21 bp, Artificial sequence
  SiRNA target sequence
atgtaaaagtgtccatgttgc

SEQ ID NO: 81672 - DNA, 21 bp, Artificial sequence
  SiRNA target sequence
tgtaaaagtgtccatgttgct

SEQ ID NO: 81673 - DNA, 21 bp, Artificial sequence
  SiRNA target sequence
gtaaaagtgtccatgttgctc

SEQ ID NO: 81674 - DNA, 21 bp, Artificial sequence
  SiRNA target sequence
taaaagtgtccatgttgctct

SEQ ID NO: 81675 - DNA, 21 bp, Artificial sequence
  SiRNA target sequence
aaaagtgtccatgttgctctc

SEQ ID NO: 81676 - DNA, 21 bp, Artificial sequence
  SiRNA target sequence
aaagtgtccatgttgctctcc

SEQ ID NO: 81677 - DNA, 21 bp, Artificial sequence
  SiRNA target sequence
aagtgtccatgttgctctccc

SEQ ID NO: 81678 - DNA, 21 bp, Artificial sequence
  SiRNA target sequence
agtgtccatgttgctctcccc

SEQ ID NO: 81679 - DNA, 21 bp, Artificial sequence
  SiRNA target sequence
gtgtccatgttgctctcccca

SEQ ID NO: 81680 - DNA, 21 bp, Artificial sequence
  SiRNA target sequence
tgtccatgttgctctccccaa

SEQ ID NO: 81681 - DNA, 21 bp, Artificial sequence
  SiRNA target sequence
gtccatgttgctctccccaat

SEQ ID NO: 81682 - DNA, 21 bp, Artificial sequence
  SiRNA target sequence
tccatgttgctctccccaatc

SEQ ID NO: 81683 - DNA, 21 bp, Artificial sequence
  SiRNA target sequence
ccatgttgctctccccaatct

SEQ ID NO: 81684 - DNA, 21 bp, Artificial sequence
  SiRNA target sequence
catgttgctctccccaatcta

SEQ ID NO: 81685 - DNA, 21 bp, Artificial sequence
  SiRNA target sequence
atgttgctctccccaatctat

SEQ ID NO: 81686 - DNA, 21 bp, Artificial sequence
  SiRNA target sequence
tgttgctctccccaatctatc

SEQ ID NO: 81687 - DNA, 21 bp, Artificial sequence
  SiRNA target sequence
gttgctctccccaatctatct

SEQ ID NO: 81688 - DNA, 21 bp, Artificial sequence
  SiRNA target sequence
ttgctctccccaatctatctt

SEQ ID NO: 81689 - DNA, 21 bp, Artificial sequence
  SiRNA target sequence
tgctctccccaatctatcttt

SEQ ID NO: 81690 - DNA, 21 bp, Artificial sequence
  SiRNA target sequence
gctctccccaatctatcttta

SEQ ID NO: 81691 - DNA, 21 bp, Artificial sequence
  SiRNA target sequence
ctctccccaatctatctttaa

SEQ ID NO: 81692 - DNA, 21 bp, Artificial sequence
  SiRNA target sequence
tctccccaatctatctttaac

SEQ ID NO: 81693 - DNA, 21 bp, Artificial sequence
  SiRNA target sequence
ctccccaatctatctttaact

SEQ ID NO: 81694 - DNA, 21 bp, Artificial sequence
  SiRNA target sequence
tccccaatctatctttaactt

SEQ ID NO: 81695 - DNA, 21 bp, Artificial sequence
  SiRNA target sequence
ccccaatctatctttaacttc

SEQ ID NO: 81696 - DNA, 21 bp, Artificial sequence
  SiRNA target sequence
cccaatctatctttaacttcc

SEQ ID NO: 81697 - DNA, 21 bp, Artificial sequence
  SiRNA target sequence
ccaatctatctttaacttcct

SEQ ID NO: 81698 - DNA, 21 bp, Artificial sequence
  SiRNA target sequence
caatctatctttaacttcctt

SEQ ID NO: 81699 - DNA, 21 bp, Artificial sequence
  SiRNA target sequence
aatctatctttaacttcctta

SEQ ID NO: 81700 - DNA, 21 bp, Artificial sequence
  SiRNA target sequence
atctatctttaacttccttat

SEQ ID NO: 81701 - DNA, 21 bp, Artificial sequence
  SiRNA target sequence
tctatctttaacttccttatt

SEQ ID NO: 81702 - DNA, 21 bp, Artificial sequence
  SiRNA target sequence
ctatctttaacttccttattt

SEQ ID NO: 81703 - DNA, 21 bp, Artificial sequence
  SiRNA target sequence
tatctttaacttccttatttg

SEQ ID NO: 81704 - DNA, 21 bp, Artificial sequence
  SiRNA target sequence
atctttaacttccttatttgt

SEQ ID NO: 81705 - DNA, 21 bp, Artificial sequence
  SiRNA target sequence
tctttaacttccttatttgtt

SEQ ID NO: 81706 - DNA, 21 bp, Artificial sequence
  SiRNA target sequence
ctttaacttccttatttgtta

SEQ ID NO: 81707 - DNA, 21 bp, Artificial sequence
  SiRNA target sequence
tttaacttccttatttgttaa

SEQ ID NO: 81708 - DNA, 21 bp, Artificial sequence
  SiRNA target sequence
ttaacttccttatttgttaat

SEQ ID NO: 81709 - DNA, 21 bp, Artificial sequence
  SiRNA target sequence
taacttccttatttgttaatt

SEQ ID NO: 81710 - DNA, 21 bp, Artificial sequence
  SiRNA target sequence
aacttccttatttgttaattt

SEQ ID NO: 81711 - DNA, 21 bp, Artificial sequence
  SiRNA target sequence
acttccttatttgttaatttt

SEQ ID NO: 81712 - DNA, 21 bp, Artificial sequence
  SiRNA target sequence
cttccttatttgttaattttt

SEQ ID NO: 81713 - DNA, 21 bp, Artificial sequence
  SiRNA target sequence
ttccttatttgttaatttttg

SEQ ID NO: 81714 - DNA, 21 bp, Artificial sequence
  SiRNA target sequence
tccttatttgttaatttttga

SEQ ID NO: 81715 - DNA, 21 bp, Artificial sequence
  SiRNA target sequence
ccttatttgttaatttttgat

SEQ ID NO: 81716 - DNA, 21 bp, Artificial sequence
  SiRNA target sequence
cttatttgttaatttttgatt

SEQ ID NO: 81717 - DNA, 21 bp, Artificial sequence
  SiRNA target sequence
ttatttgttaatttttgatta

SEQ ID NO: 81718 - DNA, 21 bp, Artificial sequence
  SiRNA target sequence
tatttgttaatttttgattat

SEQ ID NO: 81719 - DNA, 21 bp, Artificial sequence
  SiRNA target sequence
atttgttaatttttgattatg

SEQ ID NO: 81720 - DNA, 21 bp, Artificial sequence
  SiRNA target sequence
tttgttaatttttgattatga

SEQ ID NO: 81721 - DNA, 21 bp, Artificial sequence
  SiRNA target sequence
ttgttaatttttgattatgaa

SEQ ID NO: 81722 - DNA, 21 bp, Artificial sequence
  SiRNA target sequence
tgttaatttttgattatgaat

SEQ ID NO: 81723 - DNA, 21 bp, Artificial sequence
  SiRNA target sequence
gttaatttttgattatgaatt

SEQ ID NO: 81724 - DNA, 21 bp, Artificial sequence
  SiRNA target sequence
ttaatttttgattatgaatta

SEQ ID NO: 81725 - DNA, 21 bp, Artificial sequence
  SiRNA target sequence
taatttttgattatgaattag

SEQ ID NO: 81726 - DNA, 21 bp, Artificial sequence
  SiRNA target sequence
aatttttgattatgaattaga

SEQ ID NO: 81727 - DNA, 21 bp, Artificial sequence
  SiRNA target sequence
atttttgattatgaattagac

SEQ ID NO: 81728 - DNA, 21 bp, Artificial sequence
  SiRNA target sequence
tttttgattatgaattagacc

SEQ ID NO: 81729 - DNA, 21 bp, Artificial sequence
  SiRNA target sequence
ttttgattatgaattagacct

SEQ ID NO: 81730 - DNA, 21 bp, Artificial sequence
  SiRNA target sequence
tttgattatgaattagaccta

SEQ ID NO: 81731 - DNA, 21 bp, Artificial sequence
  SiRNA target sequence
ttgattatgaattagacctaa

SEQ ID NO: 81732 - DNA, 21 bp, Artificial sequence
  SiRNA target sequence
tgattatgaattagacctaat

SEQ ID NO: 81733 - DNA, 21 bp, Artificial sequence
  SiRNA target sequence
gattatgaattagacctaatt

SEQ ID NO: 81734 - DNA, 21 bp, Artificial sequence
  SiRNA target sequence
attatgaattagacctaattc

SEQ ID NO: 81735 - DNA, 21 bp, Artificial sequence
  SiRNA target sequence
ttatgaattagacctaattca

SEQ ID NO: 81736 - DNA, 21 bp, Artificial sequence
  SiRNA target sequence
tatgaattagacctaattcac

SEQ ID NO: 81737 - DNA, 21 bp, Artificial sequence
  SiRNA target sequence
atgaattagacctaattcacc

SEQ ID NO: 81738 - DNA, 21 bp, Artificial sequence
  SiRNA target sequence
tgaattagacctaattcacct

SEQ ID NO: 81739 - DNA, 21 bp, Artificial sequence
  SiRNA target sequence
gaattagacctaattcaccta

SEQ ID NO: 81740 - DNA, 21 bp, Artificial sequence
  SiRNA target sequence
aattagacctaattcacctac

SEQ ID NO: 81741 - DNA, 21 bp, Artificial sequence
  SiRNA target sequence
attagacctaattcacctact

SEQ ID NO: 81742 - DNA, 21 bp, Artificial sequence
  SiRNA target sequence
ttagacctaattcacctactt

SEQ ID NO: 81743 - DNA, 21 bp, Artificial sequence
  SiRNA target sequence
tagacctaattcacctacttt

SEQ ID NO: 81744 - DNA, 21 bp, Artificial sequence
  SiRNA target sequence
agacctaattcacctactttt

SEQ ID NO: 81745 - DNA, 21 bp, Artificial sequence
  SiRNA target sequence
gacctaattcacctacttttg

SEQ ID NO: 81746 - DNA, 21 bp, Artificial sequence
  SiRNA target sequence
acctaattcacctacttttgg

SEQ ID NO: 81747 - DNA, 21 bp, Artificial sequence
  SiRNA target sequence
cctaattcacctacttttggt

SEQ ID NO: 81748 - DNA, 21 bp, Artificial sequence
  SiRNA target sequence
ctaattcacctacttttggtg

SEQ ID NO: 81749 - DNA, 21 bp, Artificial sequence
  SiRNA target sequence
taattcacctacttttggtga

SEQ ID NO: 81750 - DNA, 21 bp, Artificial sequence
  SiRNA target sequence
aattcacctacttttggtgaa

SEQ ID NO: 81751 - DNA, 21 bp, Artificial sequence
  SiRNA target sequence
attcacctacttttggtgaaa

SEQ ID NO: 81752 - DNA, 21 bp, Artificial sequence
  SiRNA target sequence
ttcacctacttttggtgaaat

SEQ ID NO: 81753 - DNA, 21 bp, Artificial sequence
  SiRNA target sequence
tcacctacttttggtgaaata

SEQ ID NO: 81754 - DNA, 21 bp, Artificial sequence
  SiRNA target sequence
cacctacttttggtgaaatag

SEQ ID NO: 81755 - DNA, 21 bp, Artificial sequence
  SiRNA target sequence
acctacttttggtgaaataga

SEQ ID NO: 81756 - DNA, 21 bp, Artificial sequence
  SiRNA target sequence
cctacttttggtgaaatagat

SEQ ID NO: 81757 - DNA, 21 bp, Artificial sequence
  SiRNA target sequence
ctacttttggtgaaatagatt

SEQ ID NO: 81758 - DNA, 21 bp, Artificial sequence
  SiRNA target sequence
tacttttggtgaaatagattg

SEQ ID NO: 81759 - DNA, 21 bp, Artificial sequence
  SiRNA target sequence
acttttggtgaaatagattgt

SEQ ID NO: 81760 - DNA, 21 bp, Artificial sequence
  SiRNA target sequence
cttttggtgaaatagattgta

SEQ ID NO: 81761 - DNA, 21 bp, Artificial sequence
  SiRNA target sequence
ttttggtgaaatagattgtaa

SEQ ID NO: 81762 - DNA, 21 bp, Artificial sequence
  SiRNA target sequence
tttggtgaaatagattgtaaa

SEQ ID NO: 81763 - DNA, 21 bp, Artificial sequence
  SiRNA target sequence
ttggtgaaatagattgtaaaa

SEQ ID NO: 81764 - DNA, 21 bp, Artificial sequence
  SiRNA target sequence
tggtgaaatagattgtaaaac

SEQ ID NO: 81765 - DNA, 21 bp, Artificial sequence
  SiRNA target sequence
ggtgaaatagattgtaaaaca

SEQ ID NO: 81766 - DNA, 21 bp, Artificial sequence
  SiRNA target sequence
gtgaaatagattgtaaaacag

SEQ ID NO: 81767 - DNA, 21 bp, Artificial sequence
  SiRNA target sequence
tgaaatagattgtaaaacaga

SEQ ID NO: 81768 - DNA, 21 bp, Artificial sequence
  SiRNA target sequence
gaaatagattgtaaaacagat

SEQ ID NO: 81769 - DNA, 21 bp, Artificial sequence
  SiRNA target sequence
aaatagattgtaaaacagatt

SEQ ID NO: 81770 - DNA, 21 bp, Artificial sequence
  SiRNA target sequence
aatagattgtaaaacagattt

SEQ ID NO: 81771 - DNA, 21 bp, Artificial sequence
  SiRNA target sequence
atagattgtaaaacagatttt

SEQ ID NO: 81772 - DNA, 21 bp, Artificial sequence
  SiRNA target sequence
tagattgtaaaacagattttc

SEQ ID NO: 81773 - DNA, 21 bp, Artificial sequence
  SiRNA target sequence
agattgtaaaacagattttcc

SEQ ID NO: 81774 - DNA, 21 bp, Artificial sequence
  SiRNA target sequence
gattgtaaaacagattttcca

SEQ ID NO: 81775 - DNA, 21 bp, Artificial sequence
  SiRNA target sequence
attgtaaaacagattttccaa

SEQ ID NO: 81776 - DNA, 21 bp, Artificial sequence
  SiRNA target sequence
ttgtaaaacagattttccaag

SEQ ID NO: 81777 - DNA, 21 bp, Artificial sequence
  SiRNA target sequence
tgtaaaacagattttccaagt

SEQ ID NO: 81778 - DNA, 21 bp, Artificial sequence
  SiRNA target sequence
gtaaaacagattttccaagtg

SEQ ID NO: 81779 - DNA, 21 bp, Artificial sequence
  SiRNA target sequence
taaaacagattttccaagtga

SEQ ID NO: 81780 - DNA, 21 bp, Artificial sequence
  SiRNA target sequence
aaaacagattttccaagtgag

SEQ ID NO: 81781 - DNA, 21 bp, Artificial sequence
  SiRNA target sequence
aaacagattttccaagtgagt

SEQ ID NO: 81782 - DNA, 21 bp, Artificial sequence
  SiRNA target sequence
aacagattttccaagtgagtt

SEQ ID NO: 81783 - DNA, 21 bp, Artificial sequence
  SiRNA target sequence
acagattttccaagtgagttg

SEQ ID NO: 81784 - DNA, 21 bp, Artificial sequence
  SiRNA target sequence
cagattttccaagtgagttgt

SEQ ID NO: 81785 - DNA, 21 bp, Artificial sequence
  SiRNA target sequence
agattttccaagtgagttgtc

SEQ ID NO: 81786 - DNA, 21 bp, Artificial sequence
  SiRNA target sequence
gattttccaagtgagttgtct

SEQ ID NO: 81787 - DNA, 21 bp, Artificial sequence
  SiRNA target sequence
attttccaagtgagttgtctg

SEQ ID NO: 81788 - DNA, 21 bp, Artificial sequence
  SiRNA target sequence
ttttccaagtgagttgtctgc

SEQ ID NO: 81789 - DNA, 21 bp, Artificial sequence
  SiRNA target sequence
tttccaagtgagttgtctgca

SEQ ID NO: 81790 - DNA, 21 bp, Artificial sequence
  SiRNA target sequence
ttccaagtgagttgtctgcat

SEQ ID NO: 81791 - DNA, 21 bp, Artificial sequence
  SiRNA target sequence
tccaagtgagttgtctgcatg

SEQ ID NO: 81792 - DNA, 21 bp, Artificial sequence
  SiRNA target sequence
ccaagtgagttgtctgcatgt

SEQ ID NO: 81793 - DNA, 21 bp, Artificial sequence
  SiRNA target sequence
caagtgagttgtctgcatgtg

SEQ ID NO: 81794 - DNA, 21 bp, Artificial sequence
  SiRNA target sequence
aagtgagttgtctgcatgtgt

SEQ ID NO: 81795 - DNA, 21 bp, Artificial sequence
  SiRNA target sequence
agtgagttgtctgcatgtgta

SEQ ID NO: 81796 - DNA, 21 bp, Artificial sequence
  SiRNA target sequence
gtgagttgtctgcatgtgtat

SEQ ID NO: 81797 - DNA, 21 bp, Artificial sequence
  SiRNA target sequence
tgagttgtctgcatgtgtatg

SEQ ID NO: 81798 - DNA, 21 bp, Artificial sequence
  SiRNA target sequence
gagttgtctgcatgtgtatgc

SEQ ID NO: 81799 - DNA, 21 bp, Artificial sequence
  SiRNA target sequence
agttgtctgcatgtgtatgcg

SEQ ID NO: 81800 - DNA, 21 bp, Artificial sequence
  SiRNA target sequence
gttgtctgcatgtgtatgcgg

SEQ ID NO: 81801 - DNA, 21 bp, Artificial sequence
  SiRNA target sequence
ttgtctgcatgtgtatgcggg

SEQ ID NO: 81802 - DNA, 21 bp, Artificial sequence
  SiRNA target sequence
tgtctgcatgtgtatgcggga

SEQ ID NO: 81803 - DNA, 21 bp, Artificial sequence
  SiRNA target sequence
gtctgcatgtgtatgcgggaa

SEQ ID NO: 81804 - DNA, 21 bp, Artificial sequence
  SiRNA target sequence
tctgcatgtgtatgcgggaaa

SEQ ID NO: 81805 - DNA, 21 bp, Artificial sequence
  SiRNA target sequence
ctgcatgtgtatgcgggaaaa

SEQ ID NO: 81806 - DNA, 21 bp, Artificial sequence
  SiRNA target sequence
tgcatgtgtatgcgggaaaaa

SEQ ID NO: 81807 - DNA, 21 bp, Artificial sequence
  SiRNA target sequence
gcatgtgtatgcgggaaaaaa

SEQ ID NO: 81808 - DNA, 21 bp, Artificial sequence
  SiRNA target sequence
catgtgtatgcgggaaaaaat

SEQ ID NO: 81809 - DNA, 21 bp, Artificial sequence
  SiRNA target sequence
atgtgtatgcgggaaaaaatg

SEQ ID NO: 81810 - DNA, 21 bp, Artificial sequence
  SiRNA target sequence
tgtgtatgcgggaaaaaatgc

SEQ ID NO: 81811 - DNA, 21 bp, Artificial sequence
  SiRNA target sequence
gtgtatgcgggaaaaaatgct

SEQ ID NO: 81812 - DNA, 21 bp, Artificial sequence
  SiRNA target sequence
tgtatgcgggaaaaaatgctg

SEQ ID NO: 81813 - DNA, 21 bp, Artificial sequence
  SiRNA target sequence
gtatgcgggaaaaaatgctgt

SEQ ID NO: 81814 - DNA, 21 bp, Artificial sequence
  SiRNA target sequence
tatgcgggaaaaaatgctgtt

SEQ ID NO: 81815 - DNA, 21 bp, Artificial sequence
  SiRNA target sequence
atgcgggaaaaaatgctgttt

SEQ ID NO: 81816 - DNA, 21 bp, Artificial sequence
  SiRNA target sequence
tgcgggaaaaaatgctgtttt

SEQ ID NO: 81817 - DNA, 21 bp, Artificial sequence
  SiRNA target sequence
gcgggaaaaaatgctgttttg

SEQ ID NO: 81818 - DNA, 21 bp, Artificial sequence
  SiRNA target sequence
cgggaaaaaatgctgttttgc

SEQ ID NO: 81819 - DNA, 21 bp, Artificial sequence
  SiRNA target sequence
gggaaaaaatgctgttttgct

SEQ ID NO: 81820 - DNA, 21 bp, Artificial sequence
  SiRNA target sequence
ggaaaaaatgctgttttgcta

SEQ ID NO: 81821 - DNA, 21 bp, Artificial sequence
  SiRNA target sequence
gaaaaaatgctgttttgctaa

SEQ ID NO: 81822 - DNA, 21 bp, Artificial sequence
  SiRNA target sequence
aaaaaatgctgttttgctaaa

SEQ ID NO: 81823 - DNA, 21 bp, Artificial sequence
  SiRNA target sequence
aaaaatgctgttttgctaaat

SEQ ID NO: 81824 - DNA, 21 bp, Artificial sequence
  SiRNA target sequence
aaaatgctgttttgctaaata

SEQ ID NO: 81825 - DNA, 21 bp, Artificial sequence
  SiRNA target sequence
aaatgctgttttgctaaataa

SEQ ID NO: 81826 - DNA, 21 bp, Artificial sequence
  SiRNA target sequence
aatgctgttttgctaaataaa

SEQ ID NO: 81827 - DNA, 21 bp, Artificial sequence
  SiRNA target sequence
atgctgttttgctaaataaac

SEQ ID NO: 81828 - DNA, 21 bp, Artificial sequence
  SiRNA target sequence
tgctgttttgctaaataaaca

SEQ ID NO: 81829 - DNA, 21 bp, Artificial sequence
  SiRNA target sequence
gctgttttgctaaataaacaa

SEQ ID NO: 81830 - DNA, 21 bp, Artificial sequence
  SiRNA target sequence
ctgttttgctaaataaacaat

SEQ ID NO: 81831 - DNA, 21 bp, Artificial sequence
  SiRNA target sequence
tgttttgctaaataaacaatc

SEQ ID NO: 81832 - DNA, 21 bp, Artificial sequence
  SiRNA target sequence
gttttgctaaataaacaatcc

SEQ ID NO: 81833 - DNA, 21 bp, Artificial sequence
  SiRNA target sequence
ttttgctaaataaacaatcca

SEQ ID NO: 81834 - DNA, 21 bp, Artificial sequence
  SiRNA target sequence
tttgctaaataaacaatccat

SEQ ID NO: 81835 - DNA, 21 bp, Artificial sequence
  SiRNA target sequence
ttgctaaataaacaatccata

SEQ ID NO: 81836 - DNA, 21 bp, Artificial sequence
  SiRNA target sequence
tgctaaataaacaatccatac

SEQ ID NO: 81837 - DNA, 21 bp, Artificial sequence
  SiRNA target sequence
gctaaataaacaatccataca

SEQ ID NO: 81838 - DNA, 21 bp, Artificial sequence
  SiRNA target sequence
ctaaataaacaatccatacac

SEQ ID NO: 81839 - DNA, 21 bp, Artificial sequence
  SiRNA target sequence
taaataaacaatccatacacc

SEQ ID NO: 81840 - DNA, 21 bp, Artificial sequence
  SiRNA target sequence
aaataaacaatccatacaccc

SEQ ID NO: 81841 - DNA, 21 bp, Artificial sequence
  SiRNA target sequence
aataaacaatccatacaccca

SEQ ID NO: 81842 - DNA, 21 bp, Artificial sequence
  SiRNA target sequence
ataaacaatccatacacccaa

SEQ ID NO: 81843 - DNA, 21 bp, Artificial sequence
  SiRNA target sequence
taaacaatccatacacccaat

SEQ ID NO: 81844 - DNA, 21 bp, Artificial sequence
  SiRNA target sequence
aaacaatccatacacccaata

SEQ ID NO: 81845 - DNA, 21 bp, Artificial sequence
  SiRNA target sequence
aacaatccatacacccaataa

SEQ ID NO: 81846 - DNA, 21 bp, Artificial sequence
  SiRNA target sequence
acaatccatacacccaataag

SEQ ID NO: 81847 - DNA, 21 bp, Artificial sequence
  SiRNA target sequence
caatccatacacccaataaga

SEQ ID NO: 81848 - DNA, 21 bp, Artificial sequence
  SiRNA target sequence
aatccatacacccaataagat

SEQ ID NO: 81849 - DNA, 21 bp, Artificial sequence
  SiRNA target sequence
atccatacacccaataagata

SEQ ID NO: 81850 - DNA, 21 bp, Artificial sequence
  SiRNA target sequence
tccatacacccaataagataa

SEQ ID NO: 81851 - DNA, 21 bp, Artificial sequence
  SiRNA target sequence
ccatacacccaataagataat

SEQ ID NO: 81852 - DNA, 21 bp, Artificial sequence
  SiRNA target sequence
catacacccaataagataata

SEQ ID NO: 81853 - DNA, 21 bp, Artificial sequence
  SiRNA target sequence
atacacccaataagataataa

SEQ ID NO: 81854 - DNA, 21 bp, Artificial sequence
  SiRNA target sequence
tacacccaataagataataag

SEQ ID NO: 81855 - DNA, 21 bp, Artificial sequence
  SiRNA target sequence
acacccaataagataataagt

SEQ ID NO: 81856 - DNA, 21 bp, Artificial sequence
  SiRNA target sequence
cacccaataagataataagtc

SEQ ID NO: 81857 - DNA, 21 bp, Artificial sequence
  SiRNA target sequence
acccaataagataataagtcc

SEQ ID NO: 81858 - DNA, 21 bp, Artificial sequence
  SiRNA target sequence
cccaataagataataagtcct

SEQ ID NO: 81859 - DNA, 21 bp, Artificial sequence
  SiRNA target sequence
ccaataagataataagtcctc

SEQ ID NO: 81860 - DNA, 21 bp, Artificial sequence
  SiRNA target sequence
caataagataataagtcctct

SEQ ID NO: 81861 - DNA, 21 bp, Artificial sequence
  SiRNA target sequence
aataagataataagtcctctt

SEQ ID NO: 81862 - DNA, 21 bp, Artificial sequence
  SiRNA target sequence
ataagataataagtcctctta

SEQ ID NO: 81863 - DNA, 21 bp, Artificial sequence
  SiRNA target sequence
taagataataagtcctcttaa

SEQ ID NO: 81864 - DNA, 21 bp, Artificial sequence
  SiRNA target sequence
aagataataagtcctcttaat

SEQ ID NO: 81865 - DNA, 21 bp, Artificial sequence
  SiRNA target sequence
agataataagtcctcttaata

SEQ ID NO: 81866 - DNA, 21 bp, Artificial sequence
  SiRNA target sequence
gataataagtcctcttaatac

SEQ ID NO: 81867 - DNA, 21 bp, Artificial sequence
  SiRNA target sequence
ataataagtcctcttaatact

SEQ ID NO: 81868 - DNA, 21 bp, Artificial sequence
  SiRNA target sequence
taataagtcctcttaatactt

SEQ ID NO: 81869 - DNA, 21 bp, Artificial sequence
  SiRNA target sequence
aataagtcctcttaatacttt

SEQ ID NO: 81870 - DNA, 21 bp, Artificial sequence
  SiRNA target sequence
ataagtcctcttaatactttc

SEQ ID NO: 81871 - DNA, 21 bp, Artificial sequence
  SiRNA target sequence
taagtcctcttaatactttct

SEQ ID NO: 81872 - DNA, 21 bp, Artificial sequence
  SiRNA target sequence
aagtcctcttaatactttctg

SEQ ID NO: 81873 - DNA, 21 bp, Artificial sequence
  SiRNA target sequence
agtcctcttaatactttctgc

SEQ ID NO: 81874 - DNA, 21 bp, Artificial sequence
  SiRNA target sequence
gtcctcttaatactttctgct

SEQ ID NO: 81875 - DNA, 21 bp, Artificial sequence
  SiRNA target sequence
tcctcttaatactttctgctc

SEQ ID NO: 81876 - DNA, 21 bp, Artificial sequence
  SiRNA target sequence
cctcttaatactttctgctct

SEQ ID NO: 81877 - DNA, 21 bp, Artificial sequence
  SiRNA target sequence
ctcttaatactttctgctctt

SEQ ID NO: 81878 - DNA, 21 bp, Artificial sequence
  SiRNA target sequence
tcttaatactttctgctcttt

SEQ ID NO: 81879 - DNA, 21 bp, Artificial sequence
  SiRNA target sequence
cttaatactttctgctctttg

SEQ ID NO: 81880 - DNA, 21 bp, Artificial sequence
  SiRNA target sequence
ttaatactttctgctctttgt

SEQ ID NO: 81881 - DNA, 21 bp, Artificial sequence
  SiRNA target sequence
taatactttctgctctttgtt

SEQ ID NO: 81882 - DNA, 21 bp, Artificial sequence
  SiRNA target sequence
aatactttctgctctttgttc

SEQ ID NO: 81883 - DNA, 21 bp, Artificial sequence
  SiRNA target sequence
atactttctgctctttgttca

SEQ ID NO: 81884 - DNA, 21 bp, Artificial sequence
  SiRNA target sequence
tactttctgctctttgttcat

SEQ ID NO: 81885 - DNA, 22 bp, Artificial sequence
  SiRNA target sequence
ttattctggttcacaaccacaa

SEQ ID NO: 81886 - DNA, 22 bp, Artificial sequence
  SiRNA target sequence
tattctggttcacaaccacaac

SEQ ID NO: 81887 - DNA, 22 bp, Artificial sequence
  SiRNA target sequence
attctggttcacaaccacaact

SEQ ID NO: 81888 - DNA, 22 bp, Artificial sequence
  SiRNA target sequence
ttctggttcacaaccacaactc

SEQ ID NO: 81889 - DNA, 22 bp, Artificial sequence
  SiRNA target sequence
tctggttcacaaccacaactcc

SEQ ID NO: 81890 - DNA, 22 bp, Artificial sequence
  SiRNA target sequence
ctggttcacaaccacaactcca

SEQ ID NO: 81891 - DNA, 22 bp, Artificial sequence
  SiRNA target sequence
tggttcacaaccacaactccaa

SEQ ID NO: 81892 - DNA, 22 bp, Artificial sequence
  SiRNA target sequence
ggttcacaaccacaactccaaa

SEQ ID NO: 81893 - DNA, 22 bp, Artificial sequence
  SiRNA target sequence
gttcacaaccacaactccaaac

SEQ ID NO: 81894 - DNA, 22 bp, Artificial sequence
  SiRNA target sequence
ttcacaaccacaactccaaaca

SEQ ID NO: 81895 - DNA, 22 bp, Artificial sequence
  SiRNA target sequence
tcacaaccacaactccaaacac

SEQ ID NO: 81896 - DNA, 22 bp, Artificial sequence
  SiRNA target sequence
cacaaccacaactccaaacacc

SEQ ID NO: 81897 - DNA, 22 bp, Artificial sequence
  SiRNA target sequence
acaaccacaactccaaacacct

SEQ ID NO: 81898 - DNA, 22 bp, Artificial sequence
  SiRNA target sequence
caaccacaactccaaacacctt

SEQ ID NO: 81899 - DNA, 22 bp, Artificial sequence
  SiRNA target sequence
aaccacaactccaaacaccttc

SEQ ID NO: 81900 - DNA, 22 bp, Artificial sequence
  SiRNA target sequence
accacaactccaaacaccttct

SEQ ID NO: 81901 - DNA, 22 bp, Artificial sequence
  SiRNA target sequence
ccacaactccaaacaccttcta

SEQ ID NO: 81902 - DNA, 22 bp, Artificial sequence
  SiRNA target sequence
cacaactccaaacaccttctac

SEQ ID NO: 81903 - DNA, 22 bp, Artificial sequence
  SiRNA target sequence
acaactccaaacaccttctacc

SEQ ID NO: 81904 - DNA, 22 bp, Artificial sequence
  SiRNA target sequence
caactccaaacaccttctacct

SEQ ID NO: 81905 - DNA, 22 bp, Artificial sequence
  SiRNA target sequence
aactccaaacaccttctacctt

SEQ ID NO: 81906 - DNA, 22 bp, Artificial sequence
  SiRNA target sequence
actccaaacaccttctaccttt

SEQ ID NO: 81907 - DNA, 22 bp, Artificial sequence
  SiRNA target sequence
ctccaaacaccttctacctttt

SEQ ID NO: 81908 - DNA, 22 bp, Artificial sequence
  SiRNA target sequence
tccaaacaccttctaccttttt

SEQ ID NO: 81909 - DNA, 22 bp, Artificial sequence
  SiRNA target sequence
ccaaacaccttctaccttttta

SEQ ID NO: 81910 - DNA, 22 bp, Artificial sequence
  SiRNA target sequence
caaacaccttctacctttttac

SEQ ID NO: 81911 - DNA, 22 bp, Artificial sequence
  SiRNA target sequence
aaacaccttctacctttttaca

SEQ ID NO: 81912 - DNA, 22 bp, Artificial sequence
  SiRNA target sequence
aacaccttctacctttttacag

SEQ ID NO: 81913 - DNA, 22 bp, Artificial sequence
  SiRNA target sequence
acaccttctacctttttacagt

SEQ ID NO: 81914 - DNA, 22 bp, Artificial sequence
  SiRNA target sequence
caccttctacctttttacagtc

SEQ ID NO: 81915 - DNA, 22 bp, Artificial sequence
  SiRNA target sequence
accttctacctttttacagtcc

SEQ ID NO: 81916 - DNA, 22 bp, Artificial sequence
  SiRNA target sequence
ccttctacctttttacagtcca

SEQ ID NO: 81917 - DNA, 22 bp, Artificial sequence
  SiRNA target sequence
cttctacctttttacagtccat

SEQ ID NO: 81918 - DNA, 22 bp, Artificial sequence
  SiRNA target sequence
ttctacctttttacagtccata

SEQ ID NO: 81919 - DNA, 22 bp, Artificial sequence
  SiRNA target sequence
tctacctttttacagtccataa

SEQ ID NO: 81920 - DNA, 22 bp, Artificial sequence
  SiRNA target sequence
ctacctttttacagtccataat

SEQ ID NO: 81921 - DNA, 22 bp, Artificial sequence
  SiRNA target sequence
tacctttttacagtccataatg

SEQ ID NO: 81922 - DNA, 22 bp, Artificial sequence
  SiRNA target sequence
acctttttacagtccataatgg

SEQ ID NO: 81923 - DNA, 22 bp, Artificial sequence
  SiRNA target sequence
cctttttacagtccataatggg

SEQ ID NO: 81924 - DNA, 22 bp, Artificial sequence
  SiRNA target sequence
ctttttacagtccataatgggc

SEQ ID NO: 81925 - DNA, 22 bp, Artificial sequence
  SiRNA target sequence
tttttacagtccataatgggct

SEQ ID NO: 81926 - DNA, 22 bp, Artificial sequence
  SiRNA target sequence
ttttacagtccataatgggctt

SEQ ID NO: 81927 - DNA, 22 bp, Artificial sequence
  SiRNA target sequence
tttacagtccataatgggcttt

SEQ ID NO: 81928 - DNA, 22 bp, Artificial sequence
  SiRNA target sequence
ttacagtccataatgggctttc

SEQ ID NO: 81929 - DNA, 22 bp, Artificial sequence
  SiRNA target sequence
tacagtccataatgggctttcc

SEQ ID NO: 81930 - DNA, 22 bp, Artificial sequence
  SiRNA target sequence
acagtccataatgggctttcct

SEQ ID NO: 81931 - DNA, 22 bp, Artificial sequence
  SiRNA target sequence
cagtccataatgggctttccta

SEQ ID NO: 81932 - DNA, 22 bp, Artificial sequence
  SiRNA target sequence
agtccataatgggctttcctaa

SEQ ID NO: 81933 - DNA, 22 bp, Artificial sequence
  SiRNA target sequence
gtccataatgggctttcctaat

SEQ ID NO: 81934 - DNA, 22 bp, Artificial sequence
  SiRNA target sequence
tccataatgggctttcctaatc

SEQ ID NO: 81935 - DNA, 22 bp, Artificial sequence
  SiRNA target sequence
ccataatgggctttcctaatct

SEQ ID NO: 81936 - DNA, 22 bp, Artificial sequence
  SiRNA target sequence
cataatgggctttcctaatctt

SEQ ID NO: 81937 - DNA, 22 bp, Artificial sequence
  SiRNA target sequence
ataatgggctttcctaatcttt

SEQ ID NO: 81938 - DNA, 22 bp, Artificial sequence
  SiRNA target sequence
taatgggctttcctaatctttt

SEQ ID NO: 81939 - DNA, 22 bp, Artificial sequence
  SiRNA target sequence
aatgggctttcctaatctttta

SEQ ID NO: 81940 - DNA, 22 bp, Artificial sequence
  SiRNA target sequence
atgggctttcctaatcttttat

SEQ ID NO: 81941 - DNA, 22 bp, Artificial sequence
  SiRNA target sequence
tgggctttcctaatcttttatt

SEQ ID NO: 81942 - DNA, 22 bp, Artificial sequence
  SiRNA target sequence
gggctttcctaatcttttatta

SEQ ID NO: 81943 - DNA, 22 bp, Artificial sequence
  SiRNA target sequence
ggctttcctaatcttttattaa

SEQ ID NO: 81944 - DNA, 22 bp, Artificial sequence
  SiRNA target sequence
gctttcctaatcttttattaac

SEQ ID NO: 81945 - DNA, 22 bp, Artificial sequence
  SiRNA target sequence
ctttcctaatcttttattaact

SEQ ID NO: 81946 - DNA, 22 bp, Artificial sequence
  SiRNA target sequence
tttcctaatcttttattaacta

SEQ ID NO: 81947 - DNA, 22 bp, Artificial sequence
  SiRNA target sequence
ttcctaatcttttattaactat

SEQ ID NO: 81948 - DNA, 22 bp, Artificial sequence
  SiRNA target sequence
tcctaatcttttattaactatg

SEQ ID NO: 81949 - DNA, 22 bp, Artificial sequence
  SiRNA target sequence
cctaatcttttattaactatgt

SEQ ID NO: 81950 - DNA, 22 bp, Artificial sequence
  SiRNA target sequence
ctaatcttttattaactatgtt

SEQ ID NO: 81951 - DNA, 22 bp, Artificial sequence
  SiRNA target sequence
taatcttttattaactatgtta

SEQ ID NO: 81952 - DNA, 22 bp, Artificial sequence
  SiRNA target sequence
aatcttttattaactatgttat

SEQ ID NO: 81953 - DNA, 22 bp, Artificial sequence
  SiRNA target sequence
atcttttattaactatgttatg

SEQ ID NO: 81954 - DNA, 22 bp, Artificial sequence
  SiRNA target sequence
tcttttattaactatgttatgt

SEQ ID NO: 81955 - DNA, 22 bp, Artificial sequence
  SiRNA target sequence
cttttattaactatgttatgtg

SEQ ID NO: 81956 - DNA, 22 bp, Artificial sequence
  SiRNA target sequence
ttttattaactatgttatgtgc

SEQ ID NO: 81957 - DNA, 22 bp, Artificial sequence
  SiRNA target sequence
tttattaactatgttatgtgct

SEQ ID NO: 81958 - DNA, 22 bp, Artificial sequence
  SiRNA target sequence
ttattaactatgttatgtgctt

SEQ ID NO: 81959 - DNA, 22 bp, Artificial sequence
  SiRNA target sequence
tattaactatgttatgtgcttt

SEQ ID NO: 81960 - DNA, 22 bp, Artificial sequence
  SiRNA target sequence
attaactatgttatgtgcttta

SEQ ID NO: 81961 - DNA, 22 bp, Artificial sequence
  SiRNA target sequence
ttaactatgttatgtgctttac

SEQ ID NO: 81962 - DNA, 22 bp, Artificial sequence
  SiRNA target sequence
taactatgttatgtgctttaca

SEQ ID NO: 81963 - DNA, 22 bp, Artificial sequence
  SiRNA target sequence
aactatgttatgtgctttacat

SEQ ID NO: 81964 - DNA, 22 bp, Artificial sequence
  SiRNA target sequence
actatgttatgtgctttacata

SEQ ID NO: 81965 - DNA, 22 bp, Artificial sequence
  SiRNA target sequence
ctatgttatgtgctttacatag

SEQ ID NO: 81966 - DNA, 22 bp, Artificial sequence
  SiRNA target sequence
tatgttatgtgctttacatagc

SEQ ID NO: 81967 - DNA, 22 bp, Artificial sequence
  SiRNA target sequence
atgttatgtgctttacatagcc

SEQ ID NO: 81968 - DNA, 22 bp, Artificial sequence
  SiRNA target sequence
tgttatgtgctttacatagcca

SEQ ID NO: 81969 - DNA, 22 bp, Artificial sequence
  SiRNA target sequence
gttatgtgctttacatagccac

SEQ ID NO: 81970 - DNA, 22 bp, Artificial sequence
  SiRNA target sequence
ttatgtgctttacatagccact

SEQ ID NO: 81971 - DNA, 22 bp, Artificial sequence
  SiRNA target sequence
tatgtgctttacatagccactg

SEQ ID NO: 81972 - DNA, 22 bp, Artificial sequence
  SiRNA target sequence
atgtgctttacatagccactgg

SEQ ID NO: 81973 - DNA, 22 bp, Artificial sequence
  SiRNA target sequence
tgtgctttacatagccactgga

SEQ ID NO: 81974 - DNA, 22 bp, Artificial sequence
  SiRNA target sequence
gtgctttacatagccactggac

SEQ ID NO: 81975 - DNA, 22 bp, Artificial sequence
  SiRNA target sequence
tgctttacatagccactggaca

SEQ ID NO: 81976 - DNA, 22 bp, Artificial sequence
  SiRNA target sequence
gctttacatagccactggacaa

SEQ ID NO: 81977 - DNA, 22 bp, Artificial sequence
  SiRNA target sequence
ctttacatagccactggacaaa

SEQ ID NO: 81978 - DNA, 22 bp, Artificial sequence
  SiRNA target sequence
tttacatagccactggacaaat

SEQ ID NO: 81979 - DNA, 22 bp, Artificial sequence
  SiRNA target sequence
ttacatagccactggacaaatt

SEQ ID NO: 81980 - DNA, 22 bp, Artificial sequence
  SiRNA target sequence
tacatagccactggacaaattc

SEQ ID NO: 81981 - DNA, 22 bp, Artificial sequence
  SiRNA target sequence
acatagccactggacaaattcg

SEQ ID NO: 81982 - DNA, 22 bp, Artificial sequence
  SiRNA target sequence
catagccactggacaaattcgt

SEQ ID NO: 81983 - DNA, 22 bp, Artificial sequence
  SiRNA target sequence
atagccactggacaaattcgtc

SEQ ID NO: 81984 - DNA, 22 bp, Artificial sequence
  SiRNA target sequence
tagccactggacaaattcgtca

SEQ ID NO: 81985 - DNA, 22 bp, Artificial sequence
  SiRNA target sequence
agccactggacaaattcgtcat

SEQ ID NO: 81986 - DNA, 22 bp, Artificial sequence
  SiRNA target sequence
gccactggacaaattcgtcatg

SEQ ID NO: 81987 - DNA, 22 bp, Artificial sequence
  SiRNA target sequence
ccactggacaaattcgtcatgt

SEQ ID NO: 81988 - DNA, 22 bp, Artificial sequence
  SiRNA target sequence
cactggacaaattcgtcatgtg

SEQ ID NO: 81989 - DNA, 22 bp, Artificial sequence
  SiRNA target sequence
actggacaaattcgtcatgtgt

SEQ ID NO: 81990 - DNA, 22 bp, Artificial sequence
  SiRNA target sequence
ctggacaaattcgtcatgtgtg

SEQ ID NO: 81991 - DNA, 22 bp, Artificial sequence
  SiRNA target sequence
tggacaaattcgtcatgtgtgg

SEQ ID NO: 81992 - DNA, 22 bp, Artificial sequence
  SiRNA target sequence
ggacaaattcgtcatgtgtggc

SEQ ID NO: 81993 - DNA, 22 bp, Artificial sequence
  SiRNA target sequence
gacaaattcgtcatgtgtggca

SEQ ID NO: 81994 - DNA, 22 bp, Artificial sequence
  SiRNA target sequence
acaaattcgtcatgtgtggcaa

SEQ ID NO: 81995 - DNA, 22 bp, Artificial sequence
  SiRNA target sequence
caaattcgtcatgtgtggcaac

SEQ ID NO: 81996 - DNA, 22 bp, Artificial sequence
  SiRNA target sequence
aaattcgtcatgtgtggcaact

SEQ ID NO: 81997 - DNA, 22 bp, Artificial sequence
  SiRNA target sequence
aattcgtcatgtgtggcaactt

SEQ ID NO: 81998 - DNA, 22 bp, Artificial sequence
  SiRNA target sequence
attcgtcatgtgtggcaacttg

SEQ ID NO: 81999 - DNA, 22 bp, Artificial sequence
  SiRNA target sequence
ttcgtcatgtgtggcaacttgt

SEQ ID NO: 82000 - DNA, 22 bp, Artificial sequence
  SiRNA target sequence
tcgtcatgtgtggcaacttgtg

SEQ ID NO: 82001 - DNA, 22 bp, Artificial sequence
  SiRNA target sequence
cgtcatgtgtggcaacttgtgg

SEQ ID NO: 82002 - DNA, 22 bp, Artificial sequence
  SiRNA target sequence
gtcatgtgtggcaacttgtgga

SEQ ID NO: 82003 - DNA, 22 bp, Artificial sequence
  SiRNA target sequence
tcatgtgtggcaacttgtggag

SEQ ID NO: 82004 - DNA, 22 bp, Artificial sequence
  SiRNA target sequence
catgtgtggcaacttgtggagg

SEQ ID NO: 82005 - DNA, 22 bp, Artificial sequence
  SiRNA target sequence
atgtgtggcaacttgtggagga

SEQ ID NO: 82006 - DNA, 22 bp, Artificial sequence
  SiRNA target sequence
tgtgtggcaacttgtggaggat

SEQ ID NO: 82007 - DNA, 22 bp, Artificial sequence
  SiRNA target sequence
gtgtggcaacttgtggaggatt

SEQ ID NO: 82008 - DNA, 22 bp, Artificial sequence
  SiRNA target sequence
tgtggcaacttgtggaggattt

SEQ ID NO: 82009 - DNA, 22 bp, Artificial sequence
  SiRNA target sequence
gtggcaacttgtggaggattta

SEQ ID NO: 82010 - DNA, 22 bp, Artificial sequence
  SiRNA target sequence
tggcaacttgtggaggatttaa

SEQ ID NO: 82011 - DNA, 22 bp, Artificial sequence
  SiRNA target sequence
ggcaacttgtggaggatttaag

SEQ ID NO: 82012 - DNA, 22 bp, Artificial sequence
  SiRNA target sequence
gcaacttgtggaggatttaagc

SEQ ID NO: 82013 - DNA, 22 bp, Artificial sequence
  SiRNA target sequence
caacttgtggaggatttaagct

SEQ ID NO: 82014 - DNA, 22 bp, Artificial sequence
  SiRNA target sequence
aacttgtggaggatttaagctt

SEQ ID NO: 82015 - DNA, 22 bp, Artificial sequence
  SiRNA target sequence
acttgtggaggatttaagctta

SEQ ID NO: 82016 - DNA, 22 bp, Artificial sequence
  SiRNA target sequence
cttgtggaggatttaagcttaa

SEQ ID NO: 82017 - DNA, 22 bp, Artificial sequence
  SiRNA target sequence
ttgtggaggatttaagcttaac

SEQ ID NO: 82018 - DNA, 22 bp, Artificial sequence
  SiRNA target sequence
tgtggaggatttaagcttaaca

SEQ ID NO: 82019 - DNA, 22 bp, Artificial sequence
  SiRNA target sequence
gtggaggatttaagcttaacag

SEQ ID NO: 82020 - DNA, 22 bp, Artificial sequence
  SiRNA target sequence
tggaggatttaagcttaacagt

SEQ ID NO: 82021 - DNA, 22 bp, Artificial sequence
  SiRNA target sequence
ggaggatttaagcttaacagtc

SEQ ID NO: 82022 - DNA, 22 bp, Artificial sequence
  SiRNA target sequence
gaggatttaagcttaacagtct

SEQ ID NO: 82023 - DNA, 22 bp, Artificial sequence
  SiRNA target sequence
aggatttaagcttaacagtctt

SEQ ID NO: 82024 - DNA, 22 bp, Artificial sequence
  SiRNA target sequence
ggatttaagcttaacagtcttt

SEQ ID NO: 82025 - DNA, 22 bp, Artificial sequence
  SiRNA target sequence
gatttaagcttaacagtctttg

SEQ ID NO: 82026 - DNA, 22 bp, Artificial sequence
  SiRNA target sequence
atttaagcttaacagtctttga

SEQ ID NO: 82027 - DNA, 22 bp, Artificial sequence
  SiRNA target sequence
tttaagcttaacagtctttgaa

SEQ ID NO: 82028 - DNA, 22 bp, Artificial sequence
  SiRNA target sequence
ttaagcttaacagtctttgaaa

SEQ ID NO: 82029 - DNA, 22 bp, Artificial sequence
  SiRNA target sequence
taagcttaacagtctttgaaaa

SEQ ID NO: 82030 - DNA, 22 bp, Artificial sequence
  SiRNA target sequence
aagcttaacagtctttgaaaat

SEQ ID NO: 82031 - DNA, 22 bp, Artificial sequence
  SiRNA target sequence
agcttaacagtctttgaaaatg

SEQ ID NO: 82032 - DNA, 22 bp, Artificial sequence
  SiRNA target sequence
gcttaacagtctttgaaaatgt

SEQ ID NO: 82033 - DNA, 22 bp, Artificial sequence
  SiRNA target sequence
cttaacagtctttgaaaatgtc

SEQ ID NO: 82034 - DNA, 22 bp, Artificial sequence
  SiRNA target sequence
ttaacagtctttgaaaatgtcc

SEQ ID NO: 82035 - DNA, 22 bp, Artificial sequence
  SiRNA target sequence
taacagtctttgaaaatgtcca

SEQ ID NO: 82036 - DNA, 22 bp, Artificial sequence
  SiRNA target sequence
aacagtctttgaaaatgtccac

SEQ ID NO: 82037 - DNA, 22 bp, Artificial sequence
  SiRNA target sequence
acagtctttgaaaatgtccaca

SEQ ID NO: 82038 - DNA, 22 bp, Artificial sequence
  SiRNA target sequence
cagtctttgaaaatgtccacaa

SEQ ID NO: 82039 - DNA, 22 bp, Artificial sequence
  SiRNA target sequence
agtctttgaaaatgtccacaac

SEQ ID NO: 82040 - DNA, 22 bp, Artificial sequence
  SiRNA target sequence
gtctttgaaaatgtccacaaca

SEQ ID NO: 82041 - DNA, 22 bp, Artificial sequence
  SiRNA target sequence
tctttgaaaatgtccacaacat

SEQ ID NO: 82042 - DNA, 22 bp, Artificial sequence
  SiRNA target sequence
ctttgaaaatgtccacaacatt

SEQ ID NO: 82043 - DNA, 22 bp, Artificial sequence
  SiRNA target sequence
tttgaaaatgtccacaacattc

SEQ ID NO: 82044 - DNA, 22 bp, Artificial sequence
  SiRNA target sequence
ttgaaaatgtccacaacattct

SEQ ID NO: 82045 - DNA, 22 bp, Artificial sequence
  SiRNA target sequence
tgaaaatgtccacaacattctg

SEQ ID NO: 82046 - DNA, 22 bp, Artificial sequence
  SiRNA target sequence
gaaaatgtccacaacattctgc

SEQ ID NO: 82047 - DNA, 22 bp, Artificial sequence
  SiRNA target sequence
aaaatgtccacaacattctgca

SEQ ID NO: 82048 - DNA, 22 bp, Artificial sequence
  SiRNA target sequence
aaatgtccacaacattctgcac

SEQ ID NO: 82049 - DNA, 22 bp, Artificial sequence
  SiRNA target sequence
aatgtccacaacattctgcaca

SEQ ID NO: 82050 - DNA, 22 bp, Artificial sequence
  SiRNA target sequence
atgtccacaacattctgcacag

SEQ ID NO: 82051 - DNA, 22 bp, Artificial sequence
  SiRNA target sequence
tgtccacaacattctgcacagg

SEQ ID NO: 82052 - DNA, 22 bp, Artificial sequence
  SiRNA target sequence
gtccacaacattctgcacaggg

SEQ ID NO: 82053 - DNA, 22 bp, Artificial sequence
  SiRNA target sequence
tccacaacattctgcacagggg

SEQ ID NO: 82054 - DNA, 22 bp, Artificial sequence
  SiRNA target sequence
ccacaacattctgcacagggga

SEQ ID NO: 82055 - DNA, 22 bp, Artificial sequence
  SiRNA target sequence
cacaacattctgcacaggggaa

SEQ ID NO: 82056 - DNA, 22 bp, Artificial sequence
  SiRNA target sequence
acaacattctgcacaggggaaa

SEQ ID NO: 82057 - DNA, 22 bp, Artificial sequence
  SiRNA target sequence
caacattctgcacaggggaaaa

SEQ ID NO: 82058 - DNA, 22 bp, Artificial sequence
  SiRNA target sequence
aacattctgcacaggggaaaag

SEQ ID NO: 82059 - DNA, 22 bp, Artificial sequence
  SiRNA target sequence
acattctgcacaggggaaaaga

SEQ ID NO: 82060 - DNA, 22 bp, Artificial sequence
  SiRNA target sequence
cattctgcacaggggaaaagag

SEQ ID NO: 82061 - DNA, 22 bp, Artificial sequence
  SiRNA target sequence
attctgcacaggggaaaagaga

SEQ ID NO: 82062 - DNA, 22 bp, Artificial sequence
  SiRNA target sequence
ttctgcacaggggaaaagagat

SEQ ID NO: 82063 - DNA, 22 bp, Artificial sequence
  SiRNA target sequence
tctgcacaggggaaaagagatg

SEQ ID NO: 82064 - DNA, 22 bp, Artificial sequence
  SiRNA target sequence
ctgcacaggggaaaagagatga

SEQ ID NO: 82065 - DNA, 22 bp, Artificial sequence
  SiRNA target sequence
tgcacaggggaaaagagatgat

SEQ ID NO: 82066 - DNA, 22 bp, Artificial sequence
  SiRNA target sequence
gcacaggggaaaagagatgata

SEQ ID NO: 82067 - DNA, 22 bp, Artificial sequence
  SiRNA target sequence
cacaggggaaaagagatgataa

SEQ ID NO: 82068 - DNA, 22 bp, Artificial sequence
  SiRNA target sequence
acaggggaaaagagatgataaa

SEQ ID NO: 82069 - DNA, 22 bp, Artificial sequence
  SiRNA target sequence
caggggaaaagagatgataaaa

SEQ ID NO: 82070 - DNA, 22 bp, Artificial sequence
  SiRNA target sequence
aggggaaaagagatgataaaag

SEQ ID NO: 82071 - DNA, 22 bp, Artificial sequence
  SiRNA target sequence
ggggaaaagagatgataaaagg

SEQ ID NO: 82072 - DNA, 22 bp, Artificial sequence
  SiRNA target sequence
gggaaaagagatgataaaaggt

SEQ ID NO: 82073 - DNA, 22 bp, Artificial sequence
  SiRNA target sequence
ggaaaagagatgataaaaggta

SEQ ID NO: 82074 - DNA, 22 bp, Artificial sequence
  SiRNA target sequence
gaaaagagatgataaaaggtaa

SEQ ID NO: 82075 - DNA, 22 bp, Artificial sequence
  SiRNA target sequence
aaaagagatgataaaaggtaaa

SEQ ID NO: 82076 - DNA, 22 bp, Artificial sequence
  SiRNA target sequence
aaagagatgataaaaggtaaat

SEQ ID NO: 82077 - DNA, 22 bp, Artificial sequence
  SiRNA target sequence
aagagatgataaaaggtaaata

SEQ ID NO: 82078 - DNA, 22 bp, Artificial sequence
  SiRNA target sequence
agagatgataaaaggtaaataa

SEQ ID NO: 82079 - DNA, 22 bp, Artificial sequence
  SiRNA target sequence
gagatgataaaaggtaaataaa

SEQ ID NO: 82080 - DNA, 22 bp, Artificial sequence
  SiRNA target sequence
agatgataaaaggtaaataaat

SEQ ID NO: 82081 - DNA, 22 bp, Artificial sequence
  SiRNA target sequence
gatgataaaaggtaaataaatt

SEQ ID NO: 82082 - DNA, 22 bp, Artificial sequence
  SiRNA target sequence
atgataaaaggtaaataaattg

SEQ ID NO: 82083 - DNA, 22 bp, Artificial sequence
  SiRNA target sequence
tgataaaaggtaaataaattga

SEQ ID NO: 82084 - DNA, 22 bp, Artificial sequence
  SiRNA target sequence
gataaaaggtaaataaattgaa

SEQ ID NO: 82085 - DNA, 22 bp, Artificial sequence
  SiRNA target sequence
ataaaaggtaaataaattgaag

SEQ ID NO: 82086 - DNA, 22 bp, Artificial sequence
  SiRNA target sequence
taaaaggtaaataaattgaagt

SEQ ID NO: 82087 - DNA, 22 bp, Artificial sequence
  SiRNA target sequence
aaaaggtaaataaattgaagtg

SEQ ID NO: 82088 - DNA, 22 bp, Artificial sequence
  SiRNA target sequence
aaaggtaaataaattgaagtgt

SEQ ID NO: 82089 - DNA, 22 bp, Artificial sequence
  SiRNA target sequence
aaggtaaataaattgaagtgta

SEQ ID NO: 82090 - DNA, 22 bp, Artificial sequence
  SiRNA target sequence
aggtaaataaattgaagtgtat

SEQ ID NO: 82091 - DNA, 22 bp, Artificial sequence
  SiRNA target sequence
ggtaaataaattgaagtgtatc

SEQ ID NO: 82092 - DNA, 22 bp, Artificial sequence
  SiRNA target sequence
gtaaataaattgaagtgtatct

SEQ ID NO: 82093 - DNA, 22 bp, Artificial sequence
  SiRNA target sequence
taaataaattgaagtgtatctt

SEQ ID NO: 82094 - DNA, 22 bp, Artificial sequence
  SiRNA target sequence
aaataaattgaagtgtatcttt

SEQ ID NO: 82095 - DNA, 22 bp, Artificial sequence
  SiRNA target sequence
aataaattgaagtgtatctttt

SEQ ID NO: 82096 - DNA, 22 bp, Artificial sequence
  SiRNA target sequence
ataaattgaagtgtatcttttt

SEQ ID NO: 82097 - DNA, 22 bp, Artificial sequence
  SiRNA target sequence
taaattgaagtgtatctttttt

SEQ ID NO: 82098 - DNA, 22 bp, Artificial sequence
  SiRNA target sequence
aaattgaagtgtatctttttta

SEQ ID NO: 82099 - DNA, 22 bp, Artificial sequence
  SiRNA target sequence
aattgaagtgtatcttttttat

SEQ ID NO: 82100 - DNA, 22 bp, Artificial sequence
  SiRNA target sequence
attgaagtgtatcttttttatg

SEQ ID NO: 82101 - DNA, 22 bp, Artificial sequence
  SiRNA target sequence
ttgaagtgtatcttttttatgt

SEQ ID NO: 82102 - DNA, 22 bp, Artificial sequence
  SiRNA target sequence
tgaagtgtatcttttttatgtt

SEQ ID NO: 82103 - DNA, 22 bp, Artificial sequence
  SiRNA target sequence
gaagtgtatcttttttatgttg

SEQ ID NO: 82104 - DNA, 22 bp, Artificial sequence
  SiRNA target sequence
aagtgtatcttttttatgttgt

SEQ ID NO: 82105 - DNA, 22 bp, Artificial sequence
  SiRNA target sequence
agtgtatcttttttatgttgta

SEQ ID NO: 82106 - DNA, 22 bp, Artificial sequence
  SiRNA target sequence
gtgtatcttttttatgttgtac

SEQ ID NO: 82107 - DNA, 22 bp, Artificial sequence
  SiRNA target sequence
tgtatcttttttatgttgtact

SEQ ID NO: 82108 - DNA, 22 bp, Artificial sequence
  SiRNA target sequence
gtatcttttttatgttgtactg

SEQ ID NO: 82109 - DNA, 22 bp, Artificial sequence
  SiRNA target sequence
tatcttttttatgttgtactgt

SEQ ID NO: 82110 - DNA, 22 bp, Artificial sequence
  SiRNA target sequence
atcttttttatgttgtactgta

SEQ ID NO: 82111 - DNA, 22 bp, Artificial sequence
  SiRNA target sequence
tcttttttatgttgtactgtag

SEQ ID NO: 82112 - DNA, 22 bp, Artificial sequence
  SiRNA target sequence
cttttttatgttgtactgtagg

SEQ ID NO: 82113 - DNA, 22 bp, Artificial sequence
  SiRNA target sequence
ttttttatgttgtactgtagga

SEQ ID NO: 82114 - DNA, 22 bp, Artificial sequence
  SiRNA target sequence
tttttatgttgtactgtaggaa

SEQ ID NO: 82115 - DNA, 22 bp, Artificial sequence
  SiRNA target sequence
ttttatgttgtactgtaggaaa

SEQ ID NO: 82116 - DNA, 22 bp, Artificial sequence
  SiRNA target sequence
tttatgttgtactgtaggaaat

SEQ ID NO: 82117 - DNA, 22 bp, Artificial sequence
  SiRNA target sequence
ttatgttgtactgtaggaaatg

SEQ ID NO: 82118 - DNA, 22 bp, Artificial sequence
  SiRNA target sequence
tatgttgtactgtaggaaatgc

SEQ ID NO: 82119 - DNA, 22 bp, Artificial sequence
  SiRNA target sequence
atgttgtactgtaggaaatgca

SEQ ID NO: 82120 - DNA, 22 bp, Artificial sequence
  SiRNA target sequence
tgttgtactgtaggaaatgcag

SEQ ID NO: 82121 - DNA, 22 bp, Artificial sequence
  SiRNA target sequence
gttgtactgtaggaaatgcagg

SEQ ID NO: 82122 - DNA, 22 bp, Artificial sequence
  SiRNA target sequence
ttgtactgtaggaaatgcagga

SEQ ID NO: 82123 - DNA, 22 bp, Artificial sequence
  SiRNA target sequence
tgtactgtaggaaatgcaggat

SEQ ID NO: 82124 - DNA, 22 bp, Artificial sequence
  SiRNA target sequence
gtactgtaggaaatgcaggata

SEQ ID NO: 82125 - DNA, 22 bp, Artificial sequence
  SiRNA target sequence
tactgtaggaaatgcaggataa

SEQ ID NO: 82126 - DNA, 22 bp, Artificial sequence
  SiRNA target sequence
actgtaggaaatgcaggataaa

SEQ ID NO: 82127 - DNA, 22 bp, Artificial sequence
  SiRNA target sequence
ctgtaggaaatgcaggataaac

SEQ ID NO: 82128 - DNA, 22 bp, Artificial sequence
  SiRNA target sequence
tgtaggaaatgcaggataaaca

SEQ ID NO: 82129 - DNA, 22 bp, Artificial sequence
  SiRNA target sequence
gtaggaaatgcaggataaacag

SEQ ID NO: 82130 - DNA, 22 bp, Artificial sequence
  SiRNA target sequence
taggaaatgcaggataaacagc

SEQ ID NO: 82131 - DNA, 22 bp, Artificial sequence
  SiRNA target sequence
aggaaatgcaggataaacagct

SEQ ID NO: 82132 - DNA, 22 bp, Artificial sequence
  SiRNA target sequence
ggaaatgcaggataaacagctg

SEQ ID NO: 82133 - DNA, 22 bp, Artificial sequence
  SiRNA target sequence
gaaatgcaggataaacagctgc

SEQ ID NO: 82134 - DNA, 22 bp, Artificial sequence
  SiRNA target sequence
aaatgcaggataaacagctgcc

SEQ ID NO: 82135 - DNA, 22 bp, Artificial sequence
  SiRNA target sequence
aatgcaggataaacagctgcca

SEQ ID NO: 82136 - DNA, 22 bp, Artificial sequence
  SiRNA target sequence
atgcaggataaacagctgccat

SEQ ID NO: 82137 - DNA, 22 bp, Artificial sequence
  SiRNA target sequence
tgcaggataaacagctgccatg

SEQ ID NO: 82138 - DNA, 22 bp, Artificial sequence
  SiRNA target sequence
gcaggataaacagctgccatgg

SEQ ID NO: 82139 - DNA, 22 bp, Artificial sequence
  SiRNA target sequence
caggataaacagctgccatggt

SEQ ID NO: 82140 - DNA, 22 bp, Artificial sequence
  SiRNA target sequence
aggataaacagctgccatggta

SEQ ID NO: 82141 - DNA, 22 bp, Artificial sequence
  SiRNA target sequence
ggataaacagctgccatggtat

SEQ ID NO: 82142 - DNA, 22 bp, Artificial sequence
  SiRNA target sequence
gataaacagctgccatggtatg

SEQ ID NO: 82143 - DNA, 22 bp, Artificial sequence
  SiRNA target sequence
ataaacagctgccatggtatgt

SEQ ID NO: 82144 - DNA, 22 bp, Artificial sequence
  SiRNA target sequence
taaacagctgccatggtatgta

SEQ ID NO: 82145 - DNA, 22 bp, Artificial sequence
  SiRNA target sequence
aaacagctgccatggtatgtaa

SEQ ID NO: 82146 - DNA, 22 bp, Artificial sequence
  SiRNA target sequence
aacagctgccatggtatgtaaa

SEQ ID NO: 82147 - DNA, 22 bp, Artificial sequence
  SiRNA target sequence
acagctgccatggtatgtaaaa

SEQ ID NO: 82148 - DNA, 22 bp, Artificial sequence
  SiRNA target sequence
cagctgccatggtatgtaaaag

SEQ ID NO: 82149 - DNA, 22 bp, Artificial sequence
  SiRNA target sequence
agctgccatggtatgtaaaagt

SEQ ID NO: 82150 - DNA, 22 bp, Artificial sequence
  SiRNA target sequence
gctgccatggtatgtaaaagtg

SEQ ID NO: 82151 - DNA, 22 bp, Artificial sequence
  SiRNA target sequence
ctgccatggtatgtaaaagtgt

SEQ ID NO: 82152 - DNA, 22 bp, Artificial sequence
  SiRNA target sequence
tgccatggtatgtaaaagtgtc

SEQ ID NO: 82153 - DNA, 22 bp, Artificial sequence
  SiRNA target sequence
gccatggtatgtaaaagtgtcc

SEQ ID NO: 82154 - DNA, 22 bp, Artificial sequence
  SiRNA target sequence
ccatggtatgtaaaagtgtcca

SEQ ID NO: 82155 - DNA, 22 bp, Artificial sequence
  SiRNA target sequence
catggtatgtaaaagtgtccat

SEQ ID NO: 82156 - DNA, 22 bp, Artificial sequence
  SiRNA target sequence
atggtatgtaaaagtgtccatg

SEQ ID NO: 82157 - DNA, 22 bp, Artificial sequence
  SiRNA target sequence
tggtatgtaaaagtgtccatgt

SEQ ID NO: 82158 - DNA, 22 bp, Artificial sequence
  SiRNA target sequence
ggtatgtaaaagtgtccatgtt

SEQ ID NO: 82159 - DNA, 22 bp, Artificial sequence
  SiRNA target sequence
gtatgtaaaagtgtccatgttg

SEQ ID NO: 82160 - DNA, 22 bp, Artificial sequence
  SiRNA target sequence
tatgtaaaagtgtccatgttgc

SEQ ID NO: 82161 - DNA, 22 bp, Artificial sequence
  SiRNA target sequence
atgtaaaagtgtccatgttgct

SEQ ID NO: 82162 - DNA, 22 bp, Artificial sequence
  SiRNA target sequence
tgtaaaagtgtccatgttgctc

SEQ ID NO: 82163 - DNA, 22 bp, Artificial sequence
  SiRNA target sequence
gtaaaagtgtccatgttgctct

SEQ ID NO: 82164 - DNA, 22 bp, Artificial sequence
  SiRNA target sequence
taaaagtgtccatgttgctctc

SEQ ID NO: 82165 - DNA, 22 bp, Artificial sequence
  SiRNA target sequence
aaaagtgtccatgttgctctcc

SEQ ID NO: 82166 - DNA, 22 bp, Artificial sequence
  SiRNA target sequence
aaagtgtccatgttgctctccc

SEQ ID NO: 82167 - DNA, 22 bp, Artificial sequence
  SiRNA target sequence
aagtgtccatgttgctctcccc

SEQ ID NO: 82168 - DNA, 22 bp, Artificial sequence
  SiRNA target sequence
agtgtccatgttgctctcccca

SEQ ID NO: 82169 - DNA, 22 bp, Artificial sequence
  SiRNA target sequence
gtgtccatgttgctctccccaa

SEQ ID NO: 82170 - DNA, 22 bp, Artificial sequence
  SiRNA target sequence
tgtccatgttgctctccccaat

SEQ ID NO: 82171 - DNA, 22 bp, Artificial sequence
  SiRNA target sequence
gtccatgttgctctccccaatc

SEQ ID NO: 82172 - DNA, 22 bp, Artificial sequence
  SiRNA target sequence
tccatgttgctctccccaatct

SEQ ID NO: 82173 - DNA, 22 bp, Artificial sequence
  SiRNA target sequence
ccatgttgctctccccaatcta

SEQ ID NO: 82174 - DNA, 22 bp, Artificial sequence
  SiRNA target sequence
catgttgctctccccaatctat

SEQ ID NO: 82175 - DNA, 22 bp, Artificial sequence
  SiRNA target sequence
atgttgctctccccaatctatc

SEQ ID NO: 82176 - DNA, 22 bp, Artificial sequence
  SiRNA target sequence
tgttgctctccccaatctatct

SEQ ID NO: 82177 - DNA, 22 bp, Artificial sequence
  SiRNA target sequence
gttgctctccccaatctatctt

SEQ ID NO: 82178 - DNA, 22 bp, Artificial sequence
  SiRNA target sequence
ttgctctccccaatctatcttt

SEQ ID NO: 82179 - DNA, 22 bp, Artificial sequence
  SiRNA target sequence
tgctctccccaatctatcttta

SEQ ID NO: 82180 - DNA, 22 bp, Artificial sequence
  SiRNA target sequence
gctctccccaatctatctttaa

SEQ ID NO: 82181 - DNA, 22 bp, Artificial sequence
  SiRNA target sequence
ctctccccaatctatctttaac

SEQ ID NO: 82182 - DNA, 22 bp, Artificial sequence
  SiRNA target sequence
tctccccaatctatctttaact

SEQ ID NO: 82183 - DNA, 22 bp, Artificial sequence
  SiRNA target sequence
ctccccaatctatctttaactt

SEQ ID NO: 82184 - DNA, 22 bp, Artificial sequence
  SiRNA target sequence
tccccaatctatctttaacttc

SEQ ID NO: 82185 - DNA, 22 bp, Artificial sequence
  SiRNA target sequence
ccccaatctatctttaacttcc

SEQ ID NO: 82186 - DNA, 22 bp, Artificial sequence
  SiRNA target sequence
cccaatctatctttaacttcct

SEQ ID NO: 82187 - DNA, 22 bp, Artificial sequence
  SiRNA target sequence
ccaatctatctttaacttcctt

SEQ ID NO: 82188 - DNA, 22 bp, Artificial sequence
  SiRNA target sequence
caatctatctttaacttcctta

SEQ ID NO: 82189 - DNA, 22 bp, Artificial sequence
  SiRNA target sequence
aatctatctttaacttccttat

SEQ ID NO: 82190 - DNA, 22 bp, Artificial sequence
  SiRNA target sequence
atctatctttaacttccttatt

SEQ ID NO: 82191 - DNA, 22 bp, Artificial sequence
  SiRNA target sequence
tctatctttaacttccttattt

SEQ ID NO: 82192 - DNA, 22 bp, Artificial sequence
  SiRNA target sequence
ctatctttaacttccttatttg

SEQ ID NO: 82193 - DNA, 22 bp, Artificial sequence
  SiRNA target sequence
tatctttaacttccttatttgt

SEQ ID NO: 82194 - DNA, 22 bp, Artificial sequence
  SiRNA target sequence
atctttaacttccttatttgtt

SEQ ID NO: 82195 - DNA, 22 bp, Artificial sequence
  SiRNA target sequence
tctttaacttccttatttgtta

SEQ ID NO: 82196 - DNA, 22 bp, Artificial sequence
  SiRNA target sequence
ctttaacttccttatttgttaa

SEQ ID NO: 82197 - DNA, 22 bp, Artificial sequence
  SiRNA target sequence
tttaacttccttatttgttaat

SEQ ID NO: 82198 - DNA, 22 bp, Artificial sequence
  SiRNA target sequence
ttaacttccttatttgttaatt

SEQ ID NO: 82199 - DNA, 22 bp, Artificial sequence
  SiRNA target sequence
taacttccttatttgttaattt

SEQ ID NO: 82200 - DNA, 22 bp, Artificial sequence
  SiRNA target sequence
aacttccttatttgttaatttt

SEQ ID NO: 82201 - DNA, 22 bp, Artificial sequence
  SiRNA target sequence
acttccttatttgttaattttt

SEQ ID NO: 82202 - DNA, 22 bp, Artificial sequence
  SiRNA target sequence
cttccttatttgttaatttttg

SEQ ID NO: 82203 - DNA, 22 bp, Artificial sequence
  SiRNA target sequence
ttccttatttgttaatttttga

SEQ ID NO: 82204 - DNA, 22 bp, Artificial sequence
  SiRNA target sequence
tccttatttgttaatttttgat

SEQ ID NO: 82205 - DNA, 22 bp, Artificial sequence
  SiRNA target sequence
ccttatttgttaatttttgatt

SEQ ID NO: 82206 - DNA, 22 bp, Artificial sequence
  SiRNA target sequence
cttatttgttaatttttgatta

SEQ ID NO: 82207 - DNA, 22 bp, Artificial sequence
  SiRNA target sequence
ttatttgttaatttttgattat

SEQ ID NO: 82208 - DNA, 22 bp, Artificial sequence
  SiRNA target sequence
tatttgttaatttttgattatg

SEQ ID NO: 82209 - DNA, 22 bp, Artificial sequence
  SiRNA target sequence
atttgttaatttttgattatga

SEQ ID NO: 82210 - DNA, 22 bp, Artificial sequence
  SiRNA target sequence
tttgttaatttttgattatgaa

SEQ ID NO: 82211 - DNA, 22 bp, Artificial sequence
  SiRNA target sequence
ttgttaatttttgattatgaat

SEQ ID NO: 82212 - DNA, 22 bp, Artificial sequence
  SiRNA target sequence
tgttaatttttgattatgaatt

SEQ ID NO: 82213 - DNA, 22 bp, Artificial sequence
  SiRNA target sequence
gttaatttttgattatgaatta

SEQ ID NO: 82214 - DNA, 22 bp, Artificial sequence
  SiRNA target sequence
ttaatttttgattatgaattag

SEQ ID NO: 82215 - DNA, 22 bp, Artificial sequence
  SiRNA target sequence
taatttttgattatgaattaga

SEQ ID NO: 82216 - DNA, 22 bp, Artificial sequence
  SiRNA target sequence
aatttttgattatgaattagac

SEQ ID NO: 82217 - DNA, 22 bp, Artificial sequence
  SiRNA target sequence
atttttgattatgaattagacc

SEQ ID NO: 82218 - DNA, 22 bp, Artificial sequence
  SiRNA target sequence
tttttgattatgaattagacct

SEQ ID NO: 82219 - DNA, 22 bp, Artificial sequence
  SiRNA target sequence
ttttgattatgaattagaccta

SEQ ID NO: 82220 - DNA, 22 bp, Artificial sequence
  SiRNA target sequence
tttgattatgaattagacctaa

SEQ ID NO: 82221 - DNA, 22 bp, Artificial sequence
  SiRNA target sequence
ttgattatgaattagacctaat

SEQ ID NO: 82222 - DNA, 22 bp, Artificial sequence
  SiRNA target sequence
tgattatgaattagacctaatt

SEQ ID NO: 82223 - DNA, 22 bp, Artificial sequence
  SiRNA target sequence
gattatgaattagacctaattc

SEQ ID NO: 82224 - DNA, 22 bp, Artificial sequence
  SiRNA target sequence
attatgaattagacctaattca

SEQ ID NO: 82225 - DNA, 22 bp, Artificial sequence
  SiRNA target sequence
ttatgaattagacctaattcac

SEQ ID NO: 82226 - DNA, 22 bp, Artificial sequence
  SiRNA target sequence
tatgaattagacctaattcacc

SEQ ID NO: 82227 - DNA, 22 bp, Artificial sequence
  SiRNA target sequence
atgaattagacctaattcacct

SEQ ID NO: 82228 - DNA, 22 bp, Artificial sequence
  SiRNA target sequence
tgaattagacctaattcaccta

SEQ ID NO: 82229 - DNA, 22 bp, Artificial sequence
  SiRNA target sequence
gaattagacctaattcacctac

SEQ ID NO: 82230 - DNA, 22 bp, Artificial sequence
  SiRNA target sequence
aattagacctaattcacctact

SEQ ID NO: 82231 - DNA, 22 bp, Artificial sequence
  SiRNA target sequence
attagacctaattcacctactt

SEQ ID NO: 82232 - DNA, 22 bp, Artificial sequence
  SiRNA target sequence
ttagacctaattcacctacttt

SEQ ID NO: 82233 - DNA, 22 bp, Artificial sequence
  SiRNA target sequence
tagacctaattcacctactttt

SEQ ID NO: 82234 - DNA, 22 bp, Artificial sequence
  SiRNA target sequence
agacctaattcacctacttttg

SEQ ID NO: 82235 - DNA, 22 bp, Artificial sequence
  SiRNA target sequence
gacctaattcacctacttttgg

SEQ ID NO: 82236 - DNA, 22 bp, Artificial sequence
  SiRNA target sequence
acctaattcacctacttttggt

SEQ ID NO: 82237 - DNA, 22 bp, Artificial sequence
  SiRNA target sequence
cctaattcacctacttttggtg

SEQ ID NO: 82238 - DNA, 22 bp, Artificial sequence
  SiRNA target sequence
ctaattcacctacttttggtga

SEQ ID NO: 82239 - DNA, 22 bp, Artificial sequence
  SiRNA target sequence
taattcacctacttttggtgaa

SEQ ID NO: 82240 - DNA, 22 bp, Artificial sequence
  SiRNA target sequence
aattcacctacttttggtgaaa

SEQ ID NO: 82241 - DNA, 22 bp, Artificial sequence
  SiRNA target sequence
attcacctacttttggtgaaat

SEQ ID NO: 82242 - DNA, 22 bp, Artificial sequence
  SiRNA target sequence
ttcacctacttttggtgaaata

SEQ ID NO: 82243 - DNA, 22 bp, Artificial sequence
  SiRNA target sequence
tcacctacttttggtgaaatag

SEQ ID NO: 82244 - DNA, 22 bp, Artificial sequence
  SiRNA target sequence
cacctacttttggtgaaataga

SEQ ID NO: 82245 - DNA, 22 bp, Artificial sequence
  SiRNA target sequence
acctacttttggtgaaatagat

SEQ ID NO: 82246 - DNA, 22 bp, Artificial sequence
  SiRNA target sequence
cctacttttggtgaaatagatt

SEQ ID NO: 82247 - DNA, 22 bp, Artificial sequence
  SiRNA target sequence
ctacttttggtgaaatagattg

SEQ ID NO: 82248 - DNA, 22 bp, Artificial sequence
  SiRNA target sequence
tacttttggtgaaatagattgt

SEQ ID NO: 82249 - DNA, 22 bp, Artificial sequence
  SiRNA target sequence
acttttggtgaaatagattgta

SEQ ID NO: 82250 - DNA, 22 bp, Artificial sequence
  SiRNA target sequence
cttttggtgaaatagattgtaa

SEQ ID NO: 82251 - DNA, 22 bp, Artificial sequence
  SiRNA target sequence
ttttggtgaaatagattgtaaa

SEQ ID NO: 82252 - DNA, 22 bp, Artificial sequence
  SiRNA target sequence
tttggtgaaatagattgtaaaa

SEQ ID NO: 82253 - DNA, 22 bp, Artificial sequence
  SiRNA target sequence
ttggtgaaatagattgtaaaac

SEQ ID NO: 82254 - DNA, 22 bp, Artificial sequence
  SiRNA target sequence
tggtgaaatagattgtaaaaca

SEQ ID NO: 82255 - DNA, 22 bp, Artificial sequence
  SiRNA target sequence
ggtgaaatagattgtaaaacag

SEQ ID NO: 82256 - DNA, 22 bp, Artificial sequence
  SiRNA target sequence
gtgaaatagattgtaaaacaga

SEQ ID NO: 82257 - DNA, 22 bp, Artificial sequence
  SiRNA target sequence
tgaaatagattgtaaaacagat

SEQ ID NO: 82258 - DNA, 22 bp, Artificial sequence
  SiRNA target sequence
gaaatagattgtaaaacagatt

SEQ ID NO: 82259 - DNA, 22 bp, Artificial sequence
  SiRNA target sequence
aaatagattgtaaaacagattt

SEQ ID NO: 82260 - DNA, 22 bp, Artificial sequence
  SiRNA target sequence
aatagattgtaaaacagatttt

SEQ ID NO: 82261 - DNA, 22 bp, Artificial sequence
  SiRNA target sequence
atagattgtaaaacagattttc

SEQ ID NO: 82262 - DNA, 22 bp, Artificial sequence
  SiRNA target sequence
tagattgtaaaacagattttcc

SEQ ID NO: 82263 - DNA, 22 bp, Artificial sequence
  SiRNA target sequence
agattgtaaaacagattttcca

SEQ ID NO: 82264 - DNA, 22 bp, Artificial sequence
  SiRNA target sequence
gattgtaaaacagattttccaa

SEQ ID NO: 82265 - DNA, 22 bp, Artificial sequence
  SiRNA target sequence
attgtaaaacagattttccaag

SEQ ID NO: 82266 - DNA, 22 bp, Artificial sequence
  SiRNA target sequence
ttgtaaaacagattttccaagt

SEQ ID NO: 82267 - DNA, 22 bp, Artificial sequence
  SiRNA target sequence
tgtaaaacagattttccaagtg

SEQ ID NO: 82268 - DNA, 22 bp, Artificial sequence
  SiRNA target sequence
gtaaaacagattttccaagtga

SEQ ID NO: 82269 - DNA, 22 bp, Artificial sequence
  SiRNA target sequence
taaaacagattttccaagtgag

SEQ ID NO: 82270 - DNA, 22 bp, Artificial sequence
  SiRNA target sequence
aaaacagattttccaagtgagt

SEQ ID NO: 82271 - DNA, 22 bp, Artificial sequence
  SiRNA target sequence
aaacagattttccaagtgagtt

SEQ ID NO: 82272 - DNA, 22 bp, Artificial sequence
  SiRNA target sequence
aacagattttccaagtgagttg

SEQ ID NO: 82273 - DNA, 22 bp, Artificial sequence
  SiRNA target sequence
acagattttccaagtgagttgt

SEQ ID NO: 82274 - DNA, 22 bp, Artificial sequence
  SiRNA target sequence
cagattttccaagtgagttgtc

SEQ ID NO: 82275 - DNA, 22 bp, Artificial sequence
  SiRNA target sequence
agattttccaagtgagttgtct

SEQ ID NO: 82276 - DNA, 22 bp, Artificial sequence
  SiRNA target sequence
gattttccaagtgagttgtctg

SEQ ID NO: 82277 - DNA, 22 bp, Artificial sequence
  SiRNA target sequence
attttccaagtgagttgtctgc

SEQ ID NO: 82278 - DNA, 22 bp, Artificial sequence
  SiRNA target sequence
ttttccaagtgagttgtctgca

SEQ ID NO: 82279 - DNA, 22 bp, Artificial sequence
  SiRNA target sequence
tttccaagtgagttgtctgcat

SEQ ID NO: 82280 - DNA, 22 bp, Artificial sequence
  SiRNA target sequence
ttccaagtgagttgtctgcatg

SEQ ID NO: 82281 - DNA, 22 bp, Artificial sequence
  SiRNA target sequence
tccaagtgagttgtctgcatgt

SEQ ID NO: 82282 - DNA, 22 bp, Artificial sequence
  SiRNA target sequence
ccaagtgagttgtctgcatgtg

SEQ ID NO: 82283 - DNA, 22 bp, Artificial sequence
  SiRNA target sequence
caagtgagttgtctgcatgtgt

SEQ ID NO: 82284 - DNA, 22 bp, Artificial sequence
  SiRNA target sequence
aagtgagttgtctgcatgtgta

SEQ ID NO: 82285 - DNA, 22 bp, Artificial sequence
  SiRNA target sequence
agtgagttgtctgcatgtgtat

SEQ ID NO: 82286 - DNA, 22 bp, Artificial sequence
  SiRNA target sequence
gtgagttgtctgcatgtgtatg

SEQ ID NO: 82287 - DNA, 22 bp, Artificial sequence
  SiRNA target sequence
tgagttgtctgcatgtgtatgc

SEQ ID NO: 82288 - DNA, 22 bp, Artificial sequence
  SiRNA target sequence
gagttgtctgcatgtgtatgcg

SEQ ID NO: 82289 - DNA, 22 bp, Artificial sequence
  SiRNA target sequence
agttgtctgcatgtgtatgcgg

SEQ ID NO: 82290 - DNA, 22 bp, Artificial sequence
  SiRNA target sequence
gttgtctgcatgtgtatgcggg

SEQ ID NO: 82291 - DNA, 22 bp, Artificial sequence
  SiRNA target sequence
ttgtctgcatgtgtatgcggga

SEQ ID NO: 82292 - DNA, 22 bp, Artificial sequence
  SiRNA target sequence
tgtctgcatgtgtatgcgggaa

SEQ ID NO: 82293 - DNA, 22 bp, Artificial sequence
  SiRNA target sequence
gtctgcatgtgtatgcgggaaa

SEQ ID NO: 82294 - DNA, 22 bp, Artificial sequence
  SiRNA target sequence
tctgcatgtgtatgcgggaaaa

SEQ ID NO: 82295 - DNA, 22 bp, Artificial sequence
  SiRNA target sequence
ctgcatgtgtatgcgggaaaaa

SEQ ID NO: 82296 - DNA, 22 bp, Artificial sequence
  SiRNA target sequence
tgcatgtgtatgcgggaaaaaa

SEQ ID NO: 82297 - DNA, 22 bp, Artificial sequence
  SiRNA target sequence
gcatgtgtatgcgggaaaaaat

SEQ ID NO: 82298 - DNA, 22 bp, Artificial sequence
  SiRNA target sequence
catgtgtatgcgggaaaaaatg

SEQ ID NO: 82299 - DNA, 22 bp, Artificial sequence
  SiRNA target sequence
atgtgtatgcgggaaaaaatgc

SEQ ID NO: 82300 - DNA, 22 bp, Artificial sequence
  SiRNA target sequence
tgtgtatgcgggaaaaaatgct

SEQ ID NO: 82301 - DNA, 22 bp, Artificial sequence
  SiRNA target sequence
gtgtatgcgggaaaaaatgctg

SEQ ID NO: 82302 - DNA, 22 bp, Artificial sequence
  SiRNA target sequence
tgtatgcgggaaaaaatgctgt

SEQ ID NO: 82303 - DNA, 22 bp, Artificial sequence
  SiRNA target sequence
gtatgcgggaaaaaatgctgtt

SEQ ID NO: 82304 - DNA, 22 bp, Artificial sequence
  SiRNA target sequence
tatgcgggaaaaaatgctgttt

SEQ ID NO: 82305 - DNA, 22 bp, Artificial sequence
  SiRNA target sequence
atgcgggaaaaaatgctgtttt

SEQ ID NO: 82306 - DNA, 22 bp, Artificial sequence
  SiRNA target sequence
tgcgggaaaaaatgctgttttg

SEQ ID NO: 82307 - DNA, 22 bp, Artificial sequence
  SiRNA target sequence
gcgggaaaaaatgctgttttgc

SEQ ID NO: 82308 - DNA, 22 bp, Artificial sequence
  SiRNA target sequence
cgggaaaaaatgctgttttgct

SEQ ID NO: 82309 - DNA, 22 bp, Artificial sequence
  SiRNA target sequence
gggaaaaaatgctgttttgcta

SEQ ID NO: 82310 - DNA, 22 bp, Artificial sequence
  SiRNA target sequence
ggaaaaaatgctgttttgctaa

SEQ ID NO: 82311 - DNA, 22 bp, Artificial sequence
  SiRNA target sequence
gaaaaaatgctgttttgctaaa

SEQ ID NO: 82312 - DNA, 22 bp, Artificial sequence
  SiRNA target sequence
aaaaaatgctgttttgctaaat

SEQ ID NO: 82313 - DNA, 22 bp, Artificial sequence
  SiRNA target sequence
aaaaatgctgttttgctaaata

SEQ ID NO: 82314 - DNA, 22 bp, Artificial sequence
  SiRNA target sequence
aaaatgctgttttgctaaataa

SEQ ID NO: 82315 - DNA, 22 bp, Artificial sequence
  SiRNA target sequence
aaatgctgttttgctaaataaa

SEQ ID NO: 82316 - DNA, 22 bp, Artificial sequence
  SiRNA target sequence
aatgctgttttgctaaataaac

SEQ ID NO: 82317 - DNA, 22 bp, Artificial sequence
  SiRNA target sequence
atgctgttttgctaaataaaca

SEQ ID NO: 82318 - DNA, 22 bp, Artificial sequence
  SiRNA target sequence
tgctgttttgctaaataaacaa

SEQ ID NO: 82319 - DNA, 22 bp, Artificial sequence
  SiRNA target sequence
gctgttttgctaaataaacaat

SEQ ID NO: 82320 - DNA, 22 bp, Artificial sequence
  SiRNA target sequence
ctgttttgctaaataaacaatc

SEQ ID NO: 82321 - DNA, 22 bp, Artificial sequence
  SiRNA target sequence
tgttttgctaaataaacaatcc

SEQ ID NO: 82322 - DNA, 22 bp, Artificial sequence
  SiRNA target sequence
gttttgctaaataaacaatcca

SEQ ID NO: 82323 - DNA, 22 bp, Artificial sequence
  SiRNA target sequence
ttttgctaaataaacaatccat

SEQ ID NO: 82324 - DNA, 22 bp, Artificial sequence
  SiRNA target sequence
tttgctaaataaacaatccata

SEQ ID NO: 82325 - DNA, 22 bp, Artificial sequence
  SiRNA target sequence
ttgctaaataaacaatccatac

SEQ ID NO: 82326 - DNA, 22 bp, Artificial sequence
  SiRNA target sequence
tgctaaataaacaatccataca

SEQ ID NO: 82327 - DNA, 22 bp, Artificial sequence
  SiRNA target sequence
gctaaataaacaatccatacac

SEQ ID NO: 82328 - DNA, 22 bp, Artificial sequence
  SiRNA target sequence
ctaaataaacaatccatacacc

SEQ ID NO: 82329 - DNA, 22 bp, Artificial sequence
  SiRNA target sequence
taaataaacaatccatacaccc

SEQ ID NO: 82330 - DNA, 22 bp, Artificial sequence
  SiRNA target sequence
aaataaacaatccatacaccca

SEQ ID NO: 82331 - DNA, 22 bp, Artificial sequence
  SiRNA target sequence
aataaacaatccatacacccaa

SEQ ID NO: 82332 - DNA, 22 bp, Artificial sequence
  SiRNA target sequence
ataaacaatccatacacccaat

SEQ ID NO: 82333 - DNA, 22 bp, Artificial sequence
  SiRNA target sequence
taaacaatccatacacccaata

SEQ ID NO: 82334 - DNA, 22 bp, Artificial sequence
  SiRNA target sequence
aaacaatccatacacccaataa

SEQ ID NO: 82335 - DNA, 22 bp, Artificial sequence
  SiRNA target sequence
aacaatccatacacccaataag

SEQ ID NO: 82336 - DNA, 22 bp, Artificial sequence
  SiRNA target sequence
acaatccatacacccaataaga

SEQ ID NO: 82337 - DNA, 22 bp, Artificial sequence
  SiRNA target sequence
caatccatacacccaataagat

SEQ ID NO: 82338 - DNA, 22 bp, Artificial sequence
  SiRNA target sequence
aatccatacacccaataagata

SEQ ID NO: 82339 - DNA, 22 bp, Artificial sequence
  SiRNA target sequence
atccatacacccaataagataa

SEQ ID NO: 82340 - DNA, 22 bp, Artificial sequence
  SiRNA target sequence
tccatacacccaataagataat

SEQ ID NO: 82341 - DNA, 22 bp, Artificial sequence
  SiRNA target sequence
ccatacacccaataagataata

SEQ ID NO: 82342 - DNA, 22 bp, Artificial sequence
  SiRNA target sequence
catacacccaataagataataa

SEQ ID NO: 82343 - DNA, 22 bp, Artificial sequence
  SiRNA target sequence
atacacccaataagataataag

SEQ ID NO: 82344 - DNA, 22 bp, Artificial sequence
  SiRNA target sequence
tacacccaataagataataagt

SEQ ID NO: 82345 - DNA, 22 bp, Artificial sequence
  SiRNA target sequence
acacccaataagataataagtc

SEQ ID NO: 82346 - DNA, 22 bp, Artificial sequence
  SiRNA target sequence
cacccaataagataataagtcc

SEQ ID NO: 82347 - DNA, 22 bp, Artificial sequence
  SiRNA target sequence
acccaataagataataagtcct

SEQ ID NO: 82348 - DNA, 22 bp, Artificial sequence
  SiRNA target sequence
cccaataagataataagtcctc

SEQ ID NO: 82349 - DNA, 22 bp, Artificial sequence
  SiRNA target sequence
ccaataagataataagtcctct

SEQ ID NO: 82350 - DNA, 22 bp, Artificial sequence
  SiRNA target sequence
caataagataataagtcctctt

SEQ ID NO: 82351 - DNA, 22 bp, Artificial sequence
  SiRNA target sequence
aataagataataagtcctctta

SEQ ID NO: 82352 - DNA, 22 bp, Artificial sequence
  SiRNA target sequence
ataagataataagtcctcttaa

SEQ ID NO: 82353 - DNA, 22 bp, Artificial sequence
  SiRNA target sequence
taagataataagtcctcttaat

SEQ ID NO: 82354 - DNA, 22 bp, Artificial sequence
  SiRNA target sequence
aagataataagtcctcttaata

SEQ ID NO: 82355 - DNA, 22 bp, Artificial sequence
  SiRNA target sequence
agataataagtcctcttaatac

SEQ ID NO: 82356 - DNA, 22 bp, Artificial sequence
  SiRNA target sequence
gataataagtcctcttaatact

SEQ ID NO: 82357 - DNA, 22 bp, Artificial sequence
  SiRNA target sequence
ataataagtcctcttaatactt

SEQ ID NO: 82358 - DNA, 22 bp, Artificial sequence
  SiRNA target sequence
taataagtcctcttaatacttt

SEQ ID NO: 82359 - DNA, 22 bp, Artificial sequence
  SiRNA target sequence
aataagtcctcttaatactttc

SEQ ID NO: 82360 - DNA, 22 bp, Artificial sequence
  SiRNA target sequence
ataagtcctcttaatactttct

SEQ ID NO: 82361 - DNA, 22 bp, Artificial sequence
  SiRNA target sequence
taagtcctcttaatactttctg

SEQ ID NO: 82362 - DNA, 22 bp, Artificial sequence
  SiRNA target sequence
aagtcctcttaatactttctgc

SEQ ID NO: 82363 - DNA, 22 bp, Artificial sequence
  SiRNA target sequence
agtcctcttaatactttctgct

SEQ ID NO: 82364 - DNA, 22 bp, Artificial sequence
  SiRNA target sequence
gtcctcttaatactttctgctc

SEQ ID NO: 82365 - DNA, 22 bp, Artificial sequence
  SiRNA target sequence
tcctcttaatactttctgctct

SEQ ID NO: 82366 - DNA, 22 bp, Artificial sequence
  SiRNA target sequence
cctcttaatactttctgctctt

SEQ ID NO: 82367 - DNA, 22 bp, Artificial sequence
  SiRNA target sequence
ctcttaatactttctgctcttt

SEQ ID NO: 82368 - DNA, 22 bp, Artificial sequence
  SiRNA target sequence
tcttaatactttctgctctttg

SEQ ID NO: 82369 - DNA, 22 bp, Artificial sequence
  SiRNA target sequence
cttaatactttctgctctttgt

SEQ ID NO: 82370 - DNA, 22 bp, Artificial sequence
  SiRNA target sequence
ttaatactttctgctctttgtt

SEQ ID NO: 82371 - DNA, 22 bp, Artificial sequence
  SiRNA target sequence
taatactttctgctctttgttc

SEQ ID NO: 82372 - DNA, 22 bp, Artificial sequence
  SiRNA target sequence
aatactttctgctctttgttca

SEQ ID NO: 82373 - DNA, 22 bp, Artificial sequence
  SiRNA target sequence
atactttctgctctttgttcat

SEQ ID NO: 82374 - DNA, 23 bp, Artificial sequence
  SiRNA target sequence
ttattctggttcacaaccacaac

SEQ ID NO: 82375 - DNA, 23 bp, Artificial sequence
  SiRNA target sequence
tattctggttcacaaccacaact

SEQ ID NO: 82376 - DNA, 23 bp, Artificial sequence
  SiRNA target sequence
attctggttcacaaccacaactc

SEQ ID NO: 82377 - DNA, 23 bp, Artificial sequence
  SiRNA target sequence
ttctggttcacaaccacaactcc

SEQ ID NO: 82378 - DNA, 23 bp, Artificial sequence
  SiRNA target sequence
tctggttcacaaccacaactcca

SEQ ID NO: 82379 - DNA, 23 bp, Artificial sequence
  SiRNA target sequence
ctggttcacaaccacaactccaa

SEQ ID NO: 82380 - DNA, 23 bp, Artificial sequence
  SiRNA target sequence
tggttcacaaccacaactccaaa

SEQ ID NO: 82381 - DNA, 23 bp, Artificial sequence
  SiRNA target sequence
ggttcacaaccacaactccaaac

SEQ ID NO: 82382 - DNA, 23 bp, Artificial sequence
  SiRNA target sequence
gttcacaaccacaactccaaaca

SEQ ID NO: 82383 - DNA, 23 bp, Artificial sequence
  SiRNA target sequence
ttcacaaccacaactccaaacac

SEQ ID NO: 82384 - DNA, 23 bp, Artificial sequence
  SiRNA target sequence
tcacaaccacaactccaaacacc

SEQ ID NO: 82385 - DNA, 23 bp, Artificial sequence
  SiRNA target sequence
cacaaccacaactccaaacacct

SEQ ID NO: 82386 - DNA, 23 bp, Artificial sequence
  SiRNA target sequence
acaaccacaactccaaacacctt

SEQ ID NO: 82387 - DNA, 23 bp, Artificial sequence
  SiRNA target sequence
caaccacaactccaaacaccttc

SEQ ID NO: 82388 - DNA, 23 bp, Artificial sequence
  SiRNA target sequence
aaccacaactccaaacaccttct

SEQ ID NO: 82389 - DNA, 23 bp, Artificial sequence
  SiRNA target sequence
accacaactccaaacaccttcta

SEQ ID NO: 82390 - DNA, 23 bp, Artificial sequence
  SiRNA target sequence
ccacaactccaaacaccttctac

SEQ ID NO: 82391 - DNA, 23 bp, Artificial sequence
  SiRNA target sequence
cacaactccaaacaccttctacc

SEQ ID NO: 82392 - DNA, 23 bp, Artificial sequence
  SiRNA target sequence
acaactccaaacaccttctacct

SEQ ID NO: 82393 - DNA, 23 bp, Artificial sequence
  SiRNA target sequence
caactccaaacaccttctacctt

SEQ ID NO: 82394 - DNA, 23 bp, Artificial sequence
  SiRNA target sequence
aactccaaacaccttctaccttt

SEQ ID NO: 82395 - DNA, 23 bp, Artificial sequence
  SiRNA target sequence
actccaaacaccttctacctttt

SEQ ID NO: 82396 - DNA, 23 bp, Artificial sequence
  SiRNA target sequence
ctccaaacaccttctaccttttt

SEQ ID NO: 82397 - DNA, 23 bp, Artificial sequence
  SiRNA target sequence
tccaaacaccttctaccttttta

SEQ ID NO: 82398 - DNA, 23 bp, Artificial sequence
  SiRNA target sequence
ccaaacaccttctacctttttac

SEQ ID NO: 82399 - DNA, 23 bp, Artificial sequence
  SiRNA target sequence
caaacaccttctacctttttaca

SEQ ID NO: 82400 - DNA, 23 bp, Artificial sequence
  SiRNA target sequence
aaacaccttctacctttttacag

SEQ ID NO: 82401 - DNA, 23 bp, Artificial sequence
  SiRNA target sequence
aacaccttctacctttttacagt

SEQ ID NO: 82402 - DNA, 23 bp, Artificial sequence
  SiRNA target sequence
acaccttctacctttttacagtc

SEQ ID NO: 82403 - DNA, 23 bp, Artificial sequence
  SiRNA target sequence
caccttctacctttttacagtcc

SEQ ID NO: 82404 - DNA, 23 bp, Artificial sequence
  SiRNA target sequence
accttctacctttttacagtcca

SEQ ID NO: 82405 - DNA, 23 bp, Artificial sequence
  SiRNA target sequence
ccttctacctttttacagtccat

SEQ ID NO: 82406 - DNA, 23 bp, Artificial sequence
  SiRNA target sequence
cttctacctttttacagtccata

SEQ ID NO: 82407 - DNA, 23 bp, Artificial sequence
  SiRNA target sequence
ttctacctttttacagtccataa

SEQ ID NO: 82408 - DNA, 23 bp, Artificial sequence
  SiRNA target sequence
tctacctttttacagtccataat

SEQ ID NO: 82409 - DNA, 23 bp, Artificial sequence
  SiRNA target sequence
ctacctttttacagtccataatg

SEQ ID NO: 82410 - DNA, 23 bp, Artificial sequence
  SiRNA target sequence
tacctttttacagtccataatgg

SEQ ID NO: 82411 - DNA, 23 bp, Artificial sequence
  SiRNA target sequence
acctttttacagtccataatggg

SEQ ID NO: 82412 - DNA, 23 bp, Artificial sequence
  SiRNA target sequence
cctttttacagtccataatgggc

SEQ ID NO: 82413 - DNA, 23 bp, Artificial sequence
  SiRNA target sequence
ctttttacagtccataatgggct

SEQ ID NO: 82414 - DNA, 23 bp, Artificial sequence
  SiRNA target sequence
tttttacagtccataatgggctt

SEQ ID NO: 82415 - DNA, 23 bp, Artificial sequence
  SiRNA target sequence
ttttacagtccataatgggcttt

SEQ ID NO: 82416 - DNA, 23 bp, Artificial sequence
  SiRNA target sequence
tttacagtccataatgggctttc

SEQ ID NO: 82417 - DNA, 23 bp, Artificial sequence
  SiRNA target sequence
ttacagtccataatgggctttcc

SEQ ID NO: 82418 - DNA, 23 bp, Artificial sequence
  SiRNA target sequence
tacagtccataatgggctttcct

SEQ ID NO: 82419 - DNA, 23 bp, Artificial sequence
  SiRNA target sequence
acagtccataatgggctttccta

SEQ ID NO: 82420 - DNA, 23 bp, Artificial sequence
  SiRNA target sequence
cagtccataatgggctttcctaa

SEQ ID NO: 82421 - DNA, 23 bp, Artificial sequence
  SiRNA target sequence
agtccataatgggctttcctaat

SEQ ID NO: 82422 - DNA, 23 bp, Artificial sequence
  SiRNA target sequence
gtccataatgggctttcctaatc

SEQ ID NO: 82423 - DNA, 23 bp, Artificial sequence
  SiRNA target sequence
tccataatgggctttcctaatct

SEQ ID NO: 82424 - DNA, 23 bp, Artificial sequence
  SiRNA target sequence
ccataatgggctttcctaatctt

SEQ ID NO: 82425 - DNA, 23 bp, Artificial sequence
  SiRNA target sequence
cataatgggctttcctaatcttt

SEQ ID NO: 82426 - DNA, 23 bp, Artificial sequence
  SiRNA target sequence
ataatgggctttcctaatctttt

SEQ ID NO: 82427 - DNA, 23 bp, Artificial sequence
  SiRNA target sequence
taatgggctttcctaatctttta

SEQ ID NO: 82428 - DNA, 23 bp, Artificial sequence
  SiRNA target sequence
aatgggctttcctaatcttttat

SEQ ID NO: 82429 - DNA, 23 bp, Artificial sequence
  SiRNA target sequence
atgggctttcctaatcttttatt

SEQ ID NO: 82430 - DNA, 23 bp, Artificial sequence
  SiRNA target sequence
tgggctttcctaatcttttatta

SEQ ID NO: 82431 - DNA, 23 bp, Artificial sequence
  SiRNA target sequence
gggctttcctaatcttttattaa

SEQ ID NO: 82432 - DNA, 23 bp, Artificial sequence
  SiRNA target sequence
ggctttcctaatcttttattaac

SEQ ID NO: 82433 - DNA, 23 bp, Artificial sequence
  SiRNA target sequence
gctttcctaatcttttattaact

SEQ ID NO: 82434 - DNA, 23 bp, Artificial sequence
  SiRNA target sequence
ctttcctaatcttttattaacta

SEQ ID NO: 82435 - DNA, 23 bp, Artificial sequence
  SiRNA target sequence
tttcctaatcttttattaactat

SEQ ID NO: 82436 - DNA, 23 bp, Artificial sequence
  SiRNA target sequence
ttcctaatcttttattaactatg

SEQ ID NO: 82437 - DNA, 23 bp, Artificial sequence
  SiRNA target sequence
tcctaatcttttattaactatgt

SEQ ID NO: 82438 - DNA, 23 bp, Artificial sequence
  SiRNA target sequence
cctaatcttttattaactatgtt

SEQ ID NO: 82439 - DNA, 23 bp, Artificial sequence
  SiRNA target sequence
ctaatcttttattaactatgtta

SEQ ID NO: 82440 - DNA, 23 bp, Artificial sequence
  SiRNA target sequence
taatcttttattaactatgttat

SEQ ID NO: 82441 - DNA, 23 bp, Artificial sequence
  SiRNA target sequence
aatcttttattaactatgttatg

SEQ ID NO: 82442 - DNA, 23 bp, Artificial sequence
  SiRNA target sequence
atcttttattaactatgttatgt

SEQ ID NO: 82443 - DNA, 23 bp, Artificial sequence
  SiRNA target sequence
tcttttattaactatgttatgtg

SEQ ID NO: 82444 - DNA, 23 bp, Artificial sequence
  SiRNA target sequence
cttttattaactatgttatgtgc

SEQ ID NO: 82445 - DNA, 23 bp, Artificial sequence
  SiRNA target sequence
ttttattaactatgttatgtgct

SEQ ID NO: 82446 - DNA, 23 bp, Artificial sequence
  SiRNA target sequence
tttattaactatgttatgtgctt

SEQ ID NO: 82447 - DNA, 23 bp, Artificial sequence
  SiRNA target sequence
ttattaactatgttatgtgcttt

SEQ ID NO: 82448 - DNA, 23 bp, Artificial sequence
  SiRNA target sequence
tattaactatgttatgtgcttta

SEQ ID NO: 82449 - DNA, 23 bp, Artificial sequence
  SiRNA target sequence
attaactatgttatgtgctttac

SEQ ID NO: 82450 - DNA, 23 bp, Artificial sequence
  SiRNA target sequence
ttaactatgttatgtgctttaca

SEQ ID NO: 82451 - DNA, 23 bp, Artificial sequence
  SiRNA target sequence
taactatgttatgtgctttacat

SEQ ID NO: 82452 - DNA, 23 bp, Artificial sequence
  SiRNA target sequence
aactatgttatgtgctttacata

SEQ ID NO: 82453 - DNA, 23 bp, Artificial sequence
  SiRNA target sequence
actatgttatgtgctttacatag

SEQ ID NO: 82454 - DNA, 23 bp, Artificial sequence
  SiRNA target sequence
ctatgttatgtgctttacatagc

SEQ ID NO: 82455 - DNA, 23 bp, Artificial sequence
  SiRNA target sequence
tatgttatgtgctttacatagcc

SEQ ID NO: 82456 - DNA, 23 bp, Artificial sequence
  SiRNA target sequence
atgttatgtgctttacatagcca

SEQ ID NO: 82457 - DNA, 23 bp, Artificial sequence
  SiRNA target sequence
tgttatgtgctttacatagccac

SEQ ID NO: 82458 - DNA, 23 bp, Artificial sequence
  SiRNA target sequence
gttatgtgctttacatagccact

SEQ ID NO: 82459 - DNA, 23 bp, Artificial sequence
  SiRNA target sequence
ttatgtgctttacatagccactg

SEQ ID NO: 82460 - DNA, 23 bp, Artificial sequence
  SiRNA target sequence
tatgtgctttacatagccactgg

SEQ ID NO: 82461 - DNA, 23 bp, Artificial sequence
  SiRNA target sequence
atgtgctttacatagccactgga

SEQ ID NO: 82462 - DNA, 23 bp, Artificial sequence
  SiRNA target sequence
tgtgctttacatagccactggac

SEQ ID NO: 82463 - DNA, 23 bp, Artificial sequence
  SiRNA target sequence
gtgctttacatagccactggaca

SEQ ID NO: 82464 - DNA, 23 bp, Artificial sequence
  SiRNA target sequence
tgctttacatagccactggacaa

SEQ ID NO: 82465 - DNA, 23 bp, Artificial sequence
  SiRNA target sequence
gctttacatagccactggacaaa

SEQ ID NO: 82466 - DNA, 23 bp, Artificial sequence
  SiRNA target sequence
ctttacatagccactggacaaat

SEQ ID NO: 82467 - DNA, 23 bp, Artificial sequence
  SiRNA target sequence
tttacatagccactggacaaatt

SEQ ID NO: 82468 - DNA, 23 bp, Artificial sequence
  SiRNA target sequence
ttacatagccactggacaaattc

SEQ ID NO: 82469 - DNA, 23 bp, Artificial sequence
  SiRNA target sequence
tacatagccactggacaaattcg

SEQ ID NO: 82470 - DNA, 23 bp, Artificial sequence
  SiRNA target sequence
acatagccactggacaaattcgt

SEQ ID NO: 82471 - DNA, 23 bp, Artificial sequence
  SiRNA target sequence
catagccactggacaaattcgtc

SEQ ID NO: 82472 - DNA, 23 bp, Artificial sequence
  SiRNA target sequence
atagccactggacaaattcgtca

SEQ ID NO: 82473 - DNA, 23 bp, Artificial sequence
  SiRNA target sequence
tagccactggacaaattcgtcat

SEQ ID NO: 82474 - DNA, 23 bp, Artificial sequence
  SiRNA target sequence
agccactggacaaattcgtcatg

SEQ ID NO: 82475 - DNA, 23 bp, Artificial sequence
  SiRNA target sequence
gccactggacaaattcgtcatgt

SEQ ID NO: 82476 - DNA, 23 bp, Artificial sequence
  SiRNA target sequence
ccactggacaaattcgtcatgtg

SEQ ID NO: 82477 - DNA, 23 bp, Artificial sequence
  SiRNA target sequence
cactggacaaattcgtcatgtgt

SEQ ID NO: 82478 - DNA, 23 bp, Artificial sequence
  SiRNA target sequence
actggacaaattcgtcatgtgtg

SEQ ID NO: 82479 - DNA, 23 bp, Artificial sequence
  SiRNA target sequence
ctggacaaattcgtcatgtgtgg

SEQ ID NO: 82480 - DNA, 23 bp, Artificial sequence
  SiRNA target sequence
tggacaaattcgtcatgtgtggc

SEQ ID NO: 82481 - DNA, 23 bp, Artificial sequence
  SiRNA target sequence
ggacaaattcgtcatgtgtggca

SEQ ID NO: 82482 - DNA, 23 bp, Artificial sequence
  SiRNA target sequence
gacaaattcgtcatgtgtggcaa

SEQ ID NO: 82483 - DNA, 23 bp, Artificial sequence
  SiRNA target sequence
acaaattcgtcatgtgtggcaac

SEQ ID NO: 82484 - DNA, 23 bp, Artificial sequence
  SiRNA target sequence
caaattcgtcatgtgtggcaact

SEQ ID NO: 82485 - DNA, 23 bp, Artificial sequence
  SiRNA target sequence
aaattcgtcatgtgtggcaactt

SEQ ID NO: 82486 - DNA, 23 bp, Artificial sequence
  SiRNA target sequence
aattcgtcatgtgtggcaacttg

SEQ ID NO: 82487 - DNA, 23 bp, Artificial sequence
  SiRNA target sequence
attcgtcatgtgtggcaacttgt

SEQ ID NO: 82488 - DNA, 23 bp, Artificial sequence
  SiRNA target sequence
ttcgtcatgtgtggcaacttgtg

SEQ ID NO: 82489 - DNA, 23 bp, Artificial sequence
  SiRNA target sequence
tcgtcatgtgtggcaacttgtgg

SEQ ID NO: 82490 - DNA, 23 bp, Artificial sequence
  SiRNA target sequence
cgtcatgtgtggcaacttgtgga

SEQ ID NO: 82491 - DNA, 23 bp, Artificial sequence
  SiRNA target sequence
gtcatgtgtggcaacttgtggag

SEQ ID NO: 82492 - DNA, 23 bp, Artificial sequence
  SiRNA target sequence
tcatgtgtggcaacttgtggagg

SEQ ID NO: 82493 - DNA, 23 bp, Artificial sequence
  SiRNA target sequence
catgtgtggcaacttgtggagga

SEQ ID NO: 82494 - DNA, 23 bp, Artificial sequence
  SiRNA target sequence
atgtgtggcaacttgtggaggat

SEQ ID NO: 82495 - DNA, 23 bp, Artificial sequence
  SiRNA target sequence
tgtgtggcaacttgtggaggatt

SEQ ID NO: 82496 - DNA, 23 bp, Artificial sequence
  SiRNA target sequence
gtgtggcaacttgtggaggattt

SEQ ID NO: 82497 - DNA, 23 bp, Artificial sequence
  SiRNA target sequence
tgtggcaacttgtggaggattta

SEQ ID NO: 82498 - DNA, 23 bp, Artificial sequence
  SiRNA target sequence
gtggcaacttgtggaggatttaa

SEQ ID NO: 82499 - DNA, 23 bp, Artificial sequence
  SiRNA target sequence
tggcaacttgtggaggatttaag

SEQ ID NO: 82500 - DNA, 23 bp, Artificial sequence
  SiRNA target sequence
ggcaacttgtggaggatttaagc

SEQ ID NO: 82501 - DNA, 23 bp, Artificial sequence
  SiRNA target sequence
gcaacttgtggaggatttaagct

SEQ ID NO: 82502 - DNA, 23 bp, Artificial sequence
  SiRNA target sequence
caacttgtggaggatttaagctt

SEQ ID NO: 82503 - DNA, 23 bp, Artificial sequence
  SiRNA target sequence
aacttgtggaggatttaagctta

SEQ ID NO: 82504 - DNA, 23 bp, Artificial sequence
  SiRNA target sequence
acttgtggaggatttaagcttaa

SEQ ID NO: 82505 - DNA, 23 bp, Artificial sequence
  SiRNA target sequence
cttgtggaggatttaagcttaac

SEQ ID NO: 82506 - DNA, 23 bp, Artificial sequence
  SiRNA target sequence
ttgtggaggatttaagcttaaca

SEQ ID NO: 82507 - DNA, 23 bp, Artificial sequence
  SiRNA target sequence
tgtggaggatttaagcttaacag

SEQ ID NO: 82508 - DNA, 23 bp, Artificial sequence
  SiRNA target sequence
gtggaggatttaagcttaacagt

SEQ ID NO: 82509 - DNA, 23 bp, Artificial sequence
  SiRNA target sequence
tggaggatttaagcttaacagtc

SEQ ID NO: 82510 - DNA, 23 bp, Artificial sequence
  SiRNA target sequence
ggaggatttaagcttaacagtct

SEQ ID NO: 82511 - DNA, 23 bp, Artificial sequence
  SiRNA target sequence
gaggatttaagcttaacagtctt

SEQ ID NO: 82512 - DNA, 23 bp, Artificial sequence
  SiRNA target sequence
aggatttaagcttaacagtcttt

SEQ ID NO: 82513 - DNA, 23 bp, Artificial sequence
  SiRNA target sequence
ggatttaagcttaacagtctttg

SEQ ID NO: 82514 - DNA, 23 bp, Artificial sequence
  SiRNA target sequence
gatttaagcttaacagtctttga

SEQ ID NO: 82515 - DNA, 23 bp, Artificial sequence
  SiRNA target sequence
atttaagcttaacagtctttgaa

SEQ ID NO: 82516 - DNA, 23 bp, Artificial sequence
  SiRNA target sequence
tttaagcttaacagtctttgaaa

SEQ ID NO: 82517 - DNA, 23 bp, Artificial sequence
  SiRNA target sequence
ttaagcttaacagtctttgaaaa

SEQ ID NO: 82518 - DNA, 23 bp, Artificial sequence
  SiRNA target sequence
taagcttaacagtctttgaaaat

SEQ ID NO: 82519 - DNA, 23 bp, Artificial sequence
  SiRNA target sequence
aagcttaacagtctttgaaaatg

SEQ ID NO: 82520 - DNA, 23 bp, Artificial sequence
  SiRNA target sequence
agcttaacagtctttgaaaatgt

SEQ ID NO: 82521 - DNA, 23 bp, Artificial sequence
  SiRNA target sequence
gcttaacagtctttgaaaatgtc

SEQ ID NO: 82522 - DNA, 23 bp, Artificial sequence
  SiRNA target sequence
cttaacagtctttgaaaatgtcc

SEQ ID NO: 82523 - DNA, 23 bp, Artificial sequence
  SiRNA target sequence
ttaacagtctttgaaaatgtcca

SEQ ID NO: 82524 - DNA, 23 bp, Artificial sequence
  SiRNA target sequence
taacagtctttgaaaatgtccac

SEQ ID NO: 82525 - DNA, 23 bp, Artificial sequence
  SiRNA target sequence
aacagtctttgaaaatgtccaca

SEQ ID NO: 82526 - DNA, 23 bp, Artificial sequence
  SiRNA target sequence
acagtctttgaaaatgtccacaa

SEQ ID NO: 82527 - DNA, 23 bp, Artificial sequence
  SiRNA target sequence
cagtctttgaaaatgtccacaac

SEQ ID NO: 82528 - DNA, 23 bp, Artificial sequence
  SiRNA target sequence
agtctttgaaaatgtccacaaca

SEQ ID NO: 82529 - DNA, 23 bp, Artificial sequence
  SiRNA target sequence
gtctttgaaaatgtccacaacat

SEQ ID NO: 82530 - DNA, 23 bp, Artificial sequence
  SiRNA target sequence
tctttgaaaatgtccacaacatt

SEQ ID NO: 82531 - DNA, 23 bp, Artificial sequence
  SiRNA target sequence
ctttgaaaatgtccacaacattc

SEQ ID NO: 82532 - DNA, 23 bp, Artificial sequence
  SiRNA target sequence
tttgaaaatgtccacaacattct

SEQ ID NO: 82533 - DNA, 23 bp, Artificial sequence
  SiRNA target sequence
ttgaaaatgtccacaacattctg

SEQ ID NO: 82534 - DNA, 23 bp, Artificial sequence
  SiRNA target sequence
tgaaaatgtccacaacattctgc

SEQ ID NO: 82535 - DNA, 23 bp, Artificial sequence
  SiRNA target sequence
gaaaatgtccacaacattctgca

SEQ ID NO: 82536 - DNA, 23 bp, Artificial sequence
  SiRNA target sequence
aaaatgtccacaacattctgcac

SEQ ID NO: 82537 - DNA, 23 bp, Artificial sequence
  SiRNA target sequence
aaatgtccacaacattctgcaca

SEQ ID NO: 82538 - DNA, 23 bp, Artificial sequence
  SiRNA target sequence
aatgtccacaacattctgcacag

SEQ ID NO: 82539 - DNA, 23 bp, Artificial sequence
  SiRNA target sequence
atgtccacaacattctgcacagg

SEQ ID NO: 82540 - DNA, 23 bp, Artificial sequence
  SiRNA target sequence
tgtccacaacattctgcacaggg

SEQ ID NO: 82541 - DNA, 23 bp, Artificial sequence
  SiRNA target sequence
gtccacaacattctgcacagggg

SEQ ID NO: 82542 - DNA, 23 bp, Artificial sequence
  SiRNA target sequence
tccacaacattctgcacagggga

SEQ ID NO: 82543 - DNA, 23 bp, Artificial sequence
  SiRNA target sequence
ccacaacattctgcacaggggaa

SEQ ID NO: 82544 - DNA, 23 bp, Artificial sequence
  SiRNA target sequence
cacaacattctgcacaggggaaa

SEQ ID NO: 82545 - DNA, 23 bp, Artificial sequence
  SiRNA target sequence
acaacattctgcacaggggaaaa

SEQ ID NO: 82546 - DNA, 23 bp, Artificial sequence
  SiRNA target sequence
caacattctgcacaggggaaaag

SEQ ID NO: 82547 - DNA, 23 bp, Artificial sequence
  SiRNA target sequence
aacattctgcacaggggaaaaga

SEQ ID NO: 82548 - DNA, 23 bp, Artificial sequence
  SiRNA target sequence
acattctgcacaggggaaaagag

SEQ ID NO: 82549 - DNA, 23 bp, Artificial sequence
  SiRNA target sequence
cattctgcacaggggaaaagaga

SEQ ID NO: 82550 - DNA, 23 bp, Artificial sequence
  SiRNA target sequence
attctgcacaggggaaaagagat

SEQ ID NO: 82551 - DNA, 23 bp, Artificial sequence
  SiRNA target sequence
ttctgcacaggggaaaagagatg

SEQ ID NO: 82552 - DNA, 23 bp, Artificial sequence
  SiRNA target sequence
tctgcacaggggaaaagagatga

SEQ ID NO: 82553 - DNA, 23 bp, Artificial sequence
  SiRNA target sequence
ctgcacaggggaaaagagatgat

SEQ ID NO: 82554 - DNA, 23 bp, Artificial sequence
  SiRNA target sequence
tgcacaggggaaaagagatgata

SEQ ID NO: 82555 - DNA, 23 bp, Artificial sequence
  SiRNA target sequence
gcacaggggaaaagagatgataa

SEQ ID NO: 82556 - DNA, 23 bp, Artificial sequence
  SiRNA target sequence
cacaggggaaaagagatgataaa

SEQ ID NO: 82557 - DNA, 23 bp, Artificial sequence
  SiRNA target sequence
acaggggaaaagagatgataaaa

SEQ ID NO: 82558 - DNA, 23 bp, Artificial sequence
  SiRNA target sequence
caggggaaaagagatgataaaag

SEQ ID NO: 82559 - DNA, 23 bp, Artificial sequence
  SiRNA target sequence
aggggaaaagagatgataaaagg

SEQ ID NO: 82560 - DNA, 23 bp, Artificial sequence
  SiRNA target sequence
ggggaaaagagatgataaaaggt

SEQ ID NO: 82561 - DNA, 23 bp, Artificial sequence
  SiRNA target sequence
gggaaaagagatgataaaaggta

SEQ ID NO: 82562 - DNA, 23 bp, Artificial sequence
  SiRNA target sequence
ggaaaagagatgataaaaggtaa

SEQ ID NO: 82563 - DNA, 23 bp, Artificial sequence
  SiRNA target sequence
gaaaagagatgataaaaggtaaa

SEQ ID NO: 82564 - DNA, 23 bp, Artificial sequence
  SiRNA target sequence
aaaagagatgataaaaggtaaat

SEQ ID NO: 82565 - DNA, 23 bp, Artificial sequence
  SiRNA target sequence
aaagagatgataaaaggtaaata

SEQ ID NO: 82566 - DNA, 23 bp, Artificial sequence
  SiRNA target sequence
aagagatgataaaaggtaaataa

SEQ ID NO: 82567 - DNA, 23 bp, Artificial sequence
  SiRNA target sequence
agagatgataaaaggtaaataaa

SEQ ID NO: 82568 - DNA, 23 bp, Artificial sequence
  SiRNA target sequence
gagatgataaaaggtaaataaat

SEQ ID NO: 82569 - DNA, 23 bp, Artificial sequence
  SiRNA target sequence
agatgataaaaggtaaataaatt

SEQ ID NO: 82570 - DNA, 23 bp, Artificial sequence
  SiRNA target sequence
gatgataaaaggtaaataaattg

SEQ ID NO: 82571 - DNA, 23 bp, Artificial sequence
  SiRNA target sequence
atgataaaaggtaaataaattga

SEQ ID NO: 82572 - DNA, 23 bp, Artificial sequence
  SiRNA target sequence
tgataaaaggtaaataaattgaa

SEQ ID NO: 82573 - DNA, 23 bp, Artificial sequence
  SiRNA target sequence
gataaaaggtaaataaattgaag

SEQ ID NO: 82574 - DNA, 23 bp, Artificial sequence
  SiRNA target sequence
ataaaaggtaaataaattgaagt

SEQ ID NO: 82575 - DNA, 23 bp, Artificial sequence
  SiRNA target sequence
taaaaggtaaataaattgaagtg

SEQ ID NO: 82576 - DNA, 23 bp, Artificial sequence
  SiRNA target sequence
aaaaggtaaataaattgaagtgt

SEQ ID NO: 82577 - DNA, 23 bp, Artificial sequence
  SiRNA target sequence
aaaggtaaataaattgaagtgta

SEQ ID NO: 82578 - DNA, 23 bp, Artificial sequence
  SiRNA target sequence
aaggtaaataaattgaagtgtat

SEQ ID NO: 82579 - DNA, 23 bp, Artificial sequence
  SiRNA target sequence
aggtaaataaattgaagtgtatc

SEQ ID NO: 82580 - DNA, 23 bp, Artificial sequence
  SiRNA target sequence
ggtaaataaattgaagtgtatct

SEQ ID NO: 82581 - DNA, 23 bp, Artificial sequence
  SiRNA target sequence
gtaaataaattgaagtgtatctt

SEQ ID NO: 82582 - DNA, 23 bp, Artificial sequence
  SiRNA target sequence
taaataaattgaagtgtatcttt

SEQ ID NO: 82583 - DNA, 23 bp, Artificial sequence
  SiRNA target sequence
aaataaattgaagtgtatctttt

SEQ ID NO: 82584 - DNA, 23 bp, Artificial sequence
  SiRNA target sequence
aataaattgaagtgtatcttttt

SEQ ID NO: 82585 - DNA, 23 bp, Artificial sequence
  SiRNA target sequence
ataaattgaagtgtatctttttt

SEQ ID NO: 82586 - DNA, 23 bp, Artificial sequence
  SiRNA target sequence
taaattgaagtgtatctttttta

SEQ ID NO: 82587 - DNA, 23 bp, Artificial sequence
  SiRNA target sequence
aaattgaagtgtatcttttttat

SEQ ID NO: 82588 - DNA, 23 bp, Artificial sequence
  SiRNA target sequence
aattgaagtgtatcttttttatg

SEQ ID NO: 82589 - DNA, 23 bp, Artificial sequence
  SiRNA target sequence
attgaagtgtatcttttttatgt

SEQ ID NO: 82590 - DNA, 23 bp, Artificial sequence
  SiRNA target sequence
ttgaagtgtatcttttttatgtt

SEQ ID NO: 82591 - DNA, 23 bp, Artificial sequence
  SiRNA target sequence
tgaagtgtatcttttttatgttg

SEQ ID NO: 82592 - DNA, 23 bp, Artificial sequence
  SiRNA target sequence
gaagtgtatcttttttatgttgt

SEQ ID NO: 82593 - DNA, 23 bp, Artificial sequence
  SiRNA target sequence
aagtgtatcttttttatgttgta

SEQ ID NO: 82594 - DNA, 23 bp, Artificial sequence
  SiRNA target sequence
agtgtatcttttttatgttgtac

SEQ ID NO: 82595 - DNA, 23 bp, Artificial sequence
  SiRNA target sequence
gtgtatcttttttatgttgtact

SEQ ID NO: 82596 - DNA, 23 bp, Artificial sequence
  SiRNA target sequence
tgtatcttttttatgttgtactg

SEQ ID NO: 82597 - DNA, 23 bp, Artificial sequence
  SiRNA target sequence
gtatcttttttatgttgtactgt

SEQ ID NO: 82598 - DNA, 23 bp, Artificial sequence
  SiRNA target sequence
tatcttttttatgttgtactgta

SEQ ID NO: 82599 - DNA, 23 bp, Artificial sequence
  SiRNA target sequence
atcttttttatgttgtactgtag

SEQ ID NO: 82600 - DNA, 23 bp, Artificial sequence
  SiRNA target sequence
tcttttttatgttgtactgtagg

SEQ ID NO: 82601 - DNA, 23 bp, Artificial sequence
  SiRNA target sequence
cttttttatgttgtactgtagga

SEQ ID NO: 82602 - DNA, 23 bp, Artificial sequence
  SiRNA target sequence
ttttttatgttgtactgtaggaa

SEQ ID NO: 82603 - DNA, 23 bp, Artificial sequence
  SiRNA target sequence
tttttatgttgtactgtaggaaa

SEQ ID NO: 82604 - DNA, 23 bp, Artificial sequence
  SiRNA target sequence
ttttatgttgtactgtaggaaat

SEQ ID NO: 82605 - DNA, 23 bp, Artificial sequence
  SiRNA target sequence
tttatgttgtactgtaggaaatg

SEQ ID NO: 82606 - DNA, 23 bp, Artificial sequence
  SiRNA target sequence
ttatgttgtactgtaggaaatgc

SEQ ID NO: 82607 - DNA, 23 bp, Artificial sequence
  SiRNA target sequence
tatgttgtactgtaggaaatgca

SEQ ID NO: 82608 - DNA, 23 bp, Artificial sequence
  SiRNA target sequence
atgttgtactgtaggaaatgcag

SEQ ID NO: 82609 - DNA, 23 bp, Artificial sequence
  SiRNA target sequence
tgttgtactgtaggaaatgcagg

SEQ ID NO: 82610 - DNA, 23 bp, Artificial sequence
  SiRNA target sequence
gttgtactgtaggaaatgcagga

SEQ ID NO: 82611 - DNA, 23 bp, Artificial sequence
  SiRNA target sequence
ttgtactgtaggaaatgcaggat

SEQ ID NO: 82612 - DNA, 23 bp, Artificial sequence
  SiRNA target sequence
tgtactgtaggaaatgcaggata

SEQ ID NO: 82613 - DNA, 23 bp, Artificial sequence
  SiRNA target sequence
gtactgtaggaaatgcaggataa

SEQ ID NO: 82614 - DNA, 23 bp, Artificial sequence
  SiRNA target sequence
tactgtaggaaatgcaggataaa

SEQ ID NO: 82615 - DNA, 23 bp, Artificial sequence
  SiRNA target sequence
actgtaggaaatgcaggataaac

SEQ ID NO: 82616 - DNA, 23 bp, Artificial sequence
  SiRNA target sequence
ctgtaggaaatgcaggataaaca

SEQ ID NO: 82617 - DNA, 23 bp, Artificial sequence
  SiRNA target sequence
tgtaggaaatgcaggataaacag

SEQ ID NO: 82618 - DNA, 23 bp, Artificial sequence
  SiRNA target sequence
gtaggaaatgcaggataaacagc

SEQ ID NO: 82619 - DNA, 23 bp, Artificial sequence
  SiRNA target sequence
taggaaatgcaggataaacagct

SEQ ID NO: 82620 - DNA, 23 bp, Artificial sequence
  SiRNA target sequence
aggaaatgcaggataaacagctg

SEQ ID NO: 82621 - DNA, 23 bp, Artificial sequence
  SiRNA target sequence
ggaaatgcaggataaacagctgc

SEQ ID NO: 82622 - DNA, 23 bp, Artificial sequence
  SiRNA target sequence
gaaatgcaggataaacagctgcc

SEQ ID NO: 82623 - DNA, 23 bp, Artificial sequence
  SiRNA target sequence
aaatgcaggataaacagctgcca

SEQ ID NO: 82624 - DNA, 23 bp, Artificial sequence
  SiRNA target sequence
aatgcaggataaacagctgccat

SEQ ID NO: 82625 - DNA, 23 bp, Artificial sequence
  SiRNA target sequence
atgcaggataaacagctgccatg

SEQ ID NO: 82626 - DNA, 23 bp, Artificial sequence
  SiRNA target sequence
tgcaggataaacagctgccatgg

SEQ ID NO: 82627 - DNA, 23 bp, Artificial sequence
  SiRNA target sequence
gcaggataaacagctgccatggt

SEQ ID NO: 82628 - DNA, 23 bp, Artificial sequence
  SiRNA target sequence
caggataaacagctgccatggta

SEQ ID NO: 82629 - DNA, 23 bp, Artificial sequence
  SiRNA target sequence
aggataaacagctgccatggtat

SEQ ID NO: 82630 - DNA, 23 bp, Artificial sequence
  SiRNA target sequence
ggataaacagctgccatggtatg

SEQ ID NO: 82631 - DNA, 23 bp, Artificial sequence
  SiRNA target sequence
gataaacagctgccatggtatgt

SEQ ID NO: 82632 - DNA, 23 bp, Artificial sequence
  SiRNA target sequence
ataaacagctgccatggtatgta

SEQ ID NO: 82633 - DNA, 23 bp, Artificial sequence
  SiRNA target sequence
taaacagctgccatggtatgtaa

SEQ ID NO: 82634 - DNA, 23 bp, Artificial sequence
  SiRNA target sequence
aaacagctgccatggtatgtaaa

SEQ ID NO: 82635 - DNA, 23 bp, Artificial sequence
  SiRNA target sequence
aacagctgccatggtatgtaaaa

SEQ ID NO: 82636 - DNA, 23 bp, Artificial sequence
  SiRNA target sequence
acagctgccatggtatgtaaaag

SEQ ID NO: 82637 - DNA, 23 bp, Artificial sequence
  SiRNA target sequence
cagctgccatggtatgtaaaagt

SEQ ID NO: 82638 - DNA, 23 bp, Artificial sequence
  SiRNA target sequence
agctgccatggtatgtaaaagtg

SEQ ID NO: 82639 - DNA, 23 bp, Artificial sequence
  SiRNA target sequence
gctgccatggtatgtaaaagtgt

SEQ ID NO: 82640 - DNA, 23 bp, Artificial sequence
  SiRNA target sequence
ctgccatggtatgtaaaagtgtc

SEQ ID NO: 82641 - DNA, 23 bp, Artificial sequence
  SiRNA target sequence
tgccatggtatgtaaaagtgtcc

SEQ ID NO: 82642 - DNA, 23 bp, Artificial sequence
  SiRNA target sequence
gccatggtatgtaaaagtgtcca

SEQ ID NO: 82643 - DNA, 23 bp, Artificial sequence
  SiRNA target sequence
ccatggtatgtaaaagtgtccat

SEQ ID NO: 82644 - DNA, 23 bp, Artificial sequence
  SiRNA target sequence
catggtatgtaaaagtgtccatg

SEQ ID NO: 82645 - DNA, 23 bp, Artificial sequence
  SiRNA target sequence
atggtatgtaaaagtgtccatgt

SEQ ID NO: 82646 - DNA, 23 bp, Artificial sequence
  SiRNA target sequence
tggtatgtaaaagtgtccatgtt

SEQ ID NO: 82647 - DNA, 23 bp, Artificial sequence
  SiRNA target sequence
ggtatgtaaaagtgtccatgttg

SEQ ID NO: 82648 - DNA, 23 bp, Artificial sequence
  SiRNA target sequence
gtatgtaaaagtgtccatgttgc

SEQ ID NO: 82649 - DNA, 23 bp, Artificial sequence
  SiRNA target sequence
tatgtaaaagtgtccatgttgct

SEQ ID NO: 82650 - DNA, 23 bp, Artificial sequence
  SiRNA target sequence
atgtaaaagtgtccatgttgctc

SEQ ID NO: 82651 - DNA, 23 bp, Artificial sequence
  SiRNA target sequence
tgtaaaagtgtccatgttgctct

SEQ ID NO: 82652 - DNA, 23 bp, Artificial sequence
  SiRNA target sequence
gtaaaagtgtccatgttgctctc

SEQ ID NO: 82653 - DNA, 23 bp, Artificial sequence
  SiRNA target sequence
taaaagtgtccatgttgctctcc

SEQ ID NO: 82654 - DNA, 23 bp, Artificial sequence
  SiRNA target sequence
aaaagtgtccatgttgctctccc

SEQ ID NO: 82655 - DNA, 23 bp, Artificial sequence
  SiRNA target sequence
aaagtgtccatgttgctctcccc

SEQ ID NO: 82656 - DNA, 23 bp, Artificial sequence
  SiRNA target sequence
aagtgtccatgttgctctcccca

SEQ ID NO: 82657 - DNA, 23 bp, Artificial sequence
  SiRNA target sequence
agtgtccatgttgctctccccaa

SEQ ID NO: 82658 - DNA, 23 bp, Artificial sequence
  SiRNA target sequence
gtgtccatgttgctctccccaat

SEQ ID NO: 82659 - DNA, 23 bp, Artificial sequence
  SiRNA target sequence
tgtccatgttgctctccccaatc

SEQ ID NO: 82660 - DNA, 23 bp, Artificial sequence
  SiRNA target sequence
gtccatgttgctctccccaatct

SEQ ID NO: 82661 - DNA, 23 bp, Artificial sequence
  SiRNA target sequence
tccatgttgctctccccaatcta

SEQ ID NO: 82662 - DNA, 23 bp, Artificial sequence
  SiRNA target sequence
ccatgttgctctccccaatctat

SEQ ID NO: 82663 - DNA, 23 bp, Artificial sequence
  SiRNA target sequence
catgttgctctccccaatctatc

SEQ ID NO: 82664 - DNA, 23 bp, Artificial sequence
  SiRNA target sequence
atgttgctctccccaatctatct

SEQ ID NO: 82665 - DNA, 23 bp, Artificial sequence
  SiRNA target sequence
tgttgctctccccaatctatctt

SEQ ID NO: 82666 - DNA, 23 bp, Artificial sequence
  SiRNA target sequence
gttgctctccccaatctatcttt

SEQ ID NO: 82667 - DNA, 23 bp, Artificial sequence
  SiRNA target sequence
ttgctctccccaatctatcttta

SEQ ID NO: 82668 - DNA, 23 bp, Artificial sequence
  SiRNA target sequence
tgctctccccaatctatctttaa

SEQ ID NO: 82669 - DNA, 23 bp, Artificial sequence
  SiRNA target sequence
gctctccccaatctatctttaac

SEQ ID NO: 82670 - DNA, 23 bp, Artificial sequence
  SiRNA target sequence
ctctccccaatctatctttaact

SEQ ID NO: 82671 - DNA, 23 bp, Artificial sequence
  SiRNA target sequence
tctccccaatctatctttaactt

SEQ ID NO: 82672 - DNA, 23 bp, Artificial sequence
  SiRNA target sequence
ctccccaatctatctttaacttc

SEQ ID NO: 82673 - DNA, 23 bp, Artificial sequence
  SiRNA target sequence
tccccaatctatctttaacttcc

SEQ ID NO: 82674 - DNA, 23 bp, Artificial sequence
  SiRNA target sequence
ccccaatctatctttaacttcct

SEQ ID NO: 82675 - DNA, 23 bp, Artificial sequence
  SiRNA target sequence
cccaatctatctttaacttcctt

SEQ ID NO: 82676 - DNA, 23 bp, Artificial sequence
  SiRNA target sequence
ccaatctatctttaacttcctta

SEQ ID NO: 82677 - DNA, 23 bp, Artificial sequence
  SiRNA target sequence
caatctatctttaacttccttat

SEQ ID NO: 82678 - DNA, 23 bp, Artificial sequence
  SiRNA target sequence
aatctatctttaacttccttatt

SEQ ID NO: 82679 - DNA, 23 bp, Artificial sequence
  SiRNA target sequence
atctatctttaacttccttattt

SEQ ID NO: 82680 - DNA, 23 bp, Artificial sequence
  SiRNA target sequence
tctatctttaacttccttatttg

SEQ ID NO: 82681 - DNA, 23 bp, Artificial sequence
  SiRNA target sequence
ctatctttaacttccttatttgt

SEQ ID NO: 82682 - DNA, 23 bp, Artificial sequence
  SiRNA target sequence
tatctttaacttccttatttgtt

SEQ ID NO: 82683 - DNA, 23 bp, Artificial sequence
  SiRNA target sequence
atctttaacttccttatttgtta

SEQ ID NO: 82684 - DNA, 23 bp, Artificial sequence
  SiRNA target sequence
tctttaacttccttatttgttaa

SEQ ID NO: 82685 - DNA, 23 bp, Artificial sequence
  SiRNA target sequence
ctttaacttccttatttgttaat

SEQ ID NO: 82686 - DNA, 23 bp, Artificial sequence
  SiRNA target sequence
tttaacttccttatttgttaatt

SEQ ID NO: 82687 - DNA, 23 bp, Artificial sequence
  SiRNA target sequence
ttaacttccttatttgttaattt

SEQ ID NO: 82688 - DNA, 23 bp, Artificial sequence
  SiRNA target sequence
taacttccttatttgttaatttt

SEQ ID NO: 82689 - DNA, 23 bp, Artificial sequence
  SiRNA target sequence
aacttccttatttgttaattttt

SEQ ID NO: 82690 - DNA, 23 bp, Artificial sequence
  SiRNA target sequence
acttccttatttgttaatttttg

SEQ ID NO: 82691 - DNA, 23 bp, Artificial sequence
  SiRNA target sequence
cttccttatttgttaatttttga

SEQ ID NO: 82692 - DNA, 23 bp, Artificial sequence
  SiRNA target sequence
ttccttatttgttaatttttgat

SEQ ID NO: 82693 - DNA, 23 bp, Artificial sequence
  SiRNA target sequence
tccttatttgttaatttttgatt

SEQ ID NO: 82694 - DNA, 23 bp, Artificial sequence
  SiRNA target sequence
ccttatttgttaatttttgatta

SEQ ID NO: 82695 - DNA, 23 bp, Artificial sequence
  SiRNA target sequence
cttatttgttaatttttgattat

SEQ ID NO: 82696 - DNA, 23 bp, Artificial sequence
  SiRNA target sequence
ttatttgttaatttttgattatg

SEQ ID NO: 82697 - DNA, 23 bp, Artificial sequence
  SiRNA target sequence
tatttgttaatttttgattatga

SEQ ID NO: 82698 - DNA, 23 bp, Artificial sequence
  SiRNA target sequence
atttgttaatttttgattatgaa

SEQ ID NO: 82699 - DNA, 23 bp, Artificial sequence
  SiRNA target sequence
tttgttaatttttgattatgaat

SEQ ID NO: 82700 - DNA, 23 bp, Artificial sequence
  SiRNA target sequence
ttgttaatttttgattatgaatt

SEQ ID NO: 82701 - DNA, 23 bp, Artificial sequence
  SiRNA target sequence
tgttaatttttgattatgaatta

SEQ ID NO: 82702 - DNA, 23 bp, Artificial sequence
  SiRNA target sequence
gttaatttttgattatgaattag

SEQ ID NO: 82703 - DNA, 23 bp, Artificial sequence
  SiRNA target sequence
ttaatttttgattatgaattaga

SEQ ID NO: 82704 - DNA, 23 bp, Artificial sequence
  SiRNA target sequence
taatttttgattatgaattagac

SEQ ID NO: 82705 - DNA, 23 bp, Artificial sequence
  SiRNA target sequence
aatttttgattatgaattagacc

SEQ ID NO: 82706 - DNA, 23 bp, Artificial sequence
  SiRNA target sequence
atttttgattatgaattagacct

SEQ ID NO: 82707 - DNA, 23 bp, Artificial sequence
  SiRNA target sequence
tttttgattatgaattagaccta

SEQ ID NO: 82708 - DNA, 23 bp, Artificial sequence
  SiRNA target sequence
ttttgattatgaattagacctaa

SEQ ID NO: 82709 - DNA, 23 bp, Artificial sequence
  SiRNA target sequence
tttgattatgaattagacctaat

SEQ ID NO: 82710 - DNA, 23 bp, Artificial sequence
  SiRNA target sequence
ttgattatgaattagacctaatt

SEQ ID NO: 82711 - DNA, 23 bp, Artificial sequence
  SiRNA target sequence
tgattatgaattagacctaattc

SEQ ID NO: 82712 - DNA, 23 bp, Artificial sequence
  SiRNA target sequence
gattatgaattagacctaattca

SEQ ID NO: 82713 - DNA, 23 bp, Artificial sequence
  SiRNA target sequence
attatgaattagacctaattcac

SEQ ID NO: 82714 - DNA, 23 bp, Artificial sequence
  SiRNA target sequence
ttatgaattagacctaattcacc

SEQ ID NO: 82715 - DNA, 23 bp, Artificial sequence
  SiRNA target sequence
tatgaattagacctaattcacct

SEQ ID NO: 82716 - DNA, 23 bp, Artificial sequence
  SiRNA target sequence
atgaattagacctaattcaccta

SEQ ID NO: 82717 - DNA, 23 bp, Artificial sequence
  SiRNA target sequence
tgaattagacctaattcacctac

SEQ ID NO: 82718 - DNA, 23 bp, Artificial sequence
  SiRNA target sequence
gaattagacctaattcacctact

SEQ ID NO: 82719 - DNA, 23 bp, Artificial sequence
  SiRNA target sequence
aattagacctaattcacctactt

SEQ ID NO: 82720 - DNA, 23 bp, Artificial sequence
  SiRNA target sequence
attagacctaattcacctacttt

SEQ ID NO: 82721 - DNA, 23 bp, Artificial sequence
  SiRNA target sequence
ttagacctaattcacctactttt

SEQ ID NO: 82722 - DNA, 23 bp, Artificial sequence
  SiRNA target sequence
tagacctaattcacctacttttg

SEQ ID NO: 82723 - DNA, 23 bp, Artificial sequence
  SiRNA target sequence
agacctaattcacctacttttgg

SEQ ID NO: 82724 - DNA, 23 bp, Artificial sequence
  SiRNA target sequence
gacctaattcacctacttttggt

SEQ ID NO: 82725 - DNA, 23 bp, Artificial sequence
  SiRNA target sequence
acctaattcacctacttttggtg

SEQ ID NO: 82726 - DNA, 23 bp, Artificial sequence
  SiRNA target sequence
cctaattcacctacttttggtga

SEQ ID NO: 82727 - DNA, 23 bp, Artificial sequence
  SiRNA target sequence
ctaattcacctacttttggtgaa

SEQ ID NO: 82728 - DNA, 23 bp, Artificial sequence
  SiRNA target sequence
taattcacctacttttggtgaaa

SEQ ID NO: 82729 - DNA, 23 bp, Artificial sequence
  SiRNA target sequence
aattcacctacttttggtgaaat

SEQ ID NO: 82730 - DNA, 23 bp, Artificial sequence
  SiRNA target sequence
attcacctacttttggtgaaata

SEQ ID NO: 82731 - DNA, 23 bp, Artificial sequence
  SiRNA target sequence
ttcacctacttttggtgaaatag

SEQ ID NO: 82732 - DNA, 23 bp, Artificial sequence
  SiRNA target sequence
tcacctacttttggtgaaataga

SEQ ID NO: 82733 - DNA, 23 bp, Artificial sequence
  SiRNA target sequence
cacctacttttggtgaaatagat

SEQ ID NO: 82734 - DNA, 23 bp, Artificial sequence
  SiRNA target sequence
acctacttttggtgaaatagatt

SEQ ID NO: 82735 - DNA, 23 bp, Artificial sequence
  SiRNA target sequence
cctacttttggtgaaatagattg

SEQ ID NO: 82736 - DNA, 23 bp, Artificial sequence
  SiRNA target sequence
ctacttttggtgaaatagattgt

SEQ ID NO: 82737 - DNA, 23 bp, Artificial sequence
  SiRNA target sequence
tacttttggtgaaatagattgta

SEQ ID NO: 82738 - DNA, 23 bp, Artificial sequence
  SiRNA target sequence
acttttggtgaaatagattgtaa

SEQ ID NO: 82739 - DNA, 23 bp, Artificial sequence
  SiRNA target sequence
cttttggtgaaatagattgtaaa

SEQ ID NO: 82740 - DNA, 23 bp, Artificial sequence
  SiRNA target sequence
ttttggtgaaatagattgtaaaa

SEQ ID NO: 82741 - DNA, 23 bp, Artificial sequence
  SiRNA target sequence
tttggtgaaatagattgtaaaac

SEQ ID NO: 82742 - DNA, 23 bp, Artificial sequence
  SiRNA target sequence
ttggtgaaatagattgtaaaaca

SEQ ID NO: 82743 - DNA, 23 bp, Artificial sequence
  SiRNA target sequence
tggtgaaatagattgtaaaacag

SEQ ID NO: 82744 - DNA, 23 bp, Artificial sequence
  SiRNA target sequence
ggtgaaatagattgtaaaacaga

SEQ ID NO: 82745 - DNA, 23 bp, Artificial sequence
  SiRNA target sequence
gtgaaatagattgtaaaacagat

SEQ ID NO: 82746 - DNA, 23 bp, Artificial sequence
  SiRNA target sequence
tgaaatagattgtaaaacagatt

SEQ ID NO: 82747 - DNA, 23 bp, Artificial sequence
  SiRNA target sequence
gaaatagattgtaaaacagattt

SEQ ID NO: 82748 - DNA, 23 bp, Artificial sequence
  SiRNA target sequence
aaatagattgtaaaacagatttt

SEQ ID NO: 82749 - DNA, 23 bp, Artificial sequence
  SiRNA target sequence
aatagattgtaaaacagattttc

SEQ ID NO: 82750 - DNA, 23 bp, Artificial sequence
  SiRNA target sequence
atagattgtaaaacagattttcc

SEQ ID NO: 82751 - DNA, 23 bp, Artificial sequence
  SiRNA target sequence
tagattgtaaaacagattttcca

SEQ ID NO: 82752 - DNA, 23 bp, Artificial sequence
  SiRNA target sequence
agattgtaaaacagattttccaa

SEQ ID NO: 82753 - DNA, 23 bp, Artificial sequence
  SiRNA target sequence
gattgtaaaacagattttccaag

SEQ ID NO: 82754 - DNA, 23 bp, Artificial sequence
  SiRNA target sequence
attgtaaaacagattttccaagt

SEQ ID NO: 82755 - DNA, 23 bp, Artificial sequence
  SiRNA target sequence
ttgtaaaacagattttccaagtg

SEQ ID NO: 82756 - DNA, 23 bp, Artificial sequence
  SiRNA target sequence
tgtaaaacagattttccaagtga

SEQ ID NO: 82757 - DNA, 23 bp, Artificial sequence
  SiRNA target sequence
gtaaaacagattttccaagtgag

SEQ ID NO: 82758 - DNA, 23 bp, Artificial sequence
  SiRNA target sequence
taaaacagattttccaagtgagt

SEQ ID NO: 82759 - DNA, 23 bp, Artificial sequence
  SiRNA target sequence
aaaacagattttccaagtgagtt

SEQ ID NO: 82760 - DNA, 23 bp, Artificial sequence
  SiRNA target sequence
aaacagattttccaagtgagttg

SEQ ID NO: 82761 - DNA, 23 bp, Artificial sequence
  SiRNA target sequence
aacagattttccaagtgagttgt

SEQ ID NO: 82762 - DNA, 23 bp, Artificial sequence
  SiRNA target sequence
acagattttccaagtgagttgtc

SEQ ID NO: 82763 - DNA, 23 bp, Artificial sequence
  SiRNA target sequence
cagattttccaagtgagttgtct

SEQ ID NO: 82764 - DNA, 23 bp, Artificial sequence
  SiRNA target sequence
agattttccaagtgagttgtctg

SEQ ID NO: 82765 - DNA, 23 bp, Artificial sequence
  SiRNA target sequence
gattttccaagtgagttgtctgc

SEQ ID NO: 82766 - DNA, 23 bp, Artificial sequence
  SiRNA target sequence
attttccaagtgagttgtctgca

SEQ ID NO: 82767 - DNA, 23 bp, Artificial sequence
  SiRNA target sequence
ttttccaagtgagttgtctgcat

SEQ ID NO: 82768 - DNA, 23 bp, Artificial sequence
  SiRNA target sequence
tttccaagtgagttgtctgcatg

SEQ ID NO: 82769 - DNA, 23 bp, Artificial sequence
  SiRNA target sequence
ttccaagtgagttgtctgcatgt

SEQ ID NO: 82770 - DNA, 23 bp, Artificial sequence
  SiRNA target sequence
tccaagtgagttgtctgcatgtg

SEQ ID NO: 82771 - DNA, 23 bp, Artificial sequence
  SiRNA target sequence
ccaagtgagttgtctgcatgtgt

SEQ ID NO: 82772 - DNA, 23 bp, Artificial sequence
  SiRNA target sequence
caagtgagttgtctgcatgtgta

SEQ ID NO: 82773 - DNA, 23 bp, Artificial sequence
  SiRNA target sequence
aagtgagttgtctgcatgtgtat

SEQ ID NO: 82774 - DNA, 23 bp, Artificial sequence
  SiRNA target sequence
agtgagttgtctgcatgtgtatg

SEQ ID NO: 82775 - DNA, 23 bp, Artificial sequence
  SiRNA target sequence
gtgagttgtctgcatgtgtatgc

SEQ ID NO: 82776 - DNA, 23 bp, Artificial sequence
  SiRNA target sequence
tgagttgtctgcatgtgtatgcg

SEQ ID NO: 82777 - DNA, 23 bp, Artificial sequence
  SiRNA target sequence
gagttgtctgcatgtgtatgcgg

SEQ ID NO: 82778 - DNA, 23 bp, Artificial sequence
  SiRNA target sequence
agttgtctgcatgtgtatgcggg

SEQ ID NO: 82779 - DNA, 23 bp, Artificial sequence
  SiRNA target sequence
gttgtctgcatgtgtatgcggga

SEQ ID NO: 82780 - DNA, 23 bp, Artificial sequence
  SiRNA target sequence
ttgtctgcatgtgtatgcgggaa

SEQ ID NO: 82781 - DNA, 23 bp, Artificial sequence
  SiRNA target sequence
tgtctgcatgtgtatgcgggaaa

SEQ ID NO: 82782 - DNA, 23 bp, Artificial sequence
  SiRNA target sequence
gtctgcatgtgtatgcgggaaaa

SEQ ID NO: 82783 - DNA, 23 bp, Artificial sequence
  SiRNA target sequence
tctgcatgtgtatgcgggaaaaa

SEQ ID NO: 82784 - DNA, 23 bp, Artificial sequence
  SiRNA target sequence
ctgcatgtgtatgcgggaaaaaa

SEQ ID NO: 82785 - DNA, 23 bp, Artificial sequence
  SiRNA target sequence
tgcatgtgtatgcgggaaaaaat

SEQ ID NO: 82786 - DNA, 23 bp, Artificial sequence
  SiRNA target sequence
gcatgtgtatgcgggaaaaaatg

SEQ ID NO: 82787 - DNA, 23 bp, Artificial sequence
  SiRNA target sequence
catgtgtatgcgggaaaaaatgc

SEQ ID NO: 82788 - DNA, 23 bp, Artificial sequence
  SiRNA target sequence
atgtgtatgcgggaaaaaatgct

SEQ ID NO: 82789 - DNA, 23 bp, Artificial sequence
  SiRNA target sequence
tgtgtatgcgggaaaaaatgctg

SEQ ID NO: 82790 - DNA, 23 bp, Artificial sequence
  SiRNA target sequence
gtgtatgcgggaaaaaatgctgt

SEQ ID NO: 82791 - DNA, 23 bp, Artificial sequence
  SiRNA target sequence
tgtatgcgggaaaaaatgctgtt

SEQ ID NO: 82792 - DNA, 23 bp, Artificial sequence
  SiRNA target sequence
gtatgcgggaaaaaatgctgttt

SEQ ID NO: 82793 - DNA, 23 bp, Artificial sequence
  SiRNA target sequence
tatgcgggaaaaaatgctgtttt

SEQ ID NO: 82794 - DNA, 23 bp, Artificial sequence
  SiRNA target sequence
atgcgggaaaaaatgctgttttg

SEQ ID NO: 82795 - DNA, 23 bp, Artificial sequence
  SiRNA target sequence
tgcgggaaaaaatgctgttttgc

SEQ ID NO: 82796 - DNA, 23 bp, Artificial sequence
  SiRNA target sequence
gcgggaaaaaatgctgttttgct

SEQ ID NO: 82797 - DNA, 23 bp, Artificial sequence
  SiRNA target sequence
cgggaaaaaatgctgttttgcta

SEQ ID NO: 82798 - DNA, 23 bp, Artificial sequence
  SiRNA target sequence
gggaaaaaatgctgttttgctaa

SEQ ID NO: 82799 - DNA, 23 bp, Artificial sequence
  SiRNA target sequence
ggaaaaaatgctgttttgctaaa

SEQ ID NO: 82800 - DNA, 23 bp, Artificial sequence
  SiRNA target sequence
gaaaaaatgctgttttgctaaat

SEQ ID NO: 82801 - DNA, 23 bp, Artificial sequence
  SiRNA target sequence
aaaaaatgctgttttgctaaata

SEQ ID NO: 82802 - DNA, 23 bp, Artificial sequence
  SiRNA target sequence
aaaaatgctgttttgctaaataa

SEQ ID NO: 82803 - DNA, 23 bp, Artificial sequence
  SiRNA target sequence
aaaatgctgttttgctaaataaa

SEQ ID NO: 82804 - DNA, 23 bp, Artificial sequence
  SiRNA target sequence
aaatgctgttttgctaaataaac

SEQ ID NO: 82805 - DNA, 23 bp, Artificial sequence
  SiRNA target sequence
aatgctgttttgctaaataaaca

SEQ ID NO: 82806 - DNA, 23 bp, Artificial sequence
  SiRNA target sequence
atgctgttttgctaaataaacaa

SEQ ID NO: 82807 - DNA, 23 bp, Artificial sequence
  SiRNA target sequence
tgctgttttgctaaataaacaat

SEQ ID NO: 82808 - DNA, 23 bp, Artificial sequence
  SiRNA target sequence
gctgttttgctaaataaacaatc

SEQ ID NO: 82809 - DNA, 23 bp, Artificial sequence
  SiRNA target sequence
ctgttttgctaaataaacaatcc

SEQ ID NO: 82810 - DNA, 23 bp, Artificial sequence
  SiRNA target sequence
tgttttgctaaataaacaatcca

SEQ ID NO: 82811 - DNA, 23 bp, Artificial sequence
  SiRNA target sequence
gttttgctaaataaacaatccat

SEQ ID NO: 82812 - DNA, 23 bp, Artificial sequence
  SiRNA target sequence
ttttgctaaataaacaatccata

SEQ ID NO: 82813 - DNA, 23 bp, Artificial sequence
  SiRNA target sequence
tttgctaaataaacaatccatac

SEQ ID NO: 82814 - DNA, 23 bp, Artificial sequence
  SiRNA target sequence
ttgctaaataaacaatccataca

SEQ ID NO: 82815 - DNA, 23 bp, Artificial sequence
  SiRNA target sequence
tgctaaataaacaatccatacac

SEQ ID NO: 82816 - DNA, 23 bp, Artificial sequence
  SiRNA target sequence
gctaaataaacaatccatacacc

SEQ ID NO: 82817 - DNA, 23 bp, Artificial sequence
  SiRNA target sequence
ctaaataaacaatccatacaccc

SEQ ID NO: 82818 - DNA, 23 bp, Artificial sequence
  SiRNA target sequence
taaataaacaatccatacaccca

SEQ ID NO: 82819 - DNA, 23 bp, Artificial sequence
  SiRNA target sequence
aaataaacaatccatacacccaa

SEQ ID NO: 82820 - DNA, 23 bp, Artificial sequence
  SiRNA target sequence
aataaacaatccatacacccaat

SEQ ID NO: 82821 - DNA, 23 bp, Artificial sequence
  SiRNA target sequence
ataaacaatccatacacccaata

SEQ ID NO: 82822 - DNA, 23 bp, Artificial sequence
  SiRNA target sequence
taaacaatccatacacccaataa

SEQ ID NO: 82823 - DNA, 23 bp, Artificial sequence
  SiRNA target sequence
aaacaatccatacacccaataag

SEQ ID NO: 82824 - DNA, 23 bp, Artificial sequence
  SiRNA target sequence
aacaatccatacacccaataaga

SEQ ID NO: 82825 - DNA, 23 bp, Artificial sequence
  SiRNA target sequence
acaatccatacacccaataagat

SEQ ID NO: 82826 - DNA, 23 bp, Artificial sequence
  SiRNA target sequence
caatccatacacccaataagata

SEQ ID NO: 82827 - DNA, 23 bp, Artificial sequence
  SiRNA target sequence
aatccatacacccaataagataa

SEQ ID NO: 82828 - DNA, 23 bp, Artificial sequence
  SiRNA target sequence
atccatacacccaataagataat

SEQ ID NO: 82829 - DNA, 23 bp, Artificial sequence
  SiRNA target sequence
tccatacacccaataagataata

SEQ ID NO: 82830 - DNA, 23 bp, Artificial sequence
  SiRNA target sequence
ccatacacccaataagataataa

SEQ ID NO: 82831 - DNA, 23 bp, Artificial sequence
  SiRNA target sequence
catacacccaataagataataag

SEQ ID NO: 82832 - DNA, 23 bp, Artificial sequence
  SiRNA target sequence
atacacccaataagataataagt

SEQ ID NO: 82833 - DNA, 23 bp, Artificial sequence
  SiRNA target sequence
tacacccaataagataataagtc

SEQ ID NO: 82834 - DNA, 23 bp, Artificial sequence
  SiRNA target sequence
acacccaataagataataagtcc

SEQ ID NO: 82835 - DNA, 23 bp, Artificial sequence
  SiRNA target sequence
cacccaataagataataagtcct

SEQ ID NO: 82836 - DNA, 23 bp, Artificial sequence
  SiRNA target sequence
acccaataagataataagtcctc

SEQ ID NO: 82837 - DNA, 23 bp, Artificial sequence
  SiRNA target sequence
cccaataagataataagtcctct

SEQ ID NO: 82838 - DNA, 23 bp, Artificial sequence
  SiRNA target sequence
ccaataagataataagtcctctt

SEQ ID NO: 82839 - DNA, 23 bp, Artificial sequence
  SiRNA target sequence
caataagataataagtcctctta

SEQ ID NO: 82840 - DNA, 23 bp, Artificial sequence
  SiRNA target sequence
aataagataataagtcctcttaa

SEQ ID NO: 82841 - DNA, 23 bp, Artificial sequence
  SiRNA target sequence
ataagataataagtcctcttaat

SEQ ID NO: 82842 - DNA, 23 bp, Artificial sequence
  SiRNA target sequence
taagataataagtcctcttaata

SEQ ID NO: 82843 - DNA, 23 bp, Artificial sequence
  SiRNA target sequence
aagataataagtcctcttaatac

SEQ ID NO: 82844 - DNA, 23 bp, Artificial sequence
  SiRNA target sequence
agataataagtcctcttaatact

SEQ ID NO: 82845 - DNA, 23 bp, Artificial sequence
  SiRNA target sequence
gataataagtcctcttaatactt

SEQ ID NO: 82846 - DNA, 23 bp, Artificial sequence
  SiRNA target sequence
ataataagtcctcttaatacttt

SEQ ID NO: 82847 - DNA, 23 bp, Artificial sequence
  SiRNA target sequence
taataagtcctcttaatactttc

SEQ ID NO: 82848 - DNA, 23 bp, Artificial sequence
  SiRNA target sequence
aataagtcctcttaatactttct

SEQ ID NO: 82849 - DNA, 23 bp, Artificial sequence
  SiRNA target sequence
ataagtcctcttaatactttctg

SEQ ID NO: 82850 - DNA, 23 bp, Artificial sequence
  SiRNA target sequence
taagtcctcttaatactttctgc

SEQ ID NO: 82851 - DNA, 23 bp, Artificial sequence
  SiRNA target sequence
aagtcctcttaatactttctgct

SEQ ID NO: 82852 - DNA, 23 bp, Artificial sequence
  SiRNA target sequence
agtcctcttaatactttctgctc

SEQ ID NO: 82853 - DNA, 23 bp, Artificial sequence
  SiRNA target sequence
gtcctcttaatactttctgctct

SEQ ID NO: 82854 - DNA, 23 bp, Artificial sequence
  SiRNA target sequence
tcctcttaatactttctgctctt

SEQ ID NO: 82855 - DNA, 23 bp, Artificial sequence
  SiRNA target sequence
cctcttaatactttctgctcttt

SEQ ID NO: 82856 - DNA, 23 bp, Artificial sequence
  SiRNA target sequence
ctcttaatactttctgctctttg

SEQ ID NO: 82857 - DNA, 23 bp, Artificial sequence
  SiRNA target sequence
tcttaatactttctgctctttgt

SEQ ID NO: 82858 - DNA, 23 bp, Artificial sequence
  SiRNA target sequence
cttaatactttctgctctttgtt

SEQ ID NO: 82859 - DNA, 23 bp, Artificial sequence
  SiRNA target sequence
ttaatactttctgctctttgttc

SEQ ID NO: 82860 - DNA, 23 bp, Artificial sequence
  SiRNA target sequence
taatactttctgctctttgttca

SEQ ID NO: 82861 - DNA, 23 bp, Artificial sequence
  SiRNA target sequence
aatactttctgctctttgttcat

SEQ ID NO: 82862 - DNA, 24 bp, Artificial sequence
  SiRNA target sequence
ttattctggttcacaaccacaact

SEQ ID NO: 82863 - DNA, 24 bp, Artificial sequence
  SiRNA target sequence
tattctggttcacaaccacaactc

SEQ ID NO: 82864 - DNA, 24 bp, Artificial sequence
  SiRNA target sequence
attctggttcacaaccacaactcc

SEQ ID NO: 82865 - DNA, 24 bp, Artificial sequence
  SiRNA target sequence
ttctggttcacaaccacaactcca

SEQ ID NO: 82866 - DNA, 24 bp, Artificial sequence
  SiRNA target sequence
tctggttcacaaccacaactccaa

SEQ ID NO: 82867 - DNA, 24 bp, Artificial sequence
  SiRNA target sequence
ctggttcacaaccacaactccaaa

SEQ ID NO: 82868 - DNA, 24 bp, Artificial sequence
  SiRNA target sequence
tggttcacaaccacaactccaaac

SEQ ID NO: 82869 - DNA, 24 bp, Artificial sequence
  SiRNA target sequence
ggttcacaaccacaactccaaaca

SEQ ID NO: 82870 - DNA, 24 bp, Artificial sequence
  SiRNA target sequence
gttcacaaccacaactccaaacac

SEQ ID NO: 82871 - DNA, 24 bp, Artificial sequence
  SiRNA target sequence
ttcacaaccacaactccaaacacc

SEQ ID NO: 82872 - DNA, 24 bp, Artificial sequence
  SiRNA target sequence
tcacaaccacaactccaaacacct

SEQ ID NO: 82873 - DNA, 24 bp, Artificial sequence
  SiRNA target sequence
cacaaccacaactccaaacacctt

SEQ ID NO: 82874 - DNA, 24 bp, Artificial sequence
  SiRNA target sequence
acaaccacaactccaaacaccttc

SEQ ID NO: 82875 - DNA, 24 bp, Artificial sequence
  SiRNA target sequence
caaccacaactccaaacaccttct

SEQ ID NO: 82876 - DNA, 24 bp, Artificial sequence
  SiRNA target sequence
aaccacaactccaaacaccttcta

SEQ ID NO: 82877 - DNA, 24 bp, Artificial sequence
  SiRNA target sequence
accacaactccaaacaccttctac

SEQ ID NO: 82878 - DNA, 24 bp, Artificial sequence
  SiRNA target sequence
ccacaactccaaacaccttctacc

SEQ ID NO: 82879 - DNA, 24 bp, Artificial sequence
  SiRNA target sequence
cacaactccaaacaccttctacct

SEQ ID NO: 82880 - DNA, 24 bp, Artificial sequence
  SiRNA target sequence
acaactccaaacaccttctacctt

SEQ ID NO: 82881 - DNA, 24 bp, Artificial sequence
  SiRNA target sequence
caactccaaacaccttctaccttt

SEQ ID NO: 82882 - DNA, 24 bp, Artificial sequence
  SiRNA target sequence
aactccaaacaccttctacctttt

SEQ ID NO: 82883 - DNA, 24 bp, Artificial sequence
  SiRNA target sequence
actccaaacaccttctaccttttt

SEQ ID NO: 82884 - DNA, 24 bp, Artificial sequence
  SiRNA target sequence
ctccaaacaccttctaccttttta

SEQ ID NO: 82885 - DNA, 24 bp, Artificial sequence
  SiRNA target sequence
tccaaacaccttctacctttttac

SEQ ID NO: 82886 - DNA, 24 bp, Artificial sequence
  SiRNA target sequence
ccaaacaccttctacctttttaca

SEQ ID NO: 82887 - DNA, 24 bp, Artificial sequence
  SiRNA target sequence
caaacaccttctacctttttacag

SEQ ID NO: 82888 - DNA, 24 bp, Artificial sequence
  SiRNA target sequence
aaacaccttctacctttttacagt

SEQ ID NO: 82889 - DNA, 24 bp, Artificial sequence
  SiRNA target sequence
aacaccttctacctttttacagtc

SEQ ID NO: 82890 - DNA, 24 bp, Artificial sequence
  SiRNA target sequence
acaccttctacctttttacagtcc

SEQ ID NO: 82891 - DNA, 24 bp, Artificial sequence
  SiRNA target sequence
caccttctacctttttacagtcca

SEQ ID NO: 82892 - DNA, 24 bp, Artificial sequence
  SiRNA target sequence
accttctacctttttacagtccat

SEQ ID NO: 82893 - DNA, 24 bp, Artificial sequence
  SiRNA target sequence
ccttctacctttttacagtccata

SEQ ID NO: 82894 - DNA, 24 bp, Artificial sequence
  SiRNA target sequence
cttctacctttttacagtccataa

SEQ ID NO: 82895 - DNA, 24 bp, Artificial sequence
  SiRNA target sequence
ttctacctttttacagtccataat

SEQ ID NO: 82896 - DNA, 24 bp, Artificial sequence
  SiRNA target sequence
tctacctttttacagtccataatg

SEQ ID NO: 82897 - DNA, 24 bp, Artificial sequence
  SiRNA target sequence
ctacctttttacagtccataatgg

SEQ ID NO: 82898 - DNA, 24 bp, Artificial sequence
  SiRNA target sequence
tacctttttacagtccataatggg

SEQ ID NO: 82899 - DNA, 24 bp, Artificial sequence
  SiRNA target sequence
acctttttacagtccataatgggc

SEQ ID NO: 82900 - DNA, 24 bp, Artificial sequence
  SiRNA target sequence
cctttttacagtccataatgggct

SEQ ID NO: 82901 - DNA, 24 bp, Artificial sequence
  SiRNA target sequence
ctttttacagtccataatgggctt

SEQ ID NO: 82902 - DNA, 24 bp, Artificial sequence
  SiRNA target sequence
tttttacagtccataatgggcttt

SEQ ID NO: 82903 - DNA, 24 bp, Artificial sequence
  SiRNA target sequence
ttttacagtccataatgggctttc

SEQ ID NO: 82904 - DNA, 24 bp, Artificial sequence
  SiRNA target sequence
tttacagtccataatgggctttcc

SEQ ID NO: 82905 - DNA, 24 bp, Artificial sequence
  SiRNA target sequence
ttacagtccataatgggctttcct

SEQ ID NO: 82906 - DNA, 24 bp, Artificial sequence
  SiRNA target sequence
tacagtccataatgggctttccta

SEQ ID NO: 82907 - DNA, 24 bp, Artificial sequence
  SiRNA target sequence
acagtccataatgggctttcctaa

SEQ ID NO: 82908 - DNA, 24 bp, Artificial sequence
  SiRNA target sequence
cagtccataatgggctttcctaat

SEQ ID NO: 82909 - DNA, 24 bp, Artificial sequence
  SiRNA target sequence
agtccataatgggctttcctaatc

SEQ ID NO: 82910 - DNA, 24 bp, Artificial sequence
  SiRNA target sequence
gtccataatgggctttcctaatct

SEQ ID NO: 82911 - DNA, 24 bp, Artificial sequence
  SiRNA target sequence
tccataatgggctttcctaatctt

SEQ ID NO: 82912 - DNA, 24 bp, Artificial sequence
  SiRNA target sequence
ccataatgggctttcctaatcttt

SEQ ID NO: 82913 - DNA, 24 bp, Artificial sequence
  SiRNA target sequence
cataatgggctttcctaatctttt

SEQ ID NO: 82914 - DNA, 24 bp, Artificial sequence
  SiRNA target sequence
ataatgggctttcctaatctttta

SEQ ID NO: 82915 - DNA, 24 bp, Artificial sequence
  SiRNA target sequence
taatgggctttcctaatcttttat

SEQ ID NO: 82916 - DNA, 24 bp, Artificial sequence
  SiRNA target sequence
aatgggctttcctaatcttttatt

SEQ ID NO: 82917 - DNA, 24 bp, Artificial sequence
  SiRNA target sequence
atgggctttcctaatcttttatta

SEQ ID NO: 82918 - DNA, 24 bp, Artificial sequence
  SiRNA target sequence
tgggctttcctaatcttttattaa

SEQ ID NO: 82919 - DNA, 24 bp, Artificial sequence
  SiRNA target sequence
gggctttcctaatcttttattaac

SEQ ID NO: 82920 - DNA, 24 bp, Artificial sequence
  SiRNA target sequence
ggctttcctaatcttttattaact

SEQ ID NO: 82921 - DNA, 24 bp, Artificial sequence
  SiRNA target sequence
gctttcctaatcttttattaacta

SEQ ID NO: 82922 - DNA, 24 bp, Artificial sequence
  SiRNA target sequence
ctttcctaatcttttattaactat

SEQ ID NO: 82923 - DNA, 24 bp, Artificial sequence
  SiRNA target sequence
tttcctaatcttttattaactatg

SEQ ID NO: 82924 - DNA, 24 bp, Artificial sequence
  SiRNA target sequence
ttcctaatcttttattaactatgt

SEQ ID NO: 82925 - DNA, 24 bp, Artificial sequence
  SiRNA target sequence
tcctaatcttttattaactatgtt

SEQ ID NO: 82926 - DNA, 24 bp, Artificial sequence
  SiRNA target sequence
cctaatcttttattaactatgtta

SEQ ID NO: 82927 - DNA, 24 bp, Artificial sequence
  SiRNA target sequence
ctaatcttttattaactatgttat

SEQ ID NO: 82928 - DNA, 24 bp, Artificial sequence
  SiRNA target sequence
taatcttttattaactatgttatg

SEQ ID NO: 82929 - DNA, 24 bp, Artificial sequence
  SiRNA target sequence
aatcttttattaactatgttatgt

SEQ ID NO: 82930 - DNA, 24 bp, Artificial sequence
  SiRNA target sequence
atcttttattaactatgttatgtg

SEQ ID NO: 82931 - DNA, 24 bp, Artificial sequence
  SiRNA target sequence
tcttttattaactatgttatgtgc

SEQ ID NO: 82932 - DNA, 24 bp, Artificial sequence
  SiRNA target sequence
cttttattaactatgttatgtgct

SEQ ID NO: 82933 - DNA, 24 bp, Artificial sequence
  SiRNA target sequence
ttttattaactatgttatgtgctt

SEQ ID NO: 82934 - DNA, 24 bp, Artificial sequence
  SiRNA target sequence
tttattaactatgttatgtgcttt

SEQ ID NO: 82935 - DNA, 24 bp, Artificial sequence
  SiRNA target sequence
ttattaactatgttatgtgcttta

SEQ ID NO: 82936 - DNA, 24 bp, Artificial sequence
  SiRNA target sequence
tattaactatgttatgtgctttac

SEQ ID NO: 82937 - DNA, 24 bp, Artificial sequence
  SiRNA target sequence
attaactatgttatgtgctttaca

SEQ ID NO: 82938 - DNA, 24 bp, Artificial sequence
  SiRNA target sequence
ttaactatgttatgtgctttacat

SEQ ID NO: 82939 - DNA, 24 bp, Artificial sequence
  SiRNA target sequence
taactatgttatgtgctttacata

SEQ ID NO: 82940 - DNA, 24 bp, Artificial sequence
  SiRNA target sequence
aactatgttatgtgctttacatag

SEQ ID NO: 82941 - DNA, 24 bp, Artificial sequence
  SiRNA target sequence
actatgttatgtgctttacatagc

SEQ ID NO: 82942 - DNA, 24 bp, Artificial sequence
  SiRNA target sequence
ctatgttatgtgctttacatagcc

SEQ ID NO: 82943 - DNA, 24 bp, Artificial sequence
  SiRNA target sequence
tatgttatgtgctttacatagcca

SEQ ID NO: 82944 - DNA, 24 bp, Artificial sequence
  SiRNA target sequence
atgttatgtgctttacatagccac

SEQ ID NO: 82945 - DNA, 24 bp, Artificial sequence
  SiRNA target sequence
tgttatgtgctttacatagccact

SEQ ID NO: 82946 - DNA, 24 bp, Artificial sequence
  SiRNA target sequence
gttatgtgctttacatagccactg

SEQ ID NO: 82947 - DNA, 24 bp, Artificial sequence
  SiRNA target sequence
ttatgtgctttacatagccactgg

SEQ ID NO: 82948 - DNA, 24 bp, Artificial sequence
  SiRNA target sequence
tatgtgctttacatagccactgga

SEQ ID NO: 82949 - DNA, 24 bp, Artificial sequence
  SiRNA target sequence
atgtgctttacatagccactggac

SEQ ID NO: 82950 - DNA, 24 bp, Artificial sequence
  SiRNA target sequence
tgtgctttacatagccactggaca

SEQ ID NO: 82951 - DNA, 24 bp, Artificial sequence
  SiRNA target sequence
gtgctttacatagccactggacaa

SEQ ID NO: 82952 - DNA, 24 bp, Artificial sequence
  SiRNA target sequence
tgctttacatagccactggacaaa

SEQ ID NO: 82953 - DNA, 24 bp, Artificial sequence
  SiRNA target sequence
gctttacatagccactggacaaat

SEQ ID NO: 82954 - DNA, 24 bp, Artificial sequence
  SiRNA target sequence
ctttacatagccactggacaaatt

SEQ ID NO: 82955 - DNA, 24 bp, Artificial sequence
  SiRNA target sequence
tttacatagccactggacaaattc

SEQ ID NO: 82956 - DNA, 24 bp, Artificial sequence
  SiRNA target sequence
ttacatagccactggacaaattcg

SEQ ID NO: 82957 - DNA, 24 bp, Artificial sequence
  SiRNA target sequence
tacatagccactggacaaattcgt

SEQ ID NO: 82958 - DNA, 24 bp, Artificial sequence
  SiRNA target sequence
acatagccactggacaaattcgtc

SEQ ID NO: 82959 - DNA, 24 bp, Artificial sequence
  SiRNA target sequence
catagccactggacaaattcgtca

SEQ ID NO: 82960 - DNA, 24 bp, Artificial sequence
  SiRNA target sequence
atagccactggacaaattcgtcat

SEQ ID NO: 82961 - DNA, 24 bp, Artificial sequence
  SiRNA target sequence
tagccactggacaaattcgtcatg

SEQ ID NO: 82962 - DNA, 24 bp, Artificial sequence
  SiRNA target sequence
agccactggacaaattcgtcatgt

SEQ ID NO: 82963 - DNA, 24 bp, Artificial sequence
  SiRNA target sequence
gccactggacaaattcgtcatgtg

SEQ ID NO: 82964 - DNA, 24 bp, Artificial sequence
  SiRNA target sequence
ccactggacaaattcgtcatgtgt

SEQ ID NO: 82965 - DNA, 24 bp, Artificial sequence
  SiRNA target sequence
cactggacaaattcgtcatgtgtg

SEQ ID NO: 82966 - DNA, 24 bp, Artificial sequence
  SiRNA target sequence
actggacaaattcgtcatgtgtgg

SEQ ID NO: 82967 - DNA, 24 bp, Artificial sequence
  SiRNA target sequence
ctggacaaattcgtcatgtgtggc

SEQ ID NO: 82968 - DNA, 24 bp, Artificial sequence
  SiRNA target sequence
tggacaaattcgtcatgtgtggca

SEQ ID NO: 82969 - DNA, 24 bp, Artificial sequence
  SiRNA target sequence
ggacaaattcgtcatgtgtggcaa

SEQ ID NO: 82970 - DNA, 24 bp, Artificial sequence
  SiRNA target sequence
gacaaattcgtcatgtgtggcaac

SEQ ID NO: 82971 - DNA, 24 bp, Artificial sequence
  SiRNA target sequence
acaaattcgtcatgtgtggcaact

SEQ ID NO: 82972 - DNA, 24 bp, Artificial sequence
  SiRNA target sequence
caaattcgtcatgtgtggcaactt

SEQ ID NO: 82973 - DNA, 24 bp, Artificial sequence
  SiRNA target sequence
aaattcgtcatgtgtggcaacttg

SEQ ID NO: 82974 - DNA, 24 bp, Artificial sequence
  SiRNA target sequence
aattcgtcatgtgtggcaacttgt

SEQ ID NO: 82975 - DNA, 24 bp, Artificial sequence
  SiRNA target sequence
attcgtcatgtgtggcaacttgtg

SEQ ID NO: 82976 - DNA, 24 bp, Artificial sequence
  SiRNA target sequence
ttcgtcatgtgtggcaacttgtgg

SEQ ID NO: 82977 - DNA, 24 bp, Artificial sequence
  SiRNA target sequence
tcgtcatgtgtggcaacttgtgga

SEQ ID NO: 82978 - DNA, 24 bp, Artificial sequence
  SiRNA target sequence
cgtcatgtgtggcaacttgtggag

SEQ ID NO: 82979 - DNA, 24 bp, Artificial sequence
  SiRNA target sequence
gtcatgtgtggcaacttgtggagg

SEQ ID NO: 82980 - DNA, 24 bp, Artificial sequence
  SiRNA target sequence
tcatgtgtggcaacttgtggagga

SEQ ID NO: 82981 - DNA, 24 bp, Artificial sequence
  SiRNA target sequence
catgtgtggcaacttgtggaggat

SEQ ID NO: 82982 - DNA, 24 bp, Artificial sequence
  SiRNA target sequence
atgtgtggcaacttgtggaggatt

SEQ ID NO: 82983 - DNA, 24 bp, Artificial sequence
  SiRNA target sequence
tgtgtggcaacttgtggaggattt

SEQ ID NO: 82984 - DNA, 24 bp, Artificial sequence
  SiRNA target sequence
gtgtggcaacttgtggaggattta

SEQ ID NO: 82985 - DNA, 24 bp, Artificial sequence
  SiRNA target sequence
tgtggcaacttgtggaggatttaa

SEQ ID NO: 82986 - DNA, 24 bp, Artificial sequence
  SiRNA target sequence
gtggcaacttgtggaggatttaag

SEQ ID NO: 82987 - DNA, 24 bp, Artificial sequence
  SiRNA target sequence
tggcaacttgtggaggatttaagc

SEQ ID NO: 82988 - DNA, 24 bp, Artificial sequence
  SiRNA target sequence
ggcaacttgtggaggatttaagct

SEQ ID NO: 82989 - DNA, 24 bp, Artificial sequence
  SiRNA target sequence
gcaacttgtggaggatttaagctt

SEQ ID NO: 82990 - DNA, 24 bp, Artificial sequence
  SiRNA target sequence
caacttgtggaggatttaagctta

SEQ ID NO: 82991 - DNA, 24 bp, Artificial sequence
  SiRNA target sequence
aacttgtggaggatttaagcttaa

SEQ ID NO: 82992 - DNA, 24 bp, Artificial sequence
  SiRNA target sequence
acttgtggaggatttaagcttaac

SEQ ID NO: 82993 - DNA, 24 bp, Artificial sequence
  SiRNA target sequence
cttgtggaggatttaagcttaaca

SEQ ID NO: 82994 - DNA, 24 bp, Artificial sequence
  SiRNA target sequence
ttgtggaggatttaagcttaacag

SEQ ID NO: 82995 - DNA, 24 bp, Artificial sequence
  SiRNA target sequence
tgtggaggatttaagcttaacagt

SEQ ID NO: 82996 - DNA, 24 bp, Artificial sequence
  SiRNA target sequence
gtggaggatttaagcttaacagtc

SEQ ID NO: 82997 - DNA, 24 bp, Artificial sequence
  SiRNA target sequence
tggaggatttaagcttaacagtct

SEQ ID NO: 82998 - DNA, 24 bp, Artificial sequence
  SiRNA target sequence
ggaggatttaagcttaacagtctt

SEQ ID NO: 82999 - DNA, 24 bp, Artificial sequence
  SiRNA target sequence
gaggatttaagcttaacagtcttt

SEQ ID NO: 83000 - DNA, 24 bp, Artificial sequence
  SiRNA target sequence
aggatttaagcttaacagtctttg

SEQ ID NO: 83001 - DNA, 24 bp, Artificial sequence
  SiRNA target sequence
ggatttaagcttaacagtctttga

SEQ ID NO: 83002 - DNA, 24 bp, Artificial sequence
  SiRNA target sequence
gatttaagcttaacagtctttgaa

SEQ ID NO: 83003 - DNA, 24 bp, Artificial sequence
  SiRNA target sequence
atttaagcttaacagtctttgaaa

SEQ ID NO: 83004 - DNA, 24 bp, Artificial sequence
  SiRNA target sequence
tttaagcttaacagtctttgaaaa

SEQ ID NO: 83005 - DNA, 24 bp, Artificial sequence
  SiRNA target sequence
ttaagcttaacagtctttgaaaat

SEQ ID NO: 83006 - DNA, 24 bp, Artificial sequence
  SiRNA target sequence
taagcttaacagtctttgaaaatg

SEQ ID NO: 83007 - DNA, 24 bp, Artificial sequence
  SiRNA target sequence
aagcttaacagtctttgaaaatgt

SEQ ID NO: 83008 - DNA, 24 bp, Artificial sequence
  SiRNA target sequence
agcttaacagtctttgaaaatgtc

SEQ ID NO: 83009 - DNA, 24 bp, Artificial sequence
  SiRNA target sequence
gcttaacagtctttgaaaatgtcc

SEQ ID NO: 83010 - DNA, 24 bp, Artificial sequence
  SiRNA target sequence
cttaacagtctttgaaaatgtcca

SEQ ID NO: 83011 - DNA, 24 bp, Artificial sequence
  SiRNA target sequence
ttaacagtctttgaaaatgtccac

SEQ ID NO: 83012 - DNA, 24 bp, Artificial sequence
  SiRNA target sequence
taacagtctttgaaaatgtccaca

SEQ ID NO: 83013 - DNA, 24 bp, Artificial sequence
  SiRNA target sequence
aacagtctttgaaaatgtccacaa

SEQ ID NO: 83014 - DNA, 24 bp, Artificial sequence
  SiRNA target sequence
acagtctttgaaaatgtccacaac

SEQ ID NO: 83015 - DNA, 24 bp, Artificial sequence
  SiRNA target sequence
cagtctttgaaaatgtccacaaca

SEQ ID NO: 83016 - DNA, 24 bp, Artificial sequence
  SiRNA target sequence
agtctttgaaaatgtccacaacat

SEQ ID NO: 83017 - DNA, 24 bp, Artificial sequence
  SiRNA target sequence
gtctttgaaaatgtccacaacatt

SEQ ID NO: 83018 - DNA, 24 bp, Artificial sequence
  SiRNA target sequence
tctttgaaaatgtccacaacattc

SEQ ID NO: 83019 - DNA, 24 bp, Artificial sequence
  SiRNA target sequence
ctttgaaaatgtccacaacattct

SEQ ID NO: 83020 - DNA, 24 bp, Artificial sequence
  SiRNA target sequence
tttgaaaatgtccacaacattctg

SEQ ID NO: 83021 - DNA, 24 bp, Artificial sequence
  SiRNA target sequence
ttgaaaatgtccacaacattctgc

SEQ ID NO: 83022 - DNA, 24 bp, Artificial sequence
  SiRNA target sequence
tgaaaatgtccacaacattctgca

SEQ ID NO: 83023 - DNA, 24 bp, Artificial sequence
  SiRNA target sequence
gaaaatgtccacaacattctgcac

SEQ ID NO: 83024 - DNA, 24 bp, Artificial sequence
  SiRNA target sequence
aaaatgtccacaacattctgcaca

SEQ ID NO: 83025 - DNA, 24 bp, Artificial sequence
  SiRNA target sequence
aaatgtccacaacattctgcacag

SEQ ID NO: 83026 - DNA, 24 bp, Artificial sequence
  SiRNA target sequence
aatgtccacaacattctgcacagg

SEQ ID NO: 83027 - DNA, 24 bp, Artificial sequence
  SiRNA target sequence
atgtccacaacattctgcacaggg

SEQ ID NO: 83028 - DNA, 24 bp, Artificial sequence
  SiRNA target sequence
tgtccacaacattctgcacagggg

SEQ ID NO: 83029 - DNA, 24 bp, Artificial sequence
  SiRNA target sequence
gtccacaacattctgcacagggga

SEQ ID NO: 83030 - DNA, 24 bp, Artificial sequence
  SiRNA target sequence
tccacaacattctgcacaggggaa

SEQ ID NO: 83031 - DNA, 24 bp, Artificial sequence
  SiRNA target sequence
ccacaacattctgcacaggggaaa

SEQ ID NO: 83032 - DNA, 24 bp, Artificial sequence
  SiRNA target sequence
cacaacattctgcacaggggaaaa

SEQ ID NO: 83033 - DNA, 24 bp, Artificial sequence
  SiRNA target sequence
acaacattctgcacaggggaaaag

SEQ ID NO: 83034 - DNA, 24 bp, Artificial sequence
  SiRNA target sequence
caacattctgcacaggggaaaaga

SEQ ID NO: 83035 - DNA, 24 bp, Artificial sequence
  SiRNA target sequence
aacattctgcacaggggaaaagag

SEQ ID NO: 83036 - DNA, 24 bp, Artificial sequence
  SiRNA target sequence
acattctgcacaggggaaaagaga

SEQ ID NO: 83037 - DNA, 24 bp, Artificial sequence
  SiRNA target sequence
cattctgcacaggggaaaagagat

SEQ ID NO: 83038 - DNA, 24 bp, Artificial sequence
  SiRNA target sequence
attctgcacaggggaaaagagatg

SEQ ID NO: 83039 - DNA, 24 bp, Artificial sequence
  SiRNA target sequence
ttctgcacaggggaaaagagatga

SEQ ID NO: 83040 - DNA, 24 bp, Artificial sequence
  SiRNA target sequence
tctgcacaggggaaaagagatgat

SEQ ID NO: 83041 - DNA, 24 bp, Artificial sequence
  SiRNA target sequence
ctgcacaggggaaaagagatgata

SEQ ID NO: 83042 - DNA, 24 bp, Artificial sequence
  SiRNA target sequence
tgcacaggggaaaagagatgataa

SEQ ID NO: 83043 - DNA, 24 bp, Artificial sequence
  SiRNA target sequence
gcacaggggaaaagagatgataaa

SEQ ID NO: 83044 - DNA, 24 bp, Artificial sequence
  SiRNA target sequence
cacaggggaaaagagatgataaaa

SEQ ID NO: 83045 - DNA, 24 bp, Artificial sequence
  SiRNA target sequence
acaggggaaaagagatgataaaag

SEQ ID NO: 83046 - DNA, 24 bp, Artificial sequence
  SiRNA target sequence
caggggaaaagagatgataaaagg

SEQ ID NO: 83047 - DNA, 24 bp, Artificial sequence
  SiRNA target sequence
aggggaaaagagatgataaaaggt

SEQ ID NO: 83048 - DNA, 24 bp, Artificial sequence
  SiRNA target sequence
ggggaaaagagatgataaaaggta

SEQ ID NO: 83049 - DNA, 24 bp, Artificial sequence
  SiRNA target sequence
gggaaaagagatgataaaaggtaa

SEQ ID NO: 83050 - DNA, 24 bp, Artificial sequence
  SiRNA target sequence
ggaaaagagatgataaaaggtaaa

SEQ ID NO: 83051 - DNA, 24 bp, Artificial sequence
  SiRNA target sequence
gaaaagagatgataaaaggtaaat

SEQ ID NO: 83052 - DNA, 24 bp, Artificial sequence
  SiRNA target sequence
aaaagagatgataaaaggtaaata

SEQ ID NO: 83053 - DNA, 24 bp, Artificial sequence
  SiRNA target sequence
aaagagatgataaaaggtaaataa

SEQ ID NO: 83054 - DNA, 24 bp, Artificial sequence
  SiRNA target sequence
aagagatgataaaaggtaaataaa

SEQ ID NO: 83055 - DNA, 24 bp, Artificial sequence
  SiRNA target sequence
agagatgataaaaggtaaataaat

SEQ ID NO: 83056 - DNA, 24 bp, Artificial sequence
  SiRNA target sequence
gagatgataaaaggtaaataaatt

SEQ ID NO: 83057 - DNA, 24 bp, Artificial sequence
  SiRNA target sequence
agatgataaaaggtaaataaattg

SEQ ID NO: 83058 - DNA, 24 bp, Artificial sequence
  SiRNA target sequence
gatgataaaaggtaaataaattga

SEQ ID NO: 83059 - DNA, 24 bp, Artificial sequence
  SiRNA target sequence
atgataaaaggtaaataaattgaa

SEQ ID NO: 83060 - DNA, 24 bp, Artificial sequence
  SiRNA target sequence
tgataaaaggtaaataaattgaag

SEQ ID NO: 83061 - DNA, 24 bp, Artificial sequence
  SiRNA target sequence
gataaaaggtaaataaattgaagt

SEQ ID NO: 83062 - DNA, 24 bp, Artificial sequence
  SiRNA target sequence
ataaaaggtaaataaattgaagtg

SEQ ID NO: 83063 - DNA, 24 bp, Artificial sequence
  SiRNA target sequence
taaaaggtaaataaattgaagtgt

SEQ ID NO: 83064 - DNA, 24 bp, Artificial sequence
  SiRNA target sequence
aaaaggtaaataaattgaagtgta

SEQ ID NO: 83065 - DNA, 24 bp, Artificial sequence
  SiRNA target sequence
aaaggtaaataaattgaagtgtat

SEQ ID NO: 83066 - DNA, 24 bp, Artificial sequence
  SiRNA target sequence
aaggtaaataaattgaagtgtatc

SEQ ID NO: 83067 - DNA, 24 bp, Artificial sequence
  SiRNA target sequence
aggtaaataaattgaagtgtatct

SEQ ID NO: 83068 - DNA, 24 bp, Artificial sequence
  SiRNA target sequence
ggtaaataaattgaagtgtatctt

SEQ ID NO: 83069 - DNA, 24 bp, Artificial sequence
  SiRNA target sequence
gtaaataaattgaagtgtatcttt

SEQ ID NO: 83070 - DNA, 24 bp, Artificial sequence
  SiRNA target sequence
taaataaattgaagtgtatctttt

SEQ ID NO: 83071 - DNA, 24 bp, Artificial sequence
  SiRNA target sequence
aaataaattgaagtgtatcttttt

SEQ ID NO: 83072 - DNA, 24 bp, Artificial sequence
  SiRNA target sequence
aataaattgaagtgtatctttttt

SEQ ID NO: 83073 - DNA, 24 bp, Artificial sequence
  SiRNA target sequence
ataaattgaagtgtatctttttta

SEQ ID NO: 83074 - DNA, 24 bp, Artificial sequence
  SiRNA target sequence
taaattgaagtgtatcttttttat

SEQ ID NO: 83075 - DNA, 24 bp, Artificial sequence
  SiRNA target sequence
aaattgaagtgtatcttttttatg

SEQ ID NO: 83076 - DNA, 24 bp, Artificial sequence
  SiRNA target sequence
aattgaagtgtatcttttttatgt

SEQ ID NO: 83077 - DNA, 24 bp, Artificial sequence
  SiRNA target sequence
attgaagtgtatcttttttatgtt

SEQ ID NO: 83078 - DNA, 24 bp, Artificial sequence
  SiRNA target sequence
ttgaagtgtatcttttttatgttg

SEQ ID NO: 83079 - DNA, 24 bp, Artificial sequence
  SiRNA target sequence
tgaagtgtatcttttttatgttgt

SEQ ID NO: 83080 - DNA, 24 bp, Artificial sequence
  SiRNA target sequence
gaagtgtatcttttttatgttgta

SEQ ID NO: 83081 - DNA, 24 bp, Artificial sequence
  SiRNA target sequence
aagtgtatcttttttatgttgtac

SEQ ID NO: 83082 - DNA, 24 bp, Artificial sequence
  SiRNA target sequence
agtgtatcttttttatgttgtact

SEQ ID NO: 83083 - DNA, 24 bp, Artificial sequence
  SiRNA target sequence
gtgtatcttttttatgttgtactg

SEQ ID NO: 83084 - DNA, 24 bp, Artificial sequence
  SiRNA target sequence
tgtatcttttttatgttgtactgt

SEQ ID NO: 83085 - DNA, 24 bp, Artificial sequence
  SiRNA target sequence
gtatcttttttatgttgtactgta

SEQ ID NO: 83086 - DNA, 24 bp, Artificial sequence
  SiRNA target sequence
tatcttttttatgttgtactgtag

SEQ ID NO: 83087 - DNA, 24 bp, Artificial sequence
  SiRNA target sequence
atcttttttatgttgtactgtagg

SEQ ID NO: 83088 - DNA, 24 bp, Artificial sequence
  SiRNA target sequence
tcttttttatgttgtactgtagga

SEQ ID NO: 83089 - DNA, 24 bp, Artificial sequence
  SiRNA target sequence
cttttttatgttgtactgtaggaa

SEQ ID NO: 83090 - DNA, 24 bp, Artificial sequence
  SiRNA target sequence
ttttttatgttgtactgtaggaaa

SEQ ID NO: 83091 - DNA, 24 bp, Artificial sequence
  SiRNA target sequence
tttttatgttgtactgtaggaaat

SEQ ID NO: 83092 - DNA, 24 bp, Artificial sequence
  SiRNA target sequence
ttttatgttgtactgtaggaaatg

SEQ ID NO: 83093 - DNA, 24 bp, Artificial sequence
  SiRNA target sequence
tttatgttgtactgtaggaaatgc

SEQ ID NO: 83094 - DNA, 24 bp, Artificial sequence
  SiRNA target sequence
ttatgttgtactgtaggaaatgca

SEQ ID NO: 83095 - DNA, 24 bp, Artificial sequence
  SiRNA target sequence
tatgttgtactgtaggaaatgcag

SEQ ID NO: 83096 - DNA, 24 bp, Artificial sequence
  SiRNA target sequence
atgttgtactgtaggaaatgcagg

SEQ ID NO: 83097 - DNA, 24 bp, Artificial sequence
  SiRNA target sequence
tgttgtactgtaggaaatgcagga

SEQ ID NO: 83098 - DNA, 24 bp, Artificial sequence
  SiRNA target sequence
gttgtactgtaggaaatgcaggat

SEQ ID NO: 83099 - DNA, 24 bp, Artificial sequence
  SiRNA target sequence
ttgtactgtaggaaatgcaggata

SEQ ID NO: 83100 - DNA, 24 bp, Artificial sequence
  SiRNA target sequence
tgtactgtaggaaatgcaggataa

SEQ ID NO: 83101 - DNA, 24 bp, Artificial sequence
  SiRNA target sequence
gtactgtaggaaatgcaggataaa

SEQ ID NO: 83102 - DNA, 24 bp, Artificial sequence
  SiRNA target sequence
tactgtaggaaatgcaggataaac

SEQ ID NO: 83103 - DNA, 24 bp, Artificial sequence
  SiRNA target sequence
actgtaggaaatgcaggataaaca

SEQ ID NO: 83104 - DNA, 24 bp, Artificial sequence
  SiRNA target sequence
ctgtaggaaatgcaggataaacag

SEQ ID NO: 83105 - DNA, 24 bp, Artificial sequence
  SiRNA target sequence
tgtaggaaatgcaggataaacagc

SEQ ID NO: 83106 - DNA, 24 bp, Artificial sequence
  SiRNA target sequence
gtaggaaatgcaggataaacagct

SEQ ID NO: 83107 - DNA, 24 bp, Artificial sequence
  SiRNA target sequence
taggaaatgcaggataaacagctg

SEQ ID NO: 83108 - DNA, 24 bp, Artificial sequence
  SiRNA target sequence
aggaaatgcaggataaacagctgc

SEQ ID NO: 83109 - DNA, 24 bp, Artificial sequence
  SiRNA target sequence
ggaaatgcaggataaacagctgcc

SEQ ID NO: 83110 - DNA, 24 bp, Artificial sequence
  SiRNA target sequence
gaaatgcaggataaacagctgcca

SEQ ID NO: 83111 - DNA, 24 bp, Artificial sequence
  SiRNA target sequence
aaatgcaggataaacagctgccat

SEQ ID NO: 83112 - DNA, 24 bp, Artificial sequence
  SiRNA target sequence
aatgcaggataaacagctgccatg

SEQ ID NO: 83113 - DNA, 24 bp, Artificial sequence
  SiRNA target sequence
atgcaggataaacagctgccatgg

SEQ ID NO: 83114 - DNA, 24 bp, Artificial sequence
  SiRNA target sequence
tgcaggataaacagctgccatggt

SEQ ID NO: 83115 - DNA, 24 bp, Artificial sequence
  SiRNA target sequence
gcaggataaacagctgccatggta

SEQ ID NO: 83116 - DNA, 24 bp, Artificial sequence
  SiRNA target sequence
caggataaacagctgccatggtat

SEQ ID NO: 83117 - DNA, 24 bp, Artificial sequence
  SiRNA target sequence
aggataaacagctgccatggtatg

SEQ ID NO: 83118 - DNA, 24 bp, Artificial sequence
  SiRNA target sequence
ggataaacagctgccatggtatgt

SEQ ID NO: 83119 - DNA, 24 bp, Artificial sequence
  SiRNA target sequence
gataaacagctgccatggtatgta

SEQ ID NO: 83120 - DNA, 24 bp, Artificial sequence
  SiRNA target sequence
ataaacagctgccatggtatgtaa

SEQ ID NO: 83121 - DNA, 24 bp, Artificial sequence
  SiRNA target sequence
taaacagctgccatggtatgtaaa

SEQ ID NO: 83122 - DNA, 24 bp, Artificial sequence
  SiRNA target sequence
aaacagctgccatggtatgtaaaa

SEQ ID NO: 83123 - DNA, 24 bp, Artificial sequence
  SiRNA target sequence
aacagctgccatggtatgtaaaag

SEQ ID NO: 83124 - DNA, 24 bp, Artificial sequence
  SiRNA target sequence
acagctgccatggtatgtaaaagt

SEQ ID NO: 83125 - DNA, 24 bp, Artificial sequence
  SiRNA target sequence
cagctgccatggtatgtaaaagtg

SEQ ID NO: 83126 - DNA, 24 bp, Artificial sequence
  SiRNA target sequence
agctgccatggtatgtaaaagtgt

SEQ ID NO: 83127 - DNA, 24 bp, Artificial sequence
  SiRNA target sequence
gctgccatggtatgtaaaagtgtc

SEQ ID NO: 83128 - DNA, 24 bp, Artificial sequence
  SiRNA target sequence
ctgccatggtatgtaaaagtgtcc

SEQ ID NO: 83129 - DNA, 24 bp, Artificial sequence
  SiRNA target sequence
tgccatggtatgtaaaagtgtcca

SEQ ID NO: 83130 - DNA, 24 bp, Artificial sequence
  SiRNA target sequence
gccatggtatgtaaaagtgtccat

SEQ ID NO: 83131 - DNA, 24 bp, Artificial sequence
  SiRNA target sequence
ccatggtatgtaaaagtgtccatg

SEQ ID NO: 83132 - DNA, 24 bp, Artificial sequence
  SiRNA target sequence
catggtatgtaaaagtgtccatgt

SEQ ID NO: 83133 - DNA, 24 bp, Artificial sequence
  SiRNA target sequence
atggtatgtaaaagtgtccatgtt

SEQ ID NO: 83134 - DNA, 24 bp, Artificial sequence
  SiRNA target sequence
tggtatgtaaaagtgtccatgttg

SEQ ID NO: 83135 - DNA, 24 bp, Artificial sequence
  SiRNA target sequence
ggtatgtaaaagtgtccatgttgc

SEQ ID NO: 83136 - DNA, 24 bp, Artificial sequence
  SiRNA target sequence
gtatgtaaaagtgtccatgttgct

SEQ ID NO: 83137 - DNA, 24 bp, Artificial sequence
  SiRNA target sequence
tatgtaaaagtgtccatgttgctc

SEQ ID NO: 83138 - DNA, 24 bp, Artificial sequence
  SiRNA target sequence
atgtaaaagtgtccatgttgctct

SEQ ID NO: 83139 - DNA, 24 bp, Artificial sequence
  SiRNA target sequence
tgtaaaagtgtccatgttgctctc

SEQ ID NO: 83140 - DNA, 24 bp, Artificial sequence
  SiRNA target sequence
gtaaaagtgtccatgttgctctcc

SEQ ID NO: 83141 - DNA, 24 bp, Artificial sequence
  SiRNA target sequence
taaaagtgtccatgttgctctccc

SEQ ID NO: 83142 - DNA, 24 bp, Artificial sequence
  SiRNA target sequence
aaaagtgtccatgttgctctcccc

SEQ ID NO: 83143 - DNA, 24 bp, Artificial sequence
  SiRNA target sequence
aaagtgtccatgttgctctcccca

SEQ ID NO: 83144 - DNA, 24 bp, Artificial sequence
  SiRNA target sequence
aagtgtccatgttgctctccccaa

SEQ ID NO: 83145 - DNA, 24 bp, Artificial sequence
  SiRNA target sequence
agtgtccatgttgctctccccaat

SEQ ID NO: 83146 - DNA, 24 bp, Artificial sequence
  SiRNA target sequence
gtgtccatgttgctctccccaatc

SEQ ID NO: 83147 - DNA, 24 bp, Artificial sequence
  SiRNA target sequence
tgtccatgttgctctccccaatct

SEQ ID NO: 83148 - DNA, 24 bp, Artificial sequence
  SiRNA target sequence
gtccatgttgctctccccaatcta

SEQ ID NO: 83149 - DNA, 24 bp, Artificial sequence
  SiRNA target sequence
tccatgttgctctccccaatctat

SEQ ID NO: 83150 - DNA, 24 bp, Artificial sequence
  SiRNA target sequence
ccatgttgctctccccaatctatc

SEQ ID NO: 83151 - DNA, 24 bp, Artificial sequence
  SiRNA target sequence
catgttgctctccccaatctatct

SEQ ID NO: 83152 - DNA, 24 bp, Artificial sequence
  SiRNA target sequence
atgttgctctccccaatctatctt

SEQ ID NO: 83153 - DNA, 24 bp, Artificial sequence
  SiRNA target sequence
tgttgctctccccaatctatcttt

SEQ ID NO: 83154 - DNA, 24 bp, Artificial sequence
  SiRNA target sequence
gttgctctccccaatctatcttta

SEQ ID NO: 83155 - DNA, 24 bp, Artificial sequence
  SiRNA target sequence
ttgctctccccaatctatctttaa

SEQ ID NO: 83156 - DNA, 24 bp, Artificial sequence
  SiRNA target sequence
tgctctccccaatctatctttaac

SEQ ID NO: 83157 - DNA, 24 bp, Artificial sequence
  SiRNA target sequence
gctctccccaatctatctttaact

SEQ ID NO: 83158 - DNA, 24 bp, Artificial sequence
  SiRNA target sequence
ctctccccaatctatctttaactt

SEQ ID NO: 83159 - DNA, 24 bp, Artificial sequence
  SiRNA target sequence
tctccccaatctatctttaacttc

SEQ ID NO: 83160 - DNA, 24 bp, Artificial sequence
  SiRNA target sequence
ctccccaatctatctttaacttcc

SEQ ID NO: 83161 - DNA, 24 bp, Artificial sequence
  SiRNA target sequence
tccccaatctatctttaacttcct

SEQ ID NO: 83162 - DNA, 24 bp, Artificial sequence
  SiRNA target sequence
ccccaatctatctttaacttcctt

SEQ ID NO: 83163 - DNA, 24 bp, Artificial sequence
  SiRNA target sequence
cccaatctatctttaacttcctta

SEQ ID NO: 83164 - DNA, 24 bp, Artificial sequence
  SiRNA target sequence
ccaatctatctttaacttccttat

SEQ ID NO: 83165 - DNA, 24 bp, Artificial sequence
  SiRNA target sequence
caatctatctttaacttccttatt

SEQ ID NO: 83166 - DNA, 24 bp, Artificial sequence
  SiRNA target sequence
aatctatctttaacttccttattt

SEQ ID NO: 83167 - DNA, 24 bp, Artificial sequence
  SiRNA target sequence
atctatctttaacttccttatttg

SEQ ID NO: 83168 - DNA, 24 bp, Artificial sequence
  SiRNA target sequence
tctatctttaacttccttatttgt

SEQ ID NO: 83169 - DNA, 24 bp, Artificial sequence
  SiRNA target sequence
ctatctttaacttccttatttgtt

SEQ ID NO: 83170 - DNA, 24 bp, Artificial sequence
  SiRNA target sequence
tatctttaacttccttatttgtta

SEQ ID NO: 83171 - DNA, 24 bp, Artificial sequence
  SiRNA target sequence
atctttaacttccttatttgttaa

SEQ ID NO: 83172 - DNA, 24 bp, Artificial sequence
  SiRNA target sequence
tctttaacttccttatttgttaat

SEQ ID NO: 83173 - DNA, 24 bp, Artificial sequence
  SiRNA target sequence
ctttaacttccttatttgttaatt

SEQ ID NO: 83174 - DNA, 24 bp, Artificial sequence
  SiRNA target sequence
tttaacttccttatttgttaattt

SEQ ID NO: 83175 - DNA, 24 bp, Artificial sequence
  SiRNA target sequence
ttaacttccttatttgttaatttt

SEQ ID NO: 83176 - DNA, 24 bp, Artificial sequence
  SiRNA target sequence
taacttccttatttgttaattttt

SEQ ID NO: 83177 - DNA, 24 bp, Artificial sequence
  SiRNA target sequence
aacttccttatttgttaatttttg

SEQ ID NO: 83178 - DNA, 24 bp, Artificial sequence
  SiRNA target sequence
acttccttatttgttaatttttga

SEQ ID NO: 83179 - DNA, 24 bp, Artificial sequence
  SiRNA target sequence
cttccttatttgttaatttttgat

SEQ ID NO: 83180 - DNA, 24 bp, Artificial sequence
  SiRNA target sequence
ttccttatttgttaatttttgatt

SEQ ID NO: 83181 - DNA, 24 bp, Artificial sequence
  SiRNA target sequence
tccttatttgttaatttttgatta

SEQ ID NO: 83182 - DNA, 24 bp, Artificial sequence
  SiRNA target sequence
ccttatttgttaatttttgattat

SEQ ID NO: 83183 - DNA, 24 bp, Artificial sequence
  SiRNA target sequence
cttatttgttaatttttgattatg

SEQ ID NO: 83184 - DNA, 24 bp, Artificial sequence
  SiRNA target sequence
ttatttgttaatttttgattatga

SEQ ID NO: 83185 - DNA, 24 bp, Artificial sequence
  SiRNA target sequence
tatttgttaatttttgattatgaa

SEQ ID NO: 83186 - DNA, 24 bp, Artificial sequence
  SiRNA target sequence
atttgttaatttttgattatgaat

SEQ ID NO: 83187 - DNA, 24 bp, Artificial sequence
  SiRNA target sequence
tttgttaatttttgattatgaatt

SEQ ID NO: 83188 - DNA, 24 bp, Artificial sequence
  SiRNA target sequence
ttgttaatttttgattatgaatta

SEQ ID NO: 83189 - DNA, 24 bp, Artificial sequence
  SiRNA target sequence
tgttaatttttgattatgaattag

SEQ ID NO: 83190 - DNA, 24 bp, Artificial sequence
  SiRNA target sequence
gttaatttttgattatgaattaga

SEQ ID NO: 83191 - DNA, 24 bp, Artificial sequence
  SiRNA target sequence
ttaatttttgattatgaattagac

SEQ ID NO: 83192 - DNA, 24 bp, Artificial sequence
  SiRNA target sequence
taatttttgattatgaattagacc

SEQ ID NO: 83193 - DNA, 24 bp, Artificial sequence
  SiRNA target sequence
aatttttgattatgaattagacct

SEQ ID NO: 83194 - DNA, 24 bp, Artificial sequence
  SiRNA target sequence
atttttgattatgaattagaccta

SEQ ID NO: 83195 - DNA, 24 bp, Artificial sequence
  SiRNA target sequence
tttttgattatgaattagacctaa

SEQ ID NO: 83196 - DNA, 24 bp, Artificial sequence
  SiRNA target sequence
ttttgattatgaattagacctaat

SEQ ID NO: 83197 - DNA, 24 bp, Artificial sequence
  SiRNA target sequence
tttgattatgaattagacctaatt

SEQ ID NO: 83198 - DNA, 24 bp, Artificial sequence
  SiRNA target sequence
ttgattatgaattagacctaattc

SEQ ID NO: 83199 - DNA, 24 bp, Artificial sequence
  SiRNA target sequence
tgattatgaattagacctaattca

SEQ ID NO: 83200 - DNA, 24 bp, Artificial sequence
  SiRNA target sequence
gattatgaattagacctaattcac

SEQ ID NO: 83201 - DNA, 24 bp, Artificial sequence
  SiRNA target sequence
attatgaattagacctaattcacc

SEQ ID NO: 83202 - DNA, 24 bp, Artificial sequence
  SiRNA target sequence
ttatgaattagacctaattcacct

SEQ ID NO: 83203 - DNA, 24 bp, Artificial sequence
  SiRNA target sequence
tatgaattagacctaattcaccta

SEQ ID NO: 83204 - DNA, 24 bp, Artificial sequence
  SiRNA target sequence
atgaattagacctaattcacctac

SEQ ID NO: 83205 - DNA, 24 bp, Artificial sequence
  SiRNA target sequence
tgaattagacctaattcacctact

SEQ ID NO: 83206 - DNA, 24 bp, Artificial sequence
  SiRNA target sequence
gaattagacctaattcacctactt

SEQ ID NO: 83207 - DNA, 24 bp, Artificial sequence
  SiRNA target sequence
aattagacctaattcacctacttt

SEQ ID NO: 83208 - DNA, 24 bp, Artificial sequence
  SiRNA target sequence
attagacctaattcacctactttt

SEQ ID NO: 83209 - DNA, 24 bp, Artificial sequence
  SiRNA target sequence
ttagacctaattcacctacttttg

SEQ ID NO: 83210 - DNA, 24 bp, Artificial sequence
  SiRNA target sequence
tagacctaattcacctacttttgg

SEQ ID NO: 83211 - DNA, 24 bp, Artificial sequence
  SiRNA target sequence
agacctaattcacctacttttggt

SEQ ID NO: 83212 - DNA, 24 bp, Artificial sequence
  SiRNA target sequence
gacctaattcacctacttttggtg

SEQ ID NO: 83213 - DNA, 24 bp, Artificial sequence
  SiRNA target sequence
acctaattcacctacttttggtga

SEQ ID NO: 83214 - DNA, 24 bp, Artificial sequence
  SiRNA target sequence
cctaattcacctacttttggtgaa

SEQ ID NO: 83215 - DNA, 24 bp, Artificial sequence
  SiRNA target sequence
ctaattcacctacttttggtgaaa

SEQ ID NO: 83216 - DNA, 24 bp, Artificial sequence
  SiRNA target sequence
taattcacctacttttggtgaaat

SEQ ID NO: 83217 - DNA, 24 bp, Artificial sequence
  SiRNA target sequence
aattcacctacttttggtgaaata

SEQ ID NO: 83218 - DNA, 24 bp, Artificial sequence
  SiRNA target sequence
attcacctacttttggtgaaatag

SEQ ID NO: 83219 - DNA, 24 bp, Artificial sequence
  SiRNA target sequence
ttcacctacttttggtgaaataga

SEQ ID NO: 83220 - DNA, 24 bp, Artificial sequence
  SiRNA target sequence
tcacctacttttggtgaaatagat

SEQ ID NO: 83221 - DNA, 24 bp, Artificial sequence
  SiRNA target sequence
cacctacttttggtgaaatagatt

SEQ ID NO: 83222 - DNA, 24 bp, Artificial sequence
  SiRNA target sequence
acctacttttggtgaaatagattg

SEQ ID NO: 83223 - DNA, 24 bp, Artificial sequence
  SiRNA target sequence
cctacttttggtgaaatagattgt

SEQ ID NO: 83224 - DNA, 24 bp, Artificial sequence
  SiRNA target sequence
ctacttttggtgaaatagattgta

SEQ ID NO: 83225 - DNA, 24 bp, Artificial sequence
  SiRNA target sequence
tacttttggtgaaatagattgtaa

SEQ ID NO: 83226 - DNA, 24 bp, Artificial sequence
  SiRNA target sequence
acttttggtgaaatagattgtaaa

SEQ ID NO: 83227 - DNA, 24 bp, Artificial sequence
  SiRNA target sequence
cttttggtgaaatagattgtaaaa

SEQ ID NO: 83228 - DNA, 24 bp, Artificial sequence
  SiRNA target sequence
ttttggtgaaatagattgtaaaac

SEQ ID NO: 83229 - DNA, 24 bp, Artificial sequence
  SiRNA target sequence
tttggtgaaatagattgtaaaaca

SEQ ID NO: 83230 - DNA, 24 bp, Artificial sequence
  SiRNA target sequence
ttggtgaaatagattgtaaaacag

SEQ ID NO: 83231 - DNA, 24 bp, Artificial sequence
  SiRNA target sequence
tggtgaaatagattgtaaaacaga

SEQ ID NO: 83232 - DNA, 24 bp, Artificial sequence
  SiRNA target sequence
ggtgaaatagattgtaaaacagat

SEQ ID NO: 83233 - DNA, 24 bp, Artificial sequence
  SiRNA target sequence
gtgaaatagattgtaaaacagatt

SEQ ID NO: 83234 - DNA, 24 bp, Artificial sequence
  SiRNA target sequence
tgaaatagattgtaaaacagattt

SEQ ID NO: 83235 - DNA, 24 bp, Artificial sequence
  SiRNA target sequence
gaaatagattgtaaaacagatttt

SEQ ID NO: 83236 - DNA, 24 bp, Artificial sequence
  SiRNA target sequence
aaatagattgtaaaacagattttc

SEQ ID NO: 83237 - DNA, 24 bp, Artificial sequence
  SiRNA target sequence
aatagattgtaaaacagattttcc

SEQ ID NO: 83238 - DNA, 24 bp, Artificial sequence
  SiRNA target sequence
atagattgtaaaacagattttcca

SEQ ID NO: 83239 - DNA, 24 bp, Artificial sequence
  SiRNA target sequence
tagattgtaaaacagattttccaa

SEQ ID NO: 83240 - DNA, 24 bp, Artificial sequence
  SiRNA target sequence
agattgtaaaacagattttccaag

SEQ ID NO: 83241 - DNA, 24 bp, Artificial sequence
  SiRNA target sequence
gattgtaaaacagattttccaagt

SEQ ID NO: 83242 - DNA, 24 bp, Artificial sequence
  SiRNA target sequence
attgtaaaacagattttccaagtg

SEQ ID NO: 83243 - DNA, 24 bp, Artificial sequence
  SiRNA target sequence
ttgtaaaacagattttccaagtga

SEQ ID NO: 83244 - DNA, 24 bp, Artificial sequence
  SiRNA target sequence
tgtaaaacagattttccaagtgag

SEQ ID NO: 83245 - DNA, 24 bp, Artificial sequence
  SiRNA target sequence
gtaaaacagattttccaagtgagt

SEQ ID NO: 83246 - DNA, 24 bp, Artificial sequence
  SiRNA target sequence
taaaacagattttccaagtgagtt

SEQ ID NO: 83247 - DNA, 24 bp, Artificial sequence
  SiRNA target sequence
aaaacagattttccaagtgagttg

SEQ ID NO: 83248 - DNA, 24 bp, Artificial sequence
  SiRNA target sequence
aaacagattttccaagtgagttgt

SEQ ID NO: 83249 - DNA, 24 bp, Artificial sequence
  SiRNA target sequence
aacagattttccaagtgagttgtc

SEQ ID NO: 83250 - DNA, 24 bp, Artificial sequence
  SiRNA target sequence
acagattttccaagtgagttgtct

SEQ ID NO: 83251 - DNA, 24 bp, Artificial sequence
  SiRNA target sequence
cagattttccaagtgagttgtctg

SEQ ID NO: 83252 - DNA, 24 bp, Artificial sequence
  SiRNA target sequence
agattttccaagtgagttgtctgc

SEQ ID NO: 83253 - DNA, 24 bp, Artificial sequence
  SiRNA target sequence
gattttccaagtgagttgtctgca

SEQ ID NO: 83254 - DNA, 24 bp, Artificial sequence
  SiRNA target sequence
attttccaagtgagttgtctgcat

SEQ ID NO: 83255 - DNA, 24 bp, Artificial sequence
  SiRNA target sequence
ttttccaagtgagttgtctgcatg

SEQ ID NO: 83256 - DNA, 24 bp, Artificial sequence
  SiRNA target sequence
tttccaagtgagttgtctgcatgt

SEQ ID NO: 83257 - DNA, 24 bp, Artificial sequence
  SiRNA target sequence
ttccaagtgagttgtctgcatgtg

SEQ ID NO: 83258 - DNA, 24 bp, Artificial sequence
  SiRNA target sequence
tccaagtgagttgtctgcatgtgt

SEQ ID NO: 83259 - DNA, 24 bp, Artificial sequence
  SiRNA target sequence
ccaagtgagttgtctgcatgtgta

SEQ ID NO: 83260 - DNA, 24 bp, Artificial sequence
  SiRNA target sequence
caagtgagttgtctgcatgtgtat

SEQ ID NO: 83261 - DNA, 24 bp, Artificial sequence
  SiRNA target sequence
aagtgagttgtctgcatgtgtatg

SEQ ID NO: 83262 - DNA, 24 bp, Artificial sequence
  SiRNA target sequence
agtgagttgtctgcatgtgtatgc

SEQ ID NO: 83263 - DNA, 24 bp, Artificial sequence
  SiRNA target sequence
gtgagttgtctgcatgtgtatgcg

SEQ ID NO: 83264 - DNA, 24 bp, Artificial sequence
  SiRNA target sequence
tgagttgtctgcatgtgtatgcgg

SEQ ID NO: 83265 - DNA, 24 bp, Artificial sequence
  SiRNA target sequence
gagttgtctgcatgtgtatgcggg

SEQ ID NO: 83266 - DNA, 24 bp, Artificial sequence
  SiRNA target sequence
agttgtctgcatgtgtatgcggga

SEQ ID NO: 83267 - DNA, 24 bp, Artificial sequence
  SiRNA target sequence
gttgtctgcatgtgtatgcgggaa

SEQ ID NO: 83268 - DNA, 24 bp, Artificial sequence
  SiRNA target sequence
ttgtctgcatgtgtatgcgggaaa

SEQ ID NO: 83269 - DNA, 24 bp, Artificial sequence
  SiRNA target sequence
tgtctgcatgtgtatgcgggaaaa

SEQ ID NO: 83270 - DNA, 24 bp, Artificial sequence
  SiRNA target sequence
gtctgcatgtgtatgcgggaaaaa

SEQ ID NO: 83271 - DNA, 24 bp, Artificial sequence
  SiRNA target sequence
tctgcatgtgtatgcgggaaaaaa

SEQ ID NO: 83272 - DNA, 24 bp, Artificial sequence
  SiRNA target sequence
ctgcatgtgtatgcgggaaaaaat

SEQ ID NO: 83273 - DNA, 24 bp, Artificial sequence
  SiRNA target sequence
tgcatgtgtatgcgggaaaaaatg

SEQ ID NO: 83274 - DNA, 24 bp, Artificial sequence
  SiRNA target sequence
gcatgtgtatgcgggaaaaaatgc

SEQ ID NO: 83275 - DNA, 24 bp, Artificial sequence
  SiRNA target sequence
catgtgtatgcgggaaaaaatgct

SEQ ID NO: 83276 - DNA, 24 bp, Artificial sequence
  SiRNA target sequence
atgtgtatgcgggaaaaaatgctg

SEQ ID NO: 83277 - DNA, 24 bp, Artificial sequence
  SiRNA target sequence
tgtgtatgcgggaaaaaatgctgt

SEQ ID NO: 83278 - DNA, 24 bp, Artificial sequence
  SiRNA target sequence
gtgtatgcgggaaaaaatgctgtt

SEQ ID NO: 83279 - DNA, 24 bp, Artificial sequence
  SiRNA target sequence
tgtatgcgggaaaaaatgctgttt

SEQ ID NO: 83280 - DNA, 24 bp, Artificial sequence
  SiRNA target sequence
gtatgcgggaaaaaatgctgtttt

SEQ ID NO: 83281 - DNA, 24 bp, Artificial sequence
  SiRNA target sequence
tatgcgggaaaaaatgctgttttg

SEQ ID NO: 83282 - DNA, 24 bp, Artificial sequence
  SiRNA target sequence
atgcgggaaaaaatgctgttttgc

SEQ ID NO: 83283 - DNA, 24 bp, Artificial sequence
  SiRNA target sequence
tgcgggaaaaaatgctgttttgct

SEQ ID NO: 83284 - DNA, 24 bp, Artificial sequence
  SiRNA target sequence
gcgggaaaaaatgctgttttgcta

SEQ ID NO: 83285 - DNA, 24 bp, Artificial sequence
  SiRNA target sequence
cgggaaaaaatgctgttttgctaa

SEQ ID NO: 83286 - DNA, 24 bp, Artificial sequence
  SiRNA target sequence
gggaaaaaatgctgttttgctaaa

SEQ ID NO: 83287 - DNA, 24 bp, Artificial sequence
  SiRNA target sequence
ggaaaaaatgctgttttgctaaat

SEQ ID NO: 83288 - DNA, 24 bp, Artificial sequence
  SiRNA target sequence
gaaaaaatgctgttttgctaaata

SEQ ID NO: 83289 - DNA, 24 bp, Artificial sequence
  SiRNA target sequence
aaaaaatgctgttttgctaaataa

SEQ ID NO: 83290 - DNA, 24 bp, Artificial sequence
  SiRNA target sequence
aaaaatgctgttttgctaaataaa

SEQ ID NO: 83291 - DNA, 24 bp, Artificial sequence
  SiRNA target sequence
aaaatgctgttttgctaaataaac

SEQ ID NO: 83292 - DNA, 24 bp, Artificial sequence
  SiRNA target sequence
aaatgctgttttgctaaataaaca

SEQ ID NO: 83293 - DNA, 24 bp, Artificial sequence
  SiRNA target sequence
aatgctgttttgctaaataaacaa

SEQ ID NO: 83294 - DNA, 24 bp, Artificial sequence
  SiRNA target sequence
atgctgttttgctaaataaacaat

SEQ ID NO: 83295 - DNA, 24 bp, Artificial sequence
  SiRNA target sequence
tgctgttttgctaaataaacaatc

SEQ ID NO: 83296 - DNA, 24 bp, Artificial sequence
  SiRNA target sequence
gctgttttgctaaataaacaatcc

SEQ ID NO: 83297 - DNA, 24 bp, Artificial sequence
  SiRNA target sequence
ctgttttgctaaataaacaatcca

SEQ ID NO: 83298 - DNA, 24 bp, Artificial sequence
  SiRNA target sequence
tgttttgctaaataaacaatccat

SEQ ID NO: 83299 - DNA, 24 bp, Artificial sequence
  SiRNA target sequence
gttttgctaaataaacaatccata

SEQ ID NO: 83300 - DNA, 24 bp, Artificial sequence
  SiRNA target sequence
ttttgctaaataaacaatccatac

SEQ ID NO: 83301 - DNA, 24 bp, Artificial sequence
  SiRNA target sequence
tttgctaaataaacaatccataca

SEQ ID NO: 83302 - DNA, 24 bp, Artificial sequence
  SiRNA target sequence
ttgctaaataaacaatccatacac

SEQ ID NO: 83303 - DNA, 24 bp, Artificial sequence
  SiRNA target sequence
tgctaaataaacaatccatacacc

SEQ ID NO: 83304 - DNA, 24 bp, Artificial sequence
  SiRNA target sequence
gctaaataaacaatccatacaccc

SEQ ID NO: 83305 - DNA, 24 bp, Artificial sequence
  SiRNA target sequence
ctaaataaacaatccatacaccca

SEQ ID NO: 83306 - DNA, 24 bp, Artificial sequence
  SiRNA target sequence
taaataaacaatccatacacccaa

SEQ ID NO: 83307 - DNA, 24 bp, Artificial sequence
  SiRNA target sequence
aaataaacaatccatacacccaat

SEQ ID NO: 83308 - DNA, 24 bp, Artificial sequence
  SiRNA target sequence
aataaacaatccatacacccaata

SEQ ID NO: 83309 - DNA, 24 bp, Artificial sequence
  SiRNA target sequence
ataaacaatccatacacccaataa

SEQ ID NO: 83310 - DNA, 24 bp, Artificial sequence
  SiRNA target sequence
taaacaatccatacacccaataag

SEQ ID NO: 83311 - DNA, 24 bp, Artificial sequence
  SiRNA target sequence
aaacaatccatacacccaataaga

SEQ ID NO: 83312 - DNA, 24 bp, Artificial sequence
  SiRNA target sequence
aacaatccatacacccaataagat

SEQ ID NO: 83313 - DNA, 24 bp, Artificial sequence
  SiRNA target sequence
acaatccatacacccaataagata

SEQ ID NO: 83314 - DNA, 24 bp, Artificial sequence
  SiRNA target sequence
caatccatacacccaataagataa

SEQ ID NO: 83315 - DNA, 24 bp, Artificial sequence
  SiRNA target sequence
aatccatacacccaataagataat

SEQ ID NO: 83316 - DNA, 24 bp, Artificial sequence
  SiRNA target sequence
atccatacacccaataagataata

SEQ ID NO: 83317 - DNA, 24 bp, Artificial sequence
  SiRNA target sequence
tccatacacccaataagataataa

SEQ ID NO: 83318 - DNA, 24 bp, Artificial sequence
  SiRNA target sequence
ccatacacccaataagataataag

SEQ ID NO: 83319 - DNA, 24 bp, Artificial sequence
  SiRNA target sequence
catacacccaataagataataagt

SEQ ID NO: 83320 - DNA, 24 bp, Artificial sequence
  SiRNA target sequence
atacacccaataagataataagtc

SEQ ID NO: 83321 - DNA, 24 bp, Artificial sequence
  SiRNA target sequence
tacacccaataagataataagtcc

SEQ ID NO: 83322 - DNA, 24 bp, Artificial sequence
  SiRNA target sequence
acacccaataagataataagtcct

SEQ ID NO: 83323 - DNA, 24 bp, Artificial sequence
  SiRNA target sequence
cacccaataagataataagtcctc

SEQ ID NO: 83324 - DNA, 24 bp, Artificial sequence
  SiRNA target sequence
acccaataagataataagtcctct

SEQ ID NO: 83325 - DNA, 24 bp, Artificial sequence
  SiRNA target sequence
cccaataagataataagtcctctt

SEQ ID NO: 83326 - DNA, 24 bp, Artificial sequence
  SiRNA target sequence
ccaataagataataagtcctctta

SEQ ID NO: 83327 - DNA, 24 bp, Artificial sequence
  SiRNA target sequence
caataagataataagtcctcttaa

SEQ ID NO: 83328 - DNA, 24 bp, Artificial sequence
  SiRNA target sequence
aataagataataagtcctcttaat

SEQ ID NO: 83329 - DNA, 24 bp, Artificial sequence
  SiRNA target sequence
ataagataataagtcctcttaata

SEQ ID NO: 83330 - DNA, 24 bp, Artificial sequence
  SiRNA target sequence
taagataataagtcctcttaatac

SEQ ID NO: 83331 - DNA, 24 bp, Artificial sequence
  SiRNA target sequence
aagataataagtcctcttaatact

SEQ ID NO: 83332 - DNA, 24 bp, Artificial sequence
  SiRNA target sequence
agataataagtcctcttaatactt

SEQ ID NO: 83333 - DNA, 24 bp, Artificial sequence
  SiRNA target sequence
gataataagtcctcttaatacttt

SEQ ID NO: 83334 - DNA, 24 bp, Artificial sequence
  SiRNA target sequence
ataataagtcctcttaatactttc

SEQ ID NO: 83335 - DNA, 24 bp, Artificial sequence
  SiRNA target sequence
taataagtcctcttaatactttct

SEQ ID NO: 83336 - DNA, 24 bp, Artificial sequence
  SiRNA target sequence
aataagtcctcttaatactttctg

SEQ ID NO: 83337 - DNA, 24 bp, Artificial sequence
  SiRNA target sequence
ataagtcctcttaatactttctgc

SEQ ID NO: 83338 - DNA, 24 bp, Artificial sequence
  SiRNA target sequence
taagtcctcttaatactttctgct

SEQ ID NO: 83339 - DNA, 24 bp, Artificial sequence
  SiRNA target sequence
aagtcctcttaatactttctgctc

SEQ ID NO: 83340 - DNA, 24 bp, Artificial sequence
  SiRNA target sequence
agtcctcttaatactttctgctct

SEQ ID NO: 83341 - DNA, 24 bp, Artificial sequence
  SiRNA target sequence
gtcctcttaatactttctgctctt

SEQ ID NO: 83342 - DNA, 24 bp, Artificial sequence
  SiRNA target sequence
tcctcttaatactttctgctcttt

SEQ ID NO: 83343 - DNA, 24 bp, Artificial sequence
  SiRNA target sequence
cctcttaatactttctgctctttg

SEQ ID NO: 83344 - DNA, 24 bp, Artificial sequence
  SiRNA target sequence
ctcttaatactttctgctctttgt

SEQ ID NO: 83345 - DNA, 24 bp, Artificial sequence
  SiRNA target sequence
tcttaatactttctgctctttgtt

SEQ ID NO: 83346 - DNA, 24 bp, Artificial sequence
  SiRNA target sequence
cttaatactttctgctctttgttc

SEQ ID NO: 83347 - DNA, 24 bp, Artificial sequence
  SiRNA target sequence
ttaatactttctgctctttgttca

SEQ ID NO: 83348 - DNA, 24 bp, Artificial sequence
  SiRNA target sequence
taatactttctgctctttgttcat

SEQ ID NO: 83349 - DNA, 25 bp, Artificial sequence
  SiRNA target sequence
ttattctggttcacaaccacaactc

SEQ ID NO: 83350 - DNA, 25 bp, Artificial sequence
  SiRNA target sequence
tattctggttcacaaccacaactcc

SEQ ID NO: 83351 - DNA, 25 bp, Artificial sequence
  SiRNA target sequence
attctggttcacaaccacaactcca

SEQ ID NO: 83352 - DNA, 25 bp, Artificial sequence
  SiRNA target sequence
ttctggttcacaaccacaactccaa

SEQ ID NO: 83353 - DNA, 25 bp, Artificial sequence
  SiRNA target sequence
tctggttcacaaccacaactccaaa

SEQ ID NO: 83354 - DNA, 25 bp, Artificial sequence
  SiRNA target sequence
ctggttcacaaccacaactccaaac

SEQ ID NO: 83355 - DNA, 25 bp, Artificial sequence
  SiRNA target sequence
tggttcacaaccacaactccaaaca

SEQ ID NO: 83356 - DNA, 25 bp, Artificial sequence
  SiRNA target sequence
ggttcacaaccacaactccaaacac

SEQ ID NO: 83357 - DNA, 25 bp, Artificial sequence
  SiRNA target sequence
gttcacaaccacaactccaaacacc

SEQ ID NO: 83358 - DNA, 25 bp, Artificial sequence
  SiRNA target sequence
ttcacaaccacaactccaaacacct

SEQ ID NO: 83359 - DNA, 25 bp, Artificial sequence
  SiRNA target sequence
tcacaaccacaactccaaacacctt

SEQ ID NO: 83360 - DNA, 25 bp, Artificial sequence
  SiRNA target sequence
cacaaccacaactccaaacaccttc

SEQ ID NO: 83361 - DNA, 25 bp, Artificial sequence
  SiRNA target sequence
acaaccacaactccaaacaccttct

SEQ ID NO: 83362 - DNA, 25 bp, Artificial sequence
  SiRNA target sequence
caaccacaactccaaacaccttcta

SEQ ID NO: 83363 - DNA, 25 bp, Artificial sequence
  SiRNA target sequence
aaccacaactccaaacaccttctac

SEQ ID NO: 83364 - DNA, 25 bp, Artificial sequence
  SiRNA target sequence
accacaactccaaacaccttctacc

SEQ ID NO: 83365 - DNA, 25 bp, Artificial sequence
  SiRNA target sequence
ccacaactccaaacaccttctacct

SEQ ID NO: 83366 - DNA, 25 bp, Artificial sequence
  SiRNA target sequence
cacaactccaaacaccttctacctt

SEQ ID NO: 83367 - DNA, 25 bp, Artificial sequence
  SiRNA target sequence
acaactccaaacaccttctaccttt

SEQ ID NO: 83368 - DNA, 25 bp, Artificial sequence
  SiRNA target sequence
caactccaaacaccttctacctttt

SEQ ID NO: 83369 - DNA, 25 bp, Artificial sequence
  SiRNA target sequence
aactccaaacaccttctaccttttt

SEQ ID NO: 83370 - DNA, 25 bp, Artificial sequence
  SiRNA target sequence
actccaaacaccttctaccttttta

SEQ ID NO: 83371 - DNA, 25 bp, Artificial sequence
  SiRNA target sequence
ctccaaacaccttctacctttttac

SEQ ID NO: 83372 - DNA, 25 bp, Artificial sequence
  SiRNA target sequence
tccaaacaccttctacctttttaca

SEQ ID NO: 83373 - DNA, 25 bp, Artificial sequence
  SiRNA target sequence
ccaaacaccttctacctttttacag

SEQ ID NO: 83374 - DNA, 25 bp, Artificial sequence
  SiRNA target sequence
caaacaccttctacctttttacagt

SEQ ID NO: 83375 - DNA, 25 bp, Artificial sequence
  SiRNA target sequence
aaacaccttctacctttttacagtc

SEQ ID NO: 83376 - DNA, 25 bp, Artificial sequence
  SiRNA target sequence
aacaccttctacctttttacagtcc

SEQ ID NO: 83377 - DNA, 25 bp, Artificial sequence
  SiRNA target sequence
acaccttctacctttttacagtcca

SEQ ID NO: 83378 - DNA, 25 bp, Artificial sequence
  SiRNA target sequence
caccttctacctttttacagtccat

SEQ ID NO: 83379 - DNA, 25 bp, Artificial sequence
  SiRNA target sequence
accttctacctttttacagtccata

SEQ ID NO: 83380 - DNA, 25 bp, Artificial sequence
  SiRNA target sequence
ccttctacctttttacagtccataa

SEQ ID NO: 83381 - DNA, 25 bp, Artificial sequence
  SiRNA target sequence
cttctacctttttacagtccataat

SEQ ID NO: 83382 - DNA, 25 bp, Artificial sequence
  SiRNA target sequence
ttctacctttttacagtccataatg

SEQ ID NO: 83383 - DNA, 25 bp, Artificial sequence
  SiRNA target sequence
tctacctttttacagtccataatgg

SEQ ID NO: 83384 - DNA, 25 bp, Artificial sequence
  SiRNA target sequence
ctacctttttacagtccataatggg

SEQ ID NO: 83385 - DNA, 25 bp, Artificial sequence
  SiRNA target sequence
tacctttttacagtccataatgggc

SEQ ID NO: 83386 - DNA, 25 bp, Artificial sequence
  SiRNA target sequence
acctttttacagtccataatgggct

SEQ ID NO: 83387 - DNA, 25 bp, Artificial sequence
  SiRNA target sequence
cctttttacagtccataatgggctt

SEQ ID NO: 83388 - DNA, 25 bp, Artificial sequence
  SiRNA target sequence
ctttttacagtccataatgggcttt

SEQ ID NO: 83389 - DNA, 25 bp, Artificial sequence
  SiRNA target sequence
tttttacagtccataatgggctttc

SEQ ID NO: 83390 - DNA, 25 bp, Artificial sequence
  SiRNA target sequence
ttttacagtccataatgggctttcc

SEQ ID NO: 83391 - DNA, 25 bp, Artificial sequence
  SiRNA target sequence
tttacagtccataatgggctttcct

SEQ ID NO: 83392 - DNA, 25 bp, Artificial sequence
  SiRNA target sequence
ttacagtccataatgggctttccta

SEQ ID NO: 83393 - DNA, 25 bp, Artificial sequence
  SiRNA target sequence
tacagtccataatgggctttcctaa

SEQ ID NO: 83394 - DNA, 25 bp, Artificial sequence
  SiRNA target sequence
acagtccataatgggctttcctaat

SEQ ID NO: 83395 - DNA, 25 bp, Artificial sequence
  SiRNA target sequence
cagtccataatgggctttcctaatc

SEQ ID NO: 83396 - DNA, 25 bp, Artificial sequence
  SiRNA target sequence
agtccataatgggctttcctaatct

SEQ ID NO: 83397 - DNA, 25 bp, Artificial sequence
  SiRNA target sequence
gtccataatgggctttcctaatctt

SEQ ID NO: 83398 - DNA, 25 bp, Artificial sequence
  SiRNA target sequence
tccataatgggctttcctaatcttt

SEQ ID NO: 83399 - DNA, 25 bp, Artificial sequence
  SiRNA target sequence
ccataatgggctttcctaatctttt

SEQ ID NO: 83400 - DNA, 25 bp, Artificial sequence
  SiRNA target sequence
cataatgggctttcctaatctttta

SEQ ID NO: 83401 - DNA, 25 bp, Artificial sequence
  SiRNA target sequence
ataatgggctttcctaatcttttat

SEQ ID NO: 83402 - DNA, 25 bp, Artificial sequence
  SiRNA target sequence
taatgggctttcctaatcttttatt

SEQ ID NO: 83403 - DNA, 25 bp, Artificial sequence
  SiRNA target sequence
aatgggctttcctaatcttttatta

SEQ ID NO: 83404 - DNA, 25 bp, Artificial sequence
  SiRNA target sequence
atgggctttcctaatcttttattaa

SEQ ID NO: 83405 - DNA, 25 bp, Artificial sequence
  SiRNA target sequence
tgggctttcctaatcttttattaac

SEQ ID NO: 83406 - DNA, 25 bp, Artificial sequence
  SiRNA target sequence
gggctttcctaatcttttattaact

SEQ ID NO: 83407 - DNA, 25 bp, Artificial sequence
  SiRNA target sequence
ggctttcctaatcttttattaacta

SEQ ID NO: 83408 - DNA, 25 bp, Artificial sequence
  SiRNA target sequence
gctttcctaatcttttattaactat

SEQ ID NO: 83409 - DNA, 25 bp, Artificial sequence
  SiRNA target sequence
ctttcctaatcttttattaactatg

SEQ ID NO: 83410 - DNA, 25 bp, Artificial sequence
  SiRNA target sequence
tttcctaatcttttattaactatgt

SEQ ID NO: 83411 - DNA, 25 bp, Artificial sequence
  SiRNA target sequence
ttcctaatcttttattaactatgtt

SEQ ID NO: 83412 - DNA, 25 bp, Artificial sequence
  SiRNA target sequence
tcctaatcttttattaactatgtta

SEQ ID NO: 83413 - DNA, 25 bp, Artificial sequence
  SiRNA target sequence
cctaatcttttattaactatgttat

SEQ ID NO: 83414 - DNA, 25 bp, Artificial sequence
  SiRNA target sequence
ctaatcttttattaactatgttatg

SEQ ID NO: 83415 - DNA, 25 bp, Artificial sequence
  SiRNA target sequence
taatcttttattaactatgttatgt

SEQ ID NO: 83416 - DNA, 25 bp, Artificial sequence
  SiRNA target sequence
aatcttttattaactatgttatgtg

SEQ ID NO: 83417 - DNA, 25 bp, Artificial sequence
  SiRNA target sequence
atcttttattaactatgttatgtgc

SEQ ID NO: 83418 - DNA, 25 bp, Artificial sequence
  SiRNA target sequence
tcttttattaactatgttatgtgct

SEQ ID NO: 83419 - DNA, 25 bp, Artificial sequence
  SiRNA target sequence
cttttattaactatgttatgtgctt

SEQ ID NO: 83420 - DNA, 25 bp, Artificial sequence
  SiRNA target sequence
ttttattaactatgttatgtgcttt

SEQ ID NO: 83421 - DNA, 25 bp, Artificial sequence
  SiRNA target sequence
tttattaactatgttatgtgcttta

SEQ ID NO: 83422 - DNA, 25 bp, Artificial sequence
  SiRNA target sequence
ttattaactatgttatgtgctttac

SEQ ID NO: 83423 - DNA, 25 bp, Artificial sequence
  SiRNA target sequence
tattaactatgttatgtgctttaca

SEQ ID NO: 83424 - DNA, 25 bp, Artificial sequence
  SiRNA target sequence
attaactatgttatgtgctttacat

SEQ ID NO: 83425 - DNA, 25 bp, Artificial sequence
  SiRNA target sequence
ttaactatgttatgtgctttacata

SEQ ID NO: 83426 - DNA, 25 bp, Artificial sequence
  SiRNA target sequence
taactatgttatgtgctttacatag

SEQ ID NO: 83427 - DNA, 25 bp, Artificial sequence
  SiRNA target sequence
aactatgttatgtgctttacatagc

SEQ ID NO: 83428 - DNA, 25 bp, Artificial sequence
  SiRNA target sequence
actatgttatgtgctttacatagcc

SEQ ID NO: 83429 - DNA, 25 bp, Artificial sequence
  SiRNA target sequence
ctatgttatgtgctttacatagcca

SEQ ID NO: 83430 - DNA, 25 bp, Artificial sequence
  SiRNA target sequence
tatgttatgtgctttacatagccac

SEQ ID NO: 83431 - DNA, 25 bp, Artificial sequence
  SiRNA target sequence
atgttatgtgctttacatagccact

SEQ ID NO: 83432 - DNA, 25 bp, Artificial sequence
  SiRNA target sequence
tgttatgtgctttacatagccactg

SEQ ID NO: 83433 - DNA, 25 bp, Artificial sequence
  SiRNA target sequence
gttatgtgctttacatagccactgg

SEQ ID NO: 83434 - DNA, 25 bp, Artificial sequence
  SiRNA target sequence
ttatgtgctttacatagccactgga

SEQ ID NO: 83435 - DNA, 25 bp, Artificial sequence
  SiRNA target sequence
tatgtgctttacatagccactggac

SEQ ID NO: 83436 - DNA, 25 bp, Artificial sequence
  SiRNA target sequence
atgtgctttacatagccactggaca

SEQ ID NO: 83437 - DNA, 25 bp, Artificial sequence
  SiRNA target sequence
tgtgctttacatagccactggacaa

SEQ ID NO: 83438 - DNA, 25 bp, Artificial sequence
  SiRNA target sequence
gtgctttacatagccactggacaaa

SEQ ID NO: 83439 - DNA, 25 bp, Artificial sequence
  SiRNA target sequence
tgctttacatagccactggacaaat

SEQ ID NO: 83440 - DNA, 25 bp, Artificial sequence
  SiRNA target sequence
gctttacatagccactggacaaatt

SEQ ID NO: 83441 - DNA, 25 bp, Artificial sequence
  SiRNA target sequence
ctttacatagccactggacaaattc

SEQ ID NO: 83442 - DNA, 25 bp, Artificial sequence
  SiRNA target sequence
tttacatagccactggacaaattcg

SEQ ID NO: 83443 - DNA, 25 bp, Artificial sequence
  SiRNA target sequence
ttacatagccactggacaaattcgt

SEQ ID NO: 83444 - DNA, 25 bp, Artificial sequence
  SiRNA target sequence
tacatagccactggacaaattcgtc

SEQ ID NO: 83445 - DNA, 25 bp, Artificial sequence
  SiRNA target sequence
acatagccactggacaaattcgtca

SEQ ID NO: 83446 - DNA, 25 bp, Artificial sequence
  SiRNA target sequence
catagccactggacaaattcgtcat

SEQ ID NO: 83447 - DNA, 25 bp, Artificial sequence
  SiRNA target sequence
atagccactggacaaattcgtcatg

SEQ ID NO: 83448 - DNA, 25 bp, Artificial sequence
  SiRNA target sequence
tagccactggacaaattcgtcatgt

SEQ ID NO: 83449 - DNA, 25 bp, Artificial sequence
  SiRNA target sequence
agccactggacaaattcgtcatgtg

SEQ ID NO: 83450 - DNA, 25 bp, Artificial sequence
  SiRNA target sequence
gccactggacaaattcgtcatgtgt

SEQ ID NO: 83451 - DNA, 25 bp, Artificial sequence
  SiRNA target sequence
ccactggacaaattcgtcatgtgtg

SEQ ID NO: 83452 - DNA, 25 bp, Artificial sequence
  SiRNA target sequence
cactggacaaattcgtcatgtgtgg

SEQ ID NO: 83453 - DNA, 25 bp, Artificial sequence
  SiRNA target sequence
actggacaaattcgtcatgtgtggc

SEQ ID NO: 83454 - DNA, 25 bp, Artificial sequence
  SiRNA target sequence
ctggacaaattcgtcatgtgtggca

SEQ ID NO: 83455 - DNA, 25 bp, Artificial sequence
  SiRNA target sequence
tggacaaattcgtcatgtgtggcaa

SEQ ID NO: 83456 - DNA, 25 bp, Artificial sequence
  SiRNA target sequence
ggacaaattcgtcatgtgtggcaac

SEQ ID NO: 83457 - DNA, 25 bp, Artificial sequence
  SiRNA target sequence
gacaaattcgtcatgtgtggcaact

SEQ ID NO: 83458 - DNA, 25 bp, Artificial sequence
  SiRNA target sequence
acaaattcgtcatgtgtggcaactt

SEQ ID NO: 83459 - DNA, 25 bp, Artificial sequence
  SiRNA target sequence
caaattcgtcatgtgtggcaacttg

SEQ ID NO: 83460 - DNA, 25 bp, Artificial sequence
  SiRNA target sequence
aaattcgtcatgtgtggcaacttgt

SEQ ID NO: 83461 - DNA, 25 bp, Artificial sequence
  SiRNA target sequence
aattcgtcatgtgtggcaacttgtg

SEQ ID NO: 83462 - DNA, 25 bp, Artificial sequence
  SiRNA target sequence
attcgtcatgtgtggcaacttgtgg

SEQ ID NO: 83463 - DNA, 25 bp, Artificial sequence
  SiRNA target sequence
ttcgtcatgtgtggcaacttgtgga

SEQ ID NO: 83464 - DNA, 25 bp, Artificial sequence
  SiRNA target sequence
tcgtcatgtgtggcaacttgtggag

SEQ ID NO: 83465 - DNA, 25 bp, Artificial sequence
  SiRNA target sequence
cgtcatgtgtggcaacttgtggagg

SEQ ID NO: 83466 - DNA, 25 bp, Artificial sequence
  SiRNA target sequence
gtcatgtgtggcaacttgtggagga

SEQ ID NO: 83467 - DNA, 25 bp, Artificial sequence
  SiRNA target sequence
tcatgtgtggcaacttgtggaggat

SEQ ID NO: 83468 - DNA, 25 bp, Artificial sequence
  SiRNA target sequence
catgtgtggcaacttgtggaggatt

SEQ ID NO: 83469 - DNA, 25 bp, Artificial sequence
  SiRNA target sequence
atgtgtggcaacttgtggaggattt

SEQ ID NO: 83470 - DNA, 25 bp, Artificial sequence
  SiRNA target sequence
tgtgtggcaacttgtggaggattta

SEQ ID NO: 83471 - DNA, 25 bp, Artificial sequence
  SiRNA target sequence
gtgtggcaacttgtggaggatttaa

SEQ ID NO: 83472 - DNA, 25 bp, Artificial sequence
  SiRNA target sequence
tgtggcaacttgtggaggatttaag

SEQ ID NO: 83473 - DNA, 25 bp, Artificial sequence
  SiRNA target sequence
gtggcaacttgtggaggatttaagc

SEQ ID NO: 83474 - DNA, 25 bp, Artificial sequence
  SiRNA target sequence
tggcaacttgtggaggatttaagct

SEQ ID NO: 83475 - DNA, 25 bp, Artificial sequence
  SiRNA target sequence
ggcaacttgtggaggatttaagctt

SEQ ID NO: 83476 - DNA, 25 bp, Artificial sequence
  SiRNA target sequence
gcaacttgtggaggatttaagctta

SEQ ID NO: 83477 - DNA, 25 bp, Artificial sequence
  SiRNA target sequence
caacttgtggaggatttaagcttaa

SEQ ID NO: 83478 - DNA, 25 bp, Artificial sequence
  SiRNA target sequence
aacttgtggaggatttaagcttaac

SEQ ID NO: 83479 - DNA, 25 bp, Artificial sequence
  SiRNA target sequence
acttgtggaggatttaagcttaaca

SEQ ID NO: 83480 - DNA, 25 bp, Artificial sequence
  SiRNA target sequence
cttgtggaggatttaagcttaacag

SEQ ID NO: 83481 - DNA, 25 bp, Artificial sequence
  SiRNA target sequence
ttgtggaggatttaagcttaacagt

SEQ ID NO: 83482 - DNA, 25 bp, Artificial sequence
  SiRNA target sequence
tgtggaggatttaagcttaacagtc

SEQ ID NO: 83483 - DNA, 25 bp, Artificial sequence
  SiRNA target sequence
gtggaggatttaagcttaacagtct

SEQ ID NO: 83484 - DNA, 25 bp, Artificial sequence
  SiRNA target sequence
tggaggatttaagcttaacagtctt

SEQ ID NO: 83485 - DNA, 25 bp, Artificial sequence
  SiRNA target sequence
ggaggatttaagcttaacagtcttt

SEQ ID NO: 83486 - DNA, 25 bp, Artificial sequence
  SiRNA target sequence
gaggatttaagcttaacagtctttg

SEQ ID NO: 83487 - DNA, 25 bp, Artificial sequence
  SiRNA target sequence
aggatttaagcttaacagtctttga

SEQ ID NO: 83488 - DNA, 25 bp, Artificial sequence
  SiRNA target sequence
ggatttaagcttaacagtctttgaa

SEQ ID NO: 83489 - DNA, 25 bp, Artificial sequence
  SiRNA target sequence
gatttaagcttaacagtctttgaaa

SEQ ID NO: 83490 - DNA, 25 bp, Artificial sequence
  SiRNA target sequence
atttaagcttaacagtctttgaaaa

SEQ ID NO: 83491 - DNA, 25 bp, Artificial sequence
  SiRNA target sequence
tttaagcttaacagtctttgaaaat

SEQ ID NO: 83492 - DNA, 25 bp, Artificial sequence
  SiRNA target sequence
ttaagcttaacagtctttgaaaatg

SEQ ID NO: 83493 - DNA, 25 bp, Artificial sequence
  SiRNA target sequence
taagcttaacagtctttgaaaatgt

SEQ ID NO: 83494 - DNA, 25 bp, Artificial sequence
  SiRNA target sequence
aagcttaacagtctttgaaaatgtc

SEQ ID NO: 83495 - DNA, 25 bp, Artificial sequence
  SiRNA target sequence
agcttaacagtctttgaaaatgtcc

SEQ ID NO: 83496 - DNA, 25 bp, Artificial sequence
  SiRNA target sequence
gcttaacagtctttgaaaatgtcca

SEQ ID NO: 83497 - DNA, 25 bp, Artificial sequence
  SiRNA target sequence
cttaacagtctttgaaaatgtccac

SEQ ID NO: 83498 - DNA, 25 bp, Artificial sequence
  SiRNA target sequence
ttaacagtctttgaaaatgtccaca

SEQ ID NO: 83499 - DNA, 25 bp, Artificial sequence
  SiRNA target sequence
taacagtctttgaaaatgtccacaa

SEQ ID NO: 83500 - DNA, 25 bp, Artificial sequence
  SiRNA target sequence
aacagtctttgaaaatgtccacaac

SEQ ID NO: 83501 - DNA, 25 bp, Artificial sequence
  SiRNA target sequence
acagtctttgaaaatgtccacaaca

SEQ ID NO: 83502 - DNA, 25 bp, Artificial sequence
  SiRNA target sequence
cagtctttgaaaatgtccacaacat

SEQ ID NO: 83503 - DNA, 25 bp, Artificial sequence
  SiRNA target sequence
agtctttgaaaatgtccacaacatt

SEQ ID NO: 83504 - DNA, 25 bp, Artificial sequence
  SiRNA target sequence
gtctttgaaaatgtccacaacattc

SEQ ID NO: 83505 - DNA, 25 bp, Artificial sequence
  SiRNA target sequence
tctttgaaaatgtccacaacattct

SEQ ID NO: 83506 - DNA, 25 bp, Artificial sequence
  SiRNA target sequence
ctttgaaaatgtccacaacattctg

SEQ ID NO: 83507 - DNA, 25 bp, Artificial sequence
  SiRNA target sequence
tttgaaaatgtccacaacattctgc

SEQ ID NO: 83508 - DNA, 25 bp, Artificial sequence
  SiRNA target sequence
ttgaaaatgtccacaacattctgca

SEQ ID NO: 83509 - DNA, 25 bp, Artificial sequence
  SiRNA target sequence
tgaaaatgtccacaacattctgcac

SEQ ID NO: 83510 - DNA, 25 bp, Artificial sequence
  SiRNA target sequence
gaaaatgtccacaacattctgcaca

SEQ ID NO: 83511 - DNA, 25 bp, Artificial sequence
  SiRNA target sequence
aaaatgtccacaacattctgcacag

SEQ ID NO: 83512 - DNA, 25 bp, Artificial sequence
  SiRNA target sequence
aaatgtccacaacattctgcacagg

SEQ ID NO: 83513 - DNA, 25 bp, Artificial sequence
  SiRNA target sequence
aatgtccacaacattctgcacaggg

SEQ ID NO: 83514 - DNA, 25 bp, Artificial sequence
  SiRNA target sequence
atgtccacaacattctgcacagggg

SEQ ID NO: 83515 - DNA, 25 bp, Artificial sequence
  SiRNA target sequence
tgtccacaacattctgcacagggga

SEQ ID NO: 83516 - DNA, 25 bp, Artificial sequence
  SiRNA target sequence
gtccacaacattctgcacaggggaa

SEQ ID NO: 83517 - DNA, 25 bp, Artificial sequence
  SiRNA target sequence
tccacaacattctgcacaggggaaa

SEQ ID NO: 83518 - DNA, 25 bp, Artificial sequence
  SiRNA target sequence
ccacaacattctgcacaggggaaaa

SEQ ID NO: 83519 - DNA, 25 bp, Artificial sequence
  SiRNA target sequence
cacaacattctgcacaggggaaaag

SEQ ID NO: 83520 - DNA, 25 bp, Artificial sequence
  SiRNA target sequence
acaacattctgcacaggggaaaaga

SEQ ID NO: 83521 - DNA, 25 bp, Artificial sequence
  SiRNA target sequence
caacattctgcacaggggaaaagag

SEQ ID NO: 83522 - DNA, 25 bp, Artificial sequence
  SiRNA target sequence
aacattctgcacaggggaaaagaga

SEQ ID NO: 83523 - DNA, 25 bp, Artificial sequence
  SiRNA target sequence
acattctgcacaggggaaaagagat

SEQ ID NO: 83524 - DNA, 25 bp, Artificial sequence
  SiRNA target sequence
cattctgcacaggggaaaagagatg

SEQ ID NO: 83525 - DNA, 25 bp, Artificial sequence
  SiRNA target sequence
attctgcacaggggaaaagagatga

SEQ ID NO: 83526 - DNA, 25 bp, Artificial sequence
  SiRNA target sequence
ttctgcacaggggaaaagagatgat

SEQ ID NO: 83527 - DNA, 25 bp, Artificial sequence
  SiRNA target sequence
tctgcacaggggaaaagagatgata

SEQ ID NO: 83528 - DNA, 25 bp, Artificial sequence
  SiRNA target sequence
ctgcacaggggaaaagagatgataa

SEQ ID NO: 83529 - DNA, 25 bp, Artificial sequence
  SiRNA target sequence
tgcacaggggaaaagagatgataaa

SEQ ID NO: 83530 - DNA, 25 bp, Artificial sequence
  SiRNA target sequence
gcacaggggaaaagagatgataaaa

SEQ ID NO: 83531 - DNA, 25 bp, Artificial sequence
  SiRNA target sequence
cacaggggaaaagagatgataaaag

SEQ ID NO: 83532 - DNA, 25 bp, Artificial sequence
  SiRNA target sequence
acaggggaaaagagatgataaaagg

SEQ ID NO: 83533 - DNA, 25 bp, Artificial sequence
  SiRNA target sequence
caggggaaaagagatgataaaaggt

SEQ ID NO: 83534 - DNA, 25 bp, Artificial sequence
  SiRNA target sequence
aggggaaaagagatgataaaaggta

SEQ ID NO: 83535 - DNA, 25 bp, Artificial sequence
  SiRNA target sequence
ggggaaaagagatgataaaaggtaa

SEQ ID NO: 83536 - DNA, 25 bp, Artificial sequence
  SiRNA target sequence
gggaaaagagatgataaaaggtaaa

SEQ ID NO: 83537 - DNA, 25 bp, Artificial sequence
  SiRNA target sequence
ggaaaagagatgataaaaggtaaat

SEQ ID NO: 83538 - DNA, 25 bp, Artificial sequence
  SiRNA target sequence
gaaaagagatgataaaaggtaaata

SEQ ID NO: 83539 - DNA, 25 bp, Artificial sequence
  SiRNA target sequence
aaaagagatgataaaaggtaaataa

SEQ ID NO: 83540 - DNA, 25 bp, Artificial sequence
  SiRNA target sequence
aaagagatgataaaaggtaaataaa

SEQ ID NO: 83541 - DNA, 25 bp, Artificial sequence
  SiRNA target sequence
aagagatgataaaaggtaaataaat

SEQ ID NO: 83542 - DNA, 25 bp, Artificial sequence
  SiRNA target sequence
agagatgataaaaggtaaataaatt

SEQ ID NO: 83543 - DNA, 25 bp, Artificial sequence
  SiRNA target sequence
gagatgataaaaggtaaataaattg

SEQ ID NO: 83544 - DNA, 25 bp, Artificial sequence
  SiRNA target sequence
agatgataaaaggtaaataaattga

SEQ ID NO: 83545 - DNA, 25 bp, Artificial sequence
  SiRNA target sequence
gatgataaaaggtaaataaattgaa

SEQ ID NO: 83546 - DNA, 25 bp, Artificial sequence
  SiRNA target sequence
atgataaaaggtaaataaattgaag

SEQ ID NO: 83547 - DNA, 25 bp, Artificial sequence
  SiRNA target sequence
tgataaaaggtaaataaattgaagt

SEQ ID NO: 83548 - DNA, 25 bp, Artificial sequence
  SiRNA target sequence
gataaaaggtaaataaattgaagtg

SEQ ID NO: 83549 - DNA, 25 bp, Artificial sequence
  SiRNA target sequence
ataaaaggtaaataaattgaagtgt

SEQ ID NO: 83550 - DNA, 25 bp, Artificial sequence
  SiRNA target sequence
taaaaggtaaataaattgaagtgta

SEQ ID NO: 83551 - DNA, 25 bp, Artificial sequence
  SiRNA target sequence
aaaaggtaaataaattgaagtgtat

SEQ ID NO: 83552 - DNA, 25 bp, Artificial sequence
  SiRNA target sequence
aaaggtaaataaattgaagtgtatc

SEQ ID NO: 83553 - DNA, 25 bp, Artificial sequence
  SiRNA target sequence
aaggtaaataaattgaagtgtatct

SEQ ID NO: 83554 - DNA, 25 bp, Artificial sequence
  SiRNA target sequence
aggtaaataaattgaagtgtatctt

SEQ ID NO: 83555 - DNA, 25 bp, Artificial sequence
  SiRNA target sequence
ggtaaataaattgaagtgtatcttt

SEQ ID NO: 83556 - DNA, 25 bp, Artificial sequence
  SiRNA target sequence
gtaaataaattgaagtgtatctttt

SEQ ID NO: 83557 - DNA, 25 bp, Artificial sequence
  SiRNA target sequence
taaataaattgaagtgtatcttttt

SEQ ID NO: 83558 - DNA, 25 bp, Artificial sequence
  SiRNA target sequence
aaataaattgaagtgtatctttttt

SEQ ID NO: 83559 - DNA, 25 bp, Artificial sequence
  SiRNA target sequence
aataaattgaagtgtatctttttta

SEQ ID NO: 83560 - DNA, 25 bp, Artificial sequence
  SiRNA target sequence
ataaattgaagtgtatcttttttat

SEQ ID NO: 83561 - DNA, 25 bp, Artificial sequence
  SiRNA target sequence
taaattgaagtgtatcttttttatg

SEQ ID NO: 83562 - DNA, 25 bp, Artificial sequence
  SiRNA target sequence
aaattgaagtgtatcttttttatgt

SEQ ID NO: 83563 - DNA, 25 bp, Artificial sequence
  SiRNA target sequence
aattgaagtgtatcttttttatgtt

SEQ ID NO: 83564 - DNA, 25 bp, Artificial sequence
  SiRNA target sequence
attgaagtgtatcttttttatgttg

SEQ ID NO: 83565 - DNA, 25 bp, Artificial sequence
  SiRNA target sequence
ttgaagtgtatcttttttatgttgt

SEQ ID NO: 83566 - DNA, 25 bp, Artificial sequence
  SiRNA target sequence
tgaagtgtatcttttttatgttgta

SEQ ID NO: 83567 - DNA, 25 bp, Artificial sequence
  SiRNA target sequence
gaagtgtatcttttttatgttgtac

SEQ ID NO: 83568 - DNA, 25 bp, Artificial sequence
  SiRNA target sequence
aagtgtatcttttttatgttgtact

SEQ ID NO: 83569 - DNA, 25 bp, Artificial sequence
  SiRNA target sequence
agtgtatcttttttatgttgtactg

SEQ ID NO: 83570 - DNA, 25 bp, Artificial sequence
  SiRNA target sequence
gtgtatcttttttatgttgtactgt

SEQ ID NO: 83571 - DNA, 25 bp, Artificial sequence
  SiRNA target sequence
tgtatcttttttatgttgtactgta

SEQ ID NO: 83572 - DNA, 25 bp, Artificial sequence
  SiRNA target sequence
gtatcttttttatgttgtactgtag

SEQ ID NO: 83573 - DNA, 25 bp, Artificial sequence
  SiRNA target sequence
tatcttttttatgttgtactgtagg

SEQ ID NO: 83574 - DNA, 25 bp, Artificial sequence
  SiRNA target sequence
atcttttttatgttgtactgtagga

SEQ ID NO: 83575 - DNA, 25 bp, Artificial sequence
  SiRNA target sequence
tcttttttatgttgtactgtaggaa

SEQ ID NO: 83576 - DNA, 25 bp, Artificial sequence
  SiRNA target sequence
cttttttatgttgtactgtaggaaa

SEQ ID NO: 83577 - DNA, 25 bp, Artificial sequence
  SiRNA target sequence
ttttttatgttgtactgtaggaaat

SEQ ID NO: 83578 - DNA, 25 bp, Artificial sequence
  SiRNA target sequence
tttttatgttgtactgtaggaaatg

SEQ ID NO: 83579 - DNA, 25 bp, Artificial sequence
  SiRNA target sequence
ttttatgttgtactgtaggaaatgc

SEQ ID NO: 83580 - DNA, 25 bp, Artificial sequence
  SiRNA target sequence
tttatgttgtactgtaggaaatgca

SEQ ID NO: 83581 - DNA, 25 bp, Artificial sequence
  SiRNA target sequence
ttatgttgtactgtaggaaatgcag

SEQ ID NO: 83582 - DNA, 25 bp, Artificial sequence
  SiRNA target sequence
tatgttgtactgtaggaaatgcagg

SEQ ID NO: 83583 - DNA, 25 bp, Artificial sequence
  SiRNA target sequence
atgttgtactgtaggaaatgcagga

SEQ ID NO: 83584 - DNA, 25 bp, Artificial sequence
  SiRNA target sequence
tgttgtactgtaggaaatgcaggat

SEQ ID NO: 83585 - DNA, 25 bp, Artificial sequence
  SiRNA target sequence
gttgtactgtaggaaatgcaggata

SEQ ID NO: 83586 - DNA, 25 bp, Artificial sequence
  SiRNA target sequence
ttgtactgtaggaaatgcaggataa

SEQ ID NO: 83587 - DNA, 25 bp, Artificial sequence
  SiRNA target sequence
tgtactgtaggaaatgcaggataaa

SEQ ID NO: 83588 - DNA, 25 bp, Artificial sequence
  SiRNA target sequence
gtactgtaggaaatgcaggataaac

SEQ ID NO: 83589 - DNA, 25 bp, Artificial sequence
  SiRNA target sequence
tactgtaggaaatgcaggataaaca

SEQ ID NO: 83590 - DNA, 25 bp, Artificial sequence
  SiRNA target sequence
actgtaggaaatgcaggataaacag

SEQ ID NO: 83591 - DNA, 25 bp, Artificial sequence
  SiRNA target sequence
ctgtaggaaatgcaggataaacagc

SEQ ID NO: 83592 - DNA, 25 bp, Artificial sequence
  SiRNA target sequence
tgtaggaaatgcaggataaacagct

SEQ ID NO: 83593 - DNA, 25 bp, Artificial sequence
  SiRNA target sequence
gtaggaaatgcaggataaacagctg

SEQ ID NO: 83594 - DNA, 25 bp, Artificial sequence
  SiRNA target sequence
taggaaatgcaggataaacagctgc

SEQ ID NO: 83595 - DNA, 25 bp, Artificial sequence
  SiRNA target sequence
aggaaatgcaggataaacagctgcc

SEQ ID NO: 83596 - DNA, 25 bp, Artificial sequence
  SiRNA target sequence
ggaaatgcaggataaacagctgcca

SEQ ID NO: 83597 - DNA, 25 bp, Artificial sequence
  SiRNA target sequence
gaaatgcaggataaacagctgccat

SEQ ID NO: 83598 - DNA, 25 bp, Artificial sequence
  SiRNA target sequence
aaatgcaggataaacagctgccatg

SEQ ID NO: 83599 - DNA, 25 bp, Artificial sequence
  SiRNA target sequence
aatgcaggataaacagctgccatgg

SEQ ID NO: 83600 - DNA, 25 bp, Artificial sequence
  SiRNA target sequence
atgcaggataaacagctgccatggt

SEQ ID NO: 83601 - DNA, 25 bp, Artificial sequence
  SiRNA target sequence
tgcaggataaacagctgccatggta

SEQ ID NO: 83602 - DNA, 25 bp, Artificial sequence
  SiRNA target sequence
gcaggataaacagctgccatggtat

SEQ ID NO: 83603 - DNA, 25 bp, Artificial sequence
  SiRNA target sequence
caggataaacagctgccatggtatg

SEQ ID NO: 83604 - DNA, 25 bp, Artificial sequence
  SiRNA target sequence
aggataaacagctgccatggtatgt

SEQ ID NO: 83605 - DNA, 25 bp, Artificial sequence
  SiRNA target sequence
ggataaacagctgccatggtatgta

SEQ ID NO: 83606 - DNA, 25 bp, Artificial sequence
  SiRNA target sequence
gataaacagctgccatggtatgtaa

SEQ ID NO: 83607 - DNA, 25 bp, Artificial sequence
  SiRNA target sequence
ataaacagctgccatggtatgtaaa

SEQ ID NO: 83608 - DNA, 25 bp, Artificial sequence
  SiRNA target sequence
taaacagctgccatggtatgtaaaa

SEQ ID NO: 83609 - DNA, 25 bp, Artificial sequence
  SiRNA target sequence
aaacagctgccatggtatgtaaaag

SEQ ID NO: 83610 - DNA, 25 bp, Artificial sequence
  SiRNA target sequence
aacagctgccatggtatgtaaaagt

SEQ ID NO: 83611 - DNA, 25 bp, Artificial sequence
  SiRNA target sequence
acagctgccatggtatgtaaaagtg

SEQ ID NO: 83612 - DNA, 25 bp, Artificial sequence
  SiRNA target sequence
cagctgccatggtatgtaaaagtgt

SEQ ID NO: 83613 - DNA, 25 bp, Artificial sequence
  SiRNA target sequence
agctgccatggtatgtaaaagtgtc

SEQ ID NO: 83614 - DNA, 25 bp, Artificial sequence
  SiRNA target sequence
gctgccatggtatgtaaaagtgtcc

SEQ ID NO: 83615 - DNA, 25 bp, Artificial sequence
  SiRNA target sequence
ctgccatggtatgtaaaagtgtcca

SEQ ID NO: 83616 - DNA, 25 bp, Artificial sequence
  SiRNA target sequence
tgccatggtatgtaaaagtgtccat

SEQ ID NO: 83617 - DNA, 25 bp, Artificial sequence
  SiRNA target sequence
gccatggtatgtaaaagtgtccatg

SEQ ID NO: 83618 - DNA, 25 bp, Artificial sequence
  SiRNA target sequence
ccatggtatgtaaaagtgtccatgt

SEQ ID NO: 83619 - DNA, 25 bp, Artificial sequence
  SiRNA target sequence
catggtatgtaaaagtgtccatgtt

SEQ ID NO: 83620 - DNA, 25 bp, Artificial sequence
  SiRNA target sequence
atggtatgtaaaagtgtccatgttg

SEQ ID NO: 83621 - DNA, 25 bp, Artificial sequence
  SiRNA target sequence
tggtatgtaaaagtgtccatgttgc

SEQ ID NO: 83622 - DNA, 25 bp, Artificial sequence
  SiRNA target sequence
ggtatgtaaaagtgtccatgttgct

SEQ ID NO: 83623 - DNA, 25 bp, Artificial sequence
  SiRNA target sequence
gtatgtaaaagtgtccatgttgctc

SEQ ID NO: 83624 - DNA, 25 bp, Artificial sequence
  SiRNA target sequence
tatgtaaaagtgtccatgttgctct

SEQ ID NO: 83625 - DNA, 25 bp, Artificial sequence
  SiRNA target sequence
atgtaaaagtgtccatgttgctctc

SEQ ID NO: 83626 - DNA, 25 bp, Artificial sequence
  SiRNA target sequence
tgtaaaagtgtccatgttgctctcc

SEQ ID NO: 83627 - DNA, 25 bp, Artificial sequence
  SiRNA target sequence
gtaaaagtgtccatgttgctctccc

SEQ ID NO: 83628 - DNA, 25 bp, Artificial sequence
  SiRNA target sequence
taaaagtgtccatgttgctctcccc

SEQ ID NO: 83629 - DNA, 25 bp, Artificial sequence
  SiRNA target sequence
aaaagtgtccatgttgctctcccca

SEQ ID NO: 83630 - DNA, 25 bp, Artificial sequence
  SiRNA target sequence
aaagtgtccatgttgctctccccaa

SEQ ID NO: 83631 - DNA, 25 bp, Artificial sequence
  SiRNA target sequence
aagtgtccatgttgctctccccaat

SEQ ID NO: 83632 - DNA, 25 bp, Artificial sequence
  SiRNA target sequence
agtgtccatgttgctctccccaatc

SEQ ID NO: 83633 - DNA, 25 bp, Artificial sequence
  SiRNA target sequence
gtgtccatgttgctctccccaatct

SEQ ID NO: 83634 - DNA, 25 bp, Artificial sequence
  SiRNA target sequence
tgtccatgttgctctccccaatcta

SEQ ID NO: 83635 - DNA, 25 bp, Artificial sequence
  SiRNA target sequence
gtccatgttgctctccccaatctat

SEQ ID NO: 83636 - DNA, 25 bp, Artificial sequence
  SiRNA target sequence
tccatgttgctctccccaatctatc

SEQ ID NO: 83637 - DNA, 25 bp, Artificial sequence
  SiRNA target sequence
ccatgttgctctccccaatctatct

SEQ ID NO: 83638 - DNA, 25 bp, Artificial sequence
  SiRNA target sequence
catgttgctctccccaatctatctt

SEQ ID NO: 83639 - DNA, 25 bp, Artificial sequence
  SiRNA target sequence
atgttgctctccccaatctatcttt

SEQ ID NO: 83640 - DNA, 25 bp, Artificial sequence
  SiRNA target sequence
tgttgctctccccaatctatcttta

SEQ ID NO: 83641 - DNA, 25 bp, Artificial sequence
  SiRNA target sequence
gttgctctccccaatctatctttaa

SEQ ID NO: 83642 - DNA, 25 bp, Artificial sequence
  SiRNA target sequence
ttgctctccccaatctatctttaac

SEQ ID NO: 83643 - DNA, 25 bp, Artificial sequence
  SiRNA target sequence
tgctctccccaatctatctttaact

SEQ ID NO: 83644 - DNA, 25 bp, Artificial sequence
  SiRNA target sequence
gctctccccaatctatctttaactt

SEQ ID NO: 83645 - DNA, 25 bp, Artificial sequence
  SiRNA target sequence
ctctccccaatctatctttaacttc

SEQ ID NO: 83646 - DNA, 25 bp, Artificial sequence
  SiRNA target sequence
tctccccaatctatctttaacttcc

SEQ ID NO: 83647 - DNA, 25 bp, Artificial sequence
  SiRNA target sequence
ctccccaatctatctttaacttcct

SEQ ID NO: 83648 - DNA, 25 bp, Artificial sequence
  SiRNA target sequence
tccccaatctatctttaacttcctt

SEQ ID NO: 83649 - DNA, 25 bp, Artificial sequence
  SiRNA target sequence
ccccaatctatctttaacttcctta

SEQ ID NO: 83650 - DNA, 25 bp, Artificial sequence
  SiRNA target sequence
cccaatctatctttaacttccttat

SEQ ID NO: 83651 - DNA, 25 bp, Artificial sequence
  SiRNA target sequence
ccaatctatctttaacttccttatt

SEQ ID NO: 83652 - DNA, 25 bp, Artificial sequence
  SiRNA target sequence
caatctatctttaacttccttattt

SEQ ID NO: 83653 - DNA, 25 bp, Artificial sequence
  SiRNA target sequence
aatctatctttaacttccttatttg

SEQ ID NO: 83654 - DNA, 25 bp, Artificial sequence
  SiRNA target sequence
atctatctttaacttccttatttgt

SEQ ID NO: 83655 - DNA, 25 bp, Artificial sequence
  SiRNA target sequence
tctatctttaacttccttatttgtt

SEQ ID NO: 83656 - DNA, 25 bp, Artificial sequence
  SiRNA target sequence
ctatctttaacttccttatttgtta

SEQ ID NO: 83657 - DNA, 25 bp, Artificial sequence
  SiRNA target sequence
tatctttaacttccttatttgttaa

SEQ ID NO: 83658 - DNA, 25 bp, Artificial sequence
  SiRNA target sequence
atctttaacttccttatttgttaat

SEQ ID NO: 83659 - DNA, 25 bp, Artificial sequence
  SiRNA target sequence
tctttaacttccttatttgttaatt

SEQ ID NO: 83660 - DNA, 25 bp, Artificial sequence
  SiRNA target sequence
ctttaacttccttatttgttaattt

SEQ ID NO: 83661 - DNA, 25 bp, Artificial sequence
  SiRNA target sequence
tttaacttccttatttgttaatttt

SEQ ID NO: 83662 - DNA, 25 bp, Artificial sequence
  SiRNA target sequence
ttaacttccttatttgttaattttt

SEQ ID NO: 83663 - DNA, 25 bp, Artificial sequence
  SiRNA target sequence
taacttccttatttgttaatttttg

SEQ ID NO: 83664 - DNA, 25 bp, Artificial sequence
  SiRNA target sequence
aacttccttatttgttaatttttga

SEQ ID NO: 83665 - DNA, 25 bp, Artificial sequence
  SiRNA target sequence
acttccttatttgttaatttttgat

SEQ ID NO: 83666 - DNA, 25 bp, Artificial sequence
  SiRNA target sequence
cttccttatttgttaatttttgatt

SEQ ID NO: 83667 - DNA, 25 bp, Artificial sequence
  SiRNA target sequence
ttccttatttgttaatttttgatta

SEQ ID NO: 83668 - DNA, 25 bp, Artificial sequence
  SiRNA target sequence
tccttatttgttaatttttgattat

SEQ ID NO: 83669 - DNA, 25 bp, Artificial sequence
  SiRNA target sequence
ccttatttgttaatttttgattatg

SEQ ID NO: 83670 - DNA, 25 bp, Artificial sequence
  SiRNA target sequence
cttatttgttaatttttgattatga

SEQ ID NO: 83671 - DNA, 25 bp, Artificial sequence
  SiRNA target sequence
ttatttgttaatttttgattatgaa

SEQ ID NO: 83672 - DNA, 25 bp, Artificial sequence
  SiRNA target sequence
tatttgttaatttttgattatgaat

SEQ ID NO: 83673 - DNA, 25 bp, Artificial sequence
  SiRNA target sequence
atttgttaatttttgattatgaatt

SEQ ID NO: 83674 - DNA, 25 bp, Artificial sequence
  SiRNA target sequence
tttgttaatttttgattatgaatta

SEQ ID NO: 83675 - DNA, 25 bp, Artificial sequence
  SiRNA target sequence
ttgttaatttttgattatgaattag

SEQ ID NO: 83676 - DNA, 25 bp, Artificial sequence
  SiRNA target sequence
tgttaatttttgattatgaattaga

SEQ ID NO: 83677 - DNA, 25 bp, Artificial sequence
  SiRNA target sequence
gttaatttttgattatgaattagac

SEQ ID NO: 83678 - DNA, 25 bp, Artificial sequence
  SiRNA target sequence
ttaatttttgattatgaattagacc

SEQ ID NO: 83679 - DNA, 25 bp, Artificial sequence
  SiRNA target sequence
taatttttgattatgaattagacct

SEQ ID NO: 83680 - DNA, 25 bp, Artificial sequence
  SiRNA target sequence
aatttttgattatgaattagaccta

SEQ ID NO: 83681 - DNA, 25 bp, Artificial sequence
  SiRNA target sequence
atttttgattatgaattagacctaa

SEQ ID NO: 83682 - DNA, 25 bp, Artificial sequence
  SiRNA target sequence
tttttgattatgaattagacctaat

SEQ ID NO: 83683 - DNA, 25 bp, Artificial sequence
  SiRNA target sequence
ttttgattatgaattagacctaatt

SEQ ID NO: 83684 - DNA, 25 bp, Artificial sequence
  SiRNA target sequence
tttgattatgaattagacctaattc

SEQ ID NO: 83685 - DNA, 25 bp, Artificial sequence
  SiRNA target sequence
ttgattatgaattagacctaattca

SEQ ID NO: 83686 - DNA, 25 bp, Artificial sequence
  SiRNA target sequence
tgattatgaattagacctaattcac

SEQ ID NO: 83687 - DNA, 25 bp, Artificial sequence
  SiRNA target sequence
gattatgaattagacctaattcacc

SEQ ID NO: 83688 - DNA, 25 bp, Artificial sequence
  SiRNA target sequence
attatgaattagacctaattcacct

SEQ ID NO: 83689 - DNA, 25 bp, Artificial sequence
  SiRNA target sequence
ttatgaattagacctaattcaccta

SEQ ID NO: 83690 - DNA, 25 bp, Artificial sequence
  SiRNA target sequence
tatgaattagacctaattcacctac

SEQ ID NO: 83691 - DNA, 25 bp, Artificial sequence
  SiRNA target sequence
atgaattagacctaattcacctact

SEQ ID NO: 83692 - DNA, 25 bp, Artificial sequence
  SiRNA target sequence
tgaattagacctaattcacctactt

SEQ ID NO: 83693 - DNA, 25 bp, Artificial sequence
  SiRNA target sequence
gaattagacctaattcacctacttt

SEQ ID NO: 83694 - DNA, 25 bp, Artificial sequence
  SiRNA target sequence
aattagacctaattcacctactttt

SEQ ID NO: 83695 - DNA, 25 bp, Artificial sequence
  SiRNA target sequence
attagacctaattcacctacttttg

SEQ ID NO: 83696 - DNA, 25 bp, Artificial sequence
  SiRNA target sequence
ttagacctaattcacctacttttgg

SEQ ID NO: 83697 - DNA, 25 bp, Artificial sequence
  SiRNA target sequence
tagacctaattcacctacttttggt

SEQ ID NO: 83698 - DNA, 25 bp, Artificial sequence
  SiRNA target sequence
agacctaattcacctacttttggtg

SEQ ID NO: 83699 - DNA, 25 bp, Artificial sequence
  SiRNA target sequence
gacctaattcacctacttttggtga

SEQ ID NO: 83700 - DNA, 25 bp, Artificial sequence
  SiRNA target sequence
acctaattcacctacttttggtgaa

SEQ ID NO: 83701 - DNA, 25 bp, Artificial sequence
  SiRNA target sequence
cctaattcacctacttttggtgaaa

SEQ ID NO: 83702 - DNA, 25 bp, Artificial sequence
  SiRNA target sequence
ctaattcacctacttttggtgaaat

SEQ ID NO: 83703 - DNA, 25 bp, Artificial sequence
  SiRNA target sequence
taattcacctacttttggtgaaata

SEQ ID NO: 83704 - DNA, 25 bp, Artificial sequence
  SiRNA target sequence
aattcacctacttttggtgaaatag

SEQ ID NO: 83705 - DNA, 25 bp, Artificial sequence
  SiRNA target sequence
attcacctacttttggtgaaataga

SEQ ID NO: 83706 - DNA, 25 bp, Artificial sequence
  SiRNA target sequence
ttcacctacttttggtgaaatagat

SEQ ID NO: 83707 - DNA, 25 bp, Artificial sequence
  SiRNA target sequence
tcacctacttttggtgaaatagatt

SEQ ID NO: 83708 - DNA, 25 bp, Artificial sequence
  SiRNA target sequence
cacctacttttggtgaaatagattg

SEQ ID NO: 83709 - DNA, 25 bp, Artificial sequence
  SiRNA target sequence
acctacttttggtgaaatagattgt

SEQ ID NO: 83710 - DNA, 25 bp, Artificial sequence
  SiRNA target sequence
cctacttttggtgaaatagattgta

SEQ ID NO: 83711 - DNA, 25 bp, Artificial sequence
  SiRNA target sequence
ctacttttggtgaaatagattgtaa

SEQ ID NO: 83712 - DNA, 25 bp, Artificial sequence
  SiRNA target sequence
tacttttggtgaaatagattgtaaa

SEQ ID NO: 83713 - DNA, 25 bp, Artificial sequence
  SiRNA target sequence
acttttggtgaaatagattgtaaaa

SEQ ID NO: 83714 - DNA, 25 bp, Artificial sequence
  SiRNA target sequence
cttttggtgaaatagattgtaaaac

SEQ ID NO: 83715 - DNA, 25 bp, Artificial sequence
  SiRNA target sequence
ttttggtgaaatagattgtaaaaca

SEQ ID NO: 83716 - DNA, 25 bp, Artificial sequence
  SiRNA target sequence
tttggtgaaatagattgtaaaacag

SEQ ID NO: 83717 - DNA, 25 bp, Artificial sequence
  SiRNA target sequence
ttggtgaaatagattgtaaaacaga

SEQ ID NO: 83718 - DNA, 25 bp, Artificial sequence
  SiRNA target sequence
tggtgaaatagattgtaaaacagat

SEQ ID NO: 83719 - DNA, 25 bp, Artificial sequence
  SiRNA target sequence
ggtgaaatagattgtaaaacagatt

SEQ ID NO: 83720 - DNA, 25 bp, Artificial sequence
  SiRNA target sequence
gtgaaatagattgtaaaacagattt

SEQ ID NO: 83721 - DNA, 25 bp, Artificial sequence
  SiRNA target sequence
tgaaatagattgtaaaacagatttt

SEQ ID NO: 83722 - DNA, 25 bp, Artificial sequence
  SiRNA target sequence
gaaatagattgtaaaacagattttc

SEQ ID NO: 83723 - DNA, 25 bp, Artificial sequence
  SiRNA target sequence
aaatagattgtaaaacagattttcc

SEQ ID NO: 83724 - DNA, 25 bp, Artificial sequence
  SiRNA target sequence
aatagattgtaaaacagattttcca

SEQ ID NO: 83725 - DNA, 25 bp, Artificial sequence
  SiRNA target sequence
atagattgtaaaacagattttccaa

SEQ ID NO: 83726 - DNA, 25 bp, Artificial sequence
  SiRNA target sequence
tagattgtaaaacagattttccaag

SEQ ID NO: 83727 - DNA, 25 bp, Artificial sequence
  SiRNA target sequence
agattgtaaaacagattttccaagt

SEQ ID NO: 83728 - DNA, 25 bp, Artificial sequence
  SiRNA target sequence
gattgtaaaacagattttccaagtg

SEQ ID NO: 83729 - DNA, 25 bp, Artificial sequence
  SiRNA target sequence
attgtaaaacagattttccaagtga

SEQ ID NO: 83730 - DNA, 25 bp, Artificial sequence
  SiRNA target sequence
ttgtaaaacagattttccaagtgag

SEQ ID NO: 83731 - DNA, 25 bp, Artificial sequence
  SiRNA target sequence
tgtaaaacagattttccaagtgagt

SEQ ID NO: 83732 - DNA, 25 bp, Artificial sequence
  SiRNA target sequence
gtaaaacagattttccaagtgagtt

SEQ ID NO: 83733 - DNA, 25 bp, Artificial sequence
  SiRNA target sequence
taaaacagattttccaagtgagttg

SEQ ID NO: 83734 - DNA, 25 bp, Artificial sequence
  SiRNA target sequence
aaaacagattttccaagtgagttgt

SEQ ID NO: 83735 - DNA, 25 bp, Artificial sequence
  SiRNA target sequence
aaacagattttccaagtgagttgtc

SEQ ID NO: 83736 - DNA, 25 bp, Artificial sequence
  SiRNA target sequence
aacagattttccaagtgagttgtct

SEQ ID NO: 83737 - DNA, 25 bp, Artificial sequence
  SiRNA target sequence
acagattttccaagtgagttgtctg

SEQ ID NO: 83738 - DNA, 25 bp, Artificial sequence
  SiRNA target sequence
cagattttccaagtgagttgtctgc

SEQ ID NO: 83739 - DNA, 25 bp, Artificial sequence
  SiRNA target sequence
agattttccaagtgagttgtctgca

SEQ ID NO: 83740 - DNA, 25 bp, Artificial sequence
  SiRNA target sequence
gattttccaagtgagttgtctgcat

SEQ ID NO: 83741 - DNA, 25 bp, Artificial sequence
  SiRNA target sequence
attttccaagtgagttgtctgcatg

SEQ ID NO: 83742 - DNA, 25 bp, Artificial sequence
  SiRNA target sequence
ttttccaagtgagttgtctgcatgt

SEQ ID NO: 83743 - DNA, 25 bp, Artificial sequence
  SiRNA target sequence
tttccaagtgagttgtctgcatgtg

SEQ ID NO: 83744 - DNA, 25 bp, Artificial sequence
  SiRNA target sequence
ttccaagtgagttgtctgcatgtgt

SEQ ID NO: 83745 - DNA, 25 bp, Artificial sequence
  SiRNA target sequence
tccaagtgagttgtctgcatgtgta

SEQ ID NO: 83746 - DNA, 25 bp, Artificial sequence
  SiRNA target sequence
ccaagtgagttgtctgcatgtgtat

SEQ ID NO: 83747 - DNA, 25 bp, Artificial sequence
  SiRNA target sequence
caagtgagttgtctgcatgtgtatg

SEQ ID NO: 83748 - DNA, 25 bp, Artificial sequence
  SiRNA target sequence
aagtgagttgtctgcatgtgtatgc

SEQ ID NO: 83749 - DNA, 25 bp, Artificial sequence
  SiRNA target sequence
agtgagttgtctgcatgtgtatgcg

SEQ ID NO: 83750 - DNA, 25 bp, Artificial sequence
  SiRNA target sequence
gtgagttgtctgcatgtgtatgcgg

SEQ ID NO: 83751 - DNA, 25 bp, Artificial sequence
  SiRNA target sequence
tgagttgtctgcatgtgtatgcggg

SEQ ID NO: 83752 - DNA, 25 bp, Artificial sequence
  SiRNA target sequence
gagttgtctgcatgtgtatgcggga

SEQ ID NO: 83753 - DNA, 25 bp, Artificial sequence
  SiRNA target sequence
agttgtctgcatgtgtatgcgggaa

SEQ ID NO: 83754 - DNA, 25 bp, Artificial sequence
  SiRNA target sequence
gttgtctgcatgtgtatgcgggaaa

SEQ ID NO: 83755 - DNA, 25 bp, Artificial sequence
  SiRNA target sequence
ttgtctgcatgtgtatgcgggaaaa

SEQ ID NO: 83756 - DNA, 25 bp, Artificial sequence
  SiRNA target sequence
tgtctgcatgtgtatgcgggaaaaa

SEQ ID NO: 83757 - DNA, 25 bp, Artificial sequence
  SiRNA target sequence
gtctgcatgtgtatgcgggaaaaaa

SEQ ID NO: 83758 - DNA, 25 bp, Artificial sequence
  SiRNA target sequence
tctgcatgtgtatgcgggaaaaaat

SEQ ID NO: 83759 - DNA, 25 bp, Artificial sequence
  SiRNA target sequence
ctgcatgtgtatgcgggaaaaaatg

SEQ ID NO: 83760 - DNA, 25 bp, Artificial sequence
  SiRNA target sequence
tgcatgtgtatgcgggaaaaaatgc

SEQ ID NO: 83761 - DNA, 25 bp, Artificial sequence
  SiRNA target sequence
gcatgtgtatgcgggaaaaaatgct

SEQ ID NO: 83762 - DNA, 25 bp, Artificial sequence
  SiRNA target sequence
catgtgtatgcgggaaaaaatgctg

SEQ ID NO: 83763 - DNA, 25 bp, Artificial sequence
  SiRNA target sequence
atgtgtatgcgggaaaaaatgctgt

SEQ ID NO: 83764 - DNA, 25 bp, Artificial sequence
  SiRNA target sequence
tgtgtatgcgggaaaaaatgctgtt

SEQ ID NO: 83765 - DNA, 25 bp, Artificial sequence
  SiRNA target sequence
gtgtatgcgggaaaaaatgctgttt

SEQ ID NO: 83766 - DNA, 25 bp, Artificial sequence
  SiRNA target sequence
tgtatgcgggaaaaaatgctgtttt

SEQ ID NO: 83767 - DNA, 25 bp, Artificial sequence
  SiRNA target sequence
gtatgcgggaaaaaatgctgttttg

SEQ ID NO: 83768 - DNA, 25 bp, Artificial sequence
  SiRNA target sequence
tatgcgggaaaaaatgctgttttgc

SEQ ID NO: 83769 - DNA, 25 bp, Artificial sequence
  SiRNA target sequence
atgcgggaaaaaatgctgttttgct

SEQ ID NO: 83770 - DNA, 25 bp, Artificial sequence
  SiRNA target sequence
tgcgggaaaaaatgctgttttgcta

SEQ ID NO: 83771 - DNA, 25 bp, Artificial sequence
  SiRNA target sequence
gcgggaaaaaatgctgttttgctaa

SEQ ID NO: 83772 - DNA, 25 bp, Artificial sequence
  SiRNA target sequence
cgggaaaaaatgctgttttgctaaa

SEQ ID NO: 83773 - DNA, 25 bp, Artificial sequence
  SiRNA target sequence
gggaaaaaatgctgttttgctaaat

SEQ ID NO: 83774 - DNA, 25 bp, Artificial sequence
  SiRNA target sequence
ggaaaaaatgctgttttgctaaata

SEQ ID NO: 83775 - DNA, 25 bp, Artificial sequence
  SiRNA target sequence
gaaaaaatgctgttttgctaaataa

SEQ ID NO: 83776 - DNA, 25 bp, Artificial sequence
  SiRNA target sequence
aaaaaatgctgttttgctaaataaa

SEQ ID NO: 83777 - DNA, 25 bp, Artificial sequence
  SiRNA target sequence
aaaaatgctgttttgctaaataaac

SEQ ID NO: 83778 - DNA, 25 bp, Artificial sequence
  SiRNA target sequence
aaaatgctgttttgctaaataaaca

SEQ ID NO: 83779 - DNA, 25 bp, Artificial sequence
  SiRNA target sequence
aaatgctgttttgctaaataaacaa

SEQ ID NO: 83780 - DNA, 25 bp, Artificial sequence
  SiRNA target sequence
aatgctgttttgctaaataaacaat

SEQ ID NO: 83781 - DNA, 25 bp, Artificial sequence
  SiRNA target sequence
atgctgttttgctaaataaacaatc

SEQ ID NO: 83782 - DNA, 25 bp, Artificial sequence
  SiRNA target sequence
tgctgttttgctaaataaacaatcc

SEQ ID NO: 83783 - DNA, 25 bp, Artificial sequence
  SiRNA target sequence
gctgttttgctaaataaacaatcca

SEQ ID NO: 83784 - DNA, 25 bp, Artificial sequence
  SiRNA target sequence
ctgttttgctaaataaacaatccat

SEQ ID NO: 83785 - DNA, 25 bp, Artificial sequence
  SiRNA target sequence
tgttttgctaaataaacaatccata

SEQ ID NO: 83786 - DNA, 25 bp, Artificial sequence
  SiRNA target sequence
gttttgctaaataaacaatccatac

SEQ ID NO: 83787 - DNA, 25 bp, Artificial sequence
  SiRNA target sequence
ttttgctaaataaacaatccataca

SEQ ID NO: 83788 - DNA, 25 bp, Artificial sequence
  SiRNA target sequence
tttgctaaataaacaatccatacac

SEQ ID NO: 83789 - DNA, 25 bp, Artificial sequence
  SiRNA target sequence
ttgctaaataaacaatccatacacc

SEQ ID NO: 83790 - DNA, 25 bp, Artificial sequence
  SiRNA target sequence
tgctaaataaacaatccatacaccc

SEQ ID NO: 83791 - DNA, 25 bp, Artificial sequence
  SiRNA target sequence
gctaaataaacaatccatacaccca

SEQ ID NO: 83792 - DNA, 25 bp, Artificial sequence
  SiRNA target sequence
ctaaataaacaatccatacacccaa

SEQ ID NO: 83793 - DNA, 25 bp, Artificial sequence
  SiRNA target sequence
taaataaacaatccatacacccaat

SEQ ID NO: 83794 - DNA, 25 bp, Artificial sequence
  SiRNA target sequence
aaataaacaatccatacacccaata

SEQ ID NO: 83795 - DNA, 25 bp, Artificial sequence
  SiRNA target sequence
aataaacaatccatacacccaataa

SEQ ID NO: 83796 - DNA, 25 bp, Artificial sequence
  SiRNA target sequence
ataaacaatccatacacccaataag

SEQ ID NO: 83797 - DNA, 25 bp, Artificial sequence
  SiRNA target sequence
taaacaatccatacacccaataaga

SEQ ID NO: 83798 - DNA, 25 bp, Artificial sequence
  SiRNA target sequence
aaacaatccatacacccaataagat

SEQ ID NO: 83799 - DNA, 25 bp, Artificial sequence
  SiRNA target sequence
aacaatccatacacccaataagata

SEQ ID NO: 83800 - DNA, 25 bp, Artificial sequence
  SiRNA target sequence
acaatccatacacccaataagataa

SEQ ID NO: 83801 - DNA, 25 bp, Artificial sequence
  SiRNA target sequence
caatccatacacccaataagataat

SEQ ID NO: 83802 - DNA, 25 bp, Artificial sequence
  SiRNA target sequence
aatccatacacccaataagataata

SEQ ID NO: 83803 - DNA, 25 bp, Artificial sequence
  SiRNA target sequence
atccatacacccaataagataataa

SEQ ID NO: 83804 - DNA, 25 bp, Artificial sequence
  SiRNA target sequence
tccatacacccaataagataataag

SEQ ID NO: 83805 - DNA, 25 bp, Artificial sequence
  SiRNA target sequence
ccatacacccaataagataataagt

SEQ ID NO: 83806 - DNA, 25 bp, Artificial sequence
  SiRNA target sequence
catacacccaataagataataagtc

SEQ ID NO: 83807 - DNA, 25 bp, Artificial sequence
  SiRNA target sequence
atacacccaataagataataagtcc

SEQ ID NO: 83808 - DNA, 25 bp, Artificial sequence
  SiRNA target sequence
tacacccaataagataataagtcct

SEQ ID NO: 83809 - DNA, 25 bp, Artificial sequence
  SiRNA target sequence
acacccaataagataataagtcctc

SEQ ID NO: 83810 - DNA, 25 bp, Artificial sequence
  SiRNA target sequence
cacccaataagataataagtcctct

SEQ ID NO: 83811 - DNA, 25 bp, Artificial sequence
  SiRNA target sequence
acccaataagataataagtcctctt

SEQ ID NO: 83812 - DNA, 25 bp, Artificial sequence
  SiRNA target sequence
cccaataagataataagtcctctta

SEQ ID NO: 83813 - DNA, 25 bp, Artificial sequence
  SiRNA target sequence
ccaataagataataagtcctcttaa

SEQ ID NO: 83814 - DNA, 25 bp, Artificial sequence
  SiRNA target sequence
caataagataataagtcctcttaat

SEQ ID NO: 83815 - DNA, 25 bp, Artificial sequence
  SiRNA target sequence
aataagataataagtcctcttaata

SEQ ID NO: 83816 - DNA, 25 bp, Artificial sequence
  SiRNA target sequence
ataagataataagtcctcttaatac

SEQ ID NO: 83817 - DNA, 25 bp, Artificial sequence
  SiRNA target sequence
taagataataagtcctcttaatact

SEQ ID NO: 83818 - DNA, 25 bp, Artificial sequence
  SiRNA target sequence
aagataataagtcctcttaatactt

SEQ ID NO: 83819 - DNA, 25 bp, Artificial sequence
  SiRNA target sequence
agataataagtcctcttaatacttt

SEQ ID NO: 83820 - DNA, 25 bp, Artificial sequence
  SiRNA target sequence
gataataagtcctcttaatactttc

SEQ ID NO: 83821 - DNA, 25 bp, Artificial sequence
  SiRNA target sequence
ataataagtcctcttaatactttct

SEQ ID NO: 83822 - DNA, 25 bp, Artificial sequence
  SiRNA target sequence
taataagtcctcttaatactttctg

SEQ ID NO: 83823 - DNA, 25 bp, Artificial sequence
  SiRNA target sequence
aataagtcctcttaatactttctgc

SEQ ID NO: 83824 - DNA, 25 bp, Artificial sequence
  SiRNA target sequence
ataagtcctcttaatactttctgct

SEQ ID NO: 83825 - DNA, 25 bp, Artificial sequence
  SiRNA target sequence
taagtcctcttaatactttctgctc

SEQ ID NO: 83826 - DNA, 25 bp, Artificial sequence
  SiRNA target sequence
aagtcctcttaatactttctgctct

SEQ ID NO: 83827 - DNA, 25 bp, Artificial sequence
  SiRNA target sequence
agtcctcttaatactttctgctctt

SEQ ID NO: 83828 - DNA, 25 bp, Artificial sequence
  SiRNA target sequence
gtcctcttaatactttctgctcttt

SEQ ID NO: 83829 - DNA, 25 bp, Artificial sequence
  SiRNA target sequence
tcctcttaatactttctgctctttg

SEQ ID NO: 83830 - DNA, 25 bp, Artificial sequence
  SiRNA target sequence
cctcttaatactttctgctctttgt

SEQ ID NO: 83831 - DNA, 25 bp, Artificial sequence
  SiRNA target sequence
ctcttaatactttctgctctttgtt

SEQ ID NO: 83832 - DNA, 25 bp, Artificial sequence
  SiRNA target sequence
tcttaatactttctgctctttgttc

SEQ ID NO: 83833 - DNA, 25 bp, Artificial sequence
  SiRNA target sequence
cttaatactttctgctctttgttca

SEQ ID NO: 83834 - DNA, 25 bp, Artificial sequence
  SiRNA target sequence
ttaatactttctgctctttgttcat

SEQ ID NO: 83835 - DNA, 26 bp, Artificial sequence
  SiRNA target sequence
ttattctggttcacaaccacaactcc

SEQ ID NO: 83836 - DNA, 26 bp, Artificial sequence
  SiRNA target sequence
tattctggttcacaaccacaactcca

SEQ ID NO: 83837 - DNA, 26 bp, Artificial sequence
  SiRNA target sequence
attctggttcacaaccacaactccaa

SEQ ID NO: 83838 - DNA, 26 bp, Artificial sequence
  SiRNA target sequence
ttctggttcacaaccacaactccaaa

SEQ ID NO: 83839 - DNA, 26 bp, Artificial sequence
  SiRNA target sequence
tctggttcacaaccacaactccaaac

SEQ ID NO: 83840 - DNA, 26 bp, Artificial sequence
  SiRNA target sequence
ctggttcacaaccacaactccaaaca

SEQ ID NO: 83841 - DNA, 26 bp, Artificial sequence
  SiRNA target sequence
tggttcacaaccacaactccaaacac

SEQ ID NO: 83842 - DNA, 26 bp, Artificial sequence
  SiRNA target sequence
ggttcacaaccacaactccaaacacc

SEQ ID NO: 83843 - DNA, 26 bp, Artificial sequence
  SiRNA target sequence
gttcacaaccacaactccaaacacct

SEQ ID NO: 83844 - DNA, 26 bp, Artificial sequence
  SiRNA target sequence
ttcacaaccacaactccaaacacctt

SEQ ID NO: 83845 - DNA, 26 bp, Artificial sequence
  SiRNA target sequence
tcacaaccacaactccaaacaccttc

SEQ ID NO: 83846 - DNA, 26 bp, Artificial sequence
  SiRNA target sequence
cacaaccacaactccaaacaccttct

SEQ ID NO: 83847 - DNA, 26 bp, Artificial sequence
  SiRNA target sequence
acaaccacaactccaaacaccttcta

SEQ ID NO: 83848 - DNA, 26 bp, Artificial sequence
  SiRNA target sequence
caaccacaactccaaacaccttctac

SEQ ID NO: 83849 - DNA, 26 bp, Artificial sequence
  SiRNA target sequence
aaccacaactccaaacaccttctacc

SEQ ID NO: 83850 - DNA, 26 bp, Artificial sequence
  SiRNA target sequence
accacaactccaaacaccttctacct

SEQ ID NO: 83851 - DNA, 26 bp, Artificial sequence
  SiRNA target sequence
ccacaactccaaacaccttctacctt

SEQ ID NO: 83852 - DNA, 26 bp, Artificial sequence
  SiRNA target sequence
cacaactccaaacaccttctaccttt

SEQ ID NO: 83853 - DNA, 26 bp, Artificial sequence
  SiRNA target sequence
acaactccaaacaccttctacctttt

SEQ ID NO: 83854 - DNA, 26 bp, Artificial sequence
  SiRNA target sequence
caactccaaacaccttctaccttttt

SEQ ID NO: 83855 - DNA, 26 bp, Artificial sequence
  SiRNA target sequence
aactccaaacaccttctaccttttta

SEQ ID NO: 83856 - DNA, 26 bp, Artificial sequence
  SiRNA target sequence
actccaaacaccttctacctttttac

SEQ ID NO: 83857 - DNA, 26 bp, Artificial sequence
  SiRNA target sequence
ctccaaacaccttctacctttttaca

SEQ ID NO: 83858 - DNA, 26 bp, Artificial sequence
  SiRNA target sequence
tccaaacaccttctacctttttacag

SEQ ID NO: 83859 - DNA, 26 bp, Artificial sequence
  SiRNA target sequence
ccaaacaccttctacctttttacagt

SEQ ID NO: 83860 - DNA, 26 bp, Artificial sequence
  SiRNA target sequence
caaacaccttctacctttttacagtc

SEQ ID NO: 83861 - DNA, 26 bp, Artificial sequence
  SiRNA target sequence
aaacaccttctacctttttacagtcc

SEQ ID NO: 83862 - DNA, 26 bp, Artificial sequence
  SiRNA target sequence
aacaccttctacctttttacagtcca

SEQ ID NO: 83863 - DNA, 26 bp, Artificial sequence
  SiRNA target sequence
acaccttctacctttttacagtccat

SEQ ID NO: 83864 - DNA, 26 bp, Artificial sequence
  SiRNA target sequence
caccttctacctttttacagtccata

SEQ ID NO: 83865 - DNA, 26 bp, Artificial sequence
  SiRNA target sequence
accttctacctttttacagtccataa

SEQ ID NO: 83866 - DNA, 26 bp, Artificial sequence
  SiRNA target sequence
ccttctacctttttacagtccataat

SEQ ID NO: 83867 - DNA, 26 bp, Artificial sequence
  SiRNA target sequence
cttctacctttttacagtccataatg

SEQ ID NO: 83868 - DNA, 26 bp, Artificial sequence
  SiRNA target sequence
ttctacctttttacagtccataatgg

SEQ ID NO: 83869 - DNA, 26 bp, Artificial sequence
  SiRNA target sequence
tctacctttttacagtccataatggg

SEQ ID NO: 83870 - DNA, 26 bp, Artificial sequence
  SiRNA target sequence
ctacctttttacagtccataatgggc

SEQ ID NO: 83871 - DNA, 26 bp, Artificial sequence
  SiRNA target sequence
tacctttttacagtccataatgggct

SEQ ID NO: 83872 - DNA, 26 bp, Artificial sequence
  SiRNA target sequence
acctttttacagtccataatgggctt

SEQ ID NO: 83873 - DNA, 26 bp, Artificial sequence
  SiRNA target sequence
cctttttacagtccataatgggcttt

SEQ ID NO: 83874 - DNA, 26 bp, Artificial sequence
  SiRNA target sequence
ctttttacagtccataatgggctttc

SEQ ID NO: 83875 - DNA, 26 bp, Artificial sequence
  SiRNA target sequence
tttttacagtccataatgggctttcc

SEQ ID NO: 83876 - DNA, 26 bp, Artificial sequence
  SiRNA target sequence
ttttacagtccataatgggctttcct

SEQ ID NO: 83877 - DNA, 26 bp, Artificial sequence
  SiRNA target sequence
tttacagtccataatgggctttccta

SEQ ID NO: 83878 - DNA, 26 bp, Artificial sequence
  SiRNA target sequence
ttacagtccataatgggctttcctaa

SEQ ID NO: 83879 - DNA, 26 bp, Artificial sequence
  SiRNA target sequence
tacagtccataatgggctttcctaat

SEQ ID NO: 83880 - DNA, 26 bp, Artificial sequence
  SiRNA target sequence
acagtccataatgggctttcctaatc

SEQ ID NO: 83881 - DNA, 26 bp, Artificial sequence
  SiRNA target sequence
cagtccataatgggctttcctaatct

SEQ ID NO: 83882 - DNA, 26 bp, Artificial sequence
  SiRNA target sequence
agtccataatgggctttcctaatctt

SEQ ID NO: 83883 - DNA, 26 bp, Artificial sequence
  SiRNA target sequence
gtccataatgggctttcctaatcttt

SEQ ID NO: 83884 - DNA, 26 bp, Artificial sequence
  SiRNA target sequence
tccataatgggctttcctaatctttt

SEQ ID NO: 83885 - DNA, 26 bp, Artificial sequence
  SiRNA target sequence
ccataatgggctttcctaatctttta

SEQ ID NO: 83886 - DNA, 26 bp, Artificial sequence
  SiRNA target sequence
cataatgggctttcctaatcttttat

SEQ ID NO: 83887 - DNA, 26 bp, Artificial sequence
  SiRNA target sequence
ataatgggctttcctaatcttttatt

SEQ ID NO: 83888 - DNA, 26 bp, Artificial sequence
  SiRNA target sequence
taatgggctttcctaatcttttatta

SEQ ID NO: 83889 - DNA, 26 bp, Artificial sequence
  SiRNA target sequence
aatgggctttcctaatcttttattaa

SEQ ID NO: 83890 - DNA, 26 bp, Artificial sequence
  SiRNA target sequence
atgggctttcctaatcttttattaac

SEQ ID NO: 83891 - DNA, 26 bp, Artificial sequence
  SiRNA target sequence
tgggctttcctaatcttttattaact

SEQ ID NO: 83892 - DNA, 26 bp, Artificial sequence
  SiRNA target sequence
gggctttcctaatcttttattaacta

SEQ ID NO: 83893 - DNA, 26 bp, Artificial sequence
  SiRNA target sequence
ggctttcctaatcttttattaactat

SEQ ID NO: 83894 - DNA, 26 bp, Artificial sequence
  SiRNA target sequence
gctttcctaatcttttattaactatg

SEQ ID NO: 83895 - DNA, 26 bp, Artificial sequence
  SiRNA target sequence
ctttcctaatcttttattaactatgt

SEQ ID NO: 83896 - DNA, 26 bp, Artificial sequence
  SiRNA target sequence
tttcctaatcttttattaactatgtt

SEQ ID NO: 83897 - DNA, 26 bp, Artificial sequence
  SiRNA target sequence
ttcctaatcttttattaactatgtta

SEQ ID NO: 83898 - DNA, 26 bp, Artificial sequence
  SiRNA target sequence
tcctaatcttttattaactatgttat

SEQ ID NO: 83899 - DNA, 26 bp, Artificial sequence
  SiRNA target sequence
cctaatcttttattaactatgttatg

SEQ ID NO: 83900 - DNA, 26 bp, Artificial sequence
  SiRNA target sequence
ctaatcttttattaactatgttatgt

SEQ ID NO: 83901 - DNA, 26 bp, Artificial sequence
  SiRNA target sequence
taatcttttattaactatgttatgtg

SEQ ID NO: 83902 - DNA, 26 bp, Artificial sequence
  SiRNA target sequence
aatcttttattaactatgttatgtgc

SEQ ID NO: 83903 - DNA, 26 bp, Artificial sequence
  SiRNA target sequence
atcttttattaactatgttatgtgct

SEQ ID NO: 83904 - DNA, 26 bp, Artificial sequence
  SiRNA target sequence
tcttttattaactatgttatgtgctt

SEQ ID NO: 83905 - DNA, 26 bp, Artificial sequence
  SiRNA target sequence
cttttattaactatgttatgtgcttt

SEQ ID NO: 83906 - DNA, 26 bp, Artificial sequence
  SiRNA target sequence
ttttattaactatgttatgtgcttta

SEQ ID NO: 83907 - DNA, 26 bp, Artificial sequence
  SiRNA target sequence
tttattaactatgttatgtgctttac

SEQ ID NO: 83908 - DNA, 26 bp, Artificial sequence
  SiRNA target sequence
ttattaactatgttatgtgctttaca

SEQ ID NO: 83909 - DNA, 26 bp, Artificial sequence
  SiRNA target sequence
tattaactatgttatgtgctttacat

SEQ ID NO: 83910 - DNA, 26 bp, Artificial sequence
  SiRNA target sequence
attaactatgttatgtgctttacata

SEQ ID NO: 83911 - DNA, 26 bp, Artificial sequence
  SiRNA target sequence
ttaactatgttatgtgctttacatag

SEQ ID NO: 83912 - DNA, 26 bp, Artificial sequence
  SiRNA target sequence
taactatgttatgtgctttacatagc

SEQ ID NO: 83913 - DNA, 26 bp, Artificial sequence
  SiRNA target sequence
aactatgttatgtgctttacatagcc

SEQ ID NO: 83914 - DNA, 26 bp, Artificial sequence
  SiRNA target sequence
actatgttatgtgctttacatagcca

SEQ ID NO: 83915 - DNA, 26 bp, Artificial sequence
  SiRNA target sequence
ctatgttatgtgctttacatagccac

SEQ ID NO: 83916 - DNA, 26 bp, Artificial sequence
  SiRNA target sequence
tatgttatgtgctttacatagccact

SEQ ID NO: 83917 - DNA, 26 bp, Artificial sequence
  SiRNA target sequence
atgttatgtgctttacatagccactg

SEQ ID NO: 83918 - DNA, 26 bp, Artificial sequence
  SiRNA target sequence
tgttatgtgctttacatagccactgg

SEQ ID NO: 83919 - DNA, 26 bp, Artificial sequence
  SiRNA target sequence
gttatgtgctttacatagccactgga

SEQ ID NO: 83920 - DNA, 26 bp, Artificial sequence
  SiRNA target sequence
ttatgtgctttacatagccactggac

SEQ ID NO: 83921 - DNA, 26 bp, Artificial sequence
  SiRNA target sequence
tatgtgctttacatagccactggaca

SEQ ID NO: 83922 - DNA, 26 bp, Artificial sequence
  SiRNA target sequence
atgtgctttacatagccactggacaa

SEQ ID NO: 83923 - DNA, 26 bp, Artificial sequence
  SiRNA target sequence
tgtgctttacatagccactggacaaa

SEQ ID NO: 83924 - DNA, 26 bp, Artificial sequence
  SiRNA target sequence
gtgctttacatagccactggacaaat

SEQ ID NO: 83925 - DNA, 26 bp, Artificial sequence
  SiRNA target sequence
tgctttacatagccactggacaaatt

SEQ ID NO: 83926 - DNA, 26 bp, Artificial sequence
  SiRNA target sequence
gctttacatagccactggacaaattc

SEQ ID NO: 83927 - DNA, 26 bp, Artificial sequence
  SiRNA target sequence
ctttacatagccactggacaaattcg

SEQ ID NO: 83928 - DNA, 26 bp, Artificial sequence
  SiRNA target sequence
tttacatagccactggacaaattcgt

SEQ ID NO: 83929 - DNA, 26 bp, Artificial sequence
  SiRNA target sequence
ttacatagccactggacaaattcgtc

SEQ ID NO: 83930 - DNA, 26 bp, Artificial sequence
  SiRNA target sequence
tacatagccactggacaaattcgtca

SEQ ID NO: 83931 - DNA, 26 bp, Artificial sequence
  SiRNA target sequence
acatagccactggacaaattcgtcat

SEQ ID NO: 83932 - DNA, 26 bp, Artificial sequence
  SiRNA target sequence
catagccactggacaaattcgtcatg

SEQ ID NO: 83933 - DNA, 26 bp, Artificial sequence
  SiRNA target sequence
atagccactggacaaattcgtcatgt

SEQ ID NO: 83934 - DNA, 26 bp, Artificial sequence
  SiRNA target sequence
tagccactggacaaattcgtcatgtg

SEQ ID NO: 83935 - DNA, 26 bp, Artificial sequence
  SiRNA target sequence
agccactggacaaattcgtcatgtgt

SEQ ID NO: 83936 - DNA, 26 bp, Artificial sequence
  SiRNA target sequence
gccactggacaaattcgtcatgtgtg

SEQ ID NO: 83937 - DNA, 26 bp, Artificial sequence
  SiRNA target sequence
ccactggacaaattcgtcatgtgtgg

SEQ ID NO: 83938 - DNA, 26 bp, Artificial sequence
  SiRNA target sequence
cactggacaaattcgtcatgtgtggc

SEQ ID NO: 83939 - DNA, 26 bp, Artificial sequence
  SiRNA target sequence
actggacaaattcgtcatgtgtggca

SEQ ID NO: 83940 - DNA, 26 bp, Artificial sequence
  SiRNA target sequence
ctggacaaattcgtcatgtgtggcaa

SEQ ID NO: 83941 - DNA, 26 bp, Artificial sequence
  SiRNA target sequence
tggacaaattcgtcatgtgtggcaac

SEQ ID NO: 83942 - DNA, 26 bp, Artificial sequence
  SiRNA target sequence
ggacaaattcgtcatgtgtggcaact

SEQ ID NO: 83943 - DNA, 26 bp, Artificial sequence
  SiRNA target sequence
gacaaattcgtcatgtgtggcaactt

SEQ ID NO: 83944 - DNA, 26 bp, Artificial sequence
  SiRNA target sequence
acaaattcgtcatgtgtggcaacttg

SEQ ID NO: 83945 - DNA, 26 bp, Artificial sequence
  SiRNA target sequence
caaattcgtcatgtgtggcaacttgt

SEQ ID NO: 83946 - DNA, 26 bp, Artificial sequence
  SiRNA target sequence
aaattcgtcatgtgtggcaacttgtg

SEQ ID NO: 83947 - DNA, 26 bp, Artificial sequence
  SiRNA target sequence
aattcgtcatgtgtggcaacttgtgg

SEQ ID NO: 83948 - DNA, 26 bp, Artificial sequence
  SiRNA target sequence
attcgtcatgtgtggcaacttgtgga

SEQ ID NO: 83949 - DNA, 26 bp, Artificial sequence
  SiRNA target sequence
ttcgtcatgtgtggcaacttgtggag

SEQ ID NO: 83950 - DNA, 26 bp, Artificial sequence
  SiRNA target sequence
tcgtcatgtgtggcaacttgtggagg

SEQ ID NO: 83951 - DNA, 26 bp, Artificial sequence
  SiRNA target sequence
cgtcatgtgtggcaacttgtggagga

SEQ ID NO: 83952 - DNA, 26 bp, Artificial sequence
  SiRNA target sequence
gtcatgtgtggcaacttgtggaggat

SEQ ID NO: 83953 - DNA, 26 bp, Artificial sequence
  SiRNA target sequence
tcatgtgtggcaacttgtggaggatt

SEQ ID NO: 83954 - DNA, 26 bp, Artificial sequence
  SiRNA target sequence
catgtgtggcaacttgtggaggattt

SEQ ID NO: 83955 - DNA, 26 bp, Artificial sequence
  SiRNA target sequence
atgtgtggcaacttgtggaggattta

SEQ ID NO: 83956 - DNA, 26 bp, Artificial sequence
  SiRNA target sequence
tgtgtggcaacttgtggaggatttaa

SEQ ID NO: 83957 - DNA, 26 bp, Artificial sequence
  SiRNA target sequence
gtgtggcaacttgtggaggatttaag

SEQ ID NO: 83958 - DNA, 26 bp, Artificial sequence
  SiRNA target sequence
tgtggcaacttgtggaggatttaagc

SEQ ID NO: 83959 - DNA, 26 bp, Artificial sequence
  SiRNA target sequence
gtggcaacttgtggaggatttaagct

SEQ ID NO: 83960 - DNA, 26 bp, Artificial sequence
  SiRNA target sequence
tggcaacttgtggaggatttaagctt

SEQ ID NO: 83961 - DNA, 26 bp, Artificial sequence
  SiRNA target sequence
ggcaacttgtggaggatttaagctta

SEQ ID NO: 83962 - DNA, 26 bp, Artificial sequence
  SiRNA target sequence
gcaacttgtggaggatttaagcttaa

SEQ ID NO: 83963 - DNA, 26 bp, Artificial sequence
  SiRNA target sequence
caacttgtggaggatttaagcttaac

SEQ ID NO: 83964 - DNA, 26 bp, Artificial sequence
  SiRNA target sequence
aacttgtggaggatttaagcttaaca

SEQ ID NO: 83965 - DNA, 26 bp, Artificial sequence
  SiRNA target sequence
acttgtggaggatttaagcttaacag

SEQ ID NO: 83966 - DNA, 26 bp, Artificial sequence
  SiRNA target sequence
cttgtggaggatttaagcttaacagt

SEQ ID NO: 83967 - DNA, 26 bp, Artificial sequence
  SiRNA target sequence
ttgtggaggatttaagcttaacagtc

SEQ ID NO: 83968 - DNA, 26 bp, Artificial sequence
  SiRNA target sequence
tgtggaggatttaagcttaacagtct

SEQ ID NO: 83969 - DNA, 26 bp, Artificial sequence
  SiRNA target sequence
gtggaggatttaagcttaacagtctt

SEQ ID NO: 83970 - DNA, 26 bp, Artificial sequence
  SiRNA target sequence
tggaggatttaagcttaacagtcttt

SEQ ID NO: 83971 - DNA, 26 bp, Artificial sequence
  SiRNA target sequence
ggaggatttaagcttaacagtctttg

SEQ ID NO: 83972 - DNA, 26 bp, Artificial sequence
  SiRNA target sequence
gaggatttaagcttaacagtctttga

SEQ ID NO: 83973 - DNA, 26 bp, Artificial sequence
  SiRNA target sequence
aggatttaagcttaacagtctttgaa

SEQ ID NO: 83974 - DNA, 26 bp, Artificial sequence
  SiRNA target sequence
ggatttaagcttaacagtctttgaaa

SEQ ID NO: 83975 - DNA, 26 bp, Artificial sequence
  SiRNA target sequence
gatttaagcttaacagtctttgaaaa

SEQ ID NO: 83976 - DNA, 26 bp, Artificial sequence
  SiRNA target sequence
atttaagcttaacagtctttgaaaat

SEQ ID NO: 83977 - DNA, 26 bp, Artificial sequence
  SiRNA target sequence
tttaagcttaacagtctttgaaaatg

SEQ ID NO: 83978 - DNA, 26 bp, Artificial sequence
  SiRNA target sequence
ttaagcttaacagtctttgaaaatgt

SEQ ID NO: 83979 - DNA, 26 bp, Artificial sequence
  SiRNA target sequence
taagcttaacagtctttgaaaatgtc

SEQ ID NO: 83980 - DNA, 26 bp, Artificial sequence
  SiRNA target sequence
aagcttaacagtctttgaaaatgtcc

SEQ ID NO: 83981 - DNA, 26 bp, Artificial sequence
  SiRNA target sequence
agcttaacagtctttgaaaatgtcca

SEQ ID NO: 83982 - DNA, 26 bp, Artificial sequence
  SiRNA target sequence
gcttaacagtctttgaaaatgtccac

SEQ ID NO: 83983 - DNA, 26 bp, Artificial sequence
  SiRNA target sequence
cttaacagtctttgaaaatgtccaca

SEQ ID NO: 83984 - DNA, 26 bp, Artificial sequence
  SiRNA target sequence
ttaacagtctttgaaaatgtccacaa

SEQ ID NO: 83985 - DNA, 26 bp, Artificial sequence
  SiRNA target sequence
taacagtctttgaaaatgtccacaac

SEQ ID NO: 83986 - DNA, 26 bp, Artificial sequence
  SiRNA target sequence
aacagtctttgaaaatgtccacaaca

SEQ ID NO: 83987 - DNA, 26 bp, Artificial sequence
  SiRNA target sequence
acagtctttgaaaatgtccacaacat

SEQ ID NO: 83988 - DNA, 26 bp, Artificial sequence
  SiRNA target sequence
cagtctttgaaaatgtccacaacatt

SEQ ID NO: 83989 - DNA, 26 bp, Artificial sequence
  SiRNA target sequence
agtctttgaaaatgtccacaacattc

SEQ ID NO: 83990 - DNA, 26 bp, Artificial sequence
  SiRNA target sequence
gtctttgaaaatgtccacaacattct

SEQ ID NO: 83991 - DNA, 26 bp, Artificial sequence
  SiRNA target sequence
tctttgaaaatgtccacaacattctg

SEQ ID NO: 83992 - DNA, 26 bp, Artificial sequence
  SiRNA target sequence
ctttgaaaatgtccacaacattctgc

SEQ ID NO: 83993 - DNA, 26 bp, Artificial sequence
  SiRNA target sequence
tttgaaaatgtccacaacattctgca

SEQ ID NO: 83994 - DNA, 26 bp, Artificial sequence
  SiRNA target sequence
ttgaaaatgtccacaacattctgcac

SEQ ID NO: 83995 - DNA, 26 bp, Artificial sequence
  SiRNA target sequence
tgaaaatgtccacaacattctgcaca

SEQ ID NO: 83996 - DNA, 26 bp, Artificial sequence
  SiRNA target sequence
gaaaatgtccacaacattctgcacag

SEQ ID NO: 83997 - DNA, 26 bp, Artificial sequence
  SiRNA target sequence
aaaatgtccacaacattctgcacagg

SEQ ID NO: 83998 - DNA, 26 bp, Artificial sequence
  SiRNA target sequence
aaatgtccacaacattctgcacaggg

SEQ ID NO: 83999 - DNA, 26 bp, Artificial sequence
  SiRNA target sequence
aatgtccacaacattctgcacagggg

SEQ ID NO: 84000 - DNA, 26 bp, Artificial sequence
  SiRNA target sequence
atgtccacaacattctgcacagggga

SEQ ID NO: 84001 - DNA, 26 bp, Artificial sequence
  SiRNA target sequence
tgtccacaacattctgcacaggggaa

SEQ ID NO: 84002 - DNA, 26 bp, Artificial sequence
  SiRNA target sequence
gtccacaacattctgcacaggggaaa

SEQ ID NO: 84003 - DNA, 26 bp, Artificial sequence
  SiRNA target sequence
tccacaacattctgcacaggggaaaa

SEQ ID NO: 84004 - DNA, 26 bp, Artificial sequence
  SiRNA target sequence
ccacaacattctgcacaggggaaaag

SEQ ID NO: 84005 - DNA, 26 bp, Artificial sequence
  SiRNA target sequence
cacaacattctgcacaggggaaaaga

SEQ ID NO: 84006 - DNA, 26 bp, Artificial sequence
  SiRNA target sequence
acaacattctgcacaggggaaaagag

SEQ ID NO: 84007 - DNA, 26 bp, Artificial sequence
  SiRNA target sequence
caacattctgcacaggggaaaagaga

SEQ ID NO: 84008 - DNA, 26 bp, Artificial sequence
  SiRNA target sequence
aacattctgcacaggggaaaagagat

SEQ ID NO: 84009 - DNA, 26 bp, Artificial sequence
  SiRNA target sequence
acattctgcacaggggaaaagagatg

SEQ ID NO: 84010 - DNA, 26 bp, Artificial sequence
  SiRNA target sequence
cattctgcacaggggaaaagagatga

SEQ ID NO: 84011 - DNA, 26 bp, Artificial sequence
  SiRNA target sequence
attctgcacaggggaaaagagatgat

SEQ ID NO: 84012 - DNA, 26 bp, Artificial sequence
  SiRNA target sequence
ttctgcacaggggaaaagagatgata

SEQ ID NO: 84013 - DNA, 26 bp, Artificial sequence
  SiRNA target sequence
tctgcacaggggaaaagagatgataa

SEQ ID NO: 84014 - DNA, 26 bp, Artificial sequence
  SiRNA target sequence
ctgcacaggggaaaagagatgataaa

SEQ ID NO: 84015 - DNA, 26 bp, Artificial sequence
  SiRNA target sequence
tgcacaggggaaaagagatgataaaa

SEQ ID NO: 84016 - DNA, 26 bp, Artificial sequence
  SiRNA target sequence
gcacaggggaaaagagatgataaaag

SEQ ID NO: 84017 - DNA, 26 bp, Artificial sequence
  SiRNA target sequence
cacaggggaaaagagatgataaaagg

SEQ ID NO: 84018 - DNA, 26 bp, Artificial sequence
  SiRNA target sequence
acaggggaaaagagatgataaaaggt

SEQ ID NO: 84019 - DNA, 26 bp, Artificial sequence
  SiRNA target sequence
caggggaaaagagatgataaaaggta

SEQ ID NO: 84020 - DNA, 26 bp, Artificial sequence
  SiRNA target sequence
aggggaaaagagatgataaaaggtaa

SEQ ID NO: 84021 - DNA, 26 bp, Artificial sequence
  SiRNA target sequence
ggggaaaagagatgataaaaggtaaa

SEQ ID NO: 84022 - DNA, 26 bp, Artificial sequence
  SiRNA target sequence
gggaaaagagatgataaaaggtaaat

SEQ ID NO: 84023 - DNA, 26 bp, Artificial sequence
  SiRNA target sequence
ggaaaagagatgataaaaggtaaata

SEQ ID NO: 84024 - DNA, 26 bp, Artificial sequence
  SiRNA target sequence
gaaaagagatgataaaaggtaaataa

SEQ ID NO: 84025 - DNA, 26 bp, Artificial sequence
  SiRNA target sequence
aaaagagatgataaaaggtaaataaa

SEQ ID NO: 84026 - DNA, 26 bp, Artificial sequence
  SiRNA target sequence
aaagagatgataaaaggtaaataaat

SEQ ID NO: 84027 - DNA, 26 bp, Artificial sequence
  SiRNA target sequence
aagagatgataaaaggtaaataaatt

SEQ ID NO: 84028 - DNA, 26 bp, Artificial sequence
  SiRNA target sequence
agagatgataaaaggtaaataaattg

SEQ ID NO: 84029 - DNA, 26 bp, Artificial sequence
  SiRNA target sequence
gagatgataaaaggtaaataaattga

SEQ ID NO: 84030 - DNA, 26 bp, Artificial sequence
  SiRNA target sequence
agatgataaaaggtaaataaattgaa

SEQ ID NO: 84031 - DNA, 26 bp, Artificial sequence
  SiRNA target sequence
gatgataaaaggtaaataaattgaag

SEQ ID NO: 84032 - DNA, 26 bp, Artificial sequence
  SiRNA target sequence
atgataaaaggtaaataaattgaagt

SEQ ID NO: 84033 - DNA, 26 bp, Artificial sequence
  SiRNA target sequence
tgataaaaggtaaataaattgaagtg

SEQ ID NO: 84034 - DNA, 26 bp, Artificial sequence
  SiRNA target sequence
gataaaaggtaaataaattgaagtgt

SEQ ID NO: 84035 - DNA, 26 bp, Artificial sequence
  SiRNA target sequence
ataaaaggtaaataaattgaagtgta

SEQ ID NO: 84036 - DNA, 26 bp, Artificial sequence
  SiRNA target sequence
taaaaggtaaataaattgaagtgtat

SEQ ID NO: 84037 - DNA, 26 bp, Artificial sequence
  SiRNA target sequence
aaaaggtaaataaattgaagtgtatc

SEQ ID NO: 84038 - DNA, 26 bp, Artificial sequence
  SiRNA target sequence
aaaggtaaataaattgaagtgtatct

SEQ ID NO: 84039 - DNA, 26 bp, Artificial sequence
  SiRNA target sequence
aaggtaaataaattgaagtgtatctt

SEQ ID NO: 84040 - DNA, 26 bp, Artificial sequence
  SiRNA target sequence
aggtaaataaattgaagtgtatcttt

SEQ ID NO: 84041 - DNA, 26 bp, Artificial sequence
  SiRNA target sequence
ggtaaataaattgaagtgtatctttt

SEQ ID NO: 84042 - DNA, 26 bp, Artificial sequence
  SiRNA target sequence
gtaaataaattgaagtgtatcttttt

SEQ ID NO: 84043 - DNA, 26 bp, Artificial sequence
  SiRNA target sequence
taaataaattgaagtgtatctttttt

SEQ ID NO: 84044 - DNA, 26 bp, Artificial sequence
  SiRNA target sequence
aaataaattgaagtgtatctttttta

SEQ ID NO: 84045 - DNA, 26 bp, Artificial sequence
  SiRNA target sequence
aataaattgaagtgtatcttttttat

SEQ ID NO: 84046 - DNA, 26 bp, Artificial sequence
  SiRNA target sequence
ataaattgaagtgtatcttttttatg

SEQ ID NO: 84047 - DNA, 26 bp, Artificial sequence
  SiRNA target sequence
taaattgaagtgtatcttttttatgt

SEQ ID NO: 84048 - DNA, 26 bp, Artificial sequence
  SiRNA target sequence
aaattgaagtgtatcttttttatgtt

SEQ ID NO: 84049 - DNA, 26 bp, Artificial sequence
  SiRNA target sequence
aattgaagtgtatcttttttatgttg

SEQ ID NO: 84050 - DNA, 26 bp, Artificial sequence
  SiRNA target sequence
attgaagtgtatcttttttatgttgt

SEQ ID NO: 84051 - DNA, 26 bp, Artificial sequence
  SiRNA target sequence
ttgaagtgtatcttttttatgttgta

SEQ ID NO: 84052 - DNA, 26 bp, Artificial sequence
  SiRNA target sequence
tgaagtgtatcttttttatgttgtac

SEQ ID NO: 84053 - DNA, 26 bp, Artificial sequence
  SiRNA target sequence
gaagtgtatcttttttatgttgtact

SEQ ID NO: 84054 - DNA, 26 bp, Artificial sequence
  SiRNA target sequence
aagtgtatcttttttatgttgtactg

SEQ ID NO: 84055 - DNA, 26 bp, Artificial sequence
  SiRNA target sequence
agtgtatcttttttatgttgtactgt

SEQ ID NO: 84056 - DNA, 26 bp, Artificial sequence
  SiRNA target sequence
gtgtatcttttttatgttgtactgta

SEQ ID NO: 84057 - DNA, 26 bp, Artificial sequence
  SiRNA target sequence
tgtatcttttttatgttgtactgtag

SEQ ID NO: 84058 - DNA, 26 bp, Artificial sequence
  SiRNA target sequence
gtatcttttttatgttgtactgtagg

SEQ ID NO: 84059 - DNA, 26 bp, Artificial sequence
  SiRNA target sequence
tatcttttttatgttgtactgtagga

SEQ ID NO: 84060 - DNA, 26 bp, Artificial sequence
  SiRNA target sequence
atcttttttatgttgtactgtaggaa

SEQ ID NO: 84061 - DNA, 26 bp, Artificial sequence
  SiRNA target sequence
tcttttttatgttgtactgtaggaaa

SEQ ID NO: 84062 - DNA, 26 bp, Artificial sequence
  SiRNA target sequence
cttttttatgttgtactgtaggaaat

SEQ ID NO: 84063 - DNA, 26 bp, Artificial sequence
  SiRNA target sequence
ttttttatgttgtactgtaggaaatg

SEQ ID NO: 84064 - DNA, 26 bp, Artificial sequence
  SiRNA target sequence
tttttatgttgtactgtaggaaatgc

SEQ ID NO: 84065 - DNA, 26 bp, Artificial sequence
  SiRNA target sequence
ttttatgttgtactgtaggaaatgca

SEQ ID NO: 84066 - DNA, 26 bp, Artificial sequence
  SiRNA target sequence
tttatgttgtactgtaggaaatgcag

SEQ ID NO: 84067 - DNA, 26 bp, Artificial sequence
  SiRNA target sequence
ttatgttgtactgtaggaaatgcagg

SEQ ID NO: 84068 - DNA, 26 bp, Artificial sequence
  SiRNA target sequence
tatgttgtactgtaggaaatgcagga

SEQ ID NO: 84069 - DNA, 26 bp, Artificial sequence
  SiRNA target sequence
atgttgtactgtaggaaatgcaggat

SEQ ID NO: 84070 - DNA, 26 bp, Artificial sequence
  SiRNA target sequence
tgttgtactgtaggaaatgcaggata

SEQ ID NO: 84071 - DNA, 26 bp, Artificial sequence
  SiRNA target sequence
gttgtactgtaggaaatgcaggataa

SEQ ID NO: 84072 - DNA, 26 bp, Artificial sequence
  SiRNA target sequence
ttgtactgtaggaaatgcaggataaa

SEQ ID NO: 84073 - DNA, 26 bp, Artificial sequence
  SiRNA target sequence
tgtactgtaggaaatgcaggataaac

SEQ ID NO: 84074 - DNA, 26 bp, Artificial sequence
  SiRNA target sequence
gtactgtaggaaatgcaggataaaca

SEQ ID NO: 84075 - DNA, 26 bp, Artificial sequence
  SiRNA target sequence
tactgtaggaaatgcaggataaacag

SEQ ID NO: 84076 - DNA, 26 bp, Artificial sequence
  SiRNA target sequence
actgtaggaaatgcaggataaacagc

SEQ ID NO: 84077 - DNA, 26 bp, Artificial sequence
  SiRNA target sequence
ctgtaggaaatgcaggataaacagct

SEQ ID NO: 84078 - DNA, 26 bp, Artificial sequence
  SiRNA target sequence
tgtaggaaatgcaggataaacagctg

SEQ ID NO: 84079 - DNA, 26 bp, Artificial sequence
  SiRNA target sequence
gtaggaaatgcaggataaacagctgc

SEQ ID NO: 84080 - DNA, 26 bp, Artificial sequence
  SiRNA target sequence
taggaaatgcaggataaacagctgcc

SEQ ID NO: 84081 - DNA, 26 bp, Artificial sequence
  SiRNA target sequence
aggaaatgcaggataaacagctgcca

SEQ ID NO: 84082 - DNA, 26 bp, Artificial sequence
  SiRNA target sequence
ggaaatgcaggataaacagctgccat

SEQ ID NO: 84083 - DNA, 26 bp, Artificial sequence
  SiRNA target sequence
gaaatgcaggataaacagctgccatg

SEQ ID NO: 84084 - DNA, 26 bp, Artificial sequence
  SiRNA target sequence
aaatgcaggataaacagctgccatgg

SEQ ID NO: 84085 - DNA, 26 bp, Artificial sequence
  SiRNA target sequence
aatgcaggataaacagctgccatggt

SEQ ID NO: 84086 - DNA, 26 bp, Artificial sequence
  SiRNA target sequence
atgcaggataaacagctgccatggta

SEQ ID NO: 84087 - DNA, 26 bp, Artificial sequence
  SiRNA target sequence
tgcaggataaacagctgccatggtat

SEQ ID NO: 84088 - DNA, 26 bp, Artificial sequence
  SiRNA target sequence
gcaggataaacagctgccatggtatg

SEQ ID NO: 84089 - DNA, 26 bp, Artificial sequence
  SiRNA target sequence
caggataaacagctgccatggtatgt

SEQ ID NO: 84090 - DNA, 26 bp, Artificial sequence
  SiRNA target sequence
aggataaacagctgccatggtatgta

SEQ ID NO: 84091 - DNA, 26 bp, Artificial sequence
  SiRNA target sequence
ggataaacagctgccatggtatgtaa

SEQ ID NO: 84092 - DNA, 26 bp, Artificial sequence
  SiRNA target sequence
gataaacagctgccatggtatgtaaa

SEQ ID NO: 84093 - DNA, 26 bp, Artificial sequence
  SiRNA target sequence
ataaacagctgccatggtatgtaaaa

SEQ ID NO: 84094 - DNA, 26 bp, Artificial sequence
  SiRNA target sequence
taaacagctgccatggtatgtaaaag

SEQ ID NO: 84095 - DNA, 26 bp, Artificial sequence
  SiRNA target sequence
aaacagctgccatggtatgtaaaagt

SEQ ID NO: 84096 - DNA, 26 bp, Artificial sequence
  SiRNA target sequence
aacagctgccatggtatgtaaaagtg

SEQ ID NO: 84097 - DNA, 26 bp, Artificial sequence
  SiRNA target sequence
acagctgccatggtatgtaaaagtgt

SEQ ID NO: 84098 - DNA, 26 bp, Artificial sequence
  SiRNA target sequence
cagctgccatggtatgtaaaagtgtc

SEQ ID NO: 84099 - DNA, 26 bp, Artificial sequence
  SiRNA target sequence
agctgccatggtatgtaaaagtgtcc

SEQ ID NO: 84100 - DNA, 26 bp, Artificial sequence
  SiRNA target sequence
gctgccatggtatgtaaaagtgtcca

SEQ ID NO: 84101 - DNA, 26 bp, Artificial sequence
  SiRNA target sequence
ctgccatggtatgtaaaagtgtccat

SEQ ID NO: 84102 - DNA, 26 bp, Artificial sequence
  SiRNA target sequence
tgccatggtatgtaaaagtgtccatg

SEQ ID NO: 84103 - DNA, 26 bp, Artificial sequence
  SiRNA target sequence
gccatggtatgtaaaagtgtccatgt

SEQ ID NO: 84104 - DNA, 26 bp, Artificial sequence
  SiRNA target sequence
ccatggtatgtaaaagtgtccatgtt

SEQ ID NO: 84105 - DNA, 26 bp, Artificial sequence
  SiRNA target sequence
catggtatgtaaaagtgtccatgttg

SEQ ID NO: 84106 - DNA, 26 bp, Artificial sequence
  SiRNA target sequence
atggtatgtaaaagtgtccatgttgc

SEQ ID NO: 84107 - DNA, 26 bp, Artificial sequence
  SiRNA target sequence
tggtatgtaaaagtgtccatgttgct

SEQ ID NO: 84108 - DNA, 26 bp, Artificial sequence
  SiRNA target sequence
ggtatgtaaaagtgtccatgttgctc

SEQ ID NO: 84109 - DNA, 26 bp, Artificial sequence
  SiRNA target sequence
gtatgtaaaagtgtccatgttgctct

SEQ ID NO: 84110 - DNA, 26 bp, Artificial sequence
  SiRNA target sequence
tatgtaaaagtgtccatgttgctctc

SEQ ID NO: 84111 - DNA, 26 bp, Artificial sequence
  SiRNA target sequence
atgtaaaagtgtccatgttgctctcc

SEQ ID NO: 84112 - DNA, 26 bp, Artificial sequence
  SiRNA target sequence
tgtaaaagtgtccatgttgctctccc

SEQ ID NO: 84113 - DNA, 26 bp, Artificial sequence
  SiRNA target sequence
gtaaaagtgtccatgttgctctcccc

SEQ ID NO: 84114 - DNA, 26 bp, Artificial sequence
  SiRNA target sequence
taaaagtgtccatgttgctctcccca

SEQ ID NO: 84115 - DNA, 26 bp, Artificial sequence
  SiRNA target sequence
aaaagtgtccatgttgctctccccaa

SEQ ID NO: 84116 - DNA, 26 bp, Artificial sequence
  SiRNA target sequence
aaagtgtccatgttgctctccccaat

SEQ ID NO: 84117 - DNA, 26 bp, Artificial sequence
  SiRNA target sequence
aagtgtccatgttgctctccccaatc

SEQ ID NO: 84118 - DNA, 26 bp, Artificial sequence
  SiRNA target sequence
agtgtccatgttgctctccccaatct

SEQ ID NO: 84119 - DNA, 26 bp, Artificial sequence
  SiRNA target sequence
gtgtccatgttgctctccccaatcta

SEQ ID NO: 84120 - DNA, 26 bp, Artificial sequence
  SiRNA target sequence
tgtccatgttgctctccccaatctat

SEQ ID NO: 84121 - DNA, 26 bp, Artificial sequence
  SiRNA target sequence
gtccatgttgctctccccaatctatc

SEQ ID NO: 84122 - DNA, 26 bp, Artificial sequence
  SiRNA target sequence
tccatgttgctctccccaatctatct

SEQ ID NO: 84123 - DNA, 26 bp, Artificial sequence
  SiRNA target sequence
ccatgttgctctccccaatctatctt

SEQ ID NO: 84124 - DNA, 26 bp, Artificial sequence
  SiRNA target sequence
catgttgctctccccaatctatcttt

SEQ ID NO: 84125 - DNA, 26 bp, Artificial sequence
  SiRNA target sequence
atgttgctctccccaatctatcttta

SEQ ID NO: 84126 - DNA, 26 bp, Artificial sequence
  SiRNA target sequence
tgttgctctccccaatctatctttaa

SEQ ID NO: 84127 - DNA, 26 bp, Artificial sequence
  SiRNA target sequence
gttgctctccccaatctatctttaac

SEQ ID NO: 84128 - DNA, 26 bp, Artificial sequence
  SiRNA target sequence
ttgctctccccaatctatctttaact

SEQ ID NO: 84129 - DNA, 26 bp, Artificial sequence
  SiRNA target sequence
tgctctccccaatctatctttaactt

SEQ ID NO: 84130 - DNA, 26 bp, Artificial sequence
  SiRNA target sequence
gctctccccaatctatctttaacttc

SEQ ID NO: 84131 - DNA, 26 bp, Artificial sequence
  SiRNA target sequence
ctctccccaatctatctttaacttcc

SEQ ID NO: 84132 - DNA, 26 bp, Artificial sequence
  SiRNA target sequence
tctccccaatctatctttaacttcct

SEQ ID NO: 84133 - DNA, 26 bp, Artificial sequence
  SiRNA target sequence
ctccccaatctatctttaacttcctt

SEQ ID NO: 84134 - DNA, 26 bp, Artificial sequence
  SiRNA target sequence
tccccaatctatctttaacttcctta

SEQ ID NO: 84135 - DNA, 26 bp, Artificial sequence
  SiRNA target sequence
ccccaatctatctttaacttccttat

SEQ ID NO: 84136 - DNA, 26 bp, Artificial sequence
  SiRNA target sequence
cccaatctatctttaacttccttatt

SEQ ID NO: 84137 - DNA, 26 bp, Artificial sequence
  SiRNA target sequence
ccaatctatctttaacttccttattt

SEQ ID NO: 84138 - DNA, 26 bp, Artificial sequence
  SiRNA target sequence
caatctatctttaacttccttatttg

SEQ ID NO: 84139 - DNA, 26 bp, Artificial sequence
  SiRNA target sequence
aatctatctttaacttccttatttgt

SEQ ID NO: 84140 - DNA, 26 bp, Artificial sequence
  SiRNA target sequence
atctatctttaacttccttatttgtt

SEQ ID NO: 84141 - DNA, 26 bp, Artificial sequence
  SiRNA target sequence
tctatctttaacttccttatttgtta

SEQ ID NO: 84142 - DNA, 26 bp, Artificial sequence
  SiRNA target sequence
ctatctttaacttccttatttgttaa

SEQ ID NO: 84143 - DNA, 26 bp, Artificial sequence
  SiRNA target sequence
tatctttaacttccttatttgttaat

SEQ ID NO: 84144 - DNA, 26 bp, Artificial sequence
  SiRNA target sequence
atctttaacttccttatttgttaatt

SEQ ID NO: 84145 - DNA, 26 bp, Artificial sequence
  SiRNA target sequence
tctttaacttccttatttgttaattt

SEQ ID NO: 84146 - DNA, 26 bp, Artificial sequence
  SiRNA target sequence
ctttaacttccttatttgttaatttt

SEQ ID NO: 84147 - DNA, 26 bp, Artificial sequence
  SiRNA target sequence
tttaacttccttatttgttaattttt

SEQ ID NO: 84148 - DNA, 26 bp, Artificial sequence
  SiRNA target sequence
ttaacttccttatttgttaatttttg

SEQ ID NO: 84149 - DNA, 26 bp, Artificial sequence
  SiRNA target sequence
taacttccttatttgttaatttttga

SEQ ID NO: 84150 - DNA, 26 bp, Artificial sequence
  SiRNA target sequence
aacttccttatttgttaatttttgat

SEQ ID NO: 84151 - DNA, 26 bp, Artificial sequence
  SiRNA target sequence
acttccttatttgttaatttttgatt

SEQ ID NO: 84152 - DNA, 26 bp, Artificial sequence
  SiRNA target sequence
cttccttatttgttaatttttgatta

SEQ ID NO: 84153 - DNA, 26 bp, Artificial sequence
  SiRNA target sequence
ttccttatttgttaatttttgattat

SEQ ID NO: 84154 - DNA, 26 bp, Artificial sequence
  SiRNA target sequence
tccttatttgttaatttttgattatg

SEQ ID NO: 84155 - DNA, 26 bp, Artificial sequence
  SiRNA target sequence
ccttatttgttaatttttgattatga

SEQ ID NO: 84156 - DNA, 26 bp, Artificial sequence
  SiRNA target sequence
cttatttgttaatttttgattatgaa

SEQ ID NO: 84157 - DNA, 26 bp, Artificial sequence
  SiRNA target sequence
ttatttgttaatttttgattatgaat

SEQ ID NO: 84158 - DNA, 26 bp, Artificial sequence
  SiRNA target sequence
tatttgttaatttttgattatgaatt

SEQ ID NO: 84159 - DNA, 26 bp, Artificial sequence
  SiRNA target sequence
atttgttaatttttgattatgaatta

SEQ ID NO: 84160 - DNA, 26 bp, Artificial sequence
  SiRNA target sequence
tttgttaatttttgattatgaattag

SEQ ID NO: 84161 - DNA, 26 bp, Artificial sequence
  SiRNA target sequence
ttgttaatttttgattatgaattaga

SEQ ID NO: 84162 - DNA, 26 bp, Artificial sequence
  SiRNA target sequence
tgttaatttttgattatgaattagac

SEQ ID NO: 84163 - DNA, 26 bp, Artificial sequence
  SiRNA target sequence
gttaatttttgattatgaattagacc

SEQ ID NO: 84164 - DNA, 26 bp, Artificial sequence
  SiRNA target sequence
ttaatttttgattatgaattagacct

SEQ ID NO: 84165 - DNA, 26 bp, Artificial sequence
  SiRNA target sequence
taatttttgattatgaattagaccta

SEQ ID NO: 84166 - DNA, 26 bp, Artificial sequence
  SiRNA target sequence
aatttttgattatgaattagacctaa

SEQ ID NO: 84167 - DNA, 26 bp, Artificial sequence
  SiRNA target sequence
atttttgattatgaattagacctaat

SEQ ID NO: 84168 - DNA, 26 bp, Artificial sequence
  SiRNA target sequence
tttttgattatgaattagacctaatt

SEQ ID NO: 84169 - DNA, 26 bp, Artificial sequence
  SiRNA target sequence
ttttgattatgaattagacctaattc

SEQ ID NO: 84170 - DNA, 26 bp, Artificial sequence
  SiRNA target sequence
tttgattatgaattagacctaattca

SEQ ID NO: 84171 - DNA, 26 bp, Artificial sequence
  SiRNA target sequence
ttgattatgaattagacctaattcac

SEQ ID NO: 84172 - DNA, 26 bp, Artificial sequence
  SiRNA target sequence
tgattatgaattagacctaattcacc

SEQ ID NO: 84173 - DNA, 26 bp, Artificial sequence
  SiRNA target sequence
gattatgaattagacctaattcacct

SEQ ID NO: 84174 - DNA, 26 bp, Artificial sequence
  SiRNA target sequence
attatgaattagacctaattcaccta

SEQ ID NO: 84175 - DNA, 26 bp, Artificial sequence
  SiRNA target sequence
ttatgaattagacctaattcacctac

SEQ ID NO: 84176 - DNA, 26 bp, Artificial sequence
  SiRNA target sequence
tatgaattagacctaattcacctact

SEQ ID NO: 84177 - DNA, 26 bp, Artificial sequence
  SiRNA target sequence
atgaattagacctaattcacctactt

SEQ ID NO: 84178 - DNA, 26 bp, Artificial sequence
  SiRNA target sequence
tgaattagacctaattcacctacttt

SEQ ID NO: 84179 - DNA, 26 bp, Artificial sequence
  SiRNA target sequence
gaattagacctaattcacctactttt

SEQ ID NO: 84180 - DNA, 26 bp, Artificial sequence
  SiRNA target sequence
aattagacctaattcacctacttttg

SEQ ID NO: 84181 - DNA, 26 bp, Artificial sequence
  SiRNA target sequence
attagacctaattcacctacttttgg

SEQ ID NO: 84182 - DNA, 26 bp, Artificial sequence
  SiRNA target sequence
ttagacctaattcacctacttttggt

SEQ ID NO: 84183 - DNA, 26 bp, Artificial sequence
  SiRNA target sequence
tagacctaattcacctacttttggtg

SEQ ID NO: 84184 - DNA, 26 bp, Artificial sequence
  SiRNA target sequence
agacctaattcacctacttttggtga

SEQ ID NO: 84185 - DNA, 26 bp, Artificial sequence
  SiRNA target sequence
gacctaattcacctacttttggtgaa

SEQ ID NO: 84186 - DNA, 26 bp, Artificial sequence
  SiRNA target sequence
acctaattcacctacttttggtgaaa

SEQ ID NO: 84187 - DNA, 26 bp, Artificial sequence
  SiRNA target sequence
cctaattcacctacttttggtgaaat

SEQ ID NO: 84188 - DNA, 26 bp, Artificial sequence
  SiRNA target sequence
ctaattcacctacttttggtgaaata

SEQ ID NO: 84189 - DNA, 26 bp, Artificial sequence
  SiRNA target sequence
taattcacctacttttggtgaaatag

SEQ ID NO: 84190 - DNA, 26 bp, Artificial sequence
  SiRNA target sequence
aattcacctacttttggtgaaataga

SEQ ID NO: 84191 - DNA, 26 bp, Artificial sequence
  SiRNA target sequence
attcacctacttttggtgaaatagat

SEQ ID NO: 84192 - DNA, 26 bp, Artificial sequence
  SiRNA target sequence
ttcacctacttttggtgaaatagatt

SEQ ID NO: 84193 - DNA, 26 bp, Artificial sequence
  SiRNA target sequence
tcacctacttttggtgaaatagattg

SEQ ID NO: 84194 - DNA, 26 bp, Artificial sequence
  SiRNA target sequence
cacctacttttggtgaaatagattgt

SEQ ID NO: 84195 - DNA, 26 bp, Artificial sequence
  SiRNA target sequence
acctacttttggtgaaatagattgta

SEQ ID NO: 84196 - DNA, 26 bp, Artificial sequence
  SiRNA target sequence
cctacttttggtgaaatagattgtaa

SEQ ID NO: 84197 - DNA, 26 bp, Artificial sequence
  SiRNA target sequence
ctacttttggtgaaatagattgtaaa

SEQ ID NO: 84198 - DNA, 26 bp, Artificial sequence
  SiRNA target sequence
tacttttggtgaaatagattgtaaaa

SEQ ID NO: 84199 - DNA, 26 bp, Artificial sequence
  SiRNA target sequence
acttttggtgaaatagattgtaaaac

SEQ ID NO: 84200 - DNA, 26 bp, Artificial sequence
  SiRNA target sequence
cttttggtgaaatagattgtaaaaca

SEQ ID NO: 84201 - DNA, 26 bp, Artificial sequence
  SiRNA target sequence
ttttggtgaaatagattgtaaaacag

SEQ ID NO: 84202 - DNA, 26 bp, Artificial sequence
  SiRNA target sequence
tttggtgaaatagattgtaaaacaga

SEQ ID NO: 84203 - DNA, 26 bp, Artificial sequence
  SiRNA target sequence
ttggtgaaatagattgtaaaacagat

SEQ ID NO: 84204 - DNA, 26 bp, Artificial sequence
  SiRNA target sequence
tggtgaaatagattgtaaaacagatt

SEQ ID NO: 84205 - DNA, 26 bp, Artificial sequence
  SiRNA target sequence
ggtgaaatagattgtaaaacagattt

SEQ ID NO: 84206 - DNA, 26 bp, Artificial sequence
  SiRNA target sequence
gtgaaatagattgtaaaacagatttt

SEQ ID NO: 84207 - DNA, 26 bp, Artificial sequence
  SiRNA target sequence
tgaaatagattgtaaaacagattttc

SEQ ID NO: 84208 - DNA, 26 bp, Artificial sequence
  SiRNA target sequence
gaaatagattgtaaaacagattttcc

SEQ ID NO: 84209 - DNA, 26 bp, Artificial sequence
  SiRNA target sequence
aaatagattgtaaaacagattttcca

SEQ ID NO: 84210 - DNA, 26 bp, Artificial sequence
  SiRNA target sequence
aatagattgtaaaacagattttccaa

SEQ ID NO: 84211 - DNA, 26 bp, Artificial sequence
  SiRNA target sequence
atagattgtaaaacagattttccaag

SEQ ID NO: 84212 - DNA, 26 bp, Artificial sequence
  SiRNA target sequence
tagattgtaaaacagattttccaagt

SEQ ID NO: 84213 - DNA, 26 bp, Artificial sequence
  SiRNA target sequence
agattgtaaaacagattttccaagtg

SEQ ID NO: 84214 - DNA, 26 bp, Artificial sequence
  SiRNA target sequence
gattgtaaaacagattttccaagtga

SEQ ID NO: 84215 - DNA, 26 bp, Artificial sequence
  SiRNA target sequence
attgtaaaacagattttccaagtgag

SEQ ID NO: 84216 - DNA, 26 bp, Artificial sequence
  SiRNA target sequence
ttgtaaaacagattttccaagtgagt

SEQ ID NO: 84217 - DNA, 26 bp, Artificial sequence
  SiRNA target sequence
tgtaaaacagattttccaagtgagtt

SEQ ID NO: 84218 - DNA, 26 bp, Artificial sequence
  SiRNA target sequence
gtaaaacagattttccaagtgagttg

SEQ ID NO: 84219 - DNA, 26 bp, Artificial sequence
  SiRNA target sequence
taaaacagattttccaagtgagttgt

SEQ ID NO: 84220 - DNA, 26 bp, Artificial sequence
  SiRNA target sequence
aaaacagattttccaagtgagttgtc

SEQ ID NO: 84221 - DNA, 26 bp, Artificial sequence
  SiRNA target sequence
aaacagattttccaagtgagttgtct

SEQ ID NO: 84222 - DNA, 26 bp, Artificial sequence
  SiRNA target sequence
aacagattttccaagtgagttgtctg

SEQ ID NO: 84223 - DNA, 26 bp, Artificial sequence
  SiRNA target sequence
acagattttccaagtgagttgtctgc

SEQ ID NO: 84224 - DNA, 26 bp, Artificial sequence
  SiRNA target sequence
cagattttccaagtgagttgtctgca

SEQ ID NO: 84225 - DNA, 26 bp, Artificial sequence
  SiRNA target sequence
agattttccaagtgagttgtctgcat

SEQ ID NO: 84226 - DNA, 26 bp, Artificial sequence
  SiRNA target sequence
gattttccaagtgagttgtctgcatg

SEQ ID NO: 84227 - DNA, 26 bp, Artificial sequence
  SiRNA target sequence
attttccaagtgagttgtctgcatgt

SEQ ID NO: 84228 - DNA, 26 bp, Artificial sequence
  SiRNA target sequence
ttttccaagtgagttgtctgcatgtg

SEQ ID NO: 84229 - DNA, 26 bp, Artificial sequence
  SiRNA target sequence
tttccaagtgagttgtctgcatgtgt

SEQ ID NO: 84230 - DNA, 26 bp, Artificial sequence
  SiRNA target sequence
ttccaagtgagttgtctgcatgtgta

SEQ ID NO: 84231 - DNA, 26 bp, Artificial sequence
  SiRNA target sequence
tccaagtgagttgtctgcatgtgtat

SEQ ID NO: 84232 - DNA, 26 bp, Artificial sequence
  SiRNA target sequence
ccaagtgagttgtctgcatgtgtatg

SEQ ID NO: 84233 - DNA, 26 bp, Artificial sequence
  SiRNA target sequence
caagtgagttgtctgcatgtgtatgc

SEQ ID NO: 84234 - DNA, 26 bp, Artificial sequence
  SiRNA target sequence
aagtgagttgtctgcatgtgtatgcg

SEQ ID NO: 84235 - DNA, 26 bp, Artificial sequence
  SiRNA target sequence
agtgagttgtctgcatgtgtatgcgg

SEQ ID NO: 84236 - DNA, 26 bp, Artificial sequence
  SiRNA target sequence
gtgagttgtctgcatgtgtatgcggg

SEQ ID NO: 84237 - DNA, 26 bp, Artificial sequence
  SiRNA target sequence
tgagttgtctgcatgtgtatgcggga

SEQ ID NO: 84238 - DNA, 26 bp, Artificial sequence
  SiRNA target sequence
gagttgtctgcatgtgtatgcgggaa

SEQ ID NO: 84239 - DNA, 26 bp, Artificial sequence
  SiRNA target sequence
agttgtctgcatgtgtatgcgggaaa

SEQ ID NO: 84240 - DNA, 26 bp, Artificial sequence
  SiRNA target sequence
gttgtctgcatgtgtatgcgggaaaa

SEQ ID NO: 84241 - DNA, 26 bp, Artificial sequence
  SiRNA target sequence
ttgtctgcatgtgtatgcgggaaaaa

SEQ ID NO: 84242 - DNA, 26 bp, Artificial sequence
  SiRNA target sequence
tgtctgcatgtgtatgcgggaaaaaa

SEQ ID NO: 84243 - DNA, 26 bp, Artificial sequence
  SiRNA target sequence
gtctgcatgtgtatgcgggaaaaaat

SEQ ID NO: 84244 - DNA, 26 bp, Artificial sequence
  SiRNA target sequence
tctgcatgtgtatgcgggaaaaaatg

SEQ ID NO: 84245 - DNA, 26 bp, Artificial sequence
  SiRNA target sequence
ctgcatgtgtatgcgggaaaaaatgc

SEQ ID NO: 84246 - DNA, 26 bp, Artificial sequence
  SiRNA target sequence
tgcatgtgtatgcgggaaaaaatgct

SEQ ID NO: 84247 - DNA, 26 bp, Artificial sequence
  SiRNA target sequence
gcatgtgtatgcgggaaaaaatgctg

SEQ ID NO: 84248 - DNA, 26 bp, Artificial sequence
  SiRNA target sequence
catgtgtatgcgggaaaaaatgctgt

SEQ ID NO: 84249 - DNA, 26 bp, Artificial sequence
  SiRNA target sequence
atgtgtatgcgggaaaaaatgctgtt

SEQ ID NO: 84250 - DNA, 26 bp, Artificial sequence
  SiRNA target sequence
tgtgtatgcgggaaaaaatgctgttt

SEQ ID NO: 84251 - DNA, 26 bp, Artificial sequence
  SiRNA target sequence
gtgtatgcgggaaaaaatgctgtttt

SEQ ID NO: 84252 - DNA, 26 bp, Artificial sequence
  SiRNA target sequence
tgtatgcgggaaaaaatgctgttttg

SEQ ID NO: 84253 - DNA, 26 bp, Artificial sequence
  SiRNA target sequence
gtatgcgggaaaaaatgctgttttgc

SEQ ID NO: 84254 - DNA, 26 bp, Artificial sequence
  SiRNA target sequence
tatgcgggaaaaaatgctgttttgct

SEQ ID NO: 84255 - DNA, 26 bp, Artificial sequence
  SiRNA target sequence
atgcgggaaaaaatgctgttttgcta

SEQ ID NO: 84256 - DNA, 26 bp, Artificial sequence
  SiRNA target sequence
tgcgggaaaaaatgctgttttgctaa

SEQ ID NO: 84257 - DNA, 26 bp, Artificial sequence
  SiRNA target sequence
gcgggaaaaaatgctgttttgctaaa

SEQ ID NO: 84258 - DNA, 26 bp, Artificial sequence
  SiRNA target sequence
cgggaaaaaatgctgttttgctaaat

SEQ ID NO: 84259 - DNA, 26 bp, Artificial sequence
  SiRNA target sequence
gggaaaaaatgctgttttgctaaata

SEQ ID NO: 84260 - DNA, 26 bp, Artificial sequence
  SiRNA target sequence
ggaaaaaatgctgttttgctaaataa

SEQ ID NO: 84261 - DNA, 26 bp, Artificial sequence
  SiRNA target sequence
gaaaaaatgctgttttgctaaataaa

SEQ ID NO: 84262 - DNA, 26 bp, Artificial sequence
  SiRNA target sequence
aaaaaatgctgttttgctaaataaac

SEQ ID NO: 84263 - DNA, 26 bp, Artificial sequence
  SiRNA target sequence
aaaaatgctgttttgctaaataaaca

SEQ ID NO: 84264 - DNA, 26 bp, Artificial sequence
  SiRNA target sequence
aaaatgctgttttgctaaataaacaa

SEQ ID NO: 84265 - DNA, 26 bp, Artificial sequence
  SiRNA target sequence
aaatgctgttttgctaaataaacaat

SEQ ID NO: 84266 - DNA, 26 bp, Artificial sequence
  SiRNA target sequence
aatgctgttttgctaaataaacaatc

SEQ ID NO: 84267 - DNA, 26 bp, Artificial sequence
  SiRNA target sequence
atgctgttttgctaaataaacaatcc

SEQ ID NO: 84268 - DNA, 26 bp, Artificial sequence
  SiRNA target sequence
tgctgttttgctaaataaacaatcca

SEQ ID NO: 84269 - DNA, 26 bp, Artificial sequence
  SiRNA target sequence
gctgttttgctaaataaacaatccat

SEQ ID NO: 84270 - DNA, 26 bp, Artificial sequence
  SiRNA target sequence
ctgttttgctaaataaacaatccata

SEQ ID NO: 84271 - DNA, 26 bp, Artificial sequence
  SiRNA target sequence
tgttttgctaaataaacaatccatac

SEQ ID NO: 84272 - DNA, 26 bp, Artificial sequence
  SiRNA target sequence
gttttgctaaataaacaatccataca

SEQ ID NO: 84273 - DNA, 26 bp, Artificial sequence
  SiRNA target sequence
ttttgctaaataaacaatccatacac

SEQ ID NO: 84274 - DNA, 26 bp, Artificial sequence
  SiRNA target sequence
tttgctaaataaacaatccatacacc

SEQ ID NO: 84275 - DNA, 26 bp, Artificial sequence
  SiRNA target sequence
ttgctaaataaacaatccatacaccc

SEQ ID NO: 84276 - DNA, 26 bp, Artificial sequence
  SiRNA target sequence
tgctaaataaacaatccatacaccca

SEQ ID NO: 84277 - DNA, 26 bp, Artificial sequence
  SiRNA target sequence
gctaaataaacaatccatacacccaa

SEQ ID NO: 84278 - DNA, 26 bp, Artificial sequence
  SiRNA target sequence
ctaaataaacaatccatacacccaat

SEQ ID NO: 84279 - DNA, 26 bp, Artificial sequence
  SiRNA target sequence
taaataaacaatccatacacccaata

SEQ ID NO: 84280 - DNA, 26 bp, Artificial sequence
  SiRNA target sequence
aaataaacaatccatacacccaataa

SEQ ID NO: 84281 - DNA, 26 bp, Artificial sequence
  SiRNA target sequence
aataaacaatccatacacccaataag

SEQ ID NO: 84282 - DNA, 26 bp, Artificial sequence
  SiRNA target sequence
ataaacaatccatacacccaataaga

SEQ ID NO: 84283 - DNA, 26 bp, Artificial sequence
  SiRNA target sequence
taaacaatccatacacccaataagat

SEQ ID NO: 84284 - DNA, 26 bp, Artificial sequence
  SiRNA target sequence
aaacaatccatacacccaataagata

SEQ ID NO: 84285 - DNA, 26 bp, Artificial sequence
  SiRNA target sequence
aacaatccatacacccaataagataa

SEQ ID NO: 84286 - DNA, 26 bp, Artificial sequence
  SiRNA target sequence
acaatccatacacccaataagataat

SEQ ID NO: 84287 - DNA, 26 bp, Artificial sequence
  SiRNA target sequence
caatccatacacccaataagataata

SEQ ID NO: 84288 - DNA, 26 bp, Artificial sequence
  SiRNA target sequence
aatccatacacccaataagataataa

SEQ ID NO: 84289 - DNA, 26 bp, Artificial sequence
  SiRNA target sequence
atccatacacccaataagataataag

SEQ ID NO: 84290 - DNA, 26 bp, Artificial sequence
  SiRNA target sequence
tccatacacccaataagataataagt

SEQ ID NO: 84291 - DNA, 26 bp, Artificial sequence
  SiRNA target sequence
ccatacacccaataagataataagtc

SEQ ID NO: 84292 - DNA, 26 bp, Artificial sequence
  SiRNA target sequence
catacacccaataagataataagtcc

SEQ ID NO: 84293 - DNA, 26 bp, Artificial sequence
  SiRNA target sequence
atacacccaataagataataagtcct

SEQ ID NO: 84294 - DNA, 26 bp, Artificial sequence
  SiRNA target sequence
tacacccaataagataataagtcctc

SEQ ID NO: 84295 - DNA, 26 bp, Artificial sequence
  SiRNA target sequence
acacccaataagataataagtcctct

SEQ ID NO: 84296 - DNA, 26 bp, Artificial sequence
  SiRNA target sequence
cacccaataagataataagtcctctt

SEQ ID NO: 84297 - DNA, 26 bp, Artificial sequence
  SiRNA target sequence
acccaataagataataagtcctctta

SEQ ID NO: 84298 - DNA, 26 bp, Artificial sequence
  SiRNA target sequence
cccaataagataataagtcctcttaa

SEQ ID NO: 84299 - DNA, 26 bp, Artificial sequence
  SiRNA target sequence
ccaataagataataagtcctcttaat

SEQ ID NO: 84300 - DNA, 26 bp, Artificial sequence
  SiRNA target sequence
caataagataataagtcctcttaata

SEQ ID NO: 84301 - DNA, 26 bp, Artificial sequence
  SiRNA target sequence
aataagataataagtcctcttaatac

SEQ ID NO: 84302 - DNA, 26 bp, Artificial sequence
  SiRNA target sequence
ataagataataagtcctcttaatact

SEQ ID NO: 84303 - DNA, 26 bp, Artificial sequence
  SiRNA target sequence
taagataataagtcctcttaatactt

SEQ ID NO: 84304 - DNA, 26 bp, Artificial sequence
  SiRNA target sequence
aagataataagtcctcttaatacttt

SEQ ID NO: 84305 - DNA, 26 bp, Artificial sequence
  SiRNA target sequence
agataataagtcctcttaatactttc

SEQ ID NO: 84306 - DNA, 26 bp, Artificial sequence
  SiRNA target sequence
gataataagtcctcttaatactttct

SEQ ID NO: 84307 - DNA, 26 bp, Artificial sequence
  SiRNA target sequence
ataataagtcctcttaatactttctg

SEQ ID NO: 84308 - DNA, 26 bp, Artificial sequence
  SiRNA target sequence
taataagtcctcttaatactttctgc

SEQ ID NO: 84309 - DNA, 26 bp, Artificial sequence
  SiRNA target sequence
aataagtcctcttaatactttctgct

SEQ ID NO: 84310 - DNA, 26 bp, Artificial sequence
  SiRNA target sequence
ataagtcctcttaatactttctgctc

SEQ ID NO: 84311 - DNA, 26 bp, Artificial sequence
  SiRNA target sequence
taagtcctcttaatactttctgctct

SEQ ID NO: 84312 - DNA, 26 bp, Artificial sequence
  SiRNA target sequence
aagtcctcttaatactttctgctctt

SEQ ID NO: 84313 - DNA, 26 bp, Artificial sequence
  SiRNA target sequence
agtcctcttaatactttctgctcttt

SEQ ID NO: 84314 - DNA, 26 bp, Artificial sequence
  SiRNA target sequence
gtcctcttaatactttctgctctttg

SEQ ID NO: 84315 - DNA, 26 bp, Artificial sequence
  SiRNA target sequence
tcctcttaatactttctgctctttgt

SEQ ID NO: 84316 - DNA, 26 bp, Artificial sequence
  SiRNA target sequence
cctcttaatactttctgctctttgtt

SEQ ID NO: 84317 - DNA, 26 bp, Artificial sequence
  SiRNA target sequence
ctcttaatactttctgctctttgttc

SEQ ID NO: 84318 - DNA, 26 bp, Artificial sequence
  SiRNA target sequence
tcttaatactttctgctctttgttca

SEQ ID NO: 84319 - DNA, 26 bp, Artificial sequence
  SiRNA target sequence
cttaatactttctgctctttgttcat

SEQ ID NO: 84320 - DNA, 27 bp, Artificial sequence
  SiRNA target sequence
ttattctggttcacaaccacaactcca

SEQ ID NO: 84321 - DNA, 27 bp, Artificial sequence
  SiRNA target sequence
tattctggttcacaaccacaactccaa

SEQ ID NO: 84322 - DNA, 27 bp, Artificial sequence
  SiRNA target sequence
attctggttcacaaccacaactccaaa

SEQ ID NO: 84323 - DNA, 27 bp, Artificial sequence
  SiRNA target sequence
ttctggttcacaaccacaactccaaac

SEQ ID NO: 84324 - DNA, 27 bp, Artificial sequence
  SiRNA target sequence
tctggttcacaaccacaactccaaaca

SEQ ID NO: 84325 - DNA, 27 bp, Artificial sequence
  SiRNA target sequence
ctggttcacaaccacaactccaaacac

SEQ ID NO: 84326 - DNA, 27 bp, Artificial sequence
  SiRNA target sequence
tggttcacaaccacaactccaaacacc

SEQ ID NO: 84327 - DNA, 27 bp, Artificial sequence
  SiRNA target sequence
ggttcacaaccacaactccaaacacct

SEQ ID NO: 84328 - DNA, 27 bp, Artificial sequence
  SiRNA target sequence
gttcacaaccacaactccaaacacctt

SEQ ID NO: 84329 - DNA, 27 bp, Artificial sequence
  SiRNA target sequence
ttcacaaccacaactccaaacaccttc

SEQ ID NO: 84330 - DNA, 27 bp, Artificial sequence
  SiRNA target sequence
tcacaaccacaactccaaacaccttct

SEQ ID NO: 84331 - DNA, 27 bp, Artificial sequence
  SiRNA target sequence
cacaaccacaactccaaacaccttcta

SEQ ID NO: 84332 - DNA, 27 bp, Artificial sequence
  SiRNA target sequence
acaaccacaactccaaacaccttctac

SEQ ID NO: 84333 - DNA, 27 bp, Artificial sequence
  SiRNA target sequence
caaccacaactccaaacaccttctacc

SEQ ID NO: 84334 - DNA, 27 bp, Artificial sequence
  SiRNA target sequence
aaccacaactccaaacaccttctacct

SEQ ID NO: 84335 - DNA, 27 bp, Artificial sequence
  SiRNA target sequence
accacaactccaaacaccttctacctt

SEQ ID NO: 84336 - DNA, 27 bp, Artificial sequence
  SiRNA target sequence
ccacaactccaaacaccttctaccttt

SEQ ID NO: 84337 - DNA, 27 bp, Artificial sequence
  SiRNA target sequence
cacaactccaaacaccttctacctttt

SEQ ID NO: 84338 - DNA, 27 bp, Artificial sequence
  SiRNA target sequence
acaactccaaacaccttctaccttttt

SEQ ID NO: 84339 - DNA, 27 bp, Artificial sequence
  SiRNA target sequence
caactccaaacaccttctaccttttta

SEQ ID NO: 84340 - DNA, 27 bp, Artificial sequence
  SiRNA target sequence
aactccaaacaccttctacctttttac

SEQ ID NO: 84341 - DNA, 27 bp, Artificial sequence
  SiRNA target sequence
actccaaacaccttctacctttttaca

SEQ ID NO: 84342 - DNA, 27 bp, Artificial sequence
  SiRNA target sequence
ctccaaacaccttctacctttttacag

SEQ ID NO: 84343 - DNA, 27 bp, Artificial sequence
  SiRNA target sequence
tccaaacaccttctacctttttacagt

SEQ ID NO: 84344 - DNA, 27 bp, Artificial sequence
  SiRNA target sequence
ccaaacaccttctacctttttacagtc

SEQ ID NO: 84345 - DNA, 27 bp, Artificial sequence
  SiRNA target sequence
caaacaccttctacctttttacagtcc

SEQ ID NO: 84346 - DNA, 27 bp, Artificial sequence
  SiRNA target sequence
aaacaccttctacctttttacagtcca

SEQ ID NO: 84347 - DNA, 27 bp, Artificial sequence
  SiRNA target sequence
aacaccttctacctttttacagtccat

SEQ ID NO: 84348 - DNA, 27 bp, Artificial sequence
  SiRNA target sequence
acaccttctacctttttacagtccata

SEQ ID NO: 84349 - DNA, 27 bp, Artificial sequence
  SiRNA target sequence
caccttctacctttttacagtccataa

SEQ ID NO: 84350 - DNA, 27 bp, Artificial sequence
  SiRNA target sequence
accttctacctttttacagtccataat

SEQ ID NO: 84351 - DNA, 27 bp, Artificial sequence
  SiRNA target sequence
ccttctacctttttacagtccataatg

SEQ ID NO: 84352 - DNA, 27 bp, Artificial sequence
  SiRNA target sequence
cttctacctttttacagtccataatgg

SEQ ID NO: 84353 - DNA, 27 bp, Artificial sequence
  SiRNA target sequence
ttctacctttttacagtccataatggg

SEQ ID NO: 84354 - DNA, 27 bp, Artificial sequence
  SiRNA target sequence
tctacctttttacagtccataatgggc

SEQ ID NO: 84355 - DNA, 27 bp, Artificial sequence
  SiRNA target sequence
ctacctttttacagtccataatgggct

SEQ ID NO: 84356 - DNA, 27 bp, Artificial sequence
  SiRNA target sequence
tacctttttacagtccataatgggctt

SEQ ID NO: 84357 - DNA, 27 bp, Artificial sequence
  SiRNA target sequence
acctttttacagtccataatgggcttt

SEQ ID NO: 84358 - DNA, 27 bp, Artificial sequence
  SiRNA target sequence
cctttttacagtccataatgggctttc

SEQ ID NO: 84359 - DNA, 27 bp, Artificial sequence
  SiRNA target sequence
ctttttacagtccataatgggctttcc

SEQ ID NO: 84360 - DNA, 27 bp, Artificial sequence
  SiRNA target sequence
tttttacagtccataatgggctttcct

SEQ ID NO: 84361 - DNA, 27 bp, Artificial sequence
  SiRNA target sequence
ttttacagtccataatgggctttccta

SEQ ID NO: 84362 - DNA, 27 bp, Artificial sequence
  SiRNA target sequence
tttacagtccataatgggctttcctaa

SEQ ID NO: 84363 - DNA, 27 bp, Artificial sequence
  SiRNA target sequence
ttacagtccataatgggctttcctaat

SEQ ID NO: 84364 - DNA, 27 bp, Artificial sequence
  SiRNA target sequence
tacagtccataatgggctttcctaatc

SEQ ID NO: 84365 - DNA, 27 bp, Artificial sequence
  SiRNA target sequence
acagtccataatgggctttcctaatct

SEQ ID NO: 84366 - DNA, 27 bp, Artificial sequence
  SiRNA target sequence
cagtccataatgggctttcctaatctt

SEQ ID NO: 84367 - DNA, 27 bp, Artificial sequence
  SiRNA target sequence
agtccataatgggctttcctaatcttt

SEQ ID NO: 84368 - DNA, 27 bp, Artificial sequence
  SiRNA target sequence
gtccataatgggctttcctaatctttt

SEQ ID NO: 84369 - DNA, 27 bp, Artificial sequence
  SiRNA target sequence
tccataatgggctttcctaatctttta

SEQ ID NO: 84370 - DNA, 27 bp, Artificial sequence
  SiRNA target sequence
ccataatgggctttcctaatcttttat

SEQ ID NO: 84371 - DNA, 27 bp, Artificial sequence
  SiRNA target sequence
cataatgggctttcctaatcttttatt

SEQ ID NO: 84372 - DNA, 27 bp, Artificial sequence
  SiRNA target sequence
ataatgggctttcctaatcttttatta

SEQ ID NO: 84373 - DNA, 27 bp, Artificial sequence
  SiRNA target sequence
taatgggctttcctaatcttttattaa

SEQ ID NO: 84374 - DNA, 27 bp, Artificial sequence
  SiRNA target sequence
aatgggctttcctaatcttttattaac

SEQ ID NO: 84375 - DNA, 27 bp, Artificial sequence
  SiRNA target sequence
atgggctttcctaatcttttattaact

SEQ ID NO: 84376 - DNA, 27 bp, Artificial sequence
  SiRNA target sequence
tgggctttcctaatcttttattaacta

SEQ ID NO: 84377 - DNA, 27 bp, Artificial sequence
  SiRNA target sequence
gggctttcctaatcttttattaactat

SEQ ID NO: 84378 - DNA, 27 bp, Artificial sequence
  SiRNA target sequence
ggctttcctaatcttttattaactatg

SEQ ID NO: 84379 - DNA, 27 bp, Artificial sequence
  SiRNA target sequence
gctttcctaatcttttattaactatgt

SEQ ID NO: 84380 - DNA, 27 bp, Artificial sequence
  SiRNA target sequence
ctttcctaatcttttattaactatgtt

SEQ ID NO: 84381 - DNA, 27 bp, Artificial sequence
  SiRNA target sequence
tttcctaatcttttattaactatgtta

SEQ ID NO: 84382 - DNA, 27 bp, Artificial sequence
  SiRNA target sequence
ttcctaatcttttattaactatgttat

SEQ ID NO: 84383 - DNA, 27 bp, Artificial sequence
  SiRNA target sequence
tcctaatcttttattaactatgttatg

SEQ ID NO: 84384 - DNA, 27 bp, Artificial sequence
  SiRNA target sequence
cctaatcttttattaactatgttatgt

SEQ ID NO: 84385 - DNA, 27 bp, Artificial sequence
  SiRNA target sequence
ctaatcttttattaactatgttatgtg

SEQ ID NO: 84386 - DNA, 27 bp, Artificial sequence
  SiRNA target sequence
taatcttttattaactatgttatgtgc

SEQ ID NO: 84387 - DNA, 27 bp, Artificial sequence
  SiRNA target sequence
aatcttttattaactatgttatgtgct

SEQ ID NO: 84388 - DNA, 27 bp, Artificial sequence
  SiRNA target sequence
atcttttattaactatgttatgtgctt

SEQ ID NO: 84389 - DNA, 27 bp, Artificial sequence
  SiRNA target sequence
tcttttattaactatgttatgtgcttt

SEQ ID NO: 84390 - DNA, 27 bp, Artificial sequence
  SiRNA target sequence
cttttattaactatgttatgtgcttta

SEQ ID NO: 84391 - DNA, 27 bp, Artificial sequence
  SiRNA target sequence
ttttattaactatgttatgtgctttac

SEQ ID NO: 84392 - DNA, 27 bp, Artificial sequence
  SiRNA target sequence
tttattaactatgttatgtgctttaca

SEQ ID NO: 84393 - DNA, 27 bp, Artificial sequence
  SiRNA target sequence
ttattaactatgttatgtgctttacat

SEQ ID NO: 84394 - DNA, 27 bp, Artificial sequence
  SiRNA target sequence
tattaactatgttatgtgctttacata

SEQ ID NO: 84395 - DNA, 27 bp, Artificial sequence
  SiRNA target sequence
attaactatgttatgtgctttacatag

SEQ ID NO: 84396 - DNA, 27 bp, Artificial sequence
  SiRNA target sequence
ttaactatgttatgtgctttacatagc

SEQ ID NO: 84397 - DNA, 27 bp, Artificial sequence
  SiRNA target sequence
taactatgttatgtgctttacatagcc

SEQ ID NO: 84398 - DNA, 27 bp, Artificial sequence
  SiRNA target sequence
aactatgttatgtgctttacatagcca

SEQ ID NO: 84399 - DNA, 27 bp, Artificial sequence
  SiRNA target sequence
actatgttatgtgctttacatagccac

SEQ ID NO: 84400 - DNA, 27 bp, Artificial sequence
  SiRNA target sequence
ctatgttatgtgctttacatagccact

SEQ ID NO: 84401 - DNA, 27 bp, Artificial sequence
  SiRNA target sequence
tatgttatgtgctttacatagccactg

SEQ ID NO: 84402 - DNA, 27 bp, Artificial sequence
  SiRNA target sequence
atgttatgtgctttacatagccactgg

SEQ ID NO: 84403 - DNA, 27 bp, Artificial sequence
  SiRNA target sequence
tgttatgtgctttacatagccactgga

SEQ ID NO: 84404 - DNA, 27 bp, Artificial sequence
  SiRNA target sequence
gttatgtgctttacatagccactggac

SEQ ID NO: 84405 - DNA, 27 bp, Artificial sequence
  SiRNA target sequence
ttatgtgctttacatagccactggaca

SEQ ID NO: 84406 - DNA, 27 bp, Artificial sequence
  SiRNA target sequence
tatgtgctttacatagccactggacaa

SEQ ID NO: 84407 - DNA, 27 bp, Artificial sequence
  SiRNA target sequence
atgtgctttacatagccactggacaaa

SEQ ID NO: 84408 - DNA, 27 bp, Artificial sequence
  SiRNA target sequence
tgtgctttacatagccactggacaaat

SEQ ID NO: 84409 - DNA, 27 bp, Artificial sequence
  SiRNA target sequence
gtgctttacatagccactggacaaatt

SEQ ID NO: 84410 - DNA, 27 bp, Artificial sequence
  SiRNA target sequence
tgctttacatagccactggacaaattc

SEQ ID NO: 84411 - DNA, 27 bp, Artificial sequence
  SiRNA target sequence
gctttacatagccactggacaaattcg

SEQ ID NO: 84412 - DNA, 27 bp, Artificial sequence
  SiRNA target sequence
ctttacatagccactggacaaattcgt

SEQ ID NO: 84413 - DNA, 27 bp, Artificial sequence
  SiRNA target sequence
tttacatagccactggacaaattcgtc

SEQ ID NO: 84414 - DNA, 27 bp, Artificial sequence
  SiRNA target sequence
ttacatagccactggacaaattcgtca

SEQ ID NO: 84415 - DNA, 27 bp, Artificial sequence
  SiRNA target sequence
tacatagccactggacaaattcgtcat

SEQ ID NO: 84416 - DNA, 27 bp, Artificial sequence
  SiRNA target sequence
acatagccactggacaaattcgtcatg

SEQ ID NO: 84417 - DNA, 27 bp, Artificial sequence
  SiRNA target sequence
catagccactggacaaattcgtcatgt

SEQ ID NO: 84418 - DNA, 27 bp, Artificial sequence
  SiRNA target sequence
atagccactggacaaattcgtcatgtg

SEQ ID NO: 84419 - DNA, 27 bp, Artificial sequence
  SiRNA target sequence
tagccactggacaaattcgtcatgtgt

SEQ ID NO: 84420 - DNA, 27 bp, Artificial sequence
  SiRNA target sequence
agccactggacaaattcgtcatgtgtg

SEQ ID NO: 84421 - DNA, 27 bp, Artificial sequence
  SiRNA target sequence
gccactggacaaattcgtcatgtgtgg

SEQ ID NO: 84422 - DNA, 27 bp, Artificial sequence
  SiRNA target sequence
ccactggacaaattcgtcatgtgtggc

SEQ ID NO: 84423 - DNA, 27 bp, Artificial sequence
  SiRNA target sequence
cactggacaaattcgtcatgtgtggca

SEQ ID NO: 84424 - DNA, 27 bp, Artificial sequence
  SiRNA target sequence
actggacaaattcgtcatgtgtggcaa

SEQ ID NO: 84425 - DNA, 27 bp, Artificial sequence
  SiRNA target sequence
ctggacaaattcgtcatgtgtggcaac

SEQ ID NO: 84426 - DNA, 27 bp, Artificial sequence
  SiRNA target sequence
tggacaaattcgtcatgtgtggcaact

SEQ ID NO: 84427 - DNA, 27 bp, Artificial sequence
  SiRNA target sequence
ggacaaattcgtcatgtgtggcaactt

SEQ ID NO: 84428 - DNA, 27 bp, Artificial sequence
  SiRNA target sequence
gacaaattcgtcatgtgtggcaacttg

SEQ ID NO: 84429 - DNA, 27 bp, Artificial sequence
  SiRNA target sequence
acaaattcgtcatgtgtggcaacttgt

SEQ ID NO: 84430 - DNA, 27 bp, Artificial sequence
  SiRNA target sequence
caaattcgtcatgtgtggcaacttgtg

SEQ ID NO: 84431 - DNA, 27 bp, Artificial sequence
  SiRNA target sequence
aaattcgtcatgtgtggcaacttgtgg

SEQ ID NO: 84432 - DNA, 27 bp, Artificial sequence
  SiRNA target sequence
aattcgtcatgtgtggcaacttgtgga

SEQ ID NO: 84433 - DNA, 27 bp, Artificial sequence
  SiRNA target sequence
attcgtcatgtgtggcaacttgtggag

SEQ ID NO: 84434 - DNA, 27 bp, Artificial sequence
  SiRNA target sequence
ttcgtcatgtgtggcaacttgtggagg

SEQ ID NO: 84435 - DNA, 27 bp, Artificial sequence
  SiRNA target sequence
tcgtcatgtgtggcaacttgtggagga

SEQ ID NO: 84436 - DNA, 27 bp, Artificial sequence
  SiRNA target sequence
cgtcatgtgtggcaacttgtggaggat

SEQ ID NO: 84437 - DNA, 27 bp, Artificial sequence
  SiRNA target sequence
gtcatgtgtggcaacttgtggaggatt

SEQ ID NO: 84438 - DNA, 27 bp, Artificial sequence
  SiRNA target sequence
tcatgtgtggcaacttgtggaggattt

SEQ ID NO: 84439 - DNA, 27 bp, Artificial sequence
  SiRNA target sequence
catgtgtggcaacttgtggaggattta

SEQ ID NO: 84440 - DNA, 27 bp, Artificial sequence
  SiRNA target sequence
atgtgtggcaacttgtggaggatttaa

SEQ ID NO: 84441 - DNA, 27 bp, Artificial sequence
  SiRNA target sequence
tgtgtggcaacttgtggaggatttaag

SEQ ID NO: 84442 - DNA, 27 bp, Artificial sequence
  SiRNA target sequence
gtgtggcaacttgtggaggatttaagc

SEQ ID NO: 84443 - DNA, 27 bp, Artificial sequence
  SiRNA target sequence
tgtggcaacttgtggaggatttaagct

SEQ ID NO: 84444 - DNA, 27 bp, Artificial sequence
  SiRNA target sequence
gtggcaacttgtggaggatttaagctt

SEQ ID NO: 84445 - DNA, 27 bp, Artificial sequence
  SiRNA target sequence
tggcaacttgtggaggatttaagctta

SEQ ID NO: 84446 - DNA, 27 bp, Artificial sequence
  SiRNA target sequence
ggcaacttgtggaggatttaagcttaa

SEQ ID NO: 84447 - DNA, 27 bp, Artificial sequence
  SiRNA target sequence
gcaacttgtggaggatttaagcttaac

SEQ ID NO: 84448 - DNA, 27 bp, Artificial sequence
  SiRNA target sequence
caacttgtggaggatttaagcttaaca

SEQ ID NO: 84449 - DNA, 27 bp, Artificial sequence
  SiRNA target sequence
aacttgtggaggatttaagcttaacag

SEQ ID NO: 84450 - DNA, 27 bp, Artificial sequence
  SiRNA target sequence
acttgtggaggatttaagcttaacagt

SEQ ID NO: 84451 - DNA, 27 bp, Artificial sequence
  SiRNA target sequence
cttgtggaggatttaagcttaacagtc

SEQ ID NO: 84452 - DNA, 27 bp, Artificial sequence
  SiRNA target sequence
ttgtggaggatttaagcttaacagtct

SEQ ID NO: 84453 - DNA, 27 bp, Artificial sequence
  SiRNA target sequence
tgtggaggatttaagcttaacagtctt

SEQ ID NO: 84454 - DNA, 27 bp, Artificial sequence
  SiRNA target sequence
gtggaggatttaagcttaacagtcttt

SEQ ID NO: 84455 - DNA, 27 bp, Artificial sequence
  SiRNA target sequence
tggaggatttaagcttaacagtctttg

SEQ ID NO: 84456 - DNA, 27 bp, Artificial sequence
  SiRNA target sequence
ggaggatttaagcttaacagtctttga

SEQ ID NO: 84457 - DNA, 27 bp, Artificial sequence
  SiRNA target sequence
gaggatttaagcttaacagtctttgaa

SEQ ID NO: 84458 - DNA, 27 bp, Artificial sequence
  SiRNA target sequence
aggatttaagcttaacagtctttgaaa

SEQ ID NO: 84459 - DNA, 27 bp, Artificial sequence
  SiRNA target sequence
ggatttaagcttaacagtctttgaaaa

SEQ ID NO: 84460 - DNA, 27 bp, Artificial sequence
  SiRNA target sequence
gatttaagcttaacagtctttgaaaat

SEQ ID NO: 84461 - DNA, 27 bp, Artificial sequence
  SiRNA target sequence
atttaagcttaacagtctttgaaaatg

SEQ ID NO: 84462 - DNA, 27 bp, Artificial sequence
  SiRNA target sequence
tttaagcttaacagtctttgaaaatgt

SEQ ID NO: 84463 - DNA, 27 bp, Artificial sequence
  SiRNA target sequence
ttaagcttaacagtctttgaaaatgtc

SEQ ID NO: 84464 - DNA, 27 bp, Artificial sequence
  SiRNA target sequence
taagcttaacagtctttgaaaatgtcc

SEQ ID NO: 84465 - DNA, 27 bp, Artificial sequence
  SiRNA target sequence
aagcttaacagtctttgaaaatgtcca

SEQ ID NO: 84466 - DNA, 27 bp, Artificial sequence
  SiRNA target sequence
agcttaacagtctttgaaaatgtccac

SEQ ID NO: 84467 - DNA, 27 bp, Artificial sequence
  SiRNA target sequence
gcttaacagtctttgaaaatgtccaca

SEQ ID NO: 84468 - DNA, 27 bp, Artificial sequence
  SiRNA target sequence
cttaacagtctttgaaaatgtccacaa

SEQ ID NO: 84469 - DNA, 27 bp, Artificial sequence
  SiRNA target sequence
ttaacagtctttgaaaatgtccacaac

SEQ ID NO: 84470 - DNA, 27 bp, Artificial sequence
  SiRNA target sequence
taacagtctttgaaaatgtccacaaca

SEQ ID NO: 84471 - DNA, 27 bp, Artificial sequence
  SiRNA target sequence
aacagtctttgaaaatgtccacaacat

SEQ ID NO: 84472 - DNA, 27 bp, Artificial sequence
  SiRNA target sequence
acagtctttgaaaatgtccacaacatt

SEQ ID NO: 84473 - DNA, 27 bp, Artificial sequence
  SiRNA target sequence
cagtctttgaaaatgtccacaacattc

SEQ ID NO: 84474 - DNA, 27 bp, Artificial sequence
  SiRNA target sequence
agtctttgaaaatgtccacaacattct

SEQ ID NO: 84475 - DNA, 27 bp, Artificial sequence
  SiRNA target sequence
gtctttgaaaatgtccacaacattctg

SEQ ID NO: 84476 - DNA, 27 bp, Artificial sequence
  SiRNA target sequence
tctttgaaaatgtccacaacattctgc

SEQ ID NO: 84477 - DNA, 27 bp, Artificial sequence
  SiRNA target sequence
ctttgaaaatgtccacaacattctgca

SEQ ID NO: 84478 - DNA, 27 bp, Artificial sequence
  SiRNA target sequence
tttgaaaatgtccacaacattctgcac

SEQ ID NO: 84479 - DNA, 27 bp, Artificial sequence
  SiRNA target sequence
ttgaaaatgtccacaacattctgcaca

SEQ ID NO: 84480 - DNA, 27 bp, Artificial sequence
  SiRNA target sequence
tgaaaatgtccacaacattctgcacag

SEQ ID NO: 84481 - DNA, 27 bp, Artificial sequence
  SiRNA target sequence
gaaaatgtccacaacattctgcacagg

SEQ ID NO: 84482 - DNA, 27 bp, Artificial sequence
  SiRNA target sequence
aaaatgtccacaacattctgcacaggg

SEQ ID NO: 84483 - DNA, 27 bp, Artificial sequence
  SiRNA target sequence
aaatgtccacaacattctgcacagggg

SEQ ID NO: 84484 - DNA, 27 bp, Artificial sequence
  SiRNA target sequence
aatgtccacaacattctgcacagggga

SEQ ID NO: 84485 - DNA, 27 bp, Artificial sequence
  SiRNA target sequence
atgtccacaacattctgcacaggggaa

SEQ ID NO: 84486 - DNA, 27 bp, Artificial sequence
  SiRNA target sequence
tgtccacaacattctgcacaggggaaa

SEQ ID NO: 84487 - DNA, 27 bp, Artificial sequence
  SiRNA target sequence
gtccacaacattctgcacaggggaaaa

SEQ ID NO: 84488 - DNA, 27 bp, Artificial sequence
  SiRNA target sequence
tccacaacattctgcacaggggaaaag

SEQ ID NO: 84489 - DNA, 27 bp, Artificial sequence
  SiRNA target sequence
ccacaacattctgcacaggggaaaaga

SEQ ID NO: 84490 - DNA, 27 bp, Artificial sequence
  SiRNA target sequence
cacaacattctgcacaggggaaaagag

SEQ ID NO: 84491 - DNA, 27 bp, Artificial sequence
  SiRNA target sequence
acaacattctgcacaggggaaaagaga

SEQ ID NO: 84492 - DNA, 27 bp, Artificial sequence
  SiRNA target sequence
caacattctgcacaggggaaaagagat

SEQ ID NO: 84493 - DNA, 27 bp, Artificial sequence
  SiRNA target sequence
aacattctgcacaggggaaaagagatg

SEQ ID NO: 84494 - DNA, 27 bp, Artificial sequence
  SiRNA target sequence
acattctgcacaggggaaaagagatga

SEQ ID NO: 84495 - DNA, 27 bp, Artificial sequence
  SiRNA target sequence
cattctgcacaggggaaaagagatgat

SEQ ID NO: 84496 - DNA, 27 bp, Artificial sequence
  SiRNA target sequence
attctgcacaggggaaaagagatgata

SEQ ID NO: 84497 - DNA, 27 bp, Artificial sequence
  SiRNA target sequence
ttctgcacaggggaaaagagatgataa

SEQ ID NO: 84498 - DNA, 27 bp, Artificial sequence
  SiRNA target sequence
tctgcacaggggaaaagagatgataaa

SEQ ID NO: 84499 - DNA, 27 bp, Artificial sequence
  SiRNA target sequence
ctgcacaggggaaaagagatgataaaa

SEQ ID NO: 84500 - DNA, 27 bp, Artificial sequence
  SiRNA target sequence
tgcacaggggaaaagagatgataaaag

SEQ ID NO: 84501 - DNA, 27 bp, Artificial sequence
  SiRNA target sequence
gcacaggggaaaagagatgataaaagg

SEQ ID NO: 84502 - DNA, 27 bp, Artificial sequence
  SiRNA target sequence
cacaggggaaaagagatgataaaaggt

SEQ ID NO: 84503 - DNA, 27 bp, Artificial sequence
  SiRNA target sequence
acaggggaaaagagatgataaaaggta

SEQ ID NO: 84504 - DNA, 27 bp, Artificial sequence
  SiRNA target sequence
caggggaaaagagatgataaaaggtaa

SEQ ID NO: 84505 - DNA, 27 bp, Artificial sequence
  SiRNA target sequence
aggggaaaagagatgataaaaggtaaa

SEQ ID NO: 84506 - DNA, 27 bp, Artificial sequence
  SiRNA target sequence
ggggaaaagagatgataaaaggtaaat

SEQ ID NO: 84507 - DNA, 27 bp, Artificial sequence
  SiRNA target sequence
gggaaaagagatgataaaaggtaaata

SEQ ID NO: 84508 - DNA, 27 bp, Artificial sequence
  SiRNA target sequence
ggaaaagagatgataaaaggtaaataa

SEQ ID NO: 84509 - DNA, 27 bp, Artificial sequence
  SiRNA target sequence
gaaaagagatgataaaaggtaaataaa

SEQ ID NO: 84510 - DNA, 27 bp, Artificial sequence
  SiRNA target sequence
aaaagagatgataaaaggtaaataaat

SEQ ID NO: 84511 - DNA, 27 bp, Artificial sequence
  SiRNA target sequence
aaagagatgataaaaggtaaataaatt

SEQ ID NO: 84512 - DNA, 27 bp, Artificial sequence
  SiRNA target sequence
aagagatgataaaaggtaaataaattg

SEQ ID NO: 84513 - DNA, 27 bp, Artificial sequence
  SiRNA target sequence
agagatgataaaaggtaaataaattga

SEQ ID NO: 84514 - DNA, 27 bp, Artificial sequence
  SiRNA target sequence
gagatgataaaaggtaaataaattgaa

SEQ ID NO: 84515 - DNA, 27 bp, Artificial sequence
  SiRNA target sequence
agatgataaaaggtaaataaattgaag

SEQ ID NO: 84516 - DNA, 27 bp, Artificial sequence
  SiRNA target sequence
gatgataaaaggtaaataaattgaagt

SEQ ID NO: 84517 - DNA, 27 bp, Artificial sequence
  SiRNA target sequence
atgataaaaggtaaataaattgaagtg

SEQ ID NO: 84518 - DNA, 27 bp, Artificial sequence
  SiRNA target sequence
tgataaaaggtaaataaattgaagtgt

SEQ ID NO: 84519 - DNA, 27 bp, Artificial sequence
  SiRNA target sequence
gataaaaggtaaataaattgaagtgta

SEQ ID NO: 84520 - DNA, 27 bp, Artificial sequence
  SiRNA target sequence
ataaaaggtaaataaattgaagtgtat

SEQ ID NO: 84521 - DNA, 27 bp, Artificial sequence
  SiRNA target sequence
taaaaggtaaataaattgaagtgtatc

SEQ ID NO: 84522 - DNA, 27 bp, Artificial sequence
  SiRNA target sequence
aaaaggtaaataaattgaagtgtatct

SEQ ID NO: 84523 - DNA, 27 bp, Artificial sequence
  SiRNA target sequence
aaaggtaaataaattgaagtgtatctt

SEQ ID NO: 84524 - DNA, 27 bp, Artificial sequence
  SiRNA target sequence
aaggtaaataaattgaagtgtatcttt

SEQ ID NO: 84525 - DNA, 27 bp, Artificial sequence
  SiRNA target sequence
aggtaaataaattgaagtgtatctttt

SEQ ID NO: 84526 - DNA, 27 bp, Artificial sequence
  SiRNA target sequence
ggtaaataaattgaagtgtatcttttt

SEQ ID NO: 84527 - DNA, 27 bp, Artificial sequence
  SiRNA target sequence
gtaaataaattgaagtgtatctttttt

SEQ ID NO: 84528 - DNA, 27 bp, Artificial sequence
  SiRNA target sequence
taaataaattgaagtgtatctttttta

SEQ ID NO: 84529 - DNA, 27 bp, Artificial sequence
  SiRNA target sequence
aaataaattgaagtgtatcttttttat

SEQ ID NO: 84530 - DNA, 27 bp, Artificial sequence
  SiRNA target sequence
aataaattgaagtgtatcttttttatg

SEQ ID NO: 84531 - DNA, 27 bp, Artificial sequence
  SiRNA target sequence
ataaattgaagtgtatcttttttatgt

SEQ ID NO: 84532 - DNA, 27 bp, Artificial sequence
  SiRNA target sequence
taaattgaagtgtatcttttttatgtt

SEQ ID NO: 84533 - DNA, 27 bp, Artificial sequence
  SiRNA target sequence
aaattgaagtgtatcttttttatgttg

SEQ ID NO: 84534 - DNA, 27 bp, Artificial sequence
  SiRNA target sequence
aattgaagtgtatcttttttatgttgt

SEQ ID NO: 84535 - DNA, 27 bp, Artificial sequence
  SiRNA target sequence
attgaagtgtatcttttttatgttgta

SEQ ID NO: 84536 - DNA, 27 bp, Artificial sequence
  SiRNA target sequence
ttgaagtgtatcttttttatgttgtac

SEQ ID NO: 84537 - DNA, 27 bp, Artificial sequence
  SiRNA target sequence
tgaagtgtatcttttttatgttgtact

SEQ ID NO: 84538 - DNA, 27 bp, Artificial sequence
  SiRNA target sequence
gaagtgtatcttttttatgttgtactg

SEQ ID NO: 84539 - DNA, 27 bp, Artificial sequence
  SiRNA target sequence
aagtgtatcttttttatgttgtactgt

SEQ ID NO: 84540 - DNA, 27 bp, Artificial sequence
  SiRNA target sequence
agtgtatcttttttatgttgtactgta

SEQ ID NO: 84541 - DNA, 27 bp, Artificial sequence
  SiRNA target sequence
gtgtatcttttttatgttgtactgtag

SEQ ID NO: 84542 - DNA, 27 bp, Artificial sequence
  SiRNA target sequence
tgtatcttttttatgttgtactgtagg

SEQ ID NO: 84543 - DNA, 27 bp, Artificial sequence
  SiRNA target sequence
gtatcttttttatgttgtactgtagga

SEQ ID NO: 84544 - DNA, 27 bp, Artificial sequence
  SiRNA target sequence
tatcttttttatgttgtactgtaggaa

SEQ ID NO: 84545 - DNA, 27 bp, Artificial sequence
  SiRNA target sequence
atcttttttatgttgtactgtaggaaa

SEQ ID NO: 84546 - DNA, 27 bp, Artificial sequence
  SiRNA target sequence
tcttttttatgttgtactgtaggaaat

SEQ ID NO: 84547 - DNA, 27 bp, Artificial sequence
  SiRNA target sequence
cttttttatgttgtactgtaggaaatg

SEQ ID NO: 84548 - DNA, 27 bp, Artificial sequence
  SiRNA target sequence
ttttttatgttgtactgtaggaaatgc

SEQ ID NO: 84549 - DNA, 27 bp, Artificial sequence
  SiRNA target sequence
tttttatgttgtactgtaggaaatgca

SEQ ID NO: 84550 - DNA, 27 bp, Artificial sequence
  SiRNA target sequence
ttttatgttgtactgtaggaaatgcag

SEQ ID NO: 84551 - DNA, 27 bp, Artificial sequence
  SiRNA target sequence
tttatgttgtactgtaggaaatgcagg

SEQ ID NO: 84552 - DNA, 27 bp, Artificial sequence
  SiRNA target sequence
ttatgttgtactgtaggaaatgcagga

SEQ ID NO: 84553 - DNA, 27 bp, Artificial sequence
  SiRNA target sequence
tatgttgtactgtaggaaatgcaggat

SEQ ID NO: 84554 - DNA, 27 bp, Artificial sequence
  SiRNA target sequence
atgttgtactgtaggaaatgcaggata

SEQ ID NO: 84555 - DNA, 27 bp, Artificial sequence
  SiRNA target sequence
tgttgtactgtaggaaatgcaggataa

SEQ ID NO: 84556 - DNA, 27 bp, Artificial sequence
  SiRNA target sequence
gttgtactgtaggaaatgcaggataaa

SEQ ID NO: 84557 - DNA, 27 bp, Artificial sequence
  SiRNA target sequence
ttgtactgtaggaaatgcaggataaac

SEQ ID NO: 84558 - DNA, 27 bp, Artificial sequence
  SiRNA target sequence
tgtactgtaggaaatgcaggataaaca

SEQ ID NO: 84559 - DNA, 27 bp, Artificial sequence
  SiRNA target sequence
gtactgtaggaaatgcaggataaacag

SEQ ID NO: 84560 - DNA, 27 bp, Artificial sequence
  SiRNA target sequence
tactgtaggaaatgcaggataaacagc

SEQ ID NO: 84561 - DNA, 27 bp, Artificial sequence
  SiRNA target sequence
actgtaggaaatgcaggataaacagct

SEQ ID NO: 84562 - DNA, 27 bp, Artificial sequence
  SiRNA target sequence
ctgtaggaaatgcaggataaacagctg

SEQ ID NO: 84563 - DNA, 27 bp, Artificial sequence
  SiRNA target sequence
tgtaggaaatgcaggataaacagctgc

SEQ ID NO: 84564 - DNA, 27 bp, Artificial sequence
  SiRNA target sequence
gtaggaaatgcaggataaacagctgcc

SEQ ID NO: 84565 - DNA, 27 bp, Artificial sequence
  SiRNA target sequence
taggaaatgcaggataaacagctgcca

SEQ ID NO: 84566 - DNA, 27 bp, Artificial sequence
  SiRNA target sequence
aggaaatgcaggataaacagctgccat

SEQ ID NO: 84567 - DNA, 27 bp, Artificial sequence
  SiRNA target sequence
ggaaatgcaggataaacagctgccatg

SEQ ID NO: 84568 - DNA, 27 bp, Artificial sequence
  SiRNA target sequence
gaaatgcaggataaacagctgccatgg

SEQ ID NO: 84569 - DNA, 27 bp, Artificial sequence
  SiRNA target sequence
aaatgcaggataaacagctgccatggt

SEQ ID NO: 84570 - DNA, 27 bp, Artificial sequence
  SiRNA target sequence
aatgcaggataaacagctgccatggta

SEQ ID NO: 84571 - DNA, 27 bp, Artificial sequence
  SiRNA target sequence
atgcaggataaacagctgccatggtat

SEQ ID NO: 84572 - DNA, 27 bp, Artificial sequence
  SiRNA target sequence
tgcaggataaacagctgccatggtatg

SEQ ID NO: 84573 - DNA, 27 bp, Artificial sequence
  SiRNA target sequence
gcaggataaacagctgccatggtatgt

SEQ ID NO: 84574 - DNA, 27 bp, Artificial sequence
  SiRNA target sequence
caggataaacagctgccatggtatgta

SEQ ID NO: 84575 - DNA, 27 bp, Artificial sequence
  SiRNA target sequence
aggataaacagctgccatggtatgtaa

SEQ ID NO: 84576 - DNA, 27 bp, Artificial sequence
  SiRNA target sequence
ggataaacagctgccatggtatgtaaa

SEQ ID NO: 84577 - DNA, 27 bp, Artificial sequence
  SiRNA target sequence
gataaacagctgccatggtatgtaaaa

SEQ ID NO: 84578 - DNA, 27 bp, Artificial sequence
  SiRNA target sequence
ataaacagctgccatggtatgtaaaag

SEQ ID NO: 84579 - DNA, 27 bp, Artificial sequence
  SiRNA target sequence
taaacagctgccatggtatgtaaaagt

SEQ ID NO: 84580 - DNA, 27 bp, Artificial sequence
  SiRNA target sequence
aaacagctgccatggtatgtaaaagtg

SEQ ID NO: 84581 - DNA, 27 bp, Artificial sequence
  SiRNA target sequence
aacagctgccatggtatgtaaaagtgt

SEQ ID NO: 84582 - DNA, 27 bp, Artificial sequence
  SiRNA target sequence
acagctgccatggtatgtaaaagtgtc

SEQ ID NO: 84583 - DNA, 27 bp, Artificial sequence
  SiRNA target sequence
cagctgccatggtatgtaaaagtgtcc

SEQ ID NO: 84584 - DNA, 27 bp, Artificial sequence
  SiRNA target sequence
agctgccatggtatgtaaaagtgtcca

SEQ ID NO: 84585 - DNA, 27 bp, Artificial sequence
  SiRNA target sequence
gctgccatggtatgtaaaagtgtccat

SEQ ID NO: 84586 - DNA, 27 bp, Artificial sequence
  SiRNA target sequence
ctgccatggtatgtaaaagtgtccatg

SEQ ID NO: 84587 - DNA, 27 bp, Artificial sequence
  SiRNA target sequence
tgccatggtatgtaaaagtgtccatgt

SEQ ID NO: 84588 - DNA, 27 bp, Artificial sequence
  SiRNA target sequence
gccatggtatgtaaaagtgtccatgtt

SEQ ID NO: 84589 - DNA, 27 bp, Artificial sequence
  SiRNA target sequence
ccatggtatgtaaaagtgtccatgttg

SEQ ID NO: 84590 - DNA, 27 bp, Artificial sequence
  SiRNA target sequence
catggtatgtaaaagtgtccatgttgc

SEQ ID NO: 84591 - DNA, 27 bp, Artificial sequence
  SiRNA target sequence
atggtatgtaaaagtgtccatgttgct

SEQ ID NO: 84592 - DNA, 27 bp, Artificial sequence
  SiRNA target sequence
tggtatgtaaaagtgtccatgttgctc

SEQ ID NO: 84593 - DNA, 27 bp, Artificial sequence
  SiRNA target sequence
ggtatgtaaaagtgtccatgttgctct

SEQ ID NO: 84594 - DNA, 27 bp, Artificial sequence
  SiRNA target sequence
gtatgtaaaagtgtccatgttgctctc

SEQ ID NO: 84595 - DNA, 27 bp, Artificial sequence
  SiRNA target sequence
tatgtaaaagtgtccatgttgctctcc

SEQ ID NO: 84596 - DNA, 27 bp, Artificial sequence
  SiRNA target sequence
atgtaaaagtgtccatgttgctctccc

SEQ ID NO: 84597 - DNA, 27 bp, Artificial sequence
  SiRNA target sequence
tgtaaaagtgtccatgttgctctcccc

SEQ ID NO: 84598 - DNA, 27 bp, Artificial sequence
  SiRNA target sequence
gtaaaagtgtccatgttgctctcccca

SEQ ID NO: 84599 - DNA, 27 bp, Artificial sequence
  SiRNA target sequence
taaaagtgtccatgttgctctccccaa

SEQ ID NO: 84600 - DNA, 27 bp, Artificial sequence
  SiRNA target sequence
aaaagtgtccatgttgctctccccaat

SEQ ID NO: 84601 - DNA, 27 bp, Artificial sequence
  SiRNA target sequence
aaagtgtccatgttgctctccccaatc

SEQ ID NO: 84602 - DNA, 27 bp, Artificial sequence
  SiRNA target sequence
aagtgtccatgttgctctccccaatct

SEQ ID NO: 84603 - DNA, 27 bp, Artificial sequence
  SiRNA target sequence
agtgtccatgttgctctccccaatcta

SEQ ID NO: 84604 - DNA, 27 bp, Artificial sequence
  SiRNA target sequence
gtgtccatgttgctctccccaatctat

SEQ ID NO: 84605 - DNA, 27 bp, Artificial sequence
  SiRNA target sequence
tgtccatgttgctctccccaatctatc

SEQ ID NO: 84606 - DNA, 27 bp, Artificial sequence
  SiRNA target sequence
gtccatgttgctctccccaatctatct

SEQ ID NO: 84607 - DNA, 27 bp, Artificial sequence
  SiRNA target sequence
tccatgttgctctccccaatctatctt

SEQ ID NO: 84608 - DNA, 27 bp, Artificial sequence
  SiRNA target sequence
ccatgttgctctccccaatctatcttt

SEQ ID NO: 84609 - DNA, 27 bp, Artificial sequence
  SiRNA target sequence
catgttgctctccccaatctatcttta

SEQ ID NO: 84610 - DNA, 27 bp, Artificial sequence
  SiRNA target sequence
atgttgctctccccaatctatctttaa

SEQ ID NO: 84611 - DNA, 27 bp, Artificial sequence
  SiRNA target sequence
tgttgctctccccaatctatctttaac

SEQ ID NO: 84612 - DNA, 27 bp, Artificial sequence
  SiRNA target sequence
gttgctctccccaatctatctttaact

SEQ ID NO: 84613 - DNA, 27 bp, Artificial sequence
  SiRNA target sequence
ttgctctccccaatctatctttaactt

SEQ ID NO: 84614 - DNA, 27 bp, Artificial sequence
  SiRNA target sequence
tgctctccccaatctatctttaacttc

SEQ ID NO: 84615 - DNA, 27 bp, Artificial sequence
  SiRNA target sequence
gctctccccaatctatctttaacttcc

SEQ ID NO: 84616 - DNA, 27 bp, Artificial sequence
  SiRNA target sequence
ctctccccaatctatctttaacttcct

SEQ ID NO: 84617 - DNA, 27 bp, Artificial sequence
  SiRNA target sequence
tctccccaatctatctttaacttcctt

SEQ ID NO: 84618 - DNA, 27 bp, Artificial sequence
  SiRNA target sequence
ctccccaatctatctttaacttcctta

SEQ ID NO: 84619 - DNA, 27 bp, Artificial sequence
  SiRNA target sequence
tccccaatctatctttaacttccttat

SEQ ID NO: 84620 - DNA, 27 bp, Artificial sequence
  SiRNA target sequence
ccccaatctatctttaacttccttatt

SEQ ID NO: 84621 - DNA, 27 bp, Artificial sequence
  SiRNA target sequence
cccaatctatctttaacttccttattt

SEQ ID NO: 84622 - DNA, 27 bp, Artificial sequence
  SiRNA target sequence
ccaatctatctttaacttccttatttg

SEQ ID NO: 84623 - DNA, 27 bp, Artificial sequence
  SiRNA target sequence
caatctatctttaacttccttatttgt

SEQ ID NO: 84624 - DNA, 27 bp, Artificial sequence
  SiRNA target sequence
aatctatctttaacttccttatttgtt

SEQ ID NO: 84625 - DNA, 27 bp, Artificial sequence
  SiRNA target sequence
atctatctttaacttccttatttgtta

SEQ ID NO: 84626 - DNA, 27 bp, Artificial sequence
  SiRNA target sequence
tctatctttaacttccttatttgttaa

SEQ ID NO: 84627 - DNA, 27 bp, Artificial sequence
  SiRNA target sequence
ctatctttaacttccttatttgttaat

SEQ ID NO: 84628 - DNA, 27 bp, Artificial sequence
  SiRNA target sequence
tatctttaacttccttatttgttaatt

SEQ ID NO: 84629 - DNA, 27 bp, Artificial sequence
  SiRNA target sequence
atctttaacttccttatttgttaattt

SEQ ID NO: 84630 - DNA, 27 bp, Artificial sequence
  SiRNA target sequence
tctttaacttccttatttgttaatttt

SEQ ID NO: 84631 - DNA, 27 bp, Artificial sequence
  SiRNA target sequence
ctttaacttccttatttgttaattttt

SEQ ID NO: 84632 - DNA, 27 bp, Artificial sequence
  SiRNA target sequence
tttaacttccttatttgttaatttttg

SEQ ID NO: 84633 - DNA, 27 bp, Artificial sequence
  SiRNA target sequence
ttaacttccttatttgttaatttttga

SEQ ID NO: 84634 - DNA, 27 bp, Artificial sequence
  SiRNA target sequence
taacttccttatttgttaatttttgat

SEQ ID NO: 84635 - DNA, 27 bp, Artificial sequence
  SiRNA target sequence
aacttccttatttgttaatttttgatt

SEQ ID NO: 84636 - DNA, 27 bp, Artificial sequence
  SiRNA target sequence
acttccttatttgttaatttttgatta

SEQ ID NO: 84637 - DNA, 27 bp, Artificial sequence
  SiRNA target sequence
cttccttatttgttaatttttgattat

SEQ ID NO: 84638 - DNA, 27 bp, Artificial sequence
  SiRNA target sequence
ttccttatttgttaatttttgattatg

SEQ ID NO: 84639 - DNA, 27 bp, Artificial sequence
  SiRNA target sequence
tccttatttgttaatttttgattatga

SEQ ID NO: 84640 - DNA, 27 bp, Artificial sequence
  SiRNA target sequence
ccttatttgttaatttttgattatgaa

SEQ ID NO: 84641 - DNA, 27 bp, Artificial sequence
  SiRNA target sequence
cttatttgttaatttttgattatgaat

SEQ ID NO: 84642 - DNA, 27 bp, Artificial sequence
  SiRNA target sequence
ttatttgttaatttttgattatgaatt

SEQ ID NO: 84643 - DNA, 27 bp, Artificial sequence
  SiRNA target sequence
tatttgttaatttttgattatgaatta

SEQ ID NO: 84644 - DNA, 27 bp, Artificial sequence
  SiRNA target sequence
atttgttaatttttgattatgaattag

SEQ ID NO: 84645 - DNA, 27 bp, Artificial sequence
  SiRNA target sequence
tttgttaatttttgattatgaattaga

SEQ ID NO: 84646 - DNA, 27 bp, Artificial sequence
  SiRNA target sequence
ttgttaatttttgattatgaattagac

SEQ ID NO: 84647 - DNA, 27 bp, Artificial sequence
  SiRNA target sequence
tgttaatttttgattatgaattagacc

SEQ ID NO: 84648 - DNA, 27 bp, Artificial sequence
  SiRNA target sequence
gttaatttttgattatgaattagacct

SEQ ID NO: 84649 - DNA, 27 bp, Artificial sequence
  SiRNA target sequence
ttaatttttgattatgaattagaccta

SEQ ID NO: 84650 - DNA, 27 bp, Artificial sequence
  SiRNA target sequence
taatttttgattatgaattagacctaa

SEQ ID NO: 84651 - DNA, 27 bp, Artificial sequence
  SiRNA target sequence
aatttttgattatgaattagacctaat

SEQ ID NO: 84652 - DNA, 27 bp, Artificial sequence
  SiRNA target sequence
atttttgattatgaattagacctaatt

SEQ ID NO: 84653 - DNA, 27 bp, Artificial sequence
  SiRNA target sequence
tttttgattatgaattagacctaattc

SEQ ID NO: 84654 - DNA, 27 bp, Artificial sequence
  SiRNA target sequence
ttttgattatgaattagacctaattca

SEQ ID NO: 84655 - DNA, 27 bp, Artificial sequence
  SiRNA target sequence
tttgattatgaattagacctaattcac

SEQ ID NO: 84656 - DNA, 27 bp, Artificial sequence
  SiRNA target sequence
ttgattatgaattagacctaattcacc

SEQ ID NO: 84657 - DNA, 27 bp, Artificial sequence
  SiRNA target sequence
tgattatgaattagacctaattcacct

SEQ ID NO: 84658 - DNA, 27 bp, Artificial sequence
  SiRNA target sequence
gattatgaattagacctaattcaccta

SEQ ID NO: 84659 - DNA, 27 bp, Artificial sequence
  SiRNA target sequence
attatgaattagacctaattcacctac

SEQ ID NO: 84660 - DNA, 27 bp, Artificial sequence
  SiRNA target sequence
ttatgaattagacctaattcacctact

SEQ ID NO: 84661 - DNA, 27 bp, Artificial sequence
  SiRNA target sequence
tatgaattagacctaattcacctactt

SEQ ID NO: 84662 - DNA, 27 bp, Artificial sequence
  SiRNA target sequence
atgaattagacctaattcacctacttt

SEQ ID NO: 84663 - DNA, 27 bp, Artificial sequence
  SiRNA target sequence
tgaattagacctaattcacctactttt

SEQ ID NO: 84664 - DNA, 27 bp, Artificial sequence
  SiRNA target sequence
gaattagacctaattcacctacttttg

SEQ ID NO: 84665 - DNA, 27 bp, Artificial sequence
  SiRNA target sequence
aattagacctaattcacctacttttgg

SEQ ID NO: 84666 - DNA, 27 bp, Artificial sequence
  SiRNA target sequence
attagacctaattcacctacttttggt

SEQ ID NO: 84667 - DNA, 27 bp, Artificial sequence
  SiRNA target sequence
ttagacctaattcacctacttttggtg

SEQ ID NO: 84668 - DNA, 27 bp, Artificial sequence
  SiRNA target sequence
tagacctaattcacctacttttggtga

SEQ ID NO: 84669 - DNA, 27 bp, Artificial sequence
  SiRNA target sequence
agacctaattcacctacttttggtgaa

SEQ ID NO: 84670 - DNA, 27 bp, Artificial sequence
  SiRNA target sequence
gacctaattcacctacttttggtgaaa

SEQ ID NO: 84671 - DNA, 27 bp, Artificial sequence
  SiRNA target sequence
acctaattcacctacttttggtgaaat

SEQ ID NO: 84672 - DNA, 27 bp, Artificial sequence
  SiRNA target sequence
cctaattcacctacttttggtgaaata

SEQ ID NO: 84673 - DNA, 27 bp, Artificial sequence
  SiRNA target sequence
ctaattcacctacttttggtgaaatag

SEQ ID NO: 84674 - DNA, 27 bp, Artificial sequence
  SiRNA target sequence
taattcacctacttttggtgaaataga

SEQ ID NO: 84675 - DNA, 27 bp, Artificial sequence
  SiRNA target sequence
aattcacctacttttggtgaaatagat

SEQ ID NO: 84676 - DNA, 27 bp, Artificial sequence
  SiRNA target sequence
attcacctacttttggtgaaatagatt

SEQ ID NO: 84677 - DNA, 27 bp, Artificial sequence
  SiRNA target sequence
ttcacctacttttggtgaaatagattg

SEQ ID NO: 84678 - DNA, 27 bp, Artificial sequence
  SiRNA target sequence
tcacctacttttggtgaaatagattgt

SEQ ID NO: 84679 - DNA, 27 bp, Artificial sequence
  SiRNA target sequence
cacctacttttggtgaaatagattgta

SEQ ID NO: 84680 - DNA, 27 bp, Artificial sequence
  SiRNA target sequence
acctacttttggtgaaatagattgtaa

SEQ ID NO: 84681 - DNA, 27 bp, Artificial sequence
  SiRNA target sequence
cctacttttggtgaaatagattgtaaa

SEQ ID NO: 84682 - DNA, 27 bp, Artificial sequence
  SiRNA target sequence
ctacttttggtgaaatagattgtaaaa

SEQ ID NO: 84683 - DNA, 27 bp, Artificial sequence
  SiRNA target sequence
tacttttggtgaaatagattgtaaaac

SEQ ID NO: 84684 - DNA, 27 bp, Artificial sequence
  SiRNA target sequence
acttttggtgaaatagattgtaaaaca

SEQ ID NO: 84685 - DNA, 27 bp, Artificial sequence
  SiRNA target sequence
cttttggtgaaatagattgtaaaacag

SEQ ID NO: 84686 - DNA, 27 bp, Artificial sequence
  SiRNA target sequence
ttttggtgaaatagattgtaaaacaga

SEQ ID NO: 84687 - DNA, 27 bp, Artificial sequence
  SiRNA target sequence
tttggtgaaatagattgtaaaacagat

SEQ ID NO: 84688 - DNA, 27 bp, Artificial sequence
  SiRNA target sequence
ttggtgaaatagattgtaaaacagatt

SEQ ID NO: 84689 - DNA, 27 bp, Artificial sequence
  SiRNA target sequence
tggtgaaatagattgtaaaacagattt

SEQ ID NO: 84690 - DNA, 27 bp, Artificial sequence
  SiRNA target sequence
ggtgaaatagattgtaaaacagatttt

SEQ ID NO: 84691 - DNA, 27 bp, Artificial sequence
  SiRNA target sequence
gtgaaatagattgtaaaacagattttc

SEQ ID NO: 84692 - DNA, 27 bp, Artificial sequence
  SiRNA target sequence
tgaaatagattgtaaaacagattttcc

SEQ ID NO: 84693 - DNA, 27 bp, Artificial sequence
  SiRNA target sequence
gaaatagattgtaaaacagattttcca

SEQ ID NO: 84694 - DNA, 27 bp, Artificial sequence
  SiRNA target sequence
aaatagattgtaaaacagattttccaa

SEQ ID NO: 84695 - DNA, 27 bp, Artificial sequence
  SiRNA target sequence
aatagattgtaaaacagattttccaag

SEQ ID NO: 84696 - DNA, 27 bp, Artificial sequence
  SiRNA target sequence
atagattgtaaaacagattttccaagt

SEQ ID NO: 84697 - DNA, 27 bp, Artificial sequence
  SiRNA target sequence
tagattgtaaaacagattttccaagtg

SEQ ID NO: 84698 - DNA, 27 bp, Artificial sequence
  SiRNA target sequence
agattgtaaaacagattttccaagtga

SEQ ID NO: 84699 - DNA, 27 bp, Artificial sequence
  SiRNA target sequence
gattgtaaaacagattttccaagtgag

SEQ ID NO: 84700 - DNA, 27 bp, Artificial sequence
  SiRNA target sequence
attgtaaaacagattttccaagtgagt

SEQ ID NO: 84701 - DNA, 27 bp, Artificial sequence
  SiRNA target sequence
ttgtaaaacagattttccaagtgagtt

SEQ ID NO: 84702 - DNA, 27 bp, Artificial sequence
  SiRNA target sequence
tgtaaaacagattttccaagtgagttg

SEQ ID NO: 84703 - DNA, 27 bp, Artificial sequence
  SiRNA target sequence
gtaaaacagattttccaagtgagttgt

SEQ ID NO: 84704 - DNA, 27 bp, Artificial sequence
  SiRNA target sequence
taaaacagattttccaagtgagttgtc

SEQ ID NO: 84705 - DNA, 27 bp, Artificial sequence
  SiRNA target sequence
aaaacagattttccaagtgagttgtct

SEQ ID NO: 84706 - DNA, 27 bp, Artificial sequence
  SiRNA target sequence
aaacagattttccaagtgagttgtctg

SEQ ID NO: 84707 - DNA, 27 bp, Artificial sequence
  SiRNA target sequence
aacagattttccaagtgagttgtctgc

SEQ ID NO: 84708 - DNA, 27 bp, Artificial sequence
  SiRNA target sequence
acagattttccaagtgagttgtctgca

SEQ ID NO: 84709 - DNA, 27 bp, Artificial sequence
  SiRNA target sequence
cagattttccaagtgagttgtctgcat

SEQ ID NO: 84710 - DNA, 27 bp, Artificial sequence
  SiRNA target sequence
agattttccaagtgagttgtctgcatg

SEQ ID NO: 84711 - DNA, 27 bp, Artificial sequence
  SiRNA target sequence
gattttccaagtgagttgtctgcatgt

SEQ ID NO: 84712 - DNA, 27 bp, Artificial sequence
  SiRNA target sequence
attttccaagtgagttgtctgcatgtg

SEQ ID NO: 84713 - DNA, 27 bp, Artificial sequence
  SiRNA target sequence
ttttccaagtgagttgtctgcatgtgt

SEQ ID NO: 84714 - DNA, 27 bp, Artificial sequence
  SiRNA target sequence
tttccaagtgagttgtctgcatgtgta

SEQ ID NO: 84715 - DNA, 27 bp, Artificial sequence
  SiRNA target sequence
ttccaagtgagttgtctgcatgtgtat

SEQ ID NO: 84716 - DNA, 27 bp, Artificial sequence
  SiRNA target sequence
tccaagtgagttgtctgcatgtgtatg

SEQ ID NO: 84717 - DNA, 27 bp, Artificial sequence
  SiRNA target sequence
ccaagtgagttgtctgcatgtgtatgc

SEQ ID NO: 84718 - DNA, 27 bp, Artificial sequence
  SiRNA target sequence
caagtgagttgtctgcatgtgtatgcg

SEQ ID NO: 84719 - DNA, 27 bp, Artificial sequence
  SiRNA target sequence
aagtgagttgtctgcatgtgtatgcgg

SEQ ID NO: 84720 - DNA, 27 bp, Artificial sequence
  SiRNA target sequence
agtgagttgtctgcatgtgtatgcggg

SEQ ID NO: 84721 - DNA, 27 bp, Artificial sequence
  SiRNA target sequence
gtgagttgtctgcatgtgtatgcggga

SEQ ID NO: 84722 - DNA, 27 bp, Artificial sequence
  SiRNA target sequence
tgagttgtctgcatgtgtatgcgggaa

SEQ ID NO: 84723 - DNA, 27 bp, Artificial sequence
  SiRNA target sequence
gagttgtctgcatgtgtatgcgggaaa

SEQ ID NO: 84724 - DNA, 27 bp, Artificial sequence
  SiRNA target sequence
agttgtctgcatgtgtatgcgggaaaa

SEQ ID NO: 84725 - DNA, 27 bp, Artificial sequence
  SiRNA target sequence
gttgtctgcatgtgtatgcgggaaaaa

SEQ ID NO: 84726 - DNA, 27 bp, Artificial sequence
  SiRNA target sequence
ttgtctgcatgtgtatgcgggaaaaaa

SEQ ID NO: 84727 - DNA, 27 bp, Artificial sequence
  SiRNA target sequence
tgtctgcatgtgtatgcgggaaaaaat

SEQ ID NO: 84728 - DNA, 27 bp, Artificial sequence
  SiRNA target sequence
gtctgcatgtgtatgcgggaaaaaatg

SEQ ID NO: 84729 - DNA, 27 bp, Artificial sequence
  SiRNA target sequence
tctgcatgtgtatgcgggaaaaaatgc

SEQ ID NO: 84730 - DNA, 27 bp, Artificial sequence
  SiRNA target sequence
ctgcatgtgtatgcgggaaaaaatgct

SEQ ID NO: 84731 - DNA, 27 bp, Artificial sequence
  SiRNA target sequence
tgcatgtgtatgcgggaaaaaatgctg

SEQ ID NO: 84732 - DNA, 27 bp, Artificial sequence
  SiRNA target sequence
gcatgtgtatgcgggaaaaaatgctgt

SEQ ID NO: 84733 - DNA, 27 bp, Artificial sequence
  SiRNA target sequence
catgtgtatgcgggaaaaaatgctgtt

SEQ ID NO: 84734 - DNA, 27 bp, Artificial sequence
  SiRNA target sequence
atgtgtatgcgggaaaaaatgctgttt

SEQ ID NO: 84735 - DNA, 27 bp, Artificial sequence
  SiRNA target sequence
tgtgtatgcgggaaaaaatgctgtttt

SEQ ID NO: 84736 - DNA, 27 bp, Artificial sequence
  SiRNA target sequence
gtgtatgcgggaaaaaatgctgttttg

SEQ ID NO: 84737 - DNA, 27 bp, Artificial sequence
  SiRNA target sequence
tgtatgcgggaaaaaatgctgttttgc

SEQ ID NO: 84738 - DNA, 27 bp, Artificial sequence
  SiRNA target sequence
gtatgcgggaaaaaatgctgttttgct

SEQ ID NO: 84739 - DNA, 27 bp, Artificial sequence
  SiRNA target sequence
tatgcgggaaaaaatgctgttttgcta

SEQ ID NO: 84740 - DNA, 27 bp, Artificial sequence
  SiRNA target sequence
atgcgggaaaaaatgctgttttgctaa

SEQ ID NO: 84741 - DNA, 27 bp, Artificial sequence
  SiRNA target sequence
tgcgggaaaaaatgctgttttgctaaa

SEQ ID NO: 84742 - DNA, 27 bp, Artificial sequence
  SiRNA target sequence
gcgggaaaaaatgctgttttgctaaat

SEQ ID NO: 84743 - DNA, 27 bp, Artificial sequence
  SiRNA target sequence
cgggaaaaaatgctgttttgctaaata

SEQ ID NO: 84744 - DNA, 27 bp, Artificial sequence
  SiRNA target sequence
gggaaaaaatgctgttttgctaaataa

SEQ ID NO: 84745 - DNA, 27 bp, Artificial sequence
  SiRNA target sequence
ggaaaaaatgctgttttgctaaataaa

SEQ ID NO: 84746 - DNA, 27 bp, Artificial sequence
  SiRNA target sequence
gaaaaaatgctgttttgctaaataaac

SEQ ID NO: 84747 - DNA, 27 bp, Artificial sequence
  SiRNA target sequence
aaaaaatgctgttttgctaaataaaca

SEQ ID NO: 84748 - DNA, 27 bp, Artificial sequence
  SiRNA target sequence
aaaaatgctgttttgctaaataaacaa

SEQ ID NO: 84749 - DNA, 27 bp, Artificial sequence
  SiRNA target sequence
aaaatgctgttttgctaaataaacaat

SEQ ID NO: 84750 - DNA, 27 bp, Artificial sequence
  SiRNA target sequence
aaatgctgttttgctaaataaacaatc

SEQ ID NO: 84751 - DNA, 27 bp, Artificial sequence
  SiRNA target sequence
aatgctgttttgctaaataaacaatcc

SEQ ID NO: 84752 - DNA, 27 bp, Artificial sequence
  SiRNA target sequence
atgctgttttgctaaataaacaatcca

SEQ ID NO: 84753 - DNA, 27 bp, Artificial sequence
  SiRNA target sequence
tgctgttttgctaaataaacaatccat

SEQ ID NO: 84754 - DNA, 27 bp, Artificial sequence
  SiRNA target sequence
gctgttttgctaaataaacaatccata

SEQ ID NO: 84755 - DNA, 27 bp, Artificial sequence
  SiRNA target sequence
ctgttttgctaaataaacaatccatac

SEQ ID NO: 84756 - DNA, 27 bp, Artificial sequence
  SiRNA target sequence
tgttttgctaaataaacaatccataca

SEQ ID NO: 84757 - DNA, 27 bp, Artificial sequence
  SiRNA target sequence
gttttgctaaataaacaatccatacac

SEQ ID NO: 84758 - DNA, 27 bp, Artificial sequence
  SiRNA target sequence
ttttgctaaataaacaatccatacacc

SEQ ID NO: 84759 - DNA, 27 bp, Artificial sequence
  SiRNA target sequence
tttgctaaataaacaatccatacaccc

SEQ ID NO: 84760 - DNA, 27 bp, Artificial sequence
  SiRNA target sequence
ttgctaaataaacaatccatacaccca

SEQ ID NO: 84761 - DNA, 27 bp, Artificial sequence
  SiRNA target sequence
tgctaaataaacaatccatacacccaa

SEQ ID NO: 84762 - DNA, 27 bp, Artificial sequence
  SiRNA target sequence
gctaaataaacaatccatacacccaat

SEQ ID NO: 84763 - DNA, 27 bp, Artificial sequence
  SiRNA target sequence
ctaaataaacaatccatacacccaata

SEQ ID NO: 84764 - DNA, 27 bp, Artificial sequence
  SiRNA target sequence
taaataaacaatccatacacccaataa

SEQ ID NO: 84765 - DNA, 27 bp, Artificial sequence
  SiRNA target sequence
aaataaacaatccatacacccaataag

SEQ ID NO: 84766 - DNA, 27 bp, Artificial sequence
  SiRNA target sequence
aataaacaatccatacacccaataaga

SEQ ID NO: 84767 - DNA, 27 bp, Artificial sequence
  SiRNA target sequence
ataaacaatccatacacccaataagat

SEQ ID NO: 84768 - DNA, 27 bp, Artificial sequence
  SiRNA target sequence
taaacaatccatacacccaataagata

SEQ ID NO: 84769 - DNA, 27 bp, Artificial sequence
  SiRNA target sequence
aaacaatccatacacccaataagataa

SEQ ID NO: 84770 - DNA, 27 bp, Artificial sequence
  SiRNA target sequence
aacaatccatacacccaataagataat

SEQ ID NO: 84771 - DNA, 27 bp, Artificial sequence
  SiRNA target sequence
acaatccatacacccaataagataata

SEQ ID NO: 84772 - DNA, 27 bp, Artificial sequence
  SiRNA target sequence
caatccatacacccaataagataataa

SEQ ID NO: 84773 - DNA, 27 bp, Artificial sequence
  SiRNA target sequence
aatccatacacccaataagataataag

SEQ ID NO: 84774 - DNA, 27 bp, Artificial sequence
  SiRNA target sequence
atccatacacccaataagataataagt

SEQ ID NO: 84775 - DNA, 27 bp, Artificial sequence
  SiRNA target sequence
tccatacacccaataagataataagtc

SEQ ID NO: 84776 - DNA, 27 bp, Artificial sequence
  SiRNA target sequence
ccatacacccaataagataataagtcc

SEQ ID NO: 84777 - DNA, 27 bp, Artificial sequence
  SiRNA target sequence
catacacccaataagataataagtcct

SEQ ID NO: 84778 - DNA, 27 bp, Artificial sequence
  SiRNA target sequence
atacacccaataagataataagtcctc

SEQ ID NO: 84779 - DNA, 27 bp, Artificial sequence
  SiRNA target sequence
tacacccaataagataataagtcctct

SEQ ID NO: 84780 - DNA, 27 bp, Artificial sequence
  SiRNA target sequence
acacccaataagataataagtcctctt

SEQ ID NO: 84781 - DNA, 27 bp, Artificial sequence
  SiRNA target sequence
cacccaataagataataagtcctctta

SEQ ID NO: 84782 - DNA, 27 bp, Artificial sequence
  SiRNA target sequence
acccaataagataataagtcctcttaa

SEQ ID NO: 84783 - DNA, 27 bp, Artificial sequence
  SiRNA target sequence
cccaataagataataagtcctcttaat

SEQ ID NO: 84784 - DNA, 27 bp, Artificial sequence
  SiRNA target sequence
ccaataagataataagtcctcttaata

SEQ ID NO: 84785 - DNA, 27 bp, Artificial sequence
  SiRNA target sequence
caataagataataagtcctcttaatac

SEQ ID NO: 84786 - DNA, 27 bp, Artificial sequence
  SiRNA target sequence
aataagataataagtcctcttaatact

SEQ ID NO: 84787 - DNA, 27 bp, Artificial sequence
  SiRNA target sequence
ataagataataagtcctcttaatactt

SEQ ID NO: 84788 - DNA, 27 bp, Artificial sequence
  SiRNA target sequence
taagataataagtcctcttaatacttt

SEQ ID NO: 84789 - DNA, 27 bp, Artificial sequence
  SiRNA target sequence
aagataataagtcctcttaatactttc

SEQ ID NO: 84790 - DNA, 27 bp, Artificial sequence
  SiRNA target sequence
agataataagtcctcttaatactttct

SEQ ID NO: 84791 - DNA, 27 bp, Artificial sequence
  SiRNA target sequence
gataataagtcctcttaatactttctg

SEQ ID NO: 84792 - DNA, 27 bp, Artificial sequence
  SiRNA target sequence
ataataagtcctcttaatactttctgc

SEQ ID NO: 84793 - DNA, 27 bp, Artificial sequence
  SiRNA target sequence
taataagtcctcttaatactttctgct

SEQ ID NO: 84794 - DNA, 27 bp, Artificial sequence
  SiRNA target sequence
aataagtcctcttaatactttctgctc

SEQ ID NO: 84795 - DNA, 27 bp, Artificial sequence
  SiRNA target sequence
ataagtcctcttaatactttctgctct

SEQ ID NO: 84796 - DNA, 27 bp, Artificial sequence
  SiRNA target sequence
taagtcctcttaatactttctgctctt

SEQ ID NO: 84797 - DNA, 27 bp, Artificial sequence
  SiRNA target sequence
aagtcctcttaatactttctgctcttt

SEQ ID NO: 84798 - DNA, 27 bp, Artificial sequence
  SiRNA target sequence
agtcctcttaatactttctgctctttg

SEQ ID NO: 84799 - DNA, 27 bp, Artificial sequence
  SiRNA target sequence
gtcctcttaatactttctgctctttgt

SEQ ID NO: 84800 - DNA, 27 bp, Artificial sequence
  SiRNA target sequence
tcctcttaatactttctgctctttgtt

SEQ ID NO: 84801 - DNA, 27 bp, Artificial sequence
  SiRNA target sequence
cctcttaatactttctgctctttgttc

SEQ ID NO: 84802 - DNA, 27 bp, Artificial sequence
  SiRNA target sequence
ctcttaatactttctgctctttgttca

SEQ ID NO: 84803 - DNA, 27 bp, Artificial sequence
  SiRNA target sequence
tcttaatactttctgctctttgttcat

SEQ ID NO: 84804 - DNA, 19 bp, Artificial sequence
  SiRNA target sequence
ttatatccaactatcaaaa

SEQ ID NO: 84805 - DNA, 19 bp, Artificial sequence
  SiRNA target sequence
tatatccaactatcaaaaa

SEQ ID NO: 84806 - DNA, 19 bp, Artificial sequence
  SiRNA target sequence
atatccaactatcaaaaaa

SEQ ID NO: 84807 - DNA, 19 bp, Artificial sequence
  SiRNA target sequence
tatccaactatcaaaaaat

SEQ ID NO: 84808 - DNA, 19 bp, Artificial sequence
  SiRNA target sequence
atccaactatcaaaaaata

SEQ ID NO: 84809 - DNA, 19 bp, Artificial sequence
  SiRNA target sequence
tccaactatcaaaaaatag

SEQ ID NO: 84810 - DNA, 19 bp, Artificial sequence
  SiRNA target sequence
ccaactatcaaaaaatagc

SEQ ID NO: 84811 - DNA, 19 bp, Artificial sequence
  SiRNA target sequence
caactatcaaaaaatagcc

SEQ ID NO: 84812 - DNA, 19 bp, Artificial sequence
  SiRNA target sequence
aactatcaaaaaatagcct

SEQ ID NO: 84813 - DNA, 19 bp, Artificial sequence
  SiRNA target sequence
actatcaaaaaatagcctc

SEQ ID NO: 84814 - DNA, 19 bp, Artificial sequence
  SiRNA target sequence
ctatcaaaaaatagcctct

SEQ ID NO: 84815 - DNA, 19 bp, Artificial sequence
  SiRNA target sequence
tatcaaaaaatagcctctt

SEQ ID NO: 84816 - DNA, 19 bp, Artificial sequence
  SiRNA target sequence
atcaaaaaatagcctcttt

SEQ ID NO: 84817 - DNA, 19 bp, Artificial sequence
  SiRNA target sequence
tcaaaaaatagcctctttt

SEQ ID NO: 84818 - DNA, 19 bp, Artificial sequence
  SiRNA target sequence
caaaaaatagcctcttttc

SEQ ID NO: 84819 - DNA, 19 bp, Artificial sequence
  SiRNA target sequence
aaaaaatagcctcttttct

SEQ ID NO: 84820 - DNA, 19 bp, Artificial sequence
  SiRNA target sequence
aaaaatagcctcttttctt

SEQ ID NO: 84821 - DNA, 19 bp, Artificial sequence
  SiRNA target sequence
aaaatagcctcttttcttt

SEQ ID NO: 84822 - DNA, 19 bp, Artificial sequence
  SiRNA target sequence
aaatagcctcttttctttc

SEQ ID NO: 84823 - DNA, 19 bp, Artificial sequence
  SiRNA target sequence
aatagcctcttttctttca

SEQ ID NO: 84824 - DNA, 19 bp, Artificial sequence
  SiRNA target sequence
atagcctcttttctttcac

SEQ ID NO: 84825 - DNA, 19 bp, Artificial sequence
  SiRNA target sequence
tagcctcttttctttcaca

SEQ ID NO: 84826 - DNA, 19 bp, Artificial sequence
  SiRNA target sequence
agcctcttttctttcacaa

SEQ ID NO: 84827 - DNA, 19 bp, Artificial sequence
  SiRNA target sequence
gcctcttttctttcacaat

SEQ ID NO: 84828 - DNA, 19 bp, Artificial sequence
  SiRNA target sequence
cctcttttctttcacaatt

SEQ ID NO: 84829 - DNA, 19 bp, Artificial sequence
  SiRNA target sequence
ctcttttctttcacaattt

SEQ ID NO: 84830 - DNA, 19 bp, Artificial sequence
  SiRNA target sequence
tcttttctttcacaatttc

SEQ ID NO: 84831 - DNA, 19 bp, Artificial sequence
  SiRNA target sequence
cttttctttcacaatttca

SEQ ID NO: 84832 - DNA, 19 bp, Artificial sequence
  SiRNA target sequence
ttttctttcacaatttcag

SEQ ID NO: 84833 - DNA, 19 bp, Artificial sequence
  SiRNA target sequence
tttctttcacaatttcaga

SEQ ID NO: 84834 - DNA, 19 bp, Artificial sequence
  SiRNA target sequence
ttctttcacaatttcagaa

SEQ ID NO: 84835 - DNA, 19 bp, Artificial sequence
  SiRNA target sequence
tctttcacaatttcagaaa

SEQ ID NO: 84836 - DNA, 19 bp, Artificial sequence
  SiRNA target sequence
ctttcacaatttcagaaaa

SEQ ID NO: 84837 - DNA, 19 bp, Artificial sequence
  SiRNA target sequence
tttcacaatttcagaaaaa

SEQ ID NO: 84838 - DNA, 19 bp, Artificial sequence
  SiRNA target sequence
ttcacaatttcagaaaaat

SEQ ID NO: 84839 - DNA, 19 bp, Artificial sequence
  SiRNA target sequence
tcacaatttcagaaaaatt

SEQ ID NO: 84840 - DNA, 19 bp, Artificial sequence
  SiRNA target sequence
cacaatttcagaaaaattt

SEQ ID NO: 84841 - DNA, 19 bp, Artificial sequence
  SiRNA target sequence
acaatttcagaaaaatttt

SEQ ID NO: 84842 - DNA, 19 bp, Artificial sequence
  SiRNA target sequence
caatttcagaaaaattttc

SEQ ID NO: 84843 - DNA, 19 bp, Artificial sequence
  SiRNA target sequence
aatttcagaaaaattttca

SEQ ID NO: 84844 - DNA, 19 bp, Artificial sequence
  SiRNA target sequence
atttcagaaaaattttcat

SEQ ID NO: 84845 - DNA, 19 bp, Artificial sequence
  SiRNA target sequence
tttcagaaaaattttcatt

SEQ ID NO: 84846 - DNA, 19 bp, Artificial sequence
  SiRNA target sequence
ttcagaaaaattttcatta

SEQ ID NO: 84847 - DNA, 19 bp, Artificial sequence
  SiRNA target sequence
tcagaaaaattttcattaa

SEQ ID NO: 84848 - DNA, 19 bp, Artificial sequence
  SiRNA target sequence
cagaaaaattttcattaaa

SEQ ID NO: 84849 - DNA, 19 bp, Artificial sequence
  SiRNA target sequence
agaaaaattttcattaaaa

SEQ ID NO: 84850 - DNA, 19 bp, Artificial sequence
  SiRNA target sequence
gaaaaattttcattaaaaa

SEQ ID NO: 84851 - DNA, 19 bp, Artificial sequence
  SiRNA target sequence
aaaaattttcattaaaaat

SEQ ID NO: 84852 - DNA, 19 bp, Artificial sequence
  SiRNA target sequence
aaaattttcattaaaaatg

SEQ ID NO: 84853 - DNA, 19 bp, Artificial sequence
  SiRNA target sequence
aaattttcattaaaaatgc

SEQ ID NO: 84854 - DNA, 19 bp, Artificial sequence
  SiRNA target sequence
aattttcattaaaaatgct

SEQ ID NO: 84855 - DNA, 19 bp, Artificial sequence
  SiRNA target sequence
attttcattaaaaatgcta

SEQ ID NO: 84856 - DNA, 19 bp, Artificial sequence
  SiRNA target sequence
ttttcattaaaaatgctat

SEQ ID NO: 84857 - DNA, 19 bp, Artificial sequence
  SiRNA target sequence
tttcattaaaaatgctata

SEQ ID NO: 84858 - DNA, 19 bp, Artificial sequence
  SiRNA target sequence
ttcattaaaaatgctataa

SEQ ID NO: 84859 - DNA, 19 bp, Artificial sequence
  SiRNA target sequence
tcattaaaaatgctataaa

SEQ ID NO: 84860 - DNA, 19 bp, Artificial sequence
  SiRNA target sequence
cattaaaaatgctataaat

SEQ ID NO: 84861 - DNA, 19 bp, Artificial sequence
  SiRNA target sequence
attaaaaatgctataaata

SEQ ID NO: 84862 - DNA, 19 bp, Artificial sequence
  SiRNA target sequence
ttaaaaatgctataaatag

SEQ ID NO: 84863 - DNA, 19 bp, Artificial sequence
  SiRNA target sequence
taaaaatgctataaatagt

SEQ ID NO: 84864 - DNA, 19 bp, Artificial sequence
  SiRNA target sequence
aaaaatgctataaatagtt

SEQ ID NO: 84865 - DNA, 19 bp, Artificial sequence
  SiRNA target sequence
aaaatgctataaatagttt

SEQ ID NO: 84866 - DNA, 19 bp, Artificial sequence
  SiRNA target sequence
aaatgctataaatagtttt

SEQ ID NO: 84867 - DNA, 19 bp, Artificial sequence
  SiRNA target sequence
aatgctataaatagttttt

SEQ ID NO: 84868 - DNA, 19 bp, Artificial sequence
  SiRNA target sequence
atgctataaatagtttttt

SEQ ID NO: 84869 - DNA, 19 bp, Artificial sequence
  SiRNA target sequence
tgctataaatagttttttg

SEQ ID NO: 84870 - DNA, 19 bp, Artificial sequence
  SiRNA target sequence
gctataaatagttttttgc

SEQ ID NO: 84871 - DNA, 19 bp, Artificial sequence
  SiRNA target sequence
ctataaatagttttttgca

SEQ ID NO: 84872 - DNA, 19 bp, Artificial sequence
  SiRNA target sequence
tataaatagttttttgcat

SEQ ID NO: 84873 - DNA, 19 bp, Artificial sequence
  SiRNA target sequence
ataaatagttttttgcata

SEQ ID NO: 84874 - DNA, 19 bp, Artificial sequence
  SiRNA target sequence
taaatagttttttgcatat

SEQ ID NO: 84875 - DNA, 19 bp, Artificial sequence
  SiRNA target sequence
aaatagttttttgcatatc

SEQ ID NO: 84876 - DNA, 19 bp, Artificial sequence
  SiRNA target sequence
aatagttttttgcatatca

SEQ ID NO: 84877 - DNA, 19 bp, Artificial sequence
  SiRNA target sequence
atagttttttgcatatcag

SEQ ID NO: 84878 - DNA, 19 bp, Artificial sequence
  SiRNA target sequence
tagttttttgcatatcagg

SEQ ID NO: 84879 - DNA, 19 bp, Artificial sequence
  SiRNA target sequence
agttttttgcatatcaggt

SEQ ID NO: 84880 - DNA, 19 bp, Artificial sequence
  SiRNA target sequence
gttttttgcatatcaggtc

SEQ ID NO: 84881 - DNA, 19 bp, Artificial sequence
  SiRNA target sequence
ttttttgcatatcaggtcg

SEQ ID NO: 84882 - DNA, 19 bp, Artificial sequence
  SiRNA target sequence
tttttgcatatcaggtcgg

SEQ ID NO: 84883 - DNA, 19 bp, Artificial sequence
  SiRNA target sequence
ttttgcatatcaggtcggc

SEQ ID NO: 84884 - DNA, 19 bp, Artificial sequence
  SiRNA target sequence
tttgcatatcaggtcggcc

SEQ ID NO: 84885 - DNA, 19 bp, Artificial sequence
  SiRNA target sequence
ttgcatatcaggtcggcca

SEQ ID NO: 84886 - DNA, 19 bp, Artificial sequence
  SiRNA target sequence
tgcatatcaggtcggccac

SEQ ID NO: 84887 - DNA, 19 bp, Artificial sequence
  SiRNA target sequence
gcatatcaggtcggccaca

SEQ ID NO: 84888 - DNA, 19 bp, Artificial sequence
  SiRNA target sequence
catatcaggtcggccacaa

SEQ ID NO: 84889 - DNA, 19 bp, Artificial sequence
  SiRNA target sequence
atatcaggtcggccacaaa

SEQ ID NO: 84890 - DNA, 19 bp, Artificial sequence
  SiRNA target sequence
tatcaggtcggccacaaac

SEQ ID NO: 84891 - DNA, 19 bp, Artificial sequence
  SiRNA target sequence
atcaggtcggccacaaaca

SEQ ID NO: 84892 - DNA, 19 bp, Artificial sequence
  SiRNA target sequence
tcaggtcggccacaaacat

SEQ ID NO: 84893 - DNA, 19 bp, Artificial sequence
  SiRNA target sequence
caggtcggccacaaacata

SEQ ID NO: 84894 - DNA, 19 bp, Artificial sequence
  SiRNA target sequence
aggtcggccacaaacataa

SEQ ID NO: 84895 - DNA, 19 bp, Artificial sequence
  SiRNA target sequence
ggtcggccacaaacataaa

SEQ ID NO: 84896 - DNA, 19 bp, Artificial sequence
  SiRNA target sequence
gtcggccacaaacataaac

SEQ ID NO: 84897 - DNA, 19 bp, Artificial sequence
  SiRNA target sequence
tcggccacaaacataaacc

SEQ ID NO: 84898 - DNA, 19 bp, Artificial sequence
  SiRNA target sequence
cggccacaaacataaacca

SEQ ID NO: 84899 - DNA, 19 bp, Artificial sequence
  SiRNA target sequence
ggccacaaacataaaccaa

SEQ ID NO: 84900 - DNA, 19 bp, Artificial sequence
  SiRNA target sequence
gccacaaacataaaccaaa

SEQ ID NO: 84901 - DNA, 19 bp, Artificial sequence
  SiRNA target sequence
ccacaaacataaaccaaac

SEQ ID NO: 84902 - DNA, 19 bp, Artificial sequence
  SiRNA target sequence
cacaaacataaaccaaaca

SEQ ID NO: 84903 - DNA, 19 bp, Artificial sequence
  SiRNA target sequence
acaaacataaaccaaacat

SEQ ID NO: 84904 - DNA, 19 bp, Artificial sequence
  SiRNA target sequence
caaacataaaccaaacatc

SEQ ID NO: 84905 - DNA, 19 bp, Artificial sequence
  SiRNA target sequence
aaacataaaccaaacatcc

SEQ ID NO: 84906 - DNA, 19 bp, Artificial sequence
  SiRNA target sequence
aacataaaccaaacatccg

SEQ ID NO: 84907 - DNA, 19 bp, Artificial sequence
  SiRNA target sequence
acataaaccaaacatccgt

SEQ ID NO: 84908 - DNA, 19 bp, Artificial sequence
  SiRNA target sequence
cataaaccaaacatccgtc

SEQ ID NO: 84909 - DNA, 19 bp, Artificial sequence
  SiRNA target sequence
ataaaccaaacatccgtct

SEQ ID NO: 84910 - DNA, 19 bp, Artificial sequence
  SiRNA target sequence
taaaccaaacatccgtctt

SEQ ID NO: 84911 - DNA, 19 bp, Artificial sequence
  SiRNA target sequence
aaaccaaacatccgtcttt

SEQ ID NO: 84912 - DNA, 19 bp, Artificial sequence
  SiRNA target sequence
aaccaaacatccgtcttta

SEQ ID NO: 84913 - DNA, 19 bp, Artificial sequence
  SiRNA target sequence
accaaacatccgtctttaa

SEQ ID NO: 84914 - DNA, 19 bp, Artificial sequence
  SiRNA target sequence
ccaaacatccgtctttaat

SEQ ID NO: 84915 - DNA, 19 bp, Artificial sequence
  SiRNA target sequence
caaacatccgtctttaatg

SEQ ID NO: 84916 - DNA, 19 bp, Artificial sequence
  SiRNA target sequence
aaacatccgtctttaatgt

SEQ ID NO: 84917 - DNA, 19 bp, Artificial sequence
  SiRNA target sequence
aacatccgtctttaatgta

SEQ ID NO: 84918 - DNA, 19 bp, Artificial sequence
  SiRNA target sequence
acatccgtctttaatgtat

SEQ ID NO: 84919 - DNA, 19 bp, Artificial sequence
  SiRNA target sequence
catccgtctttaatgtatg

SEQ ID NO: 84920 - DNA, 19 bp, Artificial sequence
  SiRNA target sequence
atccgtctttaatgtatgt

SEQ ID NO: 84921 - DNA, 19 bp, Artificial sequence
  SiRNA target sequence
tccgtctttaatgtatgtt

SEQ ID NO: 84922 - DNA, 19 bp, Artificial sequence
  SiRNA target sequence
ccgtctttaatgtatgttt

SEQ ID NO: 84923 - DNA, 19 bp, Artificial sequence
  SiRNA target sequence
cgtctttaatgtatgtttt

SEQ ID NO: 84924 - DNA, 19 bp, Artificial sequence
  SiRNA target sequence
gtctttaatgtatgttttt

SEQ ID NO: 84925 - DNA, 19 bp, Artificial sequence
  SiRNA target sequence
tctttaatgtatgttttta

SEQ ID NO: 84926 - DNA, 19 bp, Artificial sequence
  SiRNA target sequence
ctttaatgtatgtttttat

SEQ ID NO: 84927 - DNA, 19 bp, Artificial sequence
  SiRNA target sequence
tttaatgtatgtttttatc

SEQ ID NO: 84928 - DNA, 19 bp, Artificial sequence
  SiRNA target sequence
ttaatgtatgtttttatct

SEQ ID NO: 84929 - DNA, 19 bp, Artificial sequence
  SiRNA target sequence
taatgtatgtttttatctc

SEQ ID NO: 84930 - DNA, 19 bp, Artificial sequence
  SiRNA target sequence
aatgtatgtttttatctca

SEQ ID NO: 84931 - DNA, 19 bp, Artificial sequence
  SiRNA target sequence
atgtatgtttttatctcat

SEQ ID NO: 84932 - DNA, 19 bp, Artificial sequence
  SiRNA target sequence
tgtatgtttttatctcatt

SEQ ID NO: 84933 - DNA, 19 bp, Artificial sequence
  SiRNA target sequence
gtatgtttttatctcattt

SEQ ID NO: 84934 - DNA, 19 bp, Artificial sequence
  SiRNA target sequence
tatgtttttatctcattta

SEQ ID NO: 84935 - DNA, 19 bp, Artificial sequence
  SiRNA target sequence
atgtttttatctcatttaa

SEQ ID NO: 84936 - DNA, 19 bp, Artificial sequence
  SiRNA target sequence
tgtttttatctcatttaaa

SEQ ID NO: 84937 - DNA, 19 bp, Artificial sequence
  SiRNA target sequence
gtttttatctcatttaaat

SEQ ID NO: 84938 - DNA, 19 bp, Artificial sequence
  SiRNA target sequence
tttttatctcatttaaatt

SEQ ID NO: 84939 - DNA, 19 bp, Artificial sequence
  SiRNA target sequence
ttttatctcatttaaattt

SEQ ID NO: 84940 - DNA, 19 bp, Artificial sequence
  SiRNA target sequence
tttatctcatttaaatttt

SEQ ID NO: 84941 - DNA, 19 bp, Artificial sequence
  SiRNA target sequence
ttatctcatttaaattttg

SEQ ID NO: 84942 - DNA, 19 bp, Artificial sequence
  SiRNA target sequence
tatctcatttaaattttgt

SEQ ID NO: 84943 - DNA, 19 bp, Artificial sequence
  SiRNA target sequence
atctcatttaaattttgta

SEQ ID NO: 84944 - DNA, 19 bp, Artificial sequence
  SiRNA target sequence
tctcatttaaattttgtaa

SEQ ID NO: 84945 - DNA, 19 bp, Artificial sequence
  SiRNA target sequence
ctcatttaaattttgtaat

SEQ ID NO: 84946 - DNA, 19 bp, Artificial sequence
  SiRNA target sequence
tcatttaaattttgtaata

SEQ ID NO: 84947 - DNA, 19 bp, Artificial sequence
  SiRNA target sequence
catttaaattttgtaataa

SEQ ID NO: 84948 - DNA, 19 bp, Artificial sequence
  SiRNA target sequence
atttaaattttgtaataaa

SEQ ID NO: 84949 - DNA, 19 bp, Artificial sequence
  SiRNA target sequence
tttaaattttgtaataaat

SEQ ID NO: 84950 - DNA, 19 bp, Artificial sequence
  SiRNA target sequence
ttaaattttgtaataaata

SEQ ID NO: 84951 - DNA, 19 bp, Artificial sequence
  SiRNA target sequence
taaattttgtaataaataa

SEQ ID NO: 84952 - DNA, 19 bp, Artificial sequence
  SiRNA target sequence
aaattttgtaataaataat

SEQ ID NO: 84953 - DNA, 19 bp, Artificial sequence
  SiRNA target sequence
aattttgtaataaataatc

SEQ ID NO: 84954 - DNA, 19 bp, Artificial sequence
  SiRNA target sequence
attttgtaataaataatca

SEQ ID NO: 84955 - DNA, 19 bp, Artificial sequence
  SiRNA target sequence
ttttgtaataaataatcag

SEQ ID NO: 84956 - DNA, 19 bp, Artificial sequence
  SiRNA target sequence
tttgtaataaataatcagt

SEQ ID NO: 84957 - DNA, 19 bp, Artificial sequence
  SiRNA target sequence
ttgtaataaataatcagta

SEQ ID NO: 84958 - DNA, 19 bp, Artificial sequence
  SiRNA target sequence
tgtaataaataatcagtaa

SEQ ID NO: 84959 - DNA, 19 bp, Artificial sequence
  SiRNA target sequence
gtaataaataatcagtaac

SEQ ID NO: 84960 - DNA, 19 bp, Artificial sequence
  SiRNA target sequence
taataaataatcagtaaca

SEQ ID NO: 84961 - DNA, 19 bp, Artificial sequence
  SiRNA target sequence
aataaataatcagtaacat

SEQ ID NO: 84962 - DNA, 19 bp, Artificial sequence
  SiRNA target sequence
ataaataatcagtaacata

SEQ ID NO: 84963 - DNA, 19 bp, Artificial sequence
  SiRNA target sequence
taaataatcagtaacataa

SEQ ID NO: 84964 - DNA, 19 bp, Artificial sequence
  SiRNA target sequence
aaataatcagtaacataaa

SEQ ID NO: 84965 - DNA, 19 bp, Artificial sequence
  SiRNA target sequence
aataatcagtaacataaat

SEQ ID NO: 84966 - DNA, 19 bp, Artificial sequence
  SiRNA target sequence
ataatcagtaacataaatt

SEQ ID NO: 84967 - DNA, 19 bp, Artificial sequence
  SiRNA target sequence
taatcagtaacataaattt

SEQ ID NO: 84968 - DNA, 19 bp, Artificial sequence
  SiRNA target sequence
aatcagtaacataaatttt

SEQ ID NO: 84969 - DNA, 19 bp, Artificial sequence
  SiRNA target sequence
atcagtaacataaatttta

SEQ ID NO: 84970 - DNA, 19 bp, Artificial sequence
  SiRNA target sequence
tcagtaacataaattttat

SEQ ID NO: 84971 - DNA, 19 bp, Artificial sequence
  SiRNA target sequence
cagtaacataaattttatt

SEQ ID NO: 84972 - DNA, 19 bp, Artificial sequence
  SiRNA target sequence
agtaacataaattttatta

SEQ ID NO: 84973 - DNA, 19 bp, Artificial sequence
  SiRNA target sequence
gtaacataaattttattac

SEQ ID NO: 84974 - DNA, 19 bp, Artificial sequence
  SiRNA target sequence
taacataaattttattaca

SEQ ID NO: 84975 - DNA, 19 bp, Artificial sequence
  SiRNA target sequence
aacataaattttattacaa

SEQ ID NO: 84976 - DNA, 19 bp, Artificial sequence
  SiRNA target sequence
acataaattttattacaag

SEQ ID NO: 84977 - DNA, 19 bp, Artificial sequence
  SiRNA target sequence
cataaattttattacaaga

SEQ ID NO: 84978 - DNA, 19 bp, Artificial sequence
  SiRNA target sequence
ataaattttattacaagat

SEQ ID NO: 84979 - DNA, 19 bp, Artificial sequence
  SiRNA target sequence
taaattttattacaagata

SEQ ID NO: 84980 - DNA, 19 bp, Artificial sequence
  SiRNA target sequence
aaattttattacaagataa

SEQ ID NO: 84981 - DNA, 19 bp, Artificial sequence
  SiRNA target sequence
aattttattacaagataaa

SEQ ID NO: 84982 - DNA, 19 bp, Artificial sequence
  SiRNA target sequence
attttattacaagataaaa

SEQ ID NO: 84983 - DNA, 19 bp, Artificial sequence
  SiRNA target sequence
ttttattacaagataaaat

SEQ ID NO: 84984 - DNA, 19 bp, Artificial sequence
  SiRNA target sequence
tttattacaagataaaatt

SEQ ID NO: 84985 - DNA, 19 bp, Artificial sequence
  SiRNA target sequence
ttattacaagataaaattt

SEQ ID NO: 84986 - DNA, 19 bp, Artificial sequence
  SiRNA target sequence
tattacaagataaaatttt

SEQ ID NO: 84987 - DNA, 19 bp, Artificial sequence
  SiRNA target sequence
attacaagataaaatttta

SEQ ID NO: 84988 - DNA, 19 bp, Artificial sequence
  SiRNA target sequence
ttacaagataaaattttaa

SEQ ID NO: 84989 - DNA, 19 bp, Artificial sequence
  SiRNA target sequence
tacaagataaaattttaat

SEQ ID NO: 84990 - DNA, 19 bp, Artificial sequence
  SiRNA target sequence
acaagataaaattttaata

SEQ ID NO: 84991 - DNA, 19 bp, Artificial sequence
  SiRNA target sequence
caagataaaattttaataa

SEQ ID NO: 84992 - DNA, 19 bp, Artificial sequence
  SiRNA target sequence
aagataaaattttaataat

SEQ ID NO: 84993 - DNA, 19 bp, Artificial sequence
  SiRNA target sequence
agataaaattttaataatt

SEQ ID NO: 84994 - DNA, 19 bp, Artificial sequence
  SiRNA target sequence
gataaaattttaataattt

SEQ ID NO: 84995 - DNA, 19 bp, Artificial sequence
  SiRNA target sequence
ataaaattttaataatttc

SEQ ID NO: 84996 - DNA, 19 bp, Artificial sequence
  SiRNA target sequence
taaaattttaataatttct

SEQ ID NO: 84997 - DNA, 19 bp, Artificial sequence
  SiRNA target sequence
aaaattttaataatttctg

SEQ ID NO: 84998 - DNA, 19 bp, Artificial sequence
  SiRNA target sequence
aaattttaataatttctgt

SEQ ID NO: 84999 - DNA, 19 bp, Artificial sequence
  SiRNA target sequence
aattttaataatttctgtg

SEQ ID NO: 85000 - DNA, 19 bp, Artificial sequence
  SiRNA target sequence
attttaataatttctgtgt

SEQ ID NO: 85001 - DNA, 19 bp, Artificial sequence
  SiRNA target sequence
ttttaataatttctgtgtt

SEQ ID NO: 85002 - DNA, 19 bp, Artificial sequence
  SiRNA target sequence
tttaataatttctgtgttt

SEQ ID NO: 85003 - DNA, 19 bp, Artificial sequence
  SiRNA target sequence
ttaataatttctgtgtttt

SEQ ID NO: 85004 - DNA, 19 bp, Artificial sequence
  SiRNA target sequence
taataatttctgtgttttt

SEQ ID NO: 85005 - DNA, 19 bp, Artificial sequence
  SiRNA target sequence
aataatttctgtgttttta

SEQ ID NO: 85006 - DNA, 19 bp, Artificial sequence
  SiRNA target sequence
ataatttctgtgtttttat

SEQ ID NO: 85007 - DNA, 19 bp, Artificial sequence
  SiRNA target sequence
taatttctgtgtttttata

SEQ ID NO: 85008 - DNA, 19 bp, Artificial sequence
  SiRNA target sequence
aatttctgtgtttttatat

SEQ ID NO: 85009 - DNA, 19 bp, Artificial sequence
  SiRNA target sequence
atttctgtgtttttatatt

SEQ ID NO: 85010 - DNA, 19 bp, Artificial sequence
  SiRNA target sequence
tttctgtgtttttatattt

SEQ ID NO: 85011 - DNA, 19 bp, Artificial sequence
  SiRNA target sequence
ttctgtgtttttatatttt

SEQ ID NO: 85012 - DNA, 19 bp, Artificial sequence
  SiRNA target sequence
tctgtgtttttatattttg

SEQ ID NO: 85013 - DNA, 19 bp, Artificial sequence
  SiRNA target sequence
ctgtgtttttatattttgc

SEQ ID NO: 85014 - DNA, 19 bp, Artificial sequence
  SiRNA target sequence
tgtgtttttatattttgca

SEQ ID NO: 85015 - DNA, 19 bp, Artificial sequence
  SiRNA target sequence
gtgtttttatattttgcat

SEQ ID NO: 85016 - DNA, 19 bp, Artificial sequence
  SiRNA target sequence
tgtttttatattttgcatc

SEQ ID NO: 85017 - DNA, 19 bp, Artificial sequence
  SiRNA target sequence
gtttttatattttgcatct

SEQ ID NO: 85018 - DNA, 19 bp, Artificial sequence
  SiRNA target sequence
tttttatattttgcatctt

SEQ ID NO: 85019 - DNA, 19 bp, Artificial sequence
  SiRNA target sequence
ttttatattttgcatcttt

SEQ ID NO: 85020 - DNA, 19 bp, Artificial sequence
  SiRNA target sequence
tttatattttgcatcttta

SEQ ID NO: 85021 - DNA, 19 bp, Artificial sequence
  SiRNA target sequence
ttatattttgcatctttaa

SEQ ID NO: 85022 - DNA, 19 bp, Artificial sequence
  SiRNA target sequence
tatattttgcatctttaat

SEQ ID NO: 85023 - DNA, 19 bp, Artificial sequence
  SiRNA target sequence
atattttgcatctttaata

SEQ ID NO: 85024 - DNA, 19 bp, Artificial sequence
  SiRNA target sequence
tattttgcatctttaataa

SEQ ID NO: 85025 - DNA, 19 bp, Artificial sequence
  SiRNA target sequence
attttgcatctttaataag

SEQ ID NO: 85026 - DNA, 19 bp, Artificial sequence
  SiRNA target sequence
ttttgcatctttaataaga

SEQ ID NO: 85027 - DNA, 19 bp, Artificial sequence
  SiRNA target sequence
tttgcatctttaataagat

SEQ ID NO: 85028 - DNA, 19 bp, Artificial sequence
  SiRNA target sequence
ttgcatctttaataagatc

SEQ ID NO: 85029 - DNA, 19 bp, Artificial sequence
  SiRNA target sequence
tgcatctttaataagatca

SEQ ID NO: 85030 - DNA, 19 bp, Artificial sequence
  SiRNA target sequence
gcatctttaataagatcat

SEQ ID NO: 85031 - DNA, 19 bp, Artificial sequence
  SiRNA target sequence
catctttaataagatcatc

SEQ ID NO: 85032 - DNA, 19 bp, Artificial sequence
  SiRNA target sequence
atctttaataagatcatct

SEQ ID NO: 85033 - DNA, 19 bp, Artificial sequence
  SiRNA target sequence
tctttaataagatcatctt

SEQ ID NO: 85034 - DNA, 19 bp, Artificial sequence
  SiRNA target sequence
ctttaataagatcatcttc

SEQ ID NO: 85035 - DNA, 19 bp, Artificial sequence
  SiRNA target sequence
tttaataagatcatcttct

SEQ ID NO: 85036 - DNA, 19 bp, Artificial sequence
  SiRNA target sequence
ttaataagatcatcttctt

SEQ ID NO: 85037 - DNA, 19 bp, Artificial sequence
  SiRNA target sequence
taataagatcatcttcttg

SEQ ID NO: 85038 - DNA, 19 bp, Artificial sequence
  SiRNA target sequence
aataagatcatcttcttga

SEQ ID NO: 85039 - DNA, 19 bp, Artificial sequence
  SiRNA target sequence
ataagatcatcttcttgat

SEQ ID NO: 85040 - DNA, 19 bp, Artificial sequence
  SiRNA target sequence
taagatcatcttcttgatt

SEQ ID NO: 85041 - DNA, 19 bp, Artificial sequence
  SiRNA target sequence
aagatcatcttcttgattt

SEQ ID NO: 85042 - DNA, 19 bp, Artificial sequence
  SiRNA target sequence
agatcatcttcttgatttc

SEQ ID NO: 85043 - DNA, 19 bp, Artificial sequence
  SiRNA target sequence
gatcatcttcttgatttct

SEQ ID NO: 85044 - DNA, 19 bp, Artificial sequence
  SiRNA target sequence
atcatcttcttgatttcta

SEQ ID NO: 85045 - DNA, 19 bp, Artificial sequence
  SiRNA target sequence
tcatcttcttgatttctaa

SEQ ID NO: 85046 - DNA, 19 bp, Artificial sequence
  SiRNA target sequence
catcttcttgatttctaaa

SEQ ID NO: 85047 - DNA, 19 bp, Artificial sequence
  SiRNA target sequence
atcttcttgatttctaaat

SEQ ID NO: 85048 - DNA, 19 bp, Artificial sequence
  SiRNA target sequence
tcttcttgatttctaaatc

SEQ ID NO: 85049 - DNA, 19 bp, Artificial sequence
  SiRNA target sequence
cttcttgatttctaaatcc

SEQ ID NO: 85050 - DNA, 19 bp, Artificial sequence
  SiRNA target sequence
ttcttgatttctaaatcca

SEQ ID NO: 85051 - DNA, 19 bp, Artificial sequence
  SiRNA target sequence
tcttgatttctaaatccat

SEQ ID NO: 85052 - DNA, 19 bp, Artificial sequence
  SiRNA target sequence
cttgatttctaaatccata

SEQ ID NO: 85053 - DNA, 19 bp, Artificial sequence
  SiRNA target sequence
ttgatttctaaatccatat

SEQ ID NO: 85054 - DNA, 19 bp, Artificial sequence
  SiRNA target sequence
tgatttctaaatccatata

SEQ ID NO: 85055 - DNA, 19 bp, Artificial sequence
  SiRNA target sequence
gatttctaaatccatatat

SEQ ID NO: 85056 - DNA, 19 bp, Artificial sequence
  SiRNA target sequence
atttctaaatccatatatt

SEQ ID NO: 85057 - DNA, 19 bp, Artificial sequence
  SiRNA target sequence
tttctaaatccatatatta

SEQ ID NO: 85058 - DNA, 19 bp, Artificial sequence
  SiRNA target sequence
ttctaaatccatatattag

SEQ ID NO: 85059 - DNA, 19 bp, Artificial sequence
  SiRNA target sequence
tctaaatccatatattagt

SEQ ID NO: 85060 - DNA, 19 bp, Artificial sequence
  SiRNA target sequence
ctaaatccatatattagtt

SEQ ID NO: 85061 - DNA, 19 bp, Artificial sequence
  SiRNA target sequence
taaatccatatattagttt

SEQ ID NO: 85062 - DNA, 19 bp, Artificial sequence
  SiRNA target sequence
aaatccatatattagtttg

SEQ ID NO: 85063 - DNA, 19 bp, Artificial sequence
  SiRNA target sequence
aatccatatattagtttga

SEQ ID NO: 85064 - DNA, 19 bp, Artificial sequence
  SiRNA target sequence
atccatatattagtttgat

SEQ ID NO: 85065 - DNA, 19 bp, Artificial sequence
  SiRNA target sequence
tccatatattagtttgata

SEQ ID NO: 85066 - DNA, 19 bp, Artificial sequence
  SiRNA target sequence
ccatatattagtttgatat

SEQ ID NO: 85067 - DNA, 19 bp, Artificial sequence
  SiRNA target sequence
catatattagtttgatata

SEQ ID NO: 85068 - DNA, 19 bp, Artificial sequence
  SiRNA target sequence
atatattagtttgatatat

SEQ ID NO: 85069 - DNA, 19 bp, Artificial sequence
  SiRNA target sequence
tatattagtttgatatatt

SEQ ID NO: 85070 - DNA, 19 bp, Artificial sequence
  SiRNA target sequence
atattagtttgatatattg

SEQ ID NO: 85071 - DNA, 19 bp, Artificial sequence
  SiRNA target sequence
tattagtttgatatattga

SEQ ID NO: 85072 - DNA, 19 bp, Artificial sequence
  SiRNA target sequence
attagtttgatatattgat

SEQ ID NO: 85073 - DNA, 19 bp, Artificial sequence
  SiRNA target sequence
ttagtttgatatattgatc

SEQ ID NO: 85074 - DNA, 19 bp, Artificial sequence
  SiRNA target sequence
tagtttgatatattgatcg

SEQ ID NO: 85075 - DNA, 19 bp, Artificial sequence
  SiRNA target sequence
agtttgatatattgatcgt

SEQ ID NO: 85076 - DNA, 19 bp, Artificial sequence
  SiRNA target sequence
gtttgatatattgatcgtc

SEQ ID NO: 85077 - DNA, 19 bp, Artificial sequence
  SiRNA target sequence
tttgatatattgatcgtct

SEQ ID NO: 85078 - DNA, 19 bp, Artificial sequence
  SiRNA target sequence
ttgatatattgatcgtctt

SEQ ID NO: 85079 - DNA, 19 bp, Artificial sequence
  SiRNA target sequence
tgatatattgatcgtcttc

SEQ ID NO: 85080 - DNA, 19 bp, Artificial sequence
  SiRNA target sequence
gatatattgatcgtcttct

SEQ ID NO: 85081 - DNA, 19 bp, Artificial sequence
  SiRNA target sequence
atatattgatcgtcttctt

SEQ ID NO: 85082 - DNA, 19 bp, Artificial sequence
  SiRNA target sequence
tatattgatcgtcttcttt

SEQ ID NO: 85083 - DNA, 19 bp, Artificial sequence
  SiRNA target sequence
atattgatcgtcttcttta

SEQ ID NO: 85084 - DNA, 19 bp, Artificial sequence
  SiRNA target sequence
tattgatcgtcttctttat

SEQ ID NO: 85085 - DNA, 19 bp, Artificial sequence
  SiRNA target sequence
attgatcgtcttctttatt

SEQ ID NO: 85086 - DNA, 19 bp, Artificial sequence
  SiRNA target sequence
ttgatcgtcttctttattt

SEQ ID NO: 85087 - DNA, 19 bp, Artificial sequence
  SiRNA target sequence
tgatcgtcttctttatttt

SEQ ID NO: 85088 - DNA, 19 bp, Artificial sequence
  SiRNA target sequence
gatcgtcttctttattttt

SEQ ID NO: 85089 - DNA, 19 bp, Artificial sequence
  SiRNA target sequence
atcgtcttctttatttttc

SEQ ID NO: 85090 - DNA, 19 bp, Artificial sequence
  SiRNA target sequence
tcgtcttctttatttttca

SEQ ID NO: 85091 - DNA, 19 bp, Artificial sequence
  SiRNA target sequence
cgtcttctttatttttcaa

SEQ ID NO: 85092 - DNA, 19 bp, Artificial sequence
  SiRNA target sequence
gtcttctttatttttcaaa

SEQ ID NO: 85093 - DNA, 19 bp, Artificial sequence
  SiRNA target sequence
tcttctttatttttcaaaa

SEQ ID NO: 85094 - DNA, 19 bp, Artificial sequence
  SiRNA target sequence
cttctttatttttcaaaaa

SEQ ID NO: 85095 - DNA, 19 bp, Artificial sequence
  SiRNA target sequence
ttctttatttttcaaaaac

SEQ ID NO: 85096 - DNA, 19 bp, Artificial sequence
  SiRNA target sequence
tctttatttttcaaaaacg

SEQ ID NO: 85097 - DNA, 19 bp, Artificial sequence
  SiRNA target sequence
ctttatttttcaaaaacga

SEQ ID NO: 85098 - DNA, 19 bp, Artificial sequence
  SiRNA target sequence
tttatttttcaaaaacgaa

SEQ ID NO: 85099 - DNA, 19 bp, Artificial sequence
  SiRNA target sequence
ttatttttcaaaaacgaaa

SEQ ID NO: 85100 - DNA, 19 bp, Artificial sequence
  SiRNA target sequence
tatttttcaaaaacgaaaa

SEQ ID NO: 85101 - DNA, 19 bp, Artificial sequence
  SiRNA target sequence
atttttcaaaaacgaaaaa

SEQ ID NO: 85102 - DNA, 19 bp, Artificial sequence
  SiRNA target sequence
tttttcaaaaacgaaaaaa

SEQ ID NO: 85103 - DNA, 19 bp, Artificial sequence
  SiRNA target sequence
ttttcaaaaacgaaaaaaa

SEQ ID NO: 85104 - DNA, 19 bp, Artificial sequence
  SiRNA target sequence
tttcaaaaacgaaaaaaat

SEQ ID NO: 85105 - DNA, 19 bp, Artificial sequence
  SiRNA target sequence
ttcaaaaacgaaaaaaatg

SEQ ID NO: 85106 - DNA, 19 bp, Artificial sequence
  SiRNA target sequence
tcaaaaacgaaaaaaatgg

SEQ ID NO: 85107 - DNA, 19 bp, Artificial sequence
  SiRNA target sequence
caaaaacgaaaaaaatgga

SEQ ID NO: 85108 - DNA, 19 bp, Artificial sequence
  SiRNA target sequence
aaaaacgaaaaaaatggag

SEQ ID NO: 85109 - DNA, 19 bp, Artificial sequence
  SiRNA target sequence
aaaacgaaaaaaatggagc

SEQ ID NO: 85110 - DNA, 19 bp, Artificial sequence
  SiRNA target sequence
aaacgaaaaaaatggagca

SEQ ID NO: 85111 - DNA, 19 bp, Artificial sequence
  SiRNA target sequence
aacgaaaaaaatggagcaa

SEQ ID NO: 85112 - DNA, 19 bp, Artificial sequence
  SiRNA target sequence
acgaaaaaaatggagcaat

SEQ ID NO: 85113 - DNA, 19 bp, Artificial sequence
  SiRNA target sequence
cgaaaaaaatggagcaatg

SEQ ID NO: 85114 - DNA, 19 bp, Artificial sequence
  SiRNA target sequence
gaaaaaaatggagcaatgc

SEQ ID NO: 85115 - DNA, 19 bp, Artificial sequence
  SiRNA target sequence
aaaaaaatggagcaatgcc

SEQ ID NO: 85116 - DNA, 19 bp, Artificial sequence
  SiRNA target sequence
aaaaaatggagcaatgcca

SEQ ID NO: 85117 - DNA, 19 bp, Artificial sequence
  SiRNA target sequence
aaaaatggagcaatgccag

SEQ ID NO: 85118 - DNA, 19 bp, Artificial sequence
  SiRNA target sequence
aaaatggagcaatgccagt

SEQ ID NO: 85119 - DNA, 19 bp, Artificial sequence
  SiRNA target sequence
aaatggagcaatgccagtt

SEQ ID NO: 85120 - DNA, 19 bp, Artificial sequence
  SiRNA target sequence
aatggagcaatgccagttc

SEQ ID NO: 85121 - DNA, 19 bp, Artificial sequence
  SiRNA target sequence
atggagcaatgccagttcc

SEQ ID NO: 85122 - DNA, 19 bp, Artificial sequence
  SiRNA target sequence
tggagcaatgccagttcca

SEQ ID NO: 85123 - DNA, 19 bp, Artificial sequence
  SiRNA target sequence
ggagcaatgccagttccag

SEQ ID NO: 85124 - DNA, 19 bp, Artificial sequence
  SiRNA target sequence
gagcaatgccagttccagt

SEQ ID NO: 85125 - DNA, 19 bp, Artificial sequence
  SiRNA target sequence
agcaatgccagttccagta

SEQ ID NO: 85126 - DNA, 19 bp, Artificial sequence
  SiRNA target sequence
gcaatgccagttccagtac

SEQ ID NO: 85127 - DNA, 19 bp, Artificial sequence
  SiRNA target sequence
caatgccagttccagtaca

SEQ ID NO: 85128 - DNA, 19 bp, Artificial sequence
  SiRNA target sequence
aatgccagttccagtacaa

SEQ ID NO: 85129 - DNA, 19 bp, Artificial sequence
  SiRNA target sequence
atgccagttccagtacaaa

SEQ ID NO: 85130 - DNA, 19 bp, Artificial sequence
  SiRNA target sequence
tgccagttccagtacaaat

SEQ ID NO: 85131 - DNA, 19 bp, Artificial sequence
  SiRNA target sequence
gccagttccagtacaaata

SEQ ID NO: 85132 - DNA, 19 bp, Artificial sequence
  SiRNA target sequence
ccagttccagtacaaatac

SEQ ID NO: 85133 - DNA, 19 bp, Artificial sequence
  SiRNA target sequence
cagttccagtacaaatacc

SEQ ID NO: 85134 - DNA, 19 bp, Artificial sequence
  SiRNA target sequence
agttccagtacaaataccc

SEQ ID NO: 85135 - DNA, 19 bp, Artificial sequence
  SiRNA target sequence
gttccagtacaaataccca

SEQ ID NO: 85136 - DNA, 19 bp, Artificial sequence
  SiRNA target sequence
ttccagtacaaatacccaa

SEQ ID NO: 85137 - DNA, 19 bp, Artificial sequence
  SiRNA target sequence
tccagtacaaatacccaac

SEQ ID NO: 85138 - DNA, 19 bp, Artificial sequence
  SiRNA target sequence
ccagtacaaatacccaaca

SEQ ID NO: 85139 - DNA, 19 bp, Artificial sequence
  SiRNA target sequence
cagtacaaatacccaacac

SEQ ID NO: 85140 - DNA, 19 bp, Artificial sequence
  SiRNA target sequence
agtacaaatacccaacact

SEQ ID NO: 85141 - DNA, 19 bp, Artificial sequence
  SiRNA target sequence
gtacaaatacccaacactt

SEQ ID NO: 85142 - DNA, 19 bp, Artificial sequence
  SiRNA target sequence
tacaaatacccaacacttt

SEQ ID NO: 85143 - DNA, 19 bp, Artificial sequence
  SiRNA target sequence
acaaatacccaacactttt

SEQ ID NO: 85144 - DNA, 19 bp, Artificial sequence
  SiRNA target sequence
caaatacccaacacttttt

SEQ ID NO: 85145 - DNA, 19 bp, Artificial sequence
  SiRNA target sequence
aaatacccaacactttttt

SEQ ID NO: 85146 - DNA, 19 bp, Artificial sequence
  SiRNA target sequence
aatacccaacactttttta

SEQ ID NO: 85147 - DNA, 19 bp, Artificial sequence
  SiRNA target sequence
atacccaacacttttttac

SEQ ID NO: 85148 - DNA, 19 bp, Artificial sequence
  SiRNA target sequence
tacccaacacttttttaca

SEQ ID NO: 85149 - DNA, 19 bp, Artificial sequence
  SiRNA target sequence
acccaacacttttttacaa

SEQ ID NO: 85150 - DNA, 19 bp, Artificial sequence
  SiRNA target sequence
cccaacacttttttacaaa

SEQ ID NO: 85151 - DNA, 19 bp, Artificial sequence
  SiRNA target sequence
ccaacacttttttacaaaa

SEQ ID NO: 85152 - DNA, 19 bp, Artificial sequence
  SiRNA target sequence
caacacttttttacaaaaa

SEQ ID NO: 85153 - DNA, 19 bp, Artificial sequence
  SiRNA target sequence
aacacttttttacaaaaat

SEQ ID NO: 85154 - DNA, 19 bp, Artificial sequence
  SiRNA target sequence
acacttttttacaaaaatt

SEQ ID NO: 85155 - DNA, 19 bp, Artificial sequence
  SiRNA target sequence
cacttttttacaaaaattt

SEQ ID NO: 85156 - DNA, 19 bp, Artificial sequence
  SiRNA target sequence
acttttttacaaaaattta

SEQ ID NO: 85157 - DNA, 19 bp, Artificial sequence
  SiRNA target sequence
cttttttacaaaaatttaa

SEQ ID NO: 85158 - DNA, 19 bp, Artificial sequence
  SiRNA target sequence
ttttttacaaaaatttaat

SEQ ID NO: 85159 - DNA, 19 bp, Artificial sequence
  SiRNA target sequence
tttttacaaaaatttaatc

SEQ ID NO: 85160 - DNA, 19 bp, Artificial sequence
  SiRNA target sequence
ttttacaaaaatttaatct

SEQ ID NO: 85161 - DNA, 19 bp, Artificial sequence
  SiRNA target sequence
tttacaaaaatttaatcta

SEQ ID NO: 85162 - DNA, 19 bp, Artificial sequence
  SiRNA target sequence
ttacaaaaatttaatctaa

SEQ ID NO: 85163 - DNA, 19 bp, Artificial sequence
  SiRNA target sequence
tacaaaaatttaatctaaa

SEQ ID NO: 85164 - DNA, 19 bp, Artificial sequence
  SiRNA target sequence
acaaaaatttaatctaaat

SEQ ID NO: 85165 - DNA, 19 bp, Artificial sequence
  SiRNA target sequence
caaaaatttaatctaaata

SEQ ID NO: 85166 - DNA, 19 bp, Artificial sequence
  SiRNA target sequence
aaaaatttaatctaaataa

SEQ ID NO: 85167 - DNA, 19 bp, Artificial sequence
  SiRNA target sequence
aaaatttaatctaaataat

SEQ ID NO: 85168 - DNA, 19 bp, Artificial sequence
  SiRNA target sequence
aaatttaatctaaataatt

SEQ ID NO: 85169 - DNA, 19 bp, Artificial sequence
  SiRNA target sequence
aatttaatctaaataattt

SEQ ID NO: 85170 - DNA, 19 bp, Artificial sequence
  SiRNA target sequence
atttaatctaaataattta

SEQ ID NO: 85171 - DNA, 19 bp, Artificial sequence
  SiRNA target sequence
tttaatctaaataatttac

SEQ ID NO: 85172 - DNA, 19 bp, Artificial sequence
  SiRNA target sequence
ttaatctaaataatttact

SEQ ID NO: 85173 - DNA, 19 bp, Artificial sequence
  SiRNA target sequence
taatctaaataatttactc

SEQ ID NO: 85174 - DNA, 19 bp, Artificial sequence
  SiRNA target sequence
aatctaaataatttactcg

SEQ ID NO: 85175 - DNA, 19 bp, Artificial sequence
  SiRNA target sequence
atctaaataatttactcgg

SEQ ID NO: 85176 - DNA, 19 bp, Artificial sequence
  SiRNA target sequence
tctaaataatttactcggt

SEQ ID NO: 85177 - DNA, 19 bp, Artificial sequence
  SiRNA target sequence
ctaaataatttactcggtc

SEQ ID NO: 85178 - DNA, 19 bp, Artificial sequence
  SiRNA target sequence
taaataatttactcggtct

SEQ ID NO: 85179 - DNA, 19 bp, Artificial sequence
  SiRNA target sequence
aaataatttactcggtctg

SEQ ID NO: 85180 - DNA, 19 bp, Artificial sequence
  SiRNA target sequence
aataatttactcggtctgt

SEQ ID NO: 85181 - DNA, 19 bp, Artificial sequence
  SiRNA target sequence
ataatttactcggtctgtg

SEQ ID NO: 85182 - DNA, 19 bp, Artificial sequence
  SiRNA target sequence
taatttactcggtctgtga

SEQ ID NO: 85183 - DNA, 19 bp, Artificial sequence
  SiRNA target sequence
aatttactcggtctgtgac

SEQ ID NO: 85184 - DNA, 19 bp, Artificial sequence
  SiRNA target sequence
atttactcggtctgtgaca

SEQ ID NO: 85185 - DNA, 19 bp, Artificial sequence
  SiRNA target sequence
tttactcggtctgtgacag

SEQ ID NO: 85186 - DNA, 19 bp, Artificial sequence
  SiRNA target sequence
ttactcggtctgtgacaga

SEQ ID NO: 85187 - DNA, 19 bp, Artificial sequence
  SiRNA target sequence
tactcggtctgtgacagat

SEQ ID NO: 85188 - DNA, 19 bp, Artificial sequence
  SiRNA target sequence
actcggtctgtgacagatc

SEQ ID NO: 85189 - DNA, 19 bp, Artificial sequence
  SiRNA target sequence
ctcggtctgtgacagatct

SEQ ID NO: 85190 - DNA, 19 bp, Artificial sequence
  SiRNA target sequence
tcggtctgtgacagatctt

SEQ ID NO: 85191 - DNA, 19 bp, Artificial sequence
  SiRNA target sequence
cggtctgtgacagatcttt

SEQ ID NO: 85192 - DNA, 19 bp, Artificial sequence
  SiRNA target sequence
ggtctgtgacagatcttta

SEQ ID NO: 85193 - DNA, 19 bp, Artificial sequence
  SiRNA target sequence
gtctgtgacagatctttaa

SEQ ID NO: 85194 - DNA, 19 bp, Artificial sequence
  SiRNA target sequence
tctgtgacagatctttaaa

SEQ ID NO: 85195 - DNA, 19 bp, Artificial sequence
  SiRNA target sequence
ctgtgacagatctttaaat

SEQ ID NO: 85196 - DNA, 19 bp, Artificial sequence
  SiRNA target sequence
tgtgacagatctttaaatt

SEQ ID NO: 85197 - DNA, 19 bp, Artificial sequence
  SiRNA target sequence
gtgacagatctttaaatta

SEQ ID NO: 85198 - DNA, 19 bp, Artificial sequence
  SiRNA target sequence
tgacagatctttaaattat

SEQ ID NO: 85199 - DNA, 19 bp, Artificial sequence
  SiRNA target sequence
gacagatctttaaattatt

SEQ ID NO: 85200 - DNA, 19 bp, Artificial sequence
  SiRNA target sequence
acagatctttaaattatta

SEQ ID NO: 85201 - DNA, 19 bp, Artificial sequence
  SiRNA target sequence
cagatctttaaattattat

SEQ ID NO: 85202 - DNA, 19 bp, Artificial sequence
  SiRNA target sequence
agatctttaaattattata

SEQ ID NO: 85203 - DNA, 19 bp, Artificial sequence
  SiRNA target sequence
gatctttaaattattataa

SEQ ID NO: 85204 - DNA, 19 bp, Artificial sequence
  SiRNA target sequence
atctttaaattattataat

SEQ ID NO: 85205 - DNA, 19 bp, Artificial sequence
  SiRNA target sequence
tctttaaattattataatt

SEQ ID NO: 85206 - DNA, 19 bp, Artificial sequence
  SiRNA target sequence
ctttaaattattataattt

SEQ ID NO: 85207 - DNA, 19 bp, Artificial sequence
  SiRNA target sequence
tttaaattattataatttt

SEQ ID NO: 85208 - DNA, 19 bp, Artificial sequence
  SiRNA target sequence
ttaaattattataattttg

SEQ ID NO: 85209 - DNA, 19 bp, Artificial sequence
  SiRNA target sequence
taaattattataattttgc

SEQ ID NO: 85210 - DNA, 19 bp, Artificial sequence
  SiRNA target sequence
aaattattataattttgca

SEQ ID NO: 85211 - DNA, 19 bp, Artificial sequence
  SiRNA target sequence
aattattataattttgcat

SEQ ID NO: 85212 - DNA, 19 bp, Artificial sequence
  SiRNA target sequence
attattataattttgcata

SEQ ID NO: 85213 - DNA, 19 bp, Artificial sequence
  SiRNA target sequence
ttattataattttgcatat

SEQ ID NO: 85214 - DNA, 19 bp, Artificial sequence
  SiRNA target sequence
tattataattttgcatatc

SEQ ID NO: 85215 - DNA, 19 bp, Artificial sequence
  SiRNA target sequence
attataattttgcatatct

SEQ ID NO: 85216 - DNA, 19 bp, Artificial sequence
  SiRNA target sequence
ttataattttgcatatcta

SEQ ID NO: 85217 - DNA, 19 bp, Artificial sequence
  SiRNA target sequence
tataattttgcatatctat

SEQ ID NO: 85218 - DNA, 19 bp, Artificial sequence
  SiRNA target sequence
ataattttgcatatctatg

SEQ ID NO: 85219 - DNA, 19 bp, Artificial sequence
  SiRNA target sequence
taattttgcatatctatga

SEQ ID NO: 85220 - DNA, 19 bp, Artificial sequence
  SiRNA target sequence
aattttgcatatctatgaa

SEQ ID NO: 85221 - DNA, 19 bp, Artificial sequence
  SiRNA target sequence
attttgcatatctatgaaa

SEQ ID NO: 85222 - DNA, 19 bp, Artificial sequence
  SiRNA target sequence
ttttgcatatctatgaaat

SEQ ID NO: 85223 - DNA, 19 bp, Artificial sequence
  SiRNA target sequence
tttgcatatctatgaaatt

SEQ ID NO: 85224 - DNA, 19 bp, Artificial sequence
  SiRNA target sequence
ttgcatatctatgaaattg

SEQ ID NO: 85225 - DNA, 19 bp, Artificial sequence
  SiRNA target sequence
tgcatatctatgaaattgg

SEQ ID NO: 85226 - DNA, 19 bp, Artificial sequence
  SiRNA target sequence
gcatatctatgaaattgga

SEQ ID NO: 85227 - DNA, 19 bp, Artificial sequence
  SiRNA target sequence
catatctatgaaattggaa

SEQ ID NO: 85228 - DNA, 19 bp, Artificial sequence
  SiRNA target sequence
atatctatgaaattggaaa

SEQ ID NO: 85229 - DNA, 19 bp, Artificial sequence
  SiRNA target sequence
tatctatgaaattggaaac

SEQ ID NO: 85230 - DNA, 19 bp, Artificial sequence
  SiRNA target sequence
atctatgaaattggaaaca

SEQ ID NO: 85231 - DNA, 19 bp, Artificial sequence
  SiRNA target sequence
tctatgaaattggaaacat

SEQ ID NO: 85232 - DNA, 19 bp, Artificial sequence
  SiRNA target sequence
ctatgaaattggaaacatg

SEQ ID NO: 85233 - DNA, 19 bp, Artificial sequence
  SiRNA target sequence
tatgaaattggaaacatgt

SEQ ID NO: 85234 - DNA, 19 bp, Artificial sequence
  SiRNA target sequence
atgaaattggaaacatgtc

SEQ ID NO: 85235 - DNA, 19 bp, Artificial sequence
  SiRNA target sequence
tgaaattggaaacatgtcc

SEQ ID NO: 85236 - DNA, 19 bp, Artificial sequence
  SiRNA target sequence
gaaattggaaacatgtcca

SEQ ID NO: 85237 - DNA, 19 bp, Artificial sequence
  SiRNA target sequence
aaattggaaacatgtccat

SEQ ID NO: 85238 - DNA, 19 bp, Artificial sequence
  SiRNA target sequence
aattggaaacatgtccata

SEQ ID NO: 85239 - DNA, 19 bp, Artificial sequence
  SiRNA target sequence
attggaaacatgtccatat

SEQ ID NO: 85240 - DNA, 19 bp, Artificial sequence
  SiRNA target sequence
ttggaaacatgtccatatc

SEQ ID NO: 85241 - DNA, 19 bp, Artificial sequence
  SiRNA target sequence
tggaaacatgtccatatct

SEQ ID NO: 85242 - DNA, 19 bp, Artificial sequence
  SiRNA target sequence
ggaaacatgtccatatcta

SEQ ID NO: 85243 - DNA, 19 bp, Artificial sequence
  SiRNA target sequence
gaaacatgtccatatctat

SEQ ID NO: 85244 - DNA, 19 bp, Artificial sequence
  SiRNA target sequence
aaacatgtccatatctatc

SEQ ID NO: 85245 - DNA, 19 bp, Artificial sequence
  SiRNA target sequence
aacatgtccatatctatcg

SEQ ID NO: 85246 - DNA, 19 bp, Artificial sequence
  SiRNA target sequence
acatgtccatatctatcgc

SEQ ID NO: 85247 - DNA, 19 bp, Artificial sequence
  SiRNA target sequence
catgtccatatctatcgcc

SEQ ID NO: 85248 - DNA, 19 bp, Artificial sequence
  SiRNA target sequence
atgtccatatctatcgcct

SEQ ID NO: 85249 - DNA, 19 bp, Artificial sequence
  SiRNA target sequence
tgtccatatctatcgcctt

SEQ ID NO: 85250 - DNA, 19 bp, Artificial sequence
  SiRNA target sequence
gtccatatctatcgccttt

SEQ ID NO: 85251 - DNA, 19 bp, Artificial sequence
  SiRNA target sequence
tccatatctatcgcctttt

SEQ ID NO: 85252 - DNA, 19 bp, Artificial sequence
  SiRNA target sequence
ccatatctatcgccttttt

SEQ ID NO: 85253 - DNA, 19 bp, Artificial sequence
  SiRNA target sequence
catatctatcgcctttttt

SEQ ID NO: 85254 - DNA, 19 bp, Artificial sequence
  SiRNA target sequence
atatctatcgcctttttta

SEQ ID NO: 85255 - DNA, 19 bp, Artificial sequence
  SiRNA target sequence
tatctatcgccttttttaa

SEQ ID NO: 85256 - DNA, 19 bp, Artificial sequence
  SiRNA target sequence
atctatcgccttttttaat

SEQ ID NO: 85257 - DNA, 19 bp, Artificial sequence
  SiRNA target sequence
tctatcgccttttttaata

SEQ ID NO: 85258 - DNA, 19 bp, Artificial sequence
  SiRNA target sequence
ctatcgccttttttaataa

SEQ ID NO: 85259 - DNA, 19 bp, Artificial sequence
  SiRNA target sequence
tatcgccttttttaataat

SEQ ID NO: 85260 - DNA, 19 bp, Artificial sequence
  SiRNA target sequence
atcgccttttttaataatt

SEQ ID NO: 85261 - DNA, 19 bp, Artificial sequence
  SiRNA target sequence
tcgccttttttaataattg

SEQ ID NO: 85262 - DNA, 19 bp, Artificial sequence
  SiRNA target sequence
cgccttttttaataattgc

SEQ ID NO: 85263 - DNA, 19 bp, Artificial sequence
  SiRNA target sequence
gccttttttaataattgct

SEQ ID NO: 85264 - DNA, 19 bp, Artificial sequence
  SiRNA target sequence
ccttttttaataattgcta

SEQ ID NO: 85265 - DNA, 19 bp, Artificial sequence
  SiRNA target sequence
cttttttaataattgctac

SEQ ID NO: 85266 - DNA, 19 bp, Artificial sequence
  SiRNA target sequence
ttttttaataattgctact

SEQ ID NO: 85267 - DNA, 19 bp, Artificial sequence
  SiRNA target sequence
tttttaataattgctacta

SEQ ID NO: 85268 - DNA, 19 bp, Artificial sequence
  SiRNA target sequence
ttttaataattgctactaa

SEQ ID NO: 85269 - DNA, 19 bp, Artificial sequence
  SiRNA target sequence
tttaataattgctactaaa

SEQ ID NO: 85270 - DNA, 19 bp, Artificial sequence
  SiRNA target sequence
ttaataattgctactaaaa

SEQ ID NO: 85271 - DNA, 19 bp, Artificial sequence
  SiRNA target sequence
taataattgctactaaaat

SEQ ID NO: 85272 - DNA, 19 bp, Artificial sequence
  SiRNA target sequence
aataattgctactaaaatt

SEQ ID NO: 85273 - DNA, 19 bp, Artificial sequence
  SiRNA target sequence
ataattgctactaaaattt

SEQ ID NO: 85274 - DNA, 19 bp, Artificial sequence
  SiRNA target sequence
taattgctactaaaatttc

SEQ ID NO: 85275 - DNA, 19 bp, Artificial sequence
  SiRNA target sequence
aattgctactaaaatttca

SEQ ID NO: 85276 - DNA, 19 bp, Artificial sequence
  SiRNA target sequence
attgctactaaaatttcac

SEQ ID NO: 85277 - DNA, 19 bp, Artificial sequence
  SiRNA target sequence
ttgctactaaaatttcaca

SEQ ID NO: 85278 - DNA, 19 bp, Artificial sequence
  SiRNA target sequence
tgctactaaaatttcacat

SEQ ID NO: 85279 - DNA, 19 bp, Artificial sequence
  SiRNA target sequence
gctactaaaatttcacatt

SEQ ID NO: 85280 - DNA, 19 bp, Artificial sequence
  SiRNA target sequence
ctactaaaatttcacattt

SEQ ID NO: 85281 - DNA, 19 bp, Artificial sequence
  SiRNA target sequence
tactaaaatttcacatttt

SEQ ID NO: 85282 - DNA, 19 bp, Artificial sequence
  SiRNA target sequence
actaaaatttcacattttt

SEQ ID NO: 85283 - DNA, 19 bp, Artificial sequence
  SiRNA target sequence
ctaaaatttcacatttttc

SEQ ID NO: 85284 - DNA, 19 bp, Artificial sequence
  SiRNA target sequence
taaaatttcacatttttca

SEQ ID NO: 85285 - DNA, 19 bp, Artificial sequence
  SiRNA target sequence
aaaatttcacatttttcat

SEQ ID NO: 85286 - DNA, 19 bp, Artificial sequence
  SiRNA target sequence
aaatttcacatttttcatt

SEQ ID NO: 85287 - DNA, 19 bp, Artificial sequence
  SiRNA target sequence
aatttcacatttttcattt

SEQ ID NO: 85288 - DNA, 19 bp, Artificial sequence
  SiRNA target sequence
atttcacatttttcattta

SEQ ID NO: 85289 - DNA, 19 bp, Artificial sequence
  SiRNA target sequence
tttcacatttttcatttac

SEQ ID NO: 85290 - DNA, 19 bp, Artificial sequence
  SiRNA target sequence
ttcacatttttcatttacg

SEQ ID NO: 85291 - DNA, 19 bp, Artificial sequence
  SiRNA target sequence
tcacatttttcatttacgt

SEQ ID NO: 85292 - DNA, 19 bp, Artificial sequence
  SiRNA target sequence
cacatttttcatttacgtg

SEQ ID NO: 85293 - DNA, 19 bp, Artificial sequence
  SiRNA target sequence
acatttttcatttacgtgg

SEQ ID NO: 85294 - DNA, 19 bp, Artificial sequence
  SiRNA target sequence
catttttcatttacgtggt

SEQ ID NO: 85295 - DNA, 19 bp, Artificial sequence
  SiRNA target sequence
atttttcatttacgtggtt

SEQ ID NO: 85296 - DNA, 19 bp, Artificial sequence
  SiRNA target sequence
tttttcatttacgtggtta

SEQ ID NO: 85297 - DNA, 19 bp, Artificial sequence
  SiRNA target sequence
ttttcatttacgtggttag

SEQ ID NO: 85298 - DNA, 19 bp, Artificial sequence
  SiRNA target sequence
tttcatttacgtggttagt

SEQ ID NO: 85299 - DNA, 19 bp, Artificial sequence
  SiRNA target sequence
ttcatttacgtggttagta

SEQ ID NO: 85300 - DNA, 19 bp, Artificial sequence
  SiRNA target sequence
tcatttacgtggttagtaa

SEQ ID NO: 85301 - DNA, 19 bp, Artificial sequence
  SiRNA target sequence
catttacgtggttagtaag

SEQ ID NO: 85302 - DNA, 19 bp, Artificial sequence
  SiRNA target sequence
atttacgtggttagtaagt

SEQ ID NO: 85303 - DNA, 19 bp, Artificial sequence
  SiRNA target sequence
tttacgtggttagtaagtg

SEQ ID NO: 85304 - DNA, 19 bp, Artificial sequence
  SiRNA target sequence
ttacgtggttagtaagtga

SEQ ID NO: 85305 - DNA, 19 bp, Artificial sequence
  SiRNA target sequence
tacgtggttagtaagtgaa

SEQ ID NO: 85306 - DNA, 19 bp, Artificial sequence
  SiRNA target sequence
acgtggttagtaagtgaat

SEQ ID NO: 85307 - DNA, 19 bp, Artificial sequence
  SiRNA target sequence
cgtggttagtaagtgaata

SEQ ID NO: 85308 - DNA, 19 bp, Artificial sequence
  SiRNA target sequence
gtggttagtaagtgaataa

SEQ ID NO: 85309 - DNA, 19 bp, Artificial sequence
  SiRNA target sequence
tggttagtaagtgaataat

SEQ ID NO: 85310 - DNA, 19 bp, Artificial sequence
  SiRNA target sequence
ggttagtaagtgaataata

SEQ ID NO: 85311 - DNA, 19 bp, Artificial sequence
  SiRNA target sequence
gttagtaagtgaataatat

SEQ ID NO: 85312 - DNA, 19 bp, Artificial sequence
  SiRNA target sequence
ttagtaagtgaataatatc

SEQ ID NO: 85313 - DNA, 19 bp, Artificial sequence
  SiRNA target sequence
tagtaagtgaataatatct

SEQ ID NO: 85314 - DNA, 19 bp, Artificial sequence
  SiRNA target sequence
agtaagtgaataatatctt

SEQ ID NO: 85315 - DNA, 19 bp, Artificial sequence
  SiRNA target sequence
gtaagtgaataatatcttg

SEQ ID NO: 85316 - DNA, 19 bp, Artificial sequence
  SiRNA target sequence
taagtgaataatatcttgg

SEQ ID NO: 85317 - DNA, 19 bp, Artificial sequence
  SiRNA target sequence
aagtgaataatatcttggc

SEQ ID NO: 85318 - DNA, 19 bp, Artificial sequence
  SiRNA target sequence
agtgaataatatcttggct

SEQ ID NO: 85319 - DNA, 19 bp, Artificial sequence
  SiRNA target sequence
gtgaataatatcttggctt

SEQ ID NO: 85320 - DNA, 19 bp, Artificial sequence
  SiRNA target sequence
tgaataatatcttggctta

SEQ ID NO: 85321 - DNA, 19 bp, Artificial sequence
  SiRNA target sequence
gaataatatcttggcttaa

SEQ ID NO: 85322 - DNA, 19 bp, Artificial sequence
  SiRNA target sequence
aataatatcttggcttaat

SEQ ID NO: 85323 - DNA, 19 bp, Artificial sequence
  SiRNA target sequence
ataatatcttggcttaatt

SEQ ID NO: 85324 - DNA, 19 bp, Artificial sequence
  SiRNA target sequence
taatatcttggcttaattg

SEQ ID NO: 85325 - DNA, 19 bp, Artificial sequence
  SiRNA target sequence
aatatcttggcttaattgt

SEQ ID NO: 85326 - DNA, 19 bp, Artificial sequence
  SiRNA target sequence
atatcttggcttaattgtt

SEQ ID NO: 85327 - DNA, 19 bp, Artificial sequence
  SiRNA target sequence
tatcttggcttaattgttt

SEQ ID NO: 85328 - DNA, 19 bp, Artificial sequence
  SiRNA target sequence
atcttggcttaattgtttg

SEQ ID NO: 85329 - DNA, 19 bp, Artificial sequence
  SiRNA target sequence
tcttggcttaattgtttga

SEQ ID NO: 85330 - DNA, 19 bp, Artificial sequence
  SiRNA target sequence
cttggcttaattgtttgac

SEQ ID NO: 85331 - DNA, 19 bp, Artificial sequence
  SiRNA target sequence
ttggcttaattgtttgaca

SEQ ID NO: 85332 - DNA, 19 bp, Artificial sequence
  SiRNA target sequence
tggcttaattgtttgacaa

SEQ ID NO: 85333 - DNA, 19 bp, Artificial sequence
  SiRNA target sequence
ggcttaattgtttgacaat

SEQ ID NO: 85334 - DNA, 19 bp, Artificial sequence
  SiRNA target sequence
gcttaattgtttgacaatt

SEQ ID NO: 85335 - DNA, 19 bp, Artificial sequence
  SiRNA target sequence
cttaattgtttgacaattc

SEQ ID NO: 85336 - DNA, 19 bp, Artificial sequence
  SiRNA target sequence
ttaattgtttgacaattca

SEQ ID NO: 85337 - DNA, 19 bp, Artificial sequence
  SiRNA target sequence
taattgtttgacaattcat

SEQ ID NO: 85338 - DNA, 19 bp, Artificial sequence
  SiRNA target sequence
aattgtttgacaattcata

SEQ ID NO: 85339 - DNA, 19 bp, Artificial sequence
  SiRNA target sequence
attgtttgacaattcataa

SEQ ID NO: 85340 - DNA, 19 bp, Artificial sequence
  SiRNA target sequence
ttgtttgacaattcataat

SEQ ID NO: 85341 - DNA, 19 bp, Artificial sequence
  SiRNA target sequence
tgtttgacaattcataata

SEQ ID NO: 85342 - DNA, 19 bp, Artificial sequence
  SiRNA target sequence
gtttgacaattcataataa

SEQ ID NO: 85343 - DNA, 19 bp, Artificial sequence
  SiRNA target sequence
tttgacaattcataataag

SEQ ID NO: 85344 - DNA, 19 bp, Artificial sequence
  SiRNA target sequence
ttgacaattcataataaga

SEQ ID NO: 85345 - DNA, 19 bp, Artificial sequence
  SiRNA target sequence
tgacaattcataataagat

SEQ ID NO: 85346 - DNA, 19 bp, Artificial sequence
  SiRNA target sequence
gacaattcataataagatc

SEQ ID NO: 85347 - DNA, 19 bp, Artificial sequence
  SiRNA target sequence
acaattcataataagatcc

SEQ ID NO: 85348 - DNA, 19 bp, Artificial sequence
  SiRNA target sequence
caattcataataagatcct

SEQ ID NO: 85349 - DNA, 19 bp, Artificial sequence
  SiRNA target sequence
aattcataataagatcctc

SEQ ID NO: 85350 - DNA, 19 bp, Artificial sequence
  SiRNA target sequence
attcataataagatcctct

SEQ ID NO: 85351 - DNA, 19 bp, Artificial sequence
  SiRNA target sequence
ttcataataagatcctcta

SEQ ID NO: 85352 - DNA, 19 bp, Artificial sequence
  SiRNA target sequence
tcataataagatcctctaa

SEQ ID NO: 85353 - DNA, 19 bp, Artificial sequence
  SiRNA target sequence
cataataagatcctctaaa

SEQ ID NO: 85354 - DNA, 19 bp, Artificial sequence
  SiRNA target sequence
ataataagatcctctaaac

SEQ ID NO: 85355 - DNA, 19 bp, Artificial sequence
  SiRNA target sequence
taataagatcctctaaact

SEQ ID NO: 85356 - DNA, 19 bp, Artificial sequence
  SiRNA target sequence
aataagatcctctaaactt

SEQ ID NO: 85357 - DNA, 19 bp, Artificial sequence
  SiRNA target sequence
ataagatcctctaaacttg

SEQ ID NO: 85358 - DNA, 19 bp, Artificial sequence
  SiRNA target sequence
taagatcctctaaacttgg

SEQ ID NO: 85359 - DNA, 19 bp, Artificial sequence
  SiRNA target sequence
aagatcctctaaacttggt

SEQ ID NO: 85360 - DNA, 19 bp, Artificial sequence
  SiRNA target sequence
agatcctctaaacttggtt

SEQ ID NO: 85361 - DNA, 19 bp, Artificial sequence
  SiRNA target sequence
gatcctctaaacttggttt

SEQ ID NO: 85362 - DNA, 19 bp, Artificial sequence
  SiRNA target sequence
atcctctaaacttggttta

SEQ ID NO: 85363 - DNA, 19 bp, Artificial sequence
  SiRNA target sequence
tcctctaaacttggtttac

SEQ ID NO: 85364 - DNA, 19 bp, Artificial sequence
  SiRNA target sequence
cctctaaacttggtttaca

SEQ ID NO: 85365 - DNA, 19 bp, Artificial sequence
  SiRNA target sequence
ctctaaacttggtttacat

SEQ ID NO: 85366 - DNA, 19 bp, Artificial sequence
  SiRNA target sequence
tctaaacttggtttacatt

SEQ ID NO: 85367 - DNA, 19 bp, Artificial sequence
  SiRNA target sequence
ctaaacttggtttacattg

SEQ ID NO: 85368 - DNA, 19 bp, Artificial sequence
  SiRNA target sequence
taaacttggtttacattga

SEQ ID NO: 85369 - DNA, 19 bp, Artificial sequence
  SiRNA target sequence
aaacttggtttacattgaa

SEQ ID NO: 85370 - DNA, 19 bp, Artificial sequence
  SiRNA target sequence
aacttggtttacattgaaa

SEQ ID NO: 85371 - DNA, 19 bp, Artificial sequence
  SiRNA target sequence
acttggtttacattgaaat

SEQ ID NO: 85372 - DNA, 19 bp, Artificial sequence
  SiRNA target sequence
cttggtttacattgaaatg

SEQ ID NO: 85373 - DNA, 19 bp, Artificial sequence
  SiRNA target sequence
ttggtttacattgaaatgt

SEQ ID NO: 85374 - DNA, 19 bp, Artificial sequence
  SiRNA target sequence
tggtttacattgaaatgta

SEQ ID NO: 85375 - DNA, 19 bp, Artificial sequence
  SiRNA target sequence
ggtttacattgaaatgtat

SEQ ID NO: 85376 - DNA, 19 bp, Artificial sequence
  SiRNA target sequence
gtttacattgaaatgtata

SEQ ID NO: 85377 - DNA, 19 bp, Artificial sequence
  SiRNA target sequence
tttacattgaaatgtatat

SEQ ID NO: 85378 - DNA, 19 bp, Artificial sequence
  SiRNA target sequence
ttacattgaaatgtatata

SEQ ID NO: 85379 - DNA, 19 bp, Artificial sequence
  SiRNA target sequence
tacattgaaatgtatatat

SEQ ID NO: 85380 - DNA, 19 bp, Artificial sequence
  SiRNA target sequence
acattgaaatgtatatata

SEQ ID NO: 85381 - DNA, 19 bp, Artificial sequence
  SiRNA target sequence
cattgaaatgtatatataa

SEQ ID NO: 85382 - DNA, 19 bp, Artificial sequence
  SiRNA target sequence
attgaaatgtatatataat

SEQ ID NO: 85383 - DNA, 19 bp, Artificial sequence
  SiRNA target sequence
ttgaaatgtatatataatg

SEQ ID NO: 85384 - DNA, 19 bp, Artificial sequence
  SiRNA target sequence
tgaaatgtatatataatgt

SEQ ID NO: 85385 - DNA, 19 bp, Artificial sequence
  SiRNA target sequence
gaaatgtatatataatgtc

SEQ ID NO: 85386 - DNA, 19 bp, Artificial sequence
  SiRNA target sequence
aaatgtatatataatgtca

SEQ ID NO: 85387 - DNA, 19 bp, Artificial sequence
  SiRNA target sequence
aatgtatatataatgtcaa

SEQ ID NO: 85388 - DNA, 19 bp, Artificial sequence
  SiRNA target sequence
atgtatatataatgtcaag

SEQ ID NO: 85389 - DNA, 19 bp, Artificial sequence
  SiRNA target sequence
tgtatatataatgtcaagc

SEQ ID NO: 85390 - DNA, 19 bp, Artificial sequence
  SiRNA target sequence
gtatatataatgtcaagca

SEQ ID NO: 85391 - DNA, 19 bp, Artificial sequence
  SiRNA target sequence
tatatataatgtcaagcac

SEQ ID NO: 85392 - DNA, 19 bp, Artificial sequence
  SiRNA target sequence
atatataatgtcaagcaca

SEQ ID NO: 85393 - DNA, 19 bp, Artificial sequence
  SiRNA target sequence
tatataatgtcaagcacat

SEQ ID NO: 85394 - DNA, 19 bp, Artificial sequence
  SiRNA target sequence
atataatgtcaagcacatt

SEQ ID NO: 85395 - DNA, 19 bp, Artificial sequence
  SiRNA target sequence
tataatgtcaagcacatta

SEQ ID NO: 85396 - DNA, 19 bp, Artificial sequence
  SiRNA target sequence
ataatgtcaagcacattat

SEQ ID NO: 85397 - DNA, 19 bp, Artificial sequence
  SiRNA target sequence
taatgtcaagcacattatt

SEQ ID NO: 85398 - DNA, 19 bp, Artificial sequence
  SiRNA target sequence
aatgtcaagcacattattc

SEQ ID NO: 85399 - DNA, 19 bp, Artificial sequence
  SiRNA target sequence
atgtcaagcacattattcc

SEQ ID NO: 85400 - DNA, 19 bp, Artificial sequence
  SiRNA target sequence
tgtcaagcacattattcca

SEQ ID NO: 85401 - DNA, 19 bp, Artificial sequence
  SiRNA target sequence
gtcaagcacattattccag

SEQ ID NO: 85402 - DNA, 19 bp, Artificial sequence
  SiRNA target sequence
tcaagcacattattccagt

SEQ ID NO: 85403 - DNA, 19 bp, Artificial sequence
  SiRNA target sequence
caagcacattattccagtt

SEQ ID NO: 85404 - DNA, 19 bp, Artificial sequence
  SiRNA target sequence
aagcacattattccagttc

SEQ ID NO: 85405 - DNA, 19 bp, Artificial sequence
  SiRNA target sequence
agcacattattccagttct

SEQ ID NO: 85406 - DNA, 19 bp, Artificial sequence
  SiRNA target sequence
gcacattattccagttctt

SEQ ID NO: 85407 - DNA, 19 bp, Artificial sequence
  SiRNA target sequence
cacattattccagttctta

SEQ ID NO: 85408 - DNA, 19 bp, Artificial sequence
  SiRNA target sequence
acattattccagttcttaa

SEQ ID NO: 85409 - DNA, 19 bp, Artificial sequence
  SiRNA target sequence
cattattccagttcttaat

SEQ ID NO: 85410 - DNA, 19 bp, Artificial sequence
  SiRNA target sequence
attattccagttcttaatg

SEQ ID NO: 85411 - DNA, 19 bp, Artificial sequence
  SiRNA target sequence
ttattccagttcttaatga

SEQ ID NO: 85412 - DNA, 19 bp, Artificial sequence
  SiRNA target sequence
tattccagttcttaatgat

SEQ ID NO: 85413 - DNA, 19 bp, Artificial sequence
  SiRNA target sequence
attccagttcttaatgatg

SEQ ID NO: 85414 - DNA, 19 bp, Artificial sequence
  SiRNA target sequence
ttccagttcttaatgatgc

SEQ ID NO: 85415 - DNA, 19 bp, Artificial sequence
  SiRNA target sequence
tccagttcttaatgatgct

SEQ ID NO: 85416 - DNA, 19 bp, Artificial sequence
  SiRNA target sequence
ccagttcttaatgatgctt

SEQ ID NO: 85417 - DNA, 19 bp, Artificial sequence
  SiRNA target sequence
cagttcttaatgatgctta

SEQ ID NO: 85418 - DNA, 19 bp, Artificial sequence
  SiRNA target sequence
agttcttaatgatgcttaa

SEQ ID NO: 85419 - DNA, 19 bp, Artificial sequence
  SiRNA target sequence
gttcttaatgatgcttaaa

SEQ ID NO: 85420 - DNA, 19 bp, Artificial sequence
  SiRNA target sequence
ttcttaatgatgcttaaat

SEQ ID NO: 85421 - DNA, 19 bp, Artificial sequence
  SiRNA target sequence
tcttaatgatgcttaaata

SEQ ID NO: 85422 - DNA, 19 bp, Artificial sequence
  SiRNA target sequence
cttaatgatgcttaaataa

SEQ ID NO: 85423 - DNA, 19 bp, Artificial sequence
  SiRNA target sequence
ttaatgatgcttaaataat

SEQ ID NO: 85424 - DNA, 19 bp, Artificial sequence
  SiRNA target sequence
taatgatgcttaaataatc

SEQ ID NO: 85425 - DNA, 19 bp, Artificial sequence
  SiRNA target sequence
aatgatgcttaaataatct

SEQ ID NO: 85426 - DNA, 19 bp, Artificial sequence
  SiRNA target sequence
atgatgcttaaataatctt

SEQ ID NO: 85427 - DNA, 19 bp, Artificial sequence
  SiRNA target sequence
tgatgcttaaataatcttt

SEQ ID NO: 85428 - DNA, 19 bp, Artificial sequence
  SiRNA target sequence
gatgcttaaataatctttt

SEQ ID NO: 85429 - DNA, 19 bp, Artificial sequence
  SiRNA target sequence
atgcttaaataatctttta

SEQ ID NO: 85430 - DNA, 19 bp, Artificial sequence
  SiRNA target sequence
tgcttaaataatcttttac

SEQ ID NO: 85431 - DNA, 19 bp, Artificial sequence
  SiRNA target sequence
gcttaaataatcttttact

SEQ ID NO: 85432 - DNA, 19 bp, Artificial sequence
  SiRNA target sequence
cttaaataatcttttactc

SEQ ID NO: 85433 - DNA, 19 bp, Artificial sequence
  SiRNA target sequence
ttaaataatcttttactcc

SEQ ID NO: 85434 - DNA, 19 bp, Artificial sequence
  SiRNA target sequence
taaataatcttttactcct

SEQ ID NO: 85435 - DNA, 19 bp, Artificial sequence
  SiRNA target sequence
aaataatcttttactcctt

SEQ ID NO: 85436 - DNA, 19 bp, Artificial sequence
  SiRNA target sequence
aataatcttttactccttc

SEQ ID NO: 85437 - DNA, 19 bp, Artificial sequence
  SiRNA target sequence
ataatcttttactccttct

SEQ ID NO: 85438 - DNA, 19 bp, Artificial sequence
  SiRNA target sequence
taatcttttactccttctt

SEQ ID NO: 85439 - DNA, 19 bp, Artificial sequence
  SiRNA target sequence
aatcttttactccttcttt

SEQ ID NO: 85440 - DNA, 19 bp, Artificial sequence
  SiRNA target sequence
atcttttactccttcttta

SEQ ID NO: 85441 - DNA, 19 bp, Artificial sequence
  SiRNA target sequence
tcttttactccttctttag

SEQ ID NO: 85442 - DNA, 19 bp, Artificial sequence
  SiRNA target sequence
cttttactccttctttaga

SEQ ID NO: 85443 - DNA, 19 bp, Artificial sequence
  SiRNA target sequence
ttttactccttctttagaa

SEQ ID NO: 85444 - DNA, 19 bp, Artificial sequence
  SiRNA target sequence
tttactccttctttagaac

SEQ ID NO: 85445 - DNA, 19 bp, Artificial sequence
  SiRNA target sequence
ttactccttctttagaaca

SEQ ID NO: 85446 - DNA, 19 bp, Artificial sequence
  SiRNA target sequence
tactccttctttagaacac

SEQ ID NO: 85447 - DNA, 19 bp, Artificial sequence
  SiRNA target sequence
actccttctttagaacaca

SEQ ID NO: 85448 - DNA, 19 bp, Artificial sequence
  SiRNA target sequence
ctccttctttagaacacag

SEQ ID NO: 85449 - DNA, 19 bp, Artificial sequence
  SiRNA target sequence
tccttctttagaacacaga

SEQ ID NO: 85450 - DNA, 19 bp, Artificial sequence
  SiRNA target sequence
ccttctttagaacacagat

SEQ ID NO: 85451 - DNA, 19 bp, Artificial sequence
  SiRNA target sequence
cttctttagaacacagata

SEQ ID NO: 85452 - DNA, 19 bp, Artificial sequence
  SiRNA target sequence
ttctttagaacacagatat

SEQ ID NO: 85453 - DNA, 19 bp, Artificial sequence
  SiRNA target sequence
tctttagaacacagatatt

SEQ ID NO: 85454 - DNA, 19 bp, Artificial sequence
  SiRNA target sequence
ctttagaacacagatattc

SEQ ID NO: 85455 - DNA, 19 bp, Artificial sequence
  SiRNA target sequence
tttagaacacagatattca

SEQ ID NO: 85456 - DNA, 19 bp, Artificial sequence
  SiRNA target sequence
ttagaacacagatattcaa

SEQ ID NO: 85457 - DNA, 19 bp, Artificial sequence
  SiRNA target sequence
tagaacacagatattcaat

SEQ ID NO: 85458 - DNA, 19 bp, Artificial sequence
  SiRNA target sequence
agaacacagatattcaata

SEQ ID NO: 85459 - DNA, 19 bp, Artificial sequence
  SiRNA target sequence
gaacacagatattcaatat

SEQ ID NO: 85460 - DNA, 19 bp, Artificial sequence
  SiRNA target sequence
aacacagatattcaatatc

SEQ ID NO: 85461 - DNA, 19 bp, Artificial sequence
  SiRNA target sequence
acacagatattcaatatca

SEQ ID NO: 85462 - DNA, 19 bp, Artificial sequence
  SiRNA target sequence
cacagatattcaatatcat

SEQ ID NO: 85463 - DNA, 19 bp, Artificial sequence
  SiRNA target sequence
acagatattcaatatcatg

SEQ ID NO: 85464 - DNA, 19 bp, Artificial sequence
  SiRNA target sequence
cagatattcaatatcatgc

SEQ ID NO: 85465 - DNA, 19 bp, Artificial sequence
  SiRNA target sequence
agatattcaatatcatgct

SEQ ID NO: 85466 - DNA, 19 bp, Artificial sequence
  SiRNA target sequence
gatattcaatatcatgctt

SEQ ID NO: 85467 - DNA, 19 bp, Artificial sequence
  SiRNA target sequence
atattcaatatcatgctta

SEQ ID NO: 85468 - DNA, 19 bp, Artificial sequence
  SiRNA target sequence
tattcaatatcatgcttat

SEQ ID NO: 85469 - DNA, 19 bp, Artificial sequence
  SiRNA target sequence
attcaatatcatgcttatt

SEQ ID NO: 85470 - DNA, 19 bp, Artificial sequence
  SiRNA target sequence
ttcaatatcatgcttattt

SEQ ID NO: 85471 - DNA, 19 bp, Artificial sequence
  SiRNA target sequence
tcaatatcatgcttatttt

SEQ ID NO: 85472 - DNA, 19 bp, Artificial sequence
  SiRNA target sequence
caatatcatgcttattttt

SEQ ID NO: 85473 - DNA, 19 bp, Artificial sequence
  SiRNA target sequence
aatatcatgcttattttta

SEQ ID NO: 85474 - DNA, 19 bp, Artificial sequence
  SiRNA target sequence
atatcatgcttatttttag

SEQ ID NO: 85475 - DNA, 19 bp, Artificial sequence
  SiRNA target sequence
tatcatgcttatttttaga

SEQ ID NO: 85476 - DNA, 19 bp, Artificial sequence
  SiRNA target sequence
atcatgcttatttttagag

SEQ ID NO: 85477 - DNA, 19 bp, Artificial sequence
  SiRNA target sequence
tcatgcttatttttagagg

SEQ ID NO: 85478 - DNA, 19 bp, Artificial sequence
  SiRNA target sequence
catgcttatttttagaggt

SEQ ID NO: 85479 - DNA, 19 bp, Artificial sequence
  SiRNA target sequence
atgcttatttttagaggtt

SEQ ID NO: 85480 - DNA, 19 bp, Artificial sequence
  SiRNA target sequence
tgcttatttttagaggttt

SEQ ID NO: 85481 - DNA, 19 bp, Artificial sequence
  SiRNA target sequence
gcttatttttagaggtttt

SEQ ID NO: 85482 - DNA, 19 bp, Artificial sequence
  SiRNA target sequence
cttatttttagaggtttta

SEQ ID NO: 85483 - DNA, 19 bp, Artificial sequence
  SiRNA target sequence
ttatttttagaggttttag

SEQ ID NO: 85484 - DNA, 19 bp, Artificial sequence
  SiRNA target sequence
tatttttagaggttttaga

SEQ ID NO: 85485 - DNA, 19 bp, Artificial sequence
  SiRNA target sequence
atttttagaggttttagaa

SEQ ID NO: 85486 - DNA, 19 bp, Artificial sequence
  SiRNA target sequence
tttttagaggttttagaaa

SEQ ID NO: 85487 - DNA, 19 bp, Artificial sequence
  SiRNA target sequence
ttttagaggttttagaaat

SEQ ID NO: 85488 - DNA, 19 bp, Artificial sequence
  SiRNA target sequence
tttagaggttttagaaata

SEQ ID NO: 85489 - DNA, 19 bp, Artificial sequence
  SiRNA target sequence
ttagaggttttagaaatat

SEQ ID NO: 85490 - DNA, 19 bp, Artificial sequence
  SiRNA target sequence
tagaggttttagaaatatc

SEQ ID NO: 85491 - DNA, 19 bp, Artificial sequence
  SiRNA target sequence
agaggttttagaaatatcc

SEQ ID NO: 85492 - DNA, 19 bp, Artificial sequence
  SiRNA target sequence
gaggttttagaaatatcca

SEQ ID NO: 85493 - DNA, 19 bp, Artificial sequence
  SiRNA target sequence
aggttttagaaatatccat

SEQ ID NO: 85494 - DNA, 19 bp, Artificial sequence
  SiRNA target sequence
ggttttagaaatatccata

SEQ ID NO: 85495 - DNA, 19 bp, Artificial sequence
  SiRNA target sequence
gttttagaaatatccataa

SEQ ID NO: 85496 - DNA, 19 bp, Artificial sequence
  SiRNA target sequence
ttttagaaatatccataag

SEQ ID NO: 85497 - DNA, 19 bp, Artificial sequence
  SiRNA target sequence
tttagaaatatccataagc

SEQ ID NO: 85498 - DNA, 19 bp, Artificial sequence
  SiRNA target sequence
ttagaaatatccataagcc

SEQ ID NO: 85499 - DNA, 19 bp, Artificial sequence
  SiRNA target sequence
tagaaatatccataagcca

SEQ ID NO: 85500 - DNA, 19 bp, Artificial sequence
  SiRNA target sequence
agaaatatccataagccat

SEQ ID NO: 85501 - DNA, 19 bp, Artificial sequence
  SiRNA target sequence
gaaatatccataagccatg

SEQ ID NO: 85502 - DNA, 19 bp, Artificial sequence
  SiRNA target sequence
aaatatccataagccatgc

SEQ ID NO: 85503 - DNA, 19 bp, Artificial sequence
  SiRNA target sequence
aatatccataagccatgct

SEQ ID NO: 85504 - DNA, 19 bp, Artificial sequence
  SiRNA target sequence
atatccataagccatgctt

SEQ ID NO: 85505 - DNA, 19 bp, Artificial sequence
  SiRNA target sequence
tatccataagccatgcttt

SEQ ID NO: 85506 - DNA, 19 bp, Artificial sequence
  SiRNA target sequence
atccataagccatgctttt

SEQ ID NO: 85507 - DNA, 19 bp, Artificial sequence
  SiRNA target sequence
tccataagccatgcttttt

SEQ ID NO: 85508 - DNA, 19 bp, Artificial sequence
  SiRNA target sequence
ccataagccatgctttttt

SEQ ID NO: 85509 - DNA, 19 bp, Artificial sequence
  SiRNA target sequence
cataagccatgctttttta

SEQ ID NO: 85510 - DNA, 19 bp, Artificial sequence
  SiRNA target sequence
ataagccatgcttttttag

SEQ ID NO: 85511 - DNA, 19 bp, Artificial sequence
  SiRNA target sequence
taagccatgcttttttagg

SEQ ID NO: 85512 - DNA, 19 bp, Artificial sequence
  SiRNA target sequence
aagccatgcttttttaggc

SEQ ID NO: 85513 - DNA, 19 bp, Artificial sequence
  SiRNA target sequence
agccatgcttttttaggca

SEQ ID NO: 85514 - DNA, 19 bp, Artificial sequence
  SiRNA target sequence
gccatgcttttttaggcaa

SEQ ID NO: 85515 - DNA, 19 bp, Artificial sequence
  SiRNA target sequence
ccatgcttttttaggcaat

SEQ ID NO: 85516 - DNA, 19 bp, Artificial sequence
  SiRNA target sequence
catgcttttttaggcaatg

SEQ ID NO: 85517 - DNA, 19 bp, Artificial sequence
  SiRNA target sequence
atgcttttttaggcaatga

SEQ ID NO: 85518 - DNA, 19 bp, Artificial sequence
  SiRNA target sequence
tgcttttttaggcaatgaa

SEQ ID NO: 85519 - DNA, 19 bp, Artificial sequence
  SiRNA target sequence
gcttttttaggcaatgaag

SEQ ID NO: 85520 - DNA, 19 bp, Artificial sequence
  SiRNA target sequence
cttttttaggcaatgaagt

SEQ ID NO: 85521 - DNA, 19 bp, Artificial sequence
  SiRNA target sequence
ttttttaggcaatgaagta

SEQ ID NO: 85522 - DNA, 19 bp, Artificial sequence
  SiRNA target sequence
tttttaggcaatgaagtaa

SEQ ID NO: 85523 - DNA, 19 bp, Artificial sequence
  SiRNA target sequence
ttttaggcaatgaagtaaa

SEQ ID NO: 85524 - DNA, 19 bp, Artificial sequence
  SiRNA target sequence
tttaggcaatgaagtaaaa

SEQ ID NO: 85525 - DNA, 19 bp, Artificial sequence
  SiRNA target sequence
ttaggcaatgaagtaaaat

SEQ ID NO: 85526 - DNA, 19 bp, Artificial sequence
  SiRNA target sequence
taggcaatgaagtaaaatc

SEQ ID NO: 85527 - DNA, 19 bp, Artificial sequence
  SiRNA target sequence
aggcaatgaagtaaaatca

SEQ ID NO: 85528 - DNA, 19 bp, Artificial sequence
  SiRNA target sequence
ggcaatgaagtaaaatcaa

SEQ ID NO: 85529 - DNA, 19 bp, Artificial sequence
  SiRNA target sequence
gcaatgaagtaaaatcaaa

SEQ ID NO: 85530 - DNA, 19 bp, Artificial sequence
  SiRNA target sequence
caatgaagtaaaatcaaaa

SEQ ID NO: 85531 - DNA, 19 bp, Artificial sequence
  SiRNA target sequence
aatgaagtaaaatcaaaaa

SEQ ID NO: 85532 - DNA, 19 bp, Artificial sequence
  SiRNA target sequence
atgaagtaaaatcaaaaat

SEQ ID NO: 85533 - DNA, 19 bp, Artificial sequence
  SiRNA target sequence
tgaagtaaaatcaaaaata

SEQ ID NO: 85534 - DNA, 19 bp, Artificial sequence
  SiRNA target sequence
gaagtaaaatcaaaaatat

SEQ ID NO: 85535 - DNA, 19 bp, Artificial sequence
  SiRNA target sequence
aagtaaaatcaaaaatata

SEQ ID NO: 85536 - DNA, 19 bp, Artificial sequence
  SiRNA target sequence
agtaaaatcaaaaatatac

SEQ ID NO: 85537 - DNA, 19 bp, Artificial sequence
  SiRNA target sequence
gtaaaatcaaaaatatact

SEQ ID NO: 85538 - DNA, 19 bp, Artificial sequence
  SiRNA target sequence
taaaatcaaaaatatactt

SEQ ID NO: 85539 - DNA, 19 bp, Artificial sequence
  SiRNA target sequence
aaaatcaaaaatatacttg

SEQ ID NO: 85540 - DNA, 19 bp, Artificial sequence
  SiRNA target sequence
aaatcaaaaatatacttga

SEQ ID NO: 85541 - DNA, 19 bp, Artificial sequence
  SiRNA target sequence
aatcaaaaatatacttgaa

SEQ ID NO: 85542 - DNA, 19 bp, Artificial sequence
  SiRNA target sequence
atcaaaaatatacttgaaa

SEQ ID NO: 85543 - DNA, 19 bp, Artificial sequence
  SiRNA target sequence
tcaaaaatatacttgaaaa

SEQ ID NO: 85544 - DNA, 19 bp, Artificial sequence
  SiRNA target sequence
caaaaatatacttgaaaaa

SEQ ID NO: 85545 - DNA, 19 bp, Artificial sequence
  SiRNA target sequence
aaaaatatacttgaaaaag

SEQ ID NO: 85546 - DNA, 19 bp, Artificial sequence
  SiRNA target sequence
aaaatatacttgaaaaagt

SEQ ID NO: 85547 - DNA, 19 bp, Artificial sequence
  SiRNA target sequence
aaatatacttgaaaaagtc

SEQ ID NO: 85548 - DNA, 19 bp, Artificial sequence
  SiRNA target sequence
aatatacttgaaaaagtca

SEQ ID NO: 85549 - DNA, 19 bp, Artificial sequence
  SiRNA target sequence
atatacttgaaaaagtcac

SEQ ID NO: 85550 - DNA, 19 bp, Artificial sequence
  SiRNA target sequence
tatacttgaaaaagtcacg

SEQ ID NO: 85551 - DNA, 19 bp, Artificial sequence
  SiRNA target sequence
atacttgaaaaagtcacgc

SEQ ID NO: 85552 - DNA, 19 bp, Artificial sequence
  SiRNA target sequence
tacttgaaaaagtcacgca

SEQ ID NO: 85553 - DNA, 19 bp, Artificial sequence
  SiRNA target sequence
acttgaaaaagtcacgcaa

SEQ ID NO: 85554 - DNA, 19 bp, Artificial sequence
  SiRNA target sequence
cttgaaaaagtcacgcaaa

SEQ ID NO: 85555 - DNA, 19 bp, Artificial sequence
  SiRNA target sequence
ttgaaaaagtcacgcaaag

SEQ ID NO: 85556 - DNA, 19 bp, Artificial sequence
  SiRNA target sequence
tgaaaaagtcacgcaaaga

SEQ ID NO: 85557 - DNA, 19 bp, Artificial sequence
  SiRNA target sequence
gaaaaagtcacgcaaagat

SEQ ID NO: 85558 - DNA, 19 bp, Artificial sequence
  SiRNA target sequence
aaaaagtcacgcaaagatc

SEQ ID NO: 85559 - DNA, 19 bp, Artificial sequence
  SiRNA target sequence
aaaagtcacgcaaagatcc

SEQ ID NO: 85560 - DNA, 19 bp, Artificial sequence
  SiRNA target sequence
aaagtcacgcaaagatcct

SEQ ID NO: 85561 - DNA, 19 bp, Artificial sequence
  SiRNA target sequence
aagtcacgcaaagatcctt

SEQ ID NO: 85562 - DNA, 19 bp, Artificial sequence
  SiRNA target sequence
agtcacgcaaagatccttc

SEQ ID NO: 85563 - DNA, 19 bp, Artificial sequence
  SiRNA target sequence
gtcacgcaaagatccttcg

SEQ ID NO: 85564 - DNA, 19 bp, Artificial sequence
  SiRNA target sequence
tcacgcaaagatccttcga

SEQ ID NO: 85565 - DNA, 19 bp, Artificial sequence
  SiRNA target sequence
cacgcaaagatccttcgaa

SEQ ID NO: 85566 - DNA, 19 bp, Artificial sequence
  SiRNA target sequence
acgcaaagatccttcgaat

SEQ ID NO: 85567 - DNA, 19 bp, Artificial sequence
  SiRNA target sequence
cgcaaagatccttcgaatt

SEQ ID NO: 85568 - DNA, 19 bp, Artificial sequence
  SiRNA target sequence
gcaaagatccttcgaattg

SEQ ID NO: 85569 - DNA, 19 bp, Artificial sequence
  SiRNA target sequence
caaagatccttcgaattga

SEQ ID NO: 85570 - DNA, 19 bp, Artificial sequence
  SiRNA target sequence
aaagatccttcgaattgaa

SEQ ID NO: 85571 - DNA, 19 bp, Artificial sequence
  SiRNA target sequence
aagatccttcgaattgaaa

SEQ ID NO: 85572 - DNA, 19 bp, Artificial sequence
  SiRNA target sequence
agatccttcgaattgaaac

SEQ ID NO: 85573 - DNA, 19 bp, Artificial sequence
  SiRNA target sequence
gatccttcgaattgaaacc

SEQ ID NO: 85574 - DNA, 19 bp, Artificial sequence
  SiRNA target sequence
atccttcgaattgaaaccc

SEQ ID NO: 85575 - DNA, 19 bp, Artificial sequence
  SiRNA target sequence
tccttcgaattgaaacccc

SEQ ID NO: 85576 - DNA, 19 bp, Artificial sequence
  SiRNA target sequence
ccttcgaattgaaaccccg

SEQ ID NO: 85577 - DNA, 19 bp, Artificial sequence
  SiRNA target sequence
cttcgaattgaaaccccgt

SEQ ID NO: 85578 - DNA, 19 bp, Artificial sequence
  SiRNA target sequence
ttcgaattgaaaccccgtt

SEQ ID NO: 85579 - DNA, 19 bp, Artificial sequence
  SiRNA target sequence
tcgaattgaaaccccgttt

SEQ ID NO: 85580 - DNA, 19 bp, Artificial sequence
  SiRNA target sequence
cgaattgaaaccccgtttt

SEQ ID NO: 85581 - DNA, 19 bp, Artificial sequence
  SiRNA target sequence
gaattgaaaccccgttttt

SEQ ID NO: 85582 - DNA, 19 bp, Artificial sequence
  SiRNA target sequence
aattgaaaccccgtttttc

SEQ ID NO: 85583 - DNA, 19 bp, Artificial sequence
  SiRNA target sequence
attgaaaccccgtttttcc

SEQ ID NO: 85584 - DNA, 19 bp, Artificial sequence
  SiRNA target sequence
ttgaaaccccgtttttcca

SEQ ID NO: 85585 - DNA, 19 bp, Artificial sequence
  SiRNA target sequence
tgaaaccccgtttttccaa

SEQ ID NO: 85586 - DNA, 19 bp, Artificial sequence
  SiRNA target sequence
gaaaccccgtttttccaac

SEQ ID NO: 85587 - DNA, 19 bp, Artificial sequence
  SiRNA target sequence
aaaccccgtttttccaact

SEQ ID NO: 85588 - DNA, 19 bp, Artificial sequence
  SiRNA target sequence
aaccccgtttttccaactt

SEQ ID NO: 85589 - DNA, 19 bp, Artificial sequence
  SiRNA target sequence
accccgtttttccaacttg

SEQ ID NO: 85590 - DNA, 19 bp, Artificial sequence
  SiRNA target sequence
ccccgtttttccaacttgc

SEQ ID NO: 85591 - DNA, 19 bp, Artificial sequence
  SiRNA target sequence
cccgtttttccaacttgct

SEQ ID NO: 85592 - DNA, 19 bp, Artificial sequence
  SiRNA target sequence
ccgtttttccaacttgctc

SEQ ID NO: 85593 - DNA, 19 bp, Artificial sequence
  SiRNA target sequence
cgtttttccaacttgctca

SEQ ID NO: 85594 - DNA, 19 bp, Artificial sequence
  SiRNA target sequence
gtttttccaacttgctcaa

SEQ ID NO: 85595 - DNA, 19 bp, Artificial sequence
  SiRNA target sequence
tttttccaacttgctcaat

SEQ ID NO: 85596 - DNA, 19 bp, Artificial sequence
  SiRNA target sequence
ttttccaacttgctcaata

SEQ ID NO: 85597 - DNA, 19 bp, Artificial sequence
  SiRNA target sequence
tttccaacttgctcaatat

SEQ ID NO: 85598 - DNA, 19 bp, Artificial sequence
  SiRNA target sequence
ttccaacttgctcaatata

SEQ ID NO: 85599 - DNA, 19 bp, Artificial sequence
  SiRNA target sequence
tccaacttgctcaatatat

SEQ ID NO: 85600 - DNA, 19 bp, Artificial sequence
  SiRNA target sequence
ccaacttgctcaatatata

SEQ ID NO: 85601 - DNA, 19 bp, Artificial sequence
  SiRNA target sequence
caacttgctcaatatataa

SEQ ID NO: 85602 - DNA, 19 bp, Artificial sequence
  SiRNA target sequence
aacttgctcaatatataat

SEQ ID NO: 85603 - DNA, 19 bp, Artificial sequence
  SiRNA target sequence
acttgctcaatatataata

SEQ ID NO: 85604 - DNA, 19 bp, Artificial sequence
  SiRNA target sequence
cttgctcaatatataataa

SEQ ID NO: 85605 - DNA, 19 bp, Artificial sequence
  SiRNA target sequence
ttgctcaatatataataat

SEQ ID NO: 85606 - DNA, 19 bp, Artificial sequence
  SiRNA target sequence
tgctcaatatataataatg

SEQ ID NO: 85607 - DNA, 19 bp, Artificial sequence
  SiRNA target sequence
gctcaatatataataatgt

SEQ ID NO: 85608 - DNA, 19 bp, Artificial sequence
  SiRNA target sequence
ctcaatatataataatgta

SEQ ID NO: 85609 - DNA, 19 bp, Artificial sequence
  SiRNA target sequence
tcaatatataataatgtat

SEQ ID NO: 85610 - DNA, 19 bp, Artificial sequence
  SiRNA target sequence
caatatataataatgtatc

SEQ ID NO: 85611 - DNA, 19 bp, Artificial sequence
  SiRNA target sequence
aatatataataatgtatca

SEQ ID NO: 85612 - DNA, 19 bp, Artificial sequence
  SiRNA target sequence
atatataataatgtatcac

SEQ ID NO: 85613 - DNA, 19 bp, Artificial sequence
  SiRNA target sequence
tatataataatgtatcacc

SEQ ID NO: 85614 - DNA, 19 bp, Artificial sequence
  SiRNA target sequence
atataataatgtatcacca

SEQ ID NO: 85615 - DNA, 19 bp, Artificial sequence
  SiRNA target sequence
tataataatgtatcaccag

SEQ ID NO: 85616 - DNA, 19 bp, Artificial sequence
  SiRNA target sequence
ataataatgtatcaccaga

SEQ ID NO: 85617 - DNA, 19 bp, Artificial sequence
  SiRNA target sequence
taataatgtatcaccagac

SEQ ID NO: 85618 - DNA, 19 bp, Artificial sequence
  SiRNA target sequence
aataatgtatcaccagaca

SEQ ID NO: 85619 - DNA, 19 bp, Artificial sequence
  SiRNA target sequence
ataatgtatcaccagacat

SEQ ID NO: 85620 - DNA, 19 bp, Artificial sequence
  SiRNA target sequence
taatgtatcaccagacatt

SEQ ID NO: 85621 - DNA, 19 bp, Artificial sequence
  SiRNA target sequence
aatgtatcaccagacattt

SEQ ID NO: 85622 - DNA, 19 bp, Artificial sequence
  SiRNA target sequence
atgtatcaccagacatttc

SEQ ID NO: 85623 - DNA, 19 bp, Artificial sequence
  SiRNA target sequence
tgtatcaccagacatttct

SEQ ID NO: 85624 - DNA, 19 bp, Artificial sequence
  SiRNA target sequence
gtatcaccagacatttcta

SEQ ID NO: 85625 - DNA, 19 bp, Artificial sequence
  SiRNA target sequence
tatcaccagacatttctag

SEQ ID NO: 85626 - DNA, 19 bp, Artificial sequence
  SiRNA target sequence
atcaccagacatttctagt

SEQ ID NO: 85627 - DNA, 19 bp, Artificial sequence
  SiRNA target sequence
tcaccagacatttctagta

SEQ ID NO: 85628 - DNA, 19 bp, Artificial sequence
  SiRNA target sequence
caccagacatttctagtaa

SEQ ID NO: 85629 - DNA, 19 bp, Artificial sequence
  SiRNA target sequence
accagacatttctagtaaa

SEQ ID NO: 85630 - DNA, 19 bp, Artificial sequence
  SiRNA target sequence
ccagacatttctagtaaac

SEQ ID NO: 85631 - DNA, 19 bp, Artificial sequence
  SiRNA target sequence
cagacatttctagtaaact

SEQ ID NO: 85632 - DNA, 19 bp, Artificial sequence
  SiRNA target sequence
agacatttctagtaaactt

SEQ ID NO: 85633 - DNA, 19 bp, Artificial sequence
  SiRNA target sequence
gacatttctagtaaactta

SEQ ID NO: 85634 - DNA, 19 bp, Artificial sequence
  SiRNA target sequence
acatttctagtaaacttaa

SEQ ID NO: 85635 - DNA, 19 bp, Artificial sequence
  SiRNA target sequence
catttctagtaaacttaac

SEQ ID NO: 85636 - DNA, 19 bp, Artificial sequence
  SiRNA target sequence
atttctagtaaacttaaca

SEQ ID NO: 85637 - DNA, 19 bp, Artificial sequence
  SiRNA target sequence
tttctagtaaacttaacat

SEQ ID NO: 85638 - DNA, 19 bp, Artificial sequence
  SiRNA target sequence
ttctagtaaacttaacatt

SEQ ID NO: 85639 - DNA, 19 bp, Artificial sequence
  SiRNA target sequence
tctagtaaacttaacattt

SEQ ID NO: 85640 - DNA, 19 bp, Artificial sequence
  SiRNA target sequence
ctagtaaacttaacatttc

SEQ ID NO: 85641 - DNA, 19 bp, Artificial sequence
  SiRNA target sequence
tagtaaacttaacatttca

SEQ ID NO: 85642 - DNA, 19 bp, Artificial sequence
  SiRNA target sequence
agtaaacttaacatttcat

SEQ ID NO: 85643 - DNA, 19 bp, Artificial sequence
  SiRNA target sequence
gtaaacttaacatttcatt

SEQ ID NO: 85644 - DNA, 19 bp, Artificial sequence
  SiRNA target sequence
taaacttaacatttcatta

SEQ ID NO: 85645 - DNA, 19 bp, Artificial sequence
  SiRNA target sequence
aaacttaacatttcattaa

SEQ ID NO: 85646 - DNA, 19 bp, Artificial sequence
  SiRNA target sequence
aacttaacatttcattaac

SEQ ID NO: 85647 - DNA, 19 bp, Artificial sequence
  SiRNA target sequence
acttaacatttcattaaca

SEQ ID NO: 85648 - DNA, 19 bp, Artificial sequence
  SiRNA target sequence
cttaacatttcattaacaa

SEQ ID NO: 85649 - DNA, 19 bp, Artificial sequence
  SiRNA target sequence
ttaacatttcattaacaag

SEQ ID NO: 85650 - DNA, 19 bp, Artificial sequence
  SiRNA target sequence
taacatttcattaacaagc

SEQ ID NO: 85651 - DNA, 19 bp, Artificial sequence
  SiRNA target sequence
aacatttcattaacaagca

SEQ ID NO: 85652 - DNA, 19 bp, Artificial sequence
  SiRNA target sequence
acatttcattaacaagcaa

SEQ ID NO: 85653 - DNA, 19 bp, Artificial sequence
  SiRNA target sequence
catttcattaacaagcaaa

SEQ ID NO: 85654 - DNA, 19 bp, Artificial sequence
  SiRNA target sequence
atttcattaacaagcaaat

SEQ ID NO: 85655 - DNA, 19 bp, Artificial sequence
  SiRNA target sequence
tttcattaacaagcaaatc

SEQ ID NO: 85656 - DNA, 19 bp, Artificial sequence
  SiRNA target sequence
ttcattaacaagcaaatca

SEQ ID NO: 85657 - DNA, 19 bp, Artificial sequence
  SiRNA target sequence
tcattaacaagcaaatcat

SEQ ID NO: 85658 - DNA, 19 bp, Artificial sequence
  SiRNA target sequence
cattaacaagcaaatcatt

SEQ ID NO: 85659 - DNA, 19 bp, Artificial sequence
  SiRNA target sequence
attaacaagcaaatcatta

SEQ ID NO: 85660 - DNA, 19 bp, Artificial sequence
  SiRNA target sequence
ttaacaagcaaatcattat

SEQ ID NO: 85661 - DNA, 19 bp, Artificial sequence
  SiRNA target sequence
taacaagcaaatcattatt

SEQ ID NO: 85662 - DNA, 19 bp, Artificial sequence
  SiRNA target sequence
aacaagcaaatcattattt

SEQ ID NO: 85663 - DNA, 19 bp, Artificial sequence
  SiRNA target sequence
acaagcaaatcattatttg

SEQ ID NO: 85664 - DNA, 19 bp, Artificial sequence
  SiRNA target sequence
caagcaaatcattatttga

SEQ ID NO: 85665 - DNA, 19 bp, Artificial sequence
  SiRNA target sequence
aagcaaatcattatttgaa

SEQ ID NO: 85666 - DNA, 19 bp, Artificial sequence
  SiRNA target sequence
agcaaatcattatttgaac

SEQ ID NO: 85667 - DNA, 19 bp, Artificial sequence
  SiRNA target sequence
gcaaatcattatttgaaca

SEQ ID NO: 85668 - DNA, 19 bp, Artificial sequence
  SiRNA target sequence
caaatcattatttgaacaa

SEQ ID NO: 85669 - DNA, 19 bp, Artificial sequence
  SiRNA target sequence
aaatcattatttgaacaaa

SEQ ID NO: 85670 - DNA, 19 bp, Artificial sequence
  SiRNA target sequence
aatcattatttgaacaaag

SEQ ID NO: 85671 - DNA, 19 bp, Artificial sequence
  SiRNA target sequence
atcattatttgaacaaagt

SEQ ID NO: 85672 - DNA, 19 bp, Artificial sequence
  SiRNA target sequence
tcattatttgaacaaagta

SEQ ID NO: 85673 - DNA, 19 bp, Artificial sequence
  SiRNA target sequence
cattatttgaacaaagtag

SEQ ID NO: 85674 - DNA, 19 bp, Artificial sequence
  SiRNA target sequence
attatttgaacaaagtaga

SEQ ID NO: 85675 - DNA, 19 bp, Artificial sequence
  SiRNA target sequence
ttatttgaacaaagtagac

SEQ ID NO: 85676 - DNA, 19 bp, Artificial sequence
  SiRNA target sequence
tatttgaacaaagtagacc

SEQ ID NO: 85677 - DNA, 19 bp, Artificial sequence
  SiRNA target sequence
atttgaacaaagtagacca

SEQ ID NO: 85678 - DNA, 19 bp, Artificial sequence
  SiRNA target sequence
tttgaacaaagtagaccaa

SEQ ID NO: 85679 - DNA, 19 bp, Artificial sequence
  SiRNA target sequence
ttgaacaaagtagaccaat

SEQ ID NO: 85680 - DNA, 19 bp, Artificial sequence
  SiRNA target sequence
tgaacaaagtagaccaata

SEQ ID NO: 85681 - DNA, 19 bp, Artificial sequence
  SiRNA target sequence
gaacaaagtagaccaatac

SEQ ID NO: 85682 - DNA, 19 bp, Artificial sequence
  SiRNA target sequence
aacaaagtagaccaatact

SEQ ID NO: 85683 - DNA, 19 bp, Artificial sequence
  SiRNA target sequence
acaaagtagaccaatacta

SEQ ID NO: 85684 - DNA, 19 bp, Artificial sequence
  SiRNA target sequence
caaagtagaccaatactat

SEQ ID NO: 85685 - DNA, 19 bp, Artificial sequence
  SiRNA target sequence
aaagtagaccaatactatc

SEQ ID NO: 85686 - DNA, 19 bp, Artificial sequence
  SiRNA target sequence
aagtagaccaatactatca

SEQ ID NO: 85687 - DNA, 19 bp, Artificial sequence
  SiRNA target sequence
agtagaccaatactatcac

SEQ ID NO: 85688 - DNA, 19 bp, Artificial sequence
  SiRNA target sequence
gtagaccaatactatcacc

SEQ ID NO: 85689 - DNA, 19 bp, Artificial sequence
  SiRNA target sequence
tagaccaatactatcacca

SEQ ID NO: 85690 - DNA, 19 bp, Artificial sequence
  SiRNA target sequence
agaccaatactatcaccag

SEQ ID NO: 85691 - DNA, 19 bp, Artificial sequence
  SiRNA target sequence
gaccaatactatcaccagg

SEQ ID NO: 85692 - DNA, 19 bp, Artificial sequence
  SiRNA target sequence
accaatactatcaccagga

SEQ ID NO: 85693 - DNA, 19 bp, Artificial sequence
  SiRNA target sequence
ccaatactatcaccaggaa

SEQ ID NO: 85694 - DNA, 19 bp, Artificial sequence
  SiRNA target sequence
caatactatcaccaggaac

SEQ ID NO: 85695 - DNA, 19 bp, Artificial sequence
  SiRNA target sequence
aatactatcaccaggaaca

SEQ ID NO: 85696 - DNA, 19 bp, Artificial sequence
  SiRNA target sequence
atactatcaccaggaacaa

SEQ ID NO: 85697 - DNA, 19 bp, Artificial sequence
  SiRNA target sequence
tactatcaccaggaacaaa

SEQ ID NO: 85698 - DNA, 19 bp, Artificial sequence
  SiRNA target sequence
actatcaccaggaacaaaa

SEQ ID NO: 85699 - DNA, 19 bp, Artificial sequence
  SiRNA target sequence
ctatcaccaggaacaaaat

SEQ ID NO: 85700 - DNA, 19 bp, Artificial sequence
  SiRNA target sequence
tatcaccaggaacaaaatc

SEQ ID NO: 85701 - DNA, 19 bp, Artificial sequence
  SiRNA target sequence
atcaccaggaacaaaatct

SEQ ID NO: 85702 - DNA, 19 bp, Artificial sequence
  SiRNA target sequence
tcaccaggaacaaaatcta

SEQ ID NO: 85703 - DNA, 19 bp, Artificial sequence
  SiRNA target sequence
caccaggaacaaaatctaa

SEQ ID NO: 85704 - DNA, 19 bp, Artificial sequence
  SiRNA target sequence
accaggaacaaaatctaat

SEQ ID NO: 85705 - DNA, 19 bp, Artificial sequence
  SiRNA target sequence
ccaggaacaaaatctaatg

SEQ ID NO: 85706 - DNA, 19 bp, Artificial sequence
  SiRNA target sequence
caggaacaaaatctaatgt

SEQ ID NO: 85707 - DNA, 19 bp, Artificial sequence
  SiRNA target sequence
aggaacaaaatctaatgta

SEQ ID NO: 85708 - DNA, 19 bp, Artificial sequence
  SiRNA target sequence
ggaacaaaatctaatgtat

SEQ ID NO: 85709 - DNA, 19 bp, Artificial sequence
  SiRNA target sequence
gaacaaaatctaatgtata

SEQ ID NO: 85710 - DNA, 19 bp, Artificial sequence
  SiRNA target sequence
aacaaaatctaatgtataa

SEQ ID NO: 85711 - DNA, 19 bp, Artificial sequence
  SiRNA target sequence
acaaaatctaatgtataat

SEQ ID NO: 85712 - DNA, 19 bp, Artificial sequence
  SiRNA target sequence
caaaatctaatgtataatt

SEQ ID NO: 85713 - DNA, 19 bp, Artificial sequence
  SiRNA target sequence
aaaatctaatgtataatta

SEQ ID NO: 85714 - DNA, 19 bp, Artificial sequence
  SiRNA target sequence
aaatctaatgtataattaa

SEQ ID NO: 85715 - DNA, 19 bp, Artificial sequence
  SiRNA target sequence
aatctaatgtataattaag

SEQ ID NO: 85716 - DNA, 19 bp, Artificial sequence
  SiRNA target sequence
atctaatgtataattaagt

SEQ ID NO: 85717 - DNA, 19 bp, Artificial sequence
  SiRNA target sequence
tctaatgtataattaagtt

SEQ ID NO: 85718 - DNA, 19 bp, Artificial sequence
  SiRNA target sequence
ctaatgtataattaagttg

SEQ ID NO: 85719 - DNA, 19 bp, Artificial sequence
  SiRNA target sequence
taatgtataattaagttga

SEQ ID NO: 85720 - DNA, 19 bp, Artificial sequence
  SiRNA target sequence
aatgtataattaagttgaa

SEQ ID NO: 85721 - DNA, 19 bp, Artificial sequence
  SiRNA target sequence
atgtataattaagttgaac

SEQ ID NO: 85722 - DNA, 19 bp, Artificial sequence
  SiRNA target sequence
tgtataattaagttgaacc

SEQ ID NO: 85723 - DNA, 19 bp, Artificial sequence
  SiRNA target sequence
gtataattaagttgaacct

SEQ ID NO: 85724 - DNA, 19 bp, Artificial sequence
  SiRNA target sequence
tataattaagttgaacctt

SEQ ID NO: 85725 - DNA, 19 bp, Artificial sequence
  SiRNA target sequence
ataattaagttgaacctta

SEQ ID NO: 85726 - DNA, 19 bp, Artificial sequence
  SiRNA target sequence
taattaagttgaaccttat

SEQ ID NO: 85727 - DNA, 19 bp, Artificial sequence
  SiRNA target sequence
aattaagttgaaccttata

SEQ ID NO: 85728 - DNA, 19 bp, Artificial sequence
  SiRNA target sequence
attaagttgaaccttatat

SEQ ID NO: 85729 - DNA, 19 bp, Artificial sequence
  SiRNA target sequence
ttaagttgaaccttatata

SEQ ID NO: 85730 - DNA, 19 bp, Artificial sequence
  SiRNA target sequence
taagttgaaccttatatac

SEQ ID NO: 85731 - DNA, 19 bp, Artificial sequence
  SiRNA target sequence
aagttgaaccttatatacc

SEQ ID NO: 85732 - DNA, 19 bp, Artificial sequence
  SiRNA target sequence
agttgaaccttatatacct

SEQ ID NO: 85733 - DNA, 19 bp, Artificial sequence
  SiRNA target sequence
gttgaaccttatatacctt

SEQ ID NO: 85734 - DNA, 19 bp, Artificial sequence
  SiRNA target sequence
ttgaaccttatataccttt

SEQ ID NO: 85735 - DNA, 19 bp, Artificial sequence
  SiRNA target sequence
tgaaccttatatacctttt

SEQ ID NO: 85736 - DNA, 19 bp, Artificial sequence
  SiRNA target sequence
gaaccttatataccttttt

SEQ ID NO: 85737 - DNA, 19 bp, Artificial sequence
  SiRNA target sequence
aaccttatatacctttttc

SEQ ID NO: 85738 - DNA, 19 bp, Artificial sequence
  SiRNA target sequence
accttatatacctttttcc

SEQ ID NO: 85739 - DNA, 19 bp, Artificial sequence
  SiRNA target sequence
ccttatatacctttttcca

SEQ ID NO: 85740 - DNA, 19 bp, Artificial sequence
  SiRNA target sequence
cttatatacctttttccat

SEQ ID NO: 85741 - DNA, 19 bp, Artificial sequence
  SiRNA target sequence
ttatatacctttttccatg

SEQ ID NO: 85742 - DNA, 19 bp, Artificial sequence
  SiRNA target sequence
tatatacctttttccatgt

SEQ ID NO: 85743 - DNA, 19 bp, Artificial sequence
  SiRNA target sequence
atatacctttttccatgta

SEQ ID NO: 85744 - DNA, 19 bp, Artificial sequence
  SiRNA target sequence
tatacctttttccatgtac

SEQ ID NO: 85745 - DNA, 19 bp, Artificial sequence
  SiRNA target sequence
atacctttttccatgtaca

SEQ ID NO: 85746 - DNA, 19 bp, Artificial sequence
  SiRNA target sequence
tacctttttccatgtacag

SEQ ID NO: 85747 - DNA, 19 bp, Artificial sequence
  SiRNA target sequence
acctttttccatgtacagg

SEQ ID NO: 85748 - DNA, 19 bp, Artificial sequence
  SiRNA target sequence
cctttttccatgtacagga

SEQ ID NO: 85749 - DNA, 19 bp, Artificial sequence
  SiRNA target sequence
ctttttccatgtacaggaa

SEQ ID NO: 85750 - DNA, 19 bp, Artificial sequence
  SiRNA target sequence
tttttccatgtacaggaaa

SEQ ID NO: 85751 - DNA, 19 bp, Artificial sequence
  SiRNA target sequence
ttttccatgtacaggaaag

SEQ ID NO: 85752 - DNA, 19 bp, Artificial sequence
  SiRNA target sequence
tttccatgtacaggaaagg

SEQ ID NO: 85753 - DNA, 19 bp, Artificial sequence
  SiRNA target sequence
ttccatgtacaggaaaggt

SEQ ID NO: 85754 - DNA, 19 bp, Artificial sequence
  SiRNA target sequence
tccatgtacaggaaaggtt

SEQ ID NO: 85755 - DNA, 19 bp, Artificial sequence
  SiRNA target sequence
ccatgtacaggaaaggttt

SEQ ID NO: 85756 - DNA, 19 bp, Artificial sequence
  SiRNA target sequence
catgtacaggaaaggtttt

SEQ ID NO: 85757 - DNA, 19 bp, Artificial sequence
  SiRNA target sequence
atgtacaggaaaggttttc

SEQ ID NO: 85758 - DNA, 19 bp, Artificial sequence
  SiRNA target sequence
tgtacaggaaaggttttca

SEQ ID NO: 85759 - DNA, 19 bp, Artificial sequence
  SiRNA target sequence
gtacaggaaaggttttcaa

SEQ ID NO: 85760 - DNA, 19 bp, Artificial sequence
  SiRNA target sequence
tacaggaaaggttttcaat

SEQ ID NO: 85761 - DNA, 19 bp, Artificial sequence
  SiRNA target sequence
acaggaaaggttttcaata

SEQ ID NO: 85762 - DNA, 19 bp, Artificial sequence
  SiRNA target sequence
caggaaaggttttcaatat

SEQ ID NO: 85763 - DNA, 19 bp, Artificial sequence
  SiRNA target sequence
aggaaaggttttcaatatt

SEQ ID NO: 85764 - DNA, 19 bp, Artificial sequence
  SiRNA target sequence
ggaaaggttttcaatattt

SEQ ID NO: 85765 - DNA, 19 bp, Artificial sequence
  SiRNA target sequence
gaaaggttttcaatattta

SEQ ID NO: 85766 - DNA, 19 bp, Artificial sequence
  SiRNA target sequence
aaaggttttcaatatttag

SEQ ID NO: 85767 - DNA, 19 bp, Artificial sequence
  SiRNA target sequence
aaggttttcaatatttagt

SEQ ID NO: 85768 - DNA, 19 bp, Artificial sequence
  SiRNA target sequence
aggttttcaatatttagta

SEQ ID NO: 85769 - DNA, 19 bp, Artificial sequence
  SiRNA target sequence
ggttttcaatatttagtat

SEQ ID NO: 85770 - DNA, 19 bp, Artificial sequence
  SiRNA target sequence
gttttcaatatttagtata

SEQ ID NO: 85771 - DNA, 19 bp, Artificial sequence
  SiRNA target sequence
ttttcaatatttagtatat

SEQ ID NO: 85772 - DNA, 19 bp, Artificial sequence
  SiRNA target sequence
tttcaatatttagtatatt

SEQ ID NO: 85773 - DNA, 19 bp, Artificial sequence
  SiRNA target sequence
ttcaatatttagtatattt

SEQ ID NO: 85774 - DNA, 19 bp, Artificial sequence
  SiRNA target sequence
tcaatatttagtatatttg

SEQ ID NO: 85775 - DNA, 19 bp, Artificial sequence
  SiRNA target sequence
caatatttagtatatttgt

SEQ ID NO: 85776 - DNA, 19 bp, Artificial sequence
  SiRNA target sequence
aatatttagtatatttgta

SEQ ID NO: 85777 - DNA, 19 bp, Artificial sequence
  SiRNA target sequence
atatttagtatatttgtat

SEQ ID NO: 85778 - DNA, 19 bp, Artificial sequence
  SiRNA target sequence
tatttagtatatttgtatc

SEQ ID NO: 85779 - DNA, 19 bp, Artificial sequence
  SiRNA target sequence
atttagtatatttgtatct

SEQ ID NO: 85780 - DNA, 19 bp, Artificial sequence
  SiRNA target sequence
tttagtatatttgtatcta

SEQ ID NO: 85781 - DNA, 19 bp, Artificial sequence
  SiRNA target sequence
ttagtatatttgtatctat

SEQ ID NO: 85782 - DNA, 19 bp, Artificial sequence
  SiRNA target sequence
tagtatatttgtatctatc

SEQ ID NO: 85783 - DNA, 19 bp, Artificial sequence
  SiRNA target sequence
agtatatttgtatctatca

SEQ ID NO: 85784 - DNA, 19 bp, Artificial sequence
  SiRNA target sequence
gtatatttgtatctatcaa

SEQ ID NO: 85785 - DNA, 19 bp, Artificial sequence
  SiRNA target sequence
tatatttgtatctatcaaa

SEQ ID NO: 85786 - DNA, 19 bp, Artificial sequence
  SiRNA target sequence
atatttgtatctatcaaat

SEQ ID NO: 85787 - DNA, 19 bp, Artificial sequence
  SiRNA target sequence
tatttgtatctatcaaatt

SEQ ID NO: 85788 - DNA, 19 bp, Artificial sequence
  SiRNA target sequence
atttgtatctatcaaattt

SEQ ID NO: 85789 - DNA, 19 bp, Artificial sequence
  SiRNA target sequence
tttgtatctatcaaattta

SEQ ID NO: 85790 - DNA, 19 bp, Artificial sequence
  SiRNA target sequence
ttgtatctatcaaatttat

SEQ ID NO: 85791 - DNA, 19 bp, Artificial sequence
  SiRNA target sequence
tgtatctatcaaatttata

SEQ ID NO: 85792 - DNA, 19 bp, Artificial sequence
  SiRNA target sequence
gtatctatcaaatttatat

SEQ ID NO: 85793 - DNA, 19 bp, Artificial sequence
  SiRNA target sequence
tatctatcaaatttatatt

SEQ ID NO: 85794 - DNA, 19 bp, Artificial sequence
  SiRNA target sequence
atctatcaaatttatattc

SEQ ID NO: 85795 - DNA, 19 bp, Artificial sequence
  SiRNA target sequence
tctatcaaatttatattct

SEQ ID NO: 85796 - DNA, 19 bp, Artificial sequence
  SiRNA target sequence
ctatcaaatttatattctc

SEQ ID NO: 85797 - DNA, 19 bp, Artificial sequence
  SiRNA target sequence
tatcaaatttatattctcg

SEQ ID NO: 85798 - DNA, 19 bp, Artificial sequence
  SiRNA target sequence
atcaaatttatattctcgt

SEQ ID NO: 85799 - DNA, 19 bp, Artificial sequence
  SiRNA target sequence
tcaaatttatattctcgtt

SEQ ID NO: 85800 - DNA, 19 bp, Artificial sequence
  SiRNA target sequence
caaatttatattctcgttt

SEQ ID NO: 85801 - DNA, 19 bp, Artificial sequence
  SiRNA target sequence
aaatttatattctcgtttg

SEQ ID NO: 85802 - DNA, 19 bp, Artificial sequence
  SiRNA target sequence
aatttatattctcgtttgt

SEQ ID NO: 85803 - DNA, 19 bp, Artificial sequence
  SiRNA target sequence
atttatattctcgtttgtc

SEQ ID NO: 85804 - DNA, 19 bp, Artificial sequence
  SiRNA target sequence
tttatattctcgtttgtct

SEQ ID NO: 85805 - DNA, 19 bp, Artificial sequence
  SiRNA target sequence
ttatattctcgtttgtctt

SEQ ID NO: 85806 - DNA, 19 bp, Artificial sequence
  SiRNA target sequence
tatattctcgtttgtcttt

SEQ ID NO: 85807 - DNA, 19 bp, Artificial sequence
  SiRNA target sequence
atattctcgtttgtcttta

SEQ ID NO: 85808 - DNA, 19 bp, Artificial sequence
  SiRNA target sequence
tattctcgtttgtctttat

SEQ ID NO: 85809 - DNA, 19 bp, Artificial sequence
  SiRNA target sequence
attctcgtttgtctttatt

SEQ ID NO: 85810 - DNA, 19 bp, Artificial sequence
  SiRNA target sequence
ttctcgtttgtctttattt

SEQ ID NO: 85811 - DNA, 19 bp, Artificial sequence
  SiRNA target sequence
tctcgtttgtctttatttt

SEQ ID NO: 85812 - DNA, 19 bp, Artificial sequence
  SiRNA target sequence
ctcgtttgtctttatttta

SEQ ID NO: 85813 - DNA, 19 bp, Artificial sequence
  SiRNA target sequence
tcgtttgtctttattttat

SEQ ID NO: 85814 - DNA, 19 bp, Artificial sequence
  SiRNA target sequence
cgtttgtctttattttata

SEQ ID NO: 85815 - DNA, 19 bp, Artificial sequence
  SiRNA target sequence
gtttgtctttattttataa

SEQ ID NO: 85816 - DNA, 19 bp, Artificial sequence
  SiRNA target sequence
tttgtctttattttataag

SEQ ID NO: 85817 - DNA, 19 bp, Artificial sequence
  SiRNA target sequence
ttgtctttattttataaga

SEQ ID NO: 85818 - DNA, 19 bp, Artificial sequence
  SiRNA target sequence
tgtctttattttataagaa

SEQ ID NO: 85819 - DNA, 19 bp, Artificial sequence
  SiRNA target sequence
gtctttattttataagaac

SEQ ID NO: 85820 - DNA, 19 bp, Artificial sequence
  SiRNA target sequence
tctttattttataagaacc

SEQ ID NO: 85821 - DNA, 19 bp, Artificial sequence
  SiRNA target sequence
ctttattttataagaacct

SEQ ID NO: 85822 - DNA, 19 bp, Artificial sequence
  SiRNA target sequence
tttattttataagaacctg

SEQ ID NO: 85823 - DNA, 19 bp, Artificial sequence
  SiRNA target sequence
ttattttataagaacctgt

SEQ ID NO: 85824 - DNA, 19 bp, Artificial sequence
  SiRNA target sequence
tattttataagaacctgta

SEQ ID NO: 85825 - DNA, 19 bp, Artificial sequence
  SiRNA target sequence
attttataagaacctgtat

SEQ ID NO: 85826 - DNA, 19 bp, Artificial sequence
  SiRNA target sequence
ttttataagaacctgtata

SEQ ID NO: 85827 - DNA, 19 bp, Artificial sequence
  SiRNA target sequence
tttataagaacctgtatag

SEQ ID NO: 85828 - DNA, 19 bp, Artificial sequence
  SiRNA target sequence
ttataagaacctgtatagt

SEQ ID NO: 85829 - DNA, 19 bp, Artificial sequence
  SiRNA target sequence
tataagaacctgtatagtt

SEQ ID NO: 85830 - DNA, 19 bp, Artificial sequence
  SiRNA target sequence
ataagaacctgtatagttg

SEQ ID NO: 85831 - DNA, 19 bp, Artificial sequence
  SiRNA target sequence
taagaacctgtatagttgg

SEQ ID NO: 85832 - DNA, 19 bp, Artificial sequence
  SiRNA target sequence
aagaacctgtatagttggt

SEQ ID NO: 85833 - DNA, 19 bp, Artificial sequence
  SiRNA target sequence
agaacctgtatagttggtc

SEQ ID NO: 85834 - DNA, 19 bp, Artificial sequence
  SiRNA target sequence
gaacctgtatagttggtct

SEQ ID NO: 85835 - DNA, 19 bp, Artificial sequence
  SiRNA target sequence
aacctgtatagttggtctt

SEQ ID NO: 85836 - DNA, 19 bp, Artificial sequence
  SiRNA target sequence
acctgtatagttggtcttt

SEQ ID NO: 85837 - DNA, 19 bp, Artificial sequence
  SiRNA target sequence
cctgtatagttggtctttt

SEQ ID NO: 85838 - DNA, 19 bp, Artificial sequence
  SiRNA target sequence
ctgtatagttggtcttttt

SEQ ID NO: 85839 - DNA, 19 bp, Artificial sequence
  SiRNA target sequence
tgtatagttggtcttttta

SEQ ID NO: 85840 - DNA, 19 bp, Artificial sequence
  SiRNA target sequence
gtatagttggtctttttaa

SEQ ID NO: 85841 - DNA, 19 bp, Artificial sequence
  SiRNA target sequence
tatagttggtctttttaat

SEQ ID NO: 85842 - DNA, 19 bp, Artificial sequence
  SiRNA target sequence
atagttggtctttttaatt

SEQ ID NO: 85843 - DNA, 19 bp, Artificial sequence
  SiRNA target sequence
tagttggtctttttaatta

SEQ ID NO: 85844 - DNA, 19 bp, Artificial sequence
  SiRNA target sequence
agttggtctttttaattat

SEQ ID NO: 85845 - DNA, 19 bp, Artificial sequence
  SiRNA target sequence
gttggtctttttaattata

SEQ ID NO: 85846 - DNA, 19 bp, Artificial sequence
  SiRNA target sequence
ttggtctttttaattataa

SEQ ID NO: 85847 - DNA, 19 bp, Artificial sequence
  SiRNA target sequence
tggtctttttaattataag

SEQ ID NO: 85848 - DNA, 19 bp, Artificial sequence
  SiRNA target sequence
ggtctttttaattataagc

SEQ ID NO: 85849 - DNA, 19 bp, Artificial sequence
  SiRNA target sequence
gtctttttaattataagct

SEQ ID NO: 85850 - DNA, 19 bp, Artificial sequence
  SiRNA target sequence
tctttttaattataagctt

SEQ ID NO: 85851 - DNA, 19 bp, Artificial sequence
  SiRNA target sequence
ctttttaattataagctta

SEQ ID NO: 85852 - DNA, 19 bp, Artificial sequence
  SiRNA target sequence
tttttaattataagcttat

SEQ ID NO: 85853 - DNA, 19 bp, Artificial sequence
  SiRNA target sequence
ttttaattataagcttatt

SEQ ID NO: 85854 - DNA, 19 bp, Artificial sequence
  SiRNA target sequence
tttaattataagcttattg

SEQ ID NO: 85855 - DNA, 19 bp, Artificial sequence
  SiRNA target sequence
ttaattataagcttattga

SEQ ID NO: 85856 - DNA, 19 bp, Artificial sequence
  SiRNA target sequence
taattataagcttattgaa

SEQ ID NO: 85857 - DNA, 19 bp, Artificial sequence
  SiRNA target sequence
aattataagcttattgaaa

SEQ ID NO: 85858 - DNA, 19 bp, Artificial sequence
  SiRNA target sequence
attataagcttattgaaat

SEQ ID NO: 85859 - DNA, 19 bp, Artificial sequence
  SiRNA target sequence
ttataagcttattgaaatt

SEQ ID NO: 85860 - DNA, 19 bp, Artificial sequence
  SiRNA target sequence
tataagcttattgaaattt

SEQ ID NO: 85861 - DNA, 19 bp, Artificial sequence
  SiRNA target sequence
ataagcttattgaaatttc

SEQ ID NO: 85862 - DNA, 19 bp, Artificial sequence
  SiRNA target sequence
taagcttattgaaatttct

SEQ ID NO: 85863 - DNA, 19 bp, Artificial sequence
  SiRNA target sequence
aagcttattgaaatttcta

SEQ ID NO: 85864 - DNA, 19 bp, Artificial sequence
  SiRNA target sequence
agcttattgaaatttctaa

SEQ ID NO: 85865 - DNA, 19 bp, Artificial sequence
  SiRNA target sequence
gcttattgaaatttctaat

SEQ ID NO: 85866 - DNA, 19 bp, Artificial sequence
  SiRNA target sequence
cttattgaaatttctaata

SEQ ID NO: 85867 - DNA, 19 bp, Artificial sequence
  SiRNA target sequence
ttattgaaatttctaatat

SEQ ID NO: 85868 - DNA, 19 bp, Artificial sequence
  SiRNA target sequence
tattgaaatttctaatatt

SEQ ID NO: 85869 - DNA, 19 bp, Artificial sequence
  SiRNA target sequence
attgaaatttctaatattt

SEQ ID NO: 85870 - DNA, 19 bp, Artificial sequence
  SiRNA target sequence
ttgaaatttctaatattta

SEQ ID NO: 85871 - DNA, 19 bp, Artificial sequence
  SiRNA target sequence
tgaaatttctaatatttaa

SEQ ID NO: 85872 - DNA, 19 bp, Artificial sequence
  SiRNA target sequence
gaaatttctaatatttaaa

SEQ ID NO: 85873 - DNA, 19 bp, Artificial sequence
  SiRNA target sequence
aaatttctaatatttaaag

SEQ ID NO: 85874 - DNA, 19 bp, Artificial sequence
  SiRNA target sequence
aatttctaatatttaaagg

SEQ ID NO: 85875 - DNA, 19 bp, Artificial sequence
  SiRNA target sequence
atttctaatatttaaagga

SEQ ID NO: 85876 - DNA, 19 bp, Artificial sequence
  SiRNA target sequence
tttctaatatttaaaggaa

SEQ ID NO: 85877 - DNA, 19 bp, Artificial sequence
  SiRNA target sequence
ttctaatatttaaaggaac

SEQ ID NO: 85878 - DNA, 19 bp, Artificial sequence
  SiRNA target sequence
tctaatatttaaaggaaca

SEQ ID NO: 85879 - DNA, 19 bp, Artificial sequence
  SiRNA target sequence
ctaatatttaaaggaacaa

SEQ ID NO: 85880 - DNA, 19 bp, Artificial sequence
  SiRNA target sequence
taatatttaaaggaacaaa

SEQ ID NO: 85881 - DNA, 19 bp, Artificial sequence
  SiRNA target sequence
aatatttaaaggaacaaaa

SEQ ID NO: 85882 - DNA, 19 bp, Artificial sequence
  SiRNA target sequence
atatttaaaggaacaaaat

SEQ ID NO: 85883 - DNA, 19 bp, Artificial sequence
  SiRNA target sequence
tatttaaaggaacaaaatc

SEQ ID NO: 85884 - DNA, 19 bp, Artificial sequence
  SiRNA target sequence
atttaaaggaacaaaatct

SEQ ID NO: 85885 - DNA, 19 bp, Artificial sequence
  SiRNA target sequence
tttaaaggaacaaaatcta

SEQ ID NO: 85886 - DNA, 19 bp, Artificial sequence
  SiRNA target sequence
ttaaaggaacaaaatctac

SEQ ID NO: 85887 - DNA, 19 bp, Artificial sequence
  SiRNA target sequence
taaaggaacaaaatctaca

SEQ ID NO: 85888 - DNA, 19 bp, Artificial sequence
  SiRNA target sequence
aaaggaacaaaatctacat

SEQ ID NO: 85889 - DNA, 19 bp, Artificial sequence
  SiRNA target sequence
aaggaacaaaatctacatt

SEQ ID NO: 85890 - DNA, 19 bp, Artificial sequence
  SiRNA target sequence
aggaacaaaatctacattt

SEQ ID NO: 85891 - DNA, 19 bp, Artificial sequence
  SiRNA target sequence
ggaacaaaatctacattta

SEQ ID NO: 85892 - DNA, 19 bp, Artificial sequence
  SiRNA target sequence
gaacaaaatctacatttag

SEQ ID NO: 85893 - DNA, 19 bp, Artificial sequence
  SiRNA target sequence
aacaaaatctacatttaga

SEQ ID NO: 85894 - DNA, 19 bp, Artificial sequence
  SiRNA target sequence
acaaaatctacatttagat

SEQ ID NO: 85895 - DNA, 19 bp, Artificial sequence
  SiRNA target sequence
caaaatctacatttagatt

SEQ ID NO: 85896 - DNA, 19 bp, Artificial sequence
  SiRNA target sequence
aaaatctacatttagatta

SEQ ID NO: 85897 - DNA, 19 bp, Artificial sequence
  SiRNA target sequence
aaatctacatttagattat

SEQ ID NO: 85898 - DNA, 19 bp, Artificial sequence
  SiRNA target sequence
aatctacatttagattata

SEQ ID NO: 85899 - DNA, 19 bp, Artificial sequence
  SiRNA target sequence
atctacatttagattatat

SEQ ID NO: 85900 - DNA, 19 bp, Artificial sequence
  SiRNA target sequence
tctacatttagattatatt

SEQ ID NO: 85901 - DNA, 19 bp, Artificial sequence
  SiRNA target sequence
ctacatttagattatattc

SEQ ID NO: 85902 - DNA, 19 bp, Artificial sequence
  SiRNA target sequence
tacatttagattatattct

SEQ ID NO: 85903 - DNA, 19 bp, Artificial sequence
  SiRNA target sequence
acatttagattatattcta

SEQ ID NO: 85904 - DNA, 19 bp, Artificial sequence
  SiRNA target sequence
catttagattatattctaa

SEQ ID NO: 85905 - DNA, 19 bp, Artificial sequence
  SiRNA target sequence
atttagattatattctaat

SEQ ID NO: 85906 - DNA, 19 bp, Artificial sequence
  SiRNA target sequence
tttagattatattctaatt

SEQ ID NO: 85907 - DNA, 19 bp, Artificial sequence
  SiRNA target sequence
ttagattatattctaattt

SEQ ID NO: 85908 - DNA, 19 bp, Artificial sequence
  SiRNA target sequence
tagattatattctaattta

SEQ ID NO: 85909 - DNA, 19 bp, Artificial sequence
  SiRNA target sequence
agattatattctaatttat

SEQ ID NO: 85910 - DNA, 19 bp, Artificial sequence
  SiRNA target sequence
gattatattctaatttatt

SEQ ID NO: 85911 - DNA, 19 bp, Artificial sequence
  SiRNA target sequence
attatattctaatttattg

SEQ ID NO: 85912 - DNA, 19 bp, Artificial sequence
  SiRNA target sequence
ttatattctaatttattga

SEQ ID NO: 85913 - DNA, 19 bp, Artificial sequence
  SiRNA target sequence
tatattctaatttattgaa

SEQ ID NO: 85914 - DNA, 19 bp, Artificial sequence
  SiRNA target sequence
atattctaatttattgaat

SEQ ID NO: 85915 - DNA, 19 bp, Artificial sequence
  SiRNA target sequence
tattctaatttattgaatt

SEQ ID NO: 85916 - DNA, 19 bp, Artificial sequence
  SiRNA target sequence
attctaatttattgaattt

SEQ ID NO: 85917 - DNA, 19 bp, Artificial sequence
  SiRNA target sequence
ttctaatttattgaatttc

SEQ ID NO: 85918 - DNA, 19 bp, Artificial sequence
  SiRNA target sequence
tctaatttattgaatttca

SEQ ID NO: 85919 - DNA, 19 bp, Artificial sequence
  SiRNA target sequence
ctaatttattgaatttcat

SEQ ID NO: 85920 - DNA, 20 bp, Artificial sequence
  SiRNA target sequence
ttatatccaactatcaaaaa

SEQ ID NO: 85921 - DNA, 20 bp, Artificial sequence
  SiRNA target sequence
tatatccaactatcaaaaaa

SEQ ID NO: 85922 - DNA, 20 bp, Artificial sequence
  SiRNA target sequence
atatccaactatcaaaaaat

SEQ ID NO: 85923 - DNA, 20 bp, Artificial sequence
  SiRNA target sequence
tatccaactatcaaaaaata

SEQ ID NO: 85924 - DNA, 20 bp, Artificial sequence
  SiRNA target sequence
atccaactatcaaaaaatag

SEQ ID NO: 85925 - DNA, 20 bp, Artificial sequence
  SiRNA target sequence
tccaactatcaaaaaatagc

SEQ ID NO: 85926 - DNA, 20 bp, Artificial sequence
  SiRNA target sequence
ccaactatcaaaaaatagcc

SEQ ID NO: 85927 - DNA, 20 bp, Artificial sequence
  SiRNA target sequence
caactatcaaaaaatagcct

SEQ ID NO: 85928 - DNA, 20 bp, Artificial sequence
  SiRNA target sequence
aactatcaaaaaatagcctc

SEQ ID NO: 85929 - DNA, 20 bp, Artificial sequence
  SiRNA target sequence
actatcaaaaaatagcctct

SEQ ID NO: 85930 - DNA, 20 bp, Artificial sequence
  SiRNA target sequence
ctatcaaaaaatagcctctt

SEQ ID NO: 85931 - DNA, 20 bp, Artificial sequence
  SiRNA target sequence
tatcaaaaaatagcctcttt

SEQ ID NO: 85932 - DNA, 20 bp, Artificial sequence
  SiRNA target sequence
atcaaaaaatagcctctttt

SEQ ID NO: 85933 - DNA, 20 bp, Artificial sequence
  SiRNA target sequence
tcaaaaaatagcctcttttc

SEQ ID NO: 85934 - DNA, 20 bp, Artificial sequence
  SiRNA target sequence
caaaaaatagcctcttttct

SEQ ID NO: 85935 - DNA, 20 bp, Artificial sequence
  SiRNA target sequence
aaaaaatagcctcttttctt

SEQ ID NO: 85936 - DNA, 20 bp, Artificial sequence
  SiRNA target sequence
aaaaatagcctcttttcttt

SEQ ID NO: 85937 - DNA, 20 bp, Artificial sequence
  SiRNA target sequence
aaaatagcctcttttctttc

SEQ ID NO: 85938 - DNA, 20 bp, Artificial sequence
  SiRNA target sequence
aaatagcctcttttctttca

SEQ ID NO: 85939 - DNA, 20 bp, Artificial sequence
  SiRNA target sequence
aatagcctcttttctttcac

SEQ ID NO: 85940 - DNA, 20 bp, Artificial sequence
  SiRNA target sequence
atagcctcttttctttcaca

SEQ ID NO: 85941 - DNA, 20 bp, Artificial sequence
  SiRNA target sequence
tagcctcttttctttcacaa

SEQ ID NO: 85942 - DNA, 20 bp, Artificial sequence
  SiRNA target sequence
agcctcttttctttcacaat

SEQ ID NO: 85943 - DNA, 20 bp, Artificial sequence
  SiRNA target sequence
gcctcttttctttcacaatt

SEQ ID NO: 85944 - DNA, 20 bp, Artificial sequence
  SiRNA target sequence
cctcttttctttcacaattt

SEQ ID NO: 85945 - DNA, 20 bp, Artificial sequence
  SiRNA target sequence
ctcttttctttcacaatttc

SEQ ID NO: 85946 - DNA, 20 bp, Artificial sequence
  SiRNA target sequence
tcttttctttcacaatttca

SEQ ID NO: 85947 - DNA, 20 bp, Artificial sequence
  SiRNA target sequence
cttttctttcacaatttcag

SEQ ID NO: 85948 - DNA, 20 bp, Artificial sequence
  SiRNA target sequence
ttttctttcacaatttcaga

SEQ ID NO: 85949 - DNA, 20 bp, Artificial sequence
  SiRNA target sequence
tttctttcacaatttcagaa

SEQ ID NO: 85950 - DNA, 20 bp, Artificial sequence
  SiRNA target sequence
ttctttcacaatttcagaaa

SEQ ID NO: 85951 - DNA, 20 bp, Artificial sequence
  SiRNA target sequence
tctttcacaatttcagaaaa

SEQ ID NO: 85952 - DNA, 20 bp, Artificial sequence
  SiRNA target sequence
ctttcacaatttcagaaaaa

SEQ ID NO: 85953 - DNA, 20 bp, Artificial sequence
  SiRNA target sequence
tttcacaatttcagaaaaat

SEQ ID NO: 85954 - DNA, 20 bp, Artificial sequence
  SiRNA target sequence
ttcacaatttcagaaaaatt

SEQ ID NO: 85955 - DNA, 20 bp, Artificial sequence
  SiRNA target sequence
tcacaatttcagaaaaattt

SEQ ID NO: 85956 - DNA, 20 bp, Artificial sequence
  SiRNA target sequence
cacaatttcagaaaaatttt

SEQ ID NO: 85957 - DNA, 20 bp, Artificial sequence
  SiRNA target sequence
acaatttcagaaaaattttc

SEQ ID NO: 85958 - DNA, 20 bp, Artificial sequence
  SiRNA target sequence
caatttcagaaaaattttca

SEQ ID NO: 85959 - DNA, 20 bp, Artificial sequence
  SiRNA target sequence
aatttcagaaaaattttcat

SEQ ID NO: 85960 - DNA, 20 bp, Artificial sequence
  SiRNA target sequence
atttcagaaaaattttcatt

SEQ ID NO: 85961 - DNA, 20 bp, Artificial sequence
  SiRNA target sequence
tttcagaaaaattttcatta

SEQ ID NO: 85962 - DNA, 20 bp, Artificial sequence
  SiRNA target sequence
ttcagaaaaattttcattaa

SEQ ID NO: 85963 - DNA, 20 bp, Artificial sequence
  SiRNA target sequence
tcagaaaaattttcattaaa

SEQ ID NO: 85964 - DNA, 20 bp, Artificial sequence
  SiRNA target sequence
cagaaaaattttcattaaaa

SEQ ID NO: 85965 - DNA, 20 bp, Artificial sequence
  SiRNA target sequence
agaaaaattttcattaaaaa

SEQ ID NO: 85966 - DNA, 20 bp, Artificial sequence
  SiRNA target sequence
gaaaaattttcattaaaaat

SEQ ID NO: 85967 - DNA, 20 bp, Artificial sequence
  SiRNA target sequence
aaaaattttcattaaaaatg

SEQ ID NO: 85968 - DNA, 20 bp, Artificial sequence
  SiRNA target sequence
aaaattttcattaaaaatgc

SEQ ID NO: 85969 - DNA, 20 bp, Artificial sequence
  SiRNA target sequence
aaattttcattaaaaatgct

SEQ ID NO: 85970 - DNA, 20 bp, Artificial sequence
  SiRNA target sequence
aattttcattaaaaatgcta

SEQ ID NO: 85971 - DNA, 20 bp, Artificial sequence
  SiRNA target sequence
attttcattaaaaatgctat

SEQ ID NO: 85972 - DNA, 20 bp, Artificial sequence
  SiRNA target sequence
ttttcattaaaaatgctata

SEQ ID NO: 85973 - DNA, 20 bp, Artificial sequence
  SiRNA target sequence
tttcattaaaaatgctataa

SEQ ID NO: 85974 - DNA, 20 bp, Artificial sequence
  SiRNA target sequence
ttcattaaaaatgctataaa

SEQ ID NO: 85975 - DNA, 20 bp, Artificial sequence
  SiRNA target sequence
tcattaaaaatgctataaat

SEQ ID NO: 85976 - DNA, 20 bp, Artificial sequence
  SiRNA target sequence
cattaaaaatgctataaata

SEQ ID NO: 85977 - DNA, 20 bp, Artificial sequence
  SiRNA target sequence
attaaaaatgctataaatag

SEQ ID NO: 85978 - DNA, 20 bp, Artificial sequence
  SiRNA target sequence
ttaaaaatgctataaatagt

SEQ ID NO: 85979 - DNA, 20 bp, Artificial sequence
  SiRNA target sequence
taaaaatgctataaatagtt

SEQ ID NO: 85980 - DNA, 20 bp, Artificial sequence
  SiRNA target sequence
aaaaatgctataaatagttt

SEQ ID NO: 85981 - DNA, 20 bp, Artificial sequence
  SiRNA target sequence
aaaatgctataaatagtttt

SEQ ID NO: 85982 - DNA, 20 bp, Artificial sequence
  SiRNA target sequence
aaatgctataaatagttttt

SEQ ID NO: 85983 - DNA, 20 bp, Artificial sequence
  SiRNA target sequence
aatgctataaatagtttttt

SEQ ID NO: 85984 - DNA, 20 bp, Artificial sequence
  SiRNA target sequence
atgctataaatagttttttg

SEQ ID NO: 85985 - DNA, 20 bp, Artificial sequence
  SiRNA target sequence
tgctataaatagttttttgc

SEQ ID NO: 85986 - DNA, 20 bp, Artificial sequence
  SiRNA target sequence
gctataaatagttttttgca

SEQ ID NO: 85987 - DNA, 20 bp, Artificial sequence
  SiRNA target sequence
ctataaatagttttttgcat

SEQ ID NO: 85988 - DNA, 20 bp, Artificial sequence
  SiRNA target sequence
tataaatagttttttgcata

SEQ ID NO: 85989 - DNA, 20 bp, Artificial sequence
  SiRNA target sequence
ataaatagttttttgcatat

SEQ ID NO: 85990 - DNA, 20 bp, Artificial sequence
  SiRNA target sequence
taaatagttttttgcatatc

SEQ ID NO: 85991 - DNA, 20 bp, Artificial sequence
  SiRNA target sequence
aaatagttttttgcatatca

SEQ ID NO: 85992 - DNA, 20 bp, Artificial sequence
  SiRNA target sequence
aatagttttttgcatatcag

SEQ ID NO: 85993 - DNA, 20 bp, Artificial sequence
  SiRNA target sequence
atagttttttgcatatcagg

SEQ ID NO: 85994 - DNA, 20 bp, Artificial sequence
  SiRNA target sequence
tagttttttgcatatcaggt

SEQ ID NO: 85995 - DNA, 20 bp, Artificial sequence
  SiRNA target sequence
agttttttgcatatcaggtc

SEQ ID NO: 85996 - DNA, 20 bp, Artificial sequence
  SiRNA target sequence
gttttttgcatatcaggtcg

SEQ ID NO: 85997 - DNA, 20 bp, Artificial sequence
  SiRNA target sequence
ttttttgcatatcaggtcgg

SEQ ID NO: 85998 - DNA, 20 bp, Artificial sequence
  SiRNA target sequence
tttttgcatatcaggtcggc

SEQ ID NO: 85999 - DNA, 20 bp, Artificial sequence
  SiRNA target sequence
ttttgcatatcaggtcggcc

SEQ ID NO: 86000 - DNA, 20 bp, Artificial sequence
  SiRNA target sequence
tttgcatatcaggtcggcca

SEQ ID NO: 86001 - DNA, 20 bp, Artificial sequence
  SiRNA target sequence
ttgcatatcaggtcggccac

SEQ ID NO: 86002 - DNA, 20 bp, Artificial sequence
  SiRNA target sequence
tgcatatcaggtcggccaca

SEQ ID NO: 86003 - DNA, 20 bp, Artificial sequence
  SiRNA target sequence
gcatatcaggtcggccacaa

SEQ ID NO: 86004 - DNA, 20 bp, Artificial sequence
  SiRNA target sequence
catatcaggtcggccacaaa

SEQ ID NO: 86005 - DNA, 20 bp, Artificial sequence
  SiRNA target sequence
atatcaggtcggccacaaac

SEQ ID NO: 86006 - DNA, 20 bp, Artificial sequence
  SiRNA target sequence
tatcaggtcggccacaaaca

SEQ ID NO: 86007 - DNA, 20 bp, Artificial sequence
  SiRNA target sequence
atcaggtcggccacaaacat

SEQ ID NO: 86008 - DNA, 20 bp, Artificial sequence
  SiRNA target sequence
tcaggtcggccacaaacata

SEQ ID NO: 86009 - DNA, 20 bp, Artificial sequence
  SiRNA target sequence
caggtcggccacaaacataa

SEQ ID NO: 86010 - DNA, 20 bp, Artificial sequence
  SiRNA target sequence
aggtcggccacaaacataaa

SEQ ID NO: 86011 - DNA, 20 bp, Artificial sequence
  SiRNA target sequence
ggtcggccacaaacataaac

SEQ ID NO: 86012 - DNA, 20 bp, Artificial sequence
  SiRNA target sequence
gtcggccacaaacataaacc

SEQ ID NO: 86013 - DNA, 20 bp, Artificial sequence
  SiRNA target sequence
tcggccacaaacataaacca

SEQ ID NO: 86014 - DNA, 20 bp, Artificial sequence
  SiRNA target sequence
cggccacaaacataaaccaa

SEQ ID NO: 86015 - DNA, 20 bp, Artificial sequence
  SiRNA target sequence
ggccacaaacataaaccaaa

SEQ ID NO: 86016 - DNA, 20 bp, Artificial sequence
  SiRNA target sequence
gccacaaacataaaccaaac

SEQ ID NO: 86017 - DNA, 20 bp, Artificial sequence
  SiRNA target sequence
ccacaaacataaaccaaaca

SEQ ID NO: 86018 - DNA, 20 bp, Artificial sequence
  SiRNA target sequence
cacaaacataaaccaaacat

SEQ ID NO: 86019 - DNA, 20 bp, Artificial sequence
  SiRNA target sequence
acaaacataaaccaaacatc

SEQ ID NO: 86020 - DNA, 20 bp, Artificial sequence
  SiRNA target sequence
caaacataaaccaaacatcc

SEQ ID NO: 86021 - DNA, 20 bp, Artificial sequence
  SiRNA target sequence
aaacataaaccaaacatccg

SEQ ID NO: 86022 - DNA, 20 bp, Artificial sequence
  SiRNA target sequence
aacataaaccaaacatccgt

SEQ ID NO: 86023 - DNA, 20 bp, Artificial sequence
  SiRNA target sequence
acataaaccaaacatccgtc

SEQ ID NO: 86024 - DNA, 20 bp, Artificial sequence
  SiRNA target sequence
cataaaccaaacatccgtct

SEQ ID NO: 86025 - DNA, 20 bp, Artificial sequence
  SiRNA target sequence
ataaaccaaacatccgtctt

SEQ ID NO: 86026 - DNA, 20 bp, Artificial sequence
  SiRNA target sequence
taaaccaaacatccgtcttt

SEQ ID NO: 86027 - DNA, 20 bp, Artificial sequence
  SiRNA target sequence
aaaccaaacatccgtcttta

SEQ ID NO: 86028 - DNA, 20 bp, Artificial sequence
  SiRNA target sequence
aaccaaacatccgtctttaa

SEQ ID NO: 86029 - DNA, 20 bp, Artificial sequence
  SiRNA target sequence
accaaacatccgtctttaat

SEQ ID NO: 86030 - DNA, 20 bp, Artificial sequence
  SiRNA target sequence
ccaaacatccgtctttaatg

SEQ ID NO: 86031 - DNA, 20 bp, Artificial sequence
  SiRNA target sequence
caaacatccgtctttaatgt

SEQ ID NO: 86032 - DNA, 20 bp, Artificial sequence
  SiRNA target sequence
aaacatccgtctttaatgta

SEQ ID NO: 86033 - DNA, 20 bp, Artificial sequence
  SiRNA target sequence
aacatccgtctttaatgtat

SEQ ID NO: 86034 - DNA, 20 bp, Artificial sequence
  SiRNA target sequence
acatccgtctttaatgtatg

SEQ ID NO: 86035 - DNA, 20 bp, Artificial sequence
  SiRNA target sequence
catccgtctttaatgtatgt

SEQ ID NO: 86036 - DNA, 20 bp, Artificial sequence
  SiRNA target sequence
atccgtctttaatgtatgtt

SEQ ID NO: 86037 - DNA, 20 bp, Artificial sequence
  SiRNA target sequence
tccgtctttaatgtatgttt

SEQ ID NO: 86038 - DNA, 20 bp, Artificial sequence
  SiRNA target sequence
ccgtctttaatgtatgtttt

SEQ ID NO: 86039 - DNA, 20 bp, Artificial sequence
  SiRNA target sequence
cgtctttaatgtatgttttt

SEQ ID NO: 86040 - DNA, 20 bp, Artificial sequence
  SiRNA target sequence
gtctttaatgtatgttttta

SEQ ID NO: 86041 - DNA, 20 bp, Artificial sequence
  SiRNA target sequence
tctttaatgtatgtttttat

SEQ ID NO: 86042 - DNA, 20 bp, Artificial sequence
  SiRNA target sequence
ctttaatgtatgtttttatc

SEQ ID NO: 86043 - DNA, 20 bp, Artificial sequence
  SiRNA target sequence
tttaatgtatgtttttatct

SEQ ID NO: 86044 - DNA, 20 bp, Artificial sequence
  SiRNA target sequence
ttaatgtatgtttttatctc

SEQ ID NO: 86045 - DNA, 20 bp, Artificial sequence
  SiRNA target sequence
taatgtatgtttttatctca

SEQ ID NO: 86046 - DNA, 20 bp, Artificial sequence
  SiRNA target sequence
aatgtatgtttttatctcat

SEQ ID NO: 86047 - DNA, 20 bp, Artificial sequence
  SiRNA target sequence
atgtatgtttttatctcatt

SEQ ID NO: 86048 - DNA, 20 bp, Artificial sequence
  SiRNA target sequence
tgtatgtttttatctcattt

SEQ ID NO: 86049 - DNA, 20 bp, Artificial sequence
  SiRNA target sequence
gtatgtttttatctcattta

SEQ ID NO: 86050 - DNA, 20 bp, Artificial sequence
  SiRNA target sequence
tatgtttttatctcatttaa

SEQ ID NO: 86051 - DNA, 20 bp, Artificial sequence
  SiRNA target sequence
atgtttttatctcatttaaa

SEQ ID NO: 86052 - DNA, 20 bp, Artificial sequence
  SiRNA target sequence
tgtttttatctcatttaaat

SEQ ID NO: 86053 - DNA, 20 bp, Artificial sequence
  SiRNA target sequence
gtttttatctcatttaaatt

SEQ ID NO: 86054 - DNA, 20 bp, Artificial sequence
  SiRNA target sequence
tttttatctcatttaaattt

SEQ ID NO: 86055 - DNA, 20 bp, Artificial sequence
  SiRNA target sequence
ttttatctcatttaaatttt

SEQ ID NO: 86056 - DNA, 20 bp, Artificial sequence
  SiRNA target sequence
tttatctcatttaaattttg

SEQ ID NO: 86057 - DNA, 20 bp, Artificial sequence
  SiRNA target sequence
ttatctcatttaaattttgt

SEQ ID NO: 86058 - DNA, 20 bp, Artificial sequence
  SiRNA target sequence
tatctcatttaaattttgta

SEQ ID NO: 86059 - DNA, 20 bp, Artificial sequence
  SiRNA target sequence
atctcatttaaattttgtaa

SEQ ID NO: 86060 - DNA, 20 bp, Artificial sequence
  SiRNA target sequence
tctcatttaaattttgtaat

SEQ ID NO: 86061 - DNA, 20 bp, Artificial sequence
  SiRNA target sequence
ctcatttaaattttgtaata

SEQ ID NO: 86062 - DNA, 20 bp, Artificial sequence
  SiRNA target sequence
tcatttaaattttgtaataa

SEQ ID NO: 86063 - DNA, 20 bp, Artificial sequence
  SiRNA target sequence
catttaaattttgtaataaa

SEQ ID NO: 86064 - DNA, 20 bp, Artificial sequence
  SiRNA target sequence
atttaaattttgtaataaat

SEQ ID NO: 86065 - DNA, 20 bp, Artificial sequence
  SiRNA target sequence
tttaaattttgtaataaata

SEQ ID NO: 86066 - DNA, 20 bp, Artificial sequence
  SiRNA target sequence
ttaaattttgtaataaataa

SEQ ID NO: 86067 - DNA, 20 bp, Artificial sequence
  SiRNA target sequence
taaattttgtaataaataat

SEQ ID NO: 86068 - DNA, 20 bp, Artificial sequence
  SiRNA target sequence
aaattttgtaataaataatc

SEQ ID NO: 86069 - DNA, 20 bp, Artificial sequence
  SiRNA target sequence
aattttgtaataaataatca

SEQ ID NO: 86070 - DNA, 20 bp, Artificial sequence
  SiRNA target sequence
attttgtaataaataatcag

SEQ ID NO: 86071 - DNA, 20 bp, Artificial sequence
  SiRNA target sequence
ttttgtaataaataatcagt

SEQ ID NO: 86072 - DNA, 20 bp, Artificial sequence
  SiRNA target sequence
tttgtaataaataatcagta

SEQ ID NO: 86073 - DNA, 20 bp, Artificial sequence
  SiRNA target sequence
ttgtaataaataatcagtaa

SEQ ID NO: 86074 - DNA, 20 bp, Artificial sequence
  SiRNA target sequence
tgtaataaataatcagtaac

SEQ ID NO: 86075 - DNA, 20 bp, Artificial sequence
  SiRNA target sequence
gtaataaataatcagtaaca

SEQ ID NO: 86076 - DNA, 20 bp, Artificial sequence
  SiRNA target sequence
taataaataatcagtaacat

SEQ ID NO: 86077 - DNA, 20 bp, Artificial sequence
  SiRNA target sequence
aataaataatcagtaacata

SEQ ID NO: 86078 - DNA, 20 bp, Artificial sequence
  SiRNA target sequence
ataaataatcagtaacataa

SEQ ID NO: 86079 - DNA, 20 bp, Artificial sequence
  SiRNA target sequence
taaataatcagtaacataaa

SEQ ID NO: 86080 - DNA, 20 bp, Artificial sequence
  SiRNA target sequence
aaataatcagtaacataaat

SEQ ID NO: 86081 - DNA, 20 bp, Artificial sequence
  SiRNA target sequence
aataatcagtaacataaatt

SEQ ID NO: 86082 - DNA, 20 bp, Artificial sequence
  SiRNA target sequence
ataatcagtaacataaattt

SEQ ID NO: 86083 - DNA, 20 bp, Artificial sequence
  SiRNA target sequence
taatcagtaacataaatttt

SEQ ID NO: 86084 - DNA, 20 bp, Artificial sequence
  SiRNA target sequence
aatcagtaacataaatttta

SEQ ID NO: 86085 - DNA, 20 bp, Artificial sequence
  SiRNA target sequence
atcagtaacataaattttat

SEQ ID NO: 86086 - DNA, 20 bp, Artificial sequence
  SiRNA target sequence
tcagtaacataaattttatt

SEQ ID NO: 86087 - DNA, 20 bp, Artificial sequence
  SiRNA target sequence
cagtaacataaattttatta

SEQ ID NO: 86088 - DNA, 20 bp, Artificial sequence
  SiRNA target sequence
agtaacataaattttattac

SEQ ID NO: 86089 - DNA, 20 bp, Artificial sequence
  SiRNA target sequence
gtaacataaattttattaca

SEQ ID NO: 86090 - DNA, 20 bp, Artificial sequence
  SiRNA target sequence
taacataaattttattacaa

SEQ ID NO: 86091 - DNA, 20 bp, Artificial sequence
  SiRNA target sequence
aacataaattttattacaag

SEQ ID NO: 86092 - DNA, 20 bp, Artificial sequence
  SiRNA target sequence
acataaattttattacaaga

SEQ ID NO: 86093 - DNA, 20 bp, Artificial sequence
  SiRNA target sequence
cataaattttattacaagat

SEQ ID NO: 86094 - DNA, 20 bp, Artificial sequence
  SiRNA target sequence
ataaattttattacaagata

SEQ ID NO: 86095 - DNA, 20 bp, Artificial sequence
  SiRNA target sequence
taaattttattacaagataa

SEQ ID NO: 86096 - DNA, 20 bp, Artificial sequence
  SiRNA target sequence
aaattttattacaagataaa

SEQ ID NO: 86097 - DNA, 20 bp, Artificial sequence
  SiRNA target sequence
aattttattacaagataaaa

SEQ ID NO: 86098 - DNA, 20 bp, Artificial sequence
  SiRNA target sequence
attttattacaagataaaat

SEQ ID NO: 86099 - DNA, 20 bp, Artificial sequence
  SiRNA target sequence
ttttattacaagataaaatt

SEQ ID NO: 86100 - DNA, 20 bp, Artificial sequence
  SiRNA target sequence
tttattacaagataaaattt

SEQ ID NO: 86101 - DNA, 20 bp, Artificial sequence
  SiRNA target sequence
ttattacaagataaaatttt

SEQ ID NO: 86102 - DNA, 20 bp, Artificial sequence
  SiRNA target sequence
tattacaagataaaatttta

SEQ ID NO: 86103 - DNA, 20 bp, Artificial sequence
  SiRNA target sequence
attacaagataaaattttaa

SEQ ID NO: 86104 - DNA, 20 bp, Artificial sequence
  SiRNA target sequence
ttacaagataaaattttaat

SEQ ID NO: 86105 - DNA, 20 bp, Artificial sequence
  SiRNA target sequence
tacaagataaaattttaata

SEQ ID NO: 86106 - DNA, 20 bp, Artificial sequence
  SiRNA target sequence
acaagataaaattttaataa

SEQ ID NO: 86107 - DNA, 20 bp, Artificial sequence
  SiRNA target sequence
caagataaaattttaataat

SEQ ID NO: 86108 - DNA, 20 bp, Artificial sequence
  SiRNA target sequence
aagataaaattttaataatt

SEQ ID NO: 86109 - DNA, 20 bp, Artificial sequence
  SiRNA target sequence
agataaaattttaataattt

SEQ ID NO: 86110 - DNA, 20 bp, Artificial sequence
  SiRNA target sequence
gataaaattttaataatttc

SEQ ID NO: 86111 - DNA, 20 bp, Artificial sequence
  SiRNA target sequence
ataaaattttaataatttct

SEQ ID NO: 86112 - DNA, 20 bp, Artificial sequence
  SiRNA target sequence
taaaattttaataatttctg

SEQ ID NO: 86113 - DNA, 20 bp, Artificial sequence
  SiRNA target sequence
aaaattttaataatttctgt

SEQ ID NO: 86114 - DNA, 20 bp, Artificial sequence
  SiRNA target sequence
aaattttaataatttctgtg

SEQ ID NO: 86115 - DNA, 20 bp, Artificial sequence
  SiRNA target sequence
aattttaataatttctgtgt

SEQ ID NO: 86116 - DNA, 20 bp, Artificial sequence
  SiRNA target sequence
attttaataatttctgtgtt

SEQ ID NO: 86117 - DNA, 20 bp, Artificial sequence
  SiRNA target sequence
ttttaataatttctgtgttt

SEQ ID NO: 86118 - DNA, 20 bp, Artificial sequence
  SiRNA target sequence
tttaataatttctgtgtttt

SEQ ID NO: 86119 - DNA, 20 bp, Artificial sequence
  SiRNA target sequence
ttaataatttctgtgttttt

SEQ ID NO: 86120 - DNA, 20 bp, Artificial sequence
  SiRNA target sequence
taataatttctgtgttttta

SEQ ID NO: 86121 - DNA, 20 bp, Artificial sequence
  SiRNA target sequence
aataatttctgtgtttttat

SEQ ID NO: 86122 - DNA, 20 bp, Artificial sequence
  SiRNA target sequence
ataatttctgtgtttttata

SEQ ID NO: 86123 - DNA, 20 bp, Artificial sequence
  SiRNA target sequence
taatttctgtgtttttatat

SEQ ID NO: 86124 - DNA, 20 bp, Artificial sequence
  SiRNA target sequence
aatttctgtgtttttatatt

SEQ ID NO: 86125 - DNA, 20 bp, Artificial sequence
  SiRNA target sequence
atttctgtgtttttatattt

SEQ ID NO: 86126 - DNA, 20 bp, Artificial sequence
  SiRNA target sequence
tttctgtgtttttatatttt

SEQ ID NO: 86127 - DNA, 20 bp, Artificial sequence
  SiRNA target sequence
ttctgtgtttttatattttg

SEQ ID NO: 86128 - DNA, 20 bp, Artificial sequence
  SiRNA target sequence
tctgtgtttttatattttgc

SEQ ID NO: 86129 - DNA, 20 bp, Artificial sequence
  SiRNA target sequence
ctgtgtttttatattttgca

SEQ ID NO: 86130 - DNA, 20 bp, Artificial sequence
  SiRNA target sequence
tgtgtttttatattttgcat

SEQ ID NO: 86131 - DNA, 20 bp, Artificial sequence
  SiRNA target sequence
gtgtttttatattttgcatc

SEQ ID NO: 86132 - DNA, 20 bp, Artificial sequence
  SiRNA target sequence
tgtttttatattttgcatct

SEQ ID NO: 86133 - DNA, 20 bp, Artificial sequence
  SiRNA target sequence
gtttttatattttgcatctt

SEQ ID NO: 86134 - DNA, 20 bp, Artificial sequence
  SiRNA target sequence
tttttatattttgcatcttt

SEQ ID NO: 86135 - DNA, 20 bp, Artificial sequence
  SiRNA target sequence
ttttatattttgcatcttta

SEQ ID NO: 86136 - DNA, 20 bp, Artificial sequence
  SiRNA target sequence
tttatattttgcatctttaa

SEQ ID NO: 86137 - DNA, 20 bp, Artificial sequence
  SiRNA target sequence
ttatattttgcatctttaat

SEQ ID NO: 86138 - DNA, 20 bp, Artificial sequence
  SiRNA target sequence
tatattttgcatctttaata

SEQ ID NO: 86139 - DNA, 20 bp, Artificial sequence
  SiRNA target sequence
atattttgcatctttaataa

SEQ ID NO: 86140 - DNA, 20 bp, Artificial sequence
  SiRNA target sequence
tattttgcatctttaataag

SEQ ID NO: 86141 - DNA, 20 bp, Artificial sequence
  SiRNA target sequence
attttgcatctttaataaga

SEQ ID NO: 86142 - DNA, 20 bp, Artificial sequence
  SiRNA target sequence
ttttgcatctttaataagat

SEQ ID NO: 86143 - DNA, 20 bp, Artificial sequence
  SiRNA target sequence
tttgcatctttaataagatc

SEQ ID NO: 86144 - DNA, 20 bp, Artificial sequence
  SiRNA target sequence
ttgcatctttaataagatca

SEQ ID NO: 86145 - DNA, 20 bp, Artificial sequence
  SiRNA target sequence
tgcatctttaataagatcat

SEQ ID NO: 86146 - DNA, 20 bp, Artificial sequence
  SiRNA target sequence
gcatctttaataagatcatc

SEQ ID NO: 86147 - DNA, 20 bp, Artificial sequence
  SiRNA target sequence
catctttaataagatcatct

SEQ ID NO: 86148 - DNA, 20 bp, Artificial sequence
  SiRNA target sequence
atctttaataagatcatctt

SEQ ID NO: 86149 - DNA, 20 bp, Artificial sequence
  SiRNA target sequence
tctttaataagatcatcttc

SEQ ID NO: 86150 - DNA, 20 bp, Artificial sequence
  SiRNA target sequence
ctttaataagatcatcttct

SEQ ID NO: 86151 - DNA, 20 bp, Artificial sequence
  SiRNA target sequence
tttaataagatcatcttctt

SEQ ID NO: 86152 - DNA, 20 bp, Artificial sequence
  SiRNA target sequence
ttaataagatcatcttcttg

SEQ ID NO: 86153 - DNA, 20 bp, Artificial sequence
  SiRNA target sequence
taataagatcatcttcttga

SEQ ID NO: 86154 - DNA, 20 bp, Artificial sequence
  SiRNA target sequence
aataagatcatcttcttgat

SEQ ID NO: 86155 - DNA, 20 bp, Artificial sequence
  SiRNA target sequence
ataagatcatcttcttgatt

SEQ ID NO: 86156 - DNA, 20 bp, Artificial sequence
  SiRNA target sequence
taagatcatcttcttgattt

SEQ ID NO: 86157 - DNA, 20 bp, Artificial sequence
  SiRNA target sequence
aagatcatcttcttgatttc

SEQ ID NO: 86158 - DNA, 20 bp, Artificial sequence
  SiRNA target sequence
agatcatcttcttgatttct

SEQ ID NO: 86159 - DNA, 20 bp, Artificial sequence
  SiRNA target sequence
gatcatcttcttgatttcta

SEQ ID NO: 86160 - DNA, 20 bp, Artificial sequence
  SiRNA target sequence
atcatcttcttgatttctaa

SEQ ID NO: 86161 - DNA, 20 bp, Artificial sequence
  SiRNA target sequence
tcatcttcttgatttctaaa

SEQ ID NO: 86162 - DNA, 20 bp, Artificial sequence
  SiRNA target sequence
catcttcttgatttctaaat

SEQ ID NO: 86163 - DNA, 20 bp, Artificial sequence
  SiRNA target sequence
atcttcttgatttctaaatc

SEQ ID NO: 86164 - DNA, 20 bp, Artificial sequence
  SiRNA target sequence
tcttcttgatttctaaatcc

SEQ ID NO: 86165 - DNA, 20 bp, Artificial sequence
  SiRNA target sequence
cttcttgatttctaaatcca

SEQ ID NO: 86166 - DNA, 20 bp, Artificial sequence
  SiRNA target sequence
ttcttgatttctaaatccat

SEQ ID NO: 86167 - DNA, 20 bp, Artificial sequence
  SiRNA target sequence
tcttgatttctaaatccata

SEQ ID NO: 86168 - DNA, 20 bp, Artificial sequence
  SiRNA target sequence
cttgatttctaaatccatat

SEQ ID NO: 86169 - DNA, 20 bp, Artificial sequence
  SiRNA target sequence
ttgatttctaaatccatata

SEQ ID NO: 86170 - DNA, 20 bp, Artificial sequence
  SiRNA target sequence
tgatttctaaatccatatat

SEQ ID NO: 86171 - DNA, 20 bp, Artificial sequence
  SiRNA target sequence
gatttctaaatccatatatt

SEQ ID NO: 86172 - DNA, 20 bp, Artificial sequence
  SiRNA target sequence
atttctaaatccatatatta

SEQ ID NO: 86173 - DNA, 20 bp, Artificial sequence
  SiRNA target sequence
tttctaaatccatatattag

SEQ ID NO: 86174 - DNA, 20 bp, Artificial sequence
  SiRNA target sequence
ttctaaatccatatattagt

SEQ ID NO: 86175 - DNA, 20 bp, Artificial sequence
  SiRNA target sequence
tctaaatccatatattagtt

SEQ ID NO: 86176 - DNA, 20 bp, Artificial sequence
  SiRNA target sequence
ctaaatccatatattagttt

SEQ ID NO: 86177 - DNA, 20 bp, Artificial sequence
  SiRNA target sequence
taaatccatatattagtttg

SEQ ID NO: 86178 - DNA, 20 bp, Artificial sequence
  SiRNA target sequence
aaatccatatattagtttga

SEQ ID NO: 86179 - DNA, 20 bp, Artificial sequence
  SiRNA target sequence
aatccatatattagtttgat

SEQ ID NO: 86180 - DNA, 20 bp, Artificial sequence
  SiRNA target sequence
atccatatattagtttgata

SEQ ID NO: 86181 - DNA, 20 bp, Artificial sequence
  SiRNA target sequence
tccatatattagtttgatat

SEQ ID NO: 86182 - DNA, 20 bp, Artificial sequence
  SiRNA target sequence
ccatatattagtttgatata

SEQ ID NO: 86183 - DNA, 20 bp, Artificial sequence
  SiRNA target sequence
catatattagtttgatatat

SEQ ID NO: 86184 - DNA, 20 bp, Artificial sequence
  SiRNA target sequence
atatattagtttgatatatt

SEQ ID NO: 86185 - DNA, 20 bp, Artificial sequence
  SiRNA target sequence
tatattagtttgatatattg

SEQ ID NO: 86186 - DNA, 20 bp, Artificial sequence
  SiRNA target sequence
atattagtttgatatattga

SEQ ID NO: 86187 - DNA, 20 bp, Artificial sequence
  SiRNA target sequence
tattagtttgatatattgat

SEQ ID NO: 86188 - DNA, 20 bp, Artificial sequence
  SiRNA target sequence
attagtttgatatattgatc

SEQ ID NO: 86189 - DNA, 20 bp, Artificial sequence
  SiRNA target sequence
ttagtttgatatattgatcg

SEQ ID NO: 86190 - DNA, 20 bp, Artificial sequence
  SiRNA target sequence
tagtttgatatattgatcgt

SEQ ID NO: 86191 - DNA, 20 bp, Artificial sequence
  SiRNA target sequence
agtttgatatattgatcgtc

SEQ ID NO: 86192 - DNA, 20 bp, Artificial sequence
  SiRNA target sequence
gtttgatatattgatcgtct

SEQ ID NO: 86193 - DNA, 20 bp, Artificial sequence
  SiRNA target sequence
tttgatatattgatcgtctt

SEQ ID NO: 86194 - DNA, 20 bp, Artificial sequence
  SiRNA target sequence
ttgatatattgatcgtcttc

SEQ ID NO: 86195 - DNA, 20 bp, Artificial sequence
  SiRNA target sequence
tgatatattgatcgtcttct

SEQ ID NO: 86196 - DNA, 20 bp, Artificial sequence
  SiRNA target sequence
gatatattgatcgtcttctt

SEQ ID NO: 86197 - DNA, 20 bp, Artificial sequence
  SiRNA target sequence
atatattgatcgtcttcttt

SEQ ID NO: 86198 - DNA, 20 bp, Artificial sequence
  SiRNA target sequence
tatattgatcgtcttcttta

SEQ ID NO: 86199 - DNA, 20 bp, Artificial sequence
  SiRNA target sequence
atattgatcgtcttctttat

SEQ ID NO: 86200 - DNA, 20 bp, Artificial sequence
  SiRNA target sequence
tattgatcgtcttctttatt

SEQ ID NO: 86201 - DNA, 20 bp, Artificial sequence
  SiRNA target sequence
attgatcgtcttctttattt

SEQ ID NO: 86202 - DNA, 20 bp, Artificial sequence
  SiRNA target sequence
ttgatcgtcttctttatttt

SEQ ID NO: 86203 - DNA, 20 bp, Artificial sequence
  SiRNA target sequence
tgatcgtcttctttattttt

SEQ ID NO: 86204 - DNA, 20 bp, Artificial sequence
  SiRNA target sequence
gatcgtcttctttatttttc

SEQ ID NO: 86205 - DNA, 20 bp, Artificial sequence
  SiRNA target sequence
atcgtcttctttatttttca

SEQ ID NO: 86206 - DNA, 20 bp, Artificial sequence
  SiRNA target sequence
tcgtcttctttatttttcaa

SEQ ID NO: 86207 - DNA, 20 bp, Artificial sequence
  SiRNA target sequence
cgtcttctttatttttcaaa

SEQ ID NO: 86208 - DNA, 20 bp, Artificial sequence
  SiRNA target sequence
gtcttctttatttttcaaaa

SEQ ID NO: 86209 - DNA, 20 bp, Artificial sequence
  SiRNA target sequence
tcttctttatttttcaaaaa

SEQ ID NO: 86210 - DNA, 20 bp, Artificial sequence
  SiRNA target sequence
cttctttatttttcaaaaac

SEQ ID NO: 86211 - DNA, 20 bp, Artificial sequence
  SiRNA target sequence
ttctttatttttcaaaaacg

SEQ ID NO: 86212 - DNA, 20 bp, Artificial sequence
  SiRNA target sequence
tctttatttttcaaaaacga

SEQ ID NO: 86213 - DNA, 20 bp, Artificial sequence
  SiRNA target sequence
ctttatttttcaaaaacgaa

SEQ ID NO: 86214 - DNA, 20 bp, Artificial sequence
  SiRNA target sequence
tttatttttcaaaaacgaaa

SEQ ID NO: 86215 - DNA, 20 bp, Artificial sequence
  SiRNA target sequence
ttatttttcaaaaacgaaaa

SEQ ID NO: 86216 - DNA, 20 bp, Artificial sequence
  SiRNA target sequence
tatttttcaaaaacgaaaaa

SEQ ID NO: 86217 - DNA, 20 bp, Artificial sequence
  SiRNA target sequence
atttttcaaaaacgaaaaaa

SEQ ID NO: 86218 - DNA, 20 bp, Artificial sequence
  SiRNA target sequence
tttttcaaaaacgaaaaaaa

SEQ ID NO: 86219 - DNA, 20 bp, Artificial sequence
  SiRNA target sequence
ttttcaaaaacgaaaaaaat

SEQ ID NO: 86220 - DNA, 20 bp, Artificial sequence
  SiRNA target sequence
tttcaaaaacgaaaaaaatg

SEQ ID NO: 86221 - DNA, 20 bp, Artificial sequence
  SiRNA target sequence
ttcaaaaacgaaaaaaatgg

SEQ ID NO: 86222 - DNA, 20 bp, Artificial sequence
  SiRNA target sequence
tcaaaaacgaaaaaaatgga

SEQ ID NO: 86223 - DNA, 20 bp, Artificial sequence
  SiRNA target sequence
caaaaacgaaaaaaatggag

SEQ ID NO: 86224 - DNA, 20 bp, Artificial sequence
  SiRNA target sequence
aaaaacgaaaaaaatggagc

SEQ ID NO: 86225 - DNA, 20 bp, Artificial sequence
  SiRNA target sequence
aaaacgaaaaaaatggagca

SEQ ID NO: 86226 - DNA, 20 bp, Artificial sequence
  SiRNA target sequence
aaacgaaaaaaatggagcaa

SEQ ID NO: 86227 - DNA, 20 bp, Artificial sequence
  SiRNA target sequence
aacgaaaaaaatggagcaat

SEQ ID NO: 86228 - DNA, 20 bp, Artificial sequence
  SiRNA target sequence
acgaaaaaaatggagcaatg

SEQ ID NO: 86229 - DNA, 20 bp, Artificial sequence
  SiRNA target sequence
cgaaaaaaatggagcaatgc

SEQ ID NO: 86230 - DNA, 20 bp, Artificial sequence
  SiRNA target sequence
gaaaaaaatggagcaatgcc

SEQ ID NO: 86231 - DNA, 20 bp, Artificial sequence
  SiRNA target sequence
aaaaaaatggagcaatgcca

SEQ ID NO: 86232 - DNA, 20 bp, Artificial sequence
  SiRNA target sequence
aaaaaatggagcaatgccag

SEQ ID NO: 86233 - DNA, 20 bp, Artificial sequence
  SiRNA target sequence
aaaaatggagcaatgccagt

SEQ ID NO: 86234 - DNA, 20 bp, Artificial sequence
  SiRNA target sequence
aaaatggagcaatgccagtt

SEQ ID NO: 86235 - DNA, 20 bp, Artificial sequence
  SiRNA target sequence
aaatggagcaatgccagttc

SEQ ID NO: 86236 - DNA, 20 bp, Artificial sequence
  SiRNA target sequence
aatggagcaatgccagttcc

SEQ ID NO: 86237 - DNA, 20 bp, Artificial sequence
  SiRNA target sequence
atggagcaatgccagttcca

SEQ ID NO: 86238 - DNA, 20 bp, Artificial sequence
  SiRNA target sequence
tggagcaatgccagttccag

SEQ ID NO: 86239 - DNA, 20 bp, Artificial sequence
  SiRNA target sequence
ggagcaatgccagttccagt

SEQ ID NO: 86240 - DNA, 20 bp, Artificial sequence
  SiRNA target sequence
gagcaatgccagttccagta

SEQ ID NO: 86241 - DNA, 20 bp, Artificial sequence
  SiRNA target sequence
agcaatgccagttccagtac

SEQ ID NO: 86242 - DNA, 20 bp, Artificial sequence
  SiRNA target sequence
gcaatgccagttccagtaca

SEQ ID NO: 86243 - DNA, 20 bp, Artificial sequence
  SiRNA target sequence
caatgccagttccagtacaa

SEQ ID NO: 86244 - DNA, 20 bp, Artificial sequence
  SiRNA target sequence
aatgccagttccagtacaaa

SEQ ID NO: 86245 - DNA, 20 bp, Artificial sequence
  SiRNA target sequence
atgccagttccagtacaaat

SEQ ID NO: 86246 - DNA, 20 bp, Artificial sequence
  SiRNA target sequence
tgccagttccagtacaaata

SEQ ID NO: 86247 - DNA, 20 bp, Artificial sequence
  SiRNA target sequence
gccagttccagtacaaatac

SEQ ID NO: 86248 - DNA, 20 bp, Artificial sequence
  SiRNA target sequence
ccagttccagtacaaatacc

SEQ ID NO: 86249 - DNA, 20 bp, Artificial sequence
  SiRNA target sequence
cagttccagtacaaataccc

SEQ ID NO: 86250 - DNA, 20 bp, Artificial sequence
  SiRNA target sequence
agttccagtacaaataccca

SEQ ID NO: 86251 - DNA, 20 bp, Artificial sequence
  SiRNA target sequence
gttccagtacaaatacccaa

SEQ ID NO: 86252 - DNA, 20 bp, Artificial sequence
  SiRNA target sequence
ttccagtacaaatacccaac

SEQ ID NO: 86253 - DNA, 20 bp, Artificial sequence
  SiRNA target sequence
tccagtacaaatacccaaca

SEQ ID NO: 86254 - DNA, 20 bp, Artificial sequence
  SiRNA target sequence
ccagtacaaatacccaacac

SEQ ID NO: 86255 - DNA, 20 bp, Artificial sequence
  SiRNA target sequence
cagtacaaatacccaacact

SEQ ID NO: 86256 - DNA, 20 bp, Artificial sequence
  SiRNA target sequence
agtacaaatacccaacactt

SEQ ID NO: 86257 - DNA, 20 bp, Artificial sequence
  SiRNA target sequence
gtacaaatacccaacacttt

SEQ ID NO: 86258 - DNA, 20 bp, Artificial sequence
  SiRNA target sequence
tacaaatacccaacactttt

SEQ ID NO: 86259 - DNA, 20 bp, Artificial sequence
  SiRNA target sequence
acaaatacccaacacttttt

SEQ ID NO: 86260 - DNA, 20 bp, Artificial sequence
  SiRNA target sequence
caaatacccaacactttttt

SEQ ID NO: 86261 - DNA, 20 bp, Artificial sequence
  SiRNA target sequence
aaatacccaacactttttta

SEQ ID NO: 86262 - DNA, 20 bp, Artificial sequence
  SiRNA target sequence
aatacccaacacttttttac

SEQ ID NO: 86263 - DNA, 20 bp, Artificial sequence
  SiRNA target sequence
atacccaacacttttttaca

SEQ ID NO: 86264 - DNA, 20 bp, Artificial sequence
  SiRNA target sequence
tacccaacacttttttacaa

SEQ ID NO: 86265 - DNA, 20 bp, Artificial sequence
  SiRNA target sequence
acccaacacttttttacaaa

SEQ ID NO: 86266 - DNA, 20 bp, Artificial sequence
  SiRNA target sequence
cccaacacttttttacaaaa

SEQ ID NO: 86267 - DNA, 20 bp, Artificial sequence
  SiRNA target sequence
ccaacacttttttacaaaaa

SEQ ID NO: 86268 - DNA, 20 bp, Artificial sequence
  SiRNA target sequence
caacacttttttacaaaaat

SEQ ID NO: 86269 - DNA, 20 bp, Artificial sequence
  SiRNA target sequence
aacacttttttacaaaaatt

SEQ ID NO: 86270 - DNA, 20 bp, Artificial sequence
  SiRNA target sequence
acacttttttacaaaaattt

SEQ ID NO: 86271 - DNA, 20 bp, Artificial sequence
  SiRNA target sequence
cacttttttacaaaaattta

SEQ ID NO: 86272 - DNA, 20 bp, Artificial sequence
  SiRNA target sequence
acttttttacaaaaatttaa

SEQ ID NO: 86273 - DNA, 20 bp, Artificial sequence
  SiRNA target sequence
cttttttacaaaaatttaat

SEQ ID NO: 86274 - DNA, 20 bp, Artificial sequence
  SiRNA target sequence
ttttttacaaaaatttaatc

SEQ ID NO: 86275 - DNA, 20 bp, Artificial sequence
  SiRNA target sequence
tttttacaaaaatttaatct

SEQ ID NO: 86276 - DNA, 20 bp, Artificial sequence
  SiRNA target sequence
ttttacaaaaatttaatcta

SEQ ID NO: 86277 - DNA, 20 bp, Artificial sequence
  SiRNA target sequence
tttacaaaaatttaatctaa

SEQ ID NO: 86278 - DNA, 20 bp, Artificial sequence
  SiRNA target sequence
ttacaaaaatttaatctaaa

SEQ ID NO: 86279 - DNA, 20 bp, Artificial sequence
  SiRNA target sequence
tacaaaaatttaatctaaat

SEQ ID NO: 86280 - DNA, 20 bp, Artificial sequence
  SiRNA target sequence
acaaaaatttaatctaaata

SEQ ID NO: 86281 - DNA, 20 bp, Artificial sequence
  SiRNA target sequence
caaaaatttaatctaaataa

SEQ ID NO: 86282 - DNA, 20 bp, Artificial sequence
  SiRNA target sequence
aaaaatttaatctaaataat

SEQ ID NO: 86283 - DNA, 20 bp, Artificial sequence
  SiRNA target sequence
aaaatttaatctaaataatt

SEQ ID NO: 86284 - DNA, 20 bp, Artificial sequence
  SiRNA target sequence
aaatttaatctaaataattt

SEQ ID NO: 86285 - DNA, 20 bp, Artificial sequence
  SiRNA target sequence
aatttaatctaaataattta

SEQ ID NO: 86286 - DNA, 20 bp, Artificial sequence
  SiRNA target sequence
atttaatctaaataatttac

SEQ ID NO: 86287 - DNA, 20 bp, Artificial sequence
  SiRNA target sequence
tttaatctaaataatttact

SEQ ID NO: 86288 - DNA, 20 bp, Artificial sequence
  SiRNA target sequence
ttaatctaaataatttactc

SEQ ID NO: 86289 - DNA, 20 bp, Artificial sequence
  SiRNA target sequence
taatctaaataatttactcg

SEQ ID NO: 86290 - DNA, 20 bp, Artificial sequence
  SiRNA target sequence
aatctaaataatttactcgg

SEQ ID NO: 86291 - DNA, 20 bp, Artificial sequence
  SiRNA target sequence
atctaaataatttactcggt

SEQ ID NO: 86292 - DNA, 20 bp, Artificial sequence
  SiRNA target sequence
tctaaataatttactcggtc

SEQ ID NO: 86293 - DNA, 20 bp, Artificial sequence
  SiRNA target sequence
ctaaataatttactcggtct

SEQ ID NO: 86294 - DNA, 20 bp, Artificial sequence
  SiRNA target sequence
taaataatttactcggtctg

SEQ ID NO: 86295 - DNA, 20 bp, Artificial sequence
  SiRNA target sequence
aaataatttactcggtctgt

SEQ ID NO: 86296 - DNA, 20 bp, Artificial sequence
  SiRNA target sequence
aataatttactcggtctgtg

SEQ ID NO: 86297 - DNA, 20 bp, Artificial sequence
  SiRNA target sequence
ataatttactcggtctgtga

SEQ ID NO: 86298 - DNA, 20 bp, Artificial sequence
  SiRNA target sequence
taatttactcggtctgtgac

SEQ ID NO: 86299 - DNA, 20 bp, Artificial sequence
  SiRNA target sequence
aatttactcggtctgtgaca

SEQ ID NO: 86300 - DNA, 20 bp, Artificial sequence
  SiRNA target sequence
atttactcggtctgtgacag

SEQ ID NO: 86301 - DNA, 20 bp, Artificial sequence
  SiRNA target sequence
tttactcggtctgtgacaga

SEQ ID NO: 86302 - DNA, 20 bp, Artificial sequence
  SiRNA target sequence
ttactcggtctgtgacagat

SEQ ID NO: 86303 - DNA, 20 bp, Artificial sequence
  SiRNA target sequence
tactcggtctgtgacagatc

SEQ ID NO: 86304 - DNA, 20 bp, Artificial sequence
  SiRNA target sequence
actcggtctgtgacagatct

SEQ ID NO: 86305 - DNA, 20 bp, Artificial sequence
  SiRNA target sequence
ctcggtctgtgacagatctt

SEQ ID NO: 86306 - DNA, 20 bp, Artificial sequence
  SiRNA target sequence
tcggtctgtgacagatcttt

SEQ ID NO: 86307 - DNA, 20 bp, Artificial sequence
  SiRNA target sequence
cggtctgtgacagatcttta

SEQ ID NO: 86308 - DNA, 20 bp, Artificial sequence
  SiRNA target sequence
ggtctgtgacagatctttaa

SEQ ID NO: 86309 - DNA, 20 bp, Artificial sequence
  SiRNA target sequence
gtctgtgacagatctttaaa

SEQ ID NO: 86310 - DNA, 20 bp, Artificial sequence
  SiRNA target sequence
tctgtgacagatctttaaat

SEQ ID NO: 86311 - DNA, 20 bp, Artificial sequence
  SiRNA target sequence
ctgtgacagatctttaaatt

SEQ ID NO: 86312 - DNA, 20 bp, Artificial sequence
  SiRNA target sequence
tgtgacagatctttaaatta

SEQ ID NO: 86313 - DNA, 20 bp, Artificial sequence
  SiRNA target sequence
gtgacagatctttaaattat

SEQ ID NO: 86314 - DNA, 20 bp, Artificial sequence
  SiRNA target sequence
tgacagatctttaaattatt

SEQ ID NO: 86315 - DNA, 20 bp, Artificial sequence
  SiRNA target sequence
gacagatctttaaattatta

SEQ ID NO: 86316 - DNA, 20 bp, Artificial sequence
  SiRNA target sequence
acagatctttaaattattat

SEQ ID NO: 86317 - DNA, 20 bp, Artificial sequence
  SiRNA target sequence
cagatctttaaattattata

SEQ ID NO: 86318 - DNA, 20 bp, Artificial sequence
  SiRNA target sequence
agatctttaaattattataa

SEQ ID NO: 86319 - DNA, 20 bp, Artificial sequence
  SiRNA target sequence
gatctttaaattattataat

SEQ ID NO: 86320 - DNA, 20 bp, Artificial sequence
  SiRNA target sequence
atctttaaattattataatt

SEQ ID NO: 86321 - DNA, 20 bp, Artificial sequence
  SiRNA target sequence
tctttaaattattataattt

SEQ ID NO: 86322 - DNA, 20 bp, Artificial sequence
  SiRNA target sequence
ctttaaattattataatttt

SEQ ID NO: 86323 - DNA, 20 bp, Artificial sequence
  SiRNA target sequence
tttaaattattataattttg

SEQ ID NO: 86324 - DNA, 20 bp, Artificial sequence
  SiRNA target sequence
ttaaattattataattttgc

SEQ ID NO: 86325 - DNA, 20 bp, Artificial sequence
  SiRNA target sequence
taaattattataattttgca

SEQ ID NO: 86326 - DNA, 20 bp, Artificial sequence
  SiRNA target sequence
aaattattataattttgcat

SEQ ID NO: 86327 - DNA, 20 bp, Artificial sequence
  SiRNA target sequence
aattattataattttgcata

SEQ ID NO: 86328 - DNA, 20 bp, Artificial sequence
  SiRNA target sequence
attattataattttgcatat

SEQ ID NO: 86329 - DNA, 20 bp, Artificial sequence
  SiRNA target sequence
ttattataattttgcatatc

SEQ ID NO: 86330 - DNA, 20 bp, Artificial sequence
  SiRNA target sequence
tattataattttgcatatct

SEQ ID NO: 86331 - DNA, 20 bp, Artificial sequence
  SiRNA target sequence
attataattttgcatatcta

SEQ ID NO: 86332 - DNA, 20 bp, Artificial sequence
  SiRNA target sequence
ttataattttgcatatctat

SEQ ID NO: 86333 - DNA, 20 bp, Artificial sequence
  SiRNA target sequence
tataattttgcatatctatg

SEQ ID NO: 86334 - DNA, 20 bp, Artificial sequence
  SiRNA target sequence
ataattttgcatatctatga

SEQ ID NO: 86335 - DNA, 20 bp, Artificial sequence
  SiRNA target sequence
taattttgcatatctatgaa

SEQ ID NO: 86336 - DNA, 20 bp, Artificial sequence
  SiRNA target sequence
aattttgcatatctatgaaa

SEQ ID NO: 86337 - DNA, 20 bp, Artificial sequence
  SiRNA target sequence
attttgcatatctatgaaat

SEQ ID NO: 86338 - DNA, 20 bp, Artificial sequence
  SiRNA target sequence
ttttgcatatctatgaaatt

SEQ ID NO: 86339 - DNA, 20 bp, Artificial sequence
  SiRNA target sequence
tttgcatatctatgaaattg

SEQ ID NO: 86340 - DNA, 20 bp, Artificial sequence
  SiRNA target sequence
ttgcatatctatgaaattgg

SEQ ID NO: 86341 - DNA, 20 bp, Artificial sequence
  SiRNA target sequence
tgcatatctatgaaattgga

SEQ ID NO: 86342 - DNA, 20 bp, Artificial sequence
  SiRNA target sequence
gcatatctatgaaattggaa

SEQ ID NO: 86343 - DNA, 20 bp, Artificial sequence
  SiRNA target sequence
catatctatgaaattggaaa

SEQ ID NO: 86344 - DNA, 20 bp, Artificial sequence
  SiRNA target sequence
atatctatgaaattggaaac

SEQ ID NO: 86345 - DNA, 20 bp, Artificial sequence
  SiRNA target sequence
tatctatgaaattggaaaca

SEQ ID NO: 86346 - DNA, 20 bp, Artificial sequence
  SiRNA target sequence
atctatgaaattggaaacat

SEQ ID NO: 86347 - DNA, 20 bp, Artificial sequence
  SiRNA target sequence
tctatgaaattggaaacatg

SEQ ID NO: 86348 - DNA, 20 bp, Artificial sequence
  SiRNA target sequence
ctatgaaattggaaacatgt

SEQ ID NO: 86349 - DNA, 20 bp, Artificial sequence
  SiRNA target sequence
tatgaaattggaaacatgtc

SEQ ID NO: 86350 - DNA, 20 bp, Artificial sequence
  SiRNA target sequence
atgaaattggaaacatgtcc

SEQ ID NO: 86351 - DNA, 20 bp, Artificial sequence
  SiRNA target sequence
tgaaattggaaacatgtcca

SEQ ID NO: 86352 - DNA, 20 bp, Artificial sequence
  SiRNA target sequence
gaaattggaaacatgtccat

SEQ ID NO: 86353 - DNA, 20 bp, Artificial sequence
  SiRNA target sequence
aaattggaaacatgtccata

SEQ ID NO: 86354 - DNA, 20 bp, Artificial sequence
  SiRNA target sequence
aattggaaacatgtccatat

SEQ ID NO: 86355 - DNA, 20 bp, Artificial sequence
  SiRNA target sequence
attggaaacatgtccatatc

SEQ ID NO: 86356 - DNA, 20 bp, Artificial sequence
  SiRNA target sequence
ttggaaacatgtccatatct

SEQ ID NO: 86357 - DNA, 20 bp, Artificial sequence
  SiRNA target sequence
tggaaacatgtccatatcta

SEQ ID NO: 86358 - DNA, 20 bp, Artificial sequence
  SiRNA target sequence
ggaaacatgtccatatctat

SEQ ID NO: 86359 - DNA, 20 bp, Artificial sequence
  SiRNA target sequence
gaaacatgtccatatctatc

SEQ ID NO: 86360 - DNA, 20 bp, Artificial sequence
  SiRNA target sequence
aaacatgtccatatctatcg

SEQ ID NO: 86361 - DNA, 20 bp, Artificial sequence
  SiRNA target sequence
aacatgtccatatctatcgc

SEQ ID NO: 86362 - DNA, 20 bp, Artificial sequence
  SiRNA target sequence
acatgtccatatctatcgcc

SEQ ID NO: 86363 - DNA, 20 bp, Artificial sequence
  SiRNA target sequence
catgtccatatctatcgcct

SEQ ID NO: 86364 - DNA, 20 bp, Artificial sequence
  SiRNA target sequence
atgtccatatctatcgcctt

SEQ ID NO: 86365 - DNA, 20 bp, Artificial sequence
  SiRNA target sequence
tgtccatatctatcgccttt

SEQ ID NO: 86366 - DNA, 20 bp, Artificial sequence
  SiRNA target sequence
gtccatatctatcgcctttt

SEQ ID NO: 86367 - DNA, 20 bp, Artificial sequence
  SiRNA target sequence
tccatatctatcgccttttt

SEQ ID NO: 86368 - DNA, 20 bp, Artificial sequence
  SiRNA target sequence
ccatatctatcgcctttttt

SEQ ID NO: 86369 - DNA, 20 bp, Artificial sequence
  SiRNA target sequence
catatctatcgcctttttta

SEQ ID NO: 86370 - DNA, 20 bp, Artificial sequence
  SiRNA target sequence
atatctatcgccttttttaa

SEQ ID NO: 86371 - DNA, 20 bp, Artificial sequence
  SiRNA target sequence
tatctatcgccttttttaat

SEQ ID NO: 86372 - DNA, 20 bp, Artificial sequence
  SiRNA target sequence
atctatcgccttttttaata

SEQ ID NO: 86373 - DNA, 20 bp, Artificial sequence
  SiRNA target sequence
tctatcgccttttttaataa

SEQ ID NO: 86374 - DNA, 20 bp, Artificial sequence
  SiRNA target sequence
ctatcgccttttttaataat

SEQ ID NO: 86375 - DNA, 20 bp, Artificial sequence
  SiRNA target sequence
tatcgccttttttaataatt

SEQ ID NO: 86376 - DNA, 20 bp, Artificial sequence
  SiRNA target sequence
atcgccttttttaataattg

SEQ ID NO: 86377 - DNA, 20 bp, Artificial sequence
  SiRNA target sequence
tcgccttttttaataattgc

SEQ ID NO: 86378 - DNA, 20 bp, Artificial sequence
  SiRNA target sequence
cgccttttttaataattgct

SEQ ID NO: 86379 - DNA, 20 bp, Artificial sequence
  SiRNA target sequence
gccttttttaataattgcta

SEQ ID NO: 86380 - DNA, 20 bp, Artificial sequence
  SiRNA target sequence
ccttttttaataattgctac

SEQ ID NO: 86381 - DNA, 20 bp, Artificial sequence
  SiRNA target sequence
cttttttaataattgctact

SEQ ID NO: 86382 - DNA, 20 bp, Artificial sequence
  SiRNA target sequence
ttttttaataattgctacta

SEQ ID NO: 86383 - DNA, 20 bp, Artificial sequence
  SiRNA target sequence
tttttaataattgctactaa

SEQ ID NO: 86384 - DNA, 20 bp, Artificial sequence
  SiRNA target sequence
ttttaataattgctactaaa

SEQ ID NO: 86385 - DNA, 20 bp, Artificial sequence
  SiRNA target sequence
tttaataattgctactaaaa

SEQ ID NO: 86386 - DNA, 20 bp, Artificial sequence
  SiRNA target sequence
ttaataattgctactaaaat

SEQ ID NO: 86387 - DNA, 20 bp, Artificial sequence
  SiRNA target sequence
taataattgctactaaaatt

SEQ ID NO: 86388 - DNA, 20 bp, Artificial sequence
  SiRNA target sequence
aataattgctactaaaattt

SEQ ID NO: 86389 - DNA, 20 bp, Artificial sequence
  SiRNA target sequence
ataattgctactaaaatttc

SEQ ID NO: 86390 - DNA, 20 bp, Artificial sequence
  SiRNA target sequence
taattgctactaaaatttca

SEQ ID NO: 86391 - DNA, 20 bp, Artificial sequence
  SiRNA target sequence
aattgctactaaaatttcac

SEQ ID NO: 86392 - DNA, 20 bp, Artificial sequence
  SiRNA target sequence
attgctactaaaatttcaca

SEQ ID NO: 86393 - DNA, 20 bp, Artificial sequence
  SiRNA target sequence
ttgctactaaaatttcacat

SEQ ID NO: 86394 - DNA, 20 bp, Artificial sequence
  SiRNA target sequence
tgctactaaaatttcacatt

SEQ ID NO: 86395 - DNA, 20 bp, Artificial sequence
  SiRNA target sequence
gctactaaaatttcacattt

SEQ ID NO: 86396 - DNA, 20 bp, Artificial sequence
  SiRNA target sequence
ctactaaaatttcacatttt

SEQ ID NO: 86397 - DNA, 20 bp, Artificial sequence
  SiRNA target sequence
tactaaaatttcacattttt

SEQ ID NO: 86398 - DNA, 20 bp, Artificial sequence
  SiRNA target sequence
actaaaatttcacatttttc

SEQ ID NO: 86399 - DNA, 20 bp, Artificial sequence
  SiRNA target sequence
ctaaaatttcacatttttca

SEQ ID NO: 86400 - DNA, 20 bp, Artificial sequence
  SiRNA target sequence
taaaatttcacatttttcat

SEQ ID NO: 86401 - DNA, 20 bp, Artificial sequence
  SiRNA target sequence
aaaatttcacatttttcatt

SEQ ID NO: 86402 - DNA, 20 bp, Artificial sequence
  SiRNA target sequence
aaatttcacatttttcattt

SEQ ID NO: 86403 - DNA, 20 bp, Artificial sequence
  SiRNA target sequence
aatttcacatttttcattta

SEQ ID NO: 86404 - DNA, 20 bp, Artificial sequence
  SiRNA target sequence
atttcacatttttcatttac

SEQ ID NO: 86405 - DNA, 20 bp, Artificial sequence
  SiRNA target sequence
tttcacatttttcatttacg

SEQ ID NO: 86406 - DNA, 20 bp, Artificial sequence
  SiRNA target sequence
ttcacatttttcatttacgt

SEQ ID NO: 86407 - DNA, 20 bp, Artificial sequence
  SiRNA target sequence
tcacatttttcatttacgtg

SEQ ID NO: 86408 - DNA, 20 bp, Artificial sequence
  SiRNA target sequence
cacatttttcatttacgtgg

SEQ ID NO: 86409 - DNA, 20 bp, Artificial sequence
  SiRNA target sequence
acatttttcatttacgtggt

SEQ ID NO: 86410 - DNA, 20 bp, Artificial sequence
  SiRNA target sequence
catttttcatttacgtggtt

SEQ ID NO: 86411 - DNA, 20 bp, Artificial sequence
  SiRNA target sequence
atttttcatttacgtggtta

SEQ ID NO: 86412 - DNA, 20 bp, Artificial sequence
  SiRNA target sequence
tttttcatttacgtggttag

SEQ ID NO: 86413 - DNA, 20 bp, Artificial sequence
  SiRNA target sequence
ttttcatttacgtggttagt

SEQ ID NO: 86414 - DNA, 20 bp, Artificial sequence
  SiRNA target sequence
tttcatttacgtggttagta

SEQ ID NO: 86415 - DNA, 20 bp, Artificial sequence
  SiRNA target sequence
ttcatttacgtggttagtaa

SEQ ID NO: 86416 - DNA, 20 bp, Artificial sequence
  SiRNA target sequence
tcatttacgtggttagtaag

SEQ ID NO: 86417 - DNA, 20 bp, Artificial sequence
  SiRNA target sequence
catttacgtggttagtaagt

SEQ ID NO: 86418 - DNA, 20 bp, Artificial sequence
  SiRNA target sequence
atttacgtggttagtaagtg

SEQ ID NO: 86419 - DNA, 20 bp, Artificial sequence
  SiRNA target sequence
tttacgtggttagtaagtga

SEQ ID NO: 86420 - DNA, 20 bp, Artificial sequence
  SiRNA target sequence
ttacgtggttagtaagtgaa

SEQ ID NO: 86421 - DNA, 20 bp, Artificial sequence
  SiRNA target sequence
tacgtggttagtaagtgaat

SEQ ID NO: 86422 - DNA, 20 bp, Artificial sequence
  SiRNA target sequence
acgtggttagtaagtgaata

SEQ ID NO: 86423 - DNA, 20 bp, Artificial sequence
  SiRNA target sequence
cgtggttagtaagtgaataa

SEQ ID NO: 86424 - DNA, 20 bp, Artificial sequence
  SiRNA target sequence
gtggttagtaagtgaataat

SEQ ID NO: 86425 - DNA, 20 bp, Artificial sequence
  SiRNA target sequence
tggttagtaagtgaataata

SEQ ID NO: 86426 - DNA, 20 bp, Artificial sequence
  SiRNA target sequence
ggttagtaagtgaataatat

SEQ ID NO: 86427 - DNA, 20 bp, Artificial sequence
  SiRNA target sequence
gttagtaagtgaataatatc

SEQ ID NO: 86428 - DNA, 20 bp, Artificial sequence
  SiRNA target sequence
ttagtaagtgaataatatct

SEQ ID NO: 86429 - DNA, 20 bp, Artificial sequence
  SiRNA target sequence
tagtaagtgaataatatctt

SEQ ID NO: 86430 - DNA, 20 bp, Artificial sequence
  SiRNA target sequence
agtaagtgaataatatcttg

SEQ ID NO: 86431 - DNA, 20 bp, Artificial sequence
  SiRNA target sequence
gtaagtgaataatatcttgg

SEQ ID NO: 86432 - DNA, 20 bp, Artificial sequence
  SiRNA target sequence
taagtgaataatatcttggc

SEQ ID NO: 86433 - DNA, 20 bp, Artificial sequence
  SiRNA target sequence
aagtgaataatatcttggct

SEQ ID NO: 86434 - DNA, 20 bp, Artificial sequence
  SiRNA target sequence
agtgaataatatcttggctt

SEQ ID NO: 86435 - DNA, 20 bp, Artificial sequence
  SiRNA target sequence
gtgaataatatcttggctta

SEQ ID NO: 86436 - DNA, 20 bp, Artificial sequence
  SiRNA target sequence
tgaataatatcttggcttaa

SEQ ID NO: 86437 - DNA, 20 bp, Artificial sequence
  SiRNA target sequence
gaataatatcttggcttaat

SEQ ID NO: 86438 - DNA, 20 bp, Artificial sequence
  SiRNA target sequence
aataatatcttggcttaatt

SEQ ID NO: 86439 - DNA, 20 bp, Artificial sequence
  SiRNA target sequence
ataatatcttggcttaattg

SEQ ID NO: 86440 - DNA, 20 bp, Artificial sequence
  SiRNA target sequence
taatatcttggcttaattgt

SEQ ID NO: 86441 - DNA, 20 bp, Artificial sequence
  SiRNA target sequence
aatatcttggcttaattgtt

SEQ ID NO: 86442 - DNA, 20 bp, Artificial sequence
  SiRNA target sequence
atatcttggcttaattgttt

SEQ ID NO: 86443 - DNA, 20 bp, Artificial sequence
  SiRNA target sequence
tatcttggcttaattgtttg

SEQ ID NO: 86444 - DNA, 20 bp, Artificial sequence
  SiRNA target sequence
atcttggcttaattgtttga

SEQ ID NO: 86445 - DNA, 20 bp, Artificial sequence
  SiRNA target sequence
tcttggcttaattgtttgac

SEQ ID NO: 86446 - DNA, 20 bp, Artificial sequence
  SiRNA target sequence
cttggcttaattgtttgaca

SEQ ID NO: 86447 - DNA, 20 bp, Artificial sequence
  SiRNA target sequence
ttggcttaattgtttgacaa

SEQ ID NO: 86448 - DNA, 20 bp, Artificial sequence
  SiRNA target sequence
tggcttaattgtttgacaat

SEQ ID NO: 86449 - DNA, 20 bp, Artificial sequence
  SiRNA target sequence
ggcttaattgtttgacaatt

SEQ ID NO: 86450 - DNA, 20 bp, Artificial sequence
  SiRNA target sequence
gcttaattgtttgacaattc

SEQ ID NO: 86451 - DNA, 20 bp, Artificial sequence
  SiRNA target sequence
cttaattgtttgacaattca

SEQ ID NO: 86452 - DNA, 20 bp, Artificial sequence
  SiRNA target sequence
ttaattgtttgacaattcat

SEQ ID NO: 86453 - DNA, 20 bp, Artificial sequence
  SiRNA target sequence
taattgtttgacaattcata

SEQ ID NO: 86454 - DNA, 20 bp, Artificial sequence
  SiRNA target sequence
aattgtttgacaattcataa

SEQ ID NO: 86455 - DNA, 20 bp, Artificial sequence
  SiRNA target sequence
attgtttgacaattcataat

SEQ ID NO: 86456 - DNA, 20 bp, Artificial sequence
  SiRNA target sequence
ttgtttgacaattcataata

SEQ ID NO: 86457 - DNA, 20 bp, Artificial sequence
  SiRNA target sequence
tgtttgacaattcataataa

SEQ ID NO: 86458 - DNA, 20 bp, Artificial sequence
  SiRNA target sequence
gtttgacaattcataataag

SEQ ID NO: 86459 - DNA, 20 bp, Artificial sequence
  SiRNA target sequence
tttgacaattcataataaga

SEQ ID NO: 86460 - DNA, 20 bp, Artificial sequence
  SiRNA target sequence
ttgacaattcataataagat

SEQ ID NO: 86461 - DNA, 20 bp, Artificial sequence
  SiRNA target sequence
tgacaattcataataagatc

SEQ ID NO: 86462 - DNA, 20 bp, Artificial sequence
  SiRNA target sequence
gacaattcataataagatcc

SEQ ID NO: 86463 - DNA, 20 bp, Artificial sequence
  SiRNA target sequence
acaattcataataagatcct

SEQ ID NO: 86464 - DNA, 20 bp, Artificial sequence
  SiRNA target sequence
caattcataataagatcctc

SEQ ID NO: 86465 - DNA, 20 bp, Artificial sequence
  SiRNA target sequence
aattcataataagatcctct

SEQ ID NO: 86466 - DNA, 20 bp, Artificial sequence
  SiRNA target sequence
attcataataagatcctcta

SEQ ID NO: 86467 - DNA, 20 bp, Artificial sequence
  SiRNA target sequence
ttcataataagatcctctaa

SEQ ID NO: 86468 - DNA, 20 bp, Artificial sequence
  SiRNA target sequence
tcataataagatcctctaaa

SEQ ID NO: 86469 - DNA, 20 bp, Artificial sequence
  SiRNA target sequence
cataataagatcctctaaac

SEQ ID NO: 86470 - DNA, 20 bp, Artificial sequence
  SiRNA target sequence
ataataagatcctctaaact

SEQ ID NO: 86471 - DNA, 20 bp, Artificial sequence
  SiRNA target sequence
taataagatcctctaaactt

SEQ ID NO: 86472 - DNA, 20 bp, Artificial sequence
  SiRNA target sequence
aataagatcctctaaacttg

SEQ ID NO: 86473 - DNA, 20 bp, Artificial sequence
  SiRNA target sequence
ataagatcctctaaacttgg

SEQ ID NO: 86474 - DNA, 20 bp, Artificial sequence
  SiRNA target sequence
taagatcctctaaacttggt

SEQ ID NO: 86475 - DNA, 20 bp, Artificial sequence
  SiRNA target sequence
aagatcctctaaacttggtt

SEQ ID NO: 86476 - DNA, 20 bp, Artificial sequence
  SiRNA target sequence
agatcctctaaacttggttt

SEQ ID NO: 86477 - DNA, 20 bp, Artificial sequence
  SiRNA target sequence
gatcctctaaacttggttta

SEQ ID NO: 86478 - DNA, 20 bp, Artificial sequence
  SiRNA target sequence
atcctctaaacttggtttac

SEQ ID NO: 86479 - DNA, 20 bp, Artificial sequence
  SiRNA target sequence
tcctctaaacttggtttaca

SEQ ID NO: 86480 - DNA, 20 bp, Artificial sequence
  SiRNA target sequence
cctctaaacttggtttacat

SEQ ID NO: 86481 - DNA, 20 bp, Artificial sequence
  SiRNA target sequence
ctctaaacttggtttacatt

SEQ ID NO: 86482 - DNA, 20 bp, Artificial sequence
  SiRNA target sequence
tctaaacttggtttacattg

SEQ ID NO: 86483 - DNA, 20 bp, Artificial sequence
  SiRNA target sequence
ctaaacttggtttacattga

SEQ ID NO: 86484 - DNA, 20 bp, Artificial sequence
  SiRNA target sequence
taaacttggtttacattgaa

SEQ ID NO: 86485 - DNA, 20 bp, Artificial sequence
  SiRNA target sequence
aaacttggtttacattgaaa

SEQ ID NO: 86486 - DNA, 20 bp, Artificial sequence
  SiRNA target sequence
aacttggtttacattgaaat

SEQ ID NO: 86487 - DNA, 20 bp, Artificial sequence
  SiRNA target sequence
acttggtttacattgaaatg

SEQ ID NO: 86488 - DNA, 20 bp, Artificial sequence
  SiRNA target sequence
cttggtttacattgaaatgt

SEQ ID NO: 86489 - DNA, 20 bp, Artificial sequence
  SiRNA target sequence
ttggtttacattgaaatgta

SEQ ID NO: 86490 - DNA, 20 bp, Artificial sequence
  SiRNA target sequence
tggtttacattgaaatgtat

SEQ ID NO: 86491 - DNA, 20 bp, Artificial sequence
  SiRNA target sequence
ggtttacattgaaatgtata

SEQ ID NO: 86492 - DNA, 20 bp, Artificial sequence
  SiRNA target sequence
gtttacattgaaatgtatat

SEQ ID NO: 86493 - DNA, 20 bp, Artificial sequence
  SiRNA target sequence
tttacattgaaatgtatata

SEQ ID NO: 86494 - DNA, 20 bp, Artificial sequence
  SiRNA target sequence
ttacattgaaatgtatatat

SEQ ID NO: 86495 - DNA, 20 bp, Artificial sequence
  SiRNA target sequence
tacattgaaatgtatatata

SEQ ID NO: 86496 - DNA, 20 bp, Artificial sequence
  SiRNA target sequence
acattgaaatgtatatataa

SEQ ID NO: 86497 - DNA, 20 bp, Artificial sequence
  SiRNA target sequence
cattgaaatgtatatataat

SEQ ID NO: 86498 - DNA, 20 bp, Artificial sequence
  SiRNA target sequence
attgaaatgtatatataatg

SEQ ID NO: 86499 - DNA, 20 bp, Artificial sequence
  SiRNA target sequence
ttgaaatgtatatataatgt

SEQ ID NO: 86500 - DNA, 20 bp, Artificial sequence
  SiRNA target sequence
tgaaatgtatatataatgtc

SEQ ID NO: 86501 - DNA, 20 bp, Artificial sequence
  SiRNA target sequence
gaaatgtatatataatgtca

SEQ ID NO: 86502 - DNA, 20 bp, Artificial sequence
  SiRNA target sequence
aaatgtatatataatgtcaa

SEQ ID NO: 86503 - DNA, 20 bp, Artificial sequence
  SiRNA target sequence
aatgtatatataatgtcaag

SEQ ID NO: 86504 - DNA, 20 bp, Artificial sequence
  SiRNA target sequence
atgtatatataatgtcaagc

SEQ ID NO: 86505 - DNA, 20 bp, Artificial sequence
  SiRNA target sequence
tgtatatataatgtcaagca

SEQ ID NO: 86506 - DNA, 20 bp, Artificial sequence
  SiRNA target sequence
gtatatataatgtcaagcac

SEQ ID NO: 86507 - DNA, 20 bp, Artificial sequence
  SiRNA target sequence
tatatataatgtcaagcaca

SEQ ID NO: 86508 - DNA, 20 bp, Artificial sequence
  SiRNA target sequence
atatataatgtcaagcacat

SEQ ID NO: 86509 - DNA, 20 bp, Artificial sequence
  SiRNA target sequence
tatataatgtcaagcacatt

SEQ ID NO: 86510 - DNA, 20 bp, Artificial sequence
  SiRNA target sequence
atataatgtcaagcacatta

SEQ ID NO: 86511 - DNA, 20 bp, Artificial sequence
  SiRNA target sequence
tataatgtcaagcacattat

SEQ ID NO: 86512 - DNA, 20 bp, Artificial sequence
  SiRNA target sequence
ataatgtcaagcacattatt

SEQ ID NO: 86513 - DNA, 20 bp, Artificial sequence
  SiRNA target sequence
taatgtcaagcacattattc

SEQ ID NO: 86514 - DNA, 20 bp, Artificial sequence
  SiRNA target sequence
aatgtcaagcacattattcc

SEQ ID NO: 86515 - DNA, 20 bp, Artificial sequence
  SiRNA target sequence
atgtcaagcacattattcca

SEQ ID NO: 86516 - DNA, 20 bp, Artificial sequence
  SiRNA target sequence
tgtcaagcacattattccag

SEQ ID NO: 86517 - DNA, 20 bp, Artificial sequence
  SiRNA target sequence
gtcaagcacattattccagt

SEQ ID NO: 86518 - DNA, 20 bp, Artificial sequence
  SiRNA target sequence
tcaagcacattattccagtt

SEQ ID NO: 86519 - DNA, 20 bp, Artificial sequence
  SiRNA target sequence
caagcacattattccagttc

SEQ ID NO: 86520 - DNA, 20 bp, Artificial sequence
  SiRNA target sequence
aagcacattattccagttct

SEQ ID NO: 86521 - DNA, 20 bp, Artificial sequence
  SiRNA target sequence
agcacattattccagttctt

SEQ ID NO: 86522 - DNA, 20 bp, Artificial sequence
  SiRNA target sequence
gcacattattccagttctta

SEQ ID NO: 86523 - DNA, 20 bp, Artificial sequence
  SiRNA target sequence
cacattattccagttcttaa

SEQ ID NO: 86524 - DNA, 20 bp, Artificial sequence
  SiRNA target sequence
acattattccagttcttaat

SEQ ID NO: 86525 - DNA, 20 bp, Artificial sequence
  SiRNA target sequence
cattattccagttcttaatg

SEQ ID NO: 86526 - DNA, 20 bp, Artificial sequence
  SiRNA target sequence
attattccagttcttaatga

SEQ ID NO: 86527 - DNA, 20 bp, Artificial sequence
  SiRNA target sequence
ttattccagttcttaatgat

SEQ ID NO: 86528 - DNA, 20 bp, Artificial sequence
  SiRNA target sequence
tattccagttcttaatgatg

SEQ ID NO: 86529 - DNA, 20 bp, Artificial sequence
  SiRNA target sequence
attccagttcttaatgatgc

SEQ ID NO: 86530 - DNA, 20 bp, Artificial sequence
  SiRNA target sequence
ttccagttcttaatgatgct

SEQ ID NO: 86531 - DNA, 20 bp, Artificial sequence
  SiRNA target sequence
tccagttcttaatgatgctt

SEQ ID NO: 86532 - DNA, 20 bp, Artificial sequence
  SiRNA target sequence
ccagttcttaatgatgctta

SEQ ID NO: 86533 - DNA, 20 bp, Artificial sequence
  SiRNA target sequence
cagttcttaatgatgcttaa

SEQ ID NO: 86534 - DNA, 20 bp, Artificial sequence
  SiRNA target sequence
agttcttaatgatgcttaaa

SEQ ID NO: 86535 - DNA, 20 bp, Artificial sequence
  SiRNA target sequence
gttcttaatgatgcttaaat

SEQ ID NO: 86536 - DNA, 20 bp, Artificial sequence
  SiRNA target sequence
ttcttaatgatgcttaaata

SEQ ID NO: 86537 - DNA, 20 bp, Artificial sequence
  SiRNA target sequence
tcttaatgatgcttaaataa

SEQ ID NO: 86538 - DNA, 20 bp, Artificial sequence
  SiRNA target sequence
cttaatgatgcttaaataat

SEQ ID NO: 86539 - DNA, 20 bp, Artificial sequence
  SiRNA target sequence
ttaatgatgcttaaataatc

SEQ ID NO: 86540 - DNA, 20 bp, Artificial sequence
  SiRNA target sequence
taatgatgcttaaataatct

SEQ ID NO: 86541 - DNA, 20 bp, Artificial sequence
  SiRNA target sequence
aatgatgcttaaataatctt

SEQ ID NO: 86542 - DNA, 20 bp, Artificial sequence
  SiRNA target sequence
atgatgcttaaataatcttt

SEQ ID NO: 86543 - DNA, 20 bp, Artificial sequence
  SiRNA target sequence
tgatgcttaaataatctttt

SEQ ID NO: 86544 - DNA, 20 bp, Artificial sequence
  SiRNA target sequence
gatgcttaaataatctttta

SEQ ID NO: 86545 - DNA, 20 bp, Artificial sequence
  SiRNA target sequence
atgcttaaataatcttttac

SEQ ID NO: 86546 - DNA, 20 bp, Artificial sequence
  SiRNA target sequence
tgcttaaataatcttttact

SEQ ID NO: 86547 - DNA, 20 bp, Artificial sequence
  SiRNA target sequence
gcttaaataatcttttactc

SEQ ID NO: 86548 - DNA, 20 bp, Artificial sequence
  SiRNA target sequence
cttaaataatcttttactcc

SEQ ID NO: 86549 - DNA, 20 bp, Artificial sequence
  SiRNA target sequence
ttaaataatcttttactcct

SEQ ID NO: 86550 - DNA, 20 bp, Artificial sequence
  SiRNA target sequence
taaataatcttttactcctt

SEQ ID NO: 86551 - DNA, 20 bp, Artificial sequence
  SiRNA target sequence
aaataatcttttactccttc

SEQ ID NO: 86552 - DNA, 20 bp, Artificial sequence
  SiRNA target sequence
aataatcttttactccttct

SEQ ID NO: 86553 - DNA, 20 bp, Artificial sequence
  SiRNA target sequence
ataatcttttactccttctt

SEQ ID NO: 86554 - DNA, 20 bp, Artificial sequence
  SiRNA target sequence
taatcttttactccttcttt

SEQ ID NO: 86555 - DNA, 20 bp, Artificial sequence
  SiRNA target sequence
aatcttttactccttcttta

SEQ ID NO: 86556 - DNA, 20 bp, Artificial sequence
  SiRNA target sequence
atcttttactccttctttag

SEQ ID NO: 86557 - DNA, 20 bp, Artificial sequence
  SiRNA target sequence
tcttttactccttctttaga

SEQ ID NO: 86558 - DNA, 20 bp, Artificial sequence
  SiRNA target sequence
cttttactccttctttagaa

SEQ ID NO: 86559 - DNA, 20 bp, Artificial sequence
  SiRNA target sequence
ttttactccttctttagaac

SEQ ID NO: 86560 - DNA, 20 bp, Artificial sequence
  SiRNA target sequence
tttactccttctttagaaca

SEQ ID NO: 86561 - DNA, 20 bp, Artificial sequence
  SiRNA target sequence
ttactccttctttagaacac

SEQ ID NO: 86562 - DNA, 20 bp, Artificial sequence
  SiRNA target sequence
tactccttctttagaacaca

SEQ ID NO: 86563 - DNA, 20 bp, Artificial sequence
  SiRNA target sequence
actccttctttagaacacag

SEQ ID NO: 86564 - DNA, 20 bp, Artificial sequence
  SiRNA target sequence
ctccttctttagaacacaga

SEQ ID NO: 86565 - DNA, 20 bp, Artificial sequence
  SiRNA target sequence
tccttctttagaacacagat

SEQ ID NO: 86566 - DNA, 20 bp, Artificial sequence
  SiRNA target sequence
ccttctttagaacacagata

SEQ ID NO: 86567 - DNA, 20 bp, Artificial sequence
  SiRNA target sequence
cttctttagaacacagatat

SEQ ID NO: 86568 - DNA, 20 bp, Artificial sequence
  SiRNA target sequence
ttctttagaacacagatatt

SEQ ID NO: 86569 - DNA, 20 bp, Artificial sequence
  SiRNA target sequence
tctttagaacacagatattc

SEQ ID NO: 86570 - DNA, 20 bp, Artificial sequence
  SiRNA target sequence
ctttagaacacagatattca

SEQ ID NO: 86571 - DNA, 20 bp, Artificial sequence
  SiRNA target sequence
tttagaacacagatattcaa

SEQ ID NO: 86572 - DNA, 20 bp, Artificial sequence
  SiRNA target sequence
ttagaacacagatattcaat

SEQ ID NO: 86573 - DNA, 20 bp, Artificial sequence
  SiRNA target sequence
tagaacacagatattcaata

SEQ ID NO: 86574 - DNA, 20 bp, Artificial sequence
  SiRNA target sequence
agaacacagatattcaatat

SEQ ID NO: 86575 - DNA, 20 bp, Artificial sequence
  SiRNA target sequence
gaacacagatattcaatatc

SEQ ID NO: 86576 - DNA, 20 bp, Artificial sequence
  SiRNA target sequence
aacacagatattcaatatca

SEQ ID NO: 86577 - DNA, 20 bp, Artificial sequence
  SiRNA target sequence
acacagatattcaatatcat

SEQ ID NO: 86578 - DNA, 20 bp, Artificial sequence
  SiRNA target sequence
cacagatattcaatatcatg

SEQ ID NO: 86579 - DNA, 20 bp, Artificial sequence
  SiRNA target sequence
acagatattcaatatcatgc

SEQ ID NO: 86580 - DNA, 20 bp, Artificial sequence
  SiRNA target sequence
cagatattcaatatcatgct

SEQ ID NO: 86581 - DNA, 20 bp, Artificial sequence
  SiRNA target sequence
agatattcaatatcatgctt

SEQ ID NO: 86582 - DNA, 20 bp, Artificial sequence
  SiRNA target sequence
gatattcaatatcatgctta

SEQ ID NO: 86583 - DNA, 20 bp, Artificial sequence
  SiRNA target sequence
atattcaatatcatgcttat

SEQ ID NO: 86584 - DNA, 20 bp, Artificial sequence
  SiRNA target sequence
tattcaatatcatgcttatt

SEQ ID NO: 86585 - DNA, 20 bp, Artificial sequence
  SiRNA target sequence
attcaatatcatgcttattt

SEQ ID NO: 86586 - DNA, 20 bp, Artificial sequence
  SiRNA target sequence
ttcaatatcatgcttatttt

SEQ ID NO: 86587 - DNA, 20 bp, Artificial sequence
  SiRNA target sequence
tcaatatcatgcttattttt

SEQ ID NO: 86588 - DNA, 20 bp, Artificial sequence
  SiRNA target sequence
caatatcatgcttattttta

SEQ ID NO: 86589 - DNA, 20 bp, Artificial sequence
  SiRNA target sequence
aatatcatgcttatttttag

SEQ ID NO: 86590 - DNA, 20 bp, Artificial sequence
  SiRNA target sequence
atatcatgcttatttttaga

SEQ ID NO: 86591 - DNA, 20 bp, Artificial sequence
  SiRNA target sequence
tatcatgcttatttttagag

SEQ ID NO: 86592 - DNA, 20 bp, Artificial sequence
  SiRNA target sequence
atcatgcttatttttagagg

SEQ ID NO: 86593 - DNA, 20 bp, Artificial sequence
  SiRNA target sequence
tcatgcttatttttagaggt

SEQ ID NO: 86594 - DNA, 20 bp, Artificial sequence
  SiRNA target sequence
catgcttatttttagaggtt

SEQ ID NO: 86595 - DNA, 20 bp, Artificial sequence
  SiRNA target sequence
atgcttatttttagaggttt

SEQ ID NO: 86596 - DNA, 20 bp, Artificial sequence
  SiRNA target sequence
tgcttatttttagaggtttt

SEQ ID NO: 86597 - DNA, 20 bp, Artificial sequence
  SiRNA target sequence
gcttatttttagaggtttta

SEQ ID NO: 86598 - DNA, 20 bp, Artificial sequence
  SiRNA target sequence
cttatttttagaggttttag

SEQ ID NO: 86599 - DNA, 20 bp, Artificial sequence
  SiRNA target sequence
ttatttttagaggttttaga

SEQ ID NO: 86600 - DNA, 20 bp, Artificial sequence
  SiRNA target sequence
tatttttagaggttttagaa

SEQ ID NO: 86601 - DNA, 20 bp, Artificial sequence
  SiRNA target sequence
atttttagaggttttagaaa

SEQ ID NO: 86602 - DNA, 20 bp, Artificial sequence
  SiRNA target sequence
tttttagaggttttagaaat

SEQ ID NO: 86603 - DNA, 20 bp, Artificial sequence
  SiRNA target sequence
ttttagaggttttagaaata

SEQ ID NO: 86604 - DNA, 20 bp, Artificial sequence
  SiRNA target sequence
tttagaggttttagaaatat

SEQ ID NO: 86605 - DNA, 20 bp, Artificial sequence
  SiRNA target sequence
ttagaggttttagaaatatc

SEQ ID NO: 86606 - DNA, 20 bp, Artificial sequence
  SiRNA target sequence
tagaggttttagaaatatcc

SEQ ID NO: 86607 - DNA, 20 bp, Artificial sequence
  SiRNA target sequence
agaggttttagaaatatcca

SEQ ID NO: 86608 - DNA, 20 bp, Artificial sequence
  SiRNA target sequence
gaggttttagaaatatccat

SEQ ID NO: 86609 - DNA, 20 bp, Artificial sequence
  SiRNA target sequence
aggttttagaaatatccata

SEQ ID NO: 86610 - DNA, 20 bp, Artificial sequence
  SiRNA target sequence
ggttttagaaatatccataa

SEQ ID NO: 86611 - DNA, 20 bp, Artificial sequence
  SiRNA target sequence
gttttagaaatatccataag

SEQ ID NO: 86612 - DNA, 20 bp, Artificial sequence
  SiRNA target sequence
ttttagaaatatccataagc

SEQ ID NO: 86613 - DNA, 20 bp, Artificial sequence
  SiRNA target sequence
tttagaaatatccataagcc

SEQ ID NO: 86614 - DNA, 20 bp, Artificial sequence
  SiRNA target sequence
ttagaaatatccataagcca

SEQ ID NO: 86615 - DNA, 20 bp, Artificial sequence
  SiRNA target sequence
tagaaatatccataagccat

SEQ ID NO: 86616 - DNA, 20 bp, Artificial sequence
  SiRNA target sequence
agaaatatccataagccatg

SEQ ID NO: 86617 - DNA, 20 bp, Artificial sequence
  SiRNA target sequence
gaaatatccataagccatgc

SEQ ID NO: 86618 - DNA, 20 bp, Artificial sequence
  SiRNA target sequence
aaatatccataagccatgct

SEQ ID NO: 86619 - DNA, 20 bp, Artificial sequence
  SiRNA target sequence
aatatccataagccatgctt

SEQ ID NO: 86620 - DNA, 20 bp, Artificial sequence
  SiRNA target sequence
atatccataagccatgcttt

SEQ ID NO: 86621 - DNA, 20 bp, Artificial sequence
  SiRNA target sequence
tatccataagccatgctttt

SEQ ID NO: 86622 - DNA, 20 bp, Artificial sequence
  SiRNA target sequence
atccataagccatgcttttt

SEQ ID NO: 86623 - DNA, 20 bp, Artificial sequence
  SiRNA target sequence
tccataagccatgctttttt

SEQ ID NO: 86624 - DNA, 20 bp, Artificial sequence
  SiRNA target sequence
ccataagccatgctttttta

SEQ ID NO: 86625 - DNA, 20 bp, Artificial sequence
  SiRNA target sequence
cataagccatgcttttttag

SEQ ID NO: 86626 - DNA, 20 bp, Artificial sequence
  SiRNA target sequence
ataagccatgcttttttagg

SEQ ID NO: 86627 - DNA, 20 bp, Artificial sequence
  SiRNA target sequence
taagccatgcttttttaggc

SEQ ID NO: 86628 - DNA, 20 bp, Artificial sequence
  SiRNA target sequence
aagccatgcttttttaggca

SEQ ID NO: 86629 - DNA, 20 bp, Artificial sequence
  SiRNA target sequence
agccatgcttttttaggcaa

SEQ ID NO: 86630 - DNA, 20 bp, Artificial sequence
  SiRNA target sequence
gccatgcttttttaggcaat

SEQ ID NO: 86631 - DNA, 20 bp, Artificial sequence
  SiRNA target sequence
ccatgcttttttaggcaatg

SEQ ID NO: 86632 - DNA, 20 bp, Artificial sequence
  SiRNA target sequence
catgcttttttaggcaatga

SEQ ID NO: 86633 - DNA, 20 bp, Artificial sequence
  SiRNA target sequence
atgcttttttaggcaatgaa

SEQ ID NO: 86634 - DNA, 20 bp, Artificial sequence
  SiRNA target sequence
tgcttttttaggcaatgaag

SEQ ID NO: 86635 - DNA, 20 bp, Artificial sequence
  SiRNA target sequence
gcttttttaggcaatgaagt

SEQ ID NO: 86636 - DNA, 20 bp, Artificial sequence
  SiRNA target sequence
cttttttaggcaatgaagta

SEQ ID NO: 86637 - DNA, 20 bp, Artificial sequence
  SiRNA target sequence
ttttttaggcaatgaagtaa

SEQ ID NO: 86638 - DNA, 20 bp, Artificial sequence
  SiRNA target sequence
tttttaggcaatgaagtaaa

SEQ ID NO: 86639 - DNA, 20 bp, Artificial sequence
  SiRNA target sequence
ttttaggcaatgaagtaaaa

SEQ ID NO: 86640 - DNA, 20 bp, Artificial sequence
  SiRNA target sequence
tttaggcaatgaagtaaaat

SEQ ID NO: 86641 - DNA, 20 bp, Artificial sequence
  SiRNA target sequence
ttaggcaatgaagtaaaatc

SEQ ID NO: 86642 - DNA, 20 bp, Artificial sequence
  SiRNA target sequence
taggcaatgaagtaaaatca

SEQ ID NO: 86643 - DNA, 20 bp, Artificial sequence
  SiRNA target sequence
aggcaatgaagtaaaatcaa

SEQ ID NO: 86644 - DNA, 20 bp, Artificial sequence
  SiRNA target sequence
ggcaatgaagtaaaatcaaa

SEQ ID NO: 86645 - DNA, 20 bp, Artificial sequence
  SiRNA target sequence
gcaatgaagtaaaatcaaaa

SEQ ID NO: 86646 - DNA, 20 bp, Artificial sequence
  SiRNA target sequence
caatgaagtaaaatcaaaaa

SEQ ID NO: 86647 - DNA, 20 bp, Artificial sequence
  SiRNA target sequence
aatgaagtaaaatcaaaaat

SEQ ID NO: 86648 - DNA, 20 bp, Artificial sequence
  SiRNA target sequence
atgaagtaaaatcaaaaata

SEQ ID NO: 86649 - DNA, 20 bp, Artificial sequence
  SiRNA target sequence
tgaagtaaaatcaaaaatat

SEQ ID NO: 86650 - DNA, 20 bp, Artificial sequence
  SiRNA target sequence
gaagtaaaatcaaaaatata

SEQ ID NO: 86651 - DNA, 20 bp, Artificial sequence
  SiRNA target sequence
aagtaaaatcaaaaatatac

SEQ ID NO: 86652 - DNA, 20 bp, Artificial sequence
  SiRNA target sequence
agtaaaatcaaaaatatact

SEQ ID NO: 86653 - DNA, 20 bp, Artificial sequence
  SiRNA target sequence
gtaaaatcaaaaatatactt

SEQ ID NO: 86654 - DNA, 20 bp, Artificial sequence
  SiRNA target sequence
taaaatcaaaaatatacttg

SEQ ID NO: 86655 - DNA, 20 bp, Artificial sequence
  SiRNA target sequence
aaaatcaaaaatatacttga

SEQ ID NO: 86656 - DNA, 20 bp, Artificial sequence
  SiRNA target sequence
aaatcaaaaatatacttgaa

SEQ ID NO: 86657 - DNA, 20 bp, Artificial sequence
  SiRNA target sequence
aatcaaaaatatacttgaaa

SEQ ID NO: 86658 - DNA, 20 bp, Artificial sequence
  SiRNA target sequence
atcaaaaatatacttgaaaa

SEQ ID NO: 86659 - DNA, 20 bp, Artificial sequence
  SiRNA target sequence
tcaaaaatatacttgaaaaa

SEQ ID NO: 86660 - DNA, 20 bp, Artificial sequence
  SiRNA target sequence
caaaaatatacttgaaaaag

SEQ ID NO: 86661 - DNA, 20 bp, Artificial sequence
  SiRNA target sequence
aaaaatatacttgaaaaagt

SEQ ID NO: 86662 - DNA, 20 bp, Artificial sequence
  SiRNA target sequence
aaaatatacttgaaaaagtc

SEQ ID NO: 86663 - DNA, 20 bp, Artificial sequence
  SiRNA target sequence
aaatatacttgaaaaagtca

SEQ ID NO: 86664 - DNA, 20 bp, Artificial sequence
  SiRNA target sequence
aatatacttgaaaaagtcac

SEQ ID NO: 86665 - DNA, 20 bp, Artificial sequence
  SiRNA target sequence
atatacttgaaaaagtcacg

SEQ ID NO: 86666 - DNA, 20 bp, Artificial sequence
  SiRNA target sequence
tatacttgaaaaagtcacgc

SEQ ID NO: 86667 - DNA, 20 bp, Artificial sequence
  SiRNA target sequence
atacttgaaaaagtcacgca

SEQ ID NO: 86668 - DNA, 20 bp, Artificial sequence
  SiRNA target sequence
tacttgaaaaagtcacgcaa

SEQ ID NO: 86669 - DNA, 20 bp, Artificial sequence
  SiRNA target sequence
acttgaaaaagtcacgcaaa

SEQ ID NO: 86670 - DNA, 20 bp, Artificial sequence
  SiRNA target sequence
cttgaaaaagtcacgcaaag

SEQ ID NO: 86671 - DNA, 20 bp, Artificial sequence
  SiRNA target sequence
ttgaaaaagtcacgcaaaga

SEQ ID NO: 86672 - DNA, 20 bp, Artificial sequence
  SiRNA target sequence
tgaaaaagtcacgcaaagat

SEQ ID NO: 86673 - DNA, 20 bp, Artificial sequence
  SiRNA target sequence
gaaaaagtcacgcaaagatc

SEQ ID NO: 86674 - DNA, 20 bp, Artificial sequence
  SiRNA target sequence
aaaaagtcacgcaaagatcc

SEQ ID NO: 86675 - DNA, 20 bp, Artificial sequence
  SiRNA target sequence
aaaagtcacgcaaagatcct

SEQ ID NO: 86676 - DNA, 20 bp, Artificial sequence
  SiRNA target sequence
aaagtcacgcaaagatcctt

SEQ ID NO: 86677 - DNA, 20 bp, Artificial sequence
  SiRNA target sequence
aagtcacgcaaagatccttc

SEQ ID NO: 86678 - DNA, 20 bp, Artificial sequence
  SiRNA target sequence
agtcacgcaaagatccttcg

SEQ ID NO: 86679 - DNA, 20 bp, Artificial sequence
  SiRNA target sequence
gtcacgcaaagatccttcga

SEQ ID NO: 86680 - DNA, 20 bp, Artificial sequence
  SiRNA target sequence
tcacgcaaagatccttcgaa

SEQ ID NO: 86681 - DNA, 20 bp, Artificial sequence
  SiRNA target sequence
cacgcaaagatccttcgaat

SEQ ID NO: 86682 - DNA, 20 bp, Artificial sequence
  SiRNA target sequence
acgcaaagatccttcgaatt

SEQ ID NO: 86683 - DNA, 20 bp, Artificial sequence
  SiRNA target sequence
cgcaaagatccttcgaattg

SEQ ID NO: 86684 - DNA, 20 bp, Artificial sequence
  SiRNA target sequence
gcaaagatccttcgaattga

SEQ ID NO: 86685 - DNA, 20 bp, Artificial sequence
  SiRNA target sequence
caaagatccttcgaattgaa

SEQ ID NO: 86686 - DNA, 20 bp, Artificial sequence
  SiRNA target sequence
aaagatccttcgaattgaaa

SEQ ID NO: 86687 - DNA, 20 bp, Artificial sequence
  SiRNA target sequence
aagatccttcgaattgaaac

SEQ ID NO: 86688 - DNA, 20 bp, Artificial sequence
  SiRNA target sequence
agatccttcgaattgaaacc

SEQ ID NO: 86689 - DNA, 20 bp, Artificial sequence
  SiRNA target sequence
gatccttcgaattgaaaccc

SEQ ID NO: 86690 - DNA, 20 bp, Artificial sequence
  SiRNA target sequence
atccttcgaattgaaacccc

SEQ ID NO: 86691 - DNA, 20 bp, Artificial sequence
  SiRNA target sequence
tccttcgaattgaaaccccg

SEQ ID NO: 86692 - DNA, 20 bp, Artificial sequence
  SiRNA target sequence
ccttcgaattgaaaccccgt

SEQ ID NO: 86693 - DNA, 20 bp, Artificial sequence
  SiRNA target sequence
cttcgaattgaaaccccgtt

SEQ ID NO: 86694 - DNA, 20 bp, Artificial sequence
  SiRNA target sequence
ttcgaattgaaaccccgttt

SEQ ID NO: 86695 - DNA, 20 bp, Artificial sequence
  SiRNA target sequence
tcgaattgaaaccccgtttt

SEQ ID NO: 86696 - DNA, 20 bp, Artificial sequence
  SiRNA target sequence
cgaattgaaaccccgttttt

SEQ ID NO: 86697 - DNA, 20 bp, Artificial sequence
  SiRNA target sequence
gaattgaaaccccgtttttc

SEQ ID NO: 86698 - DNA, 20 bp, Artificial sequence
  SiRNA target sequence
aattgaaaccccgtttttcc

SEQ ID NO: 86699 - DNA, 20 bp, Artificial sequence
  SiRNA target sequence
attgaaaccccgtttttcca

SEQ ID NO: 86700 - DNA, 20 bp, Artificial sequence
  SiRNA target sequence
ttgaaaccccgtttttccaa

SEQ ID NO: 86701 - DNA, 20 bp, Artificial sequence
  SiRNA target sequence
tgaaaccccgtttttccaac

SEQ ID NO: 86702 - DNA, 20 bp, Artificial sequence
  SiRNA target sequence
gaaaccccgtttttccaact

SEQ ID NO: 86703 - DNA, 20 bp, Artificial sequence
  SiRNA target sequence
aaaccccgtttttccaactt

SEQ ID NO: 86704 - DNA, 20 bp, Artificial sequence
  SiRNA target sequence
aaccccgtttttccaacttg

SEQ ID NO: 86705 - DNA, 20 bp, Artificial sequence
  SiRNA target sequence
accccgtttttccaacttgc

SEQ ID NO: 86706 - DNA, 20 bp, Artificial sequence
  SiRNA target sequence
ccccgtttttccaacttgct

SEQ ID NO: 86707 - DNA, 20 bp, Artificial sequence
  SiRNA target sequence
cccgtttttccaacttgctc

SEQ ID NO: 86708 - DNA, 20 bp, Artificial sequence
  SiRNA target sequence
ccgtttttccaacttgctca

SEQ ID NO: 86709 - DNA, 20 bp, Artificial sequence
  SiRNA target sequence
cgtttttccaacttgctcaa

SEQ ID NO: 86710 - DNA, 20 bp, Artificial sequence
  SiRNA target sequence
gtttttccaacttgctcaat

SEQ ID NO: 86711 - DNA, 20 bp, Artificial sequence
  SiRNA target sequence
tttttccaacttgctcaata

SEQ ID NO: 86712 - DNA, 20 bp, Artificial sequence
  SiRNA target sequence
ttttccaacttgctcaatat

SEQ ID NO: 86713 - DNA, 20 bp, Artificial sequence
  SiRNA target sequence
tttccaacttgctcaatata

SEQ ID NO: 86714 - DNA, 20 bp, Artificial sequence
  SiRNA target sequence
ttccaacttgctcaatatat

SEQ ID NO: 86715 - DNA, 20 bp, Artificial sequence
  SiRNA target sequence
tccaacttgctcaatatata

SEQ ID NO: 86716 - DNA, 20 bp, Artificial sequence
  SiRNA target sequence
ccaacttgctcaatatataa

SEQ ID NO: 86717 - DNA, 20 bp, Artificial sequence
  SiRNA target sequence
caacttgctcaatatataat

SEQ ID NO: 86718 - DNA, 20 bp, Artificial sequence
  SiRNA target sequence
aacttgctcaatatataata

SEQ ID NO: 86719 - DNA, 20 bp, Artificial sequence
  SiRNA target sequence
acttgctcaatatataataa

SEQ ID NO: 86720 - DNA, 20 bp, Artificial sequence
  SiRNA target sequence
cttgctcaatatataataat

SEQ ID NO: 86721 - DNA, 20 bp, Artificial sequence
  SiRNA target sequence
ttgctcaatatataataatg

SEQ ID NO: 86722 - DNA, 20 bp, Artificial sequence
  SiRNA target sequence
tgctcaatatataataatgt

SEQ ID NO: 86723 - DNA, 20 bp, Artificial sequence
  SiRNA target sequence
gctcaatatataataatgta

SEQ ID NO: 86724 - DNA, 20 bp, Artificial sequence
  SiRNA target sequence
ctcaatatataataatgtat

SEQ ID NO: 86725 - DNA, 20 bp, Artificial sequence
  SiRNA target sequence
tcaatatataataatgtatc

SEQ ID NO: 86726 - DNA, 20 bp, Artificial sequence
  SiRNA target sequence
caatatataataatgtatca

SEQ ID NO: 86727 - DNA, 20 bp, Artificial sequence
  SiRNA target sequence
aatatataataatgtatcac

SEQ ID NO: 86728 - DNA, 20 bp, Artificial sequence
  SiRNA target sequence
atatataataatgtatcacc

SEQ ID NO: 86729 - DNA, 20 bp, Artificial sequence
  SiRNA target sequence
tatataataatgtatcacca

SEQ ID NO: 86730 - DNA, 20 bp, Artificial sequence
  SiRNA target sequence
atataataatgtatcaccag

SEQ ID NO: 86731 - DNA, 20 bp, Artificial sequence
  SiRNA target sequence
tataataatgtatcaccaga

SEQ ID NO: 86732 - DNA, 20 bp, Artificial sequence
  SiRNA target sequence
ataataatgtatcaccagac

SEQ ID NO: 86733 - DNA, 20 bp, Artificial sequence
  SiRNA target sequence
taataatgtatcaccagaca

SEQ ID NO: 86734 - DNA, 20 bp, Artificial sequence
  SiRNA target sequence
aataatgtatcaccagacat

SEQ ID NO: 86735 - DNA, 20 bp, Artificial sequence
  SiRNA target sequence
ataatgtatcaccagacatt

SEQ ID NO: 86736 - DNA, 20 bp, Artificial sequence
  SiRNA target sequence
taatgtatcaccagacattt

SEQ ID NO: 86737 - DNA, 20 bp, Artificial sequence
  SiRNA target sequence
aatgtatcaccagacatttc

SEQ ID NO: 86738 - DNA, 20 bp, Artificial sequence
  SiRNA target sequence
atgtatcaccagacatttct

SEQ ID NO: 86739 - DNA, 20 bp, Artificial sequence
  SiRNA target sequence
tgtatcaccagacatttcta

SEQ ID NO: 86740 - DNA, 20 bp, Artificial sequence
  SiRNA target sequence
gtatcaccagacatttctag

SEQ ID NO: 86741 - DNA, 20 bp, Artificial sequence
  SiRNA target sequence
tatcaccagacatttctagt

SEQ ID NO: 86742 - DNA, 20 bp, Artificial sequence
  SiRNA target sequence
atcaccagacatttctagta

SEQ ID NO: 86743 - DNA, 20 bp, Artificial sequence
  SiRNA target sequence
tcaccagacatttctagtaa

SEQ ID NO: 86744 - DNA, 20 bp, Artificial sequence
  SiRNA target sequence
caccagacatttctagtaaa

SEQ ID NO: 86745 - DNA, 20 bp, Artificial sequence
  SiRNA target sequence
accagacatttctagtaaac

SEQ ID NO: 86746 - DNA, 20 bp, Artificial sequence
  SiRNA target sequence
ccagacatttctagtaaact

SEQ ID NO: 86747 - DNA, 20 bp, Artificial sequence
  SiRNA target sequence
cagacatttctagtaaactt

SEQ ID NO: 86748 - DNA, 20 bp, Artificial sequence
  SiRNA target sequence
agacatttctagtaaactta

SEQ ID NO: 86749 - DNA, 20 bp, Artificial sequence
  SiRNA target sequence
gacatttctagtaaacttaa

SEQ ID NO: 86750 - DNA, 20 bp, Artificial sequence
  SiRNA target sequence
acatttctagtaaacttaac

SEQ ID NO: 86751 - DNA, 20 bp, Artificial sequence
  SiRNA target sequence
catttctagtaaacttaaca

SEQ ID NO: 86752 - DNA, 20 bp, Artificial sequence
  SiRNA target sequence
atttctagtaaacttaacat

SEQ ID NO: 86753 - DNA, 20 bp, Artificial sequence
  SiRNA target sequence
tttctagtaaacttaacatt

SEQ ID NO: 86754 - DNA, 20 bp, Artificial sequence
  SiRNA target sequence
ttctagtaaacttaacattt

SEQ ID NO: 86755 - DNA, 20 bp, Artificial sequence
  SiRNA target sequence
tctagtaaacttaacatttc

SEQ ID NO: 86756 - DNA, 20 bp, Artificial sequence
  SiRNA target sequence
ctagtaaacttaacatttca

SEQ ID NO: 86757 - DNA, 20 bp, Artificial sequence
  SiRNA target sequence
tagtaaacttaacatttcat

SEQ ID NO: 86758 - DNA, 20 bp, Artificial sequence
  SiRNA target sequence
agtaaacttaacatttcatt

SEQ ID NO: 86759 - DNA, 20 bp, Artificial sequence
  SiRNA target sequence
gtaaacttaacatttcatta

SEQ ID NO: 86760 - DNA, 20 bp, Artificial sequence
  SiRNA target sequence
taaacttaacatttcattaa

SEQ ID NO: 86761 - DNA, 20 bp, Artificial sequence
  SiRNA target sequence
aaacttaacatttcattaac

SEQ ID NO: 86762 - DNA, 20 bp, Artificial sequence
  SiRNA target sequence
aacttaacatttcattaaca

SEQ ID NO: 86763 - DNA, 20 bp, Artificial sequence
  SiRNA target sequence
acttaacatttcattaacaa

SEQ ID NO: 86764 - DNA, 20 bp, Artificial sequence
  SiRNA target sequence
cttaacatttcattaacaag

SEQ ID NO: 86765 - DNA, 20 bp, Artificial sequence
  SiRNA target sequence
ttaacatttcattaacaagc

SEQ ID NO: 86766 - DNA, 20 bp, Artificial sequence
  SiRNA target sequence
taacatttcattaacaagca

SEQ ID NO: 86767 - DNA, 20 bp, Artificial sequence
  SiRNA target sequence
aacatttcattaacaagcaa

SEQ ID NO: 86768 - DNA, 20 bp, Artificial sequence
  SiRNA target sequence
acatttcattaacaagcaaa

SEQ ID NO: 86769 - DNA, 20 bp, Artificial sequence
  SiRNA target sequence
catttcattaacaagcaaat

SEQ ID NO: 86770 - DNA, 20 bp, Artificial sequence
  SiRNA target sequence
atttcattaacaagcaaatc

SEQ ID NO: 86771 - DNA, 20 bp, Artificial sequence
  SiRNA target sequence
tttcattaacaagcaaatca

SEQ ID NO: 86772 - DNA, 20 bp, Artificial sequence
  SiRNA target sequence
ttcattaacaagcaaatcat

SEQ ID NO: 86773 - DNA, 20 bp, Artificial sequence
  SiRNA target sequence
tcattaacaagcaaatcatt

SEQ ID NO: 86774 - DNA, 20 bp, Artificial sequence
  SiRNA target sequence
cattaacaagcaaatcatta

SEQ ID NO: 86775 - DNA, 20 bp, Artificial sequence
  SiRNA target sequence
attaacaagcaaatcattat

SEQ ID NO: 86776 - DNA, 20 bp, Artificial sequence
  SiRNA target sequence
ttaacaagcaaatcattatt

SEQ ID NO: 86777 - DNA, 20 bp, Artificial sequence
  SiRNA target sequence
taacaagcaaatcattattt

SEQ ID NO: 86778 - DNA, 20 bp, Artificial sequence
  SiRNA target sequence
aacaagcaaatcattatttg

SEQ ID NO: 86779 - DNA, 20 bp, Artificial sequence
  SiRNA target sequence
acaagcaaatcattatttga

SEQ ID NO: 86780 - DNA, 20 bp, Artificial sequence
  SiRNA target sequence
caagcaaatcattatttgaa

SEQ ID NO: 86781 - DNA, 20 bp, Artificial sequence
  SiRNA target sequence
aagcaaatcattatttgaac

SEQ ID NO: 86782 - DNA, 20 bp, Artificial sequence
  SiRNA target sequence
agcaaatcattatttgaaca

SEQ ID NO: 86783 - DNA, 20 bp, Artificial sequence
  SiRNA target sequence
gcaaatcattatttgaacaa

SEQ ID NO: 86784 - DNA, 20 bp, Artificial sequence
  SiRNA target sequence
caaatcattatttgaacaaa

SEQ ID NO: 86785 - DNA, 20 bp, Artificial sequence
  SiRNA target sequence
aaatcattatttgaacaaag

SEQ ID NO: 86786 - DNA, 20 bp, Artificial sequence
  SiRNA target sequence
aatcattatttgaacaaagt

SEQ ID NO: 86787 - DNA, 20 bp, Artificial sequence
  SiRNA target sequence
atcattatttgaacaaagta

SEQ ID NO: 86788 - DNA, 20 bp, Artificial sequence
  SiRNA target sequence
tcattatttgaacaaagtag

SEQ ID NO: 86789 - DNA, 20 bp, Artificial sequence
  SiRNA target sequence
cattatttgaacaaagtaga

SEQ ID NO: 86790 - DNA, 20 bp, Artificial sequence
  SiRNA target sequence
attatttgaacaaagtagac

SEQ ID NO: 86791 - DNA, 20 bp, Artificial sequence
  SiRNA target sequence
ttatttgaacaaagtagacc

SEQ ID NO: 86792 - DNA, 20 bp, Artificial sequence
  SiRNA target sequence
tatttgaacaaagtagacca

SEQ ID NO: 86793 - DNA, 20 bp, Artificial sequence
  SiRNA target sequence
atttgaacaaagtagaccaa

SEQ ID NO: 86794 - DNA, 20 bp, Artificial sequence
  SiRNA target sequence
tttgaacaaagtagaccaat

SEQ ID NO: 86795 - DNA, 20 bp, Artificial sequence
  SiRNA target sequence
ttgaacaaagtagaccaata

SEQ ID NO: 86796 - DNA, 20 bp, Artificial sequence
  SiRNA target sequence
tgaacaaagtagaccaatac

SEQ ID NO: 86797 - DNA, 20 bp, Artificial sequence
  SiRNA target sequence
gaacaaagtagaccaatact

SEQ ID NO: 86798 - DNA, 20 bp, Artificial sequence
  SiRNA target sequence
aacaaagtagaccaatacta

SEQ ID NO: 86799 - DNA, 20 bp, Artificial sequence
  SiRNA target sequence
acaaagtagaccaatactat

SEQ ID NO: 86800 - DNA, 20 bp, Artificial sequence
  SiRNA target sequence
caaagtagaccaatactatc

SEQ ID NO: 86801 - DNA, 20 bp, Artificial sequence
  SiRNA target sequence
aaagtagaccaatactatca

SEQ ID NO: 86802 - DNA, 20 bp, Artificial sequence
  SiRNA target sequence
aagtagaccaatactatcac

SEQ ID NO: 86803 - DNA, 20 bp, Artificial sequence
  SiRNA target sequence
agtagaccaatactatcacc

SEQ ID NO: 86804 - DNA, 20 bp, Artificial sequence
  SiRNA target sequence
gtagaccaatactatcacca

SEQ ID NO: 86805 - DNA, 20 bp, Artificial sequence
  SiRNA target sequence
tagaccaatactatcaccag

SEQ ID NO: 86806 - DNA, 20 bp, Artificial sequence
  SiRNA target sequence
agaccaatactatcaccagg

SEQ ID NO: 86807 - DNA, 20 bp, Artificial sequence
  SiRNA target sequence
gaccaatactatcaccagga

SEQ ID NO: 86808 - DNA, 20 bp, Artificial sequence
  SiRNA target sequence
accaatactatcaccaggaa

SEQ ID NO: 86809 - DNA, 20 bp, Artificial sequence
  SiRNA target sequence
ccaatactatcaccaggaac

SEQ ID NO: 86810 - DNA, 20 bp, Artificial sequence
  SiRNA target sequence
caatactatcaccaggaaca

SEQ ID NO: 86811 - DNA, 20 bp, Artificial sequence
  SiRNA target sequence
aatactatcaccaggaacaa

SEQ ID NO: 86812 - DNA, 20 bp, Artificial sequence
  SiRNA target sequence
atactatcaccaggaacaaa

SEQ ID NO: 86813 - DNA, 20 bp, Artificial sequence
  SiRNA target sequence
tactatcaccaggaacaaaa

SEQ ID NO: 86814 - DNA, 20 bp, Artificial sequence
  SiRNA target sequence
actatcaccaggaacaaaat

SEQ ID NO: 86815 - DNA, 20 bp, Artificial sequence
  SiRNA target sequence
ctatcaccaggaacaaaatc

SEQ ID NO: 86816 - DNA, 20 bp, Artificial sequence
  SiRNA target sequence
tatcaccaggaacaaaatct

SEQ ID NO: 86817 - DNA, 20 bp, Artificial sequence
  SiRNA target sequence
atcaccaggaacaaaatcta

SEQ ID NO: 86818 - DNA, 20 bp, Artificial sequence
  SiRNA target sequence
tcaccaggaacaaaatctaa

SEQ ID NO: 86819 - DNA, 20 bp, Artificial sequence
  SiRNA target sequence
caccaggaacaaaatctaat

SEQ ID NO: 86820 - DNA, 20 bp, Artificial sequence
  SiRNA target sequence
accaggaacaaaatctaatg

SEQ ID NO: 86821 - DNA, 20 bp, Artificial sequence
  SiRNA target sequence
ccaggaacaaaatctaatgt

SEQ ID NO: 86822 - DNA, 20 bp, Artificial sequence
  SiRNA target sequence
caggaacaaaatctaatgta

SEQ ID NO: 86823 - DNA, 20 bp, Artificial sequence
  SiRNA target sequence
aggaacaaaatctaatgtat

SEQ ID NO: 86824 - DNA, 20 bp, Artificial sequence
  SiRNA target sequence
ggaacaaaatctaatgtata

SEQ ID NO: 86825 - DNA, 20 bp, Artificial sequence
  SiRNA target sequence
gaacaaaatctaatgtataa

SEQ ID NO: 86826 - DNA, 20 bp, Artificial sequence
  SiRNA target sequence
aacaaaatctaatgtataat

SEQ ID NO: 86827 - DNA, 20 bp, Artificial sequence
  SiRNA target sequence
acaaaatctaatgtataatt

SEQ ID NO: 86828 - DNA, 20 bp, Artificial sequence
  SiRNA target sequence
caaaatctaatgtataatta

SEQ ID NO: 86829 - DNA, 20 bp, Artificial sequence
  SiRNA target sequence
aaaatctaatgtataattaa

SEQ ID NO: 86830 - DNA, 20 bp, Artificial sequence
  SiRNA target sequence
aaatctaatgtataattaag

SEQ ID NO: 86831 - DNA, 20 bp, Artificial sequence
  SiRNA target sequence
aatctaatgtataattaagt

SEQ ID NO: 86832 - DNA, 20 bp, Artificial sequence
  SiRNA target sequence
atctaatgtataattaagtt

SEQ ID NO: 86833 - DNA, 20 bp, Artificial sequence
  SiRNA target sequence
tctaatgtataattaagttg

SEQ ID NO: 86834 - DNA, 20 bp, Artificial sequence
  SiRNA target sequence
ctaatgtataattaagttga

SEQ ID NO: 86835 - DNA, 20 bp, Artificial sequence
  SiRNA target sequence
taatgtataattaagttgaa

SEQ ID NO: 86836 - DNA, 20 bp, Artificial sequence
  SiRNA target sequence
aatgtataattaagttgaac

SEQ ID NO: 86837 - DNA, 20 bp, Artificial sequence
  SiRNA target sequence
atgtataattaagttgaacc

SEQ ID NO: 86838 - DNA, 20 bp, Artificial sequence
  SiRNA target sequence
tgtataattaagttgaacct

SEQ ID NO: 86839 - DNA, 20 bp, Artificial sequence
  SiRNA target sequence
gtataattaagttgaacctt

SEQ ID NO: 86840 - DNA, 20 bp, Artificial sequence
  SiRNA target sequence
tataattaagttgaacctta

SEQ ID NO: 86841 - DNA, 20 bp, Artificial sequence
  SiRNA target sequence
ataattaagttgaaccttat

SEQ ID NO: 86842 - DNA, 20 bp, Artificial sequence
  SiRNA target sequence
taattaagttgaaccttata

SEQ ID NO: 86843 - DNA, 20 bp, Artificial sequence
  SiRNA target sequence
aattaagttgaaccttatat

SEQ ID NO: 86844 - DNA, 20 bp, Artificial sequence
  SiRNA target sequence
attaagttgaaccttatata

SEQ ID NO: 86845 - DNA, 20 bp, Artificial sequence
  SiRNA target sequence
ttaagttgaaccttatatac

SEQ ID NO: 86846 - DNA, 20 bp, Artificial sequence
  SiRNA target sequence
taagttgaaccttatatacc

SEQ ID NO: 86847 - DNA, 20 bp, Artificial sequence
  SiRNA target sequence
aagttgaaccttatatacct

SEQ ID NO: 86848 - DNA, 20 bp, Artificial sequence
  SiRNA target sequence
agttgaaccttatatacctt

SEQ ID NO: 86849 - DNA, 20 bp, Artificial sequence
  SiRNA target sequence
gttgaaccttatataccttt

SEQ ID NO: 86850 - DNA, 20 bp, Artificial sequence
  SiRNA target sequence
ttgaaccttatatacctttt

SEQ ID NO: 86851 - DNA, 20 bp, Artificial sequence
  SiRNA target sequence
tgaaccttatataccttttt

SEQ ID NO: 86852 - DNA, 20 bp, Artificial sequence
  SiRNA target sequence
gaaccttatatacctttttc

SEQ ID NO: 86853 - DNA, 20 bp, Artificial sequence
  SiRNA target sequence
aaccttatatacctttttcc

SEQ ID NO: 86854 - DNA, 20 bp, Artificial sequence
  SiRNA target sequence
accttatatacctttttcca

SEQ ID NO: 86855 - DNA, 20 bp, Artificial sequence
  SiRNA target sequence
ccttatatacctttttccat

SEQ ID NO: 86856 - DNA, 20 bp, Artificial sequence
  SiRNA target sequence
cttatatacctttttccatg

SEQ ID NO: 86857 - DNA, 20 bp, Artificial sequence
  SiRNA target sequence
ttatatacctttttccatgt

SEQ ID NO: 86858 - DNA, 20 bp, Artificial sequence
  SiRNA target sequence
tatatacctttttccatgta

SEQ ID NO: 86859 - DNA, 20 bp, Artificial sequence
  SiRNA target sequence
atatacctttttccatgtac

SEQ ID NO: 86860 - DNA, 20 bp, Artificial sequence
  SiRNA target sequence
tatacctttttccatgtaca

SEQ ID NO: 86861 - DNA, 20 bp, Artificial sequence
  SiRNA target sequence
atacctttttccatgtacag

SEQ ID NO: 86862 - DNA, 20 bp, Artificial sequence
  SiRNA target sequence
tacctttttccatgtacagg

SEQ ID NO: 86863 - DNA, 20 bp, Artificial sequence
  SiRNA target sequence
acctttttccatgtacagga

SEQ ID NO: 86864 - DNA, 20 bp, Artificial sequence
  SiRNA target sequence
cctttttccatgtacaggaa

SEQ ID NO: 86865 - DNA, 20 bp, Artificial sequence
  SiRNA target sequence
ctttttccatgtacaggaaa

SEQ ID NO: 86866 - DNA, 20 bp, Artificial sequence
  SiRNA target sequence
tttttccatgtacaggaaag

SEQ ID NO: 86867 - DNA, 20 bp, Artificial sequence
  SiRNA target sequence
ttttccatgtacaggaaagg

SEQ ID NO: 86868 - DNA, 20 bp, Artificial sequence
  SiRNA target sequence
tttccatgtacaggaaaggt

SEQ ID NO: 86869 - DNA, 20 bp, Artificial sequence
  SiRNA target sequence
ttccatgtacaggaaaggtt

SEQ ID NO: 86870 - DNA, 20 bp, Artificial sequence
  SiRNA target sequence
tccatgtacaggaaaggttt

SEQ ID NO: 86871 - DNA, 20 bp, Artificial sequence
  SiRNA target sequence
ccatgtacaggaaaggtttt

SEQ ID NO: 86872 - DNA, 20 bp, Artificial sequence
  SiRNA target sequence
catgtacaggaaaggttttc

SEQ ID NO: 86873 - DNA, 20 bp, Artificial sequence
  SiRNA target sequence
atgtacaggaaaggttttca

SEQ ID NO: 86874 - DNA, 20 bp, Artificial sequence
  SiRNA target sequence
tgtacaggaaaggttttcaa

SEQ ID NO: 86875 - DNA, 20 bp, Artificial sequence
  SiRNA target sequence
gtacaggaaaggttttcaat

SEQ ID NO: 86876 - DNA, 20 bp, Artificial sequence
  SiRNA target sequence
tacaggaaaggttttcaata

SEQ ID NO: 86877 - DNA, 20 bp, Artificial sequence
  SiRNA target sequence
acaggaaaggttttcaatat

SEQ ID NO: 86878 - DNA, 20 bp, Artificial sequence
  SiRNA target sequence
caggaaaggttttcaatatt

SEQ ID NO: 86879 - DNA, 20 bp, Artificial sequence
  SiRNA target sequence
aggaaaggttttcaatattt

SEQ ID NO: 86880 - DNA, 20 bp, Artificial sequence
  SiRNA target sequence
ggaaaggttttcaatattta

SEQ ID NO: 86881 - DNA, 20 bp, Artificial sequence
  SiRNA target sequence
gaaaggttttcaatatttag

SEQ ID NO: 86882 - DNA, 20 bp, Artificial sequence
  SiRNA target sequence
aaaggttttcaatatttagt

SEQ ID NO: 86883 - DNA, 20 bp, Artificial sequence
  SiRNA target sequence
aaggttttcaatatttagta

SEQ ID NO: 86884 - DNA, 20 bp, Artificial sequence
  SiRNA target sequence
aggttttcaatatttagtat

SEQ ID NO: 86885 - DNA, 20 bp, Artificial sequence
  SiRNA target sequence
ggttttcaatatttagtata

SEQ ID NO: 86886 - DNA, 20 bp, Artificial sequence
  SiRNA target sequence
gttttcaatatttagtatat

SEQ ID NO: 86887 - DNA, 20 bp, Artificial sequence
  SiRNA target sequence
ttttcaatatttagtatatt

SEQ ID NO: 86888 - DNA, 20 bp, Artificial sequence
  SiRNA target sequence
tttcaatatttagtatattt

SEQ ID NO: 86889 - DNA, 20 bp, Artificial sequence
  SiRNA target sequence
ttcaatatttagtatatttg

SEQ ID NO: 86890 - DNA, 20 bp, Artificial sequence
  SiRNA target sequence
tcaatatttagtatatttgt

SEQ ID NO: 86891 - DNA, 20 bp, Artificial sequence
  SiRNA target sequence
caatatttagtatatttgta

SEQ ID NO: 86892 - DNA, 20 bp, Artificial sequence
  SiRNA target sequence
aatatttagtatatttgtat

SEQ ID NO: 86893 - DNA, 20 bp, Artificial sequence
  SiRNA target sequence
atatttagtatatttgtatc

SEQ ID NO: 86894 - DNA, 20 bp, Artificial sequence
  SiRNA target sequence
tatttagtatatttgtatct

SEQ ID NO: 86895 - DNA, 20 bp, Artificial sequence
  SiRNA target sequence
atttagtatatttgtatcta

SEQ ID NO: 86896 - DNA, 20 bp, Artificial sequence
  SiRNA target sequence
tttagtatatttgtatctat

SEQ ID NO: 86897 - DNA, 20 bp, Artificial sequence
  SiRNA target sequence
ttagtatatttgtatctatc

SEQ ID NO: 86898 - DNA, 20 bp, Artificial sequence
  SiRNA target sequence
tagtatatttgtatctatca

SEQ ID NO: 86899 - DNA, 20 bp, Artificial sequence
  SiRNA target sequence
agtatatttgtatctatcaa

SEQ ID NO: 86900 - DNA, 20 bp, Artificial sequence
  SiRNA target sequence
gtatatttgtatctatcaaa

SEQ ID NO: 86901 - DNA, 20 bp, Artificial sequence
  SiRNA target sequence
tatatttgtatctatcaaat

SEQ ID NO: 86902 - DNA, 20 bp, Artificial sequence
  SiRNA target sequence
atatttgtatctatcaaatt

SEQ ID NO: 86903 - DNA, 20 bp, Artificial sequence
  SiRNA target sequence
tatttgtatctatcaaattt

SEQ ID NO: 86904 - DNA, 20 bp, Artificial sequence
  SiRNA target sequence
atttgtatctatcaaattta

SEQ ID NO: 86905 - DNA, 20 bp, Artificial sequence
  SiRNA target sequence
tttgtatctatcaaatttat

SEQ ID NO: 86906 - DNA, 20 bp, Artificial sequence
  SiRNA target sequence
ttgtatctatcaaatttata

SEQ ID NO: 86907 - DNA, 20 bp, Artificial sequence
  SiRNA target sequence
tgtatctatcaaatttatat

SEQ ID NO: 86908 - DNA, 20 bp, Artificial sequence
  SiRNA target sequence
gtatctatcaaatttatatt

SEQ ID NO: 86909 - DNA, 20 bp, Artificial sequence
  SiRNA target sequence
tatctatcaaatttatattc

SEQ ID NO: 86910 - DNA, 20 bp, Artificial sequence
  SiRNA target sequence
atctatcaaatttatattct

SEQ ID NO: 86911 - DNA, 20 bp, Artificial sequence
  SiRNA target sequence
tctatcaaatttatattctc

SEQ ID NO: 86912 - DNA, 20 bp, Artificial sequence
  SiRNA target sequence
ctatcaaatttatattctcg

SEQ ID NO: 86913 - DNA, 20 bp, Artificial sequence
  SiRNA target sequence
tatcaaatttatattctcgt

SEQ ID NO: 86914 - DNA, 20 bp, Artificial sequence
  SiRNA target sequence
atcaaatttatattctcgtt

SEQ ID NO: 86915 - DNA, 20 bp, Artificial sequence
  SiRNA target sequence
tcaaatttatattctcgttt

SEQ ID NO: 86916 - DNA, 20 bp, Artificial sequence
  SiRNA target sequence
caaatttatattctcgtttg

SEQ ID NO: 86917 - DNA, 20 bp, Artificial sequence
  SiRNA target sequence
aaatttatattctcgtttgt

SEQ ID NO: 86918 - DNA, 20 bp, Artificial sequence
  SiRNA target sequence
aatttatattctcgtttgtc

SEQ ID NO: 86919 - DNA, 20 bp, Artificial sequence
  SiRNA target sequence
atttatattctcgtttgtct

SEQ ID NO: 86920 - DNA, 20 bp, Artificial sequence
  SiRNA target sequence
tttatattctcgtttgtctt

SEQ ID NO: 86921 - DNA, 20 bp, Artificial sequence
  SiRNA target sequence
ttatattctcgtttgtcttt

SEQ ID NO: 86922 - DNA, 20 bp, Artificial sequence
  SiRNA target sequence
tatattctcgtttgtcttta

SEQ ID NO: 86923 - DNA, 20 bp, Artificial sequence
  SiRNA target sequence
atattctcgtttgtctttat

SEQ ID NO: 86924 - DNA, 20 bp, Artificial sequence
  SiRNA target sequence
tattctcgtttgtctttatt

SEQ ID NO: 86925 - DNA, 20 bp, Artificial sequence
  SiRNA target sequence
attctcgtttgtctttattt

SEQ ID NO: 86926 - DNA, 20 bp, Artificial sequence
  SiRNA target sequence
ttctcgtttgtctttatttt

SEQ ID NO: 86927 - DNA, 20 bp, Artificial sequence
  SiRNA target sequence
tctcgtttgtctttatttta

SEQ ID NO: 86928 - DNA, 20 bp, Artificial sequence
  SiRNA target sequence
ctcgtttgtctttattttat

SEQ ID NO: 86929 - DNA, 20 bp, Artificial sequence
  SiRNA target sequence
tcgtttgtctttattttata

SEQ ID NO: 86930 - DNA, 20 bp, Artificial sequence
  SiRNA target sequence
cgtttgtctttattttataa

SEQ ID NO: 86931 - DNA, 20 bp, Artificial sequence
  SiRNA target sequence
gtttgtctttattttataag

SEQ ID NO: 86932 - DNA, 20 bp, Artificial sequence
  SiRNA target sequence
tttgtctttattttataaga

SEQ ID NO: 86933 - DNA, 20 bp, Artificial sequence
  SiRNA target sequence
ttgtctttattttataagaa

SEQ ID NO: 86934 - DNA, 20 bp, Artificial sequence
  SiRNA target sequence
tgtctttattttataagaac

SEQ ID NO: 86935 - DNA, 20 bp, Artificial sequence
  SiRNA target sequence
gtctttattttataagaacc

SEQ ID NO: 86936 - DNA, 20 bp, Artificial sequence
  SiRNA target sequence
tctttattttataagaacct

SEQ ID NO: 86937 - DNA, 20 bp, Artificial sequence
  SiRNA target sequence
ctttattttataagaacctg

SEQ ID NO: 86938 - DNA, 20 bp, Artificial sequence
  SiRNA target sequence
tttattttataagaacctgt

SEQ ID NO: 86939 - DNA, 20 bp, Artificial sequence
  SiRNA target sequence
ttattttataagaacctgta

SEQ ID NO: 86940 - DNA, 20 bp, Artificial sequence
  SiRNA target sequence
tattttataagaacctgtat

SEQ ID NO: 86941 - DNA, 20 bp, Artificial sequence
  SiRNA target sequence
attttataagaacctgtata

SEQ ID NO: 86942 - DNA, 20 bp, Artificial sequence
  SiRNA target sequence
ttttataagaacctgtatag

SEQ ID NO: 86943 - DNA, 20 bp, Artificial sequence
  SiRNA target sequence
tttataagaacctgtatagt

SEQ ID NO: 86944 - DNA, 20 bp, Artificial sequence
  SiRNA target sequence
ttataagaacctgtatagtt

SEQ ID NO: 86945 - DNA, 20 bp, Artificial sequence
  SiRNA target sequence
tataagaacctgtatagttg

SEQ ID NO: 86946 - DNA, 20 bp, Artificial sequence
  SiRNA target sequence
ataagaacctgtatagttgg

SEQ ID NO: 86947 - DNA, 20 bp, Artificial sequence
  SiRNA target sequence
taagaacctgtatagttggt

SEQ ID NO: 86948 - DNA, 20 bp, Artificial sequence
  SiRNA target sequence
aagaacctgtatagttggtc

SEQ ID NO: 86949 - DNA, 20 bp, Artificial sequence
  SiRNA target sequence
agaacctgtatagttggtct

SEQ ID NO: 86950 - DNA, 20 bp, Artificial sequence
  SiRNA target sequence
gaacctgtatagttggtctt

SEQ ID NO: 86951 - DNA, 20 bp, Artificial sequence
  SiRNA target sequence
aacctgtatagttggtcttt

SEQ ID NO: 86952 - DNA, 20 bp, Artificial sequence
  SiRNA target sequence
acctgtatagttggtctttt

SEQ ID NO: 86953 - DNA, 20 bp, Artificial sequence
  SiRNA target sequence
cctgtatagttggtcttttt

SEQ ID NO: 86954 - DNA, 20 bp, Artificial sequence
  SiRNA target sequence
ctgtatagttggtcttttta

SEQ ID NO: 86955 - DNA, 20 bp, Artificial sequence
  SiRNA target sequence
tgtatagttggtctttttaa

SEQ ID NO: 86956 - DNA, 20 bp, Artificial sequence
  SiRNA target sequence
gtatagttggtctttttaat

SEQ ID NO: 86957 - DNA, 20 bp, Artificial sequence
  SiRNA target sequence
tatagttggtctttttaatt

SEQ ID NO: 86958 - DNA, 20 bp, Artificial sequence
  SiRNA target sequence
atagttggtctttttaatta

SEQ ID NO: 86959 - DNA, 20 bp, Artificial sequence
  SiRNA target sequence
tagttggtctttttaattat

SEQ ID NO: 86960 - DNA, 20 bp, Artificial sequence
  SiRNA target sequence
agttggtctttttaattata

SEQ ID NO: 86961 - DNA, 20 bp, Artificial sequence
  SiRNA target sequence
gttggtctttttaattataa

SEQ ID NO: 86962 - DNA, 20 bp, Artificial sequence
  SiRNA target sequence
ttggtctttttaattataag

SEQ ID NO: 86963 - DNA, 20 bp, Artificial sequence
  SiRNA target sequence
tggtctttttaattataagc

SEQ ID NO: 86964 - DNA, 20 bp, Artificial sequence
  SiRNA target sequence
ggtctttttaattataagct

SEQ ID NO: 86965 - DNA, 20 bp, Artificial sequence
  SiRNA target sequence
gtctttttaattataagctt

SEQ ID NO: 86966 - DNA, 20 bp, Artificial sequence
  SiRNA target sequence
tctttttaattataagctta

SEQ ID NO: 86967 - DNA, 20 bp, Artificial sequence
  SiRNA target sequence
ctttttaattataagcttat

SEQ ID NO: 86968 - DNA, 20 bp, Artificial sequence
  SiRNA target sequence
tttttaattataagcttatt

SEQ ID NO: 86969 - DNA, 20 bp, Artificial sequence
  SiRNA target sequence
ttttaattataagcttattg

SEQ ID NO: 86970 - DNA, 20 bp, Artificial sequence
  SiRNA target sequence
tttaattataagcttattga

SEQ ID NO: 86971 - DNA, 20 bp, Artificial sequence
  SiRNA target sequence
ttaattataagcttattgaa

SEQ ID NO: 86972 - DNA, 20 bp, Artificial sequence
  SiRNA target sequence
taattataagcttattgaaa

SEQ ID NO: 86973 - DNA, 20 bp, Artificial sequence
  SiRNA target sequence
aattataagcttattgaaat

SEQ ID NO: 86974 - DNA, 20 bp, Artificial sequence
  SiRNA target sequence
attataagcttattgaaatt

SEQ ID NO: 86975 - DNA, 20 bp, Artificial sequence
  SiRNA target sequence
ttataagcttattgaaattt

SEQ ID NO: 86976 - DNA, 20 bp, Artificial sequence
  SiRNA target sequence
tataagcttattgaaatttc

SEQ ID NO: 86977 - DNA, 20 bp, Artificial sequence
  SiRNA target sequence
ataagcttattgaaatttct

SEQ ID NO: 86978 - DNA, 20 bp, Artificial sequence
  SiRNA target sequence
taagcttattgaaatttcta

SEQ ID NO: 86979 - DNA, 20 bp, Artificial sequence
  SiRNA target sequence
aagcttattgaaatttctaa

SEQ ID NO: 86980 - DNA, 20 bp, Artificial sequence
  SiRNA target sequence
agcttattgaaatttctaat

SEQ ID NO: 86981 - DNA, 20 bp, Artificial sequence
  SiRNA target sequence
gcttattgaaatttctaata

SEQ ID NO: 86982 - DNA, 20 bp, Artificial sequence
  SiRNA target sequence
cttattgaaatttctaatat

SEQ ID NO: 86983 - DNA, 20 bp, Artificial sequence
  SiRNA target sequence
ttattgaaatttctaatatt

SEQ ID NO: 86984 - DNA, 20 bp, Artificial sequence
  SiRNA target sequence
tattgaaatttctaatattt

SEQ ID NO: 86985 - DNA, 20 bp, Artificial sequence
  SiRNA target sequence
attgaaatttctaatattta

SEQ ID NO: 86986 - DNA, 20 bp, Artificial sequence
  SiRNA target sequence
ttgaaatttctaatatttaa

SEQ ID NO: 86987 - DNA, 20 bp, Artificial sequence
  SiRNA target sequence
tgaaatttctaatatttaaa

SEQ ID NO: 86988 - DNA, 20 bp, Artificial sequence
  SiRNA target sequence
gaaatttctaatatttaaag

SEQ ID NO: 86989 - DNA, 20 bp, Artificial sequence
  SiRNA target sequence
aaatttctaatatttaaagg

SEQ ID NO: 86990 - DNA, 20 bp, Artificial sequence
  SiRNA target sequence
aatttctaatatttaaagga

SEQ ID NO: 86991 - DNA, 20 bp, Artificial sequence
  SiRNA target sequence
atttctaatatttaaaggaa

SEQ ID NO: 86992 - DNA, 20 bp, Artificial sequence
  SiRNA target sequence
tttctaatatttaaaggaac

SEQ ID NO: 86993 - DNA, 20 bp, Artificial sequence
  SiRNA target sequence
ttctaatatttaaaggaaca

SEQ ID NO: 86994 - DNA, 20 bp, Artificial sequence
  SiRNA target sequence
tctaatatttaaaggaacaa

SEQ ID NO: 86995 - DNA, 20 bp, Artificial sequence
  SiRNA target sequence
ctaatatttaaaggaacaaa

SEQ ID NO: 86996 - DNA, 20 bp, Artificial sequence
  SiRNA target sequence
taatatttaaaggaacaaaa

SEQ ID NO: 86997 - DNA, 20 bp, Artificial sequence
  SiRNA target sequence
aatatttaaaggaacaaaat

SEQ ID NO: 86998 - DNA, 20 bp, Artificial sequence
  SiRNA target sequence
atatttaaaggaacaaaatc

SEQ ID NO: 86999 - DNA, 20 bp, Artificial sequence
  SiRNA target sequence
tatttaaaggaacaaaatct

SEQ ID NO: 87000 - DNA, 20 bp, Artificial sequence
  SiRNA target sequence
atttaaaggaacaaaatcta

SEQ ID NO: 87001 - DNA, 20 bp, Artificial sequence
  SiRNA target sequence
tttaaaggaacaaaatctac

SEQ ID NO: 87002 - DNA, 20 bp, Artificial sequence
  SiRNA target sequence
ttaaaggaacaaaatctaca

SEQ ID NO: 87003 - DNA, 20 bp, Artificial sequence
  SiRNA target sequence
taaaggaacaaaatctacat

SEQ ID NO: 87004 - DNA, 20 bp, Artificial sequence
  SiRNA target sequence
aaaggaacaaaatctacatt

SEQ ID NO: 87005 - DNA, 20 bp, Artificial sequence
  SiRNA target sequence
aaggaacaaaatctacattt

SEQ ID NO: 87006 - DNA, 20 bp, Artificial sequence
  SiRNA target sequence
aggaacaaaatctacattta

SEQ ID NO: 87007 - DNA, 20 bp, Artificial sequence
  SiRNA target sequence
ggaacaaaatctacatttag

SEQ ID NO: 87008 - DNA, 20 bp, Artificial sequence
  SiRNA target sequence
gaacaaaatctacatttaga

SEQ ID NO: 87009 - DNA, 20 bp, Artificial sequence
  SiRNA target sequence
aacaaaatctacatttagat

SEQ ID NO: 87010 - DNA, 20 bp, Artificial sequence
  SiRNA target sequence
acaaaatctacatttagatt

SEQ ID NO: 87011 - DNA, 20 bp, Artificial sequence
  SiRNA target sequence
caaaatctacatttagatta

SEQ ID NO: 87012 - DNA, 20 bp, Artificial sequence
  SiRNA target sequence
aaaatctacatttagattat

SEQ ID NO: 87013 - DNA, 20 bp, Artificial sequence
  SiRNA target sequence
aaatctacatttagattata

SEQ ID NO: 87014 - DNA, 20 bp, Artificial sequence
  SiRNA target sequence
aatctacatttagattatat

SEQ ID NO: 87015 - DNA, 20 bp, Artificial sequence
  SiRNA target sequence
atctacatttagattatatt

SEQ ID NO: 87016 - DNA, 20 bp, Artificial sequence
  SiRNA target sequence
tctacatttagattatattc

SEQ ID NO: 87017 - DNA, 20 bp, Artificial sequence
  SiRNA target sequence
ctacatttagattatattct

SEQ ID NO: 87018 - DNA, 20 bp, Artificial sequence
  SiRNA target sequence
tacatttagattatattcta

SEQ ID NO: 87019 - DNA, 20 bp, Artificial sequence
  SiRNA target sequence
acatttagattatattctaa

SEQ ID NO: 87020 - DNA, 20 bp, Artificial sequence
  SiRNA target sequence
catttagattatattctaat

SEQ ID NO: 87021 - DNA, 20 bp, Artificial sequence
  SiRNA target sequence
atttagattatattctaatt

SEQ ID NO: 87022 - DNA, 20 bp, Artificial sequence
  SiRNA target sequence
tttagattatattctaattt

SEQ ID NO: 87023 - DNA, 20 bp, Artificial sequence
  SiRNA target sequence
ttagattatattctaattta

SEQ ID NO: 87024 - DNA, 20 bp, Artificial sequence
  SiRNA target sequence
tagattatattctaatttat

SEQ ID NO: 87025 - DNA, 20 bp, Artificial sequence
  SiRNA target sequence
agattatattctaatttatt

SEQ ID NO: 87026 - DNA, 20 bp, Artificial sequence
  SiRNA target sequence
gattatattctaatttattg

SEQ ID NO: 87027 - DNA, 20 bp, Artificial sequence
  SiRNA target sequence
attatattctaatttattga

SEQ ID NO: 87028 - DNA, 20 bp, Artificial sequence
  SiRNA target sequence
ttatattctaatttattgaa

SEQ ID NO: 87029 - DNA, 20 bp, Artificial sequence
  SiRNA target sequence
tatattctaatttattgaat

SEQ ID NO: 87030 - DNA, 20 bp, Artificial sequence
  SiRNA target sequence
atattctaatttattgaatt

SEQ ID NO: 87031 - DNA, 20 bp, Artificial sequence
  SiRNA target sequence
tattctaatttattgaattt

SEQ ID NO: 87032 - DNA, 20 bp, Artificial sequence
  SiRNA target sequence
attctaatttattgaatttc

SEQ ID NO: 87033 - DNA, 20 bp, Artificial sequence
  SiRNA target sequence
ttctaatttattgaatttca

SEQ ID NO: 87034 - DNA, 20 bp, Artificial sequence
  SiRNA target sequence
tctaatttattgaatttcat

SEQ ID NO: 87035 - DNA, 21 bp, Artificial sequence
  SiRNA target sequence
ttatatccaactatcaaaaaa

SEQ ID NO: 87036 - DNA, 21 bp, Artificial sequence
  SiRNA target sequence
tatatccaactatcaaaaaat

SEQ ID NO: 87037 - DNA, 21 bp, Artificial sequence
  SiRNA target sequence
atatccaactatcaaaaaata

SEQ ID NO: 87038 - DNA, 21 bp, Artificial sequence
  SiRNA target sequence
tatccaactatcaaaaaatag

SEQ ID NO: 87039 - DNA, 21 bp, Artificial sequence
  SiRNA target sequence
atccaactatcaaaaaatagc

SEQ ID NO: 87040 - DNA, 21 bp, Artificial sequence
  SiRNA target sequence
tccaactatcaaaaaatagcc

SEQ ID NO: 87041 - DNA, 21 bp, Artificial sequence
  SiRNA target sequence
ccaactatcaaaaaatagcct

SEQ ID NO: 87042 - DNA, 21 bp, Artificial sequence
  SiRNA target sequence
caactatcaaaaaatagcctc

SEQ ID NO: 87043 - DNA, 21 bp, Artificial sequence
  SiRNA target sequence
aactatcaaaaaatagcctct

SEQ ID NO: 87044 - DNA, 21 bp, Artificial sequence
  SiRNA target sequence
actatcaaaaaatagcctctt

SEQ ID NO: 87045 - DNA, 21 bp, Artificial sequence
  SiRNA target sequence
ctatcaaaaaatagcctcttt

SEQ ID NO: 87046 - DNA, 21 bp, Artificial sequence
  SiRNA target sequence
tatcaaaaaatagcctctttt

SEQ ID NO: 87047 - DNA, 21 bp, Artificial sequence
  SiRNA target sequence
atcaaaaaatagcctcttttc

SEQ ID NO: 87048 - DNA, 21 bp, Artificial sequence
  SiRNA target sequence
tcaaaaaatagcctcttttct

SEQ ID NO: 87049 - DNA, 21 bp, Artificial sequence
  SiRNA target sequence
caaaaaatagcctcttttctt

SEQ ID NO: 87050 - DNA, 21 bp, Artificial sequence
  SiRNA target sequence
aaaaaatagcctcttttcttt

SEQ ID NO: 87051 - DNA, 21 bp, Artificial sequence
  SiRNA target sequence
aaaaatagcctcttttctttc

SEQ ID NO: 87052 - DNA, 21 bp, Artificial sequence
  SiRNA target sequence
aaaatagcctcttttctttca

SEQ ID NO: 87053 - DNA, 21 bp, Artificial sequence
  SiRNA target sequence
aaatagcctcttttctttcac

SEQ ID NO: 87054 - DNA, 21 bp, Artificial sequence
  SiRNA target sequence
aatagcctcttttctttcaca

SEQ ID NO: 87055 - DNA, 21 bp, Artificial sequence
  SiRNA target sequence
atagcctcttttctttcacaa

SEQ ID NO: 87056 - DNA, 21 bp, Artificial sequence
  SiRNA target sequence
tagcctcttttctttcacaat

SEQ ID NO: 87057 - DNA, 21 bp, Artificial sequence
  SiRNA target sequence
agcctcttttctttcacaatt

SEQ ID NO: 87058 - DNA, 21 bp, Artificial sequence
  SiRNA target sequence
gcctcttttctttcacaattt

SEQ ID NO: 87059 - DNA, 21 bp, Artificial sequence
  SiRNA target sequence
cctcttttctttcacaatttc

SEQ ID NO: 87060 - DNA, 21 bp, Artificial sequence
  SiRNA target sequence
ctcttttctttcacaatttca

SEQ ID NO: 87061 - DNA, 21 bp, Artificial sequence
  SiRNA target sequence
tcttttctttcacaatttcag

SEQ ID NO: 87062 - DNA, 21 bp, Artificial sequence
  SiRNA target sequence
cttttctttcacaatttcaga

SEQ ID NO: 87063 - DNA, 21 bp, Artificial sequence
  SiRNA target sequence
ttttctttcacaatttcagaa

SEQ ID NO: 87064 - DNA, 21 bp, Artificial sequence
  SiRNA target sequence
tttctttcacaatttcagaaa

SEQ ID NO: 87065 - DNA, 21 bp, Artificial sequence
  SiRNA target sequence
ttctttcacaatttcagaaaa

SEQ ID NO: 87066 - DNA, 21 bp, Artificial sequence
  SiRNA target sequence
tctttcacaatttcagaaaaa

SEQ ID NO: 87067 - DNA, 21 bp, Artificial sequence
  SiRNA target sequence
ctttcacaatttcagaaaaat

SEQ ID NO: 87068 - DNA, 21 bp, Artificial sequence
  SiRNA target sequence
tttcacaatttcagaaaaatt

SEQ ID NO: 87069 - DNA, 21 bp, Artificial sequence
  SiRNA target sequence
ttcacaatttcagaaaaattt

SEQ ID NO: 87070 - DNA, 21 bp, Artificial sequence
  SiRNA target sequence
tcacaatttcagaaaaatttt

SEQ ID NO: 87071 - DNA, 21 bp, Artificial sequence
  SiRNA target sequence
cacaatttcagaaaaattttc

SEQ ID NO: 87072 - DNA, 21 bp, Artificial sequence
  SiRNA target sequence
acaatttcagaaaaattttca

SEQ ID NO: 87073 - DNA, 21 bp, Artificial sequence
  SiRNA target sequence
caatttcagaaaaattttcat

SEQ ID NO: 87074 - DNA, 21 bp, Artificial sequence
  SiRNA target sequence
aatttcagaaaaattttcatt

SEQ ID NO: 87075 - DNA, 21 bp, Artificial sequence
  SiRNA target sequence
atttcagaaaaattttcatta

SEQ ID NO: 87076 - DNA, 21 bp, Artificial sequence
  SiRNA target sequence
tttcagaaaaattttcattaa

SEQ ID NO: 87077 - DNA, 21 bp, Artificial sequence
  SiRNA target sequence
ttcagaaaaattttcattaaa

SEQ ID NO: 87078 - DNA, 21 bp, Artificial sequence
  SiRNA target sequence
tcagaaaaattttcattaaaa

SEQ ID NO: 87079 - DNA, 21 bp, Artificial sequence
  SiRNA target sequence
cagaaaaattttcattaaaaa

SEQ ID NO: 87080 - DNA, 21 bp, Artificial sequence
  SiRNA target sequence
agaaaaattttcattaaaaat

SEQ ID NO: 87081 - DNA, 21 bp, Artificial sequence
  SiRNA target sequence
gaaaaattttcattaaaaatg

SEQ ID NO: 87082 - DNA, 21 bp, Artificial sequence
  SiRNA target sequence
aaaaattttcattaaaaatgc

SEQ ID NO: 87083 - DNA, 21 bp, Artificial sequence
  SiRNA target sequence
aaaattttcattaaaaatgct

SEQ ID NO: 87084 - DNA, 21 bp, Artificial sequence
  SiRNA target sequence
aaattttcattaaaaatgcta

SEQ ID NO: 87085 - DNA, 21 bp, Artificial sequence
  SiRNA target sequence
aattttcattaaaaatgctat

SEQ ID NO: 87086 - DNA, 21 bp, Artificial sequence
  SiRNA target sequence
attttcattaaaaatgctata

SEQ ID NO: 87087 - DNA, 21 bp, Artificial sequence
  SiRNA target sequence
ttttcattaaaaatgctataa

SEQ ID NO: 87088 - DNA, 21 bp, Artificial sequence
  SiRNA target sequence
tttcattaaaaatgctataaa

SEQ ID NO: 87089 - DNA, 21 bp, Artificial sequence
  SiRNA target sequence
ttcattaaaaatgctataaat

SEQ ID NO: 87090 - DNA, 21 bp, Artificial sequence
  SiRNA target sequence
tcattaaaaatgctataaata

SEQ ID NO: 87091 - DNA, 21 bp, Artificial sequence
  SiRNA target sequence
cattaaaaatgctataaatag

SEQ ID NO: 87092 - DNA, 21 bp, Artificial sequence
  SiRNA target sequence
attaaaaatgctataaatagt

SEQ ID NO: 87093 - DNA, 21 bp, Artificial sequence
  SiRNA target sequence
ttaaaaatgctataaatagtt

SEQ ID NO: 87094 - DNA, 21 bp, Artificial sequence
  SiRNA target sequence
taaaaatgctataaatagttt

SEQ ID NO: 87095 - DNA, 21 bp, Artificial sequence
  SiRNA target sequence
aaaaatgctataaatagtttt

SEQ ID NO: 87096 - DNA, 21 bp, Artificial sequence
  SiRNA target sequence
aaaatgctataaatagttttt

SEQ ID NO: 87097 - DNA, 21 bp, Artificial sequence
  SiRNA target sequence
aaatgctataaatagtttttt

SEQ ID NO: 87098 - DNA, 21 bp, Artificial sequence
  SiRNA target sequence
aatgctataaatagttttttg

SEQ ID NO: 87099 - DNA, 21 bp, Artificial sequence
  SiRNA target sequence
atgctataaatagttttttgc

SEQ ID NO: 87100 - DNA, 21 bp, Artificial sequence
  SiRNA target sequence
tgctataaatagttttttgca

SEQ ID NO: 87101 - DNA, 21 bp, Artificial sequence
  SiRNA target sequence
gctataaatagttttttgcat

SEQ ID NO: 87102 - DNA, 21 bp, Artificial sequence
  SiRNA target sequence
ctataaatagttttttgcata

SEQ ID NO: 87103 - DNA, 21 bp, Artificial sequence
  SiRNA target sequence
tataaatagttttttgcatat

SEQ ID NO: 87104 - DNA, 21 bp, Artificial sequence
  SiRNA target sequence
ataaatagttttttgcatatc

SEQ ID NO: 87105 - DNA, 21 bp, Artificial sequence
  SiRNA target sequence
taaatagttttttgcatatca

SEQ ID NO: 87106 - DNA, 21 bp, Artificial sequence
  SiRNA target sequence
aaatagttttttgcatatcag

SEQ ID NO: 87107 - DNA, 21 bp, Artificial sequence
  SiRNA target sequence
aatagttttttgcatatcagg

SEQ ID NO: 87108 - DNA, 21 bp, Artificial sequence
  SiRNA target sequence
atagttttttgcatatcaggt

SEQ ID NO: 87109 - DNA, 21 bp, Artificial sequence
  SiRNA target sequence
tagttttttgcatatcaggtc

SEQ ID NO: 87110 - DNA, 21 bp, Artificial sequence
  SiRNA target sequence
agttttttgcatatcaggtcg

SEQ ID NO: 87111 - DNA, 21 bp, Artificial sequence
  SiRNA target sequence
gttttttgcatatcaggtcgg

SEQ ID NO: 87112 - DNA, 21 bp, Artificial sequence
  SiRNA target sequence
ttttttgcatatcaggtcggc

SEQ ID NO: 87113 - DNA, 21 bp, Artificial sequence
  SiRNA target sequence
tttttgcatatcaggtcggcc

SEQ ID NO: 87114 - DNA, 21 bp, Artificial sequence
  SiRNA target sequence
ttttgcatatcaggtcggcca

SEQ ID NO: 87115 - DNA, 21 bp, Artificial sequence
  SiRNA target sequence
tttgcatatcaggtcggccac

SEQ ID NO: 87116 - DNA, 21 bp, Artificial sequence
  SiRNA target sequence
ttgcatatcaggtcggccaca

SEQ ID NO: 87117 - DNA, 21 bp, Artificial sequence
  SiRNA target sequence
tgcatatcaggtcggccacaa

SEQ ID NO: 87118 - DNA, 21 bp, Artificial sequence
  SiRNA target sequence
gcatatcaggtcggccacaaa

SEQ ID NO: 87119 - DNA, 21 bp, Artificial sequence
  SiRNA target sequence
catatcaggtcggccacaaac

SEQ ID NO: 87120 - DNA, 21 bp, Artificial sequence
  SiRNA target sequence
atatcaggtcggccacaaaca

SEQ ID NO: 87121 - DNA, 21 bp, Artificial sequence
  SiRNA target sequence
tatcaggtcggccacaaacat

SEQ ID NO: 87122 - DNA, 21 bp, Artificial sequence
  SiRNA target sequence
atcaggtcggccacaaacata

SEQ ID NO: 87123 - DNA, 21 bp, Artificial sequence
  SiRNA target sequence
tcaggtcggccacaaacataa

SEQ ID NO: 87124 - DNA, 21 bp, Artificial sequence
  SiRNA target sequence
caggtcggccacaaacataaa

SEQ ID NO: 87125 - DNA, 21 bp, Artificial sequence
  SiRNA target sequence
aggtcggccacaaacataaac

SEQ ID NO: 87126 - DNA, 21 bp, Artificial sequence
  SiRNA target sequence
ggtcggccacaaacataaacc

SEQ ID NO: 87127 - DNA, 21 bp, Artificial sequence
  SiRNA target sequence
gtcggccacaaacataaacca

SEQ ID NO: 87128 - DNA, 21 bp, Artificial sequence
  SiRNA target sequence
tcggccacaaacataaaccaa

SEQ ID NO: 87129 - DNA, 21 bp, Artificial sequence
  SiRNA target sequence
cggccacaaacataaaccaaa

SEQ ID NO: 87130 - DNA, 21 bp, Artificial sequence
  SiRNA target sequence
ggccacaaacataaaccaaac

SEQ ID NO: 87131 - DNA, 21 bp, Artificial sequence
  SiRNA target sequence
gccacaaacataaaccaaaca

SEQ ID NO: 87132 - DNA, 21 bp, Artificial sequence
  SiRNA target sequence
ccacaaacataaaccaaacat

SEQ ID NO: 87133 - DNA, 21 bp, Artificial sequence
  SiRNA target sequence
cacaaacataaaccaaacatc

SEQ ID NO: 87134 - DNA, 21 bp, Artificial sequence
  SiRNA target sequence
acaaacataaaccaaacatcc

SEQ ID NO: 87135 - DNA, 21 bp, Artificial sequence
  SiRNA target sequence
caaacataaaccaaacatccg

SEQ ID NO: 87136 - DNA, 21 bp, Artificial sequence
  SiRNA target sequence
aaacataaaccaaacatccgt

SEQ ID NO: 87137 - DNA, 21 bp, Artificial sequence
  SiRNA target sequence
aacataaaccaaacatccgtc

SEQ ID NO: 87138 - DNA, 21 bp, Artificial sequence
  SiRNA target sequence
acataaaccaaacatccgtct

SEQ ID NO: 87139 - DNA, 21 bp, Artificial sequence
  SiRNA target sequence
cataaaccaaacatccgtctt

SEQ ID NO: 87140 - DNA, 21 bp, Artificial sequence
  SiRNA target sequence
ataaaccaaacatccgtcttt

SEQ ID NO: 87141 - DNA, 21 bp, Artificial sequence
  SiRNA target sequence
taaaccaaacatccgtcttta

SEQ ID NO: 87142 - DNA, 21 bp, Artificial sequence
  SiRNA target sequence
aaaccaaacatccgtctttaa

SEQ ID NO: 87143 - DNA, 21 bp, Artificial sequence
  SiRNA target sequence
aaccaaacatccgtctttaat

SEQ ID NO: 87144 - DNA, 21 bp, Artificial sequence
  SiRNA target sequence
accaaacatccgtctttaatg

SEQ ID NO: 87145 - DNA, 21 bp, Artificial sequence
  SiRNA target sequence
ccaaacatccgtctttaatgt

SEQ ID NO: 87146 - DNA, 21 bp, Artificial sequence
  SiRNA target sequence
caaacatccgtctttaatgta

SEQ ID NO: 87147 - DNA, 21 bp, Artificial sequence
  SiRNA target sequence
aaacatccgtctttaatgtat

SEQ ID NO: 87148 - DNA, 21 bp, Artificial sequence
  SiRNA target sequence
aacatccgtctttaatgtatg

SEQ ID NO: 87149 - DNA, 21 bp, Artificial sequence
  SiRNA target sequence
acatccgtctttaatgtatgt

SEQ ID NO: 87150 - DNA, 21 bp, Artificial sequence
  SiRNA target sequence
catccgtctttaatgtatgtt

SEQ ID NO: 87151 - DNA, 21 bp, Artificial sequence
  SiRNA target sequence
atccgtctttaatgtatgttt

SEQ ID NO: 87152 - DNA, 21 bp, Artificial sequence
  SiRNA target sequence
tccgtctttaatgtatgtttt

SEQ ID NO: 87153 - DNA, 21 bp, Artificial sequence
  SiRNA target sequence
ccgtctttaatgtatgttttt

SEQ ID NO: 87154 - DNA, 21 bp, Artificial sequence
  SiRNA target sequence
cgtctttaatgtatgttttta

SEQ ID NO: 87155 - DNA, 21 bp, Artificial sequence
  SiRNA target sequence
gtctttaatgtatgtttttat

SEQ ID NO: 87156 - DNA, 21 bp, Artificial sequence
  SiRNA target sequence
tctttaatgtatgtttttatc

SEQ ID NO: 87157 - DNA, 21 bp, Artificial sequence
  SiRNA target sequence
ctttaatgtatgtttttatct

SEQ ID NO: 87158 - DNA, 21 bp, Artificial sequence
  SiRNA target sequence
tttaatgtatgtttttatctc

SEQ ID NO: 87159 - DNA, 21 bp, Artificial sequence
  SiRNA target sequence
ttaatgtatgtttttatctca

SEQ ID NO: 87160 - DNA, 21 bp, Artificial sequence
  SiRNA target sequence
taatgtatgtttttatctcat

SEQ ID NO: 87161 - DNA, 21 bp, Artificial sequence
  SiRNA target sequence
aatgtatgtttttatctcatt

SEQ ID NO: 87162 - DNA, 21 bp, Artificial sequence
  SiRNA target sequence
atgtatgtttttatctcattt

SEQ ID NO: 87163 - DNA, 21 bp, Artificial sequence
  SiRNA target sequence
tgtatgtttttatctcattta

SEQ ID NO: 87164 - DNA, 21 bp, Artificial sequence
  SiRNA target sequence
gtatgtttttatctcatttaa

SEQ ID NO: 87165 - DNA, 21 bp, Artificial sequence
  SiRNA target sequence
tatgtttttatctcatttaaa

SEQ ID NO: 87166 - DNA, 21 bp, Artificial sequence
  SiRNA target sequence
atgtttttatctcatttaaat

SEQ ID NO: 87167 - DNA, 21 bp, Artificial sequence
  SiRNA target sequence
tgtttttatctcatttaaatt

SEQ ID NO: 87168 - DNA, 21 bp, Artificial sequence
  SiRNA target sequence
gtttttatctcatttaaattt

SEQ ID NO: 87169 - DNA, 21 bp, Artificial sequence
  SiRNA target sequence
tttttatctcatttaaatttt

SEQ ID NO: 87170 - DNA, 21 bp, Artificial sequence
  SiRNA target sequence
ttttatctcatttaaattttg

SEQ ID NO: 87171 - DNA, 21 bp, Artificial sequence
  SiRNA target sequence
tttatctcatttaaattttgt

SEQ ID NO: 87172 - DNA, 21 bp, Artificial sequence
  SiRNA target sequence
ttatctcatttaaattttgta

SEQ ID NO: 87173 - DNA, 21 bp, Artificial sequence
  SiRNA target sequence
tatctcatttaaattttgtaa

SEQ ID NO: 87174 - DNA, 21 bp, Artificial sequence
  SiRNA target sequence
atctcatttaaattttgtaat

SEQ ID NO: 87175 - DNA, 21 bp, Artificial sequence
  SiRNA target sequence
tctcatttaaattttgtaata

SEQ ID NO: 87176 - DNA, 21 bp, Artificial sequence
  SiRNA target sequence
ctcatttaaattttgtaataa

SEQ ID NO: 87177 - DNA, 21 bp, Artificial sequence
  SiRNA target sequence
tcatttaaattttgtaataaa

SEQ ID NO: 87178 - DNA, 21 bp, Artificial sequence
  SiRNA target sequence
catttaaattttgtaataaat

SEQ ID NO: 87179 - DNA, 21 bp, Artificial sequence
  SiRNA target sequence
atttaaattttgtaataaata

SEQ ID NO: 87180 - DNA, 21 bp, Artificial sequence
  SiRNA target sequence
tttaaattttgtaataaataa

SEQ ID NO: 87181 - DNA, 21 bp, Artificial sequence
  SiRNA target sequence
ttaaattttgtaataaataat

SEQ ID NO: 87182 - DNA, 21 bp, Artificial sequence
  SiRNA target sequence
taaattttgtaataaataatc

SEQ ID NO: 87183 - DNA, 21 bp, Artificial sequence
  SiRNA target sequence
aaattttgtaataaataatca

SEQ ID NO: 87184 - DNA, 21 bp, Artificial sequence
  SiRNA target sequence
aattttgtaataaataatcag

SEQ ID NO: 87185 - DNA, 21 bp, Artificial sequence
  SiRNA target sequence
attttgtaataaataatcagt

SEQ ID NO: 87186 - DNA, 21 bp, Artificial sequence
  SiRNA target sequence
ttttgtaataaataatcagta

SEQ ID NO: 87187 - DNA, 21 bp, Artificial sequence
  SiRNA target sequence
tttgtaataaataatcagtaa

SEQ ID NO: 87188 - DNA, 21 bp, Artificial sequence
  SiRNA target sequence
ttgtaataaataatcagtaac

SEQ ID NO: 87189 - DNA, 21 bp, Artificial sequence
  SiRNA target sequence
tgtaataaataatcagtaaca

SEQ ID NO: 87190 - DNA, 21 bp, Artificial sequence
  SiRNA target sequence
gtaataaataatcagtaacat

SEQ ID NO: 87191 - DNA, 21 bp, Artificial sequence
  SiRNA target sequence
taataaataatcagtaacata

SEQ ID NO: 87192 - DNA, 21 bp, Artificial sequence
  SiRNA target sequence
aataaataatcagtaacataa

SEQ ID NO: 87193 - DNA, 21 bp, Artificial sequence
  SiRNA target sequence
ataaataatcagtaacataaa

SEQ ID NO: 87194 - DNA, 21 bp, Artificial sequence
  SiRNA target sequence
taaataatcagtaacataaat

SEQ ID NO: 87195 - DNA, 21 bp, Artificial sequence
  SiRNA target sequence
aaataatcagtaacataaatt

SEQ ID NO: 87196 - DNA, 21 bp, Artificial sequence
  SiRNA target sequence
aataatcagtaacataaattt

SEQ ID NO: 87197 - DNA, 21 bp, Artificial sequence
  SiRNA target sequence
ataatcagtaacataaatttt

SEQ ID NO: 87198 - DNA, 21 bp, Artificial sequence
  SiRNA target sequence
taatcagtaacataaatttta

SEQ ID NO: 87199 - DNA, 21 bp, Artificial sequence
  SiRNA target sequence
aatcagtaacataaattttat

SEQ ID NO: 87200 - DNA, 21 bp, Artificial sequence
  SiRNA target sequence
atcagtaacataaattttatt

SEQ ID NO: 87201 - DNA, 21 bp, Artificial sequence
  SiRNA target sequence
tcagtaacataaattttatta

SEQ ID NO: 87202 - DNA, 21 bp, Artificial sequence
  SiRNA target sequence
cagtaacataaattttattac

SEQ ID NO: 87203 - DNA, 21 bp, Artificial sequence
  SiRNA target sequence
agtaacataaattttattaca

SEQ ID NO: 87204 - DNA, 21 bp, Artificial sequence
  SiRNA target sequence
gtaacataaattttattacaa

SEQ ID NO: 87205 - DNA, 21 bp, Artificial sequence
  SiRNA target sequence
taacataaattttattacaag

SEQ ID NO: 87206 - DNA, 21 bp, Artificial sequence
  SiRNA target sequence
aacataaattttattacaaga

SEQ ID NO: 87207 - DNA, 21 bp, Artificial sequence
  SiRNA target sequence
acataaattttattacaagat

SEQ ID NO: 87208 - DNA, 21 bp, Artificial sequence
  SiRNA target sequence
cataaattttattacaagata

SEQ ID NO: 87209 - DNA, 21 bp, Artificial sequence
  SiRNA target sequence
ataaattttattacaagataa

SEQ ID NO: 87210 - DNA, 21 bp, Artificial sequence
  SiRNA target sequence
taaattttattacaagataaa

SEQ ID NO: 87211 - DNA, 21 bp, Artificial sequence
  SiRNA target sequence
aaattttattacaagataaaa

SEQ ID NO: 87212 - DNA, 21 bp, Artificial sequence
  SiRNA target sequence
aattttattacaagataaaat

SEQ ID NO: 87213 - DNA, 21 bp, Artificial sequence
  SiRNA target sequence
attttattacaagataaaatt

SEQ ID NO: 87214 - DNA, 21 bp, Artificial sequence
  SiRNA target sequence
ttttattacaagataaaattt

SEQ ID NO: 87215 - DNA, 21 bp, Artificial sequence
  SiRNA target sequence
tttattacaagataaaatttt

SEQ ID NO: 87216 - DNA, 21 bp, Artificial sequence
  SiRNA target sequence
ttattacaagataaaatttta

SEQ ID NO: 87217 - DNA, 21 bp, Artificial sequence
  SiRNA target sequence
tattacaagataaaattttaa

SEQ ID NO: 87218 - DNA, 21 bp, Artificial sequence
  SiRNA target sequence
attacaagataaaattttaat

SEQ ID NO: 87219 - DNA, 21 bp, Artificial sequence
  SiRNA target sequence
ttacaagataaaattttaata

SEQ ID NO: 87220 - DNA, 21 bp, Artificial sequence
  SiRNA target sequence
tacaagataaaattttaataa

SEQ ID NO: 87221 - DNA, 21 bp, Artificial sequence
  SiRNA target sequence
acaagataaaattttaataat

SEQ ID NO: 87222 - DNA, 21 bp, Artificial sequence
  SiRNA target sequence
caagataaaattttaataatt

SEQ ID NO: 87223 - DNA, 21 bp, Artificial sequence
  SiRNA target sequence
aagataaaattttaataattt

SEQ ID NO: 87224 - DNA, 21 bp, Artificial sequence
  SiRNA target sequence
agataaaattttaataatttc

SEQ ID NO: 87225 - DNA, 21 bp, Artificial sequence
  SiRNA target sequence
gataaaattttaataatttct

SEQ ID NO: 87226 - DNA, 21 bp, Artificial sequence
  SiRNA target sequence
ataaaattttaataatttctg

SEQ ID NO: 87227 - DNA, 21 bp, Artificial sequence
  SiRNA target sequence
taaaattttaataatttctgt

SEQ ID NO: 87228 - DNA, 21 bp, Artificial sequence
  SiRNA target sequence
aaaattttaataatttctgtg

SEQ ID NO: 87229 - DNA, 21 bp, Artificial sequence
  SiRNA target sequence
aaattttaataatttctgtgt

SEQ ID NO: 87230 - DNA, 21 bp, Artificial sequence
  SiRNA target sequence
aattttaataatttctgtgtt

SEQ ID NO: 87231 - DNA, 21 bp, Artificial sequence
  SiRNA target sequence
attttaataatttctgtgttt

SEQ ID NO: 87232 - DNA, 21 bp, Artificial sequence
  SiRNA target sequence
ttttaataatttctgtgtttt

SEQ ID NO: 87233 - DNA, 21 bp, Artificial sequence
  SiRNA target sequence
tttaataatttctgtgttttt

SEQ ID NO: 87234 - DNA, 21 bp, Artificial sequence
  SiRNA target sequence
ttaataatttctgtgttttta

SEQ ID NO: 87235 - DNA, 21 bp, Artificial sequence
  SiRNA target sequence
taataatttctgtgtttttat

SEQ ID NO: 87236 - DNA, 21 bp, Artificial sequence
  SiRNA target sequence
aataatttctgtgtttttata

SEQ ID NO: 87237 - DNA, 21 bp, Artificial sequence
  SiRNA target sequence
ataatttctgtgtttttatat

SEQ ID NO: 87238 - DNA, 21 bp, Artificial sequence
  SiRNA target sequence
taatttctgtgtttttatatt

SEQ ID NO: 87239 - DNA, 21 bp, Artificial sequence
  SiRNA target sequence
aatttctgtgtttttatattt

SEQ ID NO: 87240 - DNA, 21 bp, Artificial sequence
  SiRNA target sequence
atttctgtgtttttatatttt

SEQ ID NO: 87241 - DNA, 21 bp, Artificial sequence
  SiRNA target sequence
tttctgtgtttttatattttg

SEQ ID NO: 87242 - DNA, 21 bp, Artificial sequence
  SiRNA target sequence
ttctgtgtttttatattttgc

SEQ ID NO: 87243 - DNA, 21 bp, Artificial sequence
  SiRNA target sequence
tctgtgtttttatattttgca

SEQ ID NO: 87244 - DNA, 21 bp, Artificial sequence
  SiRNA target sequence
ctgtgtttttatattttgcat

SEQ ID NO: 87245 - DNA, 21 bp, Artificial sequence
  SiRNA target sequence
tgtgtttttatattttgcatc

SEQ ID NO: 87246 - DNA, 21 bp, Artificial sequence
  SiRNA target sequence
gtgtttttatattttgcatct

SEQ ID NO: 87247 - DNA, 21 bp, Artificial sequence
  SiRNA target sequence
tgtttttatattttgcatctt

SEQ ID NO: 87248 - DNA, 21 bp, Artificial sequence
  SiRNA target sequence
gtttttatattttgcatcttt

SEQ ID NO: 87249 - DNA, 21 bp, Artificial sequence
  SiRNA target sequence
tttttatattttgcatcttta

SEQ ID NO: 87250 - DNA, 21 bp, Artificial sequence
  SiRNA target sequence
ttttatattttgcatctttaa

SEQ ID NO: 87251 - DNA, 21 bp, Artificial sequence
  SiRNA target sequence
tttatattttgcatctttaat

SEQ ID NO: 87252 - DNA, 21 bp, Artificial sequence
  SiRNA target sequence
ttatattttgcatctttaata

SEQ ID NO: 87253 - DNA, 21 bp, Artificial sequence
  SiRNA target sequence
tatattttgcatctttaataa

SEQ ID NO: 87254 - DNA, 21 bp, Artificial sequence
  SiRNA target sequence
atattttgcatctttaataag

SEQ ID NO: 87255 - DNA, 21 bp, Artificial sequence
  SiRNA target sequence
tattttgcatctttaataaga

SEQ ID NO: 87256 - DNA, 21 bp, Artificial sequence
  SiRNA target sequence
attttgcatctttaataagat

SEQ ID NO: 87257 - DNA, 21 bp, Artificial sequence
  SiRNA target sequence
ttttgcatctttaataagatc

SEQ ID NO: 87258 - DNA, 21 bp, Artificial sequence
  SiRNA target sequence
tttgcatctttaataagatca

SEQ ID NO: 87259 - DNA, 21 bp, Artificial sequence
  SiRNA target sequence
ttgcatctttaataagatcat

SEQ ID NO: 87260 - DNA, 21 bp, Artificial sequence
  SiRNA target sequence
tgcatctttaataagatcatc

SEQ ID NO: 87261 - DNA, 21 bp, Artificial sequence
  SiRNA target sequence
gcatctttaataagatcatct

SEQ ID NO: 87262 - DNA, 21 bp, Artificial sequence
  SiRNA target sequence
catctttaataagatcatctt

SEQ ID NO: 87263 - DNA, 21 bp, Artificial sequence
  SiRNA target sequence
atctttaataagatcatcttc

SEQ ID NO: 87264 - DNA, 21 bp, Artificial sequence
  SiRNA target sequence
tctttaataagatcatcttct

SEQ ID NO: 87265 - DNA, 21 bp, Artificial sequence
  SiRNA target sequence
ctttaataagatcatcttctt

SEQ ID NO: 87266 - DNA, 21 bp, Artificial sequence
  SiRNA target sequence
tttaataagatcatcttcttg

SEQ ID NO: 87267 - DNA, 21 bp, Artificial sequence
  SiRNA target sequence
ttaataagatcatcttcttga

SEQ ID NO: 87268 - DNA, 21 bp, Artificial sequence
  SiRNA target sequence
taataagatcatcttcttgat

SEQ ID NO: 87269 - DNA, 21 bp, Artificial sequence
  SiRNA target sequence
aataagatcatcttcttgatt

SEQ ID NO: 87270 - DNA, 21 bp, Artificial sequence
  SiRNA target sequence
ataagatcatcttcttgattt

SEQ ID NO: 87271 - DNA, 21 bp, Artificial sequence
  SiRNA target sequence
taagatcatcttcttgatttc

SEQ ID NO: 87272 - DNA, 21 bp, Artificial sequence
  SiRNA target sequence
aagatcatcttcttgatttct

SEQ ID NO: 87273 - DNA, 21 bp, Artificial sequence
  SiRNA target sequence
agatcatcttcttgatttcta

SEQ ID NO: 87274 - DNA, 21 bp, Artificial sequence
  SiRNA target sequence
gatcatcttcttgatttctaa

SEQ ID NO: 87275 - DNA, 21 bp, Artificial sequence
  SiRNA target sequence
atcatcttcttgatttctaaa

SEQ ID NO: 87276 - DNA, 21 bp, Artificial sequence
  SiRNA target sequence
tcatcttcttgatttctaaat

SEQ ID NO: 87277 - DNA, 21 bp, Artificial sequence
  SiRNA target sequence
catcttcttgatttctaaatc

SEQ ID NO: 87278 - DNA, 21 bp, Artificial sequence
  SiRNA target sequence
atcttcttgatttctaaatcc

SEQ ID NO: 87279 - DNA, 21 bp, Artificial sequence
  SiRNA target sequence
tcttcttgatttctaaatcca

SEQ ID NO: 87280 - DNA, 21 bp, Artificial sequence
  SiRNA target sequence
cttcttgatttctaaatccat

SEQ ID NO: 87281 - DNA, 21 bp, Artificial sequence
  SiRNA target sequence
ttcttgatttctaaatccata

SEQ ID NO: 87282 - DNA, 21 bp, Artificial sequence
  SiRNA target sequence
tcttgatttctaaatccatat

SEQ ID NO: 87283 - DNA, 21 bp, Artificial sequence
  SiRNA target sequence
cttgatttctaaatccatata

SEQ ID NO: 87284 - DNA, 21 bp, Artificial sequence
  SiRNA target sequence
ttgatttctaaatccatatat

SEQ ID NO: 87285 - DNA, 21 bp, Artificial sequence
  SiRNA target sequence
tgatttctaaatccatatatt

SEQ ID NO: 87286 - DNA, 21 bp, Artificial sequence
  SiRNA target sequence
gatttctaaatccatatatta

SEQ ID NO: 87287 - DNA, 21 bp, Artificial sequence
  SiRNA target sequence
atttctaaatccatatattag

SEQ ID NO: 87288 - DNA, 21 bp, Artificial sequence
  SiRNA target sequence
tttctaaatccatatattagt

SEQ ID NO: 87289 - DNA, 21 bp, Artificial sequence
  SiRNA target sequence
ttctaaatccatatattagtt

SEQ ID NO: 87290 - DNA, 21 bp, Artificial sequence
  SiRNA target sequence
tctaaatccatatattagttt

SEQ ID NO: 87291 - DNA, 21 bp, Artificial sequence
  SiRNA target sequence
ctaaatccatatattagtttg

SEQ ID NO: 87292 - DNA, 21 bp, Artificial sequence
  SiRNA target sequence
taaatccatatattagtttga

SEQ ID NO: 87293 - DNA, 21 bp, Artificial sequence
  SiRNA target sequence
aaatccatatattagtttgat

SEQ ID NO: 87294 - DNA, 21 bp, Artificial sequence
  SiRNA target sequence
aatccatatattagtttgata

SEQ ID NO: 87295 - DNA, 21 bp, Artificial sequence
  SiRNA target sequence
atccatatattagtttgatat

SEQ ID NO: 87296 - DNA, 21 bp, Artificial sequence
  SiRNA target sequence
tccatatattagtttgatata

SEQ ID NO: 87297 - DNA, 21 bp, Artificial sequence
  SiRNA target sequence
ccatatattagtttgatatat

SEQ ID NO: 87298 - DNA, 21 bp, Artificial sequence
  SiRNA target sequence
catatattagtttgatatatt

SEQ ID NO: 87299 - DNA, 21 bp, Artificial sequence
  SiRNA target sequence
atatattagtttgatatattg

SEQ ID NO: 87300 - DNA, 21 bp, Artificial sequence
  SiRNA target sequence
tatattagtttgatatattga

SEQ ID NO: 87301 - DNA, 21 bp, Artificial sequence
  SiRNA target sequence
atattagtttgatatattgat

SEQ ID NO: 87302 - DNA, 21 bp, Artificial sequence
  SiRNA target sequence
tattagtttgatatattgatc

SEQ ID NO: 87303 - DNA, 21 bp, Artificial sequence
  SiRNA target sequence
attagtttgatatattgatcg

SEQ ID NO: 87304 - DNA, 21 bp, Artificial sequence
  SiRNA target sequence
ttagtttgatatattgatcgt

SEQ ID NO: 87305 - DNA, 21 bp, Artificial sequence
  SiRNA target sequence
tagtttgatatattgatcgtc

SEQ ID NO: 87306 - DNA, 21 bp, Artificial sequence
  SiRNA target sequence
agtttgatatattgatcgtct

SEQ ID NO: 87307 - DNA, 21 bp, Artificial sequence
  SiRNA target sequence
gtttgatatattgatcgtctt

SEQ ID NO: 87308 - DNA, 21 bp, Artificial sequence
  SiRNA target sequence
tttgatatattgatcgtcttc

SEQ ID NO: 87309 - DNA, 21 bp, Artificial sequence
  SiRNA target sequence
ttgatatattgatcgtcttct

SEQ ID NO: 87310 - DNA, 21 bp, Artificial sequence
  SiRNA target sequence
tgatatattgatcgtcttctt

SEQ ID NO: 87311 - DNA, 21 bp, Artificial sequence
  SiRNA target sequence
gatatattgatcgtcttcttt

SEQ ID NO: 87312 - DNA, 21 bp, Artificial sequence
  SiRNA target sequence
atatattgatcgtcttcttta

SEQ ID NO: 87313 - DNA, 21 bp, Artificial sequence
  SiRNA target sequence
tatattgatcgtcttctttat

SEQ ID NO: 87314 - DNA, 21 bp, Artificial sequence
  SiRNA target sequence
atattgatcgtcttctttatt

SEQ ID NO: 87315 - DNA, 21 bp, Artificial sequence
  SiRNA target sequence
tattgatcgtcttctttattt

SEQ ID NO: 87316 - DNA, 21 bp, Artificial sequence
  SiRNA target sequence
attgatcgtcttctttatttt

SEQ ID NO: 87317 - DNA, 21 bp, Artificial sequence
  SiRNA target sequence
ttgatcgtcttctttattttt

SEQ ID NO: 87318 - DNA, 21 bp, Artificial sequence
  SiRNA target sequence
tgatcgtcttctttatttttc

SEQ ID NO: 87319 - DNA, 21 bp, Artificial sequence
  SiRNA target sequence
gatcgtcttctttatttttca

SEQ ID NO: 87320 - DNA, 21 bp, Artificial sequence
  SiRNA target sequence
atcgtcttctttatttttcaa

SEQ ID NO: 87321 - DNA, 21 bp, Artificial sequence
  SiRNA target sequence
tcgtcttctttatttttcaaa

SEQ ID NO: 87322 - DNA, 21 bp, Artificial sequence
  SiRNA target sequence
cgtcttctttatttttcaaaa

SEQ ID NO: 87323 - DNA, 21 bp, Artificial sequence
  SiRNA target sequence
gtcttctttatttttcaaaaa

SEQ ID NO: 87324 - DNA, 21 bp, Artificial sequence
  SiRNA target sequence
tcttctttatttttcaaaaac

SEQ ID NO: 87325 - DNA, 21 bp, Artificial sequence
  SiRNA target sequence
cttctttatttttcaaaaacg

SEQ ID NO: 87326 - DNA, 21 bp, Artificial sequence
  SiRNA target sequence
ttctttatttttcaaaaacga

SEQ ID NO: 87327 - DNA, 21 bp, Artificial sequence
  SiRNA target sequence
tctttatttttcaaaaacgaa

SEQ ID NO: 87328 - DNA, 21 bp, Artificial sequence
  SiRNA target sequence
ctttatttttcaaaaacgaaa

SEQ ID NO: 87329 - DNA, 21 bp, Artificial sequence
  SiRNA target sequence
tttatttttcaaaaacgaaaa

SEQ ID NO: 87330 - DNA, 21 bp, Artificial sequence
  SiRNA target sequence
ttatttttcaaaaacgaaaaa

SEQ ID NO: 87331 - DNA, 21 bp, Artificial sequence
  SiRNA target sequence
tatttttcaaaaacgaaaaaa

SEQ ID NO: 87332 - DNA, 21 bp, Artificial sequence
  SiRNA target sequence
atttttcaaaaacgaaaaaaa

SEQ ID NO: 87333 - DNA, 21 bp, Artificial sequence
  SiRNA target sequence
tttttcaaaaacgaaaaaaat

SEQ ID NO: 87334 - DNA, 21 bp, Artificial sequence
  SiRNA target sequence
ttttcaaaaacgaaaaaaatg

SEQ ID NO: 87335 - DNA, 21 bp, Artificial sequence
  SiRNA target sequence
tttcaaaaacgaaaaaaatgg

SEQ ID NO: 87336 - DNA, 21 bp, Artificial sequence
  SiRNA target sequence
ttcaaaaacgaaaaaaatgga

SEQ ID NO: 87337 - DNA, 21 bp, Artificial sequence
  SiRNA target sequence
tcaaaaacgaaaaaaatggag

SEQ ID NO: 87338 - DNA, 21 bp, Artificial sequence
  SiRNA target sequence
caaaaacgaaaaaaatggagc

SEQ ID NO: 87339 - DNA, 21 bp, Artificial sequence
  SiRNA target sequence
aaaaacgaaaaaaatggagca

SEQ ID NO: 87340 - DNA, 21 bp, Artificial sequence
  SiRNA target sequence
aaaacgaaaaaaatggagcaa

SEQ ID NO: 87341 - DNA, 21 bp, Artificial sequence
  SiRNA target sequence
aaacgaaaaaaatggagcaat

SEQ ID NO: 87342 - DNA, 21 bp, Artificial sequence
  SiRNA target sequence
aacgaaaaaaatggagcaatg

SEQ ID NO: 87343 - DNA, 21 bp, Artificial sequence
  SiRNA target sequence
acgaaaaaaatggagcaatgc

SEQ ID NO: 87344 - DNA, 21 bp, Artificial sequence
  SiRNA target sequence
cgaaaaaaatggagcaatgcc

SEQ ID NO: 87345 - DNA, 21 bp, Artificial sequence
  SiRNA target sequence
gaaaaaaatggagcaatgcca

SEQ ID NO: 87346 - DNA, 21 bp, Artificial sequence
  SiRNA target sequence
aaaaaaatggagcaatgccag

SEQ ID NO: 87347 - DNA, 21 bp, Artificial sequence
  SiRNA target sequence
aaaaaatggagcaatgccagt

SEQ ID NO: 87348 - DNA, 21 bp, Artificial sequence
  SiRNA target sequence
aaaaatggagcaatgccagtt

SEQ ID NO: 87349 - DNA, 21 bp, Artificial sequence
  SiRNA target sequence
aaaatggagcaatgccagttc

SEQ ID NO: 87350 - DNA, 21 bp, Artificial sequence
  SiRNA target sequence
aaatggagcaatgccagttcc

SEQ ID NO: 87351 - DNA, 21 bp, Artificial sequence
  SiRNA target sequence
aatggagcaatgccagttcca

SEQ ID NO: 87352 - DNA, 21 bp, Artificial sequence
  SiRNA target sequence
atggagcaatgccagttccag

SEQ ID NO: 87353 - DNA, 21 bp, Artificial sequence
  SiRNA target sequence
tggagcaatgccagttccagt

SEQ ID NO: 87354 - DNA, 21 bp, Artificial sequence
  SiRNA target sequence
ggagcaatgccagttccagta

SEQ ID NO: 87355 - DNA, 21 bp, Artificial sequence
  SiRNA target sequence
gagcaatgccagttccagtac

SEQ ID NO: 87356 - DNA, 21 bp, Artificial sequence
  SiRNA target sequence
agcaatgccagttccagtaca

SEQ ID NO: 87357 - DNA, 21 bp, Artificial sequence
  SiRNA target sequence
gcaatgccagttccagtacaa

SEQ ID NO: 87358 - DNA, 21 bp, Artificial sequence
  SiRNA target sequence
caatgccagttccagtacaaa

SEQ ID NO: 87359 - DNA, 21 bp, Artificial sequence
  SiRNA target sequence
aatgccagttccagtacaaat

SEQ ID NO: 87360 - DNA, 21 bp, Artificial sequence
  SiRNA target sequence
atgccagttccagtacaaata

SEQ ID NO: 87361 - DNA, 21 bp, Artificial sequence
  SiRNA target sequence
tgccagttccagtacaaatac

SEQ ID NO: 87362 - DNA, 21 bp, Artificial sequence
  SiRNA target sequence
gccagttccagtacaaatacc

SEQ ID NO: 87363 - DNA, 21 bp, Artificial sequence
  SiRNA target sequence
ccagttccagtacaaataccc

SEQ ID NO: 87364 - DNA, 21 bp, Artificial sequence
  SiRNA target sequence
cagttccagtacaaataccca

SEQ ID NO: 87365 - DNA, 21 bp, Artificial sequence
  SiRNA target sequence
agttccagtacaaatacccaa

SEQ ID NO: 87366 - DNA, 21 bp, Artificial sequence
  SiRNA target sequence
gttccagtacaaatacccaac

SEQ ID NO: 87367 - DNA, 21 bp, Artificial sequence
  SiRNA target sequence
ttccagtacaaatacccaaca

SEQ ID NO: 87368 - DNA, 21 bp, Artificial sequence
  SiRNA target sequence
tccagtacaaatacccaacac

SEQ ID NO: 87369 - DNA, 21 bp, Artificial sequence
  SiRNA target sequence
ccagtacaaatacccaacact

SEQ ID NO: 87370 - DNA, 21 bp, Artificial sequence
  SiRNA target sequence
cagtacaaatacccaacactt

SEQ ID NO: 87371 - DNA, 21 bp, Artificial sequence
  SiRNA target sequence
agtacaaatacccaacacttt

SEQ ID NO: 87372 - DNA, 21 bp, Artificial sequence
  SiRNA target sequence
gtacaaatacccaacactttt

SEQ ID NO: 87373 - DNA, 21 bp, Artificial sequence
  SiRNA target sequence
tacaaatacccaacacttttt

SEQ ID NO: 87374 - DNA, 21 bp, Artificial sequence
  SiRNA target sequence
acaaatacccaacactttttt

SEQ ID NO: 87375 - DNA, 21 bp, Artificial sequence
  SiRNA target sequence
caaatacccaacactttttta

SEQ ID NO: 87376 - DNA, 21 bp, Artificial sequence
  SiRNA target sequence
aaatacccaacacttttttac

SEQ ID NO: 87377 - DNA, 21 bp, Artificial sequence
  SiRNA target sequence
aatacccaacacttttttaca

SEQ ID NO: 87378 - DNA, 21 bp, Artificial sequence
  SiRNA target sequence
atacccaacacttttttacaa

SEQ ID NO: 87379 - DNA, 21 bp, Artificial sequence
  SiRNA target sequence
tacccaacacttttttacaaa

SEQ ID NO: 87380 - DNA, 21 bp, Artificial sequence
  SiRNA target sequence
acccaacacttttttacaaaa

SEQ ID NO: 87381 - DNA, 21 bp, Artificial sequence
  SiRNA target sequence
cccaacacttttttacaaaaa

SEQ ID NO: 87382 - DNA, 21 bp, Artificial sequence
  SiRNA target sequence
ccaacacttttttacaaaaat

SEQ ID NO: 87383 - DNA, 21 bp, Artificial sequence
  SiRNA target sequence
caacacttttttacaaaaatt

SEQ ID NO: 87384 - DNA, 21 bp, Artificial sequence
  SiRNA target sequence
aacacttttttacaaaaattt

SEQ ID NO: 87385 - DNA, 21 bp, Artificial sequence
  SiRNA target sequence
acacttttttacaaaaattta

SEQ ID NO: 87386 - DNA, 21 bp, Artificial sequence
  SiRNA target sequence
cacttttttacaaaaatttaa

SEQ ID NO: 87387 - DNA, 21 bp, Artificial sequence
  SiRNA target sequence
acttttttacaaaaatttaat

SEQ ID NO: 87388 - DNA, 21 bp, Artificial sequence
  SiRNA target sequence
cttttttacaaaaatttaatc

SEQ ID NO: 87389 - DNA, 21 bp, Artificial sequence
  SiRNA target sequence
ttttttacaaaaatttaatct

SEQ ID NO: 87390 - DNA, 21 bp, Artificial sequence
  SiRNA target sequence
tttttacaaaaatttaatcta

SEQ ID NO: 87391 - DNA, 21 bp, Artificial sequence
  SiRNA target sequence
ttttacaaaaatttaatctaa

SEQ ID NO: 87392 - DNA, 21 bp, Artificial sequence
  SiRNA target sequence
tttacaaaaatttaatctaaa

SEQ ID NO: 87393 - DNA, 21 bp, Artificial sequence
  SiRNA target sequence
ttacaaaaatttaatctaaat

SEQ ID NO: 87394 - DNA, 21 bp, Artificial sequence
  SiRNA target sequence
tacaaaaatttaatctaaata

SEQ ID NO: 87395 - DNA, 21 bp, Artificial sequence
  SiRNA target sequence
acaaaaatttaatctaaataa

SEQ ID NO: 87396 - DNA, 21 bp, Artificial sequence
  SiRNA target sequence
caaaaatttaatctaaataat

SEQ ID NO: 87397 - DNA, 21 bp, Artificial sequence
  SiRNA target sequence
aaaaatttaatctaaataatt

SEQ ID NO: 87398 - DNA, 21 bp, Artificial sequence
  SiRNA target sequence
aaaatttaatctaaataattt

SEQ ID NO: 87399 - DNA, 21 bp, Artificial sequence
  SiRNA target sequence
aaatttaatctaaataattta

SEQ ID NO: 87400 - DNA, 21 bp, Artificial sequence
  SiRNA target sequence
aatttaatctaaataatttac

SEQ ID NO: 87401 - DNA, 21 bp, Artificial sequence
  SiRNA target sequence
atttaatctaaataatttact

SEQ ID NO: 87402 - DNA, 21 bp, Artificial sequence
  SiRNA target sequence
tttaatctaaataatttactc

SEQ ID NO: 87403 - DNA, 21 bp, Artificial sequence
  SiRNA target sequence
ttaatctaaataatttactcg

SEQ ID NO: 87404 - DNA, 21 bp, Artificial sequence
  SiRNA target sequence
taatctaaataatttactcgg

SEQ ID NO: 87405 - DNA, 21 bp, Artificial sequence
  SiRNA target sequence
aatctaaataatttactcggt

SEQ ID NO: 87406 - DNA, 21 bp, Artificial sequence
  SiRNA target sequence
atctaaataatttactcggtc

SEQ ID NO: 87407 - DNA, 21 bp, Artificial sequence
  SiRNA target sequence
tctaaataatttactcggtct

SEQ ID NO: 87408 - DNA, 21 bp, Artificial sequence
  SiRNA target sequence
ctaaataatttactcggtctg

SEQ ID NO: 87409 - DNA, 21 bp, Artificial sequence
  SiRNA target sequence
taaataatttactcggtctgt

SEQ ID NO: 87410 - DNA, 21 bp, Artificial sequence
  SiRNA target sequence
aaataatttactcggtctgtg

SEQ ID NO: 87411 - DNA, 21 bp, Artificial sequence
  SiRNA target sequence
aataatttactcggtctgtga

SEQ ID NO: 87412 - DNA, 21 bp, Artificial sequence
  SiRNA target sequence
ataatttactcggtctgtgac

SEQ ID NO: 87413 - DNA, 21 bp, Artificial sequence
  SiRNA target sequence
taatttactcggtctgtgaca

SEQ ID NO: 87414 - DNA, 21 bp, Artificial sequence
  SiRNA target sequence
aatttactcggtctgtgacag

SEQ ID NO: 87415 - DNA, 21 bp, Artificial sequence
  SiRNA target sequence
atttactcggtctgtgacaga

SEQ ID NO: 87416 - DNA, 21 bp, Artificial sequence
  SiRNA target sequence
tttactcggtctgtgacagat

SEQ ID NO: 87417 - DNA, 21 bp, Artificial sequence
  SiRNA target sequence
ttactcggtctgtgacagatc

SEQ ID NO: 87418 - DNA, 21 bp, Artificial sequence
  SiRNA target sequence
tactcggtctgtgacagatct

SEQ ID NO: 87419 - DNA, 21 bp, Artificial sequence
  SiRNA target sequence
actcggtctgtgacagatctt

SEQ ID NO: 87420 - DNA, 21 bp, Artificial sequence
  SiRNA target sequence
ctcggtctgtgacagatcttt

SEQ ID NO: 87421 - DNA, 21 bp, Artificial sequence
  SiRNA target sequence
tcggtctgtgacagatcttta

SEQ ID NO: 87422 - DNA, 21 bp, Artificial sequence
  SiRNA target sequence
cggtctgtgacagatctttaa

SEQ ID NO: 87423 - DNA, 21 bp, Artificial sequence
  SiRNA target sequence
ggtctgtgacagatctttaaa

SEQ ID NO: 87424 - DNA, 21 bp, Artificial sequence
  SiRNA target sequence
gtctgtgacagatctttaaat

SEQ ID NO: 87425 - DNA, 21 bp, Artificial sequence
  SiRNA target sequence
tctgtgacagatctttaaatt

SEQ ID NO: 87426 - DNA, 21 bp, Artificial sequence
  SiRNA target sequence
ctgtgacagatctttaaatta

SEQ ID NO: 87427 - DNA, 21 bp, Artificial sequence
  SiRNA target sequence
tgtgacagatctttaaattat

SEQ ID NO: 87428 - DNA, 21 bp, Artificial sequence
  SiRNA target sequence
gtgacagatctttaaattatt

SEQ ID NO: 87429 - DNA, 21 bp, Artificial sequence
  SiRNA target sequence
tgacagatctttaaattatta

SEQ ID NO: 87430 - DNA, 21 bp, Artificial sequence
  SiRNA target sequence
gacagatctttaaattattat

SEQ ID NO: 87431 - DNA, 21 bp, Artificial sequence
  SiRNA target sequence
acagatctttaaattattata

SEQ ID NO: 87432 - DNA, 21 bp, Artificial sequence
  SiRNA target sequence
cagatctttaaattattataa

SEQ ID NO: 87433 - DNA, 21 bp, Artificial sequence
  SiRNA target sequence
agatctttaaattattataat

SEQ ID NO: 87434 - DNA, 21 bp, Artificial sequence
  SiRNA target sequence
gatctttaaattattataatt

SEQ ID NO: 87435 - DNA, 21 bp, Artificial sequence
  SiRNA target sequence
atctttaaattattataattt

SEQ ID NO: 87436 - DNA, 21 bp, Artificial sequence
  SiRNA target sequence
tctttaaattattataatttt

SEQ ID NO: 87437 - DNA, 21 bp, Artificial sequence
  SiRNA target sequence
ctttaaattattataattttg

SEQ ID NO: 87438 - DNA, 21 bp, Artificial sequence
  SiRNA target sequence
tttaaattattataattttgc

SEQ ID NO: 87439 - DNA, 21 bp, Artificial sequence
  SiRNA target sequence
ttaaattattataattttgca

SEQ ID NO: 87440 - DNA, 21 bp, Artificial sequence
  SiRNA target sequence
taaattattataattttgcat

SEQ ID NO: 87441 - DNA, 21 bp, Artificial sequence
  SiRNA target sequence
aaattattataattttgcata

SEQ ID NO: 87442 - DNA, 21 bp, Artificial sequence
  SiRNA target sequence
aattattataattttgcatat

SEQ ID NO: 87443 - DNA, 21 bp, Artificial sequence
  SiRNA target sequence
attattataattttgcatatc

SEQ ID NO: 87444 - DNA, 21 bp, Artificial sequence
  SiRNA target sequence
ttattataattttgcatatct

SEQ ID NO: 87445 - DNA, 21 bp, Artificial sequence
  SiRNA target sequence
tattataattttgcatatcta

SEQ ID NO: 87446 - DNA, 21 bp, Artificial sequence
  SiRNA target sequence
attataattttgcatatctat

SEQ ID NO: 87447 - DNA, 21 bp, Artificial sequence
  SiRNA target sequence
ttataattttgcatatctatg

SEQ ID NO: 87448 - DNA, 21 bp, Artificial sequence
  SiRNA target sequence
tataattttgcatatctatga

SEQ ID NO: 87449 - DNA, 21 bp, Artificial sequence
  SiRNA target sequence
ataattttgcatatctatgaa

SEQ ID NO: 87450 - DNA, 21 bp, Artificial sequence
  SiRNA target sequence
taattttgcatatctatgaaa

SEQ ID NO: 87451 - DNA, 21 bp, Artificial sequence
  SiRNA target sequence
aattttgcatatctatgaaat

SEQ ID NO: 87452 - DNA, 21 bp, Artificial sequence
  SiRNA target sequence
attttgcatatctatgaaatt

SEQ ID NO: 87453 - DNA, 21 bp, Artificial sequence
  SiRNA target sequence
ttttgcatatctatgaaattg

SEQ ID NO: 87454 - DNA, 21 bp, Artificial sequence
  SiRNA target sequence
tttgcatatctatgaaattgg

SEQ ID NO: 87455 - DNA, 21 bp, Artificial sequence
  SiRNA target sequence
ttgcatatctatgaaattgga

SEQ ID NO: 87456 - DNA, 21 bp, Artificial sequence
  SiRNA target sequence
tgcatatctatgaaattggaa

SEQ ID NO: 87457 - DNA, 21 bp, Artificial sequence
  SiRNA target sequence
gcatatctatgaaattggaaa

SEQ ID NO: 87458 - DNA, 21 bp, Artificial sequence
  SiRNA target sequence
catatctatgaaattggaaac

SEQ ID NO: 87459 - DNA, 21 bp, Artificial sequence
  SiRNA target sequence
atatctatgaaattggaaaca

SEQ ID NO: 87460 - DNA, 21 bp, Artificial sequence
  SiRNA target sequence
tatctatgaaattggaaacat

SEQ ID NO: 87461 - DNA, 21 bp, Artificial sequence
  SiRNA target sequence
atctatgaaattggaaacatg

SEQ ID NO: 87462 - DNA, 21 bp, Artificial sequence
  SiRNA target sequence
tctatgaaattggaaacatgt

SEQ ID NO: 87463 - DNA, 21 bp, Artificial sequence
  SiRNA target sequence
ctatgaaattggaaacatgtc

SEQ ID NO: 87464 - DNA, 21 bp, Artificial sequence
  SiRNA target sequence
tatgaaattggaaacatgtcc

SEQ ID NO: 87465 - DNA, 21 bp, Artificial sequence
  SiRNA target sequence
atgaaattggaaacatgtcca

SEQ ID NO: 87466 - DNA, 21 bp, Artificial sequence
  SiRNA target sequence
tgaaattggaaacatgtccat

SEQ ID NO: 87467 - DNA, 21 bp, Artificial sequence
  SiRNA target sequence
gaaattggaaacatgtccata

SEQ ID NO: 87468 - DNA, 21 bp, Artificial sequence
  SiRNA target sequence
aaattggaaacatgtccatat

SEQ ID NO: 87469 - DNA, 21 bp, Artificial sequence
  SiRNA target sequence
aattggaaacatgtccatatc

SEQ ID NO: 87470 - DNA, 21 bp, Artificial sequence
  SiRNA target sequence
attggaaacatgtccatatct

SEQ ID NO: 87471 - DNA, 21 bp, Artificial sequence
  SiRNA target sequence
ttggaaacatgtccatatcta

SEQ ID NO: 87472 - DNA, 21 bp, Artificial sequence
  SiRNA target sequence
tggaaacatgtccatatctat

SEQ ID NO: 87473 - DNA, 21 bp, Artificial sequence
  SiRNA target sequence
ggaaacatgtccatatctatc

SEQ ID NO: 87474 - DNA, 21 bp, Artificial sequence
  SiRNA target sequence
gaaacatgtccatatctatcg

SEQ ID NO: 87475 - DNA, 21 bp, Artificial sequence
  SiRNA target sequence
aaacatgtccatatctatcgc

SEQ ID NO: 87476 - DNA, 21 bp, Artificial sequence
  SiRNA target sequence
aacatgtccatatctatcgcc

SEQ ID NO: 87477 - DNA, 21 bp, Artificial sequence
  SiRNA target sequence
acatgtccatatctatcgcct

SEQ ID NO: 87478 - DNA, 21 bp, Artificial sequence
  SiRNA target sequence
catgtccatatctatcgcctt

SEQ ID NO: 87479 - DNA, 21 bp, Artificial sequence
  SiRNA target sequence
atgtccatatctatcgccttt

SEQ ID NO: 87480 - DNA, 21 bp, Artificial sequence
  SiRNA target sequence
tgtccatatctatcgcctttt

SEQ ID NO: 87481 - DNA, 21 bp, Artificial sequence
  SiRNA target sequence
gtccatatctatcgccttttt

SEQ ID NO: 87482 - DNA, 21 bp, Artificial sequence
  SiRNA target sequence
tccatatctatcgcctttttt

SEQ ID NO: 87483 - DNA, 21 bp, Artificial sequence
  SiRNA target sequence
ccatatctatcgcctttttta

SEQ ID NO: 87484 - DNA, 21 bp, Artificial sequence
  SiRNA target sequence
catatctatcgccttttttaa

SEQ ID NO: 87485 - DNA, 21 bp, Artificial sequence
  SiRNA target sequence
atatctatcgccttttttaat

SEQ ID NO: 87486 - DNA, 21 bp, Artificial sequence
  SiRNA target sequence
tatctatcgccttttttaata

SEQ ID NO: 87487 - DNA, 21 bp, Artificial sequence
  SiRNA target sequence
atctatcgccttttttaataa

SEQ ID NO: 87488 - DNA, 21 bp, Artificial sequence
  SiRNA target sequence
tctatcgccttttttaataat

SEQ ID NO: 87489 - DNA, 21 bp, Artificial sequence
  SiRNA target sequence
ctatcgccttttttaataatt

SEQ ID NO: 87490 - DNA, 21 bp, Artificial sequence
  SiRNA target sequence
tatcgccttttttaataattg

SEQ ID NO: 87491 - DNA, 21 bp, Artificial sequence
  SiRNA target sequence
atcgccttttttaataattgc

SEQ ID NO: 87492 - DNA, 21 bp, Artificial sequence
  SiRNA target sequence
tcgccttttttaataattgct

SEQ ID NO: 87493 - DNA, 21 bp, Artificial sequence
  SiRNA target sequence
cgccttttttaataattgcta

SEQ ID NO: 87494 - DNA, 21 bp, Artificial sequence
  SiRNA target sequence
gccttttttaataattgctac

SEQ ID NO: 87495 - DNA, 21 bp, Artificial sequence
  SiRNA target sequence
ccttttttaataattgctact

SEQ ID NO: 87496 - DNA, 21 bp, Artificial sequence
  SiRNA target sequence
cttttttaataattgctacta

SEQ ID NO: 87497 - DNA, 21 bp, Artificial sequence
  SiRNA target sequence
ttttttaataattgctactaa

SEQ ID NO: 87498 - DNA, 21 bp, Artificial sequence
  SiRNA target sequence
tttttaataattgctactaaa

SEQ ID NO: 87499 - DNA, 21 bp, Artificial sequence
  SiRNA target sequence
ttttaataattgctactaaaa

SEQ ID NO: 87500 - DNA, 21 bp, Artificial sequence
  SiRNA target sequence
tttaataattgctactaaaat

SEQ ID NO: 87501 - DNA, 21 bp, Artificial sequence
  SiRNA target sequence
ttaataattgctactaaaatt

SEQ ID NO: 87502 - DNA, 21 bp, Artificial sequence
  SiRNA target sequence
taataattgctactaaaattt

SEQ ID NO: 87503 - DNA, 21 bp, Artificial sequence
  SiRNA target sequence
aataattgctactaaaatttc

SEQ ID NO: 87504 - DNA, 21 bp, Artificial sequence
  SiRNA target sequence
ataattgctactaaaatttca

SEQ ID NO: 87505 - DNA, 21 bp, Artificial sequence
  SiRNA target sequence
taattgctactaaaatttcac

SEQ ID NO: 87506 - DNA, 21 bp, Artificial sequence
  SiRNA target sequence
aattgctactaaaatttcaca

SEQ ID NO: 87507 - DNA, 21 bp, Artificial sequence
  SiRNA target sequence
attgctactaaaatttcacat

SEQ ID NO: 87508 - DNA, 21 bp, Artificial sequence
  SiRNA target sequence
ttgctactaaaatttcacatt

SEQ ID NO: 87509 - DNA, 21 bp, Artificial sequence
  SiRNA target sequence
tgctactaaaatttcacattt

SEQ ID NO: 87510 - DNA, 21 bp, Artificial sequence
  SiRNA target sequence
gctactaaaatttcacatttt

SEQ ID NO: 87511 - DNA, 21 bp, Artificial sequence
  SiRNA target sequence
ctactaaaatttcacattttt

SEQ ID NO: 87512 - DNA, 21 bp, Artificial sequence
  SiRNA target sequence
tactaaaatttcacatttttc

SEQ ID NO: 87513 - DNA, 21 bp, Artificial sequence
  SiRNA target sequence
actaaaatttcacatttttca

SEQ ID NO: 87514 - DNA, 21 bp, Artificial sequence
  SiRNA target sequence
ctaaaatttcacatttttcat

SEQ ID NO: 87515 - DNA, 21 bp, Artificial sequence
  SiRNA target sequence
taaaatttcacatttttcatt

SEQ ID NO: 87516 - DNA, 21 bp, Artificial sequence
  SiRNA target sequence
aaaatttcacatttttcattt

SEQ ID NO: 87517 - DNA, 21 bp, Artificial sequence
  SiRNA target sequence
aaatttcacatttttcattta

SEQ ID NO: 87518 - DNA, 21 bp, Artificial sequence
  SiRNA target sequence
aatttcacatttttcatttac

SEQ ID NO: 87519 - DNA, 21 bp, Artificial sequence
  SiRNA target sequence
atttcacatttttcatttacg

SEQ ID NO: 87520 - DNA, 21 bp, Artificial sequence
  SiRNA target sequence
tttcacatttttcatttacgt

SEQ ID NO: 87521 - DNA, 21 bp, Artificial sequence
  SiRNA target sequence
ttcacatttttcatttacgtg

SEQ ID NO: 87522 - DNA, 21 bp, Artificial sequence
  SiRNA target sequence
tcacatttttcatttacgtgg

SEQ ID NO: 87523 - DNA, 21 bp, Artificial sequence
  SiRNA target sequence
cacatttttcatttacgtggt

SEQ ID NO: 87524 - DNA, 21 bp, Artificial sequence
  SiRNA target sequence
acatttttcatttacgtggtt

SEQ ID NO: 87525 - DNA, 21 bp, Artificial sequence
  SiRNA target sequence
catttttcatttacgtggtta

SEQ ID NO: 87526 - DNA, 21 bp, Artificial sequence
  SiRNA target sequence
atttttcatttacgtggttag

SEQ ID NO: 87527 - DNA, 21 bp, Artificial sequence
  SiRNA target sequence
tttttcatttacgtggttagt

SEQ ID NO: 87528 - DNA, 21 bp, Artificial sequence
  SiRNA target sequence
ttttcatttacgtggttagta

SEQ ID NO: 87529 - DNA, 21 bp, Artificial sequence
  SiRNA target sequence
tttcatttacgtggttagtaa

SEQ ID NO: 87530 - DNA, 21 bp, Artificial sequence
  SiRNA target sequence
ttcatttacgtggttagtaag

SEQ ID NO: 87531 - DNA, 21 bp, Artificial sequence
  SiRNA target sequence
tcatttacgtggttagtaagt

SEQ ID NO: 87532 - DNA, 21 bp, Artificial sequence
  SiRNA target sequence
catttacgtggttagtaagtg

SEQ ID NO: 87533 - DNA, 21 bp, Artificial sequence
  SiRNA target sequence
atttacgtggttagtaagtga

SEQ ID NO: 87534 - DNA, 21 bp, Artificial sequence
  SiRNA target sequence
tttacgtggttagtaagtgaa

SEQ ID NO: 87535 - DNA, 21 bp, Artificial sequence
  SiRNA target sequence
ttacgtggttagtaagtgaat

SEQ ID NO: 87536 - DNA, 21 bp, Artificial sequence
  SiRNA target sequence
tacgtggttagtaagtgaata

SEQ ID NO: 87537 - DNA, 21 bp, Artificial sequence
  SiRNA target sequence
acgtggttagtaagtgaataa

SEQ ID NO: 87538 - DNA, 21 bp, Artificial sequence
  SiRNA target sequence
cgtggttagtaagtgaataat

SEQ ID NO: 87539 - DNA, 21 bp, Artificial sequence
  SiRNA target sequence
gtggttagtaagtgaataata

SEQ ID NO: 87540 - DNA, 21 bp, Artificial sequence
  SiRNA target sequence
tggttagtaagtgaataatat

SEQ ID NO: 87541 - DNA, 21 bp, Artificial sequence
  SiRNA target sequence
ggttagtaagtgaataatatc

SEQ ID NO: 87542 - DNA, 21 bp, Artificial sequence
  SiRNA target sequence
gttagtaagtgaataatatct

SEQ ID NO: 87543 - DNA, 21 bp, Artificial sequence
  SiRNA target sequence
ttagtaagtgaataatatctt

SEQ ID NO: 87544 - DNA, 21 bp, Artificial sequence
  SiRNA target sequence
tagtaagtgaataatatcttg

SEQ ID NO: 87545 - DNA, 21 bp, Artificial sequence
  SiRNA target sequence
agtaagtgaataatatcttgg

SEQ ID NO: 87546 - DNA, 21 bp, Artificial sequence
  SiRNA target sequence
gtaagtgaataatatcttggc

SEQ ID NO: 87547 - DNA, 21 bp, Artificial sequence
  SiRNA target sequence
taagtgaataatatcttggct

SEQ ID NO: 87548 - DNA, 21 bp, Artificial sequence
  SiRNA target sequence
aagtgaataatatcttggctt

SEQ ID NO: 87549 - DNA, 21 bp, Artificial sequence
  SiRNA target sequence
agtgaataatatcttggctta

SEQ ID NO: 87550 - DNA, 21 bp, Artificial sequence
  SiRNA target sequence
gtgaataatatcttggcttaa

SEQ ID NO: 87551 - DNA, 21 bp, Artificial sequence
  SiRNA target sequence
tgaataatatcttggcttaat

SEQ ID NO: 87552 - DNA, 21 bp, Artificial sequence
  SiRNA target sequence
gaataatatcttggcttaatt

SEQ ID NO: 87553 - DNA, 21 bp, Artificial sequence
  SiRNA target sequence
aataatatcttggcttaattg

SEQ ID NO: 87554 - DNA, 21 bp, Artificial sequence
  SiRNA target sequence
ataatatcttggcttaattgt

SEQ ID NO: 87555 - DNA, 21 bp, Artificial sequence
  SiRNA target sequence
taatatcttggcttaattgtt

SEQ ID NO: 87556 - DNA, 21 bp, Artificial sequence
  SiRNA target sequence
aatatcttggcttaattgttt

SEQ ID NO: 87557 - DNA, 21 bp, Artificial sequence
  SiRNA target sequence
atatcttggcttaattgtttg

SEQ ID NO: 87558 - DNA, 21 bp, Artificial sequence
  SiRNA target sequence
tatcttggcttaattgtttga

SEQ ID NO: 87559 - DNA, 21 bp, Artificial sequence
  SiRNA target sequence
atcttggcttaattgtttgac

SEQ ID NO: 87560 - DNA, 21 bp, Artificial sequence
  SiRNA target sequence
tcttggcttaattgtttgaca

SEQ ID NO: 87561 - DNA, 21 bp, Artificial sequence
  SiRNA target sequence
cttggcttaattgtttgacaa

SEQ ID NO: 87562 - DNA, 21 bp, Artificial sequence
  SiRNA target sequence
ttggcttaattgtttgacaat

SEQ ID NO: 87563 - DNA, 21 bp, Artificial sequence
  SiRNA target sequence
tggcttaattgtttgacaatt

SEQ ID NO: 87564 - DNA, 21 bp, Artificial sequence
  SiRNA target sequence
ggcttaattgtttgacaattc

SEQ ID NO: 87565 - DNA, 21 bp, Artificial sequence
  SiRNA target sequence
gcttaattgtttgacaattca

SEQ ID NO: 87566 - DNA, 21 bp, Artificial sequence
  SiRNA target sequence
cttaattgtttgacaattcat

SEQ ID NO: 87567 - DNA, 21 bp, Artificial sequence
  SiRNA target sequence
ttaattgtttgacaattcata

SEQ ID NO: 87568 - DNA, 21 bp, Artificial sequence
  SiRNA target sequence
taattgtttgacaattcataa

SEQ ID NO: 87569 - DNA, 21 bp, Artificial sequence
  SiRNA target sequence
aattgtttgacaattcataat

SEQ ID NO: 87570 - DNA, 21 bp, Artificial sequence
  SiRNA target sequence
attgtttgacaattcataata

SEQ ID NO: 87571 - DNA, 21 bp, Artificial sequence
  SiRNA target sequence
ttgtttgacaattcataataa

SEQ ID NO: 87572 - DNA, 21 bp, Artificial sequence
  SiRNA target sequence
tgtttgacaattcataataag

SEQ ID NO: 87573 - DNA, 21 bp, Artificial sequence
  SiRNA target sequence
gtttgacaattcataataaga

SEQ ID NO: 87574 - DNA, 21 bp, Artificial sequence
  SiRNA target sequence
tttgacaattcataataagat

SEQ ID NO: 87575 - DNA, 21 bp, Artificial sequence
  SiRNA target sequence
ttgacaattcataataagatc

SEQ ID NO: 87576 - DNA, 21 bp, Artificial sequence
  SiRNA target sequence
tgacaattcataataagatcc

SEQ ID NO: 87577 - DNA, 21 bp, Artificial sequence
  SiRNA target sequence
gacaattcataataagatcct

SEQ ID NO: 87578 - DNA, 21 bp, Artificial sequence
  SiRNA target sequence
acaattcataataagatcctc

SEQ ID NO: 87579 - DNA, 21 bp, Artificial sequence
  SiRNA target sequence
caattcataataagatcctct

SEQ ID NO: 87580 - DNA, 21 bp, Artificial sequence
  SiRNA target sequence
aattcataataagatcctcta

SEQ ID NO: 87581 - DNA, 21 bp, Artificial sequence
  SiRNA target sequence
attcataataagatcctctaa

SEQ ID NO: 87582 - DNA, 21 bp, Artificial sequence
  SiRNA target sequence
ttcataataagatcctctaaa

SEQ ID NO: 87583 - DNA, 21 bp, Artificial sequence
  SiRNA target sequence
tcataataagatcctctaaac

SEQ ID NO: 87584 - DNA, 21 bp, Artificial sequence
  SiRNA target sequence
cataataagatcctctaaact

SEQ ID NO: 87585 - DNA, 21 bp, Artificial sequence
  SiRNA target sequence
ataataagatcctctaaactt

SEQ ID NO: 87586 - DNA, 21 bp, Artificial sequence
  SiRNA target sequence
taataagatcctctaaacttg

SEQ ID NO: 87587 - DNA, 21 bp, Artificial sequence
  SiRNA target sequence
aataagatcctctaaacttgg

SEQ ID NO: 87588 - DNA, 21 bp, Artificial sequence
  SiRNA target sequence
ataagatcctctaaacttggt

SEQ ID NO: 87589 - DNA, 21 bp, Artificial sequence
  SiRNA target sequence
taagatcctctaaacttggtt

SEQ ID NO: 87590 - DNA, 21 bp, Artificial sequence
  SiRNA target sequence
aagatcctctaaacttggttt

SEQ ID NO: 87591 - DNA, 21 bp, Artificial sequence
  SiRNA target sequence
agatcctctaaacttggttta

SEQ ID NO: 87592 - DNA, 21 bp, Artificial sequence
  SiRNA target sequence
gatcctctaaacttggtttac

SEQ ID NO: 87593 - DNA, 21 bp, Artificial sequence
  SiRNA target sequence
atcctctaaacttggtttaca

SEQ ID NO: 87594 - DNA, 21 bp, Artificial sequence
  SiRNA target sequence
tcctctaaacttggtttacat

SEQ ID NO: 87595 - DNA, 21 bp, Artificial sequence
  SiRNA target sequence
cctctaaacttggtttacatt

SEQ ID NO: 87596 - DNA, 21 bp, Artificial sequence
  SiRNA target sequence
ctctaaacttggtttacattg

SEQ ID NO: 87597 - DNA, 21 bp, Artificial sequence
  SiRNA target sequence
tctaaacttggtttacattga

SEQ ID NO: 87598 - DNA, 21 bp, Artificial sequence
  SiRNA target sequence
ctaaacttggtttacattgaa

SEQ ID NO: 87599 - DNA, 21 bp, Artificial sequence
  SiRNA target sequence
taaacttggtttacattgaaa

SEQ ID NO: 87600 - DNA, 21 bp, Artificial sequence
  SiRNA target sequence
aaacttggtttacattgaaat

SEQ ID NO: 87601 - DNA, 21 bp, Artificial sequence
  SiRNA target sequence
aacttggtttacattgaaatg

SEQ ID NO: 87602 - DNA, 21 bp, Artificial sequence
  SiRNA target sequence
acttggtttacattgaaatgt

SEQ ID NO: 87603 - DNA, 21 bp, Artificial sequence
  SiRNA target sequence
cttggtttacattgaaatgta

SEQ ID NO: 87604 - DNA, 21 bp, Artificial sequence
  SiRNA target sequence
ttggtttacattgaaatgtat

SEQ ID NO: 87605 - DNA, 21 bp, Artificial sequence
  SiRNA target sequence
tggtttacattgaaatgtata

SEQ ID NO: 87606 - DNA, 21 bp, Artificial sequence
  SiRNA target sequence
ggtttacattgaaatgtatat

SEQ ID NO: 87607 - DNA, 21 bp, Artificial sequence
  SiRNA target sequence
gtttacattgaaatgtatata

SEQ ID NO: 87608 - DNA, 21 bp, Artificial sequence
  SiRNA target sequence
tttacattgaaatgtatatat

SEQ ID NO: 87609 - DNA, 21 bp, Artificial sequence
  SiRNA target sequence
ttacattgaaatgtatatata

SEQ ID NO: 87610 - DNA, 21 bp, Artificial sequence
  SiRNA target sequence
tacattgaaatgtatatataa

SEQ ID NO: 87611 - DNA, 21 bp, Artificial sequence
  SiRNA target sequence
acattgaaatgtatatataat

SEQ ID NO: 87612 - DNA, 21 bp, Artificial sequence
  SiRNA target sequence
cattgaaatgtatatataatg

SEQ ID NO: 87613 - DNA, 21 bp, Artificial sequence
  SiRNA target sequence
attgaaatgtatatataatgt

SEQ ID NO: 87614 - DNA, 21 bp, Artificial sequence
  SiRNA target sequence
ttgaaatgtatatataatgtc

SEQ ID NO: 87615 - DNA, 21 bp, Artificial sequence
  SiRNA target sequence
tgaaatgtatatataatgtca

SEQ ID NO: 87616 - DNA, 21 bp, Artificial sequence
  SiRNA target sequence
gaaatgtatatataatgtcaa

SEQ ID NO: 87617 - DNA, 21 bp, Artificial sequence
  SiRNA target sequence
aaatgtatatataatgtcaag

SEQ ID NO: 87618 - DNA, 21 bp, Artificial sequence
  SiRNA target sequence
aatgtatatataatgtcaagc

SEQ ID NO: 87619 - DNA, 21 bp, Artificial sequence
  SiRNA target sequence
atgtatatataatgtcaagca

SEQ ID NO: 87620 - DNA, 21 bp, Artificial sequence
  SiRNA target sequence
tgtatatataatgtcaagcac

SEQ ID NO: 87621 - DNA, 21 bp, Artificial sequence
  SiRNA target sequence
gtatatataatgtcaagcaca

SEQ ID NO: 87622 - DNA, 21 bp, Artificial sequence
  SiRNA target sequence
tatatataatgtcaagcacat

SEQ ID NO: 87623 - DNA, 21 bp, Artificial sequence
  SiRNA target sequence
atatataatgtcaagcacatt

SEQ ID NO: 87624 - DNA, 21 bp, Artificial sequence
  SiRNA target sequence
tatataatgtcaagcacatta

SEQ ID NO: 87625 - DNA, 21 bp, Artificial sequence
  SiRNA target sequence
atataatgtcaagcacattat

SEQ ID NO: 87626 - DNA, 21 bp, Artificial sequence
  SiRNA target sequence
tataatgtcaagcacattatt

SEQ ID NO: 87627 - DNA, 21 bp, Artificial sequence
  SiRNA target sequence
ataatgtcaagcacattattc

SEQ ID NO: 87628 - DNA, 21 bp, Artificial sequence
  SiRNA target sequence
taatgtcaagcacattattcc

SEQ ID NO: 87629 - DNA, 21 bp, Artificial sequence
  SiRNA target sequence
aatgtcaagcacattattcca

SEQ ID NO: 87630 - DNA, 21 bp, Artificial sequence
  SiRNA target sequence
atgtcaagcacattattccag

SEQ ID NO: 87631 - DNA, 21 bp, Artificial sequence
  SiRNA target sequence
tgtcaagcacattattccagt

SEQ ID NO: 87632 - DNA, 21 bp, Artificial sequence
  SiRNA target sequence
gtcaagcacattattccagtt

SEQ ID NO: 87633 - DNA, 21 bp, Artificial sequence
  SiRNA target sequence
tcaagcacattattccagttc

SEQ ID NO: 87634 - DNA, 21 bp, Artificial sequence
  SiRNA target sequence
caagcacattattccagttct

SEQ ID NO: 87635 - DNA, 21 bp, Artificial sequence
  SiRNA target sequence
aagcacattattccagttctt

SEQ ID NO: 87636 - DNA, 21 bp, Artificial sequence
  SiRNA target sequence
agcacattattccagttctta

SEQ ID NO: 87637 - DNA, 21 bp, Artificial sequence
  SiRNA target sequence
gcacattattccagttcttaa

SEQ ID NO: 87638 - DNA, 21 bp, Artificial sequence
  SiRNA target sequence
cacattattccagttcttaat

SEQ ID NO: 87639 - DNA, 21 bp, Artificial sequence
  SiRNA target sequence
acattattccagttcttaatg

SEQ ID NO: 87640 - DNA, 21 bp, Artificial sequence
  SiRNA target sequence
cattattccagttcttaatga

SEQ ID NO: 87641 - DNA, 21 bp, Artificial sequence
  SiRNA target sequence
attattccagttcttaatgat

SEQ ID NO: 87642 - DNA, 21 bp, Artificial sequence
  SiRNA target sequence
ttattccagttcttaatgatg

SEQ ID NO: 87643 - DNA, 21 bp, Artificial sequence
  SiRNA target sequence
tattccagttcttaatgatgc

SEQ ID NO: 87644 - DNA, 21 bp, Artificial sequence
  SiRNA target sequence
attccagttcttaatgatgct

SEQ ID NO: 87645 - DNA, 21 bp, Artificial sequence
  SiRNA target sequence
ttccagttcttaatgatgctt

SEQ ID NO: 87646 - DNA, 21 bp, Artificial sequence
  SiRNA target sequence
tccagttcttaatgatgctta

SEQ ID NO: 87647 - DNA, 21 bp, Artificial sequence
  SiRNA target sequence
ccagttcttaatgatgcttaa

SEQ ID NO: 87648 - DNA, 21 bp, Artificial sequence
  SiRNA target sequence
cagttcttaatgatgcttaaa

SEQ ID NO: 87649 - DNA, 21 bp, Artificial sequence
  SiRNA target sequence
agttcttaatgatgcttaaat

SEQ ID NO: 87650 - DNA, 21 bp, Artificial sequence
  SiRNA target sequence
gttcttaatgatgcttaaata

SEQ ID NO: 87651 - DNA, 21 bp, Artificial sequence
  SiRNA target sequence
ttcttaatgatgcttaaataa

SEQ ID NO: 87652 - DNA, 21 bp, Artificial sequence
  SiRNA target sequence
tcttaatgatgcttaaataat

SEQ ID NO: 87653 - DNA, 21 bp, Artificial sequence
  SiRNA target sequence
cttaatgatgcttaaataatc

SEQ ID NO: 87654 - DNA, 21 bp, Artificial sequence
  SiRNA target sequence
ttaatgatgcttaaataatct

SEQ ID NO: 87655 - DNA, 21 bp, Artificial sequence
  SiRNA target sequence
taatgatgcttaaataatctt

SEQ ID NO: 87656 - DNA, 21 bp, Artificial sequence
  SiRNA target sequence
aatgatgcttaaataatcttt

SEQ ID NO: 87657 - DNA, 21 bp, Artificial sequence
  SiRNA target sequence
atgatgcttaaataatctttt

SEQ ID NO: 87658 - DNA, 21 bp, Artificial sequence
  SiRNA target sequence
tgatgcttaaataatctttta

SEQ ID NO: 87659 - DNA, 21 bp, Artificial sequence
  SiRNA target sequence
gatgcttaaataatcttttac

SEQ ID NO: 87660 - DNA, 21 bp, Artificial sequence
  SiRNA target sequence
atgcttaaataatcttttact

SEQ ID NO: 87661 - DNA, 21 bp, Artificial sequence
  SiRNA target sequence
tgcttaaataatcttttactc

SEQ ID NO: 87662 - DNA, 21 bp, Artificial sequence
  SiRNA target sequence
gcttaaataatcttttactcc

SEQ ID NO: 87663 - DNA, 21 bp, Artificial sequence
  SiRNA target sequence
cttaaataatcttttactcct

SEQ ID NO: 87664 - DNA, 21 bp, Artificial sequence
  SiRNA target sequence
ttaaataatcttttactcctt

SEQ ID NO: 87665 - DNA, 21 bp, Artificial sequence
  SiRNA target sequence
taaataatcttttactccttc

SEQ ID NO: 87666 - DNA, 21 bp, Artificial sequence
  SiRNA target sequence
aaataatcttttactccttct

SEQ ID NO: 87667 - DNA, 21 bp, Artificial sequence
  SiRNA target sequence
aataatcttttactccttctt

SEQ ID NO: 87668 - DNA, 21 bp, Artificial sequence
  SiRNA target sequence
ataatcttttactccttcttt

SEQ ID NO: 87669 - DNA, 21 bp, Artificial sequence
  SiRNA target sequence
taatcttttactccttcttta

SEQ ID NO: 87670 - DNA, 21 bp, Artificial sequence
  SiRNA target sequence
aatcttttactccttctttag

SEQ ID NO: 87671 - DNA, 21 bp, Artificial sequence
  SiRNA target sequence
atcttttactccttctttaga

SEQ ID NO: 87672 - DNA, 21 bp, Artificial sequence
  SiRNA target sequence
tcttttactccttctttagaa

SEQ ID NO: 87673 - DNA, 21 bp, Artificial sequence
  SiRNA target sequence
cttttactccttctttagaac

SEQ ID NO: 87674 - DNA, 21 bp, Artificial sequence
  SiRNA target sequence
ttttactccttctttagaaca

SEQ ID NO: 87675 - DNA, 21 bp, Artificial sequence
  SiRNA target sequence
tttactccttctttagaacac

SEQ ID NO: 87676 - DNA, 21 bp, Artificial sequence
  SiRNA target sequence
ttactccttctttagaacaca

SEQ ID NO: 87677 - DNA, 21 bp, Artificial sequence
  SiRNA target sequence
tactccttctttagaacacag

SEQ ID NO: 87678 - DNA, 21 bp, Artificial sequence
  SiRNA target sequence
actccttctttagaacacaga

SEQ ID NO: 87679 - DNA, 21 bp, Artificial sequence
  SiRNA target sequence
ctccttctttagaacacagat

SEQ ID NO: 87680 - DNA, 21 bp, Artificial sequence
  SiRNA target sequence
tccttctttagaacacagata

SEQ ID NO: 87681 - DNA, 21 bp, Artificial sequence
  SiRNA target sequence
ccttctttagaacacagatat

SEQ ID NO: 87682 - DNA, 21 bp, Artificial sequence
  SiRNA target sequence
cttctttagaacacagatatt

SEQ ID NO: 87683 - DNA, 21 bp, Artificial sequence
  SiRNA target sequence
ttctttagaacacagatattc

SEQ ID NO: 87684 - DNA, 21 bp, Artificial sequence
  SiRNA target sequence
tctttagaacacagatattca

SEQ ID NO: 87685 - DNA, 21 bp, Artificial sequence
  SiRNA target sequence
ctttagaacacagatattcaa

SEQ ID NO: 87686 - DNA, 21 bp, Artificial sequence
  SiRNA target sequence
tttagaacacagatattcaat

SEQ ID NO: 87687 - DNA, 21 bp, Artificial sequence
  SiRNA target sequence
ttagaacacagatattcaata

SEQ ID NO: 87688 - DNA, 21 bp, Artificial sequence
  SiRNA target sequence
tagaacacagatattcaatat

SEQ ID NO: 87689 - DNA, 21 bp, Artificial sequence
  SiRNA target sequence
agaacacagatattcaatatc

SEQ ID NO: 87690 - DNA, 21 bp, Artificial sequence
  SiRNA target sequence
gaacacagatattcaatatca

SEQ ID NO: 87691 - DNA, 21 bp, Artificial sequence
  SiRNA target sequence
aacacagatattcaatatcat

SEQ ID NO: 87692 - DNA, 21 bp, Artificial sequence
  SiRNA target sequence
acacagatattcaatatcatg

SEQ ID NO: 87693 - DNA, 21 bp, Artificial sequence
  SiRNA target sequence
cacagatattcaatatcatgc

SEQ ID NO: 87694 - DNA, 21 bp, Artificial sequence
  SiRNA target sequence
acagatattcaatatcatgct

SEQ ID NO: 87695 - DNA, 21 bp, Artificial sequence
  SiRNA target sequence
cagatattcaatatcatgctt

SEQ ID NO: 87696 - DNA, 21 bp, Artificial sequence
  SiRNA target sequence
agatattcaatatcatgctta

SEQ ID NO: 87697 - DNA, 21 bp, Artificial sequence
  SiRNA target sequence
gatattcaatatcatgcttat

SEQ ID NO: 87698 - DNA, 21 bp, Artificial sequence
  SiRNA target sequence
atattcaatatcatgcttatt

SEQ ID NO: 87699 - DNA, 21 bp, Artificial sequence
  SiRNA target sequence
tattcaatatcatgcttattt

SEQ ID NO: 87700 - DNA, 21 bp, Artificial sequence
  SiRNA target sequence
attcaatatcatgcttatttt

SEQ ID NO: 87701 - DNA, 21 bp, Artificial sequence
  SiRNA target sequence
ttcaatatcatgcttattttt

SEQ ID NO: 87702 - DNA, 21 bp, Artificial sequence
  SiRNA target sequence
tcaatatcatgcttattttta

SEQ ID NO: 87703 - DNA, 21 bp, Artificial sequence
  SiRNA target sequence
caatatcatgcttatttttag

SEQ ID NO: 87704 - DNA, 21 bp, Artificial sequence
  SiRNA target sequence
aatatcatgcttatttttaga

SEQ ID NO: 87705 - DNA, 21 bp, Artificial sequence
  SiRNA target sequence
atatcatgcttatttttagag

SEQ ID NO: 87706 - DNA, 21 bp, Artificial sequence
  SiRNA target sequence
tatcatgcttatttttagagg

SEQ ID NO: 87707 - DNA, 21 bp, Artificial sequence
  SiRNA target sequence
atcatgcttatttttagaggt

SEQ ID NO: 87708 - DNA, 21 bp, Artificial sequence
  SiRNA target sequence
tcatgcttatttttagaggtt

SEQ ID NO: 87709 - DNA, 21 bp, Artificial sequence
  SiRNA target sequence
catgcttatttttagaggttt

SEQ ID NO: 87710 - DNA, 21 bp, Artificial sequence
  SiRNA target sequence
atgcttatttttagaggtttt

SEQ ID NO: 87711 - DNA, 21 bp, Artificial sequence
  SiRNA target sequence
tgcttatttttagaggtttta

SEQ ID NO: 87712 - DNA, 21 bp, Artificial sequence
  SiRNA target sequence
gcttatttttagaggttttag

SEQ ID NO: 87713 - DNA, 21 bp, Artificial sequence
  SiRNA target sequence
cttatttttagaggttttaga

SEQ ID NO: 87714 - DNA, 21 bp, Artificial sequence
  SiRNA target sequence
ttatttttagaggttttagaa

SEQ ID NO: 87715 - DNA, 21 bp, Artificial sequence
  SiRNA target sequence
tatttttagaggttttagaaa

SEQ ID NO: 87716 - DNA, 21 bp, Artificial sequence
  SiRNA target sequence
atttttagaggttttagaaat

SEQ ID NO: 87717 - DNA, 21 bp, Artificial sequence
  SiRNA target sequence
tttttagaggttttagaaata

SEQ ID NO: 87718 - DNA, 21 bp, Artificial sequence
  SiRNA target sequence
ttttagaggttttagaaatat

SEQ ID NO: 87719 - DNA, 21 bp, Artificial sequence
  SiRNA target sequence
tttagaggttttagaaatatc

SEQ ID NO: 87720 - DNA, 21 bp, Artificial sequence
  SiRNA target sequence
ttagaggttttagaaatatcc

SEQ ID NO: 87721 - DNA, 21 bp, Artificial sequence
  SiRNA target sequence
tagaggttttagaaatatcca

SEQ ID NO: 87722 - DNA, 21 bp, Artificial sequence
  SiRNA target sequence
agaggttttagaaatatccat

SEQ ID NO: 87723 - DNA, 21 bp, Artificial sequence
  SiRNA target sequence
gaggttttagaaatatccata

SEQ ID NO: 87724 - DNA, 21 bp, Artificial sequence
  SiRNA target sequence
aggttttagaaatatccataa

SEQ ID NO: 87725 - DNA, 21 bp, Artificial sequence
  SiRNA target sequence
ggttttagaaatatccataag

SEQ ID NO: 87726 - DNA, 21 bp, Artificial sequence
  SiRNA target sequence
gttttagaaatatccataagc

SEQ ID NO: 87727 - DNA, 21 bp, Artificial sequence
  SiRNA target sequence
ttttagaaatatccataagcc

SEQ ID NO: 87728 - DNA, 21 bp, Artificial sequence
  SiRNA target sequence
tttagaaatatccataagcca

SEQ ID NO: 87729 - DNA, 21 bp, Artificial sequence
  SiRNA target sequence
ttagaaatatccataagccat

SEQ ID NO: 87730 - DNA, 21 bp, Artificial sequence
  SiRNA target sequence
tagaaatatccataagccatg

SEQ ID NO: 87731 - DNA, 21 bp, Artificial sequence
  SiRNA target sequence
agaaatatccataagccatgc

SEQ ID NO: 87732 - DNA, 21 bp, Artificial sequence
  SiRNA target sequence
gaaatatccataagccatgct

SEQ ID NO: 87733 - DNA, 21 bp, Artificial sequence
  SiRNA target sequence
aaatatccataagccatgctt

SEQ ID NO: 87734 - DNA, 21 bp, Artificial sequence
  SiRNA target sequence
aatatccataagccatgcttt

SEQ ID NO: 87735 - DNA, 21 bp, Artificial sequence
  SiRNA target sequence
atatccataagccatgctttt

SEQ ID NO: 87736 - DNA, 21 bp, Artificial sequence
  SiRNA target sequence
tatccataagccatgcttttt

SEQ ID NO: 87737 - DNA, 21 bp, Artificial sequence
  SiRNA target sequence
atccataagccatgctttttt

SEQ ID NO: 87738 - DNA, 21 bp, Artificial sequence
  SiRNA target sequence
tccataagccatgctttttta

SEQ ID NO: 87739 - DNA, 21 bp, Artificial sequence
  SiRNA target sequence
ccataagccatgcttttttag

SEQ ID NO: 87740 - DNA, 21 bp, Artificial sequence
  SiRNA target sequence
cataagccatgcttttttagg

SEQ ID NO: 87741 - DNA, 21 bp, Artificial sequence
  SiRNA target sequence
ataagccatgcttttttaggc

SEQ ID NO: 87742 - DNA, 21 bp, Artificial sequence
  SiRNA target sequence
taagccatgcttttttaggca

SEQ ID NO: 87743 - DNA, 21 bp, Artificial sequence
  SiRNA target sequence
aagccatgcttttttaggcaa

SEQ ID NO: 87744 - DNA, 21 bp, Artificial sequence
  SiRNA target sequence
agccatgcttttttaggcaat

SEQ ID NO: 87745 - DNA, 21 bp, Artificial sequence
  SiRNA target sequence
gccatgcttttttaggcaatg

SEQ ID NO: 87746 - DNA, 21 bp, Artificial sequence
  SiRNA target sequence
ccatgcttttttaggcaatga

SEQ ID NO: 87747 - DNA, 21 bp, Artificial sequence
  SiRNA target sequence
catgcttttttaggcaatgaa

SEQ ID NO: 87748 - DNA, 21 bp, Artificial sequence
  SiRNA target sequence
atgcttttttaggcaatgaag

SEQ ID NO: 87749 - DNA, 21 bp, Artificial sequence
  SiRNA target sequence
tgcttttttaggcaatgaagt

SEQ ID NO: 87750 - DNA, 21 bp, Artificial sequence
  SiRNA target sequence
gcttttttaggcaatgaagta

SEQ ID NO: 87751 - DNA, 21 bp, Artificial sequence
  SiRNA target sequence
cttttttaggcaatgaagtaa

SEQ ID NO: 87752 - DNA, 21 bp, Artificial sequence
  SiRNA target sequence
ttttttaggcaatgaagtaaa

SEQ ID NO: 87753 - DNA, 21 bp, Artificial sequence
  SiRNA target sequence
tttttaggcaatgaagtaaaa

SEQ ID NO: 87754 - DNA, 21 bp, Artificial sequence
  SiRNA target sequence
ttttaggcaatgaagtaaaat

SEQ ID NO: 87755 - DNA, 21 bp, Artificial sequence
  SiRNA target sequence
tttaggcaatgaagtaaaatc

SEQ ID NO: 87756 - DNA, 21 bp, Artificial sequence
  SiRNA target sequence
ttaggcaatgaagtaaaatca

SEQ ID NO: 87757 - DNA, 21 bp, Artificial sequence
  SiRNA target sequence
taggcaatgaagtaaaatcaa

SEQ ID NO: 87758 - DNA, 21 bp, Artificial sequence
  SiRNA target sequence
aggcaatgaagtaaaatcaaa

SEQ ID NO: 87759 - DNA, 21 bp, Artificial sequence
  SiRNA target sequence
ggcaatgaagtaaaatcaaaa

SEQ ID NO: 87760 - DNA, 21 bp, Artificial sequence
  SiRNA target sequence
gcaatgaagtaaaatcaaaaa

SEQ ID NO: 87761 - DNA, 21 bp, Artificial sequence
  SiRNA target sequence
caatgaagtaaaatcaaaaat

SEQ ID NO: 87762 - DNA, 21 bp, Artificial sequence
  SiRNA target sequence
aatgaagtaaaatcaaaaata

SEQ ID NO: 87763 - DNA, 21 bp, Artificial sequence
  SiRNA target sequence
atgaagtaaaatcaaaaatat

SEQ ID NO: 87764 - DNA, 21 bp, Artificial sequence
  SiRNA target sequence
tgaagtaaaatcaaaaatata

SEQ ID NO: 87765 - DNA, 21 bp, Artificial sequence
  SiRNA target sequence
gaagtaaaatcaaaaatatac

SEQ ID NO: 87766 - DNA, 21 bp, Artificial sequence
  SiRNA target sequence
aagtaaaatcaaaaatatact

SEQ ID NO: 87767 - DNA, 21 bp, Artificial sequence
  SiRNA target sequence
agtaaaatcaaaaatatactt

SEQ ID NO: 87768 - DNA, 21 bp, Artificial sequence
  SiRNA target sequence
gtaaaatcaaaaatatacttg

SEQ ID NO: 87769 - DNA, 21 bp, Artificial sequence
  SiRNA target sequence
taaaatcaaaaatatacttga

SEQ ID NO: 87770 - DNA, 21 bp, Artificial sequence
  SiRNA target sequence
aaaatcaaaaatatacttgaa

SEQ ID NO: 87771 - DNA, 21 bp, Artificial sequence
  SiRNA target sequence
aaatcaaaaatatacttgaaa

SEQ ID NO: 87772 - DNA, 21 bp, Artificial sequence
  SiRNA target sequence
aatcaaaaatatacttgaaaa

SEQ ID NO: 87773 - DNA, 21 bp, Artificial sequence
  SiRNA target sequence
atcaaaaatatacttgaaaaa

SEQ ID NO: 87774 - DNA, 21 bp, Artificial sequence
  SiRNA target sequence
tcaaaaatatacttgaaaaag

SEQ ID NO: 87775 - DNA, 21 bp, Artificial sequence
  SiRNA target sequence
caaaaatatacttgaaaaagt

SEQ ID NO: 87776 - DNA, 21 bp, Artificial sequence
  SiRNA target sequence
aaaaatatacttgaaaaagtc

SEQ ID NO: 87777 - DNA, 21 bp, Artificial sequence
  SiRNA target sequence
aaaatatacttgaaaaagtca

SEQ ID NO: 87778 - DNA, 21 bp, Artificial sequence
  SiRNA target sequence
aaatatacttgaaaaagtcac

SEQ ID NO: 87779 - DNA, 21 bp, Artificial sequence
  SiRNA target sequence
aatatacttgaaaaagtcacg

SEQ ID NO: 87780 - DNA, 21 bp, Artificial sequence
  SiRNA target sequence
atatacttgaaaaagtcacgc

SEQ ID NO: 87781 - DNA, 21 bp, Artificial sequence
  SiRNA target sequence
tatacttgaaaaagtcacgca

SEQ ID NO: 87782 - DNA, 21 bp, Artificial sequence
  SiRNA target sequence
atacttgaaaaagtcacgcaa

SEQ ID NO: 87783 - DNA, 21 bp, Artificial sequence
  SiRNA target sequence
tacttgaaaaagtcacgcaaa

SEQ ID NO: 87784 - DNA, 21 bp, Artificial sequence
  SiRNA target sequence
acttgaaaaagtcacgcaaag

SEQ ID NO: 87785 - DNA, 21 bp, Artificial sequence
  SiRNA target sequence
cttgaaaaagtcacgcaaaga

SEQ ID NO: 87786 - DNA, 21 bp, Artificial sequence
  SiRNA target sequence
ttgaaaaagtcacgcaaagat

SEQ ID NO: 87787 - DNA, 21 bp, Artificial sequence
  SiRNA target sequence
tgaaaaagtcacgcaaagatc

SEQ ID NO: 87788 - DNA, 21 bp, Artificial sequence
  SiRNA target sequence
gaaaaagtcacgcaaagatcc

SEQ ID NO: 87789 - DNA, 21 bp, Artificial sequence
  SiRNA target sequence
aaaaagtcacgcaaagatcct

SEQ ID NO: 87790 - DNA, 21 bp, Artificial sequence
  SiRNA target sequence
aaaagtcacgcaaagatcctt

SEQ ID NO: 87791 - DNA, 21 bp, Artificial sequence
  SiRNA target sequence
aaagtcacgcaaagatccttc

SEQ ID NO: 87792 - DNA, 21 bp, Artificial sequence
  SiRNA target sequence
aagtcacgcaaagatccttcg

SEQ ID NO: 87793 - DNA, 21 bp, Artificial sequence
  SiRNA target sequence
agtcacgcaaagatccttcga

SEQ ID NO: 87794 - DNA, 21 bp, Artificial sequence
  SiRNA target sequence
gtcacgcaaagatccttcgaa

SEQ ID NO: 87795 - DNA, 21 bp, Artificial sequence
  SiRNA target sequence
tcacgcaaagatccttcgaat

SEQ ID NO: 87796 - DNA, 21 bp, Artificial sequence
  SiRNA target sequence
cacgcaaagatccttcgaatt

SEQ ID NO: 87797 - DNA, 21 bp, Artificial sequence
  SiRNA target sequence
acgcaaagatccttcgaattg

SEQ ID NO: 87798 - DNA, 21 bp, Artificial sequence
  SiRNA target sequence
cgcaaagatccttcgaattga

SEQ ID NO: 87799 - DNA, 21 bp, Artificial sequence
  SiRNA target sequence
gcaaagatccttcgaattgaa

SEQ ID NO: 87800 - DNA, 21 bp, Artificial sequence
  SiRNA target sequence
caaagatccttcgaattgaaa

SEQ ID NO: 87801 - DNA, 21 bp, Artificial sequence
  SiRNA target sequence
aaagatccttcgaattgaaac

SEQ ID NO: 87802 - DNA, 21 bp, Artificial sequence
  SiRNA target sequence
aagatccttcgaattgaaacc

SEQ ID NO: 87803 - DNA, 21 bp, Artificial sequence
  SiRNA target sequence
agatccttcgaattgaaaccc

SEQ ID NO: 87804 - DNA, 21 bp, Artificial sequence
  SiRNA target sequence
gatccttcgaattgaaacccc

SEQ ID NO: 87805 - DNA, 21 bp, Artificial sequence
  SiRNA target sequence
atccttcgaattgaaaccccg

SEQ ID NO: 87806 - DNA, 21 bp, Artificial sequence
  SiRNA target sequence
tccttcgaattgaaaccccgt

SEQ ID NO: 87807 - DNA, 21 bp, Artificial sequence
  SiRNA target sequence
ccttcgaattgaaaccccgtt

SEQ ID NO: 87808 - DNA, 21 bp, Artificial sequence
  SiRNA target sequence
cttcgaattgaaaccccgttt

SEQ ID NO: 87809 - DNA, 21 bp, Artificial sequence
  SiRNA target sequence
ttcgaattgaaaccccgtttt

SEQ ID NO: 87810 - DNA, 21 bp, Artificial sequence
  SiRNA target sequence
tcgaattgaaaccccgttttt

SEQ ID NO: 87811 - DNA, 21 bp, Artificial sequence
  SiRNA target sequence
cgaattgaaaccccgtttttc

SEQ ID NO: 87812 - DNA, 21 bp, Artificial sequence
  SiRNA target sequence
gaattgaaaccccgtttttcc

SEQ ID NO: 87813 - DNA, 21 bp, Artificial sequence
  SiRNA target sequence
aattgaaaccccgtttttcca

SEQ ID NO: 87814 - DNA, 21 bp, Artificial sequence
  SiRNA target sequence
attgaaaccccgtttttccaa

SEQ ID NO: 87815 - DNA, 21 bp, Artificial sequence
  SiRNA target sequence
ttgaaaccccgtttttccaac

SEQ ID NO: 87816 - DNA, 21 bp, Artificial sequence
  SiRNA target sequence
tgaaaccccgtttttccaact

SEQ ID NO: 87817 - DNA, 21 bp, Artificial sequence
  SiRNA target sequence
gaaaccccgtttttccaactt

SEQ ID NO: 87818 - DNA, 21 bp, Artificial sequence
  SiRNA target sequence
aaaccccgtttttccaacttg

SEQ ID NO: 87819 - DNA, 21 bp, Artificial sequence
  SiRNA target sequence
aaccccgtttttccaacttgc

SEQ ID NO: 87820 - DNA, 21 bp, Artificial sequence
  SiRNA target sequence
accccgtttttccaacttgct

SEQ ID NO: 87821 - DNA, 21 bp, Artificial sequence
  SiRNA target sequence
ccccgtttttccaacttgctc

SEQ ID NO: 87822 - DNA, 21 bp, Artificial sequence
  SiRNA target sequence
cccgtttttccaacttgctca

SEQ ID NO: 87823 - DNA, 21 bp, Artificial sequence
  SiRNA target sequence
ccgtttttccaacttgctcaa

SEQ ID NO: 87824 - DNA, 21 bp, Artificial sequence
  SiRNA target sequence
cgtttttccaacttgctcaat

SEQ ID NO: 87825 - DNA, 21 bp, Artificial sequence
  SiRNA target sequence
gtttttccaacttgctcaata

SEQ ID NO: 87826 - DNA, 21 bp, Artificial sequence
  SiRNA target sequence
tttttccaacttgctcaatat

SEQ ID NO: 87827 - DNA, 21 bp, Artificial sequence
  SiRNA target sequence
ttttccaacttgctcaatata

SEQ ID NO: 87828 - DNA, 21 bp, Artificial sequence
  SiRNA target sequence
tttccaacttgctcaatatat

SEQ ID NO: 87829 - DNA, 21 bp, Artificial sequence
  SiRNA target sequence
ttccaacttgctcaatatata

SEQ ID NO: 87830 - DNA, 21 bp, Artificial sequence
  SiRNA target sequence
tccaacttgctcaatatataa

SEQ ID NO: 87831 - DNA, 21 bp, Artificial sequence
  SiRNA target sequence
ccaacttgctcaatatataat

SEQ ID NO: 87832 - DNA, 21 bp, Artificial sequence
  SiRNA target sequence
caacttgctcaatatataata

SEQ ID NO: 87833 - DNA, 21 bp, Artificial sequence
  SiRNA target sequence
aacttgctcaatatataataa

SEQ ID NO: 87834 - DNA, 21 bp, Artificial sequence
  SiRNA target sequence
acttgctcaatatataataat

SEQ ID NO: 87835 - DNA, 21 bp, Artificial sequence
  SiRNA target sequence
cttgctcaatatataataatg

SEQ ID NO: 87836 - DNA, 21 bp, Artificial sequence
  SiRNA target sequence
ttgctcaatatataataatgt

SEQ ID NO: 87837 - DNA, 21 bp, Artificial sequence
  SiRNA target sequence
tgctcaatatataataatgta

SEQ ID NO: 87838 - DNA, 21 bp, Artificial sequence
  SiRNA target sequence
gctcaatatataataatgtat

SEQ ID NO: 87839 - DNA, 21 bp, Artificial sequence
  SiRNA target sequence
ctcaatatataataatgtatc

SEQ ID NO: 87840 - DNA, 21 bp, Artificial sequence
  SiRNA target sequence
tcaatatataataatgtatca

SEQ ID NO: 87841 - DNA, 21 bp, Artificial sequence
  SiRNA target sequence
caatatataataatgtatcac

SEQ ID NO: 87842 - DNA, 21 bp, Artificial sequence
  SiRNA target sequence
aatatataataatgtatcacc

SEQ ID NO: 87843 - DNA, 21 bp, Artificial sequence
  SiRNA target sequence
atatataataatgtatcacca

SEQ ID NO: 87844 - DNA, 21 bp, Artificial sequence
  SiRNA target sequence
tatataataatgtatcaccag

SEQ ID NO: 87845 - DNA, 21 bp, Artificial sequence
  SiRNA target sequence
atataataatgtatcaccaga

SEQ ID NO: 87846 - DNA, 21 bp, Artificial sequence
  SiRNA target sequence
tataataatgtatcaccagac

SEQ ID NO: 87847 - DNA, 21 bp, Artificial sequence
  SiRNA target sequence
ataataatgtatcaccagaca

SEQ ID NO: 87848 - DNA, 21 bp, Artificial sequence
  SiRNA target sequence
taataatgtatcaccagacat

SEQ ID NO: 87849 - DNA, 21 bp, Artificial sequence
  SiRNA target sequence
aataatgtatcaccagacatt

SEQ ID NO: 87850 - DNA, 21 bp, Artificial sequence
  SiRNA target sequence
ataatgtatcaccagacattt

SEQ ID NO: 87851 - DNA, 21 bp, Artificial sequence
  SiRNA target sequence
taatgtatcaccagacatttc

SEQ ID NO: 87852 - DNA, 21 bp, Artificial sequence
  SiRNA target sequence
aatgtatcaccagacatttct

SEQ ID NO: 87853 - DNA, 21 bp, Artificial sequence
  SiRNA target sequence
atgtatcaccagacatttcta

SEQ ID NO: 87854 - DNA, 21 bp, Artificial sequence
  SiRNA target sequence
tgtatcaccagacatttctag

SEQ ID NO: 87855 - DNA, 21 bp, Artificial sequence
  SiRNA target sequence
gtatcaccagacatttctagt

SEQ ID NO: 87856 - DNA, 21 bp, Artificial sequence
  SiRNA target sequence
tatcaccagacatttctagta

SEQ ID NO: 87857 - DNA, 21 bp, Artificial sequence
  SiRNA target sequence
atcaccagacatttctagtaa

SEQ ID NO: 87858 - DNA, 21 bp, Artificial sequence
  SiRNA target sequence
tcaccagacatttctagtaaa

SEQ ID NO: 87859 - DNA, 21 bp, Artificial sequence
  SiRNA target sequence
caccagacatttctagtaaac

SEQ ID NO: 87860 - DNA, 21 bp, Artificial sequence
  SiRNA target sequence
accagacatttctagtaaact

SEQ ID NO: 87861 - DNA, 21 bp, Artificial sequence
  SiRNA target sequence
ccagacatttctagtaaactt

SEQ ID NO: 87862 - DNA, 21 bp, Artificial sequence
  SiRNA target sequence
cagacatttctagtaaactta

SEQ ID NO: 87863 - DNA, 21 bp, Artificial sequence
  SiRNA target sequence
agacatttctagtaaacttaa

SEQ ID NO: 87864 - DNA, 21 bp, Artificial sequence
  SiRNA target sequence
gacatttctagtaaacttaac

SEQ ID NO: 87865 - DNA, 21 bp, Artificial sequence
  SiRNA target sequence
acatttctagtaaacttaaca

SEQ ID NO: 87866 - DNA, 21 bp, Artificial sequence
  SiRNA target sequence
catttctagtaaacttaacat

SEQ ID NO: 87867 - DNA, 21 bp, Artificial sequence
  SiRNA target sequence
atttctagtaaacttaacatt

SEQ ID NO: 87868 - DNA, 21 bp, Artificial sequence
  SiRNA target sequence
tttctagtaaacttaacattt

SEQ ID NO: 87869 - DNA, 21 bp, Artificial sequence
  SiRNA target sequence
ttctagtaaacttaacatttc

SEQ ID NO: 87870 - DNA, 21 bp, Artificial sequence
  SiRNA target sequence
tctagtaaacttaacatttca

SEQ ID NO: 87871 - DNA, 21 bp, Artificial sequence
  SiRNA target sequence
ctagtaaacttaacatttcat

SEQ ID NO: 87872 - DNA, 21 bp, Artificial sequence
  SiRNA target sequence
tagtaaacttaacatttcatt

SEQ ID NO: 87873 - DNA, 21 bp, Artificial sequence
  SiRNA target sequence
agtaaacttaacatttcatta

SEQ ID NO: 87874 - DNA, 21 bp, Artificial sequence
  SiRNA target sequence
gtaaacttaacatttcattaa

SEQ ID NO: 87875 - DNA, 21 bp, Artificial sequence
  SiRNA target sequence
taaacttaacatttcattaac

SEQ ID NO: 87876 - DNA, 21 bp, Artificial sequence
  SiRNA target sequence
aaacttaacatttcattaaca

SEQ ID NO: 87877 - DNA, 21 bp, Artificial sequence
  SiRNA target sequence
aacttaacatttcattaacaa

SEQ ID NO: 87878 - DNA, 21 bp, Artificial sequence
  SiRNA target sequence
acttaacatttcattaacaag

SEQ ID NO: 87879 - DNA, 21 bp, Artificial sequence
  SiRNA target sequence
cttaacatttcattaacaagc

SEQ ID NO: 87880 - DNA, 21 bp, Artificial sequence
  SiRNA target sequence
ttaacatttcattaacaagca

SEQ ID NO: 87881 - DNA, 21 bp, Artificial sequence
  SiRNA target sequence
taacatttcattaacaagcaa

SEQ ID NO: 87882 - DNA, 21 bp, Artificial sequence
  SiRNA target sequence
aacatttcattaacaagcaaa

SEQ ID NO: 87883 - DNA, 21 bp, Artificial sequence
  SiRNA target sequence
acatttcattaacaagcaaat

SEQ ID NO: 87884 - DNA, 21 bp, Artificial sequence
  SiRNA target sequence
catttcattaacaagcaaatc

SEQ ID NO: 87885 - DNA, 21 bp, Artificial sequence
  SiRNA target sequence
atttcattaacaagcaaatca

SEQ ID NO: 87886 - DNA, 21 bp, Artificial sequence
  SiRNA target sequence
tttcattaacaagcaaatcat

SEQ ID NO: 87887 - DNA, 21 bp, Artificial sequence
  SiRNA target sequence
ttcattaacaagcaaatcatt

SEQ ID NO: 87888 - DNA, 21 bp, Artificial sequence
  SiRNA target sequence
tcattaacaagcaaatcatta

SEQ ID NO: 87889 - DNA, 21 bp, Artificial sequence
  SiRNA target sequence
cattaacaagcaaatcattat

SEQ ID NO: 87890 - DNA, 21 bp, Artificial sequence
  SiRNA target sequence
attaacaagcaaatcattatt

SEQ ID NO: 87891 - DNA, 21 bp, Artificial sequence
  SiRNA target sequence
ttaacaagcaaatcattattt

SEQ ID NO: 87892 - DNA, 21 bp, Artificial sequence
  SiRNA target sequence
taacaagcaaatcattatttg

SEQ ID NO: 87893 - DNA, 21 bp, Artificial sequence
  SiRNA target sequence
aacaagcaaatcattatttga

SEQ ID NO: 87894 - DNA, 21 bp, Artificial sequence
  SiRNA target sequence
acaagcaaatcattatttgaa

SEQ ID NO: 87895 - DNA, 21 bp, Artificial sequence
  SiRNA target sequence
caagcaaatcattatttgaac

SEQ ID NO: 87896 - DNA, 21 bp, Artificial sequence
  SiRNA target sequence
aagcaaatcattatttgaaca

SEQ ID NO: 87897 - DNA, 21 bp, Artificial sequence
  SiRNA target sequence
agcaaatcattatttgaacaa

SEQ ID NO: 87898 - DNA, 21 bp, Artificial sequence
  SiRNA target sequence
gcaaatcattatttgaacaaa

SEQ ID NO: 87899 - DNA, 21 bp, Artificial sequence
  SiRNA target sequence
caaatcattatttgaacaaag

SEQ ID NO: 87900 - DNA, 21 bp, Artificial sequence
  SiRNA target sequence
aaatcattatttgaacaaagt

SEQ ID NO: 87901 - DNA, 21 bp, Artificial sequence
  SiRNA target sequence
aatcattatttgaacaaagta

SEQ ID NO: 87902 - DNA, 21 bp, Artificial sequence
  SiRNA target sequence
atcattatttgaacaaagtag

SEQ ID NO: 87903 - DNA, 21 bp, Artificial sequence
  SiRNA target sequence
tcattatttgaacaaagtaga

SEQ ID NO: 87904 - DNA, 21 bp, Artificial sequence
  SiRNA target sequence
cattatttgaacaaagtagac

SEQ ID NO: 87905 - DNA, 21 bp, Artificial sequence
  SiRNA target sequence
attatttgaacaaagtagacc

SEQ ID NO: 87906 - DNA, 21 bp, Artificial sequence
  SiRNA target sequence
ttatttgaacaaagtagacca

SEQ ID NO: 87907 - DNA, 21 bp, Artificial sequence
  SiRNA target sequence
tatttgaacaaagtagaccaa

SEQ ID NO: 87908 - DNA, 21 bp, Artificial sequence
  SiRNA target sequence
atttgaacaaagtagaccaat

SEQ ID NO: 87909 - DNA, 21 bp, Artificial sequence
  SiRNA target sequence
tttgaacaaagtagaccaata

SEQ ID NO: 87910 - DNA, 21 bp, Artificial sequence
  SiRNA target sequence
ttgaacaaagtagaccaatac

SEQ ID NO: 87911 - DNA, 21 bp, Artificial sequence
  SiRNA target sequence
tgaacaaagtagaccaatact

SEQ ID NO: 87912 - DNA, 21 bp, Artificial sequence
  SiRNA target sequence
gaacaaagtagaccaatacta

SEQ ID NO: 87913 - DNA, 21 bp, Artificial sequence
  SiRNA target sequence
aacaaagtagaccaatactat

SEQ ID NO: 87914 - DNA, 21 bp, Artificial sequence
  SiRNA target sequence
acaaagtagaccaatactatc

SEQ ID NO: 87915 - DNA, 21 bp, Artificial sequence
  SiRNA target sequence
caaagtagaccaatactatca

SEQ ID NO: 87916 - DNA, 21 bp, Artificial sequence
  SiRNA target sequence
aaagtagaccaatactatcac

SEQ ID NO: 87917 - DNA, 21 bp, Artificial sequence
  SiRNA target sequence
aagtagaccaatactatcacc

SEQ ID NO: 87918 - DNA, 21 bp, Artificial sequence
  SiRNA target sequence
agtagaccaatactatcacca

SEQ ID NO: 87919 - DNA, 21 bp, Artificial sequence
  SiRNA target sequence
gtagaccaatactatcaccag

SEQ ID NO: 87920 - DNA, 21 bp, Artificial sequence
  SiRNA target sequence
tagaccaatactatcaccagg

SEQ ID NO: 87921 - DNA, 21 bp, Artificial sequence
  SiRNA target sequence
agaccaatactatcaccagga

SEQ ID NO: 87922 - DNA, 21 bp, Artificial sequence
  SiRNA target sequence
gaccaatactatcaccaggaa

SEQ ID NO: 87923 - DNA, 21 bp, Artificial sequence
  SiRNA target sequence
accaatactatcaccaggaac

SEQ ID NO: 87924 - DNA, 21 bp, Artificial sequence
  SiRNA target sequence
ccaatactatcaccaggaaca

SEQ ID NO: 87925 - DNA, 21 bp, Artificial sequence
  SiRNA target sequence
caatactatcaccaggaacaa

SEQ ID NO: 87926 - DNA, 21 bp, Artificial sequence
  SiRNA target sequence
aatactatcaccaggaacaaa

SEQ ID NO: 87927 - DNA, 21 bp, Artificial sequence
  SiRNA target sequence
atactatcaccaggaacaaaa

SEQ ID NO: 87928 - DNA, 21 bp, Artificial sequence
  SiRNA target sequence
tactatcaccaggaacaaaat

SEQ ID NO: 87929 - DNA, 21 bp, Artificial sequence
  SiRNA target sequence
actatcaccaggaacaaaatc

SEQ ID NO: 87930 - DNA, 21 bp, Artificial sequence
  SiRNA target sequence
ctatcaccaggaacaaaatct

SEQ ID NO: 87931 - DNA, 21 bp, Artificial sequence
  SiRNA target sequence
tatcaccaggaacaaaatcta

SEQ ID NO: 87932 - DNA, 21 bp, Artificial sequence
  SiRNA target sequence
atcaccaggaacaaaatctaa

SEQ ID NO: 87933 - DNA, 21 bp, Artificial sequence
  SiRNA target sequence
tcaccaggaacaaaatctaat

SEQ ID NO: 87934 - DNA, 21 bp, Artificial sequence
  SiRNA target sequence
caccaggaacaaaatctaatg

SEQ ID NO: 87935 - DNA, 21 bp, Artificial sequence
  SiRNA target sequence
accaggaacaaaatctaatgt

SEQ ID NO: 87936 - DNA, 21 bp, Artificial sequence
  SiRNA target sequence
ccaggaacaaaatctaatgta

SEQ ID NO: 87937 - DNA, 21 bp, Artificial sequence
  SiRNA target sequence
caggaacaaaatctaatgtat

SEQ ID NO: 87938 - DNA, 21 bp, Artificial sequence
  SiRNA target sequence
aggaacaaaatctaatgtata

SEQ ID NO: 87939 - DNA, 21 bp, Artificial sequence
  SiRNA target sequence
ggaacaaaatctaatgtataa

SEQ ID NO: 87940 - DNA, 21 bp, Artificial sequence
  SiRNA target sequence
gaacaaaatctaatgtataat

SEQ ID NO: 87941 - DNA, 21 bp, Artificial sequence
  SiRNA target sequence
aacaaaatctaatgtataatt

SEQ ID NO: 87942 - DNA, 21 bp, Artificial sequence
  SiRNA target sequence
acaaaatctaatgtataatta

SEQ ID NO: 87943 - DNA, 21 bp, Artificial sequence
  SiRNA target sequence
caaaatctaatgtataattaa

SEQ ID NO: 87944 - DNA, 21 bp, Artificial sequence
  SiRNA target sequence
aaaatctaatgtataattaag

SEQ ID NO: 87945 - DNA, 21 bp, Artificial sequence
  SiRNA target sequence
aaatctaatgtataattaagt

SEQ ID NO: 87946 - DNA, 21 bp, Artificial sequence
  SiRNA target sequence
aatctaatgtataattaagtt

SEQ ID NO: 87947 - DNA, 21 bp, Artificial sequence
  SiRNA target sequence
atctaatgtataattaagttg

SEQ ID NO: 87948 - DNA, 21 bp, Artificial sequence
  SiRNA target sequence
tctaatgtataattaagttga

SEQ ID NO: 87949 - DNA, 21 bp, Artificial sequence
  SiRNA target sequence
ctaatgtataattaagttgaa

SEQ ID NO: 87950 - DNA, 21 bp, Artificial sequence
  SiRNA target sequence
taatgtataattaagttgaac

SEQ ID NO: 87951 - DNA, 21 bp, Artificial sequence
  SiRNA target sequence
aatgtataattaagttgaacc

SEQ ID NO: 87952 - DNA, 21 bp, Artificial sequence
  SiRNA target sequence
atgtataattaagttgaacct

SEQ ID NO: 87953 - DNA, 21 bp, Artificial sequence
  SiRNA target sequence
tgtataattaagttgaacctt

SEQ ID NO: 87954 - DNA, 21 bp, Artificial sequence
  SiRNA target sequence
gtataattaagttgaacctta

SEQ ID NO: 87955 - DNA, 21 bp, Artificial sequence
  SiRNA target sequence
tataattaagttgaaccttat

SEQ ID NO: 87956 - DNA, 21 bp, Artificial sequence
  SiRNA target sequence
ataattaagttgaaccttata

SEQ ID NO: 87957 - DNA, 21 bp, Artificial sequence
  SiRNA target sequence
taattaagttgaaccttatat

SEQ ID NO: 87958 - DNA, 21 bp, Artificial sequence
  SiRNA target sequence
aattaagttgaaccttatata

SEQ ID NO: 87959 - DNA, 21 bp, Artificial sequence
  SiRNA target sequence
attaagttgaaccttatatac

SEQ ID NO: 87960 - DNA, 21 bp, Artificial sequence
  SiRNA target sequence
ttaagttgaaccttatatacc

SEQ ID NO: 87961 - DNA, 21 bp, Artificial sequence
  SiRNA target sequence
taagttgaaccttatatacct

SEQ ID NO: 87962 - DNA, 21 bp, Artificial sequence
  SiRNA target sequence
aagttgaaccttatatacctt

SEQ ID NO: 87963 - DNA, 21 bp, Artificial sequence
  SiRNA target sequence
agttgaaccttatataccttt

SEQ ID NO: 87964 - DNA, 21 bp, Artificial sequence
  SiRNA target sequence
gttgaaccttatatacctttt

SEQ ID NO: 87965 - DNA, 21 bp, Artificial sequence
  SiRNA target sequence
ttgaaccttatataccttttt

SEQ ID NO: 87966 - DNA, 21 bp, Artificial sequence
  SiRNA target sequence
tgaaccttatatacctttttc

SEQ ID NO: 87967 - DNA, 21 bp, Artificial sequence
  SiRNA target sequence
gaaccttatatacctttttcc

SEQ ID NO: 87968 - DNA, 21 bp, Artificial sequence
  SiRNA target sequence
aaccttatatacctttttcca

SEQ ID NO: 87969 - DNA, 21 bp, Artificial sequence
  SiRNA target sequence
accttatatacctttttccat

SEQ ID NO: 87970 - DNA, 21 bp, Artificial sequence
  SiRNA target sequence
ccttatatacctttttccatg

SEQ ID NO: 87971 - DNA, 21 bp, Artificial sequence
  SiRNA target sequence
cttatatacctttttccatgt

SEQ ID NO: 87972 - DNA, 21 bp, Artificial sequence
  SiRNA target sequence
ttatatacctttttccatgta

SEQ ID NO: 87973 - DNA, 21 bp, Artificial sequence
  SiRNA target sequence
tatatacctttttccatgtac

SEQ ID NO: 87974 - DNA, 21 bp, Artificial sequence
  SiRNA target sequence
atatacctttttccatgtaca

SEQ ID NO: 87975 - DNA, 21 bp, Artificial sequence
  SiRNA target sequence
tatacctttttccatgtacag

SEQ ID NO: 87976 - DNA, 21 bp, Artificial sequence
  SiRNA target sequence
atacctttttccatgtacagg

SEQ ID NO: 87977 - DNA, 21 bp, Artificial sequence
  SiRNA target sequence
tacctttttccatgtacagga

SEQ ID NO: 87978 - DNA, 21 bp, Artificial sequence
  SiRNA target sequence
acctttttccatgtacaggaa

SEQ ID NO: 87979 - DNA, 21 bp, Artificial sequence
  SiRNA target sequence
cctttttccatgtacaggaaa

SEQ ID NO: 87980 - DNA, 21 bp, Artificial sequence
  SiRNA target sequence
ctttttccatgtacaggaaag

SEQ ID NO: 87981 - DNA, 21 bp, Artificial sequence
  SiRNA target sequence
tttttccatgtacaggaaagg

SEQ ID NO: 87982 - DNA, 21 bp, Artificial sequence
  SiRNA target sequence
ttttccatgtacaggaaaggt

SEQ ID NO: 87983 - DNA, 21 bp, Artificial sequence
  SiRNA target sequence
tttccatgtacaggaaaggtt

SEQ ID NO: 87984 - DNA, 21 bp, Artificial sequence
  SiRNA target sequence
ttccatgtacaggaaaggttt

SEQ ID NO: 87985 - DNA, 21 bp, Artificial sequence
  SiRNA target sequence
tccatgtacaggaaaggtttt

SEQ ID NO: 87986 - DNA, 21 bp, Artificial sequence
  SiRNA target sequence
ccatgtacaggaaaggttttc

SEQ ID NO: 87987 - DNA, 21 bp, Artificial sequence
  SiRNA target sequence
catgtacaggaaaggttttca

SEQ ID NO: 87988 - DNA, 21 bp, Artificial sequence
  SiRNA target sequence
atgtacaggaaaggttttcaa

SEQ ID NO: 87989 - DNA, 21 bp, Artificial sequence
  SiRNA target sequence
tgtacaggaaaggttttcaat

SEQ ID NO: 87990 - DNA, 21 bp, Artificial sequence
  SiRNA target sequence
gtacaggaaaggttttcaata

SEQ ID NO: 87991 - DNA, 21 bp, Artificial sequence
  SiRNA target sequence
tacaggaaaggttttcaatat

SEQ ID NO: 87992 - DNA, 21 bp, Artificial sequence
  SiRNA target sequence
acaggaaaggttttcaatatt

SEQ ID NO: 87993 - DNA, 21 bp, Artificial sequence
  SiRNA target sequence
caggaaaggttttcaatattt

SEQ ID NO: 87994 - DNA, 21 bp, Artificial sequence
  SiRNA target sequence
aggaaaggttttcaatattta

SEQ ID NO: 87995 - DNA, 21 bp, Artificial sequence
  SiRNA target sequence
ggaaaggttttcaatatttag

SEQ ID NO: 87996 - DNA, 21 bp, Artificial sequence
  SiRNA target sequence
gaaaggttttcaatatttagt

SEQ ID NO: 87997 - DNA, 21 bp, Artificial sequence
  SiRNA target sequence
aaaggttttcaatatttagta

SEQ ID NO: 87998 - DNA, 21 bp, Artificial sequence
  SiRNA target sequence
aaggttttcaatatttagtat

SEQ ID NO: 87999 - DNA, 21 bp, Artificial sequence
  SiRNA target sequence
aggttttcaatatttagtata

SEQ ID NO: 88000 - DNA, 21 bp, Artificial sequence
  SiRNA target sequence
ggttttcaatatttagtatat

SEQ ID NO: 88001 - DNA, 21 bp, Artificial sequence
  SiRNA target sequence
gttttcaatatttagtatatt

SEQ ID NO: 88002 - DNA, 21 bp, Artificial sequence
  SiRNA target sequence
ttttcaatatttagtatattt

SEQ ID NO: 88003 - DNA, 21 bp, Artificial sequence
  SiRNA target sequence
tttcaatatttagtatatttg

SEQ ID NO: 88004 - DNA, 21 bp, Artificial sequence
  SiRNA target sequence
ttcaatatttagtatatttgt

SEQ ID NO: 88005 - DNA, 21 bp, Artificial sequence
  SiRNA target sequence
tcaatatttagtatatttgta

SEQ ID NO: 88006 - DNA, 21 bp, Artificial sequence
  SiRNA target sequence
caatatttagtatatttgtat

SEQ ID NO: 88007 - DNA, 21 bp, Artificial sequence
  SiRNA target sequence
aatatttagtatatttgtatc

SEQ ID NO: 88008 - DNA, 21 bp, Artificial sequence
  SiRNA target sequence
atatttagtatatttgtatct

SEQ ID NO: 88009 - DNA, 21 bp, Artificial sequence
  SiRNA target sequence
tatttagtatatttgtatcta

SEQ ID NO: 88010 - DNA, 21 bp, Artificial sequence
  SiRNA target sequence
atttagtatatttgtatctat

SEQ ID NO: 88011 - DNA, 21 bp, Artificial sequence
  SiRNA target sequence
tttagtatatttgtatctatc

SEQ ID NO: 88012 - DNA, 21 bp, Artificial sequence
  SiRNA target sequence
ttagtatatttgtatctatca

SEQ ID NO: 88013 - DNA, 21 bp, Artificial sequence
  SiRNA target sequence
tagtatatttgtatctatcaa

SEQ ID NO: 88014 - DNA, 21 bp, Artificial sequence
  SiRNA target sequence
agtatatttgtatctatcaaa

SEQ ID NO: 88015 - DNA, 21 bp, Artificial sequence
  SiRNA target sequence
gtatatttgtatctatcaaat

SEQ ID NO: 88016 - DNA, 21 bp, Artificial sequence
  SiRNA target sequence
tatatttgtatctatcaaatt

SEQ ID NO: 88017 - DNA, 21 bp, Artificial sequence
  SiRNA target sequence
atatttgtatctatcaaattt

SEQ ID NO: 88018 - DNA, 21 bp, Artificial sequence
  SiRNA target sequence
tatttgtatctatcaaattta

SEQ ID NO: 88019 - DNA, 21 bp, Artificial sequence
  SiRNA target sequence
atttgtatctatcaaatttat

SEQ ID NO: 88020 - DNA, 21 bp, Artificial sequence
  SiRNA target sequence
tttgtatctatcaaatttata

SEQ ID NO: 88021 - DNA, 21 bp, Artificial sequence
  SiRNA target sequence
ttgtatctatcaaatttatat

SEQ ID NO: 88022 - DNA, 21 bp, Artificial sequence
  SiRNA target sequence
tgtatctatcaaatttatatt

SEQ ID NO: 88023 - DNA, 21 bp, Artificial sequence
  SiRNA target sequence
gtatctatcaaatttatattc

SEQ ID NO: 88024 - DNA, 21 bp, Artificial sequence
  SiRNA target sequence
tatctatcaaatttatattct

SEQ ID NO: 88025 - DNA, 21 bp, Artificial sequence
  SiRNA target sequence
atctatcaaatttatattctc

SEQ ID NO: 88026 - DNA, 21 bp, Artificial sequence
  SiRNA target sequence
tctatcaaatttatattctcg

SEQ ID NO: 88027 - DNA, 21 bp, Artificial sequence
  SiRNA target sequence
ctatcaaatttatattctcgt

SEQ ID NO: 88028 - DNA, 21 bp, Artificial sequence
  SiRNA target sequence
tatcaaatttatattctcgtt

SEQ ID NO: 88029 - DNA, 21 bp, Artificial sequence
  SiRNA target sequence
atcaaatttatattctcgttt

SEQ ID NO: 88030 - DNA, 21 bp, Artificial sequence
  SiRNA target sequence
tcaaatttatattctcgtttg

SEQ ID NO: 88031 - DNA, 21 bp, Artificial sequence
  SiRNA target sequence
caaatttatattctcgtttgt

SEQ ID NO: 88032 - DNA, 21 bp, Artificial sequence
  SiRNA target sequence
aaatttatattctcgtttgtc

SEQ ID NO: 88033 - DNA, 21 bp, Artificial sequence
  SiRNA target sequence
aatttatattctcgtttgtct

SEQ ID NO: 88034 - DNA, 21 bp, Artificial sequence
  SiRNA target sequence
atttatattctcgtttgtctt

SEQ ID NO: 88035 - DNA, 21 bp, Artificial sequence
  SiRNA target sequence
tttatattctcgtttgtcttt

SEQ ID NO: 88036 - DNA, 21 bp, Artificial sequence
  SiRNA target sequence
ttatattctcgtttgtcttta

SEQ ID NO: 88037 - DNA, 21 bp, Artificial sequence
  SiRNA target sequence
tatattctcgtttgtctttat

SEQ ID NO: 88038 - DNA, 21 bp, Artificial sequence
  SiRNA target sequence
atattctcgtttgtctttatt

SEQ ID NO: 88039 - DNA, 21 bp, Artificial sequence
  SiRNA target sequence
tattctcgtttgtctttattt

SEQ ID NO: 88040 - DNA, 21 bp, Artificial sequence
  SiRNA target sequence
attctcgtttgtctttatttt

SEQ ID NO: 88041 - DNA, 21 bp, Artificial sequence
  SiRNA target sequence
ttctcgtttgtctttatttta

SEQ ID NO: 88042 - DNA, 21 bp, Artificial sequence
  SiRNA target sequence
tctcgtttgtctttattttat

SEQ ID NO: 88043 - DNA, 21 bp, Artificial sequence
  SiRNA target sequence
ctcgtttgtctttattttata

SEQ ID NO: 88044 - DNA, 21 bp, Artificial sequence
  SiRNA target sequence
tcgtttgtctttattttataa

SEQ ID NO: 88045 - DNA, 21 bp, Artificial sequence
  SiRNA target sequence
cgtttgtctttattttataag

SEQ ID NO: 88046 - DNA, 21 bp, Artificial sequence
  SiRNA target sequence
gtttgtctttattttataaga

SEQ ID NO: 88047 - DNA, 21 bp, Artificial sequence
  SiRNA target sequence
tttgtctttattttataagaa

SEQ ID NO: 88048 - DNA, 21 bp, Artificial sequence
  SiRNA target sequence
ttgtctttattttataagaac

SEQ ID NO: 88049 - DNA, 21 bp, Artificial sequence
  SiRNA target sequence
tgtctttattttataagaacc

SEQ ID NO: 88050 - DNA, 21 bp, Artificial sequence
  SiRNA target sequence
gtctttattttataagaacct

SEQ ID NO: 88051 - DNA, 21 bp, Artificial sequence
  SiRNA target sequence
tctttattttataagaacctg

SEQ ID NO: 88052 - DNA, 21 bp, Artificial sequence
  SiRNA target sequence
ctttattttataagaacctgt

SEQ ID NO: 88053 - DNA, 21 bp, Artificial sequence
  SiRNA target sequence
tttattttataagaacctgta

SEQ ID NO: 88054 - DNA, 21 bp, Artificial sequence
  SiRNA target sequence
ttattttataagaacctgtat

SEQ ID NO: 88055 - DNA, 21 bp, Artificial sequence
  SiRNA target sequence
tattttataagaacctgtata

SEQ ID NO: 88056 - DNA, 21 bp, Artificial sequence
  SiRNA target sequence
attttataagaacctgtatag

SEQ ID NO: 88057 - DNA, 21 bp, Artificial sequence
  SiRNA target sequence
ttttataagaacctgtatagt

SEQ ID NO: 88058 - DNA, 21 bp, Artificial sequence
  SiRNA target sequence
tttataagaacctgtatagtt

SEQ ID NO: 88059 - DNA, 21 bp, Artificial sequence
  SiRNA target sequence
ttataagaacctgtatagttg

SEQ ID NO: 88060 - DNA, 21 bp, Artificial sequence
  SiRNA target sequence
tataagaacctgtatagttgg

SEQ ID NO: 88061 - DNA, 21 bp, Artificial sequence
  SiRNA target sequence
ataagaacctgtatagttggt

SEQ ID NO: 88062 - DNA, 21 bp, Artificial sequence
  SiRNA target sequence
taagaacctgtatagttggtc

SEQ ID NO: 88063 - DNA, 21 bp, Artificial sequence
  SiRNA target sequence
aagaacctgtatagttggtct

SEQ ID NO: 88064 - DNA, 21 bp, Artificial sequence
  SiRNA target sequence
agaacctgtatagttggtctt

SEQ ID NO: 88065 - DNA, 21 bp, Artificial sequence
  SiRNA target sequence
gaacctgtatagttggtcttt

SEQ ID NO: 88066 - DNA, 21 bp, Artificial sequence
  SiRNA target sequence
aacctgtatagttggtctttt

SEQ ID NO: 88067 - DNA, 21 bp, Artificial sequence
  SiRNA target sequence
acctgtatagttggtcttttt

SEQ ID NO: 88068 - DNA, 21 bp, Artificial sequence
  SiRNA target sequence
cctgtatagttggtcttttta

SEQ ID NO: 88069 - DNA, 21 bp, Artificial sequence
  SiRNA target sequence
ctgtatagttggtctttttaa

SEQ ID NO: 88070 - DNA, 21 bp, Artificial sequence
  SiRNA target sequence
tgtatagttggtctttttaat

SEQ ID NO: 88071 - DNA, 21 bp, Artificial sequence
  SiRNA target sequence
gtatagttggtctttttaatt

SEQ ID NO: 88072 - DNA, 21 bp, Artificial sequence
  SiRNA target sequence
tatagttggtctttttaatta

SEQ ID NO: 88073 - DNA, 21 bp, Artificial sequence
  SiRNA target sequence
atagttggtctttttaattat

SEQ ID NO: 88074 - DNA, 21 bp, Artificial sequence
  SiRNA target sequence
tagttggtctttttaattata

SEQ ID NO: 88075 - DNA, 21 bp, Artificial sequence
  SiRNA target sequence
agttggtctttttaattataa

SEQ ID NO: 88076 - DNA, 21 bp, Artificial sequence
  SiRNA target sequence
gttggtctttttaattataag

SEQ ID NO: 88077 - DNA, 21 bp, Artificial sequence
  SiRNA target sequence
ttggtctttttaattataagc

SEQ ID NO: 88078 - DNA, 21 bp, Artificial sequence
  SiRNA target sequence
tggtctttttaattataagct

SEQ ID NO: 88079 - DNA, 21 bp, Artificial sequence
  SiRNA target sequence
ggtctttttaattataagctt

SEQ ID NO: 88080 - DNA, 21 bp, Artificial sequence
  SiRNA target sequence
gtctttttaattataagctta

SEQ ID NO: 88081 - DNA, 21 bp, Artificial sequence
  SiRNA target sequence
tctttttaattataagcttat

SEQ ID NO: 88082 - DNA, 21 bp, Artificial sequence
  SiRNA target sequence
ctttttaattataagcttatt

SEQ ID NO: 88083 - DNA, 21 bp, Artificial sequence
  SiRNA target sequence
tttttaattataagcttattg

SEQ ID NO: 88084 - DNA, 21 bp, Artificial sequence
  SiRNA target sequence
ttttaattataagcttattga

SEQ ID NO: 88085 - DNA, 21 bp, Artificial sequence
  SiRNA target sequence
tttaattataagcttattgaa

SEQ ID NO: 88086 - DNA, 21 bp, Artificial sequence
  SiRNA target sequence
ttaattataagcttattgaaa

SEQ ID NO: 88087 - DNA, 21 bp, Artificial sequence
  SiRNA target sequence
taattataagcttattgaaat

SEQ ID NO: 88088 - DNA, 21 bp, Artificial sequence
  SiRNA target sequence
aattataagcttattgaaatt

SEQ ID NO: 88089 - DNA, 21 bp, Artificial sequence
  SiRNA target sequence
attataagcttattgaaattt

SEQ ID NO: 88090 - DNA, 21 bp, Artificial sequence
  SiRNA target sequence
ttataagcttattgaaatttc

SEQ ID NO: 88091 - DNA, 21 bp, Artificial sequence
  SiRNA target sequence
tataagcttattgaaatttct

SEQ ID NO: 88092 - DNA, 21 bp, Artificial sequence
  SiRNA target sequence
ataagcttattgaaatttcta

SEQ ID NO: 88093 - DNA, 21 bp, Artificial sequence
  SiRNA target sequence
taagcttattgaaatttctaa

SEQ ID NO: 88094 - DNA, 21 bp, Artificial sequence
  SiRNA target sequence
aagcttattgaaatttctaat

SEQ ID NO: 88095 - DNA, 21 bp, Artificial sequence
  SiRNA target sequence
agcttattgaaatttctaata

SEQ ID NO: 88096 - DNA, 21 bp, Artificial sequence
  SiRNA target sequence
gcttattgaaatttctaatat

SEQ ID NO: 88097 - DNA, 21 bp, Artificial sequence
  SiRNA target sequence
cttattgaaatttctaatatt

SEQ ID NO: 88098 - DNA, 21 bp, Artificial sequence
  SiRNA target sequence
ttattgaaatttctaatattt

SEQ ID NO: 88099 - DNA, 21 bp, Artificial sequence
  SiRNA target sequence
tattgaaatttctaatattta

SEQ ID NO: 88100 - DNA, 21 bp, Artificial sequence
  SiRNA target sequence
attgaaatttctaatatttaa

SEQ ID NO: 88101 - DNA, 21 bp, Artificial sequence
  SiRNA target sequence
ttgaaatttctaatatttaaa

SEQ ID NO: 88102 - DNA, 21 bp, Artificial sequence
  SiRNA target sequence
tgaaatttctaatatttaaag

SEQ ID NO: 88103 - DNA, 21 bp, Artificial sequence
  SiRNA target sequence
gaaatttctaatatttaaagg

SEQ ID NO: 88104 - DNA, 21 bp, Artificial sequence
  SiRNA target sequence
aaatttctaatatttaaagga

SEQ ID NO: 88105 - DNA, 21 bp, Artificial sequence
  SiRNA target sequence
aatttctaatatttaaaggaa

SEQ ID NO: 88106 - DNA, 21 bp, Artificial sequence
  SiRNA target sequence
atttctaatatttaaaggaac

SEQ ID NO: 88107 - DNA, 21 bp, Artificial sequence
  SiRNA target sequence
tttctaatatttaaaggaaca

SEQ ID NO: 88108 - DNA, 21 bp, Artificial sequence
  SiRNA target sequence
ttctaatatttaaaggaacaa

SEQ ID NO: 88109 - DNA, 21 bp, Artificial sequence
  SiRNA target sequence
tctaatatttaaaggaacaaa

SEQ ID NO: 88110 - DNA, 21 bp, Artificial sequence
  SiRNA target sequence
ctaatatttaaaggaacaaaa

SEQ ID NO: 88111 - DNA, 21 bp, Artificial sequence
  SiRNA target sequence
taatatttaaaggaacaaaat

SEQ ID NO: 88112 - DNA, 21 bp, Artificial sequence
  SiRNA target sequence
aatatttaaaggaacaaaatc

SEQ ID NO: 88113 - DNA, 21 bp, Artificial sequence
  SiRNA target sequence
atatttaaaggaacaaaatct

SEQ ID NO: 88114 - DNA, 21 bp, Artificial sequence
  SiRNA target sequence
tatttaaaggaacaaaatcta

SEQ ID NO: 88115 - DNA, 21 bp, Artificial sequence
  SiRNA target sequence
atttaaaggaacaaaatctac

SEQ ID NO: 88116 - DNA, 21 bp, Artificial sequence
  SiRNA target sequence
tttaaaggaacaaaatctaca

SEQ ID NO: 88117 - DNA, 21 bp, Artificial sequence
  SiRNA target sequence
ttaaaggaacaaaatctacat

SEQ ID NO: 88118 - DNA, 21 bp, Artificial sequence
  SiRNA target sequence
taaaggaacaaaatctacatt

SEQ ID NO: 88119 - DNA, 21 bp, Artificial sequence
  SiRNA target sequence
aaaggaacaaaatctacattt

SEQ ID NO: 88120 - DNA, 21 bp, Artificial sequence
  SiRNA target sequence
aaggaacaaaatctacattta

SEQ ID NO: 88121 - DNA, 21 bp, Artificial sequence
  SiRNA target sequence
aggaacaaaatctacatttag

SEQ ID NO: 88122 - DNA, 21 bp, Artificial sequence
  SiRNA target sequence
ggaacaaaatctacatttaga

SEQ ID NO: 88123 - DNA, 21 bp, Artificial sequence
  SiRNA target sequence
gaacaaaatctacatttagat

SEQ ID NO: 88124 - DNA, 21 bp, Artificial sequence
  SiRNA target sequence
aacaaaatctacatttagatt

SEQ ID NO: 88125 - DNA, 21 bp, Artificial sequence
  SiRNA target sequence
acaaaatctacatttagatta

SEQ ID NO: 88126 - DNA, 21 bp, Artificial sequence
  SiRNA target sequence
caaaatctacatttagattat

SEQ ID NO: 88127 - DNA, 21 bp, Artificial sequence
  SiRNA target sequence
aaaatctacatttagattata

SEQ ID NO: 88128 - DNA, 21 bp, Artificial sequence
  SiRNA target sequence
aaatctacatttagattatat

SEQ ID NO: 88129 - DNA, 21 bp, Artificial sequence
  SiRNA target sequence
aatctacatttagattatatt

SEQ ID NO: 88130 - DNA, 21 bp, Artificial sequence
  SiRNA target sequence
atctacatttagattatattc

SEQ ID NO: 88131 - DNA, 21 bp, Artificial sequence
  SiRNA target sequence
tctacatttagattatattct

SEQ ID NO: 88132 - DNA, 21 bp, Artificial sequence
  SiRNA target sequence
ctacatttagattatattcta

SEQ ID NO: 88133 - DNA, 21 bp, Artificial sequence
  SiRNA target sequence
tacatttagattatattctaa

SEQ ID NO: 88134 - DNA, 21 bp, Artificial sequence
  SiRNA target sequence
acatttagattatattctaat

SEQ ID NO: 88135 - DNA, 21 bp, Artificial sequence
  SiRNA target sequence
catttagattatattctaatt

SEQ ID NO: 88136 - DNA, 21 bp, Artificial sequence
  SiRNA target sequence
atttagattatattctaattt

SEQ ID NO: 88137 - DNA, 21 bp, Artificial sequence
  SiRNA target sequence
tttagattatattctaattta

SEQ ID NO: 88138 - DNA, 21 bp, Artificial sequence
  SiRNA target sequence
ttagattatattctaatttat

SEQ ID NO: 88139 - DNA, 21 bp, Artificial sequence
  SiRNA target sequence
tagattatattctaatttatt

SEQ ID NO: 88140 - DNA, 21 bp, Artificial sequence
  SiRNA target sequence
agattatattctaatttattg

SEQ ID NO: 88141 - DNA, 21 bp, Artificial sequence
  SiRNA target sequence
gattatattctaatttattga

SEQ ID NO: 88142 - DNA, 21 bp, Artificial sequence
  SiRNA target sequence
attatattctaatttattgaa

SEQ ID NO: 88143 - DNA, 21 bp, Artificial sequence
  SiRNA target sequence
ttatattctaatttattgaat

SEQ ID NO: 88144 - DNA, 21 bp, Artificial sequence
  SiRNA target sequence
tatattctaatttattgaatt

SEQ ID NO: 88145 - DNA, 21 bp, Artificial sequence
  SiRNA target sequence
atattctaatttattgaattt

SEQ ID NO: 88146 - DNA, 21 bp, Artificial sequence
  SiRNA target sequence
tattctaatttattgaatttc

SEQ ID NO: 88147 - DNA, 21 bp, Artificial sequence
  SiRNA target sequence
attctaatttattgaatttca

SEQ ID NO: 88148 - DNA, 21 bp, Artificial sequence
  SiRNA target sequence
ttctaatttattgaatttcat

SEQ ID NO: 88149 - DNA, 22 bp, Artificial sequence
  SiRNA target sequence
ttatatccaactatcaaaaaat

SEQ ID NO: 88150 - DNA, 22 bp, Artificial sequence
  SiRNA target sequence
tatatccaactatcaaaaaata

SEQ ID NO: 88151 - DNA, 22 bp, Artificial sequence
  SiRNA target sequence
atatccaactatcaaaaaatag

SEQ ID NO: 88152 - DNA, 22 bp, Artificial sequence
  SiRNA target sequence
tatccaactatcaaaaaatagc

SEQ ID NO: 88153 - DNA, 22 bp, Artificial sequence
  SiRNA target sequence
atccaactatcaaaaaatagcc

SEQ ID NO: 88154 - DNA, 22 bp, Artificial sequence
  SiRNA target sequence
tccaactatcaaaaaatagcct

SEQ ID NO: 88155 - DNA, 22 bp, Artificial sequence
  SiRNA target sequence
ccaactatcaaaaaatagcctc

SEQ ID NO: 88156 - DNA, 22 bp, Artificial sequence
  SiRNA target sequence
caactatcaaaaaatagcctct

SEQ ID NO: 88157 - DNA, 22 bp, Artificial sequence
  SiRNA target sequence
aactatcaaaaaatagcctctt

SEQ ID NO: 88158 - DNA, 22 bp, Artificial sequence
  SiRNA target sequence
actatcaaaaaatagcctcttt

SEQ ID NO: 88159 - DNA, 22 bp, Artificial sequence
  SiRNA target sequence
ctatcaaaaaatagcctctttt

SEQ ID NO: 88160 - DNA, 22 bp, Artificial sequence
  SiRNA target sequence
tatcaaaaaatagcctcttttc

SEQ ID NO: 88161 - DNA, 22 bp, Artificial sequence
  SiRNA target sequence
atcaaaaaatagcctcttttct

SEQ ID NO: 88162 - DNA, 22 bp, Artificial sequence
  SiRNA target sequence
tcaaaaaatagcctcttttctt

SEQ ID NO: 88163 - DNA, 22 bp, Artificial sequence
  SiRNA target sequence
caaaaaatagcctcttttcttt

SEQ ID NO: 88164 - DNA, 22 bp, Artificial sequence
  SiRNA target sequence
aaaaaatagcctcttttctttc

SEQ ID NO: 88165 - DNA, 22 bp, Artificial sequence
  SiRNA target sequence
aaaaatagcctcttttctttca

SEQ ID NO: 88166 - DNA, 22 bp, Artificial sequence
  SiRNA target sequence
aaaatagcctcttttctttcac

SEQ ID NO: 88167 - DNA, 22 bp, Artificial sequence
  SiRNA target sequence
aaatagcctcttttctttcaca

SEQ ID NO: 88168 - DNA, 22 bp, Artificial sequence
  SiRNA target sequence
aatagcctcttttctttcacaa

SEQ ID NO: 88169 - DNA, 22 bp, Artificial sequence
  SiRNA target sequence
atagcctcttttctttcacaat

SEQ ID NO: 88170 - DNA, 22 bp, Artificial sequence
  SiRNA target sequence
tagcctcttttctttcacaatt

SEQ ID NO: 88171 - DNA, 22 bp, Artificial sequence
  SiRNA target sequence
agcctcttttctttcacaattt

SEQ ID NO: 88172 - DNA, 22 bp, Artificial sequence
  SiRNA target sequence
gcctcttttctttcacaatttc

SEQ ID NO: 88173 - DNA, 22 bp, Artificial sequence
  SiRNA target sequence
cctcttttctttcacaatttca

SEQ ID NO: 88174 - DNA, 22 bp, Artificial sequence
  SiRNA target sequence
ctcttttctttcacaatttcag

SEQ ID NO: 88175 - DNA, 22 bp, Artificial sequence
  SiRNA target sequence
tcttttctttcacaatttcaga

SEQ ID NO: 88176 - DNA, 22 bp, Artificial sequence
  SiRNA target sequence
cttttctttcacaatttcagaa

SEQ ID NO: 88177 - DNA, 22 bp, Artificial sequence
  SiRNA target sequence
ttttctttcacaatttcagaaa

SEQ ID NO: 88178 - DNA, 22 bp, Artificial sequence
  SiRNA target sequence
tttctttcacaatttcagaaaa

SEQ ID NO: 88179 - DNA, 22 bp, Artificial sequence
  SiRNA target sequence
ttctttcacaatttcagaaaaa

SEQ ID NO: 88180 - DNA, 22 bp, Artificial sequence
  SiRNA target sequence
tctttcacaatttcagaaaaat

SEQ ID NO: 88181 - DNA, 22 bp, Artificial sequence
  SiRNA target sequence
ctttcacaatttcagaaaaatt

SEQ ID NO: 88182 - DNA, 22 bp, Artificial sequence
  SiRNA target sequence
tttcacaatttcagaaaaattt

SEQ ID NO: 88183 - DNA, 22 bp, Artificial sequence
  SiRNA target sequence
ttcacaatttcagaaaaatttt

SEQ ID NO: 88184 - DNA, 22 bp, Artificial sequence
  SiRNA target sequence
tcacaatttcagaaaaattttc

SEQ ID NO: 88185 - DNA, 22 bp, Artificial sequence
  SiRNA target sequence
cacaatttcagaaaaattttca

SEQ ID NO: 88186 - DNA, 22 bp, Artificial sequence
  SiRNA target sequence
acaatttcagaaaaattttcat

SEQ ID NO: 88187 - DNA, 22 bp, Artificial sequence
  SiRNA target sequence
caatttcagaaaaattttcatt

SEQ ID NO: 88188 - DNA, 22 bp, Artificial sequence
  SiRNA target sequence
aatttcagaaaaattttcatta

SEQ ID NO: 88189 - DNA, 22 bp, Artificial sequence
  SiRNA target sequence
atttcagaaaaattttcattaa

SEQ ID NO: 88190 - DNA, 22 bp, Artificial sequence
  SiRNA target sequence
tttcagaaaaattttcattaaa

SEQ ID NO: 88191 - DNA, 22 bp, Artificial sequence
  SiRNA target sequence
ttcagaaaaattttcattaaaa

SEQ ID NO: 88192 - DNA, 22 bp, Artificial sequence
  SiRNA target sequence
tcagaaaaattttcattaaaaa

SEQ ID NO: 88193 - DNA, 22 bp, Artificial sequence
  SiRNA target sequence
cagaaaaattttcattaaaaat

SEQ ID NO: 88194 - DNA, 22 bp, Artificial sequence
  SiRNA target sequence
agaaaaattttcattaaaaatg

SEQ ID NO: 88195 - DNA, 22 bp, Artificial sequence
  SiRNA target sequence
gaaaaattttcattaaaaatgc

SEQ ID NO: 88196 - DNA, 22 bp, Artificial sequence
  SiRNA target sequence
aaaaattttcattaaaaatgct

SEQ ID NO: 88197 - DNA, 22 bp, Artificial sequence
  SiRNA target sequence
aaaattttcattaaaaatgcta

SEQ ID NO: 88198 - DNA, 22 bp, Artificial sequence
  SiRNA target sequence
aaattttcattaaaaatgctat

SEQ ID NO: 88199 - DNA, 22 bp, Artificial sequence
  SiRNA target sequence
aattttcattaaaaatgctata

SEQ ID NO: 88200 - DNA, 22 bp, Artificial sequence
  SiRNA target sequence
attttcattaaaaatgctataa

SEQ ID NO: 88201 - DNA, 22 bp, Artificial sequence
  SiRNA target sequence
ttttcattaaaaatgctataaa

SEQ ID NO: 88202 - DNA, 22 bp, Artificial sequence
  SiRNA target sequence
tttcattaaaaatgctataaat

SEQ ID NO: 88203 - DNA, 22 bp, Artificial sequence
  SiRNA target sequence
ttcattaaaaatgctataaata

SEQ ID NO: 88204 - DNA, 22 bp, Artificial sequence
  SiRNA target sequence
tcattaaaaatgctataaatag

SEQ ID NO: 88205 - DNA, 22 bp, Artificial sequence
  SiRNA target sequence
cattaaaaatgctataaatagt

SEQ ID NO: 88206 - DNA, 22 bp, Artificial sequence
  SiRNA target sequence
attaaaaatgctataaatagtt

SEQ ID NO: 88207 - DNA, 22 bp, Artificial sequence
  SiRNA target sequence
ttaaaaatgctataaatagttt

SEQ ID NO: 88208 - DNA, 22 bp, Artificial sequence
  SiRNA target sequence
taaaaatgctataaatagtttt

SEQ ID NO: 88209 - DNA, 22 bp, Artificial sequence
  SiRNA target sequence
aaaaatgctataaatagttttt

SEQ ID NO: 88210 - DNA, 22 bp, Artificial sequence
  SiRNA target sequence
aaaatgctataaatagtttttt

SEQ ID NO: 88211 - DNA, 22 bp, Artificial sequence
  SiRNA target sequence
aaatgctataaatagttttttg

SEQ ID NO: 88212 - DNA, 22 bp, Artificial sequence
  SiRNA target sequence
aatgctataaatagttttttgc

SEQ ID NO: 88213 - DNA, 22 bp, Artificial sequence
  SiRNA target sequence
atgctataaatagttttttgca

SEQ ID NO: 88214 - DNA, 22 bp, Artificial sequence
  SiRNA target sequence
tgctataaatagttttttgcat

SEQ ID NO: 88215 - DNA, 22 bp, Artificial sequence
  SiRNA target sequence
gctataaatagttttttgcata

SEQ ID NO: 88216 - DNA, 22 bp, Artificial sequence
  SiRNA target sequence
ctataaatagttttttgcatat

SEQ ID NO: 88217 - DNA, 22 bp, Artificial sequence
  SiRNA target sequence
tataaatagttttttgcatatc

SEQ ID NO: 88218 - DNA, 22 bp, Artificial sequence
  SiRNA target sequence
ataaatagttttttgcatatca

SEQ ID NO: 88219 - DNA, 22 bp, Artificial sequence
  SiRNA target sequence
taaatagttttttgcatatcag

SEQ ID NO: 88220 - DNA, 22 bp, Artificial sequence
  SiRNA target sequence
aaatagttttttgcatatcagg

SEQ ID NO: 88221 - DNA, 22 bp, Artificial sequence
  SiRNA target sequence
aatagttttttgcatatcaggt

SEQ ID NO: 88222 - DNA, 22 bp, Artificial sequence
  SiRNA target sequence
atagttttttgcatatcaggtc

SEQ ID NO: 88223 - DNA, 22 bp, Artificial sequence
  SiRNA target sequence
tagttttttgcatatcaggtcg

SEQ ID NO: 88224 - DNA, 22 bp, Artificial sequence
  SiRNA target sequence
agttttttgcatatcaggtcgg

SEQ ID NO: 88225 - DNA, 22 bp, Artificial sequence
  SiRNA target sequence
gttttttgcatatcaggtcggc

SEQ ID NO: 88226 - DNA, 22 bp, Artificial sequence
  SiRNA target sequence
ttttttgcatatcaggtcggcc

SEQ ID NO: 88227 - DNA, 22 bp, Artificial sequence
  SiRNA target sequence
tttttgcatatcaggtcggcca

SEQ ID NO: 88228 - DNA, 22 bp, Artificial sequence
  SiRNA target sequence
ttttgcatatcaggtcggccac

SEQ ID NO: 88229 - DNA, 22 bp, Artificial sequence
  SiRNA target sequence
tttgcatatcaggtcggccaca

SEQ ID NO: 88230 - DNA, 22 bp, Artificial sequence
  SiRNA target sequence
ttgcatatcaggtcggccacaa

SEQ ID NO: 88231 - DNA, 22 bp, Artificial sequence
  SiRNA target sequence
tgcatatcaggtcggccacaaa

SEQ ID NO: 88232 - DNA, 22 bp, Artificial sequence
  SiRNA target sequence
gcatatcaggtcggccacaaac

SEQ ID NO: 88233 - DNA, 22 bp, Artificial sequence
  SiRNA target sequence
catatcaggtcggccacaaaca

SEQ ID NO: 88234 - DNA, 22 bp, Artificial sequence
  SiRNA target sequence
atatcaggtcggccacaaacat

SEQ ID NO: 88235 - DNA, 22 bp, Artificial sequence
  SiRNA target sequence
tatcaggtcggccacaaacata

SEQ ID NO: 88236 - DNA, 22 bp, Artificial sequence
  SiRNA target sequence
atcaggtcggccacaaacataa

SEQ ID NO: 88237 - DNA, 22 bp, Artificial sequence
  SiRNA target sequence
tcaggtcggccacaaacataaa

SEQ ID NO: 88238 - DNA, 22 bp, Artificial sequence
  SiRNA target sequence
caggtcggccacaaacataaac

SEQ ID NO: 88239 - DNA, 22 bp, Artificial sequence
  SiRNA target sequence
aggtcggccacaaacataaacc

SEQ ID NO: 88240 - DNA, 22 bp, Artificial sequence
  SiRNA target sequence
ggtcggccacaaacataaacca

SEQ ID NO: 88241 - DNA, 22 bp, Artificial sequence
  SiRNA target sequence
gtcggccacaaacataaaccaa

SEQ ID NO: 88242 - DNA, 22 bp, Artificial sequence
  SiRNA target sequence
tcggccacaaacataaaccaaa

SEQ ID NO: 88243 - DNA, 22 bp, Artificial sequence
  SiRNA target sequence
cggccacaaacataaaccaaac

SEQ ID NO: 88244 - DNA, 22 bp, Artificial sequence
  SiRNA target sequence
ggccacaaacataaaccaaaca

SEQ ID NO: 88245 - DNA, 22 bp, Artificial sequence
  SiRNA target sequence
gccacaaacataaaccaaacat

SEQ ID NO: 88246 - DNA, 22 bp, Artificial sequence
  SiRNA target sequence
ccacaaacataaaccaaacatc

SEQ ID NO: 88247 - DNA, 22 bp, Artificial sequence
  SiRNA target sequence
cacaaacataaaccaaacatcc

SEQ ID NO: 88248 - DNA, 22 bp, Artificial sequence
  SiRNA target sequence
acaaacataaaccaaacatccg

SEQ ID NO: 88249 - DNA, 22 bp, Artificial sequence
  SiRNA target sequence
caaacataaaccaaacatccgt

SEQ ID NO: 88250 - DNA, 22 bp, Artificial sequence
  SiRNA target sequence
aaacataaaccaaacatccgtc

SEQ ID NO: 88251 - DNA, 22 bp, Artificial sequence
  SiRNA target sequence
aacataaaccaaacatccgtct

SEQ ID NO: 88252 - DNA, 22 bp, Artificial sequence
  SiRNA target sequence
acataaaccaaacatccgtctt

SEQ ID NO: 88253 - DNA, 22 bp, Artificial sequence
  SiRNA target sequence
cataaaccaaacatccgtcttt

SEQ ID NO: 88254 - DNA, 22 bp, Artificial sequence
  SiRNA target sequence
ataaaccaaacatccgtcttta

SEQ ID NO: 88255 - DNA, 22 bp, Artificial sequence
  SiRNA target sequence
taaaccaaacatccgtctttaa

SEQ ID NO: 88256 - DNA, 22 bp, Artificial sequence
  SiRNA target sequence
aaaccaaacatccgtctttaat

SEQ ID NO: 88257 - DNA, 22 bp, Artificial sequence
  SiRNA target sequence
aaccaaacatccgtctttaatg

SEQ ID NO: 88258 - DNA, 22 bp, Artificial sequence
  SiRNA target sequence
accaaacatccgtctttaatgt

SEQ ID NO: 88259 - DNA, 22 bp, Artificial sequence
  SiRNA target sequence
ccaaacatccgtctttaatgta

SEQ ID NO: 88260 - DNA, 22 bp, Artificial sequence
  SiRNA target sequence
caaacatccgtctttaatgtat

SEQ ID NO: 88261 - DNA, 22 bp, Artificial sequence
  SiRNA target sequence
aaacatccgtctttaatgtatg

SEQ ID NO: 88262 - DNA, 22 bp, Artificial sequence
  SiRNA target sequence
aacatccgtctttaatgtatgt

SEQ ID NO: 88263 - DNA, 22 bp, Artificial sequence
  SiRNA target sequence
acatccgtctttaatgtatgtt

SEQ ID NO: 88264 - DNA, 22 bp, Artificial sequence
  SiRNA target sequence
catccgtctttaatgtatgttt

SEQ ID NO: 88265 - DNA, 22 bp, Artificial sequence
  SiRNA target sequence
atccgtctttaatgtatgtttt

SEQ ID NO: 88266 - DNA, 22 bp, Artificial sequence
  SiRNA target sequence
tccgtctttaatgtatgttttt

SEQ ID NO: 88267 - DNA, 22 bp, Artificial sequence
  SiRNA target sequence
ccgtctttaatgtatgttttta

SEQ ID NO: 88268 - DNA, 22 bp, Artificial sequence
  SiRNA target sequence
cgtctttaatgtatgtttttat

SEQ ID NO: 88269 - DNA, 22 bp, Artificial sequence
  SiRNA target sequence
gtctttaatgtatgtttttatc

SEQ ID NO: 88270 - DNA, 22 bp, Artificial sequence
  SiRNA target sequence
tctttaatgtatgtttttatct

SEQ ID NO: 88271 - DNA, 22 bp, Artificial sequence
  SiRNA target sequence
ctttaatgtatgtttttatctc

SEQ ID NO: 88272 - DNA, 22 bp, Artificial sequence
  SiRNA target sequence
tttaatgtatgtttttatctca

SEQ ID NO: 88273 - DNA, 22 bp, Artificial sequence
  SiRNA target sequence
ttaatgtatgtttttatctcat

SEQ ID NO: 88274 - DNA, 22 bp, Artificial sequence
  SiRNA target sequence
taatgtatgtttttatctcatt

SEQ ID NO: 88275 - DNA, 22 bp, Artificial sequence
  SiRNA target sequence
aatgtatgtttttatctcattt

SEQ ID NO: 88276 - DNA, 22 bp, Artificial sequence
  SiRNA target sequence
atgtatgtttttatctcattta

SEQ ID NO: 88277 - DNA, 22 bp, Artificial sequence
  SiRNA target sequence
tgtatgtttttatctcatttaa

SEQ ID NO: 88278 - DNA, 22 bp, Artificial sequence
  SiRNA target sequence
gtatgtttttatctcatttaaa

SEQ ID NO: 88279 - DNA, 22 bp, Artificial sequence
  SiRNA target sequence
tatgtttttatctcatttaaat

SEQ ID NO: 88280 - DNA, 22 bp, Artificial sequence
  SiRNA target sequence
atgtttttatctcatttaaatt

SEQ ID NO: 88281 - DNA, 22 bp, Artificial sequence
  SiRNA target sequence
tgtttttatctcatttaaattt

SEQ ID NO: 88282 - DNA, 22 bp, Artificial sequence
  SiRNA target sequence
gtttttatctcatttaaatttt

SEQ ID NO: 88283 - DNA, 22 bp, Artificial sequence
  SiRNA target sequence
tttttatctcatttaaattttg

SEQ ID NO: 88284 - DNA, 22 bp, Artificial sequence
  SiRNA target sequence
ttttatctcatttaaattttgt

SEQ ID NO: 88285 - DNA, 22 bp, Artificial sequence
  SiRNA target sequence
tttatctcatttaaattttgta

SEQ ID NO: 88286 - DNA, 22 bp, Artificial sequence
  SiRNA target sequence
ttatctcatttaaattttgtaa

SEQ ID NO: 88287 - DNA, 22 bp, Artificial sequence
  SiRNA target sequence
tatctcatttaaattttgtaat

SEQ ID NO: 88288 - DNA, 22 bp, Artificial sequence
  SiRNA target sequence
atctcatttaaattttgtaata

SEQ ID NO: 88289 - DNA, 22 bp, Artificial sequence
  SiRNA target sequence
tctcatttaaattttgtaataa

SEQ ID NO: 88290 - DNA, 22 bp, Artificial sequence
  SiRNA target sequence
ctcatttaaattttgtaataaa

SEQ ID NO: 88291 - DNA, 22 bp, Artificial sequence
  SiRNA target sequence
tcatttaaattttgtaataaat

SEQ ID NO: 88292 - DNA, 22 bp, Artificial sequence
  SiRNA target sequence
catttaaattttgtaataaata

SEQ ID NO: 88293 - DNA, 22 bp, Artificial sequence
  SiRNA target sequence
atttaaattttgtaataaataa

SEQ ID NO: 88294 - DNA, 22 bp, Artificial sequence
  SiRNA target sequence
tttaaattttgtaataaataat

SEQ ID NO: 88295 - DNA, 22 bp, Artificial sequence
  SiRNA target sequence
ttaaattttgtaataaataatc

SEQ ID NO: 88296 - DNA, 22 bp, Artificial sequence
  SiRNA target sequence
taaattttgtaataaataatca

SEQ ID NO: 88297 - DNA, 22 bp, Artificial sequence
  SiRNA target sequence
aaattttgtaataaataatcag

SEQ ID NO: 88298 - DNA, 22 bp, Artificial sequence
  SiRNA target sequence
aattttgtaataaataatcagt

SEQ ID NO: 88299 - DNA, 22 bp, Artificial sequence
  SiRNA target sequence
attttgtaataaataatcagta

SEQ ID NO: 88300 - DNA, 22 bp, Artificial sequence
  SiRNA target sequence
ttttgtaataaataatcagtaa

SEQ ID NO: 88301 - DNA, 22 bp, Artificial sequence
  SiRNA target sequence
tttgtaataaataatcagtaac

SEQ ID NO: 88302 - DNA, 22 bp, Artificial sequence
  SiRNA target sequence
ttgtaataaataatcagtaaca

SEQ ID NO: 88303 - DNA, 22 bp, Artificial sequence
  SiRNA target sequence
tgtaataaataatcagtaacat

SEQ ID NO: 88304 - DNA, 22 bp, Artificial sequence
  SiRNA target sequence
gtaataaataatcagtaacata

SEQ ID NO: 88305 - DNA, 22 bp, Artificial sequence
  SiRNA target sequence
taataaataatcagtaacataa

SEQ ID NO: 88306 - DNA, 22 bp, Artificial sequence
  SiRNA target sequence
aataaataatcagtaacataaa

SEQ ID NO: 88307 - DNA, 22 bp, Artificial sequence
  SiRNA target sequence
ataaataatcagtaacataaat

SEQ ID NO: 88308 - DNA, 22 bp, Artificial sequence
  SiRNA target sequence
taaataatcagtaacataaatt

SEQ ID NO: 88309 - DNA, 22 bp, Artificial sequence
  SiRNA target sequence
aaataatcagtaacataaattt

SEQ ID NO: 88310 - DNA, 22 bp, Artificial sequence
  SiRNA target sequence
aataatcagtaacataaatttt

SEQ ID NO: 88311 - DNA, 22 bp, Artificial sequence
  SiRNA target sequence
ataatcagtaacataaatttta

SEQ ID NO: 88312 - DNA, 22 bp, Artificial sequence
  SiRNA target sequence
taatcagtaacataaattttat

SEQ ID NO: 88313 - DNA, 22 bp, Artificial sequence
  SiRNA target sequence
aatcagtaacataaattttatt

SEQ ID NO: 88314 - DNA, 22 bp, Artificial sequence
  SiRNA target sequence
atcagtaacataaattttatta

SEQ ID NO: 88315 - DNA, 22 bp, Artificial sequence
  SiRNA target sequence
tcagtaacataaattttattac

SEQ ID NO: 88316 - DNA, 22 bp, Artificial sequence
  SiRNA target sequence
cagtaacataaattttattaca

SEQ ID NO: 88317 - DNA, 22 bp, Artificial sequence
  SiRNA target sequence
agtaacataaattttattacaa

SEQ ID NO: 88318 - DNA, 22 bp, Artificial sequence
  SiRNA target sequence
gtaacataaattttattacaag

SEQ ID NO: 88319 - DNA, 22 bp, Artificial sequence
  SiRNA target sequence
taacataaattttattacaaga

SEQ ID NO: 88320 - DNA, 22 bp, Artificial sequence
  SiRNA target sequence
aacataaattttattacaagat

SEQ ID NO: 88321 - DNA, 22 bp, Artificial sequence
  SiRNA target sequence
acataaattttattacaagata

SEQ ID NO: 88322 - DNA, 22 bp, Artificial sequence
  SiRNA target sequence
cataaattttattacaagataa

SEQ ID NO: 88323 - DNA, 22 bp, Artificial sequence
  SiRNA target sequence
ataaattttattacaagataaa

SEQ ID NO: 88324 - DNA, 22 bp, Artificial sequence
  SiRNA target sequence
taaattttattacaagataaaa

SEQ ID NO: 88325 - DNA, 22 bp, Artificial sequence
  SiRNA target sequence
aaattttattacaagataaaat

SEQ ID NO: 88326 - DNA, 22 bp, Artificial sequence
  SiRNA target sequence
aattttattacaagataaaatt

SEQ ID NO: 88327 - DNA, 22 bp, Artificial sequence
  SiRNA target sequence
attttattacaagataaaattt

SEQ ID NO: 88328 - DNA, 22 bp, Artificial sequence
  SiRNA target sequence
ttttattacaagataaaatttt

SEQ ID NO: 88329 - DNA, 22 bp, Artificial sequence
  SiRNA target sequence
tttattacaagataaaatttta

SEQ ID NO: 88330 - DNA, 22 bp, Artificial sequence
  SiRNA target sequence
ttattacaagataaaattttaa

SEQ ID NO: 88331 - DNA, 22 bp, Artificial sequence
  SiRNA target sequence
tattacaagataaaattttaat

SEQ ID NO: 88332 - DNA, 22 bp, Artificial sequence
  SiRNA target sequence
attacaagataaaattttaata

SEQ ID NO: 88333 - DNA, 22 bp, Artificial sequence
  SiRNA target sequence
ttacaagataaaattttaataa

SEQ ID NO: 88334 - DNA, 22 bp, Artificial sequence
  SiRNA target sequence
tacaagataaaattttaataat

SEQ ID NO: 88335 - DNA, 22 bp, Artificial sequence
  SiRNA target sequence
acaagataaaattttaataatt

SEQ ID NO: 88336 - DNA, 22 bp, Artificial sequence
  SiRNA target sequence
caagataaaattttaataattt

SEQ ID NO: 88337 - DNA, 22 bp, Artificial sequence
  SiRNA target sequence
aagataaaattttaataatttc

SEQ ID NO: 88338 - DNA, 22 bp, Artificial sequence
  SiRNA target sequence
agataaaattttaataatttct

SEQ ID NO: 88339 - DNA, 22 bp, Artificial sequence
  SiRNA target sequence
gataaaattttaataatttctg

SEQ ID NO: 88340 - DNA, 22 bp, Artificial sequence
  SiRNA target sequence
ataaaattttaataatttctgt

SEQ ID NO: 88341 - DNA, 22 bp, Artificial sequence
  SiRNA target sequence
taaaattttaataatttctgtg

SEQ ID NO: 88342 - DNA, 22 bp, Artificial sequence
  SiRNA target sequence
aaaattttaataatttctgtgt

SEQ ID NO: 88343 - DNA, 22 bp, Artificial sequence
  SiRNA target sequence
aaattttaataatttctgtgtt

SEQ ID NO: 88344 - DNA, 22 bp, Artificial sequence
  SiRNA target sequence
aattttaataatttctgtgttt

SEQ ID NO: 88345 - DNA, 22 bp, Artificial sequence
  SiRNA target sequence
attttaataatttctgtgtttt

SEQ ID NO: 88346 - DNA, 22 bp, Artificial sequence
  SiRNA target sequence
ttttaataatttctgtgttttt

SEQ ID NO: 88347 - DNA, 22 bp, Artificial sequence
  SiRNA target sequence
tttaataatttctgtgttttta

SEQ ID NO: 88348 - DNA, 22 bp, Artificial sequence
  SiRNA target sequence
ttaataatttctgtgtttttat

SEQ ID NO: 88349 - DNA, 22 bp, Artificial sequence
  SiRNA target sequence
taataatttctgtgtttttata

SEQ ID NO: 88350 - DNA, 22 bp, Artificial sequence
  SiRNA target sequence
aataatttctgtgtttttatat

SEQ ID NO: 88351 - DNA, 22 bp, Artificial sequence
  SiRNA target sequence
ataatttctgtgtttttatatt

SEQ ID NO: 88352 - DNA, 22 bp, Artificial sequence
  SiRNA target sequence
taatttctgtgtttttatattt

SEQ ID NO: 88353 - DNA, 22 bp, Artificial sequence
  SiRNA target sequence
aatttctgtgtttttatatttt

SEQ ID NO: 88354 - DNA, 22 bp, Artificial sequence
  SiRNA target sequence
atttctgtgtttttatattttg

SEQ ID NO: 88355 - DNA, 22 bp, Artificial sequence
  SiRNA target sequence
tttctgtgtttttatattttgc

SEQ ID NO: 88356 - DNA, 22 bp, Artificial sequence
  SiRNA target sequence
ttctgtgtttttatattttgca

SEQ ID NO: 88357 - DNA, 22 bp, Artificial sequence
  SiRNA target sequence
tctgtgtttttatattttgcat

SEQ ID NO: 88358 - DNA, 22 bp, Artificial sequence
  SiRNA target sequence
ctgtgtttttatattttgcatc

SEQ ID NO: 88359 - DNA, 22 bp, Artificial sequence
  SiRNA target sequence
tgtgtttttatattttgcatct

SEQ ID NO: 88360 - DNA, 22 bp, Artificial sequence
  SiRNA target sequence
gtgtttttatattttgcatctt

SEQ ID NO: 88361 - DNA, 22 bp, Artificial sequence
  SiRNA target sequence
tgtttttatattttgcatcttt

SEQ ID NO: 88362 - DNA, 22 bp, Artificial sequence
  SiRNA target sequence
gtttttatattttgcatcttta

SEQ ID NO: 88363 - DNA, 22 bp, Artificial sequence
  SiRNA target sequence
tttttatattttgcatctttaa

SEQ ID NO: 88364 - DNA, 22 bp, Artificial sequence
  SiRNA target sequence
ttttatattttgcatctttaat

SEQ ID NO: 88365 - DNA, 22 bp, Artificial sequence
  SiRNA target sequence
tttatattttgcatctttaata

SEQ ID NO: 88366 - DNA, 22 bp, Artificial sequence
  SiRNA target sequence
ttatattttgcatctttaataa

SEQ ID NO: 88367 - DNA, 22 bp, Artificial sequence
  SiRNA target sequence
tatattttgcatctttaataag

SEQ ID NO: 88368 - DNA, 22 bp, Artificial sequence
  SiRNA target sequence
atattttgcatctttaataaga

SEQ ID NO: 88369 - DNA, 22 bp, Artificial sequence
  SiRNA target sequence
tattttgcatctttaataagat

SEQ ID NO: 88370 - DNA, 22 bp, Artificial sequence
  SiRNA target sequence
attttgcatctttaataagatc

SEQ ID NO: 88371 - DNA, 22 bp, Artificial sequence
  SiRNA target sequence
ttttgcatctttaataagatca

SEQ ID NO: 88372 - DNA, 22 bp, Artificial sequence
  SiRNA target sequence
tttgcatctttaataagatcat

SEQ ID NO: 88373 - DNA, 22 bp, Artificial sequence
  SiRNA target sequence
ttgcatctttaataagatcatc

SEQ ID NO: 88374 - DNA, 22 bp, Artificial sequence
  SiRNA target sequence
tgcatctttaataagatcatct

SEQ ID NO: 88375 - DNA, 22 bp, Artificial sequence
  SiRNA target sequence
gcatctttaataagatcatctt

SEQ ID NO: 88376 - DNA, 22 bp, Artificial sequence
  SiRNA target sequence
catctttaataagatcatcttc

SEQ ID NO: 88377 - DNA, 22 bp, Artificial sequence
  SiRNA target sequence
atctttaataagatcatcttct

SEQ ID NO: 88378 - DNA, 22 bp, Artificial sequence
  SiRNA target sequence
tctttaataagatcatcttctt

SEQ ID NO: 88379 - DNA, 22 bp, Artificial sequence
  SiRNA target sequence
ctttaataagatcatcttcttg

SEQ ID NO: 88380 - DNA, 22 bp, Artificial sequence
  SiRNA target sequence
tttaataagatcatcttcttga

SEQ ID NO: 88381 - DNA, 22 bp, Artificial sequence
  SiRNA target sequence
ttaataagatcatcttcttgat

SEQ ID NO: 88382 - DNA, 22 bp, Artificial sequence
  SiRNA target sequence
taataagatcatcttcttgatt

SEQ ID NO: 88383 - DNA, 22 bp, Artificial sequence
  SiRNA target sequence
aataagatcatcttcttgattt

SEQ ID NO: 88384 - DNA, 22 bp, Artificial sequence
  SiRNA target sequence
ataagatcatcttcttgatttc

SEQ ID NO: 88385 - DNA, 22 bp, Artificial sequence
  SiRNA target sequence
taagatcatcttcttgatttct

SEQ ID NO: 88386 - DNA, 22 bp, Artificial sequence
  SiRNA target sequence
aagatcatcttcttgatttcta

SEQ ID NO: 88387 - DNA, 22 bp, Artificial sequence
  SiRNA target sequence
agatcatcttcttgatttctaa

SEQ ID NO: 88388 - DNA, 22 bp, Artificial sequence
  SiRNA target sequence
gatcatcttcttgatttctaaa

SEQ ID NO: 88389 - DNA, 22 bp, Artificial sequence
  SiRNA target sequence
atcatcttcttgatttctaaat

SEQ ID NO: 88390 - DNA, 22 bp, Artificial sequence
  SiRNA target sequence
tcatcttcttgatttctaaatc

SEQ ID NO: 88391 - DNA, 22 bp, Artificial sequence
  SiRNA target sequence
catcttcttgatttctaaatcc

SEQ ID NO: 88392 - DNA, 22 bp, Artificial sequence
  SiRNA target sequence
atcttcttgatttctaaatcca

SEQ ID NO: 88393 - DNA, 22 bp, Artificial sequence
  SiRNA target sequence
tcttcttgatttctaaatccat

SEQ ID NO: 88394 - DNA, 22 bp, Artificial sequence
  SiRNA target sequence
cttcttgatttctaaatccata

SEQ ID NO: 88395 - DNA, 22 bp, Artificial sequence
  SiRNA target sequence
ttcttgatttctaaatccatat

SEQ ID NO: 88396 - DNA, 22 bp, Artificial sequence
  SiRNA target sequence
tcttgatttctaaatccatata

SEQ ID NO: 88397 - DNA, 22 bp, Artificial sequence
  SiRNA target sequence
cttgatttctaaatccatatat

SEQ ID NO: 88398 - DNA, 22 bp, Artificial sequence
  SiRNA target sequence
ttgatttctaaatccatatatt

SEQ ID NO: 88399 - DNA, 22 bp, Artificial sequence
  SiRNA target sequence
tgatttctaaatccatatatta

SEQ ID NO: 88400 - DNA, 22 bp, Artificial sequence
  SiRNA target sequence
gatttctaaatccatatattag

SEQ ID NO: 88401 - DNA, 22 bp, Artificial sequence
  SiRNA target sequence
atttctaaatccatatattagt

SEQ ID NO: 88402 - DNA, 22 bp, Artificial sequence
  SiRNA target sequence
tttctaaatccatatattagtt

SEQ ID NO: 88403 - DNA, 22 bp, Artificial sequence
  SiRNA target sequence
ttctaaatccatatattagttt

SEQ ID NO: 88404 - DNA, 22 bp, Artificial sequence
  SiRNA target sequence
tctaaatccatatattagtttg

SEQ ID NO: 88405 - DNA, 22 bp, Artificial sequence
  SiRNA target sequence
ctaaatccatatattagtttga

SEQ ID NO: 88406 - DNA, 22 bp, Artificial sequence
  SiRNA target sequence
taaatccatatattagtttgat

SEQ ID NO: 88407 - DNA, 22 bp, Artificial sequence
  SiRNA target sequence
aaatccatatattagtttgata

SEQ ID NO: 88408 - DNA, 22 bp, Artificial sequence
  SiRNA target sequence
aatccatatattagtttgatat

SEQ ID NO: 88409 - DNA, 22 bp, Artificial sequence
  SiRNA target sequence
atccatatattagtttgatata

SEQ ID NO: 88410 - DNA, 22 bp, Artificial sequence
  SiRNA target sequence
tccatatattagtttgatatat

SEQ ID NO: 88411 - DNA, 22 bp, Artificial sequence
  SiRNA target sequence
ccatatattagtttgatatatt

SEQ ID NO: 88412 - DNA, 22 bp, Artificial sequence
  SiRNA target sequence
catatattagtttgatatattg

SEQ ID NO: 88413 - DNA, 22 bp, Artificial sequence
  SiRNA target sequence
atatattagtttgatatattga

SEQ ID NO: 88414 - DNA, 22 bp, Artificial sequence
  SiRNA target sequence
tatattagtttgatatattgat

SEQ ID NO: 88415 - DNA, 22 bp, Artificial sequence
  SiRNA target sequence
atattagtttgatatattgatc

SEQ ID NO: 88416 - DNA, 22 bp, Artificial sequence
  SiRNA target sequence
tattagtttgatatattgatcg

SEQ ID NO: 88417 - DNA, 22 bp, Artificial sequence
  SiRNA target sequence
attagtttgatatattgatcgt

SEQ ID NO: 88418 - DNA, 22 bp, Artificial sequence
  SiRNA target sequence
ttagtttgatatattgatcgtc

SEQ ID NO: 88419 - DNA, 22 bp, Artificial sequence
  SiRNA target sequence
tagtttgatatattgatcgtct

SEQ ID NO: 88420 - DNA, 22 bp, Artificial sequence
  SiRNA target sequence
agtttgatatattgatcgtctt

SEQ ID NO: 88421 - DNA, 22 bp, Artificial sequence
  SiRNA target sequence
gtttgatatattgatcgtcttc

SEQ ID NO: 88422 - DNA, 22 bp, Artificial sequence
  SiRNA target sequence
tttgatatattgatcgtcttct

SEQ ID NO: 88423 - DNA, 22 bp, Artificial sequence
  SiRNA target sequence
ttgatatattgatcgtcttctt

SEQ ID NO: 88424 - DNA, 22 bp, Artificial sequence
  SiRNA target sequence
tgatatattgatcgtcttcttt

SEQ ID NO: 88425 - DNA, 22 bp, Artificial sequence
  SiRNA target sequence
gatatattgatcgtcttcttta

SEQ ID NO: 88426 - DNA, 22 bp, Artificial sequence
  SiRNA target sequence
atatattgatcgtcttctttat

SEQ ID NO: 88427 - DNA, 22 bp, Artificial sequence
  SiRNA target sequence
tatattgatcgtcttctttatt

SEQ ID NO: 88428 - DNA, 22 bp, Artificial sequence
  SiRNA target sequence
atattgatcgtcttctttattt

SEQ ID NO: 88429 - DNA, 22 bp, Artificial sequence
  SiRNA target sequence
tattgatcgtcttctttatttt

SEQ ID NO: 88430 - DNA, 22 bp, Artificial sequence
  SiRNA target sequence
attgatcgtcttctttattttt

SEQ ID NO: 88431 - DNA, 22 bp, Artificial sequence
  SiRNA target sequence
ttgatcgtcttctttatttttc

SEQ ID NO: 88432 - DNA, 22 bp, Artificial sequence
  SiRNA target sequence
tgatcgtcttctttatttttca

SEQ ID NO: 88433 - DNA, 22 bp, Artificial sequence
  SiRNA target sequence
gatcgtcttctttatttttcaa

SEQ ID NO: 88434 - DNA, 22 bp, Artificial sequence
  SiRNA target sequence
atcgtcttctttatttttcaaa

SEQ ID NO: 88435 - DNA, 22 bp, Artificial sequence
  SiRNA target sequence
tcgtcttctttatttttcaaaa

SEQ ID NO: 88436 - DNA, 22 bp, Artificial sequence
  SiRNA target sequence
cgtcttctttatttttcaaaaa

SEQ ID NO: 88437 - DNA, 22 bp, Artificial sequence
  SiRNA target sequence
gtcttctttatttttcaaaaac

SEQ ID NO: 88438 - DNA, 22 bp, Artificial sequence
  SiRNA target sequence
tcttctttatttttcaaaaacg

SEQ ID NO: 88439 - DNA, 22 bp, Artificial sequence
  SiRNA target sequence
cttctttatttttcaaaaacga

SEQ ID NO: 88440 - DNA, 22 bp, Artificial sequence
  SiRNA target sequence
ttctttatttttcaaaaacgaa

SEQ ID NO: 88441 - DNA, 22 bp, Artificial sequence
  SiRNA target sequence
tctttatttttcaaaaacgaaa

SEQ ID NO: 88442 - DNA, 22 bp, Artificial sequence
  SiRNA target sequence
ctttatttttcaaaaacgaaaa

SEQ ID NO: 88443 - DNA, 22 bp, Artificial sequence
  SiRNA target sequence
tttatttttcaaaaacgaaaaa

SEQ ID NO: 88444 - DNA, 22 bp, Artificial sequence
  SiRNA target sequence
ttatttttcaaaaacgaaaaaa

SEQ ID NO: 88445 - DNA, 22 bp, Artificial sequence
  SiRNA target sequence
tatttttcaaaaacgaaaaaaa

SEQ ID NO: 88446 - DNA, 22 bp, Artificial sequence
  SiRNA target sequence
atttttcaaaaacgaaaaaaat

SEQ ID NO: 88447 - DNA, 22 bp, Artificial sequence
  SiRNA target sequence
tttttcaaaaacgaaaaaaatg

SEQ ID NO: 88448 - DNA, 22 bp, Artificial sequence
  SiRNA target sequence
ttttcaaaaacgaaaaaaatgg

SEQ ID NO: 88449 - DNA, 22 bp, Artificial sequence
  SiRNA target sequence
tttcaaaaacgaaaaaaatgga

SEQ ID NO: 88450 - DNA, 22 bp, Artificial sequence
  SiRNA target sequence
ttcaaaaacgaaaaaaatggag

SEQ ID NO: 88451 - DNA, 22 bp, Artificial sequence
  SiRNA target sequence
tcaaaaacgaaaaaaatggagc

SEQ ID NO: 88452 - DNA, 22 bp, Artificial sequence
  SiRNA target sequence
caaaaacgaaaaaaatggagca

SEQ ID NO: 88453 - DNA, 22 bp, Artificial sequence
  SiRNA target sequence
aaaaacgaaaaaaatggagcaa

SEQ ID NO: 88454 - DNA, 22 bp, Artificial sequence
  SiRNA target sequence
aaaacgaaaaaaatggagcaat

SEQ ID NO: 88455 - DNA, 22 bp, Artificial sequence
  SiRNA target sequence
aaacgaaaaaaatggagcaatg

SEQ ID NO: 88456 - DNA, 22 bp, Artificial sequence
  SiRNA target sequence
aacgaaaaaaatggagcaatgc

SEQ ID NO: 88457 - DNA, 22 bp, Artificial sequence
  SiRNA target sequence
acgaaaaaaatggagcaatgcc

SEQ ID NO: 88458 - DNA, 22 bp, Artificial sequence
  SiRNA target sequence
cgaaaaaaatggagcaatgcca

SEQ ID NO: 88459 - DNA, 22 bp, Artificial sequence
  SiRNA target sequence
gaaaaaaatggagcaatgccag

SEQ ID NO: 88460 - DNA, 22 bp, Artificial sequence
  SiRNA target sequence
aaaaaaatggagcaatgccagt

SEQ ID NO: 88461 - DNA, 22 bp, Artificial sequence
  SiRNA target sequence
aaaaaatggagcaatgccagtt

SEQ ID NO: 88462 - DNA, 22 bp, Artificial sequence
  SiRNA target sequence
aaaaatggagcaatgccagttc

SEQ ID NO: 88463 - DNA, 22 bp, Artificial sequence
  SiRNA target sequence
aaaatggagcaatgccagttcc

SEQ ID NO: 88464 - DNA, 22 bp, Artificial sequence
  SiRNA target sequence
aaatggagcaatgccagttcca

SEQ ID NO: 88465 - DNA, 22 bp, Artificial sequence
  SiRNA target sequence
aatggagcaatgccagttccag

SEQ ID NO: 88466 - DNA, 22 bp, Artificial sequence
  SiRNA target sequence
atggagcaatgccagttccagt

SEQ ID NO: 88467 - DNA, 22 bp, Artificial sequence
  SiRNA target sequence
tggagcaatgccagttccagta

SEQ ID NO: 88468 - DNA, 22 bp, Artificial sequence
  SiRNA target sequence
ggagcaatgccagttccagtac

SEQ ID NO: 88469 - DNA, 22 bp, Artificial sequence
  SiRNA target sequence
gagcaatgccagttccagtaca

SEQ ID NO: 88470 - DNA, 22 bp, Artificial sequence
  SiRNA target sequence
agcaatgccagttccagtacaa

SEQ ID NO: 88471 - DNA, 22 bp, Artificial sequence
  SiRNA target sequence
gcaatgccagttccagtacaaa

SEQ ID NO: 88472 - DNA, 22 bp, Artificial sequence
  SiRNA target sequence
caatgccagttccagtacaaat

SEQ ID NO: 88473 - DNA, 22 bp, Artificial sequence
  SiRNA target sequence
aatgccagttccagtacaaata

SEQ ID NO: 88474 - DNA, 22 bp, Artificial sequence
  SiRNA target sequence
atgccagttccagtacaaatac

SEQ ID NO: 88475 - DNA, 22 bp, Artificial sequence
  SiRNA target sequence
tgccagttccagtacaaatacc

SEQ ID NO: 88476 - DNA, 22 bp, Artificial sequence
  SiRNA target sequence
gccagttccagtacaaataccc

SEQ ID NO: 88477 - DNA, 22 bp, Artificial sequence
  SiRNA target sequence
ccagttccagtacaaataccca

SEQ ID NO: 88478 - DNA, 22 bp, Artificial sequence
  SiRNA target sequence
cagttccagtacaaatacccaa

SEQ ID NO: 88479 - DNA, 22 bp, Artificial sequence
  SiRNA target sequence
agttccagtacaaatacccaac

SEQ ID NO: 88480 - DNA, 22 bp, Artificial sequence
  SiRNA target sequence
gttccagtacaaatacccaaca

SEQ ID NO: 88481 - DNA, 22 bp, Artificial sequence
  SiRNA target sequence
ttccagtacaaatacccaacac

SEQ ID NO: 88482 - DNA, 22 bp, Artificial sequence
  SiRNA target sequence
tccagtacaaatacccaacact

SEQ ID NO: 88483 - DNA, 22 bp, Artificial sequence
  SiRNA target sequence
ccagtacaaatacccaacactt

SEQ ID NO: 88484 - DNA, 22 bp, Artificial sequence
  SiRNA target sequence
cagtacaaatacccaacacttt

SEQ ID NO: 88485 - DNA, 22 bp, Artificial sequence
  SiRNA target sequence
agtacaaatacccaacactttt

SEQ ID NO: 88486 - DNA, 22 bp, Artificial sequence
  SiRNA target sequence
gtacaaatacccaacacttttt

SEQ ID NO: 88487 - DNA, 22 bp, Artificial sequence
  SiRNA target sequence
tacaaatacccaacactttttt

SEQ ID NO: 88488 - DNA, 22 bp, Artificial sequence
  SiRNA target sequence
acaaatacccaacactttttta

SEQ ID NO: 88489 - DNA, 22 bp, Artificial sequence
  SiRNA target sequence
caaatacccaacacttttttac

SEQ ID NO: 88490 - DNA, 22 bp, Artificial sequence
  SiRNA target sequence
aaatacccaacacttttttaca

SEQ ID NO: 88491 - DNA, 22 bp, Artificial sequence
  SiRNA target sequence
aatacccaacacttttttacaa

SEQ ID NO: 88492 - DNA, 22 bp, Artificial sequence
  SiRNA target sequence
atacccaacacttttttacaaa

SEQ ID NO: 88493 - DNA, 22 bp, Artificial sequence
  SiRNA target sequence
tacccaacacttttttacaaaa

SEQ ID NO: 88494 - DNA, 22 bp, Artificial sequence
  SiRNA target sequence
acccaacacttttttacaaaaa

SEQ ID NO: 88495 - DNA, 22 bp, Artificial sequence
  SiRNA target sequence
cccaacacttttttacaaaaat

SEQ ID NO: 88496 - DNA, 22 bp, Artificial sequence
  SiRNA target sequence
ccaacacttttttacaaaaatt

SEQ ID NO: 88497 - DNA, 22 bp, Artificial sequence
  SiRNA target sequence
caacacttttttacaaaaattt

SEQ ID NO: 88498 - DNA, 22 bp, Artificial sequence
  SiRNA target sequence
aacacttttttacaaaaattta

SEQ ID NO: 88499 - DNA, 22 bp, Artificial sequence
  SiRNA target sequence
acacttttttacaaaaatttaa

SEQ ID NO: 88500 - DNA, 22 bp, Artificial sequence
  SiRNA target sequence
cacttttttacaaaaatttaat

SEQ ID NO: 88501 - DNA, 22 bp, Artificial sequence
  SiRNA target sequence
acttttttacaaaaatttaatc

SEQ ID NO: 88502 - DNA, 22 bp, Artificial sequence
  SiRNA target sequence
cttttttacaaaaatttaatct

SEQ ID NO: 88503 - DNA, 22 bp, Artificial sequence
  SiRNA target sequence
ttttttacaaaaatttaatcta

SEQ ID NO: 88504 - DNA, 22 bp, Artificial sequence
  SiRNA target sequence
tttttacaaaaatttaatctaa

SEQ ID NO: 88505 - DNA, 22 bp, Artificial sequence
  SiRNA target sequence
ttttacaaaaatttaatctaaa

SEQ ID NO: 88506 - DNA, 22 bp, Artificial sequence
  SiRNA target sequence
tttacaaaaatttaatctaaat

SEQ ID NO: 88507 - DNA, 22 bp, Artificial sequence
  SiRNA target sequence
ttacaaaaatttaatctaaata

SEQ ID NO: 88508 - DNA, 22 bp, Artificial sequence
  SiRNA target sequence
tacaaaaatttaatctaaataa

SEQ ID NO: 88509 - DNA, 22 bp, Artificial sequence
  SiRNA target sequence
acaaaaatttaatctaaataat

SEQ ID NO: 88510 - DNA, 22 bp, Artificial sequence
  SiRNA target sequence
caaaaatttaatctaaataatt

SEQ ID NO: 88511 - DNA, 22 bp, Artificial sequence
  SiRNA target sequence
aaaaatttaatctaaataattt

SEQ ID NO: 88512 - DNA, 22 bp, Artificial sequence
  SiRNA target sequence
aaaatttaatctaaataattta

SEQ ID NO: 88513 - DNA, 22 bp, Artificial sequence
  SiRNA target sequence
aaatttaatctaaataatttac

SEQ ID NO: 88514 - DNA, 22 bp, Artificial sequence
  SiRNA target sequence
aatttaatctaaataatttact

SEQ ID NO: 88515 - DNA, 22 bp, Artificial sequence
  SiRNA target sequence
atttaatctaaataatttactc

SEQ ID NO: 88516 - DNA, 22 bp, Artificial sequence
  SiRNA target sequence
tttaatctaaataatttactcg

SEQ ID NO: 88517 - DNA, 22 bp, Artificial sequence
  SiRNA target sequence
ttaatctaaataatttactcgg

SEQ ID NO: 88518 - DNA, 22 bp, Artificial sequence
  SiRNA target sequence
taatctaaataatttactcggt

SEQ ID NO: 88519 - DNA, 22 bp, Artificial sequence
  SiRNA target sequence
aatctaaataatttactcggtc

SEQ ID NO: 88520 - DNA, 22 bp, Artificial sequence
  SiRNA target sequence
atctaaataatttactcggtct

SEQ ID NO: 88521 - DNA, 22 bp, Artificial sequence
  SiRNA target sequence
tctaaataatttactcggtctg

SEQ ID NO: 88522 - DNA, 22 bp, Artificial sequence
  SiRNA target sequence
ctaaataatttactcggtctgt

SEQ ID NO: 88523 - DNA, 22 bp, Artificial sequence
  SiRNA target sequence
taaataatttactcggtctgtg

SEQ ID NO: 88524 - DNA, 22 bp, Artificial sequence
  SiRNA target sequence
aaataatttactcggtctgtga

SEQ ID NO: 88525 - DNA, 22 bp, Artificial sequence
  SiRNA target sequence
aataatttactcggtctgtgac

SEQ ID NO: 88526 - DNA, 22 bp, Artificial sequence
  SiRNA target sequence
ataatttactcggtctgtgaca

SEQ ID NO: 88527 - DNA, 22 bp, Artificial sequence
  SiRNA target sequence
taatttactcggtctgtgacag

SEQ ID NO: 88528 - DNA, 22 bp, Artificial sequence
  SiRNA target sequence
aatttactcggtctgtgacaga

SEQ ID NO: 88529 - DNA, 22 bp, Artificial sequence
  SiRNA target sequence
atttactcggtctgtgacagat

SEQ ID NO: 88530 - DNA, 22 bp, Artificial sequence
  SiRNA target sequence
tttactcggtctgtgacagatc

SEQ ID NO: 88531 - DNA, 22 bp, Artificial sequence
  SiRNA target sequence
ttactcggtctgtgacagatct

SEQ ID NO: 88532 - DNA, 22 bp, Artificial sequence
  SiRNA target sequence
tactcggtctgtgacagatctt

SEQ ID NO: 88533 - DNA, 22 bp, Artificial sequence
  SiRNA target sequence
actcggtctgtgacagatcttt

SEQ ID NO: 88534 - DNA, 22 bp, Artificial sequence
  SiRNA target sequence
ctcggtctgtgacagatcttta

SEQ ID NO: 88535 - DNA, 22 bp, Artificial sequence
  SiRNA target sequence
tcggtctgtgacagatctttaa

SEQ ID NO: 88536 - DNA, 22 bp, Artificial sequence
  SiRNA target sequence
cggtctgtgacagatctttaaa

SEQ ID NO: 88537 - DNA, 22 bp, Artificial sequence
  SiRNA target sequence
ggtctgtgacagatctttaaat

SEQ ID NO: 88538 - DNA, 22 bp, Artificial sequence
  SiRNA target sequence
gtctgtgacagatctttaaatt

SEQ ID NO: 88539 - DNA, 22 bp, Artificial sequence
  SiRNA target sequence
tctgtgacagatctttaaatta

SEQ ID NO: 88540 - DNA, 22 bp, Artificial sequence
  SiRNA target sequence
ctgtgacagatctttaaattat

SEQ ID NO: 88541 - DNA, 22 bp, Artificial sequence
  SiRNA target sequence
tgtgacagatctttaaattatt

SEQ ID NO: 88542 - DNA, 22 bp, Artificial sequence
  SiRNA target sequence
gtgacagatctttaaattatta

SEQ ID NO: 88543 - DNA, 22 bp, Artificial sequence
  SiRNA target sequence
tgacagatctttaaattattat

SEQ ID NO: 88544 - DNA, 22 bp, Artificial sequence
  SiRNA target sequence
gacagatctttaaattattata

SEQ ID NO: 88545 - DNA, 22 bp, Artificial sequence
  SiRNA target sequence
acagatctttaaattattataa

SEQ ID NO: 88546 - DNA, 22 bp, Artificial sequence
  SiRNA target sequence
cagatctttaaattattataat

SEQ ID NO: 88547 - DNA, 22 bp, Artificial sequence
  SiRNA target sequence
agatctttaaattattataatt

SEQ ID NO: 88548 - DNA, 22 bp, Artificial sequence
  SiRNA target sequence
gatctttaaattattataattt

SEQ ID NO: 88549 - DNA, 22 bp, Artificial sequence
  SiRNA target sequence
atctttaaattattataatttt

SEQ ID NO: 88550 - DNA, 22 bp, Artificial sequence
  SiRNA target sequence
tctttaaattattataattttg

SEQ ID NO: 88551 - DNA, 22 bp, Artificial sequence
  SiRNA target sequence
ctttaaattattataattttgc

SEQ ID NO: 88552 - DNA, 22 bp, Artificial sequence
  SiRNA target sequence
tttaaattattataattttgca

SEQ ID NO: 88553 - DNA, 22 bp, Artificial sequence
  SiRNA target sequence
ttaaattattataattttgcat

SEQ ID NO: 88554 - DNA, 22 bp, Artificial sequence
  SiRNA target sequence
taaattattataattttgcata

SEQ ID NO: 88555 - DNA, 22 bp, Artificial sequence
  SiRNA target sequence
aaattattataattttgcatat

SEQ ID NO: 88556 - DNA, 22 bp, Artificial sequence
  SiRNA target sequence
aattattataattttgcatatc

SEQ ID NO: 88557 - DNA, 22 bp, Artificial sequence
  SiRNA target sequence
attattataattttgcatatct

SEQ ID NO: 88558 - DNA, 22 bp, Artificial sequence
  SiRNA target sequence
ttattataattttgcatatcta

SEQ ID NO: 88559 - DNA, 22 bp, Artificial sequence
  SiRNA target sequence
tattataattttgcatatctat

SEQ ID NO: 88560 - DNA, 22 bp, Artificial sequence
  SiRNA target sequence
attataattttgcatatctatg

SEQ ID NO: 88561 - DNA, 22 bp, Artificial sequence
  SiRNA target sequence
ttataattttgcatatctatga

SEQ ID NO: 88562 - DNA, 22 bp, Artificial sequence
  SiRNA target sequence
tataattttgcatatctatgaa

SEQ ID NO: 88563 - DNA, 22 bp, Artificial sequence
  SiRNA target sequence
ataattttgcatatctatgaaa

SEQ ID NO: 88564 - DNA, 22 bp, Artificial sequence
  SiRNA target sequence
taattttgcatatctatgaaat

SEQ ID NO: 88565 - DNA, 22 bp, Artificial sequence
  SiRNA target sequence
aattttgcatatctatgaaatt

SEQ ID NO: 88566 - DNA, 22 bp, Artificial sequence
  SiRNA target sequence
attttgcatatctatgaaattg

SEQ ID NO: 88567 - DNA, 22 bp, Artificial sequence
  SiRNA target sequence
ttttgcatatctatgaaattgg

SEQ ID NO: 88568 - DNA, 22 bp, Artificial sequence
  SiRNA target sequence
tttgcatatctatgaaattgga

SEQ ID NO: 88569 - DNA, 22 bp, Artificial sequence
  SiRNA target sequence
ttgcatatctatgaaattggaa

SEQ ID NO: 88570 - DNA, 22 bp, Artificial sequence
  SiRNA target sequence
tgcatatctatgaaattggaaa

SEQ ID NO: 88571 - DNA, 22 bp, Artificial sequence
  SiRNA target sequence
gcatatctatgaaattggaaac

SEQ ID NO: 88572 - DNA, 22 bp, Artificial sequence
  SiRNA target sequence
catatctatgaaattggaaaca

SEQ ID NO: 88573 - DNA, 22 bp, Artificial sequence
  SiRNA target sequence
atatctatgaaattggaaacat

SEQ ID NO: 88574 - DNA, 22 bp, Artificial sequence
  SiRNA target sequence
tatctatgaaattggaaacatg

SEQ ID NO: 88575 - DNA, 22 bp, Artificial sequence
  SiRNA target sequence
atctatgaaattggaaacatgt

SEQ ID NO: 88576 - DNA, 22 bp, Artificial sequence
  SiRNA target sequence
tctatgaaattggaaacatgtc

SEQ ID NO: 88577 - DNA, 22 bp, Artificial sequence
  SiRNA target sequence
ctatgaaattggaaacatgtcc

SEQ ID NO: 88578 - DNA, 22 bp, Artificial sequence
  SiRNA target sequence
tatgaaattggaaacatgtcca

SEQ ID NO: 88579 - DNA, 22 bp, Artificial sequence
  SiRNA target sequence
atgaaattggaaacatgtccat

SEQ ID NO: 88580 - DNA, 22 bp, Artificial sequence
  SiRNA target sequence
tgaaattggaaacatgtccata

SEQ ID NO: 88581 - DNA, 22 bp, Artificial sequence
  SiRNA target sequence
gaaattggaaacatgtccatat

SEQ ID NO: 88582 - DNA, 22 bp, Artificial sequence
  SiRNA target sequence
aaattggaaacatgtccatatc

SEQ ID NO: 88583 - DNA, 22 bp, Artificial sequence
  SiRNA target sequence
aattggaaacatgtccatatct

SEQ ID NO: 88584 - DNA, 22 bp, Artificial sequence
  SiRNA target sequence
attggaaacatgtccatatcta

SEQ ID NO: 88585 - DNA, 22 bp, Artificial sequence
  SiRNA target sequence
ttggaaacatgtccatatctat

SEQ ID NO: 88586 - DNA, 22 bp, Artificial sequence
  SiRNA target sequence
tggaaacatgtccatatctatc

SEQ ID NO: 88587 - DNA, 22 bp, Artificial sequence
  SiRNA target sequence
ggaaacatgtccatatctatcg

SEQ ID NO: 88588 - DNA, 22 bp, Artificial sequence
  SiRNA target sequence
gaaacatgtccatatctatcgc

SEQ ID NO: 88589 - DNA, 22 bp, Artificial sequence
  SiRNA target sequence
aaacatgtccatatctatcgcc

SEQ ID NO: 88590 - DNA, 22 bp, Artificial sequence
  SiRNA target sequence
aacatgtccatatctatcgcct

SEQ ID NO: 88591 - DNA, 22 bp, Artificial sequence
  SiRNA target sequence
acatgtccatatctatcgcctt

SEQ ID NO: 88592 - DNA, 22 bp, Artificial sequence
  SiRNA target sequence
catgtccatatctatcgccttt

SEQ ID NO: 88593 - DNA, 22 bp, Artificial sequence
  SiRNA target sequence
atgtccatatctatcgcctttt

SEQ ID NO: 88594 - DNA, 22 bp, Artificial sequence
  SiRNA target sequence
tgtccatatctatcgccttttt

SEQ ID NO: 88595 - DNA, 22 bp, Artificial sequence
  SiRNA target sequence
gtccatatctatcgcctttttt

SEQ ID NO: 88596 - DNA, 22 bp, Artificial sequence
  SiRNA target sequence
tccatatctatcgcctttttta

SEQ ID NO: 88597 - DNA, 22 bp, Artificial sequence
  SiRNA target sequence
ccatatctatcgccttttttaa

SEQ ID NO: 88598 - DNA, 22 bp, Artificial sequence
  SiRNA target sequence
catatctatcgccttttttaat

SEQ ID NO: 88599 - DNA, 22 bp, Artificial sequence
  SiRNA target sequence
atatctatcgccttttttaata

SEQ ID NO: 88600 - DNA, 22 bp, Artificial sequence
  SiRNA target sequence
tatctatcgccttttttaataa

SEQ ID NO: 88601 - DNA, 22 bp, Artificial sequence
  SiRNA target sequence
atctatcgccttttttaataat

SEQ ID NO: 88602 - DNA, 22 bp, Artificial sequence
  SiRNA target sequence
tctatcgccttttttaataatt

SEQ ID NO: 88603 - DNA, 22 bp, Artificial sequence
  SiRNA target sequence
ctatcgccttttttaataattg

SEQ ID NO: 88604 - DNA, 22 bp, Artificial sequence
  SiRNA target sequence
tatcgccttttttaataattgc

SEQ ID NO: 88605 - DNA, 22 bp, Artificial sequence
  SiRNA target sequence
atcgccttttttaataattgct

SEQ ID NO: 88606 - DNA, 22 bp, Artificial sequence
  SiRNA target sequence
tcgccttttttaataattgcta

SEQ ID NO: 88607 - DNA, 22 bp, Artificial sequence
  SiRNA target sequence
cgccttttttaataattgctac

SEQ ID NO: 88608 - DNA, 22 bp, Artificial sequence
  SiRNA target sequence
gccttttttaataattgctact

SEQ ID NO: 88609 - DNA, 22 bp, Artificial sequence
  SiRNA target sequence
ccttttttaataattgctacta

SEQ ID NO: 88610 - DNA, 22 bp, Artificial sequence
  SiRNA target sequence
cttttttaataattgctactaa

SEQ ID NO: 88611 - DNA, 22 bp, Artificial sequence
  SiRNA target sequence
ttttttaataattgctactaaa

SEQ ID NO: 88612 - DNA, 22 bp, Artificial sequence
  SiRNA target sequence
tttttaataattgctactaaaa

SEQ ID NO: 88613 - DNA, 22 bp, Artificial sequence
  SiRNA target sequence
ttttaataattgctactaaaat

SEQ ID NO: 88614 - DNA, 22 bp, Artificial sequence
  SiRNA target sequence
tttaataattgctactaaaatt

SEQ ID NO: 88615 - DNA, 22 bp, Artificial sequence
  SiRNA target sequence
ttaataattgctactaaaattt

SEQ ID NO: 88616 - DNA, 22 bp, Artificial sequence
  SiRNA target sequence
taataattgctactaaaatttc

SEQ ID NO: 88617 - DNA, 22 bp, Artificial sequence
  SiRNA target sequence
aataattgctactaaaatttca

SEQ ID NO: 88618 - DNA, 22 bp, Artificial sequence
  SiRNA target sequence
ataattgctactaaaatttcac

SEQ ID NO: 88619 - DNA, 22 bp, Artificial sequence
  SiRNA target sequence
taattgctactaaaatttcaca

SEQ ID NO: 88620 - DNA, 22 bp, Artificial sequence
  SiRNA target sequence
aattgctactaaaatttcacat

SEQ ID NO: 88621 - DNA, 22 bp, Artificial sequence
  SiRNA target sequence
attgctactaaaatttcacatt

SEQ ID NO: 88622 - DNA, 22 bp, Artificial sequence
  SiRNA target sequence
ttgctactaaaatttcacattt

SEQ ID NO: 88623 - DNA, 22 bp, Artificial sequence
  SiRNA target sequence
tgctactaaaatttcacatttt

SEQ ID NO: 88624 - DNA, 22 bp, Artificial sequence
  SiRNA target sequence
gctactaaaatttcacattttt

SEQ ID NO: 88625 - DNA, 22 bp, Artificial sequence
  SiRNA target sequence
ctactaaaatttcacatttttc

SEQ ID NO: 88626 - DNA, 22 bp, Artificial sequence
  SiRNA target sequence
tactaaaatttcacatttttca

SEQ ID NO: 88627 - DNA, 22 bp, Artificial sequence
  SiRNA target sequence
actaaaatttcacatttttcat

SEQ ID NO: 88628 - DNA, 22 bp, Artificial sequence
  SiRNA target sequence
ctaaaatttcacatttttcatt

SEQ ID NO: 88629 - DNA, 22 bp, Artificial sequence
  SiRNA target sequence
taaaatttcacatttttcattt

SEQ ID NO: 88630 - DNA, 22 bp, Artificial sequence
  SiRNA target sequence
aaaatttcacatttttcattta

SEQ ID NO: 88631 - DNA, 22 bp, Artificial sequence
  SiRNA target sequence
aaatttcacatttttcatttac

SEQ ID NO: 88632 - DNA, 22 bp, Artificial sequence
  SiRNA target sequence
aatttcacatttttcatttacg

SEQ ID NO: 88633 - DNA, 22 bp, Artificial sequence
  SiRNA target sequence
atttcacatttttcatttacgt

SEQ ID NO: 88634 - DNA, 22 bp, Artificial sequence
  SiRNA target sequence
tttcacatttttcatttacgtg

SEQ ID NO: 88635 - DNA, 22 bp, Artificial sequence
  SiRNA target sequence
ttcacatttttcatttacgtgg

SEQ ID NO: 88636 - DNA, 22 bp, Artificial sequence
  SiRNA target sequence
tcacatttttcatttacgtggt

SEQ ID NO: 88637 - DNA, 22 bp, Artificial sequence
  SiRNA target sequence
cacatttttcatttacgtggtt

SEQ ID NO: 88638 - DNA, 22 bp, Artificial sequence
  SiRNA target sequence
acatttttcatttacgtggtta

SEQ ID NO: 88639 - DNA, 22 bp, Artificial sequence
  SiRNA target sequence
catttttcatttacgtggttag

SEQ ID NO: 88640 - DNA, 22 bp, Artificial sequence
  SiRNA target sequence
atttttcatttacgtggttagt

SEQ ID NO: 88641 - DNA, 22 bp, Artificial sequence
  SiRNA target sequence
tttttcatttacgtggttagta

SEQ ID NO: 88642 - DNA, 22 bp, Artificial sequence
  SiRNA target sequence
ttttcatttacgtggttagtaa

SEQ ID NO: 88643 - DNA, 22 bp, Artificial sequence
  SiRNA target sequence
tttcatttacgtggttagtaag

SEQ ID NO: 88644 - DNA, 22 bp, Artificial sequence
  SiRNA target sequence
ttcatttacgtggttagtaagt

SEQ ID NO: 88645 - DNA, 22 bp, Artificial sequence
  SiRNA target sequence
tcatttacgtggttagtaagtg

SEQ ID NO: 88646 - DNA, 22 bp, Artificial sequence
  SiRNA target sequence
catttacgtggttagtaagtga

SEQ ID NO: 88647 - DNA, 22 bp, Artificial sequence
  SiRNA target sequence
atttacgtggttagtaagtgaa

SEQ ID NO: 88648 - DNA, 22 bp, Artificial sequence
  SiRNA target sequence
tttacgtggttagtaagtgaat

SEQ ID NO: 88649 - DNA, 22 bp, Artificial sequence
  SiRNA target sequence
ttacgtggttagtaagtgaata

SEQ ID NO: 88650 - DNA, 22 bp, Artificial sequence
  SiRNA target sequence
tacgtggttagtaagtgaataa

SEQ ID NO: 88651 - DNA, 22 bp, Artificial sequence
  SiRNA target sequence
acgtggttagtaagtgaataat

SEQ ID NO: 88652 - DNA, 22 bp, Artificial sequence
  SiRNA target sequence
cgtggttagtaagtgaataata

SEQ ID NO: 88653 - DNA, 22 bp, Artificial sequence
  SiRNA target sequence
gtggttagtaagtgaataatat

SEQ ID NO: 88654 - DNA, 22 bp, Artificial sequence
  SiRNA target sequence
tggttagtaagtgaataatatc

SEQ ID NO: 88655 - DNA, 22 bp, Artificial sequence
  SiRNA target sequence
ggttagtaagtgaataatatct

SEQ ID NO: 88656 - DNA, 22 bp, Artificial sequence
  SiRNA target sequence
gttagtaagtgaataatatctt

SEQ ID NO: 88657 - DNA, 22 bp, Artificial sequence
  SiRNA target sequence
ttagtaagtgaataatatcttg

SEQ ID NO: 88658 - DNA, 22 bp, Artificial sequence
  SiRNA target sequence
tagtaagtgaataatatcttgg

SEQ ID NO: 88659 - DNA, 22 bp, Artificial sequence
  SiRNA target sequence
agtaagtgaataatatcttggc

SEQ ID NO: 88660 - DNA, 22 bp, Artificial sequence
  SiRNA target sequence
gtaagtgaataatatcttggct

SEQ ID NO: 88661 - DNA, 22 bp, Artificial sequence
  SiRNA target sequence
taagtgaataatatcttggctt

SEQ ID NO: 88662 - DNA, 22 bp, Artificial sequence
  SiRNA target sequence
aagtgaataatatcttggctta

SEQ ID NO: 88663 - DNA, 22 bp, Artificial sequence
  SiRNA target sequence
agtgaataatatcttggcttaa

SEQ ID NO: 88664 - DNA, 22 bp, Artificial sequence
  SiRNA target sequence
gtgaataatatcttggcttaat

SEQ ID NO: 88665 - DNA, 22 bp, Artificial sequence
  SiRNA target sequence
tgaataatatcttggcttaatt

SEQ ID NO: 88666 - DNA, 22 bp, Artificial sequence
  SiRNA target sequence
gaataatatcttggcttaattg

SEQ ID NO: 88667 - DNA, 22 bp, Artificial sequence
  SiRNA target sequence
aataatatcttggcttaattgt

SEQ ID NO: 88668 - DNA, 22 bp, Artificial sequence
  SiRNA target sequence
ataatatcttggcttaattgtt

SEQ ID NO: 88669 - DNA, 22 bp, Artificial sequence
  SiRNA target sequence
taatatcttggcttaattgttt

SEQ ID NO: 88670 - DNA, 22 bp, Artificial sequence
  SiRNA target sequence
aatatcttggcttaattgtttg

SEQ ID NO: 88671 - DNA, 22 bp, Artificial sequence
  SiRNA target sequence
atatcttggcttaattgtttga

SEQ ID NO: 88672 - DNA, 22 bp, Artificial sequence
  SiRNA target sequence
tatcttggcttaattgtttgac

SEQ ID NO: 88673 - DNA, 22 bp, Artificial sequence
  SiRNA target sequence
atcttggcttaattgtttgaca

SEQ ID NO: 88674 - DNA, 22 bp, Artificial sequence
  SiRNA target sequence
tcttggcttaattgtttgacaa

SEQ ID NO: 88675 - DNA, 22 bp, Artificial sequence
  SiRNA target sequence
cttggcttaattgtttgacaat

SEQ ID NO: 88676 - DNA, 22 bp, Artificial sequence
  SiRNA target sequence
ttggcttaattgtttgacaatt

SEQ ID NO: 88677 - DNA, 22 bp, Artificial sequence
  SiRNA target sequence
tggcttaattgtttgacaattc

SEQ ID NO: 88678 - DNA, 22 bp, Artificial sequence
  SiRNA target sequence
ggcttaattgtttgacaattca

SEQ ID NO: 88679 - DNA, 22 bp, Artificial sequence
  SiRNA target sequence
gcttaattgtttgacaattcat

SEQ ID NO: 88680 - DNA, 22 bp, Artificial sequence
  SiRNA target sequence
cttaattgtttgacaattcata

SEQ ID NO: 88681 - DNA, 22 bp, Artificial sequence
  SiRNA target sequence
ttaattgtttgacaattcataa

SEQ ID NO: 88682 - DNA, 22 bp, Artificial sequence
  SiRNA target sequence
taattgtttgacaattcataat

SEQ ID NO: 88683 - DNA, 22 bp, Artificial sequence
  SiRNA target sequence
aattgtttgacaattcataata

SEQ ID NO: 88684 - DNA, 22 bp, Artificial sequence
  SiRNA target sequence
attgtttgacaattcataataa

SEQ ID NO: 88685 - DNA, 22 bp, Artificial sequence
  SiRNA target sequence
ttgtttgacaattcataataag

SEQ ID NO: 88686 - DNA, 22 bp, Artificial sequence
  SiRNA target sequence
tgtttgacaattcataataaga

SEQ ID NO: 88687 - DNA, 22 bp, Artificial sequence
  SiRNA target sequence
gtttgacaattcataataagat

SEQ ID NO: 88688 - DNA, 22 bp, Artificial sequence
  SiRNA target sequence
tttgacaattcataataagatc

SEQ ID NO: 88689 - DNA, 22 bp, Artificial sequence
  SiRNA target sequence
ttgacaattcataataagatcc

SEQ ID NO: 88690 - DNA, 22 bp, Artificial sequence
  SiRNA target sequence
tgacaattcataataagatcct

SEQ ID NO: 88691 - DNA, 22 bp, Artificial sequence
  SiRNA target sequence
gacaattcataataagatcctc

SEQ ID NO: 88692 - DNA, 22 bp, Artificial sequence
  SiRNA target sequence
acaattcataataagatcctct

SEQ ID NO: 88693 - DNA, 22 bp, Artificial sequence
  SiRNA target sequence
caattcataataagatcctcta

SEQ ID NO: 88694 - DNA, 22 bp, Artificial sequence
  SiRNA target sequence
aattcataataagatcctctaa

SEQ ID NO: 88695 - DNA, 22 bp, Artificial sequence
  SiRNA target sequence
attcataataagatcctctaaa

SEQ ID NO: 88696 - DNA, 22 bp, Artificial sequence
  SiRNA target sequence
ttcataataagatcctctaaac

SEQ ID NO: 88697 - DNA, 22 bp, Artificial sequence
  SiRNA target sequence
tcataataagatcctctaaact

SEQ ID NO: 88698 - DNA, 22 bp, Artificial sequence
  SiRNA target sequence
cataataagatcctctaaactt

SEQ ID NO: 88699 - DNA, 22 bp, Artificial sequence
  SiRNA target sequence
ataataagatcctctaaacttg

SEQ ID NO: 88700 - DNA, 22 bp, Artificial sequence
  SiRNA target sequence
taataagatcctctaaacttgg

SEQ ID NO: 88701 - DNA, 22 bp, Artificial sequence
  SiRNA target sequence
aataagatcctctaaacttggt

SEQ ID NO: 88702 - DNA, 22 bp, Artificial sequence
  SiRNA target sequence
ataagatcctctaaacttggtt

SEQ ID NO: 88703 - DNA, 22 bp, Artificial sequence
  SiRNA target sequence
taagatcctctaaacttggttt

SEQ ID NO: 88704 - DNA, 22 bp, Artificial sequence
  SiRNA target sequence
aagatcctctaaacttggttta

SEQ ID NO: 88705 - DNA, 22 bp, Artificial sequence
  SiRNA target sequence
agatcctctaaacttggtttac

SEQ ID NO: 88706 - DNA, 22 bp, Artificial sequence
  SiRNA target sequence
gatcctctaaacttggtttaca

SEQ ID NO: 88707 - DNA, 22 bp, Artificial sequence
  SiRNA target sequence
atcctctaaacttggtttacat

SEQ ID NO: 88708 - DNA, 22 bp, Artificial sequence
  SiRNA target sequence
tcctctaaacttggtttacatt

SEQ ID NO: 88709 - DNA, 22 bp, Artificial sequence
  SiRNA target sequence
cctctaaacttggtttacattg

SEQ ID NO: 88710 - DNA, 22 bp, Artificial sequence
  SiRNA target sequence
ctctaaacttggtttacattga

SEQ ID NO: 88711 - DNA, 22 bp, Artificial sequence
  SiRNA target sequence
tctaaacttggtttacattgaa

SEQ ID NO: 88712 - DNA, 22 bp, Artificial sequence
  SiRNA target sequence
ctaaacttggtttacattgaaa

SEQ ID NO: 88713 - DNA, 22 bp, Artificial sequence
  SiRNA target sequence
taaacttggtttacattgaaat

SEQ ID NO: 88714 - DNA, 22 bp, Artificial sequence
  SiRNA target sequence
aaacttggtttacattgaaatg

SEQ ID NO: 88715 - DNA, 22 bp, Artificial sequence
  SiRNA target sequence
aacttggtttacattgaaatgt

SEQ ID NO: 88716 - DNA, 22 bp, Artificial sequence
  SiRNA target sequence
acttggtttacattgaaatgta

SEQ ID NO: 88717 - DNA, 22 bp, Artificial sequence
  SiRNA target sequence
cttggtttacattgaaatgtat

SEQ ID NO: 88718 - DNA, 22 bp, Artificial sequence
  SiRNA target sequence
ttggtttacattgaaatgtata

SEQ ID NO: 88719 - DNA, 22 bp, Artificial sequence
  SiRNA target sequence
tggtttacattgaaatgtatat

SEQ ID NO: 88720 - DNA, 22 bp, Artificial sequence
  SiRNA target sequence
ggtttacattgaaatgtatata

SEQ ID NO: 88721 - DNA, 22 bp, Artificial sequence
  SiRNA target sequence
gtttacattgaaatgtatatat

SEQ ID NO: 88722 - DNA, 22 bp, Artificial sequence
  SiRNA target sequence
tttacattgaaatgtatatata

SEQ ID NO: 88723 - DNA, 22 bp, Artificial sequence
  SiRNA target sequence
ttacattgaaatgtatatataa

SEQ ID NO: 88724 - DNA, 22 bp, Artificial sequence
  SiRNA target sequence
tacattgaaatgtatatataat

SEQ ID NO: 88725 - DNA, 22 bp, Artificial sequence
  SiRNA target sequence
acattgaaatgtatatataatg

SEQ ID NO: 88726 - DNA, 22 bp, Artificial sequence
  SiRNA target sequence
cattgaaatgtatatataatgt

SEQ ID NO: 88727 - DNA, 22 bp, Artificial sequence
  SiRNA target sequence
attgaaatgtatatataatgtc

SEQ ID NO: 88728 - DNA, 22 bp, Artificial sequence
  SiRNA target sequence
ttgaaatgtatatataatgtca

SEQ ID NO: 88729 - DNA, 22 bp, Artificial sequence
  SiRNA target sequence
tgaaatgtatatataatgtcaa

SEQ ID NO: 88730 - DNA, 22 bp, Artificial sequence
  SiRNA target sequence
gaaatgtatatataatgtcaag

SEQ ID NO: 88731 - DNA, 22 bp, Artificial sequence
  SiRNA target sequence
aaatgtatatataatgtcaagc

SEQ ID NO: 88732 - DNA, 22 bp, Artificial sequence
  SiRNA target sequence
aatgtatatataatgtcaagca

SEQ ID NO: 88733 - DNA, 22 bp, Artificial sequence
  SiRNA target sequence
atgtatatataatgtcaagcac

SEQ ID NO: 88734 - DNA, 22 bp, Artificial sequence
  SiRNA target sequence
tgtatatataatgtcaagcaca

SEQ ID NO: 88735 - DNA, 22 bp, Artificial sequence
  SiRNA target sequence
gtatatataatgtcaagcacat

SEQ ID NO: 88736 - DNA, 22 bp, Artificial sequence
  SiRNA target sequence
tatatataatgtcaagcacatt

SEQ ID NO: 88737 - DNA, 22 bp, Artificial sequence
  SiRNA target sequence
atatataatgtcaagcacatta

SEQ ID NO: 88738 - DNA, 22 bp, Artificial sequence
  SiRNA target sequence
tatataatgtcaagcacattat

SEQ ID NO: 88739 - DNA, 22 bp, Artificial sequence
  SiRNA target sequence
atataatgtcaagcacattatt

SEQ ID NO: 88740 - DNA, 22 bp, Artificial sequence
  SiRNA target sequence
tataatgtcaagcacattattc

SEQ ID NO: 88741 - DNA, 22 bp, Artificial sequence
  SiRNA target sequence
ataatgtcaagcacattattcc

SEQ ID NO: 88742 - DNA, 22 bp, Artificial sequence
  SiRNA target sequence
taatgtcaagcacattattcca

SEQ ID NO: 88743 - DNA, 22 bp, Artificial sequence
  SiRNA target sequence
aatgtcaagcacattattccag

SEQ ID NO: 88744 - DNA, 22 bp, Artificial sequence
  SiRNA target sequence
atgtcaagcacattattccagt

SEQ ID NO: 88745 - DNA, 22 bp, Artificial sequence
  SiRNA target sequence
tgtcaagcacattattccagtt

SEQ ID NO: 88746 - DNA, 22 bp, Artificial sequence
  SiRNA target sequence
gtcaagcacattattccagttc

SEQ ID NO: 88747 - DNA, 22 bp, Artificial sequence
  SiRNA target sequence
tcaagcacattattccagttct

SEQ ID NO: 88748 - DNA, 22 bp, Artificial sequence
  SiRNA target sequence
caagcacattattccagttctt

SEQ ID NO: 88749 - DNA, 22 bp, Artificial sequence
  SiRNA target sequence
aagcacattattccagttctta

SEQ ID NO: 88750 - DNA, 22 bp, Artificial sequence
  SiRNA target sequence
agcacattattccagttcttaa

SEQ ID NO: 88751 - DNA, 22 bp, Artificial sequence
  SiRNA target sequence
gcacattattccagttcttaat

SEQ ID NO: 88752 - DNA, 22 bp, Artificial sequence
  SiRNA target sequence
cacattattccagttcttaatg

SEQ ID NO: 88753 - DNA, 22 bp, Artificial sequence
  SiRNA target sequence
acattattccagttcttaatga

SEQ ID NO: 88754 - DNA, 22 bp, Artificial sequence
  SiRNA target sequence
cattattccagttcttaatgat

SEQ ID NO: 88755 - DNA, 22 bp, Artificial sequence
  SiRNA target sequence
attattccagttcttaatgatg

SEQ ID NO: 88756 - DNA, 22 bp, Artificial sequence
  SiRNA target sequence
ttattccagttcttaatgatgc

SEQ ID NO: 88757 - DNA, 22 bp, Artificial sequence
  SiRNA target sequence
tattccagttcttaatgatgct

SEQ ID NO: 88758 - DNA, 22 bp, Artificial sequence
  SiRNA target sequence
attccagttcttaatgatgctt

SEQ ID NO: 88759 - DNA, 22 bp, Artificial sequence
  SiRNA target sequence
ttccagttcttaatgatgctta

SEQ ID NO: 88760 - DNA, 22 bp, Artificial sequence
  SiRNA target sequence
tccagttcttaatgatgcttaa

SEQ ID NO: 88761 - DNA, 22 bp, Artificial sequence
  SiRNA target sequence
ccagttcttaatgatgcttaaa

SEQ ID NO: 88762 - DNA, 22 bp, Artificial sequence
  SiRNA target sequence
cagttcttaatgatgcttaaat

SEQ ID NO: 88763 - DNA, 22 bp, Artificial sequence
  SiRNA target sequence
agttcttaatgatgcttaaata

SEQ ID NO: 88764 - DNA, 22 bp, Artificial sequence
  SiRNA target sequence
gttcttaatgatgcttaaataa

SEQ ID NO: 88765 - DNA, 22 bp, Artificial sequence
  SiRNA target sequence
ttcttaatgatgcttaaataat

SEQ ID NO: 88766 - DNA, 22 bp, Artificial sequence
  SiRNA target sequence
tcttaatgatgcttaaataatc

SEQ ID NO: 88767 - DNA, 22 bp, Artificial sequence
  SiRNA target sequence
cttaatgatgcttaaataatct

SEQ ID NO: 88768 - DNA, 22 bp, Artificial sequence
  SiRNA target sequence
ttaatgatgcttaaataatctt

SEQ ID NO: 88769 - DNA, 22 bp, Artificial sequence
  SiRNA target sequence
taatgatgcttaaataatcttt

SEQ ID NO: 88770 - DNA, 22 bp, Artificial sequence
  SiRNA target sequence
aatgatgcttaaataatctttt

SEQ ID NO: 88771 - DNA, 22 bp, Artificial sequence
  SiRNA target sequence
atgatgcttaaataatctttta

SEQ ID NO: 88772 - DNA, 22 bp, Artificial sequence
  SiRNA target sequence
tgatgcttaaataatcttttac

SEQ ID NO: 88773 - DNA, 22 bp, Artificial sequence
  SiRNA target sequence
gatgcttaaataatcttttact

SEQ ID NO: 88774 - DNA, 22 bp, Artificial sequence
  SiRNA target sequence
atgcttaaataatcttttactc

SEQ ID NO: 88775 - DNA, 22 bp, Artificial sequence
  SiRNA target sequence
tgcttaaataatcttttactcc

SEQ ID NO: 88776 - DNA, 22 bp, Artificial sequence
  SiRNA target sequence
gcttaaataatcttttactcct

SEQ ID NO: 88777 - DNA, 22 bp, Artificial sequence
  SiRNA target sequence
cttaaataatcttttactcctt

SEQ ID NO: 88778 - DNA, 22 bp, Artificial sequence
  SiRNA target sequence
ttaaataatcttttactccttc

SEQ ID NO: 88779 - DNA, 22 bp, Artificial sequence
  SiRNA target sequence
taaataatcttttactccttct

SEQ ID NO: 88780 - DNA, 22 bp, Artificial sequence
  SiRNA target sequence
aaataatcttttactccttctt

SEQ ID NO: 88781 - DNA, 22 bp, Artificial sequence
  SiRNA target sequence
aataatcttttactccttcttt

SEQ ID NO: 88782 - DNA, 22 bp, Artificial sequence
  SiRNA target sequence
ataatcttttactccttcttta

SEQ ID NO: 88783 - DNA, 22 bp, Artificial sequence
  SiRNA target sequence
taatcttttactccttctttag

SEQ ID NO: 88784 - DNA, 22 bp, Artificial sequence
  SiRNA target sequence
aatcttttactccttctttaga

SEQ ID NO: 88785 - DNA, 22 bp, Artificial sequence
  SiRNA target sequence
atcttttactccttctttagaa

SEQ ID NO: 88786 - DNA, 22 bp, Artificial sequence
  SiRNA target sequence
tcttttactccttctttagaac

SEQ ID NO: 88787 - DNA, 22 bp, Artificial sequence
  SiRNA target sequence
cttttactccttctttagaaca

SEQ ID NO: 88788 - DNA, 22 bp, Artificial sequence
  SiRNA target sequence
ttttactccttctttagaacac

SEQ ID NO: 88789 - DNA, 22 bp, Artificial sequence
  SiRNA target sequence
tttactccttctttagaacaca

SEQ ID NO: 88790 - DNA, 22 bp, Artificial sequence
  SiRNA target sequence
ttactccttctttagaacacag

SEQ ID NO: 88791 - DNA, 22 bp, Artificial sequence
  SiRNA target sequence
tactccttctttagaacacaga

SEQ ID NO: 88792 - DNA, 22 bp, Artificial sequence
  SiRNA target sequence
actccttctttagaacacagat

SEQ ID NO: 88793 - DNA, 22 bp, Artificial sequence
  SiRNA target sequence
ctccttctttagaacacagata

SEQ ID NO: 88794 - DNA, 22 bp, Artificial sequence
  SiRNA target sequence
tccttctttagaacacagatat

SEQ ID NO: 88795 - DNA, 22 bp, Artificial sequence
  SiRNA target sequence
ccttctttagaacacagatatt

SEQ ID NO: 88796 - DNA, 22 bp, Artificial sequence
  SiRNA target sequence
cttctttagaacacagatattc

SEQ ID NO: 88797 - DNA, 22 bp, Artificial sequence
  SiRNA target sequence
ttctttagaacacagatattca

SEQ ID NO: 88798 - DNA, 22 bp, Artificial sequence
  SiRNA target sequence
tctttagaacacagatattcaa

SEQ ID NO: 88799 - DNA, 22 bp, Artificial sequence
  SiRNA target sequence
ctttagaacacagatattcaat

SEQ ID NO: 88800 - DNA, 22 bp, Artificial sequence
  SiRNA target sequence
tttagaacacagatattcaata

SEQ ID NO: 88801 - DNA, 22 bp, Artificial sequence
  SiRNA target sequence
ttagaacacagatattcaatat

SEQ ID NO: 88802 - DNA, 22 bp, Artificial sequence
  SiRNA target sequence
tagaacacagatattcaatatc

SEQ ID NO: 88803 - DNA, 22 bp, Artificial sequence
  SiRNA target sequence
agaacacagatattcaatatca

SEQ ID NO: 88804 - DNA, 22 bp, Artificial sequence
  SiRNA target sequence
gaacacagatattcaatatcat

SEQ ID NO: 88805 - DNA, 22 bp, Artificial sequence
  SiRNA target sequence
aacacagatattcaatatcatg

SEQ ID NO: 88806 - DNA, 22 bp, Artificial sequence
  SiRNA target sequence
acacagatattcaatatcatgc

SEQ ID NO: 88807 - DNA, 22 bp, Artificial sequence
  SiRNA target sequence
cacagatattcaatatcatgct

SEQ ID NO: 88808 - DNA, 22 bp, Artificial sequence
  SiRNA target sequence
acagatattcaatatcatgctt

SEQ ID NO: 88809 - DNA, 22 bp, Artificial sequence
  SiRNA target sequence
cagatattcaatatcatgctta

SEQ ID NO: 88810 - DNA, 22 bp, Artificial sequence
  SiRNA target sequence
agatattcaatatcatgcttat

SEQ ID NO: 88811 - DNA, 22 bp, Artificial sequence
  SiRNA target sequence
gatattcaatatcatgcttatt

SEQ ID NO: 88812 - DNA, 22 bp, Artificial sequence
  SiRNA target sequence
atattcaatatcatgcttattt

SEQ ID NO: 88813 - DNA, 22 bp, Artificial sequence
  SiRNA target sequence
tattcaatatcatgcttatttt

SEQ ID NO: 88814 - DNA, 22 bp, Artificial sequence
  SiRNA target sequence
attcaatatcatgcttattttt

SEQ ID NO: 88815 - DNA, 22 bp, Artificial sequence
  SiRNA target sequence
ttcaatatcatgcttattttta

SEQ ID NO: 88816 - DNA, 22 bp, Artificial sequence
  SiRNA target sequence
tcaatatcatgcttatttttag

SEQ ID NO: 88817 - DNA, 22 bp, Artificial sequence
  SiRNA target sequence
caatatcatgcttatttttaga

SEQ ID NO: 88818 - DNA, 22 bp, Artificial sequence
  SiRNA target sequence
aatatcatgcttatttttagag

SEQ ID NO: 88819 - DNA, 22 bp, Artificial sequence
  SiRNA target sequence
atatcatgcttatttttagagg

SEQ ID NO: 88820 - DNA, 22 bp, Artificial sequence
  SiRNA target sequence
tatcatgcttatttttagaggt

SEQ ID NO: 88821 - DNA, 22 bp, Artificial sequence
  SiRNA target sequence
atcatgcttatttttagaggtt

SEQ ID NO: 88822 - DNA, 22 bp, Artificial sequence
  SiRNA target sequence
tcatgcttatttttagaggttt

SEQ ID NO: 88823 - DNA, 22 bp, Artificial sequence
  SiRNA target sequence
catgcttatttttagaggtttt

SEQ ID NO: 88824 - DNA, 22 bp, Artificial sequence
  SiRNA target sequence
atgcttatttttagaggtttta

SEQ ID NO: 88825 - DNA, 22 bp, Artificial sequence
  SiRNA target sequence
tgcttatttttagaggttttag

SEQ ID NO: 88826 - DNA, 22 bp, Artificial sequence
  SiRNA target sequence
gcttatttttagaggttttaga

SEQ ID NO: 88827 - DNA, 22 bp, Artificial sequence
  SiRNA target sequence
cttatttttagaggttttagaa

SEQ ID NO: 88828 - DNA, 22 bp, Artificial sequence
  SiRNA target sequence
ttatttttagaggttttagaaa

SEQ ID NO: 88829 - DNA, 22 bp, Artificial sequence
  SiRNA target sequence
tatttttagaggttttagaaat

SEQ ID NO: 88830 - DNA, 22 bp, Artificial sequence
  SiRNA target sequence
atttttagaggttttagaaata

SEQ ID NO: 88831 - DNA, 22 bp, Artificial sequence
  SiRNA target sequence
tttttagaggttttagaaatat

SEQ ID NO: 88832 - DNA, 22 bp, Artificial sequence
  SiRNA target sequence
ttttagaggttttagaaatatc

SEQ ID NO: 88833 - DNA, 22 bp, Artificial sequence
  SiRNA target sequence
tttagaggttttagaaatatcc

SEQ ID NO: 88834 - DNA, 22 bp, Artificial sequence
  SiRNA target sequence
ttagaggttttagaaatatcca

SEQ ID NO: 88835 - DNA, 22 bp, Artificial sequence
  SiRNA target sequence
tagaggttttagaaatatccat

SEQ ID NO: 88836 - DNA, 22 bp, Artificial sequence
  SiRNA target sequence
agaggttttagaaatatccata

SEQ ID NO: 88837 - DNA, 22 bp, Artificial sequence
  SiRNA target sequence
gaggttttagaaatatccataa

SEQ ID NO: 88838 - DNA, 22 bp, Artificial sequence
  SiRNA target sequence
aggttttagaaatatccataag

SEQ ID NO: 88839 - DNA, 22 bp, Artificial sequence
  SiRNA target sequence
ggttttagaaatatccataagc

SEQ ID NO: 88840 - DNA, 22 bp, Artificial sequence
  SiRNA target sequence
gttttagaaatatccataagcc

SEQ ID NO: 88841 - DNA, 22 bp, Artificial sequence
  SiRNA target sequence
ttttagaaatatccataagcca

SEQ ID NO: 88842 - DNA, 22 bp, Artificial sequence
  SiRNA target sequence
tttagaaatatccataagccat

SEQ ID NO: 88843 - DNA, 22 bp, Artificial sequence
  SiRNA target sequence
ttagaaatatccataagccatg

SEQ ID NO: 88844 - DNA, 22 bp, Artificial sequence
  SiRNA target sequence
tagaaatatccataagccatgc

SEQ ID NO: 88845 - DNA, 22 bp, Artificial sequence
  SiRNA target sequence
agaaatatccataagccatgct

SEQ ID NO: 88846 - DNA, 22 bp, Artificial sequence
  SiRNA target sequence
gaaatatccataagccatgctt

SEQ ID NO: 88847 - DNA, 22 bp, Artificial sequence
  SiRNA target sequence
aaatatccataagccatgcttt

SEQ ID NO: 88848 - DNA, 22 bp, Artificial sequence
  SiRNA target sequence
aatatccataagccatgctttt

SEQ ID NO: 88849 - DNA, 22 bp, Artificial sequence
  SiRNA target sequence
atatccataagccatgcttttt

SEQ ID NO: 88850 - DNA, 22 bp, Artificial sequence
  SiRNA target sequence
tatccataagccatgctttttt

SEQ ID NO: 88851 - DNA, 22 bp, Artificial sequence
  SiRNA target sequence
atccataagccatgctttttta

SEQ ID NO: 88852 - DNA, 22 bp, Artificial sequence
  SiRNA target sequence
tccataagccatgcttttttag

SEQ ID NO: 88853 - DNA, 22 bp, Artificial sequence
  SiRNA target sequence
ccataagccatgcttttttagg

SEQ ID NO: 88854 - DNA, 22 bp, Artificial sequence
  SiRNA target sequence
cataagccatgcttttttaggc

SEQ ID NO: 88855 - DNA, 22 bp, Artificial sequence
  SiRNA target sequence
ataagccatgcttttttaggca

SEQ ID NO: 88856 - DNA, 22 bp, Artificial sequence
  SiRNA target sequence
taagccatgcttttttaggcaa

SEQ ID NO: 88857 - DNA, 22 bp, Artificial sequence
  SiRNA target sequence
aagccatgcttttttaggcaat

SEQ ID NO: 88858 - DNA, 22 bp, Artificial sequence
  SiRNA target sequence
agccatgcttttttaggcaatg

SEQ ID NO: 88859 - DNA, 22 bp, Artificial sequence
  SiRNA target sequence
gccatgcttttttaggcaatga

SEQ ID NO: 88860 - DNA, 22 bp, Artificial sequence
  SiRNA target sequence
ccatgcttttttaggcaatgaa

SEQ ID NO: 88861 - DNA, 22 bp, Artificial sequence
  SiRNA target sequence
catgcttttttaggcaatgaag

SEQ ID NO: 88862 - DNA, 22 bp, Artificial sequence
  SiRNA target sequence
atgcttttttaggcaatgaagt

SEQ ID NO: 88863 - DNA, 22 bp, Artificial sequence
  SiRNA target sequence
tgcttttttaggcaatgaagta

SEQ ID NO: 88864 - DNA, 22 bp, Artificial sequence
  SiRNA target sequence
gcttttttaggcaatgaagtaa

SEQ ID NO: 88865 - DNA, 22 bp, Artificial sequence
  SiRNA target sequence
cttttttaggcaatgaagtaaa

SEQ ID NO: 88866 - DNA, 22 bp, Artificial sequence
  SiRNA target sequence
ttttttaggcaatgaagtaaaa

SEQ ID NO: 88867 - DNA, 22 bp, Artificial sequence
  SiRNA target sequence
tttttaggcaatgaagtaaaat

SEQ ID NO: 88868 - DNA, 22 bp, Artificial sequence
  SiRNA target sequence
ttttaggcaatgaagtaaaatc

SEQ ID NO: 88869 - DNA, 22 bp, Artificial sequence
  SiRNA target sequence
tttaggcaatgaagtaaaatca

SEQ ID NO: 88870 - DNA, 22 bp, Artificial sequence
  SiRNA target sequence
ttaggcaatgaagtaaaatcaa

SEQ ID NO: 88871 - DNA, 22 bp, Artificial sequence
  SiRNA target sequence
taggcaatgaagtaaaatcaaa

SEQ ID NO: 88872 - DNA, 22 bp, Artificial sequence
  SiRNA target sequence
aggcaatgaagtaaaatcaaaa

SEQ ID NO: 88873 - DNA, 22 bp, Artificial sequence
  SiRNA target sequence
ggcaatgaagtaaaatcaaaaa

SEQ ID NO: 88874 - DNA, 22 bp, Artificial sequence
  SiRNA target sequence
gcaatgaagtaaaatcaaaaat

SEQ ID NO: 88875 - DNA, 22 bp, Artificial sequence
  SiRNA target sequence
caatgaagtaaaatcaaaaata

SEQ ID NO: 88876 - DNA, 22 bp, Artificial sequence
  SiRNA target sequence
aatgaagtaaaatcaaaaatat

SEQ ID NO: 88877 - DNA, 22 bp, Artificial sequence
  SiRNA target sequence
atgaagtaaaatcaaaaatata

SEQ ID NO: 88878 - DNA, 22 bp, Artificial sequence
  SiRNA target sequence
tgaagtaaaatcaaaaatatac

SEQ ID NO: 88879 - DNA, 22 bp, Artificial sequence
  SiRNA target sequence
gaagtaaaatcaaaaatatact

SEQ ID NO: 88880 - DNA, 22 bp, Artificial sequence
  SiRNA target sequence
aagtaaaatcaaaaatatactt

SEQ ID NO: 88881 - DNA, 22 bp, Artificial sequence
  SiRNA target sequence
agtaaaatcaaaaatatacttg

SEQ ID NO: 88882 - DNA, 22 bp, Artificial sequence
  SiRNA target sequence
gtaaaatcaaaaatatacttga

SEQ ID NO: 88883 - DNA, 22 bp, Artificial sequence
  SiRNA target sequence
taaaatcaaaaatatacttgaa

SEQ ID NO: 88884 - DNA, 22 bp, Artificial sequence
  SiRNA target sequence
aaaatcaaaaatatacttgaaa

SEQ ID NO: 88885 - DNA, 22 bp, Artificial sequence
  SiRNA target sequence
aaatcaaaaatatacttgaaaa

SEQ ID NO: 88886 - DNA, 22 bp, Artificial sequence
  SiRNA target sequence
aatcaaaaatatacttgaaaaa

SEQ ID NO: 88887 - DNA, 22 bp, Artificial sequence
  SiRNA target sequence
atcaaaaatatacttgaaaaag

SEQ ID NO: 88888 - DNA, 22 bp, Artificial sequence
  SiRNA target sequence
tcaaaaatatacttgaaaaagt

SEQ ID NO: 88889 - DNA, 22 bp, Artificial sequence
  SiRNA target sequence
caaaaatatacttgaaaaagtc

SEQ ID NO: 88890 - DNA, 22 bp, Artificial sequence
  SiRNA target sequence
aaaaatatacttgaaaaagtca

SEQ ID NO: 88891 - DNA, 22 bp, Artificial sequence
  SiRNA target sequence
aaaatatacttgaaaaagtcac

SEQ ID NO: 88892 - DNA, 22 bp, Artificial sequence
  SiRNA target sequence
aaatatacttgaaaaagtcacg

SEQ ID NO: 88893 - DNA, 22 bp, Artificial sequence
  SiRNA target sequence
aatatacttgaaaaagtcacgc

SEQ ID NO: 88894 - DNA, 22 bp, Artificial sequence
  SiRNA target sequence
atatacttgaaaaagtcacgca

SEQ ID NO: 88895 - DNA, 22 bp, Artificial sequence
  SiRNA target sequence
tatacttgaaaaagtcacgcaa

SEQ ID NO: 88896 - DNA, 22 bp, Artificial sequence
  SiRNA target sequence
atacttgaaaaagtcacgcaaa

SEQ ID NO: 88897 - DNA, 22 bp, Artificial sequence
  SiRNA target sequence
tacttgaaaaagtcacgcaaag

SEQ ID NO: 88898 - DNA, 22 bp, Artificial sequence
  SiRNA target sequence
acttgaaaaagtcacgcaaaga

SEQ ID NO: 88899 - DNA, 22 bp, Artificial sequence
  SiRNA target sequence
cttgaaaaagtcacgcaaagat

SEQ ID NO: 88900 - DNA, 22 bp, Artificial sequence
  SiRNA target sequence
ttgaaaaagtcacgcaaagatc

SEQ ID NO: 88901 - DNA, 22 bp, Artificial sequence
  SiRNA target sequence
tgaaaaagtcacgcaaagatcc

SEQ ID NO: 88902 - DNA, 22 bp, Artificial sequence
  SiRNA target sequence
gaaaaagtcacgcaaagatcct

SEQ ID NO: 88903 - DNA, 22 bp, Artificial sequence
  SiRNA target sequence
aaaaagtcacgcaaagatcctt

SEQ ID NO: 88904 - DNA, 22 bp, Artificial sequence
  SiRNA target sequence
aaaagtcacgcaaagatccttc

SEQ ID NO: 88905 - DNA, 22 bp, Artificial sequence
  SiRNA target sequence
aaagtcacgcaaagatccttcg

SEQ ID NO: 88906 - DNA, 22 bp, Artificial sequence
  SiRNA target sequence
aagtcacgcaaagatccttcga

SEQ ID NO: 88907 - DNA, 22 bp, Artificial sequence
  SiRNA target sequence
agtcacgcaaagatccttcgaa

SEQ ID NO: 88908 - DNA, 22 bp, Artificial sequence
  SiRNA target sequence
gtcacgcaaagatccttcgaat

SEQ ID NO: 88909 - DNA, 22 bp, Artificial sequence
  SiRNA target sequence
tcacgcaaagatccttcgaatt

SEQ ID NO: 88910 - DNA, 22 bp, Artificial sequence
  SiRNA target sequence
cacgcaaagatccttcgaattg

SEQ ID NO: 88911 - DNA, 22 bp, Artificial sequence
  SiRNA target sequence
acgcaaagatccttcgaattga

SEQ ID NO: 88912 - DNA, 22 bp, Artificial sequence
  SiRNA target sequence
cgcaaagatccttcgaattgaa

SEQ ID NO: 88913 - DNA, 22 bp, Artificial sequence
  SiRNA target sequence
gcaaagatccttcgaattgaaa

SEQ ID NO: 88914 - DNA, 22 bp, Artificial sequence
  SiRNA target sequence
caaagatccttcgaattgaaac

SEQ ID NO: 88915 - DNA, 22 bp, Artificial sequence
  SiRNA target sequence
aaagatccttcgaattgaaacc

SEQ ID NO: 88916 - DNA, 22 bp, Artificial sequence
  SiRNA target sequence
aagatccttcgaattgaaaccc

SEQ ID NO: 88917 - DNA, 22 bp, Artificial sequence
  SiRNA target sequence
agatccttcgaattgaaacccc

SEQ ID NO: 88918 - DNA, 22 bp, Artificial sequence
  SiRNA target sequence
gatccttcgaattgaaaccccg

SEQ ID NO: 88919 - DNA, 22 bp, Artificial sequence
  SiRNA target sequence
atccttcgaattgaaaccccgt

SEQ ID NO: 88920 - DNA, 22 bp, Artificial sequence
  SiRNA target sequence
tccttcgaattgaaaccccgtt

SEQ ID NO: 88921 - DNA, 22 bp, Artificial sequence
  SiRNA target sequence
ccttcgaattgaaaccccgttt

SEQ ID NO: 88922 - DNA, 22 bp, Artificial sequence
  SiRNA target sequence
cttcgaattgaaaccccgtttt

SEQ ID NO: 88923 - DNA, 22 bp, Artificial sequence
  SiRNA target sequence
ttcgaattgaaaccccgttttt

SEQ ID NO: 88924 - DNA, 22 bp, Artificial sequence
  SiRNA target sequence
tcgaattgaaaccccgtttttc

SEQ ID NO: 88925 - DNA, 22 bp, Artificial sequence
  SiRNA target sequence
cgaattgaaaccccgtttttcc

SEQ ID NO: 88926 - DNA, 22 bp, Artificial sequence
  SiRNA target sequence
gaattgaaaccccgtttttcca

SEQ ID NO: 88927 - DNA, 22 bp, Artificial sequence
  SiRNA target sequence
aattgaaaccccgtttttccaa

SEQ ID NO: 88928 - DNA, 22 bp, Artificial sequence
  SiRNA target sequence
attgaaaccccgtttttccaac

SEQ ID NO: 88929 - DNA, 22 bp, Artificial sequence
  SiRNA target sequence
ttgaaaccccgtttttccaact

SEQ ID NO: 88930 - DNA, 22 bp, Artificial sequence
  SiRNA target sequence
tgaaaccccgtttttccaactt

SEQ ID NO: 88931 - DNA, 22 bp, Artificial sequence
  SiRNA target sequence
gaaaccccgtttttccaacttg

SEQ ID NO: 88932 - DNA, 22 bp, Artificial sequence
  SiRNA target sequence
aaaccccgtttttccaacttgc

SEQ ID NO: 88933 - DNA, 22 bp, Artificial sequence
  SiRNA target sequence
aaccccgtttttccaacttgct

SEQ ID NO: 88934 - DNA, 22 bp, Artificial sequence
  SiRNA target sequence
accccgtttttccaacttgctc

SEQ ID NO: 88935 - DNA, 22 bp, Artificial sequence
  SiRNA target sequence
ccccgtttttccaacttgctca

SEQ ID NO: 88936 - DNA, 22 bp, Artificial sequence
  SiRNA target sequence
cccgtttttccaacttgctcaa

SEQ ID NO: 88937 - DNA, 22 bp, Artificial sequence
  SiRNA target sequence
ccgtttttccaacttgctcaat

SEQ ID NO: 88938 - DNA, 22 bp, Artificial sequence
  SiRNA target sequence
cgtttttccaacttgctcaata

SEQ ID NO: 88939 - DNA, 22 bp, Artificial sequence
  SiRNA target sequence
gtttttccaacttgctcaatat

SEQ ID NO: 88940 - DNA, 22 bp, Artificial sequence
  SiRNA target sequence
tttttccaacttgctcaatata

SEQ ID NO: 88941 - DNA, 22 bp, Artificial sequence
  SiRNA target sequence
ttttccaacttgctcaatatat

SEQ ID NO: 88942 - DNA, 22 bp, Artificial sequence
  SiRNA target sequence
tttccaacttgctcaatatata

SEQ ID NO: 88943 - DNA, 22 bp, Artificial sequence
  SiRNA target sequence
ttccaacttgctcaatatataa

SEQ ID NO: 88944 - DNA, 22 bp, Artificial sequence
  SiRNA target sequence
tccaacttgctcaatatataat

SEQ ID NO: 88945 - DNA, 22 bp, Artificial sequence
  SiRNA target sequence
ccaacttgctcaatatataata

SEQ ID NO: 88946 - DNA, 22 bp, Artificial sequence
  SiRNA target sequence
caacttgctcaatatataataa

SEQ ID NO: 88947 - DNA, 22 bp, Artificial sequence
  SiRNA target sequence
aacttgctcaatatataataat

SEQ ID NO: 88948 - DNA, 22 bp, Artificial sequence
  SiRNA target sequence
acttgctcaatatataataatg

SEQ ID NO: 88949 - DNA, 22 bp, Artificial sequence
  SiRNA target sequence
cttgctcaatatataataatgt

SEQ ID NO: 88950 - DNA, 22 bp, Artificial sequence
  SiRNA target sequence
ttgctcaatatataataatgta

SEQ ID NO: 88951 - DNA, 22 bp, Artificial sequence
  SiRNA target sequence
tgctcaatatataataatgtat

SEQ ID NO: 88952 - DNA, 22 bp, Artificial sequence
  SiRNA target sequence
gctcaatatataataatgtatc

SEQ ID NO: 88953 - DNA, 22 bp, Artificial sequence
  SiRNA target sequence
ctcaatatataataatgtatca

SEQ ID NO: 88954 - DNA, 22 bp, Artificial sequence
  SiRNA target sequence
tcaatatataataatgtatcac

SEQ ID NO: 88955 - DNA, 22 bp, Artificial sequence
  SiRNA target sequence
caatatataataatgtatcacc

SEQ ID NO: 88956 - DNA, 22 bp, Artificial sequence
  SiRNA target sequence
aatatataataatgtatcacca

SEQ ID NO: 88957 - DNA, 22 bp, Artificial sequence
  SiRNA target sequence
atatataataatgtatcaccag

SEQ ID NO: 88958 - DNA, 22 bp, Artificial sequence
  SiRNA target sequence
tatataataatgtatcaccaga

SEQ ID NO: 88959 - DNA, 22 bp, Artificial sequence
  SiRNA target sequence
atataataatgtatcaccagac

SEQ ID NO: 88960 - DNA, 22 bp, Artificial sequence
  SiRNA target sequence
tataataatgtatcaccagaca

SEQ ID NO: 88961 - DNA, 22 bp, Artificial sequence
  SiRNA target sequence
ataataatgtatcaccagacat

SEQ ID NO: 88962 - DNA, 22 bp, Artificial sequence
  SiRNA target sequence
taataatgtatcaccagacatt

SEQ ID NO: 88963 - DNA, 22 bp, Artificial sequence
  SiRNA target sequence
aataatgtatcaccagacattt

SEQ ID NO: 88964 - DNA, 22 bp, Artificial sequence
  SiRNA target sequence
ataatgtatcaccagacatttc

SEQ ID NO: 88965 - DNA, 22 bp, Artificial sequence
  SiRNA target sequence
taatgtatcaccagacatttct

SEQ ID NO: 88966 - DNA, 22 bp, Artificial sequence
  SiRNA target sequence
aatgtatcaccagacatttcta

SEQ ID NO: 88967 - DNA, 22 bp, Artificial sequence
  SiRNA target sequence
atgtatcaccagacatttctag

SEQ ID NO: 88968 - DNA, 22 bp, Artificial sequence
  SiRNA target sequence
tgtatcaccagacatttctagt

SEQ ID NO: 88969 - DNA, 22 bp, Artificial sequence
  SiRNA target sequence
gtatcaccagacatttctagta

SEQ ID NO: 88970 - DNA, 22 bp, Artificial sequence
  SiRNA target sequence
tatcaccagacatttctagtaa

SEQ ID NO: 88971 - DNA, 22 bp, Artificial sequence
  SiRNA target sequence
atcaccagacatttctagtaaa

SEQ ID NO: 88972 - DNA, 22 bp, Artificial sequence
  SiRNA target sequence
tcaccagacatttctagtaaac

SEQ ID NO: 88973 - DNA, 22 bp, Artificial sequence
  SiRNA target sequence
caccagacatttctagtaaact

SEQ ID NO: 88974 - DNA, 22 bp, Artificial sequence
  SiRNA target sequence
accagacatttctagtaaactt

SEQ ID NO: 88975 - DNA, 22 bp, Artificial sequence
  SiRNA target sequence
ccagacatttctagtaaactta

SEQ ID NO: 88976 - DNA, 22 bp, Artificial sequence
  SiRNA target sequence
cagacatttctagtaaacttaa

SEQ ID NO: 88977 - DNA, 22 bp, Artificial sequence
  SiRNA target sequence
agacatttctagtaaacttaac

SEQ ID NO: 88978 - DNA, 22 bp, Artificial sequence
  SiRNA target sequence
gacatttctagtaaacttaaca

SEQ ID NO: 88979 - DNA, 22 bp, Artificial sequence
  SiRNA target sequence
acatttctagtaaacttaacat

SEQ ID NO: 88980 - DNA, 22 bp, Artificial sequence
  SiRNA target sequence
catttctagtaaacttaacatt

SEQ ID NO: 88981 - DNA, 22 bp, Artificial sequence
  SiRNA target sequence
atttctagtaaacttaacattt

SEQ ID NO: 88982 - DNA, 22 bp, Artificial sequence
  SiRNA target sequence
tttctagtaaacttaacatttc

SEQ ID NO: 88983 - DNA, 22 bp, Artificial sequence
  SiRNA target sequence
ttctagtaaacttaacatttca

SEQ ID NO: 88984 - DNA, 22 bp, Artificial sequence
  SiRNA target sequence
tctagtaaacttaacatttcat

SEQ ID NO: 88985 - DNA, 22 bp, Artificial sequence
  SiRNA target sequence
ctagtaaacttaacatttcatt

SEQ ID NO: 88986 - DNA, 22 bp, Artificial sequence
  SiRNA target sequence
tagtaaacttaacatttcatta

SEQ ID NO: 88987 - DNA, 22 bp, Artificial sequence
  SiRNA target sequence
agtaaacttaacatttcattaa

SEQ ID NO: 88988 - DNA, 22 bp, Artificial sequence
  SiRNA target sequence
gtaaacttaacatttcattaac

SEQ ID NO: 88989 - DNA, 22 bp, Artificial sequence
  SiRNA target sequence
taaacttaacatttcattaaca

SEQ ID NO: 88990 - DNA, 22 bp, Artificial sequence
  SiRNA target sequence
aaacttaacatttcattaacaa

SEQ ID NO: 88991 - DNA, 22 bp, Artificial sequence
  SiRNA target sequence
aacttaacatttcattaacaag

SEQ ID NO: 88992 - DNA, 22 bp, Artificial sequence
  SiRNA target sequence
acttaacatttcattaacaagc

SEQ ID NO: 88993 - DNA, 22 bp, Artificial sequence
  SiRNA target sequence
cttaacatttcattaacaagca

SEQ ID NO: 88994 - DNA, 22 bp, Artificial sequence
  SiRNA target sequence
ttaacatttcattaacaagcaa

SEQ ID NO: 88995 - DNA, 22 bp, Artificial sequence
  SiRNA target sequence
taacatttcattaacaagcaaa

SEQ ID NO: 88996 - DNA, 22 bp, Artificial sequence
  SiRNA target sequence
aacatttcattaacaagcaaat

SEQ ID NO: 88997 - DNA, 22 bp, Artificial sequence
  SiRNA target sequence
acatttcattaacaagcaaatc

SEQ ID NO: 88998 - DNA, 22 bp, Artificial sequence
  SiRNA target sequence
catttcattaacaagcaaatca

SEQ ID NO: 88999 - DNA, 22 bp, Artificial sequence
  SiRNA target sequence
atttcattaacaagcaaatcat

SEQ ID NO: 89000 - DNA, 22 bp, Artificial sequence
  SiRNA target sequence
tttcattaacaagcaaatcatt

SEQ ID NO: 89001 - DNA, 22 bp, Artificial sequence
  SiRNA target sequence
ttcattaacaagcaaatcatta

SEQ ID NO: 89002 - DNA, 22 bp, Artificial sequence
  SiRNA target sequence
tcattaacaagcaaatcattat

SEQ ID NO: 89003 - DNA, 22 bp, Artificial sequence
  SiRNA target sequence
cattaacaagcaaatcattatt

SEQ ID NO: 89004 - DNA, 22 bp, Artificial sequence
  SiRNA target sequence
attaacaagcaaatcattattt

SEQ ID NO: 89005 - DNA, 22 bp, Artificial sequence
  SiRNA target sequence
ttaacaagcaaatcattatttg

SEQ ID NO: 89006 - DNA, 22 bp, Artificial sequence
  SiRNA target sequence
taacaagcaaatcattatttga

SEQ ID NO: 89007 - DNA, 22 bp, Artificial sequence
  SiRNA target sequence
aacaagcaaatcattatttgaa

SEQ ID NO: 89008 - DNA, 22 bp, Artificial sequence
  SiRNA target sequence
acaagcaaatcattatttgaac

SEQ ID NO: 89009 - DNA, 22 bp, Artificial sequence
  SiRNA target sequence
caagcaaatcattatttgaaca

SEQ ID NO: 89010 - DNA, 22 bp, Artificial sequence
  SiRNA target sequence
aagcaaatcattatttgaacaa

SEQ ID NO: 89011 - DNA, 22 bp, Artificial sequence
  SiRNA target sequence
agcaaatcattatttgaacaaa

SEQ ID NO: 89012 - DNA, 22 bp, Artificial sequence
  SiRNA target sequence
gcaaatcattatttgaacaaag

SEQ ID NO: 89013 - DNA, 22 bp, Artificial sequence
  SiRNA target sequence
caaatcattatttgaacaaagt

SEQ ID NO: 89014 - DNA, 22 bp, Artificial sequence
  SiRNA target sequence
aaatcattatttgaacaaagta

SEQ ID NO: 89015 - DNA, 22 bp, Artificial sequence
  SiRNA target sequence
aatcattatttgaacaaagtag

SEQ ID NO: 89016 - DNA, 22 bp, Artificial sequence
  SiRNA target sequence
atcattatttgaacaaagtaga

SEQ ID NO: 89017 - DNA, 22 bp, Artificial sequence
  SiRNA target sequence
tcattatttgaacaaagtagac

SEQ ID NO: 89018 - DNA, 22 bp, Artificial sequence
  SiRNA target sequence
cattatttgaacaaagtagacc

SEQ ID NO: 89019 - DNA, 22 bp, Artificial sequence
  SiRNA target sequence
attatttgaacaaagtagacca

SEQ ID NO: 89020 - DNA, 22 bp, Artificial sequence
  SiRNA target sequence
ttatttgaacaaagtagaccaa

SEQ ID NO: 89021 - DNA, 22 bp, Artificial sequence
  SiRNA target sequence
tatttgaacaaagtagaccaat

SEQ ID NO: 89022 - DNA, 22 bp, Artificial sequence
  SiRNA target sequence
atttgaacaaagtagaccaata

SEQ ID NO: 89023 - DNA, 22 bp, Artificial sequence
  SiRNA target sequence
tttgaacaaagtagaccaatac

SEQ ID NO: 89024 - DNA, 22 bp, Artificial sequence
  SiRNA target sequence
ttgaacaaagtagaccaatact

SEQ ID NO: 89025 - DNA, 22 bp, Artificial sequence
  SiRNA target sequence
tgaacaaagtagaccaatacta

SEQ ID NO: 89026 - DNA, 22 bp, Artificial sequence
  SiRNA target sequence
gaacaaagtagaccaatactat

SEQ ID NO: 89027 - DNA, 22 bp, Artificial sequence
  SiRNA target sequence
aacaaagtagaccaatactatc

SEQ ID NO: 89028 - DNA, 22 bp, Artificial sequence
  SiRNA target sequence
acaaagtagaccaatactatca

SEQ ID NO: 89029 - DNA, 22 bp, Artificial sequence
  SiRNA target sequence
caaagtagaccaatactatcac

SEQ ID NO: 89030 - DNA, 22 bp, Artificial sequence
  SiRNA target sequence
aaagtagaccaatactatcacc

SEQ ID NO: 89031 - DNA, 22 bp, Artificial sequence
  SiRNA target sequence
aagtagaccaatactatcacca

SEQ ID NO: 89032 - DNA, 22 bp, Artificial sequence
  SiRNA target sequence
agtagaccaatactatcaccag

SEQ ID NO: 89033 - DNA, 22 bp, Artificial sequence
  SiRNA target sequence
gtagaccaatactatcaccagg

SEQ ID NO: 89034 - DNA, 22 bp, Artificial sequence
  SiRNA target sequence
tagaccaatactatcaccagga

SEQ ID NO: 89035 - DNA, 22 bp, Artificial sequence
  SiRNA target sequence
agaccaatactatcaccaggaa

SEQ ID NO: 89036 - DNA, 22 bp, Artificial sequence
  SiRNA target sequence
gaccaatactatcaccaggaac

SEQ ID NO: 89037 - DNA, 22 bp, Artificial sequence
  SiRNA target sequence
accaatactatcaccaggaaca

SEQ ID NO: 89038 - DNA, 22 bp, Artificial sequence
  SiRNA target sequence
ccaatactatcaccaggaacaa

SEQ ID NO: 89039 - DNA, 22 bp, Artificial sequence
  SiRNA target sequence
caatactatcaccaggaacaaa

SEQ ID NO: 89040 - DNA, 22 bp, Artificial sequence
  SiRNA target sequence
aatactatcaccaggaacaaaa

SEQ ID NO: 89041 - DNA, 22 bp, Artificial sequence
  SiRNA target sequence
atactatcaccaggaacaaaat

SEQ ID NO: 89042 - DNA, 22 bp, Artificial sequence
  SiRNA target sequence
tactatcaccaggaacaaaatc

SEQ ID NO: 89043 - DNA, 22 bp, Artificial sequence
  SiRNA target sequence
actatcaccaggaacaaaatct

SEQ ID NO: 89044 - DNA, 22 bp, Artificial sequence
  SiRNA target sequence
ctatcaccaggaacaaaatcta

SEQ ID NO: 89045 - DNA, 22 bp, Artificial sequence
  SiRNA target sequence
tatcaccaggaacaaaatctaa

SEQ ID NO: 89046 - DNA, 22 bp, Artificial sequence
  SiRNA target sequence
atcaccaggaacaaaatctaat

SEQ ID NO: 89047 - DNA, 22 bp, Artificial sequence
  SiRNA target sequence
tcaccaggaacaaaatctaatg

SEQ ID NO: 89048 - DNA, 22 bp, Artificial sequence
  SiRNA target sequence
caccaggaacaaaatctaatgt

SEQ ID NO: 89049 - DNA, 22 bp, Artificial sequence
  SiRNA target sequence
accaggaacaaaatctaatgta

SEQ ID NO: 89050 - DNA, 22 bp, Artificial sequence
  SiRNA target sequence
ccaggaacaaaatctaatgtat

SEQ ID NO: 89051 - DNA, 22 bp, Artificial sequence
  SiRNA target sequence
caggaacaaaatctaatgtata

SEQ ID NO: 89052 - DNA, 22 bp, Artificial sequence
  SiRNA target sequence
aggaacaaaatctaatgtataa

SEQ ID NO: 89053 - DNA, 22 bp, Artificial sequence
  SiRNA target sequence
ggaacaaaatctaatgtataat

SEQ ID NO: 89054 - DNA, 22 bp, Artificial sequence
  SiRNA target sequence
gaacaaaatctaatgtataatt

SEQ ID NO: 89055 - DNA, 22 bp, Artificial sequence
  SiRNA target sequence
aacaaaatctaatgtataatta

SEQ ID NO: 89056 - DNA, 22 bp, Artificial sequence
  SiRNA target sequence
acaaaatctaatgtataattaa

SEQ ID NO: 89057 - DNA, 22 bp, Artificial sequence
  SiRNA target sequence
caaaatctaatgtataattaag

SEQ ID NO: 89058 - DNA, 22 bp, Artificial sequence
  SiRNA target sequence
aaaatctaatgtataattaagt

SEQ ID NO: 89059 - DNA, 22 bp, Artificial sequence
  SiRNA target sequence
aaatctaatgtataattaagtt

SEQ ID NO: 89060 - DNA, 22 bp, Artificial sequence
  SiRNA target sequence
aatctaatgtataattaagttg

SEQ ID NO: 89061 - DNA, 22 bp, Artificial sequence
  SiRNA target sequence
atctaatgtataattaagttga

SEQ ID NO: 89062 - DNA, 22 bp, Artificial sequence
  SiRNA target sequence
tctaatgtataattaagttgaa

SEQ ID NO: 89063 - DNA, 22 bp, Artificial sequence
  SiRNA target sequence
ctaatgtataattaagttgaac

SEQ ID NO: 89064 - DNA, 22 bp, Artificial sequence
  SiRNA target sequence
taatgtataattaagttgaacc

SEQ ID NO: 89065 - DNA, 22 bp, Artificial sequence
  SiRNA target sequence
aatgtataattaagttgaacct

SEQ ID NO: 89066 - DNA, 22 bp, Artificial sequence
  SiRNA target sequence
atgtataattaagttgaacctt

SEQ ID NO: 89067 - DNA, 22 bp, Artificial sequence
  SiRNA target sequence
tgtataattaagttgaacctta

SEQ ID NO: 89068 - DNA, 22 bp, Artificial sequence
  SiRNA target sequence
gtataattaagttgaaccttat

SEQ ID NO: 89069 - DNA, 22 bp, Artificial sequence
  SiRNA target sequence
tataattaagttgaaccttata

SEQ ID NO: 89070 - DNA, 22 bp, Artificial sequence
  SiRNA target sequence
ataattaagttgaaccttatat

SEQ ID NO: 89071 - DNA, 22 bp, Artificial sequence
  SiRNA target sequence
taattaagttgaaccttatata

SEQ ID NO: 89072 - DNA, 22 bp, Artificial sequence
  SiRNA target sequence
aattaagttgaaccttatatac

SEQ ID NO: 89073 - DNA, 22 bp, Artificial sequence
  SiRNA target sequence
attaagttgaaccttatatacc

SEQ ID NO: 89074 - DNA, 22 bp, Artificial sequence
  SiRNA target sequence
ttaagttgaaccttatatacct

SEQ ID NO: 89075 - DNA, 22 bp, Artificial sequence
  SiRNA target sequence
taagttgaaccttatatacctt

SEQ ID NO: 89076 - DNA, 22 bp, Artificial sequence
  SiRNA target sequence
aagttgaaccttatataccttt

SEQ ID NO: 89077 - DNA, 22 bp, Artificial sequence
  SiRNA target sequence
agttgaaccttatatacctttt

SEQ ID NO: 89078 - DNA, 22 bp, Artificial sequence
  SiRNA target sequence
gttgaaccttatataccttttt

SEQ ID NO: 89079 - DNA, 22 bp, Artificial sequence
  SiRNA target sequence
ttgaaccttatatacctttttc

SEQ ID NO: 89080 - DNA, 22 bp, Artificial sequence
  SiRNA target sequence
tgaaccttatatacctttttcc

SEQ ID NO: 89081 - DNA, 22 bp, Artificial sequence
  SiRNA target sequence
gaaccttatatacctttttcca

SEQ ID NO: 89082 - DNA, 22 bp, Artificial sequence
  SiRNA target sequence
aaccttatatacctttttccat

SEQ ID NO: 89083 - DNA, 22 bp, Artificial sequence
  SiRNA target sequence
accttatatacctttttccatg

SEQ ID NO: 89084 - DNA, 22 bp, Artificial sequence
  SiRNA target sequence
ccttatatacctttttccatgt

SEQ ID NO: 89085 - DNA, 22 bp, Artificial sequence
  SiRNA target sequence
cttatatacctttttccatgta

SEQ ID NO: 89086 - DNA, 22 bp, Artificial sequence
  SiRNA target sequence
ttatatacctttttccatgtac

SEQ ID NO: 89087 - DNA, 22 bp, Artificial sequence
  SiRNA target sequence
tatatacctttttccatgtaca

SEQ ID NO: 89088 - DNA, 22 bp, Artificial sequence
  SiRNA target sequence
atatacctttttccatgtacag

SEQ ID NO: 89089 - DNA, 22 bp, Artificial sequence
  SiRNA target sequence
tatacctttttccatgtacagg

SEQ ID NO: 89090 - DNA, 22 bp, Artificial sequence
  SiRNA target sequence
atacctttttccatgtacagga

SEQ ID NO: 89091 - DNA, 22 bp, Artificial sequence
  SiRNA target sequence
tacctttttccatgtacaggaa

SEQ ID NO: 89092 - DNA, 22 bp, Artificial sequence
  SiRNA target sequence
acctttttccatgtacaggaaa

SEQ ID NO: 89093 - DNA, 22 bp, Artificial sequence
  SiRNA target sequence
cctttttccatgtacaggaaag

SEQ ID NO: 89094 - DNA, 22 bp, Artificial sequence
  SiRNA target sequence
ctttttccatgtacaggaaagg

SEQ ID NO: 89095 - DNA, 22 bp, Artificial sequence
  SiRNA target sequence
tttttccatgtacaggaaaggt

SEQ ID NO: 89096 - DNA, 22 bp, Artificial sequence
  SiRNA target sequence
ttttccatgtacaggaaaggtt

SEQ ID NO: 89097 - DNA, 22 bp, Artificial sequence
  SiRNA target sequence
tttccatgtacaggaaaggttt

SEQ ID NO: 89098 - DNA, 22 bp, Artificial sequence
  SiRNA target sequence
ttccatgtacaggaaaggtttt

SEQ ID NO: 89099 - DNA, 22 bp, Artificial sequence
  SiRNA target sequence
tccatgtacaggaaaggttttc

SEQ ID NO: 89100 - DNA, 22 bp, Artificial sequence
  SiRNA target sequence
ccatgtacaggaaaggttttca

SEQ ID NO: 89101 - DNA, 22 bp, Artificial sequence
  SiRNA target sequence
catgtacaggaaaggttttcaa

SEQ ID NO: 89102 - DNA, 22 bp, Artificial sequence
  SiRNA target sequence
atgtacaggaaaggttttcaat

SEQ ID NO: 89103 - DNA, 22 bp, Artificial sequence
  SiRNA target sequence
tgtacaggaaaggttttcaata

SEQ ID NO: 89104 - DNA, 22 bp, Artificial sequence
  SiRNA target sequence
gtacaggaaaggttttcaatat

SEQ ID NO: 89105 - DNA, 22 bp, Artificial sequence
  SiRNA target sequence
tacaggaaaggttttcaatatt

SEQ ID NO: 89106 - DNA, 22 bp, Artificial sequence
  SiRNA target sequence
acaggaaaggttttcaatattt

SEQ ID NO: 89107 - DNA, 22 bp, Artificial sequence
  SiRNA target sequence
caggaaaggttttcaatattta

SEQ ID NO: 89108 - DNA, 22 bp, Artificial sequence
  SiRNA target sequence
aggaaaggttttcaatatttag

SEQ ID NO: 89109 - DNA, 22 bp, Artificial sequence
  SiRNA target sequence
ggaaaggttttcaatatttagt

SEQ ID NO: 89110 - DNA, 22 bp, Artificial sequence
  SiRNA target sequence
gaaaggttttcaatatttagta

SEQ ID NO: 89111 - DNA, 22 bp, Artificial sequence
  SiRNA target sequence
aaaggttttcaatatttagtat

SEQ ID NO: 89112 - DNA, 22 bp, Artificial sequence
  SiRNA target sequence
aaggttttcaatatttagtata

SEQ ID NO: 89113 - DNA, 22 bp, Artificial sequence
  SiRNA target sequence
aggttttcaatatttagtatat

SEQ ID NO: 89114 - DNA, 22 bp, Artificial sequence
  SiRNA target sequence
ggttttcaatatttagtatatt

SEQ ID NO: 89115 - DNA, 22 bp, Artificial sequence
  SiRNA target sequence
gttttcaatatttagtatattt

SEQ ID NO: 89116 - DNA, 22 bp, Artificial sequence
  SiRNA target sequence
ttttcaatatttagtatatttg

SEQ ID NO: 89117 - DNA, 22 bp, Artificial sequence
  SiRNA target sequence
tttcaatatttagtatatttgt

SEQ ID NO: 89118 - DNA, 22 bp, Artificial sequence
  SiRNA target sequence
ttcaatatttagtatatttgta

SEQ ID NO: 89119 - DNA, 22 bp, Artificial sequence
  SiRNA target sequence
tcaatatttagtatatttgtat

SEQ ID NO: 89120 - DNA, 22 bp, Artificial sequence
  SiRNA target sequence
caatatttagtatatttgtatc

SEQ ID NO: 89121 - DNA, 22 bp, Artificial sequence
  SiRNA target sequence
aatatttagtatatttgtatct

SEQ ID NO: 89122 - DNA, 22 bp, Artificial sequence
  SiRNA target sequence
atatttagtatatttgtatcta

SEQ ID NO: 89123 - DNA, 22 bp, Artificial sequence
  SiRNA target sequence
tatttagtatatttgtatctat

SEQ ID NO: 89124 - DNA, 22 bp, Artificial sequence
  SiRNA target sequence
atttagtatatttgtatctatc

SEQ ID NO: 89125 - DNA, 22 bp, Artificial sequence
  SiRNA target sequence
tttagtatatttgtatctatca

SEQ ID NO: 89126 - DNA, 22 bp, Artificial sequence
  SiRNA target sequence
ttagtatatttgtatctatcaa

SEQ ID NO: 89127 - DNA, 22 bp, Artificial sequence
  SiRNA target sequence
tagtatatttgtatctatcaaa

SEQ ID NO: 89128 - DNA, 22 bp, Artificial sequence
  SiRNA target sequence
agtatatttgtatctatcaaat

SEQ ID NO: 89129 - DNA, 22 bp, Artificial sequence
  SiRNA target sequence
gtatatttgtatctatcaaatt

SEQ ID NO: 89130 - DNA, 22 bp, Artificial sequence
  SiRNA target sequence
tatatttgtatctatcaaattt

SEQ ID NO: 89131 - DNA, 22 bp, Artificial sequence
  SiRNA target sequence
atatttgtatctatcaaattta

SEQ ID NO: 89132 - DNA, 22 bp, Artificial sequence
  SiRNA target sequence
tatttgtatctatcaaatttat

SEQ ID NO: 89133 - DNA, 22 bp, Artificial sequence
  SiRNA target sequence
atttgtatctatcaaatttata

SEQ ID NO: 89134 - DNA, 22 bp, Artificial sequence
  SiRNA target sequence
tttgtatctatcaaatttatat

SEQ ID NO: 89135 - DNA, 22 bp, Artificial sequence
  SiRNA target sequence
ttgtatctatcaaatttatatt

SEQ ID NO: 89136 - DNA, 22 bp, Artificial sequence
  SiRNA target sequence
tgtatctatcaaatttatattc

SEQ ID NO: 89137 - DNA, 22 bp, Artificial sequence
  SiRNA target sequence
gtatctatcaaatttatattct

SEQ ID NO: 89138 - DNA, 22 bp, Artificial sequence
  SiRNA target sequence
tatctatcaaatttatattctc

SEQ ID NO: 89139 - DNA, 22 bp, Artificial sequence
  SiRNA target sequence
atctatcaaatttatattctcg

SEQ ID NO: 89140 - DNA, 22 bp, Artificial sequence
  SiRNA target sequence
tctatcaaatttatattctcgt

SEQ ID NO: 89141 - DNA, 22 bp, Artificial sequence
  SiRNA target sequence
ctatcaaatttatattctcgtt

SEQ ID NO: 89142 - DNA, 22 bp, Artificial sequence
  SiRNA target sequence
tatcaaatttatattctcgttt

SEQ ID NO: 89143 - DNA, 22 bp, Artificial sequence
  SiRNA target sequence
atcaaatttatattctcgtttg

SEQ ID NO: 89144 - DNA, 22 bp, Artificial sequence
  SiRNA target sequence
tcaaatttatattctcgtttgt

SEQ ID NO: 89145 - DNA, 22 bp, Artificial sequence
  SiRNA target sequence
caaatttatattctcgtttgtc

SEQ ID NO: 89146 - DNA, 22 bp, Artificial sequence
  SiRNA target sequence
aaatttatattctcgtttgtct

SEQ ID NO: 89147 - DNA, 22 bp, Artificial sequence
  SiRNA target sequence
aatttatattctcgtttgtctt

SEQ ID NO: 89148 - DNA, 22 bp, Artificial sequence
  SiRNA target sequence
atttatattctcgtttgtcttt

SEQ ID NO: 89149 - DNA, 22 bp, Artificial sequence
  SiRNA target sequence
tttatattctcgtttgtcttta

SEQ ID NO: 89150 - DNA, 22 bp, Artificial sequence
  SiRNA target sequence
ttatattctcgtttgtctttat

SEQ ID NO: 89151 - DNA, 22 bp, Artificial sequence
  SiRNA target sequence
tatattctcgtttgtctttatt

SEQ ID NO: 89152 - DNA, 22 bp, Artificial sequence
  SiRNA target sequence
atattctcgtttgtctttattt

SEQ ID NO: 89153 - DNA, 22 bp, Artificial sequence
  SiRNA target sequence
tattctcgtttgtctttatttt

SEQ ID NO: 89154 - DNA, 22 bp, Artificial sequence
  SiRNA target sequence
attctcgtttgtctttatttta

SEQ ID NO: 89155 - DNA, 22 bp, Artificial sequence
  SiRNA target sequence
ttctcgtttgtctttattttat

SEQ ID NO: 89156 - DNA, 22 bp, Artificial sequence
  SiRNA target sequence
tctcgtttgtctttattttata

SEQ ID NO: 89157 - DNA, 22 bp, Artificial sequence
  SiRNA target sequence
ctcgtttgtctttattttataa

SEQ ID NO: 89158 - DNA, 22 bp, Artificial sequence
  SiRNA target sequence
tcgtttgtctttattttataag

SEQ ID NO: 89159 - DNA, 22 bp, Artificial sequence
  SiRNA target sequence
cgtttgtctttattttataaga

SEQ ID NO: 89160 - DNA, 22 bp, Artificial sequence
  SiRNA target sequence
gtttgtctttattttataagaa

SEQ ID NO: 89161 - DNA, 22 bp, Artificial sequence
  SiRNA target sequence
tttgtctttattttataagaac

SEQ ID NO: 89162 - DNA, 22 bp, Artificial sequence
  SiRNA target sequence
ttgtctttattttataagaacc

SEQ ID NO: 89163 - DNA, 22 bp, Artificial sequence
  SiRNA target sequence
tgtctttattttataagaacct

SEQ ID NO: 89164 - DNA, 22 bp, Artificial sequence
  SiRNA target sequence
gtctttattttataagaacctg

SEQ ID NO: 89165 - DNA, 22 bp, Artificial sequence
  SiRNA target sequence
tctttattttataagaacctgt

SEQ ID NO: 89166 - DNA, 22 bp, Artificial sequence
  SiRNA target sequence
ctttattttataagaacctgta

SEQ ID NO: 89167 - DNA, 22 bp, Artificial sequence
  SiRNA target sequence
tttattttataagaacctgtat

SEQ ID NO: 89168 - DNA, 22 bp, Artificial sequence
  SiRNA target sequence
ttattttataagaacctgtata

SEQ ID NO: 89169 - DNA, 22 bp, Artificial sequence
  SiRNA target sequence
tattttataagaacctgtatag

SEQ ID NO: 89170 - DNA, 22 bp, Artificial sequence
  SiRNA target sequence
attttataagaacctgtatagt

SEQ ID NO: 89171 - DNA, 22 bp, Artificial sequence
  SiRNA target sequence
ttttataagaacctgtatagtt

SEQ ID NO: 89172 - DNA, 22 bp, Artificial sequence
  SiRNA target sequence
tttataagaacctgtatagttg

SEQ ID NO: 89173 - DNA, 22 bp, Artificial sequence
  SiRNA target sequence
ttataagaacctgtatagttgg

SEQ ID NO: 89174 - DNA, 22 bp, Artificial sequence
  SiRNA target sequence
tataagaacctgtatagttggt

SEQ ID NO: 89175 - DNA, 22 bp, Artificial sequence
  SiRNA target sequence
ataagaacctgtatagttggtc

SEQ ID NO: 89176 - DNA, 22 bp, Artificial sequence
  SiRNA target sequence
taagaacctgtatagttggtct

SEQ ID NO: 89177 - DNA, 22 bp, Artificial sequence
  SiRNA target sequence
aagaacctgtatagttggtctt

SEQ ID NO: 89178 - DNA, 22 bp, Artificial sequence
  SiRNA target sequence
agaacctgtatagttggtcttt

SEQ ID NO: 89179 - DNA, 22 bp, Artificial sequence
  SiRNA target sequence
gaacctgtatagttggtctttt

SEQ ID NO: 89180 - DNA, 22 bp, Artificial sequence
  SiRNA target sequence
aacctgtatagttggtcttttt

SEQ ID NO: 89181 - DNA, 22 bp, Artificial sequence
  SiRNA target sequence
acctgtatagttggtcttttta

SEQ ID NO: 89182 - DNA, 22 bp, Artificial sequence
  SiRNA target sequence
cctgtatagttggtctttttaa

SEQ ID NO: 89183 - DNA, 22 bp, Artificial sequence
  SiRNA target sequence
ctgtatagttggtctttttaat

SEQ ID NO: 89184 - DNA, 22 bp, Artificial sequence
  SiRNA target sequence
tgtatagttggtctttttaatt

SEQ ID NO: 89185 - DNA, 22 bp, Artificial sequence
  SiRNA target sequence
gtatagttggtctttttaatta

SEQ ID NO: 89186 - DNA, 22 bp, Artificial sequence
  SiRNA target sequence
tatagttggtctttttaattat

SEQ ID NO: 89187 - DNA, 22 bp, Artificial sequence
  SiRNA target sequence
atagttggtctttttaattata

SEQ ID NO: 89188 - DNA, 22 bp, Artificial sequence
  SiRNA target sequence
tagttggtctttttaattataa

SEQ ID NO: 89189 - DNA, 22 bp, Artificial sequence
  SiRNA target sequence
agttggtctttttaattataag

SEQ ID NO: 89190 - DNA, 22 bp, Artificial sequence
  SiRNA target sequence
gttggtctttttaattataagc

SEQ ID NO: 89191 - DNA, 22 bp, Artificial sequence
  SiRNA target sequence
ttggtctttttaattataagct

SEQ ID NO: 89192 - DNA, 22 bp, Artificial sequence
  SiRNA target sequence
tggtctttttaattataagctt

SEQ ID NO: 89193 - DNA, 22 bp, Artificial sequence
  SiRNA target sequence
ggtctttttaattataagctta

SEQ ID NO: 89194 - DNA, 22 bp, Artificial sequence
  SiRNA target sequence
gtctttttaattataagcttat

SEQ ID NO: 89195 - DNA, 22 bp, Artificial sequence
  SiRNA target sequence
tctttttaattataagcttatt

SEQ ID NO: 89196 - DNA, 22 bp, Artificial sequence
  SiRNA target sequence
ctttttaattataagcttattg

SEQ ID NO: 89197 - DNA, 22 bp, Artificial sequence
  SiRNA target sequence
tttttaattataagcttattga

SEQ ID NO: 89198 - DNA, 22 bp, Artificial sequence
  SiRNA target sequence
ttttaattataagcttattgaa

SEQ ID NO: 89199 - DNA, 22 bp, Artificial sequence
  SiRNA target sequence
tttaattataagcttattgaaa

SEQ ID NO: 89200 - DNA, 22 bp, Artificial sequence
  SiRNA target sequence
ttaattataagcttattgaaat

SEQ ID NO: 89201 - DNA, 22 bp, Artificial sequence
  SiRNA target sequence
taattataagcttattgaaatt

SEQ ID NO: 89202 - DNA, 22 bp, Artificial sequence
  SiRNA target sequence
aattataagcttattgaaattt

SEQ ID NO: 89203 - DNA, 22 bp, Artificial sequence
  SiRNA target sequence
attataagcttattgaaatttc

SEQ ID NO: 89204 - DNA, 22 bp, Artificial sequence
  SiRNA target sequence
ttataagcttattgaaatttct

SEQ ID NO: 89205 - DNA, 22 bp, Artificial sequence
  SiRNA target sequence
tataagcttattgaaatttcta

SEQ ID NO: 89206 - DNA, 22 bp, Artificial sequence
  SiRNA target sequence
ataagcttattgaaatttctaa

SEQ ID NO: 89207 - DNA, 22 bp, Artificial sequence
  SiRNA target sequence
taagcttattgaaatttctaat

SEQ ID NO: 89208 - DNA, 22 bp, Artificial sequence
  SiRNA target sequence
aagcttattgaaatttctaata

SEQ ID NO: 89209 - DNA, 22 bp, Artificial sequence
  SiRNA target sequence
agcttattgaaatttctaatat

SEQ ID NO: 89210 - DNA, 22 bp, Artificial sequence
  SiRNA target sequence
gcttattgaaatttctaatatt

SEQ ID NO: 89211 - DNA, 22 bp, Artificial sequence
  SiRNA target sequence
cttattgaaatttctaatattt

SEQ ID NO: 89212 - DNA, 22 bp, Artificial sequence
  SiRNA target sequence
ttattgaaatttctaatattta

SEQ ID NO: 89213 - DNA, 22 bp, Artificial sequence
  SiRNA target sequence
tattgaaatttctaatatttaa

SEQ ID NO: 89214 - DNA, 22 bp, Artificial sequence
  SiRNA target sequence
attgaaatttctaatatttaaa

SEQ ID NO: 89215 - DNA, 22 bp, Artificial sequence
  SiRNA target sequence
ttgaaatttctaatatttaaag

SEQ ID NO: 89216 - DNA, 22 bp, Artificial sequence
  SiRNA target sequence
tgaaatttctaatatttaaagg

SEQ ID NO: 89217 - DNA, 22 bp, Artificial sequence
  SiRNA target sequence
gaaatttctaatatttaaagga

SEQ ID NO: 89218 - DNA, 22 bp, Artificial sequence
  SiRNA target sequence
aaatttctaatatttaaaggaa

SEQ ID NO: 89219 - DNA, 22 bp, Artificial sequence
  SiRNA target sequence
aatttctaatatttaaaggaac

SEQ ID NO: 89220 - DNA, 22 bp, Artificial sequence
  SiRNA target sequence
atttctaatatttaaaggaaca

SEQ ID NO: 89221 - DNA, 22 bp, Artificial sequence
  SiRNA target sequence
tttctaatatttaaaggaacaa

SEQ ID NO: 89222 - DNA, 22 bp, Artificial sequence
  SiRNA target sequence
ttctaatatttaaaggaacaaa

SEQ ID NO: 89223 - DNA, 22 bp, Artificial sequence
  SiRNA target sequence
tctaatatttaaaggaacaaaa

SEQ ID NO: 89224 - DNA, 22 bp, Artificial sequence
  SiRNA target sequence
ctaatatttaaaggaacaaaat

SEQ ID NO: 89225 - DNA, 22 bp, Artificial sequence
  SiRNA target sequence
taatatttaaaggaacaaaatc

SEQ ID NO: 89226 - DNA, 22 bp, Artificial sequence
  SiRNA target sequence
aatatttaaaggaacaaaatct

SEQ ID NO: 89227 - DNA, 22 bp, Artificial sequence
  SiRNA target sequence
atatttaaaggaacaaaatcta

SEQ ID NO: 89228 - DNA, 22 bp, Artificial sequence
  SiRNA target sequence
tatttaaaggaacaaaatctac

SEQ ID NO: 89229 - DNA, 22 bp, Artificial sequence
  SiRNA target sequence
atttaaaggaacaaaatctaca

SEQ ID NO: 89230 - DNA, 22 bp, Artificial sequence
  SiRNA target sequence
tttaaaggaacaaaatctacat

SEQ ID NO: 89231 - DNA, 22 bp, Artificial sequence
  SiRNA target sequence
ttaaaggaacaaaatctacatt

SEQ ID NO: 89232 - DNA, 22 bp, Artificial sequence
  SiRNA target sequence
taaaggaacaaaatctacattt

SEQ ID NO: 89233 - DNA, 22 bp, Artificial sequence
  SiRNA target sequence
aaaggaacaaaatctacattta

SEQ ID NO: 89234 - DNA, 22 bp, Artificial sequence
  SiRNA target sequence
aaggaacaaaatctacatttag

SEQ ID NO: 89235 - DNA, 22 bp, Artificial sequence
  SiRNA target sequence
aggaacaaaatctacatttaga

SEQ ID NO: 89236 - DNA, 22 bp, Artificial sequence
  SiRNA target sequence
ggaacaaaatctacatttagat

SEQ ID NO: 89237 - DNA, 22 bp, Artificial sequence
  SiRNA target sequence
gaacaaaatctacatttagatt

SEQ ID NO: 89238 - DNA, 22 bp, Artificial sequence
  SiRNA target sequence
aacaaaatctacatttagatta

SEQ ID NO: 89239 - DNA, 22 bp, Artificial sequence
  SiRNA target sequence
acaaaatctacatttagattat

SEQ ID NO: 89240 - DNA, 22 bp, Artificial sequence
  SiRNA target sequence
caaaatctacatttagattata

SEQ ID NO: 89241 - DNA, 22 bp, Artificial sequence
  SiRNA target sequence
aaaatctacatttagattatat

SEQ ID NO: 89242 - DNA, 22 bp, Artificial sequence
  SiRNA target sequence
aaatctacatttagattatatt

SEQ ID NO: 89243 - DNA, 22 bp, Artificial sequence
  SiRNA target sequence
aatctacatttagattatattc

SEQ ID NO: 89244 - DNA, 22 bp, Artificial sequence
  SiRNA target sequence
atctacatttagattatattct

SEQ ID NO: 89245 - DNA, 22 bp, Artificial sequence
  SiRNA target sequence
tctacatttagattatattcta

SEQ ID NO: 89246 - DNA, 22 bp, Artificial sequence
  SiRNA target sequence
ctacatttagattatattctaa

SEQ ID NO: 89247 - DNA, 22 bp, Artificial sequence
  SiRNA target sequence
tacatttagattatattctaat

SEQ ID NO: 89248 - DNA, 22 bp, Artificial sequence
  SiRNA target sequence
acatttagattatattctaatt

SEQ ID NO: 89249 - DNA, 22 bp, Artificial sequence
  SiRNA target sequence
catttagattatattctaattt

SEQ ID NO: 89250 - DNA, 22 bp, Artificial sequence
  SiRNA target sequence
atttagattatattctaattta

SEQ ID NO: 89251 - DNA, 22 bp, Artificial sequence
  SiRNA target sequence
tttagattatattctaatttat

SEQ ID NO: 89252 - DNA, 22 bp, Artificial sequence
  SiRNA target sequence
ttagattatattctaatttatt

SEQ ID NO: 89253 - DNA, 22 bp, Artificial sequence
  SiRNA target sequence
tagattatattctaatttattg

SEQ ID NO: 89254 - DNA, 22 bp, Artificial sequence
  SiRNA target sequence
agattatattctaatttattga

SEQ ID NO: 89255 - DNA, 22 bp, Artificial sequence
  SiRNA target sequence
gattatattctaatttattgaa

SEQ ID NO: 89256 - DNA, 22 bp, Artificial sequence
  SiRNA target sequence
attatattctaatttattgaat

SEQ ID NO: 89257 - DNA, 22 bp, Artificial sequence
  SiRNA target sequence
ttatattctaatttattgaatt

SEQ ID NO: 89258 - DNA, 22 bp, Artificial sequence
  SiRNA target sequence
tatattctaatttattgaattt

SEQ ID NO: 89259 - DNA, 22 bp, Artificial sequence
  SiRNA target sequence
atattctaatttattgaatttc

SEQ ID NO: 89260 - DNA, 22 bp, Artificial sequence
  SiRNA target sequence
tattctaatttattgaatttca

SEQ ID NO: 89261 - DNA, 22 bp, Artificial sequence
  SiRNA target sequence
attctaatttattgaatttcat

SEQ ID NO: 89262 - DNA, 23 bp, Artificial sequence
  SiRNA target sequence
ttatatccaactatcaaaaaata

SEQ ID NO: 89263 - DNA, 23 bp, Artificial sequence
  SiRNA target sequence
tatatccaactatcaaaaaatag

SEQ ID NO: 89264 - DNA, 23 bp, Artificial sequence
  SiRNA target sequence
atatccaactatcaaaaaatagc

SEQ ID NO: 89265 - DNA, 23 bp, Artificial sequence
  SiRNA target sequence
tatccaactatcaaaaaatagcc

SEQ ID NO: 89266 - DNA, 23 bp, Artificial sequence
  SiRNA target sequence
atccaactatcaaaaaatagcct

SEQ ID NO: 89267 - DNA, 23 bp, Artificial sequence
  SiRNA target sequence
tccaactatcaaaaaatagcctc

SEQ ID NO: 89268 - DNA, 23 bp, Artificial sequence
  SiRNA target sequence
ccaactatcaaaaaatagcctct

SEQ ID NO: 89269 - DNA, 23 bp, Artificial sequence
  SiRNA target sequence
caactatcaaaaaatagcctctt

SEQ ID NO: 89270 - DNA, 23 bp, Artificial sequence
  SiRNA target sequence
aactatcaaaaaatagcctcttt

SEQ ID NO: 89271 - DNA, 23 bp, Artificial sequence
  SiRNA target sequence
actatcaaaaaatagcctctttt

SEQ ID NO: 89272 - DNA, 23 bp, Artificial sequence
  SiRNA target sequence
ctatcaaaaaatagcctcttttc

SEQ ID NO: 89273 - DNA, 23 bp, Artificial sequence
  SiRNA target sequence
tatcaaaaaatagcctcttttct

SEQ ID NO: 89274 - DNA, 23 bp, Artificial sequence
  SiRNA target sequence
atcaaaaaatagcctcttttctt

SEQ ID NO: 89275 - DNA, 23 bp, Artificial sequence
  SiRNA target sequence
tcaaaaaatagcctcttttcttt

SEQ ID NO: 89276 - DNA, 23 bp, Artificial sequence
  SiRNA target sequence
caaaaaatagcctcttttctttc

SEQ ID NO: 89277 - DNA, 23 bp, Artificial sequence
  SiRNA target sequence
aaaaaatagcctcttttctttca

SEQ ID NO: 89278 - DNA, 23 bp, Artificial sequence
  SiRNA target sequence
aaaaatagcctcttttctttcac

SEQ ID NO: 89279 - DNA, 23 bp, Artificial sequence
  SiRNA target sequence
aaaatagcctcttttctttcaca

SEQ ID NO: 89280 - DNA, 23 bp, Artificial sequence
  SiRNA target sequence
aaatagcctcttttctttcacaa

SEQ ID NO: 89281 - DNA, 23 bp, Artificial sequence
  SiRNA target sequence
aatagcctcttttctttcacaat

SEQ ID NO: 89282 - DNA, 23 bp, Artificial sequence
  SiRNA target sequence
atagcctcttttctttcacaatt

SEQ ID NO: 89283 - DNA, 23 bp, Artificial sequence
  SiRNA target sequence
tagcctcttttctttcacaattt

SEQ ID NO: 89284 - DNA, 23 bp, Artificial sequence
  SiRNA target sequence
agcctcttttctttcacaatttc

SEQ ID NO: 89285 - DNA, 23 bp, Artificial sequence
  SiRNA target sequence
gcctcttttctttcacaatttca

SEQ ID NO: 89286 - DNA, 23 bp, Artificial sequence
  SiRNA target sequence
cctcttttctttcacaatttcag

SEQ ID NO: 89287 - DNA, 23 bp, Artificial sequence
  SiRNA target sequence
ctcttttctttcacaatttcaga

SEQ ID NO: 89288 - DNA, 23 bp, Artificial sequence
  SiRNA target sequence
tcttttctttcacaatttcagaa

SEQ ID NO: 89289 - DNA, 23 bp, Artificial sequence
  SiRNA target sequence
cttttctttcacaatttcagaaa

SEQ ID NO: 89290 - DNA, 23 bp, Artificial sequence
  SiRNA target sequence
ttttctttcacaatttcagaaaa

SEQ ID NO: 89291 - DNA, 23 bp, Artificial sequence
  SiRNA target sequence
tttctttcacaatttcagaaaaa

SEQ ID NO: 89292 - DNA, 23 bp, Artificial sequence
  SiRNA target sequence
ttctttcacaatttcagaaaaat

SEQ ID NO: 89293 - DNA, 23 bp, Artificial sequence
  SiRNA target sequence
tctttcacaatttcagaaaaatt

SEQ ID NO: 89294 - DNA, 23 bp, Artificial sequence
  SiRNA target sequence
ctttcacaatttcagaaaaattt

SEQ ID NO: 89295 - DNA, 23 bp, Artificial sequence
  SiRNA target sequence
tttcacaatttcagaaaaatttt

SEQ ID NO: 89296 - DNA, 23 bp, Artificial sequence
  SiRNA target sequence
ttcacaatttcagaaaaattttc

SEQ ID NO: 89297 - DNA, 23 bp, Artificial sequence
  SiRNA target sequence
tcacaatttcagaaaaattttca

SEQ ID NO: 89298 - DNA, 23 bp, Artificial sequence
  SiRNA target sequence
cacaatttcagaaaaattttcat

SEQ ID NO: 89299 - DNA, 23 bp, Artificial sequence
  SiRNA target sequence
acaatttcagaaaaattttcatt

SEQ ID NO: 89300 - DNA, 23 bp, Artificial sequence
  SiRNA target sequence
caatttcagaaaaattttcatta

SEQ ID NO: 89301 - DNA, 23 bp, Artificial sequence
  SiRNA target sequence
aatttcagaaaaattttcattaa

SEQ ID NO: 89302 - DNA, 23 bp, Artificial sequence
  SiRNA target sequence
atttcagaaaaattttcattaaa

SEQ ID NO: 89303 - DNA, 23 bp, Artificial sequence
  SiRNA target sequence
tttcagaaaaattttcattaaaa

SEQ ID NO: 89304 - DNA, 23 bp, Artificial sequence
  SiRNA target sequence
ttcagaaaaattttcattaaaaa

SEQ ID NO: 89305 - DNA, 23 bp, Artificial sequence
  SiRNA target sequence
tcagaaaaattttcattaaaaat

SEQ ID NO: 89306 - DNA, 23 bp, Artificial sequence
  SiRNA target sequence
cagaaaaattttcattaaaaatg

SEQ ID NO: 89307 - DNA, 23 bp, Artificial sequence
  SiRNA target sequence
agaaaaattttcattaaaaatgc

SEQ ID NO: 89308 - DNA, 23 bp, Artificial sequence
  SiRNA target sequence
gaaaaattttcattaaaaatgct

SEQ ID NO: 89309 - DNA, 23 bp, Artificial sequence
  SiRNA target sequence
aaaaattttcattaaaaatgcta

SEQ ID NO: 89310 - DNA, 23 bp, Artificial sequence
  SiRNA target sequence
aaaattttcattaaaaatgctat

SEQ ID NO: 89311 - DNA, 23 bp, Artificial sequence
  SiRNA target sequence
aaattttcattaaaaatgctata

SEQ ID NO: 89312 - DNA, 23 bp, Artificial sequence
  SiRNA target sequence
aattttcattaaaaatgctataa

SEQ ID NO: 89313 - DNA, 23 bp, Artificial sequence
  SiRNA target sequence
attttcattaaaaatgctataaa

SEQ ID NO: 89314 - DNA, 23 bp, Artificial sequence
  SiRNA target sequence
ttttcattaaaaatgctataaat

SEQ ID NO: 89315 - DNA, 23 bp, Artificial sequence
  SiRNA target sequence
tttcattaaaaatgctataaata

SEQ ID NO: 89316 - DNA, 23 bp, Artificial sequence
  SiRNA target sequence
ttcattaaaaatgctataaatag

SEQ ID NO: 89317 - DNA, 23 bp, Artificial sequence
  SiRNA target sequence
tcattaaaaatgctataaatagt

SEQ ID NO: 89318 - DNA, 23 bp, Artificial sequence
  SiRNA target sequence
cattaaaaatgctataaatagtt

SEQ ID NO: 89319 - DNA, 23 bp, Artificial sequence
  SiRNA target sequence
attaaaaatgctataaatagttt

SEQ ID NO: 89320 - DNA, 23 bp, Artificial sequence
  SiRNA target sequence
ttaaaaatgctataaatagtttt

SEQ ID NO: 89321 - DNA, 23 bp, Artificial sequence
  SiRNA target sequence
taaaaatgctataaatagttttt

SEQ ID NO: 89322 - DNA, 23 bp, Artificial sequence
  SiRNA target sequence
aaaaatgctataaatagtttttt

SEQ ID NO: 89323 - DNA, 23 bp, Artificial sequence
  SiRNA target sequence
aaaatgctataaatagttttttg

SEQ ID NO: 89324 - DNA, 23 bp, Artificial sequence
  SiRNA target sequence
aaatgctataaatagttttttgc

SEQ ID NO: 89325 - DNA, 23 bp, Artificial sequence
  SiRNA target sequence
aatgctataaatagttttttgca

SEQ ID NO: 89326 - DNA, 23 bp, Artificial sequence
  SiRNA target sequence
atgctataaatagttttttgcat

SEQ ID NO: 89327 - DNA, 23 bp, Artificial sequence
  SiRNA target sequence
tgctataaatagttttttgcata

SEQ ID NO: 89328 - DNA, 23 bp, Artificial sequence
  SiRNA target sequence
gctataaatagttttttgcatat

SEQ ID NO: 89329 - DNA, 23 bp, Artificial sequence
  SiRNA target sequence
ctataaatagttttttgcatatc

SEQ ID NO: 89330 - DNA, 23 bp, Artificial sequence
  SiRNA target sequence
tataaatagttttttgcatatca

SEQ ID NO: 89331 - DNA, 23 bp, Artificial sequence
  SiRNA target sequence
ataaatagttttttgcatatcag

SEQ ID NO: 89332 - DNA, 23 bp, Artificial sequence
  SiRNA target sequence
taaatagttttttgcatatcagg

SEQ ID NO: 89333 - DNA, 23 bp, Artificial sequence
  SiRNA target sequence
aaatagttttttgcatatcaggt

SEQ ID NO: 89334 - DNA, 23 bp, Artificial sequence
  SiRNA target sequence
aatagttttttgcatatcaggtc

SEQ ID NO: 89335 - DNA, 23 bp, Artificial sequence
  SiRNA target sequence
atagttttttgcatatcaggtcg

SEQ ID NO: 89336 - DNA, 23 bp, Artificial sequence
  SiRNA target sequence
tagttttttgcatatcaggtcgg

SEQ ID NO: 89337 - DNA, 23 bp, Artificial sequence
  SiRNA target sequence
agttttttgcatatcaggtcggc

SEQ ID NO: 89338 - DNA, 23 bp, Artificial sequence
  SiRNA target sequence
gttttttgcatatcaggtcggcc

SEQ ID NO: 89339 - DNA, 23 bp, Artificial sequence
  SiRNA target sequence
ttttttgcatatcaggtcggcca

SEQ ID NO: 89340 - DNA, 23 bp, Artificial sequence
  SiRNA target sequence
tttttgcatatcaggtcggccac

SEQ ID NO: 89341 - DNA, 23 bp, Artificial sequence
  SiRNA target sequence
ttttgcatatcaggtcggccaca

SEQ ID NO: 89342 - DNA, 23 bp, Artificial sequence
  SiRNA target sequence
tttgcatatcaggtcggccacaa

SEQ ID NO: 89343 - DNA, 23 bp, Artificial sequence
  SiRNA target sequence
ttgcatatcaggtcggccacaaa

SEQ ID NO: 89344 - DNA, 23 bp, Artificial sequence
  SiRNA target sequence
tgcatatcaggtcggccacaaac

SEQ ID NO: 89345 - DNA, 23 bp, Artificial sequence
  SiRNA target sequence
gcatatcaggtcggccacaaaca

SEQ ID NO: 89346 - DNA, 23 bp, Artificial sequence
  SiRNA target sequence
catatcaggtcggccacaaacat

SEQ ID NO: 89347 - DNA, 23 bp, Artificial sequence
  SiRNA target sequence
atatcaggtcggccacaaacata

SEQ ID NO: 89348 - DNA, 23 bp, Artificial sequence
  SiRNA target sequence
tatcaggtcggccacaaacataa

SEQ ID NO: 89349 - DNA, 23 bp, Artificial sequence
  SiRNA target sequence
atcaggtcggccacaaacataaa

SEQ ID NO: 89350 - DNA, 23 bp, Artificial sequence
  SiRNA target sequence
tcaggtcggccacaaacataaac

SEQ ID NO: 89351 - DNA, 23 bp, Artificial sequence
  SiRNA target sequence
caggtcggccacaaacataaacc

SEQ ID NO: 89352 - DNA, 23 bp, Artificial sequence
  SiRNA target sequence
aggtcggccacaaacataaacca

SEQ ID NO: 89353 - DNA, 23 bp, Artificial sequence
  SiRNA target sequence
ggtcggccacaaacataaaccaa

SEQ ID NO: 89354 - DNA, 23 bp, Artificial sequence
  SiRNA target sequence
gtcggccacaaacataaaccaaa

SEQ ID NO: 89355 - DNA, 23 bp, Artificial sequence
  SiRNA target sequence
tcggccacaaacataaaccaaac

SEQ ID NO: 89356 - DNA, 23 bp, Artificial sequence
  SiRNA target sequence
cggccacaaacataaaccaaaca

SEQ ID NO: 89357 - DNA, 23 bp, Artificial sequence
  SiRNA target sequence
ggccacaaacataaaccaaacat

SEQ ID NO: 89358 - DNA, 23 bp, Artificial sequence
  SiRNA target sequence
gccacaaacataaaccaaacatc

SEQ ID NO: 89359 - DNA, 23 bp, Artificial sequence
  SiRNA target sequence
ccacaaacataaaccaaacatcc

SEQ ID NO: 89360 - DNA, 23 bp, Artificial sequence
  SiRNA target sequence
cacaaacataaaccaaacatccg

SEQ ID NO: 89361 - DNA, 23 bp, Artificial sequence
  SiRNA target sequence
acaaacataaaccaaacatccgt

SEQ ID NO: 89362 - DNA, 23 bp, Artificial sequence
  SiRNA target sequence
caaacataaaccaaacatccgtc

SEQ ID NO: 89363 - DNA, 23 bp, Artificial sequence
  SiRNA target sequence
aaacataaaccaaacatccgtct

SEQ ID NO: 89364 - DNA, 23 bp, Artificial sequence
  SiRNA target sequence
aacataaaccaaacatccgtctt

SEQ ID NO: 89365 - DNA, 23 bp, Artificial sequence
  SiRNA target sequence
acataaaccaaacatccgtcttt

SEQ ID NO: 89366 - DNA, 23 bp, Artificial sequence
  SiRNA target sequence
cataaaccaaacatccgtcttta

SEQ ID NO: 89367 - DNA, 23 bp, Artificial sequence
  SiRNA target sequence
ataaaccaaacatccgtctttaa

SEQ ID NO: 89368 - DNA, 23 bp, Artificial sequence
  SiRNA target sequence
taaaccaaacatccgtctttaat

SEQ ID NO: 89369 - DNA, 23 bp, Artificial sequence
  SiRNA target sequence
aaaccaaacatccgtctttaatg

SEQ ID NO: 89370 - DNA, 23 bp, Artificial sequence
  SiRNA target sequence
aaccaaacatccgtctttaatgt

SEQ ID NO: 89371 - DNA, 23 bp, Artificial sequence
  SiRNA target sequence
accaaacatccgtctttaatgta

SEQ ID NO: 89372 - DNA, 23 bp, Artificial sequence
  SiRNA target sequence
ccaaacatccgtctttaatgtat

SEQ ID NO: 89373 - DNA, 23 bp, Artificial sequence
  SiRNA target sequence
caaacatccgtctttaatgtatg

SEQ ID NO: 89374 - DNA, 23 bp, Artificial sequence
  SiRNA target sequence
aaacatccgtctttaatgtatgt

SEQ ID NO: 89375 - DNA, 23 bp, Artificial sequence
  SiRNA target sequence
aacatccgtctttaatgtatgtt

SEQ ID NO: 89376 - DNA, 23 bp, Artificial sequence
  SiRNA target sequence
acatccgtctttaatgtatgttt

SEQ ID NO: 89377 - DNA, 23 bp, Artificial sequence
  SiRNA target sequence
catccgtctttaatgtatgtttt

SEQ ID NO: 89378 - DNA, 23 bp, Artificial sequence
  SiRNA target sequence
atccgtctttaatgtatgttttt

SEQ ID NO: 89379 - DNA, 23 bp, Artificial sequence
  SiRNA target sequence
tccgtctttaatgtatgttttta

SEQ ID NO: 89380 - DNA, 23 bp, Artificial sequence
  SiRNA target sequence
ccgtctttaatgtatgtttttat

SEQ ID NO: 89381 - DNA, 23 bp, Artificial sequence
  SiRNA target sequence
cgtctttaatgtatgtttttatc

SEQ ID NO: 89382 - DNA, 23 bp, Artificial sequence
  SiRNA target sequence
gtctttaatgtatgtttttatct

SEQ ID NO: 89383 - DNA, 23 bp, Artificial sequence
  SiRNA target sequence
tctttaatgtatgtttttatctc

SEQ ID NO: 89384 - DNA, 23 bp, Artificial sequence
  SiRNA target sequence
ctttaatgtatgtttttatctca

SEQ ID NO: 89385 - DNA, 23 bp, Artificial sequence
  SiRNA target sequence
tttaatgtatgtttttatctcat

SEQ ID NO: 89386 - DNA, 23 bp, Artificial sequence
  SiRNA target sequence
ttaatgtatgtttttatctcatt

SEQ ID NO: 89387 - DNA, 23 bp, Artificial sequence
  SiRNA target sequence
taatgtatgtttttatctcattt

SEQ ID NO: 89388 - DNA, 23 bp, Artificial sequence
  SiRNA target sequence
aatgtatgtttttatctcattta

SEQ ID NO: 89389 - DNA, 23 bp, Artificial sequence
  SiRNA target sequence
atgtatgtttttatctcatttaa

SEQ ID NO: 89390 - DNA, 23 bp, Artificial sequence
  SiRNA target sequence
tgtatgtttttatctcatttaaa

SEQ ID NO: 89391 - DNA, 23 bp, Artificial sequence
  SiRNA target sequence
gtatgtttttatctcatttaaat

SEQ ID NO: 89392 - DNA, 23 bp, Artificial sequence
  SiRNA target sequence
tatgtttttatctcatttaaatt

SEQ ID NO: 89393 - DNA, 23 bp, Artificial sequence
  SiRNA target sequence
atgtttttatctcatttaaattt

SEQ ID NO: 89394 - DNA, 23 bp, Artificial sequence
  SiRNA target sequence
tgtttttatctcatttaaatttt

SEQ ID NO: 89395 - DNA, 23 bp, Artificial sequence
  SiRNA target sequence
gtttttatctcatttaaattttg

SEQ ID NO: 89396 - DNA, 23 bp, Artificial sequence
  SiRNA target sequence
tttttatctcatttaaattttgt

SEQ ID NO: 89397 - DNA, 23 bp, Artificial sequence
  SiRNA target sequence
ttttatctcatttaaattttgta

SEQ ID NO: 89398 - DNA, 23 bp, Artificial sequence
  SiRNA target sequence
tttatctcatttaaattttgtaa

SEQ ID NO: 89399 - DNA, 23 bp, Artificial sequence
  SiRNA target sequence
ttatctcatttaaattttgtaat

SEQ ID NO: 89400 - DNA, 23 bp, Artificial sequence
  SiRNA target sequence
tatctcatttaaattttgtaata

SEQ ID NO: 89401 - DNA, 23 bp, Artificial sequence
  SiRNA target sequence
atctcatttaaattttgtaataa

SEQ ID NO: 89402 - DNA, 23 bp, Artificial sequence
  SiRNA target sequence
tctcatttaaattttgtaataaa

SEQ ID NO: 89403 - DNA, 23 bp, Artificial sequence
  SiRNA target sequence
ctcatttaaattttgtaataaat

SEQ ID NO: 89404 - DNA, 23 bp, Artificial sequence
  SiRNA target sequence
tcatttaaattttgtaataaata

SEQ ID NO: 89405 - DNA, 23 bp, Artificial sequence
  SiRNA target sequence
catttaaattttgtaataaataa

SEQ ID NO: 89406 - DNA, 23 bp, Artificial sequence
  SiRNA target sequence
atttaaattttgtaataaataat

SEQ ID NO: 89407 - DNA, 23 bp, Artificial sequence
  SiRNA target sequence
tttaaattttgtaataaataatc

SEQ ID NO: 89408 - DNA, 23 bp, Artificial sequence
  SiRNA target sequence
ttaaattttgtaataaataatca

SEQ ID NO: 89409 - DNA, 23 bp, Artificial sequence
  SiRNA target sequence
taaattttgtaataaataatcag

SEQ ID NO: 89410 - DNA, 23 bp, Artificial sequence
  SiRNA target sequence
aaattttgtaataaataatcagt

SEQ ID NO: 89411 - DNA, 23 bp, Artificial sequence
  SiRNA target sequence
aattttgtaataaataatcagta

SEQ ID NO: 89412 - DNA, 23 bp, Artificial sequence
  SiRNA target sequence
attttgtaataaataatcagtaa

SEQ ID NO: 89413 - DNA, 23 bp, Artificial sequence
  SiRNA target sequence
ttttgtaataaataatcagtaac

SEQ ID NO: 89414 - DNA, 23 bp, Artificial sequence
  SiRNA target sequence
tttgtaataaataatcagtaaca

SEQ ID NO: 89415 - DNA, 23 bp, Artificial sequence
  SiRNA target sequence
ttgtaataaataatcagtaacat

SEQ ID NO: 89416 - DNA, 23 bp, Artificial sequence
  SiRNA target sequence
tgtaataaataatcagtaacata

SEQ ID NO: 89417 - DNA, 23 bp, Artificial sequence
  SiRNA target sequence
gtaataaataatcagtaacataa

SEQ ID NO: 89418 - DNA, 23 bp, Artificial sequence
  SiRNA target sequence
taataaataatcagtaacataaa

SEQ ID NO: 89419 - DNA, 23 bp, Artificial sequence
  SiRNA target sequence
aataaataatcagtaacataaat

SEQ ID NO: 89420 - DNA, 23 bp, Artificial sequence
  SiRNA target sequence
ataaataatcagtaacataaatt

SEQ ID NO: 89421 - DNA, 23 bp, Artificial sequence
  SiRNA target sequence
taaataatcagtaacataaattt

SEQ ID NO: 89422 - DNA, 23 bp, Artificial sequence
  SiRNA target sequence
aaataatcagtaacataaatttt

SEQ ID NO: 89423 - DNA, 23 bp, Artificial sequence
  SiRNA target sequence
aataatcagtaacataaatttta

SEQ ID NO: 89424 - DNA, 23 bp, Artificial sequence
  SiRNA target sequence
ataatcagtaacataaattttat

SEQ ID NO: 89425 - DNA, 23 bp, Artificial sequence
  SiRNA target sequence
taatcagtaacataaattttatt

SEQ ID NO: 89426 - DNA, 23 bp, Artificial sequence
  SiRNA target sequence
aatcagtaacataaattttatta

SEQ ID NO: 89427 - DNA, 23 bp, Artificial sequence
  SiRNA target sequence
atcagtaacataaattttattac

SEQ ID NO: 89428 - DNA, 23 bp, Artificial sequence
  SiRNA target sequence
tcagtaacataaattttattaca

SEQ ID NO: 89429 - DNA, 23 bp, Artificial sequence
  SiRNA target sequence
cagtaacataaattttattacaa

SEQ ID NO: 89430 - DNA, 23 bp, Artificial sequence
  SiRNA target sequence
agtaacataaattttattacaag

SEQ ID NO: 89431 - DNA, 23 bp, Artificial sequence
  SiRNA target sequence
gtaacataaattttattacaaga

SEQ ID NO: 89432 - DNA, 23 bp, Artificial sequence
  SiRNA target sequence
taacataaattttattacaagat

SEQ ID NO: 89433 - DNA, 23 bp, Artificial sequence
  SiRNA target sequence
aacataaattttattacaagata

SEQ ID NO: 89434 - DNA, 23 bp, Artificial sequence
  SiRNA target sequence
acataaattttattacaagataa

SEQ ID NO: 89435 - DNA, 23 bp, Artificial sequence
  SiRNA target sequence
cataaattttattacaagataaa

SEQ ID NO: 89436 - DNA, 23 bp, Artificial sequence
  SiRNA target sequence
ataaattttattacaagataaaa

SEQ ID NO: 89437 - DNA, 23 bp, Artificial sequence
  SiRNA target sequence
taaattttattacaagataaaat

SEQ ID NO: 89438 - DNA, 23 bp, Artificial sequence
  SiRNA target sequence
aaattttattacaagataaaatt

SEQ ID NO: 89439 - DNA, 23 bp, Artificial sequence
  SiRNA target sequence
aattttattacaagataaaattt

SEQ ID NO: 89440 - DNA, 23 bp, Artificial sequence
  SiRNA target sequence
attttattacaagataaaatttt

SEQ ID NO: 89441 - DNA, 23 bp, Artificial sequence
  SiRNA target sequence
ttttattacaagataaaatttta

SEQ ID NO: 89442 - DNA, 23 bp, Artificial sequence
  SiRNA target sequence
tttattacaagataaaattttaa

SEQ ID NO: 89443 - DNA, 23 bp, Artificial sequence
  SiRNA target sequence
ttattacaagataaaattttaat

SEQ ID NO: 89444 - DNA, 23 bp, Artificial sequence
  SiRNA target sequence
tattacaagataaaattttaata

SEQ ID NO: 89445 - DNA, 23 bp, Artificial sequence
  SiRNA target sequence
attacaagataaaattttaataa

SEQ ID NO: 89446 - DNA, 23 bp, Artificial sequence
  SiRNA target sequence
ttacaagataaaattttaataat

SEQ ID NO: 89447 - DNA, 23 bp, Artificial sequence
  SiRNA target sequence
tacaagataaaattttaataatt

SEQ ID NO: 89448 - DNA, 23 bp, Artificial sequence
  SiRNA target sequence
acaagataaaattttaataattt

SEQ ID NO: 89449 - DNA, 23 bp, Artificial sequence
  SiRNA target sequence
caagataaaattttaataatttc

SEQ ID NO: 89450 - DNA, 23 bp, Artificial sequence
  SiRNA target sequence
aagataaaattttaataatttct

SEQ ID NO: 89451 - DNA, 23 bp, Artificial sequence
  SiRNA target sequence
agataaaattttaataatttctg

SEQ ID NO: 89452 - DNA, 23 bp, Artificial sequence
  SiRNA target sequence
gataaaattttaataatttctgt

SEQ ID NO: 89453 - DNA, 23 bp, Artificial sequence
  SiRNA target sequence
ataaaattttaataatttctgtg

SEQ ID NO: 89454 - DNA, 23 bp, Artificial sequence
  SiRNA target sequence
taaaattttaataatttctgtgt

SEQ ID NO: 89455 - DNA, 23 bp, Artificial sequence
  SiRNA target sequence
aaaattttaataatttctgtgtt

SEQ ID NO: 89456 - DNA, 23 bp, Artificial sequence
  SiRNA target sequence
aaattttaataatttctgtgttt

SEQ ID NO: 89457 - DNA, 23 bp, Artificial sequence
  SiRNA target sequence
aattttaataatttctgtgtttt

SEQ ID NO: 89458 - DNA, 23 bp, Artificial sequence
  SiRNA target sequence
attttaataatttctgtgttttt

SEQ ID NO: 89459 - DNA, 23 bp, Artificial sequence
  SiRNA target sequence
ttttaataatttctgtgttttta

SEQ ID NO: 89460 - DNA, 23 bp, Artificial sequence
  SiRNA target sequence
tttaataatttctgtgtttttat

SEQ ID NO: 89461 - DNA, 23 bp, Artificial sequence
  SiRNA target sequence
ttaataatttctgtgtttttata

SEQ ID NO: 89462 - DNA, 23 bp, Artificial sequence
  SiRNA target sequence
taataatttctgtgtttttatat

SEQ ID NO: 89463 - DNA, 23 bp, Artificial sequence
  SiRNA target sequence
aataatttctgtgtttttatatt

SEQ ID NO: 89464 - DNA, 23 bp, Artificial sequence
  SiRNA target sequence
ataatttctgtgtttttatattt

SEQ ID NO: 89465 - DNA, 23 bp, Artificial sequence
  SiRNA target sequence
taatttctgtgtttttatatttt

SEQ ID NO: 89466 - DNA, 23 bp, Artificial sequence
  SiRNA target sequence
aatttctgtgtttttatattttg

SEQ ID NO: 89467 - DNA, 23 bp, Artificial sequence
  SiRNA target sequence
atttctgtgtttttatattttgc

SEQ ID NO: 89468 - DNA, 23 bp, Artificial sequence
  SiRNA target sequence
tttctgtgtttttatattttgca

SEQ ID NO: 89469 - DNA, 23 bp, Artificial sequence
  SiRNA target sequence
ttctgtgtttttatattttgcat

SEQ ID NO: 89470 - DNA, 23 bp, Artificial sequence
  SiRNA target sequence
tctgtgtttttatattttgcatc

SEQ ID NO: 89471 - DNA, 23 bp, Artificial sequence
  SiRNA target sequence
ctgtgtttttatattttgcatct

SEQ ID NO: 89472 - DNA, 23 bp, Artificial sequence
  SiRNA target sequence
tgtgtttttatattttgcatctt

SEQ ID NO: 89473 - DNA, 23 bp, Artificial sequence
  SiRNA target sequence
gtgtttttatattttgcatcttt

SEQ ID NO: 89474 - DNA, 23 bp, Artificial sequence
  SiRNA target sequence
tgtttttatattttgcatcttta

SEQ ID NO: 89475 - DNA, 23 bp, Artificial sequence
  SiRNA target sequence
gtttttatattttgcatctttaa

SEQ ID NO: 89476 - DNA, 23 bp, Artificial sequence
  SiRNA target sequence
tttttatattttgcatctttaat

SEQ ID NO: 89477 - DNA, 23 bp, Artificial sequence
  SiRNA target sequence
ttttatattttgcatctttaata

SEQ ID NO: 89478 - DNA, 23 bp, Artificial sequence
  SiRNA target sequence
tttatattttgcatctttaataa

SEQ ID NO: 89479 - DNA, 23 bp, Artificial sequence
  SiRNA target sequence
ttatattttgcatctttaataag

SEQ ID NO: 89480 - DNA, 23 bp, Artificial sequence
  SiRNA target sequence
tatattttgcatctttaataaga

SEQ ID NO: 89481 - DNA, 23 bp, Artificial sequence
  SiRNA target sequence
atattttgcatctttaataagat

SEQ ID NO: 89482 - DNA, 23 bp, Artificial sequence
  SiRNA target sequence
tattttgcatctttaataagatc

SEQ ID NO: 89483 - DNA, 23 bp, Artificial sequence
  SiRNA target sequence
attttgcatctttaataagatca

SEQ ID NO: 89484 - DNA, 23 bp, Artificial sequence
  SiRNA target sequence
ttttgcatctttaataagatcat

SEQ ID NO: 89485 - DNA, 23 bp, Artificial sequence
  SiRNA target sequence
tttgcatctttaataagatcatc

SEQ ID NO: 89486 - DNA, 23 bp, Artificial sequence
  SiRNA target sequence
ttgcatctttaataagatcatct

SEQ ID NO: 89487 - DNA, 23 bp, Artificial sequence
  SiRNA target sequence
tgcatctttaataagatcatctt

SEQ ID NO: 89488 - DNA, 23 bp, Artificial sequence
  SiRNA target sequence
gcatctttaataagatcatcttc

SEQ ID NO: 89489 - DNA, 23 bp, Artificial sequence
  SiRNA target sequence
catctttaataagatcatcttct

SEQ ID NO: 89490 - DNA, 23 bp, Artificial sequence
  SiRNA target sequence
atctttaataagatcatcttctt

SEQ ID NO: 89491 - DNA, 23 bp, Artificial sequence
  SiRNA target sequence
tctttaataagatcatcttcttg

SEQ ID NO: 89492 - DNA, 23 bp, Artificial sequence
  SiRNA target sequence
ctttaataagatcatcttcttga

SEQ ID NO: 89493 - DNA, 23 bp, Artificial sequence
  SiRNA target sequence
tttaataagatcatcttcttgat

SEQ ID NO: 89494 - DNA, 23 bp, Artificial sequence
  SiRNA target sequence
ttaataagatcatcttcttgatt

SEQ ID NO: 89495 - DNA, 23 bp, Artificial sequence
  SiRNA target sequence
taataagatcatcttcttgattt

SEQ ID NO: 89496 - DNA, 23 bp, Artificial sequence
  SiRNA target sequence
aataagatcatcttcttgatttc

SEQ ID NO: 89497 - DNA, 23 bp, Artificial sequence
  SiRNA target sequence
ataagatcatcttcttgatttct

SEQ ID NO: 89498 - DNA, 23 bp, Artificial sequence
  SiRNA target sequence
taagatcatcttcttgatttcta

SEQ ID NO: 89499 - DNA, 23 bp, Artificial sequence
  SiRNA target sequence
aagatcatcttcttgatttctaa

SEQ ID NO: 89500 - DNA, 23 bp, Artificial sequence
  SiRNA target sequence
agatcatcttcttgatttctaaa

SEQ ID NO: 89501 - DNA, 23 bp, Artificial sequence
  SiRNA target sequence
gatcatcttcttgatttctaaat

SEQ ID NO: 89502 - DNA, 23 bp, Artificial sequence
  SiRNA target sequence
atcatcttcttgatttctaaatc

SEQ ID NO: 89503 - DNA, 23 bp, Artificial sequence
  SiRNA target sequence
tcatcttcttgatttctaaatcc

SEQ ID NO: 89504 - DNA, 23 bp, Artificial sequence
  SiRNA target sequence
catcttcttgatttctaaatcca

SEQ ID NO: 89505 - DNA, 23 bp, Artificial sequence
  SiRNA target sequence
atcttcttgatttctaaatccat

SEQ ID NO: 89506 - DNA, 23 bp, Artificial sequence
  SiRNA target sequence
tcttcttgatttctaaatccata

SEQ ID NO: 89507 - DNA, 23 bp, Artificial sequence
  SiRNA target sequence
cttcttgatttctaaatccatat

SEQ ID NO: 89508 - DNA, 23 bp, Artificial sequence
  SiRNA target sequence
ttcttgatttctaaatccatata

SEQ ID NO: 89509 - DNA, 23 bp, Artificial sequence
  SiRNA target sequence
tcttgatttctaaatccatatat

SEQ ID NO: 89510 - DNA, 23 bp, Artificial sequence
  SiRNA target sequence
cttgatttctaaatccatatatt

SEQ ID NO: 89511 - DNA, 23 bp, Artificial sequence
  SiRNA target sequence
ttgatttctaaatccatatatta

SEQ ID NO: 89512 - DNA, 23 bp, Artificial sequence
  SiRNA target sequence
tgatttctaaatccatatattag

SEQ ID NO: 89513 - DNA, 23 bp, Artificial sequence
  SiRNA target sequence
gatttctaaatccatatattagt

SEQ ID NO: 89514 - DNA, 23 bp, Artificial sequence
  SiRNA target sequence
atttctaaatccatatattagtt

SEQ ID NO: 89515 - DNA, 23 bp, Artificial sequence
  SiRNA target sequence
tttctaaatccatatattagttt

SEQ ID NO: 89516 - DNA, 23 bp, Artificial sequence
  SiRNA target sequence
ttctaaatccatatattagtttg

SEQ ID NO: 89517 - DNA, 23 bp, Artificial sequence
  SiRNA target sequence
tctaaatccatatattagtttga

SEQ ID NO: 89518 - DNA, 23 bp, Artificial sequence
  SiRNA target sequence
ctaaatccatatattagtttgat

SEQ ID NO: 89519 - DNA, 23 bp, Artificial sequence
  SiRNA target sequence
taaatccatatattagtttgata

SEQ ID NO: 89520 - DNA, 23 bp, Artificial sequence
  SiRNA target sequence
aaatccatatattagtttgatat

SEQ ID NO: 89521 - DNA, 23 bp, Artificial sequence
  SiRNA target sequence
aatccatatattagtttgatata

SEQ ID NO: 89522 - DNA, 23 bp, Artificial sequence
  SiRNA target sequence
atccatatattagtttgatatat

SEQ ID NO: 89523 - DNA, 23 bp, Artificial sequence
  SiRNA target sequence
tccatatattagtttgatatatt

SEQ ID NO: 89524 - DNA, 23 bp, Artificial sequence
  SiRNA target sequence
ccatatattagtttgatatattg

SEQ ID NO: 89525 - DNA, 23 bp, Artificial sequence
  SiRNA target sequence
catatattagtttgatatattga

SEQ ID NO: 89526 - DNA, 23 bp, Artificial sequence
  SiRNA target sequence
atatattagtttgatatattgat

SEQ ID NO: 89527 - DNA, 23 bp, Artificial sequence
  SiRNA target sequence
tatattagtttgatatattgatc

SEQ ID NO: 89528 - DNA, 23 bp, Artificial sequence
  SiRNA target sequence
atattagtttgatatattgatcg

SEQ ID NO: 89529 - DNA, 23 bp, Artificial sequence
  SiRNA target sequence
tattagtttgatatattgatcgt

SEQ ID NO: 89530 - DNA, 23 bp, Artificial sequence
  SiRNA target sequence
attagtttgatatattgatcgtc

SEQ ID NO: 89531 - DNA, 23 bp, Artificial sequence
  SiRNA target sequence
ttagtttgatatattgatcgtct

SEQ ID NO: 89532 - DNA, 23 bp, Artificial sequence
  SiRNA target sequence
tagtttgatatattgatcgtctt

SEQ ID NO: 89533 - DNA, 23 bp, Artificial sequence
  SiRNA target sequence
agtttgatatattgatcgtcttc

SEQ ID NO: 89534 - DNA, 23 bp, Artificial sequence
  SiRNA target sequence
gtttgatatattgatcgtcttct

SEQ ID NO: 89535 - DNA, 23 bp, Artificial sequence
  SiRNA target sequence
tttgatatattgatcgtcttctt

SEQ ID NO: 89536 - DNA, 23 bp, Artificial sequence
  SiRNA target sequence
ttgatatattgatcgtcttcttt

SEQ ID NO: 89537 - DNA, 23 bp, Artificial sequence
  SiRNA target sequence
tgatatattgatcgtcttcttta

SEQ ID NO: 89538 - DNA, 23 bp, Artificial sequence
  SiRNA target sequence
gatatattgatcgtcttctttat

SEQ ID NO: 89539 - DNA, 23 bp, Artificial sequence
  SiRNA target sequence
atatattgatcgtcttctttatt

SEQ ID NO: 89540 - DNA, 23 bp, Artificial sequence
  SiRNA target sequence
tatattgatcgtcttctttattt

SEQ ID NO: 89541 - DNA, 23 bp, Artificial sequence
  SiRNA target sequence
atattgatcgtcttctttatttt

SEQ ID NO: 89542 - DNA, 23 bp, Artificial sequence
  SiRNA target sequence
tattgatcgtcttctttattttt

SEQ ID NO: 89543 - DNA, 23 bp, Artificial sequence
  SiRNA target sequence
attgatcgtcttctttatttttc

SEQ ID NO: 89544 - DNA, 23 bp, Artificial sequence
  SiRNA target sequence
ttgatcgtcttctttatttttca

SEQ ID NO: 89545 - DNA, 23 bp, Artificial sequence
  SiRNA target sequence
tgatcgtcttctttatttttcaa

SEQ ID NO: 89546 - DNA, 23 bp, Artificial sequence
  SiRNA target sequence
gatcgtcttctttatttttcaaa

SEQ ID NO: 89547 - DNA, 23 bp, Artificial sequence
  SiRNA target sequence
atcgtcttctttatttttcaaaa

SEQ ID NO: 89548 - DNA, 23 bp, Artificial sequence
  SiRNA target sequence
tcgtcttctttatttttcaaaaa

SEQ ID NO: 89549 - DNA, 23 bp, Artificial sequence
  SiRNA target sequence
cgtcttctttatttttcaaaaac

SEQ ID NO: 89550 - DNA, 23 bp, Artificial sequence
  SiRNA target sequence
gtcttctttatttttcaaaaacg

SEQ ID NO: 89551 - DNA, 23 bp, Artificial sequence
  SiRNA target sequence
tcttctttatttttcaaaaacga

SEQ ID NO: 89552 - DNA, 23 bp, Artificial sequence
  SiRNA target sequence
cttctttatttttcaaaaacgaa

SEQ ID NO: 89553 - DNA, 23 bp, Artificial sequence
  SiRNA target sequence
ttctttatttttcaaaaacgaaa

SEQ ID NO: 89554 - DNA, 23 bp, Artificial sequence
  SiRNA target sequence
tctttatttttcaaaaacgaaaa

SEQ ID NO: 89555 - DNA, 23 bp, Artificial sequence
  SiRNA target sequence
ctttatttttcaaaaacgaaaaa

SEQ ID NO: 89556 - DNA, 23 bp, Artificial sequence
  SiRNA target sequence
tttatttttcaaaaacgaaaaaa

SEQ ID NO: 89557 - DNA, 23 bp, Artificial sequence
  SiRNA target sequence
ttatttttcaaaaacgaaaaaaa

SEQ ID NO: 89558 - DNA, 23 bp, Artificial sequence
  SiRNA target sequence
tatttttcaaaaacgaaaaaaat

SEQ ID NO: 89559 - DNA, 23 bp, Artificial sequence
  SiRNA target sequence
atttttcaaaaacgaaaaaaatg

SEQ ID NO: 89560 - DNA, 23 bp, Artificial sequence
  SiRNA target sequence
tttttcaaaaacgaaaaaaatgg

SEQ ID NO: 89561 - DNA, 23 bp, Artificial sequence
  SiRNA target sequence
ttttcaaaaacgaaaaaaatgga

SEQ ID NO: 89562 - DNA, 23 bp, Artificial sequence
  SiRNA target sequence
tttcaaaaacgaaaaaaatggag

SEQ ID NO: 89563 - DNA, 23 bp, Artificial sequence
  SiRNA target sequence
ttcaaaaacgaaaaaaatggagc

SEQ ID NO: 89564 - DNA, 23 bp, Artificial sequence
  SiRNA target sequence
tcaaaaacgaaaaaaatggagca

SEQ ID NO: 89565 - DNA, 23 bp, Artificial sequence
  SiRNA target sequence
caaaaacgaaaaaaatggagcaa

SEQ ID NO: 89566 - DNA, 23 bp, Artificial sequence
  SiRNA target sequence
aaaaacgaaaaaaatggagcaat

SEQ ID NO: 89567 - DNA, 23 bp, Artificial sequence
  SiRNA target sequence
aaaacgaaaaaaatggagcaatg

SEQ ID NO: 89568 - DNA, 23 bp, Artificial sequence
  SiRNA target sequence
aaacgaaaaaaatggagcaatgc

SEQ ID NO: 89569 - DNA, 23 bp, Artificial sequence
  SiRNA target sequence
aacgaaaaaaatggagcaatgcc

SEQ ID NO: 89570 - DNA, 23 bp, Artificial sequence
  SiRNA target sequence
acgaaaaaaatggagcaatgcca

SEQ ID NO: 89571 - DNA, 23 bp, Artificial sequence
  SiRNA target sequence
cgaaaaaaatggagcaatgccag

SEQ ID NO: 89572 - DNA, 23 bp, Artificial sequence
  SiRNA target sequence
gaaaaaaatggagcaatgccagt

SEQ ID NO: 89573 - DNA, 23 bp, Artificial sequence
  SiRNA target sequence
aaaaaaatggagcaatgccagtt

SEQ ID NO: 89574 - DNA, 23 bp, Artificial sequence
  SiRNA target sequence
aaaaaatggagcaatgccagttc

SEQ ID NO: 89575 - DNA, 23 bp, Artificial sequence
  SiRNA target sequence
aaaaatggagcaatgccagttcc

SEQ ID NO: 89576 - DNA, 23 bp, Artificial sequence
  SiRNA target sequence
aaaatggagcaatgccagttcca

SEQ ID NO: 89577 - DNA, 23 bp, Artificial sequence
  SiRNA target sequence
aaatggagcaatgccagttccag

SEQ ID NO: 89578 - DNA, 23 bp, Artificial sequence
  SiRNA target sequence
aatggagcaatgccagttccagt

SEQ ID NO: 89579 - DNA, 23 bp, Artificial sequence
  SiRNA target sequence
atggagcaatgccagttccagta

SEQ ID NO: 89580 - DNA, 23 bp, Artificial sequence
  SiRNA target sequence
tggagcaatgccagttccagtac

SEQ ID NO: 89581 - DNA, 23 bp, Artificial sequence
  SiRNA target sequence
ggagcaatgccagttccagtaca

SEQ ID NO: 89582 - DNA, 23 bp, Artificial sequence
  SiRNA target sequence
gagcaatgccagttccagtacaa

SEQ ID NO: 89583 - DNA, 23 bp, Artificial sequence
  SiRNA target sequence
agcaatgccagttccagtacaaa

SEQ ID NO: 89584 - DNA, 23 bp, Artificial sequence
  SiRNA target sequence
gcaatgccagttccagtacaaat

SEQ ID NO: 89585 - DNA, 23 bp, Artificial sequence
  SiRNA target sequence
caatgccagttccagtacaaata

SEQ ID NO: 89586 - DNA, 23 bp, Artificial sequence
  SiRNA target sequence
aatgccagttccagtacaaatac

SEQ ID NO: 89587 - DNA, 23 bp, Artificial sequence
  SiRNA target sequence
atgccagttccagtacaaatacc

SEQ ID NO: 89588 - DNA, 23 bp, Artificial sequence
  SiRNA target sequence
tgccagttccagtacaaataccc

SEQ ID NO: 89589 - DNA, 23 bp, Artificial sequence
  SiRNA target sequence
gccagttccagtacaaataccca

SEQ ID NO: 89590 - DNA, 23 bp, Artificial sequence
  SiRNA target sequence
ccagttccagtacaaatacccaa

SEQ ID NO: 89591 - DNA, 23 bp, Artificial sequence
  SiRNA target sequence
cagttccagtacaaatacccaac

SEQ ID NO: 89592 - DNA, 23 bp, Artificial sequence
  SiRNA target sequence
agttccagtacaaatacccaaca

SEQ ID NO: 89593 - DNA, 23 bp, Artificial sequence
  SiRNA target sequence
gttccagtacaaatacccaacac

SEQ ID NO: 89594 - DNA, 23 bp, Artificial sequence
  SiRNA target sequence
ttccagtacaaatacccaacact

SEQ ID NO: 89595 - DNA, 23 bp, Artificial sequence
  SiRNA target sequence
tccagtacaaatacccaacactt

SEQ ID NO: 89596 - DNA, 23 bp, Artificial sequence
  SiRNA target sequence
ccagtacaaatacccaacacttt

SEQ ID NO: 89597 - DNA, 23 bp, Artificial sequence
  SiRNA target sequence
cagtacaaatacccaacactttt

SEQ ID NO: 89598 - DNA, 23 bp, Artificial sequence
  SiRNA target sequence
agtacaaatacccaacacttttt

SEQ ID NO: 89599 - DNA, 23 bp, Artificial sequence
  SiRNA target sequence
gtacaaatacccaacactttttt

SEQ ID NO: 89600 - DNA, 23 bp, Artificial sequence
  SiRNA target sequence
tacaaatacccaacactttttta

SEQ ID NO: 89601 - DNA, 23 bp, Artificial sequence
  SiRNA target sequence
acaaatacccaacacttttttac

SEQ ID NO: 89602 - DNA, 23 bp, Artificial sequence
  SiRNA target sequence
caaatacccaacacttttttaca

SEQ ID NO: 89603 - DNA, 23 bp, Artificial sequence
  SiRNA target sequence
aaatacccaacacttttttacaa

SEQ ID NO: 89604 - DNA, 23 bp, Artificial sequence
  SiRNA target sequence
aatacccaacacttttttacaaa

SEQ ID NO: 89605 - DNA, 23 bp, Artificial sequence
  SiRNA target sequence
atacccaacacttttttacaaaa

SEQ ID NO: 89606 - DNA, 23 bp, Artificial sequence
  SiRNA target sequence
tacccaacacttttttacaaaaa

SEQ ID NO: 89607 - DNA, 23 bp, Artificial sequence
  SiRNA target sequence
acccaacacttttttacaaaaat

SEQ ID NO: 89608 - DNA, 23 bp, Artificial sequence
  SiRNA target sequence
cccaacacttttttacaaaaatt

SEQ ID NO: 89609 - DNA, 23 bp, Artificial sequence
  SiRNA target sequence
ccaacacttttttacaaaaattt

SEQ ID NO: 89610 - DNA, 23 bp, Artificial sequence
  SiRNA target sequence
caacacttttttacaaaaattta

SEQ ID NO: 89611 - DNA, 23 bp, Artificial sequence
  SiRNA target sequence
aacacttttttacaaaaatttaa

SEQ ID NO: 89612 - DNA, 23 bp, Artificial sequence
  SiRNA target sequence
acacttttttacaaaaatttaat

SEQ ID NO: 89613 - DNA, 23 bp, Artificial sequence
  SiRNA target sequence
cacttttttacaaaaatttaatc

SEQ ID NO: 89614 - DNA, 23 bp, Artificial sequence
  SiRNA target sequence
acttttttacaaaaatttaatct

SEQ ID NO: 89615 - DNA, 23 bp, Artificial sequence
  SiRNA target sequence
cttttttacaaaaatttaatcta

SEQ ID NO: 89616 - DNA, 23 bp, Artificial sequence
  SiRNA target sequence
ttttttacaaaaatttaatctaa

SEQ ID NO: 89617 - DNA, 23 bp, Artificial sequence
  SiRNA target sequence
tttttacaaaaatttaatctaaa

SEQ ID NO: 89618 - DNA, 23 bp, Artificial sequence
  SiRNA target sequence
ttttacaaaaatttaatctaaat

SEQ ID NO: 89619 - DNA, 23 bp, Artificial sequence
  SiRNA target sequence
tttacaaaaatttaatctaaata

SEQ ID NO: 89620 - DNA, 23 bp, Artificial sequence
  SiRNA target sequence
ttacaaaaatttaatctaaataa

SEQ ID NO: 89621 - DNA, 23 bp, Artificial sequence
  SiRNA target sequence
tacaaaaatttaatctaaataat

SEQ ID NO: 89622 - DNA, 23 bp, Artificial sequence
  SiRNA target sequence
acaaaaatttaatctaaataatt

SEQ ID NO: 89623 - DNA, 23 bp, Artificial sequence
  SiRNA target sequence
caaaaatttaatctaaataattt

SEQ ID NO: 89624 - DNA, 23 bp, Artificial sequence
  SiRNA target sequence
aaaaatttaatctaaataattta

SEQ ID NO: 89625 - DNA, 23 bp, Artificial sequence
  SiRNA target sequence
aaaatttaatctaaataatttac

SEQ ID NO: 89626 - DNA, 23 bp, Artificial sequence
  SiRNA target sequence
aaatttaatctaaataatttact

SEQ ID NO: 89627 - DNA, 23 bp, Artificial sequence
  SiRNA target sequence
aatttaatctaaataatttactc

SEQ ID NO: 89628 - DNA, 23 bp, Artificial sequence
  SiRNA target sequence
atttaatctaaataatttactcg

SEQ ID NO: 89629 - DNA, 23 bp, Artificial sequence
  SiRNA target sequence
tttaatctaaataatttactcgg

SEQ ID NO: 89630 - DNA, 23 bp, Artificial sequence
  SiRNA target sequence
ttaatctaaataatttactcggt

SEQ ID NO: 89631 - DNA, 23 bp, Artificial sequence
  SiRNA target sequence
taatctaaataatttactcggtc

SEQ ID NO: 89632 - DNA, 23 bp, Artificial sequence
  SiRNA target sequence
aatctaaataatttactcggtct

SEQ ID NO: 89633 - DNA, 23 bp, Artificial sequence
  SiRNA target sequence
atctaaataatttactcggtctg

SEQ ID NO: 89634 - DNA, 23 bp, Artificial sequence
  SiRNA target sequence
tctaaataatttactcggtctgt

SEQ ID NO: 89635 - DNA, 23 bp, Artificial sequence
  SiRNA target sequence
ctaaataatttactcggtctgtg

SEQ ID NO: 89636 - DNA, 23 bp, Artificial sequence
  SiRNA target sequence
taaataatttactcggtctgtga

SEQ ID NO: 89637 - DNA, 23 bp, Artificial sequence
  SiRNA target sequence
aaataatttactcggtctgtgac

SEQ ID NO: 89638 - DNA, 23 bp, Artificial sequence
  SiRNA target sequence
aataatttactcggtctgtgaca

SEQ ID NO: 89639 - DNA, 23 bp, Artificial sequence
  SiRNA target sequence
ataatttactcggtctgtgacag

SEQ ID NO: 89640 - DNA, 23 bp, Artificial sequence
  SiRNA target sequence
taatttactcggtctgtgacaga

SEQ ID NO: 89641 - DNA, 23 bp, Artificial sequence
  SiRNA target sequence
aatttactcggtctgtgacagat

SEQ ID NO: 89642 - DNA, 23 bp, Artificial sequence
  SiRNA target sequence
atttactcggtctgtgacagatc

SEQ ID NO: 89643 - DNA, 23 bp, Artificial sequence
  SiRNA target sequence
tttactcggtctgtgacagatct

SEQ ID NO: 89644 - DNA, 23 bp, Artificial sequence
  SiRNA target sequence
ttactcggtctgtgacagatctt

SEQ ID NO: 89645 - DNA, 23 bp, Artificial sequence
  SiRNA target sequence
tactcggtctgtgacagatcttt

SEQ ID NO: 89646 - DNA, 23 bp, Artificial sequence
  SiRNA target sequence
actcggtctgtgacagatcttta

SEQ ID NO: 89647 - DNA, 23 bp, Artificial sequence
  SiRNA target sequence
ctcggtctgtgacagatctttaa

SEQ ID NO: 89648 - DNA, 23 bp, Artificial sequence
  SiRNA target sequence
tcggtctgtgacagatctttaaa

SEQ ID NO: 89649 - DNA, 23 bp, Artificial sequence
  SiRNA target sequence
cggtctgtgacagatctttaaat

SEQ ID NO: 89650 - DNA, 23 bp, Artificial sequence
  SiRNA target sequence
ggtctgtgacagatctttaaatt

SEQ ID NO: 89651 - DNA, 23 bp, Artificial sequence
  SiRNA target sequence
gtctgtgacagatctttaaatta

SEQ ID NO: 89652 - DNA, 23 bp, Artificial sequence
  SiRNA target sequence
tctgtgacagatctttaaattat

SEQ ID NO: 89653 - DNA, 23 bp, Artificial sequence
  SiRNA target sequence
ctgtgacagatctttaaattatt

SEQ ID NO: 89654 - DNA, 23 bp, Artificial sequence
  SiRNA target sequence
tgtgacagatctttaaattatta

SEQ ID NO: 89655 - DNA, 23 bp, Artificial sequence
  SiRNA target sequence
gtgacagatctttaaattattat

SEQ ID NO: 89656 - DNA, 23 bp, Artificial sequence
  SiRNA target sequence
tgacagatctttaaattattata

SEQ ID NO: 89657 - DNA, 23 bp, Artificial sequence
  SiRNA target sequence
gacagatctttaaattattataa

SEQ ID NO: 89658 - DNA, 23 bp, Artificial sequence
  SiRNA target sequence
acagatctttaaattattataat

SEQ ID NO: 89659 - DNA, 23 bp, Artificial sequence
  SiRNA target sequence
cagatctttaaattattataatt

SEQ ID NO: 89660 - DNA, 23 bp, Artificial sequence
  SiRNA target sequence
agatctttaaattattataattt

SEQ ID NO: 89661 - DNA, 23 bp, Artificial sequence
  SiRNA target sequence
gatctttaaattattataatttt

SEQ ID NO: 89662 - DNA, 23 bp, Artificial sequence
  SiRNA target sequence
atctttaaattattataattttg

SEQ ID NO: 89663 - DNA, 23 bp, Artificial sequence
  SiRNA target sequence
tctttaaattattataattttgc

SEQ ID NO: 89664 - DNA, 23 bp, Artificial sequence
  SiRNA target sequence
ctttaaattattataattttgca

SEQ ID NO: 89665 - DNA, 23 bp, Artificial sequence
  SiRNA target sequence
tttaaattattataattttgcat

SEQ ID NO: 89666 - DNA, 23 bp, Artificial sequence
  SiRNA target sequence
ttaaattattataattttgcata

SEQ ID NO: 89667 - DNA, 23 bp, Artificial sequence
  SiRNA target sequence
taaattattataattttgcatat

SEQ ID NO: 89668 - DNA, 23 bp, Artificial sequence
  SiRNA target sequence
aaattattataattttgcatatc

SEQ ID NO: 89669 - DNA, 23 bp, Artificial sequence
  SiRNA target sequence
aattattataattttgcatatct

SEQ ID NO: 89670 - DNA, 23 bp, Artificial sequence
  SiRNA target sequence
attattataattttgcatatcta

SEQ ID NO: 89671 - DNA, 23 bp, Artificial sequence
  SiRNA target sequence
ttattataattttgcatatctat

SEQ ID NO: 89672 - DNA, 23 bp, Artificial sequence
  SiRNA target sequence
tattataattttgcatatctatg

SEQ ID NO: 89673 - DNA, 23 bp, Artificial sequence
  SiRNA target sequence
attataattttgcatatctatga

SEQ ID NO: 89674 - DNA, 23 bp, Artificial sequence
  SiRNA target sequence
ttataattttgcatatctatgaa

SEQ ID NO: 89675 - DNA, 23 bp, Artificial sequence
  SiRNA target sequence
tataattttgcatatctatgaaa

SEQ ID NO: 89676 - DNA, 23 bp, Artificial sequence
  SiRNA target sequence
ataattttgcatatctatgaaat

SEQ ID NO: 89677 - DNA, 23 bp, Artificial sequence
  SiRNA target sequence
taattttgcatatctatgaaatt

SEQ ID NO: 89678 - DNA, 23 bp, Artificial sequence
  SiRNA target sequence
aattttgcatatctatgaaattg

SEQ ID NO: 89679 - DNA, 23 bp, Artificial sequence
  SiRNA target sequence
attttgcatatctatgaaattgg

SEQ ID NO: 89680 - DNA, 23 bp, Artificial sequence
  SiRNA target sequence
ttttgcatatctatgaaattgga

SEQ ID NO: 89681 - DNA, 23 bp, Artificial sequence
  SiRNA target sequence
tttgcatatctatgaaattggaa

SEQ ID NO: 89682 - DNA, 23 bp, Artificial sequence
  SiRNA target sequence
ttgcatatctatgaaattggaaa

SEQ ID NO: 89683 - DNA, 23 bp, Artificial sequence
  SiRNA target sequence
tgcatatctatgaaattggaaac

SEQ ID NO: 89684 - DNA, 23 bp, Artificial sequence
  SiRNA target sequence
gcatatctatgaaattggaaaca

SEQ ID NO: 89685 - DNA, 23 bp, Artificial sequence
  SiRNA target sequence
catatctatgaaattggaaacat

SEQ ID NO: 89686 - DNA, 23 bp, Artificial sequence
  SiRNA target sequence
atatctatgaaattggaaacatg

SEQ ID NO: 89687 - DNA, 23 bp, Artificial sequence
  SiRNA target sequence
tatctatgaaattggaaacatgt

SEQ ID NO: 89688 - DNA, 23 bp, Artificial sequence
  SiRNA target sequence
atctatgaaattggaaacatgtc

SEQ ID NO: 89689 - DNA, 23 bp, Artificial sequence
  SiRNA target sequence
tctatgaaattggaaacatgtcc

SEQ ID NO: 89690 - DNA, 23 bp, Artificial sequence
  SiRNA target sequence
ctatgaaattggaaacatgtcca

SEQ ID NO: 89691 - DNA, 23 bp, Artificial sequence
  SiRNA target sequence
tatgaaattggaaacatgtccat

SEQ ID NO: 89692 - DNA, 23 bp, Artificial sequence
  SiRNA target sequence
atgaaattggaaacatgtccata

SEQ ID NO: 89693 - DNA, 23 bp, Artificial sequence
  SiRNA target sequence
tgaaattggaaacatgtccatat

SEQ ID NO: 89694 - DNA, 23 bp, Artificial sequence
  SiRNA target sequence
gaaattggaaacatgtccatatc

SEQ ID NO: 89695 - DNA, 23 bp, Artificial sequence
  SiRNA target sequence
aaattggaaacatgtccatatct

SEQ ID NO: 89696 - DNA, 23 bp, Artificial sequence
  SiRNA target sequence
aattggaaacatgtccatatcta

SEQ ID NO: 89697 - DNA, 23 bp, Artificial sequence
  SiRNA target sequence
attggaaacatgtccatatctat

SEQ ID NO: 89698 - DNA, 23 bp, Artificial sequence
  SiRNA target sequence
ttggaaacatgtccatatctatc

SEQ ID NO: 89699 - DNA, 23 bp, Artificial sequence
  SiRNA target sequence
tggaaacatgtccatatctatcg

SEQ ID NO: 89700 - DNA, 23 bp, Artificial sequence
  SiRNA target sequence
ggaaacatgtccatatctatcgc

SEQ ID NO: 89701 - DNA, 23 bp, Artificial sequence
  SiRNA target sequence
gaaacatgtccatatctatcgcc

SEQ ID NO: 89702 - DNA, 23 bp, Artificial sequence
  SiRNA target sequence
aaacatgtccatatctatcgcct

SEQ ID NO: 89703 - DNA, 23 bp, Artificial sequence
  SiRNA target sequence
aacatgtccatatctatcgcctt

SEQ ID NO: 89704 - DNA, 23 bp, Artificial sequence
  SiRNA target sequence
acatgtccatatctatcgccttt

SEQ ID NO: 89705 - DNA, 23 bp, Artificial sequence
  SiRNA target sequence
catgtccatatctatcgcctttt

SEQ ID NO: 89706 - DNA, 23 bp, Artificial sequence
  SiRNA target sequence
atgtccatatctatcgccttttt

SEQ ID NO: 89707 - DNA, 23 bp, Artificial sequence
  SiRNA target sequence
tgtccatatctatcgcctttttt

SEQ ID NO: 89708 - DNA, 23 bp, Artificial sequence
  SiRNA target sequence
gtccatatctatcgcctttttta

SEQ ID NO: 89709 - DNA, 23 bp, Artificial sequence
  SiRNA target sequence
tccatatctatcgccttttttaa

SEQ ID NO: 89710 - DNA, 23 bp, Artificial sequence
  SiRNA target sequence
ccatatctatcgccttttttaat

SEQ ID NO: 89711 - DNA, 23 bp, Artificial sequence
  SiRNA target sequence
catatctatcgccttttttaata

SEQ ID NO: 89712 - DNA, 23 bp, Artificial sequence
  SiRNA target sequence
atatctatcgccttttttaataa

SEQ ID NO: 89713 - DNA, 23 bp, Artificial sequence
  SiRNA target sequence
tatctatcgccttttttaataat

SEQ ID NO: 89714 - DNA, 23 bp, Artificial sequence
  SiRNA target sequence
atctatcgccttttttaataatt

SEQ ID NO: 89715 - DNA, 23 bp, Artificial sequence
  SiRNA target sequence
tctatcgccttttttaataattg

SEQ ID NO: 89716 - DNA, 23 bp, Artificial sequence
  SiRNA target sequence
ctatcgccttttttaataattgc

SEQ ID NO: 89717 - DNA, 23 bp, Artificial sequence
  SiRNA target sequence
tatcgccttttttaataattgct

SEQ ID NO: 89718 - DNA, 23 bp, Artificial sequence
  SiRNA target sequence
atcgccttttttaataattgcta

SEQ ID NO: 89719 - DNA, 23 bp, Artificial sequence
  SiRNA target sequence
tcgccttttttaataattgctac

SEQ ID NO: 89720 - DNA, 23 bp, Artificial sequence
  SiRNA target sequence
cgccttttttaataattgctact

SEQ ID NO: 89721 - DNA, 23 bp, Artificial sequence
  SiRNA target sequence
gccttttttaataattgctacta

SEQ ID NO: 89722 - DNA, 23 bp, Artificial sequence
  SiRNA target sequence
ccttttttaataattgctactaa

SEQ ID NO: 89723 - DNA, 23 bp, Artificial sequence
  SiRNA target sequence
cttttttaataattgctactaaa

SEQ ID NO: 89724 - DNA, 23 bp, Artificial sequence
  SiRNA target sequence
ttttttaataattgctactaaaa

SEQ ID NO: 89725 - DNA, 23 bp, Artificial sequence
  SiRNA target sequence
tttttaataattgctactaaaat

SEQ ID NO: 89726 - DNA, 23 bp, Artificial sequence
  SiRNA target sequence
ttttaataattgctactaaaatt

SEQ ID NO: 89727 - DNA, 23 bp, Artificial sequence
  SiRNA target sequence
tttaataattgctactaaaattt

SEQ ID NO: 89728 - DNA, 23 bp, Artificial sequence
  SiRNA target sequence
ttaataattgctactaaaatttc

SEQ ID NO: 89729 - DNA, 23 bp, Artificial sequence
  SiRNA target sequence
taataattgctactaaaatttca

SEQ ID NO: 89730 - DNA, 23 bp, Artificial sequence
  SiRNA target sequence
aataattgctactaaaatttcac

SEQ ID NO: 89731 - DNA, 23 bp, Artificial sequence
  SiRNA target sequence
ataattgctactaaaatttcaca

SEQ ID NO: 89732 - DNA, 23 bp, Artificial sequence
  SiRNA target sequence
taattgctactaaaatttcacat

SEQ ID NO: 89733 - DNA, 23 bp, Artificial sequence
  SiRNA target sequence
aattgctactaaaatttcacatt

SEQ ID NO: 89734 - DNA, 23 bp, Artificial sequence
  SiRNA target sequence
attgctactaaaatttcacattt

SEQ ID NO: 89735 - DNA, 23 bp, Artificial sequence
  SiRNA target sequence
ttgctactaaaatttcacatttt

SEQ ID NO: 89736 - DNA, 23 bp, Artificial sequence
  SiRNA target sequence
tgctactaaaatttcacattttt

SEQ ID NO: 89737 - DNA, 23 bp, Artificial sequence
  SiRNA target sequence
gctactaaaatttcacatttttc

SEQ ID NO: 89738 - DNA, 23 bp, Artificial sequence
  SiRNA target sequence
ctactaaaatttcacatttttca

SEQ ID NO: 89739 - DNA, 23 bp, Artificial sequence
  SiRNA target sequence
tactaaaatttcacatttttcat

SEQ ID NO: 89740 - DNA, 23 bp, Artificial sequence
  SiRNA target sequence
actaaaatttcacatttttcatt

SEQ ID NO: 89741 - DNA, 23 bp, Artificial sequence
  SiRNA target sequence
ctaaaatttcacatttttcattt

SEQ ID NO: 89742 - DNA, 23 bp, Artificial sequence
  SiRNA target sequence
taaaatttcacatttttcattta

SEQ ID NO: 89743 - DNA, 23 bp, Artificial sequence
  SiRNA target sequence
aaaatttcacatttttcatttac

SEQ ID NO: 89744 - DNA, 23 bp, Artificial sequence
  SiRNA target sequence
aaatttcacatttttcatttacg

SEQ ID NO: 89745 - DNA, 23 bp, Artificial sequence
  SiRNA target sequence
aatttcacatttttcatttacgt

SEQ ID NO: 89746 - DNA, 23 bp, Artificial sequence
  SiRNA target sequence
atttcacatttttcatttacgtg

SEQ ID NO: 89747 - DNA, 23 bp, Artificial sequence
  SiRNA target sequence
tttcacatttttcatttacgtgg

SEQ ID NO: 89748 - DNA, 23 bp, Artificial sequence
  SiRNA target sequence
ttcacatttttcatttacgtggt

SEQ ID NO: 89749 - DNA, 23 bp, Artificial sequence
  SiRNA target sequence
tcacatttttcatttacgtggtt

SEQ ID NO: 89750 - DNA, 23 bp, Artificial sequence
  SiRNA target sequence
cacatttttcatttacgtggtta

SEQ ID NO: 89751 - DNA, 23 bp, Artificial sequence
  SiRNA target sequence
acatttttcatttacgtggttag

SEQ ID NO: 89752 - DNA, 23 bp, Artificial sequence
  SiRNA target sequence
catttttcatttacgtggttagt

SEQ ID NO: 89753 - DNA, 23 bp, Artificial sequence
  SiRNA target sequence
atttttcatttacgtggttagta

SEQ ID NO: 89754 - DNA, 23 bp, Artificial sequence
  SiRNA target sequence
tttttcatttacgtggttagtaa

SEQ ID NO: 89755 - DNA, 23 bp, Artificial sequence
  SiRNA target sequence
ttttcatttacgtggttagtaag

SEQ ID NO: 89756 - DNA, 23 bp, Artificial sequence
  SiRNA target sequence
tttcatttacgtggttagtaagt

SEQ ID NO: 89757 - DNA, 23 bp, Artificial sequence
  SiRNA target sequence
ttcatttacgtggttagtaagtg

SEQ ID NO: 89758 - DNA, 23 bp, Artificial sequence
  SiRNA target sequence
tcatttacgtggttagtaagtga

SEQ ID NO: 89759 - DNA, 23 bp, Artificial sequence
  SiRNA target sequence
catttacgtggttagtaagtgaa

SEQ ID NO: 89760 - DNA, 23 bp, Artificial sequence
  SiRNA target sequence
atttacgtggttagtaagtgaat

SEQ ID NO: 89761 - DNA, 23 bp, Artificial sequence
  SiRNA target sequence
tttacgtggttagtaagtgaata

SEQ ID NO: 89762 - DNA, 23 bp, Artificial sequence
  SiRNA target sequence
ttacgtggttagtaagtgaataa

SEQ ID NO: 89763 - DNA, 23 bp, Artificial sequence
  SiRNA target sequence
tacgtggttagtaagtgaataat

SEQ ID NO: 89764 - DNA, 23 bp, Artificial sequence
  SiRNA target sequence
acgtggttagtaagtgaataata

SEQ ID NO: 89765 - DNA, 23 bp, Artificial sequence
  SiRNA target sequence
cgtggttagtaagtgaataatat

SEQ ID NO: 89766 - DNA, 23 bp, Artificial sequence
  SiRNA target sequence
gtggttagtaagtgaataatatc

SEQ ID NO: 89767 - DNA, 23 bp, Artificial sequence
  SiRNA target sequence
tggttagtaagtgaataatatct

SEQ ID NO: 89768 - DNA, 23 bp, Artificial sequence
  SiRNA target sequence
ggttagtaagtgaataatatctt

SEQ ID NO: 89769 - DNA, 23 bp, Artificial sequence
  SiRNA target sequence
gttagtaagtgaataatatcttg

SEQ ID NO: 89770 - DNA, 23 bp, Artificial sequence
  SiRNA target sequence
ttagtaagtgaataatatcttgg

SEQ ID NO: 89771 - DNA, 23 bp, Artificial sequence
  SiRNA target sequence
tagtaagtgaataatatcttggc

SEQ ID NO: 89772 - DNA, 23 bp, Artificial sequence
  SiRNA target sequence
agtaagtgaataatatcttggct

SEQ ID NO: 89773 - DNA, 23 bp, Artificial sequence
  SiRNA target sequence
gtaagtgaataatatcttggctt

SEQ ID NO: 89774 - DNA, 23 bp, Artificial sequence
  SiRNA target sequence
taagtgaataatatcttggctta

SEQ ID NO: 89775 - DNA, 23 bp, Artificial sequence
  SiRNA target sequence
aagtgaataatatcttggcttaa

SEQ ID NO: 89776 - DNA, 23 bp, Artificial sequence
  SiRNA target sequence
agtgaataatatcttggcttaat

SEQ ID NO: 89777 - DNA, 23 bp, Artificial sequence
  SiRNA target sequence
gtgaataatatcttggcttaatt

SEQ ID NO: 89778 - DNA, 23 bp, Artificial sequence
  SiRNA target sequence
tgaataatatcttggcttaattg

SEQ ID NO: 89779 - DNA, 23 bp, Artificial sequence
  SiRNA target sequence
gaataatatcttggcttaattgt

SEQ ID NO: 89780 - DNA, 23 bp, Artificial sequence
  SiRNA target sequence
aataatatcttggcttaattgtt

SEQ ID NO: 89781 - DNA, 23 bp, Artificial sequence
  SiRNA target sequence
ataatatcttggcttaattgttt

SEQ ID NO: 89782 - DNA, 23 bp, Artificial sequence
  SiRNA target sequence
taatatcttggcttaattgtttg

SEQ ID NO: 89783 - DNA, 23 bp, Artificial sequence
  SiRNA target sequence
aatatcttggcttaattgtttga

SEQ ID NO: 89784 - DNA, 23 bp, Artificial sequence
  SiRNA target sequence
atatcttggcttaattgtttgac

SEQ ID NO: 89785 - DNA, 23 bp, Artificial sequence
  SiRNA target sequence
tatcttggcttaattgtttgaca

SEQ ID NO: 89786 - DNA, 23 bp, Artificial sequence
  SiRNA target sequence
atcttggcttaattgtttgacaa

SEQ ID NO: 89787 - DNA, 23 bp, Artificial sequence
  SiRNA target sequence
tcttggcttaattgtttgacaat

SEQ ID NO: 89788 - DNA, 23 bp, Artificial sequence
  SiRNA target sequence
cttggcttaattgtttgacaatt

SEQ ID NO: 89789 - DNA, 23 bp, Artificial sequence
  SiRNA target sequence
ttggcttaattgtttgacaattc

SEQ ID NO: 89790 - DNA, 23 bp, Artificial sequence
  SiRNA target sequence
tggcttaattgtttgacaattca

SEQ ID NO: 89791 - DNA, 23 bp, Artificial sequence
  SiRNA target sequence
ggcttaattgtttgacaattcat

SEQ ID NO: 89792 - DNA, 23 bp, Artificial sequence
  SiRNA target sequence
gcttaattgtttgacaattcata

SEQ ID NO: 89793 - DNA, 23 bp, Artificial sequence
  SiRNA target sequence
cttaattgtttgacaattcataa

SEQ ID NO: 89794 - DNA, 23 bp, Artificial sequence
  SiRNA target sequence
ttaattgtttgacaattcataat

SEQ ID NO: 89795 - DNA, 23 bp, Artificial sequence
  SiRNA target sequence
taattgtttgacaattcataata

SEQ ID NO: 89796 - DNA, 23 bp, Artificial sequence
  SiRNA target sequence
aattgtttgacaattcataataa

SEQ ID NO: 89797 - DNA, 23 bp, Artificial sequence
  SiRNA target sequence
attgtttgacaattcataataag

SEQ ID NO: 89798 - DNA, 23 bp, Artificial sequence
  SiRNA target sequence
ttgtttgacaattcataataaga

SEQ ID NO: 89799 - DNA, 23 bp, Artificial sequence
  SiRNA target sequence
tgtttgacaattcataataagat

SEQ ID NO: 89800 - DNA, 23 bp, Artificial sequence
  SiRNA target sequence
gtttgacaattcataataagatc

SEQ ID NO: 89801 - DNA, 23 bp, Artificial sequence
  SiRNA target sequence
tttgacaattcataataagatcc

SEQ ID NO: 89802 - DNA, 23 bp, Artificial sequence
  SiRNA target sequence
ttgacaattcataataagatcct

SEQ ID NO: 89803 - DNA, 23 bp, Artificial sequence
  SiRNA target sequence
tgacaattcataataagatcctc

SEQ ID NO: 89804 - DNA, 23 bp, Artificial sequence
  SiRNA target sequence
gacaattcataataagatcctct

SEQ ID NO: 89805 - DNA, 23 bp, Artificial sequence
  SiRNA target sequence
acaattcataataagatcctcta

SEQ ID NO: 89806 - DNA, 23 bp, Artificial sequence
  SiRNA target sequence
caattcataataagatcctctaa

SEQ ID NO: 89807 - DNA, 23 bp, Artificial sequence
  SiRNA target sequence
aattcataataagatcctctaaa

SEQ ID NO: 89808 - DNA, 23 bp, Artificial sequence
  SiRNA target sequence
attcataataagatcctctaaac

SEQ ID NO: 89809 - DNA, 23 bp, Artificial sequence
  SiRNA target sequence
ttcataataagatcctctaaact

SEQ ID NO: 89810 - DNA, 23 bp, Artificial sequence
  SiRNA target sequence
tcataataagatcctctaaactt

SEQ ID NO: 89811 - DNA, 23 bp, Artificial sequence
  SiRNA target sequence
cataataagatcctctaaacttg

SEQ ID NO: 89812 - DNA, 23 bp, Artificial sequence
  SiRNA target sequence
ataataagatcctctaaacttgg

SEQ ID NO: 89813 - DNA, 23 bp, Artificial sequence
  SiRNA target sequence
taataagatcctctaaacttggt

SEQ ID NO: 89814 - DNA, 23 bp, Artificial sequence
  SiRNA target sequence
aataagatcctctaaacttggtt

SEQ ID NO: 89815 - DNA, 23 bp, Artificial sequence
  SiRNA target sequence
ataagatcctctaaacttggttt

SEQ ID NO: 89816 - DNA, 23 bp, Artificial sequence
  SiRNA target sequence
taagatcctctaaacttggttta

SEQ ID NO: 89817 - DNA, 23 bp, Artificial sequence
  SiRNA target sequence
aagatcctctaaacttggtttac

SEQ ID NO: 89818 - DNA, 23 bp, Artificial sequence
  SiRNA target sequence
agatcctctaaacttggtttaca

SEQ ID NO: 89819 - DNA, 23 bp, Artificial sequence
  SiRNA target sequence
gatcctctaaacttggtttacat

SEQ ID NO: 89820 - DNA, 23 bp, Artificial sequence
  SiRNA target sequence
atcctctaaacttggtttacatt

SEQ ID NO: 89821 - DNA, 23 bp, Artificial sequence
  SiRNA target sequence
tcctctaaacttggtttacattg

SEQ ID NO: 89822 - DNA, 23 bp, Artificial sequence
  SiRNA target sequence
cctctaaacttggtttacattga

SEQ ID NO: 89823 - DNA, 23 bp, Artificial sequence
  SiRNA target sequence
ctctaaacttggtttacattgaa

SEQ ID NO: 89824 - DNA, 23 bp, Artificial sequence
  SiRNA target sequence
tctaaacttggtttacattgaaa

SEQ ID NO: 89825 - DNA, 23 bp, Artificial sequence
  SiRNA target sequence
ctaaacttggtttacattgaaat

SEQ ID NO: 89826 - DNA, 23 bp, Artificial sequence
  SiRNA target sequence
taaacttggtttacattgaaatg

SEQ ID NO: 89827 - DNA, 23 bp, Artificial sequence
  SiRNA target sequence
aaacttggtttacattgaaatgt

SEQ ID NO: 89828 - DNA, 23 bp, Artificial sequence
  SiRNA target sequence
aacttggtttacattgaaatgta

SEQ ID NO: 89829 - DNA, 23 bp, Artificial sequence
  SiRNA target sequence
acttggtttacattgaaatgtat

SEQ ID NO: 89830 - DNA, 23 bp, Artificial sequence
  SiRNA target sequence
cttggtttacattgaaatgtata

SEQ ID NO: 89831 - DNA, 23 bp, Artificial sequence
  SiRNA target sequence
ttggtttacattgaaatgtatat

SEQ ID NO: 89832 - DNA, 23 bp, Artificial sequence
  SiRNA target sequence
tggtttacattgaaatgtatata

SEQ ID NO: 89833 - DNA, 23 bp, Artificial sequence
  SiRNA target sequence
ggtttacattgaaatgtatatat

SEQ ID NO: 89834 - DNA, 23 bp, Artificial sequence
  SiRNA target sequence
gtttacattgaaatgtatatata

SEQ ID NO: 89835 - DNA, 23 bp, Artificial sequence
  SiRNA target sequence
tttacattgaaatgtatatataa

SEQ ID NO: 89836 - DNA, 23 bp, Artificial sequence
  SiRNA target sequence
ttacattgaaatgtatatataat

SEQ ID NO: 89837 - DNA, 23 bp, Artificial sequence
  SiRNA target sequence
tacattgaaatgtatatataatg

SEQ ID NO: 89838 - DNA, 23 bp, Artificial sequence
  SiRNA target sequence
acattgaaatgtatatataatgt

SEQ ID NO: 89839 - DNA, 23 bp, Artificial sequence
  SiRNA target sequence
cattgaaatgtatatataatgtc

SEQ ID NO: 89840 - DNA, 23 bp, Artificial sequence
  SiRNA target sequence
attgaaatgtatatataatgtca

SEQ ID NO: 89841 - DNA, 23 bp, Artificial sequence
  SiRNA target sequence
ttgaaatgtatatataatgtcaa

SEQ ID NO: 89842 - DNA, 23 bp, Artificial sequence
  SiRNA target sequence
tgaaatgtatatataatgtcaag

SEQ ID NO: 89843 - DNA, 23 bp, Artificial sequence
  SiRNA target sequence
gaaatgtatatataatgtcaagc

SEQ ID NO: 89844 - DNA, 23 bp, Artificial sequence
  SiRNA target sequence
aaatgtatatataatgtcaagca

SEQ ID NO: 89845 - DNA, 23 bp, Artificial sequence
  SiRNA target sequence
aatgtatatataatgtcaagcac

SEQ ID NO: 89846 - DNA, 23 bp, Artificial sequence
  SiRNA target sequence
atgtatatataatgtcaagcaca

SEQ ID NO: 89847 - DNA, 23 bp, Artificial sequence
  SiRNA target sequence
tgtatatataatgtcaagcacat

SEQ ID NO: 89848 - DNA, 23 bp, Artificial sequence
  SiRNA target sequence
gtatatataatgtcaagcacatt

SEQ ID NO: 89849 - DNA, 23 bp, Artificial sequence
  SiRNA target sequence
tatatataatgtcaagcacatta

SEQ ID NO: 89850 - DNA, 23 bp, Artificial sequence
  SiRNA target sequence
atatataatgtcaagcacattat

SEQ ID NO: 89851 - DNA, 23 bp, Artificial sequence
  SiRNA target sequence
tatataatgtcaagcacattatt

SEQ ID NO: 89852 - DNA, 23 bp, Artificial sequence
  SiRNA target sequence
atataatgtcaagcacattattc

SEQ ID NO: 89853 - DNA, 23 bp, Artificial sequence
  SiRNA target sequence
tataatgtcaagcacattattcc

SEQ ID NO: 89854 - DNA, 23 bp, Artificial sequence
  SiRNA target sequence
ataatgtcaagcacattattcca

SEQ ID NO: 89855 - DNA, 23 bp, Artificial sequence
  SiRNA target sequence
taatgtcaagcacattattccag

SEQ ID NO: 89856 - DNA, 23 bp, Artificial sequence
  SiRNA target sequence
aatgtcaagcacattattccagt

SEQ ID NO: 89857 - DNA, 23 bp, Artificial sequence
  SiRNA target sequence
atgtcaagcacattattccagtt

SEQ ID NO: 89858 - DNA, 23 bp, Artificial sequence
  SiRNA target sequence
tgtcaagcacattattccagttc

SEQ ID NO: 89859 - DNA, 23 bp, Artificial sequence
  SiRNA target sequence
gtcaagcacattattccagttct

SEQ ID NO: 89860 - DNA, 23 bp, Artificial sequence
  SiRNA target sequence
tcaagcacattattccagttctt

SEQ ID NO: 89861 - DNA, 23 bp, Artificial sequence
  SiRNA target sequence
caagcacattattccagttctta

SEQ ID NO: 89862 - DNA, 23 bp, Artificial sequence
  SiRNA target sequence
aagcacattattccagttcttaa

SEQ ID NO: 89863 - DNA, 23 bp, Artificial sequence
  SiRNA target sequence
agcacattattccagttcttaat

SEQ ID NO: 89864 - DNA, 23 bp, Artificial sequence
  SiRNA target sequence
gcacattattccagttcttaatg

SEQ ID NO: 89865 - DNA, 23 bp, Artificial sequence
  SiRNA target sequence
cacattattccagttcttaatga

SEQ ID NO: 89866 - DNA, 23 bp, Artificial sequence
  SiRNA target sequence
acattattccagttcttaatgat

SEQ ID NO: 89867 - DNA, 23 bp, Artificial sequence
  SiRNA target sequence
cattattccagttcttaatgatg

SEQ ID NO: 89868 - DNA, 23 bp, Artificial sequence
  SiRNA target sequence
attattccagttcttaatgatgc

SEQ ID NO: 89869 - DNA, 23 bp, Artificial sequence
  SiRNA target sequence
ttattccagttcttaatgatgct

SEQ ID NO: 89870 - DNA, 23 bp, Artificial sequence
  SiRNA target sequence
tattccagttcttaatgatgctt

SEQ ID NO: 89871 - DNA, 23 bp, Artificial sequence
  SiRNA target sequence
attccagttcttaatgatgctta

SEQ ID NO: 89872 - DNA, 23 bp, Artificial sequence
  SiRNA target sequence
ttccagttcttaatgatgcttaa

SEQ ID NO: 89873 - DNA, 23 bp, Artificial sequence
  SiRNA target sequence
tccagttcttaatgatgcttaaa

SEQ ID NO: 89874 - DNA, 23 bp, Artificial sequence
  SiRNA target sequence
ccagttcttaatgatgcttaaat

SEQ ID NO: 89875 - DNA, 23 bp, Artificial sequence
  SiRNA target sequence
cagttcttaatgatgcttaaata

SEQ ID NO: 89876 - DNA, 23 bp, Artificial sequence
  SiRNA target sequence
agttcttaatgatgcttaaataa

SEQ ID NO: 89877 - DNA, 23 bp, Artificial sequence
  SiRNA target sequence
gttcttaatgatgcttaaataat

SEQ ID NO: 89878 - DNA, 23 bp, Artificial sequence
  SiRNA target sequence
ttcttaatgatgcttaaataatc

SEQ ID NO: 89879 - DNA, 23 bp, Artificial sequence
  SiRNA target sequence
tcttaatgatgcttaaataatct

SEQ ID NO: 89880 - DNA, 23 bp, Artificial sequence
  SiRNA target sequence
cttaatgatgcttaaataatctt

SEQ ID NO: 89881 - DNA, 23 bp, Artificial sequence
  SiRNA target sequence
ttaatgatgcttaaataatcttt

SEQ ID NO: 89882 - DNA, 23 bp, Artificial sequence
  SiRNA target sequence
taatgatgcttaaataatctttt

SEQ ID NO: 89883 - DNA, 23 bp, Artificial sequence
  SiRNA target sequence
aatgatgcttaaataatctttta

SEQ ID NO: 89884 - DNA, 23 bp, Artificial sequence
  SiRNA target sequence
atgatgcttaaataatcttttac

SEQ ID NO: 89885 - DNA, 23 bp, Artificial sequence
  SiRNA target sequence
tgatgcttaaataatcttttact

SEQ ID NO: 89886 - DNA, 23 bp, Artificial sequence
  SiRNA target sequence
gatgcttaaataatcttttactc

SEQ ID NO: 89887 - DNA, 23 bp, Artificial sequence
  SiRNA target sequence
atgcttaaataatcttttactcc

SEQ ID NO: 89888 - DNA, 23 bp, Artificial sequence
  SiRNA target sequence
tgcttaaataatcttttactcct

SEQ ID NO: 89889 - DNA, 23 bp, Artificial sequence
  SiRNA target sequence
gcttaaataatcttttactcctt

SEQ ID NO: 89890 - DNA, 23 bp, Artificial sequence
  SiRNA target sequence
cttaaataatcttttactccttc

SEQ ID NO: 89891 - DNA, 23 bp, Artificial sequence
  SiRNA target sequence
ttaaataatcttttactccttct

SEQ ID NO: 89892 - DNA, 23 bp, Artificial sequence
  SiRNA target sequence
taaataatcttttactccttctt

SEQ ID NO: 89893 - DNA, 23 bp, Artificial sequence
  SiRNA target sequence
aaataatcttttactccttcttt

SEQ ID NO: 89894 - DNA, 23 bp, Artificial sequence
  SiRNA target sequence
aataatcttttactccttcttta

SEQ ID NO: 89895 - DNA, 23 bp, Artificial sequence
  SiRNA target sequence
ataatcttttactccttctttag

SEQ ID NO: 89896 - DNA, 23 bp, Artificial sequence
  SiRNA target sequence
taatcttttactccttctttaga

SEQ ID NO: 89897 - DNA, 23 bp, Artificial sequence
  SiRNA target sequence
aatcttttactccttctttagaa

SEQ ID NO: 89898 - DNA, 23 bp, Artificial sequence
  SiRNA target sequence
atcttttactccttctttagaac

SEQ ID NO: 89899 - DNA, 23 bp, Artificial sequence
  SiRNA target sequence
tcttttactccttctttagaaca

SEQ ID NO: 89900 - DNA, 23 bp, Artificial sequence
  SiRNA target sequence
cttttactccttctttagaacac

SEQ ID NO: 89901 - DNA, 23 bp, Artificial sequence
  SiRNA target sequence
ttttactccttctttagaacaca

SEQ ID NO: 89902 - DNA, 23 bp, Artificial sequence
  SiRNA target sequence
tttactccttctttagaacacag

SEQ ID NO: 89903 - DNA, 23 bp, Artificial sequence
  SiRNA target sequence
ttactccttctttagaacacaga

SEQ ID NO: 89904 - DNA, 23 bp, Artificial sequence
  SiRNA target sequence
tactccttctttagaacacagat

SEQ ID NO: 89905 - DNA, 23 bp, Artificial sequence
  SiRNA target sequence
actccttctttagaacacagata

SEQ ID NO: 89906 - DNA, 23 bp, Artificial sequence
  SiRNA target sequence
ctccttctttagaacacagatat

SEQ ID NO: 89907 - DNA, 23 bp, Artificial sequence
  SiRNA target sequence
tccttctttagaacacagatatt

SEQ ID NO: 89908 - DNA, 23 bp, Artificial sequence
  SiRNA target sequence
ccttctttagaacacagatattc

SEQ ID NO: 89909 - DNA, 23 bp, Artificial sequence
  SiRNA target sequence
cttctttagaacacagatattca

SEQ ID NO: 89910 - DNA, 23 bp, Artificial sequence
  SiRNA target sequence
ttctttagaacacagatattcaa

SEQ ID NO: 89911 - DNA, 23 bp, Artificial sequence
  SiRNA target sequence
tctttagaacacagatattcaat

SEQ ID NO: 89912 - DNA, 23 bp, Artificial sequence
  SiRNA target sequence
ctttagaacacagatattcaata

SEQ ID NO: 89913 - DNA, 23 bp, Artificial sequence
  SiRNA target sequence
tttagaacacagatattcaatat

SEQ ID NO: 89914 - DNA, 23 bp, Artificial sequence
  SiRNA target sequence
ttagaacacagatattcaatatc

SEQ ID NO: 89915 - DNA, 23 bp, Artificial sequence
  SiRNA target sequence
tagaacacagatattcaatatca

SEQ ID NO: 89916 - DNA, 23 bp, Artificial sequence
  SiRNA target sequence
agaacacagatattcaatatcat

SEQ ID NO: 89917 - DNA, 23 bp, Artificial sequence
  SiRNA target sequence
gaacacagatattcaatatcatg

SEQ ID NO: 89918 - DNA, 23 bp, Artificial sequence
  SiRNA target sequence
aacacagatattcaatatcatgc

SEQ ID NO: 89919 - DNA, 23 bp, Artificial sequence
  SiRNA target sequence
acacagatattcaatatcatgct

SEQ ID NO: 89920 - DNA, 23 bp, Artificial sequence
  SiRNA target sequence
cacagatattcaatatcatgctt

SEQ ID NO: 89921 - DNA, 23 bp, Artificial sequence
  SiRNA target sequence
acagatattcaatatcatgctta

SEQ ID NO: 89922 - DNA, 23 bp, Artificial sequence
  SiRNA target sequence
cagatattcaatatcatgcttat

SEQ ID NO: 89923 - DNA, 23 bp, Artificial sequence
  SiRNA target sequence
agatattcaatatcatgcttatt

SEQ ID NO: 89924 - DNA, 23 bp, Artificial sequence
  SiRNA target sequence
gatattcaatatcatgcttattt

SEQ ID NO: 89925 - DNA, 23 bp, Artificial sequence
  SiRNA target sequence
atattcaatatcatgcttatttt

SEQ ID NO: 89926 - DNA, 23 bp, Artificial sequence
  SiRNA target sequence
tattcaatatcatgcttattttt

SEQ ID NO: 89927 - DNA, 23 bp, Artificial sequence
  SiRNA target sequence
attcaatatcatgcttattttta

SEQ ID NO: 89928 - DNA, 23 bp, Artificial sequence
  SiRNA target sequence
ttcaatatcatgcttatttttag

SEQ ID NO: 89929 - DNA, 23 bp, Artificial sequence
  SiRNA target sequence
tcaatatcatgcttatttttaga

SEQ ID NO: 89930 - DNA, 23 bp, Artificial sequence
  SiRNA target sequence
caatatcatgcttatttttagag

SEQ ID NO: 89931 - DNA, 23 bp, Artificial sequence
  SiRNA target sequence
aatatcatgcttatttttagagg

SEQ ID NO: 89932 - DNA, 23 bp, Artificial sequence
  SiRNA target sequence
atatcatgcttatttttagaggt

SEQ ID NO: 89933 - DNA, 23 bp, Artificial sequence
  SiRNA target sequence
tatcatgcttatttttagaggtt

SEQ ID NO: 89934 - DNA, 23 bp, Artificial sequence
  SiRNA target sequence
atcatgcttatttttagaggttt

SEQ ID NO: 89935 - DNA, 23 bp, Artificial sequence
  SiRNA target sequence
tcatgcttatttttagaggtttt

SEQ ID NO: 89936 - DNA, 23 bp, Artificial sequence
  SiRNA target sequence
catgcttatttttagaggtttta

SEQ ID NO: 89937 - DNA, 23 bp, Artificial sequence
  SiRNA target sequence
atgcttatttttagaggttttag

SEQ ID NO: 89938 - DNA, 23 bp, Artificial sequence
  SiRNA target sequence
tgcttatttttagaggttttaga

SEQ ID NO: 89939 - DNA, 23 bp, Artificial sequence
  SiRNA target sequence
gcttatttttagaggttttagaa

SEQ ID NO: 89940 - DNA, 23 bp, Artificial sequence
  SiRNA target sequence
cttatttttagaggttttagaaa

SEQ ID NO: 89941 - DNA, 23 bp, Artificial sequence
  SiRNA target sequence
ttatttttagaggttttagaaat

SEQ ID NO: 89942 - DNA, 23 bp, Artificial sequence
  SiRNA target sequence
tatttttagaggttttagaaata

SEQ ID NO: 89943 - DNA, 23 bp, Artificial sequence
  SiRNA target sequence
atttttagaggttttagaaatat

SEQ ID NO: 89944 - DNA, 23 bp, Artificial sequence
  SiRNA target sequence
tttttagaggttttagaaatatc

SEQ ID NO: 89945 - DNA, 23 bp, Artificial sequence
  SiRNA target sequence
ttttagaggttttagaaatatcc

SEQ ID NO: 89946 - DNA, 23 bp, Artificial sequence
  SiRNA target sequence
tttagaggttttagaaatatcca

SEQ ID NO: 89947 - DNA, 23 bp, Artificial sequence
  SiRNA target sequence
ttagaggttttagaaatatccat

SEQ ID NO: 89948 - DNA, 23 bp, Artificial sequence
  SiRNA target sequence
tagaggttttagaaatatccata

SEQ ID NO: 89949 - DNA, 23 bp, Artificial sequence
  SiRNA target sequence
agaggttttagaaatatccataa

SEQ ID NO: 89950 - DNA, 23 bp, Artificial sequence
  SiRNA target sequence
gaggttttagaaatatccataag

SEQ ID NO: 89951 - DNA, 23 bp, Artificial sequence
  SiRNA target sequence
aggttttagaaatatccataagc

SEQ ID NO: 89952 - DNA, 23 bp, Artificial sequence
  SiRNA target sequence
ggttttagaaatatccataagcc

SEQ ID NO: 89953 - DNA, 23 bp, Artificial sequence
  SiRNA target sequence
gttttagaaatatccataagcca

SEQ ID NO: 89954 - DNA, 23 bp, Artificial sequence
  SiRNA target sequence
ttttagaaatatccataagccat

SEQ ID NO: 89955 - DNA, 23 bp, Artificial sequence
  SiRNA target sequence
tttagaaatatccataagccatg

SEQ ID NO: 89956 - DNA, 23 bp, Artificial sequence
  SiRNA target sequence
ttagaaatatccataagccatgc

SEQ ID NO: 89957 - DNA, 23 bp, Artificial sequence
  SiRNA target sequence
tagaaatatccataagccatgct

SEQ ID NO: 89958 - DNA, 23 bp, Artificial sequence
  SiRNA target sequence
agaaatatccataagccatgctt

SEQ ID NO: 89959 - DNA, 23 bp, Artificial sequence
  SiRNA target sequence
gaaatatccataagccatgcttt

SEQ ID NO: 89960 - DNA, 23 bp, Artificial sequence
  SiRNA target sequence
aaatatccataagccatgctttt

SEQ ID NO: 89961 - DNA, 23 bp, Artificial sequence
  SiRNA target sequence
aatatccataagccatgcttttt

SEQ ID NO: 89962 - DNA, 23 bp, Artificial sequence
  SiRNA target sequence
atatccataagccatgctttttt

SEQ ID NO: 89963 - DNA, 23 bp, Artificial sequence
  SiRNA target sequence
tatccataagccatgctttttta

SEQ ID NO: 89964 - DNA, 23 bp, Artificial sequence
  SiRNA target sequence
atccataagccatgcttttttag

SEQ ID NO: 89965 - DNA, 23 bp, Artificial sequence
  SiRNA target sequence
tccataagccatgcttttttagg

SEQ ID NO: 89966 - DNA, 23 bp, Artificial sequence
  SiRNA target sequence
ccataagccatgcttttttaggc

SEQ ID NO: 89967 - DNA, 23 bp, Artificial sequence
  SiRNA target sequence
cataagccatgcttttttaggca

SEQ ID NO: 89968 - DNA, 23 bp, Artificial sequence
  SiRNA target sequence
ataagccatgcttttttaggcaa

SEQ ID NO: 89969 - DNA, 23 bp, Artificial sequence
  SiRNA target sequence
taagccatgcttttttaggcaat

SEQ ID NO: 89970 - DNA, 23 bp, Artificial sequence
  SiRNA target sequence
aagccatgcttttttaggcaatg

SEQ ID NO: 89971 - DNA, 23 bp, Artificial sequence
  SiRNA target sequence
agccatgcttttttaggcaatga

SEQ ID NO: 89972 - DNA, 23 bp, Artificial sequence
  SiRNA target sequence
gccatgcttttttaggcaatgaa

SEQ ID NO: 89973 - DNA, 23 bp, Artificial sequence
  SiRNA target sequence
ccatgcttttttaggcaatgaag

SEQ ID NO: 89974 - DNA, 23 bp, Artificial sequence
  SiRNA target sequence
catgcttttttaggcaatgaagt

SEQ ID NO: 89975 - DNA, 23 bp, Artificial sequence
  SiRNA target sequence
atgcttttttaggcaatgaagta

SEQ ID NO: 89976 - DNA, 23 bp, Artificial sequence
  SiRNA target sequence
tgcttttttaggcaatgaagtaa

SEQ ID NO: 89977 - DNA, 23 bp, Artificial sequence
  SiRNA target sequence
gcttttttaggcaatgaagtaaa

SEQ ID NO: 89978 - DNA, 23 bp, Artificial sequence
  SiRNA target sequence
cttttttaggcaatgaagtaaaa

SEQ ID NO: 89979 - DNA, 23 bp, Artificial sequence
  SiRNA target sequence
ttttttaggcaatgaagtaaaat

SEQ ID NO: 89980 - DNA, 23 bp, Artificial sequence
  SiRNA target sequence
tttttaggcaatgaagtaaaatc

SEQ ID NO: 89981 - DNA, 23 bp, Artificial sequence
  SiRNA target sequence
ttttaggcaatgaagtaaaatca

SEQ ID NO: 89982 - DNA, 23 bp, Artificial sequence
  SiRNA target sequence
tttaggcaatgaagtaaaatcaa

SEQ ID NO: 89983 - DNA, 23 bp, Artificial sequence
  SiRNA target sequence
ttaggcaatgaagtaaaatcaaa

SEQ ID NO: 89984 - DNA, 23 bp, Artificial sequence
  SiRNA target sequence
taggcaatgaagtaaaatcaaaa

SEQ ID NO: 89985 - DNA, 23 bp, Artificial sequence
  SiRNA target sequence
aggcaatgaagtaaaatcaaaaa

SEQ ID NO: 89986 - DNA, 23 bp, Artificial sequence
  SiRNA target sequence
ggcaatgaagtaaaatcaaaaat

SEQ ID NO: 89987 - DNA, 23 bp, Artificial sequence
  SiRNA target sequence
gcaatgaagtaaaatcaaaaata

SEQ ID NO: 89988 - DNA, 23 bp, Artificial sequence
  SiRNA target sequence
caatgaagtaaaatcaaaaatat

SEQ ID NO: 89989 - DNA, 23 bp, Artificial sequence
  SiRNA target sequence
aatgaagtaaaatcaaaaatata

SEQ ID NO: 89990 - DNA, 23 bp, Artificial sequence
  SiRNA target sequence
atgaagtaaaatcaaaaatatac

SEQ ID NO: 89991 - DNA, 23 bp, Artificial sequence
  SiRNA target sequence
tgaagtaaaatcaaaaatatact

SEQ ID NO: 89992 - DNA, 23 bp, Artificial sequence
  SiRNA target sequence
gaagtaaaatcaaaaatatactt

SEQ ID NO: 89993 - DNA, 23 bp, Artificial sequence
  SiRNA target sequence
aagtaaaatcaaaaatatacttg

SEQ ID NO: 89994 - DNA, 23 bp, Artificial sequence
  SiRNA target sequence
agtaaaatcaaaaatatacttga

SEQ ID NO: 89995 - DNA, 23 bp, Artificial sequence
  SiRNA target sequence
gtaaaatcaaaaatatacttgaa

SEQ ID NO: 89996 - DNA, 23 bp, Artificial sequence
  SiRNA target sequence
taaaatcaaaaatatacttgaaa

SEQ ID NO: 89997 - DNA, 23 bp, Artificial sequence
  SiRNA target sequence
aaaatcaaaaatatacttgaaaa

SEQ ID NO: 89998 - DNA, 23 bp, Artificial sequence
  SiRNA target sequence
aaatcaaaaatatacttgaaaaa

SEQ ID NO: 89999 - DNA, 23 bp, Artificial sequence
  SiRNA target sequence
aatcaaaaatatacttgaaaaag

SEQ ID NO: 90000 - DNA, 23 bp, Artificial sequence
  SiRNA target sequence
atcaaaaatatacttgaaaaagt

SEQ ID NO: 90001 - DNA, 23 bp, Artificial sequence
  SiRNA target sequence
tcaaaaatatacttgaaaaagtc

SEQ ID NO: 90002 - DNA, 23 bp, Artificial sequence
  SiRNA target sequence
caaaaatatacttgaaaaagtca

SEQ ID NO: 90003 - DNA, 23 bp, Artificial sequence
  SiRNA target sequence
aaaaatatacttgaaaaagtcac

SEQ ID NO: 90004 - DNA, 23 bp, Artificial sequence
  SiRNA target sequence
aaaatatacttgaaaaagtcacg

SEQ ID NO: 90005 - DNA, 23 bp, Artificial sequence
  SiRNA target sequence
aaatatacttgaaaaagtcacgc

SEQ ID NO: 90006 - DNA, 23 bp, Artificial sequence
  SiRNA target sequence
aatatacttgaaaaagtcacgca

SEQ ID NO: 90007 - DNA, 23 bp, Artificial sequence
  SiRNA target sequence
atatacttgaaaaagtcacgcaa

SEQ ID NO: 90008 - DNA, 23 bp, Artificial sequence
  SiRNA target sequence
tatacttgaaaaagtcacgcaaa

SEQ ID NO: 90009 - DNA, 23 bp, Artificial sequence
  SiRNA target sequence
atacttgaaaaagtcacgcaaag

SEQ ID NO: 90010 - DNA, 23 bp, Artificial sequence
  SiRNA target sequence
tacttgaaaaagtcacgcaaaga

SEQ ID NO: 90011 - DNA, 23 bp, Artificial sequence
  SiRNA target sequence
acttgaaaaagtcacgcaaagat

SEQ ID NO: 90012 - DNA, 23 bp, Artificial sequence
  SiRNA target sequence
cttgaaaaagtcacgcaaagatc

SEQ ID NO: 90013 - DNA, 23 bp, Artificial sequence
  SiRNA target sequence
ttgaaaaagtcacgcaaagatcc

SEQ ID NO: 90014 - DNA, 23 bp, Artificial sequence
  SiRNA target sequence
tgaaaaagtcacgcaaagatcct

SEQ ID NO: 90015 - DNA, 23 bp, Artificial sequence
  SiRNA target sequence
gaaaaagtcacgcaaagatcctt

SEQ ID NO: 90016 - DNA, 23 bp, Artificial sequence
  SiRNA target sequence
aaaaagtcacgcaaagatccttc

SEQ ID NO: 90017 - DNA, 23 bp, Artificial sequence
  SiRNA target sequence
aaaagtcacgcaaagatccttcg

SEQ ID NO: 90018 - DNA, 23 bp, Artificial sequence
  SiRNA target sequence
aaagtcacgcaaagatccttcga

SEQ ID NO: 90019 - DNA, 23 bp, Artificial sequence
  SiRNA target sequence
aagtcacgcaaagatccttcgaa

SEQ ID NO: 90020 - DNA, 23 bp, Artificial sequence
  SiRNA target sequence
agtcacgcaaagatccttcgaat

SEQ ID NO: 90021 - DNA, 23 bp, Artificial sequence
  SiRNA target sequence
gtcacgcaaagatccttcgaatt

SEQ ID NO: 90022 - DNA, 23 bp, Artificial sequence
  SiRNA target sequence
tcacgcaaagatccttcgaattg

SEQ ID NO: 90023 - DNA, 23 bp, Artificial sequence
  SiRNA target sequence
cacgcaaagatccttcgaattga

SEQ ID NO: 90024 - DNA, 23 bp, Artificial sequence
  SiRNA target sequence
acgcaaagatccttcgaattgaa

SEQ ID NO: 90025 - DNA, 23 bp, Artificial sequence
  SiRNA target sequence
cgcaaagatccttcgaattgaaa

SEQ ID NO: 90026 - DNA, 23 bp, Artificial sequence
  SiRNA target sequence
gcaaagatccttcgaattgaaac

SEQ ID NO: 90027 - DNA, 23 bp, Artificial sequence
  SiRNA target sequence
caaagatccttcgaattgaaacc

SEQ ID NO: 90028 - DNA, 23 bp, Artificial sequence
  SiRNA target sequence
aaagatccttcgaattgaaaccc

SEQ ID NO: 90029 - DNA, 23 bp, Artificial sequence
  SiRNA target sequence
aagatccttcgaattgaaacccc

SEQ ID NO: 90030 - DNA, 23 bp, Artificial sequence
  SiRNA target sequence
agatccttcgaattgaaaccccg

SEQ ID NO: 90031 - DNA, 23 bp, Artificial sequence
  SiRNA target sequence
gatccttcgaattgaaaccccgt

SEQ ID NO: 90032 - DNA, 23 bp, Artificial sequence
  SiRNA target sequence
atccttcgaattgaaaccccgtt

SEQ ID NO: 90033 - DNA, 23 bp, Artificial sequence
  SiRNA target sequence
tccttcgaattgaaaccccgttt

SEQ ID NO: 90034 - DNA, 23 bp, Artificial sequence
  SiRNA target sequence
ccttcgaattgaaaccccgtttt

SEQ ID NO: 90035 - DNA, 23 bp, Artificial sequence
  SiRNA target sequence
cttcgaattgaaaccccgttttt

SEQ ID NO: 90036 - DNA, 23 bp, Artificial sequence
  SiRNA target sequence
ttcgaattgaaaccccgtttttc

SEQ ID NO: 90037 - DNA, 23 bp, Artificial sequence
  SiRNA target sequence
tcgaattgaaaccccgtttttcc

SEQ ID NO: 90038 - DNA, 23 bp, Artificial sequence
  SiRNA target sequence
cgaattgaaaccccgtttttcca

SEQ ID NO: 90039 - DNA, 23 bp, Artificial sequence
  SiRNA target sequence
gaattgaaaccccgtttttccaa

SEQ ID NO: 90040 - DNA, 23 bp, Artificial sequence
  SiRNA target sequence
aattgaaaccccgtttttccaac

SEQ ID NO: 90041 - DNA, 23 bp, Artificial sequence
  SiRNA target sequence
attgaaaccccgtttttccaact

SEQ ID NO: 90042 - DNA, 23 bp, Artificial sequence
  SiRNA target sequence
ttgaaaccccgtttttccaactt

SEQ ID NO: 90043 - DNA, 23 bp, Artificial sequence
  SiRNA target sequence
tgaaaccccgtttttccaacttg

SEQ ID NO: 90044 - DNA, 23 bp, Artificial sequence
  SiRNA target sequence
gaaaccccgtttttccaacttgc

SEQ ID NO: 90045 - DNA, 23 bp, Artificial sequence
  SiRNA target sequence
aaaccccgtttttccaacttgct

SEQ ID NO: 90046 - DNA, 23 bp, Artificial sequence
  SiRNA target sequence
aaccccgtttttccaacttgctc

SEQ ID NO: 90047 - DNA, 23 bp, Artificial sequence
  SiRNA target sequence
accccgtttttccaacttgctca

SEQ ID NO: 90048 - DNA, 23 bp, Artificial sequence
  SiRNA target sequence
ccccgtttttccaacttgctcaa

SEQ ID NO: 90049 - DNA, 23 bp, Artificial sequence
  SiRNA target sequence
cccgtttttccaacttgctcaat

SEQ ID NO: 90050 - DNA, 23 bp, Artificial sequence
  SiRNA target sequence
ccgtttttccaacttgctcaata

SEQ ID NO: 90051 - DNA, 23 bp, Artificial sequence
  SiRNA target sequence
cgtttttccaacttgctcaatat

SEQ ID NO: 90052 - DNA, 23 bp, Artificial sequence
  SiRNA target sequence
gtttttccaacttgctcaatata

SEQ ID NO: 90053 - DNA, 23 bp, Artificial sequence
  SiRNA target sequence
tttttccaacttgctcaatatat

SEQ ID NO: 90054 - DNA, 23 bp, Artificial sequence
  SiRNA target sequence
ttttccaacttgctcaatatata

SEQ ID NO: 90055 - DNA, 23 bp, Artificial sequence
  SiRNA target sequence
tttccaacttgctcaatatataa

SEQ ID NO: 90056 - DNA, 23 bp, Artificial sequence
  SiRNA target sequence
ttccaacttgctcaatatataat

SEQ ID NO: 90057 - DNA, 23 bp, Artificial sequence
  SiRNA target sequence
tccaacttgctcaatatataata

SEQ ID NO: 90058 - DNA, 23 bp, Artificial sequence
  SiRNA target sequence
ccaacttgctcaatatataataa

SEQ ID NO: 90059 - DNA, 23 bp, Artificial sequence
  SiRNA target sequence
caacttgctcaatatataataat

SEQ ID NO: 90060 - DNA, 23 bp, Artificial sequence
  SiRNA target sequence
aacttgctcaatatataataatg

SEQ ID NO: 90061 - DNA, 23 bp, Artificial sequence
  SiRNA target sequence
acttgctcaatatataataatgt

SEQ ID NO: 90062 - DNA, 23 bp, Artificial sequence
  SiRNA target sequence
cttgctcaatatataataatgta

SEQ ID NO: 90063 - DNA, 23 bp, Artificial sequence
  SiRNA target sequence
ttgctcaatatataataatgtat

SEQ ID NO: 90064 - DNA, 23 bp, Artificial sequence
  SiRNA target sequence
tgctcaatatataataatgtatc

SEQ ID NO: 90065 - DNA, 23 bp, Artificial sequence
  SiRNA target sequence
gctcaatatataataatgtatca

SEQ ID NO: 90066 - DNA, 23 bp, Artificial sequence
  SiRNA target sequence
ctcaatatataataatgtatcac

SEQ ID NO: 90067 - DNA, 23 bp, Artificial sequence
  SiRNA target sequence
tcaatatataataatgtatcacc

SEQ ID NO: 90068 - DNA, 23 bp, Artificial sequence
  SiRNA target sequence
caatatataataatgtatcacca

SEQ ID NO: 90069 - DNA, 23 bp, Artificial sequence
  SiRNA target sequence
aatatataataatgtatcaccag

SEQ ID NO: 90070 - DNA, 23 bp, Artificial sequence
  SiRNA target sequence
atatataataatgtatcaccaga

SEQ ID NO: 90071 - DNA, 23 bp, Artificial sequence
  SiRNA target sequence
tatataataatgtatcaccagac

SEQ ID NO: 90072 - DNA, 23 bp, Artificial sequence
  SiRNA target sequence
atataataatgtatcaccagaca

SEQ ID NO: 90073 - DNA, 23 bp, Artificial sequence
  SiRNA target sequence
tataataatgtatcaccagacat

SEQ ID NO: 90074 - DNA, 23 bp, Artificial sequence
  SiRNA target sequence
ataataatgtatcaccagacatt

SEQ ID NO: 90075 - DNA, 23 bp, Artificial sequence
  SiRNA target sequence
taataatgtatcaccagacattt

SEQ ID NO: 90076 - DNA, 23 bp, Artificial sequence
  SiRNA target sequence
aataatgtatcaccagacatttc

SEQ ID NO: 90077 - DNA, 23 bp, Artificial sequence
  SiRNA target sequence
ataatgtatcaccagacatttct

SEQ ID NO: 90078 - DNA, 23 bp, Artificial sequence
  SiRNA target sequence
taatgtatcaccagacatttcta

SEQ ID NO: 90079 - DNA, 23 bp, Artificial sequence
  SiRNA target sequence
aatgtatcaccagacatttctag

SEQ ID NO: 90080 - DNA, 23 bp, Artificial sequence
  SiRNA target sequence
atgtatcaccagacatttctagt

SEQ ID NO: 90081 - DNA, 23 bp, Artificial sequence
  SiRNA target sequence
tgtatcaccagacatttctagta

SEQ ID NO: 90082 - DNA, 23 bp, Artificial sequence
  SiRNA target sequence
gtatcaccagacatttctagtaa

SEQ ID NO: 90083 - DNA, 23 bp, Artificial sequence
  SiRNA target sequence
tatcaccagacatttctagtaaa

SEQ ID NO: 90084 - DNA, 23 bp, Artificial sequence
  SiRNA target sequence
atcaccagacatttctagtaaac

SEQ ID NO: 90085 - DNA, 23 bp, Artificial sequence
  SiRNA target sequence
tcaccagacatttctagtaaact

SEQ ID NO: 90086 - DNA, 23 bp, Artificial sequence
  SiRNA target sequence
caccagacatttctagtaaactt

SEQ ID NO: 90087 - DNA, 23 bp, Artificial sequence
  SiRNA target sequence
accagacatttctagtaaactta

SEQ ID NO: 90088 - DNA, 23 bp, Artificial sequence
  SiRNA target sequence
ccagacatttctagtaaacttaa

SEQ ID NO: 90089 - DNA, 23 bp, Artificial sequence
  SiRNA target sequence
cagacatttctagtaaacttaac

SEQ ID NO: 90090 - DNA, 23 bp, Artificial sequence
  SiRNA target sequence
agacatttctagtaaacttaaca

SEQ ID NO: 90091 - DNA, 23 bp, Artificial sequence
  SiRNA target sequence
gacatttctagtaaacttaacat

SEQ ID NO: 90092 - DNA, 23 bp, Artificial sequence
  SiRNA target sequence
acatttctagtaaacttaacatt

SEQ ID NO: 90093 - DNA, 23 bp, Artificial sequence
  SiRNA target sequence
catttctagtaaacttaacattt

SEQ ID NO: 90094 - DNA, 23 bp, Artificial sequence
  SiRNA target sequence
atttctagtaaacttaacatttc

SEQ ID NO: 90095 - DNA, 23 bp, Artificial sequence
  SiRNA target sequence
tttctagtaaacttaacatttca

SEQ ID NO: 90096 - DNA, 23 bp, Artificial sequence
  SiRNA target sequence
ttctagtaaacttaacatttcat

SEQ ID NO: 90097 - DNA, 23 bp, Artificial sequence
  SiRNA target sequence
tctagtaaacttaacatttcatt

SEQ ID NO: 90098 - DNA, 23 bp, Artificial sequence
  SiRNA target sequence
ctagtaaacttaacatttcatta

SEQ ID NO: 90099 - DNA, 23 bp, Artificial sequence
  SiRNA target sequence
tagtaaacttaacatttcattaa

SEQ ID NO: 90100 - DNA, 23 bp, Artificial sequence
  SiRNA target sequence
agtaaacttaacatttcattaac

SEQ ID NO: 90101 - DNA, 23 bp, Artificial sequence
  SiRNA target sequence
gtaaacttaacatttcattaaca

SEQ ID NO: 90102 - DNA, 23 bp, Artificial sequence
  SiRNA target sequence
taaacttaacatttcattaacaa

SEQ ID NO: 90103 - DNA, 23 bp, Artificial sequence
  SiRNA target sequence
aaacttaacatttcattaacaag

SEQ ID NO: 90104 - DNA, 23 bp, Artificial sequence
  SiRNA target sequence
aacttaacatttcattaacaagc

SEQ ID NO: 90105 - DNA, 23 bp, Artificial sequence
  SiRNA target sequence
acttaacatttcattaacaagca

SEQ ID NO: 90106 - DNA, 23 bp, Artificial sequence
  SiRNA target sequence
cttaacatttcattaacaagcaa

SEQ ID NO: 90107 - DNA, 23 bp, Artificial sequence
  SiRNA target sequence
ttaacatttcattaacaagcaaa

SEQ ID NO: 90108 - DNA, 23 bp, Artificial sequence
  SiRNA target sequence
taacatttcattaacaagcaaat

SEQ ID NO: 90109 - DNA, 23 bp, Artificial sequence
  SiRNA target sequence
aacatttcattaacaagcaaatc

SEQ ID NO: 90110 - DNA, 23 bp, Artificial sequence
  SiRNA target sequence
acatttcattaacaagcaaatca

SEQ ID NO: 90111 - DNA, 23 bp, Artificial sequence
  SiRNA target sequence
catttcattaacaagcaaatcat

SEQ ID NO: 90112 - DNA, 23 bp, Artificial sequence
  SiRNA target sequence
atttcattaacaagcaaatcatt

SEQ ID NO: 90113 - DNA, 23 bp, Artificial sequence
  SiRNA target sequence
tttcattaacaagcaaatcatta

SEQ ID NO: 90114 - DNA, 23 bp, Artificial sequence
  SiRNA target sequence
ttcattaacaagcaaatcattat

SEQ ID NO: 90115 - DNA, 23 bp, Artificial sequence
  SiRNA target sequence
tcattaacaagcaaatcattatt

SEQ ID NO: 90116 - DNA, 23 bp, Artificial sequence
  SiRNA target sequence
cattaacaagcaaatcattattt

SEQ ID NO: 90117 - DNA, 23 bp, Artificial sequence
  SiRNA target sequence
attaacaagcaaatcattatttg

SEQ ID NO: 90118 - DNA, 23 bp, Artificial sequence
  SiRNA target sequence
ttaacaagcaaatcattatttga

SEQ ID NO: 90119 - DNA, 23 bp, Artificial sequence
  SiRNA target sequence
taacaagcaaatcattatttgaa

SEQ ID NO: 90120 - DNA, 23 bp, Artificial sequence
  SiRNA target sequence
aacaagcaaatcattatttgaac

SEQ ID NO: 90121 - DNA, 23 bp, Artificial sequence
  SiRNA target sequence
acaagcaaatcattatttgaaca

SEQ ID NO: 90122 - DNA, 23 bp, Artificial sequence
  SiRNA target sequence
caagcaaatcattatttgaacaa

SEQ ID NO: 90123 - DNA, 23 bp, Artificial sequence
  SiRNA target sequence
aagcaaatcattatttgaacaaa

SEQ ID NO: 90124 - DNA, 23 bp, Artificial sequence
  SiRNA target sequence
agcaaatcattatttgaacaaag

SEQ ID NO: 90125 - DNA, 23 bp, Artificial sequence
  SiRNA target sequence
gcaaatcattatttgaacaaagt

SEQ ID NO: 90126 - DNA, 23 bp, Artificial sequence
  SiRNA target sequence
caaatcattatttgaacaaagta

SEQ ID NO: 90127 - DNA, 23 bp, Artificial sequence
  SiRNA target sequence
aaatcattatttgaacaaagtag

SEQ ID NO: 90128 - DNA, 23 bp, Artificial sequence
  SiRNA target sequence
aatcattatttgaacaaagtaga

SEQ ID NO: 90129 - DNA, 23 bp, Artificial sequence
  SiRNA target sequence
atcattatttgaacaaagtagac

SEQ ID NO: 90130 - DNA, 23 bp, Artificial sequence
  SiRNA target sequence
tcattatttgaacaaagtagacc

SEQ ID NO: 90131 - DNA, 23 bp, Artificial sequence
  SiRNA target sequence
cattatttgaacaaagtagacca

SEQ ID NO: 90132 - DNA, 23 bp, Artificial sequence
  SiRNA target sequence
attatttgaacaaagtagaccaa

SEQ ID NO: 90133 - DNA, 23 bp, Artificial sequence
  SiRNA target sequence
ttatttgaacaaagtagaccaat

SEQ ID NO: 90134 - DNA, 23 bp, Artificial sequence
  SiRNA target sequence
tatttgaacaaagtagaccaata

SEQ ID NO: 90135 - DNA, 23 bp, Artificial sequence
  SiRNA target sequence
atttgaacaaagtagaccaatac

SEQ ID NO: 90136 - DNA, 23 bp, Artificial sequence
  SiRNA target sequence
tttgaacaaagtagaccaatact

SEQ ID NO: 90137 - DNA, 23 bp, Artificial sequence
  SiRNA target sequence
ttgaacaaagtagaccaatacta

SEQ ID NO: 90138 - DNA, 23 bp, Artificial sequence
  SiRNA target sequence
tgaacaaagtagaccaatactat

SEQ ID NO: 90139 - DNA, 23 bp, Artificial sequence
  SiRNA target sequence
gaacaaagtagaccaatactatc

SEQ ID NO: 90140 - DNA, 23 bp, Artificial sequence
  SiRNA target sequence
aacaaagtagaccaatactatca

SEQ ID NO: 90141 - DNA, 23 bp, Artificial sequence
  SiRNA target sequence
acaaagtagaccaatactatcac

SEQ ID NO: 90142 - DNA, 23 bp, Artificial sequence
  SiRNA target sequence
caaagtagaccaatactatcacc

SEQ ID NO: 90143 - DNA, 23 bp, Artificial sequence
  SiRNA target sequence
aaagtagaccaatactatcacca

SEQ ID NO: 90144 - DNA, 23 bp, Artificial sequence
  SiRNA target sequence
aagtagaccaatactatcaccag

SEQ ID NO: 90145 - DNA, 23 bp, Artificial sequence
  SiRNA target sequence
agtagaccaatactatcaccagg

SEQ ID NO: 90146 - DNA, 23 bp, Artificial sequence
  SiRNA target sequence
gtagaccaatactatcaccagga

SEQ ID NO: 90147 - DNA, 23 bp, Artificial sequence
  SiRNA target sequence
tagaccaatactatcaccaggaa

SEQ ID NO: 90148 - DNA, 23 bp, Artificial sequence
  SiRNA target sequence
agaccaatactatcaccaggaac

SEQ ID NO: 90149 - DNA, 23 bp, Artificial sequence
  SiRNA target sequence
gaccaatactatcaccaggaaca

SEQ ID NO: 90150 - DNA, 23 bp, Artificial sequence
  SiRNA target sequence
accaatactatcaccaggaacaa

SEQ ID NO: 90151 - DNA, 23 bp, Artificial sequence
  SiRNA target sequence
ccaatactatcaccaggaacaaa

SEQ ID NO: 90152 - DNA, 23 bp, Artificial sequence
  SiRNA target sequence
caatactatcaccaggaacaaaa

SEQ ID NO: 90153 - DNA, 23 bp, Artificial sequence
  SiRNA target sequence
aatactatcaccaggaacaaaat

SEQ ID NO: 90154 - DNA, 23 bp, Artificial sequence
  SiRNA target sequence
atactatcaccaggaacaaaatc

SEQ ID NO: 90155 - DNA, 23 bp, Artificial sequence
  SiRNA target sequence
tactatcaccaggaacaaaatct

SEQ ID NO: 90156 - DNA, 23 bp, Artificial sequence
  SiRNA target sequence
actatcaccaggaacaaaatcta

SEQ ID NO: 90157 - DNA, 23 bp, Artificial sequence
  SiRNA target sequence
ctatcaccaggaacaaaatctaa

SEQ ID NO: 90158 - DNA, 23 bp, Artificial sequence
  SiRNA target sequence
tatcaccaggaacaaaatctaat

SEQ ID NO: 90159 - DNA, 23 bp, Artificial sequence
  SiRNA target sequence
atcaccaggaacaaaatctaatg

SEQ ID NO: 90160 - DNA, 23 bp, Artificial sequence
  SiRNA target sequence
tcaccaggaacaaaatctaatgt

SEQ ID NO: 90161 - DNA, 23 bp, Artificial sequence
  SiRNA target sequence
caccaggaacaaaatctaatgta

SEQ ID NO: 90162 - DNA, 23 bp, Artificial sequence
  SiRNA target sequence
accaggaacaaaatctaatgtat

SEQ ID NO: 90163 - DNA, 23 bp, Artificial sequence
  SiRNA target sequence
ccaggaacaaaatctaatgtata

SEQ ID NO: 90164 - DNA, 23 bp, Artificial sequence
  SiRNA target sequence
caggaacaaaatctaatgtataa

SEQ ID NO: 90165 - DNA, 23 bp, Artificial sequence
  SiRNA target sequence
aggaacaaaatctaatgtataat

SEQ ID NO: 90166 - DNA, 23 bp, Artificial sequence
  SiRNA target sequence
ggaacaaaatctaatgtataatt

SEQ ID NO: 90167 - DNA, 23 bp, Artificial sequence
  SiRNA target sequence
gaacaaaatctaatgtataatta

SEQ ID NO: 90168 - DNA, 23 bp, Artificial sequence
  SiRNA target sequence
aacaaaatctaatgtataattaa

SEQ ID NO: 90169 - DNA, 23 bp, Artificial sequence
  SiRNA target sequence
acaaaatctaatgtataattaag

SEQ ID NO: 90170 - DNA, 23 bp, Artificial sequence
  SiRNA target sequence
caaaatctaatgtataattaagt

SEQ ID NO: 90171 - DNA, 23 bp, Artificial sequence
  SiRNA target sequence
aaaatctaatgtataattaagtt

SEQ ID NO: 90172 - DNA, 23 bp, Artificial sequence
  SiRNA target sequence
aaatctaatgtataattaagttg

SEQ ID NO: 90173 - DNA, 23 bp, Artificial sequence
  SiRNA target sequence
aatctaatgtataattaagttga

SEQ ID NO: 90174 - DNA, 23 bp, Artificial sequence
  SiRNA target sequence
atctaatgtataattaagttgaa

SEQ ID NO: 90175 - DNA, 23 bp, Artificial sequence
  SiRNA target sequence
tctaatgtataattaagttgaac

SEQ ID NO: 90176 - DNA, 23 bp, Artificial sequence
  SiRNA target sequence
ctaatgtataattaagttgaacc

SEQ ID NO: 90177 - DNA, 23 bp, Artificial sequence
  SiRNA target sequence
taatgtataattaagttgaacct

SEQ ID NO: 90178 - DNA, 23 bp, Artificial sequence
  SiRNA target sequence
aatgtataattaagttgaacctt

SEQ ID NO: 90179 - DNA, 23 bp, Artificial sequence
  SiRNA target sequence
atgtataattaagttgaacctta

SEQ ID NO: 90180 - DNA, 23 bp, Artificial sequence
  SiRNA target sequence
tgtataattaagttgaaccttat

SEQ ID NO: 90181 - DNA, 23 bp, Artificial sequence
  SiRNA target sequence
gtataattaagttgaaccttata

SEQ ID NO: 90182 - DNA, 23 bp, Artificial sequence
  SiRNA target sequence
tataattaagttgaaccttatat

SEQ ID NO: 90183 - DNA, 23 bp, Artificial sequence
  SiRNA target sequence
ataattaagttgaaccttatata

SEQ ID NO: 90184 - DNA, 23 bp, Artificial sequence
  SiRNA target sequence
taattaagttgaaccttatatac

SEQ ID NO: 90185 - DNA, 23 bp, Artificial sequence
  SiRNA target sequence
aattaagttgaaccttatatacc

SEQ ID NO: 90186 - DNA, 23 bp, Artificial sequence
  SiRNA target sequence
attaagttgaaccttatatacct

SEQ ID NO: 90187 - DNA, 23 bp, Artificial sequence
  SiRNA target sequence
ttaagttgaaccttatatacctt

SEQ ID NO: 90188 - DNA, 23 bp, Artificial sequence
  SiRNA target sequence
taagttgaaccttatataccttt

SEQ ID NO: 90189 - DNA, 23 bp, Artificial sequence
  SiRNA target sequence
aagttgaaccttatatacctttt

SEQ ID NO: 90190 - DNA, 23 bp, Artificial sequence
  SiRNA target sequence
agttgaaccttatataccttttt

SEQ ID NO: 90191 - DNA, 23 bp, Artificial sequence
  SiRNA target sequence
gttgaaccttatatacctttttc

SEQ ID NO: 90192 - DNA, 23 bp, Artificial sequence
  SiRNA target sequence
ttgaaccttatatacctttttcc

SEQ ID NO: 90193 - DNA, 23 bp, Artificial sequence
  SiRNA target sequence
tgaaccttatatacctttttcca

SEQ ID NO: 90194 - DNA, 23 bp, Artificial sequence
  SiRNA target sequence
gaaccttatatacctttttccat

SEQ ID NO: 90195 - DNA, 23 bp, Artificial sequence
  SiRNA target sequence
aaccttatatacctttttccatg

SEQ ID NO: 90196 - DNA, 23 bp, Artificial sequence
  SiRNA target sequence
accttatatacctttttccatgt

SEQ ID NO: 90197 - DNA, 23 bp, Artificial sequence
  SiRNA target sequence
ccttatatacctttttccatgta

SEQ ID NO: 90198 - DNA, 23 bp, Artificial sequence
  SiRNA target sequence
cttatatacctttttccatgtac

SEQ ID NO: 90199 - DNA, 23 bp, Artificial sequence
  SiRNA target sequence
ttatatacctttttccatgtaca

SEQ ID NO: 90200 - DNA, 23 bp, Artificial sequence
  SiRNA target sequence
tatatacctttttccatgtacag

SEQ ID NO: 90201 - DNA, 23 bp, Artificial sequence
  SiRNA target sequence
atatacctttttccatgtacagg

SEQ ID NO: 90202 - DNA, 23 bp, Artificial sequence
  SiRNA target sequence
tatacctttttccatgtacagga

SEQ ID NO: 90203 - DNA, 23 bp, Artificial sequence
  SiRNA target sequence
atacctttttccatgtacaggaa

SEQ ID NO: 90204 - DNA, 23 bp, Artificial sequence
  SiRNA target sequence
tacctttttccatgtacaggaaa

SEQ ID NO: 90205 - DNA, 23 bp, Artificial sequence
  SiRNA target sequence
acctttttccatgtacaggaaag

SEQ ID NO: 90206 - DNA, 23 bp, Artificial sequence
  SiRNA target sequence
cctttttccatgtacaggaaagg

SEQ ID NO: 90207 - DNA, 23 bp, Artificial sequence
  SiRNA target sequence
ctttttccatgtacaggaaaggt

SEQ ID NO: 90208 - DNA, 23 bp, Artificial sequence
  SiRNA target sequence
tttttccatgtacaggaaaggtt

SEQ ID NO: 90209 - DNA, 23 bp, Artificial sequence
  SiRNA target sequence
ttttccatgtacaggaaaggttt

SEQ ID NO: 90210 - DNA, 23 bp, Artificial sequence
  SiRNA target sequence
tttccatgtacaggaaaggtttt

SEQ ID NO: 90211 - DNA, 23 bp, Artificial sequence
  SiRNA target sequence
ttccatgtacaggaaaggttttc

SEQ ID NO: 90212 - DNA, 23 bp, Artificial sequence
  SiRNA target sequence
tccatgtacaggaaaggttttca

SEQ ID NO: 90213 - DNA, 23 bp, Artificial sequence
  SiRNA target sequence
ccatgtacaggaaaggttttcaa

SEQ ID NO: 90214 - DNA, 23 bp, Artificial sequence
  SiRNA target sequence
catgtacaggaaaggttttcaat

SEQ ID NO: 90215 - DNA, 23 bp, Artificial sequence
  SiRNA target sequence
atgtacaggaaaggttttcaata

SEQ ID NO: 90216 - DNA, 23 bp, Artificial sequence
  SiRNA target sequence
tgtacaggaaaggttttcaatat

SEQ ID NO: 90217 - DNA, 23 bp, Artificial sequence
  SiRNA target sequence
gtacaggaaaggttttcaatatt

SEQ ID NO: 90218 - DNA, 23 bp, Artificial sequence
  SiRNA target sequence
tacaggaaaggttttcaatattt

SEQ ID NO: 90219 - DNA, 23 bp, Artificial sequence
  SiRNA target sequence
acaggaaaggttttcaatattta

SEQ ID NO: 90220 - DNA, 23 bp, Artificial sequence
  SiRNA target sequence
caggaaaggttttcaatatttag

SEQ ID NO: 90221 - DNA, 23 bp, Artificial sequence
  SiRNA target sequence
aggaaaggttttcaatatttagt

SEQ ID NO: 90222 - DNA, 23 bp, Artificial sequence
  SiRNA target sequence
ggaaaggttttcaatatttagta

SEQ ID NO: 90223 - DNA, 23 bp, Artificial sequence
  SiRNA target sequence
gaaaggttttcaatatttagtat

SEQ ID NO: 90224 - DNA, 23 bp, Artificial sequence
  SiRNA target sequence
aaaggttttcaatatttagtata

SEQ ID NO: 90225 - DNA, 23 bp, Artificial sequence
  SiRNA target sequence
aaggttttcaatatttagtatat

SEQ ID NO: 90226 - DNA, 23 bp, Artificial sequence
  SiRNA target sequence
aggttttcaatatttagtatatt

SEQ ID NO: 90227 - DNA, 23 bp, Artificial sequence
  SiRNA target sequence
ggttttcaatatttagtatattt

SEQ ID NO: 90228 - DNA, 23 bp, Artificial sequence
  SiRNA target sequence
gttttcaatatttagtatatttg

SEQ ID NO: 90229 - DNA, 23 bp, Artificial sequence
  SiRNA target sequence
ttttcaatatttagtatatttgt

SEQ ID NO: 90230 - DNA, 23 bp, Artificial sequence
  SiRNA target sequence
tttcaatatttagtatatttgta

SEQ ID NO: 90231 - DNA, 23 bp, Artificial sequence
  SiRNA target sequence
ttcaatatttagtatatttgtat

SEQ ID NO: 90232 - DNA, 23 bp, Artificial sequence
  SiRNA target sequence
tcaatatttagtatatttgtatc

SEQ ID NO: 90233 - DNA, 23 bp, Artificial sequence
  SiRNA target sequence
caatatttagtatatttgtatct

SEQ ID NO: 90234 - DNA, 23 bp, Artificial sequence
  SiRNA target sequence
aatatttagtatatttgtatcta

SEQ ID NO: 90235 - DNA, 23 bp, Artificial sequence
  SiRNA target sequence
atatttagtatatttgtatctat

SEQ ID NO: 90236 - DNA, 23 bp, Artificial sequence
  SiRNA target sequence
tatttagtatatttgtatctatc

SEQ ID NO: 90237 - DNA, 23 bp, Artificial sequence
  SiRNA target sequence
atttagtatatttgtatctatca

SEQ ID NO: 90238 - DNA, 23 bp, Artificial sequence
  SiRNA target sequence
tttagtatatttgtatctatcaa

SEQ ID NO: 90239 - DNA, 23 bp, Artificial sequence
  SiRNA target sequence
ttagtatatttgtatctatcaaa

SEQ ID NO: 90240 - DNA, 23 bp, Artificial sequence
  SiRNA target sequence
tagtatatttgtatctatcaaat

SEQ ID NO: 90241 - DNA, 23 bp, Artificial sequence
  SiRNA target sequence
agtatatttgtatctatcaaatt

SEQ ID NO: 90242 - DNA, 23 bp, Artificial sequence
  SiRNA target sequence
gtatatttgtatctatcaaattt

SEQ ID NO: 90243 - DNA, 23 bp, Artificial sequence
  SiRNA target sequence
tatatttgtatctatcaaattta

SEQ ID NO: 90244 - DNA, 23 bp, Artificial sequence
  SiRNA target sequence
atatttgtatctatcaaatttat

SEQ ID NO: 90245 - DNA, 23 bp, Artificial sequence
  SiRNA target sequence
tatttgtatctatcaaatttata

SEQ ID NO: 90246 - DNA, 23 bp, Artificial sequence
  SiRNA target sequence
atttgtatctatcaaatttatat

SEQ ID NO: 90247 - DNA, 23 bp, Artificial sequence
  SiRNA target sequence
tttgtatctatcaaatttatatt

SEQ ID NO: 90248 - DNA, 23 bp, Artificial sequence
  SiRNA target sequence
ttgtatctatcaaatttatattc

SEQ ID NO: 90249 - DNA, 23 bp, Artificial sequence
  SiRNA target sequence
tgtatctatcaaatttatattct

SEQ ID NO: 90250 - DNA, 23 bp, Artificial sequence
  SiRNA target sequence
gtatctatcaaatttatattctc

SEQ ID NO: 90251 - DNA, 23 bp, Artificial sequence
  SiRNA target sequence
tatctatcaaatttatattctcg

SEQ ID NO: 90252 - DNA, 23 bp, Artificial sequence
  SiRNA target sequence
atctatcaaatttatattctcgt

SEQ ID NO: 90253 - DNA, 23 bp, Artificial sequence
  SiRNA target sequence
tctatcaaatttatattctcgtt

SEQ ID NO: 90254 - DNA, 23 bp, Artificial sequence
  SiRNA target sequence
ctatcaaatttatattctcgttt

SEQ ID NO: 90255 - DNA, 23 bp, Artificial sequence
  SiRNA target sequence
tatcaaatttatattctcgtttg

SEQ ID NO: 90256 - DNA, 23 bp, Artificial sequence
  SiRNA target sequence
atcaaatttatattctcgtttgt

SEQ ID NO: 90257 - DNA, 23 bp, Artificial sequence
  SiRNA target sequence
tcaaatttatattctcgtttgtc

SEQ ID NO: 90258 - DNA, 23 bp, Artificial sequence
  SiRNA target sequence
caaatttatattctcgtttgtct

SEQ ID NO: 90259 - DNA, 23 bp, Artificial sequence
  SiRNA target sequence
aaatttatattctcgtttgtctt

SEQ ID NO: 90260 - DNA, 23 bp, Artificial sequence
  SiRNA target sequence
aatttatattctcgtttgtcttt

SEQ ID NO: 90261 - DNA, 23 bp, Artificial sequence
  SiRNA target sequence
atttatattctcgtttgtcttta

SEQ ID NO: 90262 - DNA, 23 bp, Artificial sequence
  SiRNA target sequence
tttatattctcgtttgtctttat

SEQ ID NO: 90263 - DNA, 23 bp, Artificial sequence
  SiRNA target sequence
ttatattctcgtttgtctttatt

SEQ ID NO: 90264 - DNA, 23 bp, Artificial sequence
  SiRNA target sequence
tatattctcgtttgtctttattt

SEQ ID NO: 90265 - DNA, 23 bp, Artificial sequence
  SiRNA target sequence
atattctcgtttgtctttatttt

SEQ ID NO: 90266 - DNA, 23 bp, Artificial sequence
  SiRNA target sequence
tattctcgtttgtctttatttta

SEQ ID NO: 90267 - DNA, 23 bp, Artificial sequence
  SiRNA target sequence
attctcgtttgtctttattttat

SEQ ID NO: 90268 - DNA, 23 bp, Artificial sequence
  SiRNA target sequence
ttctcgtttgtctttattttata

SEQ ID NO: 90269 - DNA, 23 bp, Artificial sequence
  SiRNA target sequence
tctcgtttgtctttattttataa

SEQ ID NO: 90270 - DNA, 23 bp, Artificial sequence
  SiRNA target sequence
ctcgtttgtctttattttataag

SEQ ID NO: 90271 - DNA, 23 bp, Artificial sequence
  SiRNA target sequence
tcgtttgtctttattttataaga

SEQ ID NO: 90272 - DNA, 23 bp, Artificial sequence
  SiRNA target sequence
cgtttgtctttattttataagaa

SEQ ID NO: 90273 - DNA, 23 bp, Artificial sequence
  SiRNA target sequence
gtttgtctttattttataagaac

SEQ ID NO: 90274 - DNA, 23 bp, Artificial sequence
  SiRNA target sequence
tttgtctttattttataagaacc

SEQ ID NO: 90275 - DNA, 23 bp, Artificial sequence
  SiRNA target sequence
ttgtctttattttataagaacct

SEQ ID NO: 90276 - DNA, 23 bp, Artificial sequence
  SiRNA target sequence
tgtctttattttataagaacctg

SEQ ID NO: 90277 - DNA, 23 bp, Artificial sequence
  SiRNA target sequence
gtctttattttataagaacctgt

SEQ ID NO: 90278 - DNA, 23 bp, Artificial sequence
  SiRNA target sequence
tctttattttataagaacctgta

SEQ ID NO: 90279 - DNA, 23 bp, Artificial sequence
  SiRNA target sequence
ctttattttataagaacctgtat

SEQ ID NO: 90280 - DNA, 23 bp, Artificial sequence
  SiRNA target sequence
tttattttataagaacctgtata

SEQ ID NO: 90281 - DNA, 23 bp, Artificial sequence
  SiRNA target sequence
ttattttataagaacctgtatag

SEQ ID NO: 90282 - DNA, 23 bp, Artificial sequence
  SiRNA target sequence
tattttataagaacctgtatagt

SEQ ID NO: 90283 - DNA, 23 bp, Artificial sequence
  SiRNA target sequence
attttataagaacctgtatagtt

SEQ ID NO: 90284 - DNA, 23 bp, Artificial sequence
  SiRNA target sequence
ttttataagaacctgtatagttg

SEQ ID NO: 90285 - DNA, 23 bp, Artificial sequence
  SiRNA target sequence
tttataagaacctgtatagttgg

SEQ ID NO: 90286 - DNA, 23 bp, Artificial sequence
  SiRNA target sequence
ttataagaacctgtatagttggt

SEQ ID NO: 90287 - DNA, 23 bp, Artificial sequence
  SiRNA target sequence
tataagaacctgtatagttggtc

SEQ ID NO: 90288 - DNA, 23 bp, Artificial sequence
  SiRNA target sequence
ataagaacctgtatagttggtct

SEQ ID NO: 90289 - DNA, 23 bp, Artificial sequence
  SiRNA target sequence
taagaacctgtatagttggtctt

SEQ ID NO: 90290 - DNA, 23 bp, Artificial sequence
  SiRNA target sequence
aagaacctgtatagttggtcttt

SEQ ID NO: 90291 - DNA, 23 bp, Artificial sequence
  SiRNA target sequence
agaacctgtatagttggtctttt

SEQ ID NO: 90292 - DNA, 23 bp, Artificial sequence
  SiRNA target sequence
gaacctgtatagttggtcttttt

SEQ ID NO: 90293 - DNA, 23 bp, Artificial sequence
  SiRNA target sequence
aacctgtatagttggtcttttta

SEQ ID NO: 90294 - DNA, 23 bp, Artificial sequence
  SiRNA target sequence
acctgtatagttggtctttttaa

SEQ ID NO: 90295 - DNA, 23 bp, Artificial sequence
  SiRNA target sequence
cctgtatagttggtctttttaat

SEQ ID NO: 90296 - DNA, 23 bp, Artificial sequence
  SiRNA target sequence
ctgtatagttggtctttttaatt

SEQ ID NO: 90297 - DNA, 23 bp, Artificial sequence
  SiRNA target sequence
tgtatagttggtctttttaatta

SEQ ID NO: 90298 - DNA, 23 bp, Artificial sequence
  SiRNA target sequence
gtatagttggtctttttaattat

SEQ ID NO: 90299 - DNA, 23 bp, Artificial sequence
  SiRNA target sequence
tatagttggtctttttaattata

SEQ ID NO: 90300 - DNA, 23 bp, Artificial sequence
  SiRNA target sequence
atagttggtctttttaattataa

SEQ ID NO: 90301 - DNA, 23 bp, Artificial sequence
  SiRNA target sequence
tagttggtctttttaattataag

SEQ ID NO: 90302 - DNA, 23 bp, Artificial sequence
  SiRNA target sequence
agttggtctttttaattataagc

SEQ ID NO: 90303 - DNA, 23 bp, Artificial sequence
  SiRNA target sequence
gttggtctttttaattataagct

SEQ ID NO: 90304 - DNA, 23 bp, Artificial sequence
  SiRNA target sequence
ttggtctttttaattataagctt

SEQ ID NO: 90305 - DNA, 23 bp, Artificial sequence
  SiRNA target sequence
tggtctttttaattataagctta

SEQ ID NO: 90306 - DNA, 23 bp, Artificial sequence
  SiRNA target sequence
ggtctttttaattataagcttat

SEQ ID NO: 90307 - DNA, 23 bp, Artificial sequence
  SiRNA target sequence
gtctttttaattataagcttatt

SEQ ID NO: 90308 - DNA, 23 bp, Artificial sequence
  SiRNA target sequence
tctttttaattataagcttattg

SEQ ID NO: 90309 - DNA, 23 bp, Artificial sequence
  SiRNA target sequence
ctttttaattataagcttattga

SEQ ID NO: 90310 - DNA, 23 bp, Artificial sequence
  SiRNA target sequence
tttttaattataagcttattgaa

SEQ ID NO: 90311 - DNA, 23 bp, Artificial sequence
  SiRNA target sequence
ttttaattataagcttattgaaa

SEQ ID NO: 90312 - DNA, 23 bp, Artificial sequence
  SiRNA target sequence
tttaattataagcttattgaaat

SEQ ID NO: 90313 - DNA, 23 bp, Artificial sequence
  SiRNA target sequence
ttaattataagcttattgaaatt

SEQ ID NO: 90314 - DNA, 23 bp, Artificial sequence
  SiRNA target sequence
taattataagcttattgaaattt

SEQ ID NO: 90315 - DNA, 23 bp, Artificial sequence
  SiRNA target sequence
aattataagcttattgaaatttc

SEQ ID NO: 90316 - DNA, 23 bp, Artificial sequence
  SiRNA target sequence
attataagcttattgaaatttct

SEQ ID NO: 90317 - DNA, 23 bp, Artificial sequence
  SiRNA target sequence
ttataagcttattgaaatttcta

SEQ ID NO: 90318 - DNA, 23 bp, Artificial sequence
  SiRNA target sequence
tataagcttattgaaatttctaa

SEQ ID NO: 90319 - DNA, 23 bp, Artificial sequence
  SiRNA target sequence
ataagcttattgaaatttctaat

SEQ ID NO: 90320 - DNA, 23 bp, Artificial sequence
  SiRNA target sequence
taagcttattgaaatttctaata

SEQ ID NO: 90321 - DNA, 23 bp, Artificial sequence
  SiRNA target sequence
aagcttattgaaatttctaatat

SEQ ID NO: 90322 - DNA, 23 bp, Artificial sequence
  SiRNA target sequence
agcttattgaaatttctaatatt

SEQ ID NO: 90323 - DNA, 23 bp, Artificial sequence
  SiRNA target sequence
gcttattgaaatttctaatattt

SEQ ID NO: 90324 - DNA, 23 bp, Artificial sequence
  SiRNA target sequence
cttattgaaatttctaatattta

SEQ ID NO: 90325 - DNA, 23 bp, Artificial sequence
  SiRNA target sequence
ttattgaaatttctaatatttaa

SEQ ID NO: 90326 - DNA, 23 bp, Artificial sequence
  SiRNA target sequence
tattgaaatttctaatatttaaa

SEQ ID NO: 90327 - DNA, 23 bp, Artificial sequence
  SiRNA target sequence
attgaaatttctaatatttaaag

SEQ ID NO: 90328 - DNA, 23 bp, Artificial sequence
  SiRNA target sequence
ttgaaatttctaatatttaaagg

SEQ ID NO: 90329 - DNA, 23 bp, Artificial sequence
  SiRNA target sequence
tgaaatttctaatatttaaagga

SEQ ID NO: 90330 - DNA, 23 bp, Artificial sequence
  SiRNA target sequence
gaaatttctaatatttaaaggaa

SEQ ID NO: 90331 - DNA, 23 bp, Artificial sequence
  SiRNA target sequence
aaatttctaatatttaaaggaac

SEQ ID NO: 90332 - DNA, 23 bp, Artificial sequence
  SiRNA target sequence
aatttctaatatttaaaggaaca

SEQ ID NO: 90333 - DNA, 23 bp, Artificial sequence
  SiRNA target sequence
atttctaatatttaaaggaacaa

SEQ ID NO: 90334 - DNA, 23 bp, Artificial sequence
  SiRNA target sequence
tttctaatatttaaaggaacaaa

SEQ ID NO: 90335 - DNA, 23 bp, Artificial sequence
  SiRNA target sequence
ttctaatatttaaaggaacaaaa

SEQ ID NO: 90336 - DNA, 23 bp, Artificial sequence
  SiRNA target sequence
tctaatatttaaaggaacaaaat

SEQ ID NO: 90337 - DNA, 23 bp, Artificial sequence
  SiRNA target sequence
ctaatatttaaaggaacaaaatc

SEQ ID NO: 90338 - DNA, 23 bp, Artificial sequence
  SiRNA target sequence
taatatttaaaggaacaaaatct

SEQ ID NO: 90339 - DNA, 23 bp, Artificial sequence
  SiRNA target sequence
aatatttaaaggaacaaaatcta

SEQ ID NO: 90340 - DNA, 23 bp, Artificial sequence
  SiRNA target sequence
atatttaaaggaacaaaatctac

SEQ ID NO: 90341 - DNA, 23 bp, Artificial sequence
  SiRNA target sequence
tatttaaaggaacaaaatctaca

SEQ ID NO: 90342 - DNA, 23 bp, Artificial sequence
  SiRNA target sequence
atttaaaggaacaaaatctacat

SEQ ID NO: 90343 - DNA, 23 bp, Artificial sequence
  SiRNA target sequence
tttaaaggaacaaaatctacatt

SEQ ID NO: 90344 - DNA, 23 bp, Artificial sequence
  SiRNA target sequence
ttaaaggaacaaaatctacattt

SEQ ID NO: 90345 - DNA, 23 bp, Artificial sequence
  SiRNA target sequence
taaaggaacaaaatctacattta

SEQ ID NO: 90346 - DNA, 23 bp, Artificial sequence
  SiRNA target sequence
aaaggaacaaaatctacatttag

SEQ ID NO: 90347 - DNA, 23 bp, Artificial sequence
  SiRNA target sequence
aaggaacaaaatctacatttaga

SEQ ID NO: 90348 - DNA, 23 bp, Artificial sequence
  SiRNA target sequence
aggaacaaaatctacatttagat

SEQ ID NO: 90349 - DNA, 23 bp, Artificial sequence
  SiRNA target sequence
ggaacaaaatctacatttagatt

SEQ ID NO: 90350 - DNA, 23 bp, Artificial sequence
  SiRNA target sequence
gaacaaaatctacatttagatta

SEQ ID NO: 90351 - DNA, 23 bp, Artificial sequence
  SiRNA target sequence
aacaaaatctacatttagattat

SEQ ID NO: 90352 - DNA, 23 bp, Artificial sequence
  SiRNA target sequence
acaaaatctacatttagattata

SEQ ID NO: 90353 - DNA, 23 bp, Artificial sequence
  SiRNA target sequence
caaaatctacatttagattatat

SEQ ID NO: 90354 - DNA, 23 bp, Artificial sequence
  SiRNA target sequence
aaaatctacatttagattatatt

SEQ ID NO: 90355 - DNA, 23 bp, Artificial sequence
  SiRNA target sequence
aaatctacatttagattatattc

SEQ ID NO: 90356 - DNA, 23 bp, Artificial sequence
  SiRNA target sequence
aatctacatttagattatattct

SEQ ID NO: 90357 - DNA, 23 bp, Artificial sequence
  SiRNA target sequence
atctacatttagattatattcta

SEQ ID NO: 90358 - DNA, 23 bp, Artificial sequence
  SiRNA target sequence
tctacatttagattatattctaa

SEQ ID NO: 90359 - DNA, 23 bp, Artificial sequence
  SiRNA target sequence
ctacatttagattatattctaat

SEQ ID NO: 90360 - DNA, 23 bp, Artificial sequence
  SiRNA target sequence
tacatttagattatattctaatt

SEQ ID NO: 90361 - DNA, 23 bp, Artificial sequence
  SiRNA target sequence
acatttagattatattctaattt

SEQ ID NO: 90362 - DNA, 23 bp, Artificial sequence
  SiRNA target sequence
catttagattatattctaattta

SEQ ID NO: 90363 - DNA, 23 bp, Artificial sequence
  SiRNA target sequence
atttagattatattctaatttat

SEQ ID NO: 90364 - DNA, 23 bp, Artificial sequence
  SiRNA target sequence
tttagattatattctaatttatt

SEQ ID NO: 90365 - DNA, 23 bp, Artificial sequence
  SiRNA target sequence
ttagattatattctaatttattg

SEQ ID NO: 90366 - DNA, 23 bp, Artificial sequence
  SiRNA target sequence
tagattatattctaatttattga

SEQ ID NO: 90367 - DNA, 23 bp, Artificial sequence
  SiRNA target sequence
agattatattctaatttattgaa

SEQ ID NO: 90368 - DNA, 23 bp, Artificial sequence
  SiRNA target sequence
gattatattctaatttattgaat

SEQ ID NO: 90369 - DNA, 23 bp, Artificial sequence
  SiRNA target sequence
attatattctaatttattgaatt

SEQ ID NO: 90370 - DNA, 23 bp, Artificial sequence
  SiRNA target sequence
ttatattctaatttattgaattt

SEQ ID NO: 90371 - DNA, 23 bp, Artificial sequence
  SiRNA target sequence
tatattctaatttattgaatttc

SEQ ID NO: 90372 - DNA, 23 bp, Artificial sequence
  SiRNA target sequence
atattctaatttattgaatttca

SEQ ID NO: 90373 - DNA, 23 bp, Artificial sequence
  SiRNA target sequence
tattctaatttattgaatttcat

SEQ ID NO: 90374 - DNA, 24 bp, Artificial sequence
  SiRNA target sequence
ttatatccaactatcaaaaaatag

SEQ ID NO: 90375 - DNA, 24 bp, Artificial sequence
  SiRNA target sequence
tatatccaactatcaaaaaatagc

SEQ ID NO: 90376 - DNA, 24 bp, Artificial sequence
  SiRNA target sequence
atatccaactatcaaaaaatagcc

SEQ ID NO: 90377 - DNA, 24 bp, Artificial sequence
  SiRNA target sequence
tatccaactatcaaaaaatagcct

SEQ ID NO: 90378 - DNA, 24 bp, Artificial sequence
  SiRNA target sequence
atccaactatcaaaaaatagcctc

SEQ ID NO: 90379 - DNA, 24 bp, Artificial sequence
  SiRNA target sequence
tccaactatcaaaaaatagcctct

SEQ ID NO: 90380 - DNA, 24 bp, Artificial sequence
  SiRNA target sequence
ccaactatcaaaaaatagcctctt

SEQ ID NO: 90381 - DNA, 24 bp, Artificial sequence
  SiRNA target sequence
caactatcaaaaaatagcctcttt

SEQ ID NO: 90382 - DNA, 24 bp, Artificial sequence
  SiRNA target sequence
aactatcaaaaaatagcctctttt

SEQ ID NO: 90383 - DNA, 24 bp, Artificial sequence
  SiRNA target sequence
actatcaaaaaatagcctcttttc

SEQ ID NO: 90384 - DNA, 24 bp, Artificial sequence
  SiRNA target sequence
ctatcaaaaaatagcctcttttct

SEQ ID NO: 90385 - DNA, 24 bp, Artificial sequence
  SiRNA target sequence
tatcaaaaaatagcctcttttctt

SEQ ID NO: 90386 - DNA, 24 bp, Artificial sequence
  SiRNA target sequence
atcaaaaaatagcctcttttcttt

SEQ ID NO: 90387 - DNA, 24 bp, Artificial sequence
  SiRNA target sequence
tcaaaaaatagcctcttttctttc

SEQ ID NO: 90388 - DNA, 24 bp, Artificial sequence
  SiRNA target sequence
caaaaaatagcctcttttctttca

SEQ ID NO: 90389 - DNA, 24 bp, Artificial sequence
  SiRNA target sequence
aaaaaatagcctcttttctttcac

SEQ ID NO: 90390 - DNA, 24 bp, Artificial sequence
  SiRNA target sequence
aaaaatagcctcttttctttcaca

SEQ ID NO: 90391 - DNA, 24 bp, Artificial sequence
  SiRNA target sequence
aaaatagcctcttttctttcacaa

SEQ ID NO: 90392 - DNA, 24 bp, Artificial sequence
  SiRNA target sequence
aaatagcctcttttctttcacaat

SEQ ID NO: 90393 - DNA, 24 bp, Artificial sequence
  SiRNA target sequence
aatagcctcttttctttcacaatt

SEQ ID NO: 90394 - DNA, 24 bp, Artificial sequence
  SiRNA target sequence
atagcctcttttctttcacaattt

SEQ ID NO: 90395 - DNA, 24 bp, Artificial sequence
  SiRNA target sequence
tagcctcttttctttcacaatttc

SEQ ID NO: 90396 - DNA, 24 bp, Artificial sequence
  SiRNA target sequence
agcctcttttctttcacaatttca

SEQ ID NO: 90397 - DNA, 24 bp, Artificial sequence
  SiRNA target sequence
gcctcttttctttcacaatttcag

SEQ ID NO: 90398 - DNA, 24 bp, Artificial sequence
  SiRNA target sequence
cctcttttctttcacaatttcaga

SEQ ID NO: 90399 - DNA, 24 bp, Artificial sequence
  SiRNA target sequence
ctcttttctttcacaatttcagaa

SEQ ID NO: 90400 - DNA, 24 bp, Artificial sequence
  SiRNA target sequence
tcttttctttcacaatttcagaaa

SEQ ID NO: 90401 - DNA, 24 bp, Artificial sequence
  SiRNA target sequence
cttttctttcacaatttcagaaaa

SEQ ID NO: 90402 - DNA, 24 bp, Artificial sequence
  SiRNA target sequence
ttttctttcacaatttcagaaaaa

SEQ ID NO: 90403 - DNA, 24 bp, Artificial sequence
  SiRNA target sequence
tttctttcacaatttcagaaaaat

SEQ ID NO: 90404 - DNA, 24 bp, Artificial sequence
  SiRNA target sequence
ttctttcacaatttcagaaaaatt

SEQ ID NO: 90405 - DNA, 24 bp, Artificial sequence
  SiRNA target sequence
tctttcacaatttcagaaaaattt

SEQ ID NO: 90406 - DNA, 24 bp, Artificial sequence
  SiRNA target sequence
ctttcacaatttcagaaaaatttt

SEQ ID NO: 90407 - DNA, 24 bp, Artificial sequence
  SiRNA target sequence
tttcacaatttcagaaaaattttc

SEQ ID NO: 90408 - DNA, 24 bp, Artificial sequence
  SiRNA target sequence
ttcacaatttcagaaaaattttca

SEQ ID NO: 90409 - DNA, 24 bp, Artificial sequence
  SiRNA target sequence
tcacaatttcagaaaaattttcat

SEQ ID NO: 90410 - DNA, 24 bp, Artificial sequence
  SiRNA target sequence
cacaatttcagaaaaattttcatt

SEQ ID NO: 90411 - DNA, 24 bp, Artificial sequence
  SiRNA target sequence
acaatttcagaaaaattttcatta

SEQ ID NO: 90412 - DNA, 24 bp, Artificial sequence
  SiRNA target sequence
caatttcagaaaaattttcattaa

SEQ ID NO: 90413 - DNA, 24 bp, Artificial sequence
  SiRNA target sequence
aatttcagaaaaattttcattaaa

SEQ ID NO: 90414 - DNA, 24 bp, Artificial sequence
  SiRNA target sequence
atttcagaaaaattttcattaaaa

SEQ ID NO: 90415 - DNA, 24 bp, Artificial sequence
  SiRNA target sequence
tttcagaaaaattttcattaaaaa

SEQ ID NO: 90416 - DNA, 24 bp, Artificial sequence
  SiRNA target sequence
ttcagaaaaattttcattaaaaat

SEQ ID NO: 90417 - DNA, 24 bp, Artificial sequence
  SiRNA target sequence
tcagaaaaattttcattaaaaatg

SEQ ID NO: 90418 - DNA, 24 bp, Artificial sequence
  SiRNA target sequence
cagaaaaattttcattaaaaatgc

SEQ ID NO: 90419 - DNA, 24 bp, Artificial sequence
  SiRNA target sequence
agaaaaattttcattaaaaatgct

SEQ ID NO: 90420 - DNA, 24 bp, Artificial sequence
  SiRNA target sequence
gaaaaattttcattaaaaatgcta

SEQ ID NO: 90421 - DNA, 24 bp, Artificial sequence
  SiRNA target sequence
aaaaattttcattaaaaatgctat

SEQ ID NO: 90422 - DNA, 24 bp, Artificial sequence
  SiRNA target sequence
aaaattttcattaaaaatgctata

SEQ ID NO: 90423 - DNA, 24 bp, Artificial sequence
  SiRNA target sequence
aaattttcattaaaaatgctataa

SEQ ID NO: 90424 - DNA, 24 bp, Artificial sequence
  SiRNA target sequence
aattttcattaaaaatgctataaa

SEQ ID NO: 90425 - DNA, 24 bp, Artificial sequence
  SiRNA target sequence
attttcattaaaaatgctataaat

SEQ ID NO: 90426 - DNA, 24 bp, Artificial sequence
  SiRNA target sequence
ttttcattaaaaatgctataaata

SEQ ID NO: 90427 - DNA, 24 bp, Artificial sequence
  SiRNA target sequence
tttcattaaaaatgctataaatag

SEQ ID NO: 90428 - DNA, 24 bp, Artificial sequence
  SiRNA target sequence
ttcattaaaaatgctataaatagt

SEQ ID NO: 90429 - DNA, 24 bp, Artificial sequence
  SiRNA target sequence
tcattaaaaatgctataaatagtt

SEQ ID NO: 90430 - DNA, 24 bp, Artificial sequence
  SiRNA target sequence
cattaaaaatgctataaatagttt

SEQ ID NO: 90431 - DNA, 24 bp, Artificial sequence
  SiRNA target sequence
attaaaaatgctataaatagtttt

SEQ ID NO: 90432 - DNA, 24 bp, Artificial sequence
  SiRNA target sequence
ttaaaaatgctataaatagttttt

SEQ ID NO: 90433 - DNA, 24 bp, Artificial sequence
  SiRNA target sequence
taaaaatgctataaatagtttttt

SEQ ID NO: 90434 - DNA, 24 bp, Artificial sequence
  SiRNA target sequence
aaaaatgctataaatagttttttg

SEQ ID NO: 90435 - DNA, 24 bp, Artificial sequence
  SiRNA target sequence
aaaatgctataaatagttttttgc

SEQ ID NO: 90436 - DNA, 24 bp, Artificial sequence
  SiRNA target sequence
aaatgctataaatagttttttgca

SEQ ID NO: 90437 - DNA, 24 bp, Artificial sequence
  SiRNA target sequence
aatgctataaatagttttttgcat

SEQ ID NO: 90438 - DNA, 24 bp, Artificial sequence
  SiRNA target sequence
atgctataaatagttttttgcata

SEQ ID NO: 90439 - DNA, 24 bp, Artificial sequence
  SiRNA target sequence
tgctataaatagttttttgcatat

SEQ ID NO: 90440 - DNA, 24 bp, Artificial sequence
  SiRNA target sequence
gctataaatagttttttgcatatc

SEQ ID NO: 90441 - DNA, 24 bp, Artificial sequence
  SiRNA target sequence
ctataaatagttttttgcatatca

SEQ ID NO: 90442 - DNA, 24 bp, Artificial sequence
  SiRNA target sequence
tataaatagttttttgcatatcag

SEQ ID NO: 90443 - DNA, 24 bp, Artificial sequence
  SiRNA target sequence
ataaatagttttttgcatatcagg

SEQ ID NO: 90444 - DNA, 24 bp, Artificial sequence
  SiRNA target sequence
taaatagttttttgcatatcaggt

SEQ ID NO: 90445 - DNA, 24 bp, Artificial sequence
  SiRNA target sequence
aaatagttttttgcatatcaggtc

SEQ ID NO: 90446 - DNA, 24 bp, Artificial sequence
  SiRNA target sequence
aatagttttttgcatatcaggtcg

SEQ ID NO: 90447 - DNA, 24 bp, Artificial sequence
  SiRNA target sequence
atagttttttgcatatcaggtcgg

SEQ ID NO: 90448 - DNA, 24 bp, Artificial sequence
  SiRNA target sequence
tagttttttgcatatcaggtcggc

SEQ ID NO: 90449 - DNA, 24 bp, Artificial sequence
  SiRNA target sequence
agttttttgcatatcaggtcggcc

SEQ ID NO: 90450 - DNA, 24 bp, Artificial sequence
  SiRNA target sequence
gttttttgcatatcaggtcggcca

SEQ ID NO: 90451 - DNA, 24 bp, Artificial sequence
  SiRNA target sequence
ttttttgcatatcaggtcggccac

SEQ ID NO: 90452 - DNA, 24 bp, Artificial sequence
  SiRNA target sequence
tttttgcatatcaggtcggccaca

SEQ ID NO: 90453 - DNA, 24 bp, Artificial sequence
  SiRNA target sequence
ttttgcatatcaggtcggccacaa

SEQ ID NO: 90454 - DNA, 24 bp, Artificial sequence
  SiRNA target sequence
tttgcatatcaggtcggccacaaa

SEQ ID NO: 90455 - DNA, 24 bp, Artificial sequence
  SiRNA target sequence
ttgcatatcaggtcggccacaaac

SEQ ID NO: 90456 - DNA, 24 bp, Artificial sequence
  SiRNA target sequence
tgcatatcaggtcggccacaaaca

SEQ ID NO: 90457 - DNA, 24 bp, Artificial sequence
  SiRNA target sequence
gcatatcaggtcggccacaaacat

SEQ ID NO: 90458 - DNA, 24 bp, Artificial sequence
  SiRNA target sequence
catatcaggtcggccacaaacata

SEQ ID NO: 90459 - DNA, 24 bp, Artificial sequence
  SiRNA target sequence
atatcaggtcggccacaaacataa

SEQ ID NO: 90460 - DNA, 24 bp, Artificial sequence
  SiRNA target sequence
tatcaggtcggccacaaacataaa

SEQ ID NO: 90461 - DNA, 24 bp, Artificial sequence
  SiRNA target sequence
atcaggtcggccacaaacataaac

SEQ ID NO: 90462 - DNA, 24 bp, Artificial sequence
  SiRNA target sequence
tcaggtcggccacaaacataaacc

SEQ ID NO: 90463 - DNA, 24 bp, Artificial sequence
  SiRNA target sequence
caggtcggccacaaacataaacca

SEQ ID NO: 90464 - DNA, 24 bp, Artificial sequence
  SiRNA target sequence
aggtcggccacaaacataaaccaa

SEQ ID NO: 90465 - DNA, 24 bp, Artificial sequence
  SiRNA target sequence
ggtcggccacaaacataaaccaaa

SEQ ID NO: 90466 - DNA, 24 bp, Artificial sequence
  SiRNA target sequence
gtcggccacaaacataaaccaaac

SEQ ID NO: 90467 - DNA, 24 bp, Artificial sequence
  SiRNA target sequence
tcggccacaaacataaaccaaaca

SEQ ID NO: 90468 - DNA, 24 bp, Artificial sequence
  SiRNA target sequence
cggccacaaacataaaccaaacat

SEQ ID NO: 90469 - DNA, 24 bp, Artificial sequence
  SiRNA target sequence
ggccacaaacataaaccaaacatc

SEQ ID NO: 90470 - DNA, 24 bp, Artificial sequence
  SiRNA target sequence
gccacaaacataaaccaaacatcc

SEQ ID NO: 90471 - DNA, 24 bp, Artificial sequence
  SiRNA target sequence
ccacaaacataaaccaaacatccg

SEQ ID NO: 90472 - DNA, 24 bp, Artificial sequence
  SiRNA target sequence
cacaaacataaaccaaacatccgt

SEQ ID NO: 90473 - DNA, 24 bp, Artificial sequence
  SiRNA target sequence
acaaacataaaccaaacatccgtc

SEQ ID NO: 90474 - DNA, 24 bp, Artificial sequence
  SiRNA target sequence
caaacataaaccaaacatccgtct

SEQ ID NO: 90475 - DNA, 24 bp, Artificial sequence
  SiRNA target sequence
aaacataaaccaaacatccgtctt

SEQ ID NO: 90476 - DNA, 24 bp, Artificial sequence
  SiRNA target sequence
aacataaaccaaacatccgtcttt

SEQ ID NO: 90477 - DNA, 24 bp, Artificial sequence
  SiRNA target sequence
acataaaccaaacatccgtcttta

SEQ ID NO: 90478 - DNA, 24 bp, Artificial sequence
  SiRNA target sequence
cataaaccaaacatccgtctttaa

SEQ ID NO: 90479 - DNA, 24 bp, Artificial sequence
  SiRNA target sequence
ataaaccaaacatccgtctttaat

SEQ ID NO: 90480 - DNA, 24 bp, Artificial sequence
  SiRNA target sequence
taaaccaaacatccgtctttaatg

SEQ ID NO: 90481 - DNA, 24 bp, Artificial sequence
  SiRNA target sequence
aaaccaaacatccgtctttaatgt

SEQ ID NO: 90482 - DNA, 24 bp, Artificial sequence
  SiRNA target sequence
aaccaaacatccgtctttaatgta

SEQ ID NO: 90483 - DNA, 24 bp, Artificial sequence
  SiRNA target sequence
accaaacatccgtctttaatgtat

SEQ ID NO: 90484 - DNA, 24 bp, Artificial sequence
  SiRNA target sequence
ccaaacatccgtctttaatgtatg

SEQ ID NO: 90485 - DNA, 24 bp, Artificial sequence
  SiRNA target sequence
caaacatccgtctttaatgtatgt

SEQ ID NO: 90486 - DNA, 24 bp, Artificial sequence
  SiRNA target sequence
aaacatccgtctttaatgtatgtt

SEQ ID NO: 90487 - DNA, 24 bp, Artificial sequence
  SiRNA target sequence
aacatccgtctttaatgtatgttt

SEQ ID NO: 90488 - DNA, 24 bp, Artificial sequence
  SiRNA target sequence
acatccgtctttaatgtatgtttt

SEQ ID NO: 90489 - DNA, 24 bp, Artificial sequence
  SiRNA target sequence
catccgtctttaatgtatgttttt

SEQ ID NO: 90490 - DNA, 24 bp, Artificial sequence
  SiRNA target sequence
atccgtctttaatgtatgttttta

SEQ ID NO: 90491 - DNA, 24 bp, Artificial sequence
  SiRNA target sequence
tccgtctttaatgtatgtttttat

SEQ ID NO: 90492 - DNA, 24 bp, Artificial sequence
  SiRNA target sequence
ccgtctttaatgtatgtttttatc

SEQ ID NO: 90493 - DNA, 24 bp, Artificial sequence
  SiRNA target sequence
cgtctttaatgtatgtttttatct

SEQ ID NO: 90494 - DNA, 24 bp, Artificial sequence
  SiRNA target sequence
gtctttaatgtatgtttttatctc

SEQ ID NO: 90495 - DNA, 24 bp, Artificial sequence
  SiRNA target sequence
tctttaatgtatgtttttatctca

SEQ ID NO: 90496 - DNA, 24 bp, Artificial sequence
  SiRNA target sequence
ctttaatgtatgtttttatctcat

SEQ ID NO: 90497 - DNA, 24 bp, Artificial sequence
  SiRNA target sequence
tttaatgtatgtttttatctcatt

SEQ ID NO: 90498 - DNA, 24 bp, Artificial sequence
  SiRNA target sequence
ttaatgtatgtttttatctcattt

SEQ ID NO: 90499 - DNA, 24 bp, Artificial sequence
  SiRNA target sequence
taatgtatgtttttatctcattta

SEQ ID NO: 90500 - DNA, 24 bp, Artificial sequence
  SiRNA target sequence
aatgtatgtttttatctcatttaa

SEQ ID NO: 90501 - DNA, 24 bp, Artificial sequence
  SiRNA target sequence
atgtatgtttttatctcatttaaa

SEQ ID NO: 90502 - DNA, 24 bp, Artificial sequence
  SiRNA target sequence
tgtatgtttttatctcatttaaat

SEQ ID NO: 90503 - DNA, 24 bp, Artificial sequence
  SiRNA target sequence
gtatgtttttatctcatttaaatt

SEQ ID NO: 90504 - DNA, 24 bp, Artificial sequence
  SiRNA target sequence
tatgtttttatctcatttaaattt

SEQ ID NO: 90505 - DNA, 24 bp, Artificial sequence
  SiRNA target sequence
atgtttttatctcatttaaatttt

SEQ ID NO: 90506 - DNA, 24 bp, Artificial sequence
  SiRNA target sequence
tgtttttatctcatttaaattttg

SEQ ID NO: 90507 - DNA, 24 bp, Artificial sequence
  SiRNA target sequence
gtttttatctcatttaaattttgt

SEQ ID NO: 90508 - DNA, 24 bp, Artificial sequence
  SiRNA target sequence
tttttatctcatttaaattttgta

SEQ ID NO: 90509 - DNA, 24 bp, Artificial sequence
  SiRNA target sequence
ttttatctcatttaaattttgtaa

SEQ ID NO: 90510 - DNA, 24 bp, Artificial sequence
  SiRNA target sequence
tttatctcatttaaattttgtaat

SEQ ID NO: 90511 - DNA, 24 bp, Artificial sequence
  SiRNA target sequence
ttatctcatttaaattttgtaata

SEQ ID NO: 90512 - DNA, 24 bp, Artificial sequence
  SiRNA target sequence
tatctcatttaaattttgtaataa

SEQ ID NO: 90513 - DNA, 24 bp, Artificial sequence
  SiRNA target sequence
atctcatttaaattttgtaataaa

SEQ ID NO: 90514 - DNA, 24 bp, Artificial sequence
  SiRNA target sequence
tctcatttaaattttgtaataaat

SEQ ID NO: 90515 - DNA, 24 bp, Artificial sequence
  SiRNA target sequence
ctcatttaaattttgtaataaata

SEQ ID NO: 90516 - DNA, 24 bp, Artificial sequence
  SiRNA target sequence
tcatttaaattttgtaataaataa

SEQ ID NO: 90517 - DNA, 24 bp, Artificial sequence
  SiRNA target sequence
catttaaattttgtaataaataat

SEQ ID NO: 90518 - DNA, 24 bp, Artificial sequence
  SiRNA target sequence
atttaaattttgtaataaataatc

SEQ ID NO: 90519 - DNA, 24 bp, Artificial sequence
  SiRNA target sequence
tttaaattttgtaataaataatca

SEQ ID NO: 90520 - DNA, 24 bp, Artificial sequence
  SiRNA target sequence
ttaaattttgtaataaataatcag

SEQ ID NO: 90521 - DNA, 24 bp, Artificial sequence
  SiRNA target sequence
taaattttgtaataaataatcagt

SEQ ID NO: 90522 - DNA, 24 bp, Artificial sequence
  SiRNA target sequence
aaattttgtaataaataatcagta

SEQ ID NO: 90523 - DNA, 24 bp, Artificial sequence
  SiRNA target sequence
aattttgtaataaataatcagtaa

SEQ ID NO: 90524 - DNA, 24 bp, Artificial sequence
  SiRNA target sequence
attttgtaataaataatcagtaac

SEQ ID NO: 90525 - DNA, 24 bp, Artificial sequence
  SiRNA target sequence
ttttgtaataaataatcagtaaca

SEQ ID NO: 90526 - DNA, 24 bp, Artificial sequence
  SiRNA target sequence
tttgtaataaataatcagtaacat

SEQ ID NO: 90527 - DNA, 24 bp, Artificial sequence
  SiRNA target sequence
ttgtaataaataatcagtaacata

SEQ ID NO: 90528 - DNA, 24 bp, Artificial sequence
  SiRNA target sequence
tgtaataaataatcagtaacataa

SEQ ID NO: 90529 - DNA, 24 bp, Artificial sequence
  SiRNA target sequence
gtaataaataatcagtaacataaa

SEQ ID NO: 90530 - DNA, 24 bp, Artificial sequence
  SiRNA target sequence
taataaataatcagtaacataaat

SEQ ID NO: 90531 - DNA, 24 bp, Artificial sequence
  SiRNA target sequence
aataaataatcagtaacataaatt

SEQ ID NO: 90532 - DNA, 24 bp, Artificial sequence
  SiRNA target sequence
ataaataatcagtaacataaattt

SEQ ID NO: 90533 - DNA, 24 bp, Artificial sequence
  SiRNA target sequence
taaataatcagtaacataaatttt

SEQ ID NO: 90534 - DNA, 24 bp, Artificial sequence
  SiRNA target sequence
aaataatcagtaacataaatttta

SEQ ID NO: 90535 - DNA, 24 bp, Artificial sequence
  SiRNA target sequence
aataatcagtaacataaattttat

SEQ ID NO: 90536 - DNA, 24 bp, Artificial sequence
  SiRNA target sequence
ataatcagtaacataaattttatt

SEQ ID NO: 90537 - DNA, 24 bp, Artificial sequence
  SiRNA target sequence
taatcagtaacataaattttatta

SEQ ID NO: 90538 - DNA, 24 bp, Artificial sequence
  SiRNA target sequence
aatcagtaacataaattttattac

SEQ ID NO: 90539 - DNA, 24 bp, Artificial sequence
  SiRNA target sequence
atcagtaacataaattttattaca

SEQ ID NO: 90540 - DNA, 24 bp, Artificial sequence
  SiRNA target sequence
tcagtaacataaattttattacaa

SEQ ID NO: 90541 - DNA, 24 bp, Artificial sequence
  SiRNA target sequence
cagtaacataaattttattacaag

SEQ ID NO: 90542 - DNA, 24 bp, Artificial sequence
  SiRNA target sequence
agtaacataaattttattacaaga

SEQ ID NO: 90543 - DNA, 24 bp, Artificial sequence
  SiRNA target sequence
gtaacataaattttattacaagat

SEQ ID NO: 90544 - DNA, 24 bp, Artificial sequence
  SiRNA target sequence
taacataaattttattacaagata

SEQ ID NO: 90545 - DNA, 24 bp, Artificial sequence
  SiRNA target sequence
aacataaattttattacaagataa

SEQ ID NO: 90546 - DNA, 24 bp, Artificial sequence
  SiRNA target sequence
acataaattttattacaagataaa

SEQ ID NO: 90547 - DNA, 24 bp, Artificial sequence
  SiRNA target sequence
cataaattttattacaagataaaa

SEQ ID NO: 90548 - DNA, 24 bp, Artificial sequence
  SiRNA target sequence
ataaattttattacaagataaaat

SEQ ID NO: 90549 - DNA, 24 bp, Artificial sequence
  SiRNA target sequence
taaattttattacaagataaaatt

SEQ ID NO: 90550 - DNA, 24 bp, Artificial sequence
  SiRNA target sequence
aaattttattacaagataaaattt

SEQ ID NO: 90551 - DNA, 24 bp, Artificial sequence
  SiRNA target sequence
aattttattacaagataaaatttt

SEQ ID NO: 90552 - DNA, 24 bp, Artificial sequence
  SiRNA target sequence
attttattacaagataaaatttta

SEQ ID NO: 90553 - DNA, 24 bp, Artificial sequence
  SiRNA target sequence
ttttattacaagataaaattttaa

SEQ ID NO: 90554 - DNA, 24 bp, Artificial sequence
  SiRNA target sequence
tttattacaagataaaattttaat

SEQ ID NO: 90555 - DNA, 24 bp, Artificial sequence
  SiRNA target sequence
ttattacaagataaaattttaata

SEQ ID NO: 90556 - DNA, 24 bp, Artificial sequence
  SiRNA target sequence
tattacaagataaaattttaataa

SEQ ID NO: 90557 - DNA, 24 bp, Artificial sequence
  SiRNA target sequence
attacaagataaaattttaataat

SEQ ID NO: 90558 - DNA, 24 bp, Artificial sequence
  SiRNA target sequence
ttacaagataaaattttaataatt

SEQ ID NO: 90559 - DNA, 24 bp, Artificial sequence
  SiRNA target sequence
tacaagataaaattttaataattt

SEQ ID NO: 90560 - DNA, 24 bp, Artificial sequence
  SiRNA target sequence
acaagataaaattttaataatttc

SEQ ID NO: 90561 - DNA, 24 bp, Artificial sequence
  SiRNA target sequence
caagataaaattttaataatttct

SEQ ID NO: 90562 - DNA, 24 bp, Artificial sequence
  SiRNA target sequence
aagataaaattttaataatttctg

SEQ ID NO: 90563 - DNA, 24 bp, Artificial sequence
  SiRNA target sequence
agataaaattttaataatttctgt

SEQ ID NO: 90564 - DNA, 24 bp, Artificial sequence
  SiRNA target sequence
gataaaattttaataatttctgtg

SEQ ID NO: 90565 - DNA, 24 bp, Artificial sequence
  SiRNA target sequence
ataaaattttaataatttctgtgt

SEQ ID NO: 90566 - DNA, 24 bp, Artificial sequence
  SiRNA target sequence
taaaattttaataatttctgtgtt

SEQ ID NO: 90567 - DNA, 24 bp, Artificial sequence
  SiRNA target sequence
aaaattttaataatttctgtgttt

SEQ ID NO: 90568 - DNA, 24 bp, Artificial sequence
  SiRNA target sequence
aaattttaataatttctgtgtttt

SEQ ID NO: 90569 - DNA, 24 bp, Artificial sequence
  SiRNA target sequence
aattttaataatttctgtgttttt

SEQ ID NO: 90570 - DNA, 24 bp, Artificial sequence
  SiRNA target sequence
attttaataatttctgtgttttta

SEQ ID NO: 90571 - DNA, 24 bp, Artificial sequence
  SiRNA target sequence
ttttaataatttctgtgtttttat

SEQ ID NO: 90572 - DNA, 24 bp, Artificial sequence
  SiRNA target sequence
tttaataatttctgtgtttttata

SEQ ID NO: 90573 - DNA, 24 bp, Artificial sequence
  SiRNA target sequence
ttaataatttctgtgtttttatat

SEQ ID NO: 90574 - DNA, 24 bp, Artificial sequence
  SiRNA target sequence
taataatttctgtgtttttatatt

SEQ ID NO: 90575 - DNA, 24 bp, Artificial sequence
  SiRNA target sequence
aataatttctgtgtttttatattt

SEQ ID NO: 90576 - DNA, 24 bp, Artificial sequence
  SiRNA target sequence
ataatttctgtgtttttatatttt

SEQ ID NO: 90577 - DNA, 24 bp, Artificial sequence
  SiRNA target sequence
taatttctgtgtttttatattttg

SEQ ID NO: 90578 - DNA, 24 bp, Artificial sequence
  SiRNA target sequence
aatttctgtgtttttatattttgc

SEQ ID NO: 90579 - DNA, 24 bp, Artificial sequence
  SiRNA target sequence
atttctgtgtttttatattttgca

SEQ ID NO: 90580 - DNA, 24 bp, Artificial sequence
  SiRNA target sequence
tttctgtgtttttatattttgcat

SEQ ID NO: 90581 - DNA, 24 bp, Artificial sequence
  SiRNA target sequence
ttctgtgtttttatattttgcatc

SEQ ID NO: 90582 - DNA, 24 bp, Artificial sequence
  SiRNA target sequence
tctgtgtttttatattttgcatct

SEQ ID NO: 90583 - DNA, 24 bp, Artificial sequence
  SiRNA target sequence
ctgtgtttttatattttgcatctt

SEQ ID NO: 90584 - DNA, 24 bp, Artificial sequence
  SiRNA target sequence
tgtgtttttatattttgcatcttt

SEQ ID NO: 90585 - DNA, 24 bp, Artificial sequence
  SiRNA target sequence
gtgtttttatattttgcatcttta

SEQ ID NO: 90586 - DNA, 24 bp, Artificial sequence
  SiRNA target sequence
tgtttttatattttgcatctttaa

SEQ ID NO: 90587 - DNA, 24 bp, Artificial sequence
  SiRNA target sequence
gtttttatattttgcatctttaat

SEQ ID NO: 90588 - DNA, 24 bp, Artificial sequence
  SiRNA target sequence
tttttatattttgcatctttaata

SEQ ID NO: 90589 - DNA, 24 bp, Artificial sequence
  SiRNA target sequence
ttttatattttgcatctttaataa

SEQ ID NO: 90590 - DNA, 24 bp, Artificial sequence
  SiRNA target sequence
tttatattttgcatctttaataag

SEQ ID NO: 90591 - DNA, 24 bp, Artificial sequence
  SiRNA target sequence
ttatattttgcatctttaataaga

SEQ ID NO: 90592 - DNA, 24 bp, Artificial sequence
  SiRNA target sequence
tatattttgcatctttaataagat

SEQ ID NO: 90593 - DNA, 24 bp, Artificial sequence
  SiRNA target sequence
atattttgcatctttaataagatc

SEQ ID NO: 90594 - DNA, 24 bp, Artificial sequence
  SiRNA target sequence
tattttgcatctttaataagatca

SEQ ID NO: 90595 - DNA, 24 bp, Artificial sequence
  SiRNA target sequence
attttgcatctttaataagatcat

SEQ ID NO: 90596 - DNA, 24 bp, Artificial sequence
  SiRNA target sequence
ttttgcatctttaataagatcatc

SEQ ID NO: 90597 - DNA, 24 bp, Artificial sequence
  SiRNA target sequence
tttgcatctttaataagatcatct

SEQ ID NO: 90598 - DNA, 24 bp, Artificial sequence
  SiRNA target sequence
ttgcatctttaataagatcatctt

SEQ ID NO: 90599 - DNA, 24 bp, Artificial sequence
  SiRNA target sequence
tgcatctttaataagatcatcttc

SEQ ID NO: 90600 - DNA, 24 bp, Artificial sequence
  SiRNA target sequence
gcatctttaataagatcatcttct

SEQ ID NO: 90601 - DNA, 24 bp, Artificial sequence
  SiRNA target sequence
catctttaataagatcatcttctt

SEQ ID NO: 90602 - DNA, 24 bp, Artificial sequence
  SiRNA target sequence
atctttaataagatcatcttcttg

SEQ ID NO: 90603 - DNA, 24 bp, Artificial sequence
  SiRNA target sequence
tctttaataagatcatcttcttga

SEQ ID NO: 90604 - DNA, 24 bp, Artificial sequence
  SiRNA target sequence
ctttaataagatcatcttcttgat

SEQ ID NO: 90605 - DNA, 24 bp, Artificial sequence
  SiRNA target sequence
tttaataagatcatcttcttgatt

SEQ ID NO: 90606 - DNA, 24 bp, Artificial sequence
  SiRNA target sequence
ttaataagatcatcttcttgattt

SEQ ID NO: 90607 - DNA, 24 bp, Artificial sequence
  SiRNA target sequence
taataagatcatcttcttgatttc

SEQ ID NO: 90608 - DNA, 24 bp, Artificial sequence
  SiRNA target sequence
aataagatcatcttcttgatttct

SEQ ID NO: 90609 - DNA, 24 bp, Artificial sequence
  SiRNA target sequence
ataagatcatcttcttgatttcta

SEQ ID NO: 90610 - DNA, 24 bp, Artificial sequence
  SiRNA target sequence
taagatcatcttcttgatttctaa

SEQ ID NO: 90611 - DNA, 24 bp, Artificial sequence
  SiRNA target sequence
aagatcatcttcttgatttctaaa

SEQ ID NO: 90612 - DNA, 24 bp, Artificial sequence
  SiRNA target sequence
agatcatcttcttgatttctaaat

SEQ ID NO: 90613 - DNA, 24 bp, Artificial sequence
  SiRNA target sequence
gatcatcttcttgatttctaaatc

SEQ ID NO: 90614 - DNA, 24 bp, Artificial sequence
  SiRNA target sequence
atcatcttcttgatttctaaatcc

SEQ ID NO: 90615 - DNA, 24 bp, Artificial sequence
  SiRNA target sequence
tcatcttcttgatttctaaatcca

SEQ ID NO: 90616 - DNA, 24 bp, Artificial sequence
  SiRNA target sequence
catcttcttgatttctaaatccat

SEQ ID NO: 90617 - DNA, 24 bp, Artificial sequence
  SiRNA target sequence
atcttcttgatttctaaatccata

SEQ ID NO: 90618 - DNA, 24 bp, Artificial sequence
  SiRNA target sequence
tcttcttgatttctaaatccatat

SEQ ID NO: 90619 - DNA, 24 bp, Artificial sequence
  SiRNA target sequence
cttcttgatttctaaatccatata

SEQ ID NO: 90620 - DNA, 24 bp, Artificial sequence
  SiRNA target sequence
ttcttgatttctaaatccatatat

SEQ ID NO: 90621 - DNA, 24 bp, Artificial sequence
  SiRNA target sequence
tcttgatttctaaatccatatatt

SEQ ID NO: 90622 - DNA, 24 bp, Artificial sequence
  SiRNA target sequence
cttgatttctaaatccatatatta

SEQ ID NO: 90623 - DNA, 24 bp, Artificial sequence
  SiRNA target sequence
ttgatttctaaatccatatattag

SEQ ID NO: 90624 - DNA, 24 bp, Artificial sequence
  SiRNA target sequence
tgatttctaaatccatatattagt

SEQ ID NO: 90625 - DNA, 24 bp, Artificial sequence
  SiRNA target sequence
gatttctaaatccatatattagtt

SEQ ID NO: 90626 - DNA, 24 bp, Artificial sequence
  SiRNA target sequence
atttctaaatccatatattagttt

SEQ ID NO: 90627 - DNA, 24 bp, Artificial sequence
  SiRNA target sequence
tttctaaatccatatattagtttg

SEQ ID NO: 90628 - DNA, 24 bp, Artificial sequence
  SiRNA target sequence
ttctaaatccatatattagtttga

SEQ ID NO: 90629 - DNA, 24 bp, Artificial sequence
  SiRNA target sequence
tctaaatccatatattagtttgat

SEQ ID NO: 90630 - DNA, 24 bp, Artificial sequence
  SiRNA target sequence
ctaaatccatatattagtttgata

SEQ ID NO: 90631 - DNA, 24 bp, Artificial sequence
  SiRNA target sequence
taaatccatatattagtttgatat

SEQ ID NO: 90632 - DNA, 24 bp, Artificial sequence
  SiRNA target sequence
aaatccatatattagtttgatata

SEQ ID NO: 90633 - DNA, 24 bp, Artificial sequence
  SiRNA target sequence
aatccatatattagtttgatatat

SEQ ID NO: 90634 - DNA, 24 bp, Artificial sequence
  SiRNA target sequence
atccatatattagtttgatatatt

SEQ ID NO: 90635 - DNA, 24 bp, Artificial sequence
  SiRNA target sequence
tccatatattagtttgatatattg

SEQ ID NO: 90636 - DNA, 24 bp, Artificial sequence
  SiRNA target sequence
ccatatattagtttgatatattga

SEQ ID NO: 90637 - DNA, 24 bp, Artificial sequence
  SiRNA target sequence
catatattagtttgatatattgat

SEQ ID NO: 90638 - DNA, 24 bp, Artificial sequence
  SiRNA target sequence
atatattagtttgatatattgatc

SEQ ID NO: 90639 - DNA, 24 bp, Artificial sequence
  SiRNA target sequence
tatattagtttgatatattgatcg

SEQ ID NO: 90640 - DNA, 24 bp, Artificial sequence
  SiRNA target sequence
atattagtttgatatattgatcgt

SEQ ID NO: 90641 - DNA, 24 bp, Artificial sequence
  SiRNA target sequence
tattagtttgatatattgatcgtc

SEQ ID NO: 90642 - DNA, 24 bp, Artificial sequence
  SiRNA target sequence
attagtttgatatattgatcgtct

SEQ ID NO: 90643 - DNA, 24 bp, Artificial sequence
  SiRNA target sequence
ttagtttgatatattgatcgtctt

SEQ ID NO: 90644 - DNA, 24 bp, Artificial sequence
  SiRNA target sequence
tagtttgatatattgatcgtcttc

SEQ ID NO: 90645 - DNA, 24 bp, Artificial sequence
  SiRNA target sequence
agtttgatatattgatcgtcttct

SEQ ID NO: 90646 - DNA, 24 bp, Artificial sequence
  SiRNA target sequence
gtttgatatattgatcgtcttctt

SEQ ID NO: 90647 - DNA, 24 bp, Artificial sequence
  SiRNA target sequence
tttgatatattgatcgtcttcttt

SEQ ID NO: 90648 - DNA, 24 bp, Artificial sequence
  SiRNA target sequence
ttgatatattgatcgtcttcttta

SEQ ID NO: 90649 - DNA, 24 bp, Artificial sequence
  SiRNA target sequence
tgatatattgatcgtcttctttat

SEQ ID NO: 90650 - DNA, 24 bp, Artificial sequence
  SiRNA target sequence
gatatattgatcgtcttctttatt

SEQ ID NO: 90651 - DNA, 24 bp, Artificial sequence
  SiRNA target sequence
atatattgatcgtcttctttattt

SEQ ID NO: 90652 - DNA, 24 bp, Artificial sequence
  SiRNA target sequence
tatattgatcgtcttctttatttt

SEQ ID NO: 90653 - DNA, 24 bp, Artificial sequence
  SiRNA target sequence
atattgatcgtcttctttattttt

SEQ ID NO: 90654 - DNA, 24 bp, Artificial sequence
  SiRNA target sequence
tattgatcgtcttctttatttttc

SEQ ID NO: 90655 - DNA, 24 bp, Artificial sequence
  SiRNA target sequence
attgatcgtcttctttatttttca

SEQ ID NO: 90656 - DNA, 24 bp, Artificial sequence
  SiRNA target sequence
ttgatcgtcttctttatttttcaa

SEQ ID NO: 90657 - DNA, 24 bp, Artificial sequence
  SiRNA target sequence
tgatcgtcttctttatttttcaaa

SEQ ID NO: 90658 - DNA, 24 bp, Artificial sequence
  SiRNA target sequence
gatcgtcttctttatttttcaaaa

SEQ ID NO: 90659 - DNA, 24 bp, Artificial sequence
  SiRNA target sequence
atcgtcttctttatttttcaaaaa

SEQ ID NO: 90660 - DNA, 24 bp, Artificial sequence
  SiRNA target sequence
tcgtcttctttatttttcaaaaac

SEQ ID NO: 90661 - DNA, 24 bp, Artificial sequence
  SiRNA target sequence
cgtcttctttatttttcaaaaacg

SEQ ID NO: 90662 - DNA, 24 bp, Artificial sequence
  SiRNA target sequence
gtcttctttatttttcaaaaacga

SEQ ID NO: 90663 - DNA, 24 bp, Artificial sequence
  SiRNA target sequence
tcttctttatttttcaaaaacgaa

SEQ ID NO: 90664 - DNA, 24 bp, Artificial sequence
  SiRNA target sequence
cttctttatttttcaaaaacgaaa

SEQ ID NO: 90665 - DNA, 24 bp, Artificial sequence
  SiRNA target sequence
ttctttatttttcaaaaacgaaaa

SEQ ID NO: 90666 - DNA, 24 bp, Artificial sequence
  SiRNA target sequence
tctttatttttcaaaaacgaaaaa

SEQ ID NO: 90667 - DNA, 24 bp, Artificial sequence
  SiRNA target sequence
ctttatttttcaaaaacgaaaaaa

SEQ ID NO: 90668 - DNA, 24 bp, Artificial sequence
  SiRNA target sequence
tttatttttcaaaaacgaaaaaaa

SEQ ID NO: 90669 - DNA, 24 bp, Artificial sequence
  SiRNA target sequence
ttatttttcaaaaacgaaaaaaat

SEQ ID NO: 90670 - DNA, 24 bp, Artificial sequence
  SiRNA target sequence
tatttttcaaaaacgaaaaaaatg

SEQ ID NO: 90671 - DNA, 24 bp, Artificial sequence
  SiRNA target sequence
atttttcaaaaacgaaaaaaatgg

SEQ ID NO: 90672 - DNA, 24 bp, Artificial sequence
  SiRNA target sequence
tttttcaaaaacgaaaaaaatgga

SEQ ID NO: 90673 - DNA, 24 bp, Artificial sequence
  SiRNA target sequence
ttttcaaaaacgaaaaaaatggag

SEQ ID NO: 90674 - DNA, 24 bp, Artificial sequence
  SiRNA target sequence
tttcaaaaacgaaaaaaatggagc

SEQ ID NO: 90675 - DNA, 24 bp, Artificial sequence
  SiRNA target sequence
ttcaaaaacgaaaaaaatggagca

SEQ ID NO: 90676 - DNA, 24 bp, Artificial sequence
  SiRNA target sequence
tcaaaaacgaaaaaaatggagcaa

SEQ ID NO: 90677 - DNA, 24 bp, Artificial sequence
  SiRNA target sequence
caaaaacgaaaaaaatggagcaat

SEQ ID NO: 90678 - DNA, 24 bp, Artificial sequence
  SiRNA target sequence
aaaaacgaaaaaaatggagcaatg

SEQ ID NO: 90679 - DNA, 24 bp, Artificial sequence
  SiRNA target sequence
aaaacgaaaaaaatggagcaatgc

SEQ ID NO: 90680 - DNA, 24 bp, Artificial sequence
  SiRNA target sequence
aaacgaaaaaaatggagcaatgcc

SEQ ID NO: 90681 - DNA, 24 bp, Artificial sequence
  SiRNA target sequence
aacgaaaaaaatggagcaatgcca

SEQ ID NO: 90682 - DNA, 24 bp, Artificial sequence
  SiRNA target sequence
acgaaaaaaatggagcaatgccag

SEQ ID NO: 90683 - DNA, 24 bp, Artificial sequence
  SiRNA target sequence
cgaaaaaaatggagcaatgccagt

SEQ ID NO: 90684 - DNA, 24 bp, Artificial sequence
  SiRNA target sequence
gaaaaaaatggagcaatgccagtt

SEQ ID NO: 90685 - DNA, 24 bp, Artificial sequence
  SiRNA target sequence
aaaaaaatggagcaatgccagttc

SEQ ID NO: 90686 - DNA, 24 bp, Artificial sequence
  SiRNA target sequence
aaaaaatggagcaatgccagttcc

SEQ ID NO: 90687 - DNA, 24 bp, Artificial sequence
  SiRNA target sequence
aaaaatggagcaatgccagttcca

SEQ ID NO: 90688 - DNA, 24 bp, Artificial sequence
  SiRNA target sequence
aaaatggagcaatgccagttccag

SEQ ID NO: 90689 - DNA, 24 bp, Artificial sequence
  SiRNA target sequence
aaatggagcaatgccagttccagt

SEQ ID NO: 90690 - DNA, 24 bp, Artificial sequence
  SiRNA target sequence
aatggagcaatgccagttccagta

SEQ ID NO: 90691 - DNA, 24 bp, Artificial sequence
  SiRNA target sequence
atggagcaatgccagttccagtac

SEQ ID NO: 90692 - DNA, 24 bp, Artificial sequence
  SiRNA target sequence
tggagcaatgccagttccagtaca

SEQ ID NO: 90693 - DNA, 24 bp, Artificial sequence
  SiRNA target sequence
ggagcaatgccagttccagtacaa

SEQ ID NO: 90694 - DNA, 24 bp, Artificial sequence
  SiRNA target sequence
gagcaatgccagttccagtacaaa

SEQ ID NO: 90695 - DNA, 24 bp, Artificial sequence
  SiRNA target sequence
agcaatgccagttccagtacaaat

SEQ ID NO: 90696 - DNA, 24 bp, Artificial sequence
  SiRNA target sequence
gcaatgccagttccagtacaaata

SEQ ID NO: 90697 - DNA, 24 bp, Artificial sequence
  SiRNA target sequence
caatgccagttccagtacaaatac

SEQ ID NO: 90698 - DNA, 24 bp, Artificial sequence
  SiRNA target sequence
aatgccagttccagtacaaatacc

SEQ ID NO: 90699 - DNA, 24 bp, Artificial sequence
  SiRNA target sequence
atgccagttccagtacaaataccc

SEQ ID NO: 90700 - DNA, 24 bp, Artificial sequence
  SiRNA target sequence
tgccagttccagtacaaataccca

SEQ ID NO: 90701 - DNA, 24 bp, Artificial sequence
  SiRNA target sequence
gccagttccagtacaaatacccaa

SEQ ID NO: 90702 - DNA, 24 bp, Artificial sequence
  SiRNA target sequence
ccagttccagtacaaatacccaac

SEQ ID NO: 90703 - DNA, 24 bp, Artificial sequence
  SiRNA target sequence
cagttccagtacaaatacccaaca

SEQ ID NO: 90704 - DNA, 24 bp, Artificial sequence
  SiRNA target sequence
agttccagtacaaatacccaacac

SEQ ID NO: 90705 - DNA, 24 bp, Artificial sequence
  SiRNA target sequence
gttccagtacaaatacccaacact

SEQ ID NO: 90706 - DNA, 24 bp, Artificial sequence
  SiRNA target sequence
ttccagtacaaatacccaacactt

SEQ ID NO: 90707 - DNA, 24 bp, Artificial sequence
  SiRNA target sequence
tccagtacaaatacccaacacttt

SEQ ID NO: 90708 - DNA, 24 bp, Artificial sequence
  SiRNA target sequence
ccagtacaaatacccaacactttt

SEQ ID NO: 90709 - DNA, 24 bp, Artificial sequence
  SiRNA target sequence
cagtacaaatacccaacacttttt

SEQ ID NO: 90710 - DNA, 24 bp, Artificial sequence
  SiRNA target sequence
agtacaaatacccaacactttttt

SEQ ID NO: 90711 - DNA, 24 bp, Artificial sequence
  SiRNA target sequence
gtacaaatacccaacactttttta

SEQ ID NO: 90712 - DNA, 24 bp, Artificial sequence
  SiRNA target sequence
tacaaatacccaacacttttttac

SEQ ID NO: 90713 - DNA, 24 bp, Artificial sequence
  SiRNA target sequence
acaaatacccaacacttttttaca

SEQ ID NO: 90714 - DNA, 24 bp, Artificial sequence
  SiRNA target sequence
caaatacccaacacttttttacaa

SEQ ID NO: 90715 - DNA, 24 bp, Artificial sequence
  SiRNA target sequence
aaatacccaacacttttttacaaa

SEQ ID NO: 90716 - DNA, 24 bp, Artificial sequence
  SiRNA target sequence
aatacccaacacttttttacaaaa

SEQ ID NO: 90717 - DNA, 24 bp, Artificial sequence
  SiRNA target sequence
atacccaacacttttttacaaaaa

SEQ ID NO: 90718 - DNA, 24 bp, Artificial sequence
  SiRNA target sequence
tacccaacacttttttacaaaaat

SEQ ID NO: 90719 - DNA, 24 bp, Artificial sequence
  SiRNA target sequence
acccaacacttttttacaaaaatt

SEQ ID NO: 90720 - DNA, 24 bp, Artificial sequence
  SiRNA target sequence
cccaacacttttttacaaaaattt

SEQ ID NO: 90721 - DNA, 24 bp, Artificial sequence
  SiRNA target sequence
ccaacacttttttacaaaaattta

SEQ ID NO: 90722 - DNA, 24 bp, Artificial sequence
  SiRNA target sequence
caacacttttttacaaaaatttaa

SEQ ID NO: 90723 - DNA, 24 bp, Artificial sequence
  SiRNA target sequence
aacacttttttacaaaaatttaat

SEQ ID NO: 90724 - DNA, 24 bp, Artificial sequence
  SiRNA target sequence
acacttttttacaaaaatttaatc

SEQ ID NO: 90725 - DNA, 24 bp, Artificial sequence
  SiRNA target sequence
cacttttttacaaaaatttaatct

SEQ ID NO: 90726 - DNA, 24 bp, Artificial sequence
  SiRNA target sequence
acttttttacaaaaatttaatcta

SEQ ID NO: 90727 - DNA, 24 bp, Artificial sequence
  SiRNA target sequence
cttttttacaaaaatttaatctaa

SEQ ID NO: 90728 - DNA, 24 bp, Artificial sequence
  SiRNA target sequence
ttttttacaaaaatttaatctaaa

SEQ ID NO: 90729 - DNA, 24 bp, Artificial sequence
  SiRNA target sequence
tttttacaaaaatttaatctaaat

SEQ ID NO: 90730 - DNA, 24 bp, Artificial sequence
  SiRNA target sequence
ttttacaaaaatttaatctaaata

SEQ ID NO: 90731 - DNA, 24 bp, Artificial sequence
  SiRNA target sequence
tttacaaaaatttaatctaaataa

SEQ ID NO: 90732 - DNA, 24 bp, Artificial sequence
  SiRNA target sequence
ttacaaaaatttaatctaaataat

SEQ ID NO: 90733 - DNA, 24 bp, Artificial sequence
  SiRNA target sequence
tacaaaaatttaatctaaataatt

SEQ ID NO: 90734 - DNA, 24 bp, Artificial sequence
  SiRNA target sequence
acaaaaatttaatctaaataattt

SEQ ID NO: 90735 - DNA, 24 bp, Artificial sequence
  SiRNA target sequence
caaaaatttaatctaaataattta

SEQ ID NO: 90736 - DNA, 24 bp, Artificial sequence
  SiRNA target sequence
aaaaatttaatctaaataatttac

SEQ ID NO: 90737 - DNA, 24 bp, Artificial sequence
  SiRNA target sequence
aaaatttaatctaaataatttact

SEQ ID NO: 90738 - DNA, 24 bp, Artificial sequence
  SiRNA target sequence
aaatttaatctaaataatttactc

SEQ ID NO: 90739 - DNA, 24 bp, Artificial sequence
  SiRNA target sequence
aatttaatctaaataatttactcg

SEQ ID NO: 90740 - DNA, 24 bp, Artificial sequence
  SiRNA target sequence
atttaatctaaataatttactcgg

SEQ ID NO: 90741 - DNA, 24 bp, Artificial sequence
  SiRNA target sequence
tttaatctaaataatttactcggt

SEQ ID NO: 90742 - DNA, 24 bp, Artificial sequence
  SiRNA target sequence
ttaatctaaataatttactcggtc

SEQ ID NO: 90743 - DNA, 24 bp, Artificial sequence
  SiRNA target sequence
taatctaaataatttactcggtct

SEQ ID NO: 90744 - DNA, 24 bp, Artificial sequence
  SiRNA target sequence
aatctaaataatttactcggtctg

SEQ ID NO: 90745 - DNA, 24 bp, Artificial sequence
  SiRNA target sequence
atctaaataatttactcggtctgt

SEQ ID NO: 90746 - DNA, 24 bp, Artificial sequence
  SiRNA target sequence
tctaaataatttactcggtctgtg

SEQ ID NO: 90747 - DNA, 24 bp, Artificial sequence
  SiRNA target sequence
ctaaataatttactcggtctgtga

SEQ ID NO: 90748 - DNA, 24 bp, Artificial sequence
  SiRNA target sequence
taaataatttactcggtctgtgac

SEQ ID NO: 90749 - DNA, 24 bp, Artificial sequence
  SiRNA target sequence
aaataatttactcggtctgtgaca

SEQ ID NO: 90750 - DNA, 24 bp, Artificial sequence
  SiRNA target sequence
aataatttactcggtctgtgacag

SEQ ID NO: 90751 - DNA, 24 bp, Artificial sequence
  SiRNA target sequence
ataatttactcggtctgtgacaga

SEQ ID NO: 90752 - DNA, 24 bp, Artificial sequence
  SiRNA target sequence
taatttactcggtctgtgacagat

SEQ ID NO: 90753 - DNA, 24 bp, Artificial sequence
  SiRNA target sequence
aatttactcggtctgtgacagatc

SEQ ID NO: 90754 - DNA, 24 bp, Artificial sequence
  SiRNA target sequence
atttactcggtctgtgacagatct

SEQ ID NO: 90755 - DNA, 24 bp, Artificial sequence
  SiRNA target sequence
tttactcggtctgtgacagatctt

SEQ ID NO: 90756 - DNA, 24 bp, Artificial sequence
  SiRNA target sequence
ttactcggtctgtgacagatcttt

SEQ ID NO: 90757 - DNA, 24 bp, Artificial sequence
  SiRNA target sequence
tactcggtctgtgacagatcttta

SEQ ID NO: 90758 - DNA, 24 bp, Artificial sequence
  SiRNA target sequence
actcggtctgtgacagatctttaa

SEQ ID NO: 90759 - DNA, 24 bp, Artificial sequence
  SiRNA target sequence
ctcggtctgtgacagatctttaaa

SEQ ID NO: 90760 - DNA, 24 bp, Artificial sequence
  SiRNA target sequence
tcggtctgtgacagatctttaaat

SEQ ID NO: 90761 - DNA, 24 bp, Artificial sequence
  SiRNA target sequence
cggtctgtgacagatctttaaatt

SEQ ID NO: 90762 - DNA, 24 bp, Artificial sequence
  SiRNA target sequence
ggtctgtgacagatctttaaatta

SEQ ID NO: 90763 - DNA, 24 bp, Artificial sequence
  SiRNA target sequence
gtctgtgacagatctttaaattat

SEQ ID NO: 90764 - DNA, 24 bp, Artificial sequence
  SiRNA target sequence
tctgtgacagatctttaaattatt

SEQ ID NO: 90765 - DNA, 24 bp, Artificial sequence
  SiRNA target sequence
ctgtgacagatctttaaattatta

SEQ ID NO: 90766 - DNA, 24 bp, Artificial sequence
  SiRNA target sequence
tgtgacagatctttaaattattat

SEQ ID NO: 90767 - DNA, 24 bp, Artificial sequence
  SiRNA target sequence
gtgacagatctttaaattattata

SEQ ID NO: 90768 - DNA, 24 bp, Artificial sequence
  SiRNA target sequence
tgacagatctttaaattattataa

SEQ ID NO: 90769 - DNA, 24 bp, Artificial sequence
  SiRNA target sequence
gacagatctttaaattattataat

SEQ ID NO: 90770 - DNA, 24 bp, Artificial sequence
  SiRNA target sequence
acagatctttaaattattataatt

SEQ ID NO: 90771 - DNA, 24 bp, Artificial sequence
  SiRNA target sequence
cagatctttaaattattataattt

SEQ ID NO: 90772 - DNA, 24 bp, Artificial sequence
  SiRNA target sequence
agatctttaaattattataatttt

SEQ ID NO: 90773 - DNA, 24 bp, Artificial sequence
  SiRNA target sequence
gatctttaaattattataattttg

SEQ ID NO: 90774 - DNA, 24 bp, Artificial sequence
  SiRNA target sequence
atctttaaattattataattttgc

SEQ ID NO: 90775 - DNA, 24 bp, Artificial sequence
  SiRNA target sequence
tctttaaattattataattttgca

SEQ ID NO: 90776 - DNA, 24 bp, Artificial sequence
  SiRNA target sequence
ctttaaattattataattttgcat

SEQ ID NO: 90777 - DNA, 24 bp, Artificial sequence
  SiRNA target sequence
tttaaattattataattttgcata

SEQ ID NO: 90778 - DNA, 24 bp, Artificial sequence
  SiRNA target sequence
ttaaattattataattttgcatat

SEQ ID NO: 90779 - DNA, 24 bp, Artificial sequence
  SiRNA target sequence
taaattattataattttgcatatc

SEQ ID NO: 90780 - DNA, 24 bp, Artificial sequence
  SiRNA target sequence
aaattattataattttgcatatct

SEQ ID NO: 90781 - DNA, 24 bp, Artificial sequence
  SiRNA target sequence
aattattataattttgcatatcta

SEQ ID NO: 90782 - DNA, 24 bp, Artificial sequence
  SiRNA target sequence
attattataattttgcatatctat

SEQ ID NO: 90783 - DNA, 24 bp, Artificial sequence
  SiRNA target sequence
ttattataattttgcatatctatg

SEQ ID NO: 90784 - DNA, 24 bp, Artificial sequence
  SiRNA target sequence
tattataattttgcatatctatga

SEQ ID NO: 90785 - DNA, 24 bp, Artificial sequence
  SiRNA target sequence
attataattttgcatatctatgaa

SEQ ID NO: 90786 - DNA, 24 bp, Artificial sequence
  SiRNA target sequence
ttataattttgcatatctatgaaa

SEQ ID NO: 90787 - DNA, 24 bp, Artificial sequence
  SiRNA target sequence
tataattttgcatatctatgaaat

SEQ ID NO: 90788 - DNA, 24 bp, Artificial sequence
  SiRNA target sequence
ataattttgcatatctatgaaatt

SEQ ID NO: 90789 - DNA, 24 bp, Artificial sequence
  SiRNA target sequence
taattttgcatatctatgaaattg

SEQ ID NO: 90790 - DNA, 24 bp, Artificial sequence
  SiRNA target sequence
aattttgcatatctatgaaattgg

SEQ ID NO: 90791 - DNA, 24 bp, Artificial sequence
  SiRNA target sequence
attttgcatatctatgaaattgga

SEQ ID NO: 90792 - DNA, 24 bp, Artificial sequence
  SiRNA target sequence
ttttgcatatctatgaaattggaa

SEQ ID NO: 90793 - DNA, 24 bp, Artificial sequence
  SiRNA target sequence
tttgcatatctatgaaattggaaa

SEQ ID NO: 90794 - DNA, 24 bp, Artificial sequence
  SiRNA target sequence
ttgcatatctatgaaattggaaac

SEQ ID NO: 90795 - DNA, 24 bp, Artificial sequence
  SiRNA target sequence
tgcatatctatgaaattggaaaca

SEQ ID NO: 90796 - DNA, 24 bp, Artificial sequence
  SiRNA target sequence
gcatatctatgaaattggaaacat

SEQ ID NO: 90797 - DNA, 24 bp, Artificial sequence
  SiRNA target sequence
catatctatgaaattggaaacatg

SEQ ID NO: 90798 - DNA, 24 bp, Artificial sequence
  SiRNA target sequence
atatctatgaaattggaaacatgt

SEQ ID NO: 90799 - DNA, 24 bp, Artificial sequence
  SiRNA target sequence
tatctatgaaattggaaacatgtc

SEQ ID NO: 90800 - DNA, 24 bp, Artificial sequence
  SiRNA target sequence
atctatgaaattggaaacatgtcc

SEQ ID NO: 90801 - DNA, 24 bp, Artificial sequence
  SiRNA target sequence
tctatgaaattggaaacatgtcca

SEQ ID NO: 90802 - DNA, 24 bp, Artificial sequence
  SiRNA target sequence
ctatgaaattggaaacatgtccat

SEQ ID NO: 90803 - DNA, 24 bp, Artificial sequence
  SiRNA target sequence
tatgaaattggaaacatgtccata

SEQ ID NO: 90804 - DNA, 24 bp, Artificial sequence
  SiRNA target sequence
atgaaattggaaacatgtccatat

SEQ ID NO: 90805 - DNA, 24 bp, Artificial sequence
  SiRNA target sequence
tgaaattggaaacatgtccatatc

SEQ ID NO: 90806 - DNA, 24 bp, Artificial sequence
  SiRNA target sequence
gaaattggaaacatgtccatatct

SEQ ID NO: 90807 - DNA, 24 bp, Artificial sequence
  SiRNA target sequence
aaattggaaacatgtccatatcta

SEQ ID NO: 90808 - DNA, 24 bp, Artificial sequence
  SiRNA target sequence
aattggaaacatgtccatatctat

SEQ ID NO: 90809 - DNA, 24 bp, Artificial sequence
  SiRNA target sequence
attggaaacatgtccatatctatc

SEQ ID NO: 90810 - DNA, 24 bp, Artificial sequence
  SiRNA target sequence
ttggaaacatgtccatatctatcg

SEQ ID NO: 90811 - DNA, 24 bp, Artificial sequence
  SiRNA target sequence
tggaaacatgtccatatctatcgc

SEQ ID NO: 90812 - DNA, 24 bp, Artificial sequence
  SiRNA target sequence
ggaaacatgtccatatctatcgcc

SEQ ID NO: 90813 - DNA, 24 bp, Artificial sequence
  SiRNA target sequence
gaaacatgtccatatctatcgcct

SEQ ID NO: 90814 - DNA, 24 bp, Artificial sequence
  SiRNA target sequence
aaacatgtccatatctatcgcctt

SEQ ID NO: 90815 - DNA, 24 bp, Artificial sequence
  SiRNA target sequence
aacatgtccatatctatcgccttt

SEQ ID NO: 90816 - DNA, 24 bp, Artificial sequence
  SiRNA target sequence
acatgtccatatctatcgcctttt

SEQ ID NO: 90817 - DNA, 24 bp, Artificial sequence
  SiRNA target sequence
catgtccatatctatcgccttttt

SEQ ID NO: 90818 - DNA, 24 bp, Artificial sequence
  SiRNA target sequence
atgtccatatctatcgcctttttt

SEQ ID NO: 90819 - DNA, 24 bp, Artificial sequence
  SiRNA target sequence
tgtccatatctatcgcctttttta

SEQ ID NO: 90820 - DNA, 24 bp, Artificial sequence
  SiRNA target sequence
gtccatatctatcgccttttttaa

SEQ ID NO: 90821 - DNA, 24 bp, Artificial sequence
  SiRNA target sequence
tccatatctatcgccttttttaat

SEQ ID NO: 90822 - DNA, 24 bp, Artificial sequence
  SiRNA target sequence
ccatatctatcgccttttttaata

SEQ ID NO: 90823 - DNA, 24 bp, Artificial sequence
  SiRNA target sequence
catatctatcgccttttttaataa

SEQ ID NO: 90824 - DNA, 24 bp, Artificial sequence
  SiRNA target sequence
atatctatcgccttttttaataat

SEQ ID NO: 90825 - DNA, 24 bp, Artificial sequence
  SiRNA target sequence
tatctatcgccttttttaataatt

SEQ ID NO: 90826 - DNA, 24 bp, Artificial sequence
  SiRNA target sequence
atctatcgccttttttaataattg

SEQ ID NO: 90827 - DNA, 24 bp, Artificial sequence
  SiRNA target sequence
tctatcgccttttttaataattgc

SEQ ID NO: 90828 - DNA, 24 bp, Artificial sequence
  SiRNA target sequence
ctatcgccttttttaataattgct

SEQ ID NO: 90829 - DNA, 24 bp, Artificial sequence
  SiRNA target sequence
tatcgccttttttaataattgcta

SEQ ID NO: 90830 - DNA, 24 bp, Artificial sequence
  SiRNA target sequence
atcgccttttttaataattgctac

SEQ ID NO: 90831 - DNA, 24 bp, Artificial sequence
  SiRNA target sequence
tcgccttttttaataattgctact

SEQ ID NO: 90832 - DNA, 24 bp, Artificial sequence
  SiRNA target sequence
cgccttttttaataattgctacta

SEQ ID NO: 90833 - DNA, 24 bp, Artificial sequence
  SiRNA target sequence
gccttttttaataattgctactaa

SEQ ID NO: 90834 - DNA, 24 bp, Artificial sequence
  SiRNA target sequence
ccttttttaataattgctactaaa

SEQ ID NO: 90835 - DNA, 24 bp, Artificial sequence
  SiRNA target sequence
cttttttaataattgctactaaaa

SEQ ID NO: 90836 - DNA, 24 bp, Artificial sequence
  SiRNA target sequence
ttttttaataattgctactaaaat

SEQ ID NO: 90837 - DNA, 24 bp, Artificial sequence
  SiRNA target sequence
tttttaataattgctactaaaatt

SEQ ID NO: 90838 - DNA, 24 bp, Artificial sequence
  SiRNA target sequence
ttttaataattgctactaaaattt

SEQ ID NO: 90839 - DNA, 24 bp, Artificial sequence
  SiRNA target sequence
tttaataattgctactaaaatttc

SEQ ID NO: 90840 - DNA, 24 bp, Artificial sequence
  SiRNA target sequence
ttaataattgctactaaaatttca

SEQ ID NO: 90841 - DNA, 24 bp, Artificial sequence
  SiRNA target sequence
taataattgctactaaaatttcac

SEQ ID NO: 90842 - DNA, 24 bp, Artificial sequence
  SiRNA target sequence
aataattgctactaaaatttcaca

SEQ ID NO: 90843 - DNA, 24 bp, Artificial sequence
  SiRNA target sequence
ataattgctactaaaatttcacat

SEQ ID NO: 90844 - DNA, 24 bp, Artificial sequence
  SiRNA target sequence
taattgctactaaaatttcacatt

SEQ ID NO: 90845 - DNA, 24 bp, Artificial sequence
  SiRNA target sequence
aattgctactaaaatttcacattt

SEQ ID NO: 90846 - DNA, 24 bp, Artificial sequence
  SiRNA target sequence
attgctactaaaatttcacatttt

SEQ ID NO: 90847 - DNA, 24 bp, Artificial sequence
  SiRNA target sequence
ttgctactaaaatttcacattttt

SEQ ID NO: 90848 - DNA, 24 bp, Artificial sequence
  SiRNA target sequence
tgctactaaaatttcacatttttc

SEQ ID NO: 90849 - DNA, 24 bp, Artificial sequence
  SiRNA target sequence
gctactaaaatttcacatttttca

SEQ ID NO: 90850 - DNA, 24 bp, Artificial sequence
  SiRNA target sequence
ctactaaaatttcacatttttcat

SEQ ID NO: 90851 - DNA, 24 bp, Artificial sequence
  SiRNA target sequence
tactaaaatttcacatttttcatt

SEQ ID NO: 90852 - DNA, 24 bp, Artificial sequence
  SiRNA target sequence
actaaaatttcacatttttcattt

SEQ ID NO: 90853 - DNA, 24 bp, Artificial sequence
  SiRNA target sequence
ctaaaatttcacatttttcattta

SEQ ID NO: 90854 - DNA, 24 bp, Artificial sequence
  SiRNA target sequence
taaaatttcacatttttcatttac

SEQ ID NO: 90855 - DNA, 24 bp, Artificial sequence
  SiRNA target sequence
aaaatttcacatttttcatttacg

SEQ ID NO: 90856 - DNA, 24 bp, Artificial sequence
  SiRNA target sequence
aaatttcacatttttcatttacgt

SEQ ID NO: 90857 - DNA, 24 bp, Artificial sequence
  SiRNA target sequence
aatttcacatttttcatttacgtg

SEQ ID NO: 90858 - DNA, 24 bp, Artificial sequence
  SiRNA target sequence
atttcacatttttcatttacgtgg

SEQ ID NO: 90859 - DNA, 24 bp, Artificial sequence
  SiRNA target sequence
tttcacatttttcatttacgtggt

SEQ ID NO: 90860 - DNA, 24 bp, Artificial sequence
  SiRNA target sequence
ttcacatttttcatttacgtggtt

SEQ ID NO: 90861 - DNA, 24 bp, Artificial sequence
  SiRNA target sequence
tcacatttttcatttacgtggtta

SEQ ID NO: 90862 - DNA, 24 bp, Artificial sequence
  SiRNA target sequence
cacatttttcatttacgtggttag

SEQ ID NO: 90863 - DNA, 24 bp, Artificial sequence
  SiRNA target sequence
acatttttcatttacgtggttagt

SEQ ID NO: 90864 - DNA, 24 bp, Artificial sequence
  SiRNA target sequence
catttttcatttacgtggttagta

SEQ ID NO: 90865 - DNA, 24 bp, Artificial sequence
  SiRNA target sequence
atttttcatttacgtggttagtaa

SEQ ID NO: 90866 - DNA, 24 bp, Artificial sequence
  SiRNA target sequence
tttttcatttacgtggttagtaag

SEQ ID NO: 90867 - DNA, 24 bp, Artificial sequence
  SiRNA target sequence
ttttcatttacgtggttagtaagt

SEQ ID NO: 90868 - DNA, 24 bp, Artificial sequence
  SiRNA target sequence
tttcatttacgtggttagtaagtg

SEQ ID NO: 90869 - DNA, 24 bp, Artificial sequence
  SiRNA target sequence
ttcatttacgtggttagtaagtga

SEQ ID NO: 90870 - DNA, 24 bp, Artificial sequence
  SiRNA target sequence
tcatttacgtggttagtaagtgaa

SEQ ID NO: 90871 - DNA, 24 bp, Artificial sequence
  SiRNA target sequence
catttacgtggttagtaagtgaat

SEQ ID NO: 90872 - DNA, 24 bp, Artificial sequence
  SiRNA target sequence
atttacgtggttagtaagtgaata

SEQ ID NO: 90873 - DNA, 24 bp, Artificial sequence
  SiRNA target sequence
tttacgtggttagtaagtgaataa

SEQ ID NO: 90874 - DNA, 24 bp, Artificial sequence
  SiRNA target sequence
ttacgtggttagtaagtgaataat

SEQ ID NO: 90875 - DNA, 24 bp, Artificial sequence
  SiRNA target sequence
tacgtggttagtaagtgaataata

SEQ ID NO: 90876 - DNA, 24 bp, Artificial sequence
  SiRNA target sequence
acgtggttagtaagtgaataatat

SEQ ID NO: 90877 - DNA, 24 bp, Artificial sequence
  SiRNA target sequence
cgtggttagtaagtgaataatatc

SEQ ID NO: 90878 - DNA, 24 bp, Artificial sequence
  SiRNA target sequence
gtggttagtaagtgaataatatct

SEQ ID NO: 90879 - DNA, 24 bp, Artificial sequence
  SiRNA target sequence
tggttagtaagtgaataatatctt

SEQ ID NO: 90880 - DNA, 24 bp, Artificial sequence
  SiRNA target sequence
ggttagtaagtgaataatatcttg

SEQ ID NO: 90881 - DNA, 24 bp, Artificial sequence
  SiRNA target sequence
gttagtaagtgaataatatcttgg

SEQ ID NO: 90882 - DNA, 24 bp, Artificial sequence
  SiRNA target sequence
ttagtaagtgaataatatcttggc

SEQ ID NO: 90883 - DNA, 24 bp, Artificial sequence
  SiRNA target sequence
tagtaagtgaataatatcttggct

SEQ ID NO: 90884 - DNA, 24 bp, Artificial sequence
  SiRNA target sequence
agtaagtgaataatatcttggctt

SEQ ID NO: 90885 - DNA, 24 bp, Artificial sequence
  SiRNA target sequence
gtaagtgaataatatcttggctta

SEQ ID NO: 90886 - DNA, 24 bp, Artificial sequence
  SiRNA target sequence
taagtgaataatatcttggcttaa

SEQ ID NO: 90887 - DNA, 24 bp, Artificial sequence
  SiRNA target sequence
aagtgaataatatcttggcttaat

SEQ ID NO: 90888 - DNA, 24 bp, Artificial sequence
  SiRNA target sequence
agtgaataatatcttggcttaatt

SEQ ID NO: 90889 - DNA, 24 bp, Artificial sequence
  SiRNA target sequence
gtgaataatatcttggcttaattg

SEQ ID NO: 90890 - DNA, 24 bp, Artificial sequence
  SiRNA target sequence
tgaataatatcttggcttaattgt

SEQ ID NO: 90891 - DNA, 24 bp, Artificial sequence
  SiRNA target sequence
gaataatatcttggcttaattgtt

SEQ ID NO: 90892 - DNA, 24 bp, Artificial sequence
  SiRNA target sequence
aataatatcttggcttaattgttt

SEQ ID NO: 90893 - DNA, 24 bp, Artificial sequence
  SiRNA target sequence
ataatatcttggcttaattgtttg

SEQ ID NO: 90894 - DNA, 24 bp, Artificial sequence
  SiRNA target sequence
taatatcttggcttaattgtttga

SEQ ID NO: 90895 - DNA, 24 bp, Artificial sequence
  SiRNA target sequence
aatatcttggcttaattgtttgac

SEQ ID NO: 90896 - DNA, 24 bp, Artificial sequence
  SiRNA target sequence
atatcttggcttaattgtttgaca

SEQ ID NO: 90897 - DNA, 24 bp, Artificial sequence
  SiRNA target sequence
tatcttggcttaattgtttgacaa

SEQ ID NO: 90898 - DNA, 24 bp, Artificial sequence
  SiRNA target sequence
atcttggcttaattgtttgacaat

SEQ ID NO: 90899 - DNA, 24 bp, Artificial sequence
  SiRNA target sequence
tcttggcttaattgtttgacaatt

SEQ ID NO: 90900 - DNA, 24 bp, Artificial sequence
  SiRNA target sequence
cttggcttaattgtttgacaattc

SEQ ID NO: 90901 - DNA, 24 bp, Artificial sequence
  SiRNA target sequence
ttggcttaattgtttgacaattca

SEQ ID NO: 90902 - DNA, 24 bp, Artificial sequence
  SiRNA target sequence
tggcttaattgtttgacaattcat

SEQ ID NO: 90903 - DNA, 24 bp, Artificial sequence
  SiRNA target sequence
ggcttaattgtttgacaattcata

SEQ ID NO: 90904 - DNA, 24 bp, Artificial sequence
  SiRNA target sequence
gcttaattgtttgacaattcataa

SEQ ID NO: 90905 - DNA, 24 bp, Artificial sequence
  SiRNA target sequence
cttaattgtttgacaattcataat

SEQ ID NO: 90906 - DNA, 24 bp, Artificial sequence
  SiRNA target sequence
ttaattgtttgacaattcataata

SEQ ID NO: 90907 - DNA, 24 bp, Artificial sequence
  SiRNA target sequence
taattgtttgacaattcataataa

SEQ ID NO: 90908 - DNA, 24 bp, Artificial sequence
  SiRNA target sequence
aattgtttgacaattcataataag

SEQ ID NO: 90909 - DNA, 24 bp, Artificial sequence
  SiRNA target sequence
attgtttgacaattcataataaga

SEQ ID NO: 90910 - DNA, 24 bp, Artificial sequence
  SiRNA target sequence
ttgtttgacaattcataataagat

SEQ ID NO: 90911 - DNA, 24 bp, Artificial sequence
  SiRNA target sequence
tgtttgacaattcataataagatc

SEQ ID NO: 90912 - DNA, 24 bp, Artificial sequence
  SiRNA target sequence
gtttgacaattcataataagatcc

SEQ ID NO: 90913 - DNA, 24 bp, Artificial sequence
  SiRNA target sequence
tttgacaattcataataagatcct

SEQ ID NO: 90914 - DNA, 24 bp, Artificial sequence
  SiRNA target sequence
ttgacaattcataataagatcctc

SEQ ID NO: 90915 - DNA, 24 bp, Artificial sequence
  SiRNA target sequence
tgacaattcataataagatcctct

SEQ ID NO: 90916 - DNA, 24 bp, Artificial sequence
  SiRNA target sequence
gacaattcataataagatcctcta

SEQ ID NO: 90917 - DNA, 24 bp, Artificial sequence
  SiRNA target sequence
acaattcataataagatcctctaa

SEQ ID NO: 90918 - DNA, 24 bp, Artificial sequence
  SiRNA target sequence
caattcataataagatcctctaaa

SEQ ID NO: 90919 - DNA, 24 bp, Artificial sequence
  SiRNA target sequence
aattcataataagatcctctaaac

SEQ ID NO: 90920 - DNA, 24 bp, Artificial sequence
  SiRNA target sequence
attcataataagatcctctaaact

SEQ ID NO: 90921 - DNA, 24 bp, Artificial sequence
  SiRNA target sequence
ttcataataagatcctctaaactt

SEQ ID NO: 90922 - DNA, 24 bp, Artificial sequence
  SiRNA target sequence
tcataataagatcctctaaacttg

SEQ ID NO: 90923 - DNA, 24 bp, Artificial sequence
  SiRNA target sequence
cataataagatcctctaaacttgg

SEQ ID NO: 90924 - DNA, 24 bp, Artificial sequence
  SiRNA target sequence
ataataagatcctctaaacttggt

SEQ ID NO: 90925 - DNA, 24 bp, Artificial sequence
  SiRNA target sequence
taataagatcctctaaacttggtt

SEQ ID NO: 90926 - DNA, 24 bp, Artificial sequence
  SiRNA target sequence
aataagatcctctaaacttggttt

SEQ ID NO: 90927 - DNA, 24 bp, Artificial sequence
  SiRNA target sequence
ataagatcctctaaacttggttta

SEQ ID NO: 90928 - DNA, 24 bp, Artificial sequence
  SiRNA target sequence
taagatcctctaaacttggtttac

SEQ ID NO: 90929 - DNA, 24 bp, Artificial sequence
  SiRNA target sequence
aagatcctctaaacttggtttaca

SEQ ID NO: 90930 - DNA, 24 bp, Artificial sequence
  SiRNA target sequence
agatcctctaaacttggtttacat

SEQ ID NO: 90931 - DNA, 24 bp, Artificial sequence
  SiRNA target sequence
gatcctctaaacttggtttacatt

SEQ ID NO: 90932 - DNA, 24 bp, Artificial sequence
  SiRNA target sequence
atcctctaaacttggtttacattg

SEQ ID NO: 90933 - DNA, 24 bp, Artificial sequence
  SiRNA target sequence
tcctctaaacttggtttacattga

SEQ ID NO: 90934 - DNA, 24 bp, Artificial sequence
  SiRNA target sequence
cctctaaacttggtttacattgaa

SEQ ID NO: 90935 - DNA, 24 bp, Artificial sequence
  SiRNA target sequence
ctctaaacttggtttacattgaaa

SEQ ID NO: 90936 - DNA, 24 bp, Artificial sequence
  SiRNA target sequence
tctaaacttggtttacattgaaat

SEQ ID NO: 90937 - DNA, 24 bp, Artificial sequence
  SiRNA target sequence
ctaaacttggtttacattgaaatg

SEQ ID NO: 90938 - DNA, 24 bp, Artificial sequence
  SiRNA target sequence
taaacttggtttacattgaaatgt

SEQ ID NO: 90939 - DNA, 24 bp, Artificial sequence
  SiRNA target sequence
aaacttggtttacattgaaatgta

SEQ ID NO: 90940 - DNA, 24 bp, Artificial sequence
  SiRNA target sequence
aacttggtttacattgaaatgtat

SEQ ID NO: 90941 - DNA, 24 bp, Artificial sequence
  SiRNA target sequence
acttggtttacattgaaatgtata

SEQ ID NO: 90942 - DNA, 24 bp, Artificial sequence
  SiRNA target sequence
cttggtttacattgaaatgtatat

SEQ ID NO: 90943 - DNA, 24 bp, Artificial sequence
  SiRNA target sequence
ttggtttacattgaaatgtatata

SEQ ID NO: 90944 - DNA, 24 bp, Artificial sequence
  SiRNA target sequence
tggtttacattgaaatgtatatat

SEQ ID NO: 90945 - DNA, 24 bp, Artificial sequence
  SiRNA target sequence
ggtttacattgaaatgtatatata

SEQ ID NO: 90946 - DNA, 24 bp, Artificial sequence
  SiRNA target sequence
gtttacattgaaatgtatatataa

SEQ ID NO: 90947 - DNA, 24 bp, Artificial sequence
  SiRNA target sequence
tttacattgaaatgtatatataat

SEQ ID NO: 90948 - DNA, 24 bp, Artificial sequence
  SiRNA target sequence
ttacattgaaatgtatatataatg

SEQ ID NO: 90949 - DNA, 24 bp, Artificial sequence
  SiRNA target sequence
tacattgaaatgtatatataatgt

SEQ ID NO: 90950 - DNA, 24 bp, Artificial sequence
  SiRNA target sequence
acattgaaatgtatatataatgtc

SEQ ID NO: 90951 - DNA, 24 bp, Artificial sequence
  SiRNA target sequence
cattgaaatgtatatataatgtca

SEQ ID NO: 90952 - DNA, 24 bp, Artificial sequence
  SiRNA target sequence
attgaaatgtatatataatgtcaa

SEQ ID NO: 90953 - DNA, 24 bp, Artificial sequence
  SiRNA target sequence
ttgaaatgtatatataatgtcaag

SEQ ID NO: 90954 - DNA, 24 bp, Artificial sequence
  SiRNA target sequence
tgaaatgtatatataatgtcaagc

SEQ ID NO: 90955 - DNA, 24 bp, Artificial sequence
  SiRNA target sequence
gaaatgtatatataatgtcaagca

SEQ ID NO: 90956 - DNA, 24 bp, Artificial sequence
  SiRNA target sequence
aaatgtatatataatgtcaagcac

SEQ ID NO: 90957 - DNA, 24 bp, Artificial sequence
  SiRNA target sequence
aatgtatatataatgtcaagcaca

SEQ ID NO: 90958 - DNA, 24 bp, Artificial sequence
  SiRNA target sequence
atgtatatataatgtcaagcacat

SEQ ID NO: 90959 - DNA, 24 bp, Artificial sequence
  SiRNA target sequence
tgtatatataatgtcaagcacatt

SEQ ID NO: 90960 - DNA, 24 bp, Artificial sequence
  SiRNA target sequence
gtatatataatgtcaagcacatta

SEQ ID NO: 90961 - DNA, 24 bp, Artificial sequence
  SiRNA target sequence
tatatataatgtcaagcacattat

SEQ ID NO: 90962 - DNA, 24 bp, Artificial sequence
  SiRNA target sequence
atatataatgtcaagcacattatt

SEQ ID NO: 90963 - DNA, 24 bp, Artificial sequence
  SiRNA target sequence
tatataatgtcaagcacattattc

SEQ ID NO: 90964 - DNA, 24 bp, Artificial sequence
  SiRNA target sequence
atataatgtcaagcacattattcc

SEQ ID NO: 90965 - DNA, 24 bp, Artificial sequence
  SiRNA target sequence
tataatgtcaagcacattattcca

SEQ ID NO: 90966 - DNA, 24 bp, Artificial sequence
  SiRNA target sequence
ataatgtcaagcacattattccag

SEQ ID NO: 90967 - DNA, 24 bp, Artificial sequence
  SiRNA target sequence
taatgtcaagcacattattccagt

SEQ ID NO: 90968 - DNA, 24 bp, Artificial sequence
  SiRNA target sequence
aatgtcaagcacattattccagtt

SEQ ID NO: 90969 - DNA, 24 bp, Artificial sequence
  SiRNA target sequence
atgtcaagcacattattccagttc

SEQ ID NO: 90970 - DNA, 24 bp, Artificial sequence
  SiRNA target sequence
tgtcaagcacattattccagttct

SEQ ID NO: 90971 - DNA, 24 bp, Artificial sequence
  SiRNA target sequence
gtcaagcacattattccagttctt

SEQ ID NO: 90972 - DNA, 24 bp, Artificial sequence
  SiRNA target sequence
tcaagcacattattccagttctta

SEQ ID NO: 90973 - DNA, 24 bp, Artificial sequence
  SiRNA target sequence
caagcacattattccagttcttaa

SEQ ID NO: 90974 - DNA, 24 bp, Artificial sequence
  SiRNA target sequence
aagcacattattccagttcttaat

SEQ ID NO: 90975 - DNA, 24 bp, Artificial sequence
  SiRNA target sequence
agcacattattccagttcttaatg

SEQ ID NO: 90976 - DNA, 24 bp, Artificial sequence
  SiRNA target sequence
gcacattattccagttcttaatga

SEQ ID NO: 90977 - DNA, 24 bp, Artificial sequence
  SiRNA target sequence
cacattattccagttcttaatgat

SEQ ID NO: 90978 - DNA, 24 bp, Artificial sequence
  SiRNA target sequence
acattattccagttcttaatgatg

SEQ ID NO: 90979 - DNA, 24 bp, Artificial sequence
  SiRNA target sequence
cattattccagttcttaatgatgc

SEQ ID NO: 90980 - DNA, 24 bp, Artificial sequence
  SiRNA target sequence
attattccagttcttaatgatgct

SEQ ID NO: 90981 - DNA, 24 bp, Artificial sequence
  SiRNA target sequence
ttattccagttcttaatgatgctt

SEQ ID NO: 90982 - DNA, 24 bp, Artificial sequence
  SiRNA target sequence
tattccagttcttaatgatgctta

SEQ ID NO: 90983 - DNA, 24 bp, Artificial sequence
  SiRNA target sequence
attccagttcttaatgatgcttaa

SEQ ID NO: 90984 - DNA, 24 bp, Artificial sequence
  SiRNA target sequence
ttccagttcttaatgatgcttaaa

SEQ ID NO: 90985 - DNA, 24 bp, Artificial sequence
  SiRNA target sequence
tccagttcttaatgatgcttaaat

SEQ ID NO: 90986 - DNA, 24 bp, Artificial sequence
  SiRNA target sequence
ccagttcttaatgatgcttaaata

SEQ ID NO: 90987 - DNA, 24 bp, Artificial sequence
  SiRNA target sequence
cagttcttaatgatgcttaaataa

SEQ ID NO: 90988 - DNA, 24 bp, Artificial sequence
  SiRNA target sequence
agttcttaatgatgcttaaataat

SEQ ID NO: 90989 - DNA, 24 bp, Artificial sequence
  SiRNA target sequence
gttcttaatgatgcttaaataatc

SEQ ID NO: 90990 - DNA, 24 bp, Artificial sequence
  SiRNA target sequence
ttcttaatgatgcttaaataatct

SEQ ID NO: 90991 - DNA, 24 bp, Artificial sequence
  SiRNA target sequence
tcttaatgatgcttaaataatctt

SEQ ID NO: 90992 - DNA, 24 bp, Artificial sequence
  SiRNA target sequence
cttaatgatgcttaaataatcttt

SEQ ID NO: 90993 - DNA, 24 bp, Artificial sequence
  SiRNA target sequence
ttaatgatgcttaaataatctttt

SEQ ID NO: 90994 - DNA, 24 bp, Artificial sequence
  SiRNA target sequence
taatgatgcttaaataatctttta

SEQ ID NO: 90995 - DNA, 24 bp, Artificial sequence
  SiRNA target sequence
aatgatgcttaaataatcttttac

SEQ ID NO: 90996 - DNA, 24 bp, Artificial sequence
  SiRNA target sequence
atgatgcttaaataatcttttact

SEQ ID NO: 90997 - DNA, 24 bp, Artificial sequence
  SiRNA target sequence
tgatgcttaaataatcttttactc

SEQ ID NO: 90998 - DNA, 24 bp, Artificial sequence
  SiRNA target sequence
gatgcttaaataatcttttactcc

SEQ ID NO: 90999 - DNA, 24 bp, Artificial sequence
  SiRNA target sequence
atgcttaaataatcttttactcct

SEQ ID NO: 91000 - DNA, 24 bp, Artificial sequence
  SiRNA target sequence
tgcttaaataatcttttactcctt

SEQ ID NO: 91001 - DNA, 24 bp, Artificial sequence
  SiRNA target sequence
gcttaaataatcttttactccttc

SEQ ID NO: 91002 - DNA, 24 bp, Artificial sequence
  SiRNA target sequence
cttaaataatcttttactccttct

SEQ ID NO: 91003 - DNA, 24 bp, Artificial sequence
  SiRNA target sequence
ttaaataatcttttactccttctt

SEQ ID NO: 91004 - DNA, 24 bp, Artificial sequence
  SiRNA target sequence
taaataatcttttactccttcttt

SEQ ID NO: 91005 - DNA, 24 bp, Artificial sequence
  SiRNA target sequence
aaataatcttttactccttcttta

SEQ ID NO: 91006 - DNA, 24 bp, Artificial sequence
  SiRNA target sequence
aataatcttttactccttctttag

SEQ ID NO: 91007 - DNA, 24 bp, Artificial sequence
  SiRNA target sequence
ataatcttttactccttctttaga

SEQ ID NO: 91008 - DNA, 24 bp, Artificial sequence
  SiRNA target sequence
taatcttttactccttctttagaa

SEQ ID NO: 91009 - DNA, 24 bp, Artificial sequence
  SiRNA target sequence
aatcttttactccttctttagaac

SEQ ID NO: 91010 - DNA, 24 bp, Artificial sequence
  SiRNA target sequence
atcttttactccttctttagaaca

SEQ ID NO: 91011 - DNA, 24 bp, Artificial sequence
  SiRNA target sequence
tcttttactccttctttagaacac

SEQ ID NO: 91012 - DNA, 24 bp, Artificial sequence
  SiRNA target sequence
cttttactccttctttagaacaca

SEQ ID NO: 91013 - DNA, 24 bp, Artificial sequence
  SiRNA target sequence
ttttactccttctttagaacacag

SEQ ID NO: 91014 - DNA, 24 bp, Artificial sequence
  SiRNA target sequence
tttactccttctttagaacacaga

SEQ ID NO: 91015 - DNA, 24 bp, Artificial sequence
  SiRNA target sequence
ttactccttctttagaacacagat

SEQ ID NO: 91016 - DNA, 24 bp, Artificial sequence
  SiRNA target sequence
tactccttctttagaacacagata

SEQ ID NO: 91017 - DNA, 24 bp, Artificial sequence
  SiRNA target sequence
actccttctttagaacacagatat

SEQ ID NO: 91018 - DNA, 24 bp, Artificial sequence
  SiRNA target sequence
ctccttctttagaacacagatatt

SEQ ID NO: 91019 - DNA, 24 bp, Artificial sequence
  SiRNA target sequence
tccttctttagaacacagatattc

SEQ ID NO: 91020 - DNA, 24 bp, Artificial sequence
  SiRNA target sequence
ccttctttagaacacagatattca

SEQ ID NO: 91021 - DNA, 24 bp, Artificial sequence
  SiRNA target sequence
cttctttagaacacagatattcaa

SEQ ID NO: 91022 - DNA, 24 bp, Artificial sequence
  SiRNA target sequence
ttctttagaacacagatattcaat

SEQ ID NO: 91023 - DNA, 24 bp, Artificial sequence
  SiRNA target sequence
tctttagaacacagatattcaata

SEQ ID NO: 91024 - DNA, 24 bp, Artificial sequence
  SiRNA target sequence
ctttagaacacagatattcaatat

SEQ ID NO: 91025 - DNA, 24 bp, Artificial sequence
  SiRNA target sequence
tttagaacacagatattcaatatc

SEQ ID NO: 91026 - DNA, 24 bp, Artificial sequence
  SiRNA target sequence
ttagaacacagatattcaatatca

SEQ ID NO: 91027 - DNA, 24 bp, Artificial sequence
  SiRNA target sequence
tagaacacagatattcaatatcat

SEQ ID NO: 91028 - DNA, 24 bp, Artificial sequence
  SiRNA target sequence
agaacacagatattcaatatcatg

SEQ ID NO: 91029 - DNA, 24 bp, Artificial sequence
  SiRNA target sequence
gaacacagatattcaatatcatgc

SEQ ID NO: 91030 - DNA, 24 bp, Artificial sequence
  SiRNA target sequence
aacacagatattcaatatcatgct

SEQ ID NO: 91031 - DNA, 24 bp, Artificial sequence
  SiRNA target sequence
acacagatattcaatatcatgctt

SEQ ID NO: 91032 - DNA, 24 bp, Artificial sequence
  SiRNA target sequence
cacagatattcaatatcatgctta

SEQ ID NO: 91033 - DNA, 24 bp, Artificial sequence
  SiRNA target sequence
acagatattcaatatcatgcttat

SEQ ID NO: 91034 - DNA, 24 bp, Artificial sequence
  SiRNA target sequence
cagatattcaatatcatgcttatt

SEQ ID NO: 91035 - DNA, 24 bp, Artificial sequence
  SiRNA target sequence
agatattcaatatcatgcttattt

SEQ ID NO: 91036 - DNA, 24 bp, Artificial sequence
  SiRNA target sequence
gatattcaatatcatgcttatttt

SEQ ID NO: 91037 - DNA, 24 bp, Artificial sequence
  SiRNA target sequence
atattcaatatcatgcttattttt

SEQ ID NO: 91038 - DNA, 24 bp, Artificial sequence
  SiRNA target sequence
tattcaatatcatgcttattttta

SEQ ID NO: 91039 - DNA, 24 bp, Artificial sequence
  SiRNA target sequence
attcaatatcatgcttatttttag

SEQ ID NO: 91040 - DNA, 24 bp, Artificial sequence
  SiRNA target sequence
ttcaatatcatgcttatttttaga

SEQ ID NO: 91041 - DNA, 24 bp, Artificial sequence
  SiRNA target sequence
tcaatatcatgcttatttttagag

SEQ ID NO: 91042 - DNA, 24 bp, Artificial sequence
  SiRNA target sequence
caatatcatgcttatttttagagg

SEQ ID NO: 91043 - DNA, 24 bp, Artificial sequence
  SiRNA target sequence
aatatcatgcttatttttagaggt

SEQ ID NO: 91044 - DNA, 24 bp, Artificial sequence
  SiRNA target sequence
atatcatgcttatttttagaggtt

SEQ ID NO: 91045 - DNA, 24 bp, Artificial sequence
  SiRNA target sequence
tatcatgcttatttttagaggttt

SEQ ID NO: 91046 - DNA, 24 bp, Artificial sequence
  SiRNA target sequence
atcatgcttatttttagaggtttt

SEQ ID NO: 91047 - DNA, 24 bp, Artificial sequence
  SiRNA target sequence
tcatgcttatttttagaggtttta

SEQ ID NO: 91048 - DNA, 24 bp, Artificial sequence
  SiRNA target sequence
catgcttatttttagaggttttag

SEQ ID NO: 91049 - DNA, 24 bp, Artificial sequence
  SiRNA target sequence
atgcttatttttagaggttttaga

SEQ ID NO: 91050 - DNA, 24 bp, Artificial sequence
  SiRNA target sequence
tgcttatttttagaggttttagaa

SEQ ID NO: 91051 - DNA, 24 bp, Artificial sequence
  SiRNA target sequence
gcttatttttagaggttttagaaa

SEQ ID NO: 91052 - DNA, 24 bp, Artificial sequence
  SiRNA target sequence
cttatttttagaggttttagaaat

SEQ ID NO: 91053 - DNA, 24 bp, Artificial sequence
  SiRNA target sequence
ttatttttagaggttttagaaata

SEQ ID NO: 91054 - DNA, 24 bp, Artificial sequence
  SiRNA target sequence
tatttttagaggttttagaaatat

SEQ ID NO: 91055 - DNA, 24 bp, Artificial sequence
  SiRNA target sequence
atttttagaggttttagaaatatc

SEQ ID NO: 91056 - DNA, 24 bp, Artificial sequence
  SiRNA target sequence
tttttagaggttttagaaatatcc

SEQ ID NO: 91057 - DNA, 24 bp, Artificial sequence
  SiRNA target sequence
ttttagaggttttagaaatatcca

SEQ ID NO: 91058 - DNA, 24 bp, Artificial sequence
  SiRNA target sequence
tttagaggttttagaaatatccat

SEQ ID NO: 91059 - DNA, 24 bp, Artificial sequence
  SiRNA target sequence
ttagaggttttagaaatatccata

SEQ ID NO: 91060 - DNA, 24 bp, Artificial sequence
  SiRNA target sequence
tagaggttttagaaatatccataa

SEQ ID NO: 91061 - DNA, 24 bp, Artificial sequence
  SiRNA target sequence
agaggttttagaaatatccataag

SEQ ID NO: 91062 - DNA, 24 bp, Artificial sequence
  SiRNA target sequence
gaggttttagaaatatccataagc

SEQ ID NO: 91063 - DNA, 24 bp, Artificial sequence
  SiRNA target sequence
aggttttagaaatatccataagcc

SEQ ID NO: 91064 - DNA, 24 bp, Artificial sequence
  SiRNA target sequence
ggttttagaaatatccataagcca

SEQ ID NO: 91065 - DNA, 24 bp, Artificial sequence
  SiRNA target sequence
gttttagaaatatccataagccat

SEQ ID NO: 91066 - DNA, 24 bp, Artificial sequence
  SiRNA target sequence
ttttagaaatatccataagccatg

SEQ ID NO: 91067 - DNA, 24 bp, Artificial sequence
  SiRNA target sequence
tttagaaatatccataagccatgc

SEQ ID NO: 91068 - DNA, 24 bp, Artificial sequence
  SiRNA target sequence
ttagaaatatccataagccatgct

SEQ ID NO: 91069 - DNA, 24 bp, Artificial sequence
  SiRNA target sequence
tagaaatatccataagccatgctt

SEQ ID NO: 91070 - DNA, 24 bp, Artificial sequence
  SiRNA target sequence
agaaatatccataagccatgcttt

SEQ ID NO: 91071 - DNA, 24 bp, Artificial sequence
  SiRNA target sequence
gaaatatccataagccatgctttt

SEQ ID NO: 91072 - DNA, 24 bp, Artificial sequence
  SiRNA target sequence
aaatatccataagccatgcttttt

SEQ ID NO: 91073 - DNA, 24 bp, Artificial sequence
  SiRNA target sequence
aatatccataagccatgctttttt

SEQ ID NO: 91074 - DNA, 24 bp, Artificial sequence
  SiRNA target sequence
atatccataagccatgctttttta

SEQ ID NO: 91075 - DNA, 24 bp, Artificial sequence
  SiRNA target sequence
tatccataagccatgcttttttag

SEQ ID NO: 91076 - DNA, 24 bp, Artificial sequence
  SiRNA target sequence
atccataagccatgcttttttagg

SEQ ID NO: 91077 - DNA, 24 bp, Artificial sequence
  SiRNA target sequence
tccataagccatgcttttttaggc

SEQ ID NO: 91078 - DNA, 24 bp, Artificial sequence
  SiRNA target sequence
ccataagccatgcttttttaggca

SEQ ID NO: 91079 - DNA, 24 bp, Artificial sequence
  SiRNA target sequence
cataagccatgcttttttaggcaa

SEQ ID NO: 91080 - DNA, 24 bp, Artificial sequence
  SiRNA target sequence
ataagccatgcttttttaggcaat

SEQ ID NO: 91081 - DNA, 24 bp, Artificial sequence
  SiRNA target sequence
taagccatgcttttttaggcaatg

SEQ ID NO: 91082 - DNA, 24 bp, Artificial sequence
  SiRNA target sequence
aagccatgcttttttaggcaatga

SEQ ID NO: 91083 - DNA, 24 bp, Artificial sequence
  SiRNA target sequence
agccatgcttttttaggcaatgaa

SEQ ID NO: 91084 - DNA, 24 bp, Artificial sequence
  SiRNA target sequence
gccatgcttttttaggcaatgaag

SEQ ID NO: 91085 - DNA, 24 bp, Artificial sequence
  SiRNA target sequence
ccatgcttttttaggcaatgaagt

SEQ ID NO: 91086 - DNA, 24 bp, Artificial sequence
  SiRNA target sequence
catgcttttttaggcaatgaagta

SEQ ID NO: 91087 - DNA, 24 bp, Artificial sequence
  SiRNA target sequence
atgcttttttaggcaatgaagtaa

SEQ ID NO: 91088 - DNA, 24 bp, Artificial sequence
  SiRNA target sequence
tgcttttttaggcaatgaagtaaa

SEQ ID NO: 91089 - DNA, 24 bp, Artificial sequence
  SiRNA target sequence
gcttttttaggcaatgaagtaaaa

SEQ ID NO: 91090 - DNA, 24 bp, Artificial sequence
  SiRNA target sequence
cttttttaggcaatgaagtaaaat

SEQ ID NO: 91091 - DNA, 24 bp, Artificial sequence
  SiRNA target sequence
ttttttaggcaatgaagtaaaatc

SEQ ID NO: 91092 - DNA, 24 bp, Artificial sequence
  SiRNA target sequence
tttttaggcaatgaagtaaaatca

SEQ ID NO: 91093 - DNA, 24 bp, Artificial sequence
  SiRNA target sequence
ttttaggcaatgaagtaaaatcaa

SEQ ID NO: 91094 - DNA, 24 bp, Artificial sequence
  SiRNA target sequence
tttaggcaatgaagtaaaatcaaa

SEQ ID NO: 91095 - DNA, 24 bp, Artificial sequence
  SiRNA target sequence
ttaggcaatgaagtaaaatcaaaa

SEQ ID NO: 91096 - DNA, 24 bp, Artificial sequence
  SiRNA target sequence
taggcaatgaagtaaaatcaaaaa

SEQ ID NO: 91097 - DNA, 24 bp, Artificial sequence
  SiRNA target sequence
aggcaatgaagtaaaatcaaaaat

SEQ ID NO: 91098 - DNA, 24 bp, Artificial sequence
  SiRNA target sequence
ggcaatgaagtaaaatcaaaaata

SEQ ID NO: 91099 - DNA, 24 bp, Artificial sequence
  SiRNA target sequence
gcaatgaagtaaaatcaaaaatat

SEQ ID NO: 91100 - DNA, 24 bp, Artificial sequence
  SiRNA target sequence
caatgaagtaaaatcaaaaatata

SEQ ID NO: 91101 - DNA, 24 bp, Artificial sequence
  SiRNA target sequence
aatgaagtaaaatcaaaaatatac

SEQ ID NO: 91102 - DNA, 24 bp, Artificial sequence
  SiRNA target sequence
atgaagtaaaatcaaaaatatact

SEQ ID NO: 91103 - DNA, 24 bp, Artificial sequence
  SiRNA target sequence
tgaagtaaaatcaaaaatatactt

SEQ ID NO: 91104 - DNA, 24 bp, Artificial sequence
  SiRNA target sequence
gaagtaaaatcaaaaatatacttg

SEQ ID NO: 91105 - DNA, 24 bp, Artificial sequence
  SiRNA target sequence
aagtaaaatcaaaaatatacttga

SEQ ID NO: 91106 - DNA, 24 bp, Artificial sequence
  SiRNA target sequence
agtaaaatcaaaaatatacttgaa

SEQ ID NO: 91107 - DNA, 24 bp, Artificial sequence
  SiRNA target sequence
gtaaaatcaaaaatatacttgaaa

SEQ ID NO: 91108 - DNA, 24 bp, Artificial sequence
  SiRNA target sequence
taaaatcaaaaatatacttgaaaa

SEQ ID NO: 91109 - DNA, 24 bp, Artificial sequence
  SiRNA target sequence
aaaatcaaaaatatacttgaaaaa

SEQ ID NO: 91110 - DNA, 24 bp, Artificial sequence
  SiRNA target sequence
aaatcaaaaatatacttgaaaaag

SEQ ID NO: 91111 - DNA, 24 bp, Artificial sequence
  SiRNA target sequence
aatcaaaaatatacttgaaaaagt

SEQ ID NO: 91112 - DNA, 24 bp, Artificial sequence
  SiRNA target sequence
atcaaaaatatacttgaaaaagtc

SEQ ID NO: 91113 - DNA, 24 bp, Artificial sequence
  SiRNA target sequence
tcaaaaatatacttgaaaaagtca

SEQ ID NO: 91114 - DNA, 24 bp, Artificial sequence
  SiRNA target sequence
caaaaatatacttgaaaaagtcac

SEQ ID NO: 91115 - DNA, 24 bp, Artificial sequence
  SiRNA target sequence
aaaaatatacttgaaaaagtcacg

SEQ ID NO: 91116 - DNA, 24 bp, Artificial sequence
  SiRNA target sequence
aaaatatacttgaaaaagtcacgc

SEQ ID NO: 91117 - DNA, 24 bp, Artificial sequence
  SiRNA target sequence
aaatatacttgaaaaagtcacgca

SEQ ID NO: 91118 - DNA, 24 bp, Artificial sequence
  SiRNA target sequence
aatatacttgaaaaagtcacgcaa

SEQ ID NO: 91119 - DNA, 24 bp, Artificial sequence
  SiRNA target sequence
atatacttgaaaaagtcacgcaaa

SEQ ID NO: 91120 - DNA, 24 bp, Artificial sequence
  SiRNA target sequence
tatacttgaaaaagtcacgcaaag

SEQ ID NO: 91121 - DNA, 24 bp, Artificial sequence
  SiRNA target sequence
atacttgaaaaagtcacgcaaaga

SEQ ID NO: 91122 - DNA, 24 bp, Artificial sequence
  SiRNA target sequence
tacttgaaaaagtcacgcaaagat

SEQ ID NO: 91123 - DNA, 24 bp, Artificial sequence
  SiRNA target sequence
acttgaaaaagtcacgcaaagatc

SEQ ID NO: 91124 - DNA, 24 bp, Artificial sequence
  SiRNA target sequence
cttgaaaaagtcacgcaaagatcc

SEQ ID NO: 91125 - DNA, 24 bp, Artificial sequence
  SiRNA target sequence
ttgaaaaagtcacgcaaagatcct

SEQ ID NO: 91126 - DNA, 24 bp, Artificial sequence
  SiRNA target sequence
tgaaaaagtcacgcaaagatcctt

SEQ ID NO: 91127 - DNA, 24 bp, Artificial sequence
  SiRNA target sequence
gaaaaagtcacgcaaagatccttc

SEQ ID NO: 91128 - DNA, 24 bp, Artificial sequence
  SiRNA target sequence
aaaaagtcacgcaaagatccttcg

SEQ ID NO: 91129 - DNA, 24 bp, Artificial sequence
  SiRNA target sequence
aaaagtcacgcaaagatccttcga

SEQ ID NO: 91130 - DNA, 24 bp, Artificial sequence
  SiRNA target sequence
aaagtcacgcaaagatccttcgaa

SEQ ID NO: 91131 - DNA, 24 bp, Artificial sequence
  SiRNA target sequence
aagtcacgcaaagatccttcgaat

SEQ ID NO: 91132 - DNA, 24 bp, Artificial sequence
  SiRNA target sequence
agtcacgcaaagatccttcgaatt

SEQ ID NO: 91133 - DNA, 24 bp, Artificial sequence
  SiRNA target sequence
gtcacgcaaagatccttcgaattg

SEQ ID NO: 91134 - DNA, 24 bp, Artificial sequence
  SiRNA target sequence
tcacgcaaagatccttcgaattga

SEQ ID NO: 91135 - DNA, 24 bp, Artificial sequence
  SiRNA target sequence
cacgcaaagatccttcgaattgaa

SEQ ID NO: 91136 - DNA, 24 bp, Artificial sequence
  SiRNA target sequence
acgcaaagatccttcgaattgaaa

SEQ ID NO: 91137 - DNA, 24 bp, Artificial sequence
  SiRNA target sequence
cgcaaagatccttcgaattgaaac

SEQ ID NO: 91138 - DNA, 24 bp, Artificial sequence
  SiRNA target sequence
gcaaagatccttcgaattgaaacc

SEQ ID NO: 91139 - DNA, 24 bp, Artificial sequence
  SiRNA target sequence
caaagatccttcgaattgaaaccc

SEQ ID NO: 91140 - DNA, 24 bp, Artificial sequence
  SiRNA target sequence
aaagatccttcgaattgaaacccc

SEQ ID NO: 91141 - DNA, 24 bp, Artificial sequence
  SiRNA target sequence
aagatccttcgaattgaaaccccg

SEQ ID NO: 91142 - DNA, 24 bp, Artificial sequence
  SiRNA target sequence
agatccttcgaattgaaaccccgt

SEQ ID NO: 91143 - DNA, 24 bp, Artificial sequence
  SiRNA target sequence
gatccttcgaattgaaaccccgtt

SEQ ID NO: 91144 - DNA, 24 bp, Artificial sequence
  SiRNA target sequence
atccttcgaattgaaaccccgttt

SEQ ID NO: 91145 - DNA, 24 bp, Artificial sequence
  SiRNA target sequence
tccttcgaattgaaaccccgtttt

SEQ ID NO: 91146 - DNA, 24 bp, Artificial sequence
  SiRNA target sequence
ccttcgaattgaaaccccgttttt

SEQ ID NO: 91147 - DNA, 24 bp, Artificial sequence
  SiRNA target sequence
cttcgaattgaaaccccgtttttc

SEQ ID NO: 91148 - DNA, 24 bp, Artificial sequence
  SiRNA target sequence
ttcgaattgaaaccccgtttttcc

SEQ ID NO: 91149 - DNA, 24 bp, Artificial sequence
  SiRNA target sequence
tcgaattgaaaccccgtttttcca

SEQ ID NO: 91150 - DNA, 24 bp, Artificial sequence
  SiRNA target sequence
cgaattgaaaccccgtttttccaa

SEQ ID NO: 91151 - DNA, 24 bp, Artificial sequence
  SiRNA target sequence
gaattgaaaccccgtttttccaac

SEQ ID NO: 91152 - DNA, 24 bp, Artificial sequence
  SiRNA target sequence
aattgaaaccccgtttttccaact

SEQ ID NO: 91153 - DNA, 24 bp, Artificial sequence
  SiRNA target sequence
attgaaaccccgtttttccaactt

SEQ ID NO: 91154 - DNA, 24 bp, Artificial sequence
  SiRNA target sequence
ttgaaaccccgtttttccaacttg

SEQ ID NO: 91155 - DNA, 24 bp, Artificial sequence
  SiRNA target sequence
tgaaaccccgtttttccaacttgc

SEQ ID NO: 91156 - DNA, 24 bp, Artificial sequence
  SiRNA target sequence
gaaaccccgtttttccaacttgct

SEQ ID NO: 91157 - DNA, 24 bp, Artificial sequence
  SiRNA target sequence
aaaccccgtttttccaacttgctc

SEQ ID NO: 91158 - DNA, 24 bp, Artificial sequence
  SiRNA target sequence
aaccccgtttttccaacttgctca

SEQ ID NO: 91159 - DNA, 24 bp, Artificial sequence
  SiRNA target sequence
accccgtttttccaacttgctcaa

SEQ ID NO: 91160 - DNA, 24 bp, Artificial sequence
  SiRNA target sequence
ccccgtttttccaacttgctcaat

SEQ ID NO: 91161 - DNA, 24 bp, Artificial sequence
  SiRNA target sequence
cccgtttttccaacttgctcaata

SEQ ID NO: 91162 - DNA, 24 bp, Artificial sequence
  SiRNA target sequence
ccgtttttccaacttgctcaatat

SEQ ID NO: 91163 - DNA, 24 bp, Artificial sequence
  SiRNA target sequence
cgtttttccaacttgctcaatata

SEQ ID NO: 91164 - DNA, 24 bp, Artificial sequence
  SiRNA target sequence
gtttttccaacttgctcaatatat

SEQ ID NO: 91165 - DNA, 24 bp, Artificial sequence
  SiRNA target sequence
tttttccaacttgctcaatatata

SEQ ID NO: 91166 - DNA, 24 bp, Artificial sequence
  SiRNA target sequence
ttttccaacttgctcaatatataa

SEQ ID NO: 91167 - DNA, 24 bp, Artificial sequence
  SiRNA target sequence
tttccaacttgctcaatatataat

SEQ ID NO: 91168 - DNA, 24 bp, Artificial sequence
  SiRNA target sequence
ttccaacttgctcaatatataata

SEQ ID NO: 91169 - DNA, 24 bp, Artificial sequence
  SiRNA target sequence
tccaacttgctcaatatataataa

SEQ ID NO: 91170 - DNA, 24 bp, Artificial sequence
  SiRNA target sequence
ccaacttgctcaatatataataat

SEQ ID NO: 91171 - DNA, 24 bp, Artificial sequence
  SiRNA target sequence
caacttgctcaatatataataatg

SEQ ID NO: 91172 - DNA, 24 bp, Artificial sequence
  SiRNA target sequence
aacttgctcaatatataataatgt

SEQ ID NO: 91173 - DNA, 24 bp, Artificial sequence
  SiRNA target sequence
acttgctcaatatataataatgta

SEQ ID NO: 91174 - DNA, 24 bp, Artificial sequence
  SiRNA target sequence
cttgctcaatatataataatgtat

SEQ ID NO: 91175 - DNA, 24 bp, Artificial sequence
  SiRNA target sequence
ttgctcaatatataataatgtatc

SEQ ID NO: 91176 - DNA, 24 bp, Artificial sequence
  SiRNA target sequence
tgctcaatatataataatgtatca

SEQ ID NO: 91177 - DNA, 24 bp, Artificial sequence
  SiRNA target sequence
gctcaatatataataatgtatcac

SEQ ID NO: 91178 - DNA, 24 bp, Artificial sequence
  SiRNA target sequence
ctcaatatataataatgtatcacc

SEQ ID NO: 91179 - DNA, 24 bp, Artificial sequence
  SiRNA target sequence
tcaatatataataatgtatcacca

SEQ ID NO: 91180 - DNA, 24 bp, Artificial sequence
  SiRNA target sequence
caatatataataatgtatcaccag

SEQ ID NO: 91181 - DNA, 24 bp, Artificial sequence
  SiRNA target sequence
aatatataataatgtatcaccaga

SEQ ID NO: 91182 - DNA, 24 bp, Artificial sequence
  SiRNA target sequence
atatataataatgtatcaccagac

SEQ ID NO: 91183 - DNA, 24 bp, Artificial sequence
  SiRNA target sequence
tatataataatgtatcaccagaca

SEQ ID NO: 91184 - DNA, 24 bp, Artificial sequence
  SiRNA target sequence
atataataatgtatcaccagacat

SEQ ID NO: 91185 - DNA, 24 bp, Artificial sequence
  SiRNA target sequence
tataataatgtatcaccagacatt

SEQ ID NO: 91186 - DNA, 24 bp, Artificial sequence
  SiRNA target sequence
ataataatgtatcaccagacattt

SEQ ID NO: 91187 - DNA, 24 bp, Artificial sequence
  SiRNA target sequence
taataatgtatcaccagacatttc

SEQ ID NO: 91188 - DNA, 24 bp, Artificial sequence
  SiRNA target sequence
aataatgtatcaccagacatttct

SEQ ID NO: 91189 - DNA, 24 bp, Artificial sequence
  SiRNA target sequence
ataatgtatcaccagacatttcta

SEQ ID NO: 91190 - DNA, 24 bp, Artificial sequence
  SiRNA target sequence
taatgtatcaccagacatttctag

SEQ ID NO: 91191 - DNA, 24 bp, Artificial sequence
  SiRNA target sequence
aatgtatcaccagacatttctagt

SEQ ID NO: 91192 - DNA, 24 bp, Artificial sequence
  SiRNA target sequence
atgtatcaccagacatttctagta

SEQ ID NO: 91193 - DNA, 24 bp, Artificial sequence
  SiRNA target sequence
tgtatcaccagacatttctagtaa

SEQ ID NO: 91194 - DNA, 24 bp, Artificial sequence
  SiRNA target sequence
gtatcaccagacatttctagtaaa

SEQ ID NO: 91195 - DNA, 24 bp, Artificial sequence
  SiRNA target sequence
tatcaccagacatttctagtaaac

SEQ ID NO: 91196 - DNA, 24 bp, Artificial sequence
  SiRNA target sequence
atcaccagacatttctagtaaact

SEQ ID NO: 91197 - DNA, 24 bp, Artificial sequence
  SiRNA target sequence
tcaccagacatttctagtaaactt

SEQ ID NO: 91198 - DNA, 24 bp, Artificial sequence
  SiRNA target sequence
caccagacatttctagtaaactta

SEQ ID NO: 91199 - DNA, 24 bp, Artificial sequence
  SiRNA target sequence
accagacatttctagtaaacttaa

SEQ ID NO: 91200 - DNA, 24 bp, Artificial sequence
  SiRNA target sequence
ccagacatttctagtaaacttaac

SEQ ID NO: 91201 - DNA, 24 bp, Artificial sequence
  SiRNA target sequence
cagacatttctagtaaacttaaca

SEQ ID NO: 91202 - DNA, 24 bp, Artificial sequence
  SiRNA target sequence
agacatttctagtaaacttaacat

SEQ ID NO: 91203 - DNA, 24 bp, Artificial sequence
  SiRNA target sequence
gacatttctagtaaacttaacatt

SEQ ID NO: 91204 - DNA, 24 bp, Artificial sequence
  SiRNA target sequence
acatttctagtaaacttaacattt

SEQ ID NO: 91205 - DNA, 24 bp, Artificial sequence
  SiRNA target sequence
catttctagtaaacttaacatttc

SEQ ID NO: 91206 - DNA, 24 bp, Artificial sequence
  SiRNA target sequence
atttctagtaaacttaacatttca

SEQ ID NO: 91207 - DNA, 24 bp, Artificial sequence
  SiRNA target sequence
tttctagtaaacttaacatttcat

SEQ ID NO: 91208 - DNA, 24 bp, Artificial sequence
  SiRNA target sequence
ttctagtaaacttaacatttcatt

SEQ ID NO: 91209 - DNA, 24 bp, Artificial sequence
  SiRNA target sequence
tctagtaaacttaacatttcatta

SEQ ID NO: 91210 - DNA, 24 bp, Artificial sequence
  SiRNA target sequence
ctagtaaacttaacatttcattaa

SEQ ID NO: 91211 - DNA, 24 bp, Artificial sequence
  SiRNA target sequence
tagtaaacttaacatttcattaac

SEQ ID NO: 91212 - DNA, 24 bp, Artificial sequence
  SiRNA target sequence
agtaaacttaacatttcattaaca

SEQ ID NO: 91213 - DNA, 24 bp, Artificial sequence
  SiRNA target sequence
gtaaacttaacatttcattaacaa

SEQ ID NO: 91214 - DNA, 24 bp, Artificial sequence
  SiRNA target sequence
taaacttaacatttcattaacaag

SEQ ID NO: 91215 - DNA, 24 bp, Artificial sequence
  SiRNA target sequence
aaacttaacatttcattaacaagc

SEQ ID NO: 91216 - DNA, 24 bp, Artificial sequence
  SiRNA target sequence
aacttaacatttcattaacaagca

SEQ ID NO: 91217 - DNA, 24 bp, Artificial sequence
  SiRNA target sequence
acttaacatttcattaacaagcaa

SEQ ID NO: 91218 - DNA, 24 bp, Artificial sequence
  SiRNA target sequence
cttaacatttcattaacaagcaaa

SEQ ID NO: 91219 - DNA, 24 bp, Artificial sequence
  SiRNA target sequence
ttaacatttcattaacaagcaaat

SEQ ID NO: 91220 - DNA, 24 bp, Artificial sequence
  SiRNA target sequence
taacatttcattaacaagcaaatc

SEQ ID NO: 91221 - DNA, 24 bp, Artificial sequence
  SiRNA target sequence
aacatttcattaacaagcaaatca

SEQ ID NO: 91222 - DNA, 24 bp, Artificial sequence
  SiRNA target sequence
acatttcattaacaagcaaatcat

SEQ ID NO: 91223 - DNA, 24 bp, Artificial sequence
  SiRNA target sequence
catttcattaacaagcaaatcatt

SEQ ID NO: 91224 - DNA, 24 bp, Artificial sequence
  SiRNA target sequence
atttcattaacaagcaaatcatta

SEQ ID NO: 91225 - DNA, 24 bp, Artificial sequence
  SiRNA target sequence
tttcattaacaagcaaatcattat

SEQ ID NO: 91226 - DNA, 24 bp, Artificial sequence
  SiRNA target sequence
ttcattaacaagcaaatcattatt

SEQ ID NO: 91227 - DNA, 24 bp, Artificial sequence
  SiRNA target sequence
tcattaacaagcaaatcattattt

SEQ ID NO: 91228 - DNA, 24 bp, Artificial sequence
  SiRNA target sequence
cattaacaagcaaatcattatttg

SEQ ID NO: 91229 - DNA, 24 bp, Artificial sequence
  SiRNA target sequence
attaacaagcaaatcattatttga

SEQ ID NO: 91230 - DNA, 24 bp, Artificial sequence
  SiRNA target sequence
ttaacaagcaaatcattatttgaa

SEQ ID NO: 91231 - DNA, 24 bp, Artificial sequence
  SiRNA target sequence
taacaagcaaatcattatttgaac

SEQ ID NO: 91232 - DNA, 24 bp, Artificial sequence
  SiRNA target sequence
aacaagcaaatcattatttgaaca

SEQ ID NO: 91233 - DNA, 24 bp, Artificial sequence
  SiRNA target sequence
acaagcaaatcattatttgaacaa

SEQ ID NO: 91234 - DNA, 24 bp, Artificial sequence
  SiRNA target sequence
caagcaaatcattatttgaacaaa

SEQ ID NO: 91235 - DNA, 24 bp, Artificial sequence
  SiRNA target sequence
aagcaaatcattatttgaacaaag

SEQ ID NO: 91236 - DNA, 24 bp, Artificial sequence
  SiRNA target sequence
agcaaatcattatttgaacaaagt

SEQ ID NO: 91237 - DNA, 24 bp, Artificial sequence
  SiRNA target sequence
gcaaatcattatttgaacaaagta

SEQ ID NO: 91238 - DNA, 24 bp, Artificial sequence
  SiRNA target sequence
caaatcattatttgaacaaagtag

SEQ ID NO: 91239 - DNA, 24 bp, Artificial sequence
  SiRNA target sequence
aaatcattatttgaacaaagtaga

SEQ ID NO: 91240 - DNA, 24 bp, Artificial sequence
  SiRNA target sequence
aatcattatttgaacaaagtagac

SEQ ID NO: 91241 - DNA, 24 bp, Artificial sequence
  SiRNA target sequence
atcattatttgaacaaagtagacc

SEQ ID NO: 91242 - DNA, 24 bp, Artificial sequence
  SiRNA target sequence
tcattatttgaacaaagtagacca

SEQ ID NO: 91243 - DNA, 24 bp, Artificial sequence
  SiRNA target sequence
cattatttgaacaaagtagaccaa

SEQ ID NO: 91244 - DNA, 24 bp, Artificial sequence
  SiRNA target sequence
attatttgaacaaagtagaccaat

SEQ ID NO: 91245 - DNA, 24 bp, Artificial sequence
  SiRNA target sequence
ttatttgaacaaagtagaccaata

SEQ ID NO: 91246 - DNA, 24 bp, Artificial sequence
  SiRNA target sequence
tatttgaacaaagtagaccaatac

SEQ ID NO: 91247 - DNA, 24 bp, Artificial sequence
  SiRNA target sequence
atttgaacaaagtagaccaatact

SEQ ID NO: 91248 - DNA, 24 bp, Artificial sequence
  SiRNA target sequence
tttgaacaaagtagaccaatacta

SEQ ID NO: 91249 - DNA, 24 bp, Artificial sequence
  SiRNA target sequence
ttgaacaaagtagaccaatactat

SEQ ID NO: 91250 - DNA, 24 bp, Artificial sequence
  SiRNA target sequence
tgaacaaagtagaccaatactatc

SEQ ID NO: 91251 - DNA, 24 bp, Artificial sequence
  SiRNA target sequence
gaacaaagtagaccaatactatca

SEQ ID NO: 91252 - DNA, 24 bp, Artificial sequence
  SiRNA target sequence
aacaaagtagaccaatactatcac

SEQ ID NO: 91253 - DNA, 24 bp, Artificial sequence
  SiRNA target sequence
acaaagtagaccaatactatcacc

SEQ ID NO: 91254 - DNA, 24 bp, Artificial sequence
  SiRNA target sequence
caaagtagaccaatactatcacca

SEQ ID NO: 91255 - DNA, 24 bp, Artificial sequence
  SiRNA target sequence
aaagtagaccaatactatcaccag

SEQ ID NO: 91256 - DNA, 24 bp, Artificial sequence
  SiRNA target sequence
aagtagaccaatactatcaccagg

SEQ ID NO: 91257 - DNA, 24 bp, Artificial sequence
  SiRNA target sequence
agtagaccaatactatcaccagga

SEQ ID NO: 91258 - DNA, 24 bp, Artificial sequence
  SiRNA target sequence
gtagaccaatactatcaccaggaa

SEQ ID NO: 91259 - DNA, 24 bp, Artificial sequence
  SiRNA target sequence
tagaccaatactatcaccaggaac

SEQ ID NO: 91260 - DNA, 24 bp, Artificial sequence
  SiRNA target sequence
agaccaatactatcaccaggaaca

SEQ ID NO: 91261 - DNA, 24 bp, Artificial sequence
  SiRNA target sequence
gaccaatactatcaccaggaacaa

SEQ ID NO: 91262 - DNA, 24 bp, Artificial sequence
  SiRNA target sequence
accaatactatcaccaggaacaaa

SEQ ID NO: 91263 - DNA, 24 bp, Artificial sequence
  SiRNA target sequence
ccaatactatcaccaggaacaaaa

SEQ ID NO: 91264 - DNA, 24 bp, Artificial sequence
  SiRNA target sequence
caatactatcaccaggaacaaaat

SEQ ID NO: 91265 - DNA, 24 bp, Artificial sequence
  SiRNA target sequence
aatactatcaccaggaacaaaatc

SEQ ID NO: 91266 - DNA, 24 bp, Artificial sequence
  SiRNA target sequence
atactatcaccaggaacaaaatct

SEQ ID NO: 91267 - DNA, 24 bp, Artificial sequence
  SiRNA target sequence
tactatcaccaggaacaaaatcta

SEQ ID NO: 91268 - DNA, 24 bp, Artificial sequence
  SiRNA target sequence
actatcaccaggaacaaaatctaa

SEQ ID NO: 91269 - DNA, 24 bp, Artificial sequence
  SiRNA target sequence
ctatcaccaggaacaaaatctaat

SEQ ID NO: 91270 - DNA, 24 bp, Artificial sequence
  SiRNA target sequence
tatcaccaggaacaaaatctaatg

SEQ ID NO: 91271 - DNA, 24 bp, Artificial sequence
  SiRNA target sequence
atcaccaggaacaaaatctaatgt

SEQ ID NO: 91272 - DNA, 24 bp, Artificial sequence
  SiRNA target sequence
tcaccaggaacaaaatctaatgta

SEQ ID NO: 91273 - DNA, 24 bp, Artificial sequence
  SiRNA target sequence
caccaggaacaaaatctaatgtat

SEQ ID NO: 91274 - DNA, 24 bp, Artificial sequence
  SiRNA target sequence
accaggaacaaaatctaatgtata

SEQ ID NO: 91275 - DNA, 24 bp, Artificial sequence
  SiRNA target sequence
ccaggaacaaaatctaatgtataa

SEQ ID NO: 91276 - DNA, 24 bp, Artificial sequence
  SiRNA target sequence
caggaacaaaatctaatgtataat

SEQ ID NO: 91277 - DNA, 24 bp, Artificial sequence
  SiRNA target sequence
aggaacaaaatctaatgtataatt

SEQ ID NO: 91278 - DNA, 24 bp, Artificial sequence
  SiRNA target sequence
ggaacaaaatctaatgtataatta

SEQ ID NO: 91279 - DNA, 24 bp, Artificial sequence
  SiRNA target sequence
gaacaaaatctaatgtataattaa

SEQ ID NO: 91280 - DNA, 24 bp, Artificial sequence
  SiRNA target sequence
aacaaaatctaatgtataattaag

SEQ ID NO: 91281 - DNA, 24 bp, Artificial sequence
  SiRNA target sequence
acaaaatctaatgtataattaagt

SEQ ID NO: 91282 - DNA, 24 bp, Artificial sequence
  SiRNA target sequence
caaaatctaatgtataattaagtt

SEQ ID NO: 91283 - DNA, 24 bp, Artificial sequence
  SiRNA target sequence
aaaatctaatgtataattaagttg

SEQ ID NO: 91284 - DNA, 24 bp, Artificial sequence
  SiRNA target sequence
aaatctaatgtataattaagttga

SEQ ID NO: 91285 - DNA, 24 bp, Artificial sequence
  SiRNA target sequence
aatctaatgtataattaagttgaa

SEQ ID NO: 91286 - DNA, 24 bp, Artificial sequence
  SiRNA target sequence
atctaatgtataattaagttgaac

SEQ ID NO: 91287 - DNA, 24 bp, Artificial sequence
  SiRNA target sequence
tctaatgtataattaagttgaacc

SEQ ID NO: 91288 - DNA, 24 bp, Artificial sequence
  SiRNA target sequence
ctaatgtataattaagttgaacct

SEQ ID NO: 91289 - DNA, 24 bp, Artificial sequence
  SiRNA target sequence
taatgtataattaagttgaacctt

SEQ ID NO: 91290 - DNA, 24 bp, Artificial sequence
  SiRNA target sequence
aatgtataattaagttgaacctta

SEQ ID NO: 91291 - DNA, 24 bp, Artificial sequence
  SiRNA target sequence
atgtataattaagttgaaccttat

SEQ ID NO: 91292 - DNA, 24 bp, Artificial sequence
  SiRNA target sequence
tgtataattaagttgaaccttata

SEQ ID NO: 91293 - DNA, 24 bp, Artificial sequence
  SiRNA target sequence
gtataattaagttgaaccttatat

SEQ ID NO: 91294 - DNA, 24 bp, Artificial sequence
  SiRNA target sequence
tataattaagttgaaccttatata

SEQ ID NO: 91295 - DNA, 24 bp, Artificial sequence
  SiRNA target sequence
ataattaagttgaaccttatatac

SEQ ID NO: 91296 - DNA, 24 bp, Artificial sequence
  SiRNA target sequence
taattaagttgaaccttatatacc

SEQ ID NO: 91297 - DNA, 24 bp, Artificial sequence
  SiRNA target sequence
aattaagttgaaccttatatacct

SEQ ID NO: 91298 - DNA, 24 bp, Artificial sequence
  SiRNA target sequence
attaagttgaaccttatatacctt

SEQ ID NO: 91299 - DNA, 24 bp, Artificial sequence
  SiRNA target sequence
ttaagttgaaccttatataccttt

SEQ ID NO: 91300 - DNA, 24 bp, Artificial sequence
  SiRNA target sequence
taagttgaaccttatatacctttt

SEQ ID NO: 91301 - DNA, 24 bp, Artificial sequence
  SiRNA target sequence
aagttgaaccttatataccttttt

SEQ ID NO: 91302 - DNA, 24 bp, Artificial sequence
  SiRNA target sequence
agttgaaccttatatacctttttc

SEQ ID NO: 91303 - DNA, 24 bp, Artificial sequence
  SiRNA target sequence
gttgaaccttatatacctttttcc

SEQ ID NO: 91304 - DNA, 24 bp, Artificial sequence
  SiRNA target sequence
ttgaaccttatatacctttttcca

SEQ ID NO: 91305 - DNA, 24 bp, Artificial sequence
  SiRNA target sequence
tgaaccttatatacctttttccat

SEQ ID NO: 91306 - DNA, 24 bp, Artificial sequence
  SiRNA target sequence
gaaccttatatacctttttccatg

SEQ ID NO: 91307 - DNA, 24 bp, Artificial sequence
  SiRNA target sequence
aaccttatatacctttttccatgt

SEQ ID NO: 91308 - DNA, 24 bp, Artificial sequence
  SiRNA target sequence
accttatatacctttttccatgta

SEQ ID NO: 91309 - DNA, 24 bp, Artificial sequence
  SiRNA target sequence
ccttatatacctttttccatgtac

SEQ ID NO: 91310 - DNA, 24 bp, Artificial sequence
  SiRNA target sequence
cttatatacctttttccatgtaca

SEQ ID NO: 91311 - DNA, 24 bp, Artificial sequence
  SiRNA target sequence
ttatatacctttttccatgtacag

SEQ ID NO: 91312 - DNA, 24 bp, Artificial sequence
  SiRNA target sequence
tatatacctttttccatgtacagg

SEQ ID NO: 91313 - DNA, 24 bp, Artificial sequence
  SiRNA target sequence
atatacctttttccatgtacagga

SEQ ID NO: 91314 - DNA, 24 bp, Artificial sequence
  SiRNA target sequence
tatacctttttccatgtacaggaa

SEQ ID NO: 91315 - DNA, 24 bp, Artificial sequence
  SiRNA target sequence
atacctttttccatgtacaggaaa

SEQ ID NO: 91316 - DNA, 24 bp, Artificial sequence
  SiRNA target sequence
tacctttttccatgtacaggaaag

SEQ ID NO: 91317 - DNA, 24 bp, Artificial sequence
  SiRNA target sequence
acctttttccatgtacaggaaagg

SEQ ID NO: 91318 - DNA, 24 bp, Artificial sequence
  SiRNA target sequence
cctttttccatgtacaggaaaggt

SEQ ID NO: 91319 - DNA, 24 bp, Artificial sequence
  SiRNA target sequence
ctttttccatgtacaggaaaggtt

SEQ ID NO: 91320 - DNA, 24 bp, Artificial sequence
  SiRNA target sequence
tttttccatgtacaggaaaggttt

SEQ ID NO: 91321 - DNA, 24 bp, Artificial sequence
  SiRNA target sequence
ttttccatgtacaggaaaggtttt

SEQ ID NO: 91322 - DNA, 24 bp, Artificial sequence
  SiRNA target sequence
tttccatgtacaggaaaggttttc

SEQ ID NO: 91323 - DNA, 24 bp, Artificial sequence
  SiRNA target sequence
ttccatgtacaggaaaggttttca

SEQ ID NO: 91324 - DNA, 24 bp, Artificial sequence
  SiRNA target sequence
tccatgtacaggaaaggttttcaa

SEQ ID NO: 91325 - DNA, 24 bp, Artificial sequence
  SiRNA target sequence
ccatgtacaggaaaggttttcaat

SEQ ID NO: 91326 - DNA, 24 bp, Artificial sequence
  SiRNA target sequence
catgtacaggaaaggttttcaata

SEQ ID NO: 91327 - DNA, 24 bp, Artificial sequence
  SiRNA target sequence
atgtacaggaaaggttttcaatat

SEQ ID NO: 91328 - DNA, 24 bp, Artificial sequence
  SiRNA target sequence
tgtacaggaaaggttttcaatatt

SEQ ID NO: 91329 - DNA, 24 bp, Artificial sequence
  SiRNA target sequence
gtacaggaaaggttttcaatattt

SEQ ID NO: 91330 - DNA, 24 bp, Artificial sequence
  SiRNA target sequence
tacaggaaaggttttcaatattta

SEQ ID NO: 91331 - DNA, 24 bp, Artificial sequence
  SiRNA target sequence
acaggaaaggttttcaatatttag

SEQ ID NO: 91332 - DNA, 24 bp, Artificial sequence
  SiRNA target sequence
caggaaaggttttcaatatttagt

SEQ ID NO: 91333 - DNA, 24 bp, Artificial sequence
  SiRNA target sequence
aggaaaggttttcaatatttagta

SEQ ID NO: 91334 - DNA, 24 bp, Artificial sequence
  SiRNA target sequence
ggaaaggttttcaatatttagtat

SEQ ID NO: 91335 - DNA, 24 bp, Artificial sequence
  SiRNA target sequence
gaaaggttttcaatatttagtata

SEQ ID NO: 91336 - DNA, 24 bp, Artificial sequence
  SiRNA target sequence
aaaggttttcaatatttagtatat

SEQ ID NO: 91337 - DNA, 24 bp, Artificial sequence
  SiRNA target sequence
aaggttttcaatatttagtatatt

SEQ ID NO: 91338 - DNA, 24 bp, Artificial sequence
  SiRNA target sequence
aggttttcaatatttagtatattt

SEQ ID NO: 91339 - DNA, 24 bp, Artificial sequence
  SiRNA target sequence
ggttttcaatatttagtatatttg

SEQ ID NO: 91340 - DNA, 24 bp, Artificial sequence
  SiRNA target sequence
gttttcaatatttagtatatttgt

SEQ ID NO: 91341 - DNA, 24 bp, Artificial sequence
  SiRNA target sequence
ttttcaatatttagtatatttgta

SEQ ID NO: 91342 - DNA, 24 bp, Artificial sequence
  SiRNA target sequence
tttcaatatttagtatatttgtat

SEQ ID NO: 91343 - DNA, 24 bp, Artificial sequence
  SiRNA target sequence
ttcaatatttagtatatttgtatc

SEQ ID NO: 91344 - DNA, 24 bp, Artificial sequence
  SiRNA target sequence
tcaatatttagtatatttgtatct

SEQ ID NO: 91345 - DNA, 24 bp, Artificial sequence
  SiRNA target sequence
caatatttagtatatttgtatcta

SEQ ID NO: 91346 - DNA, 24 bp, Artificial sequence
  SiRNA target sequence
aatatttagtatatttgtatctat

SEQ ID NO: 91347 - DNA, 24 bp, Artificial sequence
  SiRNA target sequence
atatttagtatatttgtatctatc

SEQ ID NO: 91348 - DNA, 24 bp, Artificial sequence
  SiRNA target sequence
tatttagtatatttgtatctatca

SEQ ID NO: 91349 - DNA, 24 bp, Artificial sequence
  SiRNA target sequence
atttagtatatttgtatctatcaa

SEQ ID NO: 91350 - DNA, 24 bp, Artificial sequence
  SiRNA target sequence
tttagtatatttgtatctatcaaa

SEQ ID NO: 91351 - DNA, 24 bp, Artificial sequence
  SiRNA target sequence
ttagtatatttgtatctatcaaat

SEQ ID NO: 91352 - DNA, 24 bp, Artificial sequence
  SiRNA target sequence
tagtatatttgtatctatcaaatt

SEQ ID NO: 91353 - DNA, 24 bp, Artificial sequence
  SiRNA target sequence
agtatatttgtatctatcaaattt

SEQ ID NO: 91354 - DNA, 24 bp, Artificial sequence
  SiRNA target sequence
gtatatttgtatctatcaaattta

SEQ ID NO: 91355 - DNA, 24 bp, Artificial sequence
  SiRNA target sequence
tatatttgtatctatcaaatttat

SEQ ID NO: 91356 - DNA, 24 bp, Artificial sequence
  SiRNA target sequence
atatttgtatctatcaaatttata

SEQ ID NO: 91357 - DNA, 24 bp, Artificial sequence
  SiRNA target sequence
tatttgtatctatcaaatttatat

SEQ ID NO: 91358 - DNA, 24 bp, Artificial sequence
  SiRNA target sequence
atttgtatctatcaaatttatatt

SEQ ID NO: 91359 - DNA, 24 bp, Artificial sequence
  SiRNA target sequence
tttgtatctatcaaatttatattc

SEQ ID NO: 91360 - DNA, 24 bp, Artificial sequence
  SiRNA target sequence
ttgtatctatcaaatttatattct

SEQ ID NO: 91361 - DNA, 24 bp, Artificial sequence
  SiRNA target sequence
tgtatctatcaaatttatattctc

SEQ ID NO: 91362 - DNA, 24 bp, Artificial sequence
  SiRNA target sequence
gtatctatcaaatttatattctcg

SEQ ID NO: 91363 - DNA, 24 bp, Artificial sequence
  SiRNA target sequence
tatctatcaaatttatattctcgt

SEQ ID NO: 91364 - DNA, 24 bp, Artificial sequence
  SiRNA target sequence
atctatcaaatttatattctcgtt

SEQ ID NO: 91365 - DNA, 24 bp, Artificial sequence
  SiRNA target sequence
tctatcaaatttatattctcgttt

SEQ ID NO: 91366 - DNA, 24 bp, Artificial sequence
  SiRNA target sequence
ctatcaaatttatattctcgtttg

SEQ ID NO: 91367 - DNA, 24 bp, Artificial sequence
  SiRNA target sequence
tatcaaatttatattctcgtttgt

SEQ ID NO: 91368 - DNA, 24 bp, Artificial sequence
  SiRNA target sequence
atcaaatttatattctcgtttgtc

SEQ ID NO: 91369 - DNA, 24 bp, Artificial sequence
  SiRNA target sequence
tcaaatttatattctcgtttgtct

SEQ ID NO: 91370 - DNA, 24 bp, Artificial sequence
  SiRNA target sequence
caaatttatattctcgtttgtctt

SEQ ID NO: 91371 - DNA, 24 bp, Artificial sequence
  SiRNA target sequence
aaatttatattctcgtttgtcttt

SEQ ID NO: 91372 - DNA, 24 bp, Artificial sequence
  SiRNA target sequence
aatttatattctcgtttgtcttta

SEQ ID NO: 91373 - DNA, 24 bp, Artificial sequence
  SiRNA target sequence
atttatattctcgtttgtctttat

SEQ ID NO: 91374 - DNA, 24 bp, Artificial sequence
  SiRNA target sequence
tttatattctcgtttgtctttatt

SEQ ID NO: 91375 - DNA, 24 bp, Artificial sequence
  SiRNA target sequence
ttatattctcgtttgtctttattt

SEQ ID NO: 91376 - DNA, 24 bp, Artificial sequence
  SiRNA target sequence
tatattctcgtttgtctttatttt

SEQ ID NO: 91377 - DNA, 24 bp, Artificial sequence
  SiRNA target sequence
atattctcgtttgtctttatttta

SEQ ID NO: 91378 - DNA, 24 bp, Artificial sequence
  SiRNA target sequence
tattctcgtttgtctttattttat

SEQ ID NO: 91379 - DNA, 24 bp, Artificial sequence
  SiRNA target sequence
attctcgtttgtctttattttata

SEQ ID NO: 91380 - DNA, 24 bp, Artificial sequence
  SiRNA target sequence
ttctcgtttgtctttattttataa

SEQ ID NO: 91381 - DNA, 24 bp, Artificial sequence
  SiRNA target sequence
tctcgtttgtctttattttataag

SEQ ID NO: 91382 - DNA, 24 bp, Artificial sequence
  SiRNA target sequence
ctcgtttgtctttattttataaga

SEQ ID NO: 91383 - DNA, 24 bp, Artificial sequence
  SiRNA target sequence
tcgtttgtctttattttataagaa

SEQ ID NO: 91384 - DNA, 24 bp, Artificial sequence
  SiRNA target sequence
cgtttgtctttattttataagaac

SEQ ID NO: 91385 - DNA, 24 bp, Artificial sequence
  SiRNA target sequence
gtttgtctttattttataagaacc

SEQ ID NO: 91386 - DNA, 24 bp, Artificial sequence
  SiRNA target sequence
tttgtctttattttataagaacct

SEQ ID NO: 91387 - DNA, 24 bp, Artificial sequence
  SiRNA target sequence
ttgtctttattttataagaacctg

SEQ ID NO: 91388 - DNA, 24 bp, Artificial sequence
  SiRNA target sequence
tgtctttattttataagaacctgt

SEQ ID NO: 91389 - DNA, 24 bp, Artificial sequence
  SiRNA target sequence
gtctttattttataagaacctgta

SEQ ID NO: 91390 - DNA, 24 bp, Artificial sequence
  SiRNA target sequence
tctttattttataagaacctgtat

SEQ ID NO: 91391 - DNA, 24 bp, Artificial sequence
  SiRNA target sequence
ctttattttataagaacctgtata

SEQ ID NO: 91392 - DNA, 24 bp, Artificial sequence
  SiRNA target sequence
tttattttataagaacctgtatag

SEQ ID NO: 91393 - DNA, 24 bp, Artificial sequence
  SiRNA target sequence
ttattttataagaacctgtatagt

SEQ ID NO: 91394 - DNA, 24 bp, Artificial sequence
  SiRNA target sequence
tattttataagaacctgtatagtt

SEQ ID NO: 91395 - DNA, 24 bp, Artificial sequence
  SiRNA target sequence
attttataagaacctgtatagttg

SEQ ID NO: 91396 - DNA, 24 bp, Artificial sequence
  SiRNA target sequence
ttttataagaacctgtatagttgg

SEQ ID NO: 91397 - DNA, 24 bp, Artificial sequence
  SiRNA target sequence
tttataagaacctgtatagttggt

SEQ ID NO: 91398 - DNA, 24 bp, Artificial sequence
  SiRNA target sequence
ttataagaacctgtatagttggtc

SEQ ID NO: 91399 - DNA, 24 bp, Artificial sequence
  SiRNA target sequence
tataagaacctgtatagttggtct

SEQ ID NO: 91400 - DNA, 24 bp, Artificial sequence
  SiRNA target sequence
ataagaacctgtatagttggtctt

SEQ ID NO: 91401 - DNA, 24 bp, Artificial sequence
  SiRNA target sequence
taagaacctgtatagttggtcttt

SEQ ID NO: 91402 - DNA, 24 bp, Artificial sequence
  SiRNA target sequence
aagaacctgtatagttggtctttt

SEQ ID NO: 91403 - DNA, 24 bp, Artificial sequence
  SiRNA target sequence
agaacctgtatagttggtcttttt

SEQ ID NO: 91404 - DNA, 24 bp, Artificial sequence
  SiRNA target sequence
gaacctgtatagttggtcttttta

SEQ ID NO: 91405 - DNA, 24 bp, Artificial sequence
  SiRNA target sequence
aacctgtatagttggtctttttaa

SEQ ID NO: 91406 - DNA, 24 bp, Artificial sequence
  SiRNA target sequence
acctgtatagttggtctttttaat

SEQ ID NO: 91407 - DNA, 24 bp, Artificial sequence
  SiRNA target sequence
cctgtatagttggtctttttaatt

SEQ ID NO: 91408 - DNA, 24 bp, Artificial sequence
  SiRNA target sequence
ctgtatagttggtctttttaatta

SEQ ID NO: 91409 - DNA, 24 bp, Artificial sequence
  SiRNA target sequence
tgtatagttggtctttttaattat

SEQ ID NO: 91410 - DNA, 24 bp, Artificial sequence
  SiRNA target sequence
gtatagttggtctttttaattata

SEQ ID NO: 91411 - DNA, 24 bp, Artificial sequence
  SiRNA target sequence
tatagttggtctttttaattataa

SEQ ID NO: 91412 - DNA, 24 bp, Artificial sequence
  SiRNA target sequence
atagttggtctttttaattataag

SEQ ID NO: 91413 - DNA, 24 bp, Artificial sequence
  SiRNA target sequence
tagttggtctttttaattataagc

SEQ ID NO: 91414 - DNA, 24 bp, Artificial sequence
  SiRNA target sequence
agttggtctttttaattataagct

SEQ ID NO: 91415 - DNA, 24 bp, Artificial sequence
  SiRNA target sequence
gttggtctttttaattataagctt

SEQ ID NO: 91416 - DNA, 24 bp, Artificial sequence
  SiRNA target sequence
ttggtctttttaattataagctta

SEQ ID NO: 91417 - DNA, 24 bp, Artificial sequence
  SiRNA target sequence
tggtctttttaattataagcttat

SEQ ID NO: 91418 - DNA, 24 bp, Artificial sequence
  SiRNA target sequence
ggtctttttaattataagcttatt

SEQ ID NO: 91419 - DNA, 24 bp, Artificial sequence
  SiRNA target sequence
gtctttttaattataagcttattg

SEQ ID NO: 91420 - DNA, 24 bp, Artificial sequence
  SiRNA target sequence
tctttttaattataagcttattga

SEQ ID NO: 91421 - DNA, 24 bp, Artificial sequence
  SiRNA target sequence
ctttttaattataagcttattgaa

SEQ ID NO: 91422 - DNA, 24 bp, Artificial sequence
  SiRNA target sequence
tttttaattataagcttattgaaa

SEQ ID NO: 91423 - DNA, 24 bp, Artificial sequence
  SiRNA target sequence
ttttaattataagcttattgaaat

SEQ ID NO: 91424 - DNA, 24 bp, Artificial sequence
  SiRNA target sequence
tttaattataagcttattgaaatt

SEQ ID NO: 91425 - DNA, 24 bp, Artificial sequence
  SiRNA target sequence
ttaattataagcttattgaaattt

SEQ ID NO: 91426 - DNA, 24 bp, Artificial sequence
  SiRNA target sequence
taattataagcttattgaaatttc

SEQ ID NO: 91427 - DNA, 24 bp, Artificial sequence
  SiRNA target sequence
aattataagcttattgaaatttct

SEQ ID NO: 91428 - DNA, 24 bp, Artificial sequence
  SiRNA target sequence
attataagcttattgaaatttcta

SEQ ID NO: 91429 - DNA, 24 bp, Artificial sequence
  SiRNA target sequence
ttataagcttattgaaatttctaa

SEQ ID NO: 91430 - DNA, 24 bp, Artificial sequence
  SiRNA target sequence
tataagcttattgaaatttctaat

SEQ ID NO: 91431 - DNA, 24 bp, Artificial sequence
  SiRNA target sequence
ataagcttattgaaatttctaata

SEQ ID NO: 91432 - DNA, 24 bp, Artificial sequence
  SiRNA target sequence
taagcttattgaaatttctaatat

SEQ ID NO: 91433 - DNA, 24 bp, Artificial sequence
  SiRNA target sequence
aagcttattgaaatttctaatatt

SEQ ID NO: 91434 - DNA, 24 bp, Artificial sequence
  SiRNA target sequence
agcttattgaaatttctaatattt

SEQ ID NO: 91435 - DNA, 24 bp, Artificial sequence
  SiRNA target sequence
gcttattgaaatttctaatattta

SEQ ID NO: 91436 - DNA, 24 bp, Artificial sequence
  SiRNA target sequence
cttattgaaatttctaatatttaa

SEQ ID NO: 91437 - DNA, 24 bp, Artificial sequence
  SiRNA target sequence
ttattgaaatttctaatatttaaa

SEQ ID NO: 91438 - DNA, 24 bp, Artificial sequence
  SiRNA target sequence
tattgaaatttctaatatttaaag

SEQ ID NO: 91439 - DNA, 24 bp, Artificial sequence
  SiRNA target sequence
attgaaatttctaatatttaaagg

SEQ ID NO: 91440 - DNA, 24 bp, Artificial sequence
  SiRNA target sequence
ttgaaatttctaatatttaaagga

SEQ ID NO: 91441 - DNA, 24 bp, Artificial sequence
  SiRNA target sequence
tgaaatttctaatatttaaaggaa

SEQ ID NO: 91442 - DNA, 24 bp, Artificial sequence
  SiRNA target sequence
gaaatttctaatatttaaaggaac

SEQ ID NO: 91443 - DNA, 24 bp, Artificial sequence
  SiRNA target sequence
aaatttctaatatttaaaggaaca

SEQ ID NO: 91444 - DNA, 24 bp, Artificial sequence
  SiRNA target sequence
aatttctaatatttaaaggaacaa

SEQ ID NO: 91445 - DNA, 24 bp, Artificial sequence
  SiRNA target sequence
atttctaatatttaaaggaacaaa

SEQ ID NO: 91446 - DNA, 24 bp, Artificial sequence
  SiRNA target sequence
tttctaatatttaaaggaacaaaa

SEQ ID NO: 91447 - DNA, 24 bp, Artificial sequence
  SiRNA target sequence
ttctaatatttaaaggaacaaaat

SEQ ID NO: 91448 - DNA, 24 bp, Artificial sequence
  SiRNA target sequence
tctaatatttaaaggaacaaaatc

SEQ ID NO: 91449 - DNA, 24 bp, Artificial sequence
  SiRNA target sequence
ctaatatttaaaggaacaaaatct

SEQ ID NO: 91450 - DNA, 24 bp, Artificial sequence
  SiRNA target sequence
taatatttaaaggaacaaaatcta

SEQ ID NO: 91451 - DNA, 24 bp, Artificial sequence
  SiRNA target sequence
aatatttaaaggaacaaaatctac

SEQ ID NO: 91452 - DNA, 24 bp, Artificial sequence
  SiRNA target sequence
atatttaaaggaacaaaatctaca

SEQ ID NO: 91453 - DNA, 24 bp, Artificial sequence
  SiRNA target sequence
tatttaaaggaacaaaatctacat

SEQ ID NO: 91454 - DNA, 24 bp, Artificial sequence
  SiRNA target sequence
atttaaaggaacaaaatctacatt

SEQ ID NO: 91455 - DNA, 24 bp, Artificial sequence
  SiRNA target sequence
tttaaaggaacaaaatctacattt

SEQ ID NO: 91456 - DNA, 24 bp, Artificial sequence
  SiRNA target sequence
ttaaaggaacaaaatctacattta

SEQ ID NO: 91457 - DNA, 24 bp, Artificial sequence
  SiRNA target sequence
taaaggaacaaaatctacatttag

SEQ ID NO: 91458 - DNA, 24 bp, Artificial sequence
  SiRNA target sequence
aaaggaacaaaatctacatttaga

SEQ ID NO: 91459 - DNA, 24 bp, Artificial sequence
  SiRNA target sequence
aaggaacaaaatctacatttagat

SEQ ID NO: 91460 - DNA, 24 bp, Artificial sequence
  SiRNA target sequence
aggaacaaaatctacatttagatt

SEQ ID NO: 91461 - DNA, 24 bp, Artificial sequence
  SiRNA target sequence
ggaacaaaatctacatttagatta

SEQ ID NO: 91462 - DNA, 24 bp, Artificial sequence
  SiRNA target sequence
gaacaaaatctacatttagattat

SEQ ID NO: 91463 - DNA, 24 bp, Artificial sequence
  SiRNA target sequence
aacaaaatctacatttagattata

SEQ ID NO: 91464 - DNA, 24 bp, Artificial sequence
  SiRNA target sequence
acaaaatctacatttagattatat

SEQ ID NO: 91465 - DNA, 24 bp, Artificial sequence
  SiRNA target sequence
caaaatctacatttagattatatt

SEQ ID NO: 91466 - DNA, 24 bp, Artificial sequence
  SiRNA target sequence
aaaatctacatttagattatattc

SEQ ID NO: 91467 - DNA, 24 bp, Artificial sequence
  SiRNA target sequence
aaatctacatttagattatattct

SEQ ID NO: 91468 - DNA, 24 bp, Artificial sequence
  SiRNA target sequence
aatctacatttagattatattcta

SEQ ID NO: 91469 - DNA, 24 bp, Artificial sequence
  SiRNA target sequence
atctacatttagattatattctaa

SEQ ID NO: 91470 - DNA, 24 bp, Artificial sequence
  SiRNA target sequence
tctacatttagattatattctaat

SEQ ID NO: 91471 - DNA, 24 bp, Artificial sequence
  SiRNA target sequence
ctacatttagattatattctaatt

SEQ ID NO: 91472 - DNA, 24 bp, Artificial sequence
  SiRNA target sequence
tacatttagattatattctaattt

SEQ ID NO: 91473 - DNA, 24 bp, Artificial sequence
  SiRNA target sequence
acatttagattatattctaattta

SEQ ID NO: 91474 - DNA, 24 bp, Artificial sequence
  SiRNA target sequence
catttagattatattctaatttat

SEQ ID NO: 91475 - DNA, 24 bp, Artificial sequence
  SiRNA target sequence
atttagattatattctaatttatt

SEQ ID NO: 91476 - DNA, 24 bp, Artificial sequence
  SiRNA target sequence
tttagattatattctaatttattg

SEQ ID NO: 91477 - DNA, 24 bp, Artificial sequence
  SiRNA target sequence
ttagattatattctaatttattga

SEQ ID NO: 91478 - DNA, 24 bp, Artificial sequence
  SiRNA target sequence
tagattatattctaatttattgaa

SEQ ID NO: 91479 - DNA, 24 bp, Artificial sequence
  SiRNA target sequence
agattatattctaatttattgaat

SEQ ID NO: 91480 - DNA, 24 bp, Artificial sequence
  SiRNA target sequence
gattatattctaatttattgaatt

SEQ ID NO: 91481 - DNA, 24 bp, Artificial sequence
  SiRNA target sequence
attatattctaatttattgaattt

SEQ ID NO: 91482 - DNA, 24 bp, Artificial sequence
  SiRNA target sequence
ttatattctaatttattgaatttc

SEQ ID NO: 91483 - DNA, 24 bp, Artificial sequence
  SiRNA target sequence
tatattctaatttattgaatttca

SEQ ID NO: 91484 - DNA, 24 bp, Artificial sequence
  SiRNA target sequence
atattctaatttattgaatttcat

SEQ ID NO: 91485 - DNA, 25 bp, Artificial sequence
  SiRNA target sequence
ttatatccaactatcaaaaaatagc

SEQ ID NO: 91486 - DNA, 25 bp, Artificial sequence
  SiRNA target sequence
tatatccaactatcaaaaaatagcc

SEQ ID NO: 91487 - DNA, 25 bp, Artificial sequence
  SiRNA target sequence
atatccaactatcaaaaaatagcct

SEQ ID NO: 91488 - DNA, 25 bp, Artificial sequence
  SiRNA target sequence
tatccaactatcaaaaaatagcctc

SEQ ID NO: 91489 - DNA, 25 bp, Artificial sequence
  SiRNA target sequence
atccaactatcaaaaaatagcctct

SEQ ID NO: 91490 - DNA, 25 bp, Artificial sequence
  SiRNA target sequence
tccaactatcaaaaaatagcctctt

SEQ ID NO: 91491 - DNA, 25 bp, Artificial sequence
  SiRNA target sequence
ccaactatcaaaaaatagcctcttt

SEQ ID NO: 91492 - DNA, 25 bp, Artificial sequence
  SiRNA target sequence
caactatcaaaaaatagcctctttt

SEQ ID NO: 91493 - DNA, 25 bp, Artificial sequence
  SiRNA target sequence
aactatcaaaaaatagcctcttttc

SEQ ID NO: 91494 - DNA, 25 bp, Artificial sequence
  SiRNA target sequence
actatcaaaaaatagcctcttttct

SEQ ID NO: 91495 - DNA, 25 bp, Artificial sequence
  SiRNA target sequence
ctatcaaaaaatagcctcttttctt

SEQ ID NO: 91496 - DNA, 25 bp, Artificial sequence
  SiRNA target sequence
tatcaaaaaatagcctcttttcttt

SEQ ID NO: 91497 - DNA, 25 bp, Artificial sequence
  SiRNA target sequence
atcaaaaaatagcctcttttctttc

SEQ ID NO: 91498 - DNA, 25 bp, Artificial sequence
  SiRNA target sequence
tcaaaaaatagcctcttttctttca

SEQ ID NO: 91499 - DNA, 25 bp, Artificial sequence
  SiRNA target sequence
caaaaaatagcctcttttctttcac

SEQ ID NO: 91500 - DNA, 25 bp, Artificial sequence
  SiRNA target sequence
aaaaaatagcctcttttctttcaca

SEQ ID NO: 91501 - DNA, 25 bp, Artificial sequence
  SiRNA target sequence
aaaaatagcctcttttctttcacaa

SEQ ID NO: 91502 - DNA, 25 bp, Artificial sequence
  SiRNA target sequence
aaaatagcctcttttctttcacaat

SEQ ID NO: 91503 - DNA, 25 bp, Artificial sequence
  SiRNA target sequence
aaatagcctcttttctttcacaatt

SEQ ID NO: 91504 - DNA, 25 bp, Artificial sequence
  SiRNA target sequence
aatagcctcttttctttcacaattt

SEQ ID NO: 91505 - DNA, 25 bp, Artificial sequence
  SiRNA target sequence
atagcctcttttctttcacaatttc

SEQ ID NO: 91506 - DNA, 25 bp, Artificial sequence
  SiRNA target sequence
tagcctcttttctttcacaatttca

SEQ ID NO: 91507 - DNA, 25 bp, Artificial sequence
  SiRNA target sequence
agcctcttttctttcacaatttcag

SEQ ID NO: 91508 - DNA, 25 bp, Artificial sequence
  SiRNA target sequence
gcctcttttctttcacaatttcaga

SEQ ID NO: 91509 - DNA, 25 bp, Artificial sequence
  SiRNA target sequence
cctcttttctttcacaatttcagaa

SEQ ID NO: 91510 - DNA, 25 bp, Artificial sequence
  SiRNA target sequence
ctcttttctttcacaatttcagaaa

SEQ ID NO: 91511 - DNA, 25 bp, Artificial sequence
  SiRNA target sequence
tcttttctttcacaatttcagaaaa

SEQ ID NO: 91512 - DNA, 25 bp, Artificial sequence
  SiRNA target sequence
cttttctttcacaatttcagaaaaa

SEQ ID NO: 91513 - DNA, 25 bp, Artificial sequence
  SiRNA target sequence
ttttctttcacaatttcagaaaaat

SEQ ID NO: 91514 - DNA, 25 bp, Artificial sequence
  SiRNA target sequence
tttctttcacaatttcagaaaaatt

SEQ ID NO: 91515 - DNA, 25 bp, Artificial sequence
  SiRNA target sequence
ttctttcacaatttcagaaaaattt

SEQ ID NO: 91516 - DNA, 25 bp, Artificial sequence
  SiRNA target sequence
tctttcacaatttcagaaaaatttt

SEQ ID NO: 91517 - DNA, 25 bp, Artificial sequence
  SiRNA target sequence
ctttcacaatttcagaaaaattttc

SEQ ID NO: 91518 - DNA, 25 bp, Artificial sequence
  SiRNA target sequence
tttcacaatttcagaaaaattttca

SEQ ID NO: 91519 - DNA, 25 bp, Artificial sequence
  SiRNA target sequence
ttcacaatttcagaaaaattttcat

SEQ ID NO: 91520 - DNA, 25 bp, Artificial sequence
  SiRNA target sequence
tcacaatttcagaaaaattttcatt

SEQ ID NO: 91521 - DNA, 25 bp, Artificial sequence
  SiRNA target sequence
cacaatttcagaaaaattttcatta

SEQ ID NO: 91522 - DNA, 25 bp, Artificial sequence
  SiRNA target sequence
acaatttcagaaaaattttcattaa

SEQ ID NO: 91523 - DNA, 25 bp, Artificial sequence
  SiRNA target sequence
caatttcagaaaaattttcattaaa

SEQ ID NO: 91524 - DNA, 25 bp, Artificial sequence
  SiRNA target sequence
aatttcagaaaaattttcattaaaa

SEQ ID NO: 91525 - DNA, 25 bp, Artificial sequence
  SiRNA target sequence
atttcagaaaaattttcattaaaaa

SEQ ID NO: 91526 - DNA, 25 bp, Artificial sequence
  SiRNA target sequence
tttcagaaaaattttcattaaaaat

SEQ ID NO: 91527 - DNA, 25 bp, Artificial sequence
  SiRNA target sequence
ttcagaaaaattttcattaaaaatg

SEQ ID NO: 91528 - DNA, 25 bp, Artificial sequence
  SiRNA target sequence
tcagaaaaattttcattaaaaatgc

SEQ ID NO: 91529 - DNA, 25 bp, Artificial sequence
  SiRNA target sequence
cagaaaaattttcattaaaaatgct

SEQ ID NO: 91530 - DNA, 25 bp, Artificial sequence
  SiRNA target sequence
agaaaaattttcattaaaaatgcta

SEQ ID NO: 91531 - DNA, 25 bp, Artificial sequence
  SiRNA target sequence
gaaaaattttcattaaaaatgctat

SEQ ID NO: 91532 - DNA, 25 bp, Artificial sequence
  SiRNA target sequence
aaaaattttcattaaaaatgctata

SEQ ID NO: 91533 - DNA, 25 bp, Artificial sequence
  SiRNA target sequence
aaaattttcattaaaaatgctataa

SEQ ID NO: 91534 - DNA, 25 bp, Artificial sequence
  SiRNA target sequence
aaattttcattaaaaatgctataaa

SEQ ID NO: 91535 - DNA, 25 bp, Artificial sequence
  SiRNA target sequence
aattttcattaaaaatgctataaat

SEQ ID NO: 91536 - DNA, 25 bp, Artificial sequence
  SiRNA target sequence
attttcattaaaaatgctataaata

SEQ ID NO: 91537 - DNA, 25 bp, Artificial sequence
  SiRNA target sequence
ttttcattaaaaatgctataaatag

SEQ ID NO: 91538 - DNA, 25 bp, Artificial sequence
  SiRNA target sequence
tttcattaaaaatgctataaatagt

SEQ ID NO: 91539 - DNA, 25 bp, Artificial sequence
  SiRNA target sequence
ttcattaaaaatgctataaatagtt

SEQ ID NO: 91540 - DNA, 25 bp, Artificial sequence
  SiRNA target sequence
tcattaaaaatgctataaatagttt

SEQ ID NO: 91541 - DNA, 25 bp, Artificial sequence
  SiRNA target sequence
cattaaaaatgctataaatagtttt

SEQ ID NO: 91542 - DNA, 25 bp, Artificial sequence
  SiRNA target sequence
attaaaaatgctataaatagttttt

SEQ ID NO: 91543 - DNA, 25 bp, Artificial sequence
  SiRNA target sequence
ttaaaaatgctataaatagtttttt

SEQ ID NO: 91544 - DNA, 25 bp, Artificial sequence
  SiRNA target sequence
taaaaatgctataaatagttttttg

SEQ ID NO: 91545 - DNA, 25 bp, Artificial sequence
  SiRNA target sequence
aaaaatgctataaatagttttttgc

SEQ ID NO: 91546 - DNA, 25 bp, Artificial sequence
  SiRNA target sequence
aaaatgctataaatagttttttgca

SEQ ID NO: 91547 - DNA, 25 bp, Artificial sequence
  SiRNA target sequence
aaatgctataaatagttttttgcat

SEQ ID NO: 91548 - DNA, 25 bp, Artificial sequence
  SiRNA target sequence
aatgctataaatagttttttgcata

SEQ ID NO: 91549 - DNA, 25 bp, Artificial sequence
  SiRNA target sequence
atgctataaatagttttttgcatat

SEQ ID NO: 91550 - DNA, 25 bp, Artificial sequence
  SiRNA target sequence
tgctataaatagttttttgcatatc

SEQ ID NO: 91551 - DNA, 25 bp, Artificial sequence
  SiRNA target sequence
gctataaatagttttttgcatatca

SEQ ID NO: 91552 - DNA, 25 bp, Artificial sequence
  SiRNA target sequence
ctataaatagttttttgcatatcag

SEQ ID NO: 91553 - DNA, 25 bp, Artificial sequence
  SiRNA target sequence
tataaatagttttttgcatatcagg

SEQ ID NO: 91554 - DNA, 25 bp, Artificial sequence
  SiRNA target sequence
ataaatagttttttgcatatcaggt

SEQ ID NO: 91555 - DNA, 25 bp, Artificial sequence
  SiRNA target sequence
taaatagttttttgcatatcaggtc

SEQ ID NO: 91556 - DNA, 25 bp, Artificial sequence
  SiRNA target sequence
aaatagttttttgcatatcaggtcg

SEQ ID NO: 91557 - DNA, 25 bp, Artificial sequence
  SiRNA target sequence
aatagttttttgcatatcaggtcgg

SEQ ID NO: 91558 - DNA, 25 bp, Artificial sequence
  SiRNA target sequence
atagttttttgcatatcaggtcggc

SEQ ID NO: 91559 - DNA, 25 bp, Artificial sequence
  SiRNA target sequence
tagttttttgcatatcaggtcggcc

SEQ ID NO: 91560 - DNA, 25 bp, Artificial sequence
  SiRNA target sequence
agttttttgcatatcaggtcggcca

SEQ ID NO: 91561 - DNA, 25 bp, Artificial sequence
  SiRNA target sequence
gttttttgcatatcaggtcggccac

SEQ ID NO: 91562 - DNA, 25 bp, Artificial sequence
  SiRNA target sequence
ttttttgcatatcaggtcggccaca

SEQ ID NO: 91563 - DNA, 25 bp, Artificial sequence
  SiRNA target sequence
tttttgcatatcaggtcggccacaa

SEQ ID NO: 91564 - DNA, 25 bp, Artificial sequence
  SiRNA target sequence
ttttgcatatcaggtcggccacaaa

SEQ ID NO: 91565 - DNA, 25 bp, Artificial sequence
  SiRNA target sequence
tttgcatatcaggtcggccacaaac

SEQ ID NO: 91566 - DNA, 25 bp, Artificial sequence
  SiRNA target sequence
ttgcatatcaggtcggccacaaaca

SEQ ID NO: 91567 - DNA, 25 bp, Artificial sequence
  SiRNA target sequence
tgcatatcaggtcggccacaaacat

SEQ ID NO: 91568 - DNA, 25 bp, Artificial sequence
  SiRNA target sequence
gcatatcaggtcggccacaaacata

SEQ ID NO: 91569 - DNA, 25 bp, Artificial sequence
  SiRNA target sequence
catatcaggtcggccacaaacataa

SEQ ID NO: 91570 - DNA, 25 bp, Artificial sequence
  SiRNA target sequence
atatcaggtcggccacaaacataaa

SEQ ID NO: 91571 - DNA, 25 bp, Artificial sequence
  SiRNA target sequence
tatcaggtcggccacaaacataaac

SEQ ID NO: 91572 - DNA, 25 bp, Artificial sequence
  SiRNA target sequence
atcaggtcggccacaaacataaacc

SEQ ID NO: 91573 - DNA, 25 bp, Artificial sequence
  SiRNA target sequence
tcaggtcggccacaaacataaacca

SEQ ID NO: 91574 - DNA, 25 bp, Artificial sequence
  SiRNA target sequence
caggtcggccacaaacataaaccaa

SEQ ID NO: 91575 - DNA, 25 bp, Artificial sequence
  SiRNA target sequence
aggtcggccacaaacataaaccaaa

SEQ ID NO: 91576 - DNA, 25 bp, Artificial sequence
  SiRNA target sequence
ggtcggccacaaacataaaccaaac

SEQ ID NO: 91577 - DNA, 25 bp, Artificial sequence
  SiRNA target sequence
gtcggccacaaacataaaccaaaca

SEQ ID NO: 91578 - DNA, 25 bp, Artificial sequence
  SiRNA target sequence
tcggccacaaacataaaccaaacat

SEQ ID NO: 91579 - DNA, 25 bp, Artificial sequence
  SiRNA target sequence
cggccacaaacataaaccaaacatc

SEQ ID NO: 91580 - DNA, 25 bp, Artificial sequence
  SiRNA target sequence
ggccacaaacataaaccaaacatcc

SEQ ID NO: 91581 - DNA, 25 bp, Artificial sequence
  SiRNA target sequence
gccacaaacataaaccaaacatccg

SEQ ID NO: 91582 - DNA, 25 bp, Artificial sequence
  SiRNA target sequence
ccacaaacataaaccaaacatccgt

SEQ ID NO: 91583 - DNA, 25 bp, Artificial sequence
  SiRNA target sequence
cacaaacataaaccaaacatccgtc

SEQ ID NO: 91584 - DNA, 25 bp, Artificial sequence
  SiRNA target sequence
acaaacataaaccaaacatccgtct

SEQ ID NO: 91585 - DNA, 25 bp, Artificial sequence
  SiRNA target sequence
caaacataaaccaaacatccgtctt

SEQ ID NO: 91586 - DNA, 25 bp, Artificial sequence
  SiRNA target sequence
aaacataaaccaaacatccgtcttt

SEQ ID NO: 91587 - DNA, 25 bp, Artificial sequence
  SiRNA target sequence
aacataaaccaaacatccgtcttta

SEQ ID NO: 91588 - DNA, 25 bp, Artificial sequence
  SiRNA target sequence
acataaaccaaacatccgtctttaa

SEQ ID NO: 91589 - DNA, 25 bp, Artificial sequence
  SiRNA target sequence
cataaaccaaacatccgtctttaat

SEQ ID NO: 91590 - DNA, 25 bp, Artificial sequence
  SiRNA target sequence
ataaaccaaacatccgtctttaatg

SEQ ID NO: 91591 - DNA, 25 bp, Artificial sequence
  SiRNA target sequence
taaaccaaacatccgtctttaatgt

SEQ ID NO: 91592 - DNA, 25 bp, Artificial sequence
  SiRNA target sequence
aaaccaaacatccgtctttaatgta

SEQ ID NO: 91593 - DNA, 25 bp, Artificial sequence
  SiRNA target sequence
aaccaaacatccgtctttaatgtat

SEQ ID NO: 91594 - DNA, 25 bp, Artificial sequence
  SiRNA target sequence
accaaacatccgtctttaatgtatg

SEQ ID NO: 91595 - DNA, 25 bp, Artificial sequence
  SiRNA target sequence
ccaaacatccgtctttaatgtatgt

SEQ ID NO: 91596 - DNA, 25 bp, Artificial sequence
  SiRNA target sequence
caaacatccgtctttaatgtatgtt

SEQ ID NO: 91597 - DNA, 25 bp, Artificial sequence
  SiRNA target sequence
aaacatccgtctttaatgtatgttt

SEQ ID NO: 91598 - DNA, 25 bp, Artificial sequence
  SiRNA target sequence
aacatccgtctttaatgtatgtttt

SEQ ID NO: 91599 - DNA, 25 bp, Artificial sequence
  SiRNA target sequence
acatccgtctttaatgtatgttttt

SEQ ID NO: 91600 - DNA, 25 bp, Artificial sequence
  SiRNA target sequence
catccgtctttaatgtatgttttta

SEQ ID NO: 91601 - DNA, 25 bp, Artificial sequence
  SiRNA target sequence
atccgtctttaatgtatgtttttat

SEQ ID NO: 91602 - DNA, 25 bp, Artificial sequence
  SiRNA target sequence
tccgtctttaatgtatgtttttatc

SEQ ID NO: 91603 - DNA, 25 bp, Artificial sequence
  SiRNA target sequence
ccgtctttaatgtatgtttttatct

SEQ ID NO: 91604 - DNA, 25 bp, Artificial sequence
  SiRNA target sequence
cgtctttaatgtatgtttttatctc

SEQ ID NO: 91605 - DNA, 25 bp, Artificial sequence
  SiRNA target sequence
gtctttaatgtatgtttttatctca

SEQ ID NO: 91606 - DNA, 25 bp, Artificial sequence
  SiRNA target sequence
tctttaatgtatgtttttatctcat

SEQ ID NO: 91607 - DNA, 25 bp, Artificial sequence
  SiRNA target sequence
ctttaatgtatgtttttatctcatt

SEQ ID NO: 91608 - DNA, 25 bp, Artificial sequence
  SiRNA target sequence
tttaatgtatgtttttatctcattt

SEQ ID NO: 91609 - DNA, 25 bp, Artificial sequence
  SiRNA target sequence
ttaatgtatgtttttatctcattta

SEQ ID NO: 91610 - DNA, 25 bp, Artificial sequence
  SiRNA target sequence
taatgtatgtttttatctcatttaa

SEQ ID NO: 91611 - DNA, 25 bp, Artificial sequence
  SiRNA target sequence
aatgtatgtttttatctcatttaaa

SEQ ID NO: 91612 - DNA, 25 bp, Artificial sequence
  SiRNA target sequence
atgtatgtttttatctcatttaaat

SEQ ID NO: 91613 - DNA, 25 bp, Artificial sequence
  SiRNA target sequence
tgtatgtttttatctcatttaaatt

SEQ ID NO: 91614 - DNA, 25 bp, Artificial sequence
  SiRNA target sequence
gtatgtttttatctcatttaaattt

SEQ ID NO: 91615 - DNA, 25 bp, Artificial sequence
  SiRNA target sequence
tatgtttttatctcatttaaatttt

SEQ ID NO: 91616 - DNA, 25 bp, Artificial sequence
  SiRNA target sequence
atgtttttatctcatttaaattttg

SEQ ID NO: 91617 - DNA, 25 bp, Artificial sequence
  SiRNA target sequence
tgtttttatctcatttaaattttgt

SEQ ID NO: 91618 - DNA, 25 bp, Artificial sequence
  SiRNA target sequence
gtttttatctcatttaaattttgta

SEQ ID NO: 91619 - DNA, 25 bp, Artificial sequence
  SiRNA target sequence
tttttatctcatttaaattttgtaa

SEQ ID NO: 91620 - DNA, 25 bp, Artificial sequence
  SiRNA target sequence
ttttatctcatttaaattttgtaat

SEQ ID NO: 91621 - DNA, 25 bp, Artificial sequence
  SiRNA target sequence
tttatctcatttaaattttgtaata

SEQ ID NO: 91622 - DNA, 25 bp, Artificial sequence
  SiRNA target sequence
ttatctcatttaaattttgtaataa

SEQ ID NO: 91623 - DNA, 25 bp, Artificial sequence
  SiRNA target sequence
tatctcatttaaattttgtaataaa

SEQ ID NO: 91624 - DNA, 25 bp, Artificial sequence
  SiRNA target sequence
atctcatttaaattttgtaataaat

SEQ ID NO: 91625 - DNA, 25 bp, Artificial sequence
  SiRNA target sequence
tctcatttaaattttgtaataaata

SEQ ID NO: 91626 - DNA, 25 bp, Artificial sequence
  SiRNA target sequence
ctcatttaaattttgtaataaataa

SEQ ID NO: 91627 - DNA, 25 bp, Artificial sequence
  SiRNA target sequence
tcatttaaattttgtaataaataat

SEQ ID NO: 91628 - DNA, 25 bp, Artificial sequence
  SiRNA target sequence
catttaaattttgtaataaataatc

SEQ ID NO: 91629 - DNA, 25 bp, Artificial sequence
  SiRNA target sequence
atttaaattttgtaataaataatca

SEQ ID NO: 91630 - DNA, 25 bp, Artificial sequence
  SiRNA target sequence
tttaaattttgtaataaataatcag

SEQ ID NO: 91631 - DNA, 25 bp, Artificial sequence
  SiRNA target sequence
ttaaattttgtaataaataatcagt

SEQ ID NO: 91632 - DNA, 25 bp, Artificial sequence
  SiRNA target sequence
taaattttgtaataaataatcagta

SEQ ID NO: 91633 - DNA, 25 bp, Artificial sequence
  SiRNA target sequence
aaattttgtaataaataatcagtaa

SEQ ID NO: 91634 - DNA, 25 bp, Artificial sequence
  SiRNA target sequence
aattttgtaataaataatcagtaac

SEQ ID NO: 91635 - DNA, 25 bp, Artificial sequence
  SiRNA target sequence
attttgtaataaataatcagtaaca

SEQ ID NO: 91636 - DNA, 25 bp, Artificial sequence
  SiRNA target sequence
ttttgtaataaataatcagtaacat

SEQ ID NO: 91637 - DNA, 25 bp, Artificial sequence
  SiRNA target sequence
tttgtaataaataatcagtaacata

SEQ ID NO: 91638 - DNA, 25 bp, Artificial sequence
  SiRNA target sequence
ttgtaataaataatcagtaacataa

SEQ ID NO: 91639 - DNA, 25 bp, Artificial sequence
  SiRNA target sequence
tgtaataaataatcagtaacataaa

SEQ ID NO: 91640 - DNA, 25 bp, Artificial sequence
  SiRNA target sequence
gtaataaataatcagtaacataaat

SEQ ID NO: 91641 - DNA, 25 bp, Artificial sequence
  SiRNA target sequence
taataaataatcagtaacataaatt

SEQ ID NO: 91642 - DNA, 25 bp, Artificial sequence
  SiRNA target sequence
aataaataatcagtaacataaattt

SEQ ID NO: 91643 - DNA, 25 bp, Artificial sequence
  SiRNA target sequence
ataaataatcagtaacataaatttt

SEQ ID NO: 91644 - DNA, 25 bp, Artificial sequence
  SiRNA target sequence
taaataatcagtaacataaatttta

SEQ ID NO: 91645 - DNA, 25 bp, Artificial sequence
  SiRNA target sequence
aaataatcagtaacataaattttat

SEQ ID NO: 91646 - DNA, 25 bp, Artificial sequence
  SiRNA target sequence
aataatcagtaacataaattttatt

SEQ ID NO: 91647 - DNA, 25 bp, Artificial sequence
  SiRNA target sequence
ataatcagtaacataaattttatta

SEQ ID NO: 91648 - DNA, 25 bp, Artificial sequence
  SiRNA target sequence
taatcagtaacataaattttattac

SEQ ID NO: 91649 - DNA, 25 bp, Artificial sequence
  SiRNA target sequence
aatcagtaacataaattttattaca

SEQ ID NO: 91650 - DNA, 25 bp, Artificial sequence
  SiRNA target sequence
atcagtaacataaattttattacaa

SEQ ID NO: 91651 - DNA, 25 bp, Artificial sequence
  SiRNA target sequence
tcagtaacataaattttattacaag

SEQ ID NO: 91652 - DNA, 25 bp, Artificial sequence
  SiRNA target sequence
cagtaacataaattttattacaaga

SEQ ID NO: 91653 - DNA, 25 bp, Artificial sequence
  SiRNA target sequence
agtaacataaattttattacaagat

SEQ ID NO: 91654 - DNA, 25 bp, Artificial sequence
  SiRNA target sequence
gtaacataaattttattacaagata

SEQ ID NO: 91655 - DNA, 25 bp, Artificial sequence
  SiRNA target sequence
taacataaattttattacaagataa

SEQ ID NO: 91656 - DNA, 25 bp, Artificial sequence
  SiRNA target sequence
aacataaattttattacaagataaa

SEQ ID NO: 91657 - DNA, 25 bp, Artificial sequence
  SiRNA target sequence
acataaattttattacaagataaaa

SEQ ID NO: 91658 - DNA, 25 bp, Artificial sequence
  SiRNA target sequence
cataaattttattacaagataaaat

SEQ ID NO: 91659 - DNA, 25 bp, Artificial sequence
  SiRNA target sequence
ataaattttattacaagataaaatt

SEQ ID NO: 91660 - DNA, 25 bp, Artificial sequence
  SiRNA target sequence
taaattttattacaagataaaattt

SEQ ID NO: 91661 - DNA, 25 bp, Artificial sequence
  SiRNA target sequence
aaattttattacaagataaaatttt

SEQ ID NO: 91662 - DNA, 25 bp, Artificial sequence
  SiRNA target sequence
aattttattacaagataaaatttta

SEQ ID NO: 91663 - DNA, 25 bp, Artificial sequence
  SiRNA target sequence
attttattacaagataaaattttaa

SEQ ID NO: 91664 - DNA, 25 bp, Artificial sequence
  SiRNA target sequence
ttttattacaagataaaattttaat

SEQ ID NO: 91665 - DNA, 25 bp, Artificial sequence
  SiRNA target sequence
tttattacaagataaaattttaata

SEQ ID NO: 91666 - DNA, 25 bp, Artificial sequence
  SiRNA target sequence
ttattacaagataaaattttaataa

SEQ ID NO: 91667 - DNA, 25 bp, Artificial sequence
  SiRNA target sequence
tattacaagataaaattttaataat

SEQ ID NO: 91668 - DNA, 25 bp, Artificial sequence
  SiRNA target sequence
attacaagataaaattttaataatt

SEQ ID NO: 91669 - DNA, 25 bp, Artificial sequence
  SiRNA target sequence
ttacaagataaaattttaataattt

SEQ ID NO: 91670 - DNA, 25 bp, Artificial sequence
  SiRNA target sequence
tacaagataaaattttaataatttc

SEQ ID NO: 91671 - DNA, 25 bp, Artificial sequence
  SiRNA target sequence
acaagataaaattttaataatttct

SEQ ID NO: 91672 - DNA, 25 bp, Artificial sequence
  SiRNA target sequence
caagataaaattttaataatttctg

SEQ ID NO: 91673 - DNA, 25 bp, Artificial sequence
  SiRNA target sequence
aagataaaattttaataatttctgt

SEQ ID NO: 91674 - DNA, 25 bp, Artificial sequence
  SiRNA target sequence
agataaaattttaataatttctgtg

SEQ ID NO: 91675 - DNA, 25 bp, Artificial sequence
  SiRNA target sequence
gataaaattttaataatttctgtgt

SEQ ID NO: 91676 - DNA, 25 bp, Artificial sequence
  SiRNA target sequence
ataaaattttaataatttctgtgtt

SEQ ID NO: 91677 - DNA, 25 bp, Artificial sequence
  SiRNA target sequence
taaaattttaataatttctgtgttt

SEQ ID NO: 91678 - DNA, 25 bp, Artificial sequence
  SiRNA target sequence
aaaattttaataatttctgtgtttt

SEQ ID NO: 91679 - DNA, 25 bp, Artificial sequence
  SiRNA target sequence
aaattttaataatttctgtgttttt

SEQ ID NO: 91680 - DNA, 25 bp, Artificial sequence
  SiRNA target sequence
aattttaataatttctgtgttttta

SEQ ID NO: 91681 - DNA, 25 bp, Artificial sequence
  SiRNA target sequence
attttaataatttctgtgtttttat

SEQ ID NO: 91682 - DNA, 25 bp, Artificial sequence
  SiRNA target sequence
ttttaataatttctgtgtttttata

SEQ ID NO: 91683 - DNA, 25 bp, Artificial sequence
  SiRNA target sequence
tttaataatttctgtgtttttatat

SEQ ID NO: 91684 - DNA, 25 bp, Artificial sequence
  SiRNA target sequence
ttaataatttctgtgtttttatatt

SEQ ID NO: 91685 - DNA, 25 bp, Artificial sequence
  SiRNA target sequence
taataatttctgtgtttttatattt

SEQ ID NO: 91686 - DNA, 25 bp, Artificial sequence
  SiRNA target sequence
aataatttctgtgtttttatatttt

SEQ ID NO: 91687 - DNA, 25 bp, Artificial sequence
  SiRNA target sequence
ataatttctgtgtttttatattttg

SEQ ID NO: 91688 - DNA, 25 bp, Artificial sequence
  SiRNA target sequence
taatttctgtgtttttatattttgc

SEQ ID NO: 91689 - DNA, 25 bp, Artificial sequence
  SiRNA target sequence
aatttctgtgtttttatattttgca

SEQ ID NO: 91690 - DNA, 25 bp, Artificial sequence
  SiRNA target sequence
atttctgtgtttttatattttgcat

SEQ ID NO: 91691 - DNA, 25 bp, Artificial sequence
  SiRNA target sequence
tttctgtgtttttatattttgcatc

SEQ ID NO: 91692 - DNA, 25 bp, Artificial sequence
  SiRNA target sequence
ttctgtgtttttatattttgcatct

SEQ ID NO: 91693 - DNA, 25 bp, Artificial sequence
  SiRNA target sequence
tctgtgtttttatattttgcatctt

SEQ ID NO: 91694 - DNA, 25 bp, Artificial sequence
  SiRNA target sequence
ctgtgtttttatattttgcatcttt

SEQ ID NO: 91695 - DNA, 25 bp, Artificial sequence
  SiRNA target sequence
tgtgtttttatattttgcatcttta

SEQ ID NO: 91696 - DNA, 25 bp, Artificial sequence
  SiRNA target sequence
gtgtttttatattttgcatctttaa

SEQ ID NO: 91697 - DNA, 25 bp, Artificial sequence
  SiRNA target sequence
tgtttttatattttgcatctttaat

SEQ ID NO: 91698 - DNA, 25 bp, Artificial sequence
  SiRNA target sequence
gtttttatattttgcatctttaata

SEQ ID NO: 91699 - DNA, 25 bp, Artificial sequence
  SiRNA target sequence
tttttatattttgcatctttaataa

SEQ ID NO: 91700 - DNA, 25 bp, Artificial sequence
  SiRNA target sequence
ttttatattttgcatctttaataag

SEQ ID NO: 91701 - DNA, 25 bp, Artificial sequence
  SiRNA target sequence
tttatattttgcatctttaataaga

SEQ ID NO: 91702 - DNA, 25 bp, Artificial sequence
  SiRNA target sequence
ttatattttgcatctttaataagat

SEQ ID NO: 91703 - DNA, 25 bp, Artificial sequence
  SiRNA target sequence
tatattttgcatctttaataagatc

SEQ ID NO: 91704 - DNA, 25 bp, Artificial sequence
  SiRNA target sequence
atattttgcatctttaataagatca

SEQ ID NO: 91705 - DNA, 25 bp, Artificial sequence
  SiRNA target sequence
tattttgcatctttaataagatcat

SEQ ID NO: 91706 - DNA, 25 bp, Artificial sequence
  SiRNA target sequence
attttgcatctttaataagatcatc

SEQ ID NO: 91707 - DNA, 25 bp, Artificial sequence
  SiRNA target sequence
ttttgcatctttaataagatcatct

SEQ ID NO: 91708 - DNA, 25 bp, Artificial sequence
  SiRNA target sequence
tttgcatctttaataagatcatctt

SEQ ID NO: 91709 - DNA, 25 bp, Artificial sequence
  SiRNA target sequence
ttgcatctttaataagatcatcttc

SEQ ID NO: 91710 - DNA, 25 bp, Artificial sequence
  SiRNA target sequence
tgcatctttaataagatcatcttct

SEQ ID NO: 91711 - DNA, 25 bp, Artificial sequence
  SiRNA target sequence
gcatctttaataagatcatcttctt

SEQ ID NO: 91712 - DNA, 25 bp, Artificial sequence
  SiRNA target sequence
catctttaataagatcatcttcttg

SEQ ID NO: 91713 - DNA, 25 bp, Artificial sequence
  SiRNA target sequence
atctttaataagatcatcttcttga

SEQ ID NO: 91714 - DNA, 25 bp, Artificial sequence
  SiRNA target sequence
tctttaataagatcatcttcttgat

SEQ ID NO: 91715 - DNA, 25 bp, Artificial sequence
  SiRNA target sequence
ctttaataagatcatcttcttgatt

SEQ ID NO: 91716 - DNA, 25 bp, Artificial sequence
  SiRNA target sequence
tttaataagatcatcttcttgattt

SEQ ID NO: 91717 - DNA, 25 bp, Artificial sequence
  SiRNA target sequence
ttaataagatcatcttcttgatttc

SEQ ID NO: 91718 - DNA, 25 bp, Artificial sequence
  SiRNA target sequence
taataagatcatcttcttgatttct

SEQ ID NO: 91719 - DNA, 25 bp, Artificial sequence
  SiRNA target sequence
aataagatcatcttcttgatttcta

SEQ ID NO: 91720 - DNA, 25 bp, Artificial sequence
  SiRNA target sequence
ataagatcatcttcttgatttctaa

SEQ ID NO: 91721 - DNA, 25 bp, Artificial sequence
  SiRNA target sequence
taagatcatcttcttgatttctaaa

SEQ ID NO: 91722 - DNA, 25 bp, Artificial sequence
  SiRNA target sequence
aagatcatcttcttgatttctaaat

SEQ ID NO: 91723 - DNA, 25 bp, Artificial sequence
  SiRNA target sequence
agatcatcttcttgatttctaaatc

SEQ ID NO: 91724 - DNA, 25 bp, Artificial sequence
  SiRNA target sequence
gatcatcttcttgatttctaaatcc

SEQ ID NO: 91725 - DNA, 25 bp, Artificial sequence
  SiRNA target sequence
atcatcttcttgatttctaaatcca

SEQ ID NO: 91726 - DNA, 25 bp, Artificial sequence
  SiRNA target sequence
tcatcttcttgatttctaaatccat

SEQ ID NO: 91727 - DNA, 25 bp, Artificial sequence
  SiRNA target sequence
catcttcttgatttctaaatccata

SEQ ID NO: 91728 - DNA, 25 bp, Artificial sequence
  SiRNA target sequence
atcttcttgatttctaaatccatat

SEQ ID NO: 91729 - DNA, 25 bp, Artificial sequence
  SiRNA target sequence
tcttcttgatttctaaatccatata

SEQ ID NO: 91730 - DNA, 25 bp, Artificial sequence
  SiRNA target sequence
cttcttgatttctaaatccatatat

SEQ ID NO: 91731 - DNA, 25 bp, Artificial sequence
  SiRNA target sequence
ttcttgatttctaaatccatatatt

SEQ ID NO: 91732 - DNA, 25 bp, Artificial sequence
  SiRNA target sequence
tcttgatttctaaatccatatatta

SEQ ID NO: 91733 - DNA, 25 bp, Artificial sequence
  SiRNA target sequence
cttgatttctaaatccatatattag

SEQ ID NO: 91734 - DNA, 25 bp, Artificial sequence
  SiRNA target sequence
ttgatttctaaatccatatattagt

SEQ ID NO: 91735 - DNA, 25 bp, Artificial sequence
  SiRNA target sequence
tgatttctaaatccatatattagtt

SEQ ID NO: 91736 - DNA, 25 bp, Artificial sequence
  SiRNA target sequence
gatttctaaatccatatattagttt

SEQ ID NO: 91737 - DNA, 25 bp, Artificial sequence
  SiRNA target sequence
atttctaaatccatatattagtttg

SEQ ID NO: 91738 - DNA, 25 bp, Artificial sequence
  SiRNA target sequence
tttctaaatccatatattagtttga

SEQ ID NO: 91739 - DNA, 25 bp, Artificial sequence
  SiRNA target sequence
ttctaaatccatatattagtttgat

SEQ ID NO: 91740 - DNA, 25 bp, Artificial sequence
  SiRNA target sequence
tctaaatccatatattagtttgata

SEQ ID NO: 91741 - DNA, 25 bp, Artificial sequence
  SiRNA target sequence
ctaaatccatatattagtttgatat

SEQ ID NO: 91742 - DNA, 25 bp, Artificial sequence
  SiRNA target sequence
taaatccatatattagtttgatata

SEQ ID NO: 91743 - DNA, 25 bp, Artificial sequence
  SiRNA target sequence
aaatccatatattagtttgatatat

SEQ ID NO: 91744 - DNA, 25 bp, Artificial sequence
  SiRNA target sequence
aatccatatattagtttgatatatt

SEQ ID NO: 91745 - DNA, 25 bp, Artificial sequence
  SiRNA target sequence
atccatatattagtttgatatattg

SEQ ID NO: 91746 - DNA, 25 bp, Artificial sequence
  SiRNA target sequence
tccatatattagtttgatatattga

SEQ ID NO: 91747 - DNA, 25 bp, Artificial sequence
  SiRNA target sequence
ccatatattagtttgatatattgat

SEQ ID NO: 91748 - DNA, 25 bp, Artificial sequence
  SiRNA target sequence
catatattagtttgatatattgatc

SEQ ID NO: 91749 - DNA, 25 bp, Artificial sequence
  SiRNA target sequence
atatattagtttgatatattgatcg

SEQ ID NO: 91750 - DNA, 25 bp, Artificial sequence
  SiRNA target sequence
tatattagtttgatatattgatcgt

SEQ ID NO: 91751 - DNA, 25 bp, Artificial sequence
  SiRNA target sequence
atattagtttgatatattgatcgtc

SEQ ID NO: 91752 - DNA, 25 bp, Artificial sequence
  SiRNA target sequence
tattagtttgatatattgatcgtct

SEQ ID NO: 91753 - DNA, 25 bp, Artificial sequence
  SiRNA target sequence
attagtttgatatattgatcgtctt

SEQ ID NO: 91754 - DNA, 25 bp, Artificial sequence
  SiRNA target sequence
ttagtttgatatattgatcgtcttc

SEQ ID NO: 91755 - DNA, 25 bp, Artificial sequence
  SiRNA target sequence
tagtttgatatattgatcgtcttct

SEQ ID NO: 91756 - DNA, 25 bp, Artificial sequence
  SiRNA target sequence
agtttgatatattgatcgtcttctt

SEQ ID NO: 91757 - DNA, 25 bp, Artificial sequence
  SiRNA target sequence
gtttgatatattgatcgtcttcttt

SEQ ID NO: 91758 - DNA, 25 bp, Artificial sequence
  SiRNA target sequence
tttgatatattgatcgtcttcttta

SEQ ID NO: 91759 - DNA, 25 bp, Artificial sequence
  SiRNA target sequence
ttgatatattgatcgtcttctttat

SEQ ID NO: 91760 - DNA, 25 bp, Artificial sequence
  SiRNA target sequence
tgatatattgatcgtcttctttatt

SEQ ID NO: 91761 - DNA, 25 bp, Artificial sequence
  SiRNA target sequence
gatatattgatcgtcttctttattt

SEQ ID NO: 91762 - DNA, 25 bp, Artificial sequence
  SiRNA target sequence
atatattgatcgtcttctttatttt

SEQ ID NO: 91763 - DNA, 25 bp, Artificial sequence
  SiRNA target sequence
tatattgatcgtcttctttattttt

SEQ ID NO: 91764 - DNA, 25 bp, Artificial sequence
  SiRNA target sequence
atattgatcgtcttctttatttttc

SEQ ID NO: 91765 - DNA, 25 bp, Artificial sequence
  SiRNA target sequence
tattgatcgtcttctttatttttca

SEQ ID NO: 91766 - DNA, 25 bp, Artificial sequence
  SiRNA target sequence
attgatcgtcttctttatttttcaa

SEQ ID NO: 91767 - DNA, 25 bp, Artificial sequence
  SiRNA target sequence
ttgatcgtcttctttatttttcaaa

SEQ ID NO: 91768 - DNA, 25 bp, Artificial sequence
  SiRNA target sequence
tgatcgtcttctttatttttcaaaa

SEQ ID NO: 91769 - DNA, 25 bp, Artificial sequence
  SiRNA target sequence
gatcgtcttctttatttttcaaaaa

SEQ ID NO: 91770 - DNA, 25 bp, Artificial sequence
  SiRNA target sequence
atcgtcttctttatttttcaaaaac

SEQ ID NO: 91771 - DNA, 25 bp, Artificial sequence
  SiRNA target sequence
tcgtcttctttatttttcaaaaacg

SEQ ID NO: 91772 - DNA, 25 bp, Artificial sequence
  SiRNA target sequence
cgtcttctttatttttcaaaaacga

SEQ ID NO: 91773 - DNA, 25 bp, Artificial sequence
  SiRNA target sequence
gtcttctttatttttcaaaaacgaa

SEQ ID NO: 91774 - DNA, 25 bp, Artificial sequence
  SiRNA target sequence
tcttctttatttttcaaaaacgaaa

SEQ ID NO: 91775 - DNA, 25 bp, Artificial sequence
  SiRNA target sequence
cttctttatttttcaaaaacgaaaa

SEQ ID NO: 91776 - DNA, 25 bp, Artificial sequence
  SiRNA target sequence
ttctttatttttcaaaaacgaaaaa

SEQ ID NO: 91777 - DNA, 25 bp, Artificial sequence
  SiRNA target sequence
tctttatttttcaaaaacgaaaaaa

SEQ ID NO: 91778 - DNA, 25 bp, Artificial sequence
  SiRNA target sequence
ctttatttttcaaaaacgaaaaaaa

SEQ ID NO: 91779 - DNA, 25 bp, Artificial sequence
  SiRNA target sequence
tttatttttcaaaaacgaaaaaaat

SEQ ID NO: 91780 - DNA, 25 bp, Artificial sequence
  SiRNA target sequence
ttatttttcaaaaacgaaaaaaatg

SEQ ID NO: 91781 - DNA, 25 bp, Artificial sequence
  SiRNA target sequence
tatttttcaaaaacgaaaaaaatgg

SEQ ID NO: 91782 - DNA, 25 bp, Artificial sequence
  SiRNA target sequence
atttttcaaaaacgaaaaaaatgga

SEQ ID NO: 91783 - DNA, 25 bp, Artificial sequence
  SiRNA target sequence
tttttcaaaaacgaaaaaaatggag

SEQ ID NO: 91784 - DNA, 25 bp, Artificial sequence
  SiRNA target sequence
ttttcaaaaacgaaaaaaatggagc

SEQ ID NO: 91785 - DNA, 25 bp, Artificial sequence
  SiRNA target sequence
tttcaaaaacgaaaaaaatggagca

SEQ ID NO: 91786 - DNA, 25 bp, Artificial sequence
  SiRNA target sequence
ttcaaaaacgaaaaaaatggagcaa

SEQ ID NO: 91787 - DNA, 25 bp, Artificial sequence
  SiRNA target sequence
tcaaaaacgaaaaaaatggagcaat

SEQ ID NO: 91788 - DNA, 25 bp, Artificial sequence
  SiRNA target sequence
caaaaacgaaaaaaatggagcaatg

SEQ ID NO: 91789 - DNA, 25 bp, Artificial sequence
  SiRNA target sequence
aaaaacgaaaaaaatggagcaatgc

SEQ ID NO: 91790 - DNA, 25 bp, Artificial sequence
  SiRNA target sequence
aaaacgaaaaaaatggagcaatgcc

SEQ ID NO: 91791 - DNA, 25 bp, Artificial sequence
  SiRNA target sequence
aaacgaaaaaaatggagcaatgcca

SEQ ID NO: 91792 - DNA, 25 bp, Artificial sequence
  SiRNA target sequence
aacgaaaaaaatggagcaatgccag

SEQ ID NO: 91793 - DNA, 25 bp, Artificial sequence
  SiRNA target sequence
acgaaaaaaatggagcaatgccagt

SEQ ID NO: 91794 - DNA, 25 bp, Artificial sequence
  SiRNA target sequence
cgaaaaaaatggagcaatgccagtt

SEQ ID NO: 91795 - DNA, 25 bp, Artificial sequence
  SiRNA target sequence
gaaaaaaatggagcaatgccagttc

SEQ ID NO: 91796 - DNA, 25 bp, Artificial sequence
  SiRNA target sequence
aaaaaaatggagcaatgccagttcc

SEQ ID NO: 91797 - DNA, 25 bp, Artificial sequence
  SiRNA target sequence
aaaaaatggagcaatgccagttcca

SEQ ID NO: 91798 - DNA, 25 bp, Artificial sequence
  SiRNA target sequence
aaaaatggagcaatgccagttccag

SEQ ID NO: 91799 - DNA, 25 bp, Artificial sequence
  SiRNA target sequence
aaaatggagcaatgccagttccagt

SEQ ID NO: 91800 - DNA, 25 bp, Artificial sequence
  SiRNA target sequence
aaatggagcaatgccagttccagta

SEQ ID NO: 91801 - DNA, 25 bp, Artificial sequence
  SiRNA target sequence
aatggagcaatgccagttccagtac

SEQ ID NO: 91802 - DNA, 25 bp, Artificial sequence
  SiRNA target sequence
atggagcaatgccagttccagtaca

SEQ ID NO: 91803 - DNA, 25 bp, Artificial sequence
  SiRNA target sequence
tggagcaatgccagttccagtacaa

SEQ ID NO: 91804 - DNA, 25 bp, Artificial sequence
  SiRNA target sequence
ggagcaatgccagttccagtacaaa

SEQ ID NO: 91805 - DNA, 25 bp, Artificial sequence
  SiRNA target sequence
gagcaatgccagttccagtacaaat

SEQ ID NO: 91806 - DNA, 25 bp, Artificial sequence
  SiRNA target sequence
agcaatgccagttccagtacaaata

SEQ ID NO: 91807 - DNA, 25 bp, Artificial sequence
  SiRNA target sequence
gcaatgccagttccagtacaaatac

SEQ ID NO: 91808 - DNA, 25 bp, Artificial sequence
  SiRNA target sequence
caatgccagttccagtacaaatacc

SEQ ID NO: 91809 - DNA, 25 bp, Artificial sequence
  SiRNA target sequence
aatgccagttccagtacaaataccc

SEQ ID NO: 91810 - DNA, 25 bp, Artificial sequence
  SiRNA target sequence
atgccagttccagtacaaataccca

SEQ ID NO: 91811 - DNA, 25 bp, Artificial sequence
  SiRNA target sequence
tgccagttccagtacaaatacccaa

SEQ ID NO: 91812 - DNA, 25 bp, Artificial sequence
  SiRNA target sequence
gccagttccagtacaaatacccaac

SEQ ID NO: 91813 - DNA, 25 bp, Artificial sequence
  SiRNA target sequence
ccagttccagtacaaatacccaaca

SEQ ID NO: 91814 - DNA, 25 bp, Artificial sequence
  SiRNA target sequence
cagttccagtacaaatacccaacac

SEQ ID NO: 91815 - DNA, 25 bp, Artificial sequence
  SiRNA target sequence
agttccagtacaaatacccaacact

SEQ ID NO: 91816 - DNA, 25 bp, Artificial sequence
  SiRNA target sequence
gttccagtacaaatacccaacactt

SEQ ID NO: 91817 - DNA, 25 bp, Artificial sequence
  SiRNA target sequence
ttccagtacaaatacccaacacttt

SEQ ID NO: 91818 - DNA, 25 bp, Artificial sequence
  SiRNA target sequence
tccagtacaaatacccaacactttt

SEQ ID NO: 91819 - DNA, 25 bp, Artificial sequence
  SiRNA target sequence
ccagtacaaatacccaacacttttt

SEQ ID NO: 91820 - DNA, 25 bp, Artificial sequence
  SiRNA target sequence
cagtacaaatacccaacactttttt

SEQ ID NO: 91821 - DNA, 25 bp, Artificial sequence
  SiRNA target sequence
agtacaaatacccaacactttttta

SEQ ID NO: 91822 - DNA, 25 bp, Artificial sequence
  SiRNA target sequence
gtacaaatacccaacacttttttac

SEQ ID NO: 91823 - DNA, 25 bp, Artificial sequence
  SiRNA target sequence
tacaaatacccaacacttttttaca

SEQ ID NO: 91824 - DNA, 25 bp, Artificial sequence
  SiRNA target sequence
acaaatacccaacacttttttacaa

SEQ ID NO: 91825 - DNA, 25 bp, Artificial sequence
  SiRNA target sequence
caaatacccaacacttttttacaaa

SEQ ID NO: 91826 - DNA, 25 bp, Artificial sequence
  SiRNA target sequence
aaatacccaacacttttttacaaaa

SEQ ID NO: 91827 - DNA, 25 bp, Artificial sequence
  SiRNA target sequence
aatacccaacacttttttacaaaaa

SEQ ID NO: 91828 - DNA, 25 bp, Artificial sequence
  SiRNA target sequence
atacccaacacttttttacaaaaat

SEQ ID NO: 91829 - DNA, 25 bp, Artificial sequence
  SiRNA target sequence
tacccaacacttttttacaaaaatt

SEQ ID NO: 91830 - DNA, 25 bp, Artificial sequence
  SiRNA target sequence
acccaacacttttttacaaaaattt

SEQ ID NO: 91831 - DNA, 25 bp, Artificial sequence
  SiRNA target sequence
cccaacacttttttacaaaaattta

SEQ ID NO: 91832 - DNA, 25 bp, Artificial sequence
  SiRNA target sequence
ccaacacttttttacaaaaatttaa

SEQ ID NO: 91833 - DNA, 25 bp, Artificial sequence
  SiRNA target sequence
caacacttttttacaaaaatttaat

SEQ ID NO: 91834 - DNA, 25 bp, Artificial sequence
  SiRNA target sequence
aacacttttttacaaaaatttaatc

SEQ ID NO: 91835 - DNA, 25 bp, Artificial sequence
  SiRNA target sequence
acacttttttacaaaaatttaatct

SEQ ID NO: 91836 - DNA, 25 bp, Artificial sequence
  SiRNA target sequence
cacttttttacaaaaatttaatcta

SEQ ID NO: 91837 - DNA, 25 bp, Artificial sequence
  SiRNA target sequence
acttttttacaaaaatttaatctaa

SEQ ID NO: 91838 - DNA, 25 bp, Artificial sequence
  SiRNA target sequence
cttttttacaaaaatttaatctaaa

SEQ ID NO: 91839 - DNA, 25 bp, Artificial sequence
  SiRNA target sequence
ttttttacaaaaatttaatctaaat

SEQ ID NO: 91840 - DNA, 25 bp, Artificial sequence
  SiRNA target sequence
tttttacaaaaatttaatctaaata

SEQ ID NO: 91841 - DNA, 25 bp, Artificial sequence
  SiRNA target sequence
ttttacaaaaatttaatctaaataa

SEQ ID NO: 91842 - DNA, 25 bp, Artificial sequence
  SiRNA target sequence
tttacaaaaatttaatctaaataat

SEQ ID NO: 91843 - DNA, 25 bp, Artificial sequence
  SiRNA target sequence
ttacaaaaatttaatctaaataatt

SEQ ID NO: 91844 - DNA, 25 bp, Artificial sequence
  SiRNA target sequence
tacaaaaatttaatctaaataattt

SEQ ID NO: 91845 - DNA, 25 bp, Artificial sequence
  SiRNA target sequence
acaaaaatttaatctaaataattta

SEQ ID NO: 91846 - DNA, 25 bp, Artificial sequence
  SiRNA target sequence
caaaaatttaatctaaataatttac

SEQ ID NO: 91847 - DNA, 25 bp, Artificial sequence
  SiRNA target sequence
aaaaatttaatctaaataatttact

SEQ ID NO: 91848 - DNA, 25 bp, Artificial sequence
  SiRNA target sequence
aaaatttaatctaaataatttactc

SEQ ID NO: 91849 - DNA, 25 bp, Artificial sequence
  SiRNA target sequence
aaatttaatctaaataatttactcg

SEQ ID NO: 91850 - DNA, 25 bp, Artificial sequence
  SiRNA target sequence
aatttaatctaaataatttactcgg

SEQ ID NO: 91851 - DNA, 25 bp, Artificial sequence
  SiRNA target sequence
atttaatctaaataatttactcggt

SEQ ID NO: 91852 - DNA, 25 bp, Artificial sequence
  SiRNA target sequence
tttaatctaaataatttactcggtc

SEQ ID NO: 91853 - DNA, 25 bp, Artificial sequence
  SiRNA target sequence
ttaatctaaataatttactcggtct

SEQ ID NO: 91854 - DNA, 25 bp, Artificial sequence
  SiRNA target sequence
taatctaaataatttactcggtctg

SEQ ID NO: 91855 - DNA, 25 bp, Artificial sequence
  SiRNA target sequence
aatctaaataatttactcggtctgt

SEQ ID NO: 91856 - DNA, 25 bp, Artificial sequence
  SiRNA target sequence
atctaaataatttactcggtctgtg

SEQ ID NO: 91857 - DNA, 25 bp, Artificial sequence
  SiRNA target sequence
tctaaataatttactcggtctgtga

SEQ ID NO: 91858 - DNA, 25 bp, Artificial sequence
  SiRNA target sequence
ctaaataatttactcggtctgtgac

SEQ ID NO: 91859 - DNA, 25 bp, Artificial sequence
  SiRNA target sequence
taaataatttactcggtctgtgaca

SEQ ID NO: 91860 - DNA, 25 bp, Artificial sequence
  SiRNA target sequence
aaataatttactcggtctgtgacag

SEQ ID NO: 91861 - DNA, 25 bp, Artificial sequence
  SiRNA target sequence
aataatttactcggtctgtgacaga

SEQ ID NO: 91862 - DNA, 25 bp, Artificial sequence
  SiRNA target sequence
ataatttactcggtctgtgacagat

SEQ ID NO: 91863 - DNA, 25 bp, Artificial sequence
  SiRNA target sequence
taatttactcggtctgtgacagatc

SEQ ID NO: 91864 - DNA, 25 bp, Artificial sequence
  SiRNA target sequence
aatttactcggtctgtgacagatct

SEQ ID NO: 91865 - DNA, 25 bp, Artificial sequence
  SiRNA target sequence
atttactcggtctgtgacagatctt

SEQ ID NO: 91866 - DNA, 25 bp, Artificial sequence
  SiRNA target sequence
tttactcggtctgtgacagatcttt

SEQ ID NO: 91867 - DNA, 25 bp, Artificial sequence
  SiRNA target sequence
ttactcggtctgtgacagatcttta

SEQ ID NO: 91868 - DNA, 25 bp, Artificial sequence
  SiRNA target sequence
tactcggtctgtgacagatctttaa

SEQ ID NO: 91869 - DNA, 25 bp, Artificial sequence
  SiRNA target sequence
actcggtctgtgacagatctttaaa

SEQ ID NO: 91870 - DNA, 25 bp, Artificial sequence
  SiRNA target sequence
ctcggtctgtgacagatctttaaat

SEQ ID NO: 91871 - DNA, 25 bp, Artificial sequence
  SiRNA target sequence
tcggtctgtgacagatctttaaatt

SEQ ID NO: 91872 - DNA, 25 bp, Artificial sequence
  SiRNA target sequence
cggtctgtgacagatctttaaatta

SEQ ID NO: 91873 - DNA, 25 bp, Artificial sequence
  SiRNA target sequence
ggtctgtgacagatctttaaattat

SEQ ID NO: 91874 - DNA, 25 bp, Artificial sequence
  SiRNA target sequence
gtctgtgacagatctttaaattatt

SEQ ID NO: 91875 - DNA, 25 bp, Artificial sequence
  SiRNA target sequence
tctgtgacagatctttaaattatta

SEQ ID NO: 91876 - DNA, 25 bp, Artificial sequence
  SiRNA target sequence
ctgtgacagatctttaaattattat

SEQ ID NO: 91877 - DNA, 25 bp, Artificial sequence
  SiRNA target sequence
tgtgacagatctttaaattattata

SEQ ID NO: 91878 - DNA, 25 bp, Artificial sequence
  SiRNA target sequence
gtgacagatctttaaattattataa

SEQ ID NO: 91879 - DNA, 25 bp, Artificial sequence
  SiRNA target sequence
tgacagatctttaaattattataat

SEQ ID NO: 91880 - DNA, 25 bp, Artificial sequence
  SiRNA target sequence
gacagatctttaaattattataatt

SEQ ID NO: 91881 - DNA, 25 bp, Artificial sequence
  SiRNA target sequence
acagatctttaaattattataattt

SEQ ID NO: 91882 - DNA, 25 bp, Artificial sequence
  SiRNA target sequence
cagatctttaaattattataatttt

SEQ ID NO: 91883 - DNA, 25 bp, Artificial sequence
  SiRNA target sequence
agatctttaaattattataattttg

SEQ ID NO: 91884 - DNA, 25 bp, Artificial sequence
  SiRNA target sequence
gatctttaaattattataattttgc

SEQ ID NO: 91885 - DNA, 25 bp, Artificial sequence
  SiRNA target sequence
atctttaaattattataattttgca

SEQ ID NO: 91886 - DNA, 25 bp, Artificial sequence
  SiRNA target sequence
tctttaaattattataattttgcat

SEQ ID NO: 91887 - DNA, 25 bp, Artificial sequence
  SiRNA target sequence
ctttaaattattataattttgcata

SEQ ID NO: 91888 - DNA, 25 bp, Artificial sequence
  SiRNA target sequence
tttaaattattataattttgcatat

SEQ ID NO: 91889 - DNA, 25 bp, Artificial sequence
  SiRNA target sequence
ttaaattattataattttgcatatc

SEQ ID NO: 91890 - DNA, 25 bp, Artificial sequence
  SiRNA target sequence
taaattattataattttgcatatct

SEQ ID NO: 91891 - DNA, 25 bp, Artificial sequence
  SiRNA target sequence
aaattattataattttgcatatcta

SEQ ID NO: 91892 - DNA, 25 bp, Artificial sequence
  SiRNA target sequence
aattattataattttgcatatctat

SEQ ID NO: 91893 - DNA, 25 bp, Artificial sequence
  SiRNA target sequence
attattataattttgcatatctatg

SEQ ID NO: 91894 - DNA, 25 bp, Artificial sequence
  SiRNA target sequence
ttattataattttgcatatctatga

SEQ ID NO: 91895 - DNA, 25 bp, Artificial sequence
  SiRNA target sequence
tattataattttgcatatctatgaa

SEQ ID NO: 91896 - DNA, 25 bp, Artificial sequence
  SiRNA target sequence
attataattttgcatatctatgaaa

SEQ ID NO: 91897 - DNA, 25 bp, Artificial sequence
  SiRNA target sequence
ttataattttgcatatctatgaaat

SEQ ID NO: 91898 - DNA, 25 bp, Artificial sequence
  SiRNA target sequence
tataattttgcatatctatgaaatt

SEQ ID NO: 91899 - DNA, 25 bp, Artificial sequence
  SiRNA target sequence
ataattttgcatatctatgaaattg

SEQ ID NO: 91900 - DNA, 25 bp, Artificial sequence
  SiRNA target sequence
taattttgcatatctatgaaattgg

SEQ ID NO: 91901 - DNA, 25 bp, Artificial sequence
  SiRNA target sequence
aattttgcatatctatgaaattgga

SEQ ID NO: 91902 - DNA, 25 bp, Artificial sequence
  SiRNA target sequence
attttgcatatctatgaaattggaa

SEQ ID NO: 91903 - DNA, 25 bp, Artificial sequence
  SiRNA target sequence
ttttgcatatctatgaaattggaaa

SEQ ID NO: 91904 - DNA, 25 bp, Artificial sequence
  SiRNA target sequence
tttgcatatctatgaaattggaaac

SEQ ID NO: 91905 - DNA, 25 bp, Artificial sequence
  SiRNA target sequence
ttgcatatctatgaaattggaaaca

SEQ ID NO: 91906 - DNA, 25 bp, Artificial sequence
  SiRNA target sequence
tgcatatctatgaaattggaaacat

SEQ ID NO: 91907 - DNA, 25 bp, Artificial sequence
  SiRNA target sequence
gcatatctatgaaattggaaacatg

SEQ ID NO: 91908 - DNA, 25 bp, Artificial sequence
  SiRNA target sequence
catatctatgaaattggaaacatgt

SEQ ID NO: 91909 - DNA, 25 bp, Artificial sequence
  SiRNA target sequence
atatctatgaaattggaaacatgtc

SEQ ID NO: 91910 - DNA, 25 bp, Artificial sequence
  SiRNA target sequence
tatctatgaaattggaaacatgtcc

SEQ ID NO: 91911 - DNA, 25 bp, Artificial sequence
  SiRNA target sequence
atctatgaaattggaaacatgtcca

SEQ ID NO: 91912 - DNA, 25 bp, Artificial sequence
  SiRNA target sequence
tctatgaaattggaaacatgtccat

SEQ ID NO: 91913 - DNA, 25 bp, Artificial sequence
  SiRNA target sequence
ctatgaaattggaaacatgtccata

SEQ ID NO: 91914 - DNA, 25 bp, Artificial sequence
  SiRNA target sequence
tatgaaattggaaacatgtccatat

SEQ ID NO: 91915 - DNA, 25 bp, Artificial sequence
  SiRNA target sequence
atgaaattggaaacatgtccatatc

SEQ ID NO: 91916 - DNA, 25 bp, Artificial sequence
  SiRNA target sequence
tgaaattggaaacatgtccatatct

SEQ ID NO: 91917 - DNA, 25 bp, Artificial sequence
  SiRNA target sequence
gaaattggaaacatgtccatatcta

SEQ ID NO: 91918 - DNA, 25 bp, Artificial sequence
  SiRNA target sequence
aaattggaaacatgtccatatctat

SEQ ID NO: 91919 - DNA, 25 bp, Artificial sequence
  SiRNA target sequence
aattggaaacatgtccatatctatc

SEQ ID NO: 91920 - DNA, 25 bp, Artificial sequence
  SiRNA target sequence
attggaaacatgtccatatctatcg

SEQ ID NO: 91921 - DNA, 25 bp, Artificial sequence
  SiRNA target sequence
ttggaaacatgtccatatctatcgc

SEQ ID NO: 91922 - DNA, 25 bp, Artificial sequence
  SiRNA target sequence
tggaaacatgtccatatctatcgcc

SEQ ID NO: 91923 - DNA, 25 bp, Artificial sequence
  SiRNA target sequence
ggaaacatgtccatatctatcgcct

SEQ ID NO: 91924 - DNA, 25 bp, Artificial sequence
  SiRNA target sequence
gaaacatgtccatatctatcgcctt

SEQ ID NO: 91925 - DNA, 25 bp, Artificial sequence
  SiRNA target sequence
aaacatgtccatatctatcgccttt

SEQ ID NO: 91926 - DNA, 25 bp, Artificial sequence
  SiRNA target sequence
aacatgtccatatctatcgcctttt

SEQ ID NO: 91927 - DNA, 25 bp, Artificial sequence
  SiRNA target sequence
acatgtccatatctatcgccttttt

SEQ ID NO: 91928 - DNA, 25 bp, Artificial sequence
  SiRNA target sequence
catgtccatatctatcgcctttttt

SEQ ID NO: 91929 - DNA, 25 bp, Artificial sequence
  SiRNA target sequence
atgtccatatctatcgcctttttta

SEQ ID NO: 91930 - DNA, 25 bp, Artificial sequence
  SiRNA target sequence
tgtccatatctatcgccttttttaa

SEQ ID NO: 91931 - DNA, 25 bp, Artificial sequence
  SiRNA target sequence
gtccatatctatcgccttttttaat

SEQ ID NO: 91932 - DNA, 25 bp, Artificial sequence
  SiRNA target sequence
tccatatctatcgccttttttaata

SEQ ID NO: 91933 - DNA, 25 bp, Artificial sequence
  SiRNA target sequence
ccatatctatcgccttttttaataa

SEQ ID NO: 91934 - DNA, 25 bp, Artificial sequence
  SiRNA target sequence
catatctatcgccttttttaataat

SEQ ID NO: 91935 - DNA, 25 bp, Artificial sequence
  SiRNA target sequence
atatctatcgccttttttaataatt

SEQ ID NO: 91936 - DNA, 25 bp, Artificial sequence
  SiRNA target sequence
tatctatcgccttttttaataattg

SEQ ID NO: 91937 - DNA, 25 bp, Artificial sequence
  SiRNA target sequence
atctatcgccttttttaataattgc

SEQ ID NO: 91938 - DNA, 25 bp, Artificial sequence
  SiRNA target sequence
tctatcgccttttttaataattgct

SEQ ID NO: 91939 - DNA, 25 bp, Artificial sequence
  SiRNA target sequence
ctatcgccttttttaataattgcta

SEQ ID NO: 91940 - DNA, 25 bp, Artificial sequence
  SiRNA target sequence
tatcgccttttttaataattgctac

SEQ ID NO: 91941 - DNA, 25 bp, Artificial sequence
  SiRNA target sequence
atcgccttttttaataattgctact

SEQ ID NO: 91942 - DNA, 25 bp, Artificial sequence
  SiRNA target sequence
tcgccttttttaataattgctacta

SEQ ID NO: 91943 - DNA, 25 bp, Artificial sequence
  SiRNA target sequence
cgccttttttaataattgctactaa

SEQ ID NO: 91944 - DNA, 25 bp, Artificial sequence
  SiRNA target sequence
gccttttttaataattgctactaaa

SEQ ID NO: 91945 - DNA, 25 bp, Artificial sequence
  SiRNA target sequence
ccttttttaataattgctactaaaa

SEQ ID NO: 91946 - DNA, 25 bp, Artificial sequence
  SiRNA target sequence
cttttttaataattgctactaaaat

SEQ ID NO: 91947 - DNA, 25 bp, Artificial sequence
  SiRNA target sequence
ttttttaataattgctactaaaatt

SEQ ID NO: 91948 - DNA, 25 bp, Artificial sequence
  SiRNA target sequence
tttttaataattgctactaaaattt

SEQ ID NO: 91949 - DNA, 25 bp, Artificial sequence
  SiRNA target sequence
ttttaataattgctactaaaatttc

SEQ ID NO: 91950 - DNA, 25 bp, Artificial sequence
  SiRNA target sequence
tttaataattgctactaaaatttca

SEQ ID NO: 91951 - DNA, 25 bp, Artificial sequence
  SiRNA target sequence
ttaataattgctactaaaatttcac

SEQ ID NO: 91952 - DNA, 25 bp, Artificial sequence
  SiRNA target sequence
taataattgctactaaaatttcaca

SEQ ID NO: 91953 - DNA, 25 bp, Artificial sequence
  SiRNA target sequence
aataattgctactaaaatttcacat

SEQ ID NO: 91954 - DNA, 25 bp, Artificial sequence
  SiRNA target sequence
ataattgctactaaaatttcacatt

SEQ ID NO: 91955 - DNA, 25 bp, Artificial sequence
  SiRNA target sequence
taattgctactaaaatttcacattt

SEQ ID NO: 91956 - DNA, 25 bp, Artificial sequence
  SiRNA target sequence
aattgctactaaaatttcacatttt

SEQ ID NO: 91957 - DNA, 25 bp, Artificial sequence
  SiRNA target sequence
attgctactaaaatttcacattttt

SEQ ID NO: 91958 - DNA, 25 bp, Artificial sequence
  SiRNA target sequence
ttgctactaaaatttcacatttttc

SEQ ID NO: 91959 - DNA, 25 bp, Artificial sequence
  SiRNA target sequence
tgctactaaaatttcacatttttca

SEQ ID NO: 91960 - DNA, 25 bp, Artificial sequence
  SiRNA target sequence
gctactaaaatttcacatttttcat

SEQ ID NO: 91961 - DNA, 25 bp, Artificial sequence
  SiRNA target sequence
ctactaaaatttcacatttttcatt

SEQ ID NO: 91962 - DNA, 25 bp, Artificial sequence
  SiRNA target sequence
tactaaaatttcacatttttcattt

SEQ ID NO: 91963 - DNA, 25 bp, Artificial sequence
  SiRNA target sequence
actaaaatttcacatttttcattta

SEQ ID NO: 91964 - DNA, 25 bp, Artificial sequence
  SiRNA target sequence
ctaaaatttcacatttttcatttac

SEQ ID NO: 91965 - DNA, 25 bp, Artificial sequence
  SiRNA target sequence
taaaatttcacatttttcatttacg

SEQ ID NO: 91966 - DNA, 25 bp, Artificial sequence
  SiRNA target sequence
aaaatttcacatttttcatttacgt

SEQ ID NO: 91967 - DNA, 25 bp, Artificial sequence
  SiRNA target sequence
aaatttcacatttttcatttacgtg

SEQ ID NO: 91968 - DNA, 25 bp, Artificial sequence
  SiRNA target sequence
aatttcacatttttcatttacgtgg

SEQ ID NO: 91969 - DNA, 25 bp, Artificial sequence
  SiRNA target sequence
atttcacatttttcatttacgtggt

SEQ ID NO: 91970 - DNA, 25 bp, Artificial sequence
  SiRNA target sequence
tttcacatttttcatttacgtggtt

SEQ ID NO: 91971 - DNA, 25 bp, Artificial sequence
  SiRNA target sequence
ttcacatttttcatttacgtggtta

SEQ ID NO: 91972 - DNA, 25 bp, Artificial sequence
  SiRNA target sequence
tcacatttttcatttacgtggttag

SEQ ID NO: 91973 - DNA, 25 bp, Artificial sequence
  SiRNA target sequence
cacatttttcatttacgtggttagt

SEQ ID NO: 91974 - DNA, 25 bp, Artificial sequence
  SiRNA target sequence
acatttttcatttacgtggttagta

SEQ ID NO: 91975 - DNA, 25 bp, Artificial sequence
  SiRNA target sequence
catttttcatttacgtggttagtaa

SEQ ID NO: 91976 - DNA, 25 bp, Artificial sequence
  SiRNA target sequence
atttttcatttacgtggttagtaag

SEQ ID NO: 91977 - DNA, 25 bp, Artificial sequence
  SiRNA target sequence
tttttcatttacgtggttagtaagt

SEQ ID NO: 91978 - DNA, 25 bp, Artificial sequence
  SiRNA target sequence
ttttcatttacgtggttagtaagtg

SEQ ID NO: 91979 - DNA, 25 bp, Artificial sequence
  SiRNA target sequence
tttcatttacgtggttagtaagtga

SEQ ID NO: 91980 - DNA, 25 bp, Artificial sequence
  SiRNA target sequence
ttcatttacgtggttagtaagtgaa

SEQ ID NO: 91981 - DNA, 25 bp, Artificial sequence
  SiRNA target sequence
tcatttacgtggttagtaagtgaat

SEQ ID NO: 91982 - DNA, 25 bp, Artificial sequence
  SiRNA target sequence
catttacgtggttagtaagtgaata

SEQ ID NO: 91983 - DNA, 25 bp, Artificial sequence
  SiRNA target sequence
atttacgtggttagtaagtgaataa

SEQ ID NO: 91984 - DNA, 25 bp, Artificial sequence
  SiRNA target sequence
tttacgtggttagtaagtgaataat

SEQ ID NO: 91985 - DNA, 25 bp, Artificial sequence
  SiRNA target sequence
ttacgtggttagtaagtgaataata

SEQ ID NO: 91986 - DNA, 25 bp, Artificial sequence
  SiRNA target sequence
tacgtggttagtaagtgaataatat

SEQ ID NO: 91987 - DNA, 25 bp, Artificial sequence
  SiRNA target sequence
acgtggttagtaagtgaataatatc

SEQ ID NO: 91988 - DNA, 25 bp, Artificial sequence
  SiRNA target sequence
cgtggttagtaagtgaataatatct

SEQ ID NO: 91989 - DNA, 25 bp, Artificial sequence
  SiRNA target sequence
gtggttagtaagtgaataatatctt

SEQ ID NO: 91990 - DNA, 25 bp, Artificial sequence
  SiRNA target sequence
tggttagtaagtgaataatatcttg

SEQ ID NO: 91991 - DNA, 25 bp, Artificial sequence
  SiRNA target sequence
ggttagtaagtgaataatatcttgg

SEQ ID NO: 91992 - DNA, 25 bp, Artificial sequence
  SiRNA target sequence
gttagtaagtgaataatatcttggc

SEQ ID NO: 91993 - DNA, 25 bp, Artificial sequence
  SiRNA target sequence
ttagtaagtgaataatatcttggct

SEQ ID NO: 91994 - DNA, 25 bp, Artificial sequence
  SiRNA target sequence
tagtaagtgaataatatcttggctt

SEQ ID NO: 91995 - DNA, 25 bp, Artificial sequence
  SiRNA target sequence
agtaagtgaataatatcttggctta

SEQ ID NO: 91996 - DNA, 25 bp, Artificial sequence
  SiRNA target sequence
gtaagtgaataatatcttggcttaa

SEQ ID NO: 91997 - DNA, 25 bp, Artificial sequence
  SiRNA target sequence
taagtgaataatatcttggcttaat

SEQ ID NO: 91998 - DNA, 25 bp, Artificial sequence
  SiRNA target sequence
aagtgaataatatcttggcttaatt

SEQ ID NO: 91999 - DNA, 25 bp, Artificial sequence
  SiRNA target sequence
agtgaataatatcttggcttaattg

SEQ ID NO: 92000 - DNA, 25 bp, Artificial sequence
  SiRNA target sequence
gtgaataatatcttggcttaattgt

SEQ ID NO: 92001 - DNA, 25 bp, Artificial sequence
  SiRNA target sequence
tgaataatatcttggcttaattgtt

SEQ ID NO: 92002 - DNA, 25 bp, Artificial sequence
  SiRNA target sequence
gaataatatcttggcttaattgttt

SEQ ID NO: 92003 - DNA, 25 bp, Artificial sequence
  SiRNA target sequence
aataatatcttggcttaattgtttg

SEQ ID NO: 92004 - DNA, 25 bp, Artificial sequence
  SiRNA target sequence
ataatatcttggcttaattgtttga

SEQ ID NO: 92005 - DNA, 25 bp, Artificial sequence
  SiRNA target sequence
taatatcttggcttaattgtttgac

SEQ ID NO: 92006 - DNA, 25 bp, Artificial sequence
  SiRNA target sequence
aatatcttggcttaattgtttgaca

SEQ ID NO: 92007 - DNA, 25 bp, Artificial sequence
  SiRNA target sequence
atatcttggcttaattgtttgacaa

SEQ ID NO: 92008 - DNA, 25 bp, Artificial sequence
  SiRNA target sequence
tatcttggcttaattgtttgacaat

SEQ ID NO: 92009 - DNA, 25 bp, Artificial sequence
  SiRNA target sequence
atcttggcttaattgtttgacaatt

SEQ ID NO: 92010 - DNA, 25 bp, Artificial sequence
  SiRNA target sequence
tcttggcttaattgtttgacaattc

SEQ ID NO: 92011 - DNA, 25 bp, Artificial sequence
  SiRNA target sequence
cttggcttaattgtttgacaattca

SEQ ID NO: 92012 - DNA, 25 bp, Artificial sequence
  SiRNA target sequence
ttggcttaattgtttgacaattcat

SEQ ID NO: 92013 - DNA, 25 bp, Artificial sequence
  SiRNA target sequence
tggcttaattgtttgacaattcata

SEQ ID NO: 92014 - DNA, 25 bp, Artificial sequence
  SiRNA target sequence
ggcttaattgtttgacaattcataa

SEQ ID NO: 92015 - DNA, 25 bp, Artificial sequence
  SiRNA target sequence
gcttaattgtttgacaattcataat

SEQ ID NO: 92016 - DNA, 25 bp, Artificial sequence
  SiRNA target sequence
cttaattgtttgacaattcataata

SEQ ID NO: 92017 - DNA, 25 bp, Artificial sequence
  SiRNA target sequence
ttaattgtttgacaattcataataa

SEQ ID NO: 92018 - DNA, 25 bp, Artificial sequence
  SiRNA target sequence
taattgtttgacaattcataataag

SEQ ID NO: 92019 - DNA, 25 bp, Artificial sequence
  SiRNA target sequence
aattgtttgacaattcataataaga

SEQ ID NO: 92020 - DNA, 25 bp, Artificial sequence
  SiRNA target sequence
attgtttgacaattcataataagat

SEQ ID NO: 92021 - DNA, 25 bp, Artificial sequence
  SiRNA target sequence
ttgtttgacaattcataataagatc

SEQ ID NO: 92022 - DNA, 25 bp, Artificial sequence
  SiRNA target sequence
tgtttgacaattcataataagatcc

SEQ ID NO: 92023 - DNA, 25 bp, Artificial sequence
  SiRNA target sequence
gtttgacaattcataataagatcct

SEQ ID NO: 92024 - DNA, 25 bp, Artificial sequence
  SiRNA target sequence
tttgacaattcataataagatcctc

SEQ ID NO: 92025 - DNA, 25 bp, Artificial sequence
  SiRNA target sequence
ttgacaattcataataagatcctct

SEQ ID NO: 92026 - DNA, 25 bp, Artificial sequence
  SiRNA target sequence
tgacaattcataataagatcctcta

SEQ ID NO: 92027 - DNA, 25 bp, Artificial sequence
  SiRNA target sequence
gacaattcataataagatcctctaa

SEQ ID NO: 92028 - DNA, 25 bp, Artificial sequence
  SiRNA target sequence
acaattcataataagatcctctaaa

SEQ ID NO: 92029 - DNA, 25 bp, Artificial sequence
  SiRNA target sequence
caattcataataagatcctctaaac

SEQ ID NO: 92030 - DNA, 25 bp, Artificial sequence
  SiRNA target sequence
aattcataataagatcctctaaact

SEQ ID NO: 92031 - DNA, 25 bp, Artificial sequence
  SiRNA target sequence
attcataataagatcctctaaactt

SEQ ID NO: 92032 - DNA, 25 bp, Artificial sequence
  SiRNA target sequence
ttcataataagatcctctaaacttg

SEQ ID NO: 92033 - DNA, 25 bp, Artificial sequence
  SiRNA target sequence
tcataataagatcctctaaacttgg

SEQ ID NO: 92034 - DNA, 25 bp, Artificial sequence
  SiRNA target sequence
cataataagatcctctaaacttggt

SEQ ID NO: 92035 - DNA, 25 bp, Artificial sequence
  SiRNA target sequence
ataataagatcctctaaacttggtt

SEQ ID NO: 92036 - DNA, 25 bp, Artificial sequence
  SiRNA target sequence
taataagatcctctaaacttggttt

SEQ ID NO: 92037 - DNA, 25 bp, Artificial sequence
  SiRNA target sequence
aataagatcctctaaacttggttta

SEQ ID NO: 92038 - DNA, 25 bp, Artificial sequence
  SiRNA target sequence
ataagatcctctaaacttggtttac

SEQ ID NO: 92039 - DNA, 25 bp, Artificial sequence
  SiRNA target sequence
taagatcctctaaacttggtttaca

SEQ ID NO: 92040 - DNA, 25 bp, Artificial sequence
  SiRNA target sequence
aagatcctctaaacttggtttacat

SEQ ID NO: 92041 - DNA, 25 bp, Artificial sequence
  SiRNA target sequence
agatcctctaaacttggtttacatt

SEQ ID NO: 92042 - DNA, 25 bp, Artificial sequence
  SiRNA target sequence
gatcctctaaacttggtttacattg

SEQ ID NO: 92043 - DNA, 25 bp, Artificial sequence
  SiRNA target sequence
atcctctaaacttggtttacattga

SEQ ID NO: 92044 - DNA, 25 bp, Artificial sequence
  SiRNA target sequence
tcctctaaacttggtttacattgaa

SEQ ID NO: 92045 - DNA, 25 bp, Artificial sequence
  SiRNA target sequence
cctctaaacttggtttacattgaaa

SEQ ID NO: 92046 - DNA, 25 bp, Artificial sequence
  SiRNA target sequence
ctctaaacttggtttacattgaaat

SEQ ID NO: 92047 - DNA, 25 bp, Artificial sequence
  SiRNA target sequence
tctaaacttggtttacattgaaatg

SEQ ID NO: 92048 - DNA, 25 bp, Artificial sequence
  SiRNA target sequence
ctaaacttggtttacattgaaatgt

SEQ ID NO: 92049 - DNA, 25 bp, Artificial sequence
  SiRNA target sequence
taaacttggtttacattgaaatgta

SEQ ID NO: 92050 - DNA, 25 bp, Artificial sequence
  SiRNA target sequence
aaacttggtttacattgaaatgtat

SEQ ID NO: 92051 - DNA, 25 bp, Artificial sequence
  SiRNA target sequence
aacttggtttacattgaaatgtata

SEQ ID NO: 92052 - DNA, 25 bp, Artificial sequence
  SiRNA target sequence
acttggtttacattgaaatgtatat

SEQ ID NO: 92053 - DNA, 25 bp, Artificial sequence
  SiRNA target sequence
cttggtttacattgaaatgtatata

SEQ ID NO: 92054 - DNA, 25 bp, Artificial sequence
  SiRNA target sequence
ttggtttacattgaaatgtatatat

SEQ ID NO: 92055 - DNA, 25 bp, Artificial sequence
  SiRNA target sequence
tggtttacattgaaatgtatatata

SEQ ID NO: 92056 - DNA, 25 bp, Artificial sequence
  SiRNA target sequence
ggtttacattgaaatgtatatataa

SEQ ID NO: 92057 - DNA, 25 bp, Artificial sequence
  SiRNA target sequence
gtttacattgaaatgtatatataat

SEQ ID NO: 92058 - DNA, 25 bp, Artificial sequence
  SiRNA target sequence
tttacattgaaatgtatatataatg

SEQ ID NO: 92059 - DNA, 25 bp, Artificial sequence
  SiRNA target sequence
ttacattgaaatgtatatataatgt

SEQ ID NO: 92060 - DNA, 25 bp, Artificial sequence
  SiRNA target sequence
tacattgaaatgtatatataatgtc

SEQ ID NO: 92061 - DNA, 25 bp, Artificial sequence
  SiRNA target sequence
acattgaaatgtatatataatgtca

SEQ ID NO: 92062 - DNA, 25 bp, Artificial sequence
  SiRNA target sequence
cattgaaatgtatatataatgtcaa

SEQ ID NO: 92063 - DNA, 25 bp, Artificial sequence
  SiRNA target sequence
attgaaatgtatatataatgtcaag

SEQ ID NO: 92064 - DNA, 25 bp, Artificial sequence
  SiRNA target sequence
ttgaaatgtatatataatgtcaagc

SEQ ID NO: 92065 - DNA, 25 bp, Artificial sequence
  SiRNA target sequence
tgaaatgtatatataatgtcaagca

SEQ ID NO: 92066 - DNA, 25 bp, Artificial sequence
  SiRNA target sequence
gaaatgtatatataatgtcaagcac

SEQ ID NO: 92067 - DNA, 25 bp, Artificial sequence
  SiRNA target sequence
aaatgtatatataatgtcaagcaca

SEQ ID NO: 92068 - DNA, 25 bp, Artificial sequence
  SiRNA target sequence
aatgtatatataatgtcaagcacat

SEQ ID NO: 92069 - DNA, 25 bp, Artificial sequence
  SiRNA target sequence
atgtatatataatgtcaagcacatt

SEQ ID NO: 92070 - DNA, 25 bp, Artificial sequence
  SiRNA target sequence
tgtatatataatgtcaagcacatta

SEQ ID NO: 92071 - DNA, 25 bp, Artificial sequence
  SiRNA target sequence
gtatatataatgtcaagcacattat

SEQ ID NO: 92072 - DNA, 25 bp, Artificial sequence
  SiRNA target sequence
tatatataatgtcaagcacattatt

SEQ ID NO: 92073 - DNA, 25 bp, Artificial sequence
  SiRNA target sequence
atatataatgtcaagcacattattc

SEQ ID NO: 92074 - DNA, 25 bp, Artificial sequence
  SiRNA target sequence
tatataatgtcaagcacattattcc

SEQ ID NO: 92075 - DNA, 25 bp, Artificial sequence
  SiRNA target sequence
atataatgtcaagcacattattcca

SEQ ID NO: 92076 - DNA, 25 bp, Artificial sequence
  SiRNA target sequence
tataatgtcaagcacattattccag

SEQ ID NO: 92077 - DNA, 25 bp, Artificial sequence
  SiRNA target sequence
ataatgtcaagcacattattccagt

SEQ ID NO: 92078 - DNA, 25 bp, Artificial sequence
  SiRNA target sequence
taatgtcaagcacattattccagtt

SEQ ID NO: 92079 - DNA, 25 bp, Artificial sequence
  SiRNA target sequence
aatgtcaagcacattattccagttc

SEQ ID NO: 92080 - DNA, 25 bp, Artificial sequence
  SiRNA target sequence
atgtcaagcacattattccagttct

SEQ ID NO: 92081 - DNA, 25 bp, Artificial sequence
  SiRNA target sequence
tgtcaagcacattattccagttctt

SEQ ID NO: 92082 - DNA, 25 bp, Artificial sequence
  SiRNA target sequence
gtcaagcacattattccagttctta

SEQ ID NO: 92083 - DNA, 25 bp, Artificial sequence
  SiRNA target sequence
tcaagcacattattccagttcttaa

SEQ ID NO: 92084 - DNA, 25 bp, Artificial sequence
  SiRNA target sequence
caagcacattattccagttcttaat

SEQ ID NO: 92085 - DNA, 25 bp, Artificial sequence
  SiRNA target sequence
aagcacattattccagttcttaatg

SEQ ID NO: 92086 - DNA, 25 bp, Artificial sequence
  SiRNA target sequence
agcacattattccagttcttaatga

SEQ ID NO: 92087 - DNA, 25 bp, Artificial sequence
  SiRNA target sequence
gcacattattccagttcttaatgat

SEQ ID NO: 92088 - DNA, 25 bp, Artificial sequence
  SiRNA target sequence
cacattattccagttcttaatgatg

SEQ ID NO: 92089 - DNA, 25 bp, Artificial sequence
  SiRNA target sequence
acattattccagttcttaatgatgc

SEQ ID NO: 92090 - DNA, 25 bp, Artificial sequence
  SiRNA target sequence
cattattccagttcttaatgatgct

SEQ ID NO: 92091 - DNA, 25 bp, Artificial sequence
  SiRNA target sequence
attattccagttcttaatgatgctt

SEQ ID NO: 92092 - DNA, 25 bp, Artificial sequence
  SiRNA target sequence
ttattccagttcttaatgatgctta

SEQ ID NO: 92093 - DNA, 25 bp, Artificial sequence
  SiRNA target sequence
tattccagttcttaatgatgcttaa

SEQ ID NO: 92094 - DNA, 25 bp, Artificial sequence
  SiRNA target sequence
attccagttcttaatgatgcttaaa

SEQ ID NO: 92095 - DNA, 25 bp, Artificial sequence
  SiRNA target sequence
ttccagttcttaatgatgcttaaat

SEQ ID NO: 92096 - DNA, 25 bp, Artificial sequence
  SiRNA target sequence
tccagttcttaatgatgcttaaata

SEQ ID NO: 92097 - DNA, 25 bp, Artificial sequence
  SiRNA target sequence
ccagttcttaatgatgcttaaataa

SEQ ID NO: 92098 - DNA, 25 bp, Artificial sequence
  SiRNA target sequence
cagttcttaatgatgcttaaataat

SEQ ID NO: 92099 - DNA, 25 bp, Artificial sequence
  SiRNA target sequence
agttcttaatgatgcttaaataatc

SEQ ID NO: 92100 - DNA, 25 bp, Artificial sequence
  SiRNA target sequence
gttcttaatgatgcttaaataatct

SEQ ID NO: 92101 - DNA, 25 bp, Artificial sequence
  SiRNA target sequence
ttcttaatgatgcttaaataatctt

SEQ ID NO: 92102 - DNA, 25 bp, Artificial sequence
  SiRNA target sequence
tcttaatgatgcttaaataatcttt

SEQ ID NO: 92103 - DNA, 25 bp, Artificial sequence
  SiRNA target sequence
cttaatgatgcttaaataatctttt

SEQ ID NO: 92104 - DNA, 25 bp, Artificial sequence
  SiRNA target sequence
ttaatgatgcttaaataatctttta

SEQ ID NO: 92105 - DNA, 25 bp, Artificial sequence
  SiRNA target sequence
taatgatgcttaaataatcttttac

SEQ ID NO: 92106 - DNA, 25 bp, Artificial sequence
  SiRNA target sequence
aatgatgcttaaataatcttttact

SEQ ID NO: 92107 - DNA, 25 bp, Artificial sequence
  SiRNA target sequence
atgatgcttaaataatcttttactc

SEQ ID NO: 92108 - DNA, 25 bp, Artificial sequence
  SiRNA target sequence
tgatgcttaaataatcttttactcc

SEQ ID NO: 92109 - DNA, 25 bp, Artificial sequence
  SiRNA target sequence
gatgcttaaataatcttttactcct

SEQ ID NO: 92110 - DNA, 25 bp, Artificial sequence
  SiRNA target sequence
atgcttaaataatcttttactcctt

SEQ ID NO: 92111 - DNA, 25 bp, Artificial sequence
  SiRNA target sequence
tgcttaaataatcttttactccttc

SEQ ID NO: 92112 - DNA, 25 bp, Artificial sequence
  SiRNA target sequence
gcttaaataatcttttactccttct

SEQ ID NO: 92113 - DNA, 25 bp, Artificial sequence
  SiRNA target sequence
cttaaataatcttttactccttctt

SEQ ID NO: 92114 - DNA, 25 bp, Artificial sequence
  SiRNA target sequence
ttaaataatcttttactccttcttt

SEQ ID NO: 92115 - DNA, 25 bp, Artificial sequence
  SiRNA target sequence
taaataatcttttactccttcttta

SEQ ID NO: 92116 - DNA, 25 bp, Artificial sequence
  SiRNA target sequence
aaataatcttttactccttctttag

SEQ ID NO: 92117 - DNA, 25 bp, Artificial sequence
  SiRNA target sequence
aataatcttttactccttctttaga

SEQ ID NO: 92118 - DNA, 25 bp, Artificial sequence
  SiRNA target sequence
ataatcttttactccttctttagaa

SEQ ID NO: 92119 - DNA, 25 bp, Artificial sequence
  SiRNA target sequence
taatcttttactccttctttagaac

SEQ ID NO: 92120 - DNA, 25 bp, Artificial sequence
  SiRNA target sequence
aatcttttactccttctttagaaca

SEQ ID NO: 92121 - DNA, 25 bp, Artificial sequence
  SiRNA target sequence
atcttttactccttctttagaacac

SEQ ID NO: 92122 - DNA, 25 bp, Artificial sequence
  SiRNA target sequence
tcttttactccttctttagaacaca

SEQ ID NO: 92123 - DNA, 25 bp, Artificial sequence
  SiRNA target sequence
cttttactccttctttagaacacag

SEQ ID NO: 92124 - DNA, 25 bp, Artificial sequence
  SiRNA target sequence
ttttactccttctttagaacacaga

SEQ ID NO: 92125 - DNA, 25 bp, Artificial sequence
  SiRNA target sequence
tttactccttctttagaacacagat

SEQ ID NO: 92126 - DNA, 25 bp, Artificial sequence
  SiRNA target sequence
ttactccttctttagaacacagata

SEQ ID NO: 92127 - DNA, 25 bp, Artificial sequence
  SiRNA target sequence
tactccttctttagaacacagatat

SEQ ID NO: 92128 - DNA, 25 bp, Artificial sequence
  SiRNA target sequence
actccttctttagaacacagatatt

SEQ ID NO: 92129 - DNA, 25 bp, Artificial sequence
  SiRNA target sequence
ctccttctttagaacacagatattc

SEQ ID NO: 92130 - DNA, 25 bp, Artificial sequence
  SiRNA target sequence
tccttctttagaacacagatattca

SEQ ID NO: 92131 - DNA, 25 bp, Artificial sequence
  SiRNA target sequence
ccttctttagaacacagatattcaa

SEQ ID NO: 92132 - DNA, 25 bp, Artificial sequence
  SiRNA target sequence
cttctttagaacacagatattcaat

SEQ ID NO: 92133 - DNA, 25 bp, Artificial sequence
  SiRNA target sequence
ttctttagaacacagatattcaata

SEQ ID NO: 92134 - DNA, 25 bp, Artificial sequence
  SiRNA target sequence
tctttagaacacagatattcaatat

SEQ ID NO: 92135 - DNA, 25 bp, Artificial sequence
  SiRNA target sequence
ctttagaacacagatattcaatatc

SEQ ID NO: 92136 - DNA, 25 bp, Artificial sequence
  SiRNA target sequence
tttagaacacagatattcaatatca

SEQ ID NO: 92137 - DNA, 25 bp, Artificial sequence
  SiRNA target sequence
ttagaacacagatattcaatatcat

SEQ ID NO: 92138 - DNA, 25 bp, Artificial sequence
  SiRNA target sequence
tagaacacagatattcaatatcatg

SEQ ID NO: 92139 - DNA, 25 bp, Artificial sequence
  SiRNA target sequence
agaacacagatattcaatatcatgc

SEQ ID NO: 92140 - DNA, 25 bp, Artificial sequence
  SiRNA target sequence
gaacacagatattcaatatcatgct

SEQ ID NO: 92141 - DNA, 25 bp, Artificial sequence
  SiRNA target sequence
aacacagatattcaatatcatgctt

SEQ ID NO: 92142 - DNA, 25 bp, Artificial sequence
  SiRNA target sequence
acacagatattcaatatcatgctta

SEQ ID NO: 92143 - DNA, 25 bp, Artificial sequence
  SiRNA target sequence
cacagatattcaatatcatgcttat

SEQ ID NO: 92144 - DNA, 25 bp, Artificial sequence
  SiRNA target sequence
acagatattcaatatcatgcttatt

SEQ ID NO: 92145 - DNA, 25 bp, Artificial sequence
  SiRNA target sequence
cagatattcaatatcatgcttattt

SEQ ID NO: 92146 - DNA, 25 bp, Artificial sequence
  SiRNA target sequence
agatattcaatatcatgcttatttt

SEQ ID NO: 92147 - DNA, 25 bp, Artificial sequence
  SiRNA target sequence
gatattcaatatcatgcttattttt

SEQ ID NO: 92148 - DNA, 25 bp, Artificial sequence
  SiRNA target sequence
atattcaatatcatgcttattttta

SEQ ID NO: 92149 - DNA, 25 bp, Artificial sequence
  SiRNA target sequence
tattcaatatcatgcttatttttag

SEQ ID NO: 92150 - DNA, 25 bp, Artificial sequence
  SiRNA target sequence
attcaatatcatgcttatttttaga

SEQ ID NO: 92151 - DNA, 25 bp, Artificial sequence
  SiRNA target sequence
ttcaatatcatgcttatttttagag

SEQ ID NO: 92152 - DNA, 25 bp, Artificial sequence
  SiRNA target sequence
tcaatatcatgcttatttttagagg

SEQ ID NO: 92153 - DNA, 25 bp, Artificial sequence
  SiRNA target sequence
caatatcatgcttatttttagaggt

SEQ ID NO: 92154 - DNA, 25 bp, Artificial sequence
  SiRNA target sequence
aatatcatgcttatttttagaggtt

SEQ ID NO: 92155 - DNA, 25 bp, Artificial sequence
  SiRNA target sequence
atatcatgcttatttttagaggttt

SEQ ID NO: 92156 - DNA, 25 bp, Artificial sequence
  SiRNA target sequence
tatcatgcttatttttagaggtttt

SEQ ID NO: 92157 - DNA, 25 bp, Artificial sequence
  SiRNA target sequence
atcatgcttatttttagaggtttta

SEQ ID NO: 92158 - DNA, 25 bp, Artificial sequence
  SiRNA target sequence
tcatgcttatttttagaggttttag

SEQ ID NO: 92159 - DNA, 25 bp, Artificial sequence
  SiRNA target sequence
catgcttatttttagaggttttaga

SEQ ID NO: 92160 - DNA, 25 bp, Artificial sequence
  SiRNA target sequence
atgcttatttttagaggttttagaa

SEQ ID NO: 92161 - DNA, 25 bp, Artificial sequence
  SiRNA target sequence
tgcttatttttagaggttttagaaa

SEQ ID NO: 92162 - DNA, 25 bp, Artificial sequence
  SiRNA target sequence
gcttatttttagaggttttagaaat

SEQ ID NO: 92163 - DNA, 25 bp, Artificial sequence
  SiRNA target sequence
cttatttttagaggttttagaaata

SEQ ID NO: 92164 - DNA, 25 bp, Artificial sequence
  SiRNA target sequence
ttatttttagaggttttagaaatat

SEQ ID NO: 92165 - DNA, 25 bp, Artificial sequence
  SiRNA target sequence
tatttttagaggttttagaaatatc

SEQ ID NO: 92166 - DNA, 25 bp, Artificial sequence
  SiRNA target sequence
atttttagaggttttagaaatatcc

SEQ ID NO: 92167 - DNA, 25 bp, Artificial sequence
  SiRNA target sequence
tttttagaggttttagaaatatcca

SEQ ID NO: 92168 - DNA, 25 bp, Artificial sequence
  SiRNA target sequence
ttttagaggttttagaaatatccat

SEQ ID NO: 92169 - DNA, 25 bp, Artificial sequence
  SiRNA target sequence
tttagaggttttagaaatatccata

SEQ ID NO: 92170 - DNA, 25 bp, Artificial sequence
  SiRNA target sequence
ttagaggttttagaaatatccataa

SEQ ID NO: 92171 - DNA, 25 bp, Artificial sequence
  SiRNA target sequence
tagaggttttagaaatatccataag

SEQ ID NO: 92172 - DNA, 25 bp, Artificial sequence
  SiRNA target sequence
agaggttttagaaatatccataagc

SEQ ID NO: 92173 - DNA, 25 bp, Artificial sequence
  SiRNA target sequence
gaggttttagaaatatccataagcc

SEQ ID NO: 92174 - DNA, 25 bp, Artificial sequence
  SiRNA target sequence
aggttttagaaatatccataagcca

SEQ ID NO: 92175 - DNA, 25 bp, Artificial sequence
  SiRNA target sequence
ggttttagaaatatccataagccat

SEQ ID NO: 92176 - DNA, 25 bp, Artificial sequence
  SiRNA target sequence
gttttagaaatatccataagccatg

SEQ ID NO: 92177 - DNA, 25 bp, Artificial sequence
  SiRNA target sequence
ttttagaaatatccataagccatgc

SEQ ID NO: 92178 - DNA, 25 bp, Artificial sequence
  SiRNA target sequence
tttagaaatatccataagccatgct

SEQ ID NO: 92179 - DNA, 25 bp, Artificial sequence
  SiRNA target sequence
ttagaaatatccataagccatgctt

SEQ ID NO: 92180 - DNA, 25 bp, Artificial sequence
  SiRNA target sequence
tagaaatatccataagccatgcttt

SEQ ID NO: 92181 - DNA, 25 bp, Artificial sequence
  SiRNA target sequence
agaaatatccataagccatgctttt

SEQ ID NO: 92182 - DNA, 25 bp, Artificial sequence
  SiRNA target sequence
gaaatatccataagccatgcttttt

SEQ ID NO: 92183 - DNA, 25 bp, Artificial sequence
  SiRNA target sequence
aaatatccataagccatgctttttt

SEQ ID NO: 92184 - DNA, 25 bp, Artificial sequence
  SiRNA target sequence
aatatccataagccatgctttttta

SEQ ID NO: 92185 - DNA, 25 bp, Artificial sequence
  SiRNA target sequence
atatccataagccatgcttttttag

SEQ ID NO: 92186 - DNA, 25 bp, Artificial sequence
  SiRNA target sequence
tatccataagccatgcttttttagg

SEQ ID NO: 92187 - DNA, 25 bp, Artificial sequence
  SiRNA target sequence
atccataagccatgcttttttaggc

SEQ ID NO: 92188 - DNA, 25 bp, Artificial sequence
  SiRNA target sequence
tccataagccatgcttttttaggca

SEQ ID NO: 92189 - DNA, 25 bp, Artificial sequence
  SiRNA target sequence
ccataagccatgcttttttaggcaa

SEQ ID NO: 92190 - DNA, 25 bp, Artificial sequence
  SiRNA target sequence
cataagccatgcttttttaggcaat

SEQ ID NO: 92191 - DNA, 25 bp, Artificial sequence
  SiRNA target sequence
ataagccatgcttttttaggcaatg

SEQ ID NO: 92192 - DNA, 25 bp, Artificial sequence
  SiRNA target sequence
taagccatgcttttttaggcaatga

SEQ ID NO: 92193 - DNA, 25 bp, Artificial sequence
  SiRNA target sequence
aagccatgcttttttaggcaatgaa

SEQ ID NO: 92194 - DNA, 25 bp, Artificial sequence
  SiRNA target sequence
agccatgcttttttaggcaatgaag

SEQ ID NO: 92195 - DNA, 25 bp, Artificial sequence
  SiRNA target sequence
gccatgcttttttaggcaatgaagt

SEQ ID NO: 92196 - DNA, 25 bp, Artificial sequence
  SiRNA target sequence
ccatgcttttttaggcaatgaagta

SEQ ID NO: 92197 - DNA, 25 bp, Artificial sequence
  SiRNA target sequence
catgcttttttaggcaatgaagtaa

SEQ ID NO: 92198 - DNA, 25 bp, Artificial sequence
  SiRNA target sequence
atgcttttttaggcaatgaagtaaa

SEQ ID NO: 92199 - DNA, 25 bp, Artificial sequence
  SiRNA target sequence
tgcttttttaggcaatgaagtaaaa

SEQ ID NO: 92200 - DNA, 25 bp, Artificial sequence
  SiRNA target sequence
gcttttttaggcaatgaagtaaaat

SEQ ID NO: 92201 - DNA, 25 bp, Artificial sequence
  SiRNA target sequence
cttttttaggcaatgaagtaaaatc

SEQ ID NO: 92202 - DNA, 25 bp, Artificial sequence
  SiRNA target sequence
ttttttaggcaatgaagtaaaatca

SEQ ID NO: 92203 - DNA, 25 bp, Artificial sequence
  SiRNA target sequence
tttttaggcaatgaagtaaaatcaa

SEQ ID NO: 92204 - DNA, 25 bp, Artificial sequence
  SiRNA target sequence
ttttaggcaatgaagtaaaatcaaa

SEQ ID NO: 92205 - DNA, 25 bp, Artificial sequence
  SiRNA target sequence
tttaggcaatgaagtaaaatcaaaa

SEQ ID NO: 92206 - DNA, 25 bp, Artificial sequence
  SiRNA target sequence
ttaggcaatgaagtaaaatcaaaaa

SEQ ID NO: 92207 - DNA, 25 bp, Artificial sequence
  SiRNA target sequence
taggcaatgaagtaaaatcaaaaat

SEQ ID NO: 92208 - DNA, 25 bp, Artificial sequence
  SiRNA target sequence
aggcaatgaagtaaaatcaaaaata

SEQ ID NO: 92209 - DNA, 25 bp, Artificial sequence
  SiRNA target sequence
ggcaatgaagtaaaatcaaaaatat

SEQ ID NO: 92210 - DNA, 25 bp, Artificial sequence
  SiRNA target sequence
gcaatgaagtaaaatcaaaaatata

SEQ ID NO: 92211 - DNA, 25 bp, Artificial sequence
  SiRNA target sequence
caatgaagtaaaatcaaaaatatac

SEQ ID NO: 92212 - DNA, 25 bp, Artificial sequence
  SiRNA target sequence
aatgaagtaaaatcaaaaatatact

SEQ ID NO: 92213 - DNA, 25 bp, Artificial sequence
  SiRNA target sequence
atgaagtaaaatcaaaaatatactt

SEQ ID NO: 92214 - DNA, 25 bp, Artificial sequence
  SiRNA target sequence
tgaagtaaaatcaaaaatatacttg

SEQ ID NO: 92215 - DNA, 25 bp, Artificial sequence
  SiRNA target sequence
gaagtaaaatcaaaaatatacttga

SEQ ID NO: 92216 - DNA, 25 bp, Artificial sequence
  SiRNA target sequence
aagtaaaatcaaaaatatacttgaa

SEQ ID NO: 92217 - DNA, 25 bp, Artificial sequence
  SiRNA target sequence
agtaaaatcaaaaatatacttgaaa

SEQ ID NO: 92218 - DNA, 25 bp, Artificial sequence
  SiRNA target sequence
gtaaaatcaaaaatatacttgaaaa

SEQ ID NO: 92219 - DNA, 25 bp, Artificial sequence
  SiRNA target sequence
taaaatcaaaaatatacttgaaaaa

SEQ ID NO: 92220 - DNA, 25 bp, Artificial sequence
  SiRNA target sequence
aaaatcaaaaatatacttgaaaaag

SEQ ID NO: 92221 - DNA, 25 bp, Artificial sequence
  SiRNA target sequence
aaatcaaaaatatacttgaaaaagt

SEQ ID NO: 92222 - DNA, 25 bp, Artificial sequence
  SiRNA target sequence
aatcaaaaatatacttgaaaaagtc

SEQ ID NO: 92223 - DNA, 25 bp, Artificial sequence
  SiRNA target sequence
atcaaaaatatacttgaaaaagtca

SEQ ID NO: 92224 - DNA, 25 bp, Artificial sequence
  SiRNA target sequence
tcaaaaatatacttgaaaaagtcac

SEQ ID NO: 92225 - DNA, 25 bp, Artificial sequence
  SiRNA target sequence
caaaaatatacttgaaaaagtcacg

SEQ ID NO: 92226 - DNA, 25 bp, Artificial sequence
  SiRNA target sequence
aaaaatatacttgaaaaagtcacgc

SEQ ID NO: 92227 - DNA, 25 bp, Artificial sequence
  SiRNA target sequence
aaaatatacttgaaaaagtcacgca

SEQ ID NO: 92228 - DNA, 25 bp, Artificial sequence
  SiRNA target sequence
aaatatacttgaaaaagtcacgcaa

SEQ ID NO: 92229 - DNA, 25 bp, Artificial sequence
  SiRNA target sequence
aatatacttgaaaaagtcacgcaaa

SEQ ID NO: 92230 - DNA, 25 bp, Artificial sequence
  SiRNA target sequence
atatacttgaaaaagtcacgcaaag

SEQ ID NO: 92231 - DNA, 25 bp, Artificial sequence
  SiRNA target sequence
tatacttgaaaaagtcacgcaaaga

SEQ ID NO: 92232 - DNA, 25 bp, Artificial sequence
  SiRNA target sequence
atacttgaaaaagtcacgcaaagat

SEQ ID NO: 92233 - DNA, 25 bp, Artificial sequence
  SiRNA target sequence
tacttgaaaaagtcacgcaaagatc

SEQ ID NO: 92234 - DNA, 25 bp, Artificial sequence
  SiRNA target sequence
acttgaaaaagtcacgcaaagatcc

SEQ ID NO: 92235 - DNA, 25 bp, Artificial sequence
  SiRNA target sequence
cttgaaaaagtcacgcaaagatcct

SEQ ID NO: 92236 - DNA, 25 bp, Artificial sequence
  SiRNA target sequence
ttgaaaaagtcacgcaaagatcctt

SEQ ID NO: 92237 - DNA, 25 bp, Artificial sequence
  SiRNA target sequence
tgaaaaagtcacgcaaagatccttc

SEQ ID NO: 92238 - DNA, 25 bp, Artificial sequence
  SiRNA target sequence
gaaaaagtcacgcaaagatccttcg

SEQ ID NO: 92239 - DNA, 25 bp, Artificial sequence
  SiRNA target sequence
aaaaagtcacgcaaagatccttcga

SEQ ID NO: 92240 - DNA, 25 bp, Artificial sequence
  SiRNA target sequence
aaaagtcacgcaaagatccttcgaa

SEQ ID NO: 92241 - DNA, 25 bp, Artificial sequence
  SiRNA target sequence
aaagtcacgcaaagatccttcgaat

SEQ ID NO: 92242 - DNA, 25 bp, Artificial sequence
  SiRNA target sequence
aagtcacgcaaagatccttcgaatt

SEQ ID NO: 92243 - DNA, 25 bp, Artificial sequence
  SiRNA target sequence
agtcacgcaaagatccttcgaattg

SEQ ID NO: 92244 - DNA, 25 bp, Artificial sequence
  SiRNA target sequence
gtcacgcaaagatccttcgaattga

SEQ ID NO: 92245 - DNA, 25 bp, Artificial sequence
  SiRNA target sequence
tcacgcaaagatccttcgaattgaa

SEQ ID NO: 92246 - DNA, 25 bp, Artificial sequence
  SiRNA target sequence
cacgcaaagatccttcgaattgaaa

SEQ ID NO: 92247 - DNA, 25 bp, Artificial sequence
  SiRNA target sequence
acgcaaagatccttcgaattgaaac

SEQ ID NO: 92248 - DNA, 25 bp, Artificial sequence
  SiRNA target sequence
cgcaaagatccttcgaattgaaacc

SEQ ID NO: 92249 - DNA, 25 bp, Artificial sequence
  SiRNA target sequence
gcaaagatccttcgaattgaaaccc

SEQ ID NO: 92250 - DNA, 25 bp, Artificial sequence
  SiRNA target sequence
caaagatccttcgaattgaaacccc

SEQ ID NO: 92251 - DNA, 25 bp, Artificial sequence
  SiRNA target sequence
aaagatccttcgaattgaaaccccg

SEQ ID NO: 92252 - DNA, 25 bp, Artificial sequence
  SiRNA target sequence
aagatccttcgaattgaaaccccgt

SEQ ID NO: 92253 - DNA, 25 bp, Artificial sequence
  SiRNA target sequence
agatccttcgaattgaaaccccgtt

SEQ ID NO: 92254 - DNA, 25 bp, Artificial sequence
  SiRNA target sequence
gatccttcgaattgaaaccccgttt

SEQ ID NO: 92255 - DNA, 25 bp, Artificial sequence
  SiRNA target sequence
atccttcgaattgaaaccccgtttt

SEQ ID NO: 92256 - DNA, 25 bp, Artificial sequence
  SiRNA target sequence
tccttcgaattgaaaccccgttttt

SEQ ID NO: 92257 - DNA, 25 bp, Artificial sequence
  SiRNA target sequence
ccttcgaattgaaaccccgtttttc

SEQ ID NO: 92258 - DNA, 25 bp, Artificial sequence
  SiRNA target sequence
cttcgaattgaaaccccgtttttcc

SEQ ID NO: 92259 - DNA, 25 bp, Artificial sequence
  SiRNA target sequence
ttcgaattgaaaccccgtttttcca

SEQ ID NO: 92260 - DNA, 25 bp, Artificial sequence
  SiRNA target sequence
tcgaattgaaaccccgtttttccaa

SEQ ID NO: 92261 - DNA, 25 bp, Artificial sequence
  SiRNA target sequence
cgaattgaaaccccgtttttccaac

SEQ ID NO: 92262 - DNA, 25 bp, Artificial sequence
  SiRNA target sequence
gaattgaaaccccgtttttccaact

SEQ ID NO: 92263 - DNA, 25 bp, Artificial sequence
  SiRNA target sequence
aattgaaaccccgtttttccaactt

SEQ ID NO: 92264 - DNA, 25 bp, Artificial sequence
  SiRNA target sequence
attgaaaccccgtttttccaacttg

SEQ ID NO: 92265 - DNA, 25 bp, Artificial sequence
  SiRNA target sequence
ttgaaaccccgtttttccaacttgc

SEQ ID NO: 92266 - DNA, 25 bp, Artificial sequence
  SiRNA target sequence
tgaaaccccgtttttccaacttgct

SEQ ID NO: 92267 - DNA, 25 bp, Artificial sequence
  SiRNA target sequence
gaaaccccgtttttccaacttgctc

SEQ ID NO: 92268 - DNA, 25 bp, Artificial sequence
  SiRNA target sequence
aaaccccgtttttccaacttgctca

SEQ ID NO: 92269 - DNA, 25 bp, Artificial sequence
  SiRNA target sequence
aaccccgtttttccaacttgctcaa

SEQ ID NO: 92270 - DNA, 25 bp, Artificial sequence
  SiRNA target sequence
accccgtttttccaacttgctcaat

SEQ ID NO: 92271 - DNA, 25 bp, Artificial sequence
  SiRNA target sequence
ccccgtttttccaacttgctcaata

SEQ ID NO: 92272 - DNA, 25 bp, Artificial sequence
  SiRNA target sequence
cccgtttttccaacttgctcaatat

SEQ ID NO: 92273 - DNA, 25 bp, Artificial sequence
  SiRNA target sequence
ccgtttttccaacttgctcaatata

SEQ ID NO: 92274 - DNA, 25 bp, Artificial sequence
  SiRNA target sequence
cgtttttccaacttgctcaatatat

SEQ ID NO: 92275 - DNA, 25 bp, Artificial sequence
  SiRNA target sequence
gtttttccaacttgctcaatatata

SEQ ID NO: 92276 - DNA, 25 bp, Artificial sequence
  SiRNA target sequence
tttttccaacttgctcaatatataa

SEQ ID NO: 92277 - DNA, 25 bp, Artificial sequence
  SiRNA target sequence
ttttccaacttgctcaatatataat

SEQ ID NO: 92278 - DNA, 25 bp, Artificial sequence
  SiRNA target sequence
tttccaacttgctcaatatataata

SEQ ID NO: 92279 - DNA, 25 bp, Artificial sequence
  SiRNA target sequence
ttccaacttgctcaatatataataa

SEQ ID NO: 92280 - DNA, 25 bp, Artificial sequence
  SiRNA target sequence
tccaacttgctcaatatataataat

SEQ ID NO: 92281 - DNA, 25 bp, Artificial sequence
  SiRNA target sequence
ccaacttgctcaatatataataatg

SEQ ID NO: 92282 - DNA, 25 bp, Artificial sequence
  SiRNA target sequence
caacttgctcaatatataataatgt

SEQ ID NO: 92283 - DNA, 25 bp, Artificial sequence
  SiRNA target sequence
aacttgctcaatatataataatgta

SEQ ID NO: 92284 - DNA, 25 bp, Artificial sequence
  SiRNA target sequence
acttgctcaatatataataatgtat

SEQ ID NO: 92285 - DNA, 25 bp, Artificial sequence
  SiRNA target sequence
cttgctcaatatataataatgtatc

SEQ ID NO: 92286 - DNA, 25 bp, Artificial sequence
  SiRNA target sequence
ttgctcaatatataataatgtatca

SEQ ID NO: 92287 - DNA, 25 bp, Artificial sequence
  SiRNA target sequence
tgctcaatatataataatgtatcac

SEQ ID NO: 92288 - DNA, 25 bp, Artificial sequence
  SiRNA target sequence
gctcaatatataataatgtatcacc

SEQ ID NO: 92289 - DNA, 25 bp, Artificial sequence
  SiRNA target sequence
ctcaatatataataatgtatcacca

SEQ ID NO: 92290 - DNA, 25 bp, Artificial sequence
  SiRNA target sequence
tcaatatataataatgtatcaccag

SEQ ID NO: 92291 - DNA, 25 bp, Artificial sequence
  SiRNA target sequence
caatatataataatgtatcaccaga

SEQ ID NO: 92292 - DNA, 25 bp, Artificial sequence
  SiRNA target sequence
aatatataataatgtatcaccagac

SEQ ID NO: 92293 - DNA, 25 bp, Artificial sequence
  SiRNA target sequence
atatataataatgtatcaccagaca

SEQ ID NO: 92294 - DNA, 25 bp, Artificial sequence
  SiRNA target sequence
tatataataatgtatcaccagacat

SEQ ID NO: 92295 - DNA, 25 bp, Artificial sequence
  SiRNA target sequence
atataataatgtatcaccagacatt

SEQ ID NO: 92296 - DNA, 25 bp, Artificial sequence
  SiRNA target sequence
tataataatgtatcaccagacattt

SEQ ID NO: 92297 - DNA, 25 bp, Artificial sequence
  SiRNA target sequence
ataataatgtatcaccagacatttc

SEQ ID NO: 92298 - DNA, 25 bp, Artificial sequence
  SiRNA target sequence
taataatgtatcaccagacatttct

SEQ ID NO: 92299 - DNA, 25 bp, Artificial sequence
  SiRNA target sequence
aataatgtatcaccagacatttcta

SEQ ID NO: 92300 - DNA, 25 bp, Artificial sequence
  SiRNA target sequence
ataatgtatcaccagacatttctag

SEQ ID NO: 92301 - DNA, 25 bp, Artificial sequence
  SiRNA target sequence
taatgtatcaccagacatttctagt

SEQ ID NO: 92302 - DNA, 25 bp, Artificial sequence
  SiRNA target sequence
aatgtatcaccagacatttctagta

SEQ ID NO: 92303 - DNA, 25 bp, Artificial sequence
  SiRNA target sequence
atgtatcaccagacatttctagtaa

SEQ ID NO: 92304 - DNA, 25 bp, Artificial sequence
  SiRNA target sequence
tgtatcaccagacatttctagtaaa

SEQ ID NO: 92305 - DNA, 25 bp, Artificial sequence
  SiRNA target sequence
gtatcaccagacatttctagtaaac

SEQ ID NO: 92306 - DNA, 25 bp, Artificial sequence
  SiRNA target sequence
tatcaccagacatttctagtaaact

SEQ ID NO: 92307 - DNA, 25 bp, Artificial sequence
  SiRNA target sequence
atcaccagacatttctagtaaactt

SEQ ID NO: 92308 - DNA, 25 bp, Artificial sequence
  SiRNA target sequence
tcaccagacatttctagtaaactta

SEQ ID NO: 92309 - DNA, 25 bp, Artificial sequence
  SiRNA target sequence
caccagacatttctagtaaacttaa

SEQ ID NO: 92310 - DNA, 25 bp, Artificial sequence
  SiRNA target sequence
accagacatttctagtaaacttaac

SEQ ID NO: 92311 - DNA, 25 bp, Artificial sequence
  SiRNA target sequence
ccagacatttctagtaaacttaaca

SEQ ID NO: 92312 - DNA, 25 bp, Artificial sequence
  SiRNA target sequence
cagacatttctagtaaacttaacat

SEQ ID NO: 92313 - DNA, 25 bp, Artificial sequence
  SiRNA target sequence
agacatttctagtaaacttaacatt

SEQ ID NO: 92314 - DNA, 25 bp, Artificial sequence
  SiRNA target sequence
gacatttctagtaaacttaacattt

SEQ ID NO: 92315 - DNA, 25 bp, Artificial sequence
  SiRNA target sequence
acatttctagtaaacttaacatttc

SEQ ID NO: 92316 - DNA, 25 bp, Artificial sequence
  SiRNA target sequence
catttctagtaaacttaacatttca

SEQ ID NO: 92317 - DNA, 25 bp, Artificial sequence
  SiRNA target sequence
atttctagtaaacttaacatttcat

SEQ ID NO: 92318 - DNA, 25 bp, Artificial sequence
  SiRNA target sequence
tttctagtaaacttaacatttcatt

SEQ ID NO: 92319 - DNA, 25 bp, Artificial sequence
  SiRNA target sequence
ttctagtaaacttaacatttcatta

SEQ ID NO: 92320 - DNA, 25 bp, Artificial sequence
  SiRNA target sequence
tctagtaaacttaacatttcattaa

SEQ ID NO: 92321 - DNA, 25 bp, Artificial sequence
  SiRNA target sequence
ctagtaaacttaacatttcattaac

SEQ ID NO: 92322 - DNA, 25 bp, Artificial sequence
  SiRNA target sequence
tagtaaacttaacatttcattaaca

SEQ ID NO: 92323 - DNA, 25 bp, Artificial sequence
  SiRNA target sequence
agtaaacttaacatttcattaacaa

SEQ ID NO: 92324 - DNA, 25 bp, Artificial sequence
  SiRNA target sequence
gtaaacttaacatttcattaacaag

SEQ ID NO: 92325 - DNA, 25 bp, Artificial sequence
  SiRNA target sequence
taaacttaacatttcattaacaagc

SEQ ID NO: 92326 - DNA, 25 bp, Artificial sequence
  SiRNA target sequence
aaacttaacatttcattaacaagca

SEQ ID NO: 92327 - DNA, 25 bp, Artificial sequence
  SiRNA target sequence
aacttaacatttcattaacaagcaa

SEQ ID NO: 92328 - DNA, 25 bp, Artificial sequence
  SiRNA target sequence
acttaacatttcattaacaagcaaa

SEQ ID NO: 92329 - DNA, 25 bp, Artificial sequence
  SiRNA target sequence
cttaacatttcattaacaagcaaat

SEQ ID NO: 92330 - DNA, 25 bp, Artificial sequence
  SiRNA target sequence
ttaacatttcattaacaagcaaatc

SEQ ID NO: 92331 - DNA, 25 bp, Artificial sequence
  SiRNA target sequence
taacatttcattaacaagcaaatca

SEQ ID NO: 92332 - DNA, 25 bp, Artificial sequence
  SiRNA target sequence
aacatttcattaacaagcaaatcat

SEQ ID NO: 92333 - DNA, 25 bp, Artificial sequence
  SiRNA target sequence
acatttcattaacaagcaaatcatt

SEQ ID NO: 92334 - DNA, 25 bp, Artificial sequence
  SiRNA target sequence
catttcattaacaagcaaatcatta

SEQ ID NO: 92335 - DNA, 25 bp, Artificial sequence
  SiRNA target sequence
atttcattaacaagcaaatcattat

SEQ ID NO: 92336 - DNA, 25 bp, Artificial sequence
  SiRNA target sequence
tttcattaacaagcaaatcattatt

SEQ ID NO: 92337 - DNA, 25 bp, Artificial sequence
  SiRNA target sequence
ttcattaacaagcaaatcattattt

SEQ ID NO: 92338 - DNA, 25 bp, Artificial sequence
  SiRNA target sequence
tcattaacaagcaaatcattatttg

SEQ ID NO: 92339 - DNA, 25 bp, Artificial sequence
  SiRNA target sequence
cattaacaagcaaatcattatttga

SEQ ID NO: 92340 - DNA, 25 bp, Artificial sequence
  SiRNA target sequence
attaacaagcaaatcattatttgaa

SEQ ID NO: 92341 - DNA, 25 bp, Artificial sequence
  SiRNA target sequence
ttaacaagcaaatcattatttgaac

SEQ ID NO: 92342 - DNA, 25 bp, Artificial sequence
  SiRNA target sequence
taacaagcaaatcattatttgaaca

SEQ ID NO: 92343 - DNA, 25 bp, Artificial sequence
  SiRNA target sequence
aacaagcaaatcattatttgaacaa

SEQ ID NO: 92344 - DNA, 25 bp, Artificial sequence
  SiRNA target sequence
acaagcaaatcattatttgaacaaa

SEQ ID NO: 92345 - DNA, 25 bp, Artificial sequence
  SiRNA target sequence
caagcaaatcattatttgaacaaag

SEQ ID NO: 92346 - DNA, 25 bp, Artificial sequence
  SiRNA target sequence
aagcaaatcattatttgaacaaagt

SEQ ID NO: 92347 - DNA, 25 bp, Artificial sequence
  SiRNA target sequence
agcaaatcattatttgaacaaagta

SEQ ID NO: 92348 - DNA, 25 bp, Artificial sequence
  SiRNA target sequence
gcaaatcattatttgaacaaagtag

SEQ ID NO: 92349 - DNA, 25 bp, Artificial sequence
  SiRNA target sequence
caaatcattatttgaacaaagtaga

SEQ ID NO: 92350 - DNA, 25 bp, Artificial sequence
  SiRNA target sequence
aaatcattatttgaacaaagtagac

SEQ ID NO: 92351 - DNA, 25 bp, Artificial sequence
  SiRNA target sequence
aatcattatttgaacaaagtagacc

SEQ ID NO: 92352 - DNA, 25 bp, Artificial sequence
  SiRNA target sequence
atcattatttgaacaaagtagacca

SEQ ID NO: 92353 - DNA, 25 bp, Artificial sequence
  SiRNA target sequence
tcattatttgaacaaagtagaccaa

SEQ ID NO: 92354 - DNA, 25 bp, Artificial sequence
  SiRNA target sequence
cattatttgaacaaagtagaccaat

SEQ ID NO: 92355 - DNA, 25 bp, Artificial sequence
  SiRNA target sequence
attatttgaacaaagtagaccaata

SEQ ID NO: 92356 - DNA, 25 bp, Artificial sequence
  SiRNA target sequence
ttatttgaacaaagtagaccaatac

SEQ ID NO: 92357 - DNA, 25 bp, Artificial sequence
  SiRNA target sequence
tatttgaacaaagtagaccaatact

SEQ ID NO: 92358 - DNA, 25 bp, Artificial sequence
  SiRNA target sequence
atttgaacaaagtagaccaatacta

SEQ ID NO: 92359 - DNA, 25 bp, Artificial sequence
  SiRNA target sequence
tttgaacaaagtagaccaatactat

SEQ ID NO: 92360 - DNA, 25 bp, Artificial sequence
  SiRNA target sequence
ttgaacaaagtagaccaatactatc

SEQ ID NO: 92361 - DNA, 25 bp, Artificial sequence
  SiRNA target sequence
tgaacaaagtagaccaatactatca

SEQ ID NO: 92362 - DNA, 25 bp, Artificial sequence
  SiRNA target sequence
gaacaaagtagaccaatactatcac

SEQ ID NO: 92363 - DNA, 25 bp, Artificial sequence
  SiRNA target sequence
aacaaagtagaccaatactatcacc

SEQ ID NO: 92364 - DNA, 25 bp, Artificial sequence
  SiRNA target sequence
acaaagtagaccaatactatcacca

SEQ ID NO: 92365 - DNA, 25 bp, Artificial sequence
  SiRNA target sequence
caaagtagaccaatactatcaccag

SEQ ID NO: 92366 - DNA, 25 bp, Artificial sequence
  SiRNA target sequence
aaagtagaccaatactatcaccagg

SEQ ID NO: 92367 - DNA, 25 bp, Artificial sequence
  SiRNA target sequence
aagtagaccaatactatcaccagga

SEQ ID NO: 92368 - DNA, 25 bp, Artificial sequence
  SiRNA target sequence
agtagaccaatactatcaccaggaa

SEQ ID NO: 92369 - DNA, 25 bp, Artificial sequence
  SiRNA target sequence
gtagaccaatactatcaccaggaac

SEQ ID NO: 92370 - DNA, 25 bp, Artificial sequence
  SiRNA target sequence
tagaccaatactatcaccaggaaca

SEQ ID NO: 92371 - DNA, 25 bp, Artificial sequence
  SiRNA target sequence
agaccaatactatcaccaggaacaa

SEQ ID NO: 92372 - DNA, 25 bp, Artificial sequence
  SiRNA target sequence
gaccaatactatcaccaggaacaaa

SEQ ID NO: 92373 - DNA, 25 bp, Artificial sequence
  SiRNA target sequence
accaatactatcaccaggaacaaaa

SEQ ID NO: 92374 - DNA, 25 bp, Artificial sequence
  SiRNA target sequence
ccaatactatcaccaggaacaaaat

SEQ ID NO: 92375 - DNA, 25 bp, Artificial sequence
  SiRNA target sequence
caatactatcaccaggaacaaaatc

SEQ ID NO: 92376 - DNA, 25 bp, Artificial sequence
  SiRNA target sequence
aatactatcaccaggaacaaaatct

SEQ ID NO: 92377 - DNA, 25 bp, Artificial sequence
  SiRNA target sequence
atactatcaccaggaacaaaatcta

SEQ ID NO: 92378 - DNA, 25 bp, Artificial sequence
  SiRNA target sequence
tactatcaccaggaacaaaatctaa

SEQ ID NO: 92379 - DNA, 25 bp, Artificial sequence
  SiRNA target sequence
actatcaccaggaacaaaatctaat

SEQ ID NO: 92380 - DNA, 25 bp, Artificial sequence
  SiRNA target sequence
ctatcaccaggaacaaaatctaatg

SEQ ID NO: 92381 - DNA, 25 bp, Artificial sequence
  SiRNA target sequence
tatcaccaggaacaaaatctaatgt

SEQ ID NO: 92382 - DNA, 25 bp, Artificial sequence
  SiRNA target sequence
atcaccaggaacaaaatctaatgta

SEQ ID NO: 92383 - DNA, 25 bp, Artificial sequence
  SiRNA target sequence
tcaccaggaacaaaatctaatgtat

SEQ ID NO: 92384 - DNA, 25 bp, Artificial sequence
  SiRNA target sequence
caccaggaacaaaatctaatgtata

SEQ ID NO: 92385 - DNA, 25 bp, Artificial sequence
  SiRNA target sequence
accaggaacaaaatctaatgtataa

SEQ ID NO: 92386 - DNA, 25 bp, Artificial sequence
  SiRNA target sequence
ccaggaacaaaatctaatgtataat

SEQ ID NO: 92387 - DNA, 25 bp, Artificial sequence
  SiRNA target sequence
caggaacaaaatctaatgtataatt

SEQ ID NO: 92388 - DNA, 25 bp, Artificial sequence
  SiRNA target sequence
aggaacaaaatctaatgtataatta

SEQ ID NO: 92389 - DNA, 25 bp, Artificial sequence
  SiRNA target sequence
ggaacaaaatctaatgtataattaa

SEQ ID NO: 92390 - DNA, 25 bp, Artificial sequence
  SiRNA target sequence
gaacaaaatctaatgtataattaag

SEQ ID NO: 92391 - DNA, 25 bp, Artificial sequence
  SiRNA target sequence
aacaaaatctaatgtataattaagt

SEQ ID NO: 92392 - DNA, 25 bp, Artificial sequence
  SiRNA target sequence
acaaaatctaatgtataattaagtt

SEQ ID NO: 92393 - DNA, 25 bp, Artificial sequence
  SiRNA target sequence
caaaatctaatgtataattaagttg

SEQ ID NO: 92394 - DNA, 25 bp, Artificial sequence
  SiRNA target sequence
aaaatctaatgtataattaagttga

SEQ ID NO: 92395 - DNA, 25 bp, Artificial sequence
  SiRNA target sequence
aaatctaatgtataattaagttgaa

SEQ ID NO: 92396 - DNA, 25 bp, Artificial sequence
  SiRNA target sequence
aatctaatgtataattaagttgaac

SEQ ID NO: 92397 - DNA, 25 bp, Artificial sequence
  SiRNA target sequence
atctaatgtataattaagttgaacc

SEQ ID NO: 92398 - DNA, 25 bp, Artificial sequence
  SiRNA target sequence
tctaatgtataattaagttgaacct

SEQ ID NO: 92399 - DNA, 25 bp, Artificial sequence
  SiRNA target sequence
ctaatgtataattaagttgaacctt

SEQ ID NO: 92400 - DNA, 25 bp, Artificial sequence
  SiRNA target sequence
taatgtataattaagttgaacctta

SEQ ID NO: 92401 - DNA, 25 bp, Artificial sequence
  SiRNA target sequence
aatgtataattaagttgaaccttat

SEQ ID NO: 92402 - DNA, 25 bp, Artificial sequence
  SiRNA target sequence
atgtataattaagttgaaccttata

SEQ ID NO: 92403 - DNA, 25 bp, Artificial sequence
  SiRNA target sequence
tgtataattaagttgaaccttatat

SEQ ID NO: 92404 - DNA, 25 bp, Artificial sequence
  SiRNA target sequence
gtataattaagttgaaccttatata

SEQ ID NO: 92405 - DNA, 25 bp, Artificial sequence
  SiRNA target sequence
tataattaagttgaaccttatatac

SEQ ID NO: 92406 - DNA, 25 bp, Artificial sequence
  SiRNA target sequence
ataattaagttgaaccttatatacc

SEQ ID NO: 92407 - DNA, 25 bp, Artificial sequence
  SiRNA target sequence
taattaagttgaaccttatatacct

SEQ ID NO: 92408 - DNA, 25 bp, Artificial sequence
  SiRNA target sequence
aattaagttgaaccttatatacctt

SEQ ID NO: 92409 - DNA, 25 bp, Artificial sequence
  SiRNA target sequence
attaagttgaaccttatataccttt

SEQ ID NO: 92410 - DNA, 25 bp, Artificial sequence
  SiRNA target sequence
ttaagttgaaccttatatacctttt

SEQ ID NO: 92411 - DNA, 25 bp, Artificial sequence
  SiRNA target sequence
taagttgaaccttatataccttttt

SEQ ID NO: 92412 - DNA, 25 bp, Artificial sequence
  SiRNA target sequence
aagttgaaccttatatacctttttc

SEQ ID NO: 92413 - DNA, 25 bp, Artificial sequence
  SiRNA target sequence
agttgaaccttatatacctttttcc

SEQ ID NO: 92414 - DNA, 25 bp, Artificial sequence
  SiRNA target sequence
gttgaaccttatatacctttttcca

SEQ ID NO: 92415 - DNA, 25 bp, Artificial sequence
  SiRNA target sequence
ttgaaccttatatacctttttccat

SEQ ID NO: 92416 - DNA, 25 bp, Artificial sequence
  SiRNA target sequence
tgaaccttatatacctttttccatg

SEQ ID NO: 92417 - DNA, 25 bp, Artificial sequence
  SiRNA target sequence
gaaccttatatacctttttccatgt

SEQ ID NO: 92418 - DNA, 25 bp, Artificial sequence
  SiRNA target sequence
aaccttatatacctttttccatgta

SEQ ID NO: 92419 - DNA, 25 bp, Artificial sequence
  SiRNA target sequence
accttatatacctttttccatgtac

SEQ ID NO: 92420 - DNA, 25 bp, Artificial sequence
  SiRNA target sequence
ccttatatacctttttccatgtaca

SEQ ID NO: 92421 - DNA, 25 bp, Artificial sequence
  SiRNA target sequence
cttatatacctttttccatgtacag

SEQ ID NO: 92422 - DNA, 25 bp, Artificial sequence
  SiRNA target sequence
ttatatacctttttccatgtacagg

SEQ ID NO: 92423 - DNA, 25 bp, Artificial sequence
  SiRNA target sequence
tatatacctttttccatgtacagga

SEQ ID NO: 92424 - DNA, 25 bp, Artificial sequence
  SiRNA target sequence
atatacctttttccatgtacaggaa

SEQ ID NO: 92425 - DNA, 25 bp, Artificial sequence
  SiRNA target sequence
tatacctttttccatgtacaggaaa

SEQ ID NO: 92426 - DNA, 25 bp, Artificial sequence
  SiRNA target sequence
atacctttttccatgtacaggaaag

SEQ ID NO: 92427 - DNA, 25 bp, Artificial sequence
  SiRNA target sequence
tacctttttccatgtacaggaaagg

SEQ ID NO: 92428 - DNA, 25 bp, Artificial sequence
  SiRNA target sequence
acctttttccatgtacaggaaaggt

SEQ ID NO: 92429 - DNA, 25 bp, Artificial sequence
  SiRNA target sequence
cctttttccatgtacaggaaaggtt

SEQ ID NO: 92430 - DNA, 25 bp, Artificial sequence
  SiRNA target sequence
ctttttccatgtacaggaaaggttt

SEQ ID NO: 92431 - DNA, 25 bp, Artificial sequence
  SiRNA target sequence
tttttccatgtacaggaaaggtttt

SEQ ID NO: 92432 - DNA, 25 bp, Artificial sequence
  SiRNA target sequence
ttttccatgtacaggaaaggttttc

SEQ ID NO: 92433 - DNA, 25 bp, Artificial sequence
  SiRNA target sequence
tttccatgtacaggaaaggttttca

SEQ ID NO: 92434 - DNA, 25 bp, Artificial sequence
  SiRNA target sequence
ttccatgtacaggaaaggttttcaa

SEQ ID NO: 92435 - DNA, 25 bp, Artificial sequence
  SiRNA target sequence
tccatgtacaggaaaggttttcaat

SEQ ID NO: 92436 - DNA, 25 bp, Artificial sequence
  SiRNA target sequence
ccatgtacaggaaaggttttcaata

SEQ ID NO: 92437 - DNA, 25 bp, Artificial sequence
  SiRNA target sequence
catgtacaggaaaggttttcaatat

SEQ ID NO: 92438 - DNA, 25 bp, Artificial sequence
  SiRNA target sequence
atgtacaggaaaggttttcaatatt

SEQ ID NO: 92439 - DNA, 25 bp, Artificial sequence
  SiRNA target sequence
tgtacaggaaaggttttcaatattt

SEQ ID NO: 92440 - DNA, 25 bp, Artificial sequence
  SiRNA target sequence
gtacaggaaaggttttcaatattta

SEQ ID NO: 92441 - DNA, 25 bp, Artificial sequence
  SiRNA target sequence
tacaggaaaggttttcaatatttag

SEQ ID NO: 92442 - DNA, 25 bp, Artificial sequence
  SiRNA target sequence
acaggaaaggttttcaatatttagt

SEQ ID NO: 92443 - DNA, 25 bp, Artificial sequence
  SiRNA target sequence
caggaaaggttttcaatatttagta

SEQ ID NO: 92444 - DNA, 25 bp, Artificial sequence
  SiRNA target sequence
aggaaaggttttcaatatttagtat

SEQ ID NO: 92445 - DNA, 25 bp, Artificial sequence
  SiRNA target sequence
ggaaaggttttcaatatttagtata

SEQ ID NO: 92446 - DNA, 25 bp, Artificial sequence
  SiRNA target sequence
gaaaggttttcaatatttagtatat

SEQ ID NO: 92447 - DNA, 25 bp, Artificial sequence
  SiRNA target sequence
aaaggttttcaatatttagtatatt

SEQ ID NO: 92448 - DNA, 25 bp, Artificial sequence
  SiRNA target sequence
aaggttttcaatatttagtatattt

SEQ ID NO: 92449 - DNA, 25 bp, Artificial sequence
  SiRNA target sequence
aggttttcaatatttagtatatttg

SEQ ID NO: 92450 - DNA, 25 bp, Artificial sequence
  SiRNA target sequence
ggttttcaatatttagtatatttgt

SEQ ID NO: 92451 - DNA, 25 bp, Artificial sequence
  SiRNA target sequence
gttttcaatatttagtatatttgta

SEQ ID NO: 92452 - DNA, 25 bp, Artificial sequence
  SiRNA target sequence
ttttcaatatttagtatatttgtat

SEQ ID NO: 92453 - DNA, 25 bp, Artificial sequence
  SiRNA target sequence
tttcaatatttagtatatttgtatc

SEQ ID NO: 92454 - DNA, 25 bp, Artificial sequence
  SiRNA target sequence
ttcaatatttagtatatttgtatct

SEQ ID NO: 92455 - DNA, 25 bp, Artificial sequence
  SiRNA target sequence
tcaatatttagtatatttgtatcta

SEQ ID NO: 92456 - DNA, 25 bp, Artificial sequence
  SiRNA target sequence
caatatttagtatatttgtatctat

SEQ ID NO: 92457 - DNA, 25 bp, Artificial sequence
  SiRNA target sequence
aatatttagtatatttgtatctatc

SEQ ID NO: 92458 - DNA, 25 bp, Artificial sequence
  SiRNA target sequence
atatttagtatatttgtatctatca

SEQ ID NO: 92459 - DNA, 25 bp, Artificial sequence
  SiRNA target sequence
tatttagtatatttgtatctatcaa

SEQ ID NO: 92460 - DNA, 25 bp, Artificial sequence
  SiRNA target sequence
atttagtatatttgtatctatcaaa

SEQ ID NO: 92461 - DNA, 25 bp, Artificial sequence
  SiRNA target sequence
tttagtatatttgtatctatcaaat

SEQ ID NO: 92462 - DNA, 25 bp, Artificial sequence
  SiRNA target sequence
ttagtatatttgtatctatcaaatt

SEQ ID NO: 92463 - DNA, 25 bp, Artificial sequence
  SiRNA target sequence
tagtatatttgtatctatcaaattt

SEQ ID NO: 92464 - DNA, 25 bp, Artificial sequence
  SiRNA target sequence
agtatatttgtatctatcaaattta

SEQ ID NO: 92465 - DNA, 25 bp, Artificial sequence
  SiRNA target sequence
gtatatttgtatctatcaaatttat

SEQ ID NO: 92466 - DNA, 25 bp, Artificial sequence
  SiRNA target sequence
tatatttgtatctatcaaatttata

SEQ ID NO: 92467 - DNA, 25 bp, Artificial sequence
  SiRNA target sequence
atatttgtatctatcaaatttatat

SEQ ID NO: 92468 - DNA, 25 bp, Artificial sequence
  SiRNA target sequence
tatttgtatctatcaaatttatatt

SEQ ID NO: 92469 - DNA, 25 bp, Artificial sequence
  SiRNA target sequence
atttgtatctatcaaatttatattc

SEQ ID NO: 92470 - DNA, 25 bp, Artificial sequence
  SiRNA target sequence
tttgtatctatcaaatttatattct

SEQ ID NO: 92471 - DNA, 25 bp, Artificial sequence
  SiRNA target sequence
ttgtatctatcaaatttatattctc

SEQ ID NO: 92472 - DNA, 25 bp, Artificial sequence
  SiRNA target sequence
tgtatctatcaaatttatattctcg

SEQ ID NO: 92473 - DNA, 25 bp, Artificial sequence
  SiRNA target sequence
gtatctatcaaatttatattctcgt

SEQ ID NO: 92474 - DNA, 25 bp, Artificial sequence
  SiRNA target sequence
tatctatcaaatttatattctcgtt

SEQ ID NO: 92475 - DNA, 25 bp, Artificial sequence
  SiRNA target sequence
atctatcaaatttatattctcgttt

SEQ ID NO: 92476 - DNA, 25 bp, Artificial sequence
  SiRNA target sequence
tctatcaaatttatattctcgtttg

SEQ ID NO: 92477 - DNA, 25 bp, Artificial sequence
  SiRNA target sequence
ctatcaaatttatattctcgtttgt

SEQ ID NO: 92478 - DNA, 25 bp, Artificial sequence
  SiRNA target sequence
tatcaaatttatattctcgtttgtc

SEQ ID NO: 92479 - DNA, 25 bp, Artificial sequence
  SiRNA target sequence
atcaaatttatattctcgtttgtct

SEQ ID NO: 92480 - DNA, 25 bp, Artificial sequence
  SiRNA target sequence
tcaaatttatattctcgtttgtctt

SEQ ID NO: 92481 - DNA, 25 bp, Artificial sequence
  SiRNA target sequence
caaatttatattctcgtttgtcttt

SEQ ID NO: 92482 - DNA, 25 bp, Artificial sequence
  SiRNA target sequence
aaatttatattctcgtttgtcttta

SEQ ID NO: 92483 - DNA, 25 bp, Artificial sequence
  SiRNA target sequence
aatttatattctcgtttgtctttat

SEQ ID NO: 92484 - DNA, 25 bp, Artificial sequence
  SiRNA target sequence
atttatattctcgtttgtctttatt

SEQ ID NO: 92485 - DNA, 25 bp, Artificial sequence
  SiRNA target sequence
tttatattctcgtttgtctttattt

SEQ ID NO: 92486 - DNA, 25 bp, Artificial sequence
  SiRNA target sequence
ttatattctcgtttgtctttatttt

SEQ ID NO: 92487 - DNA, 25 bp, Artificial sequence
  SiRNA target sequence
tatattctcgtttgtctttatttta

SEQ ID NO: 92488 - DNA, 25 bp, Artificial sequence
  SiRNA target sequence
atattctcgtttgtctttattttat

SEQ ID NO: 92489 - DNA, 25 bp, Artificial sequence
  SiRNA target sequence
tattctcgtttgtctttattttata

SEQ ID NO: 92490 - DNA, 25 bp, Artificial sequence
  SiRNA target sequence
attctcgtttgtctttattttataa

SEQ ID NO: 92491 - DNA, 25 bp, Artificial sequence
  SiRNA target sequence
ttctcgtttgtctttattttataag

SEQ ID NO: 92492 - DNA, 25 bp, Artificial sequence
  SiRNA target sequence
tctcgtttgtctttattttataaga

SEQ ID NO: 92493 - DNA, 25 bp, Artificial sequence
  SiRNA target sequence
ctcgtttgtctttattttataagaa

SEQ ID NO: 92494 - DNA, 25 bp, Artificial sequence
  SiRNA target sequence
tcgtttgtctttattttataagaac

SEQ ID NO: 92495 - DNA, 25 bp, Artificial sequence
  SiRNA target sequence
cgtttgtctttattttataagaacc

SEQ ID NO: 92496 - DNA, 25 bp, Artificial sequence
  SiRNA target sequence
gtttgtctttattttataagaacct

SEQ ID NO: 92497 - DNA, 25 bp, Artificial sequence
  SiRNA target sequence
tttgtctttattttataagaacctg

SEQ ID NO: 92498 - DNA, 25 bp, Artificial sequence
  SiRNA target sequence
ttgtctttattttataagaacctgt

SEQ ID NO: 92499 - DNA, 25 bp, Artificial sequence
  SiRNA target sequence
tgtctttattttataagaacctgta

SEQ ID NO: 92500 - DNA, 25 bp, Artificial sequence
  SiRNA target sequence
gtctttattttataagaacctgtat

SEQ ID NO: 92501 - DNA, 25 bp, Artificial sequence
  SiRNA target sequence
tctttattttataagaacctgtata

SEQ ID NO: 92502 - DNA, 25 bp, Artificial sequence
  SiRNA target sequence
ctttattttataagaacctgtatag

SEQ ID NO: 92503 - DNA, 25 bp, Artificial sequence
  SiRNA target sequence
tttattttataagaacctgtatagt

SEQ ID NO: 92504 - DNA, 25 bp, Artificial sequence
  SiRNA target sequence
ttattttataagaacctgtatagtt

SEQ ID NO: 92505 - DNA, 25 bp, Artificial sequence
  SiRNA target sequence
tattttataagaacctgtatagttg

SEQ ID NO: 92506 - DNA, 25 bp, Artificial sequence
  SiRNA target sequence
attttataagaacctgtatagttgg

SEQ ID NO: 92507 - DNA, 25 bp, Artificial sequence
  SiRNA target sequence
ttttataagaacctgtatagttggt

SEQ ID NO: 92508 - DNA, 25 bp, Artificial sequence
  SiRNA target sequence
tttataagaacctgtatagttggtc

SEQ ID NO: 92509 - DNA, 25 bp, Artificial sequence
  SiRNA target sequence
ttataagaacctgtatagttggtct

SEQ ID NO: 92510 - DNA, 25 bp, Artificial sequence
  SiRNA target sequence
tataagaacctgtatagttggtctt

SEQ ID NO: 92511 - DNA, 25 bp, Artificial sequence
  SiRNA target sequence
ataagaacctgtatagttggtcttt

SEQ ID NO: 92512 - DNA, 25 bp, Artificial sequence
  SiRNA target sequence
taagaacctgtatagttggtctttt

SEQ ID NO: 92513 - DNA, 25 bp, Artificial sequence
  SiRNA target sequence
aagaacctgtatagttggtcttttt

SEQ ID NO: 92514 - DNA, 25 bp, Artificial sequence
  SiRNA target sequence
agaacctgtatagttggtcttttta

SEQ ID NO: 92515 - DNA, 25 bp, Artificial sequence
  SiRNA target sequence
gaacctgtatagttggtctttttaa

SEQ ID NO: 92516 - DNA, 25 bp, Artificial sequence
  SiRNA target sequence
aacctgtatagttggtctttttaat

SEQ ID NO: 92517 - DNA, 25 bp, Artificial sequence
  SiRNA target sequence
acctgtatagttggtctttttaatt

SEQ ID NO: 92518 - DNA, 25 bp, Artificial sequence
  SiRNA target sequence
cctgtatagttggtctttttaatta

SEQ ID NO: 92519 - DNA, 25 bp, Artificial sequence
  SiRNA target sequence
ctgtatagttggtctttttaattat

SEQ ID NO: 92520 - DNA, 25 bp, Artificial sequence
  SiRNA target sequence
tgtatagttggtctttttaattata

SEQ ID NO: 92521 - DNA, 25 bp, Artificial sequence
  SiRNA target sequence
gtatagttggtctttttaattataa

SEQ ID NO: 92522 - DNA, 25 bp, Artificial sequence
  SiRNA target sequence
tatagttggtctttttaattataag

SEQ ID NO: 92523 - DNA, 25 bp, Artificial sequence
  SiRNA target sequence
atagttggtctttttaattataagc

SEQ ID NO: 92524 - DNA, 25 bp, Artificial sequence
  SiRNA target sequence
tagttggtctttttaattataagct

SEQ ID NO: 92525 - DNA, 25 bp, Artificial sequence
  SiRNA target sequence
agttggtctttttaattataagctt

SEQ ID NO: 92526 - DNA, 25 bp, Artificial sequence
  SiRNA target sequence
gttggtctttttaattataagctta

SEQ ID NO: 92527 - DNA, 25 bp, Artificial sequence
  SiRNA target sequence
ttggtctttttaattataagcttat

SEQ ID NO: 92528 - DNA, 25 bp, Artificial sequence
  SiRNA target sequence
tggtctttttaattataagcttatt

SEQ ID NO: 92529 - DNA, 25 bp, Artificial sequence
  SiRNA target sequence
ggtctttttaattataagcttattg

SEQ ID NO: 92530 - DNA, 25 bp, Artificial sequence
  SiRNA target sequence
gtctttttaattataagcttattga

SEQ ID NO: 92531 - DNA, 25 bp, Artificial sequence
  SiRNA target sequence
tctttttaattataagcttattgaa

SEQ ID NO: 92532 - DNA, 25 bp, Artificial sequence
  SiRNA target sequence
ctttttaattataagcttattgaaa

SEQ ID NO: 92533 - DNA, 25 bp, Artificial sequence
  SiRNA target sequence
tttttaattataagcttattgaaat

SEQ ID NO: 92534 - DNA, 25 bp, Artificial sequence
  SiRNA target sequence
ttttaattataagcttattgaaatt

SEQ ID NO: 92535 - DNA, 25 bp, Artificial sequence
  SiRNA target sequence
tttaattataagcttattgaaattt

SEQ ID NO: 92536 - DNA, 25 bp, Artificial sequence
  SiRNA target sequence
ttaattataagcttattgaaatttc

SEQ ID NO: 92537 - DNA, 25 bp, Artificial sequence
  SiRNA target sequence
taattataagcttattgaaatttct

SEQ ID NO: 92538 - DNA, 25 bp, Artificial sequence
  SiRNA target sequence
aattataagcttattgaaatttcta

SEQ ID NO: 92539 - DNA, 25 bp, Artificial sequence
  SiRNA target sequence
attataagcttattgaaatttctaa

SEQ ID NO: 92540 - DNA, 25 bp, Artificial sequence
  SiRNA target sequence
ttataagcttattgaaatttctaat

SEQ ID NO: 92541 - DNA, 25 bp, Artificial sequence
  SiRNA target sequence
tataagcttattgaaatttctaata

SEQ ID NO: 92542 - DNA, 25 bp, Artificial sequence
  SiRNA target sequence
ataagcttattgaaatttctaatat

SEQ ID NO: 92543 - DNA, 25 bp, Artificial sequence
  SiRNA target sequence
taagcttattgaaatttctaatatt

SEQ ID NO: 92544 - DNA, 25 bp, Artificial sequence
  SiRNA target sequence
aagcttattgaaatttctaatattt

SEQ ID NO: 92545 - DNA, 25 bp, Artificial sequence
  SiRNA target sequence
agcttattgaaatttctaatattta

SEQ ID NO: 92546 - DNA, 25 bp, Artificial sequence
  SiRNA target sequence
gcttattgaaatttctaatatttaa

SEQ ID NO: 92547 - DNA, 25 bp, Artificial sequence
  SiRNA target sequence
cttattgaaatttctaatatttaaa

SEQ ID NO: 92548 - DNA, 25 bp, Artificial sequence
  SiRNA target sequence
ttattgaaatttctaatatttaaag

SEQ ID NO: 92549 - DNA, 25 bp, Artificial sequence
  SiRNA target sequence
tattgaaatttctaatatttaaagg

SEQ ID NO: 92550 - DNA, 25 bp, Artificial sequence
  SiRNA target sequence
attgaaatttctaatatttaaagga

SEQ ID NO: 92551 - DNA, 25 bp, Artificial sequence
  SiRNA target sequence
ttgaaatttctaatatttaaaggaa

SEQ ID NO: 92552 - DNA, 25 bp, Artificial sequence
  SiRNA target sequence
tgaaatttctaatatttaaaggaac

SEQ ID NO: 92553 - DNA, 25 bp, Artificial sequence
  SiRNA target sequence
gaaatttctaatatttaaaggaaca

SEQ ID NO: 92554 - DNA, 25 bp, Artificial sequence
  SiRNA target sequence
aaatttctaatatttaaaggaacaa

SEQ ID NO: 92555 - DNA, 25 bp, Artificial sequence
  SiRNA target sequence
aatttctaatatttaaaggaacaaa

SEQ ID NO: 92556 - DNA, 25 bp, Artificial sequence
  SiRNA target sequence
atttctaatatttaaaggaacaaaa

SEQ ID NO: 92557 - DNA, 25 bp, Artificial sequence
  SiRNA target sequence
tttctaatatttaaaggaacaaaat

SEQ ID NO: 92558 - DNA, 25 bp, Artificial sequence
  SiRNA target sequence
ttctaatatttaaaggaacaaaatc

SEQ ID NO: 92559 - DNA, 25 bp, Artificial sequence
  SiRNA target sequence
tctaatatttaaaggaacaaaatct

SEQ ID NO: 92560 - DNA, 25 bp, Artificial sequence
  SiRNA target sequence
ctaatatttaaaggaacaaaatcta

SEQ ID NO: 92561 - DNA, 25 bp, Artificial sequence
  SiRNA target sequence
taatatttaaaggaacaaaatctac

SEQ ID NO: 92562 - DNA, 25 bp, Artificial sequence
  SiRNA target sequence
aatatttaaaggaacaaaatctaca

SEQ ID NO: 92563 - DNA, 25 bp, Artificial sequence
  SiRNA target sequence
atatttaaaggaacaaaatctacat

SEQ ID NO: 92564 - DNA, 25 bp, Artificial sequence
  SiRNA target sequence
tatttaaaggaacaaaatctacatt

SEQ ID NO: 92565 - DNA, 25 bp, Artificial sequence
  SiRNA target sequence
atttaaaggaacaaaatctacattt

SEQ ID NO: 92566 - DNA, 25 bp, Artificial sequence
  SiRNA target sequence
tttaaaggaacaaaatctacattta

SEQ ID NO: 92567 - DNA, 25 bp, Artificial sequence
  SiRNA target sequence
ttaaaggaacaaaatctacatttag

SEQ ID NO: 92568 - DNA, 25 bp, Artificial sequence
  SiRNA target sequence
taaaggaacaaaatctacatttaga

SEQ ID NO: 92569 - DNA, 25 bp, Artificial sequence
  SiRNA target sequence
aaaggaacaaaatctacatttagat

SEQ ID NO: 92570 - DNA, 25 bp, Artificial sequence
  SiRNA target sequence
aaggaacaaaatctacatttagatt

SEQ ID NO: 92571 - DNA, 25 bp, Artificial sequence
  SiRNA target sequence
aggaacaaaatctacatttagatta

SEQ ID NO: 92572 - DNA, 25 bp, Artificial sequence
  SiRNA target sequence
ggaacaaaatctacatttagattat

SEQ ID NO: 92573 - DNA, 25 bp, Artificial sequence
  SiRNA target sequence
gaacaaaatctacatttagattata

SEQ ID NO: 92574 - DNA, 25 bp, Artificial sequence
  SiRNA target sequence
aacaaaatctacatttagattatat

SEQ ID NO: 92575 - DNA, 25 bp, Artificial sequence
  SiRNA target sequence
acaaaatctacatttagattatatt

SEQ ID NO: 92576 - DNA, 25 bp, Artificial sequence
  SiRNA target sequence
caaaatctacatttagattatattc

SEQ ID NO: 92577 - DNA, 25 bp, Artificial sequence
  SiRNA target sequence
aaaatctacatttagattatattct

SEQ ID NO: 92578 - DNA, 25 bp, Artificial sequence
  SiRNA target sequence
aaatctacatttagattatattcta

SEQ ID NO: 92579 - DNA, 25 bp, Artificial sequence
  SiRNA target sequence
aatctacatttagattatattctaa

SEQ ID NO: 92580 - DNA, 25 bp, Artificial sequence
  SiRNA target sequence
atctacatttagattatattctaat

SEQ ID NO: 92581 - DNA, 25 bp, Artificial sequence
  SiRNA target sequence
tctacatttagattatattctaatt

SEQ ID NO: 92582 - DNA, 25 bp, Artificial sequence
  SiRNA target sequence
ctacatttagattatattctaattt

SEQ ID NO: 92583 - DNA, 25 bp, Artificial sequence
  SiRNA target sequence
tacatttagattatattctaattta

SEQ ID NO: 92584 - DNA, 25 bp, Artificial sequence
  SiRNA target sequence
acatttagattatattctaatttat

SEQ ID NO: 92585 - DNA, 25 bp, Artificial sequence
  SiRNA target sequence
catttagattatattctaatttatt

SEQ ID NO: 92586 - DNA, 25 bp, Artificial sequence
  SiRNA target sequence
atttagattatattctaatttattg

SEQ ID NO: 92587 - DNA, 25 bp, Artificial sequence
  SiRNA target sequence
tttagattatattctaatttattga

SEQ ID NO: 92588 - DNA, 25 bp, Artificial sequence
  SiRNA target sequence
ttagattatattctaatttattgaa

SEQ ID NO: 92589 - DNA, 25 bp, Artificial sequence
  SiRNA target sequence
tagattatattctaatttattgaat

SEQ ID NO: 92590 - DNA, 25 bp, Artificial sequence
  SiRNA target sequence
agattatattctaatttattgaatt

SEQ ID NO: 92591 - DNA, 25 bp, Artificial sequence
  SiRNA target sequence
gattatattctaatttattgaattt

SEQ ID NO: 92592 - DNA, 25 bp, Artificial sequence
  SiRNA target sequence
attatattctaatttattgaatttc

SEQ ID NO: 92593 - DNA, 25 bp, Artificial sequence
  SiRNA target sequence
ttatattctaatttattgaatttca

SEQ ID NO: 92594 - DNA, 25 bp, Artificial sequence
  SiRNA target sequence
tatattctaatttattgaatttcat

SEQ ID NO: 92595 - DNA, 26 bp, Artificial sequence
  SiRNA target sequence
ttatatccaactatcaaaaaatagcc

SEQ ID NO: 92596 - DNA, 26 bp, Artificial sequence
  SiRNA target sequence
tatatccaactatcaaaaaatagcct

SEQ ID NO: 92597 - DNA, 26 bp, Artificial sequence
  SiRNA target sequence
atatccaactatcaaaaaatagcctc

SEQ ID NO: 92598 - DNA, 26 bp, Artificial sequence
  SiRNA target sequence
tatccaactatcaaaaaatagcctct

SEQ ID NO: 92599 - DNA, 26 bp, Artificial sequence
  SiRNA target sequence
atccaactatcaaaaaatagcctctt

SEQ ID NO: 92600 - DNA, 26 bp, Artificial sequence
  SiRNA target sequence
tccaactatcaaaaaatagcctcttt

SEQ ID NO: 92601 - DNA, 26 bp, Artificial sequence
  SiRNA target sequence
ccaactatcaaaaaatagcctctttt

SEQ ID NO: 92602 - DNA, 26 bp, Artificial sequence
  SiRNA target sequence
caactatcaaaaaatagcctcttttc

SEQ ID NO: 92603 - DNA, 26 bp, Artificial sequence
  SiRNA target sequence
aactatcaaaaaatagcctcttttct

SEQ ID NO: 92604 - DNA, 26 bp, Artificial sequence
  SiRNA target sequence
actatcaaaaaatagcctcttttctt

SEQ ID NO: 92605 - DNA, 26 bp, Artificial sequence
  SiRNA target sequence
ctatcaaaaaatagcctcttttcttt

SEQ ID NO: 92606 - DNA, 26 bp, Artificial sequence
  SiRNA target sequence
tatcaaaaaatagcctcttttctttc

SEQ ID NO: 92607 - DNA, 26 bp, Artificial sequence
  SiRNA target sequence
atcaaaaaatagcctcttttctttca

SEQ ID NO: 92608 - DNA, 26 bp, Artificial sequence
  SiRNA target sequence
tcaaaaaatagcctcttttctttcac

SEQ ID NO: 92609 - DNA, 26 bp, Artificial sequence
  SiRNA target sequence
caaaaaatagcctcttttctttcaca

SEQ ID NO: 92610 - DNA, 26 bp, Artificial sequence
  SiRNA target sequence
aaaaaatagcctcttttctttcacaa

SEQ ID NO: 92611 - DNA, 26 bp, Artificial sequence
  SiRNA target sequence
aaaaatagcctcttttctttcacaat

SEQ ID NO: 92612 - DNA, 26 bp, Artificial sequence
  SiRNA target sequence
aaaatagcctcttttctttcacaatt

SEQ ID NO: 92613 - DNA, 26 bp, Artificial sequence
  SiRNA target sequence
aaatagcctcttttctttcacaattt

SEQ ID NO: 92614 - DNA, 26 bp, Artificial sequence
  SiRNA target sequence
aatagcctcttttctttcacaatttc

SEQ ID NO: 92615 - DNA, 26 bp, Artificial sequence
  SiRNA target sequence
atagcctcttttctttcacaatttca

SEQ ID NO: 92616 - DNA, 26 bp, Artificial sequence
  SiRNA target sequence
tagcctcttttctttcacaatttcag

SEQ ID NO: 92617 - DNA, 26 bp, Artificial sequence
  SiRNA target sequence
agcctcttttctttcacaatttcaga

SEQ ID NO: 92618 - DNA, 26 bp, Artificial sequence
  SiRNA target sequence
gcctcttttctttcacaatttcagaa

SEQ ID NO: 92619 - DNA, 26 bp, Artificial sequence
  SiRNA target sequence
cctcttttctttcacaatttcagaaa

SEQ ID NO: 92620 - DNA, 26 bp, Artificial sequence
  SiRNA target sequence
ctcttttctttcacaatttcagaaaa

SEQ ID NO: 92621 - DNA, 26 bp, Artificial sequence
  SiRNA target sequence
tcttttctttcacaatttcagaaaaa

SEQ ID NO: 92622 - DNA, 26 bp, Artificial sequence
  SiRNA target sequence
cttttctttcacaatttcagaaaaat

SEQ ID NO: 92623 - DNA, 26 bp, Artificial sequence
  SiRNA target sequence
ttttctttcacaatttcagaaaaatt

SEQ ID NO: 92624 - DNA, 26 bp, Artificial sequence
  SiRNA target sequence
tttctttcacaatttcagaaaaattt

SEQ ID NO: 92625 - DNA, 26 bp, Artificial sequence
  SiRNA target sequence
ttctttcacaatttcagaaaaatttt

SEQ ID NO: 92626 - DNA, 26 bp, Artificial sequence
  SiRNA target sequence
tctttcacaatttcagaaaaattttc

SEQ ID NO: 92627 - DNA, 26 bp, Artificial sequence
  SiRNA target sequence
ctttcacaatttcagaaaaattttca

SEQ ID NO: 92628 - DNA, 26 bp, Artificial sequence
  SiRNA target sequence
tttcacaatttcagaaaaattttcat

SEQ ID NO: 92629 - DNA, 26 bp, Artificial sequence
  SiRNA target sequence
ttcacaatttcagaaaaattttcatt

SEQ ID NO: 92630 - DNA, 26 bp, Artificial sequence
  SiRNA target sequence
tcacaatttcagaaaaattttcatta

SEQ ID NO: 92631 - DNA, 26 bp, Artificial sequence
  SiRNA target sequence
cacaatttcagaaaaattttcattaa

SEQ ID NO: 92632 - DNA, 26 bp, Artificial sequence
  SiRNA target sequence
acaatttcagaaaaattttcattaaa

SEQ ID NO: 92633 - DNA, 26 bp, Artificial sequence
  SiRNA target sequence
caatttcagaaaaattttcattaaaa

SEQ ID NO: 92634 - DNA, 26 bp, Artificial sequence
  SiRNA target sequence
aatttcagaaaaattttcattaaaaa

SEQ ID NO: 92635 - DNA, 26 bp, Artificial sequence
  SiRNA target sequence
atttcagaaaaattttcattaaaaat

SEQ ID NO: 92636 - DNA, 26 bp, Artificial sequence
  SiRNA target sequence
tttcagaaaaattttcattaaaaatg

SEQ ID NO: 92637 - DNA, 26 bp, Artificial sequence
  SiRNA target sequence
ttcagaaaaattttcattaaaaatgc

SEQ ID NO: 92638 - DNA, 26 bp, Artificial sequence
  SiRNA target sequence
tcagaaaaattttcattaaaaatgct

SEQ ID NO: 92639 - DNA, 26 bp, Artificial sequence
  SiRNA target sequence
cagaaaaattttcattaaaaatgcta

SEQ ID NO: 92640 - DNA, 26 bp, Artificial sequence
  SiRNA target sequence
agaaaaattttcattaaaaatgctat

SEQ ID NO: 92641 - DNA, 26 bp, Artificial sequence
  SiRNA target sequence
gaaaaattttcattaaaaatgctata

SEQ ID NO: 92642 - DNA, 26 bp, Artificial sequence
  SiRNA target sequence
aaaaattttcattaaaaatgctataa

SEQ ID NO: 92643 - DNA, 26 bp, Artificial sequence
  SiRNA target sequence
aaaattttcattaaaaatgctataaa

SEQ ID NO: 92644 - DNA, 26 bp, Artificial sequence
  SiRNA target sequence
aaattttcattaaaaatgctataaat

SEQ ID NO: 92645 - DNA, 26 bp, Artificial sequence
  SiRNA target sequence
aattttcattaaaaatgctataaata

SEQ ID NO: 92646 - DNA, 26 bp, Artificial sequence
  SiRNA target sequence
attttcattaaaaatgctataaatag

SEQ ID NO: 92647 - DNA, 26 bp, Artificial sequence
  SiRNA target sequence
ttttcattaaaaatgctataaatagt

SEQ ID NO: 92648 - DNA, 26 bp, Artificial sequence
  SiRNA target sequence
tttcattaaaaatgctataaatagtt

SEQ ID NO: 92649 - DNA, 26 bp, Artificial sequence
  SiRNA target sequence
ttcattaaaaatgctataaatagttt

SEQ ID NO: 92650 - DNA, 26 bp, Artificial sequence
  SiRNA target sequence
tcattaaaaatgctataaatagtttt

SEQ ID NO: 92651 - DNA, 26 bp, Artificial sequence
  SiRNA target sequence
cattaaaaatgctataaatagttttt

SEQ ID NO: 92652 - DNA, 26 bp, Artificial sequence
  SiRNA target sequence
attaaaaatgctataaatagtttttt

SEQ ID NO: 92653 - DNA, 26 bp, Artificial sequence
  SiRNA target sequence
ttaaaaatgctataaatagttttttg

SEQ ID NO: 92654 - DNA, 26 bp, Artificial sequence
  SiRNA target sequence
taaaaatgctataaatagttttttgc

SEQ ID NO: 92655 - DNA, 26 bp, Artificial sequence
  SiRNA target sequence
aaaaatgctataaatagttttttgca

SEQ ID NO: 92656 - DNA, 26 bp, Artificial sequence
  SiRNA target sequence
aaaatgctataaatagttttttgcat

SEQ ID NO: 92657 - DNA, 26 bp, Artificial sequence
  SiRNA target sequence
aaatgctataaatagttttttgcata

SEQ ID NO: 92658 - DNA, 26 bp, Artificial sequence
  SiRNA target sequence
aatgctataaatagttttttgcatat

SEQ ID NO: 92659 - DNA, 26 bp, Artificial sequence
  SiRNA target sequence
atgctataaatagttttttgcatatc

SEQ ID NO: 92660 - DNA, 26 bp, Artificial sequence
  SiRNA target sequence
tgctataaatagttttttgcatatca

SEQ ID NO: 92661 - DNA, 26 bp, Artificial sequence
  SiRNA target sequence
gctataaatagttttttgcatatcag

SEQ ID NO: 92662 - DNA, 26 bp, Artificial sequence
  SiRNA target sequence
ctataaatagttttttgcatatcagg

SEQ ID NO: 92663 - DNA, 26 bp, Artificial sequence
  SiRNA target sequence
tataaatagttttttgcatatcaggt

SEQ ID NO: 92664 - DNA, 26 bp, Artificial sequence
  SiRNA target sequence
ataaatagttttttgcatatcaggtc

SEQ ID NO: 92665 - DNA, 26 bp, Artificial sequence
  SiRNA target sequence
taaatagttttttgcatatcaggtcg

SEQ ID NO: 92666 - DNA, 26 bp, Artificial sequence
  SiRNA target sequence
aaatagttttttgcatatcaggtcgg

SEQ ID NO: 92667 - DNA, 26 bp, Artificial sequence
  SiRNA target sequence
aatagttttttgcatatcaggtcggc

SEQ ID NO: 92668 - DNA, 26 bp, Artificial sequence
  SiRNA target sequence
atagttttttgcatatcaggtcggcc

SEQ ID NO: 92669 - DNA, 26 bp, Artificial sequence
  SiRNA target sequence
tagttttttgcatatcaggtcggcca

SEQ ID NO: 92670 - DNA, 26 bp, Artificial sequence
  SiRNA target sequence
agttttttgcatatcaggtcggccac

SEQ ID NO: 92671 - DNA, 26 bp, Artificial sequence
  SiRNA target sequence
gttttttgcatatcaggtcggccaca

SEQ ID NO: 92672 - DNA, 26 bp, Artificial sequence
  SiRNA target sequence
ttttttgcatatcaggtcggccacaa

SEQ ID NO: 92673 - DNA, 26 bp, Artificial sequence
  SiRNA target sequence
tttttgcatatcaggtcggccacaaa

SEQ ID NO: 92674 - DNA, 26 bp, Artificial sequence
  SiRNA target sequence
ttttgcatatcaggtcggccacaaac

SEQ ID NO: 92675 - DNA, 26 bp, Artificial sequence
  SiRNA target sequence
tttgcatatcaggtcggccacaaaca

SEQ ID NO: 92676 - DNA, 26 bp, Artificial sequence
  SiRNA target sequence
ttgcatatcaggtcggccacaaacat

SEQ ID NO: 92677 - DNA, 26 bp, Artificial sequence
  SiRNA target sequence
tgcatatcaggtcggccacaaacata

SEQ ID NO: 92678 - DNA, 26 bp, Artificial sequence
  SiRNA target sequence
gcatatcaggtcggccacaaacataa

SEQ ID NO: 92679 - DNA, 26 bp, Artificial sequence
  SiRNA target sequence
catatcaggtcggccacaaacataaa

SEQ ID NO: 92680 - DNA, 26 bp, Artificial sequence
  SiRNA target sequence
atatcaggtcggccacaaacataaac

SEQ ID NO: 92681 - DNA, 26 bp, Artificial sequence
  SiRNA target sequence
tatcaggtcggccacaaacataaacc

SEQ ID NO: 92682 - DNA, 26 bp, Artificial sequence
  SiRNA target sequence
atcaggtcggccacaaacataaacca

SEQ ID NO: 92683 - DNA, 26 bp, Artificial sequence
  SiRNA target sequence
tcaggtcggccacaaacataaaccaa

SEQ ID NO: 92684 - DNA, 26 bp, Artificial sequence
  SiRNA target sequence
caggtcggccacaaacataaaccaaa

SEQ ID NO: 92685 - DNA, 26 bp, Artificial sequence
  SiRNA target sequence
aggtcggccacaaacataaaccaaac

SEQ ID NO: 92686 - DNA, 26 bp, Artificial sequence
  SiRNA target sequence
ggtcggccacaaacataaaccaaaca

SEQ ID NO: 92687 - DNA, 26 bp, Artificial sequence
  SiRNA target sequence
gtcggccacaaacataaaccaaacat

SEQ ID NO: 92688 - DNA, 26 bp, Artificial sequence
  SiRNA target sequence
tcggccacaaacataaaccaaacatc

SEQ ID NO: 92689 - DNA, 26 bp, Artificial sequence
  SiRNA target sequence
cggccacaaacataaaccaaacatcc

SEQ ID NO: 92690 - DNA, 26 bp, Artificial sequence
  SiRNA target sequence
ggccacaaacataaaccaaacatccg

SEQ ID NO: 92691 - DNA, 26 bp, Artificial sequence
  SiRNA target sequence
gccacaaacataaaccaaacatccgt

SEQ ID NO: 92692 - DNA, 26 bp, Artificial sequence
  SiRNA target sequence
ccacaaacataaaccaaacatccgtc

SEQ ID NO: 92693 - DNA, 26 bp, Artificial sequence
  SiRNA target sequence
cacaaacataaaccaaacatccgtct

SEQ ID NO: 92694 - DNA, 26 bp, Artificial sequence
  SiRNA target sequence
acaaacataaaccaaacatccgtctt

SEQ ID NO: 92695 - DNA, 26 bp, Artificial sequence
  SiRNA target sequence
caaacataaaccaaacatccgtcttt

SEQ ID NO: 92696 - DNA, 26 bp, Artificial sequence
  SiRNA target sequence
aaacataaaccaaacatccgtcttta

SEQ ID NO: 92697 - DNA, 26 bp, Artificial sequence
  SiRNA target sequence
aacataaaccaaacatccgtctttaa

SEQ ID NO: 92698 - DNA, 26 bp, Artificial sequence
  SiRNA target sequence
acataaaccaaacatccgtctttaat

SEQ ID NO: 92699 - DNA, 26 bp, Artificial sequence
  SiRNA target sequence
cataaaccaaacatccgtctttaatg

SEQ ID NO: 92700 - DNA, 26 bp, Artificial sequence
  SiRNA target sequence
ataaaccaaacatccgtctttaatgt

SEQ ID NO: 92701 - DNA, 26 bp, Artificial sequence
  SiRNA target sequence
taaaccaaacatccgtctttaatgta

SEQ ID NO: 92702 - DNA, 26 bp, Artificial sequence
  SiRNA target sequence
aaaccaaacatccgtctttaatgtat

SEQ ID NO: 92703 - DNA, 26 bp, Artificial sequence
  SiRNA target sequence
aaccaaacatccgtctttaatgtatg

SEQ ID NO: 92704 - DNA, 26 bp, Artificial sequence
  SiRNA target sequence
accaaacatccgtctttaatgtatgt

SEQ ID NO: 92705 - DNA, 26 bp, Artificial sequence
  SiRNA target sequence
ccaaacatccgtctttaatgtatgtt

SEQ ID NO: 92706 - DNA, 26 bp, Artificial sequence
  SiRNA target sequence
caaacatccgtctttaatgtatgttt

SEQ ID NO: 92707 - DNA, 26 bp, Artificial sequence
  SiRNA target sequence
aaacatccgtctttaatgtatgtttt

SEQ ID NO: 92708 - DNA, 26 bp, Artificial sequence
  SiRNA target sequence
aacatccgtctttaatgtatgttttt

SEQ ID NO: 92709 - DNA, 26 bp, Artificial sequence
  SiRNA target sequence
acatccgtctttaatgtatgttttta

SEQ ID NO: 92710 - DNA, 26 bp, Artificial sequence
  SiRNA target sequence
catccgtctttaatgtatgtttttat

SEQ ID NO: 92711 - DNA, 26 bp, Artificial sequence
  SiRNA target sequence
atccgtctttaatgtatgtttttatc

SEQ ID NO: 92712 - DNA, 26 bp, Artificial sequence
  SiRNA target sequence
tccgtctttaatgtatgtttttatct

SEQ ID NO: 92713 - DNA, 26 bp, Artificial sequence
  SiRNA target sequence
ccgtctttaatgtatgtttttatctc

SEQ ID NO: 92714 - DNA, 26 bp, Artificial sequence
  SiRNA target sequence
cgtctttaatgtatgtttttatctca

SEQ ID NO: 92715 - DNA, 26 bp, Artificial sequence
  SiRNA target sequence
gtctttaatgtatgtttttatctcat

SEQ ID NO: 92716 - DNA, 26 bp, Artificial sequence
  SiRNA target sequence
tctttaatgtatgtttttatctcatt

SEQ ID NO: 92717 - DNA, 26 bp, Artificial sequence
  SiRNA target sequence
ctttaatgtatgtttttatctcattt

SEQ ID NO: 92718 - DNA, 26 bp, Artificial sequence
  SiRNA target sequence
tttaatgtatgtttttatctcattta

SEQ ID NO: 92719 - DNA, 26 bp, Artificial sequence
  SiRNA target sequence
ttaatgtatgtttttatctcatttaa

SEQ ID NO: 92720 - DNA, 26 bp, Artificial sequence
  SiRNA target sequence
taatgtatgtttttatctcatttaaa

SEQ ID NO: 92721 - DNA, 26 bp, Artificial sequence
  SiRNA target sequence
aatgtatgtttttatctcatttaaat

SEQ ID NO: 92722 - DNA, 26 bp, Artificial sequence
  SiRNA target sequence
atgtatgtttttatctcatttaaatt

SEQ ID NO: 92723 - DNA, 26 bp, Artificial sequence
  SiRNA target sequence
tgtatgtttttatctcatttaaattt

SEQ ID NO: 92724 - DNA, 26 bp, Artificial sequence
  SiRNA target sequence
gtatgtttttatctcatttaaatttt

SEQ ID NO: 92725 - DNA, 26 bp, Artificial sequence
  SiRNA target sequence
tatgtttttatctcatttaaattttg

SEQ ID NO: 92726 - DNA, 26 bp, Artificial sequence
  SiRNA target sequence
atgtttttatctcatttaaattttgt

SEQ ID NO: 92727 - DNA, 26 bp, Artificial sequence
  SiRNA target sequence
tgtttttatctcatttaaattttgta

SEQ ID NO: 92728 - DNA, 26 bp, Artificial sequence
  SiRNA target sequence
gtttttatctcatttaaattttgtaa

SEQ ID NO: 92729 - DNA, 26 bp, Artificial sequence
  SiRNA target sequence
tttttatctcatttaaattttgtaat

SEQ ID NO: 92730 - DNA, 26 bp, Artificial sequence
  SiRNA target sequence
ttttatctcatttaaattttgtaata

SEQ ID NO: 92731 - DNA, 26 bp, Artificial sequence
  SiRNA target sequence
tttatctcatttaaattttgtaataa

SEQ ID NO: 92732 - DNA, 26 bp, Artificial sequence
  SiRNA target sequence
ttatctcatttaaattttgtaataaa

SEQ ID NO: 92733 - DNA, 26 bp, Artificial sequence
  SiRNA target sequence
tatctcatttaaattttgtaataaat

SEQ ID NO: 92734 - DNA, 26 bp, Artificial sequence
  SiRNA target sequence
atctcatttaaattttgtaataaata

SEQ ID NO: 92735 - DNA, 26 bp, Artificial sequence
  SiRNA target sequence
tctcatttaaattttgtaataaataa

SEQ ID NO: 92736 - DNA, 26 bp, Artificial sequence
  SiRNA target sequence
ctcatttaaattttgtaataaataat

SEQ ID NO: 92737 - DNA, 26 bp, Artificial sequence
  SiRNA target sequence
tcatttaaattttgtaataaataatc

SEQ ID NO: 92738 - DNA, 26 bp, Artificial sequence
  SiRNA target sequence
catttaaattttgtaataaataatca

SEQ ID NO: 92739 - DNA, 26 bp, Artificial sequence
  SiRNA target sequence
atttaaattttgtaataaataatcag

SEQ ID NO: 92740 - DNA, 26 bp, Artificial sequence
  SiRNA target sequence
tttaaattttgtaataaataatcagt

SEQ ID NO: 92741 - DNA, 26 bp, Artificial sequence
  SiRNA target sequence
ttaaattttgtaataaataatcagta

SEQ ID NO: 92742 - DNA, 26 bp, Artificial sequence
  SiRNA target sequence
taaattttgtaataaataatcagtaa

SEQ ID NO: 92743 - DNA, 26 bp, Artificial sequence
  SiRNA target sequence
aaattttgtaataaataatcagtaac

SEQ ID NO: 92744 - DNA, 26 bp, Artificial sequence
  SiRNA target sequence
aattttgtaataaataatcagtaaca

SEQ ID NO: 92745 - DNA, 26 bp, Artificial sequence
  SiRNA target sequence
attttgtaataaataatcagtaacat

SEQ ID NO: 92746 - DNA, 26 bp, Artificial sequence
  SiRNA target sequence
ttttgtaataaataatcagtaacata

SEQ ID NO: 92747 - DNA, 26 bp, Artificial sequence
  SiRNA target sequence
tttgtaataaataatcagtaacataa

SEQ ID NO: 92748 - DNA, 26 bp, Artificial sequence
  SiRNA target sequence
ttgtaataaataatcagtaacataaa

SEQ ID NO: 92749 - DNA, 26 bp, Artificial sequence
  SiRNA target sequence
tgtaataaataatcagtaacataaat

SEQ ID NO: 92750 - DNA, 26 bp, Artificial sequence
  SiRNA target sequence
gtaataaataatcagtaacataaatt

SEQ ID NO: 92751 - DNA, 26 bp, Artificial sequence
  SiRNA target sequence
taataaataatcagtaacataaattt

SEQ ID NO: 92752 - DNA, 26 bp, Artificial sequence
  SiRNA target sequence
aataaataatcagtaacataaatttt

SEQ ID NO: 92753 - DNA, 26 bp, Artificial sequence
  SiRNA target sequence
ataaataatcagtaacataaatttta

SEQ ID NO: 92754 - DNA, 26 bp, Artificial sequence
  SiRNA target sequence
taaataatcagtaacataaattttat

SEQ ID NO: 92755 - DNA, 26 bp, Artificial sequence
  SiRNA target sequence
aaataatcagtaacataaattttatt

SEQ ID NO: 92756 - DNA, 26 bp, Artificial sequence
  SiRNA target sequence
aataatcagtaacataaattttatta

SEQ ID NO: 92757 - DNA, 26 bp, Artificial sequence
  SiRNA target sequence
ataatcagtaacataaattttattac

SEQ ID NO: 92758 - DNA, 26 bp, Artificial sequence
  SiRNA target sequence
taatcagtaacataaattttattaca

SEQ ID NO: 92759 - DNA, 26 bp, Artificial sequence
  SiRNA target sequence
aatcagtaacataaattttattacaa

SEQ ID NO: 92760 - DNA, 26 bp, Artificial sequence
  SiRNA target sequence
atcagtaacataaattttattacaag

SEQ ID NO: 92761 - DNA, 26 bp, Artificial sequence
  SiRNA target sequence
tcagtaacataaattttattacaaga

SEQ ID NO: 92762 - DNA, 26 bp, Artificial sequence
  SiRNA target sequence
cagtaacataaattttattacaagat

SEQ ID NO: 92763 - DNA, 26 bp, Artificial sequence
  SiRNA target sequence
agtaacataaattttattacaagata

SEQ ID NO: 92764 - DNA, 26 bp, Artificial sequence
  SiRNA target sequence
gtaacataaattttattacaagataa

SEQ ID NO: 92765 - DNA, 26 bp, Artificial sequence
  SiRNA target sequence
taacataaattttattacaagataaa

SEQ ID NO: 92766 - DNA, 26 bp, Artificial sequence
  SiRNA target sequence
aacataaattttattacaagataaaa

SEQ ID NO: 92767 - DNA, 26 bp, Artificial sequence
  SiRNA target sequence
acataaattttattacaagataaaat

SEQ ID NO: 92768 - DNA, 26 bp, Artificial sequence
  SiRNA target sequence
cataaattttattacaagataaaatt

SEQ ID NO: 92769 - DNA, 26 bp, Artificial sequence
  SiRNA target sequence
ataaattttattacaagataaaattt

SEQ ID NO: 92770 - DNA, 26 bp, Artificial sequence
  SiRNA target sequence
taaattttattacaagataaaatttt

SEQ ID NO: 92771 - DNA, 26 bp, Artificial sequence
  SiRNA target sequence
aaattttattacaagataaaatttta

SEQ ID NO: 92772 - DNA, 26 bp, Artificial sequence
  SiRNA target sequence
aattttattacaagataaaattttaa

SEQ ID NO: 92773 - DNA, 26 bp, Artificial sequence
  SiRNA target sequence
attttattacaagataaaattttaat

SEQ ID NO: 92774 - DNA, 26 bp, Artificial sequence
  SiRNA target sequence
ttttattacaagataaaattttaata

SEQ ID NO: 92775 - DNA, 26 bp, Artificial sequence
  SiRNA target sequence
tttattacaagataaaattttaataa

SEQ ID NO: 92776 - DNA, 26 bp, Artificial sequence
  SiRNA target sequence
ttattacaagataaaattttaataat

SEQ ID NO: 92777 - DNA, 26 bp, Artificial sequence
  SiRNA target sequence
tattacaagataaaattttaataatt

SEQ ID NO: 92778 - DNA, 26 bp, Artificial sequence
  SiRNA target sequence
attacaagataaaattttaataattt

SEQ ID NO: 92779 - DNA, 26 bp, Artificial sequence
  SiRNA target sequence
ttacaagataaaattttaataatttc

SEQ ID NO: 92780 - DNA, 26 bp, Artificial sequence
  SiRNA target sequence
tacaagataaaattttaataatttct

SEQ ID NO: 92781 - DNA, 26 bp, Artificial sequence
  SiRNA target sequence
acaagataaaattttaataatttctg

SEQ ID NO: 92782 - DNA, 26 bp, Artificial sequence
  SiRNA target sequence
caagataaaattttaataatttctgt

SEQ ID NO: 92783 - DNA, 26 bp, Artificial sequence
  SiRNA target sequence
aagataaaattttaataatttctgtg

SEQ ID NO: 92784 - DNA, 26 bp, Artificial sequence
  SiRNA target sequence
agataaaattttaataatttctgtgt

SEQ ID NO: 92785 - DNA, 26 bp, Artificial sequence
  SiRNA target sequence
gataaaattttaataatttctgtgtt

SEQ ID NO: 92786 - DNA, 26 bp, Artificial sequence
  SiRNA target sequence
ataaaattttaataatttctgtgttt

SEQ ID NO: 92787 - DNA, 26 bp, Artificial sequence
  SiRNA target sequence
taaaattttaataatttctgtgtttt

SEQ ID NO: 92788 - DNA, 26 bp, Artificial sequence
  SiRNA target sequence
aaaattttaataatttctgtgttttt

SEQ ID NO: 92789 - DNA, 26 bp, Artificial sequence
  SiRNA target sequence
aaattttaataatttctgtgttttta

SEQ ID NO: 92790 - DNA, 26 bp, Artificial sequence
  SiRNA target sequence
aattttaataatttctgtgtttttat

SEQ ID NO: 92791 - DNA, 26 bp, Artificial sequence
  SiRNA target sequence
attttaataatttctgtgtttttata

SEQ ID NO: 92792 - DNA, 26 bp, Artificial sequence
  SiRNA target sequence
ttttaataatttctgtgtttttatat

SEQ ID NO: 92793 - DNA, 26 bp, Artificial sequence
  SiRNA target sequence
tttaataatttctgtgtttttatatt

SEQ ID NO: 92794 - DNA, 26 bp, Artificial sequence
  SiRNA target sequence
ttaataatttctgtgtttttatattt

SEQ ID NO: 92795 - DNA, 26 bp, Artificial sequence
  SiRNA target sequence
taataatttctgtgtttttatatttt

SEQ ID NO: 92796 - DNA, 26 bp, Artificial sequence
  SiRNA target sequence
aataatttctgtgtttttatattttg

SEQ ID NO: 92797 - DNA, 26 bp, Artificial sequence
  SiRNA target sequence
ataatttctgtgtttttatattttgc

SEQ ID NO: 92798 - DNA, 26 bp, Artificial sequence
  SiRNA target sequence
taatttctgtgtttttatattttgca

SEQ ID NO: 92799 - DNA, 26 bp, Artificial sequence
  SiRNA target sequence
aatttctgtgtttttatattttgcat

SEQ ID NO: 92800 - DNA, 26 bp, Artificial sequence
  SiRNA target sequence
atttctgtgtttttatattttgcatc

SEQ ID NO: 92801 - DNA, 26 bp, Artificial sequence
  SiRNA target sequence
tttctgtgtttttatattttgcatct

SEQ ID NO: 92802 - DNA, 26 bp, Artificial sequence
  SiRNA target sequence
ttctgtgtttttatattttgcatctt

SEQ ID NO: 92803 - DNA, 26 bp, Artificial sequence
  SiRNA target sequence
tctgtgtttttatattttgcatcttt

SEQ ID NO: 92804 - DNA, 26 bp, Artificial sequence
  SiRNA target sequence
ctgtgtttttatattttgcatcttta

SEQ ID NO: 92805 - DNA, 26 bp, Artificial sequence
  SiRNA target sequence
tgtgtttttatattttgcatctttaa

SEQ ID NO: 92806 - DNA, 26 bp, Artificial sequence
  SiRNA target sequence
gtgtttttatattttgcatctttaat

SEQ ID NO: 92807 - DNA, 26 bp, Artificial sequence
  SiRNA target sequence
tgtttttatattttgcatctttaata

SEQ ID NO: 92808 - DNA, 26 bp, Artificial sequence
  SiRNA target sequence
gtttttatattttgcatctttaataa

SEQ ID NO: 92809 - DNA, 26 bp, Artificial sequence
  SiRNA target sequence
tttttatattttgcatctttaataag

SEQ ID NO: 92810 - DNA, 26 bp, Artificial sequence
  SiRNA target sequence
ttttatattttgcatctttaataaga

SEQ ID NO: 92811 - DNA, 26 bp, Artificial sequence
  SiRNA target sequence
tttatattttgcatctttaataagat

SEQ ID NO: 92812 - DNA, 26 bp, Artificial sequence
  SiRNA target sequence
ttatattttgcatctttaataagatc

SEQ ID NO: 92813 - DNA, 26 bp, Artificial sequence
  SiRNA target sequence
tatattttgcatctttaataagatca

SEQ ID NO: 92814 - DNA, 26 bp, Artificial sequence
  SiRNA target sequence
atattttgcatctttaataagatcat

SEQ ID NO: 92815 - DNA, 26 bp, Artificial sequence
  SiRNA target sequence
tattttgcatctttaataagatcatc

SEQ ID NO: 92816 - DNA, 26 bp, Artificial sequence
  SiRNA target sequence
attttgcatctttaataagatcatct

SEQ ID NO: 92817 - DNA, 26 bp, Artificial sequence
  SiRNA target sequence
ttttgcatctttaataagatcatctt

SEQ ID NO: 92818 - DNA, 26 bp, Artificial sequence
  SiRNA target sequence
tttgcatctttaataagatcatcttc

SEQ ID NO: 92819 - DNA, 26 bp, Artificial sequence
  SiRNA target sequence
ttgcatctttaataagatcatcttct

SEQ ID NO: 92820 - DNA, 26 bp, Artificial sequence
  SiRNA target sequence
tgcatctttaataagatcatcttctt

SEQ ID NO: 92821 - DNA, 26 bp, Artificial sequence
  SiRNA target sequence
gcatctttaataagatcatcttcttg

SEQ ID NO: 92822 - DNA, 26 bp, Artificial sequence
  SiRNA target sequence
catctttaataagatcatcttcttga

SEQ ID NO: 92823 - DNA, 26 bp, Artificial sequence
  SiRNA target sequence
atctttaataagatcatcttcttgat

SEQ ID NO: 92824 - DNA, 26 bp, Artificial sequence
  SiRNA target sequence
tctttaataagatcatcttcttgatt

SEQ ID NO: 92825 - DNA, 26 bp, Artificial sequence
  SiRNA target sequence
ctttaataagatcatcttcttgattt

SEQ ID NO: 92826 - DNA, 26 bp, Artificial sequence
  SiRNA target sequence
tttaataagatcatcttcttgatttc

SEQ ID NO: 92827 - DNA, 26 bp, Artificial sequence
  SiRNA target sequence
ttaataagatcatcttcttgatttct

SEQ ID NO: 92828 - DNA, 26 bp, Artificial sequence
  SiRNA target sequence
taataagatcatcttcttgatttcta

SEQ ID NO: 92829 - DNA, 26 bp, Artificial sequence
  SiRNA target sequence
aataagatcatcttcttgatttctaa

SEQ ID NO: 92830 - DNA, 26 bp, Artificial sequence
  SiRNA target sequence
ataagatcatcttcttgatttctaaa

SEQ ID NO: 92831 - DNA, 26 bp, Artificial sequence
  SiRNA target sequence
taagatcatcttcttgatttctaaat

SEQ ID NO: 92832 - DNA, 26 bp, Artificial sequence
  SiRNA target sequence
aagatcatcttcttgatttctaaatc

SEQ ID NO: 92833 - DNA, 26 bp, Artificial sequence
  SiRNA target sequence
agatcatcttcttgatttctaaatcc

SEQ ID NO: 92834 - DNA, 26 bp, Artificial sequence
  SiRNA target sequence
gatcatcttcttgatttctaaatcca

SEQ ID NO: 92835 - DNA, 26 bp, Artificial sequence
  SiRNA target sequence
atcatcttcttgatttctaaatccat

SEQ ID NO: 92836 - DNA, 26 bp, Artificial sequence
  SiRNA target sequence
tcatcttcttgatttctaaatccata

SEQ ID NO: 92837 - DNA, 26 bp, Artificial sequence
  SiRNA target sequence
catcttcttgatttctaaatccatat

SEQ ID NO: 92838 - DNA, 26 bp, Artificial sequence
  SiRNA target sequence
atcttcttgatttctaaatccatata

SEQ ID NO: 92839 - DNA, 26 bp, Artificial sequence
  SiRNA target sequence
tcttcttgatttctaaatccatatat

SEQ ID NO: 92840 - DNA, 26 bp, Artificial sequence
  SiRNA target sequence
cttcttgatttctaaatccatatatt

SEQ ID NO: 92841 - DNA, 26 bp, Artificial sequence
  SiRNA target sequence
ttcttgatttctaaatccatatatta

SEQ ID NO: 92842 - DNA, 26 bp, Artificial sequence
  SiRNA target sequence
tcttgatttctaaatccatatattag

SEQ ID NO: 92843 - DNA, 26 bp, Artificial sequence
  SiRNA target sequence
cttgatttctaaatccatatattagt

SEQ ID NO: 92844 - DNA, 26 bp, Artificial sequence
  SiRNA target sequence
ttgatttctaaatccatatattagtt

SEQ ID NO: 92845 - DNA, 26 bp, Artificial sequence
  SiRNA target sequence
tgatttctaaatccatatattagttt

SEQ ID NO: 92846 - DNA, 26 bp, Artificial sequence
  SiRNA target sequence
gatttctaaatccatatattagtttg

SEQ ID NO: 92847 - DNA, 26 bp, Artificial sequence
  SiRNA target sequence
atttctaaatccatatattagtttga

SEQ ID NO: 92848 - DNA, 26 bp, Artificial sequence
  SiRNA target sequence
tttctaaatccatatattagtttgat

SEQ ID NO: 92849 - DNA, 26 bp, Artificial sequence
  SiRNA target sequence
ttctaaatccatatattagtttgata

SEQ ID NO: 92850 - DNA, 26 bp, Artificial sequence
  SiRNA target sequence
tctaaatccatatattagtttgatat

SEQ ID NO: 92851 - DNA, 26 bp, Artificial sequence
  SiRNA target sequence
ctaaatccatatattagtttgatata

SEQ ID NO: 92852 - DNA, 26 bp, Artificial sequence
  SiRNA target sequence
taaatccatatattagtttgatatat

SEQ ID NO: 92853 - DNA, 26 bp, Artificial sequence
  SiRNA target sequence
aaatccatatattagtttgatatatt

SEQ ID NO: 92854 - DNA, 26 bp, Artificial sequence
  SiRNA target sequence
aatccatatattagtttgatatattg

SEQ ID NO: 92855 - DNA, 26 bp, Artificial sequence
  SiRNA target sequence
atccatatattagtttgatatattga

SEQ ID NO: 92856 - DNA, 26 bp, Artificial sequence
  SiRNA target sequence
tccatatattagtttgatatattgat

SEQ ID NO: 92857 - DNA, 26 bp, Artificial sequence
  SiRNA target sequence
ccatatattagtttgatatattgatc

SEQ ID NO: 92858 - DNA, 26 bp, Artificial sequence
  SiRNA target sequence
catatattagtttgatatattgatcg

SEQ ID NO: 92859 - DNA, 26 bp, Artificial sequence
  SiRNA target sequence
atatattagtttgatatattgatcgt

SEQ ID NO: 92860 - DNA, 26 bp, Artificial sequence
  SiRNA target sequence
tatattagtttgatatattgatcgtc

SEQ ID NO: 92861 - DNA, 26 bp, Artificial sequence
  SiRNA target sequence
atattagtttgatatattgatcgtct

SEQ ID NO: 92862 - DNA, 26 bp, Artificial sequence
  SiRNA target sequence
tattagtttgatatattgatcgtctt

SEQ ID NO: 92863 - DNA, 26 bp, Artificial sequence
  SiRNA target sequence
attagtttgatatattgatcgtcttc

SEQ ID NO: 92864 - DNA, 26 bp, Artificial sequence
  SiRNA target sequence
ttagtttgatatattgatcgtcttct

SEQ ID NO: 92865 - DNA, 26 bp, Artificial sequence
  SiRNA target sequence
tagtttgatatattgatcgtcttctt

SEQ ID NO: 92866 - DNA, 26 bp, Artificial sequence
  SiRNA target sequence
agtttgatatattgatcgtcttcttt

SEQ ID NO: 92867 - DNA, 26 bp, Artificial sequence
  SiRNA target sequence
gtttgatatattgatcgtcttcttta

SEQ ID NO: 92868 - DNA, 26 bp, Artificial sequence
  SiRNA target sequence
tttgatatattgatcgtcttctttat

SEQ ID NO: 92869 - DNA, 26 bp, Artificial sequence
  SiRNA target sequence
ttgatatattgatcgtcttctttatt

SEQ ID NO: 92870 - DNA, 26 bp, Artificial sequence
  SiRNA target sequence
tgatatattgatcgtcttctttattt

SEQ ID NO: 92871 - DNA, 26 bp, Artificial sequence
  SiRNA target sequence
gatatattgatcgtcttctttatttt

SEQ ID NO: 92872 - DNA, 26 bp, Artificial sequence
  SiRNA target sequence
atatattgatcgtcttctttattttt

SEQ ID NO: 92873 - DNA, 26 bp, Artificial sequence
  SiRNA target sequence
tatattgatcgtcttctttatttttc

SEQ ID NO: 92874 - DNA, 26 bp, Artificial sequence
  SiRNA target sequence
atattgatcgtcttctttatttttca

SEQ ID NO: 92875 - DNA, 26 bp, Artificial sequence
  SiRNA target sequence
tattgatcgtcttctttatttttcaa

SEQ ID NO: 92876 - DNA, 26 bp, Artificial sequence
  SiRNA target sequence
attgatcgtcttctttatttttcaaa

SEQ ID NO: 92877 - DNA, 26 bp, Artificial sequence
  SiRNA target sequence
ttgatcgtcttctttatttttcaaaa

SEQ ID NO: 92878 - DNA, 26 bp, Artificial sequence
  SiRNA target sequence
tgatcgtcttctttatttttcaaaaa

SEQ ID NO: 92879 - DNA, 26 bp, Artificial sequence
  SiRNA target sequence
gatcgtcttctttatttttcaaaaac

SEQ ID NO: 92880 - DNA, 26 bp, Artificial sequence
  SiRNA target sequence
atcgtcttctttatttttcaaaaacg

SEQ ID NO: 92881 - DNA, 26 bp, Artificial sequence
  SiRNA target sequence
tcgtcttctttatttttcaaaaacga

SEQ ID NO: 92882 - DNA, 26 bp, Artificial sequence
  SiRNA target sequence
cgtcttctttatttttcaaaaacgaa

SEQ ID NO: 92883 - DNA, 26 bp, Artificial sequence
  SiRNA target sequence
gtcttctttatttttcaaaaacgaaa

SEQ ID NO: 92884 - DNA, 26 bp, Artificial sequence
  SiRNA target sequence
tcttctttatttttcaaaaacgaaaa

SEQ ID NO: 92885 - DNA, 26 bp, Artificial sequence
  SiRNA target sequence
cttctttatttttcaaaaacgaaaaa

SEQ ID NO: 92886 - DNA, 26 bp, Artificial sequence
  SiRNA target sequence
ttctttatttttcaaaaacgaaaaaa

SEQ ID NO: 92887 - DNA, 26 bp, Artificial sequence
  SiRNA target sequence
tctttatttttcaaaaacgaaaaaaa

SEQ ID NO: 92888 - DNA, 26 bp, Artificial sequence
  SiRNA target sequence
ctttatttttcaaaaacgaaaaaaat

SEQ ID NO: 92889 - DNA, 26 bp, Artificial sequence
  SiRNA target sequence
tttatttttcaaaaacgaaaaaaatg

SEQ ID NO: 92890 - DNA, 26 bp, Artificial sequence
  SiRNA target sequence
ttatttttcaaaaacgaaaaaaatgg

SEQ ID NO: 92891 - DNA, 26 bp, Artificial sequence
  SiRNA target sequence
tatttttcaaaaacgaaaaaaatgga

SEQ ID NO: 92892 - DNA, 26 bp, Artificial sequence
  SiRNA target sequence
atttttcaaaaacgaaaaaaatggag

SEQ ID NO: 92893 - DNA, 26 bp, Artificial sequence
  SiRNA target sequence
tttttcaaaaacgaaaaaaatggagc

SEQ ID NO: 92894 - DNA, 26 bp, Artificial sequence
  SiRNA target sequence
ttttcaaaaacgaaaaaaatggagca

SEQ ID NO: 92895 - DNA, 26 bp, Artificial sequence
  SiRNA target sequence
tttcaaaaacgaaaaaaatggagcaa

SEQ ID NO: 92896 - DNA, 26 bp, Artificial sequence
  SiRNA target sequence
ttcaaaaacgaaaaaaatggagcaat

SEQ ID NO: 92897 - DNA, 26 bp, Artificial sequence
  SiRNA target sequence
tcaaaaacgaaaaaaatggagcaatg

SEQ ID NO: 92898 - DNA, 26 bp, Artificial sequence
  SiRNA target sequence
caaaaacgaaaaaaatggagcaatgc

SEQ ID NO: 92899 - DNA, 26 bp, Artificial sequence
  SiRNA target sequence
aaaaacgaaaaaaatggagcaatgcc

SEQ ID NO: 92900 - DNA, 26 bp, Artificial sequence
  SiRNA target sequence
aaaacgaaaaaaatggagcaatgcca

SEQ ID NO: 92901 - DNA, 26 bp, Artificial sequence
  SiRNA target sequence
aaacgaaaaaaatggagcaatgccag

SEQ ID NO: 92902 - DNA, 26 bp, Artificial sequence
  SiRNA target sequence
aacgaaaaaaatggagcaatgccagt

SEQ ID NO: 92903 - DNA, 26 bp, Artificial sequence
  SiRNA target sequence
acgaaaaaaatggagcaatgccagtt

SEQ ID NO: 92904 - DNA, 26 bp, Artificial sequence
  SiRNA target sequence
cgaaaaaaatggagcaatgccagttc

SEQ ID NO: 92905 - DNA, 26 bp, Artificial sequence
  SiRNA target sequence
gaaaaaaatggagcaatgccagttcc

SEQ ID NO: 92906 - DNA, 26 bp, Artificial sequence
  SiRNA target sequence
aaaaaaatggagcaatgccagttcca

SEQ ID NO: 92907 - DNA, 26 bp, Artificial sequence
  SiRNA target sequence
aaaaaatggagcaatgccagttccag

SEQ ID NO: 92908 - DNA, 26 bp, Artificial sequence
  SiRNA target sequence
aaaaatggagcaatgccagttccagt

SEQ ID NO: 92909 - DNA, 26 bp, Artificial sequence
  SiRNA target sequence
aaaatggagcaatgccagttccagta

SEQ ID NO: 92910 - DNA, 26 bp, Artificial sequence
  SiRNA target sequence
aaatggagcaatgccagttccagtac

SEQ ID NO: 92911 - DNA, 26 bp, Artificial sequence
  SiRNA target sequence
aatggagcaatgccagttccagtaca

SEQ ID NO: 92912 - DNA, 26 bp, Artificial sequence
  SiRNA target sequence
atggagcaatgccagttccagtacaa

SEQ ID NO: 92913 - DNA, 26 bp, Artificial sequence
  SiRNA target sequence
tggagcaatgccagttccagtacaaa

SEQ ID NO: 92914 - DNA, 26 bp, Artificial sequence
  SiRNA target sequence
ggagcaatgccagttccagtacaaat

SEQ ID NO: 92915 - DNA, 26 bp, Artificial sequence
  SiRNA target sequence
gagcaatgccagttccagtacaaata

SEQ ID NO: 92916 - DNA, 26 bp, Artificial sequence
  SiRNA target sequence
agcaatgccagttccagtacaaatac

SEQ ID NO: 92917 - DNA, 26 bp, Artificial sequence
  SiRNA target sequence
gcaatgccagttccagtacaaatacc

SEQ ID NO: 92918 - DNA, 26 bp, Artificial sequence
  SiRNA target sequence
caatgccagttccagtacaaataccc

SEQ ID NO: 92919 - DNA, 26 bp, Artificial sequence
  SiRNA target sequence
aatgccagttccagtacaaataccca

SEQ ID NO: 92920 - DNA, 26 bp, Artificial sequence
  SiRNA target sequence
atgccagttccagtacaaatacccaa

SEQ ID NO: 92921 - DNA, 26 bp, Artificial sequence
  SiRNA target sequence
tgccagttccagtacaaatacccaac

SEQ ID NO: 92922 - DNA, 26 bp, Artificial sequence
  SiRNA target sequence
gccagttccagtacaaatacccaaca

SEQ ID NO: 92923 - DNA, 26 bp, Artificial sequence
  SiRNA target sequence
ccagttccagtacaaatacccaacac

SEQ ID NO: 92924 - DNA, 26 bp, Artificial sequence
  SiRNA target sequence
cagttccagtacaaatacccaacact

SEQ ID NO: 92925 - DNA, 26 bp, Artificial sequence
  SiRNA target sequence
agttccagtacaaatacccaacactt

SEQ ID NO: 92926 - DNA, 26 bp, Artificial sequence
  SiRNA target sequence
gttccagtacaaatacccaacacttt

SEQ ID NO: 92927 - DNA, 26 bp, Artificial sequence
  SiRNA target sequence
ttccagtacaaatacccaacactttt

SEQ ID NO: 92928 - DNA, 26 bp, Artificial sequence
  SiRNA target sequence
tccagtacaaatacccaacacttttt

SEQ ID NO: 92929 - DNA, 26 bp, Artificial sequence
  SiRNA target sequence
ccagtacaaatacccaacactttttt

SEQ ID NO: 92930 - DNA, 26 bp, Artificial sequence
  SiRNA target sequence
cagtacaaatacccaacactttttta

SEQ ID NO: 92931 - DNA, 26 bp, Artificial sequence
  SiRNA target sequence
agtacaaatacccaacacttttttac

SEQ ID NO: 92932 - DNA, 26 bp, Artificial sequence
  SiRNA target sequence
gtacaaatacccaacacttttttaca

SEQ ID NO: 92933 - DNA, 26 bp, Artificial sequence
  SiRNA target sequence
tacaaatacccaacacttttttacaa

SEQ ID NO: 92934 - DNA, 26 bp, Artificial sequence
  SiRNA target sequence
acaaatacccaacacttttttacaaa

SEQ ID NO: 92935 - DNA, 26 bp, Artificial sequence
  SiRNA target sequence
caaatacccaacacttttttacaaaa

SEQ ID NO: 92936 - DNA, 26 bp, Artificial sequence
  SiRNA target sequence
aaatacccaacacttttttacaaaaa

SEQ ID NO: 92937 - DNA, 26 bp, Artificial sequence
  SiRNA target sequence
aatacccaacacttttttacaaaaat

SEQ ID NO: 92938 - DNA, 26 bp, Artificial sequence
  SiRNA target sequence
atacccaacacttttttacaaaaatt

SEQ ID NO: 92939 - DNA, 26 bp, Artificial sequence
  SiRNA target sequence
tacccaacacttttttacaaaaattt

SEQ ID NO: 92940 - DNA, 26 bp, Artificial sequence
  SiRNA target sequence
acccaacacttttttacaaaaattta

SEQ ID NO: 92941 - DNA, 26 bp, Artificial sequence
  SiRNA target sequence
cccaacacttttttacaaaaatttaa

SEQ ID NO: 92942 - DNA, 26 bp, Artificial sequence
  SiRNA target sequence
ccaacacttttttacaaaaatttaat

SEQ ID NO: 92943 - DNA, 26 bp, Artificial sequence
  SiRNA target sequence
caacacttttttacaaaaatttaatc

SEQ ID NO: 92944 - DNA, 26 bp, Artificial sequence
  SiRNA target sequence
aacacttttttacaaaaatttaatct

SEQ ID NO: 92945 - DNA, 26 bp, Artificial sequence
  SiRNA target sequence
acacttttttacaaaaatttaatcta

SEQ ID NO: 92946 - DNA, 26 bp, Artificial sequence
  SiRNA target sequence
cacttttttacaaaaatttaatctaa

SEQ ID NO: 92947 - DNA, 26 bp, Artificial sequence
  SiRNA target sequence
acttttttacaaaaatttaatctaaa

SEQ ID NO: 92948 - DNA, 26 bp, Artificial sequence
  SiRNA target sequence
cttttttacaaaaatttaatctaaat

SEQ ID NO: 92949 - DNA, 26 bp, Artificial sequence
  SiRNA target sequence
ttttttacaaaaatttaatctaaata

SEQ ID NO: 92950 - DNA, 26 bp, Artificial sequence
  SiRNA target sequence
tttttacaaaaatttaatctaaataa

SEQ ID NO: 92951 - DNA, 26 bp, Artificial sequence
  SiRNA target sequence
ttttacaaaaatttaatctaaataat

SEQ ID NO: 92952 - DNA, 26 bp, Artificial sequence
  SiRNA target sequence
tttacaaaaatttaatctaaataatt

SEQ ID NO: 92953 - DNA, 26 bp, Artificial sequence
  SiRNA target sequence
ttacaaaaatttaatctaaataattt

SEQ ID NO: 92954 - DNA, 26 bp, Artificial sequence
  SiRNA target sequence
tacaaaaatttaatctaaataattta

SEQ ID NO: 92955 - DNA, 26 bp, Artificial sequence
  SiRNA target sequence
acaaaaatttaatctaaataatttac

SEQ ID NO: 92956 - DNA, 26 bp, Artificial sequence
  SiRNA target sequence
caaaaatttaatctaaataatttact

SEQ ID NO: 92957 - DNA, 26 bp, Artificial sequence
  SiRNA target sequence
aaaaatttaatctaaataatttactc

SEQ ID NO: 92958 - DNA, 26 bp, Artificial sequence
  SiRNA target sequence
aaaatttaatctaaataatttactcg

SEQ ID NO: 92959 - DNA, 26 bp, Artificial sequence
  SiRNA target sequence
aaatttaatctaaataatttactcgg

SEQ ID NO: 92960 - DNA, 26 bp, Artificial sequence
  SiRNA target sequence
aatttaatctaaataatttactcggt

SEQ ID NO: 92961 - DNA, 26 bp, Artificial sequence
  SiRNA target sequence
atttaatctaaataatttactcggtc

SEQ ID NO: 92962 - DNA, 26 bp, Artificial sequence
  SiRNA target sequence
tttaatctaaataatttactcggtct

SEQ ID NO: 92963 - DNA, 26 bp, Artificial sequence
  SiRNA target sequence
ttaatctaaataatttactcggtctg

SEQ ID NO: 92964 - DNA, 26 bp, Artificial sequence
  SiRNA target sequence
taatctaaataatttactcggtctgt

SEQ ID NO: 92965 - DNA, 26 bp, Artificial sequence
  SiRNA target sequence
aatctaaataatttactcggtctgtg

SEQ ID NO: 92966 - DNA, 26 bp, Artificial sequence
  SiRNA target sequence
atctaaataatttactcggtctgtga

SEQ ID NO: 92967 - DNA, 26 bp, Artificial sequence
  SiRNA target sequence
tctaaataatttactcggtctgtgac

SEQ ID NO: 92968 - DNA, 26 bp, Artificial sequence
  SiRNA target sequence
ctaaataatttactcggtctgtgaca

SEQ ID NO: 92969 - DNA, 26 bp, Artificial sequence
  SiRNA target sequence
taaataatttactcggtctgtgacag

SEQ ID NO: 92970 - DNA, 26 bp, Artificial sequence
  SiRNA target sequence
aaataatttactcggtctgtgacaga

SEQ ID NO: 92971 - DNA, 26 bp, Artificial sequence
  SiRNA target sequence
aataatttactcggtctgtgacagat

SEQ ID NO: 92972 - DNA, 26 bp, Artificial sequence
  SiRNA target sequence
ataatttactcggtctgtgacagatc

SEQ ID NO: 92973 - DNA, 26 bp, Artificial sequence
  SiRNA target sequence
taatttactcggtctgtgacagatct

SEQ ID NO: 92974 - DNA, 26 bp, Artificial sequence
  SiRNA target sequence
aatttactcggtctgtgacagatctt

SEQ ID NO: 92975 - DNA, 26 bp, Artificial sequence
  SiRNA target sequence
atttactcggtctgtgacagatcttt

SEQ ID NO: 92976 - DNA, 26 bp, Artificial sequence
  SiRNA target sequence
tttactcggtctgtgacagatcttta

SEQ ID NO: 92977 - DNA, 26 bp, Artificial sequence
  SiRNA target sequence
ttactcggtctgtgacagatctttaa

SEQ ID NO: 92978 - DNA, 26 bp, Artificial sequence
  SiRNA target sequence
tactcggtctgtgacagatctttaaa

SEQ ID NO: 92979 - DNA, 26 bp, Artificial sequence
  SiRNA target sequence
actcggtctgtgacagatctttaaat

SEQ ID NO: 92980 - DNA, 26 bp, Artificial sequence
  SiRNA target sequence
ctcggtctgtgacagatctttaaatt

SEQ ID NO: 92981 - DNA, 26 bp, Artificial sequence
  SiRNA target sequence
tcggtctgtgacagatctttaaatta

SEQ ID NO: 92982 - DNA, 26 bp, Artificial sequence
  SiRNA target sequence
cggtctgtgacagatctttaaattat

SEQ ID NO: 92983 - DNA, 26 bp, Artificial sequence
  SiRNA target sequence
ggtctgtgacagatctttaaattatt

SEQ ID NO: 92984 - DNA, 26 bp, Artificial sequence
  SiRNA target sequence
gtctgtgacagatctttaaattatta

SEQ ID NO: 92985 - DNA, 26 bp, Artificial sequence
  SiRNA target sequence
tctgtgacagatctttaaattattat

SEQ ID NO: 92986 - DNA, 26 bp, Artificial sequence
  SiRNA target sequence
ctgtgacagatctttaaattattata

SEQ ID NO: 92987 - DNA, 26 bp, Artificial sequence
  SiRNA target sequence
tgtgacagatctttaaattattataa

SEQ ID NO: 92988 - DNA, 26 bp, Artificial sequence
  SiRNA target sequence
gtgacagatctttaaattattataat

SEQ ID NO: 92989 - DNA, 26 bp, Artificial sequence
  SiRNA target sequence
tgacagatctttaaattattataatt

SEQ ID NO: 92990 - DNA, 26 bp, Artificial sequence
  SiRNA target sequence
gacagatctttaaattattataattt

SEQ ID NO: 92991 - DNA, 26 bp, Artificial sequence
  SiRNA target sequence
acagatctttaaattattataatttt

SEQ ID NO: 92992 - DNA, 26 bp, Artificial sequence
  SiRNA target sequence
cagatctttaaattattataattttg

SEQ ID NO: 92993 - DNA, 26 bp, Artificial sequence
  SiRNA target sequence
agatctttaaattattataattttgc

SEQ ID NO: 92994 - DNA, 26 bp, Artificial sequence
  SiRNA target sequence
gatctttaaattattataattttgca

SEQ ID NO: 92995 - DNA, 26 bp, Artificial sequence
  SiRNA target sequence
atctttaaattattataattttgcat

SEQ ID NO: 92996 - DNA, 26 bp, Artificial sequence
  SiRNA target sequence
tctttaaattattataattttgcata

SEQ ID NO: 92997 - DNA, 26 bp, Artificial sequence
  SiRNA target sequence
ctttaaattattataattttgcatat

SEQ ID NO: 92998 - DNA, 26 bp, Artificial sequence
  SiRNA target sequence
tttaaattattataattttgcatatc

SEQ ID NO: 92999 - DNA, 26 bp, Artificial sequence
  SiRNA target sequence
ttaaattattataattttgcatatct

SEQ ID NO: 93000 - DNA, 26 bp, Artificial sequence
  SiRNA target sequence
taaattattataattttgcatatcta

SEQ ID NO: 93001 - DNA, 26 bp, Artificial sequence
  SiRNA target sequence
aaattattataattttgcatatctat

SEQ ID NO: 93002 - DNA, 26 bp, Artificial sequence
  SiRNA target sequence
aattattataattttgcatatctatg

SEQ ID NO: 93003 - DNA, 26 bp, Artificial sequence
  SiRNA target sequence
attattataattttgcatatctatga

SEQ ID NO: 93004 - DNA, 26 bp, Artificial sequence
  SiRNA target sequence
ttattataattttgcatatctatgaa

SEQ ID NO: 93005 - DNA, 26 bp, Artificial sequence
  SiRNA target sequence
tattataattttgcatatctatgaaa

SEQ ID NO: 93006 - DNA, 26 bp, Artificial sequence
  SiRNA target sequence
attataattttgcatatctatgaaat

SEQ ID NO: 93007 - DNA, 26 bp, Artificial sequence
  SiRNA target sequence
ttataattttgcatatctatgaaatt

SEQ ID NO: 93008 - DNA, 26 bp, Artificial sequence
  SiRNA target sequence
tataattttgcatatctatgaaattg

SEQ ID NO: 93009 - DNA, 26 bp, Artificial sequence
  SiRNA target sequence
ataattttgcatatctatgaaattgg

SEQ ID NO: 93010 - DNA, 26 bp, Artificial sequence
  SiRNA target sequence
taattttgcatatctatgaaattgga

SEQ ID NO: 93011 - DNA, 26 bp, Artificial sequence
  SiRNA target sequence
aattttgcatatctatgaaattggaa

SEQ ID NO: 93012 - DNA, 26 bp, Artificial sequence
  SiRNA target sequence
attttgcatatctatgaaattggaaa

SEQ ID NO: 93013 - DNA, 26 bp, Artificial sequence
  SiRNA target sequence
ttttgcatatctatgaaattggaaac

SEQ ID NO: 93014 - DNA, 26 bp, Artificial sequence
  SiRNA target sequence
tttgcatatctatgaaattggaaaca

SEQ ID NO: 93015 - DNA, 26 bp, Artificial sequence
  SiRNA target sequence
ttgcatatctatgaaattggaaacat

SEQ ID NO: 93016 - DNA, 26 bp, Artificial sequence
  SiRNA target sequence
tgcatatctatgaaattggaaacatg

SEQ ID NO: 93017 - DNA, 26 bp, Artificial sequence
  SiRNA target sequence
gcatatctatgaaattggaaacatgt

SEQ ID NO: 93018 - DNA, 26 bp, Artificial sequence
  SiRNA target sequence
catatctatgaaattggaaacatgtc

SEQ ID NO: 93019 - DNA, 26 bp, Artificial sequence
  SiRNA target sequence
atatctatgaaattggaaacatgtcc

SEQ ID NO: 93020 - DNA, 26 bp, Artificial sequence
  SiRNA target sequence
tatctatgaaattggaaacatgtcca

SEQ ID NO: 93021 - DNA, 26 bp, Artificial sequence
  SiRNA target sequence
atctatgaaattggaaacatgtccat

SEQ ID NO: 93022 - DNA, 26 bp, Artificial sequence
  SiRNA target sequence
tctatgaaattggaaacatgtccata

SEQ ID NO: 93023 - DNA, 26 bp, Artificial sequence
  SiRNA target sequence
ctatgaaattggaaacatgtccatat

SEQ ID NO: 93024 - DNA, 26 bp, Artificial sequence
  SiRNA target sequence
tatgaaattggaaacatgtccatatc

SEQ ID NO: 93025 - DNA, 26 bp, Artificial sequence
  SiRNA target sequence
atgaaattggaaacatgtccatatct

SEQ ID NO: 93026 - DNA, 26 bp, Artificial sequence
  SiRNA target sequence
tgaaattggaaacatgtccatatcta

SEQ ID NO: 93027 - DNA, 26 bp, Artificial sequence
  SiRNA target sequence
gaaattggaaacatgtccatatctat

SEQ ID NO: 93028 - DNA, 26 bp, Artificial sequence
  SiRNA target sequence
aaattggaaacatgtccatatctatc

SEQ ID NO: 93029 - DNA, 26 bp, Artificial sequence
  SiRNA target sequence
aattggaaacatgtccatatctatcg

SEQ ID NO: 93030 - DNA, 26 bp, Artificial sequence
  SiRNA target sequence
attggaaacatgtccatatctatcgc

SEQ ID NO: 93031 - DNA, 26 bp, Artificial sequence
  SiRNA target sequence
ttggaaacatgtccatatctatcgcc

SEQ ID NO: 93032 - DNA, 26 bp, Artificial sequence
  SiRNA target sequence
tggaaacatgtccatatctatcgcct

SEQ ID NO: 93033 - DNA, 26 bp, Artificial sequence
  SiRNA target sequence
ggaaacatgtccatatctatcgcctt

SEQ ID NO: 93034 - DNA, 26 bp, Artificial sequence
  SiRNA target sequence
gaaacatgtccatatctatcgccttt

SEQ ID NO: 93035 - DNA, 26 bp, Artificial sequence
  SiRNA target sequence
aaacatgtccatatctatcgcctttt

SEQ ID NO: 93036 - DNA, 26 bp, Artificial sequence
  SiRNA target sequence
aacatgtccatatctatcgccttttt

SEQ ID NO: 93037 - DNA, 26 bp, Artificial sequence
  SiRNA target sequence
acatgtccatatctatcgcctttttt

SEQ ID NO: 93038 - DNA, 26 bp, Artificial sequence
  SiRNA target sequence
catgtccatatctatcgcctttttta

SEQ ID NO: 93039 - DNA, 26 bp, Artificial sequence
  SiRNA target sequence
atgtccatatctatcgccttttttaa

SEQ ID NO: 93040 - DNA, 26 bp, Artificial sequence
  SiRNA target sequence
tgtccatatctatcgccttttttaat

SEQ ID NO: 93041 - DNA, 26 bp, Artificial sequence
  SiRNA target sequence
gtccatatctatcgccttttttaata

SEQ ID NO: 93042 - DNA, 26 bp, Artificial sequence
  SiRNA target sequence
tccatatctatcgccttttttaataa

SEQ ID NO: 93043 - DNA, 26 bp, Artificial sequence
  SiRNA target sequence
ccatatctatcgccttttttaataat

SEQ ID NO: 93044 - DNA, 26 bp, Artificial sequence
  SiRNA target sequence
catatctatcgccttttttaataatt

SEQ ID NO: 93045 - DNA, 26 bp, Artificial sequence
  SiRNA target sequence
atatctatcgccttttttaataattg

SEQ ID NO: 93046 - DNA, 26 bp, Artificial sequence
  SiRNA target sequence
tatctatcgccttttttaataattgc

SEQ ID NO: 93047 - DNA, 26 bp, Artificial sequence
  SiRNA target sequence
atctatcgccttttttaataattgct

SEQ ID NO: 93048 - DNA, 26 bp, Artificial sequence
  SiRNA target sequence
tctatcgccttttttaataattgcta

SEQ ID NO: 93049 - DNA, 26 bp, Artificial sequence
  SiRNA target sequence
ctatcgccttttttaataattgctac

SEQ ID NO: 93050 - DNA, 26 bp, Artificial sequence
  SiRNA target sequence
tatcgccttttttaataattgctact

SEQ ID NO: 93051 - DNA, 26 bp, Artificial sequence
  SiRNA target sequence
atcgccttttttaataattgctacta

SEQ ID NO: 93052 - DNA, 26 bp, Artificial sequence
  SiRNA target sequence
tcgccttttttaataattgctactaa

SEQ ID NO: 93053 - DNA, 26 bp, Artificial sequence
  SiRNA target sequence
cgccttttttaataattgctactaaa

SEQ ID NO: 93054 - DNA, 26 bp, Artificial sequence
  SiRNA target sequence
gccttttttaataattgctactaaaa

SEQ ID NO: 93055 - DNA, 26 bp, Artificial sequence
  SiRNA target sequence
ccttttttaataattgctactaaaat

SEQ ID NO: 93056 - DNA, 26 bp, Artificial sequence
  SiRNA target sequence
cttttttaataattgctactaaaatt

SEQ ID NO: 93057 - DNA, 26 bp, Artificial sequence
  SiRNA target sequence
ttttttaataattgctactaaaattt

SEQ ID NO: 93058 - DNA, 26 bp, Artificial sequence
  SiRNA target sequence
tttttaataattgctactaaaatttc

SEQ ID NO: 93059 - DNA, 26 bp, Artificial sequence
  SiRNA target sequence
ttttaataattgctactaaaatttca

SEQ ID NO: 93060 - DNA, 26 bp, Artificial sequence
  SiRNA target sequence
tttaataattgctactaaaatttcac

SEQ ID NO: 93061 - DNA, 26 bp, Artificial sequence
  SiRNA target sequence
ttaataattgctactaaaatttcaca

SEQ ID NO: 93062 - DNA, 26 bp, Artificial sequence
  SiRNA target sequence
taataattgctactaaaatttcacat

SEQ ID NO: 93063 - DNA, 26 bp, Artificial sequence
  SiRNA target sequence
aataattgctactaaaatttcacatt

SEQ ID NO: 93064 - DNA, 26 bp, Artificial sequence
  SiRNA target sequence
ataattgctactaaaatttcacattt

SEQ ID NO: 93065 - DNA, 26 bp, Artificial sequence
  SiRNA target sequence
taattgctactaaaatttcacatttt

SEQ ID NO: 93066 - DNA, 26 bp, Artificial sequence
  SiRNA target sequence
aattgctactaaaatttcacattttt

SEQ ID NO: 93067 - DNA, 26 bp, Artificial sequence
  SiRNA target sequence
attgctactaaaatttcacatttttc

SEQ ID NO: 93068 - DNA, 26 bp, Artificial sequence
  SiRNA target sequence
ttgctactaaaatttcacatttttca

SEQ ID NO: 93069 - DNA, 26 bp, Artificial sequence
  SiRNA target sequence
tgctactaaaatttcacatttttcat

SEQ ID NO: 93070 - DNA, 26 bp, Artificial sequence
  SiRNA target sequence
gctactaaaatttcacatttttcatt

SEQ ID NO: 93071 - DNA, 26 bp, Artificial sequence
  SiRNA target sequence
ctactaaaatttcacatttttcattt

SEQ ID NO: 93072 - DNA, 26 bp, Artificial sequence
  SiRNA target sequence
tactaaaatttcacatttttcattta

SEQ ID NO: 93073 - DNA, 26 bp, Artificial sequence
  SiRNA target sequence
actaaaatttcacatttttcatttac

SEQ ID NO: 93074 - DNA, 26 bp, Artificial sequence
  SiRNA target sequence
ctaaaatttcacatttttcatttacg

SEQ ID NO: 93075 - DNA, 26 bp, Artificial sequence
  SiRNA target sequence
taaaatttcacatttttcatttacgt

SEQ ID NO: 93076 - DNA, 26 bp, Artificial sequence
  SiRNA target sequence
aaaatttcacatttttcatttacgtg

SEQ ID NO: 93077 - DNA, 26 bp, Artificial sequence
  SiRNA target sequence
aaatttcacatttttcatttacgtgg

SEQ ID NO: 93078 - DNA, 26 bp, Artificial sequence
  SiRNA target sequence
aatttcacatttttcatttacgtggt

SEQ ID NO: 93079 - DNA, 26 bp, Artificial sequence
  SiRNA target sequence
atttcacatttttcatttacgtggtt

SEQ ID NO: 93080 - DNA, 26 bp, Artificial sequence
  SiRNA target sequence
tttcacatttttcatttacgtggtta

SEQ ID NO: 93081 - DNA, 26 bp, Artificial sequence
  SiRNA target sequence
ttcacatttttcatttacgtggttag

SEQ ID NO: 93082 - DNA, 26 bp, Artificial sequence
  SiRNA target sequence
tcacatttttcatttacgtggttagt

SEQ ID NO: 93083 - DNA, 26 bp, Artificial sequence
  SiRNA target sequence
cacatttttcatttacgtggttagta

SEQ ID NO: 93084 - DNA, 26 bp, Artificial sequence
  SiRNA target sequence
acatttttcatttacgtggttagtaa

SEQ ID NO: 93085 - DNA, 26 bp, Artificial sequence
  SiRNA target sequence
catttttcatttacgtggttagtaag

SEQ ID NO: 93086 - DNA, 26 bp, Artificial sequence
  SiRNA target sequence
atttttcatttacgtggttagtaagt

SEQ ID NO: 93087 - DNA, 26 bp, Artificial sequence
  SiRNA target sequence
tttttcatttacgtggttagtaagtg

SEQ ID NO: 93088 - DNA, 26 bp, Artificial sequence
  SiRNA target sequence
ttttcatttacgtggttagtaagtga

SEQ ID NO: 93089 - DNA, 26 bp, Artificial sequence
  SiRNA target sequence
tttcatttacgtggttagtaagtgaa

SEQ ID NO: 93090 - DNA, 26 bp, Artificial sequence
  SiRNA target sequence
ttcatttacgtggttagtaagtgaat

SEQ ID NO: 93091 - DNA, 26 bp, Artificial sequence
  SiRNA target sequence
tcatttacgtggttagtaagtgaata

SEQ ID NO: 93092 - DNA, 26 bp, Artificial sequence
  SiRNA target sequence
catttacgtggttagtaagtgaataa

SEQ ID NO: 93093 - DNA, 26 bp, Artificial sequence
  SiRNA target sequence
atttacgtggttagtaagtgaataat

SEQ ID NO: 93094 - DNA, 26 bp, Artificial sequence
  SiRNA target sequence
tttacgtggttagtaagtgaataata

SEQ ID NO: 93095 - DNA, 26 bp, Artificial sequence
  SiRNA target sequence
ttacgtggttagtaagtgaataatat

SEQ ID NO: 93096 - DNA, 26 bp, Artificial sequence
  SiRNA target sequence
tacgtggttagtaagtgaataatatc

SEQ ID NO: 93097 - DNA, 26 bp, Artificial sequence
  SiRNA target sequence
acgtggttagtaagtgaataatatct

SEQ ID NO: 93098 - DNA, 26 bp, Artificial sequence
  SiRNA target sequence
cgtggttagtaagtgaataatatctt

SEQ ID NO: 93099 - DNA, 26 bp, Artificial sequence
  SiRNA target sequence
gtggttagtaagtgaataatatcttg

SEQ ID NO: 93100 - DNA, 26 bp, Artificial sequence
  SiRNA target sequence
tggttagtaagtgaataatatcttgg

SEQ ID NO: 93101 - DNA, 26 bp, Artificial sequence
  SiRNA target sequence
ggttagtaagtgaataatatcttggc

SEQ ID NO: 93102 - DNA, 26 bp, Artificial sequence
  SiRNA target sequence
gttagtaagtgaataatatcttggct

SEQ ID NO: 93103 - DNA, 26 bp, Artificial sequence
  SiRNA target sequence
ttagtaagtgaataatatcttggctt

SEQ ID NO: 93104 - DNA, 26 bp, Artificial sequence
  SiRNA target sequence
tagtaagtgaataatatcttggctta

SEQ ID NO: 93105 - DNA, 26 bp, Artificial sequence
  SiRNA target sequence
agtaagtgaataatatcttggcttaa

SEQ ID NO: 93106 - DNA, 26 bp, Artificial sequence
  SiRNA target sequence
gtaagtgaataatatcttggcttaat

SEQ ID NO: 93107 - DNA, 26 bp, Artificial sequence
  SiRNA target sequence
taagtgaataatatcttggcttaatt

SEQ ID NO: 93108 - DNA, 26 bp, Artificial sequence
  SiRNA target sequence
aagtgaataatatcttggcttaattg

SEQ ID NO: 93109 - DNA, 26 bp, Artificial sequence
  SiRNA target sequence
agtgaataatatcttggcttaattgt

SEQ ID NO: 93110 - DNA, 26 bp, Artificial sequence
  SiRNA target sequence
gtgaataatatcttggcttaattgtt

SEQ ID NO: 93111 - DNA, 26 bp, Artificial sequence
  SiRNA target sequence
tgaataatatcttggcttaattgttt

SEQ ID NO: 93112 - DNA, 26 bp, Artificial sequence
  SiRNA target sequence
gaataatatcttggcttaattgtttg

SEQ ID NO: 93113 - DNA, 26 bp, Artificial sequence
  SiRNA target sequence
aataatatcttggcttaattgtttga

SEQ ID NO: 93114 - DNA, 26 bp, Artificial sequence
  SiRNA target sequence
ataatatcttggcttaattgtttgac

SEQ ID NO: 93115 - DNA, 26 bp, Artificial sequence
  SiRNA target sequence
taatatcttggcttaattgtttgaca

SEQ ID NO: 93116 - DNA, 26 bp, Artificial sequence
  SiRNA target sequence
aatatcttggcttaattgtttgacaa

SEQ ID NO: 93117 - DNA, 26 bp, Artificial sequence
  SiRNA target sequence
atatcttggcttaattgtttgacaat

SEQ ID NO: 93118 - DNA, 26 bp, Artificial sequence
  SiRNA target sequence
tatcttggcttaattgtttgacaatt

SEQ ID NO: 93119 - DNA, 26 bp, Artificial sequence
  SiRNA target sequence
atcttggcttaattgtttgacaattc

SEQ ID NO: 93120 - DNA, 26 bp, Artificial sequence
  SiRNA target sequence
tcttggcttaattgtttgacaattca

SEQ ID NO: 93121 - DNA, 26 bp, Artificial sequence
  SiRNA target sequence
cttggcttaattgtttgacaattcat

SEQ ID NO: 93122 - DNA, 26 bp, Artificial sequence
  SiRNA target sequence
ttggcttaattgtttgacaattcata

SEQ ID NO: 93123 - DNA, 26 bp, Artificial sequence
  SiRNA target sequence
tggcttaattgtttgacaattcataa

SEQ ID NO: 93124 - DNA, 26 bp, Artificial sequence
  SiRNA target sequence
ggcttaattgtttgacaattcataat

SEQ ID NO: 93125 - DNA, 26 bp, Artificial sequence
  SiRNA target sequence
gcttaattgtttgacaattcataata

SEQ ID NO: 93126 - DNA, 26 bp, Artificial sequence
  SiRNA target sequence
cttaattgtttgacaattcataataa

SEQ ID NO: 93127 - DNA, 26 bp, Artificial sequence
  SiRNA target sequence
ttaattgtttgacaattcataataag

SEQ ID NO: 93128 - DNA, 26 bp, Artificial sequence
  SiRNA target sequence
taattgtttgacaattcataataaga

SEQ ID NO: 93129 - DNA, 26 bp, Artificial sequence
  SiRNA target sequence
aattgtttgacaattcataataagat

SEQ ID NO: 93130 - DNA, 26 bp, Artificial sequence
  SiRNA target sequence
attgtttgacaattcataataagatc

SEQ ID NO: 93131 - DNA, 26 bp, Artificial sequence
  SiRNA target sequence
ttgtttgacaattcataataagatcc

SEQ ID NO: 93132 - DNA, 26 bp, Artificial sequence
  SiRNA target sequence
tgtttgacaattcataataagatcct

SEQ ID NO: 93133 - DNA, 26 bp, Artificial sequence
  SiRNA target sequence
gtttgacaattcataataagatcctc

SEQ ID NO: 93134 - DNA, 26 bp, Artificial sequence
  SiRNA target sequence
tttgacaattcataataagatcctct

SEQ ID NO: 93135 - DNA, 26 bp, Artificial sequence
  SiRNA target sequence
ttgacaattcataataagatcctcta

SEQ ID NO: 93136 - DNA, 26 bp, Artificial sequence
  SiRNA target sequence
tgacaattcataataagatcctctaa

SEQ ID NO: 93137 - DNA, 26 bp, Artificial sequence
  SiRNA target sequence
gacaattcataataagatcctctaaa

SEQ ID NO: 93138 - DNA, 26 bp, Artificial sequence
  SiRNA target sequence
acaattcataataagatcctctaaac

SEQ ID NO: 93139 - DNA, 26 bp, Artificial sequence
  SiRNA target sequence
caattcataataagatcctctaaact

SEQ ID NO: 93140 - DNA, 26 bp, Artificial sequence
  SiRNA target sequence
aattcataataagatcctctaaactt

SEQ ID NO: 93141 - DNA, 26 bp, Artificial sequence
  SiRNA target sequence
attcataataagatcctctaaacttg

SEQ ID NO: 93142 - DNA, 26 bp, Artificial sequence
  SiRNA target sequence
ttcataataagatcctctaaacttgg

SEQ ID NO: 93143 - DNA, 26 bp, Artificial sequence
  SiRNA target sequence
tcataataagatcctctaaacttggt

SEQ ID NO: 93144 - DNA, 26 bp, Artificial sequence
  SiRNA target sequence
cataataagatcctctaaacttggtt

SEQ ID NO: 93145 - DNA, 26 bp, Artificial sequence
  SiRNA target sequence
ataataagatcctctaaacttggttt

SEQ ID NO: 93146 - DNA, 26 bp, Artificial sequence
  SiRNA target sequence
taataagatcctctaaacttggttta

SEQ ID NO: 93147 - DNA, 26 bp, Artificial sequence
  SiRNA target sequence
aataagatcctctaaacttggtttac

SEQ ID NO: 93148 - DNA, 26 bp, Artificial sequence
  SiRNA target sequence
ataagatcctctaaacttggtttaca

SEQ ID NO: 93149 - DNA, 26 bp, Artificial sequence
  SiRNA target sequence
taagatcctctaaacttggtttacat

SEQ ID NO: 93150 - DNA, 26 bp, Artificial sequence
  SiRNA target sequence
aagatcctctaaacttggtttacatt

SEQ ID NO: 93151 - DNA, 26 bp, Artificial sequence
  SiRNA target sequence
agatcctctaaacttggtttacattg

SEQ ID NO: 93152 - DNA, 26 bp, Artificial sequence
  SiRNA target sequence
gatcctctaaacttggtttacattga

SEQ ID NO: 93153 - DNA, 26 bp, Artificial sequence
  SiRNA target sequence
atcctctaaacttggtttacattgaa

SEQ ID NO: 93154 - DNA, 26 bp, Artificial sequence
  SiRNA target sequence
tcctctaaacttggtttacattgaaa

SEQ ID NO: 93155 - DNA, 26 bp, Artificial sequence
  SiRNA target sequence
cctctaaacttggtttacattgaaat

SEQ ID NO: 93156 - DNA, 26 bp, Artificial sequence
  SiRNA target sequence
ctctaaacttggtttacattgaaatg

SEQ ID NO: 93157 - DNA, 26 bp, Artificial sequence
  SiRNA target sequence
tctaaacttggtttacattgaaatgt

SEQ ID NO: 93158 - DNA, 26 bp, Artificial sequence
  SiRNA target sequence
ctaaacttggtttacattgaaatgta

SEQ ID NO: 93159 - DNA, 26 bp, Artificial sequence
  SiRNA target sequence
taaacttggtttacattgaaatgtat

SEQ ID NO: 93160 - DNA, 26 bp, Artificial sequence
  SiRNA target sequence
aaacttggtttacattgaaatgtata

SEQ ID NO: 93161 - DNA, 26 bp, Artificial sequence
  SiRNA target sequence
aacttggtttacattgaaatgtatat

SEQ ID NO: 93162 - DNA, 26 bp, Artificial sequence
  SiRNA target sequence
acttggtttacattgaaatgtatata

SEQ ID NO: 93163 - DNA, 26 bp, Artificial sequence
  SiRNA target sequence
cttggtttacattgaaatgtatatat

SEQ ID NO: 93164 - DNA, 26 bp, Artificial sequence
  SiRNA target sequence
ttggtttacattgaaatgtatatata

SEQ ID NO: 93165 - DNA, 26 bp, Artificial sequence
  SiRNA target sequence
tggtttacattgaaatgtatatataa

SEQ ID NO: 93166 - DNA, 26 bp, Artificial sequence
  SiRNA target sequence
ggtttacattgaaatgtatatataat

SEQ ID NO: 93167 - DNA, 26 bp, Artificial sequence
  SiRNA target sequence
gtttacattgaaatgtatatataatg

SEQ ID NO: 93168 - DNA, 26 bp, Artificial sequence
  SiRNA target sequence
tttacattgaaatgtatatataatgt

SEQ ID NO: 93169 - DNA, 26 bp, Artificial sequence
  SiRNA target sequence
ttacattgaaatgtatatataatgtc

SEQ ID NO: 93170 - DNA, 26 bp, Artificial sequence
  SiRNA target sequence
tacattgaaatgtatatataatgtca

SEQ ID NO: 93171 - DNA, 26 bp, Artificial sequence
  SiRNA target sequence
acattgaaatgtatatataatgtcaa

SEQ ID NO: 93172 - DNA, 26 bp, Artificial sequence
  SiRNA target sequence
cattgaaatgtatatataatgtcaag

SEQ ID NO: 93173 - DNA, 26 bp, Artificial sequence
  SiRNA target sequence
attgaaatgtatatataatgtcaagc

SEQ ID NO: 93174 - DNA, 26 bp, Artificial sequence
  SiRNA target sequence
ttgaaatgtatatataatgtcaagca

SEQ ID NO: 93175 - DNA, 26 bp, Artificial sequence
  SiRNA target sequence
tgaaatgtatatataatgtcaagcac

SEQ ID NO: 93176 - DNA, 26 bp, Artificial sequence
  SiRNA target sequence
gaaatgtatatataatgtcaagcaca

SEQ ID NO: 93177 - DNA, 26 bp, Artificial sequence
  SiRNA target sequence
aaatgtatatataatgtcaagcacat

SEQ ID NO: 93178 - DNA, 26 bp, Artificial sequence
  SiRNA target sequence
aatgtatatataatgtcaagcacatt

SEQ ID NO: 93179 - DNA, 26 bp, Artificial sequence
  SiRNA target sequence
atgtatatataatgtcaagcacatta

SEQ ID NO: 93180 - DNA, 26 bp, Artificial sequence
  SiRNA target sequence
tgtatatataatgtcaagcacattat

SEQ ID NO: 93181 - DNA, 26 bp, Artificial sequence
  SiRNA target sequence
gtatatataatgtcaagcacattatt

SEQ ID NO: 93182 - DNA, 26 bp, Artificial sequence
  SiRNA target sequence
tatatataatgtcaagcacattattc

SEQ ID NO: 93183 - DNA, 26 bp, Artificial sequence
  SiRNA target sequence
atatataatgtcaagcacattattcc

SEQ ID NO: 93184 - DNA, 26 bp, Artificial sequence
  SiRNA target sequence
tatataatgtcaagcacattattcca

SEQ ID NO: 93185 - DNA, 26 bp, Artificial sequence
  SiRNA target sequence
atataatgtcaagcacattattccag

SEQ ID NO: 93186 - DNA, 26 bp, Artificial sequence
  SiRNA target sequence
tataatgtcaagcacattattccagt

SEQ ID NO: 93187 - DNA, 26 bp, Artificial sequence
  SiRNA target sequence
ataatgtcaagcacattattccagtt

SEQ ID NO: 93188 - DNA, 26 bp, Artificial sequence
  SiRNA target sequence
taatgtcaagcacattattccagttc

SEQ ID NO: 93189 - DNA, 26 bp, Artificial sequence
  SiRNA target sequence
aatgtcaagcacattattccagttct

SEQ ID NO: 93190 - DNA, 26 bp, Artificial sequence
  SiRNA target sequence
atgtcaagcacattattccagttctt

SEQ ID NO: 93191 - DNA, 26 bp, Artificial sequence
  SiRNA target sequence
tgtcaagcacattattccagttctta

SEQ ID NO: 93192 - DNA, 26 bp, Artificial sequence
  SiRNA target sequence
gtcaagcacattattccagttcttaa

SEQ ID NO: 93193 - DNA, 26 bp, Artificial sequence
  SiRNA target sequence
tcaagcacattattccagttcttaat

SEQ ID NO: 93194 - DNA, 26 bp, Artificial sequence
  SiRNA target sequence
caagcacattattccagttcttaatg

SEQ ID NO: 93195 - DNA, 26 bp, Artificial sequence
  SiRNA target sequence
aagcacattattccagttcttaatga

SEQ ID NO: 93196 - DNA, 26 bp, Artificial sequence
  SiRNA target sequence
agcacattattccagttcttaatgat

SEQ ID NO: 93197 - DNA, 26 bp, Artificial sequence
  SiRNA target sequence
gcacattattccagttcttaatgatg

SEQ ID NO: 93198 - DNA, 26 bp, Artificial sequence
  SiRNA target sequence
cacattattccagttcttaatgatgc

SEQ ID NO: 93199 - DNA, 26 bp, Artificial sequence
  SiRNA target sequence
acattattccagttcttaatgatgct

SEQ ID NO: 93200 - DNA, 26 bp, Artificial sequence
  SiRNA target sequence
cattattccagttcttaatgatgctt

SEQ ID NO: 93201 - DNA, 26 bp, Artificial sequence
  SiRNA target sequence
attattccagttcttaatgatgctta

SEQ ID NO: 93202 - DNA, 26 bp, Artificial sequence
  SiRNA target sequence
ttattccagttcttaatgatgcttaa

SEQ ID NO: 93203 - DNA, 26 bp, Artificial sequence
  SiRNA target sequence
tattccagttcttaatgatgcttaaa

SEQ ID NO: 93204 - DNA, 26 bp, Artificial sequence
  SiRNA target sequence
attccagttcttaatgatgcttaaat

SEQ ID NO: 93205 - DNA, 26 bp, Artificial sequence
  SiRNA target sequence
ttccagttcttaatgatgcttaaata

SEQ ID NO: 93206 - DNA, 26 bp, Artificial sequence
  SiRNA target sequence
tccagttcttaatgatgcttaaataa

SEQ ID NO: 93207 - DNA, 26 bp, Artificial sequence
  SiRNA target sequence
ccagttcttaatgatgcttaaataat

SEQ ID NO: 93208 - DNA, 26 bp, Artificial sequence
  SiRNA target sequence
cagttcttaatgatgcttaaataatc

SEQ ID NO: 93209 - DNA, 26 bp, Artificial sequence
  SiRNA target sequence
agttcttaatgatgcttaaataatct

SEQ ID NO: 93210 - DNA, 26 bp, Artificial sequence
  SiRNA target sequence
gttcttaatgatgcttaaataatctt

SEQ ID NO: 93211 - DNA, 26 bp, Artificial sequence
  SiRNA target sequence
ttcttaatgatgcttaaataatcttt

SEQ ID NO: 93212 - DNA, 26 bp, Artificial sequence
  SiRNA target sequence
tcttaatgatgcttaaataatctttt

SEQ ID NO: 93213 - DNA, 26 bp, Artificial sequence
  SiRNA target sequence
cttaatgatgcttaaataatctttta

SEQ ID NO: 93214 - DNA, 26 bp, Artificial sequence
  SiRNA target sequence
ttaatgatgcttaaataatcttttac

SEQ ID NO: 93215 - DNA, 26 bp, Artificial sequence
  SiRNA target sequence
taatgatgcttaaataatcttttact

SEQ ID NO: 93216 - DNA, 26 bp, Artificial sequence
  SiRNA target sequence
aatgatgcttaaataatcttttactc

SEQ ID NO: 93217 - DNA, 26 bp, Artificial sequence
  SiRNA target sequence
atgatgcttaaataatcttttactcc

SEQ ID NO: 93218 - DNA, 26 bp, Artificial sequence
  SiRNA target sequence
tgatgcttaaataatcttttactcct

SEQ ID NO: 93219 - DNA, 26 bp, Artificial sequence
  SiRNA target sequence
gatgcttaaataatcttttactcctt

SEQ ID NO: 93220 - DNA, 26 bp, Artificial sequence
  SiRNA target sequence
atgcttaaataatcttttactccttc

SEQ ID NO: 93221 - DNA, 26 bp, Artificial sequence
  SiRNA target sequence
tgcttaaataatcttttactccttct

SEQ ID NO: 93222 - DNA, 26 bp, Artificial sequence
  SiRNA target sequence
gcttaaataatcttttactccttctt

SEQ ID NO: 93223 - DNA, 26 bp, Artificial sequence
  SiRNA target sequence
cttaaataatcttttactccttcttt

SEQ ID NO: 93224 - DNA, 26 bp, Artificial sequence
  SiRNA target sequence
ttaaataatcttttactccttcttta

SEQ ID NO: 93225 - DNA, 26 bp, Artificial sequence
  SiRNA target sequence
taaataatcttttactccttctttag

SEQ ID NO: 93226 - DNA, 26 bp, Artificial sequence
  SiRNA target sequence
aaataatcttttactccttctttaga

SEQ ID NO: 93227 - DNA, 26 bp, Artificial sequence
  SiRNA target sequence
aataatcttttactccttctttagaa

SEQ ID NO: 93228 - DNA, 26 bp, Artificial sequence
  SiRNA target sequence
ataatcttttactccttctttagaac

SEQ ID NO: 93229 - DNA, 26 bp, Artificial sequence
  SiRNA target sequence
taatcttttactccttctttagaaca

SEQ ID NO: 93230 - DNA, 26 bp, Artificial sequence
  SiRNA target sequence
aatcttttactccttctttagaacac

SEQ ID NO: 93231 - DNA, 26 bp, Artificial sequence
  SiRNA target sequence
atcttttactccttctttagaacaca

SEQ ID NO: 93232 - DNA, 26 bp, Artificial sequence
  SiRNA target sequence
tcttttactccttctttagaacacag

SEQ ID NO: 93233 - DNA, 26 bp, Artificial sequence
  SiRNA target sequence
cttttactccttctttagaacacaga

SEQ ID NO: 93234 - DNA, 26 bp, Artificial sequence
  SiRNA target sequence
ttttactccttctttagaacacagat

SEQ ID NO: 93235 - DNA, 26 bp, Artificial sequence
  SiRNA target sequence
tttactccttctttagaacacagata

SEQ ID NO: 93236 - DNA, 26 bp, Artificial sequence
  SiRNA target sequence
ttactccttctttagaacacagatat

SEQ ID NO: 93237 - DNA, 26 bp, Artificial sequence
  SiRNA target sequence
tactccttctttagaacacagatatt

SEQ ID NO: 93238 - DNA, 26 bp, Artificial sequence
  SiRNA target sequence
actccttctttagaacacagatattc

SEQ ID NO: 93239 - DNA, 26 bp, Artificial sequence
  SiRNA target sequence
ctccttctttagaacacagatattca

SEQ ID NO: 93240 - DNA, 26 bp, Artificial sequence
  SiRNA target sequence
tccttctttagaacacagatattcaa

SEQ ID NO: 93241 - DNA, 26 bp, Artificial sequence
  SiRNA target sequence
ccttctttagaacacagatattcaat

SEQ ID NO: 93242 - DNA, 26 bp, Artificial sequence
  SiRNA target sequence
cttctttagaacacagatattcaata

SEQ ID NO: 93243 - DNA, 26 bp, Artificial sequence
  SiRNA target sequence
ttctttagaacacagatattcaatat

SEQ ID NO: 93244 - DNA, 26 bp, Artificial sequence
  SiRNA target sequence
tctttagaacacagatattcaatatc

SEQ ID NO: 93245 - DNA, 26 bp, Artificial sequence
  SiRNA target sequence
ctttagaacacagatattcaatatca

SEQ ID NO: 93246 - DNA, 26 bp, Artificial sequence
  SiRNA target sequence
tttagaacacagatattcaatatcat

SEQ ID NO: 93247 - DNA, 26 bp, Artificial sequence
  SiRNA target sequence
ttagaacacagatattcaatatcatg

SEQ ID NO: 93248 - DNA, 26 bp, Artificial sequence
  SiRNA target sequence
tagaacacagatattcaatatcatgc

SEQ ID NO: 93249 - DNA, 26 bp, Artificial sequence
  SiRNA target sequence
agaacacagatattcaatatcatgct

SEQ ID NO: 93250 - DNA, 26 bp, Artificial sequence
  SiRNA target sequence
gaacacagatattcaatatcatgctt

SEQ ID NO: 93251 - DNA, 26 bp, Artificial sequence
  SiRNA target sequence
aacacagatattcaatatcatgctta

SEQ ID NO: 93252 - DNA, 26 bp, Artificial sequence
  SiRNA target sequence
acacagatattcaatatcatgcttat

SEQ ID NO: 93253 - DNA, 26 bp, Artificial sequence
  SiRNA target sequence
cacagatattcaatatcatgcttatt

SEQ ID NO: 93254 - DNA, 26 bp, Artificial sequence
  SiRNA target sequence
acagatattcaatatcatgcttattt

SEQ ID NO: 93255 - DNA, 26 bp, Artificial sequence
  SiRNA target sequence
cagatattcaatatcatgcttatttt

SEQ ID NO: 93256 - DNA, 26 bp, Artificial sequence
  SiRNA target sequence
agatattcaatatcatgcttattttt

SEQ ID NO: 93257 - DNA, 26 bp, Artificial sequence
  SiRNA target sequence
gatattcaatatcatgcttattttta

SEQ ID NO: 93258 - DNA, 26 bp, Artificial sequence
  SiRNA target sequence
atattcaatatcatgcttatttttag

SEQ ID NO: 93259 - DNA, 26 bp, Artificial sequence
  SiRNA target sequence
tattcaatatcatgcttatttttaga

SEQ ID NO: 93260 - DNA, 26 bp, Artificial sequence
  SiRNA target sequence
attcaatatcatgcttatttttagag

SEQ ID NO: 93261 - DNA, 26 bp, Artificial sequence
  SiRNA target sequence
ttcaatatcatgcttatttttagagg

SEQ ID NO: 93262 - DNA, 26 bp, Artificial sequence
  SiRNA target sequence
tcaatatcatgcttatttttagaggt

SEQ ID NO: 93263 - DNA, 26 bp, Artificial sequence
  SiRNA target sequence
caatatcatgcttatttttagaggtt

SEQ ID NO: 93264 - DNA, 26 bp, Artificial sequence
  SiRNA target sequence
aatatcatgcttatttttagaggttt

SEQ ID NO: 93265 - DNA, 26 bp, Artificial sequence
  SiRNA target sequence
atatcatgcttatttttagaggtttt

SEQ ID NO: 93266 - DNA, 26 bp, Artificial sequence
  SiRNA target sequence
tatcatgcttatttttagaggtttta

SEQ ID NO: 93267 - DNA, 26 bp, Artificial sequence
  SiRNA target sequence
atcatgcttatttttagaggttttag

SEQ ID NO: 93268 - DNA, 26 bp, Artificial sequence
  SiRNA target sequence
tcatgcttatttttagaggttttaga

SEQ ID NO: 93269 - DNA, 26 bp, Artificial sequence
  SiRNA target sequence
catgcttatttttagaggttttagaa

SEQ ID NO: 93270 - DNA, 26 bp, Artificial sequence
  SiRNA target sequence
atgcttatttttagaggttttagaaa

SEQ ID NO: 93271 - DNA, 26 bp, Artificial sequence
  SiRNA target sequence
tgcttatttttagaggttttagaaat

SEQ ID NO: 93272 - DNA, 26 bp, Artificial sequence
  SiRNA target sequence
gcttatttttagaggttttagaaata

SEQ ID NO: 93273 - DNA, 26 bp, Artificial sequence
  SiRNA target sequence
cttatttttagaggttttagaaatat

SEQ ID NO: 93274 - DNA, 26 bp, Artificial sequence
  SiRNA target sequence
ttatttttagaggttttagaaatatc

SEQ ID NO: 93275 - DNA, 26 bp, Artificial sequence
  SiRNA target sequence
tatttttagaggttttagaaatatcc

SEQ ID NO: 93276 - DNA, 26 bp, Artificial sequence
  SiRNA target sequence
atttttagaggttttagaaatatcca

SEQ ID NO: 93277 - DNA, 26 bp, Artificial sequence
  SiRNA target sequence
tttttagaggttttagaaatatccat

SEQ ID NO: 93278 - DNA, 26 bp, Artificial sequence
  SiRNA target sequence
ttttagaggttttagaaatatccata

SEQ ID NO: 93279 - DNA, 26 bp, Artificial sequence
  SiRNA target sequence
tttagaggttttagaaatatccataa

SEQ ID NO: 93280 - DNA, 26 bp, Artificial sequence
  SiRNA target sequence
ttagaggttttagaaatatccataag

SEQ ID NO: 93281 - DNA, 26 bp, Artificial sequence
  SiRNA target sequence
tagaggttttagaaatatccataagc

SEQ ID NO: 93282 - DNA, 26 bp, Artificial sequence
  SiRNA target sequence
agaggttttagaaatatccataagcc

SEQ ID NO: 93283 - DNA, 26 bp, Artificial sequence
  SiRNA target sequence
gaggttttagaaatatccataagcca

SEQ ID NO: 93284 - DNA, 26 bp, Artificial sequence
  SiRNA target sequence
aggttttagaaatatccataagccat

SEQ ID NO: 93285 - DNA, 26 bp, Artificial sequence
  SiRNA target sequence
ggttttagaaatatccataagccatg

SEQ ID NO: 93286 - DNA, 26 bp, Artificial sequence
  SiRNA target sequence
gttttagaaatatccataagccatgc

SEQ ID NO: 93287 - DNA, 26 bp, Artificial sequence
  SiRNA target sequence
ttttagaaatatccataagccatgct

SEQ ID NO: 93288 - DNA, 26 bp, Artificial sequence
  SiRNA target sequence
tttagaaatatccataagccatgctt

SEQ ID NO: 93289 - DNA, 26 bp, Artificial sequence
  SiRNA target sequence
ttagaaatatccataagccatgcttt

SEQ ID NO: 93290 - DNA, 26 bp, Artificial sequence
  SiRNA target sequence
tagaaatatccataagccatgctttt

SEQ ID NO: 93291 - DNA, 26 bp, Artificial sequence
  SiRNA target sequence
agaaatatccataagccatgcttttt

SEQ ID NO: 93292 - DNA, 26 bp, Artificial sequence
  SiRNA target sequence
gaaatatccataagccatgctttttt

SEQ ID NO: 93293 - DNA, 26 bp, Artificial sequence
  SiRNA target sequence
aaatatccataagccatgctttttta

SEQ ID NO: 93294 - DNA, 26 bp, Artificial sequence
  SiRNA target sequence
aatatccataagccatgcttttttag

SEQ ID NO: 93295 - DNA, 26 bp, Artificial sequence
  SiRNA target sequence
atatccataagccatgcttttttagg

SEQ ID NO: 93296 - DNA, 26 bp, Artificial sequence
  SiRNA target sequence
tatccataagccatgcttttttaggc

SEQ ID NO: 93297 - DNA, 26 bp, Artificial sequence
  SiRNA target sequence
atccataagccatgcttttttaggca

SEQ ID NO: 93298 - DNA, 26 bp, Artificial sequence
  SiRNA target sequence
tccataagccatgcttttttaggcaa

SEQ ID NO: 93299 - DNA, 26 bp, Artificial sequence
  SiRNA target sequence
ccataagccatgcttttttaggcaat

SEQ ID NO: 93300 - DNA, 26 bp, Artificial sequence
  SiRNA target sequence
cataagccatgcttttttaggcaatg

SEQ ID NO: 93301 - DNA, 26 bp, Artificial sequence
  SiRNA target sequence
ataagccatgcttttttaggcaatga

SEQ ID NO: 93302 - DNA, 26 bp, Artificial sequence
  SiRNA target sequence
taagccatgcttttttaggcaatgaa

SEQ ID NO: 93303 - DNA, 26 bp, Artificial sequence
  SiRNA target sequence
aagccatgcttttttaggcaatgaag

SEQ ID NO: 93304 - DNA, 26 bp, Artificial sequence
  SiRNA target sequence
agccatgcttttttaggcaatgaagt

SEQ ID NO: 93305 - DNA, 26 bp, Artificial sequence
  SiRNA target sequence
gccatgcttttttaggcaatgaagta

SEQ ID NO: 93306 - DNA, 26 bp, Artificial sequence
  SiRNA target sequence
ccatgcttttttaggcaatgaagtaa

SEQ ID NO: 93307 - DNA, 26 bp, Artificial sequence
  SiRNA target sequence
catgcttttttaggcaatgaagtaaa

SEQ ID NO: 93308 - DNA, 26 bp, Artificial sequence
  SiRNA target sequence
atgcttttttaggcaatgaagtaaaa

SEQ ID NO: 93309 - DNA, 26 bp, Artificial sequence
  SiRNA target sequence
tgcttttttaggcaatgaagtaaaat

SEQ ID NO: 93310 - DNA, 26 bp, Artificial sequence
  SiRNA target sequence
gcttttttaggcaatgaagtaaaatc

SEQ ID NO: 93311 - DNA, 26 bp, Artificial sequence
  SiRNA target sequence
cttttttaggcaatgaagtaaaatca

SEQ ID NO: 93312 - DNA, 26 bp, Artificial sequence
  SiRNA target sequence
ttttttaggcaatgaagtaaaatcaa

SEQ ID NO: 93313 - DNA, 26 bp, Artificial sequence
  SiRNA target sequence
tttttaggcaatgaagtaaaatcaaa

SEQ ID NO: 93314 - DNA, 26 bp, Artificial sequence
  SiRNA target sequence
ttttaggcaatgaagtaaaatcaaaa

SEQ ID NO: 93315 - DNA, 26 bp, Artificial sequence
  SiRNA target sequence
tttaggcaatgaagtaaaatcaaaaa

SEQ ID NO: 93316 - DNA, 26 bp, Artificial sequence
  SiRNA target sequence
ttaggcaatgaagtaaaatcaaaaat

SEQ ID NO: 93317 - DNA, 26 bp, Artificial sequence
  SiRNA target sequence
taggcaatgaagtaaaatcaaaaata

SEQ ID NO: 93318 - DNA, 26 bp, Artificial sequence
  SiRNA target sequence
aggcaatgaagtaaaatcaaaaatat

SEQ ID NO: 93319 - DNA, 26 bp, Artificial sequence
  SiRNA target sequence
ggcaatgaagtaaaatcaaaaatata

SEQ ID NO: 93320 - DNA, 26 bp, Artificial sequence
  SiRNA target sequence
gcaatgaagtaaaatcaaaaatatac

SEQ ID NO: 93321 - DNA, 26 bp, Artificial sequence
  SiRNA target sequence
caatgaagtaaaatcaaaaatatact

SEQ ID NO: 93322 - DNA, 26 bp, Artificial sequence
  SiRNA target sequence
aatgaagtaaaatcaaaaatatactt

SEQ ID NO: 93323 - DNA, 26 bp, Artificial sequence
  SiRNA target sequence
atgaagtaaaatcaaaaatatacttg

SEQ ID NO: 93324 - DNA, 26 bp, Artificial sequence
  SiRNA target sequence
tgaagtaaaatcaaaaatatacttga

SEQ ID NO: 93325 - DNA, 26 bp, Artificial sequence
  SiRNA target sequence
gaagtaaaatcaaaaatatacttgaa

SEQ ID NO: 93326 - DNA, 26 bp, Artificial sequence
  SiRNA target sequence
aagtaaaatcaaaaatatacttgaaa

SEQ ID NO: 93327 - DNA, 26 bp, Artificial sequence
  SiRNA target sequence
agtaaaatcaaaaatatacttgaaaa

SEQ ID NO: 93328 - DNA, 26 bp, Artificial sequence
  SiRNA target sequence
gtaaaatcaaaaatatacttgaaaaa

SEQ ID NO: 93329 - DNA, 26 bp, Artificial sequence
  SiRNA target sequence
taaaatcaaaaatatacttgaaaaag

SEQ ID NO: 93330 - DNA, 26 bp, Artificial sequence
  SiRNA target sequence
aaaatcaaaaatatacttgaaaaagt

SEQ ID NO: 93331 - DNA, 26 bp, Artificial sequence
  SiRNA target sequence
aaatcaaaaatatacttgaaaaagtc

SEQ ID NO: 93332 - DNA, 26 bp, Artificial sequence
  SiRNA target sequence
aatcaaaaatatacttgaaaaagtca

SEQ ID NO: 93333 - DNA, 26 bp, Artificial sequence
  SiRNA target sequence
atcaaaaatatacttgaaaaagtcac

SEQ ID NO: 93334 - DNA, 26 bp, Artificial sequence
  SiRNA target sequence
tcaaaaatatacttgaaaaagtcacg

SEQ ID NO: 93335 - DNA, 26 bp, Artificial sequence
  SiRNA target sequence
caaaaatatacttgaaaaagtcacgc

SEQ ID NO: 93336 - DNA, 26 bp, Artificial sequence
  SiRNA target sequence
aaaaatatacttgaaaaagtcacgca

SEQ ID NO: 93337 - DNA, 26 bp, Artificial sequence
  SiRNA target sequence
aaaatatacttgaaaaagtcacgcaa

SEQ ID NO: 93338 - DNA, 26 bp, Artificial sequence
  SiRNA target sequence
aaatatacttgaaaaagtcacgcaaa

SEQ ID NO: 93339 - DNA, 26 bp, Artificial sequence
  SiRNA target sequence
aatatacttgaaaaagtcacgcaaag

SEQ ID NO: 93340 - DNA, 26 bp, Artificial sequence
  SiRNA target sequence
atatacttgaaaaagtcacgcaaaga

SEQ ID NO: 93341 - DNA, 26 bp, Artificial sequence
  SiRNA target sequence
tatacttgaaaaagtcacgcaaagat

SEQ ID NO: 93342 - DNA, 26 bp, Artificial sequence
  SiRNA target sequence
atacttgaaaaagtcacgcaaagatc

SEQ ID NO: 93343 - DNA, 26 bp, Artificial sequence
  SiRNA target sequence
tacttgaaaaagtcacgcaaagatcc

SEQ ID NO: 93344 - DNA, 26 bp, Artificial sequence
  SiRNA target sequence
acttgaaaaagtcacgcaaagatcct

SEQ ID NO: 93345 - DNA, 26 bp, Artificial sequence
  SiRNA target sequence
cttgaaaaagtcacgcaaagatcctt

SEQ ID NO: 93346 - DNA, 26 bp, Artificial sequence
  SiRNA target sequence
ttgaaaaagtcacgcaaagatccttc

SEQ ID NO: 93347 - DNA, 26 bp, Artificial sequence
  SiRNA target sequence
tgaaaaagtcacgcaaagatccttcg

SEQ ID NO: 93348 - DNA, 26 bp, Artificial sequence
  SiRNA target sequence
gaaaaagtcacgcaaagatccttcga

SEQ ID NO: 93349 - DNA, 26 bp, Artificial sequence
  SiRNA target sequence
aaaaagtcacgcaaagatccttcgaa

SEQ ID NO: 93350 - DNA, 26 bp, Artificial sequence
  SiRNA target sequence
aaaagtcacgcaaagatccttcgaat

SEQ ID NO: 93351 - DNA, 26 bp, Artificial sequence
  SiRNA target sequence
aaagtcacgcaaagatccttcgaatt

SEQ ID NO: 93352 - DNA, 26 bp, Artificial sequence
  SiRNA target sequence
aagtcacgcaaagatccttcgaattg

SEQ ID NO: 93353 - DNA, 26 bp, Artificial sequence
  SiRNA target sequence
agtcacgcaaagatccttcgaattga

SEQ ID NO: 93354 - DNA, 26 bp, Artificial sequence
  SiRNA target sequence
gtcacgcaaagatccttcgaattgaa

SEQ ID NO: 93355 - DNA, 26 bp, Artificial sequence
  SiRNA target sequence
tcacgcaaagatccttcgaattgaaa

SEQ ID NO: 93356 - DNA, 26 bp, Artificial sequence
  SiRNA target sequence
cacgcaaagatccttcgaattgaaac

SEQ ID NO: 93357 - DNA, 26 bp, Artificial sequence
  SiRNA target sequence
acgcaaagatccttcgaattgaaacc

SEQ ID NO: 93358 - DNA, 26 bp, Artificial sequence
  SiRNA target sequence
cgcaaagatccttcgaattgaaaccc

SEQ ID NO: 93359 - DNA, 26 bp, Artificial sequence
  SiRNA target sequence
gcaaagatccttcgaattgaaacccc

SEQ ID NO: 93360 - DNA, 26 bp, Artificial sequence
  SiRNA target sequence
caaagatccttcgaattgaaaccccg

SEQ ID NO: 93361 - DNA, 26 bp, Artificial sequence
  SiRNA target sequence
aaagatccttcgaattgaaaccccgt

SEQ ID NO: 93362 - DNA, 26 bp, Artificial sequence
  SiRNA target sequence
aagatccttcgaattgaaaccccgtt

SEQ ID NO: 93363 - DNA, 26 bp, Artificial sequence
  SiRNA target sequence
agatccttcgaattgaaaccccgttt

SEQ ID NO: 93364 - DNA, 26 bp, Artificial sequence
  SiRNA target sequence
gatccttcgaattgaaaccccgtttt

SEQ ID NO: 93365 - DNA, 26 bp, Artificial sequence
  SiRNA target sequence
atccttcgaattgaaaccccgttttt

SEQ ID NO: 93366 - DNA, 26 bp, Artificial sequence
  SiRNA target sequence
tccttcgaattgaaaccccgtttttc

SEQ ID NO: 93367 - DNA, 26 bp, Artificial sequence
  SiRNA target sequence
ccttcgaattgaaaccccgtttttcc

SEQ ID NO: 93368 - DNA, 26 bp, Artificial sequence
  SiRNA target sequence
cttcgaattgaaaccccgtttttcca

SEQ ID NO: 93369 - DNA, 26 bp, Artificial sequence
  SiRNA target sequence
ttcgaattgaaaccccgtttttccaa

SEQ ID NO: 93370 - DNA, 26 bp, Artificial sequence
  SiRNA target sequence
tcgaattgaaaccccgtttttccaac

SEQ ID NO: 93371 - DNA, 26 bp, Artificial sequence
  SiRNA target sequence
cgaattgaaaccccgtttttccaact

SEQ ID NO: 93372 - DNA, 26 bp, Artificial sequence
  SiRNA target sequence
gaattgaaaccccgtttttccaactt

SEQ ID NO: 93373 - DNA, 26 bp, Artificial sequence
  SiRNA target sequence
aattgaaaccccgtttttccaacttg

SEQ ID NO: 93374 - DNA, 26 bp, Artificial sequence
  SiRNA target sequence
attgaaaccccgtttttccaacttgc

SEQ ID NO: 93375 - DNA, 26 bp, Artificial sequence
  SiRNA target sequence
ttgaaaccccgtttttccaacttgct

SEQ ID NO: 93376 - DNA, 26 bp, Artificial sequence
  SiRNA target sequence
tgaaaccccgtttttccaacttgctc

SEQ ID NO: 93377 - DNA, 26 bp, Artificial sequence
  SiRNA target sequence
gaaaccccgtttttccaacttgctca

SEQ ID NO: 93378 - DNA, 26 bp, Artificial sequence
  SiRNA target sequence
aaaccccgtttttccaacttgctcaa

SEQ ID NO: 93379 - DNA, 26 bp, Artificial sequence
  SiRNA target sequence
aaccccgtttttccaacttgctcaat

SEQ ID NO: 93380 - DNA, 26 bp, Artificial sequence
  SiRNA target sequence
accccgtttttccaacttgctcaata

SEQ ID NO: 93381 - DNA, 26 bp, Artificial sequence
  SiRNA target sequence
ccccgtttttccaacttgctcaatat

SEQ ID NO: 93382 - DNA, 26 bp, Artificial sequence
  SiRNA target sequence
cccgtttttccaacttgctcaatata

SEQ ID NO: 93383 - DNA, 26 bp, Artificial sequence
  SiRNA target sequence
ccgtttttccaacttgctcaatatat

SEQ ID NO: 93384 - DNA, 26 bp, Artificial sequence
  SiRNA target sequence
cgtttttccaacttgctcaatatata

SEQ ID NO: 93385 - DNA, 26 bp, Artificial sequence
  SiRNA target sequence
gtttttccaacttgctcaatatataa

SEQ ID NO: 93386 - DNA, 26 bp, Artificial sequence
  SiRNA target sequence
tttttccaacttgctcaatatataat

SEQ ID NO: 93387 - DNA, 26 bp, Artificial sequence
  SiRNA target sequence
ttttccaacttgctcaatatataata

SEQ ID NO: 93388 - DNA, 26 bp, Artificial sequence
  SiRNA target sequence
tttccaacttgctcaatatataataa

SEQ ID NO: 93389 - DNA, 26 bp, Artificial sequence
  SiRNA target sequence
ttccaacttgctcaatatataataat

SEQ ID NO: 93390 - DNA, 26 bp, Artificial sequence
  SiRNA target sequence
tccaacttgctcaatatataataatg

SEQ ID NO: 93391 - DNA, 26 bp, Artificial sequence
  SiRNA target sequence
ccaacttgctcaatatataataatgt

SEQ ID NO: 93392 - DNA, 26 bp, Artificial sequence
  SiRNA target sequence
caacttgctcaatatataataatgta

SEQ ID NO: 93393 - DNA, 26 bp, Artificial sequence
  SiRNA target sequence
aacttgctcaatatataataatgtat

SEQ ID NO: 93394 - DNA, 26 bp, Artificial sequence
  SiRNA target sequence
acttgctcaatatataataatgtatc

SEQ ID NO: 93395 - DNA, 26 bp, Artificial sequence
  SiRNA target sequence
cttgctcaatatataataatgtatca

SEQ ID NO: 93396 - DNA, 26 bp, Artificial sequence
  SiRNA target sequence
ttgctcaatatataataatgtatcac

SEQ ID NO: 93397 - DNA, 26 bp, Artificial sequence
  SiRNA target sequence
tgctcaatatataataatgtatcacc

SEQ ID NO: 93398 - DNA, 26 bp, Artificial sequence
  SiRNA target sequence
gctcaatatataataatgtatcacca

SEQ ID NO: 93399 - DNA, 26 bp, Artificial sequence
  SiRNA target sequence
ctcaatatataataatgtatcaccag

SEQ ID NO: 93400 - DNA, 26 bp, Artificial sequence
  SiRNA target sequence
tcaatatataataatgtatcaccaga

SEQ ID NO: 93401 - DNA, 26 bp, Artificial sequence
  SiRNA target sequence
caatatataataatgtatcaccagac

SEQ ID NO: 93402 - DNA, 26 bp, Artificial sequence
  SiRNA target sequence
aatatataataatgtatcaccagaca

SEQ ID NO: 93403 - DNA, 26 bp, Artificial sequence
  SiRNA target sequence
atatataataatgtatcaccagacat

SEQ ID NO: 93404 - DNA, 26 bp, Artificial sequence
  SiRNA target sequence
tatataataatgtatcaccagacatt

SEQ ID NO: 93405 - DNA, 26 bp, Artificial sequence
  SiRNA target sequence
atataataatgtatcaccagacattt

SEQ ID NO: 93406 - DNA, 26 bp, Artificial sequence
  SiRNA target sequence
tataataatgtatcaccagacatttc

SEQ ID NO: 93407 - DNA, 26 bp, Artificial sequence
  SiRNA target sequence
ataataatgtatcaccagacatttct

SEQ ID NO: 93408 - DNA, 26 bp, Artificial sequence
  SiRNA target sequence
taataatgtatcaccagacatttcta

SEQ ID NO: 93409 - DNA, 26 bp, Artificial sequence
  SiRNA target sequence
aataatgtatcaccagacatttctag

SEQ ID NO: 93410 - DNA, 26 bp, Artificial sequence
  SiRNA target sequence
ataatgtatcaccagacatttctagt

SEQ ID NO: 93411 - DNA, 26 bp, Artificial sequence
  SiRNA target sequence
taatgtatcaccagacatttctagta

SEQ ID NO: 93412 - DNA, 26 bp, Artificial sequence
  SiRNA target sequence
aatgtatcaccagacatttctagtaa

SEQ ID NO: 93413 - DNA, 26 bp, Artificial sequence
  SiRNA target sequence
atgtatcaccagacatttctagtaaa

SEQ ID NO: 93414 - DNA, 26 bp, Artificial sequence
  SiRNA target sequence
tgtatcaccagacatttctagtaaac

SEQ ID NO: 93415 - DNA, 26 bp, Artificial sequence
  SiRNA target sequence
gtatcaccagacatttctagtaaact

SEQ ID NO: 93416 - DNA, 26 bp, Artificial sequence
  SiRNA target sequence
tatcaccagacatttctagtaaactt

SEQ ID NO: 93417 - DNA, 26 bp, Artificial sequence
  SiRNA target sequence
atcaccagacatttctagtaaactta

SEQ ID NO: 93418 - DNA, 26 bp, Artificial sequence
  SiRNA target sequence
tcaccagacatttctagtaaacttaa

SEQ ID NO: 93419 - DNA, 26 bp, Artificial sequence
  SiRNA target sequence
caccagacatttctagtaaacttaac

SEQ ID NO: 93420 - DNA, 26 bp, Artificial sequence
  SiRNA target sequence
accagacatttctagtaaacttaaca

SEQ ID NO: 93421 - DNA, 26 bp, Artificial sequence
  SiRNA target sequence
ccagacatttctagtaaacttaacat

SEQ ID NO: 93422 - DNA, 26 bp, Artificial sequence
  SiRNA target sequence
cagacatttctagtaaacttaacatt

SEQ ID NO: 93423 - DNA, 26 bp, Artificial sequence
  SiRNA target sequence
agacatttctagtaaacttaacattt

SEQ ID NO: 93424 - DNA, 26 bp, Artificial sequence
  SiRNA target sequence
gacatttctagtaaacttaacatttc

SEQ ID NO: 93425 - DNA, 26 bp, Artificial sequence
  SiRNA target sequence
acatttctagtaaacttaacatttca

SEQ ID NO: 93426 - DNA, 26 bp, Artificial sequence
  SiRNA target sequence
catttctagtaaacttaacatttcat

SEQ ID NO: 93427 - DNA, 26 bp, Artificial sequence
  SiRNA target sequence
atttctagtaaacttaacatttcatt

SEQ ID NO: 93428 - DNA, 26 bp, Artificial sequence
  SiRNA target sequence
tttctagtaaacttaacatttcatta

SEQ ID NO: 93429 - DNA, 26 bp, Artificial sequence
  SiRNA target sequence
ttctagtaaacttaacatttcattaa

SEQ ID NO: 93430 - DNA, 26 bp, Artificial sequence
  SiRNA target sequence
tctagtaaacttaacatttcattaac

SEQ ID NO: 93431 - DNA, 26 bp, Artificial sequence
  SiRNA target sequence
ctagtaaacttaacatttcattaaca

SEQ ID NO: 93432 - DNA, 26 bp, Artificial sequence
  SiRNA target sequence
tagtaaacttaacatttcattaacaa

SEQ ID NO: 93433 - DNA, 26 bp, Artificial sequence
  SiRNA target sequence
agtaaacttaacatttcattaacaag

SEQ ID NO: 93434 - DNA, 26 bp, Artificial sequence
  SiRNA target sequence
gtaaacttaacatttcattaacaagc

SEQ ID NO: 93435 - DNA, 26 bp, Artificial sequence
  SiRNA target sequence
taaacttaacatttcattaacaagca

SEQ ID NO: 93436 - DNA, 26 bp, Artificial sequence
  SiRNA target sequence
aaacttaacatttcattaacaagcaa

SEQ ID NO: 93437 - DNA, 26 bp, Artificial sequence
  SiRNA target sequence
aacttaacatttcattaacaagcaaa

SEQ ID NO: 93438 - DNA, 26 bp, Artificial sequence
  SiRNA target sequence
acttaacatttcattaacaagcaaat

SEQ ID NO: 93439 - DNA, 26 bp, Artificial sequence
  SiRNA target sequence
cttaacatttcattaacaagcaaatc

SEQ ID NO: 93440 - DNA, 26 bp, Artificial sequence
  SiRNA target sequence
ttaacatttcattaacaagcaaatca

SEQ ID NO: 93441 - DNA, 26 bp, Artificial sequence
  SiRNA target sequence
taacatttcattaacaagcaaatcat

SEQ ID NO: 93442 - DNA, 26 bp, Artificial sequence
  SiRNA target sequence
aacatttcattaacaagcaaatcatt

SEQ ID NO: 93443 - DNA, 26 bp, Artificial sequence
  SiRNA target sequence
acatttcattaacaagcaaatcatta

SEQ ID NO: 93444 - DNA, 26 bp, Artificial sequence
  SiRNA target sequence
catttcattaacaagcaaatcattat

SEQ ID NO: 93445 - DNA, 26 bp, Artificial sequence
  SiRNA target sequence
atttcattaacaagcaaatcattatt

SEQ ID NO: 93446 - DNA, 26 bp, Artificial sequence
  SiRNA target sequence
tttcattaacaagcaaatcattattt

SEQ ID NO: 93447 - DNA, 26 bp, Artificial sequence
  SiRNA target sequence
ttcattaacaagcaaatcattatttg

SEQ ID NO: 93448 - DNA, 26 bp, Artificial sequence
  SiRNA target sequence
tcattaacaagcaaatcattatttga

SEQ ID NO: 93449 - DNA, 26 bp, Artificial sequence
  SiRNA target sequence
cattaacaagcaaatcattatttgaa

SEQ ID NO: 93450 - DNA, 26 bp, Artificial sequence
  SiRNA target sequence
attaacaagcaaatcattatttgaac

SEQ ID NO: 93451 - DNA, 26 bp, Artificial sequence
  SiRNA target sequence
ttaacaagcaaatcattatttgaaca

SEQ ID NO: 93452 - DNA, 26 bp, Artificial sequence
  SiRNA target sequence
taacaagcaaatcattatttgaacaa

SEQ ID NO: 93453 - DNA, 26 bp, Artificial sequence
  SiRNA target sequence
aacaagcaaatcattatttgaacaaa

SEQ ID NO: 93454 - DNA, 26 bp, Artificial sequence
  SiRNA target sequence
acaagcaaatcattatttgaacaaag

SEQ ID NO: 93455 - DNA, 26 bp, Artificial sequence
  SiRNA target sequence
caagcaaatcattatttgaacaaagt

SEQ ID NO: 93456 - DNA, 26 bp, Artificial sequence
  SiRNA target sequence
aagcaaatcattatttgaacaaagta

SEQ ID NO: 93457 - DNA, 26 bp, Artificial sequence
  SiRNA target sequence
agcaaatcattatttgaacaaagtag

SEQ ID NO: 93458 - DNA, 26 bp, Artificial sequence
  SiRNA target sequence
gcaaatcattatttgaacaaagtaga

SEQ ID NO: 93459 - DNA, 26 bp, Artificial sequence
  SiRNA target sequence
caaatcattatttgaacaaagtagac

SEQ ID NO: 93460 - DNA, 26 bp, Artificial sequence
  SiRNA target sequence
aaatcattatttgaacaaagtagacc

SEQ ID NO: 93461 - DNA, 26 bp, Artificial sequence
  SiRNA target sequence
aatcattatttgaacaaagtagacca

SEQ ID NO: 93462 - DNA, 26 bp, Artificial sequence
  SiRNA target sequence
atcattatttgaacaaagtagaccaa

SEQ ID NO: 93463 - DNA, 26 bp, Artificial sequence
  SiRNA target sequence
tcattatttgaacaaagtagaccaat

SEQ ID NO: 93464 - DNA, 26 bp, Artificial sequence
  SiRNA target sequence
cattatttgaacaaagtagaccaata

SEQ ID NO: 93465 - DNA, 26 bp, Artificial sequence
  SiRNA target sequence
attatttgaacaaagtagaccaatac

SEQ ID NO: 93466 - DNA, 26 bp, Artificial sequence
  SiRNA target sequence
ttatttgaacaaagtagaccaatact

SEQ ID NO: 93467 - DNA, 26 bp, Artificial sequence
  SiRNA target sequence
tatttgaacaaagtagaccaatacta

SEQ ID NO: 93468 - DNA, 26 bp, Artificial sequence
  SiRNA target sequence
atttgaacaaagtagaccaatactat

SEQ ID NO: 93469 - DNA, 26 bp, Artificial sequence
  SiRNA target sequence
tttgaacaaagtagaccaatactatc

SEQ ID NO: 93470 - DNA, 26 bp, Artificial sequence
  SiRNA target sequence
ttgaacaaagtagaccaatactatca

SEQ ID NO: 93471 - DNA, 26 bp, Artificial sequence
  SiRNA target sequence
tgaacaaagtagaccaatactatcac

SEQ ID NO: 93472 - DNA, 26 bp, Artificial sequence
  SiRNA target sequence
gaacaaagtagaccaatactatcacc

SEQ ID NO: 93473 - DNA, 26 bp, Artificial sequence
  SiRNA target sequence
aacaaagtagaccaatactatcacca

SEQ ID NO: 93474 - DNA, 26 bp, Artificial sequence
  SiRNA target sequence
acaaagtagaccaatactatcaccag

SEQ ID NO: 93475 - DNA, 26 bp, Artificial sequence
  SiRNA target sequence
caaagtagaccaatactatcaccagg

SEQ ID NO: 93476 - DNA, 26 bp, Artificial sequence
  SiRNA target sequence
aaagtagaccaatactatcaccagga

SEQ ID NO: 93477 - DNA, 26 bp, Artificial sequence
  SiRNA target sequence
aagtagaccaatactatcaccaggaa

SEQ ID NO: 93478 - DNA, 26 bp, Artificial sequence
  SiRNA target sequence
agtagaccaatactatcaccaggaac

SEQ ID NO: 93479 - DNA, 26 bp, Artificial sequence
  SiRNA target sequence
gtagaccaatactatcaccaggaaca

SEQ ID NO: 93480 - DNA, 26 bp, Artificial sequence
  SiRNA target sequence
tagaccaatactatcaccaggaacaa

SEQ ID NO: 93481 - DNA, 26 bp, Artificial sequence
  SiRNA target sequence
agaccaatactatcaccaggaacaaa

SEQ ID NO: 93482 - DNA, 26 bp, Artificial sequence
  SiRNA target sequence
gaccaatactatcaccaggaacaaaa

SEQ ID NO: 93483 - DNA, 26 bp, Artificial sequence
  SiRNA target sequence
accaatactatcaccaggaacaaaat

SEQ ID NO: 93484 - DNA, 26 bp, Artificial sequence
  SiRNA target sequence
ccaatactatcaccaggaacaaaatc

SEQ ID NO: 93485 - DNA, 26 bp, Artificial sequence
  SiRNA target sequence
caatactatcaccaggaacaaaatct

SEQ ID NO: 93486 - DNA, 26 bp, Artificial sequence
  SiRNA target sequence
aatactatcaccaggaacaaaatcta

SEQ ID NO: 93487 - DNA, 26 bp, Artificial sequence
  SiRNA target sequence
atactatcaccaggaacaaaatctaa

SEQ ID NO: 93488 - DNA, 26 bp, Artificial sequence
  SiRNA target sequence
tactatcaccaggaacaaaatctaat

SEQ ID NO: 93489 - DNA, 26 bp, Artificial sequence
  SiRNA target sequence
actatcaccaggaacaaaatctaatg

SEQ ID NO: 93490 - DNA, 26 bp, Artificial sequence
  SiRNA target sequence
ctatcaccaggaacaaaatctaatgt

SEQ ID NO: 93491 - DNA, 26 bp, Artificial sequence
  SiRNA target sequence
tatcaccaggaacaaaatctaatgta

SEQ ID NO: 93492 - DNA, 26 bp, Artificial sequence
  SiRNA target sequence
atcaccaggaacaaaatctaatgtat

SEQ ID NO: 93493 - DNA, 26 bp, Artificial sequence
  SiRNA target sequence
tcaccaggaacaaaatctaatgtata

SEQ ID NO: 93494 - DNA, 26 bp, Artificial sequence
  SiRNA target sequence
caccaggaacaaaatctaatgtataa

SEQ ID NO: 93495 - DNA, 26 bp, Artificial sequence
  SiRNA target sequence
accaggaacaaaatctaatgtataat

SEQ ID NO: 93496 - DNA, 26 bp, Artificial sequence
  SiRNA target sequence
ccaggaacaaaatctaatgtataatt

SEQ ID NO: 93497 - DNA, 26 bp, Artificial sequence
  SiRNA target sequence
caggaacaaaatctaatgtataatta

SEQ ID NO: 93498 - DNA, 26 bp, Artificial sequence
  SiRNA target sequence
aggaacaaaatctaatgtataattaa

SEQ ID NO: 93499 - DNA, 26 bp, Artificial sequence
  SiRNA target sequence
ggaacaaaatctaatgtataattaag

SEQ ID NO: 93500 - DNA, 26 bp, Artificial sequence
  SiRNA target sequence
gaacaaaatctaatgtataattaagt

SEQ ID NO: 93501 - DNA, 26 bp, Artificial sequence
  SiRNA target sequence
aacaaaatctaatgtataattaagtt

SEQ ID NO: 93502 - DNA, 26 bp, Artificial sequence
  SiRNA target sequence
acaaaatctaatgtataattaagttg

SEQ ID NO: 93503 - DNA, 26 bp, Artificial sequence
  SiRNA target sequence
caaaatctaatgtataattaagttga

SEQ ID NO: 93504 - DNA, 26 bp, Artificial sequence
  SiRNA target sequence
aaaatctaatgtataattaagttgaa

SEQ ID NO: 93505 - DNA, 26 bp, Artificial sequence
  SiRNA target sequence
aaatctaatgtataattaagttgaac

SEQ ID NO: 93506 - DNA, 26 bp, Artificial sequence
  SiRNA target sequence
aatctaatgtataattaagttgaacc

SEQ ID NO: 93507 - DNA, 26 bp, Artificial sequence
  SiRNA target sequence
atctaatgtataattaagttgaacct

SEQ ID NO: 93508 - DNA, 26 bp, Artificial sequence
  SiRNA target sequence
tctaatgtataattaagttgaacctt

SEQ ID NO: 93509 - DNA, 26 bp, Artificial sequence
  SiRNA target sequence
ctaatgtataattaagttgaacctta

SEQ ID NO: 93510 - DNA, 26 bp, Artificial sequence
  SiRNA target sequence
taatgtataattaagttgaaccttat

SEQ ID NO: 93511 - DNA, 26 bp, Artificial sequence
  SiRNA target sequence
aatgtataattaagttgaaccttata

SEQ ID NO: 93512 - DNA, 26 bp, Artificial sequence
  SiRNA target sequence
atgtataattaagttgaaccttatat

SEQ ID NO: 93513 - DNA, 26 bp, Artificial sequence
  SiRNA target sequence
tgtataattaagttgaaccttatata

SEQ ID NO: 93514 - DNA, 26 bp, Artificial sequence
  SiRNA target sequence
gtataattaagttgaaccttatatac

SEQ ID NO: 93515 - DNA, 26 bp, Artificial sequence
  SiRNA target sequence
tataattaagttgaaccttatatacc

SEQ ID NO: 93516 - DNA, 26 bp, Artificial sequence
  SiRNA target sequence
ataattaagttgaaccttatatacct

SEQ ID NO: 93517 - DNA, 26 bp, Artificial sequence
  SiRNA target sequence
taattaagttgaaccttatatacctt

SEQ ID NO: 93518 - DNA, 26 bp, Artificial sequence
  SiRNA target sequence
aattaagttgaaccttatataccttt

SEQ ID NO: 93519 - DNA, 26 bp, Artificial sequence
  SiRNA target sequence
attaagttgaaccttatatacctttt

SEQ ID NO: 93520 - DNA, 26 bp, Artificial sequence
  SiRNA target sequence
ttaagttgaaccttatataccttttt

SEQ ID NO: 93521 - DNA, 26 bp, Artificial sequence
  SiRNA target sequence
taagttgaaccttatatacctttttc

SEQ ID NO: 93522 - DNA, 26 bp, Artificial sequence
  SiRNA target sequence
aagttgaaccttatatacctttttcc

SEQ ID NO: 93523 - DNA, 26 bp, Artificial sequence
  SiRNA target sequence
agttgaaccttatatacctttttcca

SEQ ID NO: 93524 - DNA, 26 bp, Artificial sequence
  SiRNA target sequence
gttgaaccttatatacctttttccat

SEQ ID NO: 93525 - DNA, 26 bp, Artificial sequence
  SiRNA target sequence
ttgaaccttatatacctttttccatg

SEQ ID NO: 93526 - DNA, 26 bp, Artificial sequence
  SiRNA target sequence
tgaaccttatatacctttttccatgt

SEQ ID NO: 93527 - DNA, 26 bp, Artificial sequence
  SiRNA target sequence
gaaccttatatacctttttccatgta

SEQ ID NO: 93528 - DNA, 26 bp, Artificial sequence
  SiRNA target sequence
aaccttatatacctttttccatgtac

SEQ ID NO: 93529 - DNA, 26 bp, Artificial sequence
  SiRNA target sequence
accttatatacctttttccatgtaca

SEQ ID NO: 93530 - DNA, 26 bp, Artificial sequence
  SiRNA target sequence
ccttatatacctttttccatgtacag

SEQ ID NO: 93531 - DNA, 26 bp, Artificial sequence
  SiRNA target sequence
cttatatacctttttccatgtacagg

SEQ ID NO: 93532 - DNA, 26 bp, Artificial sequence
  SiRNA target sequence
ttatatacctttttccatgtacagga

SEQ ID NO: 93533 - DNA, 26 bp, Artificial sequence
  SiRNA target sequence
tatatacctttttccatgtacaggaa

SEQ ID NO: 93534 - DNA, 26 bp, Artificial sequence
  SiRNA target sequence
atatacctttttccatgtacaggaaa

SEQ ID NO: 93535 - DNA, 26 bp, Artificial sequence
  SiRNA target sequence
tatacctttttccatgtacaggaaag

SEQ ID NO: 93536 - DNA, 26 bp, Artificial sequence
  SiRNA target sequence
atacctttttccatgtacaggaaagg

SEQ ID NO: 93537 - DNA, 26 bp, Artificial sequence
  SiRNA target sequence
tacctttttccatgtacaggaaaggt

SEQ ID NO: 93538 - DNA, 26 bp, Artificial sequence
  SiRNA target sequence
acctttttccatgtacaggaaaggtt

SEQ ID NO: 93539 - DNA, 26 bp, Artificial sequence
  SiRNA target sequence
cctttttccatgtacaggaaaggttt

SEQ ID NO: 93540 - DNA, 26 bp, Artificial sequence
  SiRNA target sequence
ctttttccatgtacaggaaaggtttt

SEQ ID NO: 93541 - DNA, 26 bp, Artificial sequence
  SiRNA target sequence
tttttccatgtacaggaaaggttttc

SEQ ID NO: 93542 - DNA, 26 bp, Artificial sequence
  SiRNA target sequence
ttttccatgtacaggaaaggttttca

SEQ ID NO: 93543 - DNA, 26 bp, Artificial sequence
  SiRNA target sequence
tttccatgtacaggaaaggttttcaa

SEQ ID NO: 93544 - DNA, 26 bp, Artificial sequence
  SiRNA target sequence
ttccatgtacaggaaaggttttcaat

SEQ ID NO: 93545 - DNA, 26 bp, Artificial sequence
  SiRNA target sequence
tccatgtacaggaaaggttttcaata

SEQ ID NO: 93546 - DNA, 26 bp, Artificial sequence
  SiRNA target sequence
ccatgtacaggaaaggttttcaatat

SEQ ID NO: 93547 - DNA, 26 bp, Artificial sequence
  SiRNA target sequence
catgtacaggaaaggttttcaatatt

SEQ ID NO: 93548 - DNA, 26 bp, Artificial sequence
  SiRNA target sequence
atgtacaggaaaggttttcaatattt

SEQ ID NO: 93549 - DNA, 26 bp, Artificial sequence
  SiRNA target sequence
tgtacaggaaaggttttcaatattta

SEQ ID NO: 93550 - DNA, 26 bp, Artificial sequence
  SiRNA target sequence
gtacaggaaaggttttcaatatttag

SEQ ID NO: 93551 - DNA, 26 bp, Artificial sequence
  SiRNA target sequence
tacaggaaaggttttcaatatttagt

SEQ ID NO: 93552 - DNA, 26 bp, Artificial sequence
  SiRNA target sequence
acaggaaaggttttcaatatttagta

SEQ ID NO: 93553 - DNA, 26 bp, Artificial sequence
  SiRNA target sequence
caggaaaggttttcaatatttagtat

SEQ ID NO: 93554 - DNA, 26 bp, Artificial sequence
  SiRNA target sequence
aggaaaggttttcaatatttagtata

SEQ ID NO: 93555 - DNA, 26 bp, Artificial sequence
  SiRNA target sequence
ggaaaggttttcaatatttagtatat

SEQ ID NO: 93556 - DNA, 26 bp, Artificial sequence
  SiRNA target sequence
gaaaggttttcaatatttagtatatt

SEQ ID NO: 93557 - DNA, 26 bp, Artificial sequence
  SiRNA target sequence
aaaggttttcaatatttagtatattt

SEQ ID NO: 93558 - DNA, 26 bp, Artificial sequence
  SiRNA target sequence
aaggttttcaatatttagtatatttg

SEQ ID NO: 93559 - DNA, 26 bp, Artificial sequence
  SiRNA target sequence
aggttttcaatatttagtatatttgt

SEQ ID NO: 93560 - DNA, 26 bp, Artificial sequence
  SiRNA target sequence
ggttttcaatatttagtatatttgta

SEQ ID NO: 93561 - DNA, 26 bp, Artificial sequence
  SiRNA target sequence
gttttcaatatttagtatatttgtat

SEQ ID NO: 93562 - DNA, 26 bp, Artificial sequence
  SiRNA target sequence
ttttcaatatttagtatatttgtatc

SEQ ID NO: 93563 - DNA, 26 bp, Artificial sequence
  SiRNA target sequence
tttcaatatttagtatatttgtatct

SEQ ID NO: 93564 - DNA, 26 bp, Artificial sequence
  SiRNA target sequence
ttcaatatttagtatatttgtatcta

SEQ ID NO: 93565 - DNA, 26 bp, Artificial sequence
  SiRNA target sequence
tcaatatttagtatatttgtatctat

SEQ ID NO: 93566 - DNA, 26 bp, Artificial sequence
  SiRNA target sequence
caatatttagtatatttgtatctatc

SEQ ID NO: 93567 - DNA, 26 bp, Artificial sequence
  SiRNA target sequence
aatatttagtatatttgtatctatca

SEQ ID NO: 93568 - DNA, 26 bp, Artificial sequence
  SiRNA target sequence
atatttagtatatttgtatctatcaa

SEQ ID NO: 93569 - DNA, 26 bp, Artificial sequence
  SiRNA target sequence
tatttagtatatttgtatctatcaaa

SEQ ID NO: 93570 - DNA, 26 bp, Artificial sequence
  SiRNA target sequence
atttagtatatttgtatctatcaaat

SEQ ID NO: 93571 - DNA, 26 bp, Artificial sequence
  SiRNA target sequence
tttagtatatttgtatctatcaaatt

SEQ ID NO: 93572 - DNA, 26 bp, Artificial sequence
  SiRNA target sequence
ttagtatatttgtatctatcaaattt

SEQ ID NO: 93573 - DNA, 26 bp, Artificial sequence
  SiRNA target sequence
tagtatatttgtatctatcaaattta

SEQ ID NO: 93574 - DNA, 26 bp, Artificial sequence
  SiRNA target sequence
agtatatttgtatctatcaaatttat

SEQ ID NO: 93575 - DNA, 26 bp, Artificial sequence
  SiRNA target sequence
gtatatttgtatctatcaaatttata

SEQ ID NO: 93576 - DNA, 26 bp, Artificial sequence
  SiRNA target sequence
tatatttgtatctatcaaatttatat

SEQ ID NO: 93577 - DNA, 26 bp, Artificial sequence
  SiRNA target sequence
atatttgtatctatcaaatttatatt

SEQ ID NO: 93578 - DNA, 26 bp, Artificial sequence
  SiRNA target sequence
tatttgtatctatcaaatttatattc

SEQ ID NO: 93579 - DNA, 26 bp, Artificial sequence
  SiRNA target sequence
atttgtatctatcaaatttatattct

SEQ ID NO: 93580 - DNA, 26 bp, Artificial sequence
  SiRNA target sequence
tttgtatctatcaaatttatattctc

SEQ ID NO: 93581 - DNA, 26 bp, Artificial sequence
  SiRNA target sequence
ttgtatctatcaaatttatattctcg

SEQ ID NO: 93582 - DNA, 26 bp, Artificial sequence
  SiRNA target sequence
tgtatctatcaaatttatattctcgt

SEQ ID NO: 93583 - DNA, 26 bp, Artificial sequence
  SiRNA target sequence
gtatctatcaaatttatattctcgtt

SEQ ID NO: 93584 - DNA, 26 bp, Artificial sequence
  SiRNA target sequence
tatctatcaaatttatattctcgttt

SEQ ID NO: 93585 - DNA, 26 bp, Artificial sequence
  SiRNA target sequence
atctatcaaatttatattctcgtttg

SEQ ID NO: 93586 - DNA, 26 bp, Artificial sequence
  SiRNA target sequence
tctatcaaatttatattctcgtttgt

SEQ ID NO: 93587 - DNA, 26 bp, Artificial sequence
  SiRNA target sequence
ctatcaaatttatattctcgtttgtc

SEQ ID NO: 93588 - DNA, 26 bp, Artificial sequence
  SiRNA target sequence
tatcaaatttatattctcgtttgtct

SEQ ID NO: 93589 - DNA, 26 bp, Artificial sequence
  SiRNA target sequence
atcaaatttatattctcgtttgtctt

SEQ ID NO: 93590 - DNA, 26 bp, Artificial sequence
  SiRNA target sequence
tcaaatttatattctcgtttgtcttt

SEQ ID NO: 93591 - DNA, 26 bp, Artificial sequence
  SiRNA target sequence
caaatttatattctcgtttgtcttta

SEQ ID NO: 93592 - DNA, 26 bp, Artificial sequence
  SiRNA target sequence
aaatttatattctcgtttgtctttat

SEQ ID NO: 93593 - DNA, 26 bp, Artificial sequence
  SiRNA target sequence
aatttatattctcgtttgtctttatt

SEQ ID NO: 93594 - DNA, 26 bp, Artificial sequence
  SiRNA target sequence
atttatattctcgtttgtctttattt

SEQ ID NO: 93595 - DNA, 26 bp, Artificial sequence
  SiRNA target sequence
tttatattctcgtttgtctttatttt

SEQ ID NO: 93596 - DNA, 26 bp, Artificial sequence
  SiRNA target sequence
ttatattctcgtttgtctttatttta

SEQ ID NO: 93597 - DNA, 26 bp, Artificial sequence
  SiRNA target sequence
tatattctcgtttgtctttattttat

SEQ ID NO: 93598 - DNA, 26 bp, Artificial sequence
  SiRNA target sequence
atattctcgtttgtctttattttata

SEQ ID NO: 93599 - DNA, 26 bp, Artificial sequence
  SiRNA target sequence
tattctcgtttgtctttattttataa

SEQ ID NO: 93600 - DNA, 26 bp, Artificial sequence
  SiRNA target sequence
attctcgtttgtctttattttataag

SEQ ID NO: 93601 - DNA, 26 bp, Artificial sequence
  SiRNA target sequence
ttctcgtttgtctttattttataaga

SEQ ID NO: 93602 - DNA, 26 bp, Artificial sequence
  SiRNA target sequence
tctcgtttgtctttattttataagaa

SEQ ID NO: 93603 - DNA, 26 bp, Artificial sequence
  SiRNA target sequence
ctcgtttgtctttattttataagaac

SEQ ID NO: 93604 - DNA, 26 bp, Artificial sequence
  SiRNA target sequence
tcgtttgtctttattttataagaacc

SEQ ID NO: 93605 - DNA, 26 bp, Artificial sequence
  SiRNA target sequence
cgtttgtctttattttataagaacct

SEQ ID NO: 93606 - DNA, 26 bp, Artificial sequence
  SiRNA target sequence
gtttgtctttattttataagaacctg

SEQ ID NO: 93607 - DNA, 26 bp, Artificial sequence
  SiRNA target sequence
tttgtctttattttataagaacctgt

SEQ ID NO: 93608 - DNA, 26 bp, Artificial sequence
  SiRNA target sequence
ttgtctttattttataagaacctgta

SEQ ID NO: 93609 - DNA, 26 bp, Artificial sequence
  SiRNA target sequence
tgtctttattttataagaacctgtat

SEQ ID NO: 93610 - DNA, 26 bp, Artificial sequence
  SiRNA target sequence
gtctttattttataagaacctgtata

SEQ ID NO: 93611 - DNA, 26 bp, Artificial sequence
  SiRNA target sequence
tctttattttataagaacctgtatag

SEQ ID NO: 93612 - DNA, 26 bp, Artificial sequence
  SiRNA target sequence
ctttattttataagaacctgtatagt

SEQ ID NO: 93613 - DNA, 26 bp, Artificial sequence
  SiRNA target sequence
tttattttataagaacctgtatagtt

SEQ ID NO: 93614 - DNA, 26 bp, Artificial sequence
  SiRNA target sequence
ttattttataagaacctgtatagttg

SEQ ID NO: 93615 - DNA, 26 bp, Artificial sequence
  SiRNA target sequence
tattttataagaacctgtatagttgg

SEQ ID NO: 93616 - DNA, 26 bp, Artificial sequence
  SiRNA target sequence
attttataagaacctgtatagttggt

SEQ ID NO: 93617 - DNA, 26 bp, Artificial sequence
  SiRNA target sequence
ttttataagaacctgtatagttggtc

SEQ ID NO: 93618 - DNA, 26 bp, Artificial sequence
  SiRNA target sequence
tttataagaacctgtatagttggtct

SEQ ID NO: 93619 - DNA, 26 bp, Artificial sequence
  SiRNA target sequence
ttataagaacctgtatagttggtctt

SEQ ID NO: 93620 - DNA, 26 bp, Artificial sequence
  SiRNA target sequence
tataagaacctgtatagttggtcttt

SEQ ID NO: 93621 - DNA, 26 bp, Artificial sequence
  SiRNA target sequence
ataagaacctgtatagttggtctttt

SEQ ID NO: 93622 - DNA, 26 bp, Artificial sequence
  SiRNA target sequence
taagaacctgtatagttggtcttttt

SEQ ID NO: 93623 - DNA, 26 bp, Artificial sequence
  SiRNA target sequence
aagaacctgtatagttggtcttttta

SEQ ID NO: 93624 - DNA, 26 bp, Artificial sequence
  SiRNA target sequence
agaacctgtatagttggtctttttaa

SEQ ID NO: 93625 - DNA, 26 bp, Artificial sequence
  SiRNA target sequence
gaacctgtatagttggtctttttaat

SEQ ID NO: 93626 - DNA, 26 bp, Artificial sequence
  SiRNA target sequence
aacctgtatagttggtctttttaatt

SEQ ID NO: 93627 - DNA, 26 bp, Artificial sequence
  SiRNA target sequence
acctgtatagttggtctttttaatta

SEQ ID NO: 93628 - DNA, 26 bp, Artificial sequence
  SiRNA target sequence
cctgtatagttggtctttttaattat

SEQ ID NO: 93629 - DNA, 26 bp, Artificial sequence
  SiRNA target sequence
ctgtatagttggtctttttaattata

SEQ ID NO: 93630 - DNA, 26 bp, Artificial sequence
  SiRNA target sequence
tgtatagttggtctttttaattataa

SEQ ID NO: 93631 - DNA, 26 bp, Artificial sequence
  SiRNA target sequence
gtatagttggtctttttaattataag

SEQ ID NO: 93632 - DNA, 26 bp, Artificial sequence
  SiRNA target sequence
tatagttggtctttttaattataagc

SEQ ID NO: 93633 - DNA, 26 bp, Artificial sequence
  SiRNA target sequence
atagttggtctttttaattataagct

SEQ ID NO: 93634 - DNA, 26 bp, Artificial sequence
  SiRNA target sequence
tagttggtctttttaattataagctt

SEQ ID NO: 93635 - DNA, 26 bp, Artificial sequence
  SiRNA target sequence
agttggtctttttaattataagctta

SEQ ID NO: 93636 - DNA, 26 bp, Artificial sequence
  SiRNA target sequence
gttggtctttttaattataagcttat

SEQ ID NO: 93637 - DNA, 26 bp, Artificial sequence
  SiRNA target sequence
ttggtctttttaattataagcttatt

SEQ ID NO: 93638 - DNA, 26 bp, Artificial sequence
  SiRNA target sequence
tggtctttttaattataagcttattg

SEQ ID NO: 93639 - DNA, 26 bp, Artificial sequence
  SiRNA target sequence
ggtctttttaattataagcttattga

SEQ ID NO: 93640 - DNA, 26 bp, Artificial sequence
  SiRNA target sequence
gtctttttaattataagcttattgaa

SEQ ID NO: 93641 - DNA, 26 bp, Artificial sequence
  SiRNA target sequence
tctttttaattataagcttattgaaa

SEQ ID NO: 93642 - DNA, 26 bp, Artificial sequence
  SiRNA target sequence
ctttttaattataagcttattgaaat

SEQ ID NO: 93643 - DNA, 26 bp, Artificial sequence
  SiRNA target sequence
tttttaattataagcttattgaaatt

SEQ ID NO: 93644 - DNA, 26 bp, Artificial sequence
  SiRNA target sequence
ttttaattataagcttattgaaattt

SEQ ID NO: 93645 - DNA, 26 bp, Artificial sequence
  SiRNA target sequence
tttaattataagcttattgaaatttc

SEQ ID NO: 93646 - DNA, 26 bp, Artificial sequence
  SiRNA target sequence
ttaattataagcttattgaaatttct

SEQ ID NO: 93647 - DNA, 26 bp, Artificial sequence
  SiRNA target sequence
taattataagcttattgaaatttcta

SEQ ID NO: 93648 - DNA, 26 bp, Artificial sequence
  SiRNA target sequence
aattataagcttattgaaatttctaa

SEQ ID NO: 93649 - DNA, 26 bp, Artificial sequence
  SiRNA target sequence
attataagcttattgaaatttctaat

SEQ ID NO: 93650 - DNA, 26 bp, Artificial sequence
  SiRNA target sequence
ttataagcttattgaaatttctaata

SEQ ID NO: 93651 - DNA, 26 bp, Artificial sequence
  SiRNA target sequence
tataagcttattgaaatttctaatat

SEQ ID NO: 93652 - DNA, 26 bp, Artificial sequence
  SiRNA target sequence
ataagcttattgaaatttctaatatt

SEQ ID NO: 93653 - DNA, 26 bp, Artificial sequence
  SiRNA target sequence
taagcttattgaaatttctaatattt

SEQ ID NO: 93654 - DNA, 26 bp, Artificial sequence
  SiRNA target sequence
aagcttattgaaatttctaatattta

SEQ ID NO: 93655 - DNA, 26 bp, Artificial sequence
  SiRNA target sequence
agcttattgaaatttctaatatttaa

SEQ ID NO: 93656 - DNA, 26 bp, Artificial sequence
  SiRNA target sequence
gcttattgaaatttctaatatttaaa

SEQ ID NO: 93657 - DNA, 26 bp, Artificial sequence
  SiRNA target sequence
cttattgaaatttctaatatttaaag

SEQ ID NO: 93658 - DNA, 26 bp, Artificial sequence
  SiRNA target sequence
ttattgaaatttctaatatttaaagg

SEQ ID NO: 93659 - DNA, 26 bp, Artificial sequence
  SiRNA target sequence
tattgaaatttctaatatttaaagga

SEQ ID NO: 93660 - DNA, 26 bp, Artificial sequence
  SiRNA target sequence
attgaaatttctaatatttaaaggaa

SEQ ID NO: 93661 - DNA, 26 bp, Artificial sequence
  SiRNA target sequence
ttgaaatttctaatatttaaaggaac

SEQ ID NO: 93662 - DNA, 26 bp, Artificial sequence
  SiRNA target sequence
tgaaatttctaatatttaaaggaaca

SEQ ID NO: 93663 - DNA, 26 bp, Artificial sequence
  SiRNA target sequence
gaaatttctaatatttaaaggaacaa

SEQ ID NO: 93664 - DNA, 26 bp, Artificial sequence
  SiRNA target sequence
aaatttctaatatttaaaggaacaaa

SEQ ID NO: 93665 - DNA, 26 bp, Artificial sequence
  SiRNA target sequence
aatttctaatatttaaaggaacaaaa

SEQ ID NO: 93666 - DNA, 26 bp, Artificial sequence
  SiRNA target sequence
atttctaatatttaaaggaacaaaat

SEQ ID NO: 93667 - DNA, 26 bp, Artificial sequence
  SiRNA target sequence
tttctaatatttaaaggaacaaaatc

SEQ ID NO: 93668 - DNA, 26 bp, Artificial sequence
  SiRNA target sequence
ttctaatatttaaaggaacaaaatct

SEQ ID NO: 93669 - DNA, 26 bp, Artificial sequence
  SiRNA target sequence
tctaatatttaaaggaacaaaatcta

SEQ ID NO: 93670 - DNA, 26 bp, Artificial sequence
  SiRNA target sequence
ctaatatttaaaggaacaaaatctac

SEQ ID NO: 93671 - DNA, 26 bp, Artificial sequence
  SiRNA target sequence
taatatttaaaggaacaaaatctaca

SEQ ID NO: 93672 - DNA, 26 bp, Artificial sequence
  SiRNA target sequence
aatatttaaaggaacaaaatctacat

SEQ ID NO: 93673 - DNA, 26 bp, Artificial sequence
  SiRNA target sequence
atatttaaaggaacaaaatctacatt

SEQ ID NO: 93674 - DNA, 26 bp, Artificial sequence
  SiRNA target sequence
tatttaaaggaacaaaatctacattt

SEQ ID NO: 93675 - DNA, 26 bp, Artificial sequence
  SiRNA target sequence
atttaaaggaacaaaatctacattta

SEQ ID NO: 93676 - DNA, 26 bp, Artificial sequence
  SiRNA target sequence
tttaaaggaacaaaatctacatttag

SEQ ID NO: 93677 - DNA, 26 bp, Artificial sequence
  SiRNA target sequence
ttaaaggaacaaaatctacatttaga

SEQ ID NO: 93678 - DNA, 26 bp, Artificial sequence
  SiRNA target sequence
taaaggaacaaaatctacatttagat

SEQ ID NO: 93679 - DNA, 26 bp, Artificial sequence
  SiRNA target sequence
aaaggaacaaaatctacatttagatt

SEQ ID NO: 93680 - DNA, 26 bp, Artificial sequence
  SiRNA target sequence
aaggaacaaaatctacatttagatta

SEQ ID NO: 93681 - DNA, 26 bp, Artificial sequence
  SiRNA target sequence
aggaacaaaatctacatttagattat

SEQ ID NO: 93682 - DNA, 26 bp, Artificial sequence
  SiRNA target sequence
ggaacaaaatctacatttagattata

SEQ ID NO: 93683 - DNA, 26 bp, Artificial sequence
  SiRNA target sequence
gaacaaaatctacatttagattatat

SEQ ID NO: 93684 - DNA, 26 bp, Artificial sequence
  SiRNA target sequence
aacaaaatctacatttagattatatt

SEQ ID NO: 93685 - DNA, 26 bp, Artificial sequence
  SiRNA target sequence
acaaaatctacatttagattatattc

SEQ ID NO: 93686 - DNA, 26 bp, Artificial sequence
  SiRNA target sequence
caaaatctacatttagattatattct

SEQ ID NO: 93687 - DNA, 26 bp, Artificial sequence
  SiRNA target sequence
aaaatctacatttagattatattcta

SEQ ID NO: 93688 - DNA, 26 bp, Artificial sequence
  SiRNA target sequence
aaatctacatttagattatattctaa

SEQ ID NO: 93689 - DNA, 26 bp, Artificial sequence
  SiRNA target sequence
aatctacatttagattatattctaat

SEQ ID NO: 93690 - DNA, 26 bp, Artificial sequence
  SiRNA target sequence
atctacatttagattatattctaatt

SEQ ID NO: 93691 - DNA, 26 bp, Artificial sequence
  SiRNA target sequence
tctacatttagattatattctaattt

SEQ ID NO: 93692 - DNA, 26 bp, Artificial sequence
  SiRNA target sequence
ctacatttagattatattctaattta

SEQ ID NO: 93693 - DNA, 26 bp, Artificial sequence
  SiRNA target sequence
tacatttagattatattctaatttat

SEQ ID NO: 93694 - DNA, 26 bp, Artificial sequence
  SiRNA target sequence
acatttagattatattctaatttatt

SEQ ID NO: 93695 - DNA, 26 bp, Artificial sequence
  SiRNA target sequence
catttagattatattctaatttattg

SEQ ID NO: 93696 - DNA, 26 bp, Artificial sequence
  SiRNA target sequence
atttagattatattctaatttattga

SEQ ID NO: 93697 - DNA, 26 bp, Artificial sequence
  SiRNA target sequence
tttagattatattctaatttattgaa

SEQ ID NO: 93698 - DNA, 26 bp, Artificial sequence
  SiRNA target sequence
ttagattatattctaatttattgaat

SEQ ID NO: 93699 - DNA, 26 bp, Artificial sequence
  SiRNA target sequence
tagattatattctaatttattgaatt

SEQ ID NO: 93700 - DNA, 26 bp, Artificial sequence
  SiRNA target sequence
agattatattctaatttattgaattt

SEQ ID NO: 93701 - DNA, 26 bp, Artificial sequence
  SiRNA target sequence
gattatattctaatttattgaatttc

SEQ ID NO: 93702 - DNA, 26 bp, Artificial sequence
  SiRNA target sequence
attatattctaatttattgaatttca

SEQ ID NO: 93703 - DNA, 26 bp, Artificial sequence
  SiRNA target sequence
ttatattctaatttattgaatttcat

SEQ ID NO: 93704 - DNA, 27 bp, Artificial sequence
  SiRNA target sequence
ttatatccaactatcaaaaaatagcct

SEQ ID NO: 93705 - DNA, 27 bp, Artificial sequence
  SiRNA target sequence
tatatccaactatcaaaaaatagcctc

SEQ ID NO: 93706 - DNA, 27 bp, Artificial sequence
  SiRNA target sequence
atatccaactatcaaaaaatagcctct

SEQ ID NO: 93707 - DNA, 27 bp, Artificial sequence
  SiRNA target sequence
tatccaactatcaaaaaatagcctctt

SEQ ID NO: 93708 - DNA, 27 bp, Artificial sequence
  SiRNA target sequence
atccaactatcaaaaaatagcctcttt

SEQ ID NO: 93709 - DNA, 27 bp, Artificial sequence
  SiRNA target sequence
tccaactatcaaaaaatagcctctttt

SEQ ID NO: 93710 - DNA, 27 bp, Artificial sequence
  SiRNA target sequence
ccaactatcaaaaaatagcctcttttc

SEQ ID NO: 93711 - DNA, 27 bp, Artificial sequence
  SiRNA target sequence
caactatcaaaaaatagcctcttttct

SEQ ID NO: 93712 - DNA, 27 bp, Artificial sequence
  SiRNA target sequence
aactatcaaaaaatagcctcttttctt

SEQ ID NO: 93713 - DNA, 27 bp, Artificial sequence
  SiRNA target sequence
actatcaaaaaatagcctcttttcttt

SEQ ID NO: 93714 - DNA, 27 bp, Artificial sequence
  SiRNA target sequence
ctatcaaaaaatagcctcttttctttc

SEQ ID NO: 93715 - DNA, 27 bp, Artificial sequence
  SiRNA target sequence
tatcaaaaaatagcctcttttctttca

SEQ ID NO: 93716 - DNA, 27 bp, Artificial sequence
  SiRNA target sequence
atcaaaaaatagcctcttttctttcac

SEQ ID NO: 93717 - DNA, 27 bp, Artificial sequence
  SiRNA target sequence
tcaaaaaatagcctcttttctttcaca

SEQ ID NO: 93718 - DNA, 27 bp, Artificial sequence
  SiRNA target sequence
caaaaaatagcctcttttctttcacaa

SEQ ID NO: 93719 - DNA, 27 bp, Artificial sequence
  SiRNA target sequence
aaaaaatagcctcttttctttcacaat

SEQ ID NO: 93720 - DNA, 27 bp, Artificial sequence
  SiRNA target sequence
aaaaatagcctcttttctttcacaatt

SEQ ID NO: 93721 - DNA, 27 bp, Artificial sequence
  SiRNA target sequence
aaaatagcctcttttctttcacaattt

SEQ ID NO: 93722 - DNA, 27 bp, Artificial sequence
  SiRNA target sequence
aaatagcctcttttctttcacaatttc

SEQ ID NO: 93723 - DNA, 27 bp, Artificial sequence
  SiRNA target sequence
aatagcctcttttctttcacaatttca

SEQ ID NO: 93724 - DNA, 27 bp, Artificial sequence
  SiRNA target sequence
atagcctcttttctttcacaatttcag

SEQ ID NO: 93725 - DNA, 27 bp, Artificial sequence
  SiRNA target sequence
tagcctcttttctttcacaatttcaga

SEQ ID NO: 93726 - DNA, 27 bp, Artificial sequence
  SiRNA target sequence
agcctcttttctttcacaatttcagaa

SEQ ID NO: 93727 - DNA, 27 bp, Artificial sequence
  SiRNA target sequence
gcctcttttctttcacaatttcagaaa

SEQ ID NO: 93728 - DNA, 27 bp, Artificial sequence
  SiRNA target sequence
cctcttttctttcacaatttcagaaaa

SEQ ID NO: 93729 - DNA, 27 bp, Artificial sequence
  SiRNA target sequence
ctcttttctttcacaatttcagaaaaa

SEQ ID NO: 93730 - DNA, 27 bp, Artificial sequence
  SiRNA target sequence
tcttttctttcacaatttcagaaaaat

SEQ ID NO: 93731 - DNA, 27 bp, Artificial sequence
  SiRNA target sequence
cttttctttcacaatttcagaaaaatt

SEQ ID NO: 93732 - DNA, 27 bp, Artificial sequence
  SiRNA target sequence
ttttctttcacaatttcagaaaaattt

SEQ ID NO: 93733 - DNA, 27 bp, Artificial sequence
  SiRNA target sequence
tttctttcacaatttcagaaaaatttt

SEQ ID NO: 93734 - DNA, 27 bp, Artificial sequence
  SiRNA target sequence
ttctttcacaatttcagaaaaattttc

SEQ ID NO: 93735 - DNA, 27 bp, Artificial sequence
  SiRNA target sequence
tctttcacaatttcagaaaaattttca

SEQ ID NO: 93736 - DNA, 27 bp, Artificial sequence
  SiRNA target sequence
ctttcacaatttcagaaaaattttcat

SEQ ID NO: 93737 - DNA, 27 bp, Artificial sequence
  SiRNA target sequence
tttcacaatttcagaaaaattttcatt

SEQ ID NO: 93738 - DNA, 27 bp, Artificial sequence
  SiRNA target sequence
ttcacaatttcagaaaaattttcatta

SEQ ID NO: 93739 - DNA, 27 bp, Artificial sequence
  SiRNA target sequence
tcacaatttcagaaaaattttcattaa

SEQ ID NO: 93740 - DNA, 27 bp, Artificial sequence
  SiRNA target sequence
cacaatttcagaaaaattttcattaaa

SEQ ID NO: 93741 - DNA, 27 bp, Artificial sequence
  SiRNA target sequence
acaatttcagaaaaattttcattaaaa

SEQ ID NO: 93742 - DNA, 27 bp, Artificial sequence
  SiRNA target sequence
caatttcagaaaaattttcattaaaaa

SEQ ID NO: 93743 - DNA, 27 bp, Artificial sequence
  SiRNA target sequence
aatttcagaaaaattttcattaaaaat

SEQ ID NO: 93744 - DNA, 27 bp, Artificial sequence
  SiRNA target sequence
atttcagaaaaattttcattaaaaatg

SEQ ID NO: 93745 - DNA, 27 bp, Artificial sequence
  SiRNA target sequence
tttcagaaaaattttcattaaaaatgc

SEQ ID NO: 93746 - DNA, 27 bp, Artificial sequence
  SiRNA target sequence
ttcagaaaaattttcattaaaaatgct

SEQ ID NO: 93747 - DNA, 27 bp, Artificial sequence
  SiRNA target sequence
tcagaaaaattttcattaaaaatgcta

SEQ ID NO: 93748 - DNA, 27 bp, Artificial sequence
  SiRNA target sequence
cagaaaaattttcattaaaaatgctat

SEQ ID NO: 93749 - DNA, 27 bp, Artificial sequence
  SiRNA target sequence
agaaaaattttcattaaaaatgctata

SEQ ID NO: 93750 - DNA, 27 bp, Artificial sequence
  SiRNA target sequence
gaaaaattttcattaaaaatgctataa

SEQ ID NO: 93751 - DNA, 27 bp, Artificial sequence
  SiRNA target sequence
aaaaattttcattaaaaatgctataaa

SEQ ID NO: 93752 - DNA, 27 bp, Artificial sequence
  SiRNA target sequence
aaaattttcattaaaaatgctataaat

SEQ ID NO: 93753 - DNA, 27 bp, Artificial sequence
  SiRNA target sequence
aaattttcattaaaaatgctataaata

SEQ ID NO: 93754 - DNA, 27 bp, Artificial sequence
  SiRNA target sequence
aattttcattaaaaatgctataaatag

SEQ ID NO: 93755 - DNA, 27 bp, Artificial sequence
  SiRNA target sequence
attttcattaaaaatgctataaatagt

SEQ ID NO: 93756 - DNA, 27 bp, Artificial sequence
  SiRNA target sequence
ttttcattaaaaatgctataaatagtt

SEQ ID NO: 93757 - DNA, 27 bp, Artificial sequence
  SiRNA target sequence
tttcattaaaaatgctataaatagttt

SEQ ID NO: 93758 - DNA, 27 bp, Artificial sequence
  SiRNA target sequence
ttcattaaaaatgctataaatagtttt

SEQ ID NO: 93759 - DNA, 27 bp, Artificial sequence
  SiRNA target sequence
tcattaaaaatgctataaatagttttt

SEQ ID NO: 93760 - DNA, 27 bp, Artificial sequence
  SiRNA target sequence
cattaaaaatgctataaatagtttttt

SEQ ID NO: 93761 - DNA, 27 bp, Artificial sequence
  SiRNA target sequence
attaaaaatgctataaatagttttttg

SEQ ID NO: 93762 - DNA, 27 bp, Artificial sequence
  SiRNA target sequence
ttaaaaatgctataaatagttttttgc

SEQ ID NO: 93763 - DNA, 27 bp, Artificial sequence
  SiRNA target sequence
taaaaatgctataaatagttttttgca

SEQ ID NO: 93764 - DNA, 27 bp, Artificial sequence
  SiRNA target sequence
aaaaatgctataaatagttttttgcat

SEQ ID NO: 93765 - DNA, 27 bp, Artificial sequence
  SiRNA target sequence
aaaatgctataaatagttttttgcata

SEQ ID NO: 93766 - DNA, 27 bp, Artificial sequence
  SiRNA target sequence
aaatgctataaatagttttttgcatat

SEQ ID NO: 93767 - DNA, 27 bp, Artificial sequence
  SiRNA target sequence
aatgctataaatagttttttgcatatc

SEQ ID NO: 93768 - DNA, 27 bp, Artificial sequence
  SiRNA target sequence
atgctataaatagttttttgcatatca

SEQ ID NO: 93769 - DNA, 27 bp, Artificial sequence
  SiRNA target sequence
tgctataaatagttttttgcatatcag

SEQ ID NO: 93770 - DNA, 27 bp, Artificial sequence
  SiRNA target sequence
gctataaatagttttttgcatatcagg

SEQ ID NO: 93771 - DNA, 27 bp, Artificial sequence
  SiRNA target sequence
ctataaatagttttttgcatatcaggt

SEQ ID NO: 93772 - DNA, 27 bp, Artificial sequence
  SiRNA target sequence
tataaatagttttttgcatatcaggtc

SEQ ID NO: 93773 - DNA, 27 bp, Artificial sequence
  SiRNA target sequence
ataaatagttttttgcatatcaggtcg

SEQ ID NO: 93774 - DNA, 27 bp, Artificial sequence
  SiRNA target sequence
taaatagttttttgcatatcaggtcgg

SEQ ID NO: 93775 - DNA, 27 bp, Artificial sequence
  SiRNA target sequence
aaatagttttttgcatatcaggtcggc

SEQ ID NO: 93776 - DNA, 27 bp, Artificial sequence
  SiRNA target sequence
aatagttttttgcatatcaggtcggcc

SEQ ID NO: 93777 - DNA, 27 bp, Artificial sequence
  SiRNA target sequence
atagttttttgcatatcaggtcggcca

SEQ ID NO: 93778 - DNA, 27 bp, Artificial sequence
  SiRNA target sequence
tagttttttgcatatcaggtcggccac

SEQ ID NO: 93779 - DNA, 27 bp, Artificial sequence
  SiRNA target sequence
agttttttgcatatcaggtcggccaca

SEQ ID NO: 93780 - DNA, 27 bp, Artificial sequence
  SiRNA target sequence
gttttttgcatatcaggtcggccacaa

SEQ ID NO: 93781 - DNA, 27 bp, Artificial sequence
  SiRNA target sequence
ttttttgcatatcaggtcggccacaaa

SEQ ID NO: 93782 - DNA, 27 bp, Artificial sequence
  SiRNA target sequence
tttttgcatatcaggtcggccacaaac

SEQ ID NO: 93783 - DNA, 27 bp, Artificial sequence
  SiRNA target sequence
ttttgcatatcaggtcggccacaaaca

SEQ ID NO: 93784 - DNA, 27 bp, Artificial sequence
  SiRNA target sequence
tttgcatatcaggtcggccacaaacat

SEQ ID NO: 93785 - DNA, 27 bp, Artificial sequence
  SiRNA target sequence
ttgcatatcaggtcggccacaaacata

SEQ ID NO: 93786 - DNA, 27 bp, Artificial sequence
  SiRNA target sequence
tgcatatcaggtcggccacaaacataa

SEQ ID NO: 93787 - DNA, 27 bp, Artificial sequence
  SiRNA target sequence
gcatatcaggtcggccacaaacataaa

SEQ ID NO: 93788 - DNA, 27 bp, Artificial sequence
  SiRNA target sequence
catatcaggtcggccacaaacataaac

SEQ ID NO: 93789 - DNA, 27 bp, Artificial sequence
  SiRNA target sequence
atatcaggtcggccacaaacataaacc

SEQ ID NO: 93790 - DNA, 27 bp, Artificial sequence
  SiRNA target sequence
tatcaggtcggccacaaacataaacca

SEQ ID NO: 93791 - DNA, 27 bp, Artificial sequence
  SiRNA target sequence
atcaggtcggccacaaacataaaccaa

SEQ ID NO: 93792 - DNA, 27 bp, Artificial sequence
  SiRNA target sequence
tcaggtcggccacaaacataaaccaaa

SEQ ID NO: 93793 - DNA, 27 bp, Artificial sequence
  SiRNA target sequence
caggtcggccacaaacataaaccaaac

SEQ ID NO: 93794 - DNA, 27 bp, Artificial sequence
  SiRNA target sequence
aggtcggccacaaacataaaccaaaca

SEQ ID NO: 93795 - DNA, 27 bp, Artificial sequence
  SiRNA target sequence
ggtcggccacaaacataaaccaaacat

SEQ ID NO: 93796 - DNA, 27 bp, Artificial sequence
  SiRNA target sequence
gtcggccacaaacataaaccaaacatc

SEQ ID NO: 93797 - DNA, 27 bp, Artificial sequence
  SiRNA target sequence
tcggccacaaacataaaccaaacatcc

SEQ ID NO: 93798 - DNA, 27 bp, Artificial sequence
  SiRNA target sequence
cggccacaaacataaaccaaacatccg

SEQ ID NO: 93799 - DNA, 27 bp, Artificial sequence
  SiRNA target sequence
ggccacaaacataaaccaaacatccgt

SEQ ID NO: 93800 - DNA, 27 bp, Artificial sequence
  SiRNA target sequence
gccacaaacataaaccaaacatccgtc

SEQ ID NO: 93801 - DNA, 27 bp, Artificial sequence
  SiRNA target sequence
ccacaaacataaaccaaacatccgtct

SEQ ID NO: 93802 - DNA, 27 bp, Artificial sequence
  SiRNA target sequence
cacaaacataaaccaaacatccgtctt

SEQ ID NO: 93803 - DNA, 27 bp, Artificial sequence
  SiRNA target sequence
acaaacataaaccaaacatccgtcttt

SEQ ID NO: 93804 - DNA, 27 bp, Artificial sequence
  SiRNA target sequence
caaacataaaccaaacatccgtcttta

SEQ ID NO: 93805 - DNA, 27 bp, Artificial sequence
  SiRNA target sequence
aaacataaaccaaacatccgtctttaa

SEQ ID NO: 93806 - DNA, 27 bp, Artificial sequence
  SiRNA target sequence
aacataaaccaaacatccgtctttaat

SEQ ID NO: 93807 - DNA, 27 bp, Artificial sequence
  SiRNA target sequence
acataaaccaaacatccgtctttaatg

SEQ ID NO: 93808 - DNA, 27 bp, Artificial sequence
  SiRNA target sequence
cataaaccaaacatccgtctttaatgt

SEQ ID NO: 93809 - DNA, 27 bp, Artificial sequence
  SiRNA target sequence
ataaaccaaacatccgtctttaatgta

SEQ ID NO: 93810 - DNA, 27 bp, Artificial sequence
  SiRNA target sequence
taaaccaaacatccgtctttaatgtat

SEQ ID NO: 93811 - DNA, 27 bp, Artificial sequence
  SiRNA target sequence
aaaccaaacatccgtctttaatgtatg

SEQ ID NO: 93812 - DNA, 27 bp, Artificial sequence
  SiRNA target sequence
aaccaaacatccgtctttaatgtatgt

SEQ ID NO: 93813 - DNA, 27 bp, Artificial sequence
  SiRNA target sequence
accaaacatccgtctttaatgtatgtt

SEQ ID NO: 93814 - DNA, 27 bp, Artificial sequence
  SiRNA target sequence
ccaaacatccgtctttaatgtatgttt

SEQ ID NO: 93815 - DNA, 27 bp, Artificial sequence
  SiRNA target sequence
caaacatccgtctttaatgtatgtttt

SEQ ID NO: 93816 - DNA, 27 bp, Artificial sequence
  SiRNA target sequence
aaacatccgtctttaatgtatgttttt

SEQ ID NO: 93817 - DNA, 27 bp, Artificial sequence
  SiRNA target sequence
aacatccgtctttaatgtatgttttta

SEQ ID NO: 93818 - DNA, 27 bp, Artificial sequence
  SiRNA target sequence
acatccgtctttaatgtatgtttttat

SEQ ID NO: 93819 - DNA, 27 bp, Artificial sequence
  SiRNA target sequence
catccgtctttaatgtatgtttttatc

SEQ ID NO: 93820 - DNA, 27 bp, Artificial sequence
  SiRNA target sequence
atccgtctttaatgtatgtttttatct

SEQ ID NO: 93821 - DNA, 27 bp, Artificial sequence
  SiRNA target sequence
tccgtctttaatgtatgtttttatctc

SEQ ID NO: 93822 - DNA, 27 bp, Artificial sequence
  SiRNA target sequence
ccgtctttaatgtatgtttttatctca

SEQ ID NO: 93823 - DNA, 27 bp, Artificial sequence
  SiRNA target sequence
cgtctttaatgtatgtttttatctcat

SEQ ID NO: 93824 - DNA, 27 bp, Artificial sequence
  SiRNA target sequence
gtctttaatgtatgtttttatctcatt

SEQ ID NO: 93825 - DNA, 27 bp, Artificial sequence
  SiRNA target sequence
tctttaatgtatgtttttatctcattt

SEQ ID NO: 93826 - DNA, 27 bp, Artificial sequence
  SiRNA target sequence
ctttaatgtatgtttttatctcattta

SEQ ID NO: 93827 - DNA, 27 bp, Artificial sequence
  SiRNA target sequence
tttaatgtatgtttttatctcatttaa

SEQ ID NO: 93828 - DNA, 27 bp, Artificial sequence
  SiRNA target sequence
ttaatgtatgtttttatctcatttaaa

SEQ ID NO: 93829 - DNA, 27 bp, Artificial sequence
  SiRNA target sequence
taatgtatgtttttatctcatttaaat

SEQ ID NO: 93830 - DNA, 27 bp, Artificial sequence
  SiRNA target sequence
aatgtatgtttttatctcatttaaatt

SEQ ID NO: 93831 - DNA, 27 bp, Artificial sequence
  SiRNA target sequence
atgtatgtttttatctcatttaaattt

SEQ ID NO: 93832 - DNA, 27 bp, Artificial sequence
  SiRNA target sequence
tgtatgtttttatctcatttaaatttt

SEQ ID NO: 93833 - DNA, 27 bp, Artificial sequence
  SiRNA target sequence
gtatgtttttatctcatttaaattttg

SEQ ID NO: 93834 - DNA, 27 bp, Artificial sequence
  SiRNA target sequence
tatgtttttatctcatttaaattttgt

SEQ ID NO: 93835 - DNA, 27 bp, Artificial sequence
  SiRNA target sequence
atgtttttatctcatttaaattttgta

SEQ ID NO: 93836 - DNA, 27 bp, Artificial sequence
  SiRNA target sequence
tgtttttatctcatttaaattttgtaa

SEQ ID NO: 93837 - DNA, 27 bp, Artificial sequence
  SiRNA target sequence
gtttttatctcatttaaattttgtaat

SEQ ID NO: 93838 - DNA, 27 bp, Artificial sequence
  SiRNA target sequence
tttttatctcatttaaattttgtaata

SEQ ID NO: 93839 - DNA, 27 bp, Artificial sequence
  SiRNA target sequence
ttttatctcatttaaattttgtaataa

SEQ ID NO: 93840 - DNA, 27 bp, Artificial sequence
  SiRNA target sequence
tttatctcatttaaattttgtaataaa

SEQ ID NO: 93841 - DNA, 27 bp, Artificial sequence
  SiRNA target sequence
ttatctcatttaaattttgtaataaat

SEQ ID NO: 93842 - DNA, 27 bp, Artificial sequence
  SiRNA target sequence
tatctcatttaaattttgtaataaata

SEQ ID NO: 93843 - DNA, 27 bp, Artificial sequence
  SiRNA target sequence
atctcatttaaattttgtaataaataa

SEQ ID NO: 93844 - DNA, 27 bp, Artificial sequence
  SiRNA target sequence
tctcatttaaattttgtaataaataat

SEQ ID NO: 93845 - DNA, 27 bp, Artificial sequence
  SiRNA target sequence
ctcatttaaattttgtaataaataatc

SEQ ID NO: 93846 - DNA, 27 bp, Artificial sequence
  SiRNA target sequence
tcatttaaattttgtaataaataatca

SEQ ID NO: 93847 - DNA, 27 bp, Artificial sequence
  SiRNA target sequence
catttaaattttgtaataaataatcag

SEQ ID NO: 93848 - DNA, 27 bp, Artificial sequence
  SiRNA target sequence
atttaaattttgtaataaataatcagt

SEQ ID NO: 93849 - DNA, 27 bp, Artificial sequence
  SiRNA target sequence
tttaaattttgtaataaataatcagta

SEQ ID NO: 93850 - DNA, 27 bp, Artificial sequence
  SiRNA target sequence
ttaaattttgtaataaataatcagtaa

SEQ ID NO: 93851 - DNA, 27 bp, Artificial sequence
  SiRNA target sequence
taaattttgtaataaataatcagtaac

SEQ ID NO: 93852 - DNA, 27 bp, Artificial sequence
  SiRNA target sequence
aaattttgtaataaataatcagtaaca

SEQ ID NO: 93853 - DNA, 27 bp, Artificial sequence
  SiRNA target sequence
aattttgtaataaataatcagtaacat

SEQ ID NO: 93854 - DNA, 27 bp, Artificial sequence
  SiRNA target sequence
attttgtaataaataatcagtaacata

SEQ ID NO: 93855 - DNA, 27 bp, Artificial sequence
  SiRNA target sequence
ttttgtaataaataatcagtaacataa

SEQ ID NO: 93856 - DNA, 27 bp, Artificial sequence
  SiRNA target sequence
tttgtaataaataatcagtaacataaa

SEQ ID NO: 93857 - DNA, 27 bp, Artificial sequence
  SiRNA target sequence
ttgtaataaataatcagtaacataaat

SEQ ID NO: 93858 - DNA, 27 bp, Artificial sequence
  SiRNA target sequence
tgtaataaataatcagtaacataaatt

SEQ ID NO: 93859 - DNA, 27 bp, Artificial sequence
  SiRNA target sequence
gtaataaataatcagtaacataaattt

SEQ ID NO: 93860 - DNA, 27 bp, Artificial sequence
  SiRNA target sequence
taataaataatcagtaacataaatttt

SEQ ID NO: 93861 - DNA, 27 bp, Artificial sequence
  SiRNA target sequence
aataaataatcagtaacataaatttta

SEQ ID NO: 93862 - DNA, 27 bp, Artificial sequence
  SiRNA target sequence
ataaataatcagtaacataaattttat

SEQ ID NO: 93863 - DNA, 27 bp, Artificial sequence
  SiRNA target sequence
taaataatcagtaacataaattttatt

SEQ ID NO: 93864 - DNA, 27 bp, Artificial sequence
  SiRNA target sequence
aaataatcagtaacataaattttatta

SEQ ID NO: 93865 - DNA, 27 bp, Artificial sequence
  SiRNA target sequence
aataatcagtaacataaattttattac

SEQ ID NO: 93866 - DNA, 27 bp, Artificial sequence
  SiRNA target sequence
ataatcagtaacataaattttattaca

SEQ ID NO: 93867 - DNA, 27 bp, Artificial sequence
  SiRNA target sequence
taatcagtaacataaattttattacaa

SEQ ID NO: 93868 - DNA, 27 bp, Artificial sequence
  SiRNA target sequence
aatcagtaacataaattttattacaag

SEQ ID NO: 93869 - DNA, 27 bp, Artificial sequence
  SiRNA target sequence
atcagtaacataaattttattacaaga

SEQ ID NO: 93870 - DNA, 27 bp, Artificial sequence
  SiRNA target sequence
tcagtaacataaattttattacaagat

SEQ ID NO: 93871 - DNA, 27 bp, Artificial sequence
  SiRNA target sequence
cagtaacataaattttattacaagata

SEQ ID NO: 93872 - DNA, 27 bp, Artificial sequence
  SiRNA target sequence
agtaacataaattttattacaagataa

SEQ ID NO: 93873 - DNA, 27 bp, Artificial sequence
  SiRNA target sequence
gtaacataaattttattacaagataaa

SEQ ID NO: 93874 - DNA, 27 bp, Artificial sequence
  SiRNA target sequence
taacataaattttattacaagataaaa

SEQ ID NO: 93875 - DNA, 27 bp, Artificial sequence
  SiRNA target sequence
aacataaattttattacaagataaaat

SEQ ID NO: 93876 - DNA, 27 bp, Artificial sequence
  SiRNA target sequence
acataaattttattacaagataaaatt

SEQ ID NO: 93877 - DNA, 27 bp, Artificial sequence
  SiRNA target sequence
cataaattttattacaagataaaattt

SEQ ID NO: 93878 - DNA, 27 bp, Artificial sequence
  SiRNA target sequence
ataaattttattacaagataaaatttt

SEQ ID NO: 93879 - DNA, 27 bp, Artificial sequence
  SiRNA target sequence
taaattttattacaagataaaatttta

SEQ ID NO: 93880 - DNA, 27 bp, Artificial sequence
  SiRNA target sequence
aaattttattacaagataaaattttaa

SEQ ID NO: 93881 - DNA, 27 bp, Artificial sequence
  SiRNA target sequence
aattttattacaagataaaattttaat

SEQ ID NO: 93882 - DNA, 27 bp, Artificial sequence
  SiRNA target sequence
attttattacaagataaaattttaata

SEQ ID NO: 93883 - DNA, 27 bp, Artificial sequence
  SiRNA target sequence
ttttattacaagataaaattttaataa

SEQ ID NO: 93884 - DNA, 27 bp, Artificial sequence
  SiRNA target sequence
tttattacaagataaaattttaataat

SEQ ID NO: 93885 - DNA, 27 bp, Artificial sequence
  SiRNA target sequence
ttattacaagataaaattttaataatt

SEQ ID NO: 93886 - DNA, 27 bp, Artificial sequence
  SiRNA target sequence
tattacaagataaaattttaataattt

SEQ ID NO: 93887 - DNA, 27 bp, Artificial sequence
  SiRNA target sequence
attacaagataaaattttaataatttc

SEQ ID NO: 93888 - DNA, 27 bp, Artificial sequence
  SiRNA target sequence
ttacaagataaaattttaataatttct

SEQ ID NO: 93889 - DNA, 27 bp, Artificial sequence
  SiRNA target sequence
tacaagataaaattttaataatttctg

SEQ ID NO: 93890 - DNA, 27 bp, Artificial sequence
  SiRNA target sequence
acaagataaaattttaataatttctgt

SEQ ID NO: 93891 - DNA, 27 bp, Artificial sequence
  SiRNA target sequence
caagataaaattttaataatttctgtg

SEQ ID NO: 93892 - DNA, 27 bp, Artificial sequence
  SiRNA target sequence
aagataaaattttaataatttctgtgt

SEQ ID NO: 93893 - DNA, 27 bp, Artificial sequence
  SiRNA target sequence
agataaaattttaataatttctgtgtt

SEQ ID NO: 93894 - DNA, 27 bp, Artificial sequence
  SiRNA target sequence
gataaaattttaataatttctgtgttt

SEQ ID NO: 93895 - DNA, 27 bp, Artificial sequence
  SiRNA target sequence
ataaaattttaataatttctgtgtttt

SEQ ID NO: 93896 - DNA, 27 bp, Artificial sequence
  SiRNA target sequence
taaaattttaataatttctgtgttttt

SEQ ID NO: 93897 - DNA, 27 bp, Artificial sequence
  SiRNA target sequence
aaaattttaataatttctgtgttttta

SEQ ID NO: 93898 - DNA, 27 bp, Artificial sequence
  SiRNA target sequence
aaattttaataatttctgtgtttttat

SEQ ID NO: 93899 - DNA, 27 bp, Artificial sequence
  SiRNA target sequence
aattttaataatttctgtgtttttata

SEQ ID NO: 93900 - DNA, 27 bp, Artificial sequence
  SiRNA target sequence
attttaataatttctgtgtttttatat

SEQ ID NO: 93901 - DNA, 27 bp, Artificial sequence
  SiRNA target sequence
ttttaataatttctgtgtttttatatt

SEQ ID NO: 93902 - DNA, 27 bp, Artificial sequence
  SiRNA target sequence
tttaataatttctgtgtttttatattt

SEQ ID NO: 93903 - DNA, 27 bp, Artificial sequence
  SiRNA target sequence
ttaataatttctgtgtttttatatttt

SEQ ID NO: 93904 - DNA, 27 bp, Artificial sequence
  SiRNA target sequence
taataatttctgtgtttttatattttg

SEQ ID NO: 93905 - DNA, 27 bp, Artificial sequence
  SiRNA target sequence
aataatttctgtgtttttatattttgc

SEQ ID NO: 93906 - DNA, 27 bp, Artificial sequence
  SiRNA target sequence
ataatttctgtgtttttatattttgca

SEQ ID NO: 93907 - DNA, 27 bp, Artificial sequence
  SiRNA target sequence
taatttctgtgtttttatattttgcat

SEQ ID NO: 93908 - DNA, 27 bp, Artificial sequence
  SiRNA target sequence
aatttctgtgtttttatattttgcatc

SEQ ID NO: 93909 - DNA, 27 bp, Artificial sequence
  SiRNA target sequence
atttctgtgtttttatattttgcatct

SEQ ID NO: 93910 - DNA, 27 bp, Artificial sequence
  SiRNA target sequence
tttctgtgtttttatattttgcatctt

SEQ ID NO: 93911 - DNA, 27 bp, Artificial sequence
  SiRNA target sequence
ttctgtgtttttatattttgcatcttt

SEQ ID NO: 93912 - DNA, 27 bp, Artificial sequence
  SiRNA target sequence
tctgtgtttttatattttgcatcttta

SEQ ID NO: 93913 - DNA, 27 bp, Artificial sequence
  SiRNA target sequence
ctgtgtttttatattttgcatctttaa

SEQ ID NO: 93914 - DNA, 27 bp, Artificial sequence
  SiRNA target sequence
tgtgtttttatattttgcatctttaat

SEQ ID NO: 93915 - DNA, 27 bp, Artificial sequence
  SiRNA target sequence
gtgtttttatattttgcatctttaata

SEQ ID NO: 93916 - DNA, 27 bp, Artificial sequence
  SiRNA target sequence
tgtttttatattttgcatctttaataa

SEQ ID NO: 93917 - DNA, 27 bp, Artificial sequence
  SiRNA target sequence
gtttttatattttgcatctttaataag

SEQ ID NO: 93918 - DNA, 27 bp, Artificial sequence
  SiRNA target sequence
tttttatattttgcatctttaataaga

SEQ ID NO: 93919 - DNA, 27 bp, Artificial sequence
  SiRNA target sequence
ttttatattttgcatctttaataagat

SEQ ID NO: 93920 - DNA, 27 bp, Artificial sequence
  SiRNA target sequence
tttatattttgcatctttaataagatc

SEQ ID NO: 93921 - DNA, 27 bp, Artificial sequence
  SiRNA target sequence
ttatattttgcatctttaataagatca

SEQ ID NO: 93922 - DNA, 27 bp, Artificial sequence
  SiRNA target sequence
tatattttgcatctttaataagatcat

SEQ ID NO: 93923 - DNA, 27 bp, Artificial sequence
  SiRNA target sequence
atattttgcatctttaataagatcatc

SEQ ID NO: 93924 - DNA, 27 bp, Artificial sequence
  SiRNA target sequence
tattttgcatctttaataagatcatct

SEQ ID NO: 93925 - DNA, 27 bp, Artificial sequence
  SiRNA target sequence
attttgcatctttaataagatcatctt

SEQ ID NO: 93926 - DNA, 27 bp, Artificial sequence
  SiRNA target sequence
ttttgcatctttaataagatcatcttc

SEQ ID NO: 93927 - DNA, 27 bp, Artificial sequence
  SiRNA target sequence
tttgcatctttaataagatcatcttct

SEQ ID NO: 93928 - DNA, 27 bp, Artificial sequence
  SiRNA target sequence
ttgcatctttaataagatcatcttctt

SEQ ID NO: 93929 - DNA, 27 bp, Artificial sequence
  SiRNA target sequence
tgcatctttaataagatcatcttcttg

SEQ ID NO: 93930 - DNA, 27 bp, Artificial sequence
  SiRNA target sequence
gcatctttaataagatcatcttcttga

SEQ ID NO: 93931 - DNA, 27 bp, Artificial sequence
  SiRNA target sequence
catctttaataagatcatcttcttgat

SEQ ID NO: 93932 - DNA, 27 bp, Artificial sequence
  SiRNA target sequence
atctttaataagatcatcttcttgatt

SEQ ID NO: 93933 - DNA, 27 bp, Artificial sequence
  SiRNA target sequence
tctttaataagatcatcttcttgattt

SEQ ID NO: 93934 - DNA, 27 bp, Artificial sequence
  SiRNA target sequence
ctttaataagatcatcttcttgatttc

SEQ ID NO: 93935 - DNA, 27 bp, Artificial sequence
  SiRNA target sequence
tttaataagatcatcttcttgatttct

SEQ ID NO: 93936 - DNA, 27 bp, Artificial sequence
  SiRNA target sequence
ttaataagatcatcttcttgatttcta

SEQ ID NO: 93937 - DNA, 27 bp, Artificial sequence
  SiRNA target sequence
taataagatcatcttcttgatttctaa

SEQ ID NO: 93938 - DNA, 27 bp, Artificial sequence
  SiRNA target sequence
aataagatcatcttcttgatttctaaa

SEQ ID NO: 93939 - DNA, 27 bp, Artificial sequence
  SiRNA target sequence
ataagatcatcttcttgatttctaaat

SEQ ID NO: 93940 - DNA, 27 bp, Artificial sequence
  SiRNA target sequence
taagatcatcttcttgatttctaaatc

SEQ ID NO: 93941 - DNA, 27 bp, Artificial sequence
  SiRNA target sequence
aagatcatcttcttgatttctaaatcc

SEQ ID NO: 93942 - DNA, 27 bp, Artificial sequence
  SiRNA target sequence
agatcatcttcttgatttctaaatcca

SEQ ID NO: 93943 - DNA, 27 bp, Artificial sequence
  SiRNA target sequence
gatcatcttcttgatttctaaatccat

SEQ ID NO: 93944 - DNA, 27 bp, Artificial sequence
  SiRNA target sequence
atcatcttcttgatttctaaatccata

SEQ ID NO: 93945 - DNA, 27 bp, Artificial sequence
  SiRNA target sequence
tcatcttcttgatttctaaatccatat

SEQ ID NO: 93946 - DNA, 27 bp, Artificial sequence
  SiRNA target sequence
catcttcttgatttctaaatccatata

SEQ ID NO: 93947 - DNA, 27 bp, Artificial sequence
  SiRNA target sequence
atcttcttgatttctaaatccatatat

SEQ ID NO: 93948 - DNA, 27 bp, Artificial sequence
  SiRNA target sequence
tcttcttgatttctaaatccatatatt

SEQ ID NO: 93949 - DNA, 27 bp, Artificial sequence
  SiRNA target sequence
cttcttgatttctaaatccatatatta

SEQ ID NO: 93950 - DNA, 27 bp, Artificial sequence
  SiRNA target sequence
ttcttgatttctaaatccatatattag

SEQ ID NO: 93951 - DNA, 27 bp, Artificial sequence
  SiRNA target sequence
tcttgatttctaaatccatatattagt

SEQ ID NO: 93952 - DNA, 27 bp, Artificial sequence
  SiRNA target sequence
cttgatttctaaatccatatattagtt

SEQ ID NO: 93953 - DNA, 27 bp, Artificial sequence
  SiRNA target sequence
ttgatttctaaatccatatattagttt

SEQ ID NO: 93954 - DNA, 27 bp, Artificial sequence
  SiRNA target sequence
tgatttctaaatccatatattagtttg

SEQ ID NO: 93955 - DNA, 27 bp, Artificial sequence
  SiRNA target sequence
gatttctaaatccatatattagtttga

SEQ ID NO: 93956 - DNA, 27 bp, Artificial sequence
  SiRNA target sequence
atttctaaatccatatattagtttgat

SEQ ID NO: 93957 - DNA, 27 bp, Artificial sequence
  SiRNA target sequence
tttctaaatccatatattagtttgata

SEQ ID NO: 93958 - DNA, 27 bp, Artificial sequence
  SiRNA target sequence
ttctaaatccatatattagtttgatat

SEQ ID NO: 93959 - DNA, 27 bp, Artificial sequence
  SiRNA target sequence
tctaaatccatatattagtttgatata

SEQ ID NO: 93960 - DNA, 27 bp, Artificial sequence
  SiRNA target sequence
ctaaatccatatattagtttgatatat

SEQ ID NO: 93961 - DNA, 27 bp, Artificial sequence
  SiRNA target sequence
taaatccatatattagtttgatatatt

SEQ ID NO: 93962 - DNA, 27 bp, Artificial sequence
  SiRNA target sequence
aaatccatatattagtttgatatattg

SEQ ID NO: 93963 - DNA, 27 bp, Artificial sequence
  SiRNA target sequence
aatccatatattagtttgatatattga

SEQ ID NO: 93964 - DNA, 27 bp, Artificial sequence
  SiRNA target sequence
atccatatattagtttgatatattgat

SEQ ID NO: 93965 - DNA, 27 bp, Artificial sequence
  SiRNA target sequence
tccatatattagtttgatatattgatc

SEQ ID NO: 93966 - DNA, 27 bp, Artificial sequence
  SiRNA target sequence
ccatatattagtttgatatattgatcg

SEQ ID NO: 93967 - DNA, 27 bp, Artificial sequence
  SiRNA target sequence
catatattagtttgatatattgatcgt

SEQ ID NO: 93968 - DNA, 27 bp, Artificial sequence
  SiRNA target sequence
atatattagtttgatatattgatcgtc

SEQ ID NO: 93969 - DNA, 27 bp, Artificial sequence
  SiRNA target sequence
tatattagtttgatatattgatcgtct

SEQ ID NO: 93970 - DNA, 27 bp, Artificial sequence
  SiRNA target sequence
atattagtttgatatattgatcgtctt

SEQ ID NO: 93971 - DNA, 27 bp, Artificial sequence
  SiRNA target sequence
tattagtttgatatattgatcgtcttc

SEQ ID NO: 93972 - DNA, 27 bp, Artificial sequence
  SiRNA target sequence
attagtttgatatattgatcgtcttct

SEQ ID NO: 93973 - DNA, 27 bp, Artificial sequence
  SiRNA target sequence
ttagtttgatatattgatcgtcttctt

SEQ ID NO: 93974 - DNA, 27 bp, Artificial sequence
  SiRNA target sequence
tagtttgatatattgatcgtcttcttt

SEQ ID NO: 93975 - DNA, 27 bp, Artificial sequence
  SiRNA target sequence
agtttgatatattgatcgtcttcttta

SEQ ID NO: 93976 - DNA, 27 bp, Artificial sequence
  SiRNA target sequence
gtttgatatattgatcgtcttctttat

SEQ ID NO: 93977 - DNA, 27 bp, Artificial sequence
  SiRNA target sequence
tttgatatattgatcgtcttctttatt

SEQ ID NO: 93978 - DNA, 27 bp, Artificial sequence
  SiRNA target sequence
ttgatatattgatcgtcttctttattt

SEQ ID NO: 93979 - DNA, 27 bp, Artificial sequence
  SiRNA target sequence
tgatatattgatcgtcttctttatttt

SEQ ID NO: 93980 - DNA, 27 bp, Artificial sequence
  SiRNA target sequence
gatatattgatcgtcttctttattttt

SEQ ID NO: 93981 - DNA, 27 bp, Artificial sequence
  SiRNA target sequence
atatattgatcgtcttctttatttttc

SEQ ID NO: 93982 - DNA, 27 bp, Artificial sequence
  SiRNA target sequence
tatattgatcgtcttctttatttttca

SEQ ID NO: 93983 - DNA, 27 bp, Artificial sequence
  SiRNA target sequence
atattgatcgtcttctttatttttcaa

SEQ ID NO: 93984 - DNA, 27 bp, Artificial sequence
  SiRNA target sequence
tattgatcgtcttctttatttttcaaa

SEQ ID NO: 93985 - DNA, 27 bp, Artificial sequence
  SiRNA target sequence
attgatcgtcttctttatttttcaaaa

SEQ ID NO: 93986 - DNA, 27 bp, Artificial sequence
  SiRNA target sequence
ttgatcgtcttctttatttttcaaaaa

SEQ ID NO: 93987 - DNA, 27 bp, Artificial sequence
  SiRNA target sequence
tgatcgtcttctttatttttcaaaaac

SEQ ID NO: 93988 - DNA, 27 bp, Artificial sequence
  SiRNA target sequence
gatcgtcttctttatttttcaaaaacg

SEQ ID NO: 93989 - DNA, 27 bp, Artificial sequence
  SiRNA target sequence
atcgtcttctttatttttcaaaaacga

SEQ ID NO: 93990 - DNA, 27 bp, Artificial sequence
  SiRNA target sequence
tcgtcttctttatttttcaaaaacgaa

SEQ ID NO: 93991 - DNA, 27 bp, Artificial sequence
  SiRNA target sequence
cgtcttctttatttttcaaaaacgaaa

SEQ ID NO: 93992 - DNA, 27 bp, Artificial sequence
  SiRNA target sequence
gtcttctttatttttcaaaaacgaaaa

SEQ ID NO: 93993 - DNA, 27 bp, Artificial sequence
  SiRNA target sequence
tcttctttatttttcaaaaacgaaaaa

SEQ ID NO: 93994 - DNA, 27 bp, Artificial sequence
  SiRNA target sequence
cttctttatttttcaaaaacgaaaaaa

SEQ ID NO: 93995 - DNA, 27 bp, Artificial sequence
  SiRNA target sequence
ttctttatttttcaaaaacgaaaaaaa

SEQ ID NO: 93996 - DNA, 27 bp, Artificial sequence
  SiRNA target sequence
tctttatttttcaaaaacgaaaaaaat

SEQ ID NO: 93997 - DNA, 27 bp, Artificial sequence
  SiRNA target sequence
ctttatttttcaaaaacgaaaaaaatg

SEQ ID NO: 93998 - DNA, 27 bp, Artificial sequence
  SiRNA target sequence
tttatttttcaaaaacgaaaaaaatgg

SEQ ID NO: 93999 - DNA, 27 bp, Artificial sequence
  SiRNA target sequence
ttatttttcaaaaacgaaaaaaatgga

SEQ ID NO: 94000 - DNA, 27 bp, Artificial sequence
  SiRNA target sequence
tatttttcaaaaacgaaaaaaatggag

SEQ ID NO: 94001 - DNA, 27 bp, Artificial sequence
  SiRNA target sequence
atttttcaaaaacgaaaaaaatggagc

SEQ ID NO: 94002 - DNA, 27 bp, Artificial sequence
  SiRNA target sequence
tttttcaaaaacgaaaaaaatggagca

SEQ ID NO: 94003 - DNA, 27 bp, Artificial sequence
  SiRNA target sequence
ttttcaaaaacgaaaaaaatggagcaa

SEQ ID NO: 94004 - DNA, 27 bp, Artificial sequence
  SiRNA target sequence
tttcaaaaacgaaaaaaatggagcaat

SEQ ID NO: 94005 - DNA, 27 bp, Artificial sequence
  SiRNA target sequence
ttcaaaaacgaaaaaaatggagcaatg

SEQ ID NO: 94006 - DNA, 27 bp, Artificial sequence
  SiRNA target sequence
tcaaaaacgaaaaaaatggagcaatgc

SEQ ID NO: 94007 - DNA, 27 bp, Artificial sequence
  SiRNA target sequence
caaaaacgaaaaaaatggagcaatgcc

SEQ ID NO: 94008 - DNA, 27 bp, Artificial sequence
  SiRNA target sequence
aaaaacgaaaaaaatggagcaatgcca

SEQ ID NO: 94009 - DNA, 27 bp, Artificial sequence
  SiRNA target sequence
aaaacgaaaaaaatggagcaatgccag

SEQ ID NO: 94010 - DNA, 27 bp, Artificial sequence
  SiRNA target sequence
aaacgaaaaaaatggagcaatgccagt

SEQ ID NO: 94011 - DNA, 27 bp, Artificial sequence
  SiRNA target sequence
aacgaaaaaaatggagcaatgccagtt

SEQ ID NO: 94012 - DNA, 27 bp, Artificial sequence
  SiRNA target sequence
acgaaaaaaatggagcaatgccagttc

SEQ ID NO: 94013 - DNA, 27 bp, Artificial sequence
  SiRNA target sequence
cgaaaaaaatggagcaatgccagttcc

SEQ ID NO: 94014 - DNA, 27 bp, Artificial sequence
  SiRNA target sequence
gaaaaaaatggagcaatgccagttcca

SEQ ID NO: 94015 - DNA, 27 bp, Artificial sequence
  SiRNA target sequence
aaaaaaatggagcaatgccagttccag

SEQ ID NO: 94016 - DNA, 27 bp, Artificial sequence
  SiRNA target sequence
aaaaaatggagcaatgccagttccagt

SEQ ID NO: 94017 - DNA, 27 bp, Artificial sequence
  SiRNA target sequence
aaaaatggagcaatgccagttccagta

SEQ ID NO: 94018 - DNA, 27 bp, Artificial sequence
  SiRNA target sequence
aaaatggagcaatgccagttccagtac

SEQ ID NO: 94019 - DNA, 27 bp, Artificial sequence
  SiRNA target sequence
aaatggagcaatgccagttccagtaca

SEQ ID NO: 94020 - DNA, 27 bp, Artificial sequence
  SiRNA target sequence
aatggagcaatgccagttccagtacaa

SEQ ID NO: 94021 - DNA, 27 bp, Artificial sequence
  SiRNA target sequence
atggagcaatgccagttccagtacaaa

SEQ ID NO: 94022 - DNA, 27 bp, Artificial sequence
  SiRNA target sequence
tggagcaatgccagttccagtacaaat

SEQ ID NO: 94023 - DNA, 27 bp, Artificial sequence
  SiRNA target sequence
ggagcaatgccagttccagtacaaata

SEQ ID NO: 94024 - DNA, 27 bp, Artificial sequence
  SiRNA target sequence
gagcaatgccagttccagtacaaatac

SEQ ID NO: 94025 - DNA, 27 bp, Artificial sequence
  SiRNA target sequence
agcaatgccagttccagtacaaatacc

SEQ ID NO: 94026 - DNA, 27 bp, Artificial sequence
  SiRNA target sequence
gcaatgccagttccagtacaaataccc

SEQ ID NO: 94027 - DNA, 27 bp, Artificial sequence
  SiRNA target sequence
caatgccagttccagtacaaataccca

SEQ ID NO: 94028 - DNA, 27 bp, Artificial sequence
  SiRNA target sequence
aatgccagttccagtacaaatacccaa

SEQ ID NO: 94029 - DNA, 27 bp, Artificial sequence
  SiRNA target sequence
atgccagttccagtacaaatacccaac

SEQ ID NO: 94030 - DNA, 27 bp, Artificial sequence
  SiRNA target sequence
tgccagttccagtacaaatacccaaca

SEQ ID NO: 94031 - DNA, 27 bp, Artificial sequence
  SiRNA target sequence
gccagttccagtacaaatacccaacac

SEQ ID NO: 94032 - DNA, 27 bp, Artificial sequence
  SiRNA target sequence
ccagttccagtacaaatacccaacact

SEQ ID NO: 94033 - DNA, 27 bp, Artificial sequence
  SiRNA target sequence
cagttccagtacaaatacccaacactt

SEQ ID NO: 94034 - DNA, 27 bp, Artificial sequence
  SiRNA target sequence
agttccagtacaaatacccaacacttt

SEQ ID NO: 94035 - DNA, 27 bp, Artificial sequence
  SiRNA target sequence
gttccagtacaaatacccaacactttt

SEQ ID NO: 94036 - DNA, 27 bp, Artificial sequence
  SiRNA target sequence
ttccagtacaaatacccaacacttttt

SEQ ID NO: 94037 - DNA, 27 bp, Artificial sequence
  SiRNA target sequence
tccagtacaaatacccaacactttttt

SEQ ID NO: 94038 - DNA, 27 bp, Artificial sequence
  SiRNA target sequence
ccagtacaaatacccaacactttttta

SEQ ID NO: 94039 - DNA, 27 bp, Artificial sequence
  SiRNA target sequence
cagtacaaatacccaacacttttttac

SEQ ID NO: 94040 - DNA, 27 bp, Artificial sequence
  SiRNA target sequence
agtacaaatacccaacacttttttaca

SEQ ID NO: 94041 - DNA, 27 bp, Artificial sequence
  SiRNA target sequence
gtacaaatacccaacacttttttacaa

SEQ ID NO: 94042 - DNA, 27 bp, Artificial sequence
  SiRNA target sequence
tacaaatacccaacacttttttacaaa

SEQ ID NO: 94043 - DNA, 27 bp, Artificial sequence
  SiRNA target sequence
acaaatacccaacacttttttacaaaa

SEQ ID NO: 94044 - DNA, 27 bp, Artificial sequence
  SiRNA target sequence
caaatacccaacacttttttacaaaaa

SEQ ID NO: 94045 - DNA, 27 bp, Artificial sequence
  SiRNA target sequence
aaatacccaacacttttttacaaaaat

SEQ ID NO: 94046 - DNA, 27 bp, Artificial sequence
  SiRNA target sequence
aatacccaacacttttttacaaaaatt

SEQ ID NO: 94047 - DNA, 27 bp, Artificial sequence
  SiRNA target sequence
atacccaacacttttttacaaaaattt

SEQ ID NO: 94048 - DNA, 27 bp, Artificial sequence
  SiRNA target sequence
tacccaacacttttttacaaaaattta

SEQ ID NO: 94049 - DNA, 27 bp, Artificial sequence
  SiRNA target sequence
acccaacacttttttacaaaaatttaa

SEQ ID NO: 94050 - DNA, 27 bp, Artificial sequence
  SiRNA target sequence
cccaacacttttttacaaaaatttaat

SEQ ID NO: 94051 - DNA, 27 bp, Artificial sequence
  SiRNA target sequence
ccaacacttttttacaaaaatttaatc

SEQ ID NO: 94052 - DNA, 27 bp, Artificial sequence
  SiRNA target sequence
caacacttttttacaaaaatttaatct

SEQ ID NO: 94053 - DNA, 27 bp, Artificial sequence
  SiRNA target sequence
aacacttttttacaaaaatttaatcta

SEQ ID NO: 94054 - DNA, 27 bp, Artificial sequence
  SiRNA target sequence
acacttttttacaaaaatttaatctaa

SEQ ID NO: 94055 - DNA, 27 bp, Artificial sequence
  SiRNA target sequence
cacttttttacaaaaatttaatctaaa

SEQ ID NO: 94056 - DNA, 27 bp, Artificial sequence
  SiRNA target sequence
acttttttacaaaaatttaatctaaat

SEQ ID NO: 94057 - DNA, 27 bp, Artificial sequence
  SiRNA target sequence
cttttttacaaaaatttaatctaaata

SEQ ID NO: 94058 - DNA, 27 bp, Artificial sequence
  SiRNA target sequence
ttttttacaaaaatttaatctaaataa

SEQ ID NO: 94059 - DNA, 27 bp, Artificial sequence
  SiRNA target sequence
tttttacaaaaatttaatctaaataat

SEQ ID NO: 94060 - DNA, 27 bp, Artificial sequence
  SiRNA target sequence
ttttacaaaaatttaatctaaataatt

SEQ ID NO: 94061 - DNA, 27 bp, Artificial sequence
  SiRNA target sequence
tttacaaaaatttaatctaaataattt

SEQ ID NO: 94062 - DNA, 27 bp, Artificial sequence
  SiRNA target sequence
ttacaaaaatttaatctaaataattta

SEQ ID NO: 94063 - DNA, 27 bp, Artificial sequence
  SiRNA target sequence
tacaaaaatttaatctaaataatttac

SEQ ID NO: 94064 - DNA, 27 bp, Artificial sequence
  SiRNA target sequence
acaaaaatttaatctaaataatttact

SEQ ID NO: 94065 - DNA, 27 bp, Artificial sequence
  SiRNA target sequence
caaaaatttaatctaaataatttactc

SEQ ID NO: 94066 - DNA, 27 bp, Artificial sequence
  SiRNA target sequence
aaaaatttaatctaaataatttactcg

SEQ ID NO: 94067 - DNA, 27 bp, Artificial sequence
  SiRNA target sequence
aaaatttaatctaaataatttactcgg

SEQ ID NO: 94068 - DNA, 27 bp, Artificial sequence
  SiRNA target sequence
aaatttaatctaaataatttactcggt

SEQ ID NO: 94069 - DNA, 27 bp, Artificial sequence
  SiRNA target sequence
aatttaatctaaataatttactcggtc

SEQ ID NO: 94070 - DNA, 27 bp, Artificial sequence
  SiRNA target sequence
atttaatctaaataatttactcggtct

SEQ ID NO: 94071 - DNA, 27 bp, Artificial sequence
  SiRNA target sequence
tttaatctaaataatttactcggtctg

SEQ ID NO: 94072 - DNA, 27 bp, Artificial sequence
  SiRNA target sequence
ttaatctaaataatttactcggtctgt

SEQ ID NO: 94073 - DNA, 27 bp, Artificial sequence
  SiRNA target sequence
taatctaaataatttactcggtctgtg

SEQ ID NO: 94074 - DNA, 27 bp, Artificial sequence
  SiRNA target sequence
aatctaaataatttactcggtctgtga

SEQ ID NO: 94075 - DNA, 27 bp, Artificial sequence
  SiRNA target sequence
atctaaataatttactcggtctgtgac

SEQ ID NO: 94076 - DNA, 27 bp, Artificial sequence
  SiRNA target sequence
tctaaataatttactcggtctgtgaca

SEQ ID NO: 94077 - DNA, 27 bp, Artificial sequence
  SiRNA target sequence
ctaaataatttactcggtctgtgacag

SEQ ID NO: 94078 - DNA, 27 bp, Artificial sequence
  SiRNA target sequence
taaataatttactcggtctgtgacaga

SEQ ID NO: 94079 - DNA, 27 bp, Artificial sequence
  SiRNA target sequence
aaataatttactcggtctgtgacagat

SEQ ID NO: 94080 - DNA, 27 bp, Artificial sequence
  SiRNA target sequence
aataatttactcggtctgtgacagatc

SEQ ID NO: 94081 - DNA, 27 bp, Artificial sequence
  SiRNA target sequence
ataatttactcggtctgtgacagatct

SEQ ID NO: 94082 - DNA, 27 bp, Artificial sequence
  SiRNA target sequence
taatttactcggtctgtgacagatctt

SEQ ID NO: 94083 - DNA, 27 bp, Artificial sequence
  SiRNA target sequence
aatttactcggtctgtgacagatcttt

SEQ ID NO: 94084 - DNA, 27 bp, Artificial sequence
  SiRNA target sequence
atttactcggtctgtgacagatcttta

SEQ ID NO: 94085 - DNA, 27 bp, Artificial sequence
  SiRNA target sequence
tttactcggtctgtgacagatctttaa

SEQ ID NO: 94086 - DNA, 27 bp, Artificial sequence
  SiRNA target sequence
ttactcggtctgtgacagatctttaaa

SEQ ID NO: 94087 - DNA, 27 bp, Artificial sequence
  SiRNA target sequence
tactcggtctgtgacagatctttaaat

SEQ ID NO: 94088 - DNA, 27 bp, Artificial sequence
  SiRNA target sequence
actcggtctgtgacagatctttaaatt

SEQ ID NO: 94089 - DNA, 27 bp, Artificial sequence
  SiRNA target sequence
ctcggtctgtgacagatctttaaatta

SEQ ID NO: 94090 - DNA, 27 bp, Artificial sequence
  SiRNA target sequence
tcggtctgtgacagatctttaaattat

SEQ ID NO: 94091 - DNA, 27 bp, Artificial sequence
  SiRNA target sequence
cggtctgtgacagatctttaaattatt

SEQ ID NO: 94092 - DNA, 27 bp, Artificial sequence
  SiRNA target sequence
ggtctgtgacagatctttaaattatta

SEQ ID NO: 94093 - DNA, 27 bp, Artificial sequence
  SiRNA target sequence
gtctgtgacagatctttaaattattat

SEQ ID NO: 94094 - DNA, 27 bp, Artificial sequence
  SiRNA target sequence
tctgtgacagatctttaaattattata

SEQ ID NO: 94095 - DNA, 27 bp, Artificial sequence
  SiRNA target sequence
ctgtgacagatctttaaattattataa

SEQ ID NO: 94096 - DNA, 27 bp, Artificial sequence
  SiRNA target sequence
tgtgacagatctttaaattattataat

SEQ ID NO: 94097 - DNA, 27 bp, Artificial sequence
  SiRNA target sequence
gtgacagatctttaaattattataatt

SEQ ID NO: 94098 - DNA, 27 bp, Artificial sequence
  SiRNA target sequence
tgacagatctttaaattattataattt

SEQ ID NO: 94099 - DNA, 27 bp, Artificial sequence
  SiRNA target sequence
gacagatctttaaattattataatttt

SEQ ID NO: 94100 - DNA, 27 bp, Artificial sequence
  SiRNA target sequence
acagatctttaaattattataattttg

SEQ ID NO: 94101 - DNA, 27 bp, Artificial sequence
  SiRNA target sequence
cagatctttaaattattataattttgc

SEQ ID NO: 94102 - DNA, 27 bp, Artificial sequence
  SiRNA target sequence
agatctttaaattattataattttgca

SEQ ID NO: 94103 - DNA, 27 bp, Artificial sequence
  SiRNA target sequence
gatctttaaattattataattttgcat

SEQ ID NO: 94104 - DNA, 27 bp, Artificial sequence
  SiRNA target sequence
atctttaaattattataattttgcata

SEQ ID NO: 94105 - DNA, 27 bp, Artificial sequence
  SiRNA target sequence
tctttaaattattataattttgcatat

SEQ ID NO: 94106 - DNA, 27 bp, Artificial sequence
  SiRNA target sequence
ctttaaattattataattttgcatatc

SEQ ID NO: 94107 - DNA, 27 bp, Artificial sequence
  SiRNA target sequence
tttaaattattataattttgcatatct

SEQ ID NO: 94108 - DNA, 27 bp, Artificial sequence
  SiRNA target sequence
ttaaattattataattttgcatatcta

SEQ ID NO: 94109 - DNA, 27 bp, Artificial sequence
  SiRNA target sequence
taaattattataattttgcatatctat

SEQ ID NO: 94110 - DNA, 27 bp, Artificial sequence
  SiRNA target sequence
aaattattataattttgcatatctatg

SEQ ID NO: 94111 - DNA, 27 bp, Artificial sequence
  SiRNA target sequence
aattattataattttgcatatctatga

SEQ ID NO: 94112 - DNA, 27 bp, Artificial sequence
  SiRNA target sequence
attattataattttgcatatctatgaa

SEQ ID NO: 94113 - DNA, 27 bp, Artificial sequence
  SiRNA target sequence
ttattataattttgcatatctatgaaa

SEQ ID NO: 94114 - DNA, 27 bp, Artificial sequence
  SiRNA target sequence
tattataattttgcatatctatgaaat

SEQ ID NO: 94115 - DNA, 27 bp, Artificial sequence
  SiRNA target sequence
attataattttgcatatctatgaaatt

SEQ ID NO: 94116 - DNA, 27 bp, Artificial sequence
  SiRNA target sequence
ttataattttgcatatctatgaaattg

SEQ ID NO: 94117 - DNA, 27 bp, Artificial sequence
  SiRNA target sequence
tataattttgcatatctatgaaattgg

SEQ ID NO: 94118 - DNA, 27 bp, Artificial sequence
  SiRNA target sequence
ataattttgcatatctatgaaattgga

SEQ ID NO: 94119 - DNA, 27 bp, Artificial sequence
  SiRNA target sequence
taattttgcatatctatgaaattggaa

SEQ ID NO: 94120 - DNA, 27 bp, Artificial sequence
  SiRNA target sequence
aattttgcatatctatgaaattggaaa

SEQ ID NO: 94121 - DNA, 27 bp, Artificial sequence
  SiRNA target sequence
attttgcatatctatgaaattggaaac

SEQ ID NO: 94122 - DNA, 27 bp, Artificial sequence
  SiRNA target sequence
ttttgcatatctatgaaattggaaaca

SEQ ID NO: 94123 - DNA, 27 bp, Artificial sequence
  SiRNA target sequence
tttgcatatctatgaaattggaaacat

SEQ ID NO: 94124 - DNA, 27 bp, Artificial sequence
  SiRNA target sequence
ttgcatatctatgaaattggaaacatg

SEQ ID NO: 94125 - DNA, 27 bp, Artificial sequence
  SiRNA target sequence
tgcatatctatgaaattggaaacatgt

SEQ ID NO: 94126 - DNA, 27 bp, Artificial sequence
  SiRNA target sequence
gcatatctatgaaattggaaacatgtc

SEQ ID NO: 94127 - DNA, 27 bp, Artificial sequence
  SiRNA target sequence
catatctatgaaattggaaacatgtcc

SEQ ID NO: 94128 - DNA, 27 bp, Artificial sequence
  SiRNA target sequence
atatctatgaaattggaaacatgtcca

SEQ ID NO: 94129 - DNA, 27 bp, Artificial sequence
  SiRNA target sequence
tatctatgaaattggaaacatgtccat

SEQ ID NO: 94130 - DNA, 27 bp, Artificial sequence
  SiRNA target sequence
atctatgaaattggaaacatgtccata

SEQ ID NO: 94131 - DNA, 27 bp, Artificial sequence
  SiRNA target sequence
tctatgaaattggaaacatgtccatat

SEQ ID NO: 94132 - DNA, 27 bp, Artificial sequence
  SiRNA target sequence
ctatgaaattggaaacatgtccatatc

SEQ ID NO: 94133 - DNA, 27 bp, Artificial sequence
  SiRNA target sequence
tatgaaattggaaacatgtccatatct

SEQ ID NO: 94134 - DNA, 27 bp, Artificial sequence
  SiRNA target sequence
atgaaattggaaacatgtccatatcta

SEQ ID NO: 94135 - DNA, 27 bp, Artificial sequence
  SiRNA target sequence
tgaaattggaaacatgtccatatctat

SEQ ID NO: 94136 - DNA, 27 bp, Artificial sequence
  SiRNA target sequence
gaaattggaaacatgtccatatctatc

SEQ ID NO: 94137 - DNA, 27 bp, Artificial sequence
  SiRNA target sequence
aaattggaaacatgtccatatctatcg

SEQ ID NO: 94138 - DNA, 27 bp, Artificial sequence
  SiRNA target sequence
aattggaaacatgtccatatctatcgc

SEQ ID NO: 94139 - DNA, 27 bp, Artificial sequence
  SiRNA target sequence
attggaaacatgtccatatctatcgcc

SEQ ID NO: 94140 - DNA, 27 bp, Artificial sequence
  SiRNA target sequence
ttggaaacatgtccatatctatcgcct

SEQ ID NO: 94141 - DNA, 27 bp, Artificial sequence
  SiRNA target sequence
tggaaacatgtccatatctatcgcctt

SEQ ID NO: 94142 - DNA, 27 bp, Artificial sequence
  SiRNA target sequence
ggaaacatgtccatatctatcgccttt

SEQ ID NO: 94143 - DNA, 27 bp, Artificial sequence
  SiRNA target sequence
gaaacatgtccatatctatcgcctttt

SEQ ID NO: 94144 - DNA, 27 bp, Artificial sequence
  SiRNA target sequence
aaacatgtccatatctatcgccttttt

SEQ ID NO: 94145 - DNA, 27 bp, Artificial sequence
  SiRNA target sequence
aacatgtccatatctatcgcctttttt

SEQ ID NO: 94146 - DNA, 27 bp, Artificial sequence
  SiRNA target sequence
acatgtccatatctatcgcctttttta

SEQ ID NO: 94147 - DNA, 27 bp, Artificial sequence
  SiRNA target sequence
catgtccatatctatcgccttttttaa

SEQ ID NO: 94148 - DNA, 27 bp, Artificial sequence
  SiRNA target sequence
atgtccatatctatcgccttttttaat

SEQ ID NO: 94149 - DNA, 27 bp, Artificial sequence
  SiRNA target sequence
tgtccatatctatcgccttttttaata

SEQ ID NO: 94150 - DNA, 27 bp, Artificial sequence
  SiRNA target sequence
gtccatatctatcgccttttttaataa

SEQ ID NO: 94151 - DNA, 27 bp, Artificial sequence
  SiRNA target sequence
tccatatctatcgccttttttaataat

SEQ ID NO: 94152 - DNA, 27 bp, Artificial sequence
  SiRNA target sequence
ccatatctatcgccttttttaataatt

SEQ ID NO: 94153 - DNA, 27 bp, Artificial sequence
  SiRNA target sequence
catatctatcgccttttttaataattg

SEQ ID NO: 94154 - DNA, 27 bp, Artificial sequence
  SiRNA target sequence
atatctatcgccttttttaataattgc

SEQ ID NO: 94155 - DNA, 27 bp, Artificial sequence
  SiRNA target sequence
tatctatcgccttttttaataattgct

SEQ ID NO: 94156 - DNA, 27 bp, Artificial sequence
  SiRNA target sequence
atctatcgccttttttaataattgcta

SEQ ID NO: 94157 - DNA, 27 bp, Artificial sequence
  SiRNA target sequence
tctatcgccttttttaataattgctac

SEQ ID NO: 94158 - DNA, 27 bp, Artificial sequence
  SiRNA target sequence
ctatcgccttttttaataattgctact

SEQ ID NO: 94159 - DNA, 27 bp, Artificial sequence
  SiRNA target sequence
tatcgccttttttaataattgctacta

SEQ ID NO: 94160 - DNA, 27 bp, Artificial sequence
  SiRNA target sequence
atcgccttttttaataattgctactaa

SEQ ID NO: 94161 - DNA, 27 bp, Artificial sequence
  SiRNA target sequence
tcgccttttttaataattgctactaaa

SEQ ID NO: 94162 - DNA, 27 bp, Artificial sequence
  SiRNA target sequence
cgccttttttaataattgctactaaaa

SEQ ID NO: 94163 - DNA, 27 bp, Artificial sequence
  SiRNA target sequence
gccttttttaataattgctactaaaat

SEQ ID NO: 94164 - DNA, 27 bp, Artificial sequence
  SiRNA target sequence
ccttttttaataattgctactaaaatt

SEQ ID NO: 94165 - DNA, 27 bp, Artificial sequence
  SiRNA target sequence
cttttttaataattgctactaaaattt

SEQ ID NO: 94166 - DNA, 27 bp, Artificial sequence
  SiRNA target sequence
ttttttaataattgctactaaaatttc

SEQ ID NO: 94167 - DNA, 27 bp, Artificial sequence
  SiRNA target sequence
tttttaataattgctactaaaatttca

SEQ ID NO: 94168 - DNA, 27 bp, Artificial sequence
  SiRNA target sequence
ttttaataattgctactaaaatttcac

SEQ ID NO: 94169 - DNA, 27 bp, Artificial sequence
  SiRNA target sequence
tttaataattgctactaaaatttcaca

SEQ ID NO: 94170 - DNA, 27 bp, Artificial sequence
  SiRNA target sequence
ttaataattgctactaaaatttcacat

SEQ ID NO: 94171 - DNA, 27 bp, Artificial sequence
  SiRNA target sequence
taataattgctactaaaatttcacatt

SEQ ID NO: 94172 - DNA, 27 bp, Artificial sequence
  SiRNA target sequence
aataattgctactaaaatttcacattt

SEQ ID NO: 94173 - DNA, 27 bp, Artificial sequence
  SiRNA target sequence
ataattgctactaaaatttcacatttt

SEQ ID NO: 94174 - DNA, 27 bp, Artificial sequence
  SiRNA target sequence
taattgctactaaaatttcacattttt

SEQ ID NO: 94175 - DNA, 27 bp, Artificial sequence
  SiRNA target sequence
aattgctactaaaatttcacatttttc

SEQ ID NO: 94176 - DNA, 27 bp, Artificial sequence
  SiRNA target sequence
attgctactaaaatttcacatttttca

SEQ ID NO: 94177 - DNA, 27 bp, Artificial sequence
  SiRNA target sequence
ttgctactaaaatttcacatttttcat

SEQ ID NO: 94178 - DNA, 27 bp, Artificial sequence
  SiRNA target sequence
tgctactaaaatttcacatttttcatt

SEQ ID NO: 94179 - DNA, 27 bp, Artificial sequence
  SiRNA target sequence
gctactaaaatttcacatttttcattt

SEQ ID NO: 94180 - DNA, 27 bp, Artificial sequence
  SiRNA target sequence
ctactaaaatttcacatttttcattta

SEQ ID NO: 94181 - DNA, 27 bp, Artificial sequence
  SiRNA target sequence
tactaaaatttcacatttttcatttac

SEQ ID NO: 94182 - DNA, 27 bp, Artificial sequence
  SiRNA target sequence
actaaaatttcacatttttcatttacg

SEQ ID NO: 94183 - DNA, 27 bp, Artificial sequence
  SiRNA target sequence
ctaaaatttcacatttttcatttacgt

SEQ ID NO: 94184 - DNA, 27 bp, Artificial sequence
  SiRNA target sequence
taaaatttcacatttttcatttacgtg

SEQ ID NO: 94185 - DNA, 27 bp, Artificial sequence
  SiRNA target sequence
aaaatttcacatttttcatttacgtgg

SEQ ID NO: 94186 - DNA, 27 bp, Artificial sequence
  SiRNA target sequence
aaatttcacatttttcatttacgtggt

SEQ ID NO: 94187 - DNA, 27 bp, Artificial sequence
  SiRNA target sequence
aatttcacatttttcatttacgtggtt

SEQ ID NO: 94188 - DNA, 27 bp, Artificial sequence
  SiRNA target sequence
atttcacatttttcatttacgtggtta

SEQ ID NO: 94189 - DNA, 27 bp, Artificial sequence
  SiRNA target sequence
tttcacatttttcatttacgtggttag

SEQ ID NO: 94190 - DNA, 27 bp, Artificial sequence
  SiRNA target sequence
ttcacatttttcatttacgtggttagt

SEQ ID NO: 94191 - DNA, 27 bp, Artificial sequence
  SiRNA target sequence
tcacatttttcatttacgtggttagta

SEQ ID NO: 94192 - DNA, 27 bp, Artificial sequence
  SiRNA target sequence
cacatttttcatttacgtggttagtaa

SEQ ID NO: 94193 - DNA, 27 bp, Artificial sequence
  SiRNA target sequence
acatttttcatttacgtggttagtaag

SEQ ID NO: 94194 - DNA, 27 bp, Artificial sequence
  SiRNA target sequence
catttttcatttacgtggttagtaagt

SEQ ID NO: 94195 - DNA, 27 bp, Artificial sequence
  SiRNA target sequence
atttttcatttacgtggttagtaagtg

SEQ ID NO: 94196 - DNA, 27 bp, Artificial sequence
  SiRNA target sequence
tttttcatttacgtggttagtaagtga

SEQ ID NO: 94197 - DNA, 27 bp, Artificial sequence
  SiRNA target sequence
ttttcatttacgtggttagtaagtgaa

SEQ ID NO: 94198 - DNA, 27 bp, Artificial sequence
  SiRNA target sequence
tttcatttacgtggttagtaagtgaat

SEQ ID NO: 94199 - DNA, 27 bp, Artificial sequence
  SiRNA target sequence
ttcatttacgtggttagtaagtgaata

SEQ ID NO: 94200 - DNA, 27 bp, Artificial sequence
  SiRNA target sequence
tcatttacgtggttagtaagtgaataa

SEQ ID NO: 94201 - DNA, 27 bp, Artificial sequence
  SiRNA target sequence
catttacgtggttagtaagtgaataat

SEQ ID NO: 94202 - DNA, 27 bp, Artificial sequence
  SiRNA target sequence
atttacgtggttagtaagtgaataata

SEQ ID NO: 94203 - DNA, 27 bp, Artificial sequence
  SiRNA target sequence
tttacgtggttagtaagtgaataatat

SEQ ID NO: 94204 - DNA, 27 bp, Artificial sequence
  SiRNA target sequence
ttacgtggttagtaagtgaataatatc

SEQ ID NO: 94205 - DNA, 27 bp, Artificial sequence
  SiRNA target sequence
tacgtggttagtaagtgaataatatct

SEQ ID NO: 94206 - DNA, 27 bp, Artificial sequence
  SiRNA target sequence
acgtggttagtaagtgaataatatctt

SEQ ID NO: 94207 - DNA, 27 bp, Artificial sequence
  SiRNA target sequence
cgtggttagtaagtgaataatatcttg

SEQ ID NO: 94208 - DNA, 27 bp, Artificial sequence
  SiRNA target sequence
gtggttagtaagtgaataatatcttgg

SEQ ID NO: 94209 - DNA, 27 bp, Artificial sequence
  SiRNA target sequence
tggttagtaagtgaataatatcttggc

SEQ ID NO: 94210 - DNA, 27 bp, Artificial sequence
  SiRNA target sequence
ggttagtaagtgaataatatcttggct

SEQ ID NO: 94211 - DNA, 27 bp, Artificial sequence
  SiRNA target sequence
gttagtaagtgaataatatcttggctt

SEQ ID NO: 94212 - DNA, 27 bp, Artificial sequence
  SiRNA target sequence
ttagtaagtgaataatatcttggctta

SEQ ID NO: 94213 - DNA, 27 bp, Artificial sequence
  SiRNA target sequence
tagtaagtgaataatatcttggcttaa

SEQ ID NO: 94214 - DNA, 27 bp, Artificial sequence
  SiRNA target sequence
agtaagtgaataatatcttggcttaat

SEQ ID NO: 94215 - DNA, 27 bp, Artificial sequence
  SiRNA target sequence
gtaagtgaataatatcttggcttaatt

SEQ ID NO: 94216 - DNA, 27 bp, Artificial sequence
  SiRNA target sequence
taagtgaataatatcttggcttaattg

SEQ ID NO: 94217 - DNA, 27 bp, Artificial sequence
  SiRNA target sequence
aagtgaataatatcttggcttaattgt

SEQ ID NO: 94218 - DNA, 27 bp, Artificial sequence
  SiRNA target sequence
agtgaataatatcttggcttaattgtt

SEQ ID NO: 94219 - DNA, 27 bp, Artificial sequence
  SiRNA target sequence
gtgaataatatcttggcttaattgttt

SEQ ID NO: 94220 - DNA, 27 bp, Artificial sequence
  SiRNA target sequence
tgaataatatcttggcttaattgtttg

SEQ ID NO: 94221 - DNA, 27 bp, Artificial sequence
  SiRNA target sequence
gaataatatcttggcttaattgtttga

SEQ ID NO: 94222 - DNA, 27 bp, Artificial sequence
  SiRNA target sequence
aataatatcttggcttaattgtttgac

SEQ ID NO: 94223 - DNA, 27 bp, Artificial sequence
  SiRNA target sequence
ataatatcttggcttaattgtttgaca

SEQ ID NO: 94224 - DNA, 27 bp, Artificial sequence
  SiRNA target sequence
taatatcttggcttaattgtttgacaa

SEQ ID NO: 94225 - DNA, 27 bp, Artificial sequence
  SiRNA target sequence
aatatcttggcttaattgtttgacaat

SEQ ID NO: 94226 - DNA, 27 bp, Artificial sequence
  SiRNA target sequence
atatcttggcttaattgtttgacaatt

SEQ ID NO: 94227 - DNA, 27 bp, Artificial sequence
  SiRNA target sequence
tatcttggcttaattgtttgacaattc

SEQ ID NO: 94228 - DNA, 27 bp, Artificial sequence
  SiRNA target sequence
atcttggcttaattgtttgacaattca

SEQ ID NO: 94229 - DNA, 27 bp, Artificial sequence
  SiRNA target sequence
tcttggcttaattgtttgacaattcat

SEQ ID NO: 94230 - DNA, 27 bp, Artificial sequence
  SiRNA target sequence
cttggcttaattgtttgacaattcata

SEQ ID NO: 94231 - DNA, 27 bp, Artificial sequence
  SiRNA target sequence
ttggcttaattgtttgacaattcataa

SEQ ID NO: 94232 - DNA, 27 bp, Artificial sequence
  SiRNA target sequence
tggcttaattgtttgacaattcataat

SEQ ID NO: 94233 - DNA, 27 bp, Artificial sequence
  SiRNA target sequence
ggcttaattgtttgacaattcataata

SEQ ID NO: 94234 - DNA, 27 bp, Artificial sequence
  SiRNA target sequence
gcttaattgtttgacaattcataataa

SEQ ID NO: 94235 - DNA, 27 bp, Artificial sequence
  SiRNA target sequence
cttaattgtttgacaattcataataag

SEQ ID NO: 94236 - DNA, 27 bp, Artificial sequence
  SiRNA target sequence
ttaattgtttgacaattcataataaga

SEQ ID NO: 94237 - DNA, 27 bp, Artificial sequence
  SiRNA target sequence
taattgtttgacaattcataataagat

SEQ ID NO: 94238 - DNA, 27 bp, Artificial sequence
  SiRNA target sequence
aattgtttgacaattcataataagatc

SEQ ID NO: 94239 - DNA, 27 bp, Artificial sequence
  SiRNA target sequence
attgtttgacaattcataataagatcc

SEQ ID NO: 94240 - DNA, 27 bp, Artificial sequence
  SiRNA target sequence
ttgtttgacaattcataataagatcct

SEQ ID NO: 94241 - DNA, 27 bp, Artificial sequence
  SiRNA target sequence
tgtttgacaattcataataagatcctc

SEQ ID NO: 94242 - DNA, 27 bp, Artificial sequence
  SiRNA target sequence
gtttgacaattcataataagatcctct

SEQ ID NO: 94243 - DNA, 27 bp, Artificial sequence
  SiRNA target sequence
tttgacaattcataataagatcctcta

SEQ ID NO: 94244 - DNA, 27 bp, Artificial sequence
  SiRNA target sequence
ttgacaattcataataagatcctctaa

SEQ ID NO: 94245 - DNA, 27 bp, Artificial sequence
  SiRNA target sequence
tgacaattcataataagatcctctaaa

SEQ ID NO: 94246 - DNA, 27 bp, Artificial sequence
  SiRNA target sequence
gacaattcataataagatcctctaaac

SEQ ID NO: 94247 - DNA, 27 bp, Artificial sequence
  SiRNA target sequence
acaattcataataagatcctctaaact

SEQ ID NO: 94248 - DNA, 27 bp, Artificial sequence
  SiRNA target sequence
caattcataataagatcctctaaactt

SEQ ID NO: 94249 - DNA, 27 bp, Artificial sequence
  SiRNA target sequence
aattcataataagatcctctaaacttg

SEQ ID NO: 94250 - DNA, 27 bp, Artificial sequence
  SiRNA target sequence
attcataataagatcctctaaacttgg

SEQ ID NO: 94251 - DNA, 27 bp, Artificial sequence
  SiRNA target sequence
ttcataataagatcctctaaacttggt

SEQ ID NO: 94252 - DNA, 27 bp, Artificial sequence
  SiRNA target sequence
tcataataagatcctctaaacttggtt

SEQ ID NO: 94253 - DNA, 27 bp, Artificial sequence
  SiRNA target sequence
cataataagatcctctaaacttggttt

SEQ ID NO: 94254 - DNA, 27 bp, Artificial sequence
  SiRNA target sequence
ataataagatcctctaaacttggttta

SEQ ID NO: 94255 - DNA, 27 bp, Artificial sequence
  SiRNA target sequence
taataagatcctctaaacttggtttac

SEQ ID NO: 94256 - DNA, 27 bp, Artificial sequence
  SiRNA target sequence
aataagatcctctaaacttggtttaca

SEQ ID NO: 94257 - DNA, 27 bp, Artificial sequence
  SiRNA target sequence
ataagatcctctaaacttggtttacat

SEQ ID NO: 94258 - DNA, 27 bp, Artificial sequence
  SiRNA target sequence
taagatcctctaaacttggtttacatt

SEQ ID NO: 94259 - DNA, 27 bp, Artificial sequence
  SiRNA target sequence
aagatcctctaaacttggtttacattg

SEQ ID NO: 94260 - DNA, 27 bp, Artificial sequence
  SiRNA target sequence
agatcctctaaacttggtttacattga

SEQ ID NO: 94261 - DNA, 27 bp, Artificial sequence
  SiRNA target sequence
gatcctctaaacttggtttacattgaa

SEQ ID NO: 94262 - DNA, 27 bp, Artificial sequence
  SiRNA target sequence
atcctctaaacttggtttacattgaaa

SEQ ID NO: 94263 - DNA, 27 bp, Artificial sequence
  SiRNA target sequence
tcctctaaacttggtttacattgaaat

SEQ ID NO: 94264 - DNA, 27 bp, Artificial sequence
  SiRNA target sequence
cctctaaacttggtttacattgaaatg

SEQ ID NO: 94265 - DNA, 27 bp, Artificial sequence
  SiRNA target sequence
ctctaaacttggtttacattgaaatgt

SEQ ID NO: 94266 - DNA, 27 bp, Artificial sequence
  SiRNA target sequence
tctaaacttggtttacattgaaatgta

SEQ ID NO: 94267 - DNA, 27 bp, Artificial sequence
  SiRNA target sequence
ctaaacttggtttacattgaaatgtat

SEQ ID NO: 94268 - DNA, 27 bp, Artificial sequence
  SiRNA target sequence
taaacttggtttacattgaaatgtata

SEQ ID NO: 94269 - DNA, 27 bp, Artificial sequence
  SiRNA target sequence
aaacttggtttacattgaaatgtatat

SEQ ID NO: 94270 - DNA, 27 bp, Artificial sequence
  SiRNA target sequence
aacttggtttacattgaaatgtatata

SEQ ID NO: 94271 - DNA, 27 bp, Artificial sequence
  SiRNA target sequence
acttggtttacattgaaatgtatatat

SEQ ID NO: 94272 - DNA, 27 bp, Artificial sequence
  SiRNA target sequence
cttggtttacattgaaatgtatatata

SEQ ID NO: 94273 - DNA, 27 bp, Artificial sequence
  SiRNA target sequence
ttggtttacattgaaatgtatatataa

SEQ ID NO: 94274 - DNA, 27 bp, Artificial sequence
  SiRNA target sequence
tggtttacattgaaatgtatatataat

SEQ ID NO: 94275 - DNA, 27 bp, Artificial sequence
  SiRNA target sequence
ggtttacattgaaatgtatatataatg

SEQ ID NO: 94276 - DNA, 27 bp, Artificial sequence
  SiRNA target sequence
gtttacattgaaatgtatatataatgt

SEQ ID NO: 94277 - DNA, 27 bp, Artificial sequence
  SiRNA target sequence
tttacattgaaatgtatatataatgtc

SEQ ID NO: 94278 - DNA, 27 bp, Artificial sequence
  SiRNA target sequence
ttacattgaaatgtatatataatgtca

SEQ ID NO: 94279 - DNA, 27 bp, Artificial sequence
  SiRNA target sequence
tacattgaaatgtatatataatgtcaa

SEQ ID NO: 94280 - DNA, 27 bp, Artificial sequence
  SiRNA target sequence
acattgaaatgtatatataatgtcaag

SEQ ID NO: 94281 - DNA, 27 bp, Artificial sequence
  SiRNA target sequence
cattgaaatgtatatataatgtcaagc

SEQ ID NO: 94282 - DNA, 27 bp, Artificial sequence
  SiRNA target sequence
attgaaatgtatatataatgtcaagca

SEQ ID NO: 94283 - DNA, 27 bp, Artificial sequence
  SiRNA target sequence
ttgaaatgtatatataatgtcaagcac

SEQ ID NO: 94284 - DNA, 27 bp, Artificial sequence
  SiRNA target sequence
tgaaatgtatatataatgtcaagcaca

SEQ ID NO: 94285 - DNA, 27 bp, Artificial sequence
  SiRNA target sequence
gaaatgtatatataatgtcaagcacat

SEQ ID NO: 94286 - DNA, 27 bp, Artificial sequence
  SiRNA target sequence
aaatgtatatataatgtcaagcacatt

SEQ ID NO: 94287 - DNA, 27 bp, Artificial sequence
  SiRNA target sequence
aatgtatatataatgtcaagcacatta

SEQ ID NO: 94288 - DNA, 27 bp, Artificial sequence
  SiRNA target sequence
atgtatatataatgtcaagcacattat

SEQ ID NO: 94289 - DNA, 27 bp, Artificial sequence
  SiRNA target sequence
tgtatatataatgtcaagcacattatt

SEQ ID NO: 94290 - DNA, 27 bp, Artificial sequence
  SiRNA target sequence
gtatatataatgtcaagcacattattc

SEQ ID NO: 94291 - DNA, 27 bp, Artificial sequence
  SiRNA target sequence
tatatataatgtcaagcacattattcc

SEQ ID NO: 94292 - DNA, 27 bp, Artificial sequence
  SiRNA target sequence
atatataatgtcaagcacattattcca

SEQ ID NO: 94293 - DNA, 27 bp, Artificial sequence
  SiRNA target sequence
tatataatgtcaagcacattattccag

SEQ ID NO: 94294 - DNA, 27 bp, Artificial sequence
  SiRNA target sequence
atataatgtcaagcacattattccagt

SEQ ID NO: 94295 - DNA, 27 bp, Artificial sequence
  SiRNA target sequence
tataatgtcaagcacattattccagtt

SEQ ID NO: 94296 - DNA, 27 bp, Artificial sequence
  SiRNA target sequence
ataatgtcaagcacattattccagttc

SEQ ID NO: 94297 - DNA, 27 bp, Artificial sequence
  SiRNA target sequence
taatgtcaagcacattattccagttct

SEQ ID NO: 94298 - DNA, 27 bp, Artificial sequence
  SiRNA target sequence
aatgtcaagcacattattccagttctt

SEQ ID NO: 94299 - DNA, 27 bp, Artificial sequence
  SiRNA target sequence
atgtcaagcacattattccagttctta

SEQ ID NO: 94300 - DNA, 27 bp, Artificial sequence
  SiRNA target sequence
tgtcaagcacattattccagttcttaa

SEQ ID NO: 94301 - DNA, 27 bp, Artificial sequence
  SiRNA target sequence
gtcaagcacattattccagttcttaat

SEQ ID NO: 94302 - DNA, 27 bp, Artificial sequence
  SiRNA target sequence
tcaagcacattattccagttcttaatg

SEQ ID NO: 94303 - DNA, 27 bp, Artificial sequence
  SiRNA target sequence
caagcacattattccagttcttaatga

SEQ ID NO: 94304 - DNA, 27 bp, Artificial sequence
  SiRNA target sequence
aagcacattattccagttcttaatgat

SEQ ID NO: 94305 - DNA, 27 bp, Artificial sequence
  SiRNA target sequence
agcacattattccagttcttaatgatg

SEQ ID NO: 94306 - DNA, 27 bp, Artificial sequence
  SiRNA target sequence
gcacattattccagttcttaatgatgc

SEQ ID NO: 94307 - DNA, 27 bp, Artificial sequence
  SiRNA target sequence
cacattattccagttcttaatgatgct

SEQ ID NO: 94308 - DNA, 27 bp, Artificial sequence
  SiRNA target sequence
acattattccagttcttaatgatgctt

SEQ ID NO: 94309 - DNA, 27 bp, Artificial sequence
  SiRNA target sequence
cattattccagttcttaatgatgctta

SEQ ID NO: 94310 - DNA, 27 bp, Artificial sequence
  SiRNA target sequence
attattccagttcttaatgatgcttaa

SEQ ID NO: 94311 - DNA, 27 bp, Artificial sequence
  SiRNA target sequence
ttattccagttcttaatgatgcttaaa

SEQ ID NO: 94312 - DNA, 27 bp, Artificial sequence
  SiRNA target sequence
tattccagttcttaatgatgcttaaat

SEQ ID NO: 94313 - DNA, 27 bp, Artificial sequence
  SiRNA target sequence
attccagttcttaatgatgcttaaata

SEQ ID NO: 94314 - DNA, 27 bp, Artificial sequence
  SiRNA target sequence
ttccagttcttaatgatgcttaaataa

SEQ ID NO: 94315 - DNA, 27 bp, Artificial sequence
  SiRNA target sequence
tccagttcttaatgatgcttaaataat

SEQ ID NO: 94316 - DNA, 27 bp, Artificial sequence
  SiRNA target sequence
ccagttcttaatgatgcttaaataatc

SEQ ID NO: 94317 - DNA, 27 bp, Artificial sequence
  SiRNA target sequence
cagttcttaatgatgcttaaataatct

SEQ ID NO: 94318 - DNA, 27 bp, Artificial sequence
  SiRNA target sequence
agttcttaatgatgcttaaataatctt

SEQ ID NO: 94319 - DNA, 27 bp, Artificial sequence
  SiRNA target sequence
gttcttaatgatgcttaaataatcttt

SEQ ID NO: 94320 - DNA, 27 bp, Artificial sequence
  SiRNA target sequence
ttcttaatgatgcttaaataatctttt

SEQ ID NO: 94321 - DNA, 27 bp, Artificial sequence
  SiRNA target sequence
tcttaatgatgcttaaataatctttta

SEQ ID NO: 94322 - DNA, 27 bp, Artificial sequence
  SiRNA target sequence
cttaatgatgcttaaataatcttttac

SEQ ID NO: 94323 - DNA, 27 bp, Artificial sequence
  SiRNA target sequence
ttaatgatgcttaaataatcttttact

SEQ ID NO: 94324 - DNA, 27 bp, Artificial sequence
  SiRNA target sequence
taatgatgcttaaataatcttttactc

SEQ ID NO: 94325 - DNA, 27 bp, Artificial sequence
  SiRNA target sequence
aatgatgcttaaataatcttttactcc

SEQ ID NO: 94326 - DNA, 27 bp, Artificial sequence
  SiRNA target sequence
atgatgcttaaataatcttttactcct

SEQ ID NO: 94327 - DNA, 27 bp, Artificial sequence
  SiRNA target sequence
tgatgcttaaataatcttttactcctt

SEQ ID NO: 94328 - DNA, 27 bp, Artificial sequence
  SiRNA target sequence
gatgcttaaataatcttttactccttc

SEQ ID NO: 94329 - DNA, 27 bp, Artificial sequence
  SiRNA target sequence
atgcttaaataatcttttactccttct

SEQ ID NO: 94330 - DNA, 27 bp, Artificial sequence
  SiRNA target sequence
tgcttaaataatcttttactccttctt

SEQ ID NO: 94331 - DNA, 27 bp, Artificial sequence
  SiRNA target sequence
gcttaaataatcttttactccttcttt

SEQ ID NO: 94332 - DNA, 27 bp, Artificial sequence
  SiRNA target sequence
cttaaataatcttttactccttcttta

SEQ ID NO: 94333 - DNA, 27 bp, Artificial sequence
  SiRNA target sequence
ttaaataatcttttactccttctttag

SEQ ID NO: 94334 - DNA, 27 bp, Artificial sequence
  SiRNA target sequence
taaataatcttttactccttctttaga

SEQ ID NO: 94335 - DNA, 27 bp, Artificial sequence
  SiRNA target sequence
aaataatcttttactccttctttagaa

SEQ ID NO: 94336 - DNA, 27 bp, Artificial sequence
  SiRNA target sequence
aataatcttttactccttctttagaac

SEQ ID NO: 94337 - DNA, 27 bp, Artificial sequence
  SiRNA target sequence
ataatcttttactccttctttagaaca

SEQ ID NO: 94338 - DNA, 27 bp, Artificial sequence
  SiRNA target sequence
taatcttttactccttctttagaacac

SEQ ID NO: 94339 - DNA, 27 bp, Artificial sequence
  SiRNA target sequence
aatcttttactccttctttagaacaca

SEQ ID NO: 94340 - DNA, 27 bp, Artificial sequence
  SiRNA target sequence
atcttttactccttctttagaacacag

SEQ ID NO: 94341 - DNA, 27 bp, Artificial sequence
  SiRNA target sequence
tcttttactccttctttagaacacaga

SEQ ID NO: 94342 - DNA, 27 bp, Artificial sequence
  SiRNA target sequence
cttttactccttctttagaacacagat

SEQ ID NO: 94343 - DNA, 27 bp, Artificial sequence
  SiRNA target sequence
ttttactccttctttagaacacagata

SEQ ID NO: 94344 - DNA, 27 bp, Artificial sequence
  SiRNA target sequence
tttactccttctttagaacacagatat

SEQ ID NO: 94345 - DNA, 27 bp, Artificial sequence
  SiRNA target sequence
ttactccttctttagaacacagatatt

SEQ ID NO: 94346 - DNA, 27 bp, Artificial sequence
  SiRNA target sequence
tactccttctttagaacacagatattc

SEQ ID NO: 94347 - DNA, 27 bp, Artificial sequence
  SiRNA target sequence
actccttctttagaacacagatattca

SEQ ID NO: 94348 - DNA, 27 bp, Artificial sequence
  SiRNA target sequence
ctccttctttagaacacagatattcaa

SEQ ID NO: 94349 - DNA, 27 bp, Artificial sequence
  SiRNA target sequence
tccttctttagaacacagatattcaat

SEQ ID NO: 94350 - DNA, 27 bp, Artificial sequence
  SiRNA target sequence
ccttctttagaacacagatattcaata

SEQ ID NO: 94351 - DNA, 27 bp, Artificial sequence
  SiRNA target sequence
cttctttagaacacagatattcaatat

SEQ ID NO: 94352 - DNA, 27 bp, Artificial sequence
  SiRNA target sequence
ttctttagaacacagatattcaatatc

SEQ ID NO: 94353 - DNA, 27 bp, Artificial sequence
  SiRNA target sequence
tctttagaacacagatattcaatatca

SEQ ID NO: 94354 - DNA, 27 bp, Artificial sequence
  SiRNA target sequence
ctttagaacacagatattcaatatcat

SEQ ID NO: 94355 - DNA, 27 bp, Artificial sequence
  SiRNA target sequence
tttagaacacagatattcaatatcatg

SEQ ID NO: 94356 - DNA, 27 bp, Artificial sequence
  SiRNA target sequence
ttagaacacagatattcaatatcatgc

SEQ ID NO: 94357 - DNA, 27 bp, Artificial sequence
  SiRNA target sequence
tagaacacagatattcaatatcatgct

SEQ ID NO: 94358 - DNA, 27 bp, Artificial sequence
  SiRNA target sequence
agaacacagatattcaatatcatgctt

SEQ ID NO: 94359 - DNA, 27 bp, Artificial sequence
  SiRNA target sequence
gaacacagatattcaatatcatgctta

SEQ ID NO: 94360 - DNA, 27 bp, Artificial sequence
  SiRNA target sequence
aacacagatattcaatatcatgcttat

SEQ ID NO: 94361 - DNA, 27 bp, Artificial sequence
  SiRNA target sequence
acacagatattcaatatcatgcttatt

SEQ ID NO: 94362 - DNA, 27 bp, Artificial sequence
  SiRNA target sequence
cacagatattcaatatcatgcttattt

SEQ ID NO: 94363 - DNA, 27 bp, Artificial sequence
  SiRNA target sequence
acagatattcaatatcatgcttatttt

SEQ ID NO: 94364 - DNA, 27 bp, Artificial sequence
  SiRNA target sequence
cagatattcaatatcatgcttattttt

SEQ ID NO: 94365 - DNA, 27 bp, Artificial sequence
  SiRNA target sequence
agatattcaatatcatgcttattttta

SEQ ID NO: 94366 - DNA, 27 bp, Artificial sequence
  SiRNA target sequence
gatattcaatatcatgcttatttttag

SEQ ID NO: 94367 - DNA, 27 bp, Artificial sequence
  SiRNA target sequence
atattcaatatcatgcttatttttaga

SEQ ID NO: 94368 - DNA, 27 bp, Artificial sequence
  SiRNA target sequence
tattcaatatcatgcttatttttagag

SEQ ID NO: 94369 - DNA, 27 bp, Artificial sequence
  SiRNA target sequence
attcaatatcatgcttatttttagagg

SEQ ID NO: 94370 - DNA, 27 bp, Artificial sequence
  SiRNA target sequence
ttcaatatcatgcttatttttagaggt

SEQ ID NO: 94371 - DNA, 27 bp, Artificial sequence
  SiRNA target sequence
tcaatatcatgcttatttttagaggtt

SEQ ID NO: 94372 - DNA, 27 bp, Artificial sequence
  SiRNA target sequence
caatatcatgcttatttttagaggttt

SEQ ID NO: 94373 - DNA, 27 bp, Artificial sequence
  SiRNA target sequence
aatatcatgcttatttttagaggtttt

SEQ ID NO: 94374 - DNA, 27 bp, Artificial sequence
  SiRNA target sequence
atatcatgcttatttttagaggtttta

SEQ ID NO: 94375 - DNA, 27 bp, Artificial sequence
  SiRNA target sequence
tatcatgcttatttttagaggttttag

SEQ ID NO: 94376 - DNA, 27 bp, Artificial sequence
  SiRNA target sequence
atcatgcttatttttagaggttttaga

SEQ ID NO: 94377 - DNA, 27 bp, Artificial sequence
  SiRNA target sequence
tcatgcttatttttagaggttttagaa

SEQ ID NO: 94378 - DNA, 27 bp, Artificial sequence
  SiRNA target sequence
catgcttatttttagaggttttagaaa

SEQ ID NO: 94379 - DNA, 27 bp, Artificial sequence
  SiRNA target sequence
atgcttatttttagaggttttagaaat

SEQ ID NO: 94380 - DNA, 27 bp, Artificial sequence
  SiRNA target sequence
tgcttatttttagaggttttagaaata

SEQ ID NO: 94381 - DNA, 27 bp, Artificial sequence
  SiRNA target sequence
gcttatttttagaggttttagaaatat

SEQ ID NO: 94382 - DNA, 27 bp, Artificial sequence
  SiRNA target sequence
cttatttttagaggttttagaaatatc

SEQ ID NO: 94383 - DNA, 27 bp, Artificial sequence
  SiRNA target sequence
ttatttttagaggttttagaaatatcc

SEQ ID NO: 94384 - DNA, 27 bp, Artificial sequence
  SiRNA target sequence
tatttttagaggttttagaaatatcca

SEQ ID NO: 94385 - DNA, 27 bp, Artificial sequence
  SiRNA target sequence
atttttagaggttttagaaatatccat

SEQ ID NO: 94386 - DNA, 27 bp, Artificial sequence
  SiRNA target sequence
tttttagaggttttagaaatatccata

SEQ ID NO: 94387 - DNA, 27 bp, Artificial sequence
  SiRNA target sequence
ttttagaggttttagaaatatccataa

SEQ ID NO: 94388 - DNA, 27 bp, Artificial sequence
  SiRNA target sequence
tttagaggttttagaaatatccataag

SEQ ID NO: 94389 - DNA, 27 bp, Artificial sequence
  SiRNA target sequence
ttagaggttttagaaatatccataagc

SEQ ID NO: 94390 - DNA, 27 bp, Artificial sequence
  SiRNA target sequence
tagaggttttagaaatatccataagcc

SEQ ID NO: 94391 - DNA, 27 bp, Artificial sequence
  SiRNA target sequence
agaggttttagaaatatccataagcca

SEQ ID NO: 94392 - DNA, 27 bp, Artificial sequence
  SiRNA target sequence
gaggttttagaaatatccataagccat

SEQ ID NO: 94393 - DNA, 27 bp, Artificial sequence
  SiRNA target sequence
aggttttagaaatatccataagccatg

SEQ ID NO: 94394 - DNA, 27 bp, Artificial sequence
  SiRNA target sequence
ggttttagaaatatccataagccatgc

SEQ ID NO: 94395 - DNA, 27 bp, Artificial sequence
  SiRNA target sequence
gttttagaaatatccataagccatgct

SEQ ID NO: 94396 - DNA, 27 bp, Artificial sequence
  SiRNA target sequence
ttttagaaatatccataagccatgctt

SEQ ID NO: 94397 - DNA, 27 bp, Artificial sequence
  SiRNA target sequence
tttagaaatatccataagccatgcttt

SEQ ID NO: 94398 - DNA, 27 bp, Artificial sequence
  SiRNA target sequence
ttagaaatatccataagccatgctttt

SEQ ID NO: 94399 - DNA, 27 bp, Artificial sequence
  SiRNA target sequence
tagaaatatccataagccatgcttttt

SEQ ID NO: 94400 - DNA, 27 bp, Artificial sequence
  SiRNA target sequence
agaaatatccataagccatgctttttt

SEQ ID NO: 94401 - DNA, 27 bp, Artificial sequence
  SiRNA target sequence
gaaatatccataagccatgctttttta

SEQ ID NO: 94402 - DNA, 27 bp, Artificial sequence
  SiRNA target sequence
aaatatccataagccatgcttttttag

SEQ ID NO: 94403 - DNA, 27 bp, Artificial sequence
  SiRNA target sequence
aatatccataagccatgcttttttagg

SEQ ID NO: 94404 - DNA, 27 bp, Artificial sequence
  SiRNA target sequence
atatccataagccatgcttttttaggc

SEQ ID NO: 94405 - DNA, 27 bp, Artificial sequence
  SiRNA target sequence
tatccataagccatgcttttttaggca

SEQ ID NO: 94406 - DNA, 27 bp, Artificial sequence
  SiRNA target sequence
atccataagccatgcttttttaggcaa

SEQ ID NO: 94407 - DNA, 27 bp, Artificial sequence
  SiRNA target sequence
tccataagccatgcttttttaggcaat

SEQ ID NO: 94408 - DNA, 27 bp, Artificial sequence
  SiRNA target sequence
ccataagccatgcttttttaggcaatg

SEQ ID NO: 94409 - DNA, 27 bp, Artificial sequence
  SiRNA target sequence
cataagccatgcttttttaggcaatga

SEQ ID NO: 94410 - DNA, 27 bp, Artificial sequence
  SiRNA target sequence
ataagccatgcttttttaggcaatgaa

SEQ ID NO: 94411 - DNA, 27 bp, Artificial sequence
  SiRNA target sequence
taagccatgcttttttaggcaatgaag

SEQ ID NO: 94412 - DNA, 27 bp, Artificial sequence
  SiRNA target sequence
aagccatgcttttttaggcaatgaagt

SEQ ID NO: 94413 - DNA, 27 bp, Artificial sequence
  SiRNA target sequence
agccatgcttttttaggcaatgaagta

SEQ ID NO: 94414 - DNA, 27 bp, Artificial sequence
  SiRNA target sequence
gccatgcttttttaggcaatgaagtaa

SEQ ID NO: 94415 - DNA, 27 bp, Artificial sequence
  SiRNA target sequence
ccatgcttttttaggcaatgaagtaaa

SEQ ID NO: 94416 - DNA, 27 bp, Artificial sequence
  SiRNA target sequence
catgcttttttaggcaatgaagtaaaa

SEQ ID NO: 94417 - DNA, 27 bp, Artificial sequence
  SiRNA target sequence
atgcttttttaggcaatgaagtaaaat

SEQ ID NO: 94418 - DNA, 27 bp, Artificial sequence
  SiRNA target sequence
tgcttttttaggcaatgaagtaaaatc

SEQ ID NO: 94419 - DNA, 27 bp, Artificial sequence
  SiRNA target sequence
gcttttttaggcaatgaagtaaaatca

SEQ ID NO: 94420 - DNA, 27 bp, Artificial sequence
  SiRNA target sequence
cttttttaggcaatgaagtaaaatcaa

SEQ ID NO: 94421 - DNA, 27 bp, Artificial sequence
  SiRNA target sequence
ttttttaggcaatgaagtaaaatcaaa

SEQ ID NO: 94422 - DNA, 27 bp, Artificial sequence
  SiRNA target sequence
tttttaggcaatgaagtaaaatcaaaa

SEQ ID NO: 94423 - DNA, 27 bp, Artificial sequence
  SiRNA target sequence
ttttaggcaatgaagtaaaatcaaaaa

SEQ ID NO: 94424 - DNA, 27 bp, Artificial sequence
  SiRNA target sequence
tttaggcaatgaagtaaaatcaaaaat

SEQ ID NO: 94425 - DNA, 27 bp, Artificial sequence
  SiRNA target sequence
ttaggcaatgaagtaaaatcaaaaata

SEQ ID NO: 94426 - DNA, 27 bp, Artificial sequence
  SiRNA target sequence
taggcaatgaagtaaaatcaaaaatat

SEQ ID NO: 94427 - DNA, 27 bp, Artificial sequence
  SiRNA target sequence
aggcaatgaagtaaaatcaaaaatata

SEQ ID NO: 94428 - DNA, 27 bp, Artificial sequence
  SiRNA target sequence
ggcaatgaagtaaaatcaaaaatatac

SEQ ID NO: 94429 - DNA, 27 bp, Artificial sequence
  SiRNA target sequence
gcaatgaagtaaaatcaaaaatatact

SEQ ID NO: 94430 - DNA, 27 bp, Artificial sequence
  SiRNA target sequence
caatgaagtaaaatcaaaaatatactt

SEQ ID NO: 94431 - DNA, 27 bp, Artificial sequence
  SiRNA target sequence
aatgaagtaaaatcaaaaatatacttg

SEQ ID NO: 94432 - DNA, 27 bp, Artificial sequence
  SiRNA target sequence
atgaagtaaaatcaaaaatatacttga

SEQ ID NO: 94433 - DNA, 27 bp, Artificial sequence
  SiRNA target sequence
tgaagtaaaatcaaaaatatacttgaa

SEQ ID NO: 94434 - DNA, 27 bp, Artificial sequence
  SiRNA target sequence
gaagtaaaatcaaaaatatacttgaaa

SEQ ID NO: 94435 - DNA, 27 bp, Artificial sequence
  SiRNA target sequence
aagtaaaatcaaaaatatacttgaaaa

SEQ ID NO: 94436 - DNA, 27 bp, Artificial sequence
  SiRNA target sequence
agtaaaatcaaaaatatacttgaaaaa

SEQ ID NO: 94437 - DNA, 27 bp, Artificial sequence
  SiRNA target sequence
gtaaaatcaaaaatatacttgaaaaag

SEQ ID NO: 94438 - DNA, 27 bp, Artificial sequence
  SiRNA target sequence
taaaatcaaaaatatacttgaaaaagt

SEQ ID NO: 94439 - DNA, 27 bp, Artificial sequence
  SiRNA target sequence
aaaatcaaaaatatacttgaaaaagtc

SEQ ID NO: 94440 - DNA, 27 bp, Artificial sequence
  SiRNA target sequence
aaatcaaaaatatacttgaaaaagtca

SEQ ID NO: 94441 - DNA, 27 bp, Artificial sequence
  SiRNA target sequence
aatcaaaaatatacttgaaaaagtcac

SEQ ID NO: 94442 - DNA, 27 bp, Artificial sequence
  SiRNA target sequence
atcaaaaatatacttgaaaaagtcacg

SEQ ID NO: 94443 - DNA, 27 bp, Artificial sequence
  SiRNA target sequence
tcaaaaatatacttgaaaaagtcacgc

SEQ ID NO: 94444 - DNA, 27 bp, Artificial sequence
  SiRNA target sequence
caaaaatatacttgaaaaagtcacgca

SEQ ID NO: 94445 - DNA, 27 bp, Artificial sequence
  SiRNA target sequence
aaaaatatacttgaaaaagtcacgcaa

SEQ ID NO: 94446 - DNA, 27 bp, Artificial sequence
  SiRNA target sequence
aaaatatacttgaaaaagtcacgcaaa

SEQ ID NO: 94447 - DNA, 27 bp, Artificial sequence
  SiRNA target sequence
aaatatacttgaaaaagtcacgcaaag

SEQ ID NO: 94448 - DNA, 27 bp, Artificial sequence
  SiRNA target sequence
aatatacttgaaaaagtcacgcaaaga

SEQ ID NO: 94449 - DNA, 27 bp, Artificial sequence
  SiRNA target sequence
atatacttgaaaaagtcacgcaaagat

SEQ ID NO: 94450 - DNA, 27 bp, Artificial sequence
  SiRNA target sequence
tatacttgaaaaagtcacgcaaagatc

SEQ ID NO: 94451 - DNA, 27 bp, Artificial sequence
  SiRNA target sequence
atacttgaaaaagtcacgcaaagatcc

SEQ ID NO: 94452 - DNA, 27 bp, Artificial sequence
  SiRNA target sequence
tacttgaaaaagtcacgcaaagatcct

SEQ ID NO: 94453 - DNA, 27 bp, Artificial sequence
  SiRNA target sequence
acttgaaaaagtcacgcaaagatcctt

SEQ ID NO: 94454 - DNA, 27 bp, Artificial sequence
  SiRNA target sequence
cttgaaaaagtcacgcaaagatccttc

SEQ ID NO: 94455 - DNA, 27 bp, Artificial sequence
  SiRNA target sequence
ttgaaaaagtcacgcaaagatccttcg

SEQ ID NO: 94456 - DNA, 27 bp, Artificial sequence
  SiRNA target sequence
tgaaaaagtcacgcaaagatccttcga

SEQ ID NO: 94457 - DNA, 27 bp, Artificial sequence
  SiRNA target sequence
gaaaaagtcacgcaaagatccttcgaa

SEQ ID NO: 94458 - DNA, 27 bp, Artificial sequence
  SiRNA target sequence
aaaaagtcacgcaaagatccttcgaat

SEQ ID NO: 94459 - DNA, 27 bp, Artificial sequence
  SiRNA target sequence
aaaagtcacgcaaagatccttcgaatt

SEQ ID NO: 94460 - DNA, 27 bp, Artificial sequence
  SiRNA target sequence
aaagtcacgcaaagatccttcgaattg

SEQ ID NO: 94461 - DNA, 27 bp, Artificial sequence
  SiRNA target sequence
aagtcacgcaaagatccttcgaattga

SEQ ID NO: 94462 - DNA, 27 bp, Artificial sequence
  SiRNA target sequence
agtcacgcaaagatccttcgaattgaa

SEQ ID NO: 94463 - DNA, 27 bp, Artificial sequence
  SiRNA target sequence
gtcacgcaaagatccttcgaattgaaa

SEQ ID NO: 94464 - DNA, 27 bp, Artificial sequence
  SiRNA target sequence
tcacgcaaagatccttcgaattgaaac

SEQ ID NO: 94465 - DNA, 27 bp, Artificial sequence
  SiRNA target sequence
cacgcaaagatccttcgaattgaaacc

SEQ ID NO: 94466 - DNA, 27 bp, Artificial sequence
  SiRNA target sequence
acgcaaagatccttcgaattgaaaccc

SEQ ID NO: 94467 - DNA, 27 bp, Artificial sequence
  SiRNA target sequence
cgcaaagatccttcgaattgaaacccc

SEQ ID NO: 94468 - DNA, 27 bp, Artificial sequence
  SiRNA target sequence
gcaaagatccttcgaattgaaaccccg

SEQ ID NO: 94469 - DNA, 27 bp, Artificial sequence
  SiRNA target sequence
caaagatccttcgaattgaaaccccgt

SEQ ID NO: 94470 - DNA, 27 bp, Artificial sequence
  SiRNA target sequence
aaagatccttcgaattgaaaccccgtt

SEQ ID NO: 94471 - DNA, 27 bp, Artificial sequence
  SiRNA target sequence
aagatccttcgaattgaaaccccgttt

SEQ ID NO: 94472 - DNA, 27 bp, Artificial sequence
  SiRNA target sequence
agatccttcgaattgaaaccccgtttt

SEQ ID NO: 94473 - DNA, 27 bp, Artificial sequence
  SiRNA target sequence
gatccttcgaattgaaaccccgttttt

SEQ ID NO: 94474 - DNA, 27 bp, Artificial sequence
  SiRNA target sequence
atccttcgaattgaaaccccgtttttc

SEQ ID NO: 94475 - DNA, 27 bp, Artificial sequence
  SiRNA target sequence
tccttcgaattgaaaccccgtttttcc

SEQ ID NO: 94476 - DNA, 27 bp, Artificial sequence
  SiRNA target sequence
ccttcgaattgaaaccccgtttttcca

SEQ ID NO: 94477 - DNA, 27 bp, Artificial sequence
  SiRNA target sequence
cttcgaattgaaaccccgtttttccaa

SEQ ID NO: 94478 - DNA, 27 bp, Artificial sequence
  SiRNA target sequence
ttcgaattgaaaccccgtttttccaac

SEQ ID NO: 94479 - DNA, 27 bp, Artificial sequence
  SiRNA target sequence
tcgaattgaaaccccgtttttccaact

SEQ ID NO: 94480 - DNA, 27 bp, Artificial sequence
  SiRNA target sequence
cgaattgaaaccccgtttttccaactt

SEQ ID NO: 94481 - DNA, 27 bp, Artificial sequence
  SiRNA target sequence
gaattgaaaccccgtttttccaacttg

SEQ ID NO: 94482 - DNA, 27 bp, Artificial sequence
  SiRNA target sequence
aattgaaaccccgtttttccaacttgc

SEQ ID NO: 94483 - DNA, 27 bp, Artificial sequence
  SiRNA target sequence
attgaaaccccgtttttccaacttgct

SEQ ID NO: 94484 - DNA, 27 bp, Artificial sequence
  SiRNA target sequence
ttgaaaccccgtttttccaacttgctc

SEQ ID NO: 94485 - DNA, 27 bp, Artificial sequence
  SiRNA target sequence
tgaaaccccgtttttccaacttgctca

SEQ ID NO: 94486 - DNA, 27 bp, Artificial sequence
  SiRNA target sequence
gaaaccccgtttttccaacttgctcaa

SEQ ID NO: 94487 - DNA, 27 bp, Artificial sequence
  SiRNA target sequence
aaaccccgtttttccaacttgctcaat

SEQ ID NO: 94488 - DNA, 27 bp, Artificial sequence
  SiRNA target sequence
aaccccgtttttccaacttgctcaata

SEQ ID NO: 94489 - DNA, 27 bp, Artificial sequence
  SiRNA target sequence
accccgtttttccaacttgctcaatat

SEQ ID NO: 94490 - DNA, 27 bp, Artificial sequence
  SiRNA target sequence
ccccgtttttccaacttgctcaatata

SEQ ID NO: 94491 - DNA, 27 bp, Artificial sequence
  SiRNA target sequence
cccgtttttccaacttgctcaatatat

SEQ ID NO: 94492 - DNA, 27 bp, Artificial sequence
  SiRNA target sequence
ccgtttttccaacttgctcaatatata

SEQ ID NO: 94493 - DNA, 27 bp, Artificial sequence
  SiRNA target sequence
cgtttttccaacttgctcaatatataa

SEQ ID NO: 94494 - DNA, 27 bp, Artificial sequence
  SiRNA target sequence
gtttttccaacttgctcaatatataat

SEQ ID NO: 94495 - DNA, 27 bp, Artificial sequence
  SiRNA target sequence
tttttccaacttgctcaatatataata

SEQ ID NO: 94496 - DNA, 27 bp, Artificial sequence
  SiRNA target sequence
ttttccaacttgctcaatatataataa

SEQ ID NO: 94497 - DNA, 27 bp, Artificial sequence
  SiRNA target sequence
tttccaacttgctcaatatataataat

SEQ ID NO: 94498 - DNA, 27 bp, Artificial sequence
  SiRNA target sequence
ttccaacttgctcaatatataataatg

SEQ ID NO: 94499 - DNA, 27 bp, Artificial sequence
  SiRNA target sequence
tccaacttgctcaatatataataatgt

SEQ ID NO: 94500 - DNA, 27 bp, Artificial sequence
  SiRNA target sequence
ccaacttgctcaatatataataatgta

SEQ ID NO: 94501 - DNA, 27 bp, Artificial sequence
  SiRNA target sequence
caacttgctcaatatataataatgtat

SEQ ID NO: 94502 - DNA, 27 bp, Artificial sequence
  SiRNA target sequence
aacttgctcaatatataataatgtatc

SEQ ID NO: 94503 - DNA, 27 bp, Artificial sequence
  SiRNA target sequence
acttgctcaatatataataatgtatca

SEQ ID NO: 94504 - DNA, 27 bp, Artificial sequence
  SiRNA target sequence
cttgctcaatatataataatgtatcac

SEQ ID NO: 94505 - DNA, 27 bp, Artificial sequence
  SiRNA target sequence
ttgctcaatatataataatgtatcacc

SEQ ID NO: 94506 - DNA, 27 bp, Artificial sequence
  SiRNA target sequence
tgctcaatatataataatgtatcacca

SEQ ID NO: 94507 - DNA, 27 bp, Artificial sequence
  SiRNA target sequence
gctcaatatataataatgtatcaccag

SEQ ID NO: 94508 - DNA, 27 bp, Artificial sequence
  SiRNA target sequence
ctcaatatataataatgtatcaccaga

SEQ ID NO: 94509 - DNA, 27 bp, Artificial sequence
  SiRNA target sequence
tcaatatataataatgtatcaccagac

SEQ ID NO: 94510 - DNA, 27 bp, Artificial sequence
  SiRNA target sequence
caatatataataatgtatcaccagaca

SEQ ID NO: 94511 - DNA, 27 bp, Artificial sequence
  SiRNA target sequence
aatatataataatgtatcaccagacat

SEQ ID NO: 94512 - DNA, 27 bp, Artificial sequence
  SiRNA target sequence
atatataataatgtatcaccagacatt

SEQ ID NO: 94513 - DNA, 27 bp, Artificial sequence
  SiRNA target sequence
tatataataatgtatcaccagacattt

SEQ ID NO: 94514 - DNA, 27 bp, Artificial sequence
  SiRNA target sequence
atataataatgtatcaccagacatttc

SEQ ID NO: 94515 - DNA, 27 bp, Artificial sequence
  SiRNA target sequence
tataataatgtatcaccagacatttct

SEQ ID NO: 94516 - DNA, 27 bp, Artificial sequence
  SiRNA target sequence
ataataatgtatcaccagacatttcta

SEQ ID NO: 94517 - DNA, 27 bp, Artificial sequence
  SiRNA target sequence
taataatgtatcaccagacatttctag

SEQ ID NO: 94518 - DNA, 27 bp, Artificial sequence
  SiRNA target sequence
aataatgtatcaccagacatttctagt

SEQ ID NO: 94519 - DNA, 27 bp, Artificial sequence
  SiRNA target sequence
ataatgtatcaccagacatttctagta

SEQ ID NO: 94520 - DNA, 27 bp, Artificial sequence
  SiRNA target sequence
taatgtatcaccagacatttctagtaa

SEQ ID NO: 94521 - DNA, 27 bp, Artificial sequence
  SiRNA target sequence
aatgtatcaccagacatttctagtaaa

SEQ ID NO: 94522 - DNA, 27 bp, Artificial sequence
  SiRNA target sequence
atgtatcaccagacatttctagtaaac

SEQ ID NO: 94523 - DNA, 27 bp, Artificial sequence
  SiRNA target sequence
tgtatcaccagacatttctagtaaact

SEQ ID NO: 94524 - DNA, 27 bp, Artificial sequence
  SiRNA target sequence
gtatcaccagacatttctagtaaactt

SEQ ID NO: 94525 - DNA, 27 bp, Artificial sequence
  SiRNA target sequence
tatcaccagacatttctagtaaactta

SEQ ID NO: 94526 - DNA, 27 bp, Artificial sequence
  SiRNA target sequence
atcaccagacatttctagtaaacttaa

SEQ ID NO: 94527 - DNA, 27 bp, Artificial sequence
  SiRNA target sequence
tcaccagacatttctagtaaacttaac

SEQ ID NO: 94528 - DNA, 27 bp, Artificial sequence
  SiRNA target sequence
caccagacatttctagtaaacttaaca

SEQ ID NO: 94529 - DNA, 27 bp, Artificial sequence
  SiRNA target sequence
accagacatttctagtaaacttaacat

SEQ ID NO: 94530 - DNA, 27 bp, Artificial sequence
  SiRNA target sequence
ccagacatttctagtaaacttaacatt

SEQ ID NO: 94531 - DNA, 27 bp, Artificial sequence
  SiRNA target sequence
cagacatttctagtaaacttaacattt

SEQ ID NO: 94532 - DNA, 27 bp, Artificial sequence
  SiRNA target sequence
agacatttctagtaaacttaacatttc

SEQ ID NO: 94533 - DNA, 27 bp, Artificial sequence
  SiRNA target sequence
gacatttctagtaaacttaacatttca

SEQ ID NO: 94534 - DNA, 27 bp, Artificial sequence
  SiRNA target sequence
acatttctagtaaacttaacatttcat

SEQ ID NO: 94535 - DNA, 27 bp, Artificial sequence
  SiRNA target sequence
catttctagtaaacttaacatttcatt

SEQ ID NO: 94536 - DNA, 27 bp, Artificial sequence
  SiRNA target sequence
atttctagtaaacttaacatttcatta

SEQ ID NO: 94537 - DNA, 27 bp, Artificial sequence
  SiRNA target sequence
tttctagtaaacttaacatttcattaa

SEQ ID NO: 94538 - DNA, 27 bp, Artificial sequence
  SiRNA target sequence
ttctagtaaacttaacatttcattaac

SEQ ID NO: 94539 - DNA, 27 bp, Artificial sequence
  SiRNA target sequence
tctagtaaacttaacatttcattaaca

SEQ ID NO: 94540 - DNA, 27 bp, Artificial sequence
  SiRNA target sequence
ctagtaaacttaacatttcattaacaa

SEQ ID NO: 94541 - DNA, 27 bp, Artificial sequence
  SiRNA target sequence
tagtaaacttaacatttcattaacaag

SEQ ID NO: 94542 - DNA, 27 bp, Artificial sequence
  SiRNA target sequence
agtaaacttaacatttcattaacaagc

SEQ ID NO: 94543 - DNA, 27 bp, Artificial sequence
  SiRNA target sequence
gtaaacttaacatttcattaacaagca

SEQ ID NO: 94544 - DNA, 27 bp, Artificial sequence
  SiRNA target sequence
taaacttaacatttcattaacaagcaa

SEQ ID NO: 94545 - DNA, 27 bp, Artificial sequence
  SiRNA target sequence
aaacttaacatttcattaacaagcaaa

SEQ ID NO: 94546 - DNA, 27 bp, Artificial sequence
  SiRNA target sequence
aacttaacatttcattaacaagcaaat

SEQ ID NO: 94547 - DNA, 27 bp, Artificial sequence
  SiRNA target sequence
acttaacatttcattaacaagcaaatc

SEQ ID NO: 94548 - DNA, 27 bp, Artificial sequence
  SiRNA target sequence
cttaacatttcattaacaagcaaatca

SEQ ID NO: 94549 - DNA, 27 bp, Artificial sequence
  SiRNA target sequence
ttaacatttcattaacaagcaaatcat

SEQ ID NO: 94550 - DNA, 27 bp, Artificial sequence
  SiRNA target sequence
taacatttcattaacaagcaaatcatt

SEQ ID NO: 94551 - DNA, 27 bp, Artificial sequence
  SiRNA target sequence
aacatttcattaacaagcaaatcatta

SEQ ID NO: 94552 - DNA, 27 bp, Artificial sequence
  SiRNA target sequence
acatttcattaacaagcaaatcattat

SEQ ID NO: 94553 - DNA, 27 bp, Artificial sequence
  SiRNA target sequence
catttcattaacaagcaaatcattatt

SEQ ID NO: 94554 - DNA, 27 bp, Artificial sequence
  SiRNA target sequence
atttcattaacaagcaaatcattattt

SEQ ID NO: 94555 - DNA, 27 bp, Artificial sequence
  SiRNA target sequence
tttcattaacaagcaaatcattatttg

SEQ ID NO: 94556 - DNA, 27 bp, Artificial sequence
  SiRNA target sequence
ttcattaacaagcaaatcattatttga

SEQ ID NO: 94557 - DNA, 27 bp, Artificial sequence
  SiRNA target sequence
tcattaacaagcaaatcattatttgaa

SEQ ID NO: 94558 - DNA, 27 bp, Artificial sequence
  SiRNA target sequence
cattaacaagcaaatcattatttgaac

SEQ ID NO: 94559 - DNA, 27 bp, Artificial sequence
  SiRNA target sequence
attaacaagcaaatcattatttgaaca

SEQ ID NO: 94560 - DNA, 27 bp, Artificial sequence
  SiRNA target sequence
ttaacaagcaaatcattatttgaacaa

SEQ ID NO: 94561 - DNA, 27 bp, Artificial sequence
  SiRNA target sequence
taacaagcaaatcattatttgaacaaa

SEQ ID NO: 94562 - DNA, 27 bp, Artificial sequence
  SiRNA target sequence
aacaagcaaatcattatttgaacaaag

SEQ ID NO: 94563 - DNA, 27 bp, Artificial sequence
  SiRNA target sequence
acaagcaaatcattatttgaacaaagt

SEQ ID NO: 94564 - DNA, 27 bp, Artificial sequence
  SiRNA target sequence
caagcaaatcattatttgaacaaagta

SEQ ID NO: 94565 - DNA, 27 bp, Artificial sequence
  SiRNA target sequence
aagcaaatcattatttgaacaaagtag

SEQ ID NO: 94566 - DNA, 27 bp, Artificial sequence
  SiRNA target sequence
agcaaatcattatttgaacaaagtaga

SEQ ID NO: 94567 - DNA, 27 bp, Artificial sequence
  SiRNA target sequence
gcaaatcattatttgaacaaagtagac

SEQ ID NO: 94568 - DNA, 27 bp, Artificial sequence
  SiRNA target sequence
caaatcattatttgaacaaagtagacc

SEQ ID NO: 94569 - DNA, 27 bp, Artificial sequence
  SiRNA target sequence
aaatcattatttgaacaaagtagacca

SEQ ID NO: 94570 - DNA, 27 bp, Artificial sequence
  SiRNA target sequence
aatcattatttgaacaaagtagaccaa

SEQ ID NO: 94571 - DNA, 27 bp, Artificial sequence
  SiRNA target sequence
atcattatttgaacaaagtagaccaat

SEQ ID NO: 94572 - DNA, 27 bp, Artificial sequence
  SiRNA target sequence
tcattatttgaacaaagtagaccaata

SEQ ID NO: 94573 - DNA, 27 bp, Artificial sequence
  SiRNA target sequence
cattatttgaacaaagtagaccaatac

SEQ ID NO: 94574 - DNA, 27 bp, Artificial sequence
  SiRNA target sequence
attatttgaacaaagtagaccaatact

SEQ ID NO: 94575 - DNA, 27 bp, Artificial sequence
  SiRNA target sequence
ttatttgaacaaagtagaccaatacta

SEQ ID NO: 94576 - DNA, 27 bp, Artificial sequence
  SiRNA target sequence
tatttgaacaaagtagaccaatactat

SEQ ID NO: 94577 - DNA, 27 bp, Artificial sequence
  SiRNA target sequence
atttgaacaaagtagaccaatactatc

SEQ ID NO: 94578 - DNA, 27 bp, Artificial sequence
  SiRNA target sequence
tttgaacaaagtagaccaatactatca

SEQ ID NO: 94579 - DNA, 27 bp, Artificial sequence
  SiRNA target sequence
ttgaacaaagtagaccaatactatcac

SEQ ID NO: 94580 - DNA, 27 bp, Artificial sequence
  SiRNA target sequence
tgaacaaagtagaccaatactatcacc

SEQ ID NO: 94581 - DNA, 27 bp, Artificial sequence
  SiRNA target sequence
gaacaaagtagaccaatactatcacca

SEQ ID NO: 94582 - DNA, 27 bp, Artificial sequence
  SiRNA target sequence
aacaaagtagaccaatactatcaccag

SEQ ID NO: 94583 - DNA, 27 bp, Artificial sequence
  SiRNA target sequence
acaaagtagaccaatactatcaccagg

SEQ ID NO: 94584 - DNA, 27 bp, Artificial sequence
  SiRNA target sequence
caaagtagaccaatactatcaccagga

SEQ ID NO: 94585 - DNA, 27 bp, Artificial sequence
  SiRNA target sequence
aaagtagaccaatactatcaccaggaa

SEQ ID NO: 94586 - DNA, 27 bp, Artificial sequence
  SiRNA target sequence
aagtagaccaatactatcaccaggaac

SEQ ID NO: 94587 - DNA, 27 bp, Artificial sequence
  SiRNA target sequence
agtagaccaatactatcaccaggaaca

SEQ ID NO: 94588 - DNA, 27 bp, Artificial sequence
  SiRNA target sequence
gtagaccaatactatcaccaggaacaa

SEQ ID NO: 94589 - DNA, 27 bp, Artificial sequence
  SiRNA target sequence
tagaccaatactatcaccaggaacaaa

SEQ ID NO: 94590 - DNA, 27 bp, Artificial sequence
  SiRNA target sequence
agaccaatactatcaccaggaacaaaa

SEQ ID NO: 94591 - DNA, 27 bp, Artificial sequence
  SiRNA target sequence
gaccaatactatcaccaggaacaaaat

SEQ ID NO: 94592 - DNA, 27 bp, Artificial sequence
  SiRNA target sequence
accaatactatcaccaggaacaaaatc

SEQ ID NO: 94593 - DNA, 27 bp, Artificial sequence
  SiRNA target sequence
ccaatactatcaccaggaacaaaatct

SEQ ID NO: 94594 - DNA, 27 bp, Artificial sequence
  SiRNA target sequence
caatactatcaccaggaacaaaatcta

SEQ ID NO: 94595 - DNA, 27 bp, Artificial sequence
  SiRNA target sequence
aatactatcaccaggaacaaaatctaa

SEQ ID NO: 94596 - DNA, 27 bp, Artificial sequence
  SiRNA target sequence
atactatcaccaggaacaaaatctaat

SEQ ID NO: 94597 - DNA, 27 bp, Artificial sequence
  SiRNA target sequence
tactatcaccaggaacaaaatctaatg

SEQ ID NO: 94598 - DNA, 27 bp, Artificial sequence
  SiRNA target sequence
actatcaccaggaacaaaatctaatgt

SEQ ID NO: 94599 - DNA, 27 bp, Artificial sequence
  SiRNA target sequence
ctatcaccaggaacaaaatctaatgta

SEQ ID NO: 94600 - DNA, 27 bp, Artificial sequence
  SiRNA target sequence
tatcaccaggaacaaaatctaatgtat

SEQ ID NO: 94601 - DNA, 27 bp, Artificial sequence
  SiRNA target sequence
atcaccaggaacaaaatctaatgtata

SEQ ID NO: 94602 - DNA, 27 bp, Artificial sequence
  SiRNA target sequence
tcaccaggaacaaaatctaatgtataa

SEQ ID NO: 94603 - DNA, 27 bp, Artificial sequence
  SiRNA target sequence
caccaggaacaaaatctaatgtataat

SEQ ID NO: 94604 - DNA, 27 bp, Artificial sequence
  SiRNA target sequence
accaggaacaaaatctaatgtataatt

SEQ ID NO: 94605 - DNA, 27 bp, Artificial sequence
  SiRNA target sequence
ccaggaacaaaatctaatgtataatta

SEQ ID NO: 94606 - DNA, 27 bp, Artificial sequence
  SiRNA target sequence
caggaacaaaatctaatgtataattaa

SEQ ID NO: 94607 - DNA, 27 bp, Artificial sequence
  SiRNA target sequence
aggaacaaaatctaatgtataattaag

SEQ ID NO: 94608 - DNA, 27 bp, Artificial sequence
  SiRNA target sequence
ggaacaaaatctaatgtataattaagt

SEQ ID NO: 94609 - DNA, 27 bp, Artificial sequence
  SiRNA target sequence
gaacaaaatctaatgtataattaagtt

SEQ ID NO: 94610 - DNA, 27 bp, Artificial sequence
  SiRNA target sequence
aacaaaatctaatgtataattaagttg

SEQ ID NO: 94611 - DNA, 27 bp, Artificial sequence
  SiRNA target sequence
acaaaatctaatgtataattaagttga

SEQ ID NO: 94612 - DNA, 27 bp, Artificial sequence
  SiRNA target sequence
caaaatctaatgtataattaagttgaa

SEQ ID NO: 94613 - DNA, 27 bp, Artificial sequence
  SiRNA target sequence
aaaatctaatgtataattaagttgaac

SEQ ID NO: 94614 - DNA, 27 bp, Artificial sequence
  SiRNA target sequence
aaatctaatgtataattaagttgaacc

SEQ ID NO: 94615 - DNA, 27 bp, Artificial sequence
  SiRNA target sequence
aatctaatgtataattaagttgaacct

SEQ ID NO: 94616 - DNA, 27 bp, Artificial sequence
  SiRNA target sequence
atctaatgtataattaagttgaacctt

SEQ ID NO: 94617 - DNA, 27 bp, Artificial sequence
  SiRNA target sequence
tctaatgtataattaagttgaacctta

SEQ ID NO: 94618 - DNA, 27 bp, Artificial sequence
  SiRNA target sequence
ctaatgtataattaagttgaaccttat

SEQ ID NO: 94619 - DNA, 27 bp, Artificial sequence
  SiRNA target sequence
taatgtataattaagttgaaccttata

SEQ ID NO: 94620 - DNA, 27 bp, Artificial sequence
  SiRNA target sequence
aatgtataattaagttgaaccttatat

SEQ ID NO: 94621 - DNA, 27 bp, Artificial sequence
  SiRNA target sequence
atgtataattaagttgaaccttatata

SEQ ID NO: 94622 - DNA, 27 bp, Artificial sequence
  SiRNA target sequence
tgtataattaagttgaaccttatatac

SEQ ID NO: 94623 - DNA, 27 bp, Artificial sequence
  SiRNA target sequence
gtataattaagttgaaccttatatacc

SEQ ID NO: 94624 - DNA, 27 bp, Artificial sequence
  SiRNA target sequence
tataattaagttgaaccttatatacct

SEQ ID NO: 94625 - DNA, 27 bp, Artificial sequence
  SiRNA target sequence
ataattaagttgaaccttatatacctt

SEQ ID NO: 94626 - DNA, 27 bp, Artificial sequence
  SiRNA target sequence
taattaagttgaaccttatataccttt

SEQ ID NO: 94627 - DNA, 27 bp, Artificial sequence
  SiRNA target sequence
aattaagttgaaccttatatacctttt

SEQ ID NO: 94628 - DNA, 27 bp, Artificial sequence
  SiRNA target sequence
attaagttgaaccttatataccttttt

SEQ ID NO: 94629 - DNA, 27 bp, Artificial sequence
  SiRNA target sequence
ttaagttgaaccttatatacctttttc

SEQ ID NO: 94630 - DNA, 27 bp, Artificial sequence
  SiRNA target sequence
taagttgaaccttatatacctttttcc

SEQ ID NO: 94631 - DNA, 27 bp, Artificial sequence
  SiRNA target sequence
aagttgaaccttatatacctttttcca

SEQ ID NO: 94632 - DNA, 27 bp, Artificial sequence
  SiRNA target sequence
agttgaaccttatatacctttttccat

SEQ ID NO: 94633 - DNA, 27 bp, Artificial sequence
  SiRNA target sequence
gttgaaccttatatacctttttccatg

SEQ ID NO: 94634 - DNA, 27 bp, Artificial sequence
  SiRNA target sequence
ttgaaccttatatacctttttccatgt

SEQ ID NO: 94635 - DNA, 27 bp, Artificial sequence
  SiRNA target sequence
tgaaccttatatacctttttccatgta

SEQ ID NO: 94636 - DNA, 27 bp, Artificial sequence
  SiRNA target sequence
gaaccttatatacctttttccatgtac

SEQ ID NO: 94637 - DNA, 27 bp, Artificial sequence
  SiRNA target sequence
aaccttatatacctttttccatgtaca

SEQ ID NO: 94638 - DNA, 27 bp, Artificial sequence
  SiRNA target sequence
accttatatacctttttccatgtacag

SEQ ID NO: 94639 - DNA, 27 bp, Artificial sequence
  SiRNA target sequence
ccttatatacctttttccatgtacagg

SEQ ID NO: 94640 - DNA, 27 bp, Artificial sequence
  SiRNA target sequence
cttatatacctttttccatgtacagga

SEQ ID NO: 94641 - DNA, 27 bp, Artificial sequence
  SiRNA target sequence
ttatatacctttttccatgtacaggaa

SEQ ID NO: 94642 - DNA, 27 bp, Artificial sequence
  SiRNA target sequence
tatatacctttttccatgtacaggaaa

SEQ ID NO: 94643 - DNA, 27 bp, Artificial sequence
  SiRNA target sequence
atatacctttttccatgtacaggaaag

SEQ ID NO: 94644 - DNA, 27 bp, Artificial sequence
  SiRNA target sequence
tatacctttttccatgtacaggaaagg

SEQ ID NO: 94645 - DNA, 27 bp, Artificial sequence
  SiRNA target sequence
atacctttttccatgtacaggaaaggt

SEQ ID NO: 94646 - DNA, 27 bp, Artificial sequence
  SiRNA target sequence
tacctttttccatgtacaggaaaggtt

SEQ ID NO: 94647 - DNA, 27 bp, Artificial sequence
  SiRNA target sequence
acctttttccatgtacaggaaaggttt

SEQ ID NO: 94648 - DNA, 27 bp, Artificial sequence
  SiRNA target sequence
cctttttccatgtacaggaaaggtttt

SEQ ID NO: 94649 - DNA, 27 bp, Artificial sequence
  SiRNA target sequence
ctttttccatgtacaggaaaggttttc

SEQ ID NO: 94650 - DNA, 27 bp, Artificial sequence
  SiRNA target sequence
tttttccatgtacaggaaaggttttca

SEQ ID NO: 94651 - DNA, 27 bp, Artificial sequence
  SiRNA target sequence
ttttccatgtacaggaaaggttttcaa

SEQ ID NO: 94652 - DNA, 27 bp, Artificial sequence
  SiRNA target sequence
tttccatgtacaggaaaggttttcaat

SEQ ID NO: 94653 - DNA, 27 bp, Artificial sequence
  SiRNA target sequence
ttccatgtacaggaaaggttttcaata

SEQ ID NO: 94654 - DNA, 27 bp, Artificial sequence
  SiRNA target sequence
tccatgtacaggaaaggttttcaatat

SEQ ID NO: 94655 - DNA, 27 bp, Artificial sequence
  SiRNA target sequence
ccatgtacaggaaaggttttcaatatt

SEQ ID NO: 94656 - DNA, 27 bp, Artificial sequence
  SiRNA target sequence
catgtacaggaaaggttttcaatattt

SEQ ID NO: 94657 - DNA, 27 bp, Artificial sequence
  SiRNA target sequence
atgtacaggaaaggttttcaatattta

SEQ ID NO: 94658 - DNA, 27 bp, Artificial sequence
  SiRNA target sequence
tgtacaggaaaggttttcaatatttag

SEQ ID NO: 94659 - DNA, 27 bp, Artificial sequence
  SiRNA target sequence
gtacaggaaaggttttcaatatttagt

SEQ ID NO: 94660 - DNA, 27 bp, Artificial sequence
  SiRNA target sequence
tacaggaaaggttttcaatatttagta

SEQ ID NO: 94661 - DNA, 27 bp, Artificial sequence
  SiRNA target sequence
acaggaaaggttttcaatatttagtat

SEQ ID NO: 94662 - DNA, 27 bp, Artificial sequence
  SiRNA target sequence
caggaaaggttttcaatatttagtata

SEQ ID NO: 94663 - DNA, 27 bp, Artificial sequence
  SiRNA target sequence
aggaaaggttttcaatatttagtatat

SEQ ID NO: 94664 - DNA, 27 bp, Artificial sequence
  SiRNA target sequence
ggaaaggttttcaatatttagtatatt

SEQ ID NO: 94665 - DNA, 27 bp, Artificial sequence
  SiRNA target sequence
gaaaggttttcaatatttagtatattt

SEQ ID NO: 94666 - DNA, 27 bp, Artificial sequence
  SiRNA target sequence
aaaggttttcaatatttagtatatttg

SEQ ID NO: 94667 - DNA, 27 bp, Artificial sequence
  SiRNA target sequence
aaggttttcaatatttagtatatttgt

SEQ ID NO: 94668 - DNA, 27 bp, Artificial sequence
  SiRNA target sequence
aggttttcaatatttagtatatttgta

SEQ ID NO: 94669 - DNA, 27 bp, Artificial sequence
  SiRNA target sequence
ggttttcaatatttagtatatttgtat

SEQ ID NO: 94670 - DNA, 27 bp, Artificial sequence
  SiRNA target sequence
gttttcaatatttagtatatttgtatc

SEQ ID NO: 94671 - DNA, 27 bp, Artificial sequence
  SiRNA target sequence
ttttcaatatttagtatatttgtatct

SEQ ID NO: 94672 - DNA, 27 bp, Artificial sequence
  SiRNA target sequence
tttcaatatttagtatatttgtatcta

SEQ ID NO: 94673 - DNA, 27 bp, Artificial sequence
  SiRNA target sequence
ttcaatatttagtatatttgtatctat

SEQ ID NO: 94674 - DNA, 27 bp, Artificial sequence
  SiRNA target sequence
tcaatatttagtatatttgtatctatc

SEQ ID NO: 94675 - DNA, 27 bp, Artificial sequence
  SiRNA target sequence
caatatttagtatatttgtatctatca

SEQ ID NO: 94676 - DNA, 27 bp, Artificial sequence
  SiRNA target sequence
aatatttagtatatttgtatctatcaa

SEQ ID NO: 94677 - DNA, 27 bp, Artificial sequence
  SiRNA target sequence
atatttagtatatttgtatctatcaaa

SEQ ID NO: 94678 - DNA, 27 bp, Artificial sequence
  SiRNA target sequence
tatttagtatatttgtatctatcaaat

SEQ ID NO: 94679 - DNA, 27 bp, Artificial sequence
  SiRNA target sequence
atttagtatatttgtatctatcaaatt

SEQ ID NO: 94680 - DNA, 27 bp, Artificial sequence
  SiRNA target sequence
tttagtatatttgtatctatcaaattt

SEQ ID NO: 94681 - DNA, 27 bp, Artificial sequence
  SiRNA target sequence
ttagtatatttgtatctatcaaattta

SEQ ID NO: 94682 - DNA, 27 bp, Artificial sequence
  SiRNA target sequence
tagtatatttgtatctatcaaatttat

SEQ ID NO: 94683 - DNA, 27 bp, Artificial sequence
  SiRNA target sequence
agtatatttgtatctatcaaatttata

SEQ ID NO: 94684 - DNA, 27 bp, Artificial sequence
  SiRNA target sequence
gtatatttgtatctatcaaatttatat

SEQ ID NO: 94685 - DNA, 27 bp, Artificial sequence
  SiRNA target sequence
tatatttgtatctatcaaatttatatt

SEQ ID NO: 94686 - DNA, 27 bp, Artificial sequence
  SiRNA target sequence
atatttgtatctatcaaatttatattc

SEQ ID NO: 94687 - DNA, 27 bp, Artificial sequence
  SiRNA target sequence
tatttgtatctatcaaatttatattct

SEQ ID NO: 94688 - DNA, 27 bp, Artificial sequence
  SiRNA target sequence
atttgtatctatcaaatttatattctc

SEQ ID NO: 94689 - DNA, 27 bp, Artificial sequence
  SiRNA target sequence
tttgtatctatcaaatttatattctcg

SEQ ID NO: 94690 - DNA, 27 bp, Artificial sequence
  SiRNA target sequence
ttgtatctatcaaatttatattctcgt

SEQ ID NO: 94691 - DNA, 27 bp, Artificial sequence
  SiRNA target sequence
tgtatctatcaaatttatattctcgtt

SEQ ID NO: 94692 - DNA, 27 bp, Artificial sequence
  SiRNA target sequence
gtatctatcaaatttatattctcgttt

SEQ ID NO: 94693 - DNA, 27 bp, Artificial sequence
  SiRNA target sequence
tatctatcaaatttatattctcgtttg

SEQ ID NO: 94694 - DNA, 27 bp, Artificial sequence
  SiRNA target sequence
atctatcaaatttatattctcgtttgt

SEQ ID NO: 94695 - DNA, 27 bp, Artificial sequence
  SiRNA target sequence
tctatcaaatttatattctcgtttgtc

SEQ ID NO: 94696 - DNA, 27 bp, Artificial sequence
  SiRNA target sequence
ctatcaaatttatattctcgtttgtct

SEQ ID NO: 94697 - DNA, 27 bp, Artificial sequence
  SiRNA target sequence
tatcaaatttatattctcgtttgtctt

SEQ ID NO: 94698 - DNA, 27 bp, Artificial sequence
  SiRNA target sequence
atcaaatttatattctcgtttgtcttt

SEQ ID NO: 94699 - DNA, 27 bp, Artificial sequence
  SiRNA target sequence
tcaaatttatattctcgtttgtcttta

SEQ ID NO: 94700 - DNA, 27 bp, Artificial sequence
  SiRNA target sequence
caaatttatattctcgtttgtctttat

SEQ ID NO: 94701 - DNA, 27 bp, Artificial sequence
  SiRNA target sequence
aaatttatattctcgtttgtctttatt

SEQ ID NO: 94702 - DNA, 27 bp, Artificial sequence
  SiRNA target sequence
aatttatattctcgtttgtctttattt

SEQ ID NO: 94703 - DNA, 27 bp, Artificial sequence
  SiRNA target sequence
atttatattctcgtttgtctttatttt

SEQ ID NO: 94704 - DNA, 27 bp, Artificial sequence
  SiRNA target sequence
tttatattctcgtttgtctttatttta

SEQ ID NO: 94705 - DNA, 27 bp, Artificial sequence
  SiRNA target sequence
ttatattctcgtttgtctttattttat

SEQ ID NO: 94706 - DNA, 27 bp, Artificial sequence
  SiRNA target sequence
tatattctcgtttgtctttattttata

SEQ ID NO: 94707 - DNA, 27 bp, Artificial sequence
  SiRNA target sequence
atattctcgtttgtctttattttataa

SEQ ID NO: 94708 - DNA, 27 bp, Artificial sequence
  SiRNA target sequence
tattctcgtttgtctttattttataag

SEQ ID NO: 94709 - DNA, 27 bp, Artificial sequence
  SiRNA target sequence
attctcgtttgtctttattttataaga

SEQ ID NO: 94710 - DNA, 27 bp, Artificial sequence
  SiRNA target sequence
ttctcgtttgtctttattttataagaa

SEQ ID NO: 94711 - DNA, 27 bp, Artificial sequence
  SiRNA target sequence
tctcgtttgtctttattttataagaac

SEQ ID NO: 94712 - DNA, 27 bp, Artificial sequence
  SiRNA target sequence
ctcgtttgtctttattttataagaacc

SEQ ID NO: 94713 - DNA, 27 bp, Artificial sequence
  SiRNA target sequence
tcgtttgtctttattttataagaacct

SEQ ID NO: 94714 - DNA, 27 bp, Artificial sequence
  SiRNA target sequence
cgtttgtctttattttataagaacctg

SEQ ID NO: 94715 - DNA, 27 bp, Artificial sequence
  SiRNA target sequence
gtttgtctttattttataagaacctgt

SEQ ID NO: 94716 - DNA, 27 bp, Artificial sequence
  SiRNA target sequence
tttgtctttattttataagaacctgta

SEQ ID NO: 94717 - DNA, 27 bp, Artificial sequence
  SiRNA target sequence
ttgtctttattttataagaacctgtat

SEQ ID NO: 94718 - DNA, 27 bp, Artificial sequence
  SiRNA target sequence
tgtctttattttataagaacctgtata

SEQ ID NO: 94719 - DNA, 27 bp, Artificial sequence
  SiRNA target sequence
gtctttattttataagaacctgtatag

SEQ ID NO: 94720 - DNA, 27 bp, Artificial sequence
  SiRNA target sequence
tctttattttataagaacctgtatagt

SEQ ID NO: 94721 - DNA, 27 bp, Artificial sequence
  SiRNA target sequence
ctttattttataagaacctgtatagtt

SEQ ID NO: 94722 - DNA, 27 bp, Artificial sequence
  SiRNA target sequence
tttattttataagaacctgtatagttg

SEQ ID NO: 94723 - DNA, 27 bp, Artificial sequence
  SiRNA target sequence
ttattttataagaacctgtatagttgg

SEQ ID NO: 94724 - DNA, 27 bp, Artificial sequence
  SiRNA target sequence
tattttataagaacctgtatagttggt

SEQ ID NO: 94725 - DNA, 27 bp, Artificial sequence
  SiRNA target sequence
attttataagaacctgtatagttggtc

SEQ ID NO: 94726 - DNA, 27 bp, Artificial sequence
  SiRNA target sequence
ttttataagaacctgtatagttggtct

SEQ ID NO: 94727 - DNA, 27 bp, Artificial sequence
  SiRNA target sequence
tttataagaacctgtatagttggtctt

SEQ ID NO: 94728 - DNA, 27 bp, Artificial sequence
  SiRNA target sequence
ttataagaacctgtatagttggtcttt

SEQ ID NO: 94729 - DNA, 27 bp, Artificial sequence
  SiRNA target sequence
tataagaacctgtatagttggtctttt

SEQ ID NO: 94730 - DNA, 27 bp, Artificial sequence
  SiRNA target sequence
ataagaacctgtatagttggtcttttt

SEQ ID NO: 94731 - DNA, 27 bp, Artificial sequence
  SiRNA target sequence
taagaacctgtatagttggtcttttta

SEQ ID NO: 94732 - DNA, 27 bp, Artificial sequence
  SiRNA target sequence
aagaacctgtatagttggtctttttaa

SEQ ID NO: 94733 - DNA, 27 bp, Artificial sequence
  SiRNA target sequence
agaacctgtatagttggtctttttaat

SEQ ID NO: 94734 - DNA, 27 bp, Artificial sequence
  SiRNA target sequence
gaacctgtatagttggtctttttaatt

SEQ ID NO: 94735 - DNA, 27 bp, Artificial sequence
  SiRNA target sequence
aacctgtatagttggtctttttaatta

SEQ ID NO: 94736 - DNA, 27 bp, Artificial sequence
  SiRNA target sequence
acctgtatagttggtctttttaattat

SEQ ID NO: 94737 - DNA, 27 bp, Artificial sequence
  SiRNA target sequence
cctgtatagttggtctttttaattata

SEQ ID NO: 94738 - DNA, 27 bp, Artificial sequence
  SiRNA target sequence
ctgtatagttggtctttttaattataa

SEQ ID NO: 94739 - DNA, 27 bp, Artificial sequence
  SiRNA target sequence
tgtatagttggtctttttaattataag

SEQ ID NO: 94740 - DNA, 27 bp, Artificial sequence
  SiRNA target sequence
gtatagttggtctttttaattataagc

SEQ ID NO: 94741 - DNA, 27 bp, Artificial sequence
  SiRNA target sequence
tatagttggtctttttaattataagct

SEQ ID NO: 94742 - DNA, 27 bp, Artificial sequence
  SiRNA target sequence
atagttggtctttttaattataagctt

SEQ ID NO: 94743 - DNA, 27 bp, Artificial sequence
  SiRNA target sequence
tagttggtctttttaattataagctta

SEQ ID NO: 94744 - DNA, 27 bp, Artificial sequence
  SiRNA target sequence
agttggtctttttaattataagcttat

SEQ ID NO: 94745 - DNA, 27 bp, Artificial sequence
  SiRNA target sequence
gttggtctttttaattataagcttatt

SEQ ID NO: 94746 - DNA, 27 bp, Artificial sequence
  SiRNA target sequence
ttggtctttttaattataagcttattg

SEQ ID NO: 94747 - DNA, 27 bp, Artificial sequence
  SiRNA target sequence
tggtctttttaattataagcttattga

SEQ ID NO: 94748 - DNA, 27 bp, Artificial sequence
  SiRNA target sequence
ggtctttttaattataagcttattgaa

SEQ ID NO: 94749 - DNA, 27 bp, Artificial sequence
  SiRNA target sequence
gtctttttaattataagcttattgaaa

SEQ ID NO: 94750 - DNA, 27 bp, Artificial sequence
  SiRNA target sequence
tctttttaattataagcttattgaaat

SEQ ID NO: 94751 - DNA, 27 bp, Artificial sequence
  SiRNA target sequence
ctttttaattataagcttattgaaatt

SEQ ID NO: 94752 - DNA, 27 bp, Artificial sequence
  SiRNA target sequence
tttttaattataagcttattgaaattt

SEQ ID NO: 94753 - DNA, 27 bp, Artificial sequence
  SiRNA target sequence
ttttaattataagcttattgaaatttc

SEQ ID NO: 94754 - DNA, 27 bp, Artificial sequence
  SiRNA target sequence
tttaattataagcttattgaaatttct

SEQ ID NO: 94755 - DNA, 27 bp, Artificial sequence
  SiRNA target sequence
ttaattataagcttattgaaatttcta

SEQ ID NO: 94756 - DNA, 27 bp, Artificial sequence
  SiRNA target sequence
taattataagcttattgaaatttctaa

SEQ ID NO: 94757 - DNA, 27 bp, Artificial sequence
  SiRNA target sequence
aattataagcttattgaaatttctaat

SEQ ID NO: 94758 - DNA, 27 bp, Artificial sequence
  SiRNA target sequence
attataagcttattgaaatttctaata

SEQ ID NO: 94759 - DNA, 27 bp, Artificial sequence
  SiRNA target sequence
ttataagcttattgaaatttctaatat

SEQ ID NO: 94760 - DNA, 27 bp, Artificial sequence
  SiRNA target sequence
tataagcttattgaaatttctaatatt

SEQ ID NO: 94761 - DNA, 27 bp, Artificial sequence
  SiRNA target sequence
ataagcttattgaaatttctaatattt

SEQ ID NO: 94762 - DNA, 27 bp, Artificial sequence
  SiRNA target sequence
taagcttattgaaatttctaatattta

SEQ ID NO: 94763 - DNA, 27 bp, Artificial sequence
  SiRNA target sequence
aagcttattgaaatttctaatatttaa

SEQ ID NO: 94764 - DNA, 27 bp, Artificial sequence
  SiRNA target sequence
agcttattgaaatttctaatatttaaa

SEQ ID NO: 94765 - DNA, 27 bp, Artificial sequence
  SiRNA target sequence
gcttattgaaatttctaatatttaaag

SEQ ID NO: 94766 - DNA, 27 bp, Artificial sequence
  SiRNA target sequence
cttattgaaatttctaatatttaaagg

SEQ ID NO: 94767 - DNA, 27 bp, Artificial sequence
  SiRNA target sequence
ttattgaaatttctaatatttaaagga

SEQ ID NO: 94768 - DNA, 27 bp, Artificial sequence
  SiRNA target sequence
tattgaaatttctaatatttaaaggaa

SEQ ID NO: 94769 - DNA, 27 bp, Artificial sequence
  SiRNA target sequence
attgaaatttctaatatttaaaggaac

SEQ ID NO: 94770 - DNA, 27 bp, Artificial sequence
  SiRNA target sequence
ttgaaatttctaatatttaaaggaaca

SEQ ID NO: 94771 - DNA, 27 bp, Artificial sequence
  SiRNA target sequence
tgaaatttctaatatttaaaggaacaa

SEQ ID NO: 94772 - DNA, 27 bp, Artificial sequence
  SiRNA target sequence
gaaatttctaatatttaaaggaacaaa

SEQ ID NO: 94773 - DNA, 27 bp, Artificial sequence
  SiRNA target sequence
aaatttctaatatttaaaggaacaaaa

SEQ ID NO: 94774 - DNA, 27 bp, Artificial sequence
  SiRNA target sequence
aatttctaatatttaaaggaacaaaat

SEQ ID NO: 94775 - DNA, 27 bp, Artificial sequence
  SiRNA target sequence
atttctaatatttaaaggaacaaaatc

SEQ ID NO: 94776 - DNA, 27 bp, Artificial sequence
  SiRNA target sequence
tttctaatatttaaaggaacaaaatct

SEQ ID NO: 94777 - DNA, 27 bp, Artificial sequence
  SiRNA target sequence
ttctaatatttaaaggaacaaaatcta

SEQ ID NO: 94778 - DNA, 27 bp, Artificial sequence
  SiRNA target sequence
tctaatatttaaaggaacaaaatctac

SEQ ID NO: 94779 - DNA, 27 bp, Artificial sequence
  SiRNA target sequence
ctaatatttaaaggaacaaaatctaca

SEQ ID NO: 94780 - DNA, 27 bp, Artificial sequence
  SiRNA target sequence
taatatttaaaggaacaaaatctacat

SEQ ID NO: 94781 - DNA, 27 bp, Artificial sequence
  SiRNA target sequence
aatatttaaaggaacaaaatctacatt

SEQ ID NO: 94782 - DNA, 27 bp, Artificial sequence
  SiRNA target sequence
atatttaaaggaacaaaatctacattt

SEQ ID NO: 94783 - DNA, 27 bp, Artificial sequence
  SiRNA target sequence
tatttaaaggaacaaaatctacattta

SEQ ID NO: 94784 - DNA, 27 bp, Artificial sequence
  SiRNA target sequence
atttaaaggaacaaaatctacatttag

SEQ ID NO: 94785 - DNA, 27 bp, Artificial sequence
  SiRNA target sequence
tttaaaggaacaaaatctacatttaga

SEQ ID NO: 94786 - DNA, 27 bp, Artificial sequence
  SiRNA target sequence
ttaaaggaacaaaatctacatttagat

SEQ ID NO: 94787 - DNA, 27 bp, Artificial sequence
  SiRNA target sequence
taaaggaacaaaatctacatttagatt

SEQ ID NO: 94788 - DNA, 27 bp, Artificial sequence
  SiRNA target sequence
aaaggaacaaaatctacatttagatta

SEQ ID NO: 94789 - DNA, 27 bp, Artificial sequence
  SiRNA target sequence
aaggaacaaaatctacatttagattat

SEQ ID NO: 94790 - DNA, 27 bp, Artificial sequence
  SiRNA target sequence
aggaacaaaatctacatttagattata

SEQ ID NO: 94791 - DNA, 27 bp, Artificial sequence
  SiRNA target sequence
ggaacaaaatctacatttagattatat

SEQ ID NO: 94792 - DNA, 27 bp, Artificial sequence
  SiRNA target sequence
gaacaaaatctacatttagattatatt

SEQ ID NO: 94793 - DNA, 27 bp, Artificial sequence
  SiRNA target sequence
aacaaaatctacatttagattatattc

SEQ ID NO: 94794 - DNA, 27 bp, Artificial sequence
  SiRNA target sequence
acaaaatctacatttagattatattct

SEQ ID NO: 94795 - DNA, 27 bp, Artificial sequence
  SiRNA target sequence
caaaatctacatttagattatattcta

SEQ ID NO: 94796 - DNA, 27 bp, Artificial sequence
  SiRNA target sequence
aaaatctacatttagattatattctaa

SEQ ID NO: 94797 - DNA, 27 bp, Artificial sequence
  SiRNA target sequence
aaatctacatttagattatattctaat

SEQ ID NO: 94798 - DNA, 27 bp, Artificial sequence
  SiRNA target sequence
aatctacatttagattatattctaatt

SEQ ID NO: 94799 - DNA, 27 bp, Artificial sequence
  SiRNA target sequence
atctacatttagattatattctaattt

SEQ ID NO: 94800 - DNA, 27 bp, Artificial sequence
  SiRNA target sequence
tctacatttagattatattctaattta

SEQ ID NO: 94801 - DNA, 27 bp, Artificial sequence
  SiRNA target sequence
ctacatttagattatattctaatttat

SEQ ID NO: 94802 - DNA, 27 bp, Artificial sequence
  SiRNA target sequence
tacatttagattatattctaatttatt

SEQ ID NO: 94803 - DNA, 27 bp, Artificial sequence
  SiRNA target sequence
acatttagattatattctaatttattg

SEQ ID NO: 94804 - DNA, 27 bp, Artificial sequence
  SiRNA target sequence
catttagattatattctaatttattga

SEQ ID NO: 94805 - DNA, 27 bp, Artificial sequence
  SiRNA target sequence
atttagattatattctaatttattgaa

SEQ ID NO: 94806 - DNA, 27 bp, Artificial sequence
  SiRNA target sequence
tttagattatattctaatttattgaat

SEQ ID NO: 94807 - DNA, 27 bp, Artificial sequence
  SiRNA target sequence
ttagattatattctaatttattgaatt

SEQ ID NO: 94808 - DNA, 27 bp, Artificial sequence
  SiRNA target sequence
tagattatattctaatttattgaattt

SEQ ID NO: 94809 - DNA, 27 bp, Artificial sequence
  SiRNA target sequence
agattatattctaatttattgaatttc

SEQ ID NO: 94810 - DNA, 27 bp, Artificial sequence
  SiRNA target sequence
gattatattctaatttattgaatttca

SEQ ID NO: 94811 - DNA, 27 bp, Artificial sequence
  SiRNA target sequence
attatattctaatttattgaatttcat

SEQ ID NO: 94812 - DNA, 19 bp, Artificial sequence
  SiRNA target sequence
ttaccaagtttctgcctga

SEQ ID NO: 94813 - DNA, 19 bp, Artificial sequence
  SiRNA target sequence
taccaagtttctgcctgaa

SEQ ID NO: 94814 - DNA, 19 bp, Artificial sequence
  SiRNA target sequence
accaagtttctgcctgaaa

SEQ ID NO: 94815 - DNA, 19 bp, Artificial sequence
  SiRNA target sequence
ccaagtttctgcctgaaaa

SEQ ID NO: 94816 - DNA, 19 bp, Artificial sequence
  SiRNA target sequence
caagtttctgcctgaaaat

SEQ ID NO: 94817 - DNA, 19 bp, Artificial sequence
  SiRNA target sequence
aagtttctgcctgaaaata

SEQ ID NO: 94818 - DNA, 19 bp, Artificial sequence
  SiRNA target sequence
agtttctgcctgaaaatat

SEQ ID NO: 94819 - DNA, 19 bp, Artificial sequence
  SiRNA target sequence
gtttctgcctgaaaatata

SEQ ID NO: 94820 - DNA, 19 bp, Artificial sequence
  SiRNA target sequence
tttctgcctgaaaatatat

SEQ ID NO: 94821 - DNA, 19 bp, Artificial sequence
  SiRNA target sequence
ttctgcctgaaaatatatt

SEQ ID NO: 94822 - DNA, 19 bp, Artificial sequence
  SiRNA target sequence
tctgcctgaaaatatattt

SEQ ID NO: 94823 - DNA, 19 bp, Artificial sequence
  SiRNA target sequence
ctgcctgaaaatatatttt

SEQ ID NO: 94824 - DNA, 19 bp, Artificial sequence
  SiRNA target sequence
tgcctgaaaatatattttc

SEQ ID NO: 94825 - DNA, 19 bp, Artificial sequence
  SiRNA target sequence
gcctgaaaatatattttct

SEQ ID NO: 94826 - DNA, 19 bp, Artificial sequence
  SiRNA target sequence
cctgaaaatatattttctt

SEQ ID NO: 94827 - DNA, 19 bp, Artificial sequence
  SiRNA target sequence
ctgaaaatatattttcttt

SEQ ID NO: 94828 - DNA, 19 bp, Artificial sequence
  SiRNA target sequence
tgaaaatatattttctttt

SEQ ID NO: 94829 - DNA, 19 bp, Artificial sequence
  SiRNA target sequence
gaaaatatattttcttttt

SEQ ID NO: 94830 - DNA, 19 bp, Artificial sequence
  SiRNA target sequence
aaaatatattttcttttta

SEQ ID NO: 94831 - DNA, 19 bp, Artificial sequence
  SiRNA target sequence
aaatatattttctttttat

SEQ ID NO: 94832 - DNA, 19 bp, Artificial sequence
  SiRNA target sequence
aatatattttctttttata

SEQ ID NO: 94833 - DNA, 19 bp, Artificial sequence
  SiRNA target sequence
atatattttctttttataa

SEQ ID NO: 94834 - DNA, 19 bp, Artificial sequence
  SiRNA target sequence
tatattttctttttataaa

SEQ ID NO: 94835 - DNA, 19 bp, Artificial sequence
  SiRNA target sequence
atattttctttttataaat

SEQ ID NO: 94836 - DNA, 19 bp, Artificial sequence
  SiRNA target sequence
tattttctttttataaata

SEQ ID NO: 94837 - DNA, 19 bp, Artificial sequence
  SiRNA target sequence
attttctttttataaatat

SEQ ID NO: 94838 - DNA, 19 bp, Artificial sequence
  SiRNA target sequence
ttttctttttataaatatc

SEQ ID NO: 94839 - DNA, 19 bp, Artificial sequence
  SiRNA target sequence
tttctttttataaatatct

SEQ ID NO: 94840 - DNA, 19 bp, Artificial sequence
  SiRNA target sequence
ttctttttataaatatcta

SEQ ID NO: 94841 - DNA, 19 bp, Artificial sequence
  SiRNA target sequence
tctttttataaatatctaa

SEQ ID NO: 94842 - DNA, 19 bp, Artificial sequence
  SiRNA target sequence
ctttttataaatatctaat

SEQ ID NO: 94843 - DNA, 19 bp, Artificial sequence
  SiRNA target sequence
tttttataaatatctaata

SEQ ID NO: 94844 - DNA, 19 bp, Artificial sequence
  SiRNA target sequence
ttttataaatatctaataa

SEQ ID NO: 94845 - DNA, 19 bp, Artificial sequence
  SiRNA target sequence
tttataaatatctaataac

SEQ ID NO: 94846 - DNA, 19 bp, Artificial sequence
  SiRNA target sequence
ttataaatatctaataaca

SEQ ID NO: 94847 - DNA, 19 bp, Artificial sequence
  SiRNA target sequence
tataaatatctaataacat

SEQ ID NO: 94848 - DNA, 19 bp, Artificial sequence
  SiRNA target sequence
ataaatatctaataacatt

SEQ ID NO: 94849 - DNA, 19 bp, Artificial sequence
  SiRNA target sequence
taaatatctaataacattt

SEQ ID NO: 94850 - DNA, 19 bp, Artificial sequence
  SiRNA target sequence
aaatatctaataacatttt

SEQ ID NO: 94851 - DNA, 19 bp, Artificial sequence
  SiRNA target sequence
aatatctaataacattttt

SEQ ID NO: 94852 - DNA, 19 bp, Artificial sequence
  SiRNA target sequence
atatctaataacatttttt

SEQ ID NO: 94853 - DNA, 19 bp, Artificial sequence
  SiRNA target sequence
tatctaataacattttttc

SEQ ID NO: 94854 - DNA, 19 bp, Artificial sequence
  SiRNA target sequence
atctaataacattttttca

SEQ ID NO: 94855 - DNA, 19 bp, Artificial sequence
  SiRNA target sequence
tctaataacattttttcaa

SEQ ID NO: 94856 - DNA, 19 bp, Artificial sequence
  SiRNA target sequence
ctaataacattttttcaat

SEQ ID NO: 94857 - DNA, 19 bp, Artificial sequence
  SiRNA target sequence
taataacattttttcaata

SEQ ID NO: 94858 - DNA, 19 bp, Artificial sequence
  SiRNA target sequence
aataacattttttcaataa

SEQ ID NO: 94859 - DNA, 19 bp, Artificial sequence
  SiRNA target sequence
ataacattttttcaataat

SEQ ID NO: 94860 - DNA, 19 bp, Artificial sequence
  SiRNA target sequence
taacattttttcaataata

SEQ ID NO: 94861 - DNA, 19 bp, Artificial sequence
  SiRNA target sequence
aacattttttcaataatat

SEQ ID NO: 94862 - DNA, 19 bp, Artificial sequence
  SiRNA target sequence
acattttttcaataatatt

SEQ ID NO: 94863 - DNA, 19 bp, Artificial sequence
  SiRNA target sequence
cattttttcaataatatta

SEQ ID NO: 94864 - DNA, 19 bp, Artificial sequence
  SiRNA target sequence
attttttcaataatattat

SEQ ID NO: 94865 - DNA, 19 bp, Artificial sequence
  SiRNA target sequence
ttttttcaataatattatt

SEQ ID NO: 94866 - DNA, 19 bp, Artificial sequence
  SiRNA target sequence
tttttcaataatattatta

SEQ ID NO: 94867 - DNA, 19 bp, Artificial sequence
  SiRNA target sequence
ttttcaataatattattaa

SEQ ID NO: 94868 - DNA, 19 bp, Artificial sequence
  SiRNA target sequence
tttcaataatattattaag

SEQ ID NO: 94869 - DNA, 19 bp, Artificial sequence
  SiRNA target sequence
ttcaataatattattaagt

SEQ ID NO: 94870 - DNA, 19 bp, Artificial sequence
  SiRNA target sequence
tcaataatattattaagtc

SEQ ID NO: 94871 - DNA, 19 bp, Artificial sequence
  SiRNA target sequence
caataatattattaagtct

SEQ ID NO: 94872 - DNA, 19 bp, Artificial sequence
  SiRNA target sequence
aataatattattaagtcta

SEQ ID NO: 94873 - DNA, 19 bp, Artificial sequence
  SiRNA target sequence
ataatattattaagtctag

SEQ ID NO: 94874 - DNA, 19 bp, Artificial sequence
  SiRNA target sequence
taatattattaagtctaga

SEQ ID NO: 94875 - DNA, 19 bp, Artificial sequence
  SiRNA target sequence
aatattattaagtctagaa

SEQ ID NO: 94876 - DNA, 19 bp, Artificial sequence
  SiRNA target sequence
atattattaagtctagaat

SEQ ID NO: 94877 - DNA, 19 bp, Artificial sequence
  SiRNA target sequence
tattattaagtctagaatt

SEQ ID NO: 94878 - DNA, 19 bp, Artificial sequence
  SiRNA target sequence
attattaagtctagaattt

SEQ ID NO: 94879 - DNA, 19 bp, Artificial sequence
  SiRNA target sequence
ttattaagtctagaatttc

SEQ ID NO: 94880 - DNA, 19 bp, Artificial sequence
  SiRNA target sequence
tattaagtctagaatttcc

SEQ ID NO: 94881 - DNA, 19 bp, Artificial sequence
  SiRNA target sequence
attaagtctagaatttcca

SEQ ID NO: 94882 - DNA, 19 bp, Artificial sequence
  SiRNA target sequence
ttaagtctagaatttccac

SEQ ID NO: 94883 - DNA, 19 bp, Artificial sequence
  SiRNA target sequence
taagtctagaatttccact

SEQ ID NO: 94884 - DNA, 19 bp, Artificial sequence
  SiRNA target sequence
aagtctagaatttccactt

SEQ ID NO: 94885 - DNA, 19 bp, Artificial sequence
  SiRNA target sequence
agtctagaatttccactta

SEQ ID NO: 94886 - DNA, 19 bp, Artificial sequence
  SiRNA target sequence
gtctagaatttccacttac

SEQ ID NO: 94887 - DNA, 19 bp, Artificial sequence
  SiRNA target sequence
tctagaatttccacttaca

SEQ ID NO: 94888 - DNA, 19 bp, Artificial sequence
  SiRNA target sequence
ctagaatttccacttacaa

SEQ ID NO: 94889 - DNA, 19 bp, Artificial sequence
  SiRNA target sequence
tagaatttccacttacaaa

SEQ ID NO: 94890 - DNA, 19 bp, Artificial sequence
  SiRNA target sequence
agaatttccacttacaaat

SEQ ID NO: 94891 - DNA, 19 bp, Artificial sequence
  SiRNA target sequence
gaatttccacttacaaata

SEQ ID NO: 94892 - DNA, 19 bp, Artificial sequence
  SiRNA target sequence
aatttccacttacaaatat

SEQ ID NO: 94893 - DNA, 19 bp, Artificial sequence
  SiRNA target sequence
atttccacttacaaatatt

SEQ ID NO: 94894 - DNA, 19 bp, Artificial sequence
  SiRNA target sequence
tttccacttacaaatatta

SEQ ID NO: 94895 - DNA, 19 bp, Artificial sequence
  SiRNA target sequence
ttccacttacaaatattaa

SEQ ID NO: 94896 - DNA, 19 bp, Artificial sequence
  SiRNA target sequence
tccacttacaaatattaac

SEQ ID NO: 94897 - DNA, 19 bp, Artificial sequence
  SiRNA target sequence
ccacttacaaatattaacc

SEQ ID NO: 94898 - DNA, 19 bp, Artificial sequence
  SiRNA target sequence
cacttacaaatattaacca

SEQ ID NO: 94899 - DNA, 19 bp, Artificial sequence
  SiRNA target sequence
acttacaaatattaaccaa

SEQ ID NO: 94900 - DNA, 19 bp, Artificial sequence
  SiRNA target sequence
cttacaaatattaaccaat

SEQ ID NO: 94901 - DNA, 19 bp, Artificial sequence
  SiRNA target sequence
ttacaaatattaaccaatc

SEQ ID NO: 94902 - DNA, 19 bp, Artificial sequence
  SiRNA target sequence
tacaaatattaaccaatca

SEQ ID NO: 94903 - DNA, 19 bp, Artificial sequence
  SiRNA target sequence
acaaatattaaccaatcat

SEQ ID NO: 94904 - DNA, 19 bp, Artificial sequence
  SiRNA target sequence
caaatattaaccaatcatc

SEQ ID NO: 94905 - DNA, 19 bp, Artificial sequence
  SiRNA target sequence
aaatattaaccaatcatca

SEQ ID NO: 94906 - DNA, 19 bp, Artificial sequence
  SiRNA target sequence
aatattaaccaatcatcaa

SEQ ID NO: 94907 - DNA, 19 bp, Artificial sequence
  SiRNA target sequence
atattaaccaatcatcaat

SEQ ID NO: 94908 - DNA, 19 bp, Artificial sequence
  SiRNA target sequence
tattaaccaatcatcaata

SEQ ID NO: 94909 - DNA, 19 bp, Artificial sequence
  SiRNA target sequence
attaaccaatcatcaatat

SEQ ID NO: 94910 - DNA, 19 bp, Artificial sequence
  SiRNA target sequence
ttaaccaatcatcaatatt

SEQ ID NO: 94911 - DNA, 19 bp, Artificial sequence
  SiRNA target sequence
taaccaatcatcaatattt

SEQ ID NO: 94912 - DNA, 19 bp, Artificial sequence
  SiRNA target sequence
aaccaatcatcaatatttt

SEQ ID NO: 94913 - DNA, 19 bp, Artificial sequence
  SiRNA target sequence
accaatcatcaatattttc

SEQ ID NO: 94914 - DNA, 19 bp, Artificial sequence
  SiRNA target sequence
ccaatcatcaatattttct

SEQ ID NO: 94915 - DNA, 19 bp, Artificial sequence
  SiRNA target sequence
caatcatcaatattttcta

SEQ ID NO: 94916 - DNA, 19 bp, Artificial sequence
  SiRNA target sequence
aatcatcaatattttctag

SEQ ID NO: 94917 - DNA, 19 bp, Artificial sequence
  SiRNA target sequence
atcatcaatattttctagc

SEQ ID NO: 94918 - DNA, 19 bp, Artificial sequence
  SiRNA target sequence
tcatcaatattttctagcc

SEQ ID NO: 94919 - DNA, 19 bp, Artificial sequence
  SiRNA target sequence
catcaatattttctagccc

SEQ ID NO: 94920 - DNA, 19 bp, Artificial sequence
  SiRNA target sequence
atcaatattttctagccct

SEQ ID NO: 94921 - DNA, 19 bp, Artificial sequence
  SiRNA target sequence
tcaatattttctagccctt

SEQ ID NO: 94922 - DNA, 19 bp, Artificial sequence
  SiRNA target sequence
caatattttctagcccttt

SEQ ID NO: 94923 - DNA, 19 bp, Artificial sequence
  SiRNA target sequence
aatattttctagccctttt

SEQ ID NO: 94924 - DNA, 19 bp, Artificial sequence
  SiRNA target sequence
atattttctagccctttta

SEQ ID NO: 94925 - DNA, 19 bp, Artificial sequence
  SiRNA target sequence
tattttctagcccttttat

SEQ ID NO: 94926 - DNA, 19 bp, Artificial sequence
  SiRNA target sequence
attttctagcccttttata

SEQ ID NO: 94927 - DNA, 19 bp, Artificial sequence
  SiRNA target sequence
ttttctagcccttttatag

SEQ ID NO: 94928 - DNA, 19 bp, Artificial sequence
  SiRNA target sequence
tttctagcccttttatagt

SEQ ID NO: 94929 - DNA, 19 bp, Artificial sequence
  SiRNA target sequence
ttctagcccttttatagtc

SEQ ID NO: 94930 - DNA, 19 bp, Artificial sequence
  SiRNA target sequence
tctagcccttttatagtct

SEQ ID NO: 94931 - DNA, 19 bp, Artificial sequence
  SiRNA target sequence
ctagcccttttatagtctt

SEQ ID NO: 94932 - DNA, 19 bp, Artificial sequence
  SiRNA target sequence
tagcccttttatagtctta

SEQ ID NO: 94933 - DNA, 19 bp, Artificial sequence
  SiRNA target sequence
agcccttttatagtcttat

SEQ ID NO: 94934 - DNA, 19 bp, Artificial sequence
  SiRNA target sequence
gcccttttatagtcttata

SEQ ID NO: 94935 - DNA, 19 bp, Artificial sequence
  SiRNA target sequence
cccttttatagtcttataa

SEQ ID NO: 94936 - DNA, 19 bp, Artificial sequence
  SiRNA target sequence
ccttttatagtcttataaa

SEQ ID NO: 94937 - DNA, 19 bp, Artificial sequence
  SiRNA target sequence
cttttatagtcttataaat

SEQ ID NO: 94938 - DNA, 19 bp, Artificial sequence
  SiRNA target sequence
ttttatagtcttataaata

SEQ ID NO: 94939 - DNA, 19 bp, Artificial sequence
  SiRNA target sequence
tttatagtcttataaatat

SEQ ID NO: 94940 - DNA, 19 bp, Artificial sequence
  SiRNA target sequence
ttatagtcttataaatatc

SEQ ID NO: 94941 - DNA, 19 bp, Artificial sequence
  SiRNA target sequence
tatagtcttataaatatct

SEQ ID NO: 94942 - DNA, 19 bp, Artificial sequence
  SiRNA target sequence
atagtcttataaatatctt

SEQ ID NO: 94943 - DNA, 19 bp, Artificial sequence
  SiRNA target sequence
tagtcttataaatatcttg

SEQ ID NO: 94944 - DNA, 19 bp, Artificial sequence
  SiRNA target sequence
agtcttataaatatcttgt

SEQ ID NO: 94945 - DNA, 19 bp, Artificial sequence
  SiRNA target sequence
gtcttataaatatcttgta

SEQ ID NO: 94946 - DNA, 19 bp, Artificial sequence
  SiRNA target sequence
tcttataaatatcttgtat

SEQ ID NO: 94947 - DNA, 19 bp, Artificial sequence
  SiRNA target sequence
cttataaatatcttgtatg

SEQ ID NO: 94948 - DNA, 19 bp, Artificial sequence
  SiRNA target sequence
ttataaatatcttgtatgt

SEQ ID NO: 94949 - DNA, 19 bp, Artificial sequence
  SiRNA target sequence
tataaatatcttgtatgta

SEQ ID NO: 94950 - DNA, 19 bp, Artificial sequence
  SiRNA target sequence
ataaatatcttgtatgtat

SEQ ID NO: 94951 - DNA, 19 bp, Artificial sequence
  SiRNA target sequence
taaatatcttgtatgtatt

SEQ ID NO: 94952 - DNA, 19 bp, Artificial sequence
  SiRNA target sequence
aaatatcttgtatgtattt

SEQ ID NO: 94953 - DNA, 19 bp, Artificial sequence
  SiRNA target sequence
aatatcttgtatgtattta

SEQ ID NO: 94954 - DNA, 19 bp, Artificial sequence
  SiRNA target sequence
atatcttgtatgtatttat

SEQ ID NO: 94955 - DNA, 19 bp, Artificial sequence
  SiRNA target sequence
tatcttgtatgtatttatt

SEQ ID NO: 94956 - DNA, 19 bp, Artificial sequence
  SiRNA target sequence
atcttgtatgtatttatta

SEQ ID NO: 94957 - DNA, 19 bp, Artificial sequence
  SiRNA target sequence
tcttgtatgtatttattat

SEQ ID NO: 94958 - DNA, 19 bp, Artificial sequence
  SiRNA target sequence
cttgtatgtatttattatc

SEQ ID NO: 94959 - DNA, 19 bp, Artificial sequence
  SiRNA target sequence
ttgtatgtatttattatct

SEQ ID NO: 94960 - DNA, 19 bp, Artificial sequence
  SiRNA target sequence
tgtatgtatttattatctt

SEQ ID NO: 94961 - DNA, 19 bp, Artificial sequence
  SiRNA target sequence
gtatgtatttattatcttc

SEQ ID NO: 94962 - DNA, 19 bp, Artificial sequence
  SiRNA target sequence
tatgtatttattatcttcc

SEQ ID NO: 94963 - DNA, 19 bp, Artificial sequence
  SiRNA target sequence
atgtatttattatcttccc

SEQ ID NO: 94964 - DNA, 19 bp, Artificial sequence
  SiRNA target sequence
tgtatttattatcttccct

SEQ ID NO: 94965 - DNA, 19 bp, Artificial sequence
  SiRNA target sequence
gtatttattatcttccctt

SEQ ID NO: 94966 - DNA, 19 bp, Artificial sequence
  SiRNA target sequence
tatttattatcttcccttg

SEQ ID NO: 94967 - DNA, 19 bp, Artificial sequence
  SiRNA target sequence
atttattatcttcccttga

SEQ ID NO: 94968 - DNA, 19 bp, Artificial sequence
  SiRNA target sequence
tttattatcttcccttgaa

SEQ ID NO: 94969 - DNA, 19 bp, Artificial sequence
  SiRNA target sequence
ttattatcttcccttgaaa

SEQ ID NO: 94970 - DNA, 19 bp, Artificial sequence
  SiRNA target sequence
tattatcttcccttgaaac

SEQ ID NO: 94971 - DNA, 19 bp, Artificial sequence
  SiRNA target sequence
attatcttcccttgaaaca

SEQ ID NO: 94972 - DNA, 19 bp, Artificial sequence
  SiRNA target sequence
ttatcttcccttgaaacag

SEQ ID NO: 94973 - DNA, 19 bp, Artificial sequence
  SiRNA target sequence
tatcttcccttgaaacagc

SEQ ID NO: 94974 - DNA, 19 bp, Artificial sequence
  SiRNA target sequence
atcttcccttgaaacagcg

SEQ ID NO: 94975 - DNA, 19 bp, Artificial sequence
  SiRNA target sequence
tcttcccttgaaacagcgg

SEQ ID NO: 94976 - DNA, 19 bp, Artificial sequence
  SiRNA target sequence
cttcccttgaaacagcggg

SEQ ID NO: 94977 - DNA, 19 bp, Artificial sequence
  SiRNA target sequence
ttcccttgaaacagcgggg

SEQ ID NO: 94978 - DNA, 19 bp, Artificial sequence
  SiRNA target sequence
tcccttgaaacagcggggt

SEQ ID NO: 94979 - DNA, 19 bp, Artificial sequence
  SiRNA target sequence
cccttgaaacagcggggta

SEQ ID NO: 94980 - DNA, 19 bp, Artificial sequence
  SiRNA target sequence
ccttgaaacagcggggtaa

SEQ ID NO: 94981 - DNA, 19 bp, Artificial sequence
  SiRNA target sequence
cttgaaacagcggggtaaa

SEQ ID NO: 94982 - DNA, 19 bp, Artificial sequence
  SiRNA target sequence
ttgaaacagcggggtaaat

SEQ ID NO: 94983 - DNA, 19 bp, Artificial sequence
  SiRNA target sequence
tgaaacagcggggtaaatt

SEQ ID NO: 94984 - DNA, 19 bp, Artificial sequence
  SiRNA target sequence
gaaacagcggggtaaattt

SEQ ID NO: 94985 - DNA, 19 bp, Artificial sequence
  SiRNA target sequence
aaacagcggggtaaatttc

SEQ ID NO: 94986 - DNA, 19 bp, Artificial sequence
  SiRNA target sequence
aacagcggggtaaatttca

SEQ ID NO: 94987 - DNA, 19 bp, Artificial sequence
  SiRNA target sequence
acagcggggtaaatttcaa

SEQ ID NO: 94988 - DNA, 19 bp, Artificial sequence
  SiRNA target sequence
cagcggggtaaatttcaat

SEQ ID NO: 94989 - DNA, 19 bp, Artificial sequence
  SiRNA target sequence
agcggggtaaatttcaatg

SEQ ID NO: 94990 - DNA, 19 bp, Artificial sequence
  SiRNA target sequence
gcggggtaaatttcaatgc

SEQ ID NO: 94991 - DNA, 19 bp, Artificial sequence
  SiRNA target sequence
cggggtaaatttcaatgcc

SEQ ID NO: 94992 - DNA, 19 bp, Artificial sequence
  SiRNA target sequence
ggggtaaatttcaatgcct

SEQ ID NO: 94993 - DNA, 19 bp, Artificial sequence
  SiRNA target sequence
gggtaaatttcaatgcctt

SEQ ID NO: 94994 - DNA, 19 bp, Artificial sequence
  SiRNA target sequence
ggtaaatttcaatgccttt

SEQ ID NO: 94995 - DNA, 19 bp, Artificial sequence
  SiRNA target sequence
gtaaatttcaatgccttta

SEQ ID NO: 94996 - DNA, 19 bp, Artificial sequence
  SiRNA target sequence
taaatttcaatgcctttat

SEQ ID NO: 94997 - DNA, 19 bp, Artificial sequence
  SiRNA target sequence
aaatttcaatgcctttatt

SEQ ID NO: 94998 - DNA, 19 bp, Artificial sequence
  SiRNA target sequence
aatttcaatgcctttattt

SEQ ID NO: 94999 - DNA, 19 bp, Artificial sequence
  SiRNA target sequence
atttcaatgcctttatttt

SEQ ID NO: 95000 - DNA, 19 bp, Artificial sequence
  SiRNA target sequence
tttcaatgcctttattttc

SEQ ID NO: 95001 - DNA, 19 bp, Artificial sequence
  SiRNA target sequence
ttcaatgcctttattttca

SEQ ID NO: 95002 - DNA, 19 bp, Artificial sequence
  SiRNA target sequence
tcaatgcctttattttcaa

SEQ ID NO: 95003 - DNA, 19 bp, Artificial sequence
  SiRNA target sequence
caatgcctttattttcaaa

SEQ ID NO: 95004 - DNA, 19 bp, Artificial sequence
  SiRNA target sequence
aatgcctttattttcaaac

SEQ ID NO: 95005 - DNA, 19 bp, Artificial sequence
  SiRNA target sequence
atgcctttattttcaaact

SEQ ID NO: 95006 - DNA, 19 bp, Artificial sequence
  SiRNA target sequence
tgcctttattttcaaactc

SEQ ID NO: 95007 - DNA, 19 bp, Artificial sequence
  SiRNA target sequence
gcctttattttcaaactct

SEQ ID NO: 95008 - DNA, 19 bp, Artificial sequence
  SiRNA target sequence
cctttattttcaaactctt

SEQ ID NO: 95009 - DNA, 19 bp, Artificial sequence
  SiRNA target sequence
ctttattttcaaactcttc

SEQ ID NO: 95010 - DNA, 19 bp, Artificial sequence
  SiRNA target sequence
tttattttcaaactcttct

SEQ ID NO: 95011 - DNA, 19 bp, Artificial sequence
  SiRNA target sequence
ttattttcaaactcttctt

SEQ ID NO: 95012 - DNA, 19 bp, Artificial sequence
  SiRNA target sequence
tattttcaaactcttcttt

SEQ ID NO: 95013 - DNA, 19 bp, Artificial sequence
  SiRNA target sequence
attttcaaactcttcttta

SEQ ID NO: 95014 - DNA, 19 bp, Artificial sequence
  SiRNA target sequence
ttttcaaactcttctttat

SEQ ID NO: 95015 - DNA, 19 bp, Artificial sequence
  SiRNA target sequence
tttcaaactcttctttata

SEQ ID NO: 95016 - DNA, 19 bp, Artificial sequence
  SiRNA target sequence
ttcaaactcttctttatat

SEQ ID NO: 95017 - DNA, 19 bp, Artificial sequence
  SiRNA target sequence
tcaaactcttctttatata

SEQ ID NO: 95018 - DNA, 19 bp, Artificial sequence
  SiRNA target sequence
caaactcttctttatataa

SEQ ID NO: 95019 - DNA, 19 bp, Artificial sequence
  SiRNA target sequence
aaactcttctttatataaa

SEQ ID NO: 95020 - DNA, 19 bp, Artificial sequence
  SiRNA target sequence
aactcttctttatataaaa

SEQ ID NO: 95021 - DNA, 19 bp, Artificial sequence
  SiRNA target sequence
actcttctttatataaaaa

SEQ ID NO: 95022 - DNA, 19 bp, Artificial sequence
  SiRNA target sequence
ctcttctttatataaaaaa

SEQ ID NO: 95023 - DNA, 19 bp, Artificial sequence
  SiRNA target sequence
tcttctttatataaaaaat

SEQ ID NO: 95024 - DNA, 19 bp, Artificial sequence
  SiRNA target sequence
cttctttatataaaaaatc

SEQ ID NO: 95025 - DNA, 19 bp, Artificial sequence
  SiRNA target sequence
ttctttatataaaaaatct

SEQ ID NO: 95026 - DNA, 19 bp, Artificial sequence
  SiRNA target sequence
tctttatataaaaaatcta

SEQ ID NO: 95027 - DNA, 19 bp, Artificial sequence
  SiRNA target sequence
ctttatataaaaaatctac

SEQ ID NO: 95028 - DNA, 19 bp, Artificial sequence
  SiRNA target sequence
tttatataaaaaatctaca

SEQ ID NO: 95029 - DNA, 19 bp, Artificial sequence
  SiRNA target sequence
ttatataaaaaatctacat

SEQ ID NO: 95030 - DNA, 19 bp, Artificial sequence
  SiRNA target sequence
tatataaaaaatctacatc

SEQ ID NO: 95031 - DNA, 19 bp, Artificial sequence
  SiRNA target sequence
atataaaaaatctacatct

SEQ ID NO: 95032 - DNA, 19 bp, Artificial sequence
  SiRNA target sequence
tataaaaaatctacatctc

SEQ ID NO: 95033 - DNA, 19 bp, Artificial sequence
  SiRNA target sequence
ataaaaaatctacatctct

SEQ ID NO: 95034 - DNA, 19 bp, Artificial sequence
  SiRNA target sequence
taaaaaatctacatctcta

SEQ ID NO: 95035 - DNA, 19 bp, Artificial sequence
  SiRNA target sequence
aaaaaatctacatctctaa

SEQ ID NO: 95036 - DNA, 19 bp, Artificial sequence
  SiRNA target sequence
aaaaatctacatctctaaa

SEQ ID NO: 95037 - DNA, 19 bp, Artificial sequence
  SiRNA target sequence
aaaatctacatctctaaat

SEQ ID NO: 95038 - DNA, 19 bp, Artificial sequence
  SiRNA target sequence
aaatctacatctctaaatc

SEQ ID NO: 95039 - DNA, 19 bp, Artificial sequence
  SiRNA target sequence
aatctacatctctaaatct

SEQ ID NO: 95040 - DNA, 19 bp, Artificial sequence
  SiRNA target sequence
atctacatctctaaatcta

SEQ ID NO: 95041 - DNA, 19 bp, Artificial sequence
  SiRNA target sequence
tctacatctctaaatctaa

SEQ ID NO: 95042 - DNA, 19 bp, Artificial sequence
  SiRNA target sequence
ctacatctctaaatctaaa

SEQ ID NO: 95043 - DNA, 19 bp, Artificial sequence
  SiRNA target sequence
tacatctctaaatctaaaa

SEQ ID NO: 95044 - DNA, 19 bp, Artificial sequence
  SiRNA target sequence
acatctctaaatctaaaac

SEQ ID NO: 95045 - DNA, 19 bp, Artificial sequence
  SiRNA target sequence
catctctaaatctaaaacc

SEQ ID NO: 95046 - DNA, 19 bp, Artificial sequence
  SiRNA target sequence
atctctaaatctaaaacca

SEQ ID NO: 95047 - DNA, 19 bp, Artificial sequence
  SiRNA target sequence
tctctaaatctaaaaccat

SEQ ID NO: 95048 - DNA, 19 bp, Artificial sequence
  SiRNA target sequence
ctctaaatctaaaaccata

SEQ ID NO: 95049 - DNA, 19 bp, Artificial sequence
  SiRNA target sequence
tctaaatctaaaaccatat

SEQ ID NO: 95050 - DNA, 19 bp, Artificial sequence
  SiRNA target sequence
ctaaatctaaaaccatata

SEQ ID NO: 95051 - DNA, 19 bp, Artificial sequence
  SiRNA target sequence
taaatctaaaaccatataa

SEQ ID NO: 95052 - DNA, 19 bp, Artificial sequence
  SiRNA target sequence
aaatctaaaaccatataat

SEQ ID NO: 95053 - DNA, 19 bp, Artificial sequence
  SiRNA target sequence
aatctaaaaccatataata

SEQ ID NO: 95054 - DNA, 19 bp, Artificial sequence
  SiRNA target sequence
atctaaaaccatataataa

SEQ ID NO: 95055 - DNA, 19 bp, Artificial sequence
  SiRNA target sequence
tctaaaaccatataataaa

SEQ ID NO: 95056 - DNA, 19 bp, Artificial sequence
  SiRNA target sequence
ctaaaaccatataataaaa

SEQ ID NO: 95057 - DNA, 19 bp, Artificial sequence
  SiRNA target sequence
taaaaccatataataaaat

SEQ ID NO: 95058 - DNA, 19 bp, Artificial sequence
  SiRNA target sequence
aaaaccatataataaaata

SEQ ID NO: 95059 - DNA, 19 bp, Artificial sequence
  SiRNA target sequence
aaaccatataataaaataa

SEQ ID NO: 95060 - DNA, 19 bp, Artificial sequence
  SiRNA target sequence
aaccatataataaaataac

SEQ ID NO: 95061 - DNA, 19 bp, Artificial sequence
  SiRNA target sequence
accatataataaaataact

SEQ ID NO: 95062 - DNA, 19 bp, Artificial sequence
  SiRNA target sequence
ccatataataaaataactt

SEQ ID NO: 95063 - DNA, 19 bp, Artificial sequence
  SiRNA target sequence
catataataaaataacttt

SEQ ID NO: 95064 - DNA, 19 bp, Artificial sequence
  SiRNA target sequence
atataataaaataactttt

SEQ ID NO: 95065 - DNA, 19 bp, Artificial sequence
  SiRNA target sequence
tataataaaataacttttt

SEQ ID NO: 95066 - DNA, 19 bp, Artificial sequence
  SiRNA target sequence
ataataaaataactttttt

SEQ ID NO: 95067 - DNA, 19 bp, Artificial sequence
  SiRNA target sequence
taataaaataactttttta

SEQ ID NO: 95068 - DNA, 19 bp, Artificial sequence
  SiRNA target sequence
aataaaataacttttttaa

SEQ ID NO: 95069 - DNA, 19 bp, Artificial sequence
  SiRNA target sequence
ataaaataacttttttaaa

SEQ ID NO: 95070 - DNA, 19 bp, Artificial sequence
  SiRNA target sequence
taaaataacttttttaaaa

SEQ ID NO: 95071 - DNA, 19 bp, Artificial sequence
  SiRNA target sequence
aaaataacttttttaaaaa

SEQ ID NO: 95072 - DNA, 19 bp, Artificial sequence
  SiRNA target sequence
aaataacttttttaaaaaa

SEQ ID NO: 95073 - DNA, 19 bp, Artificial sequence
  SiRNA target sequence
aataacttttttaaaaaaa

SEQ ID NO: 95074 - DNA, 19 bp, Artificial sequence
  SiRNA target sequence
ataacttttttaaaaaaat

SEQ ID NO: 95075 - DNA, 19 bp, Artificial sequence
  SiRNA target sequence
taacttttttaaaaaaatt

SEQ ID NO: 95076 - DNA, 19 bp, Artificial sequence
  SiRNA target sequence
aacttttttaaaaaaattt

SEQ ID NO: 95077 - DNA, 19 bp, Artificial sequence
  SiRNA target sequence
acttttttaaaaaaattta

SEQ ID NO: 95078 - DNA, 19 bp, Artificial sequence
  SiRNA target sequence
cttttttaaaaaaatttaa

SEQ ID NO: 95079 - DNA, 19 bp, Artificial sequence
  SiRNA target sequence
ttttttaaaaaaatttaaa

SEQ ID NO: 95080 - DNA, 19 bp, Artificial sequence
  SiRNA target sequence
tttttaaaaaaatttaaat

SEQ ID NO: 95081 - DNA, 19 bp, Artificial sequence
  SiRNA target sequence
ttttaaaaaaatttaaatc

SEQ ID NO: 95082 - DNA, 19 bp, Artificial sequence
  SiRNA target sequence
tttaaaaaaatttaaatca

SEQ ID NO: 95083 - DNA, 19 bp, Artificial sequence
  SiRNA target sequence
ttaaaaaaatttaaatcag

SEQ ID NO: 95084 - DNA, 19 bp, Artificial sequence
  SiRNA target sequence
taaaaaaatttaaatcaga

SEQ ID NO: 95085 - DNA, 19 bp, Artificial sequence
  SiRNA target sequence
aaaaaaatttaaatcagaa

SEQ ID NO: 95086 - DNA, 19 bp, Artificial sequence
  SiRNA target sequence
aaaaaatttaaatcagaat

SEQ ID NO: 95087 - DNA, 19 bp, Artificial sequence
  SiRNA target sequence
aaaaatttaaatcagaata

SEQ ID NO: 95088 - DNA, 19 bp, Artificial sequence
  SiRNA target sequence
aaaatttaaatcagaatag

SEQ ID NO: 95089 - DNA, 19 bp, Artificial sequence
  SiRNA target sequence
aaatttaaatcagaatagt

SEQ ID NO: 95090 - DNA, 19 bp, Artificial sequence
  SiRNA target sequence
aatttaaatcagaatagta

SEQ ID NO: 95091 - DNA, 19 bp, Artificial sequence
  SiRNA target sequence
atttaaatcagaatagtaa

SEQ ID NO: 95092 - DNA, 19 bp, Artificial sequence
  SiRNA target sequence
tttaaatcagaatagtaat

SEQ ID NO: 95093 - DNA, 19 bp, Artificial sequence
  SiRNA target sequence
ttaaatcagaatagtaatt

SEQ ID NO: 95094 - DNA, 19 bp, Artificial sequence
  SiRNA target sequence
taaatcagaatagtaatta

SEQ ID NO: 95095 - DNA, 19 bp, Artificial sequence
  SiRNA target sequence
aaatcagaatagtaattaa

SEQ ID NO: 95096 - DNA, 19 bp, Artificial sequence
  SiRNA target sequence
aatcagaatagtaattaac

SEQ ID NO: 95097 - DNA, 19 bp, Artificial sequence
  SiRNA target sequence
atcagaatagtaattaaca

SEQ ID NO: 95098 - DNA, 19 bp, Artificial sequence
  SiRNA target sequence
tcagaatagtaattaacaa

SEQ ID NO: 95099 - DNA, 19 bp, Artificial sequence
  SiRNA target sequence
cagaatagtaattaacaaa

SEQ ID NO: 95100 - DNA, 19 bp, Artificial sequence
  SiRNA target sequence
agaatagtaattaacaaat

SEQ ID NO: 95101 - DNA, 19 bp, Artificial sequence
  SiRNA target sequence
gaatagtaattaacaaatg

SEQ ID NO: 95102 - DNA, 19 bp, Artificial sequence
  SiRNA target sequence
aatagtaattaacaaatgc

SEQ ID NO: 95103 - DNA, 19 bp, Artificial sequence
  SiRNA target sequence
atagtaattaacaaatgcc

SEQ ID NO: 95104 - DNA, 19 bp, Artificial sequence
  SiRNA target sequence
tagtaattaacaaatgccc

SEQ ID NO: 95105 - DNA, 19 bp, Artificial sequence
  SiRNA target sequence
agtaattaacaaatgccct

SEQ ID NO: 95106 - DNA, 19 bp, Artificial sequence
  SiRNA target sequence
gtaattaacaaatgccctg

SEQ ID NO: 95107 - DNA, 19 bp, Artificial sequence
  SiRNA target sequence
taattaacaaatgccctgg

SEQ ID NO: 95108 - DNA, 19 bp, Artificial sequence
  SiRNA target sequence
aattaacaaatgccctggg

SEQ ID NO: 95109 - DNA, 19 bp, Artificial sequence
  SiRNA target sequence
attaacaaatgccctggga

SEQ ID NO: 95110 - DNA, 19 bp, Artificial sequence
  SiRNA target sequence
ttaacaaatgccctgggaa

SEQ ID NO: 95111 - DNA, 19 bp, Artificial sequence
  SiRNA target sequence
taacaaatgccctgggaag

SEQ ID NO: 95112 - DNA, 19 bp, Artificial sequence
  SiRNA target sequence
aacaaatgccctgggaagt

SEQ ID NO: 95113 - DNA, 19 bp, Artificial sequence
  SiRNA target sequence
acaaatgccctgggaagtg

SEQ ID NO: 95114 - DNA, 19 bp, Artificial sequence
  SiRNA target sequence
caaatgccctgggaagtgt

SEQ ID NO: 95115 - DNA, 19 bp, Artificial sequence
  SiRNA target sequence
aaatgccctgggaagtgta

SEQ ID NO: 95116 - DNA, 19 bp, Artificial sequence
  SiRNA target sequence
aatgccctgggaagtgtaa

SEQ ID NO: 95117 - DNA, 19 bp, Artificial sequence
  SiRNA target sequence
atgccctgggaagtgtaat

SEQ ID NO: 95118 - DNA, 19 bp, Artificial sequence
  SiRNA target sequence
tgccctgggaagtgtaata

SEQ ID NO: 95119 - DNA, 19 bp, Artificial sequence
  SiRNA target sequence
gccctgggaagtgtaatac

SEQ ID NO: 95120 - DNA, 19 bp, Artificial sequence
  SiRNA target sequence
ccctgggaagtgtaatacc

SEQ ID NO: 95121 - DNA, 19 bp, Artificial sequence
  SiRNA target sequence
cctgggaagtgtaatacca

SEQ ID NO: 95122 - DNA, 19 bp, Artificial sequence
  SiRNA target sequence
ctgggaagtgtaataccag

SEQ ID NO: 95123 - DNA, 19 bp, Artificial sequence
  SiRNA target sequence
tgggaagtgtaataccagt

SEQ ID NO: 95124 - DNA, 19 bp, Artificial sequence
  SiRNA target sequence
gggaagtgtaataccagta

SEQ ID NO: 95125 - DNA, 19 bp, Artificial sequence
  SiRNA target sequence
ggaagtgtaataccagtac

SEQ ID NO: 95126 - DNA, 19 bp, Artificial sequence
  SiRNA target sequence
gaagtgtaataccagtacc

SEQ ID NO: 95127 - DNA, 19 bp, Artificial sequence
  SiRNA target sequence
aagtgtaataccagtacca

SEQ ID NO: 95128 - DNA, 19 bp, Artificial sequence
  SiRNA target sequence
agtgtaataccagtaccag

SEQ ID NO: 95129 - DNA, 19 bp, Artificial sequence
  SiRNA target sequence
gtgtaataccagtaccagt

SEQ ID NO: 95130 - DNA, 19 bp, Artificial sequence
  SiRNA target sequence
tgtaataccagtaccagtg

SEQ ID NO: 95131 - DNA, 19 bp, Artificial sequence
  SiRNA target sequence
gtaataccagtaccagtgc

SEQ ID NO: 95132 - DNA, 19 bp, Artificial sequence
  SiRNA target sequence
taataccagtaccagtgca

SEQ ID NO: 95133 - DNA, 19 bp, Artificial sequence
  SiRNA target sequence
aataccagtaccagtgcac

SEQ ID NO: 95134 - DNA, 19 bp, Artificial sequence
  SiRNA target sequence
ataccagtaccagtgcaca

SEQ ID NO: 95135 - DNA, 19 bp, Artificial sequence
  SiRNA target sequence
taccagtaccagtgcacat

SEQ ID NO: 95136 - DNA, 19 bp, Artificial sequence
  SiRNA target sequence
accagtaccagtgcacata

SEQ ID NO: 95137 - DNA, 19 bp, Artificial sequence
  SiRNA target sequence
ccagtaccagtgcacataa

SEQ ID NO: 95138 - DNA, 19 bp, Artificial sequence
  SiRNA target sequence
cagtaccagtgcacataaa

SEQ ID NO: 95139 - DNA, 19 bp, Artificial sequence
  SiRNA target sequence
agtaccagtgcacataaac

SEQ ID NO: 95140 - DNA, 19 bp, Artificial sequence
  SiRNA target sequence
gtaccagtgcacataaaca

SEQ ID NO: 95141 - DNA, 19 bp, Artificial sequence
  SiRNA target sequence
taccagtgcacataaacaa

SEQ ID NO: 95142 - DNA, 19 bp, Artificial sequence
  SiRNA target sequence
accagtgcacataaacaaa

SEQ ID NO: 95143 - DNA, 19 bp, Artificial sequence
  SiRNA target sequence
ccagtgcacataaacaaaa

SEQ ID NO: 95144 - DNA, 19 bp, Artificial sequence
  SiRNA target sequence
cagtgcacataaacaaaat

SEQ ID NO: 95145 - DNA, 19 bp, Artificial sequence
  SiRNA target sequence
agtgcacataaacaaaatc

SEQ ID NO: 95146 - DNA, 19 bp, Artificial sequence
  SiRNA target sequence
gtgcacataaacaaaatct

SEQ ID NO: 95147 - DNA, 19 bp, Artificial sequence
  SiRNA target sequence
tgcacataaacaaaatctt

SEQ ID NO: 95148 - DNA, 19 bp, Artificial sequence
  SiRNA target sequence
gcacataaacaaaatcttt

SEQ ID NO: 95149 - DNA, 19 bp, Artificial sequence
  SiRNA target sequence
cacataaacaaaatctttt

SEQ ID NO: 95150 - DNA, 19 bp, Artificial sequence
  SiRNA target sequence
acataaacaaaatcttttt

SEQ ID NO: 95151 - DNA, 19 bp, Artificial sequence
  SiRNA target sequence
cataaacaaaatcttttta

SEQ ID NO: 95152 - DNA, 19 bp, Artificial sequence
  SiRNA target sequence
ataaacaaaatctttttac

SEQ ID NO: 95153 - DNA, 19 bp, Artificial sequence
  SiRNA target sequence
taaacaaaatctttttacc

SEQ ID NO: 95154 - DNA, 19 bp, Artificial sequence
  SiRNA target sequence
aaacaaaatctttttacca

SEQ ID NO: 95155 - DNA, 19 bp, Artificial sequence
  SiRNA target sequence
aacaaaatctttttaccac

SEQ ID NO: 95156 - DNA, 19 bp, Artificial sequence
  SiRNA target sequence
acaaaatctttttaccact

SEQ ID NO: 95157 - DNA, 19 bp, Artificial sequence
  SiRNA target sequence
caaaatctttttaccacta

SEQ ID NO: 95158 - DNA, 19 bp, Artificial sequence
  SiRNA target sequence
aaaatctttttaccactaa

SEQ ID NO: 95159 - DNA, 19 bp, Artificial sequence
  SiRNA target sequence
aaatctttttaccactaaa

SEQ ID NO: 95160 - DNA, 19 bp, Artificial sequence
  SiRNA target sequence
aatctttttaccactaaaa

SEQ ID NO: 95161 - DNA, 19 bp, Artificial sequence
  SiRNA target sequence
atctttttaccactaaaat

SEQ ID NO: 95162 - DNA, 19 bp, Artificial sequence
  SiRNA target sequence
tctttttaccactaaaatt

SEQ ID NO: 95163 - DNA, 19 bp, Artificial sequence
  SiRNA target sequence
ctttttaccactaaaatta

SEQ ID NO: 95164 - DNA, 19 bp, Artificial sequence
  SiRNA target sequence
tttttaccactaaaattaa

SEQ ID NO: 95165 - DNA, 19 bp, Artificial sequence
  SiRNA target sequence
ttttaccactaaaattaag

SEQ ID NO: 95166 - DNA, 19 bp, Artificial sequence
  SiRNA target sequence
tttaccactaaaattaagt

SEQ ID NO: 95167 - DNA, 19 bp, Artificial sequence
  SiRNA target sequence
ttaccactaaaattaagtc

SEQ ID NO: 95168 - DNA, 19 bp, Artificial sequence
  SiRNA target sequence
taccactaaaattaagtct

SEQ ID NO: 95169 - DNA, 19 bp, Artificial sequence
  SiRNA target sequence
accactaaaattaagtcta

SEQ ID NO: 95170 - DNA, 19 bp, Artificial sequence
  SiRNA target sequence
ccactaaaattaagtctat

SEQ ID NO: 95171 - DNA, 19 bp, Artificial sequence
  SiRNA target sequence
cactaaaattaagtctatt

SEQ ID NO: 95172 - DNA, 19 bp, Artificial sequence
  SiRNA target sequence
actaaaattaagtctattt

SEQ ID NO: 95173 - DNA, 19 bp, Artificial sequence
  SiRNA target sequence
ctaaaattaagtctatttt

SEQ ID NO: 95174 - DNA, 19 bp, Artificial sequence
  SiRNA target sequence
taaaattaagtctattttg

SEQ ID NO: 95175 - DNA, 19 bp, Artificial sequence
  SiRNA target sequence
aaaattaagtctattttgt

SEQ ID NO: 95176 - DNA, 19 bp, Artificial sequence
  SiRNA target sequence
aaattaagtctattttgta

SEQ ID NO: 95177 - DNA, 19 bp, Artificial sequence
  SiRNA target sequence
aattaagtctattttgtac

SEQ ID NO: 95178 - DNA, 19 bp, Artificial sequence
  SiRNA target sequence
attaagtctattttgtact

SEQ ID NO: 95179 - DNA, 19 bp, Artificial sequence
  SiRNA target sequence
ttaagtctattttgtacta

SEQ ID NO: 95180 - DNA, 19 bp, Artificial sequence
  SiRNA target sequence
taagtctattttgtactat

SEQ ID NO: 95181 - DNA, 19 bp, Artificial sequence
  SiRNA target sequence
aagtctattttgtactatg

SEQ ID NO: 95182 - DNA, 19 bp, Artificial sequence
  SiRNA target sequence
agtctattttgtactatgt

SEQ ID NO: 95183 - DNA, 19 bp, Artificial sequence
  SiRNA target sequence
gtctattttgtactatgtt

SEQ ID NO: 95184 - DNA, 19 bp, Artificial sequence
  SiRNA target sequence
tctattttgtactatgtta

SEQ ID NO: 95185 - DNA, 19 bp, Artificial sequence
  SiRNA target sequence
ctattttgtactatgttaa

SEQ ID NO: 95186 - DNA, 19 bp, Artificial sequence
  SiRNA target sequence
tattttgtactatgttaac

SEQ ID NO: 95187 - DNA, 19 bp, Artificial sequence
  SiRNA target sequence
attttgtactatgttaaca

SEQ ID NO: 95188 - DNA, 19 bp, Artificial sequence
  SiRNA target sequence
ttttgtactatgttaacat

SEQ ID NO: 95189 - DNA, 19 bp, Artificial sequence
  SiRNA target sequence
tttgtactatgttaacatg

SEQ ID NO: 95190 - DNA, 19 bp, Artificial sequence
  SiRNA target sequence
ttgtactatgttaacatga

SEQ ID NO: 95191 - DNA, 19 bp, Artificial sequence
  SiRNA target sequence
tgtactatgttaacatgaa

SEQ ID NO: 95192 - DNA, 19 bp, Artificial sequence
  SiRNA target sequence
gtactatgttaacatgaat

SEQ ID NO: 95193 - DNA, 19 bp, Artificial sequence
  SiRNA target sequence
tactatgttaacatgaata

SEQ ID NO: 95194 - DNA, 19 bp, Artificial sequence
  SiRNA target sequence
actatgttaacatgaatag

SEQ ID NO: 95195 - DNA, 19 bp, Artificial sequence
  SiRNA target sequence
ctatgttaacatgaatagt

SEQ ID NO: 95196 - DNA, 19 bp, Artificial sequence
  SiRNA target sequence
tatgttaacatgaatagta

SEQ ID NO: 95197 - DNA, 19 bp, Artificial sequence
  SiRNA target sequence
atgttaacatgaatagtag

SEQ ID NO: 95198 - DNA, 19 bp, Artificial sequence
  SiRNA target sequence
tgttaacatgaatagtaga

SEQ ID NO: 95199 - DNA, 19 bp, Artificial sequence
  SiRNA target sequence
gttaacatgaatagtagac

SEQ ID NO: 95200 - DNA, 19 bp, Artificial sequence
  SiRNA target sequence
ttaacatgaatagtagacc

SEQ ID NO: 95201 - DNA, 19 bp, Artificial sequence
  SiRNA target sequence
taacatgaatagtagaccc

SEQ ID NO: 95202 - DNA, 19 bp, Artificial sequence
  SiRNA target sequence
aacatgaatagtagaccct

SEQ ID NO: 95203 - DNA, 19 bp, Artificial sequence
  SiRNA target sequence
acatgaatagtagaccctt

SEQ ID NO: 95204 - DNA, 19 bp, Artificial sequence
  SiRNA target sequence
catgaatagtagacccttt

SEQ ID NO: 95205 - DNA, 19 bp, Artificial sequence
  SiRNA target sequence
atgaatagtagacccttta

SEQ ID NO: 95206 - DNA, 19 bp, Artificial sequence
  SiRNA target sequence
tgaatagtagaccctttag

SEQ ID NO: 95207 - DNA, 19 bp, Artificial sequence
  SiRNA target sequence
gaatagtagaccctttagt

SEQ ID NO: 95208 - DNA, 19 bp, Artificial sequence
  SiRNA target sequence
aatagtagaccctttagta

SEQ ID NO: 95209 - DNA, 19 bp, Artificial sequence
  SiRNA target sequence
atagtagaccctttagtaa

SEQ ID NO: 95210 - DNA, 19 bp, Artificial sequence
  SiRNA target sequence
tagtagaccctttagtaag

SEQ ID NO: 95211 - DNA, 19 bp, Artificial sequence
  SiRNA target sequence
agtagaccctttagtaagt

SEQ ID NO: 95212 - DNA, 19 bp, Artificial sequence
  SiRNA target sequence
gtagaccctttagtaagta

SEQ ID NO: 95213 - DNA, 19 bp, Artificial sequence
  SiRNA target sequence
tagaccctttagtaagtaa

SEQ ID NO: 95214 - DNA, 19 bp, Artificial sequence
  SiRNA target sequence
agaccctttagtaagtaat

SEQ ID NO: 95215 - DNA, 19 bp, Artificial sequence
  SiRNA target sequence
gaccctttagtaagtaatt

SEQ ID NO: 95216 - DNA, 19 bp, Artificial sequence
  SiRNA target sequence
accctttagtaagtaattt

SEQ ID NO: 95217 - DNA, 19 bp, Artificial sequence
  SiRNA target sequence
ccctttagtaagtaatttt

SEQ ID NO: 95218 - DNA, 19 bp, Artificial sequence
  SiRNA target sequence
cctttagtaagtaatttta

SEQ ID NO: 95219 - DNA, 19 bp, Artificial sequence
  SiRNA target sequence
ctttagtaagtaattttaa

SEQ ID NO: 95220 - DNA, 19 bp, Artificial sequence
  SiRNA target sequence
tttagtaagtaattttaaa

SEQ ID NO: 95221 - DNA, 19 bp, Artificial sequence
  SiRNA target sequence
ttagtaagtaattttaaat

SEQ ID NO: 95222 - DNA, 19 bp, Artificial sequence
  SiRNA target sequence
tagtaagtaattttaaata

SEQ ID NO: 95223 - DNA, 19 bp, Artificial sequence
  SiRNA target sequence
agtaagtaattttaaatac

SEQ ID NO: 95224 - DNA, 19 bp, Artificial sequence
  SiRNA target sequence
gtaagtaattttaaatact

SEQ ID NO: 95225 - DNA, 19 bp, Artificial sequence
  SiRNA target sequence
taagtaattttaaatactc

SEQ ID NO: 95226 - DNA, 19 bp, Artificial sequence
  SiRNA target sequence
aagtaattttaaatactct

SEQ ID NO: 95227 - DNA, 19 bp, Artificial sequence
  SiRNA target sequence
agtaattttaaatactctg

SEQ ID NO: 95228 - DNA, 19 bp, Artificial sequence
  SiRNA target sequence
gtaattttaaatactctga

SEQ ID NO: 95229 - DNA, 19 bp, Artificial sequence
  SiRNA target sequence
taattttaaatactctgaa

SEQ ID NO: 95230 - DNA, 19 bp, Artificial sequence
  SiRNA target sequence
aattttaaatactctgaac

SEQ ID NO: 95231 - DNA, 19 bp, Artificial sequence
  SiRNA target sequence
attttaaatactctgaaca

SEQ ID NO: 95232 - DNA, 19 bp, Artificial sequence
  SiRNA target sequence
ttttaaatactctgaacaa

SEQ ID NO: 95233 - DNA, 19 bp, Artificial sequence
  SiRNA target sequence
tttaaatactctgaacaaa

SEQ ID NO: 95234 - DNA, 19 bp, Artificial sequence
  SiRNA target sequence
ttaaatactctgaacaaag

SEQ ID NO: 95235 - DNA, 19 bp, Artificial sequence
  SiRNA target sequence
taaatactctgaacaaaga

SEQ ID NO: 95236 - DNA, 19 bp, Artificial sequence
  SiRNA target sequence
aaatactctgaacaaagac

SEQ ID NO: 95237 - DNA, 19 bp, Artificial sequence
  SiRNA target sequence
aatactctgaacaaagacc

SEQ ID NO: 95238 - DNA, 19 bp, Artificial sequence
  SiRNA target sequence
atactctgaacaaagacct

SEQ ID NO: 95239 - DNA, 19 bp, Artificial sequence
  SiRNA target sequence
tactctgaacaaagacctt

SEQ ID NO: 95240 - DNA, 19 bp, Artificial sequence
  SiRNA target sequence
actctgaacaaagaccttt

SEQ ID NO: 95241 - DNA, 19 bp, Artificial sequence
  SiRNA target sequence
ctctgaacaaagacctttt

SEQ ID NO: 95242 - DNA, 19 bp, Artificial sequence
  SiRNA target sequence
tctgaacaaagaccttttc

SEQ ID NO: 95243 - DNA, 19 bp, Artificial sequence
  SiRNA target sequence
ctgaacaaagaccttttcg

SEQ ID NO: 95244 - DNA, 19 bp, Artificial sequence
  SiRNA target sequence
tgaacaaagaccttttcgt

SEQ ID NO: 95245 - DNA, 19 bp, Artificial sequence
  SiRNA target sequence
gaacaaagaccttttcgtt

SEQ ID NO: 95246 - DNA, 19 bp, Artificial sequence
  SiRNA target sequence
aacaaagaccttttcgttc

SEQ ID NO: 95247 - DNA, 19 bp, Artificial sequence
  SiRNA target sequence
acaaagaccttttcgttct

SEQ ID NO: 95248 - DNA, 19 bp, Artificial sequence
  SiRNA target sequence
caaagaccttttcgttctt

SEQ ID NO: 95249 - DNA, 19 bp, Artificial sequence
  SiRNA target sequence
aaagaccttttcgttcttc

SEQ ID NO: 95250 - DNA, 19 bp, Artificial sequence
  SiRNA target sequence
aagaccttttcgttcttct

SEQ ID NO: 95251 - DNA, 19 bp, Artificial sequence
  SiRNA target sequence
agaccttttcgttcttctt

SEQ ID NO: 95252 - DNA, 19 bp, Artificial sequence
  SiRNA target sequence
gaccttttcgttcttcttt

SEQ ID NO: 95253 - DNA, 19 bp, Artificial sequence
  SiRNA target sequence
accttttcgttcttctttt

SEQ ID NO: 95254 - DNA, 19 bp, Artificial sequence
  SiRNA target sequence
ccttttcgttcttctttta

SEQ ID NO: 95255 - DNA, 19 bp, Artificial sequence
  SiRNA target sequence
cttttcgttcttcttttaa

SEQ ID NO: 95256 - DNA, 19 bp, Artificial sequence
  SiRNA target sequence
ttttcgttcttcttttaaa

SEQ ID NO: 95257 - DNA, 19 bp, Artificial sequence
  SiRNA target sequence
tttcgttcttcttttaaac

SEQ ID NO: 95258 - DNA, 19 bp, Artificial sequence
  SiRNA target sequence
ttcgttcttcttttaaact

SEQ ID NO: 95259 - DNA, 19 bp, Artificial sequence
  SiRNA target sequence
tcgttcttcttttaaactt

SEQ ID NO: 95260 - DNA, 19 bp, Artificial sequence
  SiRNA target sequence
cgttcttcttttaaacttg

SEQ ID NO: 95261 - DNA, 19 bp, Artificial sequence
  SiRNA target sequence
gttcttcttttaaacttgt

SEQ ID NO: 95262 - DNA, 19 bp, Artificial sequence
  SiRNA target sequence
ttcttcttttaaacttgtt

SEQ ID NO: 95263 - DNA, 19 bp, Artificial sequence
  SiRNA target sequence
tcttcttttaaacttgttt

SEQ ID NO: 95264 - DNA, 19 bp, Artificial sequence
  SiRNA target sequence
cttcttttaaacttgtttt

SEQ ID NO: 95265 - DNA, 19 bp, Artificial sequence
  SiRNA target sequence
ttcttttaaacttgtttta

SEQ ID NO: 95266 - DNA, 19 bp, Artificial sequence
  SiRNA target sequence
tcttttaaacttgttttaa

SEQ ID NO: 95267 - DNA, 19 bp, Artificial sequence
  SiRNA target sequence
cttttaaacttgttttaaa

SEQ ID NO: 95268 - DNA, 19 bp, Artificial sequence
  SiRNA target sequence
ttttaaacttgttttaaaa

SEQ ID NO: 95269 - DNA, 19 bp, Artificial sequence
  SiRNA target sequence
tttaaacttgttttaaaag

SEQ ID NO: 95270 - DNA, 19 bp, Artificial sequence
  SiRNA target sequence
ttaaacttgttttaaaaga

SEQ ID NO: 95271 - DNA, 19 bp, Artificial sequence
  SiRNA target sequence
taaacttgttttaaaagaa

SEQ ID NO: 95272 - DNA, 19 bp, Artificial sequence
  SiRNA target sequence
aaacttgttttaaaagaaa

SEQ ID NO: 95273 - DNA, 19 bp, Artificial sequence
  SiRNA target sequence
aacttgttttaaaagaaac

SEQ ID NO: 95274 - DNA, 19 bp, Artificial sequence
  SiRNA target sequence
acttgttttaaaagaaaca

SEQ ID NO: 95275 - DNA, 19 bp, Artificial sequence
  SiRNA target sequence
cttgttttaaaagaaacaa

SEQ ID NO: 95276 - DNA, 19 bp, Artificial sequence
  SiRNA target sequence
ttgttttaaaagaaacaag

SEQ ID NO: 95277 - DNA, 19 bp, Artificial sequence
  SiRNA target sequence
tgttttaaaagaaacaaga

SEQ ID NO: 95278 - DNA, 19 bp, Artificial sequence
  SiRNA target sequence
gttttaaaagaaacaagag

SEQ ID NO: 95279 - DNA, 19 bp, Artificial sequence
  SiRNA target sequence
ttttaaaagaaacaagaga

SEQ ID NO: 95280 - DNA, 19 bp, Artificial sequence
  SiRNA target sequence
tttaaaagaaacaagagag

SEQ ID NO: 95281 - DNA, 19 bp, Artificial sequence
  SiRNA target sequence
ttaaaagaaacaagagaga

SEQ ID NO: 95282 - DNA, 19 bp, Artificial sequence
  SiRNA target sequence
taaaagaaacaagagagac

SEQ ID NO: 95283 - DNA, 19 bp, Artificial sequence
  SiRNA target sequence
aaaagaaacaagagagacg

SEQ ID NO: 95284 - DNA, 19 bp, Artificial sequence
  SiRNA target sequence
aaagaaacaagagagacgg

SEQ ID NO: 95285 - DNA, 19 bp, Artificial sequence
  SiRNA target sequence
aagaaacaagagagacggt

SEQ ID NO: 95286 - DNA, 19 bp, Artificial sequence
  SiRNA target sequence
agaaacaagagagacggtg

SEQ ID NO: 95287 - DNA, 19 bp, Artificial sequence
  SiRNA target sequence
gaaacaagagagacggtga

SEQ ID NO: 95288 - DNA, 19 bp, Artificial sequence
  SiRNA target sequence
aaacaagagagacggtgac

SEQ ID NO: 95289 - DNA, 19 bp, Artificial sequence
  SiRNA target sequence
aacaagagagacggtgaca

SEQ ID NO: 95290 - DNA, 19 bp, Artificial sequence
  SiRNA target sequence
acaagagagacggtgacaa

SEQ ID NO: 95291 - DNA, 19 bp, Artificial sequence
  SiRNA target sequence
caagagagacggtgacaaa

SEQ ID NO: 95292 - DNA, 19 bp, Artificial sequence
  SiRNA target sequence
aagagagacggtgacaaag

SEQ ID NO: 95293 - DNA, 19 bp, Artificial sequence
  SiRNA target sequence
agagagacggtgacaaagt

SEQ ID NO: 95294 - DNA, 19 bp, Artificial sequence
  SiRNA target sequence
gagagacggtgacaaagta

SEQ ID NO: 95295 - DNA, 19 bp, Artificial sequence
  SiRNA target sequence
agagacggtgacaaagtaa

SEQ ID NO: 95296 - DNA, 19 bp, Artificial sequence
  SiRNA target sequence
gagacggtgacaaagtaac

SEQ ID NO: 95297 - DNA, 19 bp, Artificial sequence
  SiRNA target sequence
agacggtgacaaagtaaca

SEQ ID NO: 95298 - DNA, 19 bp, Artificial sequence
  SiRNA target sequence
gacggtgacaaagtaacaa

SEQ ID NO: 95299 - DNA, 19 bp, Artificial sequence
  SiRNA target sequence
acggtgacaaagtaacaaa

SEQ ID NO: 95300 - DNA, 19 bp, Artificial sequence
  SiRNA target sequence
cggtgacaaagtaacaaaa

SEQ ID NO: 95301 - DNA, 19 bp, Artificial sequence
  SiRNA target sequence
ggtgacaaagtaacaaaaa

SEQ ID NO: 95302 - DNA, 19 bp, Artificial sequence
  SiRNA target sequence
gtgacaaagtaacaaaaat

SEQ ID NO: 95303 - DNA, 19 bp, Artificial sequence
  SiRNA target sequence
tgacaaagtaacaaaaatc

SEQ ID NO: 95304 - DNA, 19 bp, Artificial sequence
  SiRNA target sequence
gacaaagtaacaaaaatct

SEQ ID NO: 95305 - DNA, 19 bp, Artificial sequence
  SiRNA target sequence
acaaagtaacaaaaatctt

SEQ ID NO: 95306 - DNA, 19 bp, Artificial sequence
  SiRNA target sequence
caaagtaacaaaaatcttt

SEQ ID NO: 95307 - DNA, 19 bp, Artificial sequence
  SiRNA target sequence
aaagtaacaaaaatctttt

SEQ ID NO: 95308 - DNA, 19 bp, Artificial sequence
  SiRNA target sequence
aagtaacaaaaatcttttt

SEQ ID NO: 95309 - DNA, 19 bp, Artificial sequence
  SiRNA target sequence
agtaacaaaaatctttttt

SEQ ID NO: 95310 - DNA, 19 bp, Artificial sequence
  SiRNA target sequence
gtaacaaaaatcttttttc

SEQ ID NO: 95311 - DNA, 19 bp, Artificial sequence
  SiRNA target sequence
taacaaaaatcttttttcg

SEQ ID NO: 95312 - DNA, 19 bp, Artificial sequence
  SiRNA target sequence
aacaaaaatcttttttcgt

SEQ ID NO: 95313 - DNA, 19 bp, Artificial sequence
  SiRNA target sequence
acaaaaatcttttttcgtt

SEQ ID NO: 95314 - DNA, 19 bp, Artificial sequence
  SiRNA target sequence
caaaaatcttttttcgtta

SEQ ID NO: 95315 - DNA, 19 bp, Artificial sequence
  SiRNA target sequence
aaaaatcttttttcgttaa

SEQ ID NO: 95316 - DNA, 19 bp, Artificial sequence
  SiRNA target sequence
aaaatcttttttcgttaat

SEQ ID NO: 95317 - DNA, 19 bp, Artificial sequence
  SiRNA target sequence
aaatcttttttcgttaatg

SEQ ID NO: 95318 - DNA, 19 bp, Artificial sequence
  SiRNA target sequence
aatcttttttcgttaatgt

SEQ ID NO: 95319 - DNA, 19 bp, Artificial sequence
  SiRNA target sequence
atcttttttcgttaatgta

SEQ ID NO: 95320 - DNA, 19 bp, Artificial sequence
  SiRNA target sequence
tcttttttcgttaatgtaa

SEQ ID NO: 95321 - DNA, 19 bp, Artificial sequence
  SiRNA target sequence
cttttttcgttaatgtaaa

SEQ ID NO: 95322 - DNA, 19 bp, Artificial sequence
  SiRNA target sequence
ttttttcgttaatgtaaaa

SEQ ID NO: 95323 - DNA, 19 bp, Artificial sequence
  SiRNA target sequence
tttttcgttaatgtaaaat

SEQ ID NO: 95324 - DNA, 19 bp, Artificial sequence
  SiRNA target sequence
ttttcgttaatgtaaaata

SEQ ID NO: 95325 - DNA, 19 bp, Artificial sequence
  SiRNA target sequence
tttcgttaatgtaaaatat

SEQ ID NO: 95326 - DNA, 19 bp, Artificial sequence
  SiRNA target sequence
ttcgttaatgtaaaatatc

SEQ ID NO: 95327 - DNA, 19 bp, Artificial sequence
  SiRNA target sequence
tcgttaatgtaaaatatct

SEQ ID NO: 95328 - DNA, 19 bp, Artificial sequence
  SiRNA target sequence
cgttaatgtaaaatatctt

SEQ ID NO: 95329 - DNA, 19 bp, Artificial sequence
  SiRNA target sequence
gttaatgtaaaatatcttg

SEQ ID NO: 95330 - DNA, 19 bp, Artificial sequence
  SiRNA target sequence
ttaatgtaaaatatcttgg

SEQ ID NO: 95331 - DNA, 19 bp, Artificial sequence
  SiRNA target sequence
taatgtaaaatatcttgga

SEQ ID NO: 95332 - DNA, 19 bp, Artificial sequence
  SiRNA target sequence
aatgtaaaatatcttggat

SEQ ID NO: 95333 - DNA, 19 bp, Artificial sequence
  SiRNA target sequence
atgtaaaatatcttggatt

SEQ ID NO: 95334 - DNA, 19 bp, Artificial sequence
  SiRNA target sequence
tgtaaaatatcttggatta

SEQ ID NO: 95335 - DNA, 19 bp, Artificial sequence
  SiRNA target sequence
gtaaaatatcttggattaa

SEQ ID NO: 95336 - DNA, 19 bp, Artificial sequence
  SiRNA target sequence
taaaatatcttggattaat

SEQ ID NO: 95337 - DNA, 19 bp, Artificial sequence
  SiRNA target sequence
aaaatatcttggattaatt

SEQ ID NO: 95338 - DNA, 19 bp, Artificial sequence
  SiRNA target sequence
aaatatcttggattaatta

SEQ ID NO: 95339 - DNA, 19 bp, Artificial sequence
  SiRNA target sequence
aatatcttggattaattac

SEQ ID NO: 95340 - DNA, 19 bp, Artificial sequence
  SiRNA target sequence
atatcttggattaattaca

SEQ ID NO: 95341 - DNA, 19 bp, Artificial sequence
  SiRNA target sequence
tatcttggattaattacag

SEQ ID NO: 95342 - DNA, 19 bp, Artificial sequence
  SiRNA target sequence
atcttggattaattacagg

SEQ ID NO: 95343 - DNA, 19 bp, Artificial sequence
  SiRNA target sequence
tcttggattaattacaggg

SEQ ID NO: 95344 - DNA, 19 bp, Artificial sequence
  SiRNA target sequence
cttggattaattacaggga

SEQ ID NO: 95345 - DNA, 19 bp, Artificial sequence
  SiRNA target sequence
ttggattaattacagggat

SEQ ID NO: 95346 - DNA, 19 bp, Artificial sequence
  SiRNA target sequence
tggattaattacagggata

SEQ ID NO: 95347 - DNA, 19 bp, Artificial sequence
  SiRNA target sequence
ggattaattacagggatat

SEQ ID NO: 95348 - DNA, 19 bp, Artificial sequence
  SiRNA target sequence
gattaattacagggatata

SEQ ID NO: 95349 - DNA, 19 bp, Artificial sequence
  SiRNA target sequence
attaattacagggatatac

SEQ ID NO: 95350 - DNA, 19 bp, Artificial sequence
  SiRNA target sequence
ttaattacagggatatact

SEQ ID NO: 95351 - DNA, 19 bp, Artificial sequence
  SiRNA target sequence
taattacagggatatactt

SEQ ID NO: 95352 - DNA, 19 bp, Artificial sequence
  SiRNA target sequence
aattacagggatatacttg

SEQ ID NO: 95353 - DNA, 19 bp, Artificial sequence
  SiRNA target sequence
attacagggatatacttgt

SEQ ID NO: 95354 - DNA, 19 bp, Artificial sequence
  SiRNA target sequence
ttacagggatatacttgta

SEQ ID NO: 95355 - DNA, 19 bp, Artificial sequence
  SiRNA target sequence
tacagggatatacttgtac

SEQ ID NO: 95356 - DNA, 19 bp, Artificial sequence
  SiRNA target sequence
acagggatatacttgtaca

SEQ ID NO: 95357 - DNA, 19 bp, Artificial sequence
  SiRNA target sequence
cagggatatacttgtacat

SEQ ID NO: 95358 - DNA, 19 bp, Artificial sequence
  SiRNA target sequence
agggatatacttgtacata

SEQ ID NO: 95359 - DNA, 19 bp, Artificial sequence
  SiRNA target sequence
gggatatacttgtacataa

SEQ ID NO: 95360 - DNA, 19 bp, Artificial sequence
  SiRNA target sequence
ggatatacttgtacataaa

SEQ ID NO: 95361 - DNA, 19 bp, Artificial sequence
  SiRNA target sequence
gatatacttgtacataaaa

SEQ ID NO: 95362 - DNA, 19 bp, Artificial sequence
  SiRNA target sequence
atatacttgtacataaaat

SEQ ID NO: 95363 - DNA, 19 bp, Artificial sequence
  SiRNA target sequence
tatacttgtacataaaatt

SEQ ID NO: 95364 - DNA, 19 bp, Artificial sequence
  SiRNA target sequence
atacttgtacataaaattt

SEQ ID NO: 95365 - DNA, 19 bp, Artificial sequence
  SiRNA target sequence
tacttgtacataaaatttg

SEQ ID NO: 95366 - DNA, 19 bp, Artificial sequence
  SiRNA target sequence
acttgtacataaaatttga

SEQ ID NO: 95367 - DNA, 19 bp, Artificial sequence
  SiRNA target sequence
cttgtacataaaatttgag

SEQ ID NO: 95368 - DNA, 19 bp, Artificial sequence
  SiRNA target sequence
ttgtacataaaatttgagg

SEQ ID NO: 95369 - DNA, 19 bp, Artificial sequence
  SiRNA target sequence
tgtacataaaatttgaggt

SEQ ID NO: 95370 - DNA, 19 bp, Artificial sequence
  SiRNA target sequence
gtacataaaatttgaggta

SEQ ID NO: 95371 - DNA, 19 bp, Artificial sequence
  SiRNA target sequence
tacataaaatttgaggtaa

SEQ ID NO: 95372 - DNA, 19 bp, Artificial sequence
  SiRNA target sequence
acataaaatttgaggtaag

SEQ ID NO: 95373 - DNA, 19 bp, Artificial sequence
  SiRNA target sequence
cataaaatttgaggtaagt

SEQ ID NO: 95374 - DNA, 19 bp, Artificial sequence
  SiRNA target sequence
ataaaatttgaggtaagtt

SEQ ID NO: 95375 - DNA, 19 bp, Artificial sequence
  SiRNA target sequence
taaaatttgaggtaagttt

SEQ ID NO: 95376 - DNA, 19 bp, Artificial sequence
  SiRNA target sequence
aaaatttgaggtaagtttt

SEQ ID NO: 95377 - DNA, 19 bp, Artificial sequence
  SiRNA target sequence
aaatttgaggtaagtttta

SEQ ID NO: 95378 - DNA, 19 bp, Artificial sequence
  SiRNA target sequence
aatttgaggtaagttttat

SEQ ID NO: 95379 - DNA, 19 bp, Artificial sequence
  SiRNA target sequence
atttgaggtaagttttatc

SEQ ID NO: 95380 - DNA, 19 bp, Artificial sequence
  SiRNA target sequence
tttgaggtaagttttatct

SEQ ID NO: 95381 - DNA, 19 bp, Artificial sequence
  SiRNA target sequence
ttgaggtaagttttatctt

SEQ ID NO: 95382 - DNA, 19 bp, Artificial sequence
  SiRNA target sequence
tgaggtaagttttatctta

SEQ ID NO: 95383 - DNA, 19 bp, Artificial sequence
  SiRNA target sequence
gaggtaagttttatcttaa

SEQ ID NO: 95384 - DNA, 19 bp, Artificial sequence
  SiRNA target sequence
aggtaagttttatcttaaa

SEQ ID NO: 95385 - DNA, 19 bp, Artificial sequence
  SiRNA target sequence
ggtaagttttatcttaaaa

SEQ ID NO: 95386 - DNA, 19 bp, Artificial sequence
  SiRNA target sequence
gtaagttttatcttaaaat

SEQ ID NO: 95387 - DNA, 19 bp, Artificial sequence
  SiRNA target sequence
taagttttatcttaaaatc

SEQ ID NO: 95388 - DNA, 19 bp, Artificial sequence
  SiRNA target sequence
aagttttatcttaaaatct

SEQ ID NO: 95389 - DNA, 19 bp, Artificial sequence
  SiRNA target sequence
agttttatcttaaaatctt

SEQ ID NO: 95390 - DNA, 19 bp, Artificial sequence
  SiRNA target sequence
gttttatcttaaaatcttt

SEQ ID NO: 95391 - DNA, 19 bp, Artificial sequence
  SiRNA target sequence
ttttatcttaaaatctttt

SEQ ID NO: 95392 - DNA, 19 bp, Artificial sequence
  SiRNA target sequence
tttatcttaaaatctttta

SEQ ID NO: 95393 - DNA, 19 bp, Artificial sequence
  SiRNA target sequence
ttatcttaaaatcttttag

SEQ ID NO: 95394 - DNA, 19 bp, Artificial sequence
  SiRNA target sequence
tatcttaaaatcttttaga

SEQ ID NO: 95395 - DNA, 19 bp, Artificial sequence
  SiRNA target sequence
atcttaaaatcttttagaa

SEQ ID NO: 95396 - DNA, 19 bp, Artificial sequence
  SiRNA target sequence
tcttaaaatcttttagaac

SEQ ID NO: 95397 - DNA, 19 bp, Artificial sequence
  SiRNA target sequence
cttaaaatcttttagaacc

SEQ ID NO: 95398 - DNA, 19 bp, Artificial sequence
  SiRNA target sequence
ttaaaatcttttagaacct

SEQ ID NO: 95399 - DNA, 19 bp, Artificial sequence
  SiRNA target sequence
taaaatcttttagaacctc

SEQ ID NO: 95400 - DNA, 19 bp, Artificial sequence
  SiRNA target sequence
aaaatcttttagaacctca

SEQ ID NO: 95401 - DNA, 19 bp, Artificial sequence
  SiRNA target sequence
aaatcttttagaacctcaa

SEQ ID NO: 95402 - DNA, 19 bp, Artificial sequence
  SiRNA target sequence
aatcttttagaacctcaaa

SEQ ID NO: 95403 - DNA, 19 bp, Artificial sequence
  SiRNA target sequence
atcttttagaacctcaaaa

SEQ ID NO: 95404 - DNA, 19 bp, Artificial sequence
  SiRNA target sequence
tcttttagaacctcaaaaa

SEQ ID NO: 95405 - DNA, 19 bp, Artificial sequence
  SiRNA target sequence
cttttagaacctcaaaaat

SEQ ID NO: 95406 - DNA, 19 bp, Artificial sequence
  SiRNA target sequence
ttttagaacctcaaaaata

SEQ ID NO: 95407 - DNA, 19 bp, Artificial sequence
  SiRNA target sequence
tttagaacctcaaaaatag

SEQ ID NO: 95408 - DNA, 19 bp, Artificial sequence
  SiRNA target sequence
ttagaacctcaaaaatagt

SEQ ID NO: 95409 - DNA, 19 bp, Artificial sequence
  SiRNA target sequence
tagaacctcaaaaatagtg

SEQ ID NO: 95410 - DNA, 19 bp, Artificial sequence
  SiRNA target sequence
agaacctcaaaaatagtgc

SEQ ID NO: 95411 - DNA, 19 bp, Artificial sequence
  SiRNA target sequence
gaacctcaaaaatagtgcg

SEQ ID NO: 95412 - DNA, 19 bp, Artificial sequence
  SiRNA target sequence
aacctcaaaaatagtgcgc

SEQ ID NO: 95413 - DNA, 19 bp, Artificial sequence
  SiRNA target sequence
acctcaaaaatagtgcgct

SEQ ID NO: 95414 - DNA, 19 bp, Artificial sequence
  SiRNA target sequence
cctcaaaaatagtgcgctt

SEQ ID NO: 95415 - DNA, 19 bp, Artificial sequence
  SiRNA target sequence
ctcaaaaatagtgcgcttc

SEQ ID NO: 95416 - DNA, 19 bp, Artificial sequence
  SiRNA target sequence
tcaaaaatagtgcgcttcg

SEQ ID NO: 95417 - DNA, 19 bp, Artificial sequence
  SiRNA target sequence
caaaaatagtgcgcttcgg

SEQ ID NO: 95418 - DNA, 19 bp, Artificial sequence
  SiRNA target sequence
aaaaatagtgcgcttcggt

SEQ ID NO: 95419 - DNA, 19 bp, Artificial sequence
  SiRNA target sequence
aaaatagtgcgcttcggta

SEQ ID NO: 95420 - DNA, 19 bp, Artificial sequence
  SiRNA target sequence
aaatagtgcgcttcggtag

SEQ ID NO: 95421 - DNA, 19 bp, Artificial sequence
  SiRNA target sequence
aatagtgcgcttcggtagt

SEQ ID NO: 95422 - DNA, 19 bp, Artificial sequence
  SiRNA target sequence
atagtgcgcttcggtagta

SEQ ID NO: 95423 - DNA, 19 bp, Artificial sequence
  SiRNA target sequence
tagtgcgcttcggtagtaa

SEQ ID NO: 95424 - DNA, 19 bp, Artificial sequence
  SiRNA target sequence
agtgcgcttcggtagtaaa

SEQ ID NO: 95425 - DNA, 19 bp, Artificial sequence
  SiRNA target sequence
gtgcgcttcggtagtaaaa

SEQ ID NO: 95426 - DNA, 19 bp, Artificial sequence
  SiRNA target sequence
tgcgcttcggtagtaaaat

SEQ ID NO: 95427 - DNA, 19 bp, Artificial sequence
  SiRNA target sequence
gcgcttcggtagtaaaatg

SEQ ID NO: 95428 - DNA, 19 bp, Artificial sequence
  SiRNA target sequence
cgcttcggtagtaaaatgt

SEQ ID NO: 95429 - DNA, 19 bp, Artificial sequence
  SiRNA target sequence
gcttcggtagtaaaatgta

SEQ ID NO: 95430 - DNA, 19 bp, Artificial sequence
  SiRNA target sequence
cttcggtagtaaaatgtaa

SEQ ID NO: 95431 - DNA, 19 bp, Artificial sequence
  SiRNA target sequence
ttcggtagtaaaatgtaat

SEQ ID NO: 95432 - DNA, 19 bp, Artificial sequence
  SiRNA target sequence
tcggtagtaaaatgtaatc

SEQ ID NO: 95433 - DNA, 19 bp, Artificial sequence
  SiRNA target sequence
cggtagtaaaatgtaatca

SEQ ID NO: 95434 - DNA, 19 bp, Artificial sequence
  SiRNA target sequence
ggtagtaaaatgtaatcat

SEQ ID NO: 95435 - DNA, 19 bp, Artificial sequence
  SiRNA target sequence
gtagtaaaatgtaatcata

SEQ ID NO: 95436 - DNA, 19 bp, Artificial sequence
  SiRNA target sequence
tagtaaaatgtaatcatag

SEQ ID NO: 95437 - DNA, 19 bp, Artificial sequence
  SiRNA target sequence
agtaaaatgtaatcatagt

SEQ ID NO: 95438 - DNA, 19 bp, Artificial sequence
  SiRNA target sequence
gtaaaatgtaatcatagta

SEQ ID NO: 95439 - DNA, 19 bp, Artificial sequence
  SiRNA target sequence
taaaatgtaatcatagtac

SEQ ID NO: 95440 - DNA, 19 bp, Artificial sequence
  SiRNA target sequence
aaaatgtaatcatagtaca

SEQ ID NO: 95441 - DNA, 19 bp, Artificial sequence
  SiRNA target sequence
aaatgtaatcatagtacag

SEQ ID NO: 95442 - DNA, 19 bp, Artificial sequence
  SiRNA target sequence
aatgtaatcatagtacaga

SEQ ID NO: 95443 - DNA, 19 bp, Artificial sequence
  SiRNA target sequence
atgtaatcatagtacagat

SEQ ID NO: 95444 - DNA, 19 bp, Artificial sequence
  SiRNA target sequence
tgtaatcatagtacagatc

SEQ ID NO: 95445 - DNA, 19 bp, Artificial sequence
  SiRNA target sequence
gtaatcatagtacagatcg

SEQ ID NO: 95446 - DNA, 19 bp, Artificial sequence
  SiRNA target sequence
taatcatagtacagatcgt

SEQ ID NO: 95447 - DNA, 19 bp, Artificial sequence
  SiRNA target sequence
aatcatagtacagatcgta

SEQ ID NO: 95448 - DNA, 19 bp, Artificial sequence
  SiRNA target sequence
atcatagtacagatcgtaa

SEQ ID NO: 95449 - DNA, 19 bp, Artificial sequence
  SiRNA target sequence
tcatagtacagatcgtaat

SEQ ID NO: 95450 - DNA, 19 bp, Artificial sequence
  SiRNA target sequence
catagtacagatcgtaatt

SEQ ID NO: 95451 - DNA, 19 bp, Artificial sequence
  SiRNA target sequence
atagtacagatcgtaattt

SEQ ID NO: 95452 - DNA, 19 bp, Artificial sequence
  SiRNA target sequence
tagtacagatcgtaattta

SEQ ID NO: 95453 - DNA, 19 bp, Artificial sequence
  SiRNA target sequence
agtacagatcgtaatttag

SEQ ID NO: 95454 - DNA, 19 bp, Artificial sequence
  SiRNA target sequence
gtacagatcgtaatttaga

SEQ ID NO: 95455 - DNA, 19 bp, Artificial sequence
  SiRNA target sequence
tacagatcgtaatttagat

SEQ ID NO: 95456 - DNA, 19 bp, Artificial sequence
  SiRNA target sequence
acagatcgtaatttagata

SEQ ID NO: 95457 - DNA, 19 bp, Artificial sequence
  SiRNA target sequence
cagatcgtaatttagataa

SEQ ID NO: 95458 - DNA, 19 bp, Artificial sequence
  SiRNA target sequence
agatcgtaatttagataaa

SEQ ID NO: 95459 - DNA, 19 bp, Artificial sequence
  SiRNA target sequence
gatcgtaatttagataaat

SEQ ID NO: 95460 - DNA, 19 bp, Artificial sequence
  SiRNA target sequence
atcgtaatttagataaatt

SEQ ID NO: 95461 - DNA, 19 bp, Artificial sequence
  SiRNA target sequence
tcgtaatttagataaattt

SEQ ID NO: 95462 - DNA, 19 bp, Artificial sequence
  SiRNA target sequence
cgtaatttagataaatttc

SEQ ID NO: 95463 - DNA, 19 bp, Artificial sequence
  SiRNA target sequence
gtaatttagataaatttct

SEQ ID NO: 95464 - DNA, 19 bp, Artificial sequence
  SiRNA target sequence
taatttagataaatttctt

SEQ ID NO: 95465 - DNA, 19 bp, Artificial sequence
  SiRNA target sequence
aatttagataaatttcttt

SEQ ID NO: 95466 - DNA, 19 bp, Artificial sequence
  SiRNA target sequence
atttagataaatttcttta

SEQ ID NO: 95467 - DNA, 19 bp, Artificial sequence
  SiRNA target sequence
tttagataaatttctttac

SEQ ID NO: 95468 - DNA, 19 bp, Artificial sequence
  SiRNA target sequence
ttagataaatttctttaca

SEQ ID NO: 95469 - DNA, 19 bp, Artificial sequence
  SiRNA target sequence
tagataaatttctttacat

SEQ ID NO: 95470 - DNA, 19 bp, Artificial sequence
  SiRNA target sequence
agataaatttctttacatt

SEQ ID NO: 95471 - DNA, 19 bp, Artificial sequence
  SiRNA target sequence
gataaatttctttacattt

SEQ ID NO: 95472 - DNA, 19 bp, Artificial sequence
  SiRNA target sequence
ataaatttctttacatttc

SEQ ID NO: 95473 - DNA, 19 bp, Artificial sequence
  SiRNA target sequence
taaatttctttacatttct

SEQ ID NO: 95474 - DNA, 19 bp, Artificial sequence
  SiRNA target sequence
aaatttctttacatttctc

SEQ ID NO: 95475 - DNA, 19 bp, Artificial sequence
  SiRNA target sequence
aatttctttacatttctca

SEQ ID NO: 95476 - DNA, 19 bp, Artificial sequence
  SiRNA target sequence
atttctttacatttctcac

SEQ ID NO: 95477 - DNA, 19 bp, Artificial sequence
  SiRNA target sequence
tttctttacatttctcacg

SEQ ID NO: 95478 - DNA, 19 bp, Artificial sequence
  SiRNA target sequence
ttctttacatttctcacga

SEQ ID NO: 95479 - DNA, 19 bp, Artificial sequence
  SiRNA target sequence
tctttacatttctcacgat

SEQ ID NO: 95480 - DNA, 19 bp, Artificial sequence
  SiRNA target sequence
ctttacatttctcacgata

SEQ ID NO: 95481 - DNA, 19 bp, Artificial sequence
  SiRNA target sequence
tttacatttctcacgatat

SEQ ID NO: 95482 - DNA, 19 bp, Artificial sequence
  SiRNA target sequence
ttacatttctcacgatatt

SEQ ID NO: 95483 - DNA, 19 bp, Artificial sequence
  SiRNA target sequence
tacatttctcacgatattc

SEQ ID NO: 95484 - DNA, 19 bp, Artificial sequence
  SiRNA target sequence
acatttctcacgatattcc

SEQ ID NO: 95485 - DNA, 19 bp, Artificial sequence
  SiRNA target sequence
catttctcacgatattcct

SEQ ID NO: 95486 - DNA, 19 bp, Artificial sequence
  SiRNA target sequence
atttctcacgatattcctc

SEQ ID NO: 95487 - DNA, 19 bp, Artificial sequence
  SiRNA target sequence
tttctcacgatattcctca

SEQ ID NO: 95488 - DNA, 19 bp, Artificial sequence
  SiRNA target sequence
ttctcacgatattcctcag

SEQ ID NO: 95489 - DNA, 19 bp, Artificial sequence
  SiRNA target sequence
tctcacgatattcctcagc

SEQ ID NO: 95490 - DNA, 19 bp, Artificial sequence
  SiRNA target sequence
ctcacgatattcctcagca

SEQ ID NO: 95491 - DNA, 19 bp, Artificial sequence
  SiRNA target sequence
tcacgatattcctcagcaa

SEQ ID NO: 95492 - DNA, 19 bp, Artificial sequence
  SiRNA target sequence
cacgatattcctcagcaat

SEQ ID NO: 95493 - DNA, 19 bp, Artificial sequence
  SiRNA target sequence
acgatattcctcagcaatg

SEQ ID NO: 95494 - DNA, 19 bp, Artificial sequence
  SiRNA target sequence
cgatattcctcagcaatgg

SEQ ID NO: 95495 - DNA, 19 bp, Artificial sequence
  SiRNA target sequence
gatattcctcagcaatggt

SEQ ID NO: 95496 - DNA, 19 bp, Artificial sequence
  SiRNA target sequence
atattcctcagcaatggta

SEQ ID NO: 95497 - DNA, 19 bp, Artificial sequence
  SiRNA target sequence
tattcctcagcaatggtat

SEQ ID NO: 95498 - DNA, 19 bp, Artificial sequence
  SiRNA target sequence
attcctcagcaatggtatc

SEQ ID NO: 95499 - DNA, 19 bp, Artificial sequence
  SiRNA target sequence
ttcctcagcaatggtatct

SEQ ID NO: 95500 - DNA, 19 bp, Artificial sequence
  SiRNA target sequence
tcctcagcaatggtatctg

SEQ ID NO: 95501 - DNA, 19 bp, Artificial sequence
  SiRNA target sequence
cctcagcaatggtatctgt

SEQ ID NO: 95502 - DNA, 19 bp, Artificial sequence
  SiRNA target sequence
ctcagcaatggtatctgtg

SEQ ID NO: 95503 - DNA, 19 bp, Artificial sequence
  SiRNA target sequence
tcagcaatggtatctgtga

SEQ ID NO: 95504 - DNA, 19 bp, Artificial sequence
  SiRNA target sequence
cagcaatggtatctgtgat

SEQ ID NO: 95505 - DNA, 19 bp, Artificial sequence
  SiRNA target sequence
agcaatggtatctgtgata

SEQ ID NO: 95506 - DNA, 19 bp, Artificial sequence
  SiRNA target sequence
gcaatggtatctgtgataa

SEQ ID NO: 95507 - DNA, 19 bp, Artificial sequence
  SiRNA target sequence
caatggtatctgtgataag

SEQ ID NO: 95508 - DNA, 19 bp, Artificial sequence
  SiRNA target sequence
aatggtatctgtgataagc

SEQ ID NO: 95509 - DNA, 19 bp, Artificial sequence
  SiRNA target sequence
atggtatctgtgataagcg

SEQ ID NO: 95510 - DNA, 19 bp, Artificial sequence
  SiRNA target sequence
tggtatctgtgataagcga

SEQ ID NO: 95511 - DNA, 19 bp, Artificial sequence
  SiRNA target sequence
ggtatctgtgataagcgaa

SEQ ID NO: 95512 - DNA, 19 bp, Artificial sequence
  SiRNA target sequence
gtatctgtgataagcgaaa

SEQ ID NO: 95513 - DNA, 19 bp, Artificial sequence
  SiRNA target sequence
tatctgtgataagcgaaag

SEQ ID NO: 95514 - DNA, 19 bp, Artificial sequence
  SiRNA target sequence
atctgtgataagcgaaagt

SEQ ID NO: 95515 - DNA, 19 bp, Artificial sequence
  SiRNA target sequence
tctgtgataagcgaaagtt

SEQ ID NO: 95516 - DNA, 19 bp, Artificial sequence
  SiRNA target sequence
ctgtgataagcgaaagttg

SEQ ID NO: 95517 - DNA, 19 bp, Artificial sequence
  SiRNA target sequence
tgtgataagcgaaagttgt

SEQ ID NO: 95518 - DNA, 19 bp, Artificial sequence
  SiRNA target sequence
gtgataagcgaaagttgta

SEQ ID NO: 95519 - DNA, 19 bp, Artificial sequence
  SiRNA target sequence
tgataagcgaaagttgtag

SEQ ID NO: 95520 - DNA, 19 bp, Artificial sequence
  SiRNA target sequence
gataagcgaaagttgtaga

SEQ ID NO: 95521 - DNA, 19 bp, Artificial sequence
  SiRNA target sequence
ataagcgaaagttgtagaa

SEQ ID NO: 95522 - DNA, 19 bp, Artificial sequence
  SiRNA target sequence
taagcgaaagttgtagaaa

SEQ ID NO: 95523 - DNA, 19 bp, Artificial sequence
  SiRNA target sequence
aagcgaaagttgtagaaaa

SEQ ID NO: 95524 - DNA, 19 bp, Artificial sequence
  SiRNA target sequence
agcgaaagttgtagaaaaa

SEQ ID NO: 95525 - DNA, 19 bp, Artificial sequence
  SiRNA target sequence
gcgaaagttgtagaaaaaa

SEQ ID NO: 95526 - DNA, 19 bp, Artificial sequence
  SiRNA target sequence
cgaaagttgtagaaaaaaa

SEQ ID NO: 95527 - DNA, 19 bp, Artificial sequence
  SiRNA target sequence
gaaagttgtagaaaaaaat

SEQ ID NO: 95528 - DNA, 19 bp, Artificial sequence
  SiRNA target sequence
aaagttgtagaaaaaaata

SEQ ID NO: 95529 - DNA, 19 bp, Artificial sequence
  SiRNA target sequence
aagttgtagaaaaaaatag

SEQ ID NO: 95530 - DNA, 19 bp, Artificial sequence
  SiRNA target sequence
agttgtagaaaaaaataga

SEQ ID NO: 95531 - DNA, 19 bp, Artificial sequence
  SiRNA target sequence
gttgtagaaaaaaatagat

SEQ ID NO: 95532 - DNA, 19 bp, Artificial sequence
  SiRNA target sequence
ttgtagaaaaaaatagatt

SEQ ID NO: 95533 - DNA, 19 bp, Artificial sequence
  SiRNA target sequence
tgtagaaaaaaatagattt

SEQ ID NO: 95534 - DNA, 19 bp, Artificial sequence
  SiRNA target sequence
gtagaaaaaaatagatttg

SEQ ID NO: 95535 - DNA, 19 bp, Artificial sequence
  SiRNA target sequence
tagaaaaaaatagatttga

SEQ ID NO: 95536 - DNA, 19 bp, Artificial sequence
  SiRNA target sequence
agaaaaaaatagatttgag

SEQ ID NO: 95537 - DNA, 19 bp, Artificial sequence
  SiRNA target sequence
gaaaaaaatagatttgagg

SEQ ID NO: 95538 - DNA, 19 bp, Artificial sequence
  SiRNA target sequence
aaaaaaatagatttgagga

SEQ ID NO: 95539 - DNA, 19 bp, Artificial sequence
  SiRNA target sequence
aaaaaatagatttgaggaa

SEQ ID NO: 95540 - DNA, 19 bp, Artificial sequence
  SiRNA target sequence
aaaaatagatttgaggaat

SEQ ID NO: 95541 - DNA, 19 bp, Artificial sequence
  SiRNA target sequence
aaaatagatttgaggaata

SEQ ID NO: 95542 - DNA, 19 bp, Artificial sequence
  SiRNA target sequence
aaatagatttgaggaatag

SEQ ID NO: 95543 - DNA, 19 bp, Artificial sequence
  SiRNA target sequence
aatagatttgaggaataga

SEQ ID NO: 95544 - DNA, 19 bp, Artificial sequence
  SiRNA target sequence
atagatttgaggaatagaa

SEQ ID NO: 95545 - DNA, 19 bp, Artificial sequence
  SiRNA target sequence
tagatttgaggaatagaat

SEQ ID NO: 95546 - DNA, 19 bp, Artificial sequence
  SiRNA target sequence
agatttgaggaatagaatt

SEQ ID NO: 95547 - DNA, 19 bp, Artificial sequence
  SiRNA target sequence
gatttgaggaatagaatta

SEQ ID NO: 95548 - DNA, 19 bp, Artificial sequence
  SiRNA target sequence
atttgaggaatagaattaa

SEQ ID NO: 95549 - DNA, 19 bp, Artificial sequence
  SiRNA target sequence
tttgaggaatagaattaaa

SEQ ID NO: 95550 - DNA, 19 bp, Artificial sequence
  SiRNA target sequence
ttgaggaatagaattaaaa

SEQ ID NO: 95551 - DNA, 19 bp, Artificial sequence
  SiRNA target sequence
tgaggaatagaattaaaat

SEQ ID NO: 95552 - DNA, 19 bp, Artificial sequence
  SiRNA target sequence
gaggaatagaattaaaatc

SEQ ID NO: 95553 - DNA, 19 bp, Artificial sequence
  SiRNA target sequence
aggaatagaattaaaatca

SEQ ID NO: 95554 - DNA, 19 bp, Artificial sequence
  SiRNA target sequence
ggaatagaattaaaatcac

SEQ ID NO: 95555 - DNA, 19 bp, Artificial sequence
  SiRNA target sequence
gaatagaattaaaatcaca

SEQ ID NO: 95556 - DNA, 19 bp, Artificial sequence
  SiRNA target sequence
aatagaattaaaatcacaa

SEQ ID NO: 95557 - DNA, 19 bp, Artificial sequence
  SiRNA target sequence
atagaattaaaatcacaat

SEQ ID NO: 95558 - DNA, 19 bp, Artificial sequence
  SiRNA target sequence
tagaattaaaatcacaata

SEQ ID NO: 95559 - DNA, 19 bp, Artificial sequence
  SiRNA target sequence
agaattaaaatcacaatat

SEQ ID NO: 95560 - DNA, 19 bp, Artificial sequence
  SiRNA target sequence
gaattaaaatcacaatatt

SEQ ID NO: 95561 - DNA, 19 bp, Artificial sequence
  SiRNA target sequence
aattaaaatcacaatattt

SEQ ID NO: 95562 - DNA, 19 bp, Artificial sequence
  SiRNA target sequence
attaaaatcacaatatttt

SEQ ID NO: 95563 - DNA, 19 bp, Artificial sequence
  SiRNA target sequence
ttaaaatcacaatattttt

SEQ ID NO: 95564 - DNA, 19 bp, Artificial sequence
  SiRNA target sequence
taaaatcacaatatttttt

SEQ ID NO: 95565 - DNA, 19 bp, Artificial sequence
  SiRNA target sequence
aaaatcacaatatttttta

SEQ ID NO: 95566 - DNA, 19 bp, Artificial sequence
  SiRNA target sequence
aaatcacaatattttttaa

SEQ ID NO: 95567 - DNA, 19 bp, Artificial sequence
  SiRNA target sequence
aatcacaatattttttaat

SEQ ID NO: 95568 - DNA, 19 bp, Artificial sequence
  SiRNA target sequence
atcacaatattttttaata

SEQ ID NO: 95569 - DNA, 19 bp, Artificial sequence
  SiRNA target sequence
tcacaatattttttaatat

SEQ ID NO: 95570 - DNA, 19 bp, Artificial sequence
  SiRNA target sequence
cacaatattttttaatata

SEQ ID NO: 95571 - DNA, 19 bp, Artificial sequence
  SiRNA target sequence
acaatattttttaatatat

SEQ ID NO: 95572 - DNA, 19 bp, Artificial sequence
  SiRNA target sequence
caatattttttaatatatt

SEQ ID NO: 95573 - DNA, 19 bp, Artificial sequence
  SiRNA target sequence
aatattttttaatatattt

SEQ ID NO: 95574 - DNA, 19 bp, Artificial sequence
  SiRNA target sequence
atattttttaatatattta

SEQ ID NO: 95575 - DNA, 19 bp, Artificial sequence
  SiRNA target sequence
tattttttaatatatttaa

SEQ ID NO: 95576 - DNA, 19 bp, Artificial sequence
  SiRNA target sequence
attttttaatatatttaac

SEQ ID NO: 95577 - DNA, 19 bp, Artificial sequence
  SiRNA target sequence
ttttttaatatatttaacc

SEQ ID NO: 95578 - DNA, 19 bp, Artificial sequence
  SiRNA target sequence
tttttaatatatttaacca

SEQ ID NO: 95579 - DNA, 19 bp, Artificial sequence
  SiRNA target sequence
ttttaatatatttaaccaa

SEQ ID NO: 95580 - DNA, 19 bp, Artificial sequence
  SiRNA target sequence
tttaatatatttaaccaag

SEQ ID NO: 95581 - DNA, 19 bp, Artificial sequence
  SiRNA target sequence
ttaatatatttaaccaagg

SEQ ID NO: 95582 - DNA, 19 bp, Artificial sequence
  SiRNA target sequence
taatatatttaaccaaggt

SEQ ID NO: 95583 - DNA, 19 bp, Artificial sequence
  SiRNA target sequence
aatatatttaaccaaggta

SEQ ID NO: 95584 - DNA, 19 bp, Artificial sequence
  SiRNA target sequence
atatatttaaccaaggtat

SEQ ID NO: 95585 - DNA, 19 bp, Artificial sequence
  SiRNA target sequence
tatatttaaccaaggtatt

SEQ ID NO: 95586 - DNA, 19 bp, Artificial sequence
  SiRNA target sequence
atatttaaccaaggtattg

SEQ ID NO: 95587 - DNA, 19 bp, Artificial sequence
  SiRNA target sequence
tatttaaccaaggtattgt

SEQ ID NO: 95588 - DNA, 19 bp, Artificial sequence
  SiRNA target sequence
atttaaccaaggtattgtc

SEQ ID NO: 95589 - DNA, 19 bp, Artificial sequence
  SiRNA target sequence
tttaaccaaggtattgtcc

SEQ ID NO: 95590 - DNA, 19 bp, Artificial sequence
  SiRNA target sequence
ttaaccaaggtattgtcct

SEQ ID NO: 95591 - DNA, 19 bp, Artificial sequence
  SiRNA target sequence
taaccaaggtattgtcctt

SEQ ID NO: 95592 - DNA, 19 bp, Artificial sequence
  SiRNA target sequence
aaccaaggtattgtccttt

SEQ ID NO: 95593 - DNA, 19 bp, Artificial sequence
  SiRNA target sequence
accaaggtattgtccttta

SEQ ID NO: 95594 - DNA, 19 bp, Artificial sequence
  SiRNA target sequence
ccaaggtattgtcctttat

SEQ ID NO: 95595 - DNA, 19 bp, Artificial sequence
  SiRNA target sequence
caaggtattgtcctttatg

SEQ ID NO: 95596 - DNA, 19 bp, Artificial sequence
  SiRNA target sequence
aaggtattgtcctttatgt

SEQ ID NO: 95597 - DNA, 19 bp, Artificial sequence
  SiRNA target sequence
aggtattgtcctttatgtt

SEQ ID NO: 95598 - DNA, 19 bp, Artificial sequence
  SiRNA target sequence
ggtattgtcctttatgtta

SEQ ID NO: 95599 - DNA, 19 bp, Artificial sequence
  SiRNA target sequence
gtattgtcctttatgttat

SEQ ID NO: 95600 - DNA, 19 bp, Artificial sequence
  SiRNA target sequence
tattgtcctttatgttatt

SEQ ID NO: 95601 - DNA, 19 bp, Artificial sequence
  SiRNA target sequence
attgtcctttatgttatta

SEQ ID NO: 95602 - DNA, 19 bp, Artificial sequence
  SiRNA target sequence
ttgtcctttatgttattat

SEQ ID NO: 95603 - DNA, 19 bp, Artificial sequence
  SiRNA target sequence
tgtcctttatgttattata

SEQ ID NO: 95604 - DNA, 19 bp, Artificial sequence
  SiRNA target sequence
gtcctttatgttattatat

SEQ ID NO: 95605 - DNA, 19 bp, Artificial sequence
  SiRNA target sequence
tcctttatgttattatatc

SEQ ID NO: 95606 - DNA, 19 bp, Artificial sequence
  SiRNA target sequence
cctttatgttattatatct

SEQ ID NO: 95607 - DNA, 19 bp, Artificial sequence
  SiRNA target sequence
ctttatgttattatatctt

SEQ ID NO: 95608 - DNA, 19 bp, Artificial sequence
  SiRNA target sequence
tttatgttattatatctta

SEQ ID NO: 95609 - DNA, 19 bp, Artificial sequence
  SiRNA target sequence
ttatgttattatatcttac

SEQ ID NO: 95610 - DNA, 19 bp, Artificial sequence
  SiRNA target sequence
tatgttattatatcttaca

SEQ ID NO: 95611 - DNA, 19 bp, Artificial sequence
  SiRNA target sequence
atgttattatatcttacaa

SEQ ID NO: 95612 - DNA, 19 bp, Artificial sequence
  SiRNA target sequence
tgttattatatcttacaaa

SEQ ID NO: 95613 - DNA, 19 bp, Artificial sequence
  SiRNA target sequence
gttattatatcttacaaac

SEQ ID NO: 95614 - DNA, 19 bp, Artificial sequence
  SiRNA target sequence
ttattatatcttacaaact

SEQ ID NO: 95615 - DNA, 19 bp, Artificial sequence
  SiRNA target sequence
tattatatcttacaaactc

SEQ ID NO: 95616 - DNA, 19 bp, Artificial sequence
  SiRNA target sequence
attatatcttacaaactcc

SEQ ID NO: 95617 - DNA, 19 bp, Artificial sequence
  SiRNA target sequence
ttatatcttacaaactcct

SEQ ID NO: 95618 - DNA, 19 bp, Artificial sequence
  SiRNA target sequence
tatatcttacaaactcctc

SEQ ID NO: 95619 - DNA, 19 bp, Artificial sequence
  SiRNA target sequence
atatcttacaaactcctcg

SEQ ID NO: 95620 - DNA, 19 bp, Artificial sequence
  SiRNA target sequence
tatcttacaaactcctcgt

SEQ ID NO: 95621 - DNA, 19 bp, Artificial sequence
  SiRNA target sequence
atcttacaaactcctcgta

SEQ ID NO: 95622 - DNA, 19 bp, Artificial sequence
  SiRNA target sequence
tcttacaaactcctcgtaa

SEQ ID NO: 95623 - DNA, 19 bp, Artificial sequence
  SiRNA target sequence
cttacaaactcctcgtaat

SEQ ID NO: 95624 - DNA, 19 bp, Artificial sequence
  SiRNA target sequence
ttacaaactcctcgtaatt

SEQ ID NO: 95625 - DNA, 19 bp, Artificial sequence
  SiRNA target sequence
tacaaactcctcgtaatta

SEQ ID NO: 95626 - DNA, 19 bp, Artificial sequence
  SiRNA target sequence
acaaactcctcgtaattat

SEQ ID NO: 95627 - DNA, 19 bp, Artificial sequence
  SiRNA target sequence
caaactcctcgtaattata

SEQ ID NO: 95628 - DNA, 19 bp, Artificial sequence
  SiRNA target sequence
aaactcctcgtaattataa

SEQ ID NO: 95629 - DNA, 19 bp, Artificial sequence
  SiRNA target sequence
aactcctcgtaattataat

SEQ ID NO: 95630 - DNA, 19 bp, Artificial sequence
  SiRNA target sequence
actcctcgtaattataatt

SEQ ID NO: 95631 - DNA, 19 bp, Artificial sequence
  SiRNA target sequence
ctcctcgtaattataattt

SEQ ID NO: 95632 - DNA, 19 bp, Artificial sequence
  SiRNA target sequence
tcctcgtaattataatttt

SEQ ID NO: 95633 - DNA, 19 bp, Artificial sequence
  SiRNA target sequence
cctcgtaattataattttc

SEQ ID NO: 95634 - DNA, 19 bp, Artificial sequence
  SiRNA target sequence
ctcgtaattataattttca

SEQ ID NO: 95635 - DNA, 19 bp, Artificial sequence
  SiRNA target sequence
tcgtaattataattttcag

SEQ ID NO: 95636 - DNA, 19 bp, Artificial sequence
  SiRNA target sequence
cgtaattataattttcagg

SEQ ID NO: 95637 - DNA, 19 bp, Artificial sequence
  SiRNA target sequence
gtaattataattttcagga

SEQ ID NO: 95638 - DNA, 19 bp, Artificial sequence
  SiRNA target sequence
taattataattttcaggat

SEQ ID NO: 95639 - DNA, 19 bp, Artificial sequence
  SiRNA target sequence
aattataattttcaggata

SEQ ID NO: 95640 - DNA, 19 bp, Artificial sequence
  SiRNA target sequence
attataattttcaggataa

SEQ ID NO: 95641 - DNA, 19 bp, Artificial sequence
  SiRNA target sequence
ttataattttcaggataaa

SEQ ID NO: 95642 - DNA, 19 bp, Artificial sequence
  SiRNA target sequence
tataattttcaggataaac

SEQ ID NO: 95643 - DNA, 19 bp, Artificial sequence
  SiRNA target sequence
ataattttcaggataaacc

SEQ ID NO: 95644 - DNA, 19 bp, Artificial sequence
  SiRNA target sequence
taattttcaggataaaccg

SEQ ID NO: 95645 - DNA, 19 bp, Artificial sequence
  SiRNA target sequence
aattttcaggataaaccgc

SEQ ID NO: 95646 - DNA, 19 bp, Artificial sequence
  SiRNA target sequence
attttcaggataaaccgct

SEQ ID NO: 95647 - DNA, 19 bp, Artificial sequence
  SiRNA target sequence
ttttcaggataaaccgcta

SEQ ID NO: 95648 - DNA, 19 bp, Artificial sequence
  SiRNA target sequence
tttcaggataaaccgctag

SEQ ID NO: 95649 - DNA, 19 bp, Artificial sequence
  SiRNA target sequence
ttcaggataaaccgctaga

SEQ ID NO: 95650 - DNA, 19 bp, Artificial sequence
  SiRNA target sequence
tcaggataaaccgctagac

SEQ ID NO: 95651 - DNA, 19 bp, Artificial sequence
  SiRNA target sequence
caggataaaccgctagaca

SEQ ID NO: 95652 - DNA, 19 bp, Artificial sequence
  SiRNA target sequence
aggataaaccgctagacaa

SEQ ID NO: 95653 - DNA, 19 bp, Artificial sequence
  SiRNA target sequence
ggataaaccgctagacaat

SEQ ID NO: 95654 - DNA, 19 bp, Artificial sequence
  SiRNA target sequence
gataaaccgctagacaatc

SEQ ID NO: 95655 - DNA, 19 bp, Artificial sequence
  SiRNA target sequence
ataaaccgctagacaatca

SEQ ID NO: 95656 - DNA, 19 bp, Artificial sequence
  SiRNA target sequence
taaaccgctagacaatcac

SEQ ID NO: 95657 - DNA, 19 bp, Artificial sequence
  SiRNA target sequence
aaaccgctagacaatcacc

SEQ ID NO: 95658 - DNA, 19 bp, Artificial sequence
  SiRNA target sequence
aaccgctagacaatcaccg

SEQ ID NO: 95659 - DNA, 19 bp, Artificial sequence
  SiRNA target sequence
accgctagacaatcaccga

SEQ ID NO: 95660 - DNA, 19 bp, Artificial sequence
  SiRNA target sequence
ccgctagacaatcaccgat

SEQ ID NO: 95661 - DNA, 19 bp, Artificial sequence
  SiRNA target sequence
cgctagacaatcaccgatt

SEQ ID NO: 95662 - DNA, 19 bp, Artificial sequence
  SiRNA target sequence
gctagacaatcaccgattt

SEQ ID NO: 95663 - DNA, 19 bp, Artificial sequence
  SiRNA target sequence
ctagacaatcaccgatttc

SEQ ID NO: 95664 - DNA, 19 bp, Artificial sequence
  SiRNA target sequence
tagacaatcaccgatttca

SEQ ID NO: 95665 - DNA, 19 bp, Artificial sequence
  SiRNA target sequence
agacaatcaccgatttcaa

SEQ ID NO: 95666 - DNA, 19 bp, Artificial sequence
  SiRNA target sequence
gacaatcaccgatttcaaa

SEQ ID NO: 95667 - DNA, 19 bp, Artificial sequence
  SiRNA target sequence
acaatcaccgatttcaaaa

SEQ ID NO: 95668 - DNA, 19 bp, Artificial sequence
  SiRNA target sequence
caatcaccgatttcaaaat

SEQ ID NO: 95669 - DNA, 19 bp, Artificial sequence
  SiRNA target sequence
aatcaccgatttcaaaatt

SEQ ID NO: 95670 - DNA, 19 bp, Artificial sequence
  SiRNA target sequence
atcaccgatttcaaaattt

SEQ ID NO: 95671 - DNA, 19 bp, Artificial sequence
  SiRNA target sequence
tcaccgatttcaaaatttt

SEQ ID NO: 95672 - DNA, 19 bp, Artificial sequence
  SiRNA target sequence
caccgatttcaaaattttc

SEQ ID NO: 95673 - DNA, 19 bp, Artificial sequence
  SiRNA target sequence
accgatttcaaaattttct

SEQ ID NO: 95674 - DNA, 19 bp, Artificial sequence
  SiRNA target sequence
ccgatttcaaaattttcta

SEQ ID NO: 95675 - DNA, 19 bp, Artificial sequence
  SiRNA target sequence
cgatttcaaaattttctat

SEQ ID NO: 95676 - DNA, 19 bp, Artificial sequence
  SiRNA target sequence
gatttcaaaattttctata

SEQ ID NO: 95677 - DNA, 19 bp, Artificial sequence
  SiRNA target sequence
atttcaaaattttctatat

SEQ ID NO: 95678 - DNA, 19 bp, Artificial sequence
  SiRNA target sequence
tttcaaaattttctatatc

SEQ ID NO: 95679 - DNA, 19 bp, Artificial sequence
  SiRNA target sequence
ttcaaaattttctatatct

SEQ ID NO: 95680 - DNA, 19 bp, Artificial sequence
  SiRNA target sequence
tcaaaattttctatatcta

SEQ ID NO: 95681 - DNA, 19 bp, Artificial sequence
  SiRNA target sequence
caaaattttctatatctat

SEQ ID NO: 95682 - DNA, 19 bp, Artificial sequence
  SiRNA target sequence
aaaattttctatatctata

SEQ ID NO: 95683 - DNA, 19 bp, Artificial sequence
  SiRNA target sequence
aaattttctatatctatat

SEQ ID NO: 95684 - DNA, 19 bp, Artificial sequence
  SiRNA target sequence
aattttctatatctatatc

SEQ ID NO: 95685 - DNA, 19 bp, Artificial sequence
  SiRNA target sequence
attttctatatctatatca

SEQ ID NO: 95686 - DNA, 19 bp, Artificial sequence
  SiRNA target sequence
ttttctatatctatatcaa

SEQ ID NO: 95687 - DNA, 19 bp, Artificial sequence
  SiRNA target sequence
tttctatatctatatcaaa

SEQ ID NO: 95688 - DNA, 19 bp, Artificial sequence
  SiRNA target sequence
ttctatatctatatcaaat

SEQ ID NO: 95689 - DNA, 19 bp, Artificial sequence
  SiRNA target sequence
tctatatctatatcaaatt

SEQ ID NO: 95690 - DNA, 19 bp, Artificial sequence
  SiRNA target sequence
ctatatctatatcaaattt

SEQ ID NO: 95691 - DNA, 19 bp, Artificial sequence
  SiRNA target sequence
tatatctatatcaaatttt

SEQ ID NO: 95692 - DNA, 19 bp, Artificial sequence
  SiRNA target sequence
atatctatatcaaatttta

SEQ ID NO: 95693 - DNA, 19 bp, Artificial sequence
  SiRNA target sequence
tatctatatcaaattttat

SEQ ID NO: 95694 - DNA, 19 bp, Artificial sequence
  SiRNA target sequence
atctatatcaaattttatt

SEQ ID NO: 95695 - DNA, 19 bp, Artificial sequence
  SiRNA target sequence
tctatatcaaattttattt

SEQ ID NO: 95696 - DNA, 19 bp, Artificial sequence
  SiRNA target sequence
ctatatcaaattttatttc

SEQ ID NO: 95697 - DNA, 19 bp, Artificial sequence
  SiRNA target sequence
tatatcaaattttatttct

SEQ ID NO: 95698 - DNA, 19 bp, Artificial sequence
  SiRNA target sequence
atatcaaattttatttcta

SEQ ID NO: 95699 - DNA, 19 bp, Artificial sequence
  SiRNA target sequence
tatcaaattttatttctaa

SEQ ID NO: 95700 - DNA, 19 bp, Artificial sequence
  SiRNA target sequence
atcaaattttatttctaaa

SEQ ID NO: 95701 - DNA, 19 bp, Artificial sequence
  SiRNA target sequence
tcaaattttatttctaaaa

SEQ ID NO: 95702 - DNA, 19 bp, Artificial sequence
  SiRNA target sequence
caaattttatttctaaaat

SEQ ID NO: 95703 - DNA, 19 bp, Artificial sequence
  SiRNA target sequence
aaattttatttctaaaata

SEQ ID NO: 95704 - DNA, 19 bp, Artificial sequence
  SiRNA target sequence
aattttatttctaaaatag

SEQ ID NO: 95705 - DNA, 19 bp, Artificial sequence
  SiRNA target sequence
attttatttctaaaatagg

SEQ ID NO: 95706 - DNA, 19 bp, Artificial sequence
  SiRNA target sequence
ttttatttctaaaatagga

SEQ ID NO: 95707 - DNA, 19 bp, Artificial sequence
  SiRNA target sequence
tttatttctaaaataggat

SEQ ID NO: 95708 - DNA, 19 bp, Artificial sequence
  SiRNA target sequence
ttatttctaaaataggata

SEQ ID NO: 95709 - DNA, 19 bp, Artificial sequence
  SiRNA target sequence
tatttctaaaataggataa

SEQ ID NO: 95710 - DNA, 19 bp, Artificial sequence
  SiRNA target sequence
atttctaaaataggataaa

SEQ ID NO: 95711 - DNA, 19 bp, Artificial sequence
  SiRNA target sequence
tttctaaaataggataaat

SEQ ID NO: 95712 - DNA, 19 bp, Artificial sequence
  SiRNA target sequence
ttctaaaataggataaatg

SEQ ID NO: 95713 - DNA, 19 bp, Artificial sequence
  SiRNA target sequence
tctaaaataggataaatgt

SEQ ID NO: 95714 - DNA, 19 bp, Artificial sequence
  SiRNA target sequence
ctaaaataggataaatgta

SEQ ID NO: 95715 - DNA, 19 bp, Artificial sequence
  SiRNA target sequence
taaaataggataaatgtaa

SEQ ID NO: 95716 - DNA, 19 bp, Artificial sequence
  SiRNA target sequence
aaaataggataaatgtaat

SEQ ID NO: 95717 - DNA, 19 bp, Artificial sequence
  SiRNA target sequence
aaataggataaatgtaatt

SEQ ID NO: 95718 - DNA, 19 bp, Artificial sequence
  SiRNA target sequence
aataggataaatgtaattg

SEQ ID NO: 95719 - DNA, 19 bp, Artificial sequence
  SiRNA target sequence
ataggataaatgtaattgt

SEQ ID NO: 95720 - DNA, 19 bp, Artificial sequence
  SiRNA target sequence
taggataaatgtaattgta

SEQ ID NO: 95721 - DNA, 19 bp, Artificial sequence
  SiRNA target sequence
aggataaatgtaattgtaa

SEQ ID NO: 95722 - DNA, 19 bp, Artificial sequence
  SiRNA target sequence
ggataaatgtaattgtaag

SEQ ID NO: 95723 - DNA, 19 bp, Artificial sequence
  SiRNA target sequence
gataaatgtaattgtaagg

SEQ ID NO: 95724 - DNA, 19 bp, Artificial sequence
  SiRNA target sequence
ataaatgtaattgtaaggt

SEQ ID NO: 95725 - DNA, 19 bp, Artificial sequence
  SiRNA target sequence
taaatgtaattgtaaggtg

SEQ ID NO: 95726 - DNA, 19 bp, Artificial sequence
  SiRNA target sequence
aaatgtaattgtaaggtgt

SEQ ID NO: 95727 - DNA, 19 bp, Artificial sequence
  SiRNA target sequence
aatgtaattgtaaggtgtt

SEQ ID NO: 95728 - DNA, 19 bp, Artificial sequence
  SiRNA target sequence
atgtaattgtaaggtgtta

SEQ ID NO: 95729 - DNA, 19 bp, Artificial sequence
  SiRNA target sequence
tgtaattgtaaggtgttaa

SEQ ID NO: 95730 - DNA, 19 bp, Artificial sequence
  SiRNA target sequence
gtaattgtaaggtgttaat

SEQ ID NO: 95731 - DNA, 19 bp, Artificial sequence
  SiRNA target sequence
taattgtaaggtgttaata

SEQ ID NO: 95732 - DNA, 19 bp, Artificial sequence
  SiRNA target sequence
aattgtaaggtgttaatat

SEQ ID NO: 95733 - DNA, 19 bp, Artificial sequence
  SiRNA target sequence
attgtaaggtgttaatatc

SEQ ID NO: 95734 - DNA, 19 bp, Artificial sequence
  SiRNA target sequence
ttgtaaggtgttaatatct

SEQ ID NO: 95735 - DNA, 19 bp, Artificial sequence
  SiRNA target sequence
tgtaaggtgttaatatctt

SEQ ID NO: 95736 - DNA, 19 bp, Artificial sequence
  SiRNA target sequence
gtaaggtgttaatatctta

SEQ ID NO: 95737 - DNA, 19 bp, Artificial sequence
  SiRNA target sequence
taaggtgttaatatcttaa

SEQ ID NO: 95738 - DNA, 19 bp, Artificial sequence
  SiRNA target sequence
aaggtgttaatatcttaat

SEQ ID NO: 95739 - DNA, 19 bp, Artificial sequence
  SiRNA target sequence
aggtgttaatatcttaata

SEQ ID NO: 95740 - DNA, 19 bp, Artificial sequence
  SiRNA target sequence
ggtgttaatatcttaatat

SEQ ID NO: 95741 - DNA, 19 bp, Artificial sequence
  SiRNA target sequence
gtgttaatatcttaatatc

SEQ ID NO: 95742 - DNA, 19 bp, Artificial sequence
  SiRNA target sequence
tgttaatatcttaatatca

SEQ ID NO: 95743 - DNA, 19 bp, Artificial sequence
  SiRNA target sequence
gttaatatcttaatatcat

SEQ ID NO: 95744 - DNA, 19 bp, Artificial sequence
  SiRNA target sequence
ttaatatcttaatatcatt

SEQ ID NO: 95745 - DNA, 19 bp, Artificial sequence
  SiRNA target sequence
taatatcttaatatcattt

SEQ ID NO: 95746 - DNA, 19 bp, Artificial sequence
  SiRNA target sequence
aatatcttaatatcattta

SEQ ID NO: 95747 - DNA, 19 bp, Artificial sequence
  SiRNA target sequence
atatcttaatatcatttat

SEQ ID NO: 95748 - DNA, 19 bp, Artificial sequence
  SiRNA target sequence
tatcttaatatcatttatt

SEQ ID NO: 95749 - DNA, 19 bp, Artificial sequence
  SiRNA target sequence
atcttaatatcatttattg

SEQ ID NO: 95750 - DNA, 19 bp, Artificial sequence
  SiRNA target sequence
tcttaatatcatttattga

SEQ ID NO: 95751 - DNA, 19 bp, Artificial sequence
  SiRNA target sequence
cttaatatcatttattgac

SEQ ID NO: 95752 - DNA, 19 bp, Artificial sequence
  SiRNA target sequence
ttaatatcatttattgacg

SEQ ID NO: 95753 - DNA, 19 bp, Artificial sequence
  SiRNA target sequence
taatatcatttattgacgc

SEQ ID NO: 95754 - DNA, 19 bp, Artificial sequence
  SiRNA target sequence
aatatcatttattgacgca

SEQ ID NO: 95755 - DNA, 19 bp, Artificial sequence
  SiRNA target sequence
atatcatttattgacgcac

SEQ ID NO: 95756 - DNA, 19 bp, Artificial sequence
  SiRNA target sequence
tatcatttattgacgcact

SEQ ID NO: 95757 - DNA, 19 bp, Artificial sequence
  SiRNA target sequence
atcatttattgacgcactg

SEQ ID NO: 95758 - DNA, 19 bp, Artificial sequence
  SiRNA target sequence
tcatttattgacgcactgt

SEQ ID NO: 95759 - DNA, 19 bp, Artificial sequence
  SiRNA target sequence
catttattgacgcactgta

SEQ ID NO: 95760 - DNA, 19 bp, Artificial sequence
  SiRNA target sequence
atttattgacgcactgtat

SEQ ID NO: 95761 - DNA, 19 bp, Artificial sequence
  SiRNA target sequence
tttattgacgcactgtata

SEQ ID NO: 95762 - DNA, 19 bp, Artificial sequence
  SiRNA target sequence
ttattgacgcactgtataa

SEQ ID NO: 95763 - DNA, 19 bp, Artificial sequence
  SiRNA target sequence
tattgacgcactgtataaa

SEQ ID NO: 95764 - DNA, 19 bp, Artificial sequence
  SiRNA target sequence
attgacgcactgtataaat

SEQ ID NO: 95765 - DNA, 19 bp, Artificial sequence
  SiRNA target sequence
ttgacgcactgtataaatc

SEQ ID NO: 95766 - DNA, 19 bp, Artificial sequence
  SiRNA target sequence
tgacgcactgtataaatca

SEQ ID NO: 95767 - DNA, 19 bp, Artificial sequence
  SiRNA target sequence
gacgcactgtataaatcat

SEQ ID NO: 95768 - DNA, 19 bp, Artificial sequence
  SiRNA target sequence
acgcactgtataaatcatt

SEQ ID NO: 95769 - DNA, 19 bp, Artificial sequence
  SiRNA target sequence
cgcactgtataaatcattt

SEQ ID NO: 95770 - DNA, 19 bp, Artificial sequence
  SiRNA target sequence
gcactgtataaatcatttt

SEQ ID NO: 95771 - DNA, 19 bp, Artificial sequence
  SiRNA target sequence
cactgtataaatcattttt

SEQ ID NO: 95772 - DNA, 19 bp, Artificial sequence
  SiRNA target sequence
actgtataaatcattttta

SEQ ID NO: 95773 - DNA, 19 bp, Artificial sequence
  SiRNA target sequence
ctgtataaatcatttttac

SEQ ID NO: 95774 - DNA, 19 bp, Artificial sequence
  SiRNA target sequence
tgtataaatcatttttaca

SEQ ID NO: 95775 - DNA, 19 bp, Artificial sequence
  SiRNA target sequence
gtataaatcatttttacaa

SEQ ID NO: 95776 - DNA, 19 bp, Artificial sequence
  SiRNA target sequence
tataaatcatttttacaac

SEQ ID NO: 95777 - DNA, 19 bp, Artificial sequence
  SiRNA target sequence
ataaatcatttttacaact

SEQ ID NO: 95778 - DNA, 19 bp, Artificial sequence
  SiRNA target sequence
taaatcatttttacaactt

SEQ ID NO: 95779 - DNA, 19 bp, Artificial sequence
  SiRNA target sequence
aaatcatttttacaacttg

SEQ ID NO: 95780 - DNA, 19 bp, Artificial sequence
  SiRNA target sequence
aatcatttttacaacttgc

SEQ ID NO: 95781 - DNA, 19 bp, Artificial sequence
  SiRNA target sequence
atcatttttacaacttgca

SEQ ID NO: 95782 - DNA, 19 bp, Artificial sequence
  SiRNA target sequence
tcatttttacaacttgcaa

SEQ ID NO: 95783 - DNA, 19 bp, Artificial sequence
  SiRNA target sequence
catttttacaacttgcaaa

SEQ ID NO: 95784 - DNA, 19 bp, Artificial sequence
  SiRNA target sequence
atttttacaacttgcaaaa

SEQ ID NO: 95785 - DNA, 19 bp, Artificial sequence
  SiRNA target sequence
tttttacaacttgcaaaat

SEQ ID NO: 95786 - DNA, 19 bp, Artificial sequence
  SiRNA target sequence
ttttacaacttgcaaaatt

SEQ ID NO: 95787 - DNA, 19 bp, Artificial sequence
  SiRNA target sequence
tttacaacttgcaaaattt

SEQ ID NO: 95788 - DNA, 19 bp, Artificial sequence
  SiRNA target sequence
ttacaacttgcaaaatttt

SEQ ID NO: 95789 - DNA, 19 bp, Artificial sequence
  SiRNA target sequence
tacaacttgcaaaattttt

SEQ ID NO: 95790 - DNA, 19 bp, Artificial sequence
  SiRNA target sequence
acaacttgcaaaattttta

SEQ ID NO: 95791 - DNA, 19 bp, Artificial sequence
  SiRNA target sequence
caacttgcaaaatttttag

SEQ ID NO: 95792 - DNA, 19 bp, Artificial sequence
  SiRNA target sequence
aacttgcaaaatttttagc

SEQ ID NO: 95793 - DNA, 19 bp, Artificial sequence
  SiRNA target sequence
acttgcaaaatttttagca

SEQ ID NO: 95794 - DNA, 19 bp, Artificial sequence
  SiRNA target sequence
cttgcaaaatttttagcat

SEQ ID NO: 95795 - DNA, 19 bp, Artificial sequence
  SiRNA target sequence
ttgcaaaatttttagcatt

SEQ ID NO: 95796 - DNA, 19 bp, Artificial sequence
  SiRNA target sequence
tgcaaaatttttagcattt

SEQ ID NO: 95797 - DNA, 19 bp, Artificial sequence
  SiRNA target sequence
gcaaaatttttagcatttt

SEQ ID NO: 95798 - DNA, 19 bp, Artificial sequence
  SiRNA target sequence
caaaatttttagcattttg

SEQ ID NO: 95799 - DNA, 19 bp, Artificial sequence
  SiRNA target sequence
aaaatttttagcattttgt

SEQ ID NO: 95800 - DNA, 19 bp, Artificial sequence
  SiRNA target sequence
aaatttttagcattttgta

SEQ ID NO: 95801 - DNA, 19 bp, Artificial sequence
  SiRNA target sequence
aatttttagcattttgtag

SEQ ID NO: 95802 - DNA, 19 bp, Artificial sequence
  SiRNA target sequence
atttttagcattttgtagt

SEQ ID NO: 95803 - DNA, 19 bp, Artificial sequence
  SiRNA target sequence
tttttagcattttgtagtt

SEQ ID NO: 95804 - DNA, 19 bp, Artificial sequence
  SiRNA target sequence
ttttagcattttgtagttt

SEQ ID NO: 95805 - DNA, 19 bp, Artificial sequence
  SiRNA target sequence
tttagcattttgtagtttg

SEQ ID NO: 95806 - DNA, 19 bp, Artificial sequence
  SiRNA target sequence
ttagcattttgtagtttgt

SEQ ID NO: 95807 - DNA, 19 bp, Artificial sequence
  SiRNA target sequence
tagcattttgtagtttgta

SEQ ID NO: 95808 - DNA, 19 bp, Artificial sequence
  SiRNA target sequence
agcattttgtagtttgtaa

SEQ ID NO: 95809 - DNA, 19 bp, Artificial sequence
  SiRNA target sequence
gcattttgtagtttgtaat

SEQ ID NO: 95810 - DNA, 19 bp, Artificial sequence
  SiRNA target sequence
cattttgtagtttgtaatg

SEQ ID NO: 95811 - DNA, 19 bp, Artificial sequence
  SiRNA target sequence
attttgtagtttgtaatgc

SEQ ID NO: 95812 - DNA, 19 bp, Artificial sequence
  SiRNA target sequence
ttttgtagtttgtaatgcg

SEQ ID NO: 95813 - DNA, 19 bp, Artificial sequence
  SiRNA target sequence
tttgtagtttgtaatgcgg

SEQ ID NO: 95814 - DNA, 19 bp, Artificial sequence
  SiRNA target sequence
ttgtagtttgtaatgcggt

SEQ ID NO: 95815 - DNA, 19 bp, Artificial sequence
  SiRNA target sequence
tgtagtttgtaatgcggta

SEQ ID NO: 95816 - DNA, 19 bp, Artificial sequence
  SiRNA target sequence
gtagtttgtaatgcggtaa

SEQ ID NO: 95817 - DNA, 19 bp, Artificial sequence
  SiRNA target sequence
tagtttgtaatgcggtaat

SEQ ID NO: 95818 - DNA, 19 bp, Artificial sequence
  SiRNA target sequence
agtttgtaatgcggtaata

SEQ ID NO: 95819 - DNA, 19 bp, Artificial sequence
  SiRNA target sequence
gtttgtaatgcggtaatat

SEQ ID NO: 95820 - DNA, 19 bp, Artificial sequence
  SiRNA target sequence
tttgtaatgcggtaatata

SEQ ID NO: 95821 - DNA, 19 bp, Artificial sequence
  SiRNA target sequence
ttgtaatgcggtaatatat

SEQ ID NO: 95822 - DNA, 19 bp, Artificial sequence
  SiRNA target sequence
tgtaatgcggtaatatata

SEQ ID NO: 95823 - DNA, 19 bp, Artificial sequence
  SiRNA target sequence
gtaatgcggtaatatataa

SEQ ID NO: 95824 - DNA, 19 bp, Artificial sequence
  SiRNA target sequence
taatgcggtaatatataat

SEQ ID NO: 95825 - DNA, 19 bp, Artificial sequence
  SiRNA target sequence
aatgcggtaatatataata

SEQ ID NO: 95826 - DNA, 19 bp, Artificial sequence
  SiRNA target sequence
atgcggtaatatataatat

SEQ ID NO: 95827 - DNA, 19 bp, Artificial sequence
  SiRNA target sequence
tgcggtaatatataatata

SEQ ID NO: 95828 - DNA, 19 bp, Artificial sequence
  SiRNA target sequence
gcggtaatatataatatag

SEQ ID NO: 95829 - DNA, 19 bp, Artificial sequence
  SiRNA target sequence
cggtaatatataatataga

SEQ ID NO: 95830 - DNA, 19 bp, Artificial sequence
  SiRNA target sequence
ggtaatatataatatagat

SEQ ID NO: 95831 - DNA, 19 bp, Artificial sequence
  SiRNA target sequence
gtaatatataatatagatc

SEQ ID NO: 95832 - DNA, 19 bp, Artificial sequence
  SiRNA target sequence
taatatataatatagatct

SEQ ID NO: 95833 - DNA, 19 bp, Artificial sequence
  SiRNA target sequence
aatatataatatagatctt

SEQ ID NO: 95834 - DNA, 19 bp, Artificial sequence
  SiRNA target sequence
atatataatatagatcttt

SEQ ID NO: 95835 - DNA, 19 bp, Artificial sequence
  SiRNA target sequence
tatataatatagatctttt

SEQ ID NO: 95836 - DNA, 19 bp, Artificial sequence
  SiRNA target sequence
atataatatagatctttta

SEQ ID NO: 95837 - DNA, 19 bp, Artificial sequence
  SiRNA target sequence
tataatatagatcttttat

SEQ ID NO: 95838 - DNA, 19 bp, Artificial sequence
  SiRNA target sequence
ataatatagatcttttatc

SEQ ID NO: 95839 - DNA, 19 bp, Artificial sequence
  SiRNA target sequence
taatatagatcttttatcc

SEQ ID NO: 95840 - DNA, 19 bp, Artificial sequence
  SiRNA target sequence
aatatagatcttttatcca

SEQ ID NO: 95841 - DNA, 19 bp, Artificial sequence
  SiRNA target sequence
atatagatcttttatccat

SEQ ID NO: 95842 - DNA, 19 bp, Artificial sequence
  SiRNA target sequence
tatagatcttttatccatg

SEQ ID NO: 95843 - DNA, 19 bp, Artificial sequence
  SiRNA target sequence
atagatcttttatccatgt

SEQ ID NO: 95844 - DNA, 19 bp, Artificial sequence
  SiRNA target sequence
tagatcttttatccatgtc

SEQ ID NO: 95845 - DNA, 19 bp, Artificial sequence
  SiRNA target sequence
agatcttttatccatgtct

SEQ ID NO: 95846 - DNA, 19 bp, Artificial sequence
  SiRNA target sequence
gatcttttatccatgtctt

SEQ ID NO: 95847 - DNA, 19 bp, Artificial sequence
  SiRNA target sequence
atcttttatccatgtctta

SEQ ID NO: 95848 - DNA, 19 bp, Artificial sequence
  SiRNA target sequence
tcttttatccatgtcttaa

SEQ ID NO: 95849 - DNA, 19 bp, Artificial sequence
  SiRNA target sequence
cttttatccatgtcttaaa

SEQ ID NO: 95850 - DNA, 19 bp, Artificial sequence
  SiRNA target sequence
ttttatccatgtcttaaat

SEQ ID NO: 95851 - DNA, 19 bp, Artificial sequence
  SiRNA target sequence
tttatccatgtcttaaatt

SEQ ID NO: 95852 - DNA, 19 bp, Artificial sequence
  SiRNA target sequence
ttatccatgtcttaaattc

SEQ ID NO: 95853 - DNA, 19 bp, Artificial sequence
  SiRNA target sequence
tatccatgtcttaaattcg

SEQ ID NO: 95854 - DNA, 19 bp, Artificial sequence
  SiRNA target sequence
atccatgtcttaaattcgc

SEQ ID NO: 95855 - DNA, 19 bp, Artificial sequence
  SiRNA target sequence
tccatgtcttaaattcgcc

SEQ ID NO: 95856 - DNA, 19 bp, Artificial sequence
  SiRNA target sequence
ccatgtcttaaattcgccc

SEQ ID NO: 95857 - DNA, 19 bp, Artificial sequence
  SiRNA target sequence
catgtcttaaattcgccca

SEQ ID NO: 95858 - DNA, 19 bp, Artificial sequence
  SiRNA target sequence
atgtcttaaattcgcccat

SEQ ID NO: 95859 - DNA, 19 bp, Artificial sequence
  SiRNA target sequence
tgtcttaaattcgcccata

SEQ ID NO: 95860 - DNA, 19 bp, Artificial sequence
  SiRNA target sequence
gtcttaaattcgcccataa

SEQ ID NO: 95861 - DNA, 19 bp, Artificial sequence
  SiRNA target sequence
tcttaaattcgcccataaa

SEQ ID NO: 95862 - DNA, 19 bp, Artificial sequence
  SiRNA target sequence
cttaaattcgcccataaat

SEQ ID NO: 95863 - DNA, 19 bp, Artificial sequence
  SiRNA target sequence
ttaaattcgcccataaatc

SEQ ID NO: 95864 - DNA, 19 bp, Artificial sequence
  SiRNA target sequence
taaattcgcccataaatcc

SEQ ID NO: 95865 - DNA, 19 bp, Artificial sequence
  SiRNA target sequence
aaattcgcccataaatcct

SEQ ID NO: 95866 - DNA, 19 bp, Artificial sequence
  SiRNA target sequence
aattcgcccataaatcctt

SEQ ID NO: 95867 - DNA, 19 bp, Artificial sequence
  SiRNA target sequence
attcgcccataaatccttc

SEQ ID NO: 95868 - DNA, 19 bp, Artificial sequence
  SiRNA target sequence
ttcgcccataaatccttct

SEQ ID NO: 95869 - DNA, 19 bp, Artificial sequence
  SiRNA target sequence
tcgcccataaatccttctt

SEQ ID NO: 95870 - DNA, 19 bp, Artificial sequence
  SiRNA target sequence
cgcccataaatccttcttt

SEQ ID NO: 95871 - DNA, 19 bp, Artificial sequence
  SiRNA target sequence
gcccataaatccttctttg

SEQ ID NO: 95872 - DNA, 19 bp, Artificial sequence
  SiRNA target sequence
cccataaatccttctttgt

SEQ ID NO: 95873 - DNA, 19 bp, Artificial sequence
  SiRNA target sequence
ccataaatccttctttgtc

SEQ ID NO: 95874 - DNA, 19 bp, Artificial sequence
  SiRNA target sequence
cataaatccttctttgtct

SEQ ID NO: 95875 - DNA, 19 bp, Artificial sequence
  SiRNA target sequence
ataaatccttctttgtctt

SEQ ID NO: 95876 - DNA, 19 bp, Artificial sequence
  SiRNA target sequence
taaatccttctttgtcttg

SEQ ID NO: 95877 - DNA, 19 bp, Artificial sequence
  SiRNA target sequence
aaatccttctttgtcttgg

SEQ ID NO: 95878 - DNA, 19 bp, Artificial sequence
  SiRNA target sequence
aatccttctttgtcttggc

SEQ ID NO: 95879 - DNA, 19 bp, Artificial sequence
  SiRNA target sequence
atccttctttgtcttggct

SEQ ID NO: 95880 - DNA, 19 bp, Artificial sequence
  SiRNA target sequence
tccttctttgtcttggcta

SEQ ID NO: 95881 - DNA, 19 bp, Artificial sequence
  SiRNA target sequence
ccttctttgtcttggctat

SEQ ID NO: 95882 - DNA, 19 bp, Artificial sequence
  SiRNA target sequence
cttctttgtcttggctatc

SEQ ID NO: 95883 - DNA, 19 bp, Artificial sequence
  SiRNA target sequence
ttctttgtcttggctatct

SEQ ID NO: 95884 - DNA, 19 bp, Artificial sequence
  SiRNA target sequence
tctttgtcttggctatctc

SEQ ID NO: 95885 - DNA, 19 bp, Artificial sequence
  SiRNA target sequence
ctttgtcttggctatctcc

SEQ ID NO: 95886 - DNA, 19 bp, Artificial sequence
  SiRNA target sequence
tttgtcttggctatctcca

SEQ ID NO: 95887 - DNA, 19 bp, Artificial sequence
  SiRNA target sequence
ttgtcttggctatctccat

SEQ ID NO: 95888 - DNA, 19 bp, Artificial sequence
  SiRNA target sequence
tgtcttggctatctccatt

SEQ ID NO: 95889 - DNA, 19 bp, Artificial sequence
  SiRNA target sequence
gtcttggctatctccatta

SEQ ID NO: 95890 - DNA, 19 bp, Artificial sequence
  SiRNA target sequence
tcttggctatctccattac

SEQ ID NO: 95891 - DNA, 19 bp, Artificial sequence
  SiRNA target sequence
cttggctatctccattacc

SEQ ID NO: 95892 - DNA, 19 bp, Artificial sequence
  SiRNA target sequence
ttggctatctccattaccc

SEQ ID NO: 95893 - DNA, 19 bp, Artificial sequence
  SiRNA target sequence
tggctatctccattaccct

SEQ ID NO: 95894 - DNA, 19 bp, Artificial sequence
  SiRNA target sequence
ggctatctccattaccctt

SEQ ID NO: 95895 - DNA, 19 bp, Artificial sequence
  SiRNA target sequence
gctatctccattacccttt

SEQ ID NO: 95896 - DNA, 19 bp, Artificial sequence
  SiRNA target sequence
ctatctccattaccctttc

SEQ ID NO: 95897 - DNA, 19 bp, Artificial sequence
  SiRNA target sequence
tatctccattaccctttct

SEQ ID NO: 95898 - DNA, 19 bp, Artificial sequence
  SiRNA target sequence
atctccattaccctttctt

SEQ ID NO: 95899 - DNA, 19 bp, Artificial sequence
  SiRNA target sequence
tctccattaccctttctta

SEQ ID NO: 95900 - DNA, 19 bp, Artificial sequence
  SiRNA target sequence
ctccattaccctttcttat

SEQ ID NO: 95901 - DNA, 19 bp, Artificial sequence
  SiRNA target sequence
tccattaccctttcttatc

SEQ ID NO: 95902 - DNA, 19 bp, Artificial sequence
  SiRNA target sequence
ccattaccctttcttatca

SEQ ID NO: 95903 - DNA, 19 bp, Artificial sequence
  SiRNA target sequence
cattaccctttcttatcag

SEQ ID NO: 95904 - DNA, 19 bp, Artificial sequence
  SiRNA target sequence
attaccctttcttatcaga

SEQ ID NO: 95905 - DNA, 19 bp, Artificial sequence
  SiRNA target sequence
ttaccctttcttatcagag

SEQ ID NO: 95906 - DNA, 19 bp, Artificial sequence
  SiRNA target sequence
taccctttcttatcagagg

SEQ ID NO: 95907 - DNA, 19 bp, Artificial sequence
  SiRNA target sequence
accctttcttatcagaggt

SEQ ID NO: 95908 - DNA, 19 bp, Artificial sequence
  SiRNA target sequence
ccctttcttatcagaggtt

SEQ ID NO: 95909 - DNA, 19 bp, Artificial sequence
  SiRNA target sequence
cctttcttatcagaggttt

SEQ ID NO: 95910 - DNA, 19 bp, Artificial sequence
  SiRNA target sequence
ctttcttatcagaggttta

SEQ ID NO: 95911 - DNA, 19 bp, Artificial sequence
  SiRNA target sequence
tttcttatcagaggtttag

SEQ ID NO: 95912 - DNA, 19 bp, Artificial sequence
  SiRNA target sequence
ttcttatcagaggtttagc

SEQ ID NO: 95913 - DNA, 19 bp, Artificial sequence
  SiRNA target sequence
tcttatcagaggtttagct

SEQ ID NO: 95914 - DNA, 19 bp, Artificial sequence
  SiRNA target sequence
cttatcagaggtttagctc

SEQ ID NO: 95915 - DNA, 19 bp, Artificial sequence
  SiRNA target sequence
ttatcagaggtttagctcc

SEQ ID NO: 95916 - DNA, 19 bp, Artificial sequence
  SiRNA target sequence
tatcagaggtttagctccg

SEQ ID NO: 95917 - DNA, 19 bp, Artificial sequence
  SiRNA target sequence
atcagaggtttagctccgt

SEQ ID NO: 95918 - DNA, 19 bp, Artificial sequence
  SiRNA target sequence
tcagaggtttagctccgtg

SEQ ID NO: 95919 - DNA, 19 bp, Artificial sequence
  SiRNA target sequence
cagaggtttagctccgtgt

SEQ ID NO: 95920 - DNA, 19 bp, Artificial sequence
  SiRNA target sequence
agaggtttagctccgtgtt

SEQ ID NO: 95921 - DNA, 19 bp, Artificial sequence
  SiRNA target sequence
gaggtttagctccgtgttt

SEQ ID NO: 95922 - DNA, 19 bp, Artificial sequence
  SiRNA target sequence
aggtttagctccgtgtttt

SEQ ID NO: 95923 - DNA, 19 bp, Artificial sequence
  SiRNA target sequence
ggtttagctccgtgtttta

SEQ ID NO: 95924 - DNA, 19 bp, Artificial sequence
  SiRNA target sequence
gtttagctccgtgttttaa

SEQ ID NO: 95925 - DNA, 19 bp, Artificial sequence
  SiRNA target sequence
tttagctccgtgttttaaa

SEQ ID NO: 95926 - DNA, 19 bp, Artificial sequence
  SiRNA target sequence
ttagctccgtgttttaaaa

SEQ ID NO: 95927 - DNA, 19 bp, Artificial sequence
  SiRNA target sequence
tagctccgtgttttaaaag

SEQ ID NO: 95928 - DNA, 19 bp, Artificial sequence
  SiRNA target sequence
agctccgtgttttaaaagg

SEQ ID NO: 95929 - DNA, 19 bp, Artificial sequence
  SiRNA target sequence
gctccgtgttttaaaaggc

SEQ ID NO: 95930 - DNA, 19 bp, Artificial sequence
  SiRNA target sequence
ctccgtgttttaaaaggca

SEQ ID NO: 95931 - DNA, 19 bp, Artificial sequence
  SiRNA target sequence
tccgtgttttaaaaggcaa

SEQ ID NO: 95932 - DNA, 19 bp, Artificial sequence
  SiRNA target sequence
ccgtgttttaaaaggcaat

SEQ ID NO: 95933 - DNA, 19 bp, Artificial sequence
  SiRNA target sequence
cgtgttttaaaaggcaatt

SEQ ID NO: 95934 - DNA, 19 bp, Artificial sequence
  SiRNA target sequence
gtgttttaaaaggcaatta

SEQ ID NO: 95935 - DNA, 19 bp, Artificial sequence
  SiRNA target sequence
tgttttaaaaggcaattat

SEQ ID NO: 95936 - DNA, 19 bp, Artificial sequence
  SiRNA target sequence
gttttaaaaggcaattata

SEQ ID NO: 95937 - DNA, 19 bp, Artificial sequence
  SiRNA target sequence
ttttaaaaggcaattatac

SEQ ID NO: 95938 - DNA, 19 bp, Artificial sequence
  SiRNA target sequence
tttaaaaggcaattataca

SEQ ID NO: 95939 - DNA, 19 bp, Artificial sequence
  SiRNA target sequence
ttaaaaggcaattatacaa

SEQ ID NO: 95940 - DNA, 19 bp, Artificial sequence
  SiRNA target sequence
taaaaggcaattatacaac

SEQ ID NO: 95941 - DNA, 19 bp, Artificial sequence
  SiRNA target sequence
aaaaggcaattatacaact

SEQ ID NO: 95942 - DNA, 19 bp, Artificial sequence
  SiRNA target sequence
aaaggcaattatacaactt

SEQ ID NO: 95943 - DNA, 19 bp, Artificial sequence
  SiRNA target sequence
aaggcaattatacaacttt

SEQ ID NO: 95944 - DNA, 19 bp, Artificial sequence
  SiRNA target sequence
aggcaattatacaactttt

SEQ ID NO: 95945 - DNA, 19 bp, Artificial sequence
  SiRNA target sequence
ggcaattatacaacttttt

SEQ ID NO: 95946 - DNA, 19 bp, Artificial sequence
  SiRNA target sequence
gcaattatacaacttttta

SEQ ID NO: 95947 - DNA, 19 bp, Artificial sequence
  SiRNA target sequence
caattatacaactttttag

SEQ ID NO: 95948 - DNA, 19 bp, Artificial sequence
  SiRNA target sequence
aattatacaactttttaga

SEQ ID NO: 95949 - DNA, 19 bp, Artificial sequence
  SiRNA target sequence
attatacaactttttagaa

SEQ ID NO: 95950 - DNA, 19 bp, Artificial sequence
  SiRNA target sequence
ttatacaactttttagaac

SEQ ID NO: 95951 - DNA, 19 bp, Artificial sequence
  SiRNA target sequence
tatacaactttttagaaca

SEQ ID NO: 95952 - DNA, 19 bp, Artificial sequence
  SiRNA target sequence
atacaactttttagaacaa

SEQ ID NO: 95953 - DNA, 19 bp, Artificial sequence
  SiRNA target sequence
tacaactttttagaacaaa

SEQ ID NO: 95954 - DNA, 19 bp, Artificial sequence
  SiRNA target sequence
acaactttttagaacaaaa

SEQ ID NO: 95955 - DNA, 19 bp, Artificial sequence
  SiRNA target sequence
caactttttagaacaaaaa

SEQ ID NO: 95956 - DNA, 19 bp, Artificial sequence
  SiRNA target sequence
aactttttagaacaaaaat

SEQ ID NO: 95957 - DNA, 19 bp, Artificial sequence
  SiRNA target sequence
actttttagaacaaaaatt

SEQ ID NO: 95958 - DNA, 19 bp, Artificial sequence
  SiRNA target sequence
ctttttagaacaaaaatta

SEQ ID NO: 95959 - DNA, 19 bp, Artificial sequence
  SiRNA target sequence
tttttagaacaaaaattaa

SEQ ID NO: 95960 - DNA, 19 bp, Artificial sequence
  SiRNA target sequence
ttttagaacaaaaattaaa

SEQ ID NO: 95961 - DNA, 19 bp, Artificial sequence
  SiRNA target sequence
tttagaacaaaaattaaaa

SEQ ID NO: 95962 - DNA, 19 bp, Artificial sequence
  SiRNA target sequence
ttagaacaaaaattaaaag

SEQ ID NO: 95963 - DNA, 19 bp, Artificial sequence
  SiRNA target sequence
tagaacaaaaattaaaaga

SEQ ID NO: 95964 - DNA, 19 bp, Artificial sequence
  SiRNA target sequence
agaacaaaaattaaaagat

SEQ ID NO: 95965 - DNA, 19 bp, Artificial sequence
  SiRNA target sequence
gaacaaaaattaaaagatt

SEQ ID NO: 95966 - DNA, 19 bp, Artificial sequence
  SiRNA target sequence
aacaaaaattaaaagattt

SEQ ID NO: 95967 - DNA, 19 bp, Artificial sequence
  SiRNA target sequence
acaaaaattaaaagattta

SEQ ID NO: 95968 - DNA, 19 bp, Artificial sequence
  SiRNA target sequence
caaaaattaaaagatttat

SEQ ID NO: 95969 - DNA, 19 bp, Artificial sequence
  SiRNA target sequence
aaaaattaaaagatttata

SEQ ID NO: 95970 - DNA, 19 bp, Artificial sequence
  SiRNA target sequence
aaaattaaaagatttataa

SEQ ID NO: 95971 - DNA, 19 bp, Artificial sequence
  SiRNA target sequence
aaattaaaagatttataag

SEQ ID NO: 95972 - DNA, 19 bp, Artificial sequence
  SiRNA target sequence
aattaaaagatttataaga

SEQ ID NO: 95973 - DNA, 19 bp, Artificial sequence
  SiRNA target sequence
attaaaagatttataagac

SEQ ID NO: 95974 - DNA, 19 bp, Artificial sequence
  SiRNA target sequence
ttaaaagatttataagacg

SEQ ID NO: 95975 - DNA, 19 bp, Artificial sequence
  SiRNA target sequence
taaaagatttataagacga

SEQ ID NO: 95976 - DNA, 19 bp, Artificial sequence
  SiRNA target sequence
aaaagatttataagacgaa

SEQ ID NO: 95977 - DNA, 19 bp, Artificial sequence
  SiRNA target sequence
aaagatttataagacgaat

SEQ ID NO: 95978 - DNA, 19 bp, Artificial sequence
  SiRNA target sequence
aagatttataagacgaatc

SEQ ID NO: 95979 - DNA, 19 bp, Artificial sequence
  SiRNA target sequence
agatttataagacgaatcc

SEQ ID NO: 95980 - DNA, 19 bp, Artificial sequence
  SiRNA target sequence
gatttataagacgaatccc

SEQ ID NO: 95981 - DNA, 19 bp, Artificial sequence
  SiRNA target sequence
atttataagacgaatcccc

SEQ ID NO: 95982 - DNA, 19 bp, Artificial sequence
  SiRNA target sequence
tttataagacgaatcccca

SEQ ID NO: 95983 - DNA, 19 bp, Artificial sequence
  SiRNA target sequence
ttataagacgaatccccaa

SEQ ID NO: 95984 - DNA, 19 bp, Artificial sequence
  SiRNA target sequence
tataagacgaatccccaag

SEQ ID NO: 95985 - DNA, 19 bp, Artificial sequence
  SiRNA target sequence
ataagacgaatccccaagg

SEQ ID NO: 95986 - DNA, 19 bp, Artificial sequence
  SiRNA target sequence
taagacgaatccccaaggc

SEQ ID NO: 95987 - DNA, 19 bp, Artificial sequence
  SiRNA target sequence
aagacgaatccccaaggcc

SEQ ID NO: 95988 - DNA, 19 bp, Artificial sequence
  SiRNA target sequence
agacgaatccccaaggcca

SEQ ID NO: 95989 - DNA, 19 bp, Artificial sequence
  SiRNA target sequence
gacgaatccccaaggccaa

SEQ ID NO: 95990 - DNA, 19 bp, Artificial sequence
  SiRNA target sequence
acgaatccccaaggccaaa

SEQ ID NO: 95991 - DNA, 19 bp, Artificial sequence
  SiRNA target sequence
cgaatccccaaggccaaat

SEQ ID NO: 95992 - DNA, 19 bp, Artificial sequence
  SiRNA target sequence
gaatccccaaggccaaata

SEQ ID NO: 95993 - DNA, 19 bp, Artificial sequence
  SiRNA target sequence
aatccccaaggccaaatac

SEQ ID NO: 95994 - DNA, 19 bp, Artificial sequence
  SiRNA target sequence
atccccaaggccaaataca

SEQ ID NO: 95995 - DNA, 19 bp, Artificial sequence
  SiRNA target sequence
tccccaaggccaaatacag

SEQ ID NO: 95996 - DNA, 19 bp, Artificial sequence
  SiRNA target sequence
ccccaaggccaaatacagc

SEQ ID NO: 95997 - DNA, 19 bp, Artificial sequence
  SiRNA target sequence
cccaaggccaaatacagca

SEQ ID NO: 95998 - DNA, 19 bp, Artificial sequence
  SiRNA target sequence
ccaaggccaaatacagcaa

SEQ ID NO: 95999 - DNA, 19 bp, Artificial sequence
  SiRNA target sequence
caaggccaaatacagcaaa

SEQ ID NO: 96000 - DNA, 19 bp, Artificial sequence
  SiRNA target sequence
aaggccaaatacagcaaaa

SEQ ID NO: 96001 - DNA, 19 bp, Artificial sequence
  SiRNA target sequence
aggccaaatacagcaaaat

SEQ ID NO: 96002 - DNA, 19 bp, Artificial sequence
  SiRNA target sequence
ggccaaatacagcaaaatt

SEQ ID NO: 96003 - DNA, 19 bp, Artificial sequence
  SiRNA target sequence
gccaaatacagcaaaattt

SEQ ID NO: 96004 - DNA, 19 bp, Artificial sequence
  SiRNA target sequence
ccaaatacagcaaaattta

SEQ ID NO: 96005 - DNA, 19 bp, Artificial sequence
  SiRNA target sequence
caaatacagcaaaatttaa

SEQ ID NO: 96006 - DNA, 19 bp, Artificial sequence
  SiRNA target sequence
aaatacagcaaaatttaag

SEQ ID NO: 96007 - DNA, 19 bp, Artificial sequence
  SiRNA target sequence
aatacagcaaaatttaagt

SEQ ID NO: 96008 - DNA, 19 bp, Artificial sequence
  SiRNA target sequence
atacagcaaaatttaagtg

SEQ ID NO: 96009 - DNA, 19 bp, Artificial sequence
  SiRNA target sequence
tacagcaaaatttaagtgt

SEQ ID NO: 96010 - DNA, 19 bp, Artificial sequence
  SiRNA target sequence
acagcaaaatttaagtgtt

SEQ ID NO: 96011 - DNA, 19 bp, Artificial sequence
  SiRNA target sequence
cagcaaaatttaagtgttg

SEQ ID NO: 96012 - DNA, 19 bp, Artificial sequence
  SiRNA target sequence
agcaaaatttaagtgttgt

SEQ ID NO: 96013 - DNA, 19 bp, Artificial sequence
  SiRNA target sequence
gcaaaatttaagtgttgta

SEQ ID NO: 96014 - DNA, 19 bp, Artificial sequence
  SiRNA target sequence
caaaatttaagtgttgtaa

SEQ ID NO: 96015 - DNA, 19 bp, Artificial sequence
  SiRNA target sequence
aaaatttaagtgttgtaaa

SEQ ID NO: 96016 - DNA, 19 bp, Artificial sequence
  SiRNA target sequence
aaatttaagtgttgtaaaa

SEQ ID NO: 96017 - DNA, 19 bp, Artificial sequence
  SiRNA target sequence
aatttaagtgttgtaaaaa

SEQ ID NO: 96018 - DNA, 19 bp, Artificial sequence
  SiRNA target sequence
atttaagtgttgtaaaaaa

SEQ ID NO: 96019 - DNA, 19 bp, Artificial sequence
  SiRNA target sequence
tttaagtgttgtaaaaaat

SEQ ID NO: 96020 - DNA, 19 bp, Artificial sequence
  SiRNA target sequence
ttaagtgttgtaaaaaatt

SEQ ID NO: 96021 - DNA, 19 bp, Artificial sequence
  SiRNA target sequence
taagtgttgtaaaaaattt

SEQ ID NO: 96022 - DNA, 19 bp, Artificial sequence
  SiRNA target sequence
aagtgttgtaaaaaatttg

SEQ ID NO: 96023 - DNA, 19 bp, Artificial sequence
  SiRNA target sequence
agtgttgtaaaaaatttgt

SEQ ID NO: 96024 - DNA, 19 bp, Artificial sequence
  SiRNA target sequence
gtgttgtaaaaaatttgta

SEQ ID NO: 96025 - DNA, 19 bp, Artificial sequence
  SiRNA target sequence
tgttgtaaaaaatttgtag

SEQ ID NO: 96026 - DNA, 19 bp, Artificial sequence
  SiRNA target sequence
gttgtaaaaaatttgtagg

SEQ ID NO: 96027 - DNA, 19 bp, Artificial sequence
  SiRNA target sequence
ttgtaaaaaatttgtaggc

SEQ ID NO: 96028 - DNA, 19 bp, Artificial sequence
  SiRNA target sequence
tgtaaaaaatttgtaggca

SEQ ID NO: 96029 - DNA, 19 bp, Artificial sequence
  SiRNA target sequence
gtaaaaaatttgtaggcag

SEQ ID NO: 96030 - DNA, 19 bp, Artificial sequence
  SiRNA target sequence
taaaaaatttgtaggcaga

SEQ ID NO: 96031 - DNA, 19 bp, Artificial sequence
  SiRNA target sequence
aaaaaatttgtaggcagat

SEQ ID NO: 96032 - DNA, 19 bp, Artificial sequence
  SiRNA target sequence
aaaaatttgtaggcagatt

SEQ ID NO: 96033 - DNA, 19 bp, Artificial sequence
  SiRNA target sequence
aaaatttgtaggcagattt

SEQ ID NO: 96034 - DNA, 19 bp, Artificial sequence
  SiRNA target sequence
aaatttgtaggcagatttt

SEQ ID NO: 96035 - DNA, 19 bp, Artificial sequence
  SiRNA target sequence
aatttgtaggcagattttt

SEQ ID NO: 96036 - DNA, 19 bp, Artificial sequence
  SiRNA target sequence
atttgtaggcagatttttt

SEQ ID NO: 96037 - DNA, 19 bp, Artificial sequence
  SiRNA target sequence
tttgtaggcagattttttt

SEQ ID NO: 96038 - DNA, 19 bp, Artificial sequence
  SiRNA target sequence
ttgtaggcagatttttttt

SEQ ID NO: 96039 - DNA, 19 bp, Artificial sequence
  SiRNA target sequence
tgtaggcagattttttttg

SEQ ID NO: 96040 - DNA, 19 bp, Artificial sequence
  SiRNA target sequence
gtaggcagattttttttgc

SEQ ID NO: 96041 - DNA, 19 bp, Artificial sequence
  SiRNA target sequence
taggcagattttttttgcg

SEQ ID NO: 96042 - DNA, 19 bp, Artificial sequence
  SiRNA target sequence
aggcagattttttttgcgc

SEQ ID NO: 96043 - DNA, 19 bp, Artificial sequence
  SiRNA target sequence
ggcagattttttttgcgca

SEQ ID NO: 96044 - DNA, 19 bp, Artificial sequence
  SiRNA target sequence
gcagattttttttgcgcaa

SEQ ID NO: 96045 - DNA, 19 bp, Artificial sequence
  SiRNA target sequence
cagattttttttgcgcaaa

SEQ ID NO: 96046 - DNA, 19 bp, Artificial sequence
  SiRNA target sequence
agattttttttgcgcaaaa

SEQ ID NO: 96047 - DNA, 19 bp, Artificial sequence
  SiRNA target sequence
gattttttttgcgcaaaaa

SEQ ID NO: 96048 - DNA, 19 bp, Artificial sequence
  SiRNA target sequence
attttttttgcgcaaaaat

SEQ ID NO: 96049 - DNA, 19 bp, Artificial sequence
  SiRNA target sequence
ttttttttgcgcaaaaatt

SEQ ID NO: 96050 - DNA, 19 bp, Artificial sequence
  SiRNA target sequence
tttttttgcgcaaaaattt

SEQ ID NO: 96051 - DNA, 19 bp, Artificial sequence
  SiRNA target sequence
ttttttgcgcaaaaatttc

SEQ ID NO: 96052 - DNA, 19 bp, Artificial sequence
  SiRNA target sequence
tttttgcgcaaaaatttcc

SEQ ID NO: 96053 - DNA, 19 bp, Artificial sequence
  SiRNA target sequence
ttttgcgcaaaaatttcca

SEQ ID NO: 96054 - DNA, 19 bp, Artificial sequence
  SiRNA target sequence
tttgcgcaaaaatttccaa

SEQ ID NO: 96055 - DNA, 19 bp, Artificial sequence
  SiRNA target sequence
ttgcgcaaaaatttccaaa

SEQ ID NO: 96056 - DNA, 19 bp, Artificial sequence
  SiRNA target sequence
tgcgcaaaaatttccaaaa

SEQ ID NO: 96057 - DNA, 19 bp, Artificial sequence
  SiRNA target sequence
gcgcaaaaatttccaaaat

SEQ ID NO: 96058 - DNA, 19 bp, Artificial sequence
  SiRNA target sequence
cgcaaaaatttccaaaatt

SEQ ID NO: 96059 - DNA, 19 bp, Artificial sequence
  SiRNA target sequence
gcaaaaatttccaaaattt

SEQ ID NO: 96060 - DNA, 19 bp, Artificial sequence
  SiRNA target sequence
caaaaatttccaaaattta

SEQ ID NO: 96061 - DNA, 19 bp, Artificial sequence
  SiRNA target sequence
aaaaatttccaaaatttag

SEQ ID NO: 96062 - DNA, 19 bp, Artificial sequence
  SiRNA target sequence
aaaatttccaaaatttagt

SEQ ID NO: 96063 - DNA, 19 bp, Artificial sequence
  SiRNA target sequence
aaatttccaaaatttagtc

SEQ ID NO: 96064 - DNA, 19 bp, Artificial sequence
  SiRNA target sequence
aatttccaaaatttagtca

SEQ ID NO: 96065 - DNA, 19 bp, Artificial sequence
  SiRNA target sequence
atttccaaaatttagtcat

SEQ ID NO: 96066 - DNA, 19 bp, Artificial sequence
  SiRNA target sequence
tttccaaaatttagtcatg

SEQ ID NO: 96067 - DNA, 19 bp, Artificial sequence
  SiRNA target sequence
ttccaaaatttagtcatgt

SEQ ID NO: 96068 - DNA, 19 bp, Artificial sequence
  SiRNA target sequence
tccaaaatttagtcatgtt

SEQ ID NO: 96069 - DNA, 19 bp, Artificial sequence
  SiRNA target sequence
ccaaaatttagtcatgtta

SEQ ID NO: 96070 - DNA, 19 bp, Artificial sequence
  SiRNA target sequence
caaaatttagtcatgttaa

SEQ ID NO: 96071 - DNA, 19 bp, Artificial sequence
  SiRNA target sequence
aaaatttagtcatgttaaa

SEQ ID NO: 96072 - DNA, 19 bp, Artificial sequence
  SiRNA target sequence
aaatttagtcatgttaaaa

SEQ ID NO: 96073 - DNA, 19 bp, Artificial sequence
  SiRNA target sequence
aatttagtcatgttaaaag

SEQ ID NO: 96074 - DNA, 19 bp, Artificial sequence
  SiRNA target sequence
atttagtcatgttaaaagg

SEQ ID NO: 96075 - DNA, 19 bp, Artificial sequence
  SiRNA target sequence
tttagtcatgttaaaaggt

SEQ ID NO: 96076 - DNA, 19 bp, Artificial sequence
  SiRNA target sequence
ttagtcatgttaaaaggtt

SEQ ID NO: 96077 - DNA, 19 bp, Artificial sequence
  SiRNA target sequence
tagtcatgttaaaaggttc

SEQ ID NO: 96078 - DNA, 19 bp, Artificial sequence
  SiRNA target sequence
agtcatgttaaaaggttca

SEQ ID NO: 96079 - DNA, 19 bp, Artificial sequence
  SiRNA target sequence
gtcatgttaaaaggttcag

SEQ ID NO: 96080 - DNA, 19 bp, Artificial sequence
  SiRNA target sequence
tcatgttaaaaggttcaga

SEQ ID NO: 96081 - DNA, 19 bp, Artificial sequence
  SiRNA target sequence
catgttaaaaggttcagaa

SEQ ID NO: 96082 - DNA, 19 bp, Artificial sequence
  SiRNA target sequence
atgttaaaaggttcagaac

SEQ ID NO: 96083 - DNA, 19 bp, Artificial sequence
  SiRNA target sequence
tgttaaaaggttcagaacc

SEQ ID NO: 96084 - DNA, 19 bp, Artificial sequence
  SiRNA target sequence
gttaaaaggttcagaacca

SEQ ID NO: 96085 - DNA, 19 bp, Artificial sequence
  SiRNA target sequence
ttaaaaggttcagaaccat

SEQ ID NO: 96086 - DNA, 19 bp, Artificial sequence
  SiRNA target sequence
taaaaggttcagaaccatt

SEQ ID NO: 96087 - DNA, 19 bp, Artificial sequence
  SiRNA target sequence
aaaaggttcagaaccattc

SEQ ID NO: 96088 - DNA, 19 bp, Artificial sequence
  SiRNA target sequence
aaaggttcagaaccattcc

SEQ ID NO: 96089 - DNA, 19 bp, Artificial sequence
  SiRNA target sequence
aaggttcagaaccattccc

SEQ ID NO: 96090 - DNA, 19 bp, Artificial sequence
  SiRNA target sequence
aggttcagaaccattccca

SEQ ID NO: 96091 - DNA, 19 bp, Artificial sequence
  SiRNA target sequence
ggttcagaaccattcccat

SEQ ID NO: 96092 - DNA, 19 bp, Artificial sequence
  SiRNA target sequence
gttcagaaccattcccatg

SEQ ID NO: 96093 - DNA, 19 bp, Artificial sequence
  SiRNA target sequence
ttcagaaccattcccatga

SEQ ID NO: 96094 - DNA, 19 bp, Artificial sequence
  SiRNA target sequence
tcagaaccattcccatgag

SEQ ID NO: 96095 - DNA, 19 bp, Artificial sequence
  SiRNA target sequence
cagaaccattcccatgagt

SEQ ID NO: 96096 - DNA, 19 bp, Artificial sequence
  SiRNA target sequence
agaaccattcccatgagtc

SEQ ID NO: 96097 - DNA, 19 bp, Artificial sequence
  SiRNA target sequence
gaaccattcccatgagtcg

SEQ ID NO: 96098 - DNA, 19 bp, Artificial sequence
  SiRNA target sequence
aaccattcccatgagtcga

SEQ ID NO: 96099 - DNA, 19 bp, Artificial sequence
  SiRNA target sequence
accattcccatgagtcgaa

SEQ ID NO: 96100 - DNA, 19 bp, Artificial sequence
  SiRNA target sequence
ccattcccatgagtcgaac

SEQ ID NO: 96101 - DNA, 19 bp, Artificial sequence
  SiRNA target sequence
cattcccatgagtcgaaca

SEQ ID NO: 96102 - DNA, 19 bp, Artificial sequence
  SiRNA target sequence
attcccatgagtcgaacat

SEQ ID NO: 96103 - DNA, 19 bp, Artificial sequence
  SiRNA target sequence
ttcccatgagtcgaacata

SEQ ID NO: 96104 - DNA, 19 bp, Artificial sequence
  SiRNA target sequence
tcccatgagtcgaacatac

SEQ ID NO: 96105 - DNA, 19 bp, Artificial sequence
  SiRNA target sequence
cccatgagtcgaacataca

SEQ ID NO: 96106 - DNA, 19 bp, Artificial sequence
  SiRNA target sequence
ccatgagtcgaacatacaa

SEQ ID NO: 96107 - DNA, 19 bp, Artificial sequence
  SiRNA target sequence
catgagtcgaacatacaaa

SEQ ID NO: 96108 - DNA, 19 bp, Artificial sequence
  SiRNA target sequence
atgagtcgaacatacaaat

SEQ ID NO: 96109 - DNA, 19 bp, Artificial sequence
  SiRNA target sequence
tgagtcgaacatacaaata

SEQ ID NO: 96110 - DNA, 19 bp, Artificial sequence
  SiRNA target sequence
gagtcgaacatacaaatat

SEQ ID NO: 96111 - DNA, 19 bp, Artificial sequence
  SiRNA target sequence
agtcgaacatacaaatata

SEQ ID NO: 96112 - DNA, 19 bp, Artificial sequence
  SiRNA target sequence
gtcgaacatacaaatataa

SEQ ID NO: 96113 - DNA, 19 bp, Artificial sequence
  SiRNA target sequence
tcgaacatacaaatataat

SEQ ID NO: 96114 - DNA, 19 bp, Artificial sequence
  SiRNA target sequence
cgaacatacaaatataatc

SEQ ID NO: 96115 - DNA, 19 bp, Artificial sequence
  SiRNA target sequence
gaacatacaaatataatca

SEQ ID NO: 96116 - DNA, 19 bp, Artificial sequence
  SiRNA target sequence
aacatacaaatataatcat

SEQ ID NO: 96117 - DNA, 19 bp, Artificial sequence
  SiRNA target sequence
acatacaaatataatcata

SEQ ID NO: 96118 - DNA, 19 bp, Artificial sequence
  SiRNA target sequence
catacaaatataatcatat

SEQ ID NO: 96119 - DNA, 19 bp, Artificial sequence
  SiRNA target sequence
atacaaatataatcatatc

SEQ ID NO: 96120 - DNA, 19 bp, Artificial sequence
  SiRNA target sequence
tacaaatataatcatatca

SEQ ID NO: 96121 - DNA, 19 bp, Artificial sequence
  SiRNA target sequence
acaaatataatcatatcaa

SEQ ID NO: 96122 - DNA, 19 bp, Artificial sequence
  SiRNA target sequence
caaatataatcatatcaat

SEQ ID NO: 96123 - DNA, 19 bp, Artificial sequence
  SiRNA target sequence
aaatataatcatatcaata

SEQ ID NO: 96124 - DNA, 19 bp, Artificial sequence
  SiRNA target sequence
aatataatcatatcaatat

SEQ ID NO: 96125 - DNA, 19 bp, Artificial sequence
  SiRNA target sequence
atataatcatatcaatatc

SEQ ID NO: 96126 - DNA, 19 bp, Artificial sequence
  SiRNA target sequence
tataatcatatcaatatct

SEQ ID NO: 96127 - DNA, 19 bp, Artificial sequence
  SiRNA target sequence
ataatcatatcaatatcta

SEQ ID NO: 96128 - DNA, 19 bp, Artificial sequence
  SiRNA target sequence
taatcatatcaatatctaa

SEQ ID NO: 96129 - DNA, 19 bp, Artificial sequence
  SiRNA target sequence
aatcatatcaatatctaat

SEQ ID NO: 96130 - DNA, 19 bp, Artificial sequence
  SiRNA target sequence
atcatatcaatatctaata

SEQ ID NO: 96131 - DNA, 19 bp, Artificial sequence
  SiRNA target sequence
tcatatcaatatctaatat

SEQ ID NO: 96132 - DNA, 19 bp, Artificial sequence
  SiRNA target sequence
catatcaatatctaatatt

SEQ ID NO: 96133 - DNA, 19 bp, Artificial sequence
  SiRNA target sequence
atatcaatatctaatattt

SEQ ID NO: 96134 - DNA, 19 bp, Artificial sequence
  SiRNA target sequence
tatcaatatctaatatttt

SEQ ID NO: 96135 - DNA, 19 bp, Artificial sequence
  SiRNA target sequence
atcaatatctaatattttt

SEQ ID NO: 96136 - DNA, 19 bp, Artificial sequence
  SiRNA target sequence
tcaatatctaatatttttt

SEQ ID NO: 96137 - DNA, 19 bp, Artificial sequence
  SiRNA target sequence
caatatctaatattttttc

SEQ ID NO: 96138 - DNA, 19 bp, Artificial sequence
  SiRNA target sequence
aatatctaatattttttcg

SEQ ID NO: 96139 - DNA, 19 bp, Artificial sequence
  SiRNA target sequence
atatctaatattttttcga

SEQ ID NO: 96140 - DNA, 19 bp, Artificial sequence
  SiRNA target sequence
tatctaatattttttcgaa

SEQ ID NO: 96141 - DNA, 19 bp, Artificial sequence
  SiRNA target sequence
atctaatattttttcgaaa

SEQ ID NO: 96142 - DNA, 19 bp, Artificial sequence
  SiRNA target sequence
tctaatattttttcgaaat

SEQ ID NO: 96143 - DNA, 19 bp, Artificial sequence
  SiRNA target sequence
ctaatattttttcgaaatc

SEQ ID NO: 96144 - DNA, 19 bp, Artificial sequence
  SiRNA target sequence
taatattttttcgaaatca

SEQ ID NO: 96145 - DNA, 19 bp, Artificial sequence
  SiRNA target sequence
aatattttttcgaaatcaa

SEQ ID NO: 96146 - DNA, 19 bp, Artificial sequence
  SiRNA target sequence
atattttttcgaaatcaaa

SEQ ID NO: 96147 - DNA, 19 bp, Artificial sequence
  SiRNA target sequence
tattttttcgaaatcaaaa

SEQ ID NO: 96148 - DNA, 19 bp, Artificial sequence
  SiRNA target sequence
attttttcgaaatcaaaac

SEQ ID NO: 96149 - DNA, 19 bp, Artificial sequence
  SiRNA target sequence
ttttttcgaaatcaaaact

SEQ ID NO: 96150 - DNA, 19 bp, Artificial sequence
  SiRNA target sequence
tttttcgaaatcaaaactg

SEQ ID NO: 96151 - DNA, 19 bp, Artificial sequence
  SiRNA target sequence
ttttcgaaatcaaaactgt

SEQ ID NO: 96152 - DNA, 19 bp, Artificial sequence
  SiRNA target sequence
tttcgaaatcaaaactgtc

SEQ ID NO: 96153 - DNA, 19 bp, Artificial sequence
  SiRNA target sequence
ttcgaaatcaaaactgtcc

SEQ ID NO: 96154 - DNA, 19 bp, Artificial sequence
  SiRNA target sequence
tcgaaatcaaaactgtcca

SEQ ID NO: 96155 - DNA, 19 bp, Artificial sequence
  SiRNA target sequence
cgaaatcaaaactgtccat

SEQ ID NO: 96156 - DNA, 19 bp, Artificial sequence
  SiRNA target sequence
gaaatcaaaactgtccata

SEQ ID NO: 96157 - DNA, 19 bp, Artificial sequence
  SiRNA target sequence
aaatcaaaactgtccatat

SEQ ID NO: 96158 - DNA, 19 bp, Artificial sequence
  SiRNA target sequence
aatcaaaactgtccatatc

SEQ ID NO: 96159 - DNA, 19 bp, Artificial sequence
  SiRNA target sequence
atcaaaactgtccatatct

SEQ ID NO: 96160 - DNA, 19 bp, Artificial sequence
  SiRNA target sequence
tcaaaactgtccatatcta

SEQ ID NO: 96161 - DNA, 19 bp, Artificial sequence
  SiRNA target sequence
caaaactgtccatatctaa

SEQ ID NO: 96162 - DNA, 19 bp, Artificial sequence
  SiRNA target sequence
aaaactgtccatatctaaa

SEQ ID NO: 96163 - DNA, 19 bp, Artificial sequence
  SiRNA target sequence
aaactgtccatatctaaag

SEQ ID NO: 96164 - DNA, 19 bp, Artificial sequence
  SiRNA target sequence
aactgtccatatctaaagt

SEQ ID NO: 96165 - DNA, 19 bp, Artificial sequence
  SiRNA target sequence
actgtccatatctaaagta

SEQ ID NO: 96166 - DNA, 19 bp, Artificial sequence
  SiRNA target sequence
ctgtccatatctaaagtaa

SEQ ID NO: 96167 - DNA, 19 bp, Artificial sequence
  SiRNA target sequence
tgtccatatctaaagtaaa

SEQ ID NO: 96168 - DNA, 19 bp, Artificial sequence
  SiRNA target sequence
gtccatatctaaagtaaaa

SEQ ID NO: 96169 - DNA, 19 bp, Artificial sequence
  SiRNA target sequence
tccatatctaaagtaaaat

SEQ ID NO: 96170 - DNA, 19 bp, Artificial sequence
  SiRNA target sequence
ccatatctaaagtaaaatc

SEQ ID NO: 96171 - DNA, 19 bp, Artificial sequence
  SiRNA target sequence
catatctaaagtaaaatct

SEQ ID NO: 96172 - DNA, 19 bp, Artificial sequence
  SiRNA target sequence
atatctaaagtaaaatctg

SEQ ID NO: 96173 - DNA, 19 bp, Artificial sequence
  SiRNA target sequence
tatctaaagtaaaatctgt

SEQ ID NO: 96174 - DNA, 19 bp, Artificial sequence
  SiRNA target sequence
atctaaagtaaaatctgtt

SEQ ID NO: 96175 - DNA, 19 bp, Artificial sequence
  SiRNA target sequence
tctaaagtaaaatctgttg

SEQ ID NO: 96176 - DNA, 19 bp, Artificial sequence
  SiRNA target sequence
ctaaagtaaaatctgttgg

SEQ ID NO: 96177 - DNA, 19 bp, Artificial sequence
  SiRNA target sequence
taaagtaaaatctgttgga

SEQ ID NO: 96178 - DNA, 19 bp, Artificial sequence
  SiRNA target sequence
aaagtaaaatctgttggaa

SEQ ID NO: 96179 - DNA, 19 bp, Artificial sequence
  SiRNA target sequence
aagtaaaatctgttggaag

SEQ ID NO: 96180 - DNA, 19 bp, Artificial sequence
  SiRNA target sequence
agtaaaatctgttggaagc

SEQ ID NO: 96181 - DNA, 19 bp, Artificial sequence
  SiRNA target sequence
gtaaaatctgttggaagca

SEQ ID NO: 96182 - DNA, 19 bp, Artificial sequence
  SiRNA target sequence
taaaatctgttggaagcaa

SEQ ID NO: 96183 - DNA, 19 bp, Artificial sequence
  SiRNA target sequence
aaaatctgttggaagcaat

SEQ ID NO: 96184 - DNA, 19 bp, Artificial sequence
  SiRNA target sequence
aaatctgttggaagcaatt

SEQ ID NO: 96185 - DNA, 19 bp, Artificial sequence
  SiRNA target sequence
aatctgttggaagcaattc

SEQ ID NO: 96186 - DNA, 19 bp, Artificial sequence
  SiRNA target sequence
atctgttggaagcaattct

SEQ ID NO: 96187 - DNA, 19 bp, Artificial sequence
  SiRNA target sequence
tctgttggaagcaattctt

SEQ ID NO: 96188 - DNA, 19 bp, Artificial sequence
  SiRNA target sequence
ctgttggaagcaattcttt

SEQ ID NO: 96189 - DNA, 19 bp, Artificial sequence
  SiRNA target sequence
tgttggaagcaattcttta

SEQ ID NO: 96190 - DNA, 19 bp, Artificial sequence
  SiRNA target sequence
gttggaagcaattctttat

SEQ ID NO: 96191 - DNA, 19 bp, Artificial sequence
  SiRNA target sequence
ttggaagcaattctttatc

SEQ ID NO: 96192 - DNA, 19 bp, Artificial sequence
  SiRNA target sequence
tggaagcaattctttatca

SEQ ID NO: 96193 - DNA, 19 bp, Artificial sequence
  SiRNA target sequence
ggaagcaattctttatcaa

SEQ ID NO: 96194 - DNA, 19 bp, Artificial sequence
  SiRNA target sequence
gaagcaattctttatcaac

SEQ ID NO: 96195 - DNA, 19 bp, Artificial sequence
  SiRNA target sequence
aagcaattctttatcaacg

SEQ ID NO: 96196 - DNA, 19 bp, Artificial sequence
  SiRNA target sequence
agcaattctttatcaacgt

SEQ ID NO: 96197 - DNA, 19 bp, Artificial sequence
  SiRNA target sequence
gcaattctttatcaacgtt

SEQ ID NO: 96198 - DNA, 19 bp, Artificial sequence
  SiRNA target sequence
caattctttatcaacgtta

SEQ ID NO: 96199 - DNA, 19 bp, Artificial sequence
  SiRNA target sequence
aattctttatcaacgttat

SEQ ID NO: 96200 - DNA, 19 bp, Artificial sequence
  SiRNA target sequence
attctttatcaacgttata

SEQ ID NO: 96201 - DNA, 19 bp, Artificial sequence
  SiRNA target sequence
ttctttatcaacgttataa

SEQ ID NO: 96202 - DNA, 19 bp, Artificial sequence
  SiRNA target sequence
tctttatcaacgttataaa

SEQ ID NO: 96203 - DNA, 19 bp, Artificial sequence
  SiRNA target sequence
ctttatcaacgttataaat

SEQ ID NO: 96204 - DNA, 19 bp, Artificial sequence
  SiRNA target sequence
tttatcaacgttataaatc

SEQ ID NO: 96205 - DNA, 19 bp, Artificial sequence
  SiRNA target sequence
ttatcaacgttataaatca

SEQ ID NO: 96206 - DNA, 19 bp, Artificial sequence
  SiRNA target sequence
tatcaacgttataaatcaa

SEQ ID NO: 96207 - DNA, 19 bp, Artificial sequence
  SiRNA target sequence
atcaacgttataaatcaaa

SEQ ID NO: 96208 - DNA, 19 bp, Artificial sequence
  SiRNA target sequence
tcaacgttataaatcaaat

SEQ ID NO: 96209 - DNA, 19 bp, Artificial sequence
  SiRNA target sequence
caacgttataaatcaaatc

SEQ ID NO: 96210 - DNA, 19 bp, Artificial sequence
  SiRNA target sequence
aacgttataaatcaaatct

SEQ ID NO: 96211 - DNA, 19 bp, Artificial sequence
  SiRNA target sequence
acgttataaatcaaatctt

SEQ ID NO: 96212 - DNA, 19 bp, Artificial sequence
  SiRNA target sequence
cgttataaatcaaatcttt

SEQ ID NO: 96213 - DNA, 19 bp, Artificial sequence
  SiRNA target sequence
gttataaatcaaatcttta

SEQ ID NO: 96214 - DNA, 19 bp, Artificial sequence
  SiRNA target sequence
ttataaatcaaatctttat

SEQ ID NO: 96215 - DNA, 19 bp, Artificial sequence
  SiRNA target sequence
tataaatcaaatctttatt

SEQ ID NO: 96216 - DNA, 19 bp, Artificial sequence
  SiRNA target sequence
ataaatcaaatctttattg

SEQ ID NO: 96217 - DNA, 19 bp, Artificial sequence
  SiRNA target sequence
taaatcaaatctttattgt

SEQ ID NO: 96218 - DNA, 19 bp, Artificial sequence
  SiRNA target sequence
aaatcaaatctttattgta

SEQ ID NO: 96219 - DNA, 19 bp, Artificial sequence
  SiRNA target sequence
aatcaaatctttattgtat

SEQ ID NO: 96220 - DNA, 19 bp, Artificial sequence
  SiRNA target sequence
atcaaatctttattgtatc

SEQ ID NO: 96221 - DNA, 19 bp, Artificial sequence
  SiRNA target sequence
tcaaatctttattgtatcc

SEQ ID NO: 96222 - DNA, 19 bp, Artificial sequence
  SiRNA target sequence
caaatctttattgtatccg

SEQ ID NO: 96223 - DNA, 19 bp, Artificial sequence
  SiRNA target sequence
aaatctttattgtatccgt

SEQ ID NO: 96224 - DNA, 19 bp, Artificial sequence
  SiRNA target sequence
aatctttattgtatccgta

SEQ ID NO: 96225 - DNA, 19 bp, Artificial sequence
  SiRNA target sequence
atctttattgtatccgtat

SEQ ID NO: 96226 - DNA, 19 bp, Artificial sequence
  SiRNA target sequence
tctttattgtatccgtata

SEQ ID NO: 96227 - DNA, 19 bp, Artificial sequence
  SiRNA target sequence
ctttattgtatccgtatag

SEQ ID NO: 96228 - DNA, 19 bp, Artificial sequence
  SiRNA target sequence
tttattgtatccgtatagt

SEQ ID NO: 96229 - DNA, 19 bp, Artificial sequence
  SiRNA target sequence
ttattgtatccgtatagta

SEQ ID NO: 96230 - DNA, 19 bp, Artificial sequence
  SiRNA target sequence
tattgtatccgtatagtat

SEQ ID NO: 96231 - DNA, 19 bp, Artificial sequence
  SiRNA target sequence
attgtatccgtatagtata

SEQ ID NO: 96232 - DNA, 19 bp, Artificial sequence
  SiRNA target sequence
ttgtatccgtatagtataa

SEQ ID NO: 96233 - DNA, 19 bp, Artificial sequence
  SiRNA target sequence
tgtatccgtatagtataac

SEQ ID NO: 96234 - DNA, 19 bp, Artificial sequence
  SiRNA target sequence
gtatccgtatagtataaca

SEQ ID NO: 96235 - DNA, 19 bp, Artificial sequence
  SiRNA target sequence
tatccgtatagtataacat

SEQ ID NO: 96236 - DNA, 19 bp, Artificial sequence
  SiRNA target sequence
atccgtatagtataacatt

SEQ ID NO: 96237 - DNA, 19 bp, Artificial sequence
  SiRNA target sequence
tccgtatagtataacattt

SEQ ID NO: 96238 - DNA, 19 bp, Artificial sequence
  SiRNA target sequence
ccgtatagtataacatttt

SEQ ID NO: 96239 - DNA, 19 bp, Artificial sequence
  SiRNA target sequence
cgtatagtataacattttg

SEQ ID NO: 96240 - DNA, 19 bp, Artificial sequence
  SiRNA target sequence
gtatagtataacattttga

SEQ ID NO: 96241 - DNA, 19 bp, Artificial sequence
  SiRNA target sequence
tatagtataacattttgaa

SEQ ID NO: 96242 - DNA, 19 bp, Artificial sequence
  SiRNA target sequence
atagtataacattttgaat

SEQ ID NO: 96243 - DNA, 19 bp, Artificial sequence
  SiRNA target sequence
tagtataacattttgaata

SEQ ID NO: 96244 - DNA, 19 bp, Artificial sequence
  SiRNA target sequence
agtataacattttgaataa

SEQ ID NO: 96245 - DNA, 19 bp, Artificial sequence
  SiRNA target sequence
gtataacattttgaataag

SEQ ID NO: 96246 - DNA, 19 bp, Artificial sequence
  SiRNA target sequence
tataacattttgaataagt

SEQ ID NO: 96247 - DNA, 19 bp, Artificial sequence
  SiRNA target sequence
ataacattttgaataagtt

SEQ ID NO: 96248 - DNA, 19 bp, Artificial sequence
  SiRNA target sequence
taacattttgaataagttt

SEQ ID NO: 96249 - DNA, 19 bp, Artificial sequence
  SiRNA target sequence
aacattttgaataagttta

SEQ ID NO: 96250 - DNA, 19 bp, Artificial sequence
  SiRNA target sequence
acattttgaataagtttag

SEQ ID NO: 96251 - DNA, 19 bp, Artificial sequence
  SiRNA target sequence
cattttgaataagtttagc

SEQ ID NO: 96252 - DNA, 19 bp, Artificial sequence
  SiRNA target sequence
attttgaataagtttagca

SEQ ID NO: 96253 - DNA, 19 bp, Artificial sequence
  SiRNA target sequence
ttttgaataagtttagcaa

SEQ ID NO: 96254 - DNA, 19 bp, Artificial sequence
  SiRNA target sequence
tttgaataagtttagcaat

SEQ ID NO: 96255 - DNA, 19 bp, Artificial sequence
  SiRNA target sequence
ttgaataagtttagcaata

SEQ ID NO: 96256 - DNA, 19 bp, Artificial sequence
  SiRNA target sequence
tgaataagtttagcaatat

SEQ ID NO: 96257 - DNA, 19 bp, Artificial sequence
  SiRNA target sequence
gaataagtttagcaatatg

SEQ ID NO: 96258 - DNA, 19 bp, Artificial sequence
  SiRNA target sequence
aataagtttagcaatatgt

SEQ ID NO: 96259 - DNA, 19 bp, Artificial sequence
  SiRNA target sequence
ataagtttagcaatatgta

SEQ ID NO: 96260 - DNA, 19 bp, Artificial sequence
  SiRNA target sequence
taagtttagcaatatgtat

SEQ ID NO: 96261 - DNA, 19 bp, Artificial sequence
  SiRNA target sequence
aagtttagcaatatgtata

SEQ ID NO: 96262 - DNA, 19 bp, Artificial sequence
  SiRNA target sequence
agtttagcaatatgtatag

SEQ ID NO: 96263 - DNA, 19 bp, Artificial sequence
  SiRNA target sequence
gtttagcaatatgtataga

SEQ ID NO: 96264 - DNA, 19 bp, Artificial sequence
  SiRNA target sequence
tttagcaatatgtatagaa

SEQ ID NO: 96265 - DNA, 19 bp, Artificial sequence
  SiRNA target sequence
ttagcaatatgtatagaat

SEQ ID NO: 96266 - DNA, 19 bp, Artificial sequence
  SiRNA target sequence
tagcaatatgtatagaatt

SEQ ID NO: 96267 - DNA, 19 bp, Artificial sequence
  SiRNA target sequence
agcaatatgtatagaattt

SEQ ID NO: 96268 - DNA, 19 bp, Artificial sequence
  SiRNA target sequence
gcaatatgtatagaatttc

SEQ ID NO: 96269 - DNA, 19 bp, Artificial sequence
  SiRNA target sequence
caatatgtatagaatttcc

SEQ ID NO: 96270 - DNA, 19 bp, Artificial sequence
  SiRNA target sequence
aatatgtatagaatttcct

SEQ ID NO: 96271 - DNA, 19 bp, Artificial sequence
  SiRNA target sequence
atatgtatagaatttcctg

SEQ ID NO: 96272 - DNA, 19 bp, Artificial sequence
  SiRNA target sequence
tatgtatagaatttcctgt

SEQ ID NO: 96273 - DNA, 19 bp, Artificial sequence
  SiRNA target sequence
atgtatagaatttcctgtt

SEQ ID NO: 96274 - DNA, 19 bp, Artificial sequence
  SiRNA target sequence
tgtatagaatttcctgttt

SEQ ID NO: 96275 - DNA, 19 bp, Artificial sequence
  SiRNA target sequence
gtatagaatttcctgtttg

SEQ ID NO: 96276 - DNA, 19 bp, Artificial sequence
  SiRNA target sequence
tatagaatttcctgtttgg

SEQ ID NO: 96277 - DNA, 19 bp, Artificial sequence
  SiRNA target sequence
atagaatttcctgtttggg

SEQ ID NO: 96278 - DNA, 19 bp, Artificial sequence
  SiRNA target sequence
tagaatttcctgtttggga

SEQ ID NO: 96279 - DNA, 19 bp, Artificial sequence
  SiRNA target sequence
agaatttcctgtttgggag

SEQ ID NO: 96280 - DNA, 19 bp, Artificial sequence
  SiRNA target sequence
gaatttcctgtttgggagc

SEQ ID NO: 96281 - DNA, 19 bp, Artificial sequence
  SiRNA target sequence
aatttcctgtttgggagcc

SEQ ID NO: 96282 - DNA, 19 bp, Artificial sequence
  SiRNA target sequence
atttcctgtttgggagcca

SEQ ID NO: 96283 - DNA, 19 bp, Artificial sequence
  SiRNA target sequence
tttcctgtttgggagccat

SEQ ID NO: 96284 - DNA, 19 bp, Artificial sequence
  SiRNA target sequence
ttcctgtttgggagccata

SEQ ID NO: 96285 - DNA, 19 bp, Artificial sequence
  SiRNA target sequence
tcctgtttgggagccatat

SEQ ID NO: 96286 - DNA, 19 bp, Artificial sequence
  SiRNA target sequence
cctgtttgggagccatata

SEQ ID NO: 96287 - DNA, 19 bp, Artificial sequence
  SiRNA target sequence
ctgtttgggagccatataa

SEQ ID NO: 96288 - DNA, 19 bp, Artificial sequence
  SiRNA target sequence
tgtttgggagccatataag

SEQ ID NO: 96289 - DNA, 19 bp, Artificial sequence
  SiRNA target sequence
gtttgggagccatataaga

SEQ ID NO: 96290 - DNA, 19 bp, Artificial sequence
  SiRNA target sequence
tttgggagccatataagat

SEQ ID NO: 96291 - DNA, 19 bp, Artificial sequence
  SiRNA target sequence
ttgggagccatataagatt

SEQ ID NO: 96292 - DNA, 19 bp, Artificial sequence
  SiRNA target sequence
tgggagccatataagatta

SEQ ID NO: 96293 - DNA, 19 bp, Artificial sequence
  SiRNA target sequence
gggagccatataagattat

SEQ ID NO: 96294 - DNA, 19 bp, Artificial sequence
  SiRNA target sequence
ggagccatataagattatc

SEQ ID NO: 96295 - DNA, 19 bp, Artificial sequence
  SiRNA target sequence
gagccatataagattatca

SEQ ID NO: 96296 - DNA, 19 bp, Artificial sequence
  SiRNA target sequence
agccatataagattatcat

SEQ ID NO: 96297 - DNA, 20 bp, Artificial sequence
  SiRNA target sequence
ttaccaagtttctgcctgaa

SEQ ID NO: 96298 - DNA, 20 bp, Artificial sequence
  SiRNA target sequence
taccaagtttctgcctgaaa

SEQ ID NO: 96299 - DNA, 20 bp, Artificial sequence
  SiRNA target sequence
accaagtttctgcctgaaaa

SEQ ID NO: 96300 - DNA, 20 bp, Artificial sequence
  SiRNA target sequence
ccaagtttctgcctgaaaat

SEQ ID NO: 96301 - DNA, 20 bp, Artificial sequence
  SiRNA target sequence
caagtttctgcctgaaaata

SEQ ID NO: 96302 - DNA, 20 bp, Artificial sequence
  SiRNA target sequence
aagtttctgcctgaaaatat

SEQ ID NO: 96303 - DNA, 20 bp, Artificial sequence
  SiRNA target sequence
agtttctgcctgaaaatata

SEQ ID NO: 96304 - DNA, 20 bp, Artificial sequence
  SiRNA target sequence
gtttctgcctgaaaatatat

SEQ ID NO: 96305 - DNA, 20 bp, Artificial sequence
  SiRNA target sequence
tttctgcctgaaaatatatt

SEQ ID NO: 96306 - DNA, 20 bp, Artificial sequence
  SiRNA target sequence
ttctgcctgaaaatatattt

SEQ ID NO: 96307 - DNA, 20 bp, Artificial sequence
  SiRNA target sequence
tctgcctgaaaatatatttt

SEQ ID NO: 96308 - DNA, 20 bp, Artificial sequence
  SiRNA target sequence
ctgcctgaaaatatattttc

SEQ ID NO: 96309 - DNA, 20 bp, Artificial sequence
  SiRNA target sequence
tgcctgaaaatatattttct

SEQ ID NO: 96310 - DNA, 20 bp, Artificial sequence
  SiRNA target sequence
gcctgaaaatatattttctt

SEQ ID NO: 96311 - DNA, 20 bp, Artificial sequence
  SiRNA target sequence
cctgaaaatatattttcttt

SEQ ID NO: 96312 - DNA, 20 bp, Artificial sequence
  SiRNA target sequence
ctgaaaatatattttctttt

SEQ ID NO: 96313 - DNA, 20 bp, Artificial sequence
  SiRNA target sequence
tgaaaatatattttcttttt

SEQ ID NO: 96314 - DNA, 20 bp, Artificial sequence
  SiRNA target sequence
gaaaatatattttcttttta

SEQ ID NO: 96315 - DNA, 20 bp, Artificial sequence
  SiRNA target sequence
aaaatatattttctttttat

SEQ ID NO: 96316 - DNA, 20 bp, Artificial sequence
  SiRNA target sequence
aaatatattttctttttata

SEQ ID NO: 96317 - DNA, 20 bp, Artificial sequence
  SiRNA target sequence
aatatattttctttttataa

SEQ ID NO: 96318 - DNA, 20 bp, Artificial sequence
  SiRNA target sequence
atatattttctttttataaa

SEQ ID NO: 96319 - DNA, 20 bp, Artificial sequence
  SiRNA target sequence
tatattttctttttataaat

SEQ ID NO: 96320 - DNA, 20 bp, Artificial sequence
  SiRNA target sequence
atattttctttttataaata

SEQ ID NO: 96321 - DNA, 20 bp, Artificial sequence
  SiRNA target sequence
tattttctttttataaatat

SEQ ID NO: 96322 - DNA, 20 bp, Artificial sequence
  SiRNA target sequence
attttctttttataaatatc

SEQ ID NO: 96323 - DNA, 20 bp, Artificial sequence
  SiRNA target sequence
ttttctttttataaatatct

SEQ ID NO: 96324 - DNA, 20 bp, Artificial sequence
  SiRNA target sequence
tttctttttataaatatcta

SEQ ID NO: 96325 - DNA, 20 bp, Artificial sequence
  SiRNA target sequence
ttctttttataaatatctaa

SEQ ID NO: 96326 - DNA, 20 bp, Artificial sequence
  SiRNA target sequence
tctttttataaatatctaat

SEQ ID NO: 96327 - DNA, 20 bp, Artificial sequence
  SiRNA target sequence
ctttttataaatatctaata

SEQ ID NO: 96328 - DNA, 20 bp, Artificial sequence
  SiRNA target sequence
tttttataaatatctaataa

SEQ ID NO: 96329 - DNA, 20 bp, Artificial sequence
  SiRNA target sequence
ttttataaatatctaataac

SEQ ID NO: 96330 - DNA, 20 bp, Artificial sequence
  SiRNA target sequence
tttataaatatctaataaca

SEQ ID NO: 96331 - DNA, 20 bp, Artificial sequence
  SiRNA target sequence
ttataaatatctaataacat

SEQ ID NO: 96332 - DNA, 20 bp, Artificial sequence
  SiRNA target sequence
tataaatatctaataacatt

SEQ ID NO: 96333 - DNA, 20 bp, Artificial sequence
  SiRNA target sequence
ataaatatctaataacattt

SEQ ID NO: 96334 - DNA, 20 bp, Artificial sequence
  SiRNA target sequence
taaatatctaataacatttt

SEQ ID NO: 96335 - DNA, 20 bp, Artificial sequence
  SiRNA target sequence
aaatatctaataacattttt

SEQ ID NO: 96336 - DNA, 20 bp, Artificial sequence
  SiRNA target sequence
aatatctaataacatttttt

SEQ ID NO: 96337 - DNA, 20 bp, Artificial sequence
  SiRNA target sequence
atatctaataacattttttc

SEQ ID NO: 96338 - DNA, 20 bp, Artificial sequence
  SiRNA target sequence
tatctaataacattttttca

SEQ ID NO: 96339 - DNA, 20 bp, Artificial sequence
  SiRNA target sequence
atctaataacattttttcaa

SEQ ID NO: 96340 - DNA, 20 bp, Artificial sequence
  SiRNA target sequence
tctaataacattttttcaat

SEQ ID NO: 96341 - DNA, 20 bp, Artificial sequence
  SiRNA target sequence
ctaataacattttttcaata

SEQ ID NO: 96342 - DNA, 20 bp, Artificial sequence
  SiRNA target sequence
taataacattttttcaataa

SEQ ID NO: 96343 - DNA, 20 bp, Artificial sequence
  SiRNA target sequence
aataacattttttcaataat

SEQ ID NO: 96344 - DNA, 20 bp, Artificial sequence
  SiRNA target sequence
ataacattttttcaataata

SEQ ID NO: 96345 - DNA, 20 bp, Artificial sequence
  SiRNA target sequence
taacattttttcaataatat

SEQ ID NO: 96346 - DNA, 20 bp, Artificial sequence
  SiRNA target sequence
aacattttttcaataatatt

SEQ ID NO: 96347 - DNA, 20 bp, Artificial sequence
  SiRNA target sequence
acattttttcaataatatta

SEQ ID NO: 96348 - DNA, 20 bp, Artificial sequence
  SiRNA target sequence
cattttttcaataatattat

SEQ ID NO: 96349 - DNA, 20 bp, Artificial sequence
  SiRNA target sequence
attttttcaataatattatt

SEQ ID NO: 96350 - DNA, 20 bp, Artificial sequence
  SiRNA target sequence
ttttttcaataatattatta

SEQ ID NO: 96351 - DNA, 20 bp, Artificial sequence
  SiRNA target sequence
tttttcaataatattattaa

SEQ ID NO: 96352 - DNA, 20 bp, Artificial sequence
  SiRNA target sequence
ttttcaataatattattaag

SEQ ID NO: 96353 - DNA, 20 bp, Artificial sequence
  SiRNA target sequence
tttcaataatattattaagt

SEQ ID NO: 96354 - DNA, 20 bp, Artificial sequence
  SiRNA target sequence
ttcaataatattattaagtc

SEQ ID NO: 96355 - DNA, 20 bp, Artificial sequence
  SiRNA target sequence
tcaataatattattaagtct

SEQ ID NO: 96356 - DNA, 20 bp, Artificial sequence
  SiRNA target sequence
caataatattattaagtcta

SEQ ID NO: 96357 - DNA, 20 bp, Artificial sequence
  SiRNA target sequence
aataatattattaagtctag

SEQ ID NO: 96358 - DNA, 20 bp, Artificial sequence
  SiRNA target sequence
ataatattattaagtctaga

SEQ ID NO: 96359 - DNA, 20 bp, Artificial sequence
  SiRNA target sequence
taatattattaagtctagaa

SEQ ID NO: 96360 - DNA, 20 bp, Artificial sequence
  SiRNA target sequence
aatattattaagtctagaat

SEQ ID NO: 96361 - DNA, 20 bp, Artificial sequence
  SiRNA target sequence
atattattaagtctagaatt

SEQ ID NO: 96362 - DNA, 20 bp, Artificial sequence
  SiRNA target sequence
tattattaagtctagaattt

SEQ ID NO: 96363 - DNA, 20 bp, Artificial sequence
  SiRNA target sequence
attattaagtctagaatttc

SEQ ID NO: 96364 - DNA, 20 bp, Artificial sequence
  SiRNA target sequence
ttattaagtctagaatttcc

SEQ ID NO: 96365 - DNA, 20 bp, Artificial sequence
  SiRNA target sequence
tattaagtctagaatttcca

SEQ ID NO: 96366 - DNA, 20 bp, Artificial sequence
  SiRNA target sequence
attaagtctagaatttccac

SEQ ID NO: 96367 - DNA, 20 bp, Artificial sequence
  SiRNA target sequence
ttaagtctagaatttccact

SEQ ID NO: 96368 - DNA, 20 bp, Artificial sequence
  SiRNA target sequence
taagtctagaatttccactt

SEQ ID NO: 96369 - DNA, 20 bp, Artificial sequence
  SiRNA target sequence
aagtctagaatttccactta

SEQ ID NO: 96370 - DNA, 20 bp, Artificial sequence
  SiRNA target sequence
agtctagaatttccacttac

SEQ ID NO: 96371 - DNA, 20 bp, Artificial sequence
  SiRNA target sequence
gtctagaatttccacttaca

SEQ ID NO: 96372 - DNA, 20 bp, Artificial sequence
  SiRNA target sequence
tctagaatttccacttacaa

SEQ ID NO: 96373 - DNA, 20 bp, Artificial sequence
  SiRNA target sequence
ctagaatttccacttacaaa

SEQ ID NO: 96374 - DNA, 20 bp, Artificial sequence
  SiRNA target sequence
tagaatttccacttacaaat

SEQ ID NO: 96375 - DNA, 20 bp, Artificial sequence
  SiRNA target sequence
agaatttccacttacaaata

SEQ ID NO: 96376 - DNA, 20 bp, Artificial sequence
  SiRNA target sequence
gaatttccacttacaaatat

SEQ ID NO: 96377 - DNA, 20 bp, Artificial sequence
  SiRNA target sequence
aatttccacttacaaatatt

SEQ ID NO: 96378 - DNA, 20 bp, Artificial sequence
  SiRNA target sequence
atttccacttacaaatatta

SEQ ID NO: 96379 - DNA, 20 bp, Artificial sequence
  SiRNA target sequence
tttccacttacaaatattaa

SEQ ID NO: 96380 - DNA, 20 bp, Artificial sequence
  SiRNA target sequence
ttccacttacaaatattaac

SEQ ID NO: 96381 - DNA, 20 bp, Artificial sequence
  SiRNA target sequence
tccacttacaaatattaacc

SEQ ID NO: 96382 - DNA, 20 bp, Artificial sequence
  SiRNA target sequence
ccacttacaaatattaacca

SEQ ID NO: 96383 - DNA, 20 bp, Artificial sequence
  SiRNA target sequence
cacttacaaatattaaccaa

SEQ ID NO: 96384 - DNA, 20 bp, Artificial sequence
  SiRNA target sequence
acttacaaatattaaccaat

SEQ ID NO: 96385 - DNA, 20 bp, Artificial sequence
  SiRNA target sequence
cttacaaatattaaccaatc

SEQ ID NO: 96386 - DNA, 20 bp, Artificial sequence
  SiRNA target sequence
ttacaaatattaaccaatca

SEQ ID NO: 96387 - DNA, 20 bp, Artificial sequence
  SiRNA target sequence
tacaaatattaaccaatcat

SEQ ID NO: 96388 - DNA, 20 bp, Artificial sequence
  SiRNA target sequence
acaaatattaaccaatcatc

SEQ ID NO: 96389 - DNA, 20 bp, Artificial sequence
  SiRNA target sequence
caaatattaaccaatcatca

SEQ ID NO: 96390 - DNA, 20 bp, Artificial sequence
  SiRNA target sequence
aaatattaaccaatcatcaa

SEQ ID NO: 96391 - DNA, 20 bp, Artificial sequence
  SiRNA target sequence
aatattaaccaatcatcaat

SEQ ID NO: 96392 - DNA, 20 bp, Artificial sequence
  SiRNA target sequence
atattaaccaatcatcaata

SEQ ID NO: 96393 - DNA, 20 bp, Artificial sequence
  SiRNA target sequence
tattaaccaatcatcaatat

SEQ ID NO: 96394 - DNA, 20 bp, Artificial sequence
  SiRNA target sequence
attaaccaatcatcaatatt

SEQ ID NO: 96395 - DNA, 20 bp, Artificial sequence
  SiRNA target sequence
ttaaccaatcatcaatattt

SEQ ID NO: 96396 - DNA, 20 bp, Artificial sequence
  SiRNA target sequence
taaccaatcatcaatatttt

SEQ ID NO: 96397 - DNA, 20 bp, Artificial sequence
  SiRNA target sequence
aaccaatcatcaatattttc

SEQ ID NO: 96398 - DNA, 20 bp, Artificial sequence
  SiRNA target sequence
accaatcatcaatattttct

SEQ ID NO: 96399 - DNA, 20 bp, Artificial sequence
  SiRNA target sequence
ccaatcatcaatattttcta

SEQ ID NO: 96400 - DNA, 20 bp, Artificial sequence
  SiRNA target sequence
caatcatcaatattttctag

SEQ ID NO: 96401 - DNA, 20 bp, Artificial sequence
  SiRNA target sequence
aatcatcaatattttctagc

SEQ ID NO: 96402 - DNA, 20 bp, Artificial sequence
  SiRNA target sequence
atcatcaatattttctagcc

SEQ ID NO: 96403 - DNA, 20 bp, Artificial sequence
  SiRNA target sequence
tcatcaatattttctagccc

SEQ ID NO: 96404 - DNA, 20 bp, Artificial sequence
  SiRNA target sequence
catcaatattttctagccct

SEQ ID NO: 96405 - DNA, 20 bp, Artificial sequence
  SiRNA target sequence
atcaatattttctagccctt

SEQ ID NO: 96406 - DNA, 20 bp, Artificial sequence
  SiRNA target sequence
tcaatattttctagcccttt

SEQ ID NO: 96407 - DNA, 20 bp, Artificial sequence
  SiRNA target sequence
caatattttctagccctttt

SEQ ID NO: 96408 - DNA, 20 bp, Artificial sequence
  SiRNA target sequence
aatattttctagccctttta

SEQ ID NO: 96409 - DNA, 20 bp, Artificial sequence
  SiRNA target sequence
atattttctagcccttttat

SEQ ID NO: 96410 - DNA, 20 bp, Artificial sequence
  SiRNA target sequence
tattttctagcccttttata

SEQ ID NO: 96411 - DNA, 20 bp, Artificial sequence
  SiRNA target sequence
attttctagcccttttatag

SEQ ID NO: 96412 - DNA, 20 bp, Artificial sequence
  SiRNA target sequence
ttttctagcccttttatagt

SEQ ID NO: 96413 - DNA, 20 bp, Artificial sequence
  SiRNA target sequence
tttctagcccttttatagtc

SEQ ID NO: 96414 - DNA, 20 bp, Artificial sequence
  SiRNA target sequence
ttctagcccttttatagtct

SEQ ID NO: 96415 - DNA, 20 bp, Artificial sequence
  SiRNA target sequence
tctagcccttttatagtctt

SEQ ID NO: 96416 - DNA, 20 bp, Artificial sequence
  SiRNA target sequence
ctagcccttttatagtctta

SEQ ID NO: 96417 - DNA, 20 bp, Artificial sequence
  SiRNA target sequence
tagcccttttatagtcttat

SEQ ID NO: 96418 - DNA, 20 bp, Artificial sequence
  SiRNA target sequence
agcccttttatagtcttata

SEQ ID NO: 96419 - DNA, 20 bp, Artificial sequence
  SiRNA target sequence
gcccttttatagtcttataa

SEQ ID NO: 96420 - DNA, 20 bp, Artificial sequence
  SiRNA target sequence
cccttttatagtcttataaa

SEQ ID NO: 96421 - DNA, 20 bp, Artificial sequence
  SiRNA target sequence
ccttttatagtcttataaat

SEQ ID NO: 96422 - DNA, 20 bp, Artificial sequence
  SiRNA target sequence
cttttatagtcttataaata

SEQ ID NO: 96423 - DNA, 20 bp, Artificial sequence
  SiRNA target sequence
ttttatagtcttataaatat

SEQ ID NO: 96424 - DNA, 20 bp, Artificial sequence
  SiRNA target sequence
tttatagtcttataaatatc

SEQ ID NO: 96425 - DNA, 20 bp, Artificial sequence
  SiRNA target sequence
ttatagtcttataaatatct

SEQ ID NO: 96426 - DNA, 20 bp, Artificial sequence
  SiRNA target sequence
tatagtcttataaatatctt

SEQ ID NO: 96427 - DNA, 20 bp, Artificial sequence
  SiRNA target sequence
atagtcttataaatatcttg

SEQ ID NO: 96428 - DNA, 20 bp, Artificial sequence
  SiRNA target sequence
tagtcttataaatatcttgt

SEQ ID NO: 96429 - DNA, 20 bp, Artificial sequence
  SiRNA target sequence
agtcttataaatatcttgta

SEQ ID NO: 96430 - DNA, 20 bp, Artificial sequence
  SiRNA target sequence
gtcttataaatatcttgtat

SEQ ID NO: 96431 - DNA, 20 bp, Artificial sequence
  SiRNA target sequence
tcttataaatatcttgtatg

SEQ ID NO: 96432 - DNA, 20 bp, Artificial sequence
  SiRNA target sequence
cttataaatatcttgtatgt

SEQ ID NO: 96433 - DNA, 20 bp, Artificial sequence
  SiRNA target sequence
ttataaatatcttgtatgta

SEQ ID NO: 96434 - DNA, 20 bp, Artificial sequence
  SiRNA target sequence
tataaatatcttgtatgtat

SEQ ID NO: 96435 - DNA, 20 bp, Artificial sequence
  SiRNA target sequence
ataaatatcttgtatgtatt

SEQ ID NO: 96436 - DNA, 20 bp, Artificial sequence
  SiRNA target sequence
taaatatcttgtatgtattt

SEQ ID NO: 96437 - DNA, 20 bp, Artificial sequence
  SiRNA target sequence
aaatatcttgtatgtattta

SEQ ID NO: 96438 - DNA, 20 bp, Artificial sequence
  SiRNA target sequence
aatatcttgtatgtatttat

SEQ ID NO: 96439 - DNA, 20 bp, Artificial sequence
  SiRNA target sequence
atatcttgtatgtatttatt

SEQ ID NO: 96440 - DNA, 20 bp, Artificial sequence
  SiRNA target sequence
tatcttgtatgtatttatta

SEQ ID NO: 96441 - DNA, 20 bp, Artificial sequence
  SiRNA target sequence
atcttgtatgtatttattat

SEQ ID NO: 96442 - DNA, 20 bp, Artificial sequence
  SiRNA target sequence
tcttgtatgtatttattatc

SEQ ID NO: 96443 - DNA, 20 bp, Artificial sequence
  SiRNA target sequence
cttgtatgtatttattatct

SEQ ID NO: 96444 - DNA, 20 bp, Artificial sequence
  SiRNA target sequence
ttgtatgtatttattatctt

SEQ ID NO: 96445 - DNA, 20 bp, Artificial sequence
  SiRNA target sequence
tgtatgtatttattatcttc

SEQ ID NO: 96446 - DNA, 20 bp, Artificial sequence
  SiRNA target sequence
gtatgtatttattatcttcc

SEQ ID NO: 96447 - DNA, 20 bp, Artificial sequence
  SiRNA target sequence
tatgtatttattatcttccc

SEQ ID NO: 96448 - DNA, 20 bp, Artificial sequence
  SiRNA target sequence
atgtatttattatcttccct

SEQ ID NO: 96449 - DNA, 20 bp, Artificial sequence
  SiRNA target sequence
tgtatttattatcttccctt

SEQ ID NO: 96450 - DNA, 20 bp, Artificial sequence
  SiRNA target sequence
gtatttattatcttcccttg

SEQ ID NO: 96451 - DNA, 20 bp, Artificial sequence
  SiRNA target sequence
tatttattatcttcccttga

SEQ ID NO: 96452 - DNA, 20 bp, Artificial sequence
  SiRNA target sequence
atttattatcttcccttgaa

SEQ ID NO: 96453 - DNA, 20 bp, Artificial sequence
  SiRNA target sequence
tttattatcttcccttgaaa

SEQ ID NO: 96454 - DNA, 20 bp, Artificial sequence
  SiRNA target sequence
ttattatcttcccttgaaac

SEQ ID NO: 96455 - DNA, 20 bp, Artificial sequence
  SiRNA target sequence
tattatcttcccttgaaaca

SEQ ID NO: 96456 - DNA, 20 bp, Artificial sequence
  SiRNA target sequence
attatcttcccttgaaacag

SEQ ID NO: 96457 - DNA, 20 bp, Artificial sequence
  SiRNA target sequence
ttatcttcccttgaaacagc

SEQ ID NO: 96458 - DNA, 20 bp, Artificial sequence
  SiRNA target sequence
tatcttcccttgaaacagcg

SEQ ID NO: 96459 - DNA, 20 bp, Artificial sequence
  SiRNA target sequence
atcttcccttgaaacagcgg

SEQ ID NO: 96460 - DNA, 20 bp, Artificial sequence
  SiRNA target sequence
tcttcccttgaaacagcggg

SEQ ID NO: 96461 - DNA, 20 bp, Artificial sequence
  SiRNA target sequence
cttcccttgaaacagcgggg

SEQ ID NO: 96462 - DNA, 20 bp, Artificial sequence
  SiRNA target sequence
ttcccttgaaacagcggggt

SEQ ID NO: 96463 - DNA, 20 bp, Artificial sequence
  SiRNA target sequence
tcccttgaaacagcggggta

SEQ ID NO: 96464 - DNA, 20 bp, Artificial sequence
  SiRNA target sequence
cccttgaaacagcggggtaa

SEQ ID NO: 96465 - DNA, 20 bp, Artificial sequence
  SiRNA target sequence
ccttgaaacagcggggtaaa

SEQ ID NO: 96466 - DNA, 20 bp, Artificial sequence
  SiRNA target sequence
cttgaaacagcggggtaaat

SEQ ID NO: 96467 - DNA, 20 bp, Artificial sequence
  SiRNA target sequence
ttgaaacagcggggtaaatt

SEQ ID NO: 96468 - DNA, 20 bp, Artificial sequence
  SiRNA target sequence
tgaaacagcggggtaaattt

SEQ ID NO: 96469 - DNA, 20 bp, Artificial sequence
  SiRNA target sequence
gaaacagcggggtaaatttc

SEQ ID NO: 96470 - DNA, 20 bp, Artificial sequence
  SiRNA target sequence
aaacagcggggtaaatttca

SEQ ID NO: 96471 - DNA, 20 bp, Artificial sequence
  SiRNA target sequence
aacagcggggtaaatttcaa

SEQ ID NO: 96472 - DNA, 20 bp, Artificial sequence
  SiRNA target sequence
acagcggggtaaatttcaat

SEQ ID NO: 96473 - DNA, 20 bp, Artificial sequence
  SiRNA target sequence
cagcggggtaaatttcaatg

SEQ ID NO: 96474 - DNA, 20 bp, Artificial sequence
  SiRNA target sequence
agcggggtaaatttcaatgc

SEQ ID NO: 96475 - DNA, 20 bp, Artificial sequence
  SiRNA target sequence
gcggggtaaatttcaatgcc

SEQ ID NO: 96476 - DNA, 20 bp, Artificial sequence
  SiRNA target sequence
cggggtaaatttcaatgcct

SEQ ID NO: 96477 - DNA, 20 bp, Artificial sequence
  SiRNA target sequence
ggggtaaatttcaatgcctt

SEQ ID NO: 96478 - DNA, 20 bp, Artificial sequence
  SiRNA target sequence
gggtaaatttcaatgccttt

SEQ ID NO: 96479 - DNA, 20 bp, Artificial sequence
  SiRNA target sequence
ggtaaatttcaatgccttta

SEQ ID NO: 96480 - DNA, 20 bp, Artificial sequence
  SiRNA target sequence
gtaaatttcaatgcctttat

SEQ ID NO: 96481 - DNA, 20 bp, Artificial sequence
  SiRNA target sequence
taaatttcaatgcctttatt

SEQ ID NO: 96482 - DNA, 20 bp, Artificial sequence
  SiRNA target sequence
aaatttcaatgcctttattt

SEQ ID NO: 96483 - DNA, 20 bp, Artificial sequence
  SiRNA target sequence
aatttcaatgcctttatttt

SEQ ID NO: 96484 - DNA, 20 bp, Artificial sequence
  SiRNA target sequence
atttcaatgcctttattttc

SEQ ID NO: 96485 - DNA, 20 bp, Artificial sequence
  SiRNA target sequence
tttcaatgcctttattttca

SEQ ID NO: 96486 - DNA, 20 bp, Artificial sequence
  SiRNA target sequence
ttcaatgcctttattttcaa

SEQ ID NO: 96487 - DNA, 20 bp, Artificial sequence
  SiRNA target sequence
tcaatgcctttattttcaaa

SEQ ID NO: 96488 - DNA, 20 bp, Artificial sequence
  SiRNA target sequence
caatgcctttattttcaaac

SEQ ID NO: 96489 - DNA, 20 bp, Artificial sequence
  SiRNA target sequence
aatgcctttattttcaaact

SEQ ID NO: 96490 - DNA, 20 bp, Artificial sequence
  SiRNA target sequence
atgcctttattttcaaactc

SEQ ID NO: 96491 - DNA, 20 bp, Artificial sequence
  SiRNA target sequence
tgcctttattttcaaactct

SEQ ID NO: 96492 - DNA, 20 bp, Artificial sequence
  SiRNA target sequence
gcctttattttcaaactctt

SEQ ID NO: 96493 - DNA, 20 bp, Artificial sequence
  SiRNA target sequence
cctttattttcaaactcttc

SEQ ID NO: 96494 - DNA, 20 bp, Artificial sequence
  SiRNA target sequence
ctttattttcaaactcttct

SEQ ID NO: 96495 - DNA, 20 bp, Artificial sequence
  SiRNA target sequence
tttattttcaaactcttctt

SEQ ID NO: 96496 - DNA, 20 bp, Artificial sequence
  SiRNA target sequence
ttattttcaaactcttcttt

SEQ ID NO: 96497 - DNA, 20 bp, Artificial sequence
  SiRNA target sequence
tattttcaaactcttcttta

SEQ ID NO: 96498 - DNA, 20 bp, Artificial sequence
  SiRNA target sequence
attttcaaactcttctttat

SEQ ID NO: 96499 - DNA, 20 bp, Artificial sequence
  SiRNA target sequence
ttttcaaactcttctttata

SEQ ID NO: 96500 - DNA, 20 bp, Artificial sequence
  SiRNA target sequence
tttcaaactcttctttatat

SEQ ID NO: 96501 - DNA, 20 bp, Artificial sequence
  SiRNA target sequence
ttcaaactcttctttatata

SEQ ID NO: 96502 - DNA, 20 bp, Artificial sequence
  SiRNA target sequence
tcaaactcttctttatataa

SEQ ID NO: 96503 - DNA, 20 bp, Artificial sequence
  SiRNA target sequence
caaactcttctttatataaa

SEQ ID NO: 96504 - DNA, 20 bp, Artificial sequence
  SiRNA target sequence
aaactcttctttatataaaa

SEQ ID NO: 96505 - DNA, 20 bp, Artificial sequence
  SiRNA target sequence
aactcttctttatataaaaa

SEQ ID NO: 96506 - DNA, 20 bp, Artificial sequence
  SiRNA target sequence
actcttctttatataaaaaa

SEQ ID NO: 96507 - DNA, 20 bp, Artificial sequence
  SiRNA target sequence
ctcttctttatataaaaaat

SEQ ID NO: 96508 - DNA, 20 bp, Artificial sequence
  SiRNA target sequence
tcttctttatataaaaaatc

SEQ ID NO: 96509 - DNA, 20 bp, Artificial sequence
  SiRNA target sequence
cttctttatataaaaaatct

SEQ ID NO: 96510 - DNA, 20 bp, Artificial sequence
  SiRNA target sequence
ttctttatataaaaaatcta

SEQ ID NO: 96511 - DNA, 20 bp, Artificial sequence
  SiRNA target sequence
tctttatataaaaaatctac

SEQ ID NO: 96512 - DNA, 20 bp, Artificial sequence
  SiRNA target sequence
ctttatataaaaaatctaca

SEQ ID NO: 96513 - DNA, 20 bp, Artificial sequence
  SiRNA target sequence
tttatataaaaaatctacat

SEQ ID NO: 96514 - DNA, 20 bp, Artificial sequence
  SiRNA target sequence
ttatataaaaaatctacatc

SEQ ID NO: 96515 - DNA, 20 bp, Artificial sequence
  SiRNA target sequence
tatataaaaaatctacatct

SEQ ID NO: 96516 - DNA, 20 bp, Artificial sequence
  SiRNA target sequence
atataaaaaatctacatctc

SEQ ID NO: 96517 - DNA, 20 bp, Artificial sequence
  SiRNA target sequence
tataaaaaatctacatctct

SEQ ID NO: 96518 - DNA, 20 bp, Artificial sequence
  SiRNA target sequence
ataaaaaatctacatctcta

SEQ ID NO: 96519 - DNA, 20 bp, Artificial sequence
  SiRNA target sequence
taaaaaatctacatctctaa

SEQ ID NO: 96520 - DNA, 20 bp, Artificial sequence
  SiRNA target sequence
aaaaaatctacatctctaaa

SEQ ID NO: 96521 - DNA, 20 bp, Artificial sequence
  SiRNA target sequence
aaaaatctacatctctaaat

SEQ ID NO: 96522 - DNA, 20 bp, Artificial sequence
  SiRNA target sequence
aaaatctacatctctaaatc

SEQ ID NO: 96523 - DNA, 20 bp, Artificial sequence
  SiRNA target sequence
aaatctacatctctaaatct

SEQ ID NO: 96524 - DNA, 20 bp, Artificial sequence
  SiRNA target sequence
aatctacatctctaaatcta

SEQ ID NO: 96525 - DNA, 20 bp, Artificial sequence
  SiRNA target sequence
atctacatctctaaatctaa

SEQ ID NO: 96526 - DNA, 20 bp, Artificial sequence
  SiRNA target sequence
tctacatctctaaatctaaa

SEQ ID NO: 96527 - DNA, 20 bp, Artificial sequence
  SiRNA target sequence
ctacatctctaaatctaaaa

SEQ ID NO: 96528 - DNA, 20 bp, Artificial sequence
  SiRNA target sequence
tacatctctaaatctaaaac

SEQ ID NO: 96529 - DNA, 20 bp, Artificial sequence
  SiRNA target sequence
acatctctaaatctaaaacc

SEQ ID NO: 96530 - DNA, 20 bp, Artificial sequence
  SiRNA target sequence
catctctaaatctaaaacca

SEQ ID NO: 96531 - DNA, 20 bp, Artificial sequence
  SiRNA target sequence
atctctaaatctaaaaccat

SEQ ID NO: 96532 - DNA, 20 bp, Artificial sequence
  SiRNA target sequence
tctctaaatctaaaaccata

SEQ ID NO: 96533 - DNA, 20 bp, Artificial sequence
  SiRNA target sequence
ctctaaatctaaaaccatat

SEQ ID NO: 96534 - DNA, 20 bp, Artificial sequence
  SiRNA target sequence
tctaaatctaaaaccatata

SEQ ID NO: 96535 - DNA, 20 bp, Artificial sequence
  SiRNA target sequence
ctaaatctaaaaccatataa

SEQ ID NO: 96536 - DNA, 20 bp, Artificial sequence
  SiRNA target sequence
taaatctaaaaccatataat

SEQ ID NO: 96537 - DNA, 20 bp, Artificial sequence
  SiRNA target sequence
aaatctaaaaccatataata

SEQ ID NO: 96538 - DNA, 20 bp, Artificial sequence
  SiRNA target sequence
aatctaaaaccatataataa

SEQ ID NO: 96539 - DNA, 20 bp, Artificial sequence
  SiRNA target sequence
atctaaaaccatataataaa

SEQ ID NO: 96540 - DNA, 20 bp, Artificial sequence
  SiRNA target sequence
tctaaaaccatataataaaa

SEQ ID NO: 96541 - DNA, 20 bp, Artificial sequence
  SiRNA target sequence
ctaaaaccatataataaaat

SEQ ID NO: 96542 - DNA, 20 bp, Artificial sequence
  SiRNA target sequence
taaaaccatataataaaata

SEQ ID NO: 96543 - DNA, 20 bp, Artificial sequence
  SiRNA target sequence
aaaaccatataataaaataa

SEQ ID NO: 96544 - DNA, 20 bp, Artificial sequence
  SiRNA target sequence
aaaccatataataaaataac

SEQ ID NO: 96545 - DNA, 20 bp, Artificial sequence
  SiRNA target sequence
aaccatataataaaataact

SEQ ID NO: 96546 - DNA, 20 bp, Artificial sequence
  SiRNA target sequence
accatataataaaataactt

SEQ ID NO: 96547 - DNA, 20 bp, Artificial sequence
  SiRNA target sequence
ccatataataaaataacttt

SEQ ID NO: 96548 - DNA, 20 bp, Artificial sequence
  SiRNA target sequence
catataataaaataactttt

SEQ ID NO: 96549 - DNA, 20 bp, Artificial sequence
  SiRNA target sequence
atataataaaataacttttt

SEQ ID NO: 96550 - DNA, 20 bp, Artificial sequence
  SiRNA target sequence
tataataaaataactttttt

SEQ ID NO: 96551 - DNA, 20 bp, Artificial sequence
  SiRNA target sequence
ataataaaataactttttta

SEQ ID NO: 96552 - DNA, 20 bp, Artificial sequence
  SiRNA target sequence
taataaaataacttttttaa

SEQ ID NO: 96553 - DNA, 20 bp, Artificial sequence
  SiRNA target sequence
aataaaataacttttttaaa

SEQ ID NO: 96554 - DNA, 20 bp, Artificial sequence
  SiRNA target sequence
ataaaataacttttttaaaa

SEQ ID NO: 96555 - DNA, 20 bp, Artificial sequence
  SiRNA target sequence
taaaataacttttttaaaaa

SEQ ID NO: 96556 - DNA, 20 bp, Artificial sequence
  SiRNA target sequence
aaaataacttttttaaaaaa

SEQ ID NO: 96557 - DNA, 20 bp, Artificial sequence
  SiRNA target sequence
aaataacttttttaaaaaaa

SEQ ID NO: 96558 - DNA, 20 bp, Artificial sequence
  SiRNA target sequence
aataacttttttaaaaaaat

SEQ ID NO: 96559 - DNA, 20 bp, Artificial sequence
  SiRNA target sequence
ataacttttttaaaaaaatt

SEQ ID NO: 96560 - DNA, 20 bp, Artificial sequence
  SiRNA target sequence
taacttttttaaaaaaattt

SEQ ID NO: 96561 - DNA, 20 bp, Artificial sequence
  SiRNA target sequence
aacttttttaaaaaaattta

SEQ ID NO: 96562 - DNA, 20 bp, Artificial sequence
  SiRNA target sequence
acttttttaaaaaaatttaa

SEQ ID NO: 96563 - DNA, 20 bp, Artificial sequence
  SiRNA target sequence
cttttttaaaaaaatttaaa

SEQ ID NO: 96564 - DNA, 20 bp, Artificial sequence
  SiRNA target sequence
ttttttaaaaaaatttaaat

SEQ ID NO: 96565 - DNA, 20 bp, Artificial sequence
  SiRNA target sequence
tttttaaaaaaatttaaatc

SEQ ID NO: 96566 - DNA, 20 bp, Artificial sequence
  SiRNA target sequence
ttttaaaaaaatttaaatca

SEQ ID NO: 96567 - DNA, 20 bp, Artificial sequence
  SiRNA target sequence
tttaaaaaaatttaaatcag

SEQ ID NO: 96568 - DNA, 20 bp, Artificial sequence
  SiRNA target sequence
ttaaaaaaatttaaatcaga

SEQ ID NO: 96569 - DNA, 20 bp, Artificial sequence
  SiRNA target sequence
taaaaaaatttaaatcagaa

SEQ ID NO: 96570 - DNA, 20 bp, Artificial sequence
  SiRNA target sequence
aaaaaaatttaaatcagaat

SEQ ID NO: 96571 - DNA, 20 bp, Artificial sequence
  SiRNA target sequence
aaaaaatttaaatcagaata

SEQ ID NO: 96572 - DNA, 20 bp, Artificial sequence
  SiRNA target sequence
aaaaatttaaatcagaatag

SEQ ID NO: 96573 - DNA, 20 bp, Artificial sequence
  SiRNA target sequence
aaaatttaaatcagaatagt

SEQ ID NO: 96574 - DNA, 20 bp, Artificial sequence
  SiRNA target sequence
aaatttaaatcagaatagta

SEQ ID NO: 96575 - DNA, 20 bp, Artificial sequence
  SiRNA target sequence
aatttaaatcagaatagtaa

SEQ ID NO: 96576 - DNA, 20 bp, Artificial sequence
  SiRNA target sequence
atttaaatcagaatagtaat

SEQ ID NO: 96577 - DNA, 20 bp, Artificial sequence
  SiRNA target sequence
tttaaatcagaatagtaatt

SEQ ID NO: 96578 - DNA, 20 bp, Artificial sequence
  SiRNA target sequence
ttaaatcagaatagtaatta

SEQ ID NO: 96579 - DNA, 20 bp, Artificial sequence
  SiRNA target sequence
taaatcagaatagtaattaa

SEQ ID NO: 96580 - DNA, 20 bp, Artificial sequence
  SiRNA target sequence
aaatcagaatagtaattaac

SEQ ID NO: 96581 - DNA, 20 bp, Artificial sequence
  SiRNA target sequence
aatcagaatagtaattaaca

SEQ ID NO: 96582 - DNA, 20 bp, Artificial sequence
  SiRNA target sequence
atcagaatagtaattaacaa

SEQ ID NO: 96583 - DNA, 20 bp, Artificial sequence
  SiRNA target sequence
tcagaatagtaattaacaaa

SEQ ID NO: 96584 - DNA, 20 bp, Artificial sequence
  SiRNA target sequence
cagaatagtaattaacaaat

SEQ ID NO: 96585 - DNA, 20 bp, Artificial sequence
  SiRNA target sequence
agaatagtaattaacaaatg

SEQ ID NO: 96586 - DNA, 20 bp, Artificial sequence
  SiRNA target sequence
gaatagtaattaacaaatgc

SEQ ID NO: 96587 - DNA, 20 bp, Artificial sequence
  SiRNA target sequence
aatagtaattaacaaatgcc

SEQ ID NO: 96588 - DNA, 20 bp, Artificial sequence
  SiRNA target sequence
atagtaattaacaaatgccc

SEQ ID NO: 96589 - DNA, 20 bp, Artificial sequence
  SiRNA target sequence
tagtaattaacaaatgccct

SEQ ID NO: 96590 - DNA, 20 bp, Artificial sequence
  SiRNA target sequence
agtaattaacaaatgccctg

SEQ ID NO: 96591 - DNA, 20 bp, Artificial sequence
  SiRNA target sequence
gtaattaacaaatgccctgg

SEQ ID NO: 96592 - DNA, 20 bp, Artificial sequence
  SiRNA target sequence
taattaacaaatgccctggg

SEQ ID NO: 96593 - DNA, 20 bp, Artificial sequence
  SiRNA target sequence
aattaacaaatgccctggga

SEQ ID NO: 96594 - DNA, 20 bp, Artificial sequence
  SiRNA target sequence
attaacaaatgccctgggaa

SEQ ID NO: 96595 - DNA, 20 bp, Artificial sequence
  SiRNA target sequence
ttaacaaatgccctgggaag

SEQ ID NO: 96596 - DNA, 20 bp, Artificial sequence
  SiRNA target sequence
taacaaatgccctgggaagt

SEQ ID NO: 96597 - DNA, 20 bp, Artificial sequence
  SiRNA target sequence
aacaaatgccctgggaagtg

SEQ ID NO: 96598 - DNA, 20 bp, Artificial sequence
  SiRNA target sequence
acaaatgccctgggaagtgt

SEQ ID NO: 96599 - DNA, 20 bp, Artificial sequence
  SiRNA target sequence
caaatgccctgggaagtgta

SEQ ID NO: 96600 - DNA, 20 bp, Artificial sequence
  SiRNA target sequence
aaatgccctgggaagtgtaa

SEQ ID NO: 96601 - DNA, 20 bp, Artificial sequence
  SiRNA target sequence
aatgccctgggaagtgtaat

SEQ ID NO: 96602 - DNA, 20 bp, Artificial sequence
  SiRNA target sequence
atgccctgggaagtgtaata

SEQ ID NO: 96603 - DNA, 20 bp, Artificial sequence
  SiRNA target sequence
tgccctgggaagtgtaatac

SEQ ID NO: 96604 - DNA, 20 bp, Artificial sequence
  SiRNA target sequence
gccctgggaagtgtaatacc

SEQ ID NO: 96605 - DNA, 20 bp, Artificial sequence
  SiRNA target sequence
ccctgggaagtgtaatacca

SEQ ID NO: 96606 - DNA, 20 bp, Artificial sequence
  SiRNA target sequence
cctgggaagtgtaataccag

SEQ ID NO: 96607 - DNA, 20 bp, Artificial sequence
  SiRNA target sequence
ctgggaagtgtaataccagt

SEQ ID NO: 96608 - DNA, 20 bp, Artificial sequence
  SiRNA target sequence
tgggaagtgtaataccagta

SEQ ID NO: 96609 - DNA, 20 bp, Artificial sequence
  SiRNA target sequence
gggaagtgtaataccagtac

SEQ ID NO: 96610 - DNA, 20 bp, Artificial sequence
  SiRNA target sequence
ggaagtgtaataccagtacc

SEQ ID NO: 96611 - DNA, 20 bp, Artificial sequence
  SiRNA target sequence
gaagtgtaataccagtacca

SEQ ID NO: 96612 - DNA, 20 bp, Artificial sequence
  SiRNA target sequence
aagtgtaataccagtaccag

SEQ ID NO: 96613 - DNA, 20 bp, Artificial sequence
  SiRNA target sequence
agtgtaataccagtaccagt

SEQ ID NO: 96614 - DNA, 20 bp, Artificial sequence
  SiRNA target sequence
gtgtaataccagtaccagtg

SEQ ID NO: 96615 - DNA, 20 bp, Artificial sequence
  SiRNA target sequence
tgtaataccagtaccagtgc

SEQ ID NO: 96616 - DNA, 20 bp, Artificial sequence
  SiRNA target sequence
gtaataccagtaccagtgca

SEQ ID NO: 96617 - DNA, 20 bp, Artificial sequence
  SiRNA target sequence
taataccagtaccagtgcac

SEQ ID NO: 96618 - DNA, 20 bp, Artificial sequence
  SiRNA target sequence
aataccagtaccagtgcaca

SEQ ID NO: 96619 - DNA, 20 bp, Artificial sequence
  SiRNA target sequence
ataccagtaccagtgcacat

SEQ ID NO: 96620 - DNA, 20 bp, Artificial sequence
  SiRNA target sequence
taccagtaccagtgcacata

SEQ ID NO: 96621 - DNA, 20 bp, Artificial sequence
  SiRNA target sequence
accagtaccagtgcacataa

SEQ ID NO: 96622 - DNA, 20 bp, Artificial sequence
  SiRNA target sequence
ccagtaccagtgcacataaa

SEQ ID NO: 96623 - DNA, 20 bp, Artificial sequence
  SiRNA target sequence
cagtaccagtgcacataaac

SEQ ID NO: 96624 - DNA, 20 bp, Artificial sequence
  SiRNA target sequence
agtaccagtgcacataaaca

SEQ ID NO: 96625 - DNA, 20 bp, Artificial sequence
  SiRNA target sequence
gtaccagtgcacataaacaa

SEQ ID NO: 96626 - DNA, 20 bp, Artificial sequence
  SiRNA target sequence
taccagtgcacataaacaaa

SEQ ID NO: 96627 - DNA, 20 bp, Artificial sequence
  SiRNA target sequence
accagtgcacataaacaaaa

SEQ ID NO: 96628 - DNA, 20 bp, Artificial sequence
  SiRNA target sequence
ccagtgcacataaacaaaat

SEQ ID NO: 96629 - DNA, 20 bp, Artificial sequence
  SiRNA target sequence
cagtgcacataaacaaaatc

SEQ ID NO: 96630 - DNA, 20 bp, Artificial sequence
  SiRNA target sequence
agtgcacataaacaaaatct

SEQ ID NO: 96631 - DNA, 20 bp, Artificial sequence
  SiRNA target sequence
gtgcacataaacaaaatctt

SEQ ID NO: 96632 - DNA, 20 bp, Artificial sequence
  SiRNA target sequence
tgcacataaacaaaatcttt

SEQ ID NO: 96633 - DNA, 20 bp, Artificial sequence
  SiRNA target sequence
gcacataaacaaaatctttt

SEQ ID NO: 96634 - DNA, 20 bp, Artificial sequence
  SiRNA target sequence
cacataaacaaaatcttttt

SEQ ID NO: 96635 - DNA, 20 bp, Artificial sequence
  SiRNA target sequence
acataaacaaaatcttttta

SEQ ID NO: 96636 - DNA, 20 bp, Artificial sequence
  SiRNA target sequence
cataaacaaaatctttttac

SEQ ID NO: 96637 - DNA, 20 bp, Artificial sequence
  SiRNA target sequence
ataaacaaaatctttttacc

SEQ ID NO: 96638 - DNA, 20 bp, Artificial sequence
  SiRNA target sequence
taaacaaaatctttttacca

SEQ ID NO: 96639 - DNA, 20 bp, Artificial sequence
  SiRNA target sequence
aaacaaaatctttttaccac

SEQ ID NO: 96640 - DNA, 20 bp, Artificial sequence
  SiRNA target sequence
aacaaaatctttttaccact

SEQ ID NO: 96641 - DNA, 20 bp, Artificial sequence
  SiRNA target sequence
acaaaatctttttaccacta

SEQ ID NO: 96642 - DNA, 20 bp, Artificial sequence
  SiRNA target sequence
caaaatctttttaccactaa

SEQ ID NO: 96643 - DNA, 20 bp, Artificial sequence
  SiRNA target sequence
aaaatctttttaccactaaa

SEQ ID NO: 96644 - DNA, 20 bp, Artificial sequence
  SiRNA target sequence
aaatctttttaccactaaaa

SEQ ID NO: 96645 - DNA, 20 bp, Artificial sequence
  SiRNA target sequence
aatctttttaccactaaaat

SEQ ID NO: 96646 - DNA, 20 bp, Artificial sequence
  SiRNA target sequence
atctttttaccactaaaatt

SEQ ID NO: 96647 - DNA, 20 bp, Artificial sequence
  SiRNA target sequence
tctttttaccactaaaatta

SEQ ID NO: 96648 - DNA, 20 bp, Artificial sequence
  SiRNA target sequence
ctttttaccactaaaattaa

SEQ ID NO: 96649 - DNA, 20 bp, Artificial sequence
  SiRNA target sequence
tttttaccactaaaattaag

SEQ ID NO: 96650 - DNA, 20 bp, Artificial sequence
  SiRNA target sequence
ttttaccactaaaattaagt

SEQ ID NO: 96651 - DNA, 20 bp, Artificial sequence
  SiRNA target sequence
tttaccactaaaattaagtc

SEQ ID NO: 96652 - DNA, 20 bp, Artificial sequence
  SiRNA target sequence
ttaccactaaaattaagtct

SEQ ID NO: 96653 - DNA, 20 bp, Artificial sequence
  SiRNA target sequence
taccactaaaattaagtcta

SEQ ID NO: 96654 - DNA, 20 bp, Artificial sequence
  SiRNA target sequence
accactaaaattaagtctat

SEQ ID NO: 96655 - DNA, 20 bp, Artificial sequence
  SiRNA target sequence
ccactaaaattaagtctatt

SEQ ID NO: 96656 - DNA, 20 bp, Artificial sequence
  SiRNA target sequence
cactaaaattaagtctattt

SEQ ID NO: 96657 - DNA, 20 bp, Artificial sequence
  SiRNA target sequence
actaaaattaagtctatttt

SEQ ID NO: 96658 - DNA, 20 bp, Artificial sequence
  SiRNA target sequence
ctaaaattaagtctattttg

SEQ ID NO: 96659 - DNA, 20 bp, Artificial sequence
  SiRNA target sequence
taaaattaagtctattttgt

SEQ ID NO: 96660 - DNA, 20 bp, Artificial sequence
  SiRNA target sequence
aaaattaagtctattttgta

SEQ ID NO: 96661 - DNA, 20 bp, Artificial sequence
  SiRNA target sequence
aaattaagtctattttgtac

SEQ ID NO: 96662 - DNA, 20 bp, Artificial sequence
  SiRNA target sequence
aattaagtctattttgtact

SEQ ID NO: 96663 - DNA, 20 bp, Artificial sequence
  SiRNA target sequence
attaagtctattttgtacta

SEQ ID NO: 96664 - DNA, 20 bp, Artificial sequence
  SiRNA target sequence
ttaagtctattttgtactat

SEQ ID NO: 96665 - DNA, 20 bp, Artificial sequence
  SiRNA target sequence
taagtctattttgtactatg

SEQ ID NO: 96666 - DNA, 20 bp, Artificial sequence
  SiRNA target sequence
aagtctattttgtactatgt

SEQ ID NO: 96667 - DNA, 20 bp, Artificial sequence
  SiRNA target sequence
agtctattttgtactatgtt

SEQ ID NO: 96668 - DNA, 20 bp, Artificial sequence
  SiRNA target sequence
gtctattttgtactatgtta

SEQ ID NO: 96669 - DNA, 20 bp, Artificial sequence
  SiRNA target sequence
tctattttgtactatgttaa

SEQ ID NO: 96670 - DNA, 20 bp, Artificial sequence
  SiRNA target sequence
ctattttgtactatgttaac

SEQ ID NO: 96671 - DNA, 20 bp, Artificial sequence
  SiRNA target sequence
tattttgtactatgttaaca

SEQ ID NO: 96672 - DNA, 20 bp, Artificial sequence
  SiRNA target sequence
attttgtactatgttaacat

SEQ ID NO: 96673 - DNA, 20 bp, Artificial sequence
  SiRNA target sequence
ttttgtactatgttaacatg

SEQ ID NO: 96674 - DNA, 20 bp, Artificial sequence
  SiRNA target sequence
tttgtactatgttaacatga

SEQ ID NO: 96675 - DNA, 20 bp, Artificial sequence
  SiRNA target sequence
ttgtactatgttaacatgaa

SEQ ID NO: 96676 - DNA, 20 bp, Artificial sequence
  SiRNA target sequence
tgtactatgttaacatgaat

SEQ ID NO: 96677 - DNA, 20 bp, Artificial sequence
  SiRNA target sequence
gtactatgttaacatgaata

SEQ ID NO: 96678 - DNA, 20 bp, Artificial sequence
  SiRNA target sequence
tactatgttaacatgaatag

SEQ ID NO: 96679 - DNA, 20 bp, Artificial sequence
  SiRNA target sequence
actatgttaacatgaatagt

SEQ ID NO: 96680 - DNA, 20 bp, Artificial sequence
  SiRNA target sequence
ctatgttaacatgaatagta

SEQ ID NO: 96681 - DNA, 20 bp, Artificial sequence
  SiRNA target sequence
tatgttaacatgaatagtag

SEQ ID NO: 96682 - DNA, 20 bp, Artificial sequence
  SiRNA target sequence
atgttaacatgaatagtaga

SEQ ID NO: 96683 - DNA, 20 bp, Artificial sequence
  SiRNA target sequence
tgttaacatgaatagtagac

SEQ ID NO: 96684 - DNA, 20 bp, Artificial sequence
  SiRNA target sequence
gttaacatgaatagtagacc

SEQ ID NO: 96685 - DNA, 20 bp, Artificial sequence
  SiRNA target sequence
ttaacatgaatagtagaccc

SEQ ID NO: 96686 - DNA, 20 bp, Artificial sequence
  SiRNA target sequence
taacatgaatagtagaccct

SEQ ID NO: 96687 - DNA, 20 bp, Artificial sequence
  SiRNA target sequence
aacatgaatagtagaccctt

SEQ ID NO: 96688 - DNA, 20 bp, Artificial sequence
  SiRNA target sequence
acatgaatagtagacccttt

SEQ ID NO: 96689 - DNA, 20 bp, Artificial sequence
  SiRNA target sequence
catgaatagtagacccttta

SEQ ID NO: 96690 - DNA, 20 bp, Artificial sequence
  SiRNA target sequence
atgaatagtagaccctttag

SEQ ID NO: 96691 - DNA, 20 bp, Artificial sequence
  SiRNA target sequence
tgaatagtagaccctttagt

SEQ ID NO: 96692 - DNA, 20 bp, Artificial sequence
  SiRNA target sequence
gaatagtagaccctttagta

SEQ ID NO: 96693 - DNA, 20 bp, Artificial sequence
  SiRNA target sequence
aatagtagaccctttagtaa

SEQ ID NO: 96694 - DNA, 20 bp, Artificial sequence
  SiRNA target sequence
atagtagaccctttagtaag

SEQ ID NO: 96695 - DNA, 20 bp, Artificial sequence
  SiRNA target sequence
tagtagaccctttagtaagt

SEQ ID NO: 96696 - DNA, 20 bp, Artificial sequence
  SiRNA target sequence
agtagaccctttagtaagta

SEQ ID NO: 96697 - DNA, 20 bp, Artificial sequence
  SiRNA target sequence
gtagaccctttagtaagtaa

SEQ ID NO: 96698 - DNA, 20 bp, Artificial sequence
  SiRNA target sequence
tagaccctttagtaagtaat

SEQ ID NO: 96699 - DNA, 20 bp, Artificial sequence
  SiRNA target sequence
agaccctttagtaagtaatt

SEQ ID NO: 96700 - DNA, 20 bp, Artificial sequence
  SiRNA target sequence
gaccctttagtaagtaattt

SEQ ID NO: 96701 - DNA, 20 bp, Artificial sequence
  SiRNA target sequence
accctttagtaagtaatttt

SEQ ID NO: 96702 - DNA, 20 bp, Artificial sequence
  SiRNA target sequence
ccctttagtaagtaatttta

SEQ ID NO: 96703 - DNA, 20 bp, Artificial sequence
  SiRNA target sequence
cctttagtaagtaattttaa

SEQ ID NO: 96704 - DNA, 20 bp, Artificial sequence
  SiRNA target sequence
ctttagtaagtaattttaaa

SEQ ID NO: 96705 - DNA, 20 bp, Artificial sequence
  SiRNA target sequence
tttagtaagtaattttaaat

SEQ ID NO: 96706 - DNA, 20 bp, Artificial sequence
  SiRNA target sequence
ttagtaagtaattttaaata

SEQ ID NO: 96707 - DNA, 20 bp, Artificial sequence
  SiRNA target sequence
tagtaagtaattttaaatac

SEQ ID NO: 96708 - DNA, 20 bp, Artificial sequence
  SiRNA target sequence
agtaagtaattttaaatact

SEQ ID NO: 96709 - DNA, 20 bp, Artificial sequence
  SiRNA target sequence
gtaagtaattttaaatactc

SEQ ID NO: 96710 - DNA, 20 bp, Artificial sequence
  SiRNA target sequence
taagtaattttaaatactct

SEQ ID NO: 96711 - DNA, 20 bp, Artificial sequence
  SiRNA target sequence
aagtaattttaaatactctg

SEQ ID NO: 96712 - DNA, 20 bp, Artificial sequence
  SiRNA target sequence
agtaattttaaatactctga

SEQ ID NO: 96713 - DNA, 20 bp, Artificial sequence
  SiRNA target sequence
gtaattttaaatactctgaa

SEQ ID NO: 96714 - DNA, 20 bp, Artificial sequence
  SiRNA target sequence
taattttaaatactctgaac

SEQ ID NO: 96715 - DNA, 20 bp, Artificial sequence
  SiRNA target sequence
aattttaaatactctgaaca

SEQ ID NO: 96716 - DNA, 20 bp, Artificial sequence
  SiRNA target sequence
attttaaatactctgaacaa

SEQ ID NO: 96717 - DNA, 20 bp, Artificial sequence
  SiRNA target sequence
ttttaaatactctgaacaaa

SEQ ID NO: 96718 - DNA, 20 bp, Artificial sequence
  SiRNA target sequence
tttaaatactctgaacaaag

SEQ ID NO: 96719 - DNA, 20 bp, Artificial sequence
  SiRNA target sequence
ttaaatactctgaacaaaga

SEQ ID NO: 96720 - DNA, 20 bp, Artificial sequence
  SiRNA target sequence
taaatactctgaacaaagac

SEQ ID NO: 96721 - DNA, 20 bp, Artificial sequence
  SiRNA target sequence
aaatactctgaacaaagacc

SEQ ID NO: 96722 - DNA, 20 bp, Artificial sequence
  SiRNA target sequence
aatactctgaacaaagacct

SEQ ID NO: 96723 - DNA, 20 bp, Artificial sequence
  SiRNA target sequence
atactctgaacaaagacctt

SEQ ID NO: 96724 - DNA, 20 bp, Artificial sequence
  SiRNA target sequence
tactctgaacaaagaccttt

SEQ ID NO: 96725 - DNA, 20 bp, Artificial sequence
  SiRNA target sequence
actctgaacaaagacctttt

SEQ ID NO: 96726 - DNA, 20 bp, Artificial sequence
  SiRNA target sequence
ctctgaacaaagaccttttc

SEQ ID NO: 96727 - DNA, 20 bp, Artificial sequence
  SiRNA target sequence
tctgaacaaagaccttttcg

SEQ ID NO: 96728 - DNA, 20 bp, Artificial sequence
  SiRNA target sequence
ctgaacaaagaccttttcgt

SEQ ID NO: 96729 - DNA, 20 bp, Artificial sequence
  SiRNA target sequence
tgaacaaagaccttttcgtt

SEQ ID NO: 96730 - DNA, 20 bp, Artificial sequence
  SiRNA target sequence
gaacaaagaccttttcgttc

SEQ ID NO: 96731 - DNA, 20 bp, Artificial sequence
  SiRNA target sequence
aacaaagaccttttcgttct

SEQ ID NO: 96732 - DNA, 20 bp, Artificial sequence
  SiRNA target sequence
acaaagaccttttcgttctt

SEQ ID NO: 96733 - DNA, 20 bp, Artificial sequence
  SiRNA target sequence
caaagaccttttcgttcttc

SEQ ID NO: 96734 - DNA, 20 bp, Artificial sequence
  SiRNA target sequence
aaagaccttttcgttcttct

SEQ ID NO: 96735 - DNA, 20 bp, Artificial sequence
  SiRNA target sequence
aagaccttttcgttcttctt

SEQ ID NO: 96736 - DNA, 20 bp, Artificial sequence
  SiRNA target sequence
agaccttttcgttcttcttt

SEQ ID NO: 96737 - DNA, 20 bp, Artificial sequence
  SiRNA target sequence
gaccttttcgttcttctttt

SEQ ID NO: 96738 - DNA, 20 bp, Artificial sequence
  SiRNA target sequence
accttttcgttcttctttta

SEQ ID NO: 96739 - DNA, 20 bp, Artificial sequence
  SiRNA target sequence
ccttttcgttcttcttttaa

SEQ ID NO: 96740 - DNA, 20 bp, Artificial sequence
  SiRNA target sequence
cttttcgttcttcttttaaa

SEQ ID NO: 96741 - DNA, 20 bp, Artificial sequence
  SiRNA target sequence
ttttcgttcttcttttaaac

SEQ ID NO: 96742 - DNA, 20 bp, Artificial sequence
  SiRNA target sequence
tttcgttcttcttttaaact

SEQ ID NO: 96743 - DNA, 20 bp, Artificial sequence
  SiRNA target sequence
ttcgttcttcttttaaactt

SEQ ID NO: 96744 - DNA, 20 bp, Artificial sequence
  SiRNA target sequence
tcgttcttcttttaaacttg

SEQ ID NO: 96745 - DNA, 20 bp, Artificial sequence
  SiRNA target sequence
cgttcttcttttaaacttgt

SEQ ID NO: 96746 - DNA, 20 bp, Artificial sequence
  SiRNA target sequence
gttcttcttttaaacttgtt

SEQ ID NO: 96747 - DNA, 20 bp, Artificial sequence
  SiRNA target sequence
ttcttcttttaaacttgttt

SEQ ID NO: 96748 - DNA, 20 bp, Artificial sequence
  SiRNA target sequence
tcttcttttaaacttgtttt

SEQ ID NO: 96749 - DNA, 20 bp, Artificial sequence
  SiRNA target sequence
cttcttttaaacttgtttta

SEQ ID NO: 96750 - DNA, 20 bp, Artificial sequence
  SiRNA target sequence
ttcttttaaacttgttttaa

SEQ ID NO: 96751 - DNA, 20 bp, Artificial sequence
  SiRNA target sequence
tcttttaaacttgttttaaa

SEQ ID NO: 96752 - DNA, 20 bp, Artificial sequence
  SiRNA target sequence
cttttaaacttgttttaaaa

SEQ ID NO: 96753 - DNA, 20 bp, Artificial sequence
  SiRNA target sequence
ttttaaacttgttttaaaag

SEQ ID NO: 96754 - DNA, 20 bp, Artificial sequence
  SiRNA target sequence
tttaaacttgttttaaaaga

SEQ ID NO: 96755 - DNA, 20 bp, Artificial sequence
  SiRNA target sequence
ttaaacttgttttaaaagaa

SEQ ID NO: 96756 - DNA, 20 bp, Artificial sequence
  SiRNA target sequence
taaacttgttttaaaagaaa

SEQ ID NO: 96757 - DNA, 20 bp, Artificial sequence
  SiRNA target sequence
aaacttgttttaaaagaaac

SEQ ID NO: 96758 - DNA, 20 bp, Artificial sequence
  SiRNA target sequence
aacttgttttaaaagaaaca

SEQ ID NO: 96759 - DNA, 20 bp, Artificial sequence
  SiRNA target sequence
acttgttttaaaagaaacaa

SEQ ID NO: 96760 - DNA, 20 bp, Artificial sequence
  SiRNA target sequence
cttgttttaaaagaaacaag

SEQ ID NO: 96761 - DNA, 20 bp, Artificial sequence
  SiRNA target sequence
ttgttttaaaagaaacaaga

SEQ ID NO: 96762 - DNA, 20 bp, Artificial sequence
  SiRNA target sequence
tgttttaaaagaaacaagag

SEQ ID NO: 96763 - DNA, 20 bp, Artificial sequence
  SiRNA target sequence
gttttaaaagaaacaagaga

SEQ ID NO: 96764 - DNA, 20 bp, Artificial sequence
  SiRNA target sequence
ttttaaaagaaacaagagag

SEQ ID NO: 96765 - DNA, 20 bp, Artificial sequence
  SiRNA target sequence
tttaaaagaaacaagagaga

SEQ ID NO: 96766 - DNA, 20 bp, Artificial sequence
  SiRNA target sequence
ttaaaagaaacaagagagac

SEQ ID NO: 96767 - DNA, 20 bp, Artificial sequence
  SiRNA target sequence
taaaagaaacaagagagacg

SEQ ID NO: 96768 - DNA, 20 bp, Artificial sequence
  SiRNA target sequence
aaaagaaacaagagagacgg

SEQ ID NO: 96769 - DNA, 20 bp, Artificial sequence
  SiRNA target sequence
aaagaaacaagagagacggt

SEQ ID NO: 96770 - DNA, 20 bp, Artificial sequence
  SiRNA target sequence
aagaaacaagagagacggtg

SEQ ID NO: 96771 - DNA, 20 bp, Artificial sequence
  SiRNA target sequence
agaaacaagagagacggtga

SEQ ID NO: 96772 - DNA, 20 bp, Artificial sequence
  SiRNA target sequence
gaaacaagagagacggtgac

SEQ ID NO: 96773 - DNA, 20 bp, Artificial sequence
  SiRNA target sequence
aaacaagagagacggtgaca

SEQ ID NO: 96774 - DNA, 20 bp, Artificial sequence
  SiRNA target sequence
aacaagagagacggtgacaa

SEQ ID NO: 96775 - DNA, 20 bp, Artificial sequence
  SiRNA target sequence
acaagagagacggtgacaaa

SEQ ID NO: 96776 - DNA, 20 bp, Artificial sequence
  SiRNA target sequence
caagagagacggtgacaaag

SEQ ID NO: 96777 - DNA, 20 bp, Artificial sequence
  SiRNA target sequence
aagagagacggtgacaaagt

SEQ ID NO: 96778 - DNA, 20 bp, Artificial sequence
  SiRNA target sequence
agagagacggtgacaaagta

SEQ ID NO: 96779 - DNA, 20 bp, Artificial sequence
  SiRNA target sequence
gagagacggtgacaaagtaa

SEQ ID NO: 96780 - DNA, 20 bp, Artificial sequence
  SiRNA target sequence
agagacggtgacaaagtaac

SEQ ID NO: 96781 - DNA, 20 bp, Artificial sequence
  SiRNA target sequence
gagacggtgacaaagtaaca

SEQ ID NO: 96782 - DNA, 20 bp, Artificial sequence
  SiRNA target sequence
agacggtgacaaagtaacaa

SEQ ID NO: 96783 - DNA, 20 bp, Artificial sequence
  SiRNA target sequence
gacggtgacaaagtaacaaa

SEQ ID NO: 96784 - DNA, 20 bp, Artificial sequence
  SiRNA target sequence
acggtgacaaagtaacaaaa

SEQ ID NO: 96785 - DNA, 20 bp, Artificial sequence
  SiRNA target sequence
cggtgacaaagtaacaaaaa

SEQ ID NO: 96786 - DNA, 20 bp, Artificial sequence
  SiRNA target sequence
ggtgacaaagtaacaaaaat

SEQ ID NO: 96787 - DNA, 20 bp, Artificial sequence
  SiRNA target sequence
gtgacaaagtaacaaaaatc

SEQ ID NO: 96788 - DNA, 20 bp, Artificial sequence
  SiRNA target sequence
tgacaaagtaacaaaaatct

SEQ ID NO: 96789 - DNA, 20 bp, Artificial sequence
  SiRNA target sequence
gacaaagtaacaaaaatctt

SEQ ID NO: 96790 - DNA, 20 bp, Artificial sequence
  SiRNA target sequence
acaaagtaacaaaaatcttt

SEQ ID NO: 96791 - DNA, 20 bp, Artificial sequence
  SiRNA target sequence
caaagtaacaaaaatctttt

SEQ ID NO: 96792 - DNA, 20 bp, Artificial sequence
  SiRNA target sequence
aaagtaacaaaaatcttttt

SEQ ID NO: 96793 - DNA, 20 bp, Artificial sequence
  SiRNA target sequence
aagtaacaaaaatctttttt

SEQ ID NO: 96794 - DNA, 20 bp, Artificial sequence
  SiRNA target sequence
agtaacaaaaatcttttttc

SEQ ID NO: 96795 - DNA, 20 bp, Artificial sequence
  SiRNA target sequence
gtaacaaaaatcttttttcg

SEQ ID NO: 96796 - DNA, 20 bp, Artificial sequence
  SiRNA target sequence
taacaaaaatcttttttcgt

SEQ ID NO: 96797 - DNA, 20 bp, Artificial sequence
  SiRNA target sequence
aacaaaaatcttttttcgtt

SEQ ID NO: 96798 - DNA, 20 bp, Artificial sequence
  SiRNA target sequence
acaaaaatcttttttcgtta

SEQ ID NO: 96799 - DNA, 20 bp, Artificial sequence
  SiRNA target sequence
caaaaatcttttttcgttaa

SEQ ID NO: 96800 - DNA, 20 bp, Artificial sequence
  SiRNA target sequence
aaaaatcttttttcgttaat

SEQ ID NO: 96801 - DNA, 20 bp, Artificial sequence
  SiRNA target sequence
aaaatcttttttcgttaatg

SEQ ID NO: 96802 - DNA, 20 bp, Artificial sequence
  SiRNA target sequence
aaatcttttttcgttaatgt

SEQ ID NO: 96803 - DNA, 20 bp, Artificial sequence
  SiRNA target sequence
aatcttttttcgttaatgta

SEQ ID NO: 96804 - DNA, 20 bp, Artificial sequence
  SiRNA target sequence
atcttttttcgttaatgtaa

SEQ ID NO: 96805 - DNA, 20 bp, Artificial sequence
  SiRNA target sequence
tcttttttcgttaatgtaaa

SEQ ID NO: 96806 - DNA, 20 bp, Artificial sequence
  SiRNA target sequence
cttttttcgttaatgtaaaa

SEQ ID NO: 96807 - DNA, 20 bp, Artificial sequence
  SiRNA target sequence
ttttttcgttaatgtaaaat

SEQ ID NO: 96808 - DNA, 20 bp, Artificial sequence
  SiRNA target sequence
tttttcgttaatgtaaaata

SEQ ID NO: 96809 - DNA, 20 bp, Artificial sequence
  SiRNA target sequence
ttttcgttaatgtaaaatat

SEQ ID NO: 96810 - DNA, 20 bp, Artificial sequence
  SiRNA target sequence
tttcgttaatgtaaaatatc

SEQ ID NO: 96811 - DNA, 20 bp, Artificial sequence
  SiRNA target sequence
ttcgttaatgtaaaatatct

SEQ ID NO: 96812 - DNA, 20 bp, Artificial sequence
  SiRNA target sequence
tcgttaatgtaaaatatctt

SEQ ID NO: 96813 - DNA, 20 bp, Artificial sequence
  SiRNA target sequence
cgttaatgtaaaatatcttg

SEQ ID NO: 96814 - DNA, 20 bp, Artificial sequence
  SiRNA target sequence
gttaatgtaaaatatcttgg

SEQ ID NO: 96815 - DNA, 20 bp, Artificial sequence
  SiRNA target sequence
ttaatgtaaaatatcttgga

SEQ ID NO: 96816 - DNA, 20 bp, Artificial sequence
  SiRNA target sequence
taatgtaaaatatcttggat

SEQ ID NO: 96817 - DNA, 20 bp, Artificial sequence
  SiRNA target sequence
aatgtaaaatatcttggatt

SEQ ID NO: 96818 - DNA, 20 bp, Artificial sequence
  SiRNA target sequence
atgtaaaatatcttggatta

SEQ ID NO: 96819 - DNA, 20 bp, Artificial sequence
  SiRNA target sequence
tgtaaaatatcttggattaa

SEQ ID NO: 96820 - DNA, 20 bp, Artificial sequence
  SiRNA target sequence
gtaaaatatcttggattaat

SEQ ID NO: 96821 - DNA, 20 bp, Artificial sequence
  SiRNA target sequence
taaaatatcttggattaatt

SEQ ID NO: 96822 - DNA, 20 bp, Artificial sequence
  SiRNA target sequence
aaaatatcttggattaatta

SEQ ID NO: 96823 - DNA, 20 bp, Artificial sequence
  SiRNA target sequence
aaatatcttggattaattac

SEQ ID NO: 96824 - DNA, 20 bp, Artificial sequence
  SiRNA target sequence
aatatcttggattaattaca

SEQ ID NO: 96825 - DNA, 20 bp, Artificial sequence
  SiRNA target sequence
atatcttggattaattacag

SEQ ID NO: 96826 - DNA, 20 bp, Artificial sequence
  SiRNA target sequence
tatcttggattaattacagg

SEQ ID NO: 96827 - DNA, 20 bp, Artificial sequence
  SiRNA target sequence
atcttggattaattacaggg

SEQ ID NO: 96828 - DNA, 20 bp, Artificial sequence
  SiRNA target sequence
tcttggattaattacaggga

SEQ ID NO: 96829 - DNA, 20 bp, Artificial sequence
  SiRNA target sequence
cttggattaattacagggat

SEQ ID NO: 96830 - DNA, 20 bp, Artificial sequence
  SiRNA target sequence
ttggattaattacagggata

SEQ ID NO: 96831 - DNA, 20 bp, Artificial sequence
  SiRNA target sequence
tggattaattacagggatat

SEQ ID NO: 96832 - DNA, 20 bp, Artificial sequence
  SiRNA target sequence
ggattaattacagggatata

SEQ ID NO: 96833 - DNA, 20 bp, Artificial sequence
  SiRNA target sequence
gattaattacagggatatac

SEQ ID NO: 96834 - DNA, 20 bp, Artificial sequence
  SiRNA target sequence
attaattacagggatatact

SEQ ID NO: 96835 - DNA, 20 bp, Artificial sequence
  SiRNA target sequence
ttaattacagggatatactt

SEQ ID NO: 96836 - DNA, 20 bp, Artificial sequence
  SiRNA target sequence
taattacagggatatacttg

SEQ ID NO: 96837 - DNA, 20 bp, Artificial sequence
  SiRNA target sequence
aattacagggatatacttgt

SEQ ID NO: 96838 - DNA, 20 bp, Artificial sequence
  SiRNA target sequence
attacagggatatacttgta

SEQ ID NO: 96839 - DNA, 20 bp, Artificial sequence
  SiRNA target sequence
ttacagggatatacttgtac

SEQ ID NO: 96840 - DNA, 20 bp, Artificial sequence
  SiRNA target sequence
tacagggatatacttgtaca

SEQ ID NO: 96841 - DNA, 20 bp, Artificial sequence
  SiRNA target sequence
acagggatatacttgtacat

SEQ ID NO: 96842 - DNA, 20 bp, Artificial sequence
  SiRNA target sequence
cagggatatacttgtacata

SEQ ID NO: 96843 - DNA, 20 bp, Artificial sequence
  SiRNA target sequence
agggatatacttgtacataa

SEQ ID NO: 96844 - DNA, 20 bp, Artificial sequence
  SiRNA target sequence
gggatatacttgtacataaa

SEQ ID NO: 96845 - DNA, 20 bp, Artificial sequence
  SiRNA target sequence
ggatatacttgtacataaaa

SEQ ID NO: 96846 - DNA, 20 bp, Artificial sequence
  SiRNA target sequence
gatatacttgtacataaaat

SEQ ID NO: 96847 - DNA, 20 bp, Artificial sequence
  SiRNA target sequence
atatacttgtacataaaatt

SEQ ID NO: 96848 - DNA, 20 bp, Artificial sequence
  SiRNA target sequence
tatacttgtacataaaattt

SEQ ID NO: 96849 - DNA, 20 bp, Artificial sequence
  SiRNA target sequence
atacttgtacataaaatttg

SEQ ID NO: 96850 - DNA, 20 bp, Artificial sequence
  SiRNA target sequence
tacttgtacataaaatttga

SEQ ID NO: 96851 - DNA, 20 bp, Artificial sequence
  SiRNA target sequence
acttgtacataaaatttgag

SEQ ID NO: 96852 - DNA, 20 bp, Artificial sequence
  SiRNA target sequence
cttgtacataaaatttgagg

SEQ ID NO: 96853 - DNA, 20 bp, Artificial sequence
  SiRNA target sequence
ttgtacataaaatttgaggt

SEQ ID NO: 96854 - DNA, 20 bp, Artificial sequence
  SiRNA target sequence
tgtacataaaatttgaggta

SEQ ID NO: 96855 - DNA, 20 bp, Artificial sequence
  SiRNA target sequence
gtacataaaatttgaggtaa

SEQ ID NO: 96856 - DNA, 20 bp, Artificial sequence
  SiRNA target sequence
tacataaaatttgaggtaag

SEQ ID NO: 96857 - DNA, 20 bp, Artificial sequence
  SiRNA target sequence
acataaaatttgaggtaagt

SEQ ID NO: 96858 - DNA, 20 bp, Artificial sequence
  SiRNA target sequence
cataaaatttgaggtaagtt

SEQ ID NO: 96859 - DNA, 20 bp, Artificial sequence
  SiRNA target sequence
ataaaatttgaggtaagttt

SEQ ID NO: 96860 - DNA, 20 bp, Artificial sequence
  SiRNA target sequence
taaaatttgaggtaagtttt

SEQ ID NO: 96861 - DNA, 20 bp, Artificial sequence
  SiRNA target sequence
aaaatttgaggtaagtttta

SEQ ID NO: 96862 - DNA, 20 bp, Artificial sequence
  SiRNA target sequence
aaatttgaggtaagttttat

SEQ ID NO: 96863 - DNA, 20 bp, Artificial sequence
  SiRNA target sequence
aatttgaggtaagttttatc

SEQ ID NO: 96864 - DNA, 20 bp, Artificial sequence
  SiRNA target sequence
atttgaggtaagttttatct

SEQ ID NO: 96865 - DNA, 20 bp, Artificial sequence
  SiRNA target sequence
tttgaggtaagttttatctt

SEQ ID NO: 96866 - DNA, 20 bp, Artificial sequence
  SiRNA target sequence
ttgaggtaagttttatctta

SEQ ID NO: 96867 - DNA, 20 bp, Artificial sequence
  SiRNA target sequence
tgaggtaagttttatcttaa

SEQ ID NO: 96868 - DNA, 20 bp, Artificial sequence
  SiRNA target sequence
gaggtaagttttatcttaaa

SEQ ID NO: 96869 - DNA, 20 bp, Artificial sequence
  SiRNA target sequence
aggtaagttttatcttaaaa

SEQ ID NO: 96870 - DNA, 20 bp, Artificial sequence
  SiRNA target sequence
ggtaagttttatcttaaaat

SEQ ID NO: 96871 - DNA, 20 bp, Artificial sequence
  SiRNA target sequence
gtaagttttatcttaaaatc

SEQ ID NO: 96872 - DNA, 20 bp, Artificial sequence
  SiRNA target sequence
taagttttatcttaaaatct

SEQ ID NO: 96873 - DNA, 20 bp, Artificial sequence
  SiRNA target sequence
aagttttatcttaaaatctt

SEQ ID NO: 96874 - DNA, 20 bp, Artificial sequence
  SiRNA target sequence
agttttatcttaaaatcttt

SEQ ID NO: 96875 - DNA, 20 bp, Artificial sequence
  SiRNA target sequence
gttttatcttaaaatctttt

SEQ ID NO: 96876 - DNA, 20 bp, Artificial sequence
  SiRNA target sequence
ttttatcttaaaatctttta

SEQ ID NO: 96877 - DNA, 20 bp, Artificial sequence
  SiRNA target sequence
tttatcttaaaatcttttag

SEQ ID NO: 96878 - DNA, 20 bp, Artificial sequence
  SiRNA target sequence
ttatcttaaaatcttttaga

SEQ ID NO: 96879 - DNA, 20 bp, Artificial sequence
  SiRNA target sequence
tatcttaaaatcttttagaa

SEQ ID NO: 96880 - DNA, 20 bp, Artificial sequence
  SiRNA target sequence
atcttaaaatcttttagaac

SEQ ID NO: 96881 - DNA, 20 bp, Artificial sequence
  SiRNA target sequence
tcttaaaatcttttagaacc

SEQ ID NO: 96882 - DNA, 20 bp, Artificial sequence
  SiRNA target sequence
cttaaaatcttttagaacct

SEQ ID NO: 96883 - DNA, 20 bp, Artificial sequence
  SiRNA target sequence
ttaaaatcttttagaacctc

SEQ ID NO: 96884 - DNA, 20 bp, Artificial sequence
  SiRNA target sequence
taaaatcttttagaacctca

SEQ ID NO: 96885 - DNA, 20 bp, Artificial sequence
  SiRNA target sequence
aaaatcttttagaacctcaa

SEQ ID NO: 96886 - DNA, 20 bp, Artificial sequence
  SiRNA target sequence
aaatcttttagaacctcaaa

SEQ ID NO: 96887 - DNA, 20 bp, Artificial sequence
  SiRNA target sequence
aatcttttagaacctcaaaa

SEQ ID NO: 96888 - DNA, 20 bp, Artificial sequence
  SiRNA target sequence
atcttttagaacctcaaaaa

SEQ ID NO: 96889 - DNA, 20 bp, Artificial sequence
  SiRNA target sequence
tcttttagaacctcaaaaat

SEQ ID NO: 96890 - DNA, 20 bp, Artificial sequence
  SiRNA target sequence
cttttagaacctcaaaaata

SEQ ID NO: 96891 - DNA, 20 bp, Artificial sequence
  SiRNA target sequence
ttttagaacctcaaaaatag

SEQ ID NO: 96892 - DNA, 20 bp, Artificial sequence
  SiRNA target sequence
tttagaacctcaaaaatagt

SEQ ID NO: 96893 - DNA, 20 bp, Artificial sequence
  SiRNA target sequence
ttagaacctcaaaaatagtg

SEQ ID NO: 96894 - DNA, 20 bp, Artificial sequence
  SiRNA target sequence
tagaacctcaaaaatagtgc

SEQ ID NO: 96895 - DNA, 20 bp, Artificial sequence
  SiRNA target sequence
agaacctcaaaaatagtgcg

SEQ ID NO: 96896 - DNA, 20 bp, Artificial sequence
  SiRNA target sequence
gaacctcaaaaatagtgcgc

SEQ ID NO: 96897 - DNA, 20 bp, Artificial sequence
  SiRNA target sequence
aacctcaaaaatagtgcgct

SEQ ID NO: 96898 - DNA, 20 bp, Artificial sequence
  SiRNA target sequence
acctcaaaaatagtgcgctt

SEQ ID NO: 96899 - DNA, 20 bp, Artificial sequence
  SiRNA target sequence
cctcaaaaatagtgcgcttc

SEQ ID NO: 96900 - DNA, 20 bp, Artificial sequence
  SiRNA target sequence
ctcaaaaatagtgcgcttcg

SEQ ID NO: 96901 - DNA, 20 bp, Artificial sequence
  SiRNA target sequence
tcaaaaatagtgcgcttcgg

SEQ ID NO: 96902 - DNA, 20 bp, Artificial sequence
  SiRNA target sequence
caaaaatagtgcgcttcggt

SEQ ID NO: 96903 - DNA, 20 bp, Artificial sequence
  SiRNA target sequence
aaaaatagtgcgcttcggta

SEQ ID NO: 96904 - DNA, 20 bp, Artificial sequence
  SiRNA target sequence
aaaatagtgcgcttcggtag

SEQ ID NO: 96905 - DNA, 20 bp, Artificial sequence
  SiRNA target sequence
aaatagtgcgcttcggtagt

SEQ ID NO: 96906 - DNA, 20 bp, Artificial sequence
  SiRNA target sequence
aatagtgcgcttcggtagta

SEQ ID NO: 96907 - DNA, 20 bp, Artificial sequence
  SiRNA target sequence
atagtgcgcttcggtagtaa

SEQ ID NO: 96908 - DNA, 20 bp, Artificial sequence
  SiRNA target sequence
tagtgcgcttcggtagtaaa

SEQ ID NO: 96909 - DNA, 20 bp, Artificial sequence
  SiRNA target sequence
agtgcgcttcggtagtaaaa

SEQ ID NO: 96910 - DNA, 20 bp, Artificial sequence
  SiRNA target sequence
gtgcgcttcggtagtaaaat

SEQ ID NO: 96911 - DNA, 20 bp, Artificial sequence
  SiRNA target sequence
tgcgcttcggtagtaaaatg

SEQ ID NO: 96912 - DNA, 20 bp, Artificial sequence
  SiRNA target sequence
gcgcttcggtagtaaaatgt

SEQ ID NO: 96913 - DNA, 20 bp, Artificial sequence
  SiRNA target sequence
cgcttcggtagtaaaatgta

SEQ ID NO: 96914 - DNA, 20 bp, Artificial sequence
  SiRNA target sequence
gcttcggtagtaaaatgtaa

SEQ ID NO: 96915 - DNA, 20 bp, Artificial sequence
  SiRNA target sequence
cttcggtagtaaaatgtaat

SEQ ID NO: 96916 - DNA, 20 bp, Artificial sequence
  SiRNA target sequence
ttcggtagtaaaatgtaatc

SEQ ID NO: 96917 - DNA, 20 bp, Artificial sequence
  SiRNA target sequence
tcggtagtaaaatgtaatca

SEQ ID NO: 96918 - DNA, 20 bp, Artificial sequence
  SiRNA target sequence
cggtagtaaaatgtaatcat

SEQ ID NO: 96919 - DNA, 20 bp, Artificial sequence
  SiRNA target sequence
ggtagtaaaatgtaatcata

SEQ ID NO: 96920 - DNA, 20 bp, Artificial sequence
  SiRNA target sequence
gtagtaaaatgtaatcatag

SEQ ID NO: 96921 - DNA, 20 bp, Artificial sequence
  SiRNA target sequence
tagtaaaatgtaatcatagt

SEQ ID NO: 96922 - DNA, 20 bp, Artificial sequence
  SiRNA target sequence
agtaaaatgtaatcatagta

SEQ ID NO: 96923 - DNA, 20 bp, Artificial sequence
  SiRNA target sequence
gtaaaatgtaatcatagtac

SEQ ID NO: 96924 - DNA, 20 bp, Artificial sequence
  SiRNA target sequence
taaaatgtaatcatagtaca

SEQ ID NO: 96925 - DNA, 20 bp, Artificial sequence
  SiRNA target sequence
aaaatgtaatcatagtacag

SEQ ID NO: 96926 - DNA, 20 bp, Artificial sequence
  SiRNA target sequence
aaatgtaatcatagtacaga

SEQ ID NO: 96927 - DNA, 20 bp, Artificial sequence
  SiRNA target sequence
aatgtaatcatagtacagat

SEQ ID NO: 96928 - DNA, 20 bp, Artificial sequence
  SiRNA target sequence
atgtaatcatagtacagatc

SEQ ID NO: 96929 - DNA, 20 bp, Artificial sequence
  SiRNA target sequence
tgtaatcatagtacagatcg

SEQ ID NO: 96930 - DNA, 20 bp, Artificial sequence
  SiRNA target sequence
gtaatcatagtacagatcgt

SEQ ID NO: 96931 - DNA, 20 bp, Artificial sequence
  SiRNA target sequence
taatcatagtacagatcgta

SEQ ID NO: 96932 - DNA, 20 bp, Artificial sequence
  SiRNA target sequence
aatcatagtacagatcgtaa

SEQ ID NO: 96933 - DNA, 20 bp, Artificial sequence
  SiRNA target sequence
atcatagtacagatcgtaat

SEQ ID NO: 96934 - DNA, 20 bp, Artificial sequence
  SiRNA target sequence
tcatagtacagatcgtaatt

SEQ ID NO: 96935 - DNA, 20 bp, Artificial sequence
  SiRNA target sequence
catagtacagatcgtaattt

SEQ ID NO: 96936 - DNA, 20 bp, Artificial sequence
  SiRNA target sequence
atagtacagatcgtaattta

SEQ ID NO: 96937 - DNA, 20 bp, Artificial sequence
  SiRNA target sequence
tagtacagatcgtaatttag

SEQ ID NO: 96938 - DNA, 20 bp, Artificial sequence
  SiRNA target sequence
agtacagatcgtaatttaga

SEQ ID NO: 96939 - DNA, 20 bp, Artificial sequence
  SiRNA target sequence
gtacagatcgtaatttagat

SEQ ID NO: 96940 - DNA, 20 bp, Artificial sequence
  SiRNA target sequence
tacagatcgtaatttagata

SEQ ID NO: 96941 - DNA, 20 bp, Artificial sequence
  SiRNA target sequence
acagatcgtaatttagataa

SEQ ID NO: 96942 - DNA, 20 bp, Artificial sequence
  SiRNA target sequence
cagatcgtaatttagataaa

SEQ ID NO: 96943 - DNA, 20 bp, Artificial sequence
  SiRNA target sequence
agatcgtaatttagataaat

SEQ ID NO: 96944 - DNA, 20 bp, Artificial sequence
  SiRNA target sequence
gatcgtaatttagataaatt

SEQ ID NO: 96945 - DNA, 20 bp, Artificial sequence
  SiRNA target sequence
atcgtaatttagataaattt

SEQ ID NO: 96946 - DNA, 20 bp, Artificial sequence
  SiRNA target sequence
tcgtaatttagataaatttc

SEQ ID NO: 96947 - DNA, 20 bp, Artificial sequence
  SiRNA target sequence
cgtaatttagataaatttct

SEQ ID NO: 96948 - DNA, 20 bp, Artificial sequence
  SiRNA target sequence
gtaatttagataaatttctt

SEQ ID NO: 96949 - DNA, 20 bp, Artificial sequence
  SiRNA target sequence
taatttagataaatttcttt

SEQ ID NO: 96950 - DNA, 20 bp, Artificial sequence
  SiRNA target sequence
aatttagataaatttcttta

SEQ ID NO: 96951 - DNA, 20 bp, Artificial sequence
  SiRNA target sequence
atttagataaatttctttac

SEQ ID NO: 96952 - DNA, 20 bp, Artificial sequence
  SiRNA target sequence
tttagataaatttctttaca

SEQ ID NO: 96953 - DNA, 20 bp, Artificial sequence
  SiRNA target sequence
ttagataaatttctttacat

SEQ ID NO: 96954 - DNA, 20 bp, Artificial sequence
  SiRNA target sequence
tagataaatttctttacatt

SEQ ID NO: 96955 - DNA, 20 bp, Artificial sequence
  SiRNA target sequence
agataaatttctttacattt

SEQ ID NO: 96956 - DNA, 20 bp, Artificial sequence
  SiRNA target sequence
gataaatttctttacatttc

SEQ ID NO: 96957 - DNA, 20 bp, Artificial sequence
  SiRNA target sequence
ataaatttctttacatttct

SEQ ID NO: 96958 - DNA, 20 bp, Artificial sequence
  SiRNA target sequence
taaatttctttacatttctc

SEQ ID NO: 96959 - DNA, 20 bp, Artificial sequence
  SiRNA target sequence
aaatttctttacatttctca

SEQ ID NO: 96960 - DNA, 20 bp, Artificial sequence
  SiRNA target sequence
aatttctttacatttctcac

SEQ ID NO: 96961 - DNA, 20 bp, Artificial sequence
  SiRNA target sequence
atttctttacatttctcacg

SEQ ID NO: 96962 - DNA, 20 bp, Artificial sequence
  SiRNA target sequence
tttctttacatttctcacga

SEQ ID NO: 96963 - DNA, 20 bp, Artificial sequence
  SiRNA target sequence
ttctttacatttctcacgat

SEQ ID NO: 96964 - DNA, 20 bp, Artificial sequence
  SiRNA target sequence
tctttacatttctcacgata

SEQ ID NO: 96965 - DNA, 20 bp, Artificial sequence
  SiRNA target sequence
ctttacatttctcacgatat

SEQ ID NO: 96966 - DNA, 20 bp, Artificial sequence
  SiRNA target sequence
tttacatttctcacgatatt

SEQ ID NO: 96967 - DNA, 20 bp, Artificial sequence
  SiRNA target sequence
ttacatttctcacgatattc

SEQ ID NO: 96968 - DNA, 20 bp, Artificial sequence
  SiRNA target sequence
tacatttctcacgatattcc

SEQ ID NO: 96969 - DNA, 20 bp, Artificial sequence
  SiRNA target sequence
acatttctcacgatattcct

SEQ ID NO: 96970 - DNA, 20 bp, Artificial sequence
  SiRNA target sequence
catttctcacgatattcctc

SEQ ID NO: 96971 - DNA, 20 bp, Artificial sequence
  SiRNA target sequence
atttctcacgatattcctca

SEQ ID NO: 96972 - DNA, 20 bp, Artificial sequence
  SiRNA target sequence
tttctcacgatattcctcag

SEQ ID NO: 96973 - DNA, 20 bp, Artificial sequence
  SiRNA target sequence
ttctcacgatattcctcagc

SEQ ID NO: 96974 - DNA, 20 bp, Artificial sequence
  SiRNA target sequence
tctcacgatattcctcagca

SEQ ID NO: 96975 - DNA, 20 bp, Artificial sequence
  SiRNA target sequence
ctcacgatattcctcagcaa

SEQ ID NO: 96976 - DNA, 20 bp, Artificial sequence
  SiRNA target sequence
tcacgatattcctcagcaat

SEQ ID NO: 96977 - DNA, 20 bp, Artificial sequence
  SiRNA target sequence
cacgatattcctcagcaatg

SEQ ID NO: 96978 - DNA, 20 bp, Artificial sequence
  SiRNA target sequence
acgatattcctcagcaatgg

SEQ ID NO: 96979 - DNA, 20 bp, Artificial sequence
  SiRNA target sequence
cgatattcctcagcaatggt

SEQ ID NO: 96980 - DNA, 20 bp, Artificial sequence
  SiRNA target sequence
gatattcctcagcaatggta

SEQ ID NO: 96981 - DNA, 20 bp, Artificial sequence
  SiRNA target sequence
atattcctcagcaatggtat

SEQ ID NO: 96982 - DNA, 20 bp, Artificial sequence
  SiRNA target sequence
tattcctcagcaatggtatc

SEQ ID NO: 96983 - DNA, 20 bp, Artificial sequence
  SiRNA target sequence
attcctcagcaatggtatct

SEQ ID NO: 96984 - DNA, 20 bp, Artificial sequence
  SiRNA target sequence
ttcctcagcaatggtatctg

SEQ ID NO: 96985 - DNA, 20 bp, Artificial sequence
  SiRNA target sequence
tcctcagcaatggtatctgt

SEQ ID NO: 96986 - DNA, 20 bp, Artificial sequence
  SiRNA target sequence
cctcagcaatggtatctgtg

SEQ ID NO: 96987 - DNA, 20 bp, Artificial sequence
  SiRNA target sequence
ctcagcaatggtatctgtga

SEQ ID NO: 96988 - DNA, 20 bp, Artificial sequence
  SiRNA target sequence
tcagcaatggtatctgtgat

SEQ ID NO: 96989 - DNA, 20 bp, Artificial sequence
  SiRNA target sequence
cagcaatggtatctgtgata

SEQ ID NO: 96990 - DNA, 20 bp, Artificial sequence
  SiRNA target sequence
agcaatggtatctgtgataa

SEQ ID NO: 96991 - DNA, 20 bp, Artificial sequence
  SiRNA target sequence
gcaatggtatctgtgataag

SEQ ID NO: 96992 - DNA, 20 bp, Artificial sequence
  SiRNA target sequence
caatggtatctgtgataagc

SEQ ID NO: 96993 - DNA, 20 bp, Artificial sequence
  SiRNA target sequence
aatggtatctgtgataagcg

SEQ ID NO: 96994 - DNA, 20 bp, Artificial sequence
  SiRNA target sequence
atggtatctgtgataagcga

SEQ ID NO: 96995 - DNA, 20 bp, Artificial sequence
  SiRNA target sequence
tggtatctgtgataagcgaa

SEQ ID NO: 96996 - DNA, 20 bp, Artificial sequence
  SiRNA target sequence
ggtatctgtgataagcgaaa

SEQ ID NO: 96997 - DNA, 20 bp, Artificial sequence
  SiRNA target sequence
gtatctgtgataagcgaaag

SEQ ID NO: 96998 - DNA, 20 bp, Artificial sequence
  SiRNA target sequence
tatctgtgataagcgaaagt

SEQ ID NO: 96999 - DNA, 20 bp, Artificial sequence
  SiRNA target sequence
atctgtgataagcgaaagtt

SEQ ID NO: 97000 - DNA, 20 bp, Artificial sequence
  SiRNA target sequence
tctgtgataagcgaaagttg

SEQ ID NO: 97001 - DNA, 20 bp, Artificial sequence
  SiRNA target sequence
ctgtgataagcgaaagttgt

SEQ ID NO: 97002 - DNA, 20 bp, Artificial sequence
  SiRNA target sequence
tgtgataagcgaaagttgta

SEQ ID NO: 97003 - DNA, 20 bp, Artificial sequence
  SiRNA target sequence
gtgataagcgaaagttgtag

SEQ ID NO: 97004 - DNA, 20 bp, Artificial sequence
  SiRNA target sequence
tgataagcgaaagttgtaga

SEQ ID NO: 97005 - DNA, 20 bp, Artificial sequence
  SiRNA target sequence
gataagcgaaagttgtagaa

SEQ ID NO: 97006 - DNA, 20 bp, Artificial sequence
  SiRNA target sequence
ataagcgaaagttgtagaaa

SEQ ID NO: 97007 - DNA, 20 bp, Artificial sequence
  SiRNA target sequence
taagcgaaagttgtagaaaa

SEQ ID NO: 97008 - DNA, 20 bp, Artificial sequence
  SiRNA target sequence
aagcgaaagttgtagaaaaa

SEQ ID NO: 97009 - DNA, 20 bp, Artificial sequence
  SiRNA target sequence
agcgaaagttgtagaaaaaa

SEQ ID NO: 97010 - DNA, 20 bp, Artificial sequence
  SiRNA target sequence
gcgaaagttgtagaaaaaaa

SEQ ID NO: 97011 - DNA, 20 bp, Artificial sequence
  SiRNA target sequence
cgaaagttgtagaaaaaaat

SEQ ID NO: 97012 - DNA, 20 bp, Artificial sequence
  SiRNA target sequence
gaaagttgtagaaaaaaata

SEQ ID NO: 97013 - DNA, 20 bp, Artificial sequence
  SiRNA target sequence
aaagttgtagaaaaaaatag

SEQ ID NO: 97014 - DNA, 20 bp, Artificial sequence
  SiRNA target sequence
aagttgtagaaaaaaataga

SEQ ID NO: 97015 - DNA, 20 bp, Artificial sequence
  SiRNA target sequence
agttgtagaaaaaaatagat

SEQ ID NO: 97016 - DNA, 20 bp, Artificial sequence
  SiRNA target sequence
gttgtagaaaaaaatagatt

SEQ ID NO: 97017 - DNA, 20 bp, Artificial sequence
  SiRNA target sequence
ttgtagaaaaaaatagattt

SEQ ID NO: 97018 - DNA, 20 bp, Artificial sequence
  SiRNA target sequence
tgtagaaaaaaatagatttg

SEQ ID NO: 97019 - DNA, 20 bp, Artificial sequence
  SiRNA target sequence
gtagaaaaaaatagatttga

SEQ ID NO: 97020 - DNA, 20 bp, Artificial sequence
  SiRNA target sequence
tagaaaaaaatagatttgag

SEQ ID NO: 97021 - DNA, 20 bp, Artificial sequence
  SiRNA target sequence
agaaaaaaatagatttgagg

SEQ ID NO: 97022 - DNA, 20 bp, Artificial sequence
  SiRNA target sequence
gaaaaaaatagatttgagga

SEQ ID NO: 97023 - DNA, 20 bp, Artificial sequence
  SiRNA target sequence
aaaaaaatagatttgaggaa

SEQ ID NO: 97024 - DNA, 20 bp, Artificial sequence
  SiRNA target sequence
aaaaaatagatttgaggaat

SEQ ID NO: 97025 - DNA, 20 bp, Artificial sequence
  SiRNA target sequence
aaaaatagatttgaggaata

SEQ ID NO: 97026 - DNA, 20 bp, Artificial sequence
  SiRNA target sequence
aaaatagatttgaggaatag

SEQ ID NO: 97027 - DNA, 20 bp, Artificial sequence
  SiRNA target sequence
aaatagatttgaggaataga

SEQ ID NO: 97028 - DNA, 20 bp, Artificial sequence
  SiRNA target sequence
aatagatttgaggaatagaa

SEQ ID NO: 97029 - DNA, 20 bp, Artificial sequence
  SiRNA target sequence
atagatttgaggaatagaat

SEQ ID NO: 97030 - DNA, 20 bp, Artificial sequence
  SiRNA target sequence
tagatttgaggaatagaatt

SEQ ID NO: 97031 - DNA, 20 bp, Artificial sequence
  SiRNA target sequence
agatttgaggaatagaatta

SEQ ID NO: 97032 - DNA, 20 bp, Artificial sequence
  SiRNA target sequence
gatttgaggaatagaattaa

SEQ ID NO: 97033 - DNA, 20 bp, Artificial sequence
  SiRNA target sequence
atttgaggaatagaattaaa

SEQ ID NO: 97034 - DNA, 20 bp, Artificial sequence
  SiRNA target sequence
tttgaggaatagaattaaaa

SEQ ID NO: 97035 - DNA, 20 bp, Artificial sequence
  SiRNA target sequence
ttgaggaatagaattaaaat

SEQ ID NO: 97036 - DNA, 20 bp, Artificial sequence
  SiRNA target sequence
tgaggaatagaattaaaatc

SEQ ID NO: 97037 - DNA, 20 bp, Artificial sequence
  SiRNA target sequence
gaggaatagaattaaaatca

SEQ ID NO: 97038 - DNA, 20 bp, Artificial sequence
  SiRNA target sequence
aggaatagaattaaaatcac

SEQ ID NO: 97039 - DNA, 20 bp, Artificial sequence
  SiRNA target sequence
ggaatagaattaaaatcaca

SEQ ID NO: 97040 - DNA, 20 bp, Artificial sequence
  SiRNA target sequence
gaatagaattaaaatcacaa

SEQ ID NO: 97041 - DNA, 20 bp, Artificial sequence
  SiRNA target sequence
aatagaattaaaatcacaat

SEQ ID NO: 97042 - DNA, 20 bp, Artificial sequence
  SiRNA target sequence
atagaattaaaatcacaata

SEQ ID NO: 97043 - DNA, 20 bp, Artificial sequence
  SiRNA target sequence
tagaattaaaatcacaatat

SEQ ID NO: 97044 - DNA, 20 bp, Artificial sequence
  SiRNA target sequence
agaattaaaatcacaatatt

SEQ ID NO: 97045 - DNA, 20 bp, Artificial sequence
  SiRNA target sequence
gaattaaaatcacaatattt

SEQ ID NO: 97046 - DNA, 20 bp, Artificial sequence
  SiRNA target sequence
aattaaaatcacaatatttt

SEQ ID NO: 97047 - DNA, 20 bp, Artificial sequence
  SiRNA target sequence
attaaaatcacaatattttt

SEQ ID NO: 97048 - DNA, 20 bp, Artificial sequence
  SiRNA target sequence
ttaaaatcacaatatttttt

SEQ ID NO: 97049 - DNA, 20 bp, Artificial sequence
  SiRNA target sequence
taaaatcacaatatttttta

SEQ ID NO: 97050 - DNA, 20 bp, Artificial sequence
  SiRNA target sequence
aaaatcacaatattttttaa

SEQ ID NO: 97051 - DNA, 20 bp, Artificial sequence
  SiRNA target sequence
aaatcacaatattttttaat

SEQ ID NO: 97052 - DNA, 20 bp, Artificial sequence
  SiRNA target sequence
aatcacaatattttttaata

SEQ ID NO: 97053 - DNA, 20 bp, Artificial sequence
  SiRNA target sequence
atcacaatattttttaatat

SEQ ID NO: 97054 - DNA, 20 bp, Artificial sequence
  SiRNA target sequence
tcacaatattttttaatata

SEQ ID NO: 97055 - DNA, 20 bp, Artificial sequence
  SiRNA target sequence
cacaatattttttaatatat

SEQ ID NO: 97056 - DNA, 20 bp, Artificial sequence
  SiRNA target sequence
acaatattttttaatatatt

SEQ ID NO: 97057 - DNA, 20 bp, Artificial sequence
  SiRNA target sequence
caatattttttaatatattt

SEQ ID NO: 97058 - DNA, 20 bp, Artificial sequence
  SiRNA target sequence
aatattttttaatatattta

SEQ ID NO: 97059 - DNA, 20 bp, Artificial sequence
  SiRNA target sequence
atattttttaatatatttaa

SEQ ID NO: 97060 - DNA, 20 bp, Artificial sequence
  SiRNA target sequence
tattttttaatatatttaac

SEQ ID NO: 97061 - DNA, 20 bp, Artificial sequence
  SiRNA target sequence
attttttaatatatttaacc

SEQ ID NO: 97062 - DNA, 20 bp, Artificial sequence
  SiRNA target sequence
ttttttaatatatttaacca

SEQ ID NO: 97063 - DNA, 20 bp, Artificial sequence
  SiRNA target sequence
tttttaatatatttaaccaa

SEQ ID NO: 97064 - DNA, 20 bp, Artificial sequence
  SiRNA target sequence
ttttaatatatttaaccaag

SEQ ID NO: 97065 - DNA, 20 bp, Artificial sequence
  SiRNA target sequence
tttaatatatttaaccaagg

SEQ ID NO: 97066 - DNA, 20 bp, Artificial sequence
  SiRNA target sequence
ttaatatatttaaccaaggt

SEQ ID NO: 97067 - DNA, 20 bp, Artificial sequence
  SiRNA target sequence
taatatatttaaccaaggta

SEQ ID NO: 97068 - DNA, 20 bp, Artificial sequence
  SiRNA target sequence
aatatatttaaccaaggtat

SEQ ID NO: 97069 - DNA, 20 bp, Artificial sequence
  SiRNA target sequence
atatatttaaccaaggtatt

SEQ ID NO: 97070 - DNA, 20 bp, Artificial sequence
  SiRNA target sequence
tatatttaaccaaggtattg

SEQ ID NO: 97071 - DNA, 20 bp, Artificial sequence
  SiRNA target sequence
atatttaaccaaggtattgt

SEQ ID NO: 97072 - DNA, 20 bp, Artificial sequence
  SiRNA target sequence
tatttaaccaaggtattgtc

SEQ ID NO: 97073 - DNA, 20 bp, Artificial sequence
  SiRNA target sequence
atttaaccaaggtattgtcc

SEQ ID NO: 97074 - DNA, 20 bp, Artificial sequence
  SiRNA target sequence
tttaaccaaggtattgtcct

SEQ ID NO: 97075 - DNA, 20 bp, Artificial sequence
  SiRNA target sequence
ttaaccaaggtattgtcctt

SEQ ID NO: 97076 - DNA, 20 bp, Artificial sequence
  SiRNA target sequence
taaccaaggtattgtccttt

SEQ ID NO: 97077 - DNA, 20 bp, Artificial sequence
  SiRNA target sequence
aaccaaggtattgtccttta

SEQ ID NO: 97078 - DNA, 20 bp, Artificial sequence
  SiRNA target sequence
accaaggtattgtcctttat

SEQ ID NO: 97079 - DNA, 20 bp, Artificial sequence
  SiRNA target sequence
ccaaggtattgtcctttatg

SEQ ID NO: 97080 - DNA, 20 bp, Artificial sequence
  SiRNA target sequence
caaggtattgtcctttatgt

SEQ ID NO: 97081 - DNA, 20 bp, Artificial sequence
  SiRNA target sequence
aaggtattgtcctttatgtt

SEQ ID NO: 97082 - DNA, 20 bp, Artificial sequence
  SiRNA target sequence
aggtattgtcctttatgtta

SEQ ID NO: 97083 - DNA, 20 bp, Artificial sequence
  SiRNA target sequence
ggtattgtcctttatgttat

SEQ ID NO: 97084 - DNA, 20 bp, Artificial sequence
  SiRNA target sequence
gtattgtcctttatgttatt

SEQ ID NO: 97085 - DNA, 20 bp, Artificial sequence
  SiRNA target sequence
tattgtcctttatgttatta

SEQ ID NO: 97086 - DNA, 20 bp, Artificial sequence
  SiRNA target sequence
attgtcctttatgttattat

SEQ ID NO: 97087 - DNA, 20 bp, Artificial sequence
  SiRNA target sequence
ttgtcctttatgttattata

SEQ ID NO: 97088 - DNA, 20 bp, Artificial sequence
  SiRNA target sequence
tgtcctttatgttattatat

SEQ ID NO: 97089 - DNA, 20 bp, Artificial sequence
  SiRNA target sequence
gtcctttatgttattatatc

SEQ ID NO: 97090 - DNA, 20 bp, Artificial sequence
  SiRNA target sequence
tcctttatgttattatatct

SEQ ID NO: 97091 - DNA, 20 bp, Artificial sequence
  SiRNA target sequence
cctttatgttattatatctt

SEQ ID NO: 97092 - DNA, 20 bp, Artificial sequence
  SiRNA target sequence
ctttatgttattatatctta

SEQ ID NO: 97093 - DNA, 20 bp, Artificial sequence
  SiRNA target sequence
tttatgttattatatcttac

SEQ ID NO: 97094 - DNA, 20 bp, Artificial sequence
  SiRNA target sequence
ttatgttattatatcttaca

SEQ ID NO: 97095 - DNA, 20 bp, Artificial sequence
  SiRNA target sequence
tatgttattatatcttacaa

SEQ ID NO: 97096 - DNA, 20 bp, Artificial sequence
  SiRNA target sequence
atgttattatatcttacaaa

SEQ ID NO: 97097 - DNA, 20 bp, Artificial sequence
  SiRNA target sequence
tgttattatatcttacaaac

SEQ ID NO: 97098 - DNA, 20 bp, Artificial sequence
  SiRNA target sequence
gttattatatcttacaaact

SEQ ID NO: 97099 - DNA, 20 bp, Artificial sequence
  SiRNA target sequence
ttattatatcttacaaactc

SEQ ID NO: 97100 - DNA, 20 bp, Artificial sequence
  SiRNA target sequence
tattatatcttacaaactcc

SEQ ID NO: 97101 - DNA, 20 bp, Artificial sequence
  SiRNA target sequence
attatatcttacaaactcct

SEQ ID NO: 97102 - DNA, 20 bp, Artificial sequence
  SiRNA target sequence
ttatatcttacaaactcctc

SEQ ID NO: 97103 - DNA, 20 bp, Artificial sequence
  SiRNA target sequence
tatatcttacaaactcctcg

SEQ ID NO: 97104 - DNA, 20 bp, Artificial sequence
  SiRNA target sequence
atatcttacaaactcctcgt

SEQ ID NO: 97105 - DNA, 20 bp, Artificial sequence
  SiRNA target sequence
tatcttacaaactcctcgta

SEQ ID NO: 97106 - DNA, 20 bp, Artificial sequence
  SiRNA target sequence
atcttacaaactcctcgtaa

SEQ ID NO: 97107 - DNA, 20 bp, Artificial sequence
  SiRNA target sequence
tcttacaaactcctcgtaat

SEQ ID NO: 97108 - DNA, 20 bp, Artificial sequence
  SiRNA target sequence
cttacaaactcctcgtaatt

SEQ ID NO: 97109 - DNA, 20 bp, Artificial sequence
  SiRNA target sequence
ttacaaactcctcgtaatta

SEQ ID NO: 97110 - DNA, 20 bp, Artificial sequence
  SiRNA target sequence
tacaaactcctcgtaattat

SEQ ID NO: 97111 - DNA, 20 bp, Artificial sequence
  SiRNA target sequence
acaaactcctcgtaattata

SEQ ID NO: 97112 - DNA, 20 bp, Artificial sequence
  SiRNA target sequence
caaactcctcgtaattataa

SEQ ID NO: 97113 - DNA, 20 bp, Artificial sequence
  SiRNA target sequence
aaactcctcgtaattataat

SEQ ID NO: 97114 - DNA, 20 bp, Artificial sequence
  SiRNA target sequence
aactcctcgtaattataatt

SEQ ID NO: 97115 - DNA, 20 bp, Artificial sequence
  SiRNA target sequence
actcctcgtaattataattt

SEQ ID NO: 97116 - DNA, 20 bp, Artificial sequence
  SiRNA target sequence
ctcctcgtaattataatttt

SEQ ID NO: 97117 - DNA, 20 bp, Artificial sequence
  SiRNA target sequence
tcctcgtaattataattttc

SEQ ID NO: 97118 - DNA, 20 bp, Artificial sequence
  SiRNA target sequence
cctcgtaattataattttca

SEQ ID NO: 97119 - DNA, 20 bp, Artificial sequence
  SiRNA target sequence
ctcgtaattataattttcag

SEQ ID NO: 97120 - DNA, 20 bp, Artificial sequence
  SiRNA target sequence
tcgtaattataattttcagg

SEQ ID NO: 97121 - DNA, 20 bp, Artificial sequence
  SiRNA target sequence
cgtaattataattttcagga

SEQ ID NO: 97122 - DNA, 20 bp, Artificial sequence
  SiRNA target sequence
gtaattataattttcaggat

SEQ ID NO: 97123 - DNA, 20 bp, Artificial sequence
  SiRNA target sequence
taattataattttcaggata

SEQ ID NO: 97124 - DNA, 20 bp, Artificial sequence
  SiRNA target sequence
aattataattttcaggataa

SEQ ID NO: 97125 - DNA, 20 bp, Artificial sequence
  SiRNA target sequence
attataattttcaggataaa

SEQ ID NO: 97126 - DNA, 20 bp, Artificial sequence
  SiRNA target sequence
ttataattttcaggataaac

SEQ ID NO: 97127 - DNA, 20 bp, Artificial sequence
  SiRNA target sequence
tataattttcaggataaacc

SEQ ID NO: 97128 - DNA, 20 bp, Artificial sequence
  SiRNA target sequence
ataattttcaggataaaccg

SEQ ID NO: 97129 - DNA, 20 bp, Artificial sequence
  SiRNA target sequence
taattttcaggataaaccgc

SEQ ID NO: 97130 - DNA, 20 bp, Artificial sequence
  SiRNA target sequence
aattttcaggataaaccgct

SEQ ID NO: 97131 - DNA, 20 bp, Artificial sequence
  SiRNA target sequence
attttcaggataaaccgcta

SEQ ID NO: 97132 - DNA, 20 bp, Artificial sequence
  SiRNA target sequence
ttttcaggataaaccgctag

SEQ ID NO: 97133 - DNA, 20 bp, Artificial sequence
  SiRNA target sequence
tttcaggataaaccgctaga

SEQ ID NO: 97134 - DNA, 20 bp, Artificial sequence
  SiRNA target sequence
ttcaggataaaccgctagac

SEQ ID NO: 97135 - DNA, 20 bp, Artificial sequence
  SiRNA target sequence
tcaggataaaccgctagaca

SEQ ID NO: 97136 - DNA, 20 bp, Artificial sequence
  SiRNA target sequence
caggataaaccgctagacaa

SEQ ID NO: 97137 - DNA, 20 bp, Artificial sequence
  SiRNA target sequence
aggataaaccgctagacaat

SEQ ID NO: 97138 - DNA, 20 bp, Artificial sequence
  SiRNA target sequence
ggataaaccgctagacaatc

SEQ ID NO: 97139 - DNA, 20 bp, Artificial sequence
  SiRNA target sequence
gataaaccgctagacaatca

SEQ ID NO: 97140 - DNA, 20 bp, Artificial sequence
  SiRNA target sequence
ataaaccgctagacaatcac

SEQ ID NO: 97141 - DNA, 20 bp, Artificial sequence
  SiRNA target sequence
taaaccgctagacaatcacc

SEQ ID NO: 97142 - DNA, 20 bp, Artificial sequence
  SiRNA target sequence
aaaccgctagacaatcaccg

SEQ ID NO: 97143 - DNA, 20 bp, Artificial sequence
  SiRNA target sequence
aaccgctagacaatcaccga

SEQ ID NO: 97144 - DNA, 20 bp, Artificial sequence
  SiRNA target sequence
accgctagacaatcaccgat

SEQ ID NO: 97145 - DNA, 20 bp, Artificial sequence
  SiRNA target sequence
ccgctagacaatcaccgatt

SEQ ID NO: 97146 - DNA, 20 bp, Artificial sequence
  SiRNA target sequence
cgctagacaatcaccgattt

SEQ ID NO: 97147 - DNA, 20 bp, Artificial sequence
  SiRNA target sequence
gctagacaatcaccgatttc

SEQ ID NO: 97148 - DNA, 20 bp, Artificial sequence
  SiRNA target sequence
ctagacaatcaccgatttca

SEQ ID NO: 97149 - DNA, 20 bp, Artificial sequence
  SiRNA target sequence
tagacaatcaccgatttcaa

SEQ ID NO: 97150 - DNA, 20 bp, Artificial sequence
  SiRNA target sequence
agacaatcaccgatttcaaa

SEQ ID NO: 97151 - DNA, 20 bp, Artificial sequence
  SiRNA target sequence
gacaatcaccgatttcaaaa

SEQ ID NO: 97152 - DNA, 20 bp, Artificial sequence
  SiRNA target sequence
acaatcaccgatttcaaaat

SEQ ID NO: 97153 - DNA, 20 bp, Artificial sequence
  SiRNA target sequence
caatcaccgatttcaaaatt

SEQ ID NO: 97154 - DNA, 20 bp, Artificial sequence
  SiRNA target sequence
aatcaccgatttcaaaattt

SEQ ID NO: 97155 - DNA, 20 bp, Artificial sequence
  SiRNA target sequence
atcaccgatttcaaaatttt

SEQ ID NO: 97156 - DNA, 20 bp, Artificial sequence
  SiRNA target sequence
tcaccgatttcaaaattttc

SEQ ID NO: 97157 - DNA, 20 bp, Artificial sequence
  SiRNA target sequence
caccgatttcaaaattttct

SEQ ID NO: 97158 - DNA, 20 bp, Artificial sequence
  SiRNA target sequence
accgatttcaaaattttcta

SEQ ID NO: 97159 - DNA, 20 bp, Artificial sequence
  SiRNA target sequence
ccgatttcaaaattttctat

SEQ ID NO: 97160 - DNA, 20 bp, Artificial sequence
  SiRNA target sequence
cgatttcaaaattttctata

SEQ ID NO: 97161 - DNA, 20 bp, Artificial sequence
  SiRNA target sequence
gatttcaaaattttctatat

SEQ ID NO: 97162 - DNA, 20 bp, Artificial sequence
  SiRNA target sequence
atttcaaaattttctatatc

SEQ ID NO: 97163 - DNA, 20 bp, Artificial sequence
  SiRNA target sequence
tttcaaaattttctatatct

SEQ ID NO: 97164 - DNA, 20 bp, Artificial sequence
  SiRNA target sequence
ttcaaaattttctatatcta

SEQ ID NO: 97165 - DNA, 20 bp, Artificial sequence
  SiRNA target sequence
tcaaaattttctatatctat

SEQ ID NO: 97166 - DNA, 20 bp, Artificial sequence
  SiRNA target sequence
caaaattttctatatctata

SEQ ID NO: 97167 - DNA, 20 bp, Artificial sequence
  SiRNA target sequence
aaaattttctatatctatat

SEQ ID NO: 97168 - DNA, 20 bp, Artificial sequence
  SiRNA target sequence
aaattttctatatctatatc

SEQ ID NO: 97169 - DNA, 20 bp, Artificial sequence
  SiRNA target sequence
aattttctatatctatatca

SEQ ID NO: 97170 - DNA, 20 bp, Artificial sequence
  SiRNA target sequence
attttctatatctatatcaa

SEQ ID NO: 97171 - DNA, 20 bp, Artificial sequence
  SiRNA target sequence
ttttctatatctatatcaaa

SEQ ID NO: 97172 - DNA, 20 bp, Artificial sequence
  SiRNA target sequence
tttctatatctatatcaaat

SEQ ID NO: 97173 - DNA, 20 bp, Artificial sequence
  SiRNA target sequence
ttctatatctatatcaaatt

SEQ ID NO: 97174 - DNA, 20 bp, Artificial sequence
  SiRNA target sequence
tctatatctatatcaaattt

SEQ ID NO: 97175 - DNA, 20 bp, Artificial sequence
  SiRNA target sequence
ctatatctatatcaaatttt

SEQ ID NO: 97176 - DNA, 20 bp, Artificial sequence
  SiRNA target sequence
tatatctatatcaaatttta

SEQ ID NO: 97177 - DNA, 20 bp, Artificial sequence
  SiRNA target sequence
atatctatatcaaattttat

SEQ ID NO: 97178 - DNA, 20 bp, Artificial sequence
  SiRNA target sequence
tatctatatcaaattttatt

SEQ ID NO: 97179 - DNA, 20 bp, Artificial sequence
  SiRNA target sequence
atctatatcaaattttattt

SEQ ID NO: 97180 - DNA, 20 bp, Artificial sequence
  SiRNA target sequence
tctatatcaaattttatttc

SEQ ID NO: 97181 - DNA, 20 bp, Artificial sequence
  SiRNA target sequence
ctatatcaaattttatttct

SEQ ID NO: 97182 - DNA, 20 bp, Artificial sequence
  SiRNA target sequence
tatatcaaattttatttcta

SEQ ID NO: 97183 - DNA, 20 bp, Artificial sequence
  SiRNA target sequence
atatcaaattttatttctaa

SEQ ID NO: 97184 - DNA, 20 bp, Artificial sequence
  SiRNA target sequence
tatcaaattttatttctaaa

SEQ ID NO: 97185 - DNA, 20 bp, Artificial sequence
  SiRNA target sequence
atcaaattttatttctaaaa

SEQ ID NO: 97186 - DNA, 20 bp, Artificial sequence
  SiRNA target sequence
tcaaattttatttctaaaat

SEQ ID NO: 97187 - DNA, 20 bp, Artificial sequence
  SiRNA target sequence
caaattttatttctaaaata

SEQ ID NO: 97188 - DNA, 20 bp, Artificial sequence
  SiRNA target sequence
aaattttatttctaaaatag

SEQ ID NO: 97189 - DNA, 20 bp, Artificial sequence
  SiRNA target sequence
aattttatttctaaaatagg

SEQ ID NO: 97190 - DNA, 20 bp, Artificial sequence
  SiRNA target sequence
attttatttctaaaatagga

SEQ ID NO: 97191 - DNA, 20 bp, Artificial sequence
  SiRNA target sequence
ttttatttctaaaataggat

SEQ ID NO: 97192 - DNA, 20 bp, Artificial sequence
  SiRNA target sequence
tttatttctaaaataggata

SEQ ID NO: 97193 - DNA, 20 bp, Artificial sequence
  SiRNA target sequence
ttatttctaaaataggataa

SEQ ID NO: 97194 - DNA, 20 bp, Artificial sequence
  SiRNA target sequence
tatttctaaaataggataaa

SEQ ID NO: 97195 - DNA, 20 bp, Artificial sequence
  SiRNA target sequence
atttctaaaataggataaat

SEQ ID NO: 97196 - DNA, 20 bp, Artificial sequence
  SiRNA target sequence
tttctaaaataggataaatg

SEQ ID NO: 97197 - DNA, 20 bp, Artificial sequence
  SiRNA target sequence
ttctaaaataggataaatgt

SEQ ID NO: 97198 - DNA, 20 bp, Artificial sequence
  SiRNA target sequence
tctaaaataggataaatgta

SEQ ID NO: 97199 - DNA, 20 bp, Artificial sequence
  SiRNA target sequence
ctaaaataggataaatgtaa

SEQ ID NO: 97200 - DNA, 20 bp, Artificial sequence
  SiRNA target sequence
taaaataggataaatgtaat

SEQ ID NO: 97201 - DNA, 20 bp, Artificial sequence
  SiRNA target sequence
aaaataggataaatgtaatt

SEQ ID NO: 97202 - DNA, 20 bp, Artificial sequence
  SiRNA target sequence
aaataggataaatgtaattg

SEQ ID NO: 97203 - DNA, 20 bp, Artificial sequence
  SiRNA target sequence
aataggataaatgtaattgt

SEQ ID NO: 97204 - DNA, 20 bp, Artificial sequence
  SiRNA target sequence
ataggataaatgtaattgta

SEQ ID NO: 97205 - DNA, 20 bp, Artificial sequence
  SiRNA target sequence
taggataaatgtaattgtaa

SEQ ID NO: 97206 - DNA, 20 bp, Artificial sequence
  SiRNA target sequence
aggataaatgtaattgtaag

SEQ ID NO: 97207 - DNA, 20 bp, Artificial sequence
  SiRNA target sequence
ggataaatgtaattgtaagg

SEQ ID NO: 97208 - DNA, 20 bp, Artificial sequence
  SiRNA target sequence
gataaatgtaattgtaaggt

SEQ ID NO: 97209 - DNA, 20 bp, Artificial sequence
  SiRNA target sequence
ataaatgtaattgtaaggtg

SEQ ID NO: 97210 - DNA, 20 bp, Artificial sequence
  SiRNA target sequence
taaatgtaattgtaaggtgt

SEQ ID NO: 97211 - DNA, 20 bp, Artificial sequence
  SiRNA target sequence
aaatgtaattgtaaggtgtt

SEQ ID NO: 97212 - DNA, 20 bp, Artificial sequence
  SiRNA target sequence
aatgtaattgtaaggtgtta

SEQ ID NO: 97213 - DNA, 20 bp, Artificial sequence
  SiRNA target sequence
atgtaattgtaaggtgttaa

SEQ ID NO: 97214 - DNA, 20 bp, Artificial sequence
  SiRNA target sequence
tgtaattgtaaggtgttaat

SEQ ID NO: 97215 - DNA, 20 bp, Artificial sequence
  SiRNA target sequence
gtaattgtaaggtgttaata

SEQ ID NO: 97216 - DNA, 20 bp, Artificial sequence
  SiRNA target sequence
taattgtaaggtgttaatat

SEQ ID NO: 97217 - DNA, 20 bp, Artificial sequence
  SiRNA target sequence
aattgtaaggtgttaatatc

SEQ ID NO: 97218 - DNA, 20 bp, Artificial sequence
  SiRNA target sequence
attgtaaggtgttaatatct

SEQ ID NO: 97219 - DNA, 20 bp, Artificial sequence
  SiRNA target sequence
ttgtaaggtgttaatatctt

SEQ ID NO: 97220 - DNA, 20 bp, Artificial sequence
  SiRNA target sequence
tgtaaggtgttaatatctta

SEQ ID NO: 97221 - DNA, 20 bp, Artificial sequence
  SiRNA target sequence
gtaaggtgttaatatcttaa

SEQ ID NO: 97222 - DNA, 20 bp, Artificial sequence
  SiRNA target sequence
taaggtgttaatatcttaat

SEQ ID NO: 97223 - DNA, 20 bp, Artificial sequence
  SiRNA target sequence
aaggtgttaatatcttaata

SEQ ID NO: 97224 - DNA, 20 bp, Artificial sequence
  SiRNA target sequence
aggtgttaatatcttaatat

SEQ ID NO: 97225 - DNA, 20 bp, Artificial sequence
  SiRNA target sequence
ggtgttaatatcttaatatc

SEQ ID NO: 97226 - DNA, 20 bp, Artificial sequence
  SiRNA target sequence
gtgttaatatcttaatatca

SEQ ID NO: 97227 - DNA, 20 bp, Artificial sequence
  SiRNA target sequence
tgttaatatcttaatatcat

SEQ ID NO: 97228 - DNA, 20 bp, Artificial sequence
  SiRNA target sequence
gttaatatcttaatatcatt

SEQ ID NO: 97229 - DNA, 20 bp, Artificial sequence
  SiRNA target sequence
ttaatatcttaatatcattt

SEQ ID NO: 97230 - DNA, 20 bp, Artificial sequence
  SiRNA target sequence
taatatcttaatatcattta

SEQ ID NO: 97231 - DNA, 20 bp, Artificial sequence
  SiRNA target sequence
aatatcttaatatcatttat

SEQ ID NO: 97232 - DNA, 20 bp, Artificial sequence
  SiRNA target sequence
atatcttaatatcatttatt

SEQ ID NO: 97233 - DNA, 20 bp, Artificial sequence
  SiRNA target sequence
tatcttaatatcatttattg

SEQ ID NO: 97234 - DNA, 20 bp, Artificial sequence
  SiRNA target sequence
atcttaatatcatttattga

SEQ ID NO: 97235 - DNA, 20 bp, Artificial sequence
  SiRNA target sequence
tcttaatatcatttattgac

SEQ ID NO: 97236 - DNA, 20 bp, Artificial sequence
  SiRNA target sequence
cttaatatcatttattgacg

SEQ ID NO: 97237 - DNA, 20 bp, Artificial sequence
  SiRNA target sequence
ttaatatcatttattgacgc

SEQ ID NO: 97238 - DNA, 20 bp, Artificial sequence
  SiRNA target sequence
taatatcatttattgacgca

SEQ ID NO: 97239 - DNA, 20 bp, Artificial sequence
  SiRNA target sequence
aatatcatttattgacgcac

SEQ ID NO: 97240 - DNA, 20 bp, Artificial sequence
  SiRNA target sequence
atatcatttattgacgcact

SEQ ID NO: 97241 - DNA, 20 bp, Artificial sequence
  SiRNA target sequence
tatcatttattgacgcactg

SEQ ID NO: 97242 - DNA, 20 bp, Artificial sequence
  SiRNA target sequence
atcatttattgacgcactgt

SEQ ID NO: 97243 - DNA, 20 bp, Artificial sequence
  SiRNA target sequence
tcatttattgacgcactgta

SEQ ID NO: 97244 - DNA, 20 bp, Artificial sequence
  SiRNA target sequence
catttattgacgcactgtat

SEQ ID NO: 97245 - DNA, 20 bp, Artificial sequence
  SiRNA target sequence
atttattgacgcactgtata

SEQ ID NO: 97246 - DNA, 20 bp, Artificial sequence
  SiRNA target sequence
tttattgacgcactgtataa

SEQ ID NO: 97247 - DNA, 20 bp, Artificial sequence
  SiRNA target sequence
ttattgacgcactgtataaa

SEQ ID NO: 97248 - DNA, 20 bp, Artificial sequence
  SiRNA target sequence
tattgacgcactgtataaat

SEQ ID NO: 97249 - DNA, 20 bp, Artificial sequence
  SiRNA target sequence
attgacgcactgtataaatc

SEQ ID NO: 97250 - DNA, 20 bp, Artificial sequence
  SiRNA target sequence
ttgacgcactgtataaatca

SEQ ID NO: 97251 - DNA, 20 bp, Artificial sequence
  SiRNA target sequence
tgacgcactgtataaatcat

SEQ ID NO: 97252 - DNA, 20 bp, Artificial sequence
  SiRNA target sequence
gacgcactgtataaatcatt

SEQ ID NO: 97253 - DNA, 20 bp, Artificial sequence
  SiRNA target sequence
acgcactgtataaatcattt

SEQ ID NO: 97254 - DNA, 20 bp, Artificial sequence
  SiRNA target sequence
cgcactgtataaatcatttt

SEQ ID NO: 97255 - DNA, 20 bp, Artificial sequence
  SiRNA target sequence
gcactgtataaatcattttt

SEQ ID NO: 97256 - DNA, 20 bp, Artificial sequence
  SiRNA target sequence
cactgtataaatcattttta

SEQ ID NO: 97257 - DNA, 20 bp, Artificial sequence
  SiRNA target sequence
actgtataaatcatttttac

SEQ ID NO: 97258 - DNA, 20 bp, Artificial sequence
  SiRNA target sequence
ctgtataaatcatttttaca

SEQ ID NO: 97259 - DNA, 20 bp, Artificial sequence
  SiRNA target sequence
tgtataaatcatttttacaa

SEQ ID NO: 97260 - DNA, 20 bp, Artificial sequence
  SiRNA target sequence
gtataaatcatttttacaac

SEQ ID NO: 97261 - DNA, 20 bp, Artificial sequence
  SiRNA target sequence
tataaatcatttttacaact

SEQ ID NO: 97262 - DNA, 20 bp, Artificial sequence
  SiRNA target sequence
ataaatcatttttacaactt

SEQ ID NO: 97263 - DNA, 20 bp, Artificial sequence
  SiRNA target sequence
taaatcatttttacaacttg

SEQ ID NO: 97264 - DNA, 20 bp, Artificial sequence
  SiRNA target sequence
aaatcatttttacaacttgc

SEQ ID NO: 97265 - DNA, 20 bp, Artificial sequence
  SiRNA target sequence
aatcatttttacaacttgca

SEQ ID NO: 97266 - DNA, 20 bp, Artificial sequence
  SiRNA target sequence
atcatttttacaacttgcaa

SEQ ID NO: 97267 - DNA, 20 bp, Artificial sequence
  SiRNA target sequence
tcatttttacaacttgcaaa

SEQ ID NO: 97268 - DNA, 20 bp, Artificial sequence
  SiRNA target sequence
catttttacaacttgcaaaa

SEQ ID NO: 97269 - DNA, 20 bp, Artificial sequence
  SiRNA target sequence
atttttacaacttgcaaaat

SEQ ID NO: 97270 - DNA, 20 bp, Artificial sequence
  SiRNA target sequence
tttttacaacttgcaaaatt

SEQ ID NO: 97271 - DNA, 20 bp, Artificial sequence
  SiRNA target sequence
ttttacaacttgcaaaattt

SEQ ID NO: 97272 - DNA, 20 bp, Artificial sequence
  SiRNA target sequence
tttacaacttgcaaaatttt

SEQ ID NO: 97273 - DNA, 20 bp, Artificial sequence
  SiRNA target sequence
ttacaacttgcaaaattttt

SEQ ID NO: 97274 - DNA, 20 bp, Artificial sequence
  SiRNA target sequence
tacaacttgcaaaattttta

SEQ ID NO: 97275 - DNA, 20 bp, Artificial sequence
  SiRNA target sequence
acaacttgcaaaatttttag

SEQ ID NO: 97276 - DNA, 20 bp, Artificial sequence
  SiRNA target sequence
caacttgcaaaatttttagc

SEQ ID NO: 97277 - DNA, 20 bp, Artificial sequence
  SiRNA target sequence
aacttgcaaaatttttagca

SEQ ID NO: 97278 - DNA, 20 bp, Artificial sequence
  SiRNA target sequence
acttgcaaaatttttagcat

SEQ ID NO: 97279 - DNA, 20 bp, Artificial sequence
  SiRNA target sequence
cttgcaaaatttttagcatt

SEQ ID NO: 97280 - DNA, 20 bp, Artificial sequence
  SiRNA target sequence
ttgcaaaatttttagcattt

SEQ ID NO: 97281 - DNA, 20 bp, Artificial sequence
  SiRNA target sequence
tgcaaaatttttagcatttt

SEQ ID NO: 97282 - DNA, 20 bp, Artificial sequence
  SiRNA target sequence
gcaaaatttttagcattttg

SEQ ID NO: 97283 - DNA, 20 bp, Artificial sequence
  SiRNA target sequence
caaaatttttagcattttgt

SEQ ID NO: 97284 - DNA, 20 bp, Artificial sequence
  SiRNA target sequence
aaaatttttagcattttgta

SEQ ID NO: 97285 - DNA, 20 bp, Artificial sequence
  SiRNA target sequence
aaatttttagcattttgtag

SEQ ID NO: 97286 - DNA, 20 bp, Artificial sequence
  SiRNA target sequence
aatttttagcattttgtagt

SEQ ID NO: 97287 - DNA, 20 bp, Artificial sequence
  SiRNA target sequence
atttttagcattttgtagtt

SEQ ID NO: 97288 - DNA, 20 bp, Artificial sequence
  SiRNA target sequence
tttttagcattttgtagttt

SEQ ID NO: 97289 - DNA, 20 bp, Artificial sequence
  SiRNA target sequence
ttttagcattttgtagtttg

SEQ ID NO: 97290 - DNA, 20 bp, Artificial sequence
  SiRNA target sequence
tttagcattttgtagtttgt

SEQ ID NO: 97291 - DNA, 20 bp, Artificial sequence
  SiRNA target sequence
ttagcattttgtagtttgta

SEQ ID NO: 97292 - DNA, 20 bp, Artificial sequence
  SiRNA target sequence
tagcattttgtagtttgtaa

SEQ ID NO: 97293 - DNA, 20 bp, Artificial sequence
  SiRNA target sequence
agcattttgtagtttgtaat

SEQ ID NO: 97294 - DNA, 20 bp, Artificial sequence
  SiRNA target sequence
gcattttgtagtttgtaatg

SEQ ID NO: 97295 - DNA, 20 bp, Artificial sequence
  SiRNA target sequence
cattttgtagtttgtaatgc

SEQ ID NO: 97296 - DNA, 20 bp, Artificial sequence
  SiRNA target sequence
attttgtagtttgtaatgcg

SEQ ID NO: 97297 - DNA, 20 bp, Artificial sequence
  SiRNA target sequence
ttttgtagtttgtaatgcgg

SEQ ID NO: 97298 - DNA, 20 bp, Artificial sequence
  SiRNA target sequence
tttgtagtttgtaatgcggt

SEQ ID NO: 97299 - DNA, 20 bp, Artificial sequence
  SiRNA target sequence
ttgtagtttgtaatgcggta

SEQ ID NO: 97300 - DNA, 20 bp, Artificial sequence
  SiRNA target sequence
tgtagtttgtaatgcggtaa

SEQ ID NO: 97301 - DNA, 20 bp, Artificial sequence
  SiRNA target sequence
gtagtttgtaatgcggtaat

SEQ ID NO: 97302 - DNA, 20 bp, Artificial sequence
  SiRNA target sequence
tagtttgtaatgcggtaata

SEQ ID NO: 97303 - DNA, 20 bp, Artificial sequence
  SiRNA target sequence
agtttgtaatgcggtaatat

SEQ ID NO: 97304 - DNA, 20 bp, Artificial sequence
  SiRNA target sequence
gtttgtaatgcggtaatata

SEQ ID NO: 97305 - DNA, 20 bp, Artificial sequence
  SiRNA target sequence
tttgtaatgcggtaatatat

SEQ ID NO: 97306 - DNA, 20 bp, Artificial sequence
  SiRNA target sequence
ttgtaatgcggtaatatata

SEQ ID NO: 97307 - DNA, 20 bp, Artificial sequence
  SiRNA target sequence
tgtaatgcggtaatatataa

SEQ ID NO: 97308 - DNA, 20 bp, Artificial sequence
  SiRNA target sequence
gtaatgcggtaatatataat

SEQ ID NO: 97309 - DNA, 20 bp, Artificial sequence
  SiRNA target sequence
taatgcggtaatatataata

SEQ ID NO: 97310 - DNA, 20 bp, Artificial sequence
  SiRNA target sequence
aatgcggtaatatataatat

SEQ ID NO: 97311 - DNA, 20 bp, Artificial sequence
  SiRNA target sequence
atgcggtaatatataatata

SEQ ID NO: 97312 - DNA, 20 bp, Artificial sequence
  SiRNA target sequence
tgcggtaatatataatatag

SEQ ID NO: 97313 - DNA, 20 bp, Artificial sequence
  SiRNA target sequence
gcggtaatatataatataga

SEQ ID NO: 97314 - DNA, 20 bp, Artificial sequence
  SiRNA target sequence
cggtaatatataatatagat

SEQ ID NO: 97315 - DNA, 20 bp, Artificial sequence
  SiRNA target sequence
ggtaatatataatatagatc

SEQ ID NO: 97316 - DNA, 20 bp, Artificial sequence
  SiRNA target sequence
gtaatatataatatagatct

SEQ ID NO: 97317 - DNA, 20 bp, Artificial sequence
  SiRNA target sequence
taatatataatatagatctt

SEQ ID NO: 97318 - DNA, 20 bp, Artificial sequence
  SiRNA target sequence
aatatataatatagatcttt

SEQ ID NO: 97319 - DNA, 20 bp, Artificial sequence
  SiRNA target sequence
atatataatatagatctttt

SEQ ID NO: 97320 - DNA, 20 bp, Artificial sequence
  SiRNA target sequence
tatataatatagatctttta

SEQ ID NO: 97321 - DNA, 20 bp, Artificial sequence
  SiRNA target sequence
atataatatagatcttttat

SEQ ID NO: 97322 - DNA, 20 bp, Artificial sequence
  SiRNA target sequence
tataatatagatcttttatc

SEQ ID NO: 97323 - DNA, 20 bp, Artificial sequence
  SiRNA target sequence
ataatatagatcttttatcc

SEQ ID NO: 97324 - DNA, 20 bp, Artificial sequence
  SiRNA target sequence
taatatagatcttttatcca

SEQ ID NO: 97325 - DNA, 20 bp, Artificial sequence
  SiRNA target sequence
aatatagatcttttatccat

SEQ ID NO: 97326 - DNA, 20 bp, Artificial sequence
  SiRNA target sequence
atatagatcttttatccatg

SEQ ID NO: 97327 - DNA, 20 bp, Artificial sequence
  SiRNA target sequence
tatagatcttttatccatgt

SEQ ID NO: 97328 - DNA, 20 bp, Artificial sequence
  SiRNA target sequence
atagatcttttatccatgtc

SEQ ID NO: 97329 - DNA, 20 bp, Artificial sequence
  SiRNA target sequence
tagatcttttatccatgtct

SEQ ID NO: 97330 - DNA, 20 bp, Artificial sequence
  SiRNA target sequence
agatcttttatccatgtctt

SEQ ID NO: 97331 - DNA, 20 bp, Artificial sequence
  SiRNA target sequence
gatcttttatccatgtctta

SEQ ID NO: 97332 - DNA, 20 bp, Artificial sequence
  SiRNA target sequence
atcttttatccatgtcttaa

SEQ ID NO: 97333 - DNA, 20 bp, Artificial sequence
  SiRNA target sequence
tcttttatccatgtcttaaa

SEQ ID NO: 97334 - DNA, 20 bp, Artificial sequence
  SiRNA target sequence
cttttatccatgtcttaaat

SEQ ID NO: 97335 - DNA, 20 bp, Artificial sequence
  SiRNA target sequence
ttttatccatgtcttaaatt

SEQ ID NO: 97336 - DNA, 20 bp, Artificial sequence
  SiRNA target sequence
tttatccatgtcttaaattc

SEQ ID NO: 97337 - DNA, 20 bp, Artificial sequence
  SiRNA target sequence
ttatccatgtcttaaattcg

SEQ ID NO: 97338 - DNA, 20 bp, Artificial sequence
  SiRNA target sequence
tatccatgtcttaaattcgc

SEQ ID NO: 97339 - DNA, 20 bp, Artificial sequence
  SiRNA target sequence
atccatgtcttaaattcgcc

SEQ ID NO: 97340 - DNA, 20 bp, Artificial sequence
  SiRNA target sequence
tccatgtcttaaattcgccc

SEQ ID NO: 97341 - DNA, 20 bp, Artificial sequence
  SiRNA target sequence
ccatgtcttaaattcgccca

SEQ ID NO: 97342 - DNA, 20 bp, Artificial sequence
  SiRNA target sequence
catgtcttaaattcgcccat

SEQ ID NO: 97343 - DNA, 20 bp, Artificial sequence
  SiRNA target sequence
atgtcttaaattcgcccata

SEQ ID NO: 97344 - DNA, 20 bp, Artificial sequence
  SiRNA target sequence
tgtcttaaattcgcccataa

SEQ ID NO: 97345 - DNA, 20 bp, Artificial sequence
  SiRNA target sequence
gtcttaaattcgcccataaa

SEQ ID NO: 97346 - DNA, 20 bp, Artificial sequence
  SiRNA target sequence
tcttaaattcgcccataaat

SEQ ID NO: 97347 - DNA, 20 bp, Artificial sequence
  SiRNA target sequence
cttaaattcgcccataaatc

SEQ ID NO: 97348 - DNA, 20 bp, Artificial sequence
  SiRNA target sequence
ttaaattcgcccataaatcc

SEQ ID NO: 97349 - DNA, 20 bp, Artificial sequence
  SiRNA target sequence
taaattcgcccataaatcct

SEQ ID NO: 97350 - DNA, 20 bp, Artificial sequence
  SiRNA target sequence
aaattcgcccataaatcctt

SEQ ID NO: 97351 - DNA, 20 bp, Artificial sequence
  SiRNA target sequence
aattcgcccataaatccttc

SEQ ID NO: 97352 - DNA, 20 bp, Artificial sequence
  SiRNA target sequence
attcgcccataaatccttct

SEQ ID NO: 97353 - DNA, 20 bp, Artificial sequence
  SiRNA target sequence
ttcgcccataaatccttctt

SEQ ID NO: 97354 - DNA, 20 bp, Artificial sequence
  SiRNA target sequence
tcgcccataaatccttcttt

SEQ ID NO: 97355 - DNA, 20 bp, Artificial sequence
  SiRNA target sequence
cgcccataaatccttctttg

SEQ ID NO: 97356 - DNA, 20 bp, Artificial sequence
  SiRNA target sequence
gcccataaatccttctttgt

SEQ ID NO: 97357 - DNA, 20 bp, Artificial sequence
  SiRNA target sequence
cccataaatccttctttgtc

SEQ ID NO: 97358 - DNA, 20 bp, Artificial sequence
  SiRNA target sequence
ccataaatccttctttgtct

SEQ ID NO: 97359 - DNA, 20 bp, Artificial sequence
  SiRNA target sequence
cataaatccttctttgtctt

SEQ ID NO: 97360 - DNA, 20 bp, Artificial sequence
  SiRNA target sequence
ataaatccttctttgtcttg

SEQ ID NO: 97361 - DNA, 20 bp, Artificial sequence
  SiRNA target sequence
taaatccttctttgtcttgg

SEQ ID NO: 97362 - DNA, 20 bp, Artificial sequence
  SiRNA target sequence
aaatccttctttgtcttggc

SEQ ID NO: 97363 - DNA, 20 bp, Artificial sequence
  SiRNA target sequence
aatccttctttgtcttggct

SEQ ID NO: 97364 - DNA, 20 bp, Artificial sequence
  SiRNA target sequence
atccttctttgtcttggcta

SEQ ID NO: 97365 - DNA, 20 bp, Artificial sequence
  SiRNA target sequence
tccttctttgtcttggctat

SEQ ID NO: 97366 - DNA, 20 bp, Artificial sequence
  SiRNA target sequence
ccttctttgtcttggctatc

SEQ ID NO: 97367 - DNA, 20 bp, Artificial sequence
  SiRNA target sequence
cttctttgtcttggctatct

SEQ ID NO: 97368 - DNA, 20 bp, Artificial sequence
  SiRNA target sequence
ttctttgtcttggctatctc

SEQ ID NO: 97369 - DNA, 20 bp, Artificial sequence
  SiRNA target sequence
tctttgtcttggctatctcc

SEQ ID NO: 97370 - DNA, 20 bp, Artificial sequence
  SiRNA target sequence
ctttgtcttggctatctcca

SEQ ID NO: 97371 - DNA, 20 bp, Artificial sequence
  SiRNA target sequence
tttgtcttggctatctccat

SEQ ID NO: 97372 - DNA, 20 bp, Artificial sequence
  SiRNA target sequence
ttgtcttggctatctccatt

SEQ ID NO: 97373 - DNA, 20 bp, Artificial sequence
  SiRNA target sequence
tgtcttggctatctccatta

SEQ ID NO: 97374 - DNA, 20 bp, Artificial sequence
  SiRNA target sequence
gtcttggctatctccattac

SEQ ID NO: 97375 - DNA, 20 bp, Artificial sequence
  SiRNA target sequence
tcttggctatctccattacc

SEQ ID NO: 97376 - DNA, 20 bp, Artificial sequence
  SiRNA target sequence
cttggctatctccattaccc

SEQ ID NO: 97377 - DNA, 20 bp, Artificial sequence
  SiRNA target sequence
ttggctatctccattaccct

SEQ ID NO: 97378 - DNA, 20 bp, Artificial sequence
  SiRNA target sequence
tggctatctccattaccctt

SEQ ID NO: 97379 - DNA, 20 bp, Artificial sequence
  SiRNA target sequence
ggctatctccattacccttt

SEQ ID NO: 97380 - DNA, 20 bp, Artificial sequence
  SiRNA target sequence
gctatctccattaccctttc

SEQ ID NO: 97381 - DNA, 20 bp, Artificial sequence
  SiRNA target sequence
ctatctccattaccctttct

SEQ ID NO: 97382 - DNA, 20 bp, Artificial sequence
  SiRNA target sequence
tatctccattaccctttctt

SEQ ID NO: 97383 - DNA, 20 bp, Artificial sequence
  SiRNA target sequence
atctccattaccctttctta

SEQ ID NO: 97384 - DNA, 20 bp, Artificial sequence
  SiRNA target sequence
tctccattaccctttcttat

SEQ ID NO: 97385 - DNA, 20 bp, Artificial sequence
  SiRNA target sequence
ctccattaccctttcttatc

SEQ ID NO: 97386 - DNA, 20 bp, Artificial sequence
  SiRNA target sequence
tccattaccctttcttatca

SEQ ID NO: 97387 - DNA, 20 bp, Artificial sequence
  SiRNA target sequence
ccattaccctttcttatcag

SEQ ID NO: 97388 - DNA, 20 bp, Artificial sequence
  SiRNA target sequence
cattaccctttcttatcaga

SEQ ID NO: 97389 - DNA, 20 bp, Artificial sequence
  SiRNA target sequence
attaccctttcttatcagag

SEQ ID NO: 97390 - DNA, 20 bp, Artificial sequence
  SiRNA target sequence
ttaccctttcttatcagagg

SEQ ID NO: 97391 - DNA, 20 bp, Artificial sequence
  SiRNA target sequence
taccctttcttatcagaggt

SEQ ID NO: 97392 - DNA, 20 bp, Artificial sequence
  SiRNA target sequence
accctttcttatcagaggtt

SEQ ID NO: 97393 - DNA, 20 bp, Artificial sequence
  SiRNA target sequence
ccctttcttatcagaggttt

SEQ ID NO: 97394 - DNA, 20 bp, Artificial sequence
  SiRNA target sequence
cctttcttatcagaggttta

SEQ ID NO: 97395 - DNA, 20 bp, Artificial sequence
  SiRNA target sequence
ctttcttatcagaggtttag

SEQ ID NO: 97396 - DNA, 20 bp, Artificial sequence
  SiRNA target sequence
tttcttatcagaggtttagc

SEQ ID NO: 97397 - DNA, 20 bp, Artificial sequence
  SiRNA target sequence
ttcttatcagaggtttagct

SEQ ID NO: 97398 - DNA, 20 bp, Artificial sequence
  SiRNA target sequence
tcttatcagaggtttagctc

SEQ ID NO: 97399 - DNA, 20 bp, Artificial sequence
  SiRNA target sequence
cttatcagaggtttagctcc

SEQ ID NO: 97400 - DNA, 20 bp, Artificial sequence
  SiRNA target sequence
ttatcagaggtttagctccg

SEQ ID NO: 97401 - DNA, 20 bp, Artificial sequence
  SiRNA target sequence
tatcagaggtttagctccgt

SEQ ID NO: 97402 - DNA, 20 bp, Artificial sequence
  SiRNA target sequence
atcagaggtttagctccgtg

SEQ ID NO: 97403 - DNA, 20 bp, Artificial sequence
  SiRNA target sequence
tcagaggtttagctccgtgt

SEQ ID NO: 97404 - DNA, 20 bp, Artificial sequence
  SiRNA target sequence
cagaggtttagctccgtgtt

SEQ ID NO: 97405 - DNA, 20 bp, Artificial sequence
  SiRNA target sequence
agaggtttagctccgtgttt

SEQ ID NO: 97406 - DNA, 20 bp, Artificial sequence
  SiRNA target sequence
gaggtttagctccgtgtttt

SEQ ID NO: 97407 - DNA, 20 bp, Artificial sequence
  SiRNA target sequence
aggtttagctccgtgtttta

SEQ ID NO: 97408 - DNA, 20 bp, Artificial sequence
  SiRNA target sequence
ggtttagctccgtgttttaa

SEQ ID NO: 97409 - DNA, 20 bp, Artificial sequence
  SiRNA target sequence
gtttagctccgtgttttaaa

SEQ ID NO: 97410 - DNA, 20 bp, Artificial sequence
  SiRNA target sequence
tttagctccgtgttttaaaa

SEQ ID NO: 97411 - DNA, 20 bp, Artificial sequence
  SiRNA target sequence
ttagctccgtgttttaaaag

SEQ ID NO: 97412 - DNA, 20 bp, Artificial sequence
  SiRNA target sequence
tagctccgtgttttaaaagg

SEQ ID NO: 97413 - DNA, 20 bp, Artificial sequence
  SiRNA target sequence
agctccgtgttttaaaaggc

SEQ ID NO: 97414 - DNA, 20 bp, Artificial sequence
  SiRNA target sequence
gctccgtgttttaaaaggca

SEQ ID NO: 97415 - DNA, 20 bp, Artificial sequence
  SiRNA target sequence
ctccgtgttttaaaaggcaa

SEQ ID NO: 97416 - DNA, 20 bp, Artificial sequence
  SiRNA target sequence
tccgtgttttaaaaggcaat

SEQ ID NO: 97417 - DNA, 20 bp, Artificial sequence
  SiRNA target sequence
ccgtgttttaaaaggcaatt

SEQ ID NO: 97418 - DNA, 20 bp, Artificial sequence
  SiRNA target sequence
cgtgttttaaaaggcaatta

SEQ ID NO: 97419 - DNA, 20 bp, Artificial sequence
  SiRNA target sequence
gtgttttaaaaggcaattat

SEQ ID NO: 97420 - DNA, 20 bp, Artificial sequence
  SiRNA target sequence
tgttttaaaaggcaattata

SEQ ID NO: 97421 - DNA, 20 bp, Artificial sequence
  SiRNA target sequence
gttttaaaaggcaattatac

SEQ ID NO: 97422 - DNA, 20 bp, Artificial sequence
  SiRNA target sequence
ttttaaaaggcaattataca

SEQ ID NO: 97423 - DNA, 20 bp, Artificial sequence
  SiRNA target sequence
tttaaaaggcaattatacaa

SEQ ID NO: 97424 - DNA, 20 bp, Artificial sequence
  SiRNA target sequence
ttaaaaggcaattatacaac

SEQ ID NO: 97425 - DNA, 20 bp, Artificial sequence
  SiRNA target sequence
taaaaggcaattatacaact

SEQ ID NO: 97426 - DNA, 20 bp, Artificial sequence
  SiRNA target sequence
aaaaggcaattatacaactt

SEQ ID NO: 97427 - DNA, 20 bp, Artificial sequence
  SiRNA target sequence
aaaggcaattatacaacttt

SEQ ID NO: 97428 - DNA, 20 bp, Artificial sequence
  SiRNA target sequence
aaggcaattatacaactttt

SEQ ID NO: 97429 - DNA, 20 bp, Artificial sequence
  SiRNA target sequence
aggcaattatacaacttttt

SEQ ID NO: 97430 - DNA, 20 bp, Artificial sequence
  SiRNA target sequence
ggcaattatacaacttttta

SEQ ID NO: 97431 - DNA, 20 bp, Artificial sequence
  SiRNA target sequence
gcaattatacaactttttag

SEQ ID NO: 97432 - DNA, 20 bp, Artificial sequence
  SiRNA target sequence
caattatacaactttttaga

SEQ ID NO: 97433 - DNA, 20 bp, Artificial sequence
  SiRNA target sequence
aattatacaactttttagaa

SEQ ID NO: 97434 - DNA, 20 bp, Artificial sequence
  SiRNA target sequence
attatacaactttttagaac

SEQ ID NO: 97435 - DNA, 20 bp, Artificial sequence
  SiRNA target sequence
ttatacaactttttagaaca

SEQ ID NO: 97436 - DNA, 20 bp, Artificial sequence
  SiRNA target sequence
tatacaactttttagaacaa

SEQ ID NO: 97437 - DNA, 20 bp, Artificial sequence
  SiRNA target sequence
atacaactttttagaacaaa

SEQ ID NO: 97438 - DNA, 20 bp, Artificial sequence
  SiRNA target sequence
tacaactttttagaacaaaa

SEQ ID NO: 97439 - DNA, 20 bp, Artificial sequence
  SiRNA target sequence
acaactttttagaacaaaaa

SEQ ID NO: 97440 - DNA, 20 bp, Artificial sequence
  SiRNA target sequence
caactttttagaacaaaaat

SEQ ID NO: 97441 - DNA, 20 bp, Artificial sequence
  SiRNA target sequence
aactttttagaacaaaaatt

SEQ ID NO: 97442 - DNA, 20 bp, Artificial sequence
  SiRNA target sequence
actttttagaacaaaaatta

SEQ ID NO: 97443 - DNA, 20 bp, Artificial sequence
  SiRNA target sequence
ctttttagaacaaaaattaa

SEQ ID NO: 97444 - DNA, 20 bp, Artificial sequence
  SiRNA target sequence
tttttagaacaaaaattaaa

SEQ ID NO: 97445 - DNA, 20 bp, Artificial sequence
  SiRNA target sequence
ttttagaacaaaaattaaaa

SEQ ID NO: 97446 - DNA, 20 bp, Artificial sequence
  SiRNA target sequence
tttagaacaaaaattaaaag

SEQ ID NO: 97447 - DNA, 20 bp, Artificial sequence
  SiRNA target sequence
ttagaacaaaaattaaaaga

SEQ ID NO: 97448 - DNA, 20 bp, Artificial sequence
  SiRNA target sequence
tagaacaaaaattaaaagat

SEQ ID NO: 97449 - DNA, 20 bp, Artificial sequence
  SiRNA target sequence
agaacaaaaattaaaagatt

SEQ ID NO: 97450 - DNA, 20 bp, Artificial sequence
  SiRNA target sequence
gaacaaaaattaaaagattt

SEQ ID NO: 97451 - DNA, 20 bp, Artificial sequence
  SiRNA target sequence
aacaaaaattaaaagattta

SEQ ID NO: 97452 - DNA, 20 bp, Artificial sequence
  SiRNA target sequence
acaaaaattaaaagatttat

SEQ ID NO: 97453 - DNA, 20 bp, Artificial sequence
  SiRNA target sequence
caaaaattaaaagatttata

SEQ ID NO: 97454 - DNA, 20 bp, Artificial sequence
  SiRNA target sequence
aaaaattaaaagatttataa

SEQ ID NO: 97455 - DNA, 20 bp, Artificial sequence
  SiRNA target sequence
aaaattaaaagatttataag

SEQ ID NO: 97456 - DNA, 20 bp, Artificial sequence
  SiRNA target sequence
aaattaaaagatttataaga

SEQ ID NO: 97457 - DNA, 20 bp, Artificial sequence
  SiRNA target sequence
aattaaaagatttataagac

SEQ ID NO: 97458 - DNA, 20 bp, Artificial sequence
  SiRNA target sequence
attaaaagatttataagacg

SEQ ID NO: 97459 - DNA, 20 bp, Artificial sequence
  SiRNA target sequence
ttaaaagatttataagacga

SEQ ID NO: 97460 - DNA, 20 bp, Artificial sequence
  SiRNA target sequence
taaaagatttataagacgaa

SEQ ID NO: 97461 - DNA, 20 bp, Artificial sequence
  SiRNA target sequence
aaaagatttataagacgaat

SEQ ID NO: 97462 - DNA, 20 bp, Artificial sequence
  SiRNA target sequence
aaagatttataagacgaatc

SEQ ID NO: 97463 - DNA, 20 bp, Artificial sequence
  SiRNA target sequence
aagatttataagacgaatcc

SEQ ID NO: 97464 - DNA, 20 bp, Artificial sequence
  SiRNA target sequence
agatttataagacgaatccc

SEQ ID NO: 97465 - DNA, 20 bp, Artificial sequence
  SiRNA target sequence
gatttataagacgaatcccc

SEQ ID NO: 97466 - DNA, 20 bp, Artificial sequence
  SiRNA target sequence
atttataagacgaatcccca

SEQ ID NO: 97467 - DNA, 20 bp, Artificial sequence
  SiRNA target sequence
tttataagacgaatccccaa

SEQ ID NO: 97468 - DNA, 20 bp, Artificial sequence
  SiRNA target sequence
ttataagacgaatccccaag

SEQ ID NO: 97469 - DNA, 20 bp, Artificial sequence
  SiRNA target sequence
tataagacgaatccccaagg

SEQ ID NO: 97470 - DNA, 20 bp, Artificial sequence
  SiRNA target sequence
ataagacgaatccccaaggc

SEQ ID NO: 97471 - DNA, 20 bp, Artificial sequence
  SiRNA target sequence
taagacgaatccccaaggcc

SEQ ID NO: 97472 - DNA, 20 bp, Artificial sequence
  SiRNA target sequence
aagacgaatccccaaggcca

SEQ ID NO: 97473 - DNA, 20 bp, Artificial sequence
  SiRNA target sequence
agacgaatccccaaggccaa

SEQ ID NO: 97474 - DNA, 20 bp, Artificial sequence
  SiRNA target sequence
gacgaatccccaaggccaaa

SEQ ID NO: 97475 - DNA, 20 bp, Artificial sequence
  SiRNA target sequence
acgaatccccaaggccaaat

SEQ ID NO: 97476 - DNA, 20 bp, Artificial sequence
  SiRNA target sequence
cgaatccccaaggccaaata

SEQ ID NO: 97477 - DNA, 20 bp, Artificial sequence
  SiRNA target sequence
gaatccccaaggccaaatac

SEQ ID NO: 97478 - DNA, 20 bp, Artificial sequence
  SiRNA target sequence
aatccccaaggccaaataca

SEQ ID NO: 97479 - DNA, 20 bp, Artificial sequence
  SiRNA target sequence
atccccaaggccaaatacag

SEQ ID NO: 97480 - DNA, 20 bp, Artificial sequence
  SiRNA target sequence
tccccaaggccaaatacagc

SEQ ID NO: 97481 - DNA, 20 bp, Artificial sequence
  SiRNA target sequence
ccccaaggccaaatacagca

SEQ ID NO: 97482 - DNA, 20 bp, Artificial sequence
  SiRNA target sequence
cccaaggccaaatacagcaa

SEQ ID NO: 97483 - DNA, 20 bp, Artificial sequence
  SiRNA target sequence
ccaaggccaaatacagcaaa

SEQ ID NO: 97484 - DNA, 20 bp, Artificial sequence
  SiRNA target sequence
caaggccaaatacagcaaaa

SEQ ID NO: 97485 - DNA, 20 bp, Artificial sequence
  SiRNA target sequence
aaggccaaatacagcaaaat

SEQ ID NO: 97486 - DNA, 20 bp, Artificial sequence
  SiRNA target sequence
aggccaaatacagcaaaatt

SEQ ID NO: 97487 - DNA, 20 bp, Artificial sequence
  SiRNA target sequence
ggccaaatacagcaaaattt

SEQ ID NO: 97488 - DNA, 20 bp, Artificial sequence
  SiRNA target sequence
gccaaatacagcaaaattta

SEQ ID NO: 97489 - DNA, 20 bp, Artificial sequence
  SiRNA target sequence
ccaaatacagcaaaatttaa

SEQ ID NO: 97490 - DNA, 20 bp, Artificial sequence
  SiRNA target sequence
caaatacagcaaaatttaag
